United States Patent 7,332,310 (MUTANT OF HOMOSERINE DEHYDROGENASE FROM CORYNEBACTERIUM AND DNA ENCODING THEREOF) - sequence listing, part 3

SEQ ID NO: 1362 - DNA, 951 bp, Corynebacterium glutamicum
atgtctatttcttatgtgctggttgagcagctagatggccgcccagaaccagttacccttgaattgatcactgctgctcgcgcactcggtgacgtcgttgccgttgtcgttggcgagccaggtgccggcgtaaaccttgctgctgagctcggcaattggggtgcagcacaggttgtttccgctgaaatctctggcgcttccaaccgtttgatcttgcctgctgttgatgcgctgcacattttggctgcgaacaacccaggtccaattgttatcgctgcaactgcaagcggtaatgagatcgctggtcgtttggctgcccgtttggcttctggtgtgctcaccgatgtcgtcggaatcaatgccgaccgcaccgcacagcagtccattttcggcgacaccattcaggtgtccgctgcagttggtggcgcttcaccgctgtacaccctgcgtccaggtgcccttgatggcgtggccgttcctgcaaccggtgaattggcaaccattgagatcccaggcgcaaccgccaaggatgtcaccatcacctccttcacgccaagcacccagagcgatcgccctgagctgccacaggcaaaggtcgttatcgcaggtggacgtggtgtcggaagcgaagaaaacttccgcagcatcgttgaaccactggcagatgcattgggcggtgccgttggcgcaacccgcgacgccgttgatctgggctactacccaggcgagtaccaggttggtcagaccggtgtcaccgtgtccccagacctctacatcggcctcggcatttccggtgcaattcagcacacttctggtatgcagaccgcaaagaaggttattgtgatcaacaacgatgaggacgcgccgatcttccagattgcggacctcggtgtcgttggcgacctctttgacatcgcccctgcgctcatcgaagagatcaacaagcgcaag

SEQ ID NO: 1363 - DNA, 615 bp, Corynebacterium glutamicum
atgcgctgcacattttggctgcgaacaacccaggtccaattgttatcgctgcaactgcaagcggtaatgagatcgctggtcgtttggctgcccgtttggcttctggtgtgctcaccgatgtcgtcggaatcaatgccgaccgcaccgcacagcagtccattttcggcgacaccattcaggtgtccgctgcagttggtggcgcttcaccgctgtacaccctgcgtccaggtgcccttgatggcgtggccgttcctgcaaccggtgaattggcaaccattgagatcccaggcgcaaccgccaaggatgtcaccatcacctccttcacgccaagcacccagagcgatcgccctgagctgccacaggcaaaggtcgttatcgcaggtggacgtggtgtcggaagcgaagaaaacttccgcagcatcgttgaaccactggcagatgcattgggcggtgccgttggcgcaacccgcgacgccgttgatctgggctactacccaggcgagtaccaggttggtcagaccggtgtcaccgtgtccccagacctctacatcggcctcggcatttccggtgcaattcagcacacttctggtatgcagaccgcaaagaaggttattg

SEQ ID NO: 1364 - DNA, 1128 bp, Corynebacterium glutamicum
ttgaacactttttatctggaccatgcagccaccacaccaatgcgtgaggtggccgcagctgcgtggatggaaaacgcgcaggcattgaatcccgcgagtcagtacggttcggggcgtaaggcgcgcagcgttgcggattcggctcgtgaagaaattgcttctttgctgggctgtgaacctatcgaggttgtgtttaccgcgtccggcacggaggcagataacctcgctgtgcaggggttattccacgcatcgcctctcaatcggattatttctacgccgatcgagcaccccgggattctggaaaccgtcaaggctctagaacttggcggggcagaggcggagctcatgccgatcggtccagatggacgagtgtcttccttcgaagcgctggacaagcctgccgcggttgccactatgatgtgggcgaacaatgagaccggcgcgattcagccggtttctgagttcatcgccgccgcgcaggcgtccggcacgccaacacacatcgatgcggttcaggtcgttggccatctgccggtcaattttgatgagctcggcgccaccactttggctgcctccgcgcacaaattcggtggaccacgtggcgtcggcctgctgttggtgaggcgctcaccagcaccttcagccgtattgcacggaggtggtcaggagcgcggcatccgtccaggcacccttgatgtcgccggcgcagctgccaccgcagccgcattacgcgaagcagtggccgagcttgacggcgaagccacccgcctgcgcggacttaaaaagatgcttctcgacgccatcctccacaccatccccaacgtactggtccacaccaccgaaccatccctgccaggacacctgcatctctccttcccaggagcagaaggcgatagtttgatcatgctgctcgactccttgcggatcgaagcctccacaggttcggcctgctccaacggtgtaaaccgtgccagccacgtccttttggccatgggaatttccgaaaccgacgcccgtggtgccatccgattcaccctcggaagaaccaccactgaagaatccatcaaggcagtgatcgccgtgatcgaagacgtagtgaccagggctcgtactgcgggaatggctttt

SEQ ID NO: 1365 - DNA, 312 bp, Corynebacterium glutamicum
atgatcaagaaatacttatcaacaatcgctgctgtgactatcgctagcgctgtgctgttcgctccaagtgcccaggccaacacgatttcctcgcactttccagaacacgacatggtggatccctatggaccaaccatgacatcgactgggttgaatcgttcccaagaaaccgtgatgtttcacggactttttggtgcgatcgtgctgtcaacaggatctcccgttgttggcgactgccaaaatgttccgctgtcgcaccagcaggtgatctgcccgctggcaacggaactgcactatgcgatttacggtcgc

SEQ ID NO: 1366 - DNA, 1146 bp, Corynebacterium glutamicum
atgacccccactgccgatatctggtttaaagatactttggctgctcatttcacacgcgacggcgaccagaccacattctcctacacagctgattacgcaggtccaccgattgccacgtccctgcccatcaattctgaacccgtgattacgcgctctggagcgatcccaccatttttcgcgggattactccccgaaggtcgtcgcttaagttcacttcggagaaacattaaagcctctgccgatgatgaactttcactccttctagcagtgggagctgatcctgttggtgcagtcgctatcttcccccatggtgaaaatccacaacctgcaccacccacagttgattttgacgatgaacttgatttctcggctgcactaaccgagtccgggattgcggatcccgttgcactggccggtgtccaagacaaagcctctgcacgcaccatcgcggtccccgttgcaagcgatgccatcttgaaactctccccgcctgaatacccttacttggtggaaaacgaagcagcttgttaccagttgctgaccaaaaataagcttcgcattgaactgtccaaagtagaagttctccatgacaaacacggcaggtccggactcttagttcaccgctttgaccgcacacccaaaggcaaaatccccgtcgaggatgcaggacaggtcttgggaatctggcctgcagataaatacttagtgagctacgaggacatcgcacaagccctcactaaagtgtgcgcctcccccatcttggcgatgcgcaatctcgccttccaaatcgcagtcgcgtggctcagcggcaatggtgatcttcatgccaagaacatctccattatcaacaaaggccgcggatttgagatcagccccatctatgacatccctgccaccgcagtatatggcgacaccacgatggcattagaaatccagggatccaaaaaggatctcagccaaaagaaattcctaaaattctgtacatccatcggactaccagaaaaaacagccatgtcggttgcgaacgctgcactgttggcaacagaaaatgccgcagagacaattcttgcttcgggaaattttgatacacggatgaatcgagatctggccagggttctcaaacatcgacgaagcgcatggggagct

SEQ ID NO: 1367 - DNA, 225 bp, Corynebacterium glutamicum
atgcacatgaacgcagaagaaatcggaatggcgctgctcaacggacgcaaagagctaggccttagacaaggagagctcgcagacttagctggagtttctgaacgattcatccgcgatgtcgaaaagggaaaaactaccgtccgcctggacaaagtcatcgatgtactccgcgtccttggactcgagctttctgttggaattcacgatcccctcaaggttaatcaa

SEQ ID NO: 1368 - DNA, 504 bp, Corynebacterium glutamicum
atgagcgcattccacatccgagcggaacaatcgcgcgatatcagcgcgattcatgatgttactgaagcggcctttacaggaattgagcattcagatggaacagagcaagatctcgtcgataagcttcgtgctgcaaaggcgctgagcctttcgctcgtcgctgaggcggatggcgaggtcattgggcatatcgcagcctctgaggtactgatcggcggtggggtgcagggctggtttggcattgggcctgtcagtgttcggcccgataagcagcagcaaggcgtgggtattgcgctgatgggcagcgcgcttgatcagttgcgtgcggagggtgctggcggcatcgtgttgctgggggatccgggctattatcgacgcttcggttttgaggtcgtgcccgggctggtctatccggacgcgccagcggaattttttatggctgtgtgtttgaatgctccggcgtttccgcagggtgttgtggagtatcactcggcatttggaggg

SEQ ID NO: 1369 - DNA, 942 bp, Corynebacterium glutamicum
gtggcccgtaagaaaaacacgtccgatcaatcccgctcccaagctgccaacacgcccattgctggcacctatgagggtgaatattccgtcatcgagttggaggccgattcctacaccaccgatggctggttgatcagcattaatggcgtgcccagctctcatattgtcctggggcaaccgcaggcactggaatttgagtacatgcggtggatcgctaccggcgctcgggcgttcatcgatgcgcatcaggatgcatccaagctgcggattactcacctcggcggcggtgcgtgcacgatggccaggtatttcgcggatgtttacccgcagtcacgcaacactgtcgtggaattggatgcagagcttgcccgcctgtcgcgtgaatggttcgacattccgcgcgcgccacgggtaaagattcgtgtggatgatgcccgaatggtggcagaatctttcactcccgcaagccgcgatgtgatcatccgtgacgtttttgccggagctatcacgccgcagaacttcaccaccgtggagttctttgagcactgtcaccgtggccttgctcccggcggattgtacgttgccaactgtggcgatcattcggatctgcgcggagctaaatctgagctcgcgggaatgatggaggtgttcgagcacgtcgcggtcatcgccgatcccccgatgcttaaagggcgccgttacggcaacatcattttgatgggttcagacaccgagttctttagctccaacagcacggaagcgtccgcgattacccgtgagcttcttggcggcggcgttccagcgcagtacaaggatgaatcctgggtgcggaaattcgcctcgggagcccaggcccgccacgatggggtctctaccctccaaatgccgagtgatactccacaacaccctgcggaaacgccggagcattcaaacacacagcca

SEQ ID NO: 1370 - DNA, 1149 bp, Corynebacterium glutamicum
gtgtcttctatgtcagctcgcaatccgttccgccccactttcggagtttcccccaccgtacttgcaggccgagactcacttctacagtctttcaaacttggtctcgcggaaggccccggaagcccctttagagcattgctgatttcgggatctcgtggcatgggtaaaactgtgttgctcaatgaatttgaagatgcagctgcgtctcaagggtggatcacgctgcgcgcctatccggataattccatggtggatggcttagttaattccgccatcccggaggcgctacagaatcttgacggaccgcagtccaaaagaatgctcagtggtgtggccattcctggtatcgctacggtgacggccattgctgatccaaccaagaaggatcccactcccacgctgatttccaggctccgcgagttggctactcgtttgcaaaagcacggctccggaattttgatcacccttgatgaactccaaagcgccaatgtggatcttttgcatgtgttggccactgcggtccaggatctcctacgggatgatttcgatatcgcattggtagcagcgggtctgccagagggaatcgatcgtcttctccagcatgagggcacaacctttatccgccgagccgaaagaatcctgctcaatcctgtcaaccatgaagattcggtggagatgttcctggataccgctgcggaaggccaacgccacatgacttccgaggccgccgaactcgcggcgcagatcagcaagggctacccctactccatgcagctgactggttctctggcatgggcgcgaagtactcttgacaactccgataccatccaggccgaacaagtagatgctgtccgcgacgaggttgtgcgccgcatgggcatgcaagtccacgagccaagcctgcaccaggtccctgatggtgagctgaccattttgtacgcgattgcccaactgtcaaaaaacggcgagatggtgtctactggagatatcgcacacctcatgggcgtcaagcccaacgccttgtcgatgcagagaaagcaacttctcagcagaggtctcgtagaggttcccaagtacggtttcctcaatttcactttgccgtacatgcgcgagcacctcctcaacagcccgcaccaccgaccaatcaca

SEQ ID NO: 1371 - DNA, 396 bp, Corynebacterium glutamicum
atgagatttgaaacagaatatgtcgagcggctttatgtattttctacaacccaacaggctcaagagatttccgaagaactagcagttgaatttttgaaagaaaaccccgatatctcacaccatgaaatattggtccaacactcagcggaagacacatttgaagttgaaaaggtctgggtggaaatgttcggagacagcacagacatccaagaccgcacaatttcgctcattgaatataggttcactatcaattcaaatgcggatgaagacatggatgaactcagcatgggtatttacgcggtcatccgggctctaataaaaaagcactcaaaggtggagtatttcagcatgttttcgcttgcatcagatttacttgcgtcagatttagaggaagag

SEQ ID NO: 1372 - DNA, 1095 bp, Corynebacterium glutamicum
atgcgggttcttgcagcaatgagtggaggcgttgattccgccgtcgcggcgtcacgcgcggtcgcagctggtcatgaagtggttggcgtgcatttggcgttgtcgcaagatccgcaaacggtgcgtgagtcttcgcgcggttgctgctctctggaagattccgctgatgctcgtcgcgtgtgtgacaagttgggtatcccgttttatgtctgggatttctcggatcgtttcaaggaagatgtgatcgacaacttcattgattcttacgcgatcggtgagactccaaacccttgcctgcgttgtaatgagaaaatcaagtttgccgccttgcttgagcgtggcatcgcgcttggtttcgatgcagtggttaccggccactacgcgcgcttgacccagcctgctgatggtggcgatggctacttgcgtcgcggagttgatcccaacaaggatcagtcttacgtgcttggtgtgcttggcgctcatgagatcgagcactgcatgttcccagtcggcgataccatcaagcctgaaatccgtgaagaagccagtgctgcaggtttctctgtggcaaagaagccagactcctacgacatttgcttcattccggatggcaacacccaggcgttcttgggcaagcacatcggtatgcgtccgggcatgatcgtggatcaggaaggcacgcagctccgtgagcacgctggtgtccatgaattcaccattggtcagcgcaagggccttgacattaaggctccagcagccgatggtcgtccacgttacgtcaccgatattgatgccaagaccggcaccgtcaccgttggtactcgcgaaaacctaaagatcagcaccatccacgccgatcgtttgaagttcctccatccagcgatggacggacagatcgattgcgaagtccaggtccgcgcacacggtggagtagtttcctgctctgcgacgattgatcgtgacgctgatttcatggtgctcaacctcaatgaacctcttcagggtgttgctcgcggccaggcagcagtgctgtacctgcctgacgcggatggtgacatcgttcttggatcaggcaccatctgccacacggagtct

SEQ ID NO: 1373 - DNA, 654 bp, Corynebacterium glutamicum
atggacaccagcgtgctcacggagctgcgtgccttcctgatccacgatcatgcccggacgcataccgatgtgcttgcccaagaacgcctgggtgttgccatccggaatgaagcaaatgtcgtaggagtctggcttctttgccacagagaaacctgcagcactggcttcttcacggatttcaggcttgatggtatcgccgactgggaacatgcagtgctcgatctcatgagcgccaagcacaccaagcacgtaagactgatccttgttgggatcaactccgcgacgcaagtagccatcgccaccatcagcaggctgggtcaagcgcgcgtagtggccggtaaccactgcatcgaaaccaagcgcgatgccacgctcaagcaaggcggcaaacttgattttctcattacaacgcaggcaagggtttggagtctcaccgatcgcgtaagaatcaatgaagttgtcgatcacatcttccttgaaacgatccgagaaatcccagacataaaacgggatacccaacttgtcacacacgcgacgagcatcagcggaatcttccagagagcagcaaccgcgcgaagactcacgcaccgtttgcggatcttgcgacaacgccaaatgcacgccaaccacttcatgaccagctgcgaccgcgcg

SEQ ID NO: 1374 - DNA, 990 bp, Corynebacterium glutamicum
ttgggcgcttatggtttaggtgagcttcctggaaaatccgccgcggaagccgccgacattattcagggtgaaacgggcgatcttctccatattcctcagcttccggcgcgaggtttgggtgctgatctgatcggtcgaaccgtcggtctgctggacatgatcaacgttgatcgcggggcccgatcttgggtgatgagcacacgccccagcagattgacgcacctgaccggcgatttccttgacatggatttggatgcgtgcgaggaaacctggggaacgggcgtcgacaagctaaaaatccaagttgctggtccctggactttaggtgcgcgcattgagttggccaatggccatcgcgttttgtctgatcgcggtgcgatgcgtgatctcacgcaggcgctgatcgccggcatcgatgcgcatgcacgcaaggttgctgggcgatttcgcgccgaagtgcaggtgcaaattgatgagccggagctgaaatcgcttatcgacggctccctccctggcacttccacctttgacattattcctgcggtgaatgtcgctgatgccagtgaacgtttgcagcaggtctttagctcgattgaggggccgacatatctcaacctcaccggccagattcctacttgggatgtggctcggggtgcgggcgccgatactgtgcagatttccatggatcaagtccgtggaaatgaacatttggatggttttggtgaaaccatcaccagtggaattcgtcttggtttgggcattacgacaggaaaagatgtcgtagatgaactgctcgagcgaccgcggcaaaaggccgttgaggtagcacgcttttttgatcgtttaggtgtgggccgaaactatctcgtggatgctgttgatattcatccgggtgaggatttggtgcaggggaccatcaccgaggccgcgcaggcttatcgcatggcccgggtgatgtcggagatgttgtcgaaggattcaggcgacctt

SEQ ID NO: 1375 - DNA, 1461 bp, Corynebacterium glutamicum
gtgtctgacaaaaagcaggatctaacatcctccgcagcaggtagtgctgcaccccaaaccaaggcctaccccgccatgcccttgcctgaaaagcaagcttggccagctctaattgccttgtgcattgggtttttcatgatcctgttggatcaaaccatcgtggccgtctctaccccagcgttacaggcagacatgggcgcgtcctacaacgaggtcatctgggtaacctcggtgtatctcctcactttcgcggtgccactgcttgttactggccgtttgggcgacaagtacggtccgaaaaatgtctatgtcgcaggcatggttatcttcacagtgagctctttggcctgtggtttggccccagacatgttcacgttgattatcgctcgtggcgttcaaggtttgggcgcagcccttttgactccacaaaccatggcaacaatcaaccgcatctttgcttttgagcgccgcggtgcagctcttggagtgtggggttctacagctggccttgcatccctagcaggaccgatcctgggtggtgtcatcaccgaaaactggggttggcaatgggtcttctacatcaacgtgcccatcggcgtgatctcggtgatcgcagtaatgaagtacgttcctgaattcccaccgctgacccgaccgcttgatccgctttctatcgtgttgtccatcgtggccgtgttcttcctggtgtttgctttccaggaaggcgaaggcgctggctgggcggcatgggtgtggatcatgatcgtagccgcctttgcgctctttgcgtggtttatctaccaacaaagcagggccgagaaatccggaaacgatcctctcgtcccactggagattttcaagtttagaaacttcagcctcggcaatatctgcatcatggccatgggattcaccgtggctggtactcctctgcccatcatgttgtacttccagcaagcacacggaatgaacgccatggaagcgggtttcatgatggtgcctcaagctctcatggcagcagtactgtcaccatttgttggaaagctggttgatcgatccaaccctggactcatggcagccctcggttttagcacagtggctgtgtccattgtactgctgtcaatggtaatgattttcgatacgggtctagtctgggcacttgtttcgatgactttgctcggcatcggaaacgcctttgtgtgggcaccgaactcgacctccactatgcgcgacctgccacacaagttcatgggagcgggctctggcgtgttcaatacaacccgccaattaggttcagtcatcggcgccgctgccatcggcgcggtaatgcagattcgactggcagcaggcgatgagggcgcagcttttggtcaagcacttctacttgccgctgcggtgctggttatcggcattgtggcatcaacgatggcaggaaaaaatgcacacccagcgccggtaaagcct

SEQ ID NO: 1376 - DNA, 735 bp, Corynebacterium glutamicum
atgcgactattagggttaggaaccatgaactcaccaagcaatccatctcccaccgtcccaagcttcgacaccaccaagatgctctccttcgacctggaaacaacgggcgtcaatccctttgacacccgcatcgtcacctccgcaatggttacgatcaccagcaaaggcgctgagcctattgagctattggctgaccccggcatcgaaatccccgaggccgccactgcagtccacggcatcaccaccgaacatgcccgcgccaacggccgtccgcacgatgaggtgttagccgaaaccatctccaggctgcgcgccggctggcaggcaggactgtcggtcattgtcttcaacgcatcctatgacctgaccgtattaagaaaccatgatccaagcttcaccatcgacggcctagtttatgaccccttcgttatcgacaaagtcaaagaccgttaccgcaaaggcaagcgcacactcactgatatgtgtgctcactacgacgttcaattaggcaacgcccacgaagccacctcagatgcgctcgcagccgcacgcatcgcctggaagcaggtccgcctgtggccagaactcaccaagatgacaggcgaagaactcatggagttccaagcagtcaactattacgagcaacaaaagagcttccgtagctatctcatcgggcaaggccgcgatgccagcgatgtgaacacttcatggccagtgcaaactgaccccgcatcc

SEQ ID NO: 1377 - DNA, 2040 bp, Corynebacterium glutamicum
gtgactgaagataatgctcaactgcgtagaacgtggaacgacttagccgagaaggttcgttatcaccgagatcgttattacaacgaacagccagagatccctgatgctgattttgatgcgctttttaagcagcttcagcagttggaagaagaccacccggagctcgccgtccctgatagccccaccatggttgtgggcgctccggtggcagagcaatcaagctttgacaatgttgagcacttggagcgaatgctcagcttggacaatgtttttgatgagcaggagttgcgtgattggttgggcaggacgccagccaagcagtatttgacggagttgaaaattgatggcttgtccatcgacttggtgtatcgcaatggccagttagagcgtgccgctactcgtggtgatggtcgcgtgggcgaggacatcacggccaatgctcgcgtgatcgaagatatcccgcaccagcttcagggcactgatgaatatcctgtgcctgctgtgctggaaattcgcggtgaggtgttcatcactgtggaggatttcccagaggtcaacgcgcagcgcattgctgatggtggcaagccgtttgccaacccgcgtaatgctgcggctggttctctgcgtcagaaaaatattgaggacgtgaagaagcgccgcctgcggatgatcagccatggcatcggtttcactgaaggctttagccctgcgtctcagcatgatgcgtatctggcattggctgcctggggtttgcccacctcgccgtacacagaggctgtgactgatccagaagatgtggtgaaaaaggtcagctactgggctgatcaccgccacgacgcactccatgagatggatggcctggtgattaaggtcgatgacatcgcatctcagcgtgctttgggttccaccagccgcgcgcctcgctgggccattgcgtacaagtaccctccggaggaggtcaccaccaagctgcttgatattcaggttggcgttggtcgcaccggccgtgtcaccccattcgcggtcatggagccggttcttgttgcaggatcaacggtgtctatggcgacgctgcataaccagagcgaagtcaagcgtaaaggcgtgctcatcggtgacaccgtggttatccgcaaggcgggcgaggttatcccagaggtgcttggccctgtcgtagagcttcgtgacggcacagagcgcgagtacatcttcccaacgctgtgccctgaatgcggtacccgtctggcgcccgcgaaggccgatgacgtggattggcgttgccccaacatgcaaagctgtccaggtcagctgtccacgcgtttgacctaccttgctggtcgtggcgcttttgatattgaagcattgggcgaaaagggcgctgaagacctcattcgcaccggcattttgcttgacgagtctggcctgttcgacctcacagaggacgatctgctgagctccaatgtctacaccaccaacgccggcaaagtaaatgccagcggcaagaaactgctggacaacctgcaaaaatccaagcagaccgacctctggcgagtcctcgtggcattatctatcaggcacgtaggccccaccgcagcgcgcgcccttgcaggtcgctaccactccatccaggcgcttatcgacgcccccctcgaggaactctccgaaaccgatggagtaggtaccatcattgcccaatccttcaaggactggttcgaggttgattggcacaaggccatcgtggacaagtgggcagccgctggtgtgactatggaggaagaagtaggggaggtcgctgaacaaacccttgaaggcctaaccatcgtggtcaccggagggttggaaggcttcaccagagattcggtgaaggaagccatcatctcccgtggcggaaaagcctctggatctgtctcgaagaaaactgactacgtggtgattggtgaaaacgcaggttccaaggccaccaaggcagaagaactagggctgcgcattctggatgaggcaggattcgtccgtttgctcaataccggctcagctgacgaa

SEQ ID NO: 1378 - DNA, 663 bp, Corynebacterium glutamicum
atgtcattcctgatccgcgtcctgttgtccgacaccccaggcagcctcgcgttactcgctgaagcccttgggattgtagaggccaatattcaatccgtggacgtggtggaacgcttccccaatggcacggtcatggacgatctggtgatctccatccctcgcgatgtcatggcagacaccatcatcaccgcagctgaagaagtcgacggcgtggagattgattccatccgcccattctccgggactgttgaccgccgcggacagatccaaatgctggctgctgttgctcaccaacgccgcgatatcaccgcagcgatggaagaaatggtcgatgtcatcccccgcaccatgacctctggttgggctttggtcattgatctaaaaggacccatcactcgcatcgctggttccctagcagcgcccgaagatgacggcaccgttccggagaacatcgttctcaaagaagctcgcatgctcaacccggaaaacgatccgtggattccagagtcctggacactgcttgattcttcccttgccatcgctccgatcggcaagcacggcctggctctgattatcggtcgccctggtggccctgatttcttggccagcgaagtggagcacttaggccaagtcggtgacattatcggagcaatgcttcaaaaa

SEQ ID NO: 1379 - DNA, 297 bp, Corynebacterium glutamicum
gtgcctgagatttcgcgcgaccaggtcgctcaccttgccaaactttccagactggcgctcactgaggaagaactcgagcagtttgctggacagatcgatgacattgtcggatatgtttccgcagttcaaaacgtcgacgccgcaggtgttgagcctatgagccacccgcacagcatcgccaccaccatgcgtgaagatgtcgtgcacaagaccctcgatgctgcggctgcgttggaccaagcgcccgctgtcgaggatggacgttttatggttccgcagattctgggtgagggcgac

SEQ ID NO: 1380 - DNA, 1491 bp, Corynebacterium glutamicum
atgaccaacaagtacctggttgaaggctctgaaaacgagctgaccacaaagaccgcagcagagctggcaggtcttattcattcccgcgaggtaacttcccgcgaggttactcaagcgcacctagatcgcattgctgcggttgacggcgatattcatgcatttctccacgttggccaggaggaggccctgaacgcggcggatgacgtcgataagcgtctagacgctggagaggcacctgcctcggctttggctggcgtgccgcttgcgctgaaggatgtctttaccaccactgatgcgccgaccacggcggcatcgaagatgcttgagggctacatgagcccttatgacgcgactgtgacccgcaagatccgtgaggctggcatcccaattttgggtaagaccaacatggatgagtttgcgatgggttcctccactgagaactccgcatacggcccaacccacaatccgtgggatctggagcgcaccgcaggtggttctggtggtggctcttcagctgctcttgctgcaggtcaggcgccacttgcgattggtactgacactggtggatccatccgtcagccagctgcgctgaccaacactgtcggtgtgaagccaacctacggaaccgtatcccgttacggtctgattgcgtgtgcgtcctccctggatcagggtggcccaaccgctcgtactgttctggataccgcgcttttgcacgaggttatcgcaggccacgacgcttttgatgcgacctccgtgaatcgtccggttgctcctgttgtgcaggctgcccgtgaaggcgcgaacggtgacctgaaaggcgtgaaggtcggtgtggtcaagcagttcgaccgcgacggctaccagcctggcgtgcttgaggcattccacgcttctgttgagcagatgcgctcccagggtgcggaaatcgtcgaggttgattgccctcactttgatgacgctcttggcgcgtactacctgattcttccttgtgaagtttcctccaacctcgcgcgttttgacggcatgcgttacggtttgcgcgctggtgatgacggaactcgttccgccgatgaggtcatggcgtacacccgtgcgcagggattcggccctgaggttaagcgccgtatcatcctcggcacttacgcgttgtctgttggttactacgacgcgtactacctgcaggctcagcgcgttcgtaccctcattgcacaggacttcgccaaggcttacgagcaggtcgacatcttggtgtccccaaccactccaaccaccgcgttcaagctgggggagaaggtcaccgatccgctggagatgtacaacttcgacttgtgcaccctgccactgaacctggctggtctcgcgggcatgtccctgccttccggcttggcatcagatactggtctgcctgttggtttgcagctgatggctcctgctttccaggacgatcgtctctaccgcgtcggcgctgcttttgaagctggacgcaag

SEQ ID NO: 1381 - DNA, 849 bp, Corynebacterium glutamicum
atgaacactccagcgccccgcaaacgacgcgaaatgaaaatcaagacagcaaccgtcactggtgtgcgtcaaatttcccccgatctcatccgcttcagcttcgactgcccagaaatcgttggcgccgacctggggttcacggaccattacatcaagatcctcttcgtgccagcaggtgcggattactcctggcctttcgacatggcagaaattgcggaaacccagccccgtgagctgcaaccagtgcgccgcacctacactttccgcacggttgacactgtcgcaggcacatttgacatagatttcgttgcgcacggcaccgatggccttgccggtccttgggcgcagcaggcacaggtaggtgatgtcatcgcgttcggcggcccaggtggcgcatggaagccagaaaccacctatgagcactacgttctcgcaggcgatgaagccgcagcacccgcaattttcgcagccttagaacacctacccgccggcaccaccgccaaagccttcattgaaatctcctccaacgaagcgcgtttcaacgccccagccagcgacaacatcgaggttgtctgggtgccccgcgacggcgccacccacggtacattgcttatcgacgccctccgccaggacggctacccaaccaagaaaacttcctggttcatccacggagtcgccgaaatggtgaaggaaacccgcaaattcctcttcgtggaaggcaacgtagacaaagctgatgcatccatttccggatactggcgccttggcatgaccgaagaccagtggcaggcctccaagcgggagttcaatgagcaaaatgaggcagaagaactcgcgctcagcaaggca

SEQ ID NO: 1382 - DNA, 306 bp, Corynebacterium glutamicum
ttgaaaaaggcatcccaggtcagcactgccaccgtcgtcgcagcaggtttgatcggcggttggttgactgcccgtgaatccggcattcgcccactgggcaccattccattggcagcatccggagcgcttgctgcacgaagctggaatgaaaagaagggtcctgcagtagctactggcctgctggcaacctacgttggtgcatttggcctgtcccacccacttgccaagaagattggcgcgtggcctgcagttcttactgtgaccgctggcgctgctgcgattgcttacgcagtatctgactcccag

SEQ ID NO: 1383 - DNA, 1071 bp, Corynebacterium glutamicum
ttgttccggcgcgggtgttgtgatgggtttaatatggaagacatgcgaattgctactctcacgtcaggcggcgactgccccggactaaacgccgtcatccgaggaatcgtccgcacagccagcaatgaatttggctccaccgtcgttggttatcaagacggttgggaaggactgttaggcgatcgtcgcgtacagctgtatgacgatgaagatattgaccgaatcctccttcgaggcggcaccattttgggcactggtcgcctccatccggacaagtttaaggccggaattgatcagattaaggccaacttagaagacgccggcatcgatgcccttatcccaatcggtggcgaaggaaccctgaagggtgccaagtggctgtctgataacggtatccctgttgtcggtgtcccaaagaccattgacaatgacgtgaatggcactgacttcaccttcggtttcgatactgctgtggcagtggctaccgacgctgttgaccgcctgcacaccaccgctgaatctcacaaccgtgtgatgatcgtggaggtcatgggccgccacgtgggttggattgctctgcacgcaggtatggccggcggtgctcactacaccgttattccagaagtacctttcgatattgcagagatctgcaaggcgatggaacgtcgcttccagatgggcgagaagtacggcattatcgtcgttgcggaaggtgcgttgccacgcgaaggcaccatggagcttcgtgaaggccacattgaccagttcggtcacaagaccttcacgggaattggacagcagatcgctgatgagatccacgtgcgcctcggccacgatgttcgtacgaccgttcttggccacattcaacgtggtggaaccccaactgctttcgaccgtgttctggccactcgttatggtgttcgtgcagctcgtgcgtgccatgagggaagctttgacaaggttgttgctttgaagggtgagagcattgagatgatcacctttgaagaagcagtcggaaccttgaaggaagttccattcgaacgctgggttactgcccaggcaatgtttgga

SEQ ID NO: 1384 - DNA, 630 bp, Corynebacterium glutamicum
atggcacgcacgagctgcacgaacaccataacgagtggccagaacacggtcgaaagcagttggggttccaccacgttgaatgtggccaagaacggtcgtacgaacatcgtggccgaggcgcacgtggatctcatcagcgatctgctgtccaattcccgtgaaggtcttgtgaccgaactggtcaatgtggccttcacgaagctccatggtgccttcgcgtggcaacgcaccttccgcaacgacgataatgccgtacttctcgcccatctggaagcgacgttccatcgccttgcagatctctgcaatatcgaaaggtacttctggaataacggtgtagtgagcaccgccggccatacctgcgtgcagagcaatccaacccacgtggcggcccatgacctccacgatcatcacacggttgtgagattcagcggtggtgtgcaggcggtcaacagcgtcggtagccactgccacagcagtatcgaaaccgaaggtgaagtcagtgccattcacgtcattgtcaatggtctttgggacaccgacaacagggataccgttatcagacagccacttggcacccttcagggttccttcgccaccgattgggataagggcatcgatgccggcgtcttc

SEQ ID NO: 1385 - DNA, 1107 bp, Corynebacterium glutamicum
atggcttccgaaacctccagcccgaagaagcgggccaccacgctcaaagacatcgcgcaagcaacacagctttcagtcagcacggtgtcccgggcattggccaacaacgcgagcattccggaatccacacgcatccgagtggttgaagccgctcaaaagctgaactaccgtcccaatgcccaagctcgtgcattgcggaagtcgaggacagacaccatcggtgtcatcattccaaacattgagaacccatatttctcctcactagcagcatcgattcaaaaagctgctcgtgaagctggggtgtccaccattttgtccaactctgaagaaaacccagagctgcttggtcagactttggcgatcatggatgaccaacgcctcgatggaatcatcgtggtgccacacattcagtcagaggaacaagtcactgacttggttaacaggggagtgccagtagtgctggcagaccgtagttttgttaactcgtctattccttcggttacctcagatccagttccgggcatgactgaagctgtggacttactcctggcagctgacgtgcaattgggctaccttgccggcccgcaggatacttccactggtcagctgcgtcttaacacttttgaaagactatgcgtggaccgcggcatcgtcggagcatctgtctattacggtggctaccgccaagaatctggatatgacggcatcaaggtgctgatcaagcagggagccaatgcgattatcgctggtgactccatgatgaccatcggtgcgttgttggctcttcatgagatgaatttgaagatcggtgaggatgtgcagctcattgggtttgataacaacccaattttccggctgcagaatccaccgctgagcatcattgaccagcacgtacaagagatcggtaagcgtgcgtttgagattctgcagaagctgatcaatggggacaccgcgcaaaaatctgtggtgattccaacgcagctcagcatcaatggatcaacggcggtttcccaaaaggcggccgcaaaggcagcaaaagcagcccaaaaagcagccgcgaaagccgcacagaacacgcaacacgaggtgagcctagatggtgaactc

SEQ ID NO: 1386 - DNA, 1572 bp, Corynebacterium glutamicum
atggtgaactctgaacaagcgcttcatcagcatgatcctgcaccaatccttcagttggataaagtctccaagtcgtttggcccagtcaacgtcattaatcaagtgagcatcgatgttcgccctggcagggtgcttgcgctgttgggtgaaaatggtgcgggtaaatctacgctgatcaagatgatgtcgggtgtgtatcagcctgatggcgggcagattttggtggatggaaagcccacgactttgcctgatacgaaaactgctgagtcttttggcatcgctacgattcaccaggaattgaatctggtgcccacgatgacggtggcggaaaacgtcatgctgggccgcactcctcggaagtggggtttggtcaatttcaaacatttgcgcaggcaggcacaggcggcgctggatctcatcggcgtggatgtggatctgaatgctcaggtgggttctttaggaatcgctaggcagcagatggtggagatcgccaaggcgttgtccatgaatgcgcggatattgattttggatgagcccactgcagcgttgactggtcgtgaaattgatcagttattcaaagtggtggatcagctgaaagaaaaaggcgtggccatggtgtttatttcgcaccacttggatgagatcgcgcgcatcggcgataccgtctctgtgctgcgtgatggccagttcatcgcggagctgccagcggatactgatgaagatgagctggtgcggctgatggtgggtcgtagcattgaaaaccagtatccgcgtagtgcgccagagatcgggcagccactgttggaggtgaaaaacctcaacgcggagggccggttcacggatatttccttgactgttcgcgctggtgaagtcgtaggccttgccggtcttgtgggtgctggtcgcacggaagtggttcgctcgattgctggcgtggacaaagttgattccggtgaggtgatcgttgctggcaagaaattgcgcggcggcgatatttccgaggctattaaaaacggcatcgggcacattccggaagatcgaaaagcccagggcctggtgctggggtcgtctgtggaggacaacctgggattggcgactttggcgtcgacagcccgcgcaggtttggtcgatcgatcaggacagcacaaacgagccgccgaggtcgcggaaaaactccgcatccggatggcaagcctcaaacaaccgattagcgatttatcgggcggcaatcagcaaaaggccgtgttcggccgctgggtgcttgccgggtcaaacgtgctgcttctcgacgaaccgacccgtggcgttgacgtcggcgcgaaggtggaaatttacaacatcattaatgagatgacggaaaaaggtggcgctgtgctcatggtgtcatcggagcttcccgaagtcttgggcatggctgatcgcattttggtcatgtctggtggacgcatcgcaggcgaactgccagcgaagggaacaacccaggacgatgtcatggctctagctgtttcccaggtggatgattccatcaccgaggaagctgctgcagaaatcgaaaacacaaaggaggaccgt

SEQ ID NO: 1387 - DNA, 972 bp, Corynebacterium glutamicum
ttgagcaccgccgtagtttcacagaagaagtccacaacggcatccaaaattggacattggatgctcaataacggtgcgttggtggggctgattgcactgtgtgttggactttttattgcaacaccccactttctcaccattcctaacctgatcaacatcggtatccaatcggcgacggtggcgatcctggcgttcggcatgaccttcgtcatcgttaccgcaggcattgatttgtctgtgggatcagtggctgcgttgggtgcgatgacctcggcgtatttcttcgcggaagttggtttgccgggctggatcacgctgctgattggcctgttcatcggattgttggcgggtgcgatctctggcatttctattgcttatggcaagttgcctgcgtttattgccaccttggccatgatgtcgatcgccaggggaatcaccttggtcatttcccaaggctcaccaattcccagtgcaccagctgtgaacgctttggggcgcacctactttggcatcccgatgccgattctgatgatggcactggctggcattgtgtgttggtttattttgagccgcaccgtgctgggacggtccatgtacgccattggcggaaacatggaagcagcccgactatctggtctgccagtgaagaaaatcctggtcatggtctatgcactggctggtgtgtatgcagcacttgcgggtctggtcatgacgggacgcttgtcgtccgcgcagccgcaggcaggcgtgggatacgaactcgatgcgattgccgccgtggtcattggtggtgcgtcacttgctggcggaaccggaaaagcaacgggcactttgattggtgccatcttgttggccgtgatccgcaatggcttgaacattttgaacgtgtcctcgttctggcagcagattgtcatcggttgtgtcatcgcgcttgcggtgggcttcgatgtcatccgaaacaaaacctctaag

SEQ ID NO: 1388 - DNA, 942 bp, Corynebacterium glutamicum
atgtacgctcgtaaacttattgctctgtccgcttctgtcgttttggctttcagcttgtctgcttgcaaccgtgaatcttctggcaccagcgcagacggcggttctgcggatgggtcgatcaccttggctctgtctacccagaccaacccgttctttgtgcagcttcgtgatggtgcccaggaaaaggctgatgaattgggcgtgaccctcaatgttcaggatgcttccgatgacgctgcaacgcaggccaaccagctcaacaacgctgtcaccaccggtgctggcgtggtgattgtcaacccaactgattctgatgctgtggtgccgtcggtggaagctctcaaccaggctgacattcctgttgtggctgtcgaccgttcctccaatggtggcgaggtggcgtccttcgtggcatctgacaacgttgctggcggcgcgcaggctgctgcagccctggcagaggcgatcggtggcgaaggtgaaatcctcatgctgcaaggcattgcgggatcctctgcatcacgtgatcgtggacagggatttgaagaggagatcgctaagcatgagggcatttccattgtggctaagcagaccgccaactttgaccgcggtgagggcctggacgtggcaactaacctgctgcaggcacaccccaatgtgaaggcgatcttcgcggaaaacgatgagatggcgttgggcgcaatcgaagccctgggtgctcgtgctggtgaagatgtcatcgttgtcggtttcgatggcaccaatgatggtctggcagcggttgaagatggacgcatgttggccaccgttgctcagcagccagaagagctgggagcaaaggctgtggaagaagcagctaagctcctgcgcggtgaggacgctgaaacagaggtaccagttgaggttgtcactgtgaagctcgacaacgtcgcggacttcaag

SEQ ID NO: 1389 - DNA, 369 bp, Corynebacterium glutamicum
atgaaaaagtccggtttactaaaccccgatctgtgttacgccatcgcgcggctcgggcacaccgatacctgggcagtggcagattgcggattacccatcccagaacacgtagagatcatcgatttggcactcgtgtttgggatccccacctttgaacaagtactgaatgctctcaagccggaagtagttgtggaaggcgcggtgattgccgaaggggcacccgaacgtatccgcgaaatggtggatacggatgtggaagttgtcacgcatgaagagctgaaagcccagctcgcggaatgtgcctttgtcattcgaacaggggagaccactgcgtatgcgaatgtgatcttcaaatcaggcgtagctttc

SEQ ID NO: 1390 - DNA, 636 bp, Corynebacterium glutamicum
atgcaattcgcacaaaacccgcgtctgacgaacgacgcggtgatcttagaaccactgtcacatcagtggactcaggatctccaggaagctgtcgcctcacaagaattgtggcgccattggttcgtcgctctacccaccccagagggcatggcggaggaaattgaccgccgcctagccgaacatgcagacggactgtgtgcgccttgggcaatcatttccgctgcaacaggccgtgccgttggcatgacctcatttcatacccttgaccacgcgaataaacggctggaaattggacgcacatggatggctgcccatgtccaaggaaccggcatcaacccctcggtgaaattcctgcagttgcagcgcgcttttgaagacctcggtgtcaatgccgtggaattccgaacgaactggcacaaccaccgctcccgcgccgcaatcgaacgactcggagcaaaacaagacggcgtactacgcaaacatcgcatccaccctgacggcaccgtccgcgacaccgtcatctattccatcaccaacgatgaatggcctgccgtcaaactgacgctcatggagcgactgtaccgtcacatgcaggttcccatcattcccaacgaggcatcgcttttcgacgccagc

SEQ ID NO: 1391 - DNA, 1014 bp, Corynebacterium glutamicum
atgaaaaagcgtgtcagtttatttaagtcagctgcatcgattgtggtggttgcgggaatggcgttgggtatggtgggttgctcatcgaccgaatcggagagtgaatctagcgctgacgtgacatcatctgccgatggggcatatccagtgtccatcgcgaccaaattcggtgatgtcactgtggaaagccaaccagaacgcgtcgttgccctgggttggggagatgctgaggctgcgctggaattcggtgtgcagcctgtgggtgcatcagattggctcgcattcggtggtgaaggcgtgggaccgtggattgaggattctgcctacgatgaagcgccagaaataatcggaaccatggaaccggagtatgaaaagattgcagcgcttgaaccggatctgattttggacgtgcgcagctctggcgaccaggaacgctatgacaagttgtcttcaatcgcactgaccatcggcgttccagaaggtggcgatagctacctcaccccacgcgctgagcaggtaaccatgatcgccactgctctggggcaggctgaacgtggtgaagaagtgaacgctgaatacgagcagctcactgctgatattcgtgcagctcacccgggctggcctgagaagaccgcggctgctgtatctgcaacggcaaccagctggggtgcatacatcaagggctccaaccgtgtagatactttgctggacctgggcttccaggaaaaccctgagctggctaaacagcaacctggcgatacgggtttctccatcaaattcagtgaagagactttcggcgttgtggattccgacctggttgtcggctttgccatcggtatgactcctgaggaaatggcagagcaggttccatggcagatgttgaccgccactcgtgacggccgttcctttgtgatgccccgtgagatttccaatgcgttttctttgggttccccgcagtccactcggttcgcgttagacgccttggtgccacttctggaggagcatgcaggggag

SEQ ID NO: 1392 - DNA, 1005 bp, Corynebacterium glutamicum
atgagtactcaagttgaactcaaaacaccgaaatcggaagaccgggcagcatatatcgctgcattgggattcccggtcttggtcatcattggcggcatcatcggattcacagcctcggatgttgtgctcaatatttcttcgtgggtcaatcctttgctgggcatcatcatgttctccatgggcctgaccttgaagccagttgacttcgcccttgttgctaaacgcccactcccagttcttatcggcgtgatcgcccagtttgtcatcatgcccctgatcgcattgctggtggtctgggttttgcagctgcctgcggaaattgcggccggtgtcatcttggttggttgtgcacctggcggaacttcctccaacgtggtgtcttacctgtcccgtggtgatgttgcgctgtctgtcaccatgacttccatctccacgctgcttgctccaattttcactccactgcttaccctgtggctggcggggcaatacatgccacttaatgccgctgatatggctgtatccatcgtccaagttgtgctgatcccagtcgtgggcggacttgttgtgcggttgatcttcccgacactcattggcaaggttttgcctcttttgccatggatttcagtcattgcgatttcattgatcgttgccatcgtggtcgctggttcaagggataaaatcctcgaagcaggactgctcgtgctggctgccgtgattattcacaacaccctcggctactccctgggatacctcgctgcgaaattcactgggcagcctgctgcagctcgacgcactaccgcgattgaggtcggtatgcaaaactccggcctcgcagctggactcgcatcccagtacatgtcaccaatgtctgctctgccaggcgctatcttctctgtctggcacaacctttccggagcacttcttgctgcattgtgcagggcgtccgataagagggctgcggagaaggtggcttcagaaaaggctgcctcggagaaggccgcttcc

SEQ ID NO: 1393 - DNA, 1479 bp, Corynebacterium glutamicum
atggacttcgatgaagttctagagaaatatgacccggtgatgggacttgaggtccacgtcgaactgggcactgagaccaagatgttctctgcatcttctgcacactttggcgctgaacccaatagcaatgttgacccagtttctttgggtctcccaggcgcacttcctgtggttaacgccaagggcgtggagtgggcaattaagattggactggcgctgaactgcagcatcgctgagtcctcacgctttgcacgtaagaactacttctacccggatcagcctaagaactaccagatctcccagtatgacgagccaatcgcatacgacggctacctggatgttgttctggaggacggcaccgagtggcgtgtggaaatcgaacgcgctcacatggaggaagacaccggaaagctcacccacctgggtggtacttctggtcgtattcacggcgcaaccgcttctttggtggactgcaaccgtgcaggcgtccctttgattgaggttgtcaccaagccaatcgaaggcgctggcgctcgcgctccagagatcgctaaggcttatgtctccgcactgcgcgatctggttaaggcgctcggtgtgtccgacggccgcttggatcagggttctatgcgtgtcgacgccaacctgtccctgcgcccgatcggccaggaggaattcggcacccgtaccgaaaccaagaacatcaactccctgaagtccgttgagcaggccatcacctttgagatgcagcgccaggctcaggtactggacgacggtggtgtgattgatcaggaaacccgccactaccaggaggcagacggaagtacctccaagggtcgtccaaaggaaaccgctgaggattaccgttacttcaacgatcctgacctgcctccagtgattgcgcctcgtgagtgggtggaagaaatccgcgcaactcttccagagctgccttgggttcgccgtgcacgtatccaggaagagtggaagctttccgacgccgagatgcgcgacctcatcaacgccaacgcgctcgacctcatcatcgagaccgtggaagcgggtaccactcctgatgaagctcgtgcttggtgggtttcttacatctctcagaaggctaacgagtctggtgtcgagctcgatgctctcggtgttgcgccagctcacgttgctcgcgtcgttgcgcttgtttctgaaggcaagctgaccaataagctggcacgtcaggctatcgacggcgttattgctggcgaaggcgatgtggacgcggttgttgctgctcgtggactggaagttgttcgcgatgacggcgcaattgaaaaggctgtcgatgatgccttggctgcaaacccagacatcgtggagaagtaccgcgctggcaacaccaaggtcaccggcgccatcgttggtgctgtcatgaaggcgacccgcggtaaggctgacccagctcaggtgaaccagctgatcgcaaagaagttggct

SEQ ID NO: 1394 - DNA, 672 bp, Corynebacterium glutamicum
atgatcaaagaactgctcaacaagctcttcggaaacaagaaggcttccccggcaatgacacaatctgaaaccatttcacacaaggagaacaacacaatgaccacttacaccatcttcggccgcggcaacatgggcaccgcaatcgcaggcgtcctcaccaagggtggtgcaactgtagaacacatcggttctgcagattctgacatcgcaaccatcaacggtgacgttgttatccttgctgttccttacccagcagtagagtccatcattgcaagccacaaggatgctctcgcaggcaagaccgttatcgatatcaccaacccacttaacttcgagaccttcgattccctcgtcgttccagttggttcttctgcaaccgctgagatccaggctcagcttccaacctcccgcgttttgaaggctttcaacaccaacttcgcagccactttggctaccggaaaggttggcgatatcaccaccaccgttttagttgcaggcgatgatgaagacgcaaagaacgctcttatcaccgacgtcaacgctggcggcctcgacgcccttgacgctggttccctcaagcgtgcacacgagcttgaagcagttggtttcctgcagctcacccttgcaggttccgagaagattggatggaccggcggattcggcctggtcaag

SEQ ID NO: 1395 - DNA, 1077 bp, Corynebacterium glutamicum
gtggctaacacgtcatccgattgggcaggcgccccacaaaatgcatcagcagacggcgagttcgttcgcgataccaactacatcgatgaccgcatcgtcgcagacgttccagcgggatccgaaccaattgctcaggaagatggcactttccattggcctgtcgaggctggtcgctaccgtttagtcgctgcccgcgcatgtccatgggcacaccgcactgttatcacccgtcgtcttctcggcctggagaacgtgatctcgcttggtctgaccggcccgactcacgacgttcgttcctggactttcgatttagatccaaaccatcttgatcccgtgctgcagattcctcgtctacaggacgcgtatttcaaccgcttccccgattacccgcgcggcattactgtcccagcgctcgtggaggaatcgtctaagaaggtcgtcaccaacgattacccttccatcaccatcgatttcaatcttgagtggaagcagttccaccgtgagggtgcgcctaacctctaccccgcggagctgcgcgaggagatggcgccggtgatgaagcgcatcttcactgaggtcaacaacggcgtatacaggaccggctttgccggtagccaggaagcgcacaacgaggcgtacaagcggctttgggttgcgttggactggctagaagatcgcttatcgacgcgacgttacctcatgggggatcacatcaccgaggcggatatccgcctctacccaaccctcgtgcgtttcgatgccgtctaccacggacacttcaagtgtggccgcaacaagatcaccgaaatgccgaatctatggggctacctgcgggatcttttccagaccccaggctttggcgacaccaccgatttcaccgaaatcaagcagcactactacatcacccacgcggagattaaccccacccggatcgttccagtcggaccagatctgtctggtttcgcgacaccacacggccgtgaaaagctcggcggatccccatttgctgaaggtgttactctgcctggcccaattcctgcgggcgaagaagtgaaaaaccctgaaccttttcagaag

SEQ ID NO: 1396 - DNA, 774 bp, Corynebacterium glutamicum
atggctcgatcacaaaaaagaacacctgctatcaggtcaaccaaaaaagttaaaagtgtaatatccagcatcatcacgattgccgtggctgcagtcgcttttgcagcttacgttatagatggtggggtagaagaggcgtctggaacaccgacgtcttcggaaagctcggtagcggcaactgctccagcggcatctagcgagactgcggctgaataccgtgcgatgctcgcttcccttgacgttaaaggtcgtgcgccaggaacaggatatgaccgcgaattattcggaccagcatggaccgacactgtttccgtggaatatggacacaatggctgcgatacccgcaacgacatcctgcaacgcgacctggatgacatccaacttcgcgaaggcaccaaggattgtatcgtcacgagcggcctgctcagcgatccattttctggcgaacttattgatttcgttcgcggtgaacgttccggcgacgtgcagatcgatcacctggtcccattacatgacgcatgggtcaagggagcacagcagtgggatgagcaaactcgaaagaactttgccaacgatcccgacaaccttctcgccgttaaaggtacgcttaaccagcaaaaaggtgcaggcgatgcagcaacctggcttccaccaaacacagcttttaggtgcgattacgcaaagaaaatcatcaccgttaaagatcgctacaacgtgtgggtgactgaggctgaagcaagcgccctggaacgccaattagatacgtgtgctgca

SEQ ID NO: 1397 - DNA, 1056 bp, Corynebacterium glutamicum
atgactgataactcgcgaaattcaaatcagaattttgatcaaccagacctgaacgatctcgatgatgattcggccatccctacttacaagggaccatcgccttccgcgaattcctccaacgctaccgagcgcctcggcagtgtttacgaccgaactggccgtgcagcgccccagaacattccgccggcatcaaatgctgctgaaaccacagcatttgagcgtccagataatcaatctgcgaagccagtggcttccgaagctccaacaactattacgccggcaagctctggtgcattagcatccgatgctccgacgtcttatgttcaggcgcagccttcccagcagcagactcctcagcaagttccgccagctccgccgacacaagttactcgtcagattagccgtcctgaagagcctggttaccagccagaaccgtcttattcggagccttacactgactctgatttcgcgccagcaggtgcggccgctgcggcagctgcagtagctccaccaatgattgcggaacagccacaaattgttgaagatgcccgccgaggtaccctcgatttcggcctgttgattatccgcgcagtcattggtgtctatttgatcgtccgtggagtctttacattcttcacccttggaggatctgccggtcttgctggcctcgaggcagagttcgctggttaccagtggcctgaaatcctcgcgatcctgcttccatctattgaacttgcggctggtgtcttcctgctccttggtctgatgaccccagtggcagcagcggtagccacggtggcgacatcctttaccacccttcaccaagtcaacactcatgaaggtggttggggtgaacttagtgagccattgatgctggcactgatcctcactatcgtggttgtcggacttcagttcaccggccccggcaagatttcccttgactctggccgaggttgggcaaagcgtccactggtgagctcgtggatcttcgtggtcatcggcatcgcagcggcagttctgctgtggtggttcggtgcgggtgtgaacccaatcgcg

SEQ ID NO: 1398 - DNA, 237 bp, Corynebacterium glutamicum
ttgagcaccggttccctactttgggttccggtgctttttcatgtcttggcctgtgtgggcgtggtggagctccccgttgcaaatactcaccacaagttgcaggatttctgctggttgtggtggattttcccgctttatagccctatgcgtgcaactttcggaccgattccaaagggcaaagccctgtttgtggtggatccttgccctggaagctttcaggaaccacaactaccccac

SEQ ID NO: 1399 - DNA, 1839 bp, Corynebacterium glutamicum
atgatcccacttcgttcaaaagtcaccaccgtcggtcgcaatgcagctggcgctcgcgccctttggcgtgccaccggcaccaaggaaaatgagttcggcaagccaattgttgccatcgtaaactcctacacccagttcgtgcccggacacgttcaccttaagaacgtcggcgatattgtggcagatgcagtgcgcaaagccggtggcgttccaaaggaattcaacaccatcgccgtcgatgacggcatcgccatgggacacggcggcatgctgtactccctgccatcccgtgaaatcatcgccgactccgtcgaatacatggtcaacgcacacaccgccgacgccatggtgtgtatctccaactgtgacaagatcaccccaggcatgctcaacgcagcaatgcgcctgaacatcccagtggtcttcgtttccggtggcccaatggaagctggcaaggctgtcgtcgttgacggcgttgcacacgcaccaaccgacctcatcaccgcgatctccgcatccgcaagcgatgcagtcgacgacgcaggccttgcagccgttgaagcatccgcatgcccaacctgtggctcctgctccggtatgttcaccgcgaactccatgaactgcctcaccgaagctctgggactttctctcccgggcaacggctccactctggcaacccacgcagcacgtcgcgcactgtttgaaaaggccggcgaaaccgtcgttgaactgtgccgccgctactacggtgaagaagacgaatccgttctgccacgtggcattgccaccaagaaggcattcgaaaacgcaatggcactggatatggccatgggtggatccaccaacaccatcctccacatcctcgcagctgcccaggaaggcgaagttgacttcgacctcgcagacatcgacgaactgtccaaaaacgtcccctgcctgtccaaggttgcaccaaactccgactaccacatggaagacgtccaccgcgccggtggcattccagcactgctcggcgagctcaaccgcggtggcctgctgaacaaggacgtccactccgttcactccaacgaccttgaaggttggttggatgactgggatatccgctctggcaagaccaccgaagtagcaaccgaactcttccacgcagccccaggtggcatccgcaccaccgaagcattctccaccgagaaccgctgggacgaactcgacaccgacgctgccaagggctgcatccgcgacgttgaacacgcctacaccgccgacggcggcctggttgttcttcgcggcaacatctcccctgacggcgcagtgatcaagtccgcaggtatcgaagaagagctgtggaacttcaccggaccagcacgagttgtcgaaagccaggaagaggcagtctctgtcatcctgaccaagaccatccaagctggcgaagttctggtcgtccgctacgaaggcccatcaggtggaccaggcatgcaggaaatgcttcacccaaccgcattcctcaagggatccggcctgggcaagaagtgtgcactgatcaccgacggccgtttctccggaggttcctcaggactgtccatcggccacgtctccccagaagcagcacacggcggagtcattggtctgatcgaaaacggcgacatcgtctccatcgacgttcacaaccgcaagctcgaagttcaggtctccgacgaggaactccagcgccgccgcgacgctatgaacgcctccgagaagccatggcagccagtcaaccgtaaccgcgttgtcaccaaggcactgcgcgcatacgcaaagatggctacctccgctgataagggtgcagtccgtcaggtcgac

SEQ ID NO: 1400 - DNA, 564 bp, Corynebacterium glutamicum
ttgggcgccgttgtttttggcctgatctcattattagtcatcggcgcagcccctcagtacctgttttggctgctcgcgctccctgtcatcttcggttactgggttctaaaatcatccacgatcgttgatgaacagggcatcaccgcaaactacgccttcaagggcaaaaaggttgtggcctgggaagacctcgcaggaatcggattcaagggtgcccgcactttcgctcgcaccacctccgatgcagaagtcaccctccccggcgtcaccttcaactcccttccccgccttgaagctgcttcccacggccgcatccccgatgcgatcaccgcaagcaaggaagcagccgacggcaaggttgtagtcgttcaagaagacggctactccgtgatgatgtccaaggaagagtacttggagcgccaaaaggcactgggcaagccagttcagttgaacttcgatgacgacaccgatgggaatacaacacaaacagaaagcgttgaatcccaagagaccggacaagccgcgtctgaaacctcacatcgtgataaccctgcgtcacagcac

SEQ ID NO: 1401 - DNA, 1473 bp, Corynebacterium glutamicum
atgcgtattatcaagcgccgagtggagtctgcagccgatgcggacaccactaagaaccagctcgcgttcgccggcgttggcgtttatatcgcgcaaattgtggcgtttttcatgcttgccgtctccgcgatgcaggcttttggtttctctctcgcgggcgctgcgattccggcaaccattgcgtcagctgccattggccttggtgcgcagtcgattgttgcggacttcttggccggatttttcatcctgacggaaaagcaattcggcgtgggtgactgggtgcgttttgagggcaacggcatcgttgtcgaaggcaccgtcattgagatcaccatgcgcgcgaccaaaattcgcacgattgcacaagagaccgtgatcatccccaactccacggcgaaagtgtgcatcaacaattctaataactggtcgcgtgcggttgtcgttattccgatccccatgttgggttctgaaaacatcacagatgtcatcgcgcgctctgaagctgcgactcgtcgcgcacttggccaggagaaaatcgcaccggaaatcctcggtgaactcgatgtgcacccagccacggaagtcacgccgccaacggtggtcggcatgccgtggatggtcaccatgcgtttcctcgtgcaagtcaccgccggcaatcaatggctggtcgaacgcgccatccgcacagaaatcatcagcgaattctgggaagaatacggcagcgcaaccactacatcgggaaccctcattgattccttacacgttgagcatgaagagccaaagacctcgcttatcgacgcctccccccaggctcttaaggaaccgaagccggaggctgcggcgacggttgcatcgctagctgcatcctctaacgacgatgcagacaatgcagacgcctcggtgatcaatgcaggcaatccagagaaggaacttgattccgatgtgctggaacaagaactctccagcgaagaaccggaagaaacagcaaaaccagatcactctctccgaggcttcttccgcactgattactacccaaatcggtggcagaagatcctgtcgtttggcggacgtgtccgcatgagcacgtccctgttgttgggtgcgctgctcttgctgtcactatttaaggtcatgactgtggaaccaagtgagaattggcaaaactccagtggatggctgtcaccaagcactgccacctcaactgcggtgaccacctccgaaacttccgcgccagtaagcacgccttcgatgacagtgcccactacggtggaggagaccccaacgatggaatctaacgtcgaaacgcagcaggaaacctcaacccctgcaaccgcaacgccccagcgagccgacaccatcgaaccgaccgaggaagccacgtcgcaggaggaaacgactgcgtcgcagacgcagtctccagcagtggaagcaccaaccgcggtccaagagacagttgcgccgacgtccacccct

SEQ ID NO: 1402 - DNA, 231 bp, Corynebacterium glutamicum
atgtcgttagggttggtgaccatgaagttgtgcttggtcactggcatggtgatgccgcggatatcggcttcctggaaagcgtcggtacccagcaggccacttccgacctggccggtgatggcaaccatgggaacggagtccaagtttgcatcagcgattggggtaaccaagttggttgctcctgggccagaggttgcaatgcagacgccaacgcgtccagtaacctgcgcg

SEQ ID NO: 1403 - DNA, 606 bp, Corynebacterium glutamicum
atgatggtggcttcggggctcttggacatcacgagaactcggtcggagagcaggatggcctcgtcgacgtcgtgggtgaccatgacgacggtgcggcgggaggcttcccaaatgttgagtagttggagctggagttcgcggcgggtgagggcgtcgagggcgccgaagggttcgtcgagaagcatgattggtgggtcgatggcgaaggcgcgtgcgatgccgactcgctgttgcatgccgccggagaggcgggcggggcgccgttcggcggcgtcggtgaggcctacttgttcgaggtgggtgcgggtgatgtcggcgcgttcggttttgctcaaggaggggcgcgcggagcggaggccgaagtcgatgttgccgcgtgcggtcaatcagggcaggagggcgtggtcttggaaaaccatgcctcggtcaggtcctggtcctttaatttcttcgttgcctgcgctgactgtgccggtggatggggaggccagtccggcgatcattttgagaattgttgattttccgcagccggaagggtcgaggagggagacgaattcaccgtcgttgatggtgatgctcgtatcgccaatgatagtggtggagccg

SEQ ID NO: 1404 - DNA, 498 bp, Corynebacterium glutamicum
ttgaccgcacgcggcaacatcgacttcggcctccgctccgcgcgcccctccttgagcaaaaccgaacgcgccgacatcacccgcacccacctcgaacaagtaggcctcaccgacgccgccgaacggcgccccgcccgcctctccggcggcatgcaacagcgagtcggcatcgcacgcgccttcgccatcgacccaccaatcatgcttctcgacgaacccttcggcgccctcgacgccctcacccgccgcgaactccagctccaactactcaacatttgggaagcctcccgccgcaccgtcgtcatggtcacccacgacgtcgacgaggccatcctgctctccgaccgagttctcgtgatgtccaagagccccgaagccaccatcatcaccgatattccagtgaatcttccccgccccagacacgagctgagtgaagacgcttctgttgaagccgagaccacagccctgcgtaagcggatgctgcatctgctggagcac

SEQ ID NO: 1405 - DNA, 267 bp, Corynebacterium glutamicum
atgactaaaccaaacgcttccgtcgagctgaatacgatcaccaagtcctacggctccaccactatcattggcgatacgagcatcaccatcaacgacggtgaattcgtctccctcctcgacccttccggctgcggaaaatcaacaattctcaaaatgatcgccggactggcctccccatccaccggcacagtcagcgcaggcaacgaagaaattaaaggaccaggacctgaccgaggcatggttttccaagaccacgccctcctgccc

SEQ ID NO: 1406 - DNA, 882 bp, Corynebacterium glutamicum
gtgacacatatcctcttcgacagcaggcgttttctgcaactgggcgcttttgcgtccttgagcaccgcattggccggagcggcccgctacgtgacgtcgacaagcaataatgaacctgcggataacactcccctgaccattggctacgtgcctattgcgggctcggcgccgattgctatcgcagatgcgctagggctgtttaagaaacacggcgtgaatgtcacgttgaagaagtactcaggctggtccgacctgtggaccgcctatgcaacagagcagcttgatgttgcgcacatgctgtcgccgatgactgtggcgattaatgctggagtgaccaacgcgtcgcgcccgacggagctgtcgtttacccagaacaccaatgggcaagcaattaccttggcgtcaaagcactatggttccgtcaattcagcggcggatcttaaaggcatggtgctgggaattccttttgaatattcagtccatgcgctgctcctgcgcgattatctcgtctcaaacgcagttgatcccatcgccgatcttgagcttcgcctgctccgacctgccgatatggtcgcacaattgacagttgagggcatcgatggattcattgggcctgggccgtttaatgaacgcgccatcagcaatggctccggccggatttggctgctgaccaaacaactgtgggacaaacatccatgctgcgccgtggcgatggccaaagagtggaaagctgaacaccccacggcggctcagggtgtgcttaatgcgctggaggaagcctccgcaattttgagcaatccggcacaatttgattcctcggcacgcacgctgtcgcaggaaaaatacctcaaccagcctgccacgttgctggatggaccgtcg

SEQ ID NO: 1407 - DNA, 447 bp, Corynebacterium glutamicum
ttgtgcgaacaccgcatgaccttggattacttcaaggcatccggcactgactatgctttgggattggctgcagagtcggaaggggcacgacgcactggtatcaccggcatggcgagtgcattcaaggagtttgctggttgtggtgagatcgaccttgaagcaaccagggtagaaggtggcctcaaagttagtggaaagcttcgttgggcttccaacttgtgcgaagatccagtgattgtgcctgctgcaaagaccgcagagggcttacaactactgttcgcattgggcgcagaaaccgaaggtgtcaccctcggttcttcacttgctctactcggtttgaacgcaactgcttgcgcttgggtgagctttgaggatgtcttcattcctggggctcagattctaagccacgatttccttaccttgtggcatcggtgcgcccaaccttcg

SEQ ID NO: 1408 - DNA, 369 bp, Corynebacterium glutamicum
gtggcatcggtgcgcccaaccttcgtgatcctacggatctccgaatacttcggtgtcgctgaagctgcgattaatgcagccactggacgtctgaccagcctcagcgaagtgtttatcgacaacgctgccgagatccaagacaacctttcttcgctggtcgcgcttcagaaagatttggcagagcgagtcaacgttgaaggagtcaatcctgttactccagttgatctactggaacttcgcctcggttccgcgcagctggccgttgctgcaactgccattgaggttcgtgttgctggaggagcaggttatgtaaagtcttcatcaacgtctcgtcgtttccgtgttgaaatgggagcttgcacgggtccg

SEQ ID NO: 1409 - DNA, 486 bp, Corynebacterium glutamicum
atgactttaaaaacagtaaacggaacgcagctgcgagacactgtcggatcgttcccttcaggtgtcacggtggtcaccactaccgatggggaagtggaccacgggttgactgtgagtgcgttcgtgtccttgtcgttggagcctgccatggtgttggtgagtatcgataagaaatcaagcgttgtgccgtttttggagcagggttcaccagttgctgtgtctgtgttatcggaagagcagagcgatttggccatcacatttggccgtcatctggaaaacaaattcgacggcgtttccattaagcgttcaacaaacagggcagcggtcttggaaggtgcgtcagcatggttgagtggcgctgtggtggataaatacccaggtggagatcactttattatcaccattgccgtggaagagtgtgctcacgacgaggagcaaaagccacttctttaccaccgtggcaggctttttcagtggcaagaagat

SEQ ID NO: 1410 - DNA, 954 bp, Corynebacterium glutamicum
atggaaagccacgatcttcagcagcgcagttatgcgcacaatcccgatggccacgaccacagccatgacggactcggacactcacatgctcccagctccctcaaggctctttttgcggtcatcattttcacctcgatcatcttcctagcggaactaatcgccggccttatttccggatctttggcactgctggctgacgccatgcacatgctgtccgactccactggcttgatcattgcggctgtcgccatgctcattggccgtcgggcacgcacttctcgtgcgacctacggatacaagcgtgcggaagtcttggcagcgatggttaacgccaccgttgttacagcactgtctgtgtggatcgtcgttgaggccatcatgcgtctgggcaaggacctggaaatccagaccaacctgatgctcatcgtcgcggtcattggttttgtcaccaacggaatttccgccctggtgttgatgcgccaccaagatggcaatatcaatatgcgtggagcattccttcacgttctcagtgacatgctgggttccgttgccgtcattattgcgggcctggtgattcgctacacgggatggatgccggccgataccattgcttcgattgcgattgctgcgattattattcctcgcgcattcagcctcctgaaggaagctctcaatatcttgttggagcgtgttcctacaggtgcggagcctgcagaggtcgacgcagcccttcgtaaagtcccaggtgtcagcgatgtgcatgatcttcacatttggagcattgacggcaaggaaatcctggccacggtgcatttggtggtggattcgtctacaaatcagctgcatagttgtggcgtgttggatcgggcagaagcggaactatccaaacttgggatcttgcactcaacaattcagctggaaagcgcagatcacagtgatcatgaaagtgtgtgc

SEQ ID NO: 1411 - DNA, 153 bp, Corynebacterium glutamicum
atgaccccagctaagcacacttctccccttattgaaagcttattgaaaatgaaggggtggagaattaatcttcttgccactgaaaaagcctgccacggtggtaaagaagtggcttttgctcctcgtcgtgagcacactcttccacggcaatgg

SEQ ID NO: 1412 - DNA, 690 bp, Corynebacterium glutamicum
atgcagctgatttgtagacgaatccaccaccaaatgcaccgtggccaggatttccttgccgtcaatgctccaaatgtgaagatcatgcacatcgctgacacctgggactttacgaagggctgcgtcgacctctgcaggctccgcacctgtaggaacacgctccaacaagatattgagagcttccttcaggaggctgaatgcgcgaggaataataatcgcagcaatcgcaatcgaagcaatggtatcggccggcatccatcccgtgtagcgaatcaccaggcccgcaataatgacggcaacggaacccagcatgtcactgagaacgtgaaggaatgctccacgcatattgatattgccatcttggtggcgcatcaacaccagggcggaaattccgttggtgacaaaaccaatgaccgcgacgatgagcatcaggttggtctggatttccaggtccttgcccagacgcatgatggcctcaacgacgatccacacagacagtgctgtaacaacggtggcgttaaccatcgctgccaagacttccgcacgcttgtatccgtaggtcgcacgagaagtgcgtgcccgacggccaatgagcatggcgacagccgcaatgatcaagccagtggagtcggacagcatgtgcatggcgtcagccagcagtgccaaagatccggaaataaggccggcgat

SEQ ID NO: 1413 - DNA, 1815 bp, Corynebacterium glutamicum
atggggttttccacaccaagctatccgctaaatgatctgttcgcccgcattgaccgaggcgatatccaacttcccgattttcaacgggattacgcttgggatgttgatcgcatccgaagccttataaccactgttcttcgtggttttccagtaggtgtgctgatggcactagacacccgcggcgaggaaatgcgtttccggccacgcgcgctgtccggcgccccagatacgggcaaggatccaggtcttttgcttctcgacggacaacagcgcctcaccaccctttatcattgcttcagtggcgatggctatgtaaatacggtggacttccgatcaaagaaagtgacccggaagttttatattgatgttgctaaggctgttgaatctccggtcatgtccgatgaggctattttttcagtcgacgaaaccggcaaaatcatctcccacttcggtccagtgatcgacggcggcatcaccgatttagaaacagcacttgctcatggttgccttccagtttctgtgctgctggatgataacggcactgatttcctctttgacctcgccgatatggcaggagaaggcgctcgcgaacacgcgaagcgcttccaatcacaaatcgttaagaccttagttagttacgacatcccaatgatccgactggatcgtgaaaccgccaagggtggaattggttccatctttgctcaggccaatagctctggcttgcagatggatgtctttgatttgctcaccgcggtgttcgcagccgatgaatcggtggagaccgaattctcactgcgtgatgactgggtgcgggttgaacgaaaccttcgccaacactccgcacttgatggcatcggcagcacggagttcctcaccgcagtagccctgttggtcagtgcccgcaagggacatgcgtctggttaccgtgaagatatcttgaacttgacgctggctgaatacattcctgctgccgatgaaatgatcaagggcttcgacgaggcggctgaattcctgcgtcagcgatgcattttgagtctcgaccaggttccatacaccgcgcagattgttccactggccgtgatcctcaccctgcttgatgcagaagaaatggccaccgcacgttcatgggatcgtttgaatcagtggttctggagcggtgtcttgggtgagctttatggctcgcctgctgtgatcgcacgttccggtcgcgataccgatcaagttgctgcgtggattcgtgaaggtgccggcgaaactgcggttgtgccaaagactattcgcgataccgttttccacgaatcacgtcttctcagtgcaacccaagacaccggagtgtggaagggtatcttcgcactgctcatgggcaggggagcacgcgactggcgcaccggacagcagtttgatcgctggacttttgatgagctgggttgcaatttccaccagattttccccaccaaatggtgcaaggaacgcggcatcgatcctgtccttacggaatcagtactgaaccgcaccccgatgggtcgccgtaccgaagtagtcatcggcgatacccctccatcccgctacctgtctcgtgttcaatccaagtcgctcatgggtgatgaggaattcgatcagatgctggatacccacctgctcagcgcggaagacctgcacagttccaacaccacgcacttctttgcttctcgacgcaccaacttcatcgacatggtcgaggatgccatcggtaaagcggtgatcagggacgtcaacgagtcagatctcaccggtggacacgatggtcccgatgcatttggagacgctgccgaggag

SEQ ID NO: 1414 - DNA, 1743 bp, Corynebacterium glutamicum
ttgacacatcttgtttctccggtacgtcgcattattgcagcaaccaccacagcagtggtggcgctaggcctggtttcctgttcaacggacagcagccaggaaggcgccaacggtgctgcggaggtgatggcggagggcgcgtcgacaagcgaagttgtcgacgattcgccctaccgcgaagcgcgcgctgaaaacgtggcgcgtgtggtgtcggaggattttccgagtaccccgacggtgatcagtgacgccgactactccggaatcaaggctagcgagttgttttttgattcctctgacaatgttgttgtcgctggcaatggtattgcagaggagctgcgcgcggcctcgatcggtgtggttgcgcatgcgccggttctgcatgcgcgcggtgataataacgccgcagtcatggcggaaattgagcgtctcggcgcttcaacggtgttgttgattggcgatgcgctgccagaacttgccgaggatgagacgatcaccaaagtcattcatgacgacggtaccgaagaaggattagcgcagctcaccgctttgcaatttgagacgaaacaggttgacacggtggaggatctggttcgggaaaccgccagcctcacccctgaggatcaaacactgctcgcacctgcatggggtggtgtggcgccgacgccttccgacgacaagctggctgccttcccgctgcagtccaaacgtgacggtgaaatgtcgccgatcgtgattgccagcccagaatctggaatctccgctgtggcgactgcgcgtgcattcggcgcagaaattcgattcatggattatcccgacccgcgattcaaccaagagcagatgaagatggttgccggcctggctgatcgtcctttgcttgcactcggtgatcaatttgggaccggcgaacagctcgcggaaaagatcaagcgtggggaagaagtaaccactgaactacccggcggtggaggacttgttttcccaggtcgacgcatggtggcactgtacggacacccatccggaccagctttaggcgcacttggtgaacaaccagccgccgaagccgtggcgcgcgcgaccgacatggctgcgcagtaccaagagttcgaagaccagcccgtgattccggcattcgaagtaatcgcaacggttgcctctgaattcgcaggcgacgacggcaactactccaacgaattccccgtggaagatctagtcggatacgttgacgccatcaccgaagccggcggatacgcagtcctggatcttcaacccggacgcgccaacttcctcgaccaagccaaaatgtatgaagaactcctcaaacgaccaaacgttggattggcgctagatcccgagtggaaaatcggacccgatgagcaacccatgacacgagtgggctctgcagatgccgccgaaatcaacgaagtatcccagtggctcgccgacctgaccgccgagaacgatcttccacaaaaggcatttgtactgcaccaattccaattggaaatgctcaccaatcgggatcaaatcaataccgatcacctggaactggctgtcgtgttgcacgcagatggacacggaaacgcaggggataagtacgcaacttggaacatgcttcgcgagggactgagcccgaactacttcatggcgtggaaaaacttctacgacgaggatttcccgaccttcactccgcaacaaacctatgaagaggtcgatccgcgaccatggtttgtgtcgtatcag

SEQ ID NO: 1415 - DNA, 1590 bp, Corynebacterium glutamicum
gtgagccagaatggccgtccggtagtcctcatcgccgataagcttgcgcagtccactgttgacgcgcttggagatgcagtagaagtccgttgggttgacggacctaaccgcccagaactgcttgatgcagttaaggaagcggacgcactgctcgtgcgttctgctaccactgtcgatgctgaagtcatcgccgctgcccctaacttgaagatcgtcggtcgtgccggcgtgggcttggacaacgttgacatccctgctgccactgaagctggcgtcatggttgctaacgcaccgacctctaatattcactccgcttgtgagcacgcaatttctttgctgctgtctactgctcgccagatccctgctgctgatgcgacgctgcgtgagggcgagtggaagcggtcttctttcaacggtgtggaaattttcggaaaaactgtcggtatcgtcggttttggccacattggtcagttgtttgctcagcgtcttgctgcgtttgagaccaccattgttgcttacgatccttacgctaaccctgctcgtgcggctcagctgaacgttgagttggttgagttggatgagctgatgagccgttctgactttgtcaccattcaccttcctaagaccaaggaaactgctggcatgtttgatgcgcagctccttgctaagtccaagaagggccagatcatcatcaacgctgctcgtggtggccttgttgatgagcaggctttggctgatgcgattgagtccggtcacattcgtggcgctggtttcgatgtgtactccaccgagccttgcactgattctcctttgttcaagttgcctcaggttgttgtgactcctcacttgggtgcttctactgaagaggctcaggatcgtgcgggtactgacgttgctgattctgtgctcaaggcgctggctggcgagttcgtggcggatgctgtgaacgtttccggtggtcgcgtgggcgaagaggttgctgtgtggatggatctggctcgcaagcttggtcttcttgctggcaagcttgtcgacgccgccccagtctccattgaggttgaggctcgaggcgagctttcttccgagcaggtcgatgcacttggtttgtccgctgttcgtggtttgttctccggaattatcgaagagtccgttactttcgtcaacgctcctcgcattgctgaagagcgtggcctggacatctccgtgaagaccaactctgagtctgttactcaccgttccgtcctgcaggtcaaggtcattactggcagcggcgcgagcgcaactgttgttggtgccctgactggtcttgagcgcgttgagaagatcacccgcatcaatggccgtggcctggatctgcgcgcagagggtctgaacctcttcctgcagtacactgacgctcctggtgcactgggtaccgttggtaccaagctgggtgctgctggcatcaacatcgaggctgctgcgttgactcaggctgagaagggtgacggcgctgtcctgatcctgcgtgttgagtccgctgtctctgaagagctggaagctgaaatcaacgctgagttgggtgctacttccttccaggttgatcttgac

SEQ ID NO: 1416 - DNA, 327 bp, Corynebacterium glutamicum
atgtccaggccacgctcttcagcaatgcgaggagcgttgacgaaagtaacggactcttcgataattccggagaacaaaccacgaacagcggacaaaccaagtgcatcgacctgctcggaagaaagctcgcctcgagcctcaacctcaatggagactggggcggcgtcgacaagcttgccagcaagaagaccaagcttgcgagccagatccatccacacagcaacctcttcgcccacgcgaccaccggaaacgttcacagcatccgccacgaactcgccagccagcgccttgagcacagaatcagcaacgtcagtacccgcacgatcc

SEQ ID NO: 1417 - DNA, 867 bp, Corynebacterium glutamicum
atgccgcctgcgacgctgttcaatgttttgacttcagctggacttgaccctcaccagtcaggtgatgccattgttgtcgagtctgcccatttcacattgacgttcacgtgggatgagtggctgcgagctcaagcgacgtgggtgggggagttgagtgcgtcggattatgtgcgttctattgtggcgattaactctgcccatgatgcacgggcaacgccgaagatgatgttggatgccccgactggtctgacaacggtgcttaaggcggataagggtcagttgcaggcgtttgccgtggaggcgctgccgattggcgatggcctcagcgaggctcagttggcggggtttgtggctgccgcgtttgatggcgccatcgacctcactcgtgagtttcatgcactttacccggagcgctcgccgcaggagcgcggcgcaatgctcaacattaagcttgtcgacgcctccccctctcaaacagttacgcccgtgcgagtagctaactggttcatggatcagggggtggaggaagttccttatgatgcagcttctgggcgcatcagctttgagctgggtgacaccccagtggatgtgattttggatgatcccgagttgttgaagatccaagccgtggtggttgctgaccgcgatgtggaagccactgaagttttacatttgtgtaatcgagcgaacctggattctgatcactccaccatttttatgcgttcggatggggatgatgtggatttcgtcgccacggttgcggtgccgattcgtgctggtctgaacgatttccagttgagtcaagccctgcatgatggggtagtgggggttgttgggcaggtacgagctgtgatcaatcagctacac

SEQ ID NO: 1418 - DNA, 1062 bp, Corynebacterium glutamicum
gtgcgttatattgctttagcgaaagtaacttccatgcatcaacgttcgatgagcttcactttcattcgtacttttttcgtactttttggcatcacgttgttagtgtcatgcgttccagagcctcctgactcctacactaaagaatccactgtgctgcggtatcaggtctctgatttcaatctaaacttcgtggaattagcagttgcgcttgggtatttgaacaacattgagctccaagtagtcggatctgtacaaggcggcgttgagtccattgaatcgctcaaaaaggatgacattgacttcgcggcagtccccttcattggccttgttgcaggagagatagccaccggtgcgcccatcaaagcagtggccgcaagttacggaatttcccacgattcttcttctgcacttctagtccttaaagacagtgagatacacgaagtgcacgatctcattggcaaaacagttggcataaacaccctcggtgctctgggatctgcgatggttgagcgtcatctattcgacgccggtctcaccgaacctgagatcgtgagcgtcactcaacgtgcattacccggtgagtacttagaacaacgcctctaccaggggcaagttgatgcaatttgggtcaccgatagcgctaaacaccaagcgcttgaaactggagattttcggatcttggcagaggattcagaccttgtgcaggaactcaacactggctgcatggtggtgtcgcaaaaactcatcgacgagcaccccgcagtggttggagaattagtggatggagtagctcaggcaatcgagtttgaacgatcccactcccctgaagaagtgcgcgaagtttatttcaactacctcgaagcccatggtcagagtgatagaatatccagctttagatattgggagcattcgggcatcgcaacccgaggtggagtgctcagtgatagggagttcagcatgtggtcccactggattgaccgccaatacgacgtccccgatatcaatccagcaagtatttacaccaaccaattcaacccataccgaaaagtaaacccctcgcca

SEQ ID NO: 1419 - DNA, 1866 bp, Corynebacterium glutamicum
atggttaatctcatgtcggtcgaactcgaagaaatccgcgatttcttagcaggatttgaacctttcgcgcagctaccagccgaggaactagatcagttacctggaaaaatgagcttgcgctattttcggcgtggggaagagatcatcccaattggtgtgcccaatcattacatgggggtaatcagatcgggtgccattgatgttcttgatcaggagggcgtactgctggatcgccgtgacgcggggcgctcgtttggctattccacgatggggccagaacgaaattctcggtaccgtatggttgccgtggaagattccttggtgttgcgtctggggcgtgatgattttgatgagttagccaagcgcaaccctgatctgaaccgttactactccagctggtcgaagcgtatccgcgccgctgctgatcaattgcgccaagaatctagttcgaaggtgctgcgcacgaagttgggggagttcaagatcgccaacccgatttcctgcagcccggacaccacgatcatggatgctgccatcaagatggatgagttcggggtgtcttcgttgctggtgcagatcgatggggaactcaaaggcatcatcaccgatcgcgatatgcgcagcagggtggtggcgaaggatttggatattcagctgccggtctctgaggtcatgacggtggatccgcgttgcgcgacctcgcaggggttggcttttgaggccatgttgttgatgtcggagctgcgcattcaccacttgccgattgtggatgatggccaaatctccggcatcgtcactgcagctgacatcatgcgcttgctgcgccacgatccgatttacctcactgcggatctgtcgcgaaaaaataccgtggaggaattggccaacaccttccagtcggcagcggaggtggcttcgagatttattgatcggggagcttctgcggaagaagtcagtagcttgctcaccgtggctgcggattctttggcaagaaggctccttgtgctggcggagcggaaatttggtgcaccgccagttccgtattgctttgtggtggtgggctcgcagggcaggaaagaaatgggactggcctctgatcaagacaatgcccttgttctggacaattcctacaatgaccgcgagcatggacagtattttgcagcgctgagtgaattcgtgtgccagggcctcgaccgcgcaggacaggtgctgtgtccgggtgacatgatggcatccaatccggagtggcggaaaactgctgaccagtggatctccaccttccattcctggattactgcgccggagccggatgcgttgctgcatgcccagacattctttgatttcaggggaatttacggcgacaccgagatggctaaggatgtccaccaaaatgcggtgaatatggccaggggtgcgcgtcgcatgcatgcacacttggctagtcttgcggcccggcgcgatcctccgctggggtttttccgtggtcttgtggtggagcgttctggtgaatacggcgcgacgatggatattaagaagggtggcaccgcgggcatcgtgcagatggcgaggctgtatgcgctggccacgggtagtgatgcgattgggactcgggagcggttgattgctgcgtcgggccatggtcaggtgtcgcgtaagggtgcgcaggatttgttggatgcctttgatttcttagcggcgatggcgttccagcaccaggcgcggttgatcaaggtgggggagaagccgaactatcacattgatcccaagacgttgggcaagatggatcgggagcatttgcgcgatgcattttccattattaaagatatgcagtcggcgttagctactaaatatccggtgaggaacatc

SEQ ID NO: 1420 - DNA, 402 bp, Corynebacterium glutamicum
ttgtggatgatggccaaatctccggcatcgtcactgcagctgacatcatgcgcttgctgcgccacgatccgatttacctcactgcggatctgtcgcgaaaaaataccgtggaggaattggccaacaccttccagtcggcagcggaggtggcttcgagatttattgatcggggagcttctgcggaagaagtcagtagcttgctcaccgtggctgcggattctttggcaagaaggctccttgtgctggcggagcggaaatttggtgcaccgccagttccgtattgctttgtggtggtgggctcgcagggcaggaaagaaatgggactggcctctgatcaagacaatgcccttgttctggacaattcctacaatgaccgcgagcatggacagtattttgcagcgc

SEQ ID NO: 1421 - DNA, 654 bp, Corynebacterium glutamicum
gtgttggggcgtcgaaaagcgaaaatacggcgcgcaaccggcgcgttgcaggagttttattccgtgccgcggccgggggcgtcgacacgcattgaagacctgaagcttctggctgtggacgtggaaacgacgggcctgaagccccaccggcatcaaattgtgtcgattgggtgggtgccgattaacggcgacgtgattgatctgagcggcgcggggtatgtggtgattcgcggcagcgaggggttttcggtcggctcgtctgcggtgattcaccagctcaccgacgatgaaatcgccgcgggtatcgacatcaaagaggcgcttggccaactactgcaggcgctccagggacgcgccatgctggcgcatttttcacccatcgagcgcgattttatttcggccgcatgcctcaagcatttcggaacgcttctcgacgtccccctcgtggatacttttgccatggaacgccgccacatggagaggatgtccacctacccacgtggcgaagacctccggcttgcacgcattcgacaacgatatggtcttcccaattactccaatcaccaggcattaaccgacgctttggcgtgcgccgaggtgtatttggtgcagatcacgcaccttcgggcgaacaccctcaaagatatttgggaa

SEQ ID NO: 1422 - DNA, 804 bp, Corynebacterium glutamicum
atgcgttttggacgaattgccaccccagatggaatgtgtttttgctcaattgaaggcgaaggcgatgatgtagctaacctcaccgcccgtgagatcgagggtacccccttcactgaaccaaagttcaccggtcgcgaatggccacttaaagatgtacgcctgctggcaccaatgctgccaagcaaagtcgtcgcgattggccgtaactacgccgatcacgttgctgaggtgtttaagaagtccgcagaatcactgccaccaaccctgttcctgaagccaccaacagctgtcaccggaccagagtccccaatccgaatcccttcctttgccaccaaggtggaattcgaaggtgagctcgcagtagttatcggcaagccctgcaagaacgtcaaggctgatgactggaagtctgtcgttttgggcttcaccatcatcaacgacgtctcctcccgtgacctccagttcgctgacggccagtgggcacgcgctaagggcattgacaccttcggccccatcggaccatggattgaaactgacatcaactccatcgacttggacaacctgcccatcaaggcacgcctcacccacgacggcgaaacccaattgaagcaggactccaactccaaccagatgatcatgaagatgggcgaaattatcgagttcatcaccgcctccatgaccctgctcccaggcgacgttattgcaaccggttctccagcaggcaccgaagcaatggttgacggcgactacatcgaaatcgaaattccaggcatcggcaagctgggcaacccagttgtggacgcc

SEQ ID NO: 1423 - DNA, 618 bp, Corynebacterium glutamicum
ttgtggacgcctaaaatggatcaccaccatcacgatcatggggagaagcgtccgtacgaccaggtcaccccagaatccatggagaatcaatacaccaccacggaacaagtctggagcggcaaccccaaccaagcactcatcgcctacttgggtgaagagccagctgaaggcaccgcactagacattggctgtggcgaaggcgctgacctcgtgtggctgtcctccaagggatacgtcaccaccggcatcgacttcgcaccaactgcagtgaagcgcgcgaaacaaaacgccccatcagccgaagtcctcttggtatcattcaccgaattcgccatcgaatccggtcgccaattcgacctcgtcagctgctcgtacggccaaatcccagccaacgacacctccgtcgcgcaactggaaaacctcgtcgcacccggcggaaccctcctgttcacccaccacgactttgaatcagaatccgcagcaaccccaaagtggctgtcggaaaacctgagcgaagccttccgtgtcgaactagtggaatccttcgaacgtgacatcaaaaccggcgctggcgcacaccaccacgtggacattgtgctcaaggcaacgaaggttgat

SEQ ID NO: 1424 - DNA, 1128 bp, Corynebacterium glutamicum
atgtctgcccaccgcaacccctctgcccccaacaccgccccagatttcctcttatccagaggccacgggtctgtgcgcacccaaggatcaaaagaagtattcaccgatccctgggaggcagtagacgcccttaaacaagggcgcgtagccatggtggtgggtgctttgcccttcgaacgggacaaaccagcagcactgactgtcccagaacacatcatccgcgaagacggccccctagaacctcacgcctactacaggtttggaccaggctcagtactgcacgccagcgtcgcaggaattgatccctcaccgattgagcatttacgacgcgtcaatgcagccatcaataccatcaacaacactgtcctgaacaaagttgtgctcgcgcgcgccgtggacatctccttcgagccacccgttgatcccctgctggtggccgcacgtttgattgataactcccacaacaaggacggtttcatcgccgacctgacccctgcaggcccagactttgcaggccacatgctggttggatcctccccggaggtgttaatcaaacgccaaggttccaccatcaccgcatacccactggccggctccgcaccacggcttgccgatccagtgcgcgatgaagcccaaggacaaaacctcctggccagcgccaaaaacctagaagaacactcctacgtggtcaaccacctgcgcaccatcctggaaccactgtgctcacaattcgacgccccaacagttcctgaactgaccaaaaccaacgaaatgtggcacctcgcaacacccatcgttggcaccctcaagtacccacacatcaccgcactagaactagccatccgcacacaccccacccccgcgatctgtggcacccccaccgacgccgccgaagccctcatcatcgaagcggaatccccccgaaacttctacgccggagcagtcggctggtgtgactccaccggagacggcgaatacatggtagccatccgctgcgccgaagtatccgaagacggaacctgggccagagcatgggcaggcggaggcatcgtcgccgaatcagacgcccaagaagagtttgatgaaaccaccgcgaagctccaaaccatcatgcgctcgcttggtttg

SEQ ID NO: 1425 - DNA, 1488 bp, Corynebacterium glutamicum
atggcctgcatgactgatgttcgtgttcgtttctgcccatcgcccaccggcaccccacacgttggacttgtgcgcaccgcgctgttcaactgggcatatgctcgccacactggaggcaagttagttttccgcattgaggacactgacgctgcccgcgattccgaggagtcttactccgccatcatcgattccctgcgctggttgggaatggactgggatgagggtgtggaaaagggcggcccgcatgagccctaccgccagtcgcagcgcaaggacatctatcaggatgtgttgaagcagcttatcgacgccggtgaagtctacccagcttattccaccgcggaagaggttgaggagcgacacaaggctgctggccgcgatccaaagctcggctacgacaactttgaccgtgatctcaccgaagagcaggtcgcagcatttgaggctgaggggcgtaagcctgtgtggcgtctgcgcatgccagagcaggattggaagtggactgacctggtccgcggtgaagttgagttcaagtcgttcacccagcctgacttcgtggttgctcgttccaacggtgagcctttgtacaccctggtcaaccctgttgatgatgcgttgatggaagtcacccatgtgctgcgtggtgaggatcttttgccatcgactcctcgtcagcttgctctgtatgaggcgctcaagcgcattggcgtggcaaaggccaccccagcctttggtcacctgccatttgtgatgggtgagggcaacaagaagctgtctaagcgtgatccacagtccagcctgttcaaccaccgtgacaacggcatcatcccagagggcatgctcaactacctggcgctgctgggttggtcactgtctgctgatcaggacattttcggtgtcgatgagttgatcgctaactttgatgtcgctgacgtgttgggcaacccagctcgctttgaccagaagaagcttgaggccatcaacgcggatcacatccgacttctggagcctaaggatttcgaggctcgcctgcgcgcgtacatgactgagtacaccgagttcccagcggattacccagctgagaagtttgccattgctgcggagctggttcagacccgcatcaaggtgctcagcgaggcgtgggatctgctgaagttcctggtcaccgctgacgaagatctggtgttcaatgagaaggctgccaagaagaacctcaaggagaccgctgttgagcctctcaacgccggtatcgcagcgctggaggcagtggaggagtggaccactccaaacattgaagcagcattgaacaaggctctcattgaggatctaggcctgaagcctcgcgtggcgttcggtgcgttgcgcattggtatctccggcgaggctgtatccccaccactgtttgagtccatggagcttttgggcaaggaatccacgttggttcgtctgaaggttactcgtgagcagaccccattcgtggtcgctgag

SEQ ID NO: 1426 - DNA, 213 bp, Corynebacterium glutamicum
atggccatcatcgtcgacatcgatgtcatgctcgcccgccgcaaaatgggcgtcggcgaactcgccgaaaaaatcggcatcaccccagccaacctctcggtcttaaaaaacgggcgcgcaaaagcgatacgcttcagcacattggaggccatttgccgcgagctcggctgccagccgggcgacattttgcgttacgacgcctccctccacaac

SEQ ID NO: 1427 - DNA, 516 bp, Corynebacterium glutamicum
ttgaaacgatacgcccatccacggcgcatgtctgaaaggttccccatgaatccccgcatcctcatgctgcttcgcatcattttcggcgcggccttcctcgcactgttggtgctgcaagtcctgctcgccatcaaaatcgtgcgcgatggcctcaactccggcgagctctcccccatcccgctcaccattctcgcgagcttcgtgatcatcggtttcgggctcgtgcagttcatcatcgtctgtctgttcgcgctactgcgtctcgtggaagacgatgaaatcttcgacgcccactcgctcgcctgggttgatcgaattgccatcaccatcgcagccggcgccgttttactcctcccaatggcctacatcgtcgcagaagtcgacgacgcccccggagccatcgtcttcggtctcatcctcgcgatgctcatcacgggcgtatccctgctggtaaaaatcatgcgcgcactcctggcccgcgccatcggattctccacggaactggaatcggtgatc

SEQ ID NO: 1428 - DNA, 522 bp, Corynebacterium glutamicum
atgccgtttccagcactgttgttgccgctgattttctggacaggaattgcagctttgtcctcttgggcggtcagccgtgcacttccgctgcgcgccgataattccattgagattgatgcgccggtggaaaaggtctgggatttcatcgaggagaccaaccgcgtgccggagtggaatgagcacattctgtacgtgcaggcgcctggtgagatcgagcagggcatgaagctcaagatgaaaacaaggcacccagagaccaatcgcctcactttgaagtttcgccccaccatcgacgtgctgcgtccacaccgtgaattgacgtggtccaccaaaattgttgcgcgttggctgctcaccgtcaccgacacgatcgagctgaagcctttggaagatggtcgcactgaggtggatcaatcaatgtcctttagtggcgtactatcccccggagtgccctttttggccagcatcagcaggatcaaagagaactcaaaccgccagttgaaagcactgatcgaagccgag

SEQ ID NO: 1429 - DNA, 342 bp, Corynebacterium glutamicum
ttggatgcctcaaatgatgcccccaaatccataaacagtggggcaaacatcccgagaatccccgtaaaactctccgactgcgtcaccttcgtgctctcgcctgcaggctccagcacaaacgaatggttgccgtccatcagcccgggaaacgccacatgtcccagccagcgcagctcgcgggcgggttccgccgcgaggatggtcggagtagagcttatcgacgaacccccctccttgtttgtaaacgccacggtgttcccaaccaccgcttcaccactgaaagacgtgatggtgggatgtcactgcgggaagggctctagatcactcaacacctcccacacc

SEQ ID NO: 1430 - DNA, 621 bp, Corynebacterium glutamicum
ttgccccactgtttatggatttgggggcatcatttgaggcatccaataaagcacttgcaaattttgtggagtctaaagagcagtgatttttcccgatccccccctggccgcctagcggaaattattgataccgcgtggcggttggtggaaacacgtggctgggcgaatgtgagcatgcgaaccctggccgcggagctaaatatcaaggcgccgtcgctgtacaagcatgtaaaaacgcgcgaggatatcgccgcacacatcgccacgaaggcatttattcagctggggcaaagcctgcatgaacattgtgaaagtgtggaggatttgcttgcggaataccgctccatggctcgggaaaatccaaatatttaccggcttctcaccagttcagagttcccccgcgagctacttccagaaggcctagaaacttgggcaggaacgccattctacctggtcaccggccacgatccgatcaagggtcaagcactgtgggcattcgcgcacggcatggccatcctggaaatcgacgcccgattcgccggccccaacaatggatcccccgcggatggcgtgtgggagatcggcgcgcgggcatttgacacacaagtattcgaccaaggc

SEQ ID NO: 1431 - DNA, 303 bp, Corynebacterium glutamicum
gtggttgggaacaccgtggcgtttacaaacaaggaggggggttcgtcgataagctctactccgaccatcctcgcggcggaacccgcccgcgagctgcgctggctgggacatgtggcgtttcccgggctgatggacggcaaccattcgtttgtgctggagcctgcaggcgagagcacgaaggtgacgcagtcggagagttttacggggattctcgggatgtttgccccactgtttatggatttgggggcatcatttgaggcatccaataaagcacttgcaaattttgtggagtctaaagagcag

SEQ ID NO: 1432 - DNA, 180 bp, Corynebacterium glutamicum
atgaaaacaaagaagcagtcccgcatcttgttcatcgcacttggccttgtcatagctctacctgcactctcctttggcttaagccagctcttacctgcaaccaccaccagagaaatcaccatcgatgcccaaccagatcaggtgtgggaggtgttgagtgatctagagcccttcccgcag

SEQ ID NO: 1433 - DNA, 330 bp, Corynebacterium glutamicum
atgttttacaaggtttacaatcttgaaaaacgattggcctatggtgtaattggcaacacaacggtttctggtaccgtcattctaggttcgagtcctggtaggccagctgcgatcagctggaaaacaattgatcgtgtcctaatgccccgttcgtctagcggcctaggacgccggcctctcacgccggtaacacgggttcaaatcccgtacggggtactcttaaaagcatccacccttcatcaattgagggttggatgttttgtgtttgctaacacatctgacatcaccccctcccaggacaaatgtacgggctcatgtagcaggggattt

SEQ ID NO: 1434 - DNA, 213 bp, Corynebacterium glutamicum
ttgtccaaaccggatgtgattgatgagctcagagcaaagctcggttcagatacaagggctgtcaaagtaacgcattactcgaaaggcgctggaatttatcacgatgactatatggcacgagtttttggagagctgaagcatcatgggatcatgtggggtgcggaagggtctaggtgtttttacgggtttataactcactggaaaaaagtcacc

SEQ ID NO: 1435 - DNA, 183 bp, Corynebacterium glutamicum
gtgccggctcccccacgcgattggtggtggacactaattgccatcaaactactccctgcaactggacttatcgctgggatttggatacccgatattgccctagcagccaacatcggagtgatcgcctatttcttaattcctgccgttgctcatatacgagcgcgcttccttggacaggcattt

SEQ ID NO: 1436 - DNA, 318 bp, Corynebacterium glutamicum
atgttcgctctcgatcatcgtgtcgaaaatctagtactactagtgcatttttgtcgcctactgccattaactgtttcagtgcttacaccagctaattcagcgattcctcgaattgttatggcagcaaagaccagttcctggaaaagttgcactgcagccttgagaacacgtgcctgcgtcgcctgtttaagccgcttgcagttggaatctgctattagtcatcctttgaatgaacatgttcattttagtatcaggttcgagacagagatagcccatcactttcgggaggatttcaattatatggtggccaattacagc

SEQ ID NO: 1437 - DNA, 1152 bp, Corynebacterium glutamicum
atgaagcacatgaataactccgtagatcaacaaatcgccctctttggtcaatctggtagtggcaaaaccgccctactttgctctttttatggcgctgcacgagattcaactcaaagtgaaggtcagctatttgaactcagtgcaaaagatgatcggcataccaaactaatgaagatgtatctgggaatgaaagaagattccctagcgccaccccaaaatagattcgagtctcataagactgtcttttccctaaaacagaaaaacatcccaattaaggatgctgctaaatctgatcaggtgaatctcacttggcatgattatccaggtgaatggtttgagggtggagctgtaacggactcggaaaagcaggataaagttgaaacgtttagaaacctgctgggctcagatgtagcgctatttttagttgacggtcaaaagctgcatgattacgccaatgaagaggagcgctatcttagctatttatttgatggattcattgaaaacctaaatcagatcaaagatgcaatcctggagggtgggaaacagctccaacagttcccacgaatttgggtaattgctttatccaaagctgatctatggccagatctccaagtaaaagattttgagaatctacttaataagaaagctggcaatgaaattattgcgctgcgttcaaagcttttggagtttatcgataacgacgaagctttctccttcggtaaagatttccttttgctctcttcggcgaagttcactccaggccatattgatataagccagcgcaagggtgttgatgtcctcctcccgttggcttgtgtattgcccatgcaacgccatttgtggtggcaggagctgaaagttttgccaattaacctggctgatatacttttgggaaatgaaattgcccaaatgggtttcaagatcgtttccaaagttttgaaaaacaaagtatctggaacaaataacaaggcgatggcggcattggttttcgctgaacttgtgagggatatggttgatcagccaactgaattgcttcagaaggctcgtgaggaagccgtcggaaggcgtgaattccttaaagcgattactgcagaattcaccaggaagctgaatcaagccgaagctgatcaggttttagttcgggactttgca

SEQ ID NO: 1438 - DNA, 324 bp, Corynebacterium glutamicum
atgacactcatgtgggcaacccgtggaaaagactggggtttccgatttcttgatgatggtggggagctcgatccactcctgatctataagcaggcatttgcagaccgcgaattggccggtgaatttgtgctaattcgcccggaattcacggccacgcgcatgtttgatcctctaggacgcaccgaccatgctggccgcataattccacatgactttgtccttcgggggcagttcgcggaaggcgtcaccacattggaggatgttcaggaaattatttggccattggtcgaaaaacgatatgaggctatctgggatcgctctgtc

SEQ ID NO: 1439 - DNA, 1761 bp, Corynebacterium glutamicum
atgacgcctacccaaaatgagatccacccgaaacatagctactcccccatccgcaaggacggtctcgaggtcccggagaccgaaatccgcctcgatgactcgccaagcggccccaacgaacccttccgcatctaccgcacccgtggcccagaaaccaaccccaagcagggacttccgcggctgcgcgagtcatggatcaccgcccgcggcgacgttgccacctatcaggggcgcgagcgtttgcttatcgacgacggccgctcggcaatgcgtcgaggtcaagcttcggctgagtggaaaggccaaaaaccagctcctttgaaggcgctacctggcaaaagagtcacccaaatggcctatgcacgtgctggcgtgattactcgtgaaatggagtttgtagcgctgcgcgaacacgttgatgcggagtttgtgcgctctgaggtggcgcgcggtcgggccattattcccaacaacgtcaaccaccccgaatctgaaccgatgattattggtcgcaaatttttgaccaaaatcaacgccaatattggcaattctgcggtcacctcttcaatcgaggaagaggtgtccaagctgcagtgggccacgcgctggggtgccgataccgtgatggatctatccaccggcgatgatattcacaccacccgcgaatggattatccgcaactcccccgttcctatcggcaccgtcccgatctaccaagcgctggaaaaagtaaatggcgtggccgcagaccttaactgggaagtattccgcgataccatcattgagcagtgtgaacaaggcgtggactatatgaccatccacgccggcgtcctgctggcttatatcccactgactacccgtcgtgtcaccggcattgtctcccgcggcggatccattatggccggttggtgtctggcgcatcaccgcgaatcattcctctacgagcatttcgacgagctgtgcgaaatctttgcacaatatgacgtcgcattctccctcggtgatggcctacgccccggatcgcttgccgatgccaacgacgccgcgcaattcgccgagctgaaaaccattggtgagctcacccaacgcgcctgggaatacgatgtacaagtaatggtcgaaggacctggacacgtgccactaaacatgatccaggaaaacaacgagctggaacaaaagtgggcagcggacgcacctttttacactcttggaccactagttaccgacatcgctccaggttatgaccacatcacttctgccattggtgcagctcacatcgccatgggtggcaccgccatgctgtgttatgtcaccccgaaagaacaccttggcctgcccaaccgtgacgacgtcaaaaccggcgtaatcacctacaagctcgctgcccacgcagcagatgtggccaagggtcatcccggcgcgcgtgcctgggacgacgccatgagtaaagcgcgttttgaattccgttggaatgatcagtttgcgctctccctcgaccccgacactgcaatcgcttatcacgacgaaaccctgccggcagagcctgcgaaaaccgcacacttctgttcaatgtgtggcccgaagttctgctccatgcgaattagccaggacattcgcgatatgtttggcgatcaaatcgcggaattggggatgcctggggttggggattcttctagtgctgttgcttctagtggggcacgggaggggatggctgagaaatcccgggaatttattgctggtggtgcggaggtttatcggcgt

SEQ ID NO: 1440 - DNA, 348 bp, Corynebacterium glutamicum
gtgactggcaactcccctacatctatcgcagagctcgaacagtggttctccatccctagaatgaatacataccgaaattctgaaaatcccgaaggtttttacatctggaatacccagttatctaaagcatatttagaagatatacaacatgtagaagtgcttttaagaaacagggttgacgcccaattacgatctgctcgtggccccttctggtttgaagatgatagctattttagatttgctcaacagttcaaaaaagctctaacaaccgccaaaagaagaactaaaacaaacgattctcctgggaaaattatcaccgctcagcaagtcacatttagacgtcgacga

SEQ ID NO: 1441 - DNA, 531 bp, Corynebacterium glutamicum
gtgcccccgaaggaagatcggctctgtactcaaaagaatgcagagaagagcgattttttgaaggagattcccatggggaatatttctgctaagcctccattgcccaatagctgcggacatcatttaccaggacacgaaccctactacctacaagtaaaggttttgcgcgaaagggcgacatgggagccagttactaacctgcgtatggatggccagttcgtcgagtttgatgctggtggggaacatattcgtggttggaatcatgatccggctcggatggaatggtttgtaaaaaatggtggtctggctgaatggagtggatctagtccaaccagtcgcctcatgcgttttgagtccaaaaatgggcattacatggtcagtattggtccgaagtacgaccgcaatggttgttatggcaatatttccctggggatagtgccaacaagcccgggcctggattttcacgaaggatttaaacaggctttagaggctttcaagtatgttgagcgggaatatggcactgaacaggat

SEQ ID NO: 1442 - DNA, 132 bp, Corynebacterium glutamicum
atggtgcccagggtgagggcgccgttcatcatgaacttcatgttggaggtaccgctggcttccttgccggcggtggaaatctgttcggagacatcagacgcaggcaagatgtgctcagcaggggagacgttg

SEQ ID NO: 1443 - DNA, 936 bp, Corynebacterium glutamicum
atgaacagtgccgtgctggattggagccatgcggtcgatggtctcttcatccagtccatcggctgcgcgctccaaacggaagcggcgatcgatctctgtgatgatttcccacacgcgccagaacagctgttggaagatctgctgatcccactgctcaagagcttcggtgagcacggtgtggttggtgtatgcgaaggtcttggacacgattgcccaggattcttcccagcccatgtcatgctcgtccatgagcagacgcataagctcagggatagccaacactgggtgagtgtcattgagctgcacggagtggaactcggcaaagttgctgaggtccttgtggtgcgccaggtggccctgaatcatggcctgcagggaagcagaggtgaagaagtactgctggcgaacgcgcagcttcttgccctcgtaggtggtgtcattagggtagagcacgcggcagatatcggaaacgcgctcgcgctcgatgatggcgtcggtaaagcgctgggagttgaaggcatcgtaatcgaattcttcccacggctccgccttccacaggcgcagagttcccacgttgtgagtgccatagccggtgatcggcatgtcataaggaatagcgcgggttttcatatcgtcaaagcacacaaccaactggttggatgcacgacgaatggtaaaaggatattcctcttcgcgccatgggtctggcttttctacctggaagccctcgttaaaggactgacggaaaagaccgaagcggtagagcagaccataaccagtaacggggtagtcctgggtaacagcagaatccaggaagcaagcggcgaggcggcccaagccaccattgcccagtgctgcgtcattttcgatttccaggatgtcggtgatctcatggcccagctcacgggtagcagctgcagcctcatcaaccagacc

SEQ ID NO: 1444 - DNA, 2427 bp, Corynebacterium glutamicum
ttgggcttcattttccggcattttcctttaaactcatctgctatgactgaaaatcagccactccccgccgacctcgtcggcagccatgttcgtgccgctgctggcacccccgccgacctcgctactgatcgcaagttctggactggtctttcccgtgcagtccaggagcgcattgccgatgattgggagcgcacccgcgaagcttatggtgctgctcgccagcaacattatttctccgctgaattcctcatgggccgtgcactgctgaacaacctgaccaacttaggtctggttgatgaggctgcagctgctacccgtgagctgggccatgagatcaccgacatcctggaaatcgaaaatgacgcagcactgggcaatggtggcttgggccgcctcgccgcttgcttcctggattctgctgttacccaggactaccccgttactggttatggtctgctctaccgcttcggtcttttccgtcagtcctttaacgagggcttccaggtagaaaagccagacccatggcgcgaagaggaatatccttttaccattcgtcgtgcatccaaccagttggttgtgtgctttgacgatatgaaaacccgcgctattccttatgacatgccgatcaccggctatggcactcacaacgtgggaactctgcgcctgtggaaggcggagccgtgggaagaattcgattacgatgccttcaactcccagcgctttaccgacgccatcatcgagcgcgagcgcgtttccgatatctgccgcgtgctctaccctaatgacaccacctacgagggcaagaagctgcgcgttcgccagcagtacttcttcacctctgcttccctgcaggccatgattcagggccacctggcgcaccacaaggacctcagcaactttgccgagttccactccgtgcagctcaatgacactcacccagtgttggctatccctgagcttatgcgtctgctcatggacgagcatgacatgggctgggaagaatcctgggcaatcgtgtccaagaccttcgcatacaccaaccacaccgtgctcaccgaagctcttgagcagtgggatcagcagatcttccaacagctgttctggcgcgtgtgggaaatcatcacagagatcgatcgccgcttccgtttggagcgcgcagccgatggactggatgaagagaccatcgaccgcatggctccaatccagcacggcactgttcatatggcatggattgcctgttacgcggcatattccatcaatggcgtggcagcgctgcacaccgagatcatcaaggccgagaccttggctgactggtacgcactgtggccagagaagttcaacaacaagactaacggtgttaccccacgccgttggctgcgcatgatcaacccaggtctgtctgacctgctcactcgactttccggttccgatgattgggtaaccgatctggatgagctgaagaagctgcgctcctatgccgacgataagtccgtgcttgaagaactccgcgctatcaaggctgctaataagcaagacttcgccgagtggatcctcgagcgccagggcattgagattgatccagaatccatctttgacgtgcagattaagcgcctccacgagtacaagcgccagctcatgaacgcgctctacgtactagacctttacttccgtattaaggaagatggcctcaccgacatcccagcacgcactgtcatctttggcgccaaggccgcgccgggttatgtccgcgccaaggcgattatcaagctcatcaactctattgctgacttggtaaacaacgatcctgaggtctccccgctgctcaaggtggtctttgtagagaactacaacgtctcccctgctgagcacatcttgcctgcgtctgatgtctccgaacagatttccaccgccggcaaggaagccagcggtacctccaacatgaagttcatgatgaacggcgccctcaccctgggcaccatggacggcgccaacgtagagatcgtggattctgtgggcgaggaaaacgcctatatcttcggtgctcgcgtggaagaattgccagccctgcgcgaaagctacgagccatatgagctctatgagaccgtccctggcctcaagcgcgcattggacgccctggataacggcaccctcaacgacaacaacagtggtttgttctacgacctcaagcattccttgatccacggttatggaaaagacgccagcgacacctactacgtgcttggcgatttcgcagattaccgcgagacccgcgaccgtatggccgccgactacgcctccgatcccctgggttgggcacgcatggcctggatcaacatttgcgagtccggccgtttctcctccgaccgcaccatccgcgattatgccaccgagatctggaagctcgagccaactcctgctgttaagaag

SEQ ID NO: 1445 - DNA, 183 bp, Corynebacterium glutamicum
ttgccagggccacaaggcagagccttccaagggcttcctttccaagcttttcggctaagcatgccggatatggccaatccttccgggggttggccgttttttgcttttcgacgcaaacccaccgccgcaggcaagagtttttcgtcgaaaagcgcagtgtttttagcaatcggaagcaattat

SEQ ID NO: 1446 - DNA, 156 bp, Corynebacterium glutamicum
atgtgtcgcgcagttacttgtaagaagtgcggaaagaccacctgggcaggctgcggccagcacgttgatcaggttatgaaaaatgttccgagctcccagcgttgccagggccacaaggcagagccttccaagggcttcctttccaagcttttcggc

SEQ ID NO: 1447 - DNA, 1407 bp, Corynebacterium glutamicum
atgctttttgaacgcatctacgaagaaggcctcgcccaagccagctatttcattggctgccaacgcgaaggcaaagcgattgttgttgatgctcgccgagatatccagacctatctggaccttgcagcaaaaaacaacatggtcattagcgccgtaaccgaaacccatattcatgccgattatctctccggtactcgcgaacttgcagctgccaccggcgccgagattttcctctctggcgaaggcggagctgattggcaatatggctttacaggcaccaccttgatgcacaattccaccatcaagctgggaaatatcaccatcacagccaagcacactcccggacacactccagagcacctgtcatttttgattactgatggtgcggtctcaaaggatcccggttttatgctcagcggtgacttcgtcttcgtaggtgacgtgggacgtccagatttacttgatgaggcagctggcggcgtggacacccgcttcgccggagcacagcaactcttccatagcctaaaagagcagttccttgcactccccgaccacattcaggtttatccaggtcatggtgctggcagcccttgtggcaaggcattgggcgcgatccctagcaccaccgtgggatatgaaaaggctaatgcgtggtgggctccatatctgcgcagtgatgatgaagccggctttgtggaagagcttctcgacggccagccagatgcccacgcttactttgctcgcatgaaaaagcagaacaagcagggacctgcagtacttagtacattatccccgcttgtgaagctagaagccgaggaagtcgtcgaaaagcttggttctgaagcagtatttgtggatacccgcgagcaaaaccaagtccatctcggaaccgttgttggggcattgaatattccgcgcggcgccaaggcgtccaattttgcggcgtgggttattgatcctcaaaaggatgctcaggaccttattgttttggctccggacgccaataccgctgcggatttccgcgacgctttgctgcgggttggcatcgacactgtgcgttatttcaccaacagtatcgatggattgcctacctttgtgccagaactcatctcccccgctgagctagctgagaccaactatgacgcactgattgatatccgtgcaaagtccgaatttgccgctggcagcattcccggcgcgcagcagctttctggaggttcggccatgtggcgcctcaatgagctgcctgcgggtggcactttggtaaccttctgccaatcaggagcgcgaaataccgtggtagccaatgctttgcgacgcgccggattcaccgttatcgagctcgagggcagctacgccgcgtgggaaaaatcagctgccaatcctaaaaacttgcagactgccgtc

SEQ ID NO: 1448 - DNA, 750 bp, Corynebacterium glutamicum
gtgattctagcccttcttggcggcctaataataggcctacttcttggcatgctcggtggtggcggtgccatccttgccattccgctgcttatttatggattttcttttagcgccacgcaagctactgcagcttcattaatcatcatcggacttggcgccctcattggactgatcagccaatacgctgccgggcacgtccgccttaaagagggtctaagctttggccttttagggttggtcggctcatttgtgggcagtcaccttgctagcaatatccccgattccctactcctgagcggctttgccatcctcacgctcgtggtggcgttgaccatgatttctaaattaagaagcacccgagaatacataaccagaaggccaagcatccttgccattgctcttagtgccaccggcgtgggatttttgacgggattttttggtgtgggtggcggttttgccattgtgccagccttgatttttgcgctcggtttttccatgcggcaggctagcgccacttccctagtggtgatcgccgttaacagcgctattgccatgggatttagatattccgatttggcaagtattgactggtcagtgatctcgccaattatcatcaccaccgtattgggcgcttttagtggcgtaaaactagccaaaaaggtcaaagcatcatcactgcaactaggttttgctggcttcttgatcttcatttcgatctatatgggatttcagaatttcccggaccttttt

SEQ ID NO: 1449 - DNA, 477 bp, Corynebacterium glutamicum
atgttgaaattccagtctagagccttaatcctcacagtttctatgcttgcaactttaagtggatgcagccaggaatccgatcccattcagtcaccaataacaatcaccacaaccgccacgaccatgctcaccacaacggtcactacatccgccccgaacccagttcccccagatgcacagctgggcgattctgtagacctggaagtttcgcgagccacagtatgcatttatggcgatggatacggcaccactacctggctcgcagggacggataccagctgcgagtttgtcggcgcggtgcatcaaaaattagtaaccggagtaaatgccaccactgaagatatccgcgactttttaccgatggacattaatgtcaccagccccgtcactggccaggaatatcagatgagctgcactaatgagagtgcgaaagtaagtgcatgccgtagcaacactaacgccagcgtttatttttac

SEQ ID NO: 1450 - DNA, 564 bp, Corynebacterium glutamicum
gtgaatacactttccccgcgccttcgcaaagctatgaatactgccgcgtgggcacaccgccaccacgtacgcaaaggcggtggaattccgtatgtcagccatctttattcagtgatgtacttgctggccagcgtcactaatgatgaagatgtgctcatcgccgggctgctccacgacaccctcgaagacgtacccgaggaatacaattctgcccaacttgaagctgattttggtccgcgggtgcgcgagttggtggaagagctcaccaaacagcccttaaaaagctggaaagcgcgtgccgacgcttacctcctgcacctcagcgcaggtgccagcttagaggctgtcttaatctccaccgcagataaactgcataatctcatgtccatcttggatgaccttgaaatacacggtgaagatttatggcaacgctttaacgctggcaaagagcagcaaatctggtggtatagcgaggtttatcagatatctctccagcgcttagggttcaatgagttgaataaacaactggggttgtgcgtcgaaaagctcttaaagcaaagcgcc

SEQ ID NO: 1451 - DNA, 705 bp, Corynebacterium glutamicum
atgggacagcaagaaattatcgaggactccaccgagagcggtattaaggttttagaccgcactgtattaatcctcaatgtcatcgcagaacagcctcgatcgttggcagagctcgcagctgccaccgatctgcccagggctacagcccaccgcctcgcctcagcgcttgaggtacacggcatgttggcacgctcccgcgataatagatggaccatcggcgcacggcttgcctcattgggtgcacgcggcgctgacaccctcatcgatacggccgtaccaattatggccgaccttatggagcgcaccggcgaatccgttcagctttatcgcctcaccggcaccacccgcacgtgtgtggccagccaagagcccagctccgggctaaaaaacgtggttcccgtgggcactcgcatgcctttaaatgcagggtcagcagcgcgcgtttttgccgcctacctccccatcccctctgccagcgtcttttcccgcgaggagcttgaccaggtgcgcgccagcggcttagcggagtccgtgggcgagcgtgagctcggccttgctagcctctcctcccctgtttttgattccaacggatccatgatcgcggcactgtccatctccggcgtggccgagcgcctcaagccccaccccgccgccatgtggggcaccgagcttatcgacgccgccgagcgcctaggcgctttgctt

SEQ ID NO: 1452 - DNA, 1443 bp, Corynebacterium glutamicum
atgaccagccccgtggagaacagcacctcaactgagaagctgaccctggcagagaaggtgtggcgcgaccatgtcgtgtccaagggagaaaacggcgagcccgacctcctctacatcgacctgcagctgctgcatgaagtgacctcaccacaggcatttgacggcctgcgcatgaccggccgtaaactgcgccacccagaactgcacctggccaccgaagaccacaacgtgccaaccgaaggcatcaagactggctcactgctggaaatcaacgacaagatttcccgcctgcaggtatctactctgcgcgacaactgtgaagaattcggcgtgcgcctgcacccaatgggtgatgtccgacagggcatcgtgcacaccgtcggcccacagctcggcgcaacccagccaggcatgaccattgtgtgcggtgactcccacacctccacccacggtgcttttggctccatggcattcggcatcggtacctcagaggttgagcacgtcatggctactcaaaccctgccactgaagcctttcaagaccatggccattgaagttactggtgaactgcagccaggtgtttcctccaaggacctgattctggcgattatcgccaagatcggcaccggcggcggacagggctacgttctggaataccgcggcgaagcaatccgtaagatgtccatggatgcacgcatgaccatgtgcaacatgtccatcgaagctggcgcacgtgccggcatgatcgccccagaccaaaccaccttcgactacgttgaaggccgcgaaatggcaccaaagggcgccgactgggacgaagcagttgcttactggaagaccctgccaaccgacgaaggcgcaacctttgacaaggtcgtagaaatcgatggctccgcactgaccccattcatcacctggggcaccaacccaggccagggcctgccactgggcgaatccgtaccaagcccagaagacttcaccaacgacaacgacaaggcagcagccgaaaaggcactgcagtacatggacctggtaccaggaaccccactgcgcgacatcaagatcgacaccgtcttcctgggatcctgcaccaacgcccgcatcgaagacctgcagatcgccgctgacatcctcaagggccacaaaatcgccgacggcatgcgcatgatggtcgtgccttcctccacctggatcaagcaagaggcagaagcgctcggactggacaaaatcttcaccgacgctggcgctgaatggcgtaccgcaggctgctccatgtgcctgggcatgaacccagaccaactgaagccaggcgagcgctccgcatccacctccaaccgaaacttcgaaggacgccaaggaccaggaggccgcacccacctggtatccccagcagtcgcagccgccaccgcaatccgcggcaccctgtcctcacctgcagatatc

SEQ ID NO: 1453 - DNA, 591 bp, Corynebacterium glutamicum
atggaaaaatttaccacctacaccggcgttggcgttccactgcagcgatccaacgtggacaccgaccagatcatcccagccgtctacctcaagcgcgtcacccggaccggcttcgaagacggactgttttccaactggcgccaaaacgaccccaactttgtcctcaacaccgacacctacaagaacggctccgttctcgtagcaggccctgactttggcaccggctcctcccgcgagcacgccgtctgggcactcatggactacggcttccgcgctgtcttctcctcacgattcgccgacatcttccgcggcaactccggaaaagcgggcatgctcaccggcatcatggaacagtccgacatcgaacttctgtggaagctcatggaacaaaccccaggcctcgaactgaccgtgaacctggaaaagcagatcgtcaccgcaggcgacgtagtgatcagcttcgaagttgacccctacatccgctggcgtttgatggaaggcctcgacgacgctggcctgaccctgcgcaagctcgatgaaattgaagactacgaggctaagcgccctgcgtttaagccacgcactaacgct

SEQ ID NO: 1454 - DNA, 318 bp, Corynebacterium glutamicum
ttggcgagtgggtatgggcttgggtttgagcctgttaggggcttagaacccattctggaggggcacttttcatgcgttctaggtaatggtttcggcttgctcggggcggagcgtcatattaaaccaagggtcttggcttaccggggtcccttggtctggatatgcacttcccaggcctcaaaacgtacgaaaaagaccaagaccttaagggaatccagggcctcttggtctattccagacatgcccactccactcgcccaccaagacgcacaaaagcaccccgcgacggaagatcacggggtgctttcgctatcagac

SEQ ID NO: 1455 - DNA, 954 bp, Corynebacterium glutamicum
atgctgatcaacggtcgcctgcaacagatcccggcgcgtcccactgaggaattcacccgcccaactcttgcagcaggtgcagtactgtggcgcggcgacatcaccaacccggacagcatcgaggtcgctgtcatccaccgcccgcactatgatgactggtccctggccaagggcaaagtcgatcccggcgagtctattccgacaaccgcggcccgtgaaatccttgaagaaactggctacgacatccgtctgggcaagctgatcggcaaggttacttaccctgtgctcgaccgaaccaaagtggtctactactggactgcccaggttcttggtggagagtttgtccccaacgatgaagttgatgaaatccgttggctgtctgttgatgaagcatgcgagttgctcagctaccaagtagataccgaagttctggccaaggcagcaaagcgtttccgcactccttccaccactcgggtgctgtatgttcgccatgctcatgcacatggtcgccaaacctggggtggcgacgacaataagcgcccattggacaaaaaggggcgtcgacaagcagaaatgctcgtacccatgttgttgcccttcaaacccaccgcaatttactcggcggtgcccgatcgctgccaagccaccgcgctcccccttgccgatgagctcggcctcgacgtgtccgtcaaccgactgttcggcgacgacgcctgggaaaccgatcccgaggcctgcaagaagcgcttcaccgacgtggtcgcgcaaggtggcgtgccgatgatcgttgggcagggcgacatcattccggaaatgatcaaatggttctccgagaacggcaccctccctatcgatgagaagatcaaggcgaaaaagggcagcgtgtgggtgttgagctttcacgacggtgtgttcaccggcgctgattacctggcgagttccctgccggttaaa

SEQ ID NO: 1456 - DNA, 156 bp, Corynebacterium glutamicum
atgaaaaactacttccatctattgttcaccagcgacccgctcattgcacattctggactcggcgtgtggcgacatttttggatgattcctggcaaattctgggcagcagcggcaggtttccaggaggtttccatgcgggtggcttgggacatgggc

SEQ ID NO: 1457 - DNA, 996 bp, Corynebacterium glutamicum
gtggtttctgtaagcgtgatgggtgcaggttcctggggaaccacgttggccaaggtcttctctgatgctggcaacgctgtgacgttgtgggcgaggcgggaagagttggcaagcaccatccgtgacagccatgaaaaccgtgattaccttccggggattacgttgccggagtcgctgcaggtcacatcatcggcaacggaggctttagagggcgcagccattgtggtgttggcgattccttcgcaggcgttgcgtggcaatttggcggagtggaaagagacgatcccgcaggatgcgaccttggtgtccttggctaaaggtattgaaaagggcacgcacctgcggatgagtgaagtgatcgcggaggtgacggaagcggatccttcacgcatcgcggtgttgtcggggccaaaccttgctcgtgagatcgcggaggggcagcctgcagctacggtgattgcttgccctgatgaaaaccgagcgaaacttgtgcaggctgcagtggctgcgccgtatttccgcccgtacaccaacactgatgtggtgggcactgaaatcggtggtgcgtgtaagaacgtcatcgcgctggcctgtggtatttcccatggttacggcctgggtgagaacaccaatgcatcgttgattactcgtggccttgcagagatcgcacgcctcggtgccacattgggtgcggatgcgaagactttttctggccttgcgggaatgggcgacttggtggctacgtgttcatcaccgctgtcgcgtaaccgcagcttcggtgagcgtttgggtcagggtgaatccctagagaaggctcgcgaggcaaccaatggtcaggttgcggagggtgttatttcctcgcagtcgatttttgatcttgccaccaagcttggtgtggagatgccgatcacccaggctgtctacggtgtgtgccaccgagatatgaaagtaactgacatgattgtggctctcatgggcaggtctaagaaggctgag

SEQ ID NO: 1458 - DNA, 1080 bp, Corynebacterium glutamicum
gtgagcaactctaattctggaaaagtccgcgtcgcagtcgtttatggtggtcgcagttctgagcactccgtctcctgcgtctccgctggtgctatcatggcccatctcgatcctgagaagtacgatgtgattcccgtcggcattactgtcgacggcgcgtgggttgttggtgaaaccgatccacagaagctaactctcatcgatcgcaccatgcctgaggtggagcatcatgaagaggttcgcccaagcctggatcccgcacaccgtggagagttccacttttccgatggcagcttgtatgccaccgctgatgtgattttccctgtgctgcatggtcgttttggtgaagacggcactgtgcagggtctgtttgcactgtctgatattccggtcgttggcccaggtgtgctggcctctgctgcgggaatggacaaggaatacactaagaagctcatggcagcggaagggctgcccgttggccgtgaggtgattctacgtgatcgtaccgagctgaccgaggcagaaaagaacctgctgggcctgcctgtatttgtgaagcctgcgcgtggtggctcatcgattggtatctctcgtgttactgcgtgggaggattttaataaggctgtggggcttgctcgtgcccatgatgagaaggtcattgtggaatcagagatcgttggctctgaggtggagtgtggcgtgctgcagtatccagacggtcgtatcgtggcgtctgttcctgcgttgctgtctggcaccgaatcaggcgctggtggattctatgactttgataccaagtacttggacaacgttgttactgcagagatcccagcaccgcttgatgagaagaccacggaactgatccagtctttggctgtggaatctttccaggctcttgcgtgtgaaggccttgctcgcgtggacttctttgttaccgccaatggtcctgtgctcaatgagatcaacaccatgccaggatttacccccatttccatgtacccacagatgttcactgcatcaggcgtggcttatgaggaattgttggatgtgttggtgcagcaggcattgcaccgcgacaac

SEQ ID NO: 1459 - DNA, 978 bp, Corynebacterium glutamicum
atgagtgccgtgaacagtgctggtcgcccagccaacgggggaattaacaaaacccccatgattattgccctagtgttatctattgtgttggttttggcggtgctgttcggcgcccgagtcctccttggccccgccggccagcaacagatagccatgagtgggcttcccgccccagacgcagaatctgctgagtgcgccgcattactcgaggatctccccggcgaggccttcgggcacacccgtgcagaaatcatggatcctgttccaccgggcgctgccgcctggtccacctcagacctcgagcgtgtgacgctgcgttgtggcgtcgatatgccattccagtacaccgcgctcgccaacaccgtcgacgtcgacggcaccacctggctacctgtctccgacatgacccccggctcctccctggagacctggtactccgtcaaccgcttccccgtcgtcgccatcaccgccgatgacatcagcaccgacagcgccgacaaccccgtcgcccccttcagcagcgccgtcgacaagctagaaaagcgcgacggccagcccttcgacgccccacttaccggcttgagctcagccggcaccacatgcacttcgcttttcgacgccctcccccgccaactcgaagtcggcggcgacgacggcacaacgtacgaacgcatcgaggaggaccgcatgcaggccgccggatactccgacgacgcagtcgcgtgggacacgccgggattagaacccattgtgatccgttgcggcgtggagccttctgagaactacgcagccggtgccatgttgcagcagatcgatgacatcccgtggttcgaggacaccattttggcctccggtaccacctcgtctacctggtatgcccttggacgcgagatcgacatcgccgtgtctctgcctcaggctgcttcctcttccctgattactatctccggtttcattgaagacacggttcctgcggaa

SEQ ID NO: 1460 - DNA, 993 bp, Corynebacterium glutamicum
ttgactttggcgcactcactttcattcccggattcgcttcgcgacgggccaaccgttggagacctcggggaatttgaagtgattcgggtaatcacggagcaagctggatcatctctcaacggcgatgacgcagctgtgcttcggcatgcatcacccaattccagggctgttgtcaccaccgacatgttggttgcgggtaggcatttccaattggattggtccaccccggaacaaatagggcagaaggcgattgtgcagaactttgctgatattgaggcgatgggtgcacgtccagtagccgcattgttggcgatttccgcccccacacacacccccgtggagtttgtccgaggcttagcccgtggcatgaatcaacgcttggaggagtactccgcggaacttgttggcggagacatcaccagcggggactccttggttattgctgtaactgcaattggtcaactgggtggatccttgccagagctgacgttgggacgtgcccgaccaggacagaccctggtggcccacggaaagatcggttactccgcagcaggccttgctctactgcagcactttggtccagacaacgttccagagcaccttcgccccttggtggatgcacactgcgcaccagttctcaccccaggccgaggcatggtggcacgcgctgctggagcgaccgccatgactgataactcggacggactgattgtggatcttaaccaaatggccatgaagtctggtgtgcgcatcgatgtggattcctctagcatcagccccgatgaactccttagcgaagccgcttccgtactcggaacagacgcctggcgatggatcttaagcggcggggaagaccacaccctgctctctacgacgtttggcgatgccccctctggattccgcaccatcggccaagtcaccaaaacacgccacgaagacctcgtcaccgtagataagaaaacccccgcattttccgatggatggagaagcttc

SEQ ID NO: 1461 - DNA, 762 bp, Corynebacterium glutamicum
atggagaagcttctaatgaccaacaccctatggaattcagtagacgaactccccatccacgactcctggaaaccagtactcaaaccagtcgaagacgccatccgaaaactcggtgtattcctcgcggaagaagaattccttccaccagtagatgacgtattcagagcatttagctacccctttgacgcagtaaaagtactgatcatgggacaagacccatatcccaccccaggacatgccatgggactgagcttttccacccaaccagacgtacgaccactgccacggagcctgaacaatatcttcaaagagctggtgagtgatgtcggctctttaggcgattcggcgtcagagcagggggccttggacttaggtattaacgcgccgggctctgtcgctggcacacaagttgccttgcccgcggacggcgacctccgtgcatggagcaaccaaggcgtcgcattgttcaaccgcgtactcaccgtccacccaggccaggccggaagccacaagggtaaaggctgggaagcggtaaccgaacaggcgattaaagccttggcggagcgggatcaacccttggtggcaatcctgtggggtaaacaagcccaagaggtacagaaattccttggagatacgccgtgtatctgctcagtgcacccatcaccgctgtcggcgtcgagaggcttttttggctctaagccttttagtcgtgcgaacgaaatcttaagcagcctcggtgccaccgagatcgattggtcgctg

SEQ ID NO: 1462 - DNA, 1581 bp, Corynebacterium glutamicum
atggacgctgccggagttcttgagtgggccaggaccgctgtcgagcagctttctgaacgtcgtgcagagatcaatgcactgaatgtctttcctgttccagatgcagacactggatcaaacatgacctacaccatgacagctgcgttggatgaagcgctgaaactgggggagttgggtgatgtcgcaaggattactgaggctttggctgttggttctgtgcgtggagcccgaggaaattctggagtagtccttagtcaggtccttcgcgctattgctcaggcagctgctgacggggttattgatggccacacaatccaagaagcgctatccattgctcgctccctagttgatcgcgcaattacagatcctgtggagggcactgttgtcactgtgttgcgttctgcagctattgaagtagaacacctcgtggaggcaggacacgccgcgttgcccgatgtcgtcaacgcagcagtgaaagcagcacgcaccgcgcttgccaggacgccatcccaactagctgttctccgagaagccggagttgttgatgccgggggacagggcctagttattctcctggagtccctggccgaacaaatcaacggaaacccacctcaccatccatcgcaccacagtgaaccagccgaagaaccctccttccacggcaaaaccggcgacctagaagtgatgttttacattgcatgcgactccgcgcaaacactcgatgctctccacaacgaacttgaaacactaggcgacagcctgctcatcgcccgagaaaccaatacccgcggcaccgttcacatccattcgcgccgggcaggcgaggtcatccaaaaagcatttgccgcaggagacgtcagcgaactccgccttgaaatcctccccgatacttccggcagcttcacggaagaaccacgccgggtcctcatggctgtcgcacctgacggcctggtggcggagctgtaccgcagcgctggagtgaaggtggtggcccgcaacatcgcgcaatccaagtctgatgatgtggtggcaaagatcgtttccatcgcgcgcaagtctggtgccgatgaggtgatcttgctgcccaacggtcttttgaccaagcgtgagctggtttccattgagcgttccagccatgcttttgagcaaagtgtggttattttgcctactgccacgttggttgcaggtcttgcagcggtgtccgttcatgagccagcgcaacccctggcggtggattcctatgccatggcagaggccgccggttccatgcgcacggccacgatccgcgccgccaccagcgccgcgctcacccaggccggcgcatgctccaagggtgatctattaagcttcatcggcccggagatagctctggtctccgaggagctcaacgacgcgctatcgcgcaccgctttaaggcttctcgacggctccagcgagcaaattacccttctcatagcgcaagaccgtcagtccgccttcgacgaagatgttttccgccgtggcctgggaactcacacggatgtggagatcacggtctatcctgctactggaatggagaatctggtagagatcggagtggag

SEQ ID NO: 1463 - DNA, 2121 bp, Corynebacterium glutamicum
atgttgggttggcatgacgagcgtttgctcaaagacatccttccggcaaaggaagccacagcgattaaaaaggcgctgggctacaccactgcggaagagttgctccgccaccatgtgcgcaaatactcccaccacggctctggcgtgggaattggtgatgccactgagggcgatcttgttaccatcgtgggtcaggtcgcctttgccaagcagtcctatacccagtccggcaagatgctgtacaaggttacagtcttgactgagacggaacgcatcggcatttccttcttcggagccaagcacattccgcgtcttctcccagaaggcactcgtgcgctttttaccggcaaggtgaagttttttcgcaacgaacctcagctatctcatccagagttcattgtgatcccagatcctggatcaggccgccgactcaccgccactggcggtatgaaatctctggctgcctacggcgatgtggaagaagtggcacttcgtttggtggatcgcgaatacatcccgatctatgccggcaccgccaccatgactacctggcggatcatggctgcagtgcaacgggtactggaaaccatgccggtgatcaaagaaccactgagcgtggtgcccgaaggcatgcccagtttcgacgaggccatccgcggcattcacgatccaggccatgaatctcccagcacgtttatcaaccgtctgaaatacaacgaagcactatcgctggccacggtgatggcgatccggcgtgccgataccaagaaccgcaaagcaccacccatgccgcgcgcactcaaagggcatcagcacatgctcatcgatgcactcaactttcagctcacagtgggacagaagcaagtgatccgtgagatcagcgcggacattgaacaacgcgttcccatgtctcgtctgctccaaggtgaggttggttcgggtaaaaccatcgtgtcgttgatcgcgatgctgcaggcaattgattccggtaggcagtgcgccatgctcgccccgacggaagtgttggccacccagcatgcccgcagcctgagcaaaactctcgacgacgcaggccttgatatcaatgttgtgctcttgactggctcgatgcccacgggagccaagaaggaggctctgctggaaatcatctccggtgacgcagacattgtggtcggcacgcatgcgctgatccaggacaccgtggagttcttcgaccttggcctcgtggtggtggatgagcagcaccgtttcggcgtggagcaacgcgatcaactgcggaccaagggcagggaaggcctgaccccgcacctattggttatgactgcgaccccaattccgcgcaccatcgccatgacggtgttcggcgacttggcggtgtccacgttgcgtgaacttccaggcgggcgccggccgattcaaacctcggtgatacccgatcacaaacctggctgggttaaacgcggttgggaacgcatcggtgaggaagtcctcgccggacgccaagcctatgtggtgtgtccgcgcattgaaggcgaaggcggcgtgctggaaatccacgcctatctttccgaacaggtatatccaggattgaatgttggaatgctgcacggtcgcatggacacggatctcaaagattcggtcatgcaggaattcgcccaaggtgagatcgatattttggtcgccaccacggtcattgaggtcggtattgacgttgccaacgccaccgtcatgctcatccgcgaggcggaacgcttcggcgtttcccagatccaccagctgcgcggccgtgttggccgtgggcagcacgattccctctgcctgctgcacaccaccttcgacgaggactccccacaaggccaacgcctcgccgcaatttccaccacaaccgacggttttcaactctctgaacttgatttgcaggtacgccaagaaggcgacgtgttgggcacccgccagtccggcagcgacaccaaactccgtcacctctcgtttatcagcgaccaaaaaatcatcgagcgtgcgcttatcgacgccaccgagctggttgccgccagccgttccagggcgcttgagctggtcagcgacatcgcaatgatcaaccaggaatacctggaaaagagc

SEQ ID NO: 1464 - DNA, 324 bp, Corynebacterium glutamicum
atgtctgcgtcaccggagatgatttccagcagagcctccttcttggctcccgtgggcatcgagccagtcaagagcacaacattgatatcaaggcctgcgtcgtcgagagttttgctcaggctgcgggcatgctgggtggccaacacttccgtcggggcgagcatggcgcactgcctaccggaatcaattgcctgcagcatcgcgatcaacgacacgatggttttacccgaaccaacctcaccttggagcagacgagacatgggaacgcgttgttcaatgtccgcgctgatctcacggatcacttgcttctgtcccactgtgagc

SEQ ID NO: 1465 - DNA, 213 bp, Corynebacterium glutamicum
atgaagatctacgcaccttttgctggaatcgtccactattttgtcgatgaaggcgatcccgtggaaaccggcatgcaactgggaacggtagaaaccatcaaactcgaggcaccaatcatggcaccgggacctggcatcgtagctaaggtttcttttgatgatttctccgacgtcaccggcggcgatgaactcctcgaattggaggcaaagaac

SEQ ID NO: 1466 - DNA, 582 bp, Corynebacterium glutamicum
atgggtcaaacccgcatcatttccggcgacgcacgcggccgcaagatcgaagtaccaccagcaggtacccgccccacctctgaccgcgcacgcgaaggtctcttctcctcactgcaggtccgtttcggatttgagggccagcgcgtcctcgacatttttgccggctccggcgcactcggattggaagctgcctccaggggtgccgatgaggtagttctggtcgagtcgaatcctaaggccgtagaggtaattcgacggaatgtggacgtcgtaaagcatcctcgcgtaaccgtcgcagagatgaaagcatccacctaccttgcgtccgcacccgataagtttttcacgatggtgctcgccgacccgccctatgagcttgccgacgacgccgtcaccgagatgctcaccgcattgacgcctaagcttctcgacggcgccgccgtggtcgtggaacgccacgtagactcgccagaaaccgcatggcccgcctggctggtacccaccacccagaaacttaaaaaacgaacctacggcatagcacgcatggacatggccgttttcgacgaatctctgcttcaggag

SEQ ID NO: 1467 - DNA, 480 bp, Corynebacterium glutamicum
atgaaagctgtttgcccaggatcattcgaccccatcaccctcggccacctcgacatcgtgacccgcgccgccgcgcaatttagcgaagtcaccatcttggtcaccgccaaccccaacaaaaactcaggactgttcaccgtcgcagaacgcatggatctcatccgcgaatccaccgcacacctcgacaacgtaaaagtagacacctgggcctcactgctcgtggattacaccaccgaacatggcatcggcgccctagtcaaaggcctgcgaagctccctcgactacgaatacgagctccccatggcacagatgaacaggcgactcacgggcgtagacaccttcttcctcctcaccgacgagaaatacggctacgtcagctccacactgtgcaaagaagttgcccgcttcggtggcgatgtctccggcctcctacctgaggtagtggcaaaagccgtgacagaaaaatacagcaaccagcac

SEQ ID NO: 1468 - DNA, 1080 bp, Corynebacterium glutamicum
ttgttcgggggttccggcttcaacgacaactccatcggccatgaacacgacctggtcggcgacttcgtgggcgaagcccatttcgtgggtgacaacaagcatggtcatgccgtcgtcggcgagctgtttcatcactcgcaggacttcaccgacgagttcagggtccaaagcgctggtgggttcgtcgaaaagcatgagctttggctccatggcgacggcgcgggcaattgcaacgcgctgctgctgaccacccgacagttggacggggtaggcgtccgccttgtgggcgaggccgacctgctcaagcagctccatggcacgtgcgcgggccttgctttcgggctgcttcttcacgtggatgggagcttcgatgatgttctcgatcaccgtgcggtgggggaagaggttgaagttctggaacaccatgccgatatcggagcgctgcttggcggcgtccttctcagagatttcgtacagcacgccatcgcgctcgcggtagccaatgagatcgccatcgacatacaagcgacccgcgttgaccttttccaggtggttaacgcagcgcagcatggtggatttaccggaaccagaaggaccgatcaagcaggtgacggtacctttaggaacctgcaagtcaatgcccttgagcacttccaagcgtccgtagtttttgcagacctgctgagcatcaatcatcagttgcgacatttgctagttctccttggaagtttcaggaacaacggtgacattgcccgggattgcgccttcagcatcagccaacgcagcgagctgacgtgcggtcagggtgcgggtgctgcccttttcgaagtgcttctccaggtagtactgaccaaccataagaatagaggtgatgaccaagtaccagctcgcagcaaccagaagcattggaactggctcgaagagggagtacgcaatatccatgctgcggccgtacagctcgagagaataaggaatcgcaacaaccagagaggtggtcttgagcatggagatcagttcattgccggttggcggaatgatgatgcgcatggcctgcggcaagatggtgcgacgcatggtcat

SEQ ID NO: 1469 - DNA, 204 bp, Corynebacterium glutamicum
atgaacacgacctggtcggcgacttcgtgggcgaagcccatttcgtgggtgacaacaagcatggtcatgccgtcgtcggcgagctgtttcatcactcgcaggacttcaccgacgagttcagggtccaaagcgctggtgggttcgtcgaaaagcatgagctttggctccatggcgacggcgcgggcaattgcaacgcgctgctgc

SEQ ID NO: 1470 - DNA, 750 bp, Corynebacterium glutamicum
atgattgatgctcagcaggtctgcaaaaactacggacgcttggaagtgctcaagggcattgacttgcaggttcctaaaggtaccgtcacctgcttgatcggtccttctggttccggtaaatccaccatgctgcgctgcgttaaccacctggaaaaggtcaacgcgggtcgcttgtatgtcgatggcgatctcattggctaccgcgagcgcgatggcgtgctgtacgaaatctctgagaaggacgccgccaagcagcgctccgatatcggcatggtgttccagaacttcaacctcttcccccaccgcacggtgatcgagaacatcatcgaagctcccatccacgtgaagaagcagcccgaaagcaaggcccgcgcacgtgccatggagctgcttgagcaggtcggcctcgcccacaaggcggacgcctaccccgtccaactgtcgggtggtcagcagcagcgcgttgcaattgcccgcgccgtcgccatggagccaaagctcatgcttttcgacgaacccaccagcgctttggaccctgaactcgtcggtgaagtcctgcgagtgatgaaacagctcgccgacgacggcatgaccatgcttgttgtcacccacgaaatgggcttcgcccacgaagtcgccgaccaggtcgtgttcatggccgatggagttgtcgttgaagccggaacccccgaacaagttctggacaatccaaaggaacagcgcaccaaagacttcctgtcttctctgctc

SEQ ID NO: 1471 - DNA, 843 bp, Corynebacterium glutamicum
gtggcactgctcgcatggtttatcatcagcgcgctcaacaatgaggcctacggttgggatacctaccgctcgtatctttttgacacccgcattgccaccgcggcacttcacaccattgcgctgaccttgctgtccatgatcttgggtgtggttctcggcgcaatcttggccgtcatgcgtatgtccggcaaccctgtcatgcagggcgtagcgtggctgtacctgtggattttccgcggcaccccaatttatgtgcagttggtgttctggggcctgctgggttccttgtaccagtcgatcaacctcggtttcgcagagatcgatctgcaaagcttgctgtctaatatgttcctgctcgcggtgatcggtctgggtctcaacgaggctgcgtacatggcggaaatcgtgcgctcgggcatccaagcggtgcctgagggccagatggaggcgtcgaaagctttgggtatgaactggtcaatgaccatgcgtcgcaccatcttgccgcaggccatgcgcatcatcattccgccaaccggcaatgaactgatctccatgctcaagaccacctctctggttgttgcgattccttattctctcgagctgtacggccgcagcatggatattgcgtactccctcttcgagccagttccaatgcttctggttgctgcgagctggtacttggtcatcacctctattcttatggttggtcagtactacctggagaagcacttcgaaaagggcagcacccgcaccctgaccgcacgtcagctcgctgcgttggctgatgctgaaggcgcaatcccgggcaatgtcaccgttgttcctgaaacttccaaggagaac

SEQ ID NO: 1472 - DNA, 861 bp, Corynebacterium glutamicum
gtggcaacctcattcaccttggcttcttgtgtcaccaatgaggagcagggcaacccagatggctgggagcagatcgttccagatcctgtaccggagattcaggcgatggttcccgaagctctggctcagcgcggtgtgctcaccgccggtgccaacccacctttcccaccgtttgagtttaaagattccgatggtcagattatcggtgtggaaatggacctcgtgcgtgcaatggcgggggtgatgggcttggagttcagccctcaggagcaggatttctccctcatccttccatcggttcaagctggcacccttgatatcggagcctctggcttcactgacaacgaggaacgccgcgagaactttgatttcatcgatttcctcttcgcaggtgtgcagtgggcgcaggcaactgatcgtgaaaccccaatcgatccggaaaacgcctgtggtctcaccgttgctgtacagcgcacaaccgtggcagagaccgacgatgtccgtcctcgctcagctcaatgtgaagccgaaggcaaagagccgatcaccattttgtcttatgaaaccgcagatactgcagctaccgcattgatcctgggacgcgcagacgcacttgctgcggactcccctgtttcagcttgggctgcagagcgctccgaaggccgcatcgaagttgtgggcgatatgtacttggctgcgccatttggtttcgcattcccgttggaatctgacctcaccccagcagcagctgcggcgttccaacacttgattgacaccggcgattaccagcgcatcatggcgcaatggggcattgaagaaggccttcttgatgaggccctgatcaacgaacagccactcaac

SEQ ID NO: 1473 - DNA, 807 bp, Corynebacterium glutamicum
atgtcgagccaacaaacgatcttcatcattttgctctttgccgcagtgattctcatttccatagtaatgattacagctgccttcaaaacccggaaaaagcgctttgccgcgcgggctgaaggaatggccaaccctacaattcctgcgccaactgtgccgtggcagcgcttcgccggagcacttgcagccttgtacgctaggcctgaatggcacaagacccgcggagcgaaacgagtgtactcagctgaacagacttattttgggtttgtctcagcaatgccactggggatggtgcaaaacatgctgcaaacagactggggtgtgaaaaagtctgagcatgcagttgatcagctttctaaaggagtggaagtgatcgttggggtagccgcaggcaactggcgtaaaaacggagtatcacccgcacaagtggaagaggcaggccagcggttagcagctgaaggattggctcatccacactttgttgtattccaaaagcagcttcaacaggcagatccaaatgcagaatatgatctcgatgtgctcgcatttgatatcgcacgcgtagccaacctccttcgctgggctgcttatacagatctgttgctccctgcagaagcccgttggttccaagaccagctgggaattgcggctgctgtgtcctttgggagctgggaagaatacggagagcgatacgtccgtggactacagaagaacttcaagggcggaaacaagccatatatcgaaggagaacgctggctcaacactgaggctgaaagtccatggaagacccaaaagtggattagcgcc

SEQ ID NO: 1474 - DNA, 978 bp, Corynebacterium glutamicum
atgagcgccaccaaccctgatgccctagacgtgcagcacgtctatcccatcaagacgaaaaagactccacttgcggtgattttcaacatcattagcggtggtttgattggaatggcggagttggtgccaggaatttccggcggaactgtcgctttggttcttggaatttatgagcgcgcactgcacaacggtgatctcctcattgatctgatcaaggtgttgatcaaggaccgctcgaaggttaaggaagctgcggcgaaaatcgactggtggttcctcggcgctatcggcgttggcatggtcgtgatggtcttctcgatgtcatcgattttgcatacagttgttgaggactacccagagatcactcgcggtctgttccttggaatggttgccgtgtctatccttgttccgttgggaatgatggatatgcgggatgccaagaagcgcctcgcaatcgtcatcccgctatttataatctgcgccatgctgggattctttggaacatccttcactagtgcgcctcgcaccgatccttcactgatctttgtcttcatctgtgctgcgatcgctgtgtgtgctcttgttcttcctggtgtttcaggatcattcttcttgctggcggtcggtatgtacgcgccaatcatggaatctctgtccaaccgtgacttgtcggtcatcggcgtgttcttgcttggcgcgctcaccggtgtgatcttgtttgtgaaggttttgtcttatgttctcgagcaccaccgcaccatcacgctgaccatcatggctggtctcatgctgggttcacttcgtgcgctgtggccttggcaggacggtgacgctaatctacttgctcctggcgataacgccgtgatgattttcagcatcatcattcttggtggcgcgattgtcgctgctttgatgtttgctgagcgtgtgtcttccaagaacattgattctgagaccgtggcagaagagcacccgcgc

SEQ ID NO: 1475 - DNA, 408 bp, Corynebacterium glutamicum
gtgagaaaagggcattatgaccgttacaggaatgaaggctggggatatttaaaaaactattgcaaacacaacttcgccaaccacgctatggctgaggccgtagtagataaagcggtgattgattatggctcatcgccaggaaccagctattacaagttcgagaaaacggtgtactttctagattgcagaacttatacattcaataagaactcaggatgtaaagaaatgcacgctccgcaatgggtgactattatttacaatcctcatactttcactggagcaaattcgaacagacccaagggggtaatttcagcatggtgtaactcaaccccacctggtggaatcgaacacgagccggaaatttcccaatgtcctgatcatgtgaatctttataataagcttcgcata

SEQ ID NO: 1476 - DNA, 756 bp, Corynebacterium glutamicum
atgcccttttctcacgacaaatctgaactcggtggggaaaccccctacgggcttgtacatgttaaccctatggctgaagtgcgacctgtaaaagcacaaaccaacgagccccaagcactgcaggttgctgacattcaaccctttcacgctgttattgcggcctcaaaacaattgactctcatcgacgttgtcgatgtctgccttggaacagtgttgcgagcatgggaagcactgagcctgcgatgggtagacgtggtgcttgacgaggagcatccaagaatctttatccgaggcaccattgtctacaacaaagaaaaaggtaaccacagacaagataaaacaaaaacgaccagcagtaggcgtgtcattcagttgccagaaattgcctcagacgtcttacgcaaaagacatgcactctacgccgaacatctcgaaatggtgttcccttccgctagaggcacatatatttatgagtccaatttcaacaaattgttgcgaaaacaccgaaagggtactgcatatgattgggtgaccgtgcacagcatcaggaaaacccttgcatcaattgtctctgagaaccttgattccaaggccgcatcagacgtactcggccatgctgactcacgactcacagaacgggtctacatcgctaaaactgacaaagacgttccgattggtgatgtcgtcaaccaagcgctcaaagaggcacgaaaagtctccaaaaagtctccaaataaagaagctaaagaagaagaa

SEQ ID NO: 1477 - DNA, 744 bp, Corynebacterium glutamicum
atgacagaaccccatcaactgtgcatctacactaaaggccataaaacttccggatttcgctttatcgggccatcgctaagtctagattttctactcatcaacatcatgggaaagtggaatgcattttctagagtgacaaaaagggacggtagttcattacctttcccaggtaatgtatttactaatcagcgcatagtcggagctgttcggcagtgtctttttcaagcgatcgttgctgaaaaatggtcacttttctcgtccaatataagatccttagtagctgatctaccggatgtgctcactgtatctgagttacaggaatggttagagttctttgtgcagcacaccggaattggtgtcaaggttgggcgtgcgctgattgttgatcctgatcaggagtggacgcagctagctggacgttgtgagcttgtgggatattgtgcactgagtcctggttggcccagtcctattagctcggttttcgaaaagacagatcttgaattgtgggagtcagcattagcgacgagttggatgatgctggggccttttatagctgaacgttatacctatcaaatgccggttgaggagttttattggcgtcatgatgcggagttgcggtggtgggagagctttgtcaacggctgttttgacgatttaacaagtttgcagaagcttttgagtctgttactggctaaacactatttatcgagagattacctaatggtgcgcgttttcacaattgat

SEQ ID NO: 1478 - DNA, 432 bp, Corynebacterium glutamicum
atgggatttagcgcgttggagctgtggtcgaccgagctaggcataactgtttcggtcacgcctgagccacagaacagtgattatgaatcaggattagcacaggttgaaggccatgagtggcatgtccggactgcacggaacacgccgtcgaagccgggtgcctttgttgccttttggcagcgaggcgtaggaggacagacccagccgtttagtgacgacgggatgaatgccggtcttcttgtctttgtgaggaacgatgttcggcgcggagtgtttaggttttccgctggtcatcttgcagaattggggattaccgcagcagacggacagccgggcaaacgtggatttcgcgtttacccctcctggtgcgaagggctcaattcgcaggcgagggccacgcagcgagcacaatctagcgcattcgaggagtat

SEQ ID NO: 1479 - DNA, 507 bp, Corynebacterium glutamicum
atgaaatctgggctgtgctcagcgcgttgtttcctgctatataaacctcagatagcccaccggcagaacagacctaagtttactaacgatgtcagcagttcttgcagaaaaacctccagagtcacaacatcgtcgccaccctccactgggggtgagcacgacgtgatctcaatactcctcgaatgcgctagattgtgctcgctgcgtggccctcgcctgcgaattgagcccttcgcaccaggaggggtaaacgcgaaatccacgtttgcccggctgtccgtctgctgcggtaatccccaattctgcaagatgaccagcggaaaacctaaacactccgcgccgaacatcgttcctcacaaagacaagaagaccggcattcatcccgtcgtcactaaacggctgggtctgtcctcctacgcctcgctgccaaaaggcaacaaaggcacccggcttcgacggcgtgttccgtgcagtccggacatgccactcatggccttcaacctgtgc

SEQ ID NO: 1480 - DNA, 864 bp, Corynebacterium glutamicum
atgaacaaggctgatgaaatattcctttgcgaaggcgatatttttgctcccttgattgcgggtttaagtagcgttaacagcgcgatccgctctgccgcagttcatcatgcgtttagatctatggatcgcgctgcagcaacgggtacaacttatggagcgagtatcgttcagtcactgtgtgacattgttgttacgcatatgtatgtcgaatcagattctcaagtttcaattgattctggggttgtaagtgcattgacgattgacgggaaagaagtctctctcgatctccccaataaggaacttgaatcattagggttagatgaatactcaacctcgcctagcggtgcttccattgcagttacgaatgaaggagggggagctttccgatctctaattcatattcctaacctggaatcaaatggtgagttcgaattttcattttctaatgatatgactcttagttccttgcctgatggcggagtcacagttcgagataataagggggatatcttaggcacccttgatgcaccttgggctatagatgcgacaggggcctcggttaaaacatggtatgaaattcgtcaaagcacgatagttcaacatgtcgcaccaacttcttcaacgcaatttcccgtcgtagcagatcccttctggatcccattcttaggtatcatgggtggccatctcacgcgtcatgcgttaacccagatggctaagcgaaagatcactaaagagctagttgagcacgttataaaaacaggcagaggaagcaagggcaacgggaatactacagtatttaacggcaacgggattcgagttattgtcgataatgtgagcggaaatgtgattactgttacgaaaggc

SEQ ID NO: 1481 - DNA, 219 bp, Corynebacterium glutamicum
atgaattttgagtatgacccagaagctgatgcagcctatctaaccctaacgcagtcgggtgtccttccagaacagcagatatcagcaataactacagaaggaatggaaggagaaatagagatagacgttgatgaaaatggcaaagttattggtattgagttcgtgaatgcttctttgattcttccttcagatttcctcaaaaaatcaaaccggatatca

SEQ ID NO: 1482 - DNA, 192 bp, Corynebacterium glutamicum
ttgggaacctaccaactagctttaagcattcaacacatcaagccccgcactggtttaaaccagcgcagggctttaaacgtgctgcttttggttccccggtcgatccgctgcccggacgccttgcgctggtgtacccgttacaacacggtacgccgacattcctggtgtaaatatctcgcaccagcagtgttt

SEQ ID NO: 1483 - DNA, 855 bp, Corynebacterium glutamicum
ttgaaatatgaatttaataatagattccgaacgaaatcggtgttagcgtctgtgctgaaacaatctaatcgcgtttcaggacacctacatgatcaggagctctttttgttaaacagagtcagtcgtattgcaggcgcttctgcaatcacactatgcatcggcttaaccacaatactaagccctacttccactgcacaaagcctcgaacagatcacccctttacctgaatctgcaatcgacctcaacgccgagattcacgtaaacacaagcgacatttcagctgaacagatccttggtgctcaagatgaaatcacaactatgtacgattctcatgacccctacgagtacttcgataccctcaccgacatcgaacagcgttcaataatagcagcgcttaaacgggatccgagttcactccaacaacgccaagaaacccgtctcgcggcacagtccgacccctacaaaatttacatatcaggcctcgaaatgctttcatgcatcaatctagttgatgttgtatcatgcgggattgcaaaccaagcagcaaccaaagcaaataatgaggctgtcgcacgatacccaggcgattcccttcgcaacggcaaaggcgatgcatttcggcattgctcatggaacgctctgatgacgatacgaatcgggagcaatggagctgaaagaattgcaacaaaccacgagacaatcggggacggtccggccgatgaaaatgcaatggacctattcaataatgcacaaggccgacagatcggagccggattcattaatagtaaggatgaaactagcgcgctcgcgatatgcgcgctgtggacaaatctcggtagactaaaaactctaaaa

SEQ ID NO: 1484 - DNA, 111 bp, Corynebacterium glutamicum
atgaggcagtcattgggatcaattggcaccagtgctgacaacgcgttagcggagtcgttcaacgccgcactcaggcgggaagtcctccaagattctaagacttttgcgaac

SEQ ID NO: 1485 - DNA, 369 bp, Corynebacterium glutamicum
atgcgaaagacttatgtttttctaactcaatttattgtagaaaacggcaatgaaagtaacgcttacagcagatatcgcgaacgagttcagaatctattggctctggacggtgttgatgtaatttcagtttctaaaaaccttcagcaggctgaaaaagcttatggatgggagtcactttccgaccaatatcagatggagcataacggtaaatatccagaaaaccatatactgtgcgatgtttacactgtggtcattctaaatgacatagagaaatttgaagaagctgctgaactcttgatcatggatgaccgagacgtaagcgttgatgctttccccagtcgcgtcgacgctttcgaacaggtgctgttt

SEQ ID NO: 1486 - DNA, 315 bp, Corynebacterium glutamicum
ttggaatgtgacatgaggaaactagcttcgattggtattgcaatagcattatcacttgcaatcacccctactattcaggcgaatgaaataatcgcgcctcaagccatggatcgaattgcagtaaagtgcaatgtccacaaaatttggtcggttccaagcttgaacaactatgacggttgggtcgtagttggtcatgcctattctaaggttgaggctgaaaaaagggccaataccttcgtcccatttggtcatactaaacgccattgccttccggtacctattgaccgctttccgtttgaaggtcttaaccgaagt

SEQ ID NO: 1487 - DNA, 321 bp, Corynebacterium glutamicum
gtgatttttccgacttcacaaccggacgcatggcagaaaaaggctttcgaattcatagaacaacggaacctaagtcgcagcaattttacccggggagcagccgattcgacttcctactggtggtcctatagcactccctcagggcatcatctagctgcaggttcacgacgcttgggatcgggactacctattgactggcagcagtggagatgggacagcccggaacccccttcagctgcaccgtgggatgatgaacgctggattccatatgacggtaatatctccacatcaaactggacgattgaacctttccccttcgac

SEQ ID NO: 1488 - DNA, 375 bp, Corynebacterium glutamicum
atgaaatactttgcactaaaccgagacaacctcatcggacctgcagtagaaatccttgcacctcttggatgggcgtcatacgggctgtggcatcggcgcggcactgagcagattgtggagcttgctcgccgtggtactgacagcgcggagatcgatgcccttgttacacaacagtggaacaataccagtgaatcctttcttcaccatgtagccattccacttcggcgttatggccgaggtattgattacagctttcagcgacttcaatttcaacgaggaaatctcatcgaccaggcagtgaagtgtcatgagaatggtaattacgcagccgctatccttctgacttttcccaaatcgatgggcttacccgagata

SEQ ID NO: 1489 - DNA, 948 bp, Corynebacterium glutamicum
atgtgtagtcgctttttctcttttgtcggagctctgttgatagggctgatgccgttcaccattccggtacatgcgcaagagataacgaaagagcaggatagtggtggaaaatggccgaatactatttctgaataccgcgaattgcagcagaacccggaggcatatcctccttttaatctttcaaatattaatctggaagccactagcactcatcctgtagtggacaatagaatcgccgcgctgtggcagttcgatcctgaggccgaagataccaaaaaggttgttcgttcttgtactgctaatcacatcgagggaaaattttggataaccgcacggcactgcgttacctccgagaaagacttccttggatacctggagcaatccgatggtgaagtcgcaggtgttgaaaatacctacacaatttcagagcaccatgatttagctttaatcaaggtggggagaggtatttctgctcaaacttttgatctccccgaagaaaagatcgctataggaaaagttctgacgctcattgggtacggcggtagcaacgatttttcttcaattgcgagagttgagtcagtagcgcacttagataaattcaatgtaggtttcagtacctattatttggatgtactggaaactgtttctttaactgattctagaagctgtaacggtgattccggaggagcagtctttgcagggaatacgattcatgcagtacatacagccggagcgatcaattttgactgctcaccgggggaaggtaaaaaaatgtggcattctgctatttcgccccacactgcatggatacatcaaattatgagttcggaaaatagtacttctgtagaagaagaacaacgagcgttcgagggatttcgatctcgataccgaatcgctgaggatcaaccttcggcaactttttcgagttctttatcccctctcagttcc

SEQ ID NO: 1490 - DNA, 306 bp, Corynebacterium glutamicum
atgggaattgtaatcatgctggcagtagcggtggttctcttttttggggtccagttactagcgcggggcaacaagcagactcttaatgtgaaagcgtacacagctcttgcagtgacaacgatcattgtgctctcggttgtgattttctctggagctttacagtctgattccataggaattaccggctctctcatcgcattagtaatacttacgatcttgatgcagccagttttcgttcagcttcaaagaaaaattgaggctcagcgtgaaaagacgaaagacgaactctccccgcctcaaaacggt

SEQ ID NO: 1491 - DNA, 564 bp, Corynebacterium glutamicum
atgaagttcttcgggttttatcgtcctattgctttaattgctggcattaccgtttcagcatctattctcacatccgtagctactgcagctgaatctccaactagctttcaagcgattacacctgcattctcttcatcatcggctccagaagcagacgcagaagcaaacaccagtgaagctaccgcagacctgctttacgtggcagaaaaccaactacttattaagctttctaacgccgtcgtcgaagatgttaacggcgaaatcttaatgaaagataataagggcactcttctggagaatttgacagctgaacttcaagcccaaccaggcttctcaatcgagaaagtcgattcccatactgctttgttgaccatgaatccagatgaggtgccagatttacaggactggcgatgcggagtcggcgctttgtcaggcggggtagcaggtgtggtggcaactggtctagctctcgccgctttgggagttgccacaggtggcacggggtttgctgtgcttgcagcagggggacttgctggatatggcactggcgctgtcgccaactgc

SEQ ID NO: 1492 - DNA, 222 bp, Corynebacterium glutamicum
gtgctaaaaatggacggactgtttaccccgttttcagatgcgtcattaaacaacacggtaaaaactgatggagattcagtacctggtcaagacttacctattacgaagatctctgaggatcgattcgagcgttctgcgtatgcagcccagctagcgaagatcacgtgcgatgtggcctctcagggagagtacacagttttcggtctcactggtcagtggtgt

SEQ ID NO: 1493 - DNA, 291 bp, Corynebacterium glutamicum
gtgttgtgggtgttgaccggaatcttactggctatggtctctaccgccctacgaatccgcttcggatcaggggtagctatcgctgcaaccgtgctgtggacagttatctcaataaccttgggcggagatgtgctagccgagaccatgctctggcttgtagcagtaccatcctggccagaaacagcggatactactacccgcttccttattgcgatgctactgcaggcagttcttatcaccggcagcactatctgggctatccgagagatccgggattcagagcgccgtggc

SEQ ID NO: 1494 - DNA, 2715 bp, Corynebacterium glutamicum
ttgggtgaatgtgtcgctaatttttccactcgcctacactcgggaggcgtgactgagaagactgaccagaccttaatgcttatcgacggccactcgatggctttccgcgcattctttgctttgccggctgagaatttctccacgtcgggcgggcaggccaccaatgctgtctatggctttctctcgatgctgtccacgttgttgaaggatgagcagcctactcatgtggcggtggctttcgatgtggggcgtaagacgttccgtaccgatatgttcccggcgtataaggcgcagcgtgaagcaacgccacctgagtttaagggccaggtggaaatcctcaaggaggtgttgtccactttgggaattacgactattgagaaaatcgattttgaggctgatgatgtgatcgccacgttgtctgtggcggcgaaacctttaggctttaagacgctgattgttacgggtgaccgtgattccttccagttggtcaatgacaccaccacggtgttgtatccgatgaagggcgtgtctgtgctgcaccgtttcacgccggaagcagtggaggagaagtatggactgacaccgaggcagtatccggagtttgcagcgctgcgtggtgatccttccgataacttgcctaatattcctggcgtgggcgagaagactgctaccaagtggattgcccagtatgaaactttggataatttgcttgatcacgctgatgagatcaagggcaaggttggcgccagcctgcgtgagcgcattgagcaggtccggatgaaccgcaagctcacggagatggtgaaggatctggagctgccgcttggtccggacgattttgagatgaagcctgtgcaggttgcggaggttgcggcgaagtttgacgatctggagtttggtaccaatttgcgtgagcgggtgctggcggtggtgaaggccgagggttccgctgcccccgtggaggaagtggaagcggaacaggttgtcgtcgatacgcaatctttggcgcaatggctgcctgctagggctggccaggcgcttgctttagcgctggctggagtggctaaacctgctgctggcgacacgtatgcgctagcgattgcggataccaagcgccatgcggtgttggttgatgtggctgatatttcagcggaggatgaaaaggcgctggccacgtggttggcgtcggaagatccaaagatgctgcacggcgctaaggccgcctatcatatgctcgctgggcgcggttttgagctgcacggcgtggtgcatgacacggcgatcgcggcatacttgctgcgtccgggccaacgcacctatgagcttgccgacgtctaccagcggcatcttcaacgacagttgtctacaaacgacaatggcggccagctcacgctgctcgacgcagctgatgaccaatcgcttgttgatgatgtcattgcaatccttgagctgtctgaagaattgaccaaacagcttcaggagattcaagcttttgagctttaccatgacctggaaattccgctgtcgggaattctggcgcgcatggaggccatcggtatcgctgttgatgttgccactttggaagagcagttgaagactttcattggtcaggttgctcaggaagaggaagcagctcgcgagctcgctgaggatccaaccctgaatctctcgagcccgaagcagctgcaagtggtgctttttgagacgttcggaatgccgaaaaccaagaaaaccaagaccggctactctacggctgccgcggaaattgaagccctagcgatcaagaatccgcacccattcctagatcacctgttggcacaccgtcagtaccaaaagatgaagaccactctggaaggtctcatccgtgaggtggctcctgatggccgtattcacaccaccttcaaccagacggtggcgtctacgggacgtttgtcatccactgatcccaacctgcaaaacattcctgtgcgcactgaggctggccgaaagattcgttcgggattcgtcgtaggcgaggggtatgaaaccttgctgactgccgactattcgcagattgaaatgcgcgtgatggctcacctttcccaggacccaggcttgattgaggcgtaccgcgaaggcgaagacctgcacaattacgtgggttccaaggtgtttaatgtgcccatcgatggcgtgacccctgagctgcgtcgccaggtcaaggccatgtcttacggtctggtgtacggcttgtccgcgtttggtttgtctcagcagctgagcattcctgctggcgaagcgaagcagatcatggagtcctacttcgagcgcttcggcggagtacagcgctacctccgggagatcgtggaggaggctcgaaaagctggctacacggaaacgctgtttgggcgtcgtcgctacctgccggaactgacctcggataaccgtgtcgctcgtgaaaacgctgaacgtgccgcactgaacgccccgattcagggaactgccgcagacatcatcaaggtggccatgatccgggtggaccgttcactcaaggaagctgccgtgaaatctcgcgtgctgcttcaggtgcatgatgaattggtcgtggaagtagcggccggtgagttggaacaagtccgtgagattctggaacgcgaaatggataacgccatcaagctgtccgttcctttggaagtttcagctggtgatggcgttaactgggatgctgcagcgcac

SEQ ID NO: 1495 - DNA, 1422 bp, Corynebacterium glutamicum
ttgctgccatcaaaaattagtcacatgattttaagcatcgtccttttgggctacttcatgattctgcttgacacctccatcgtcattacgggtctacctgccatcggcagtgaacttggcatcgatcccgtgcacctgtcatgggtgcagagttcctacacattagtcttcggcgcacttcttctgctgggagctcgtgccggtgatatcttcggccgaaagaaagtgctctacattggtctcgcgttgtttgcggcttcatcgttggcaattgcgctttctccaaatgctgcggtcctcattggagcacgcgtagttcaaggcgcgggagctgcgattatcgctccagcgacacttgcgttgattactgagttcttccccgaaggcccagctcgccttcgtgctacctctgcttatggtgctgttgccggcatcggtgtggcagcaggcctagtgatcggcggcgtatttgctgatcttttgtcgtggcgcatcggcttctttatcaacgtccccatcgccgcagtgttggcctacatagtgcacaaagccattcccgcaaccttcagcaggcctggatcactcgacatcttcggagcaattacctccacggcaggtatcgccgcggtgctctacgcaattgtccgcagcgccgattacagctggacagatccgtttgtgttgatttccctcgtgctgggcatcgcagtgttcatctggttcctgcgccatgaatcctcagccaaagaaccacttctgcccctggggctctttaaaaaccgcaggcgaaacaccatcttggccagccgctttcttctggttggctccgtgatgtcattcttcttctttgccacccagctgttccaggacaccatgggaatgaatgctctccaggcaggccttgcgttcatgccgctatctctgctgcagtttgccagcgccgcgatggtgccacggctttcccgagcaggcgtatctgattccatgctcaccgtcatcggtttcgccatcatggtcatcggcatggcaggcctcgcatttgtaccaaacacgatgatcgcgctgatcctaccaatagttttggtgggatttggccaaggcttcgctttcggaccaatgacagctctggcagttcaaggtgcaccgaaggaccaatccggcgccgtttctggcctggtgaattcccttcaccaaatcggcggcaccttcggtttgggtgtgttctcctccttggctgtcgctgtcatcggacatgatgcaacatcagagatgatcagcgaccgcgcacacttcggattcttgctctccaccgtgacgctgacgctggccaccatctttgcggtcacactgctgaagcgccacgaaacccgaaagagtagcgagcgcccaacccagctcgtcgacgaaaaggcagttacctct

SEQ ID NO: 1496 - DNA, 909 bp, Corynebacterium glutamicum
atggatgtacacgcagatactcgagaattcctcactgcgcgccgcaatcgtctcactccaaaagacgccggattgcctatttaccaaggcaaaaggcgagttccggggcttcgacgtgaagaagtggccatgttggctggcgtgagcgtggactattacacacgtcttgaacgaggcaacttgagtggtgtgtcagaacaggtgttaagcgcgttagctactgccttacagctggatgatgcggagacgcagcatctgtttgatctggccaagctcagtaattcaccggcgtcacggcgtaagcgtacccctgcaccgaagtctgtgctgcgccctgaggtgctgcgaattctcaattcgatgcacgatattccagcatatattcgttctgaaagccgtgaccttctggcagccaacacttttggtcgtgcgctatatgcaccgttgtatgaaagcacggtctccgatggaattagtggggaaccggggtcaatcaatgttgcacgctttacattcctcgatccagcagcgcgcgaatttttccctgagtgggagagaacttcggcagatttggtagccagcttgcgcaccgttgcagcacagcggcccaacgacacgttgtttagcaatttgatcggtgagctggtgaccaagtcagaagtcttcgcgcaaatgtgggccgaccataatgtccgcatgcatcgaacaggttccaagaagatcgtgcacccgttggtgggggagatggagctggattttgaaacgcttgatcttccagcagatcccgatattgccctcgtggtgtactccgctgcggaaggttcgacatctgcaatgaaccttcaacttctggccaattggacaggtaatgacagcccctccctcagcacagaacttggtgacactatt

SEQ ID NO: 1497 - DNA, 873 bp, Corynebacterium glutamicum
atgactttcacactgaacaacggactcgccattcccgacattggatttggtgtattccaaaccccacccgatgaaacccgaaactccgttaacgctgctcttgaagccggctatcgccacatcgacaccgccgccgcatacggcaatgaacgtgaagtcggtgaagcaatcgcagcatccggcattggccgcgacgagatcaccatcgaaaccaaaatctgggtgaccgactacggcttcgaggaaactctccacgcattcgacaaggccacaggcaagcttggtgtcgatacactggacattttgatcttgcaccaggcagtgccaagcagctttgatcgcaccatcgccgcctacaaggcgctagagaagctgcttttcgacggcgcggtgcgggcaatcggagtcagtaatttcatgccagagcacctggacaaactccttttggaaacctccattgtcccagctctgaaccaaatcgaatgccacccctacttccagcagcgtgacgtgcttgcccgcaatgagcagcttggcattttgactcaggcgtggtcaccaatcggtggcatcaccttctaccgcgacggacagcttccaagcactctagaaaatgaggtcatcgctggaatcgccgcagaagttggcaaaacaccagctcaagtaatgctgcgctggcacctacagcgtagacgtcacgcaattccaaagtctgtgaccccatcacgcattgtggaaaactttgagatctttgatttcgaactctccgatgagcaactacagcaaatcgatgccctcaacaccgatctgcgcggtggcccagaaccagagaacatcaccatggaaaactactaccgagaaatcccagaagcc

SEQ ID NO: 1498 - DNA, 159 bp, Corynebacterium glutamicum
ttggtctcgaatgcacgtttttggtgctcaaaactgtcgaatcagaccaagcgctcccctaatttccgagcttttggtctctggatggaccgaccaaaccaggtgaccaatgaagtcgaaattgagaggtcgctggccatatggtctggtttcgacgac

SEQ ID NO: 1499 - DNA, 654 bp, Corynebacterium glutamicum
atgctgcatgaaaaagatgtacgtcttcttggcactcccgcagcactctccggcaagaaaattttagagatcggttgcggctcggcaccgtgtgctcggtggctggccaatgatgttccgaatgcctttgtcaccgctttcgacatttcttcacaaatgctcaaatacgcaggtcacgaccataacgtacacctcgtacaggccgatgcaatgtcactcccctacgccgacagttcctttgacgtggtcttttccgttttcggcgccatcccctttgtggaggattccgccgcactcatgaaggaaatcgcgcgcgtcctcaaacccggcggacgcctcattttctccatcacccacccgatgcgctggattttcctcgacgatcccggccccgcaggcctcaccgcgatcaccagctacttcgaccagcgcggctacgtcgaagaagacgaggaaaccggtgctttaagctatgcggaacagcaccgcaccatgggcgcgcggatcaatgagcttatcgacgcctccctccacttagatcacctcatcgaaccagaatggccagatgagttggaagaaaactggggccaatggtcaccacttcgaggaaagctcttccccgggacagcaatcttcctcgccacgtaccgcccc

SEQ ID NO: 1500 - DNA, 1458 bp, Corynebacterium glutamicum
atgcccaccaacaatgcacctcaggtagccatcaacgacattggctctgctgaggacttccttgcagcaatcgacgcaaccatcaagtacttcaacgatggcgatatcgttgaaggcaccgtggtaaaggtcgatcgtgacgaggtacttctcgacatcggatacaagaccgagggtgtcatcccatcccgcgagctgtccatcaagcacgatgtcgatccagacgaggtcgtcgaagtcggcgaccaaattgacgcacttgtcctcaccaaggaagacaaagaaggtcgtctgatcctttccaagaagcgtgctcagtacgagcgtgcttggggcgccatcgaggagctcaaggaaaaggacgagccagttaccggtaccgtcatcgaggtcgtcaagggtggcctcatcatcgacatcggtctccgtggcttcctgcctgcatccctcgttgagatgcgtcgcgtccgcgacctggatccgtacatcggccaggagctcgaagctaagatcatcgagctggacaagaaccgcaacaacgtcgttctgtcccgtcgcgcattcctcgagcagacccagtctgaggtccgctccgagttcctgcaccagctccagaagggccaggtccgcaagggcgtcgtctcttccatcgtcaacttcggcgcattcgtcgatctcggcggtgtcgacggactggttcacgtttccgagctgtcctggaagcacatcgaccacccatctgaggttgtcaccgtcggcgacgaagtcaccgttgaggttctcgaggtcgatctcgaccgcgagcgcgtctccctgtccctgaaggctacccaggaagacccatggcgcgtcttcgctcgcactcacgctgtgggccagatcgttccaggcaaggtcaccaagctggttccattcggtgcgttcgttcgcgtcgaagagggcatcgaaggcctcgtccacatctccgagctggctcagcgccacgtcgaggttccggaccaggttgtcgcagttggcgaagaggtcatggtcaaggtcatcgacatcgatctcgagcgtcgtcgtatctccctgtccctcaagcaggctgacgaggactacaccgaagagttcgacccatccaagtacggaatggctgactcctacgacgagcagggtaactacatcttccctgagggcttcgacgccgagaccaacgaatggctcgaaggcttcgatgagcagcgtcaggcttgggaagctcgctacgccgagtccgagcgtcgcttcaccgctcacaccgctcagatcgagcgtcgtcgtcagcaggctgaagaggcagctgccgaggctccggccggcaactactccactgattctgcagaagatgcacctgcagcagaagcagttgaagagtccgctggctccctcgcttccgatgagcagctcgctgctcttcgcgagaagctcgcaggtaac

SEQ ID NO: 1501 - DNA, 1476 bp, Corynebacterium glutamicum
gtgcaggaactattagttacctgcgagcttctcgcgaagagcagcgagctgctcatcggaagcgagggagccagcggactcttcaactgcttctgctgcaggtgcatcttctgcagaatcagtggagtagttgccggccggagcctcggcagctgcctcttcagcctgctgacgacgacgctcgatctgagcggtgtgagcggtgaagcgacgctcggactcggcgtagcgagcttcccaagcctgacgctgctcatcgaagccttcgagccattcgttggtctcggcgtcgaagccctcagggaagatgtagttaccctgctcgtcgtaggagtcagccattccgtacttggatgggtcgaactcttcggtgtagtcctcgtcagcctgcttgagggacagggagatacgacgacgctcgagatcgatgtcgatgaccttgaccatgacctcttcgccaactgcgacaacctggtccggaacctcgacgtggcgctgagccagctcggagatgtggacgaggccttcgatgccctcttcgacgcgaacgaacgcaccgaatggaaccagcttggtgaccttgcctggaacgatctggcccacagcgtgagtgcgagcgaagacgcgccatgggtcttcctgggtagccttcagggacagggagacgcgctcgcggtcgagatcgacctcgagaacctcaacggtgacttcgtcgccgacggtgacaacctcagatgggtggtcgatgtgcttccaggacagctcggaaacgtgaaccagtccgtcgacaccgccgagatcgacgaatgcgccgaagttgacgatggaagagacgacgcccttgcggacctggcccttctggagctggtgcaggaactcggagcggacctcagactgggtctgctcgaggaatgcgcgacgggacagaacgacgttgttgcggttcttgtccagctcgatgatcttagcttcgagctcctggccgatgtacggatccaggtcgcggacgcgacgcatctcaacgagggatgcaggcaggaagccacggagaccgatgtcgatgatgaggccacccttgacgacctcgatgacggtaccggtaactggctcgtccttttccttgagctcctcgatggcgccccaagcacgctcgtactgagcacgcttcttggaaaggatcagacgaccttctttgtcttccttggtgaggacaagtgcgtcaatttggtcgccgacttcgacgacctcgtctggatcgacatcgtgcttgatggacagctcgcgggatgggatgacaccctcggtcttgtatccgatgtcgagaagtacctcgtcacgatcgacctttaccacggtgccttcaacgatatcgccatcgttgaagtacttgatggttgcgtcgattgctgcaaggaagtcctcagcagagccaatgtcgttgatggctacctgaggtgcattgttggtgggcatatg

SEQ ID NO: 1502 - DNA, 600 bp, Corynebacterium glutamicum
atgttgcgcattggactaacaggagggatcggcagcggtaaatctaccgttgccgatcttttgtcatctgaaggatttctcatcgtcgacgcggaccaagttgcccgcgatatcgtcgaacccggacaaccggcattagcagagctagctgaagcttttggccaagacatcttaaaacccgacggcactctagaccgcgcgggattagcagccaaagcatttgtcagcgaagaacaaacagcgctgctcaatgccattacccaccctcgtatcgccgaagagtcagctcgtcgattcaacgaagccgaagatcaaggcgccaaagttgcggtttatgacatgcctttgcttgtagaaaaaggccttgaccgcaagatggaccttgtcgtcgtagttgatgttgacgtagaggaacgcgtccgcagacttgtggaaaaacgtggcctcacagaggacgacgtgcggcgtcgaatcgcttctcaagtgcccgacgacgtcagacttaaagccgctgacatcgttgtggacaataacggcacgctagaggaccttcatgctgaagcaagcaagctgattgctgagattcttagtcgcgtgaat

SEQ ID NO: 1503 - DNA, 1098 bp, Corynebacterium glutamicum
ttgaaggattacgcggtgcatactcgtgggttagtttctctcttaagtcttatttttcttttcgttctttcagggtgtggagggaatgccactaccgctgatgaagctgctgaaagtgacgttgttacttcaagtagcgcacctccaagtaaacgagctctagatgttggagaagcagtagagatcccaggggtcgtgctcacggtaaacagcgtcacacagtccgatcagctcatgttgtactcagaaggcagtgcgcgtggatctgagccgagagaacagcggaatgctgcgtccggagaaaagtttgtttcggtggacactaccgtgaagaattcgagctctgatccttgggatctttcatgtggtcacgtattacagacatggctcctcgaggacgaactagatgatcaacaaggtgaccaagaaaagaaatttagccctatcgacaatcttgatcagatttctggtaatccggagtgtggtgtgcttttagaagtgggtacagaaattgaaatgacgtggtcttttactattccagatgacatagaaatcactcactttggtttttctctttcggatagcacttccaatgacttggccattatcagccttgggggtgcaatagagacatcgtcggccatcacaacaactgaagttatagcaccggaaaatgacacggaaacgctgctagagataactccggttgactgtcaggtcggccttggccccatcgttacttcttggtcggatggaacggtcggaggttggtctcagcactgtcaggacgtgcatgatgaggtacttgccggtgaagtcgcagcgaataccccagtatgtgacggagttgtatgcacttaccccagtggcgccacaatgccggatccaaatgcacctcaaatcccttcagatacgagtggtgcagtgtgcgatgaaaatcagtgtgtttaccctaacggttatatcgcccgaattggggatccgaatgttccgaactatctcaagcctggcaactctccgtgggtacaaggacagattgattttcagaattgcctagacagtgggaaaactattgagcaatgccgtgaagaactgaac

SEQ ID NO: 1504 - DNA, 582 bp, Corynebacterium glutamicum
gtggatcgatatctccacaggattctggcaagaaatcgtgattctgtccggacttgccgctggtttagtcactttttgctcacgacggtatttattggtcgatttcaccagcgcagcgttgaaaaacgttgggcgccagtcacccacatggccttgacttcacttttgcaccagcttgcagataaaaaacacagtgacctcagccgggaagacatcgtaccgcgggcctttactgtcccgacctctactgacgcccacgctattcatcaagacttggaaaaactccgaaactccgtactcaaagagcaaaatcacctaaccactgtgttgggaacttggtcagaattcctcacctccaacagcgataactccgacattttgcgttcctccgctgaacttgggctccaattggagcaggtccgcgataaagcactcgaagtggaacagcgtatcaaagcctctgctcaggtggatcttacggacctggctcatgagattgagatctgcaatcaacaccacgcaaccctcatcagtgcgattcaggtaagactgcaatcgcatactgctgagcttcgggctggg

SEQ ID NO: 1505 - DNA, 246 bp, Corynebacterium glutamicum
atgaggcaatcgatgcgtactctcctgagcaaggcttccgctctgcacgttgtcacggtgattggcgcgctggcgctcattgtcatcattttgtggatcgatatctccacaggattctggcaagaaatcgtgattctgtccggacttgccgctggtttagtcactttttgctcacgacggtatttattggtcgatttcaccagcgcagcgttgaaaaacgttgggcgccagtcacccacatggcct

SEQ ID NO: 1506 - DNA, 957 bp, Corynebacterium glutamicum
ttgggtggtgcaatctgctggagccggtgcgcggaaatcagcaacggtcatgcctgtggtgagtgcgccgtacagctccacatcgagtggtgctttgcgggtggtgaatacggttgggtcaacaaggtatgcaacagcacaagggtcgtgtactggtgggttatcaaaaccctgtgcgtcctggtaattcttgcggaaagcgtcgaaaagcgcgacgacgaagtcggcgacgtcggtgcccagctcgttgaacttggcttcgatctcaggtgttgcgagcgcctggtgggtaaggtcgaggccgaccatagtcagtggccacttttcgttgaatacgatgtgggctgcttcggggtcgatcttgatgttgaattcagctacggcggtccagtttcctacgtggtagcccccgcccatgaggacaacttccttgactcgctcggcgatgcgtggttctttccggactgccagcgcgatgttggtcagtggtccggtgggaaccagcgctacgctgccgggctcgttattcatgatggtatcgatgatgaaatccaccgcgtgggtgtcttctacctgcttggttggttcaggcagttcgtacttgtggatttccatgccggtatcgccgtggatatcttcggctacctcaacggggcgcaccaatggtcgggtgacaccgcggtagatgggcgcattgatatcagcgatggtggctacgacctgcgtattgtgggtgaccttgtccaaggtctggttgccgccgaccgtggtgattccaagcagttcaatttctgggctgccggctgcgagcagcatggctacagcgtcgtcgtgtcctggatcgcagtcgaggatgatcttggtggtcatagggtaaaactccttagttcagtttgtggatttagctggcggcttgagcggcttcttcagcctggactttggctgccactgtatcgg

SEQ ID NO: 1507 - DNA, 936 bp, Corynebacterium glutamicum
atgaccaccaagatcatcctcgactgcgatccaggacacgacgacgctgtagccatgctgctcgcagccggcagcccagaaattgaactgcttggaatcaccacggtcggcggcaaccagaccttggacaaggtcacccacaatacgcaggtcgtagccaccatcgctgatatcaatgcgcccatctaccgcggtgtcacccgaccattggtgcgccccgttgaggtagccgaagatatccacggcgataccggcatggaaatccacaagtacgaactgcctgaaccaaccaagcaggtagaagacacccacgcggtggatttcatcatcgataccatcatgaataacgagcccggcagcgtagcgctggttcccaccggaccactgaccaacatcgcgctggcagtccggaaagaaccacgcatcgccgagcgagtcaaggaagttgtcctcatgggcgggggctaccacgtaggaaactggaccgccgtagctgaattcaacatcaagatcgaccccgaagcagcccacatcgtattcaacgaaaagtggccactgactatggtcggcctcgaccttacccaccaggcgctcgcaacacctgagatcgaagccaagttcaacgagctgggcaccgacgtcgccgacttcgtcgtcgcgcttttcgacgctttccgcaagaattaccaggacgcacagggttttgataacccaccagtacacgacccttgtgctgttgcataccttgttgacccaaccgtattcaccacccgcaaagcaccactcgatgtggagctgtacggcgcactcaccacaggcatgaccgttgctgatttccgcgcaccggctccagcagattgcaccacccaagtagctgttgacctggactttgataaattctggaacatggtgatcgatgcagtaaagcgcatcgga

SEQ ID NO: 1508 - DNA, 1449 bp, Corynebacterium glutamicum
atgtcacttcctgttcagccgagtaaaacctcggccgccacagtcataccattgatgatcgccctgctggtcgcggtattcgccttccagctcaacgcctccatgctggcgccggcactggccaccatggaaactgaacttaatgcaacagctgcccaaatcggcatgacgcagactgctttcttcaccgcggcggcgctgttttccctgttcctgccacgttggggcgatctgattggtcgccgcaaagtgctggtcggcatgatgattgtcaccggtattggatgtgttgtcgctgcctttgctccgaatgtgaccatcctcttcctgggccgcctgattcaaggtgttgctggcccaaccgtgccactgtgtctgatcattctgcgccagcaggtaaccaatgaaaagcaatatgcgctacttctcggaattgttacctctgtcaacggtggtatcggcggcgtggacgcgcttgctggtggctggttggctgaaacacttggtttccgttccatcttctgggtcatggctgctttctgcgctgtcgctgccctcgcactgcctttcagcgtgaaggaatccaccgctgaagaaaccccgaagatggactggcttggtgtgctgccactggcggtgtccattggatctttgctcatggctttcaacgaggccggcaaactcggtgccgcgaactggattctggtggttgtgctgttcatcatcggtatcgccggagtcatcttcttctacaacattgaaaagcgcgttaagcacccgctggtcagtgttgaatacctcggtcaacgacgcacctgggcattgctgctgagcacccttctcacaatgaccggtgtattcgccgtaatgaatggtctgctgcccaaccttgcgcaggatgctgccaacggtgccggcatgtcagcgagcgtggtgtcctggtggacacttaccccatatgcgctggctggcttggtattcggtccaatcgccggaattctcgccggaaaatttggatacaagatcgtcctgcaaattggtatcgctgccaccatcatcggcgttgccggagccaccttcttagtcggaagcacctcgcatctcgcgtacctcggcatctccatcttcgtgggtattacctatgcaggtattgccaacatcatgctcaacggcctgggcatcgtgctctcccctgctaacaaccaaggctatctgcctggcatgaacgcaggtgccttcaacctaggtgcaggtatttccttcgccatcctcttcgcagtttccacggcattcagtgacaacggcggaggatacgccgcaggcatgtgggctggcgtgatcatcttggtcctagccttcctctgctccctgctgatcccacgcccagaatcaatcaccgatacagtggcagccaaagtccaggctgaagaagccgctcaagccgccagc

SEQ ID NO: 1509 - DNA, 921 bp, Corynebacterium glutamicum
atgagtaactcaaccggtaccgacattgtcgttgtcggatccatcaatgccgatctcaccgcaaaagttcaacgccaccctgaacctggagaaaccctcctgggtagcggcggcacagtgagtgctggtggcaaaggcgccaaccaagctgtggcggcagcgcaattaggtgccaaagtcaccatgatcggtgcggtcggaaccgatcaaatggctggcgaggcgctgacacatttgcgtcaatcaggagcagatatgtccgcgattgccactgtggacggtcccactggtcttgccatcatcactgtgtctgacgatggggaaaacaccatcatcgttatccctggcgctaacgcttctgtcaccgcggaatttgttgataaacactcccaactcattgagaacgccggcattgtgttgcttcagggtgagatccctgccgatggtttcgagcgtgccgttgatctttcacaaggacgtgtggtgatcaatctggctccagttgtgcccgtgggacatgatcagctgcgtcgtgccgatccattgctggtcaacgaacacgaaggcgctctggtgctggacatgcttggaactccagcgaccacgtctgatccccaaagtttggtcactgaattgctggagcagggttttacttccgtggtgatgacacttggtgccgaaggtgctctggttggcacgccgggccaactcacggcaattcctaccccaaagatccaggcagtcgacacaaccggaagtggagacgcgtttgcgggggcactcgtcgcaaagctctctgaaggcgctggccttattgaggcggcaacttttgctgcgcgcgttggcgcttatgccgccacgaggccgggcgctcaagcctcctaccccaccctgaccactgacctcccctcaaccactcac

SEQ ID NO: 1510 - DNA, 1038 bp, Corynebacterium glutamicum
atggcgacggaaaaattccgaccgactcttaaagatgtcgctcgtcaagcaggtgtctccatcgccacagcatcacgagcactagcggataatccggcggttgctgcatcgactcgtgaaagaatccaacaattagcctctgatctgggttaccgggccaatgctcaagctcgtgcgcttcgcagttctcgcagcaacaccattggtgtgattgttcccagtttgattaaccattacttcgccgcaatggttactgaaattcaaagcaccgccagcaaagctggacttgccacgattatcaccaacagcaatgaagatgcgaccactatgtctgggtctttggagtttctcacctcgcatggtgtcgatggaatcatctgcgtacctaatgaggaatgcgcgaatcaactagaggacttgcagaagcaaggaatgccagtggtgttggttgaccgagagcttccaggagactccaccatcccaacggcgacctctaacccccaaccaggaatcgccgcagcagtagaactcctggctcacaacaacgcgttgccgattggttacctctcaggtcccatggacacctcaacaggtagagagcgattagaggatttcaaagcagcctgcgccaactccaaaattggcgaacagctcgtttttctgggtgggtacgaacaaagcgttggatttgaaggcgctacgaaattgctcgatcaaggagctaaaactctttttgccggcgattctatgatgacgatcggtgtcattgaagcctgccataaggctggtttggttatcggcaaggatgtcagcgtgattggttttgatacacatccgctttttgccctgcaacctcatccgttgacagtgattgatcaaaatgtagaacaactagcccaacgagcagtgtctatcctcaccgaattaattgcaggcacggtacctagcgtgacgaaaactacgatccccactgcccttattcatcgtgaatcaatcatcaactccactttaaggaagaaggatggactccccaatgag

SEQ ID NO: 1511 - DNA, 798 bp, Corynebacterium glutamicum
gtgaataagaaggctaatgatttaaaaccgcacttcatgagacgtcgggcaaagtatggggtacttatggagtctcacggggtaggttcatccacaacccttgcgagacttcacattccgctaatgacaggagccggaaacatgccatttgatccagtgggcgaatgggtagctaaatccattaaccgtgaacttgatgagtatccgatgacagaggccgaagtgctagaaatctgttttaggcaagggcagtacaacctgaagatggaataccggatttcaggacgaaagtttcatgtagatcgtggatctgccgaatattcactacgttttaatccttggactttagctcaaagcgaaaccagtacagatgctaatggggaagaaactacctttacgatgtccccgaagttgaccgcggatggttggttcgaaccaggggaggcggtatcaaagtccatttttatgggcagtcctcaactactgcctaggtggacgcaatttgtcaccaacaaattgtattcgcgactaggggaggacccgctcaagatcacgatgctcgactccaggtacctgaaaattgttcaagcagcaacggaagaggatccagggtggggtctctttgttgattgggttcatgattgcgggctttatttttgtcgatacggcctgaatcgggagatgtatcaggaggtggaggcaacgtctgtgcatcaatggttatccggcgagactagttttcgtgaacttgagagggatgaaattggtgagctacagattgtgaattcatctactgac

SEQ ID NO: 1512 - DNA, 2097 bp, Corynebacterium glutamicum
atggcttttgctgctgaacatcctgtcctgtcccactctgagcaccgcccggttggtgaaatcgagcgtagcgatgacaaatttgttgtcgttagtgaatttgagcctgcgggtgaccagcctgcggctattaaagagctcgatgagcgcttggatcgcggtgagcgggacgtcgttttgatgggtgctactggtacgggtaagtccgcgactgcggcgtggttgatcgaaaagcagcagcgccccgctttggtgatggcgccgaataagacgctggctgcgcagttggctaatgaattgcggcagctgttgcccaataacgcggtggagtatttcgtgtcttattacgattactaccagccagaagcgtatatcgcgcagactgatacctatattgaaaaggactcctcgattaatgaggatgtggagcgtctgcgtcactcggcgacgtcgtctttgctgagtaggcgagacgtcgtggttgttagttcggtgtcgtgtatttatggcttgggcactccacagtcttatcttgaccgttccgttgtgttgaacgtgggggaggagatcgaccgcgatcgctttttgcgcctattggtagatattcaatacgaacgcaatgatgtgggctttactcgtggtgctttccgcgtgaagggcgataccgtggacatcatcccggcctatgaggaattggcggtgcgcattgagtttttcggtgatgaaattgatgcgttgtactacatccatcccctgactggtgacaccatccggcaggtgaatgagatccgtattttcccagctacgcactatgttgcgggacctgagcggatggaaaaggcagtcgctgatattaaggcggagttggaagtgcgcctggctgatttggagaaccgtggcaagttattggaagcgcagcgtcttaggatgcgtactgaatatgacttagaaatgatcgagcaggttggtttctgttcgggcattgagaactattctcgccacattgatggacgtggggagggaaccgcaccggccacgctgattgactatttcccagaggatttcctcaccatcatcgatgagtctcacgtgacagtcccgcagatcggcggcatgtttgagggcgatatgtcccgtaaacgtaacctcgtagaattcggtttccgcctgccatccgcgatggataaccgcccattgacctgggaggagttcgatgaacgccgtggccaaacggtgttcatgtctgcaactccaggcaagtttgagatcgctgctgctgatggtgagtttgtggagcaggtcattcgcccaacaggtctggtggatccaaaggtcaccgtcaagccaacgaaggggcagattgatgatctgatccatgaaattcgccaacgcaccgataaagatgagcgcgttttggtcaccacattgaccaagaaaatggctgaggatcttactgattacctgctggaaaacggcatccgcgtgcgctacctgcactcagatattgataccttgcagcgtgtggaattgctgcgtcagcttcgcctgggcgaatacgatgtgttggtaggtattaacctgctgcgtgagggccttgacctgccagaagtctctctggttgcgattctcgacgccgacaaggaaggcttcctgcgctccaccacctcactgattcagaccattggccgcgccgcccgaaatgtgtccggcgaggtcatcatgtacgccgacaagatcactgattcgatgcagtatgccatcgaggaaaccgatcgacgccgtgaaaagcaggtcgcttataacaaggaacacggcatcgatccgcagccgcttcgaaagaaaatcgcggacatcctcgaccaggtctatgacaattccgctgatggagcaggaccttctgcctctggcgatgcggcagtcgtggctaaacctgacgtgtctagcatgcccgccaaagaagtgcaaaagcttatcgacgacctcagcgctcagatggctgcggccgcgcgggagctcaagttcgagctggcagggcgtctgcgagatgagatcttcgagctcaagaaggaactgagaggtatcaaggatgccggcatc

SEQ ID NO: 1513 - DNA, 441 bp, Corynebacterium glutamicum
atgagcgagaattacagcaagattgtcgttggcactgatggatctaagtcgtcccttctagcagttgaacgagctgcccgaatcgccgcagctttcgacgccactttgatcatcggatgtgcatactacgaaagcaaggaagacgcttcagagactttgcgccaggattctgtaacaatcctcggcgatgatcctgctcgtgaaaacctggacaaggcagcagatgcagcacgcgctgtcggcgcaacctccatcgagactgaggttcgtactggcactccagttgaggctttgatggcaatcgttaatgatcaccaagctgaccttcttgtggttggtaaccgtggaatcaactctttgaccggccgtttgttgggttcagttccagctgatgttgcacgccaatcagactgcgatgtcatgattgttcacaccgtgagc

SEQ ID NO: 1514 - DNA, 381 bp, Corynebacterium glutamicum
atggatatttcccctattcagcaaccggcaaatgtgttctcctccatgtgttcttcacgtggcgcgttgcagcatgtcactggtcgatgggggtctttgacaatggtggcgctcaaacgcagtgatgaaccgatgcgtttcgctgaaattcgccgaaaagttgagggcattagtgatcgcatgctgtcgcagacattggcccaactagaacgtgacggcatggttgatcgaacagtccacagctccattcccccacacgtggactacacactgacacctttgggcactaagctcgcggacgctttagtcctgctagtcagcactgtggaagctgaattggatcaggtagttagggcgcaagaaatctacgataagcagcac

SEQ ID NO: 1515 - DNA, 846 bp, Corynebacterium glutamicum
atgcgtattgcagtaactggagcaacgggatctttgggtggacatgttgtggatagtcttctaaacaagggcgtcgcagcatcagacatcgttgccattgttcgaaatgaagaaaaggcagcagacctcaaagcccgtggaatcgctcttggtgtggctacttttgaagacgaagcggcactgactgcagctcttgaaggtgtggatcgccttgtgtttatctctggcagcgaagtggggcagcgcgttgcgcagcacaccaatgtcatcaatgccgctaaagcagctggcgtgacattcattgcatacaccagcttgctcaaccttggtacctcaaagcttgcacttgctccagagcacattgcaacggaaaagctcctggcagaaagcggcattgaccacgcgctgctgcgcaatggttggtactgggagaactacgaatcttcaattggcgcagcgaaggccaccgggaaggtattcggcgcagctgaaggcgcacgcgtttccgcagccgcacgtaaggactacgcagaggcagctgctgttgtcatcaccagcgacaaccaggcaggcaaggtctatgagctcgcaggcgcaccagctttgacctacccagagatcgcagctggcattggtgaggtcattggttctgaggcagaatacgtcaacctctccgtggaggagtaccaaaatgcgctggagcaggctggcgttccagctgaatttgcagcacttctcgcaggcatggatcccatcattgcagagggcgcgctgtactccgacagcaccgacctacaggatctcatcggacgcccgagcacctcaatcgttgaggccctgagctca

SEQ ID NO: 1516 - DNA, 684 bp, Corynebacterium glutamicum
atgctcgcggaaaattgggcgtgcggaattgtgcgactgcctggcacgacgagctcgggtgcgggattttgccaccgttttctcatcaatggaaatctcgatgccatcaacagagaccacgatggtcttctctggcagcacttgatacgccttgactgcctcggccaaaatgctggccatttcctcgctgcccttaatttccctggtcaaagtgtcctcggaacccgttgggacgataccggggaacagctcaccgacggtggacaacaccacgccagtctcgccgagttcaggcaaaacgtgagaaatatactccaaaaatgtcttgttcgggccaatgatcaacacgccagacttagccagctgatcgcgccaggtataaagcagataagccacacggtgcaacgcgaccgcagttttacctgttccagggccaccttgaacaaccatgacaccgcgggtggtatcgcggatgatctcatcctgctcgcgctgaattgtttcaacgatgttgcgcatgtggccgctgcgggcctgttccaacgcctggtgcagcacagattcagagccgacaccaccctgctcgataacatcggccatctcaccggtcaatacctcatcatcaacacccgtgacaacgcgcccacgggtgcgaatgtgccggcggatatgcacgccctccgg

SEQ ID NO: 1517 - DNA, 2349 bp, Corynebacterium glutamicum
ttgatagctcccaagtgttgtatctattccagttcaaacactttttctcactgctccacatcaggaaacaggaggtctcccggagtgaccaccattcggcaatctgattcagaatcagatgtccataacgccctcaccacagcaattagccaagaacaggcttatgttgatgtacttttcggtcgcctcgatgatgaggtagccaggtctaatcagcgtctttctgaggtgatgaaagacgtcgacccctcaaaccctgatccggaagcacttgttcgtcgtgaaactgagtatcacggcctgaatgagaagttggaccggcttaatttggctcaactcgggttggtcttcggtcgaatcgatgtggagtctgaagctgaggacgctgagaacccggtcccgggccaccctgatttggatcgtcgttatatcggtcgcatgggtcttgatgtgcgtgaagataattaccgcacgttgctgttggattggcgctcccccatggcgcgcccgttttatctggccaccaccgtttcaccggagggcgtgcatatccgccggcacattcgcacccgtgggcgcgttgtcacgggtgttgatgatgaggtattgaccggtgagatggccgatgttatcgagcagggtggtgtcggctctgaatctgtgctgcaccaggcgttggaacaggcccgcagcggccacatgcgcaacatcgttgaaacaattcagcgcgagcaggatgagatcatccgcgataccacccgcggtgtcatggttgttcaaggtggccctggaacaggtaaaactgcggtcgcgttgcaccgtgtggcttatctgctttatacctggcgcgatcagctggctaagtctggcgtgttgatcattggcccgaacaagacatttttggagtatatttctcacgttttgcctgaactcggcgagactggcgtggtgttgtccaccgtcggtgagctgttccccggtatcgtcccaacgggttccgaggacactttgaccagggaaattaagggcagcgaggaaatggccagcattttggccgaggcagtcaaggcgtatcaagtgctgccagagaagaccatcgtggtctctgttgatggcatcgagatttccattgatgagaaaacggtggcaaaatcccgcacccgagctcgtcgtgccaggcagtcgcacaattccgcacgcccaattttccgcgagcatttagtcgaacaactcgcgcaccaaatggctcaaacgatcggcgcggatccgctgggcggcaaaaacctgctgtcagccgccgacatcgatcagctgcacgatgatttgcttgacgacgcggccctccagtccgtcatcgacgatttctggccggagctccggcctcaggacgtcctgcatgatctgttgatttccgaagagcgcattaatgttgctgccgcggggtatgacgaggaaactaagtctgctttgctgcgtggtgaactcgatccgtgggcaccatcggacgctgcattgcttgatgagttagccctgctcatcggtcttcccgatccagaggaggcacgggagaaggctgaggccaaatggcgcgagcagatcgatgacgctcaggaagtcctggacgttcttagttcatcacagtcatcggatattgatgatgtcacggaagctgaagttctctccgctttcgacgtcatcgatgcggaaactttggcacaacgccaaactgtcacggataatcgcaccactgcggaacgtgcacaggcggatcataagtgggcgtatggtcacgtgattgtagatgaagctcaggagctcagtccgatggaatggcgcatggtgtttcgccgtagcccttcgcgatggatgacccttgtgggcgatattgctcaaactggttcgcctgccggcgttgacgattgggcagaatcactgtggcccttcgtcgaaaagcgtttcaggcaccacgagctcaccgttaactaccgcaccccggccgagatcatgtcggtggccaatgagcttttgacgcagatcaatcctgatattgcgccggcaatggcgatccgcgaatctggtcgagaggtagtgaacttgccgcttgatgccgatttgtcggcagtgatggatagtttgcgtgaggaggattcacagcgcaccatcgcggtgatttcttcgcgccgccaccacgaaagcgatttctacctggtcgatgacatcaagggcttagagtttgaccacgtcatcgtggtggatcctgcgggaatcgttgaagaatccccccagggattgcaagacctctacgttgcggtcactcgtgcaacgcagagcctcaccattttaggtgag

SEQ ID NO: 1518 - DNA, 912 bp, Corynebacterium glutamicum
atgatccgcaaacttgctcgaccaatgcttgcatcggtctacgtcgcagatggcgcagaaacagtattgaacaccagcgcacacgtcgaaggcactcaggtagttctggatcgtatccgttatgtgctgccccgtaagtacgcaaagcgcatttccagagatccagaattggtcacccgcgtcattggcggcaccaaagtcggtgcgggttctttgctagctattggtcgtgcaccacgcacctctgcagctaccctcgcaatcctgactatccctaacatcctggctcgcaatgcgttctgggaaacccaggatgcggatgaaaagcgtaaccgccgcaacggtttcctcaccaacattgccctgcttggtggcctgtttatcacttctgttgatactgagggcaagcctggcgtgaagtggcgtgcaaccaatgctacaaagcgtggcaagaagcagctgcagcaggcacttccaaccaaatctgagactgaaaagttcggtgagaaggcctctgattggttcaacgatacttctgacaaggtcaccgagtacgcgtacaccgctcaggattttgtcggtgagaacaaggatgactggatcaagtccgcaaccgagactgctcacaaggtcgctgatactgtgagcgattacgctcacaaggctacctcttaccttgaggagaacagcggtgactggcttgaggctgcgcaggctaacgccaagactgctcgtaagtctgcagtgaaggctgccggcaaggctcaggaaaaggctaactttgctcttcaggtcgcagaggaaacctctggtcgcgccaacaagaaggcaactaagagctacgacaagcttcagaagcaggctgataaggccatcgatcgtgcacagaagaagctgaagggcatcgaactt

SEQ ID NO: 1519 - DNA, 600 bp, Corynebacterium glutamicum
atgactaacgagctcactcttcaccatatttccgtgtcccaaatggacaacaattgctaccttttggccgcaaatggcaacggtttactcattgatgctgcagatgacgcagctgcactacttaaattagccgaagatgccggtgtgaccatcaccaaagtgttgaccacccaccgccacgcagaccacgtccgtgcattgccggaggttctccagaagaccggagcaactcactacgcgcctttccttgaggtgccagctttgccctccgctgttgatgtggaactgcatcatggtgattcaattgaatttgagggtcatgtattccctatcagcattctgcgcggccacaccccaggcggtgcagtactcaccgctgagatcgacggtaaaactcaccttttcgtgggtgacagcctcttccccggcggtttgggcaaaaccagcagcgaaggcgacttcgtccgactgttcaacgatgtcaaagagcgcatctttgacacctacgacgatgacagcatcgtgtggccaggtcacggcaaggaaaccacccttggagccgagcgtccacagctggaaatctggtgggagcgtcgctgg

SEQ ID NO: 1520 - DNA, 2847 bp, Corynebacterium glutamicum
ttggctgatcgcctcgtagtgcgcggagcgcgtgaacataacctaaaaggcgtggatattgatttgccacgcgactcgatggtggtgttcaccggcctgtcaggttccggtaaatcatcactggcctttgacaccatctttgcggaaggccagcgccgttacgtggagtcgttgtccagttacgcccgcatgttcttggggcagatggacaagccggacgtggatttgattgatggattatccccagcggtctccattgaccaaaaatccaccaaccgcaaccctcggtccacagtcggtaccatcacggaagtctatgactacctgcgtcttctgtacgcccgcgctggtaccgcacactgcccagtgtgtgatgcccgcgtggagcgtcaaaccccccagcagatggtggaccaaatccttggcatggaggagggactgaagttccaaatccttgcgcctgtggtgcgtacccgtaaaggtgagttcgttgatcttttcgcagatcttgcatcccaaggttattcccgcgtgcgggttgatggggaagtgcaccagctctcggatcctccaaagctagaaaagcagatcaagcacgatattgatgttgtggttgaccgtctgcaggtaaaagccagccaaaagcagcgcctgacagactctatggaaaccgcacttcgcctggccgatggcgtggctgtgctggagttcgttggcctggaggaagatgatccgaataggcttcgtcgattctctgaaaagatgagctgccctaacggtcacgcgttgacggttgatgagctggagcctcgtgctttttccttcaactctccttatggcgcgtgtcctgcctgtgatggcttgggtgtgcgcaccgaagttgatattgatctgatcatcccagatccagatgcacctgcaactaaagcggttcagccctggaactccagcccaaaccactcttactttgaaaagctcattgaaggcctggcgaaagccctcggatttgatccggaaactccgtacagtgagctcaccgcagctcaaaagaaggctctggtctatggatcgaaggaagaagtaagcgttcgatacaagaaccgctacggacgcgtgcgttcttggactgcgccttttgaaggtgtcatgggctactttgatcgcaagttggagcagactgattccgaaacccaaaaagaccgactgttgggctacacccgtgaagtgccctgcccaacctgtaaaggcgcacgcctcaagccggaaatcttggccgttcgcctagactccggaagccatggagcgttgtccattgctggactaaccgcgctgtcggtgcatgaagcattcgagtttttggataacctcacactgggcaagcgcgaggaaatgatcgcgggagctgtgctgaaggaaattcacgcccgcctgaaattcctgcttgacgtgggcctttcctacctcacccttgatcgcgccgcaggcaccctgtctggtggtgaagcgcagcgtatccgcctggctactcaaattggttccggtctggctggtgtgctctacgtcttggatgagccatccattggtctgcaccaacgtgacaaccagcgcttgatcactacccttgagcatctccgagatatcggaaacacgctcattgttgtggaacacgatgaagacaccatcaggcgcgcagattggctcgtggatattggtcctcgagctggtgaatttggtggcgaagtggtctaccaaggtgagccgaagggcattttggactgcgaagaatccctcacaggtgcttacttgtctggtcgtcgaaccctgggtgttcctgatactcgccgtgagatcgacaaagagcgacagctcaaggtggttggtgctagggaaaataacctgcagggcatcgatgtgaaaatcccactgggtgtgctgtgctgcatcactggtgtgtcgggatctggtaaatccacgctggtcaatcagattttggccaaggttctggccaacaaactcaaccgcgcacgccaagtgcctggtcgcgcaaagcgggtggaaggcctcgagcacttggataagttggtccaagtggatcagtcgccaattggtcgtactccacgttcaaacccagcgacgtacacgggtgtgtttgataaagtccgtaacctttttgccgagaccactgaagcgaaggtccgcggttacaagcctggccgcttctccttcaatattaagggtggacgctgcgaagcatgtcagggcgatggcacgctgaagatcgaaatgaacttcctgcccgacgtgtatgttccgtgtgaagtctgtgatggtcagcgctacaaccgcgagaccctcgaggtgaagtacaagggcaaaaacatcgctgaagtattgggcatgccgatctctgaggctgcggacttctttgagcccatcacctcaattcaccgatacctagcaacgctggttgatgtcggccttggctatgtccgtttgggccaggcagcaacaaccttgtctggtggtgaagcccagcgtgtgaaacttgccgctgagctgcagaagcgttccaacggtcgcaccgtttacatcctcgatgagccaactactggtttgcactttgaagatattcgcaaactcatgatggtgatcgaaggcctggtggacaagggtaactccgtgatcatcatcgagcacaacctcgacgtgatcaaggctgccgactggatcgtggacatgggtccagagggcggaagcggcggtggaaccgtggtcgctgaaggaaccccagagcaagttgctgaagttgcgggttcctacaccggccaattccttaaagagttgttg

SEQ ID NO: 1521 - DNA, 306 bp, Corynebacterium glutamicum
atgctcaagggtagtgatcaagcgctggttgtcacgttggtgcagaccaatggatggctcatccaagacgtagagcacaccagccagaccggaaccaatttgagtagccaggcggatacgctgcgcttcaccaccagacagggtgcctgcggcgcgatcaagggtgaggtaggaaaggcccacgtcaagcaggaatttcaggcgggcgtgaatttccttcagcacagctcccgcgatcatttcctcgcgcttgcccagtgtgaggttatccaaaaactcgaatgcttcatgcaccgacagcgcggt

SEQ ID NO: 1522 - DNA, 450 bp, Corynebacterium glutamicum
atggggcgactagccataaaaatgaggagccttcccatgaaagcccctcatcttctcctacaacaactctttaaggaattggccggtgtaggaacccgcaacttcagcaacttgctctggggttccttcagcgaccacggttccaccgccgcttccgccctctggacccatgtccacgatccagtcggcagccttgatcacgtcgaggttgtgctcgatgatgatcacggagttacccttgtccaccaggccttcgatcaccatcatgagtttgcgaatatcttcaaagtgcaaaccagtagttggctcatcgaggatgtaaacggtgcgaccgttggaacgcttctgcagctcagcggcaagtttcacacgctgggcttcaccaccagacaaggttgttgctgcctggcccaaacggacatagccaaggccgacatcaaccagcgttgc

SEQ ID NO: 1523 - DNA, 717 bp, Corynebacterium glutamicum
atggacgcggtgtctgatgagcgcagcgcgaaaattccgagagctgccaccgcacacgctggtatcagggcaagccatggccagtcgactgcaatgaacatgctggtggtgatgaacacgatgagcaccggagaaacagcacccacccacgtggaaacagggttggtttcaaagctgcgccagtattcctccaacgcgatgtcgtggctgtcggtggcggtgatcttaaacggatcccacaatgtcaaggctacgagtaggactgcagtaattgtgccgacgattgttgctggccattccatggtttgccaggatgccgacaaaacaaactgcagaatgaccgcgaatgccgccatgctcgctcggatgatattcgtggagatgcggtacgacagcaacaatgccgcaacaatggagaaaattggccaccaggcatcggcggagagcgcgaagagtatcgcggagaatcctgaaacggcgatggctcccacaaatactgtgtggccttcggccgcggacttctcggttttggataggctccacaatcgaccaacgattaagaacccaatattgcctattaatgccaccagcgagcccaatccaggcggccaccattccaaaatgaagatgattgcactcgttgtggcaagaaacgcaatctgggaggtaaccgtcaacgcaacgagtgcttccacacgggttccgcgcttgcgcaca

SEQ ID NO: 1524 - DNA, 2124 bp, Corynebacterium glutamicum
atggacatgaactcttctgaccgattggctctacgcaccgcgttagagaaattgtcggcatcggctaccgccatggcgtcagcgagcaatgacatcaaagatctcgttgcacgccttgatgcccaagagatgtcgcttatcgacgcaaacccggctcccaccccagcgcccactgccccacccgaggctcagcttgagccccaaccactggtgtatgcaaccgcctcaacggcgcctgcactggcggatgtttccgggaccaaccgtattccacgtttcgttcggcatcgcgccctggatccagcgagcgaaggctggccacttggcgtcgagaagcaaaaagtgcaggctcctgcgtacccgcaccccgtccggccagctcgtccggcaaagccgccgatgacgtcggaggaaaagatcatgcgtggcgtggcgatcggcggtggtgtgatcaccgtggccggcgtgattttgctggtgtcggtggcgattcaacgcggttggcttggtccgctgggtcgtgtgattggtgcgtacctgctggcggtgctgcttcttggcgccgcacattatgtgcgcaagcgcggaacccgtgtggaagcactcgttgcgttgacggttacctcccagattgcgtttcttgccacaacgagtgcaatcatcttcattttggaatggtggccgcctggattgggctcgctggtggcattaataggcaatattgggttcttaatcgttggtcgattgtggagcctatccaaaaccgagaagtccgcggccgaaggccacacagtatttgtgggagccatcgccgtttcaggattctccgcgatactcttcgcgctctccgccgatgcctggtggccaattttctccattgttgcggcattgttgctgtcgtaccgcatctccacgaatatcatccgagcgagcatggcggcattcgcggtcattctgcagtttgttttgtcggcatcctggcaaaccatggaatggccagcaacaatcgtcggcacaattactgcagtcctactcgtagccttgacattgtgggatccgtttaagatcaccgccaccgacagccacgacatcgcgttggaggaatactggcgcagctttgaaaccaaccctgtttccacgtgggtgggtgctgtttctccggtgctcatcgtgttcatcaccaccagcatgttcattgcagtcgactggccatggcttgccctgataccagcgtgtgcggtggcagctctcggaattttcgcgctgcgctcatcagacaccgcgtccattgaaaatcaacgcatgtctcgcctcattgctgttgttggccttgcgttgattgctgaaacttttgtccagctgttctacggcgatctccccaccaacccgcttctcgtcatggtgttcctcatcgccggagctgcactatttatgtggttgcggatgcttccaccgcagcgtcaattaggtgtcgtcccatgggtcgcttggctgattgccgccgtggcgatgaccggcgtgctactgcgcaatgtcgtttcaatttctccactgtggctcaccgatacccaagcgctcatccaagcattgctgatcttggtgttcattgccgccacaatccaagtccgccgcagcttctacggacacaaactgtggctgcaaattttggtcggcttgacgcttctcacgctgtccgcaatttccatcgtgaccatcacaaccttcatcggtcgcctcatcgcaggaaatgccggcatgatgctcggattcctcatcggccacgccacggtttctatcctgtggatggtcatcgccgcagcactgatgcttaataggaagcttctcgacgcgcccggcgccctttggaccggcgttggcttggcggttgcgggcaccttcaagctggtgttctttgacctggtcgcgctgtccggagttccccgcgcaattgccttcctgctctccggtatcgcactgctgacaatcgctgctatgaggggccggagaacctcagaaaacaaggccgacgtagctagacctcaggtggctagacatggggcgactagccataaaaatgaggagccttcccatgaaagcccctcatcttctcctacaacaactctt

SEQ ID NO: 1525 - DNA, 567 bp, Corynebacterium glutamicum
gtggttcggtacgtcaaattttcccgcactgctaacagaggagtccacatcagcgctgaagctcgcattaatgagcgcatccgagttcccgaagtccgccttgtcggacctaacggtgagcaagtaggcatcgtccgtatcgaagatgcccgcaagctcgcattcgacgcagacctagacctggtcgaggtcgcacccaacgccaaacctccagtctgcaagatcatggactacggaaagttcaagtacgaagcggcccaaaaggctcgtgagtcacgcaagaatcagcagcagaccgtggtcaaagagcaaaagcttcgtcccaagatcgatgatcatgattatgagacgaagaagaacaatgtgatccgattccttgaaaagggatcaaaggtcaaagtcacgatcatgttccgtggtcgtgagcaggctcgcccagagcttggctacaggctcctcgagcgactggcaaacgatgtcgtagattttggcatcgtggaaacccgcgcaaagcaggacggacgaaacatgacaatggttctcggtccggtgcgcaagggcaagaaa

SEQ ID NO: 1526 - DNA, 192 bp, Corynebacterium glutamicum
atgaagaacaagacccacaagggcaccgcaaagcgcgttaaggtgactggctccggcaagctcgttcgcgagcaggcaaaccgccgccaccttctcgagggcaagtcatctacccgcactcgtcgcctgaagggcatcgttgaggttgacaaggccgacaccaagcgcatgaagcgcctgctcggcaaggct

SEQ ID NO: 1527 - DNA, 381 bp, Corynebacterium glutamicum
gtggcacgtgtcaagcggtccgttaacgcaaagaagaagcgtcgcgaaattctgaagtccgcaaagggctaccgcggccagcgctcacgcctttaccgtaaggctaaggagcagtggctgcactccatgacttactcttaccgcgatcgtcgcgcccgtaagagcgagttccgtaagctgtggatccagcgtatcaacgctgctgcacgtatgaacggcatcacctacaaccgtctcatccagggccttcgccttgctgagatcgaggtcgaccgcaagatcctcgctgatctcgcagtcaacgactttgcaaccttctccgcaatctgcgaggctgcaaaggctgcacttcctgaggacgttaacgctccaaaggctgct

SEQ ID NO: 1528 - DNA, 822 bp, Corynebacterium glutamicum
gtgagatcgaccatgacattgctcttgaagccaattttgcaggctgcgggaatcaatcctgaagatgcgttagcaatgcgtcatgtatttatttcgatccacgaggacaccaattccaatggtattacccgtgaatctaaagacgaagagattctcgcctacacagctagccagtcaagtgatccgcgtagattcccactgaatccgccacgcttctggatggtgttcatccgagaaggtggctcgcaggctcgactatggaaagtggtggaaaaccacggcgaagtcaccaatgatggcgtacgcagagtcttcaaccttactgagattgaactcatggatgaccttgcaggcagactcgttattcgttggaattcaccacgcaagtggtggattaagggcactactgctgccctatacaccgtggatactattgccgatgcggagcctattccgtttccaggtttcgacaatcttgtcctgagctacccatttcttcaagaagtgatgcgtgaacctgcctatgcttcgtggcgcacagctcttggtgctgtcaaaggtatttacctcattaccgatacccgtactggccgccactatgtcggcaaagctgaaggactagaaaacatacgccaacgctggaacagctacgccaccaatggacatggcggaaacgtaaaactcaaacagcttaagcccgacacatttcgtttttcgttgcttcgggtctttgatcccgcaactccaactagcattattaacgctgctgaaagccactttaaaattgctctcgacacgatcaagcacggattaaacgcaaac

SEQ ID NO: 1529 - DNA, 567 bp, Corynebacterium glutamicum
gtgccaatgatcaatccccgtgtccaccccaggagatatggttccaggagttactgcaccaacccatggggaggaatcatgagagtgaacagggaatttggctgggaagaagtcggcccaagccaagaaggggaacgattcacttttagtgatgaagcagtcagacacatggttgatatcaatgagcgattcaaggcgcttcaagccgagcatcctgttgtccagcggtttctggaacatgactcggaaaaagatcaggttttagatgagatctacaagtcattggcgtcggaggttatctacttttcgtcgcagtctgggttgatgatttcttttgattggatgggctgggaagaagcaaactactggctattttccgaaagatccaataaaggggagtcagtgaacatggagactgtaatggatgtggagactgcgagaaagttgataaccgcattggtccgttctgagtattttggctactacacaccaactggttttcttaaaaacggtaactttttgtttatttttgaccgcttaaccgggatgattgcacgcggtgaacgt

SEQ ID NO: 1530 - DNA, 903 bp, Corynebacterium glutamicum
gtggataagctacgtaaacgtgccaagagatcaaggcggacagaatggtggcttgccgccgcacttcttgccccaaacttgcttctcttggccatctttacgtatcggccactgttagataacttccggttgtcctttttcaactggaacatttcctcgcccacatcaaccttcattgggtttgataactacgttgagttcttcactcgtagtgacactctccaagttgttttaaacaccgtcatcttcacggcatgtgctgtgatcggatcgatggtgctcggtttgctcctggccatgttgttggatcagaagcttttcggccgtaactttgtgcgttccatggtgtttgccccgtttgtgatttccggtgctgccattggtgttgctttccagttcgtttttgaccctaattttggtttggttcaggacttgctgggacgcatcggcgttgattcgccacagttctaccaaaaccctaactgggcattgttcatggtgacgttcactttcgtgtggaagaacttgggctactcctttgttatctacctggctgcattgcaggggctaaacaaggatttgtctgaggccgcagcggtggatggcgcgagcgcgtggacacgtttttggaaggttactcttccgcagcttcgcccaaccacgttcttcctttctattactgtcacgctgaactcggttcaggtcttcgacatcattcacaccatgactcgtggtggccccttgggtaacggtacgaccaccttggtttaccaggtgtacaccgagactttcaccaactatcgcgcgggatatggtgcaacaatcgcaacgattttgttcctgttgctgctgattatcactgttatccaggttcgatacatggataaggagaacaagcagaaa

SEQ ID NO: 1531 - DNA, 834 bp, Corynebacterium glutamicum
atgatctcgactgatagaaacgttttggtcaaaatcatgggctatgtcggcatggttcttgccatcttgttcattggccttccgctggtatttattgtgctgactagcttcaagcagcagtcagagatttacacccagccggtcacgtggttcccttcggaatttaatttcgataactatgcaaatgttttcgagcgggttccgttcctgaactacttccgcaactcgatcatcatcacggttattttgtgtctggtgaagattatcttgggtgtgatctctgcatatgcgttgtcgattttgcgcttcccgggtcgaaaccttgtgttcttgctggttatctccgcgctgatggtgccttccgaagtgactgttatttccaactatgcgttggtcagtcagcttggttggcgcgatacctaccagggcatcatcgttccgctagcgggtattgctttcggaacgttcctcatgcgtaaccacttcatgtctattccttctgagctcattgaagctgcgcgaatggatcactgtggacacttcaggttgctctggaaggttttgcttccaatctctatgcctacgttggtggcgttctccatgatcaccgtggtgaatgaatggaaccaatacctgtggcctttcctgatggcagaaaccgataattcagcaactctgcccattggtttgaccatgcttcaaaacaatgagggtgtctccaactggggacctgtcatggccgcaacgatcatgaccatgttgcctgtgcttgtgatgttcttggcactgcagcagtacatgatcaagggacttatctccggcgccgtcaagggc

SEQ ID NO: 1532 - DNA, 1314 bp, Corynebacterium glutamicum
atggctcagatttctcgtcgtcacttcctggctgcagcaactgttgcaggcgcaggcgcaactttggcagcatgtgcgggtaccggtggaagcacttcttcctccagcgattctggttcagagagtgacaccaacaccatcgtttggtggtctaaccacccagcgaactccaaggacgttgagctggagctgatttcccgcttcgaggctgaaaacccagatctgaaggttcagctggttgatgctggagctaactacgctgaggtttcccagaagttcaatgccgctctttctggcggcgaccttcctgacctcgtggttctttctgacaccgagtggtttaacttcgccatcaacggcgcaaccgtgaacatcgatgaggttgcaaagcgcaacaacatcgacacctccacctacgttgactccctgttcaatgactactcacacgagggtggccactatggtttgcctttcgctcgctccactgtcctcttctactacaacaaggatctgtgggctaaggctggcctggaagatcgtggcccagagtcatgggaagagttctccgagtggggtccaaagctgcaggaagcgatggacagtggtttcgcacacggttggggagatgcaaccaactacctttcttggactttcgaaggcccaatgtggtccctcggcggcaactactctgaaggttgggagtcccgtctgactaccccagagaccatccgtgcagttgagtggctcaagtccaccgttgatgaaggtttcgcaaccgtctccaccgacgtcaccaacgagttcgcaaccggcctgatcggttcatgcatccagtccaccggtgatctgtcttcggttgccggcgctgcaagcttcgactggggcgtagcagcacttcctaacccaaccggcgagggcgcttgcccaaccggtggcgcaggcctgggaatcccatctggcatctctgagcagcgtcaggacaacgccctgaagttcatcgacttcctcaccaacgccgcgaacactggctactggtcccgcgagaccggttatgttccagttcgtaaggatgctgcatctgatccagatcacgcagcattcctcgaggagaaccctgcatacaacgttgcagtggagcagcttcctgatacccgttcccaggacaacttccgcgtgctgctgccaaacggtgaccgcaccatcggtgacgcactggagaagatctgcctgactggtgcagacatcgatgtcaccctggctgaggttgagaccaagctgaacaccatctacacccgcgacatcgaaccacttatt

SEQ ID NO: 1533 - DNA, 1224 bp, Corynebacterium glutamicum
atggcgtcaatcgtctttgaaaacgtcacacgcaaatactctccgggcgcacgcccggccgtcgacaagcttaatttggaaatcgccgacggcgagttcctagttctcgttggaccctcaggctgtggaaagtccacttctttgcgcatgctggctggtcttgagcctatcgacgagggacgtctactcattgatggtaaagacgccacggaactgcgtccgcaggatcgtgacatcgctatggtcttccagagctacgcgctgtacccgaatatgactgttcgggacaacatgggctttgcgctgaagaatcagaaggtggctaaggctgagatcgaaaagcgtgttgctgaagcctcacgcattctgcagctggatccgtatcttgatcgtaagcctgcagctttgtctggtggtcagcgccagcgcgtggccatgggccgtgcaattgtgcgtgagccatcggtgttctgcatggatgagccactgtccaacctagatgcgaagctgcgtgtgtctacgcgtgcggagatctctggtttgcagcgtcgcatgggcgtgaccacggtgtatgtgactcacgatcaggtcgaggccatgaccatgggtgatcgcgtcgctgtgcttttgctcggtgtgctgcagcaagtagacaccccgcagaacctgtacgactacccagcaaatgcgttcgtcgccagcttcattggttccccttccatgaacttgattgagggcaccatccgtggcgataaggtcactttgggtactggaattcagatttcagttcctgatgaggtggcagcagaggttcgcaacaacccggatcgctttgagggtcgtccagtcattgttggtgctcgtcccgagcacatgtatttgaccacggcgaatgagagtggtgctgtattgggcgaagtcagccacattgatgagctcggcgcggattcaatggtctacgtattggcgtctggtgtgaagaacccgaatactgatcttttgggtgagggcattccagaggatatgcgcgtgaccgttgtcggtgctgaagagaccgataaggcccggctgggtattcgtgttgagcgccatcacggtctgaaggccggcgataaggtgcacgttgttgctgcaccgaaggatgttcacctcttcgacggtcttgatggccgtcgaatcggtgcaacggttctagctccagcccatacagtccaggctggtcac

SEQ ID NO: 1534 - DNA, 249 bp, Corynebacterium glutamicum
atgtcacgatcctgcggacgcagttccgtggcgtctttaccatcaatgagtagacgtccctcgtcgataggctcaagaccagccagcatgcgcaaagaagtggactttccacagcctgagggtccaacgagaactaggaactcgccgtcggcgatttccaaattaagcttgtcgacggccgggcgtgcgcccggagagtatttgcgtgtgacgttttcaaagacgattgacgccatgtcacagcctcct

SEQ ID NO: 1535 - DNA, 717 bp, Corynebacterium glutamicum
atgtataagaatatgcacattgttgcccatcgcggtgcggaagatctgcacctcgaaaacaccatgaccgctttccaggctgccgcgcccgctgacgcttttgagctggatatccacgccaccgctgacaatcaggtcatcgttatccacgaccgcaccgcagcgcgtgttgccgcgccagattccctgcaccgcgacaccccggttgcgcgcttaagcgccgcgcaaatcaaggagataacgcttatcgacggatcccccgtaccaaccctggaggaagttctactccagacgagcctgccgatccaagtggaaatcaaatctgccggtgcagttccagcagccgcagcattattgcagaaatacccagagcacctggagcgcctgctgttcatcagtttcatcgatgcagcactggtggaaatcgtggatcgactgccagaagctcgcgtgggaatcttgcgcgatgcgtccatggatgatctgcgcattcttgattacatcccgctaaaaaatgtgggcgcgatcttgccctcgtggaaagcactaaacgtggcgtcaattgctgatctacataccaagggaatcaaggttggctgctggacaattcgggatgaaaatgcgtttgggatcgcacaacaagctggcgttgattacgccactgttagcgatccctctcgtttcctcgcgccctcccctgctggggagttgcactgg

SEQ ID NO: 1536 - DNA, 594 bp, Corynebacterium glutamicum
atgaatgtctacacccacgcgatcacggacaaggccgcgaagcatcttagcgacaccgtcaccaccacgggcatttttgcgctttgcgacgacgtcctgtggtcagtcggcaaggcgatcaccggccagccacgtctagtgagcgtgccggttgagacccgcgagcccggtaatgccggaaccttgattcgcgtatccgacgcggtcggcgccgacgccgtcgtcttcgctggtgaatcagtagatccacttggcgcaaaagctgtgcgctcctcagcgggatcgctgtttcacattccagtggcacgcaacaacaacatcgcagatgtcttggggcagcttcgttccaagggtctgcagatccttgcgacctcagccgatggggaagtagacctcgatgacgccgatgagctgctagccaagccaaccgcatggctttttggtaatgaagctcacggacttgatgagagcctgcttgctcaggctgatcaccgcgtgcgtattccgatccgcggccgcgcagaatcactcaatttggccacagcagcgtcaatttgtctgtacgaatcctccaaggcactattcgccggtgag

SEQ ID NO: 1537 - DNA, 1020 bp, Corynebacterium glutamicum
ttgaccgaagccagtttgaacgaggcggccgacgccgcgatcaaggctttcgacggtgcacaaaacctagatgaactcgcagcactacgccgcgatcacttgggtgatgccgcacctattccgcaggcacgacgctcattgggaactattcctaaagatcagcgcaaggatgcgggccgctttgtcaacatggcacttggtcgcgcagaaaagcactttgctcaggtcaaggttgttttggaagaaaagcgcaacgcagaagtcctagagcttgagcgcgttgacgtcaccgttccaaccacccgcgagcaggttggtgcgctgcaccccatcacgatcctcaacgagcagatcgcagacatcttcgtgggcatgggctgggaaatcgccgagggcccagaggtggaagcagaatacttcaacttcgacgcactgaacttcctgcctgatcacccagctcgtacactgcaggacaccttccacattgcgccggaaggctcccgccaggtgctgcgtacccacacctcaccagttcaggtgcgcaccatgctcaaccgtgaagttccgatctacatcgcatgccctggccgtgtgttccgtaccgacgaactcgatgcaacacacacccctgtgttccaccagatcgaaggccttgcagttgataagggtctgactatggctcacctgcgcggcaccttggatcacctggccaaggaactcttcggcccagagaccaagactcgtatgcgctccaactacttcccattcaccgagccttccgctgaggttgatgtgtggttccctaacaagaagggtggtgcaggctggatcgagtggggtggctgtggcatggtcaacccaaacgtgcttcgtgccgtgggtgttgacccagaggagtacaccggattcgcgttcggcatgggcattgaacgtaccctgcagttccgcaacggcctgagcgatatgcgcgacatggttgagggcgatattcgcttcaccctcccattcggcattcaggca

SEQ ID NO: 1538 - DNA, 2484 bp, Corynebacterium glutamicum
gtgacgggactgctgggccacgcaaacgaaggctggaaggtgccatcgtctgatttggactcaggttatgtccgcgtcggctttgaaaccgaaggctactggccaatccctgaaaccaccggaccactcgttttcggccgcgtggaaaccatcgaagagctcaccgagttcaagaagcccatccgccactgccacgtcaatgttggcgacgccaacggaaccggcgaactgcagtccatcgtttgtggcgcccgcaacttcaaggaaggcgacaccgttgtcgtgtcccttcctggcgctgtgctgcctggcgatttcgcgatctctgctcgtgaaacttacggacgcatgtctgcaggcatgatctgttctgcctctgagctgggtcttgctgataagcagaactccggcatcatcaccctggatccttcttacggcgagcctggcgaagacgcacgtcaagcactgggacttgaagataccgttttcgatgtcaacgtcaccccagaccgcggttacgcactgtctgctcgtggcctgacccgcgaactggcatcggctttcagcctgaccttcaccgaccctgcgatcgagccagctgtagcaggcattgaggtcaaggtcccagcagttgaaggttccttgattaacgtggagctgcgtgaagagaccaaggcaatccgtttcggtctgcgtaaagtctctggcattgatccagcagcagaatccccattctggatgcagcgtgaactcatgctctctggtcagcgaccagtcaacgccgccaccgacgtcaccaactacgtcatgttgctgctcggccagccgatgcatgctttcgacgcagccaaggttactggcgatcttgttgtccgcaacgcaactgcaggcgagaagttcgaaaccctcgatcacgtcaagcgcaccctcaatgaggaagacgttgtgatcaccgatgacaacggcattcagtctttggctggcgttatgggtggtctcacctccgagatctctgacaccaccaccgatgtctacttcgaggccgcaacctgggacaccatcaccgttgcgcgcacctcacgtcgccacaagttgagctccgaagcttctcgacgtttcgagcgtggcgttgaccctgcgatcgtggaaatcgccctcgatatcgcagcaacccttctcgtggagatcgcaggcggcaccgtcgatgcgggtcgcaccctcgttggtgatgtccctgccatgcaacccatcaccatgaaggtcactcgaccttccgagctcgcaggcgtggattattccgcagaaactgtgatcgctcgtctggaagaggtcggatgcaccgtcgctgtttccggcgacaccttggaagtaacccctccaacctggcgcggtgacctcaccatgtccgctgacctcgtggaagaagtactccgcctcgaaggtttggaagcaattccaaccatcatcccaaccgcaccagcaggccgtggactaaccgatgcacagaagcgccgccgcgccgttggccacgctttggcttacgctggctacgccgaaatcatcccaagcccattcatggacccagaggtcttcgatgtatggggactcgcagcagacgacgagcgccgcaagaccgtttccgttctcaacccacttgaggcagaacgcaacgtcctgagcacctccttgctgccctccatgctcgatgctgtcaagcgcaacgttgcacgtggacacaacgatttctccctgttcggcctgcagcaggtcgccttcgagcacggatccggcgtttccccaatgccatctgttgcttcacgccctgaagagtctgtcgtggcagaactggtggattcactgccaaaccagccactgcatgtcgcaaccgtgggcaccggcaacatcgagttcgaaggcccatggggcaagggccgcgcctacaccttcgccgacgcgattgaatccgcgcgcgcagtcgcccgcgctgctggcgtcaccttggagctggccaacgccgacgcgcttccttggcacccaggtcgttgcgccgcattgcttatcgacggtacccccgtcggttacgctggcgaacttcacccacagatcctggaaaaggccggtctaccagcacgcacctgtgcaatggaactggatctcagcgcactgccactggtagaaaacctcccagcgccagtcctgtcctccttcccagcactgcaccaagacatcgccctagttgtggatgagaccatcccggccgaagatgtccgcgcagttgtcgaagccggcgccggcgaactgatcgaaacggtcgagcttttcgacgtctaccgctccgaacagctcggcgagaacaagaaatccctcgcgttctccctgcgtttccgcgcaaccgaccgcaccctcaccgatgaggaagccaacgaagcacgacttcaggcagcagagctagcaaaggagaaattcaacgctgaaatgcgtggc

SEQ ID NO: 1539 - DNA, 771 bp, Corynebacterium glutamicum
atgcatcggctggccgagcagcaacatgacgtagttggtgacgtcggtggcggcgttgactggtcgctgaccagagagcatgagttcacgctgcatccagaatggggattctgctgctggatcaatgccagagactttacgcagaccgaaacggattgccttggtctcttcacgcagctccacgttaatcaaggaaccttcaactgctgggaccttgacctcaatgcctgctacagctggctcgatcgcagggtcggtgaaggtcaggctgaaagccgatgccagttcgcgggtcaggccacgagcagacagtgcgtaaccgcggtctggggtgacgttgacatcgaaaacggtatcttcaagtcccagtgcttgacgtgcgtcttcgccaggctcgccgtaagaaggatccagggtgatgatgccggagttctgcttatcagcaagacccagctcagaggcagaacagatcatgcctgcagacatgcgtccgtaagtttcacgagcagagatcgcgaaatcgccaggcagcacagcgccaggaagggacacgacaacggtgtcgccttccttgaagttgcgggcgccacaaacgatggactgcagttcgccggttccgttggcgtcgccaacattgacgtggcagtggcggatgggcttcttgaactcggtgagctcttcgatggtttccacgcggccgaaaacgagtggtccggtggtttcagggattggccagtagccttcggtttcaaagccgacgcggacataacc

SEQ ID NO: 1540 - DNA, 972 bp, Corynebacterium glutamicum
atggctcagcgaaaactggcctctgtgatcggtgcagcattggcagcatctgctgtactggttggattaatgacacccgcaacagcacaaagtagtggcagctcatcaacagacatcactcgagcactcacctcaagtggtggtgtggctgatagccgtgctcctgaaggtggcgcaaaggtcgttgttttcggtgactcccacacctctggcaccaatgctccattccgtaccgatgagcgtggctgcctcaagggtgcaaacaactgggcagatcagctgcagtctcagctgggacttggcgcgggagacctcattgatgtctcctgctccggtgcatcgatcaactctgatggattccacttctctgatgaagtccgccatgctgaagctcgtggcgcaatcggcccaaacaccaccgatatttttgttcagttgggcaagaatgatcagtggggcctttccaatgtgaaccttctgcagtctgttcagacctgcttgactgatgtgttcgctggttgtggcgatgctgcggttgctgctggcaagatgcaggatccaaatgcagttactgctgaaaactatgcagagcgcatgaagccagtcattgactacttgaagtactacgcaccaaacgcagagatcaccttggttggttaccaggaatacaccgctcgcagcggaagtcaggtatgtgttcgccttggtggaaccccactggtgaaaaatgatgcacctgcgctggtttcgttcatgaacaagttggacatggcgattgatggtgctgctggaatcctcggcgtcagccacgttgatctgcgtagcgcgactgaagggcacgacagctgctccaacgatccttgggtcaacggtgtctttgatgcacgtgcagaaatcgtcggcggtccgtggcacccatctgttaagggagactcggttactgcagggatcctgcgagatcgagtaaacgcc

SEQ ID NO: 1541 - DNA, 1383 bp, Corynebacterium glutamicum
atgacgtcgaaaagcattagcggcaagcgcccgaatctgccgtcgctcactggagcgcggtggctcgcggcgctcgctgtttattttttgcatgcgttggtgtttttgtcggtgtatccgttccagcagtcggaactgtttgccacaatccataaatttgtccccatgcagctgggttcagctggtgtaaccttcttctttatcttgtccggatttttgatctattggtcaaatagccagctcaagggcatgaagaatgtgctgtattactgcaagcgccgcatcaccaagatttatcccatgcacttgattgcgttggcgatgtttattgtggcgtcggcgaagttcacgactacaggcattacctgggtgctggattttgcgcgagtagagctgtggctgccgaatgcgctgctcatccacacgtggaatcctgattgggtgacgctgggtggattgaatgtaccatcgtggtcgctgggcgcggaaatgctgttctacctgacgttcccgctgtttattccgttagtgcgcaaagtgaagggcgtgggcaactggtgggcatttggcatcacctttgccgtgagcctggcgctgattacagtgattcacttttatgcggacggaccaaaggggattgagaacttctttgttcctcgcctgtgggacaccaatgtgtcaccggtcgcggaagttcacgccgatccagtgtggtttatgcaggaagaaattcccgtgctggaatcttactggctgtcttactacttcccgctgaccagactcatcgagttctacctcggtgtgtttggcgcgaagctggttgctgaaggcatgtttaaaaacaccaacatcaccatcccgctgatcgcactggctgtttcttttgttgctacttggtttgtgccactggcattcaagatgtctgtcatcatgtccctgccaatggcttttgttgtggcaacgcttgcggtgagagacattgaaggcaagagtggggaaatcgcctcgcctcgcgcagttttgttgggtaatatttcctttgccttctacatggtgcaattccccgtcatggtgtttgtgcagcgctatttcattgctggcaaagaatacggcttccttggctgggcattctatgcagtggtgtgtttcatcgtgtcggtcattctcgcgtgggtgctgtttaccttcgttgatgatcctttgatgaaggccacggcgcgcaagaaggggagtaggcgcttgaagcagtccaatattttggtccgtgacctgaaagttctcttcggcaaaagccccgaaaagccgttaaaagttgagactcgcgctgagaatctcacagaaaactccgaagctcccgctaaggtagctaccggaatcaaatct

SEQ ID NO: 1542 - DNA, 402 bp, Corynebacterium glutamicum
atggctatttaccgtaagcttgcggcttccgctgcagcactggccctgtccgcatcactggtcgcttgtggcgactctgaggacaccaccgaagaaacctcaaccacctcttcttcgaccacttccagctcctccagcagctctagctccagcaccgcggctacttccgaggaatcttccgcagttgaagagccagcagtggaagctcctgtggaagaggctccagtcgaggcacctgttgagcaggcacctgtcgtggagcaagctccagttgagcaggctccggcaccggttcaggaagcacctgcaccagtcgagcaggctccagctccagttcaggaagcacctgcagctgacgcgccacctgcacttccaggtggtggcggcggacacgctggctac

SEQ ID NO: 1543 - DNA, 1041 bp, Corynebacterium glutamicum
atgacaatcaaggttgcaatcgcaggagccagtggatatgccggcggagaaatccttcgtctccttttaggccatccagcttatgcatctggtgaactagaaatcggagcactcaccgcggcatcaaccgcaggcagcacgctcggtgaattgatgccacacattccgcagttggcggatcgtgttattcaagacaccacagctgaaactctagccggtcatgatgtcgtatttctaggacttccacacggattctctgcagaaattgcacttcagctcggaccagatgtcacagtgattgactgtgcagctgactttcgtctgcaaaatgctgcagattgggagaagttctacggctcagagcaccagggaacatggccttatggcattccagaaatgccaggacaccgcgaggctcttcgtggtgctaagcgtgtagcagtgccaggatgtttcccaaccggtgcaaccttggctcttcttcctgcggttcaagcgggacttatcgagccagatgtttccgtagtgtccatcaccggcgtatcaggtgcaggtaagaaagcatctgttgcactacttggctcggaaaccatgggttcactcaaggcgtacaacacctccggaaagcaccgccacaccccggaaattgcccagaacctcggcgaagtcagcgacaagccagtcaaggtgagcttcaccccagtgcttgcaccgttacctcgcggaattctcaccactgcaaccgcacctttgaaagaaggcgttaccgcagaacaggctcgcgcagtatatgaagagttctatgcacaggaaaccttcgtgcatgttcttccagaaggtgcacagccacaaacccaagcagttcttggctccaacatgtgccacgtgcaggtagaaattgatgaggaagcaggcaaagtccttgttacctccgcaatcgataacctcaccaagggaactgccggcgccgctgttcagtgcatgaacttaagcgttggttttgatgaggcagcaggcctgccacaggtcggcgtcgcacct

SEQ ID NO: 1544 - DNA, 1164 bp, Corynebacterium glutamicum
atggcagaaaaaggcattaccgcgccgaaaggcttcgttgcttctgcaacgaccgcgggtattaaagcttctggcaatcctgacatggcgttggtggttaaccagggtccagagttttccgcagcggccgtgtttacacgtaaccgagttttcgcagcgcctgtgaaggtgagccgagagaacgttgctgatggccagatcagggctgttttgtacaacgctggtaatgctaatgcgtgtaatggtctgcagggtgagaaggatgctcgtgagtctgtttctcatctagctcaaaatttgggcttggaggattccgatattggtgtgtgttccactggtcttattggtgagttgcttccgatggataagctcaatgcaggtattgatcagctgaccgctgagggcgctttgggtgacaatggtgcagctgctgccaaggcgatcatgaccactgacacggtggataaggaaaccgtcgtgtttgctgatggttggactgtcggcggaatgggcaagggcgtgggcatgatggcgccgtctcttgccaccatgctggtctgcttgaccactgatgcatccgttactcaggaaatggctcagatcgcgctggctaatgctacggccgttacgtttgacaccctggatattgatggatcaacctccaccaatgacaccgtgttcctgctggcatctggcgctagcggaatcaccccaactcaggatgaactcaacgatgcggtgtacgcagcttgttctgatatcgcagcgaagcttcaggctgatgcagagggtgtgaccaagcgcgttgctgtgacagtggtgggaaccaccaacaacgagcaggcgattaatgcggctcgcactgttgctcgtgacaatttgttcaagtgcgcaatgtttggatctgatccaaactggggtcgcgtgttggctgcagtcggcatggctgatgctgatatggaaccagagaagatttctgtgttcttcaatggtcaagcagtatgccttgattccactggcgctcctggtgctcgtgaggtggatctttccggcgctgacattgatgtccgaattgatttgggcaccagtggggaaggccaggcaacagttcgaaccactgacctgagcttctcctacgtggagatcaactccgcgtacagctct

SEQ ID NO: 1545 - DNA, 1173 bp, Corynebacterium glutamicum
atgagcacgctggaaacttggccacaggtcattattaatacgtacggcaccccaccagttgagctggtgtccggcaagggcgcaaccgtcactgatgaccagggcaatgtctacatcgacttgctcgcgggcatcgcagtcaacgcgttgggccacgcccacccggcgatcatcgaggcggtcaccaaccagatcggccaacttggtcacgtctcaaacttgttcgcatccaggcccgtcgtcgaggtcgccgaggagctcatcaagcgtttttcgcttgacgacgccaccctcgccgcgcaaacccgggttttcttctgcaactcgggcgccgaagcaaacgaggctgctttcaagattgcacgcttgactggtcgttcccggattctggctgcagttcatggtttccacggccgcaccatgggttccctcgcgctgactggccagccagacaagcgtgaagcgttcctgccaatgccaagcggtgtggagttctacccttacggcgacaccgattacttgcgcaaaatggtagaaaccaacccaacggatgtggctgctatcttcctcgagccaatccagggtgaaacgggcgttgttccagcacctgaaggattcctcaaggcagtgcgcgagctgtgcgatgagtacggcatcttgatgatcaccgatgaagtccagactggcgttggccgtaccggcgatttctttgcacatcagcacgatggcgttgttcccgatgtggtgaccatggccaagggacttggcggcggtcttcccatcggtgcttgtttggccactggccgtgcagctgaattgatgaccccaggcaagcacggcaccactttcggtggcaacccagttgcttgtgcagctgccaaggcagtgctgtctgttgtcgatgacgctttctgcgcagaagttgcccgcaagggcgagctgttcaaggaacttcttgccaaggttgacggcgttgtagacgtccgtggcaggggcttgatgttgggcgtggtgctggagcgcgacgtcgcaaagcaagctgttcttgatggttttaagcacggcgttattttgaatgcaccggcggacaacattatccgtttgaccccgccgctggtgatcaccgacgaagaaatcgcagacgcagtcaaggctattgccgagacaatcgca

SEQ ID NO: 1546 - DNA, 1203 bp, Corynebacterium glutamicum
atgactaaccgcatcgttcttgcatactccggcggtctggacaccactgtggcaattccatacctgaagaagatgattgatggtgaagtcatcgcagtttccctcgacctgggccagggtggagagaacatggacaacgttcgccagcgtgcattggatgccggtgcagctgagtccatcgttgttgatgcaaaggatgagttcgctgaggagtactgcctgccaaccatcaaggcaaacggcatgtacatgaagcagtacccactggtttctgcaatctcccgcccactgatcgtcaagcacctcgttgaggctggcaagcagttcaacggtacccacgttgcacacggctgcactggtaagggcaacgaccaggttcgtttcgaggtcggcttcatggacaccgatccaaacctggagatcattgcacctgctcgtgacttcgcatggacccgcgacaaggctatcgccttcgccgaggagaacaacgttccaatcgagcagtccgtgaagtccccattctccatcgaccagaacgtctggggccgcgctattgagaccggttacctggaagatctgtggaatgctccaaccaaggacatctacgcatacaccgaggatccagctctgggtaacgctccagatgaggtcatcatctccttcgagggtggcaagccagtctccatcgatggccgtccagtctccgtactgcaggctattgaagagctgaaccgtcgtgcaggcgcacagggcgttggccgccttgacatggttgaggaccgtctcgtgggcatcaagtcccgcgaaatctacgaagcaccaggcgcaatcgcactgattaaggctcacgaggctttggaagatgtcaccatcgagcgcgaactggctcgctacaagcgcggcgttgacgcacgttgggctgaggaagtatacgacggcctgtggttcggacctctgaagcgctccctggacgcgttcattgattccacccaggagcacgtcaccggcgatatccgcatggttctgcacgcaggttccatcaccatcaatggtcgtcgttccagccactccctgtacgacttcaacctggctacctacgacaccggcgacaccttcgaccagaccctggctaagggctttgtccagctgcacggtctgtcctccaagatcgctaacaagcgcgatcgcgaagctggcaacaac

SEQ ID NO: 1547 - DNA, 1209 bp, Corynebacterium glutamicum
gtgcagctggacaaagcccttagccagggtctggtcgaaggtgtcgccggtgtcgtaggtagccaggttgaagtcgtacagggagtggctggaacgacgaccattgatggtgatggaacctgcgtgcagaaccatgcggatatcgccggtgacgtgctcctgggtggaatcaatgaacgcgtccagggagcgcttcagaggtccgaaccacaggccgtcgtatacttcctcagcccaacgtgcgtcaacgccgcgcttgtagcgagccagttcgcgctcgatggtgacatcttccaaagcctcgtgagccttaatcagtgcgattgcgcctggtgcttcgtagatttcgcgggacttgatgcccacgagacggtcctcaaccatgtcaaggcggccaacgccctgtgcgcctgcacgacggttcagctcttcaatagcctgcagtacggagactggacggccatcgatggagactggcttgccaccctcgaaggagatgatgacctcatctggagcgttacccagagctggatcctcggtgtatgcgtagatgtccttggttggagcattccacagatcttccaggtaaccggtctcaatagcgcggccccagacgttctggtcgatggagaatggggacttcacggactgctcgattggaacgttgttctcctcggcgaaggcgatagccttgtcgcgggtccatgcgaagtcacgagcaggtgcaatgatctccaggtttggatcggtgtccatgaagccgacctcgaaacgaacctggtcgttgcccttaccagtgcagccgtgtgcaacgtgggtaccgttgaactgcttgccagcctcaacgaggtgcttgacgatcagtgggcgggagattgcagaaaccagtgggtactgcttcatgtacatgccgtttgccttgatggttggcaggcagtactcctcagcgaactcatcctttgcatcaacaacgatggactcagctgcaccggcatccaatgcacgctggcgaacgttgtccatgttctctccaccctggcccaggtcgagggaaactgcgatgacttcaccatcaatcatcttcttcaggtatggaattgccacagtggtgtccagaccgccggagtatgcaagaacgatgcggttagtcatgaggtgtgctccttcattttaagttccttgccagccgtggtggacagcaaggatgtt

SEQ ID NO: 1548 - DNA, 1431 bp, Corynebacterium glutamicum
atggaacagcacggaaccaatgaaggtgcgctgtggggcggccgcttctccggtggaccctccgaggccatgttcgccttgagtgtctccactcatttcgactgggttttggccccttatgatgtgttggcctccaaggcacacgccaaggttttgcaccaagcagatctactttctgatgaagatctagccaccatgctggctgggcttgatcagctgggcaaggatgtcgccgacggaaccttcggtccgctgccttctgatgaggatgtgcacggcgcgatggaacgcggtctgattgaccgcgttggtcctgaggtgggcggccgtctgcgcgctggtcgttcccgcaacgaccaggtggcaaccctgttccgcatgtgggtccgcgacgcagtgcgcgacatcgcgctgggaacaaccgagcttgtcgacgccctcagcgcccaagctaaggcacatgcaggcgcgatcatgccaggcaagacccacttccaggcagctcagccggtccttctggcacaccagctgctggcacacgcacagcctttgctgcgcgatattgatcgtatccgtgacctggacaagcgtcttgcggtgtctccttacggttccggcgcacttgctggttcctctttgaagctcaaccctgaagcaatcgctgaagaactcggctttgattccgcagcagataactccattgatgccaccagctcccgcgatttcgcatctgaaaccgccttcgtgctggcgcagcttgcagtggatatgtcccgcttggctgaagaaatcatcgcatggtgcaccccagaatttggttacatcaccttgtctgattcctggtccacaggcagctcaatcatgccgcagaagaagaaccctgacgtggcagagctgacccgtggcaagtctggtcgcttgatcggtaacctcaccggtctgctggctaccctgaaggcacagcctttagcgtacaaccgcgacctgcaggaagataaggaaccaatcgtagattccgtggcgcagctcaacctgctgctccctgcaatgactggtttggtttccaccttgaccttcaacaccgagcgcatgcgtgaacttgcaccagcaggtttcacccttgccaccgacttggctgagtggatggtgcgccagggcgttccattccgtgaggcacacgaagcatccggcgcttgcgtgcggatcgcggagtccaggggagtggaccttatcgatctcactgatgaagaactcagtggcgttgatgcacgtctgaccccagaggtacgggaagtgctcaccattgatggtgcagtggcttcccgtgcaacgcgcggtggaaccgcgggcgtgcgggttgcggagcaacgcgcacgtgtcgatgccgcaagtaccgctcacgcggagtgggcacgtgcgggggtacgtcga

SEQ ID NO: 1549 - DNA, 1143 bp, Corynebacterium glutamicum
atgaatggttcccctgattactcaagaaaatctcgaggcaggggattttccgtatttttaggcatcatcctgctggtcatcgcggtattagcggtcttggtgggccgcggaaccatcgccatgccaaagctcttcggatcaagtaacttgaccgaggtcagagcagtaattggctcggaaaagaaggaattcttcgaagatccagaagtcgttgaagccttcgccgaccacggctttgaagttaacgtggacaccgcaggatctcgtcggatcgccactgatgtggacttgagcccgtacgatttcgcgttcccatcctctgcaccagctgcgcagaagatctccgaagccaacaccacgacgggccgattcaccccattctattcgcctatggcggtagcaacattcggaaccatcaccgacatgttggaaaccaaggggatcgtgagcaatgtaggcggcaccgacaccatcgatttgggcgcgttgttgaatgaaacccaagccggaacccgctggagcgaacttagccccaactatcagtccaaccgcgtcgtgcagatttctaccaccgatgtgcgcacctctaactcggcggccatgtacctatcaatgatgtcctgggtgaaaaatggcggaaaaacggtgagcagcactgcggaagccgatgccatcatcccagagcttagccaactgttcgtgggccagggctataccgaaagcacctccgccggcccgtttgatgaatacctctcccaaggaatgggttctaaaccaatggtgatgatctacgaagcccagttcctcgcggaacaaaacaaggaaaactcacggatttccggcgatatggaactagtgtatccaagccccaccgtgtacagcacgcatacggtggttagcttgagtgacgtcggcgcggagatcggcgaactcctagaaaccgacgaaaccctgcagcagttggcagtcaaacacggttttaggccaaagaactccgcaatgatcgccgatgctggcatgaccgaccgcatgcccaacaacctcaatgtcattgatccgccggactatgacttcctagaacgactcattgatggcgtgggcgcatcgtacagtgccaccccagcagaagaggacacagatcta

SEQ ID NO: 1550 - DNA, 1575 bp, Corynebacterium glutamicum
atgaaaaatcttgtaaaaggtacagcgctgggcttgagcttggtgcttctggcaggttgttcaactgtttcggattctatcgatagcctcggcgggggcctgggtggttcctctgagactttgaagattgtggccgccacagagctggaagatctgcagcccgcgatcgagcaagcctccgacgacttgggttttgatattgaactgagctttccaggcggcacactcagcaacagccaagccctcatggatggcgcttttgaccaggactatgatgccacctggtttgccaccaaccgttacgtcgatctgatcggcgcttccaacaagctgggggagaccaccaaaatcgcgacctctcccgtggcgttcggtgtgaaaacttccatggcccaggagctcggctgggatcagcgccagccaacctgggaagagctgggccaggcctcgcagacccaagatttcaccttcggtatgaccgatccggccacttccaactccggattttccgcgctcgttgccatggccacggcatatgctgataccggccaggccttaacaaccaacgacatccccgcgatcgccgagccgatgtccacatccctttccggccaaaccatcacctccggttcctctggctggctcaaagacactttcctggaacagcctgaccgcgcgaatgcgatcatcaactacgagtccgtcctgcacaccatgatcagcgaagacggcgccgatatcaccgtcgtggtgcccgccgatggcgtggtcagcgccgattacccgctctctacgatcacgggctccgaccagggcgagcatgtagcagagctggccggctggttcgctgagcaccccgacgctttaacagatacttatcgacgtccgaccaccgcgaacgcaacgctcccagcggagcttagctcgcagaccatcatcgaagctcccttcccagggagcaagacggtcaccgacgcgcttatcgacgcctacaccaatcaattccgcgtcccaggcgaaaccacctttgtgctcgacgtttccggatccatgctgggccagcgcatcaccttgctcaaagacaccatgtcagacctgatcagcggcggcgcgaccactgaccttgccaacgtgtccctgcgcgaccgcgaaaaagtatcgatcattcctttcagcttcgggccacacgaagtaatcagcgaaaccctcggtgcggtgggcagcccaagccgcaccgatctgcagcagcgcgttgaagccttgcaagcagacggcggaaccggaatttacgacgcagtgctcgccgcctacgcagagtccgctggtggcgactacatcccatccatcgtgctcatgaccgacggcgaactcaccgcaggacgaacctacgatcaattcctcaccgaatggaacgcgcttcctagcaatatccgatcaattccagtgtttgtcatcctttacggtgaagccaatgttgcggatatggaacaattggcagcaacaaccggcggtgagacctttgacgccatcaacggtgacctagacgaagcatttaaggagattcgtgcctaccaa

SEQ ID NO: 1551 - DNA, 612 bp, Corynebacterium glutamicum
gtgcctaccaataatggaggatccttctttttctcccgcaagaatctcgcgggtatcgctattgcaacgctgattatcgcgctgcacttagtgatcggactcggagcattttggcctgttgtcgccatcgccggatacggcgctgcggtggcacttacacctaaaaaccctccgaagaaggaactccctccggttcaggcaactcccgaattagatagcccgggtctgcttgcagccaggtctcaagaactcgtgagaactatgtatagccacggtgctgcagcaccagtgatcgaagcgattaagaggctagacagctcactgcaattggtcattggtaactggacaagcctgaccaattttcccgagcaccaagtcaccattcgctcaattatcaaccagtacatcccaggcattatcgacgcttacctgaagatccccacccgcaacgatcctcgggcagtcgaagacctcattgaatccttcgacctcctgaactccgagacgatgaagatcttcaatgcgatccaagaacaaggccttaataaccttgaagatcacggtcgcgcactgcgcatgcaatttggtcaactgccagaagaattccgggaa

SEQ ID NO: 1552 - DNA, 177 bp, Corynebacterium glutamicum
atgagtcttgatccacagcttcttgaagtcctggcctgcccaaaggacaagggcccacttcgatatctggagagcgaacagctcttggtcaacgaacgcctcaacctggcctatcgcattgacgacggaattccggtgcttctcatcgacgaagccaccgagtggacccccaacaac

SEQ ID NO: 1553 - DNA, 1260 bp, Corynebacterium glutamicum
atgaacatcattgacgaactctcctggcgcggactcatcaaccagtccaccgaccttgaggcccttcgcgaggaagcttcaacccccatcaccttgtactgcggattcgacccaaccggtccatccctccacgcaggacacctcgttccactgctcatgctgcgccgtttccagcaagcaggacacaacccaatcgtgctcgcaggtggcgcaaccggcatgatcggcgacccccgcgatgtcggcgagcgcaccatgaactccgcagacaccgtctctgattgggcagaacgcatctccggtcagctcagccgcttcgttgatttcgacggcgagcacgcagcccgtctggtcaacaacgccgagtggaccaacgaaatgtccgtagtgaccttcctccgtgatgtaggaaagcacttctccctcaacaccatgctcgcccgcgacaccgtcaagcgtcgcctcgagtccgacggcatttcctacaccgagttctcctacatgctgctacaggccaacgactacgttgaactgaacaagcgcttcggctgcaccctgcaggtaggtggcggtgaccagtggggcaacatcgtttctggcgttgacctcaaccgtcgcgtcaacggcacctctgtccacgcagtgaccgtacctttggttaccgattccgacggcaagaagttcggcaagtccaccggcggcggaagcctctggttggatccggaaatgaccagcccatacgcttggtaccagtacttcatcaacgcatccgacgctgacgtgatccgttacctccgctggttcaccttcctcacccaggaagaacttgctgagttggaagttgaagttgcagagcgcccattcaagcgcgaagcacagcgtcgtcttgcacgcgaaatgaccaacttggttcacggaaccgaagcaaccgaagcagtcgagcttgctgctcaagcactgttcggccgcgcagaactccgcgacctagacgaaaaaactctcgctgcatccgtttctgaaactgcagttgcagaaatcaaggcaggggagccacgcaccatcatagatctgctcgtggccagcggacttgctgattccaagggcgcagcaaagcgtgcagtcaaggaaggcggtgcgtacgtaaacaacgaacgcatcgaatcggatgattgggagcctttcgctgaagatcttcttcacggttcatggctagtactgcgccgtggcaagaagaacttcgcaggagttcagatcctcggc

SEQ ID NO: 1554 - DNA, 465 bp, Corynebacterium glutamicum
atgaagacaatcattactggcgttgattcaagccagactgcgcttgccgcagcagagaaggctgccgagctcgcggccagctttgacgcagaactttacgtattttctgcgtacagcatcagctctgttgtagcgatgcagaccgctaagagcggaaacatggcagttaagacttccgatgcttaccagcgtctggccgatggtcaggctgcagctgctcaggaagctgcagaatctgtggctgctattttgcgcaactcttggccaacactccaggtcaaggcgattgctgttgagggacagcctgctgaagttttggttcagcaggcggagcacctcaatgctgatgcaattgttgtggggaacaagaaggcccagggcttgcaacgcattctcggaagcatctcccgtaatgtcgcggcagcagctaactgcgatctctacatcgtgaacaccacgagggat

SEQ ID NO: 1555 - DNA, 390 bp, Corynebacterium glutamicum
ttgatgtgctttcccttccgtgtagaagttcctgcgctgtcctggcgactcgaattaatctacacagcccctcacgcaagaacaaacctgcaggttaaacacgatttcaacgcagacccctgcacgcgcatgatcatgagacagcaaaagtcggccaaatttagattgaacatgccccaaagatttcgaatcctactcatccaggcgtcgacagcgttatgccgatgcaatcatttaaatgatcatatcaatcgcccatatgcgctcaaaagatatgggatgatcaataccaaggttggaatccgtcccatcattactgggatatacgcgtcgccaacccccaaaaaagaggcttccagtcaaacgctcgagaaactagaagtattcttc

SEQ ID NO: 1556 - DNA, 141 bp, Corynebacterium glutamicum; identical to SEQ ID NO: 86

SEQ ID NO: 1557 - DNA, 273 bp, Corynebacterium glutamicum; identical to SEQ ID NO: 87

SEQ ID NO: 1558 - DNA, 1353 bp, Corynebacterium glutamicum
ttgtcgttctataataaagtctttacccggttctcaacatcaaggaacaacatggctgataacttcgaccgctctcgtgacaacgatcgctcaagcgaccgcactcctcgtggagaccgcggcgatcgcggtggctaccgaaactcccgcggcaacgatgaccgcggaaactaccgtcaaaaccgagatggtgaatcacgagatcgcggcggataccgcggtgaccgtcgcgacaaccgctcaggtgaatatcgtcaacgtgacgataggcgtgacgatcgtagggacaaccgaagcgatgaccgccgcggtggttaccgctccgatcgcaactttgacgatcgcaacagcaacatgcgtgatgatcgtcgcggcggcgaccgttcatacagccgtaatgatcgctccgatcgtggctatcgtagcaatgaccgctacgaccgtaatgatcgtcgcgatgacaacagggacaccaggggtggcgatcgcggagaccgtcgctacgacaggcgcgatgaccgacgtgatgatcgtcgcgatgatcgtcgtggcggacagggccaggggcgtccaggtggagatcgtcgacatgcgaaccgtgcaggtgcaggtcgcgatcagcagcgtgattcgctgcatccacagcgcgctggtttccgtgaagagcgcttgaacactcgtctcaatgagcctgatttgccgggcgatattgatatcaaggacttggatcctttggtcctgcaggatttgaaggttttgtctaaggacaacgcagatgccgtcgcaaagcatatgatcatggctgcgacctggctggccgacgatcctcaattggcactgcgccacgcccgtgctgcgaaggatcgcgcgggacgcgtgtccgtcgtgcgtgagacgaacggcattgctgcttaccatgctggtgagtggaaggaagctctttcggagcttcgtgctgcgcgccgcatgtcgggtggtcctggtttgattgctgtgatggctgactgtgagcgtggcttgggtcgtcctgagaaggcgattgagctggctcgagaagaggatttgagctctttggatcaggataacctgatcgagttagcgattgttgttgctggagcacgccatgatttgggtcagcatgactctgcgattgtggaattgcagaaggttaatccaagcttgaagagcaccggtttcacccattctcgtttgtcttacgcttacgccgatgcgcttgttttggctggtcgtggcgatgaagcacgtgagtggttccagcacgctgccaccttggatgaggacggctacctcgatgcagaggagcgtatcgagcagctcgataatgggaacaac

SEQ ID NO: 1559 - DNA, 984 bp, Corynebacterium glutamicum
atgagtgtaatcacggaatatgacagccttcttcttgatctagatggaaccgtctacgagggcggccgagccattgagcacgtagtttctgcgctctctggcgccggcctacccgtcatgtatgtcaccaataatgcctcccgtgctccggaggtggtggctgcgcaactccgtgagattggccttgccgacaccactgcggacaatgtgatgacatctgctcaagctgcctgcaagatggcggcggagaagattcccgctggatccaaggtgtatgttttgggttcagaatccttccgcgagctagctactgaagctggttttgtggtggttgattcggctgatgataaacctgtggctgtgcttcacggccacaaccctgagaccggttgggctcagttgagcgaggctgcgctgtcaattaatgctggcgcgcagtattttgcatcaaatttggattccacccttcccatggaacgcggtcgtcacattggcaacggttccatggtggctgccgtggtcaacgcgactggcgtaaagcctctttccgcaggtaagccaggccccgcgatgttctatgcgggggctaaaactcttaattcttcaaagcctttggctgtcggcgatcgtctcgatactgatattgcaggcggaaacgctgcaggcatggacacattccaggtcctgaccggcgtcagcggctactacgatttggtgcgcgccattccagagcagcgccccacctatatcgccacctcgatgcaggatctctacagcgatccgggcgagctcaagccaggtgcccagggcggtttttcagcgcttatcgacggcgacaccctggtcatttccggcggcgatgccggcgcaactccggttgcagcactccgcactgcgttggatgtggcctgggcggccacagagccagtcaccgaggtacgcgctgattcagaggtagctgctactgcattgcagagctggtgg

SEQ ID NO: 1560 - DNA, 162 bp, Corynebacterium glutamicum
gtgaattcaccaaagcctcatgatcctcgtgcagctcatgtgaccaacccggaagaaattgcgggaaaagtcaatgaggttttaagccgcgaagcagagacactgcgagatgaagccctcaaccttgaggaagcccaccgcatcctcaacgacgcattgtct

SEQ ID NO: 1561 - DNA, 819 bp, Corynebacterium glutamicum
atggttgcacgcagaagactggacgcagaacttgttcgtcgaaagatcgcacgatcaagggaacacgcggttgaaatgatccgcggtcggcgcgtctttgttgcaggaatgcttgctttaaagcccgcaacagtcgtggaaccagaggtgtctattcgtgtggaagaagatgctagtgaagattgggcatcccgcggtgcgcacaagcttcttggtgcgctggaatcttttgagcccttggggctcaaggtcaagggccgtcgcgtgctagatgccggcgcttcgacaggcggatttacggacgtgttgctacgtcgagaagcgtctgaagtagtggcagtagacgtgggctacggacagcttatttggcgcctgcaaaacgacgaccgcgtgcgcgtggtggaccgcaccaacatcagatacatgacgctggaagacaccggcggagaatgcgacatgatggtgggcgatctctcatttatttcgcttaaactcacgttgccggcgatcgccaaggtcctaagcgacggcgctgatctattacccatggtcaagccacaatttgaagtcggaaaagaccgattgggcagtggcggcgtggtgcgctcaccagagttgcgcgcagaagttaccgcggatgtcgcgaaatttgcggccactttgggcctgagcttgaagcatgttgttgcatccccgctgcccggcccgtcaggcaacgtagaatacttcctgtggctggttaaagatggtggcgcttcaatgccggatgaccagcaattgtcggcaatgattgacacggctgtaaaggaaggtccgcaa

SEQ ID NO: 1562 - DNA, 873 bp, Corynebacterium glutamicum
ttggcagccaagctgctcgacgatgctggaatcgatgtgagggtgctgatcaatgatgcagatgatccaattgcagagcactccgttttaggccgtttcacccatgtcaggcacgctgcagacgccgctgacggcgcagaactagttctggtgctgggtggagatggcaccttcctccgcgcagcagatatggcccacgctgttgatttgcctgttctgggcatcaacctaggccatgtgggattcttggctgaatgggagtctgactcacttgaagaggcactcaaacgtgtgatcgaccgcgattaccgtattgaagatcgcatgaccttaactgtcgttgtcctagacggcggtggagaagaaatcggccgaggctgggctctcaatgaggtcagtattgaaaacttaaaccgcaggggagtgctcgatgcaaccctcgaggtagatgcacgaccagttgcttcctttggttgcgatggcgtgctgatttccaccccaaccggctccaccgcttatgcattttccgccggtggtcctgtactgtggccagaactcgatgccatcttggtggttcctaataacgcccacgcgctgtttaccaaaccgctggttgtgagcccaaaatccaccgtagctgtggaatccaattcagatacttcagcagcgatggccgtcatggatggtttccgtcccattcctatgcctccaggatcccgtgttgaggtcaccaggggtgagcgtcccgtgcgttgggtgaggcttgattcttcaccgtttaccgaccgacttgtgagcaaattaaggctccccgttaccggttggcggggtccgcaaaaacaggcggaaaataaagatcccaggtcagcgggg

SEQ ID NO: 1563 - DNA, 1779 bp, Corynebacterium glutamicum
atgctcgtagacattgctattgagaacctcggagttattccagcggcctcagctgagttcagctcaggtttaacagtgctcaccggtgagaccggcgccggaaagaccatggtagtgacaggtttacgcctgttatccggcggtcgcgccgacgcttcacgcgtgcgcacaggatcccctcaagctgttgtggaggggcgctttgttacgcaaggcgtgccctgcgacattgtcgaacgtgcaaccggaatcgtttcgaacgccggaggtgccgcagatgaaaatggagagtttttagctgtccgttccgtcggcgccaacggccgttcaaaagctcatctcggtggtcgctccgtacctgcggcaacgctgtccgagttctctgatgagctgttgaccatccacggtcaaaatgaccaactccggttgctctccccagaacgccaactagaggcgcttgatcgttttgatccagagctggcccaactgcgcaaaaactacaacgccaagtacctcacttggaagtccttggataaagatctgcagaagcgcctgagtagtaggcgagagctggctcaagaagtcgatcgcctgcaattcgcgattaatgagatcgaggaagtctcgccacagccaggcgaagacgccgaactggttgagcagatccgcaggctccaggacgtggacaccctgcgggagcaagctgcaaccgcattggctgcgattgatggtgccggctctctcagcgacgccatgggtggttccggcggctttgatgaatcccaggagtcagcctctgaccagctcggccaggcggagtccgcgctggcaggcagtgatgactcaaagctgaaagatattgccgttcagcttgcggaaatcaccagccagctcagccaagtgtccatggaattgggcgggttcctctctgatctccccgcagacccccaagcactcgatgacatgctcacccgccaacagcaattgaaactgctcacgcgtaaatacgctgcagatattgacggcgtgattgagtggcagcggaaagcccaaatccgcctagacagcattgacatttcctccgaagcgcttgacaagctgaaagaagacgcgaaaaaggcgcaggcctccatgatgcgtgccgctaagaagctttcagctgtccgtgcaaaggcagcaaccaagttggggacaactgtcaccgaggagcttcagggcctggccatgcaaaaagcccgctttgaggttgctttgacctccattgaggcgtgcgccagcggtatcgaccaggtggaattccagctcgcagcaaatgcctttgcacagcctcgtccacttgcatcctctgcgtctggtggtgaactttcccgcgttatgttggcgctcgaggtgatcttggctgctggaaccacgggcaccaccttggtgttcgacgaggttgatgcaggtgtgggcggacgcgcagcggtggaaatcggtcgccgcctggcccgccttgccaccaaaaaccaagtcatcgtggtcacccatctcccacaggtcgctgcttacgccgacacgcacctgcacgttgccaagaatgtaggagaagcctccgtgacctcaggagtggagtcactgaccttcgaccgacgcgtggaagagctctcccgcatgctcgctggcctcgacgacaccgccaccggccgagcccacgcaacggagctgctcgagcgtgcacagcgtgaaaaggaagatattaacgaggagcgagtagaaccacttctcgccgccagtgca

SEQ ID NO: 1564 - DNA, 1191 bp, Corynebacterium glutamicum
atgggctgcatgagtctgttcaaccgcaaagccgacctgcccggcctgcaaggtgccacccgaatctgcaccccgcagggcaaagggctaaagcgcctgtccgaaggcgatctcgcaatcattgatgcaccagatctatccaggaccttcgcccaacgattgctagcagcaaaacccgccgcagtcctcaacgtttcccggttcaccaccggatcggtgcccaactttggaccgcaaatgcttatcgacggcggcatccagctcgtggaaggctttggccaggagctgctcgacggcaccaaagacggtaagaaaggtcgcctgacagaagatggacagctcttctacggcgaacgactgatctctaacggcagtgttctcagtggacctgcggctgaaaatgcatttgcagacgcccagcaatcactgctggaccgcatggaagcctatttcggcaacaccattcagttcattcactcagaagcaccgctcctgatcgatggcctcggcattcccgataccggaaatgccattgaaggccgcaaagttctcattgcctcaccaggggataaccaccgcagcaggctcaaagaactccgcagcttcatccgcgaatacgatccagtactcatcggtgtcgatggggcagcagacaccttggtggaattggggtacaagcccgcgctgatcgtcggcaatcccactggtatcggcgcagatgcgctgcgcagtggcgccaacgtaattttgccagctgatccagacggccacgctgttggtctggagcgcatccaggatcttggcatcggtgcgatgaccttcccatcctcagtaaattcctccacggatctggcgctcctgcttgcggatttccacaacccgcagatgatcgtcaacgtcggcggtcctgtcacccttgatggtgtttttgaaaaccgcgaagattccgatcccgcggcgcttttgacgcgcgccaagctaggcaccaagcttgtcgacggatccgtcatcgcaagtctttacacagtgcgcagctccagcaaccttggatggatgtgggcactgttagccattttggtggttcttgcagtcgtgattgttatcgctggcaccgcaggatcaggctcttttaccgacaacctcattgacacctggaacagcttcgcgctgacagtccagggttggttcaaa

SEQ ID NO: 1565 - DNA, 963 bp, Corynebacterium glutamicum
atggctaaacgacgtggaagaggcgccgcaaccttcgccgcactgggatttggtgcagcagccggcattgcctttggaacttatgtgcttgcacccaaccttcctgaaaacattgacccaaatgcaccaacatcagctgaattagtcgaggcagagaccttggctgaggttaatgcggtgcaggccgatcaagcagacagcatcattgaccacatcgtggaagacgtggtggctggcacactgaccgatcgccccgtactggtgatgcgcaccgctgacgctgaagaatcagacgttgccgatgtgtcatggctgttgcagcaagcaggagctattaatgctggatccattacacttgaggagaatttcttctcccaagacggcgcggaccagctgaaatcaatcgtggcaaatacgttgcctgcaggcgctcagctttctgaaacccaactggatccaggaactcacgctggcgaggcacttggtgccgctttgctgctcaaccctgaaactggtgaaccactagccagcactgcagagcgcggactattgctcaacgtgctgcgcgacaacggttacatctcgtacgaagacggcaccattttgccaggccaggtcatcgtgatgattactggcgatagcgacggctcaggtgatggtgccttcgctgcagaaacacaatcgctgtttgctcgcgcacttgacgcccaaggatcaggcgtggtggttgcaggacgtattcacactgctgctgatactggagttattggacggcttcgtgccaaccctgatgctgcagaaaacgtctctacaattgattccgtgaatcgtacttggggcaagatggctaccgtgctatcagttcgtgaggaactagccggtaggtctggagcgtttggttccgctgcctccgcagacgcggcaagtccgtctctcgatggaactgcagcagcgccagcgcag

SEQ ID NO: 1566 - DNA, 1662 bp, Corynebacterium glutamicum
atgacctctagtcgaaaagtccgtcccaccaaacacattttcgtcaccggtggagttgtttcctcactcggcaaaggcctgaccgcagcaagccttggtcaattgctgattgcacggggactgtcggtgaccatgcagaagctggatccatacctcaatgttgatccgggcaccatgaatccttttgaacacggtgaagtctttgtcaccgaagacggggcagaaacagacctggatttgggccactacgagcgtttcctcgatcgcaacctggggctcaacgccaatgtcaccaccggcaaggtgtattccactgtgatcgccaaggagcgcaggggagagtacctgggtaaaactgtgcaggtcatcccacacatcactgatgagatcaaagctcgtattttgagcatgggcgaaccagatgctcatggtaacgccccagacgtggtgatctctgaggtcggtggcaccgtcggtgacattgaatcccagccattccttgaagcagctcgccaggtacgccatgaaattggtcgtgaaaactgcttcttcatccactgttctttggtgccatacttggctacctcaggtgagctgaagaccaaacccacccagcattctgtcgcagagctgcgcggcatcggtattttgccggatgctctcgtgcttcgttgcgatcgggaggtccctcaaggtctgaaagataagatcgcgatgatgtgcgatgttgattatgaaggcgttgtatcttgccctgattccagttctatttacaacattccagatgtcctctaccgcgagcacctggacaccttcattattcgtcgcctgggccttccgttccgtgatgttgactggagcacctggcacgatctgctggaacgggtgaacaacccacgccatgagctcaccgtcggcatcgtgggcaagtacattgatcttcccgatgcttatctctcagtggtggaagctgttcgcgctgcaggctacgccaattggacgcgcaccaatatcaagtggattacctcagatgattgcgaaaccccatctggcgccatgaaagcgctcagcggtttggatgccatcgtggttcccggaggtttcggtatccgaggtatcgaaggcaaaatcggtgcgattacgtttgcacgtgagcacaagatcccgcttcttggcctatgccttggcctgcagtgcaccgtcatcgaggcagcacgccaggcaggactggagcaggcatcatccactgagtttgacccagctgcaacgcagccagtgatcgccaccatggaagagcagaaagctgctgtgtcgggtgaagctgatctgggtggcaccatgcgtcttggcgcatatcctgcaaccctggaggaaggctccttagtagcggaactgtatggcacaacggaagtctccgagcgccaccgtcaccgctatgaggtcaataatgcctaccgcgcccagattgctgaaggttcagatttggtcttctccggaacctcacctgatggacatttggtggagttcgtggagtaccccaaagaggtgcatccttatctggtggcaacccaggcgcaccctgagtacaaatctcgtccaacccatgctcatccactgttttacggcctggtgaagaccgctttggagctgcgtgtccaccct

SEQ ID NO: 1567 - DNA, 657 bp, Corynebacterium glutamicum
atgcacattcccggtacccatgagttcacggtgacagatactgaactgttgttagagtccccaattttgggcgttcgtcgagattcattgatcatgccgggtggttccactgcccgccgtgaagtggttgaacactttggggcggtcgcagtggttgcctttgatggtgaaaacattgcgatggtcaagcagtaccgtcgcagcgtgggggattccttgtgggagctgcctgcaggtttgttggatattgctgatgaggatgaactcacgggcgcgcagcgcgagctcatggaggaggctggtttggaggccagtgagtggtccgtgctcactgatttgattacctcgcctggtttctgcgatgaagcggtgcgtgtctttctagcccgaggcctcacaaaggttgagcgcccgaaggttatgggcgatgaagaagcggacatgattaaccagtgggttccgctacatgaggcagtgggaatggtgtttagtggccagttggttaactccattgccattgcgggtgtcatggctgctgatgctgtgattgcgggtcgtgcgtctgcgcgtgccgtcaccgcgccgtttacctatcgccctacggcgttggcgcagcgtcgaaaagcgcacggcattgttcctgacatgaaaaaacta

SEQ ID NO: 1568 - DNA, 912 bp, Corynebacterium glutamicum
atgaaggctcgcgttttagcgaaaacatggctgacacatttggccgtggagcgtggcttgtcggcaaatacgctgagtaattatcggcgcgatgtggaacgctattgcgactggctcgaggcagctgggctggatgatattcgtgatatcaccaccgcgcatgtggaaagttatgtcaaagacctgcgccgcgggattgatggacaacaagcgttgtctgcgtcctcggcaggtcgcgcgctcatcgtcgcgcgcgggttgcacaagtttgcattgatggagggcgaggtggctgcggacgttgcggctgatgtgtcgccaccggccatgggccggcatttacctgacacgctcagcatcaacgaggtagccctgcttatcgacgcgatcccacattcagatatcgccactcccgttgatctccgtgaccgagcgctggtggaattactttatggaactggcgcgcgtatctctgaggcgattgggctggcagttgatgatgtgtcggaaatgcctgaagttcttcgcatcacgggcaaaggttccaaacaacggatcgtgccttttggttcgatggcacaacaagcggtccgggaatatttggtcagagccagacccgcgttgagtaaggggaaaagccatgcgctttttctcaaccaacgcggcggtccgctatctcggcaatctgcgtgggcagtgctgaagaaaacggttgagcgcgcaggtttagataaagatatttctccccacaccctgcggcacagctttgccacccatctcctcgaaggtggcgccgatgtccgtgtggtgcaggaactcctgggtcattcttctgtgacgaccactcagatttacacgcacatcacagccgatagcttgcgggaagtgtggcgcggggctcatcctcgtgcg

SEQ ID NO: 1569 - DNA, 1530 bp, Corynebacterium glutamicum
atggctaaaacccatattcggttacaggacctttccctgtcatacacctcaaccccgttaattacgaagctcaatatcactgtttcttctggacagtgcgcagtgattgttggtgagaatggtcgaggtaaaaccacacttctgcgagcactggctcgagaattcccgccatctgcaggtgagattctcactcatggcacggtagcaattgctcatcaacacatgcctgcaggtgatctgtccgtcggagagatctgtgatgaggcaattcgtgattcaaagaatgctctcgaagagcttgagagagctggagctctacttgagacaaacactgcgcacgcacttgatggatatcaacaagcccttgatgccgctgaagtgcttgacgcatggaacgctgaacatcgattagaaaaagctctgcgcagctttggcgcgatcaccgatagatcccgtgcactcagtgagctatcgatcgggcaaaggtatcgggtacggctggcctgcctcatcggtggcgatgctgatattttgcttctcgatgaacccaccaatcatcttgaccggggcgcgcttaactatctcaccgaagccataacctcccacaaaggtgtggtacttgttgtttctcatgatcaagcactgatcaaagatgtcgcggatttcatcatcgatattgattcaaccccagacggcctaccacggatctatcatgagggttttgattcttatcgacgccaaaggagtgcgcttcttgaaacttggaggcaggattatgccgctgcacaaactgtgcaacagcaattgcaggaggatctagagcacgcacgccagcgggtgaattcttcgtggaaacctccaaaaggaacgggaaaacacactcgcgcatctcgggctcccggagtggtgcaggccttaaagcgagcacaggatgcgttggatagcaaagcgttggacgttcccccggctccggccccattgcttctgcctaccttgaaagtgcgaccagataaacccatggtggacttttcggacctttttgtaccccaccgcttgcgtctgccaggctcacattcagtggtatcaggtgacaaaatagtgatcactggtgacaacggcgctggcaaatcaacgctcatcgaagtcttgtctggggttttgactccggcaagtggttcggttgcaaaccatgcccgaactggggttctcggccaagaatcacttgtcggcgaggtgccatcaatagcacgagatcacgcagttaagtggggacttttaagtgttgaggagagccgatttgccctacaggaattctcaattggtcaacgcagaagactagatttggccatgtcgttagctggcaatcctgaactgttgcttctcgatgaaccttcgaaccatctgtctatgcacttggtttccgcacttacagagtggctggacacgaccgcggctgcagtgatcatggtaacgcatgatcgacagctactccgcgatacggctcattggaggcacatcgagttgaaatct

SEQ ID NO: 1570 - DNA, 783 bp, Corynebacterium glutamicum
ttggaaaaacatggcccagcaacgatcattgccatggcgaatcaaaaaggtggcgttggtaaaaccacgtccaccatcaacctcggagcatgccttgcagaggcgggacgtaaagtcctgctcgttgacttggatccgcaaggtgcgttgactgctggtttgggaatccactacgacgacgtggatatcaccgtgtatgacctcatggtggacaacaattccaccattgatcaggcgatccaccacactggtcttcctgatctggatgtcgttcctgcaaatattgacttgtccgctgcagaaattcagctggtcaatgaagttggtcgtgaacaaacacttgccagggcgctgcgtcctgtcatgaaggactacgacttcatcatccttgattgtcagccatcacttggtcttttgacggtgaacgctttggcgtgcgcgcacggggttatcatcccgatggagtgcgagtacttctcactgcgtggcctcgcattgctcacagacaccgtggaaaaagttgccgatcggttgaacttcgatctggaaatcctcggcatcttggtcactatgtttgaccgacgcacctctcacgccagggaagtgatgtcacgagttgttgaggttttcgatgagaaagtgttcgatacggtaatcacccgaaccgtcaggttccccgaaacctctgttgccggtgagccgatcatcacatgggcaccaacatcacaaggtgcggagcagtaccgttccttggcgcgtgaagttatcagccgcgtcaacgac

SEQ ID NO: 1571 - DNA, 765 bp, Corynebacterium glutamicum
gtgcagctcgataattttgaaggtccttttgaccttctcctgcagctgattaccaagaagaaacttgatgtcactgaagttgccttggcccaggtgaccgacgagtttattgcttacacccgaaaactgggcgaaaccagcgatttggatgagaccacagagttcttagtggtggccgcaacgctgttggatcttaaaacagctcgcctgctcccgcgtggtgaagtcgacgatgaagatgatctcgaattgctcgaaataaaggatctccttttcgccaggttgttgcagtatcgcgcttacaagcaagttgcggaaatgtttgcgcaatggcagcgagatgctcgacgcaggtacccgcgcgctgtctcattagaaactcagtttgccaacctcttgccgcccgtttccttgggtcattccttaaaaagtttcagcgagttggctgctgtggtgtttcgtccgaaacccccagagacggtgaaaacagatcacgtgcaccaagttgcggtgtcagttccagagcaagcgggcaggattcttaacacgttgaaacttgccggaattgatcattatttgagctttcagctgctcacacgtgattgtaccgcgtcaatggaagtgattggccgcttccttgccttgctggaattgtataaggcacgcgctattgaaaccttgcaagaagagccactcggcgagcttaaagtttcgtggactggcattgatgtcgatccagcagtcgtcgcggcgagtgactgggag

SEQ ID NO: 1572 - DNA, 561 bp, Corynebacterium glutamicum
atggctacgattacacgcaccgacagactgatcctcgtaccgctcactgttgagctcgaagacgaggcccaccagatttactctgattctcgaatctgggaacaccgcccccaggcgcgtcacaccaacgtgcgtgtcacgcgcgacatcatcaagcgcaccaatgaaagctggggcaagaaagaccttggcccctggggtgtttacctccgtgaccgcccatcggaattcgttggcgttggtggcgttgaactcatcgacggaaaagtatgggacctcaagtaccgcctccgccccgacctatggggcaatggatacgccacggaaatctccaacgccgcaacactggccaccaagcgtatcgacgacagcctcccactcacggccagggtgactaccaaccaccctgcctcattccgtattttggaaaaactgggactcacccccgtatgggaaggccgacgagtcggaacggaagatgaccccaacgagcctgatgtgagaatttattctgaccgtccgctatcggatgaaattcttgaaatgctcaagcaacgacca

SEQ ID NO: 1573 - DNA, 867 bp, Corynebacterium glutamicum
atgacttctcttaaagtaacttcgtccgcagatgcaaccaataacaatgatgcccattttcctgaaggtccagtggtaaccgttgactggttgtcacacaaccttgaccgggatgatgtcatcgtgttgtgtgccacaatggaggatgatgaaattgcacgtcaagcgggaattccgggggcatttctcgctgacttggaaggagatttctcagatccacattccgagcttccacacaccgcgccaccaaatttggtgggtttgctagaaagctacggcattagcaccgattccacggtggttgtttatgatctgcacggcctcatggttgcaccgcgggtgtggtggcttctccgtgttgctggattaagcagcattggcgtgcttgatggcggattgccagcctgggttgatgctggccttccaacggaaccgctgtcgctacctacaagtggtggaaggatcagcgcagaaccacagccagatttactcgttggtgcctccggcgttgaacgggcgatcgcgcgctcaagcaaggcagtgattgatgctcgtaatgcgagccgattcgctggcgttgaagaagagccccgtccaggccttcgaaaagggtcgatccctggaagcgtcaacattcccttcactgacatttctgatgagcatggttttgtccggccagcagaagaactgaaggaattgatcttcagccgcacaaatggagcgcagtcgttggtctttagctgtggctccggagtcacggcatgtgttgatgcctacgctgcagttatcgcaggttatgacgacgttgtagtgtatgaaggctcttgggcggagtggggcaacccggcaaaccaaaagccgattgct

SEQ ID NO: 1574 - DNA, 543 bp, Corynebacterium glutamicum
atgagccttatccctcagacgaggtctcggatggaatcaatcttgttggtggtcgataccccagtttcagcacgcacgctggctggggtgttgggcattgacgtgcctgcaacagaggcaattttgaaggaaatggcctttgagctttctgaacggggcagcggcattgatctgcgggaaacggcagaaggatggcgctattacacccgcccggaaaatgcggacatcgtcgagcaattcctcctcgatggaaaccaaaccagactgtcccgtgcagcattggaaacactcgcggtggtggcatatcggcagccggtcacacgctcccagatttcagcagtgcgcggagtaaatgtcgacggcgtcatgagaaccttgcagcttcgaggcctagtcaaagaagtcgatgtggacgaatcaacgggcgcacaccgctatggcacaacggaattgctgcttgagctgttgggtattgattctttggataaattaccagatctagcaccgcttttgccggatgttgactccattgatgaagacttc

SEQ ID NO: 1575 - DNA, 756 bp, Corynebacterium glutamicum
atgggtttcttaaaccgcaatgactctgacggagttcgcctgcagaaggtgcttgcccaagcaggtgtggcatcacgtcgacacgcagaaatcctgattgatcagggccgtgtggaggtcaacgatcgtatcgtgaccacccagggcgtgcgcgtggatccaaacaacgatgtcatccgtgttgacggcgtccgcatccacatcaacgaggacctcgagtacttcgtgctcaacaagcctcgtggcatgcactccaccatgagcgatgaacttggtcgcccatgcgtgggtgatctggtcagtgagaagactgcatctggacagcgtctgttccacgtcggtcgcctcgacgcggacaccgaaggtttgctgctgctcaccaacgatggtgagttggctaaccgcctcatgcaccctaagtacgaagtgtccaagacttaccttgctaccgttcgcggtgaagcaaccaataagctagtcagcgctcttcgtgatggcgtggagttggaagatggccctgccaaggctgactttgcgcagattatcgacgtattccagggcaagtccttgttgcgcatcgaaatccacgaaggccgcaagcacattgtgcgacgcctcttcgatgagctcggtttcccagtcgagcgcctcgtgcgcaccaagctgcacaccgttcagcttggtgatcagaagccaggttcccttcgtgcactgaactcctctgagctgaccagcttatacaaggtggtccaactg

SEQ ID NO: 1576 - DNA, 690 bp, Corynebacterium glutamicum
atgcctgccggtggcctcatcgtagccatcgacgggccgtctggcaccggaaaatccaccacatcccgcgcgctcgcaacccgtctctcggccaagtacctagatactggtgcgatgtaccgcgtcgcaacgcttcatgtgcttaaccaggggattgaccctgcagatagcgcagccgtgatcgctgcaaccgctgtattgccgttgtcgatttctgacgatcccgcctccactgaggtgttgctcgcgggcgtcgatgtgcaaaaggacatccgcggaccagaagtcacccaaaatgtctccgcagtgtccgcgatccctgaggttcgtgaaaacttggtggcgttgcagcgcgcactcgccgccaaagcacatcgctgcgtcgtcgaaggcagagacatcggaacggcagtgcttgtcgacgcgcccatcaaggcgtttctcaccgcctcagcggaagtccgcgcccagcgacgctttgaccaagacaccgcagcaggtcgcgacgtagatttcgacgctgtgctggcagatgttgttcgccgcgatgaactagattccacccgtgccgcctcaccgctgaaaccagcagatgatgcacacatcgtggacacctctgatatgaccatggatcaagtacttgatcacctcatccacctagtggaagcctccgctgaaaggagcaaccag

SEQ ID NO: 1577 - DNA, 1557 bp, Corynebacterium glutamicum
atggacgtcgaaggtgcgtttgctgacgaagaagaactagcaccacacggcggttgggcttccgcagatttcgacccagcagaattcggctacgaagactctgacgatgacttcgatgcagaggactttgacgaaacagagttctccaaccctgatttcggcgaagactactctgatgaagactgggaagaaatcgagaccgcattcggattcgacccaagccaccttgaagaagctctctgcacggtcgctatcgtcggacgcccaaatgttggtaaatcaaccttggtgaaccgctttattggacgtcgagaagcagtcgtggaagatttccccggcgtaacccgtgaccgcatctcctacatctctgactggggtggacaccgtttctgggttcaggacacaggcggatgggatcctaacgtcaagggcatccacgcatcgatcgcacagcaagcagaagttgctatgagcactgccgatgtcatcgtattcgtcgtggacaccaaggtgggcatcaccgaaactgactcagtgatggcagcaaaactgttgcgctcggaagtgccagtgatcttggttgcgaacaaattcgactccgacagccagtgggctgacatggctgagttctacagcctcggccttggcgatccatacccagtttcagcccagcatggacgtggtggcgctgacgttttggacaaagtccttgaactcttcccagaagagcctcgctccaagtccatcgtggaaggccctcgtcgtgtcgcccttgtgggtaagccaaacgtgggtaagtcttcactgctcaacaagtttgctggcgagacccgctctgtcgtggacaatgttgcaggaaccaccgttgaccccgttgactccctgattcagctggatcaaaaactgtggaaattcgtggatactgctggtcttcgcaaaaaggtcaagactgcatctggccacgagtactacgcatcactgcgtacccacggtgccatcgatgcagctgagctgtgtgttttgcttatcgattcctccgaacccatcaccgagcaggatcagcgcgtgctcgcaatgatcaccgatgccggtaaggcactggttattgcgttcaacaagtgggatctcatggatgaagatcgccgcatcgatttggatcgcgaacttgatctccagttggcacacgtgccttgggcaaagcgcatcaacatctccgccaaaaccggtcgtgcactgcagcgcctcgagccagcaatgttggaagcgctcgacaactgggatcgccgtatctccactggtcagctgaacacctggctgcgtgaagcaattgctgcgaacccaccaccaatgcgtggcggacgtttgcctcgagtgctgtttgccacccaggcatctactcagccaccagtgatcgtactgttcaccaccggcttcctcgaagcaggttaccgacgatacctggagcgcaagttccgtgaacgtttcggctttgaaggcactccagtgcgaatcgctgtgcgtgttcgcgagcgccgcggcaagggcggaaacaagcag

SEQ ID NO: 1578 - DNA, 666 bp, Corynebacterium glutamicum
atggcatcaccgcgccgcccacaggttgcagcaccacgcatcaaagaacttcgcctaacaggccttgacaacgctgaccctcaagacatcgaatcgaatgagcagatagagtcatgccgttttaacgaggccgagctttccgaacgcgatctttctggtgctggtttcattgaatgtgaattccttgggctggaagcacacgaaaccgagctacgccgggctcaattcgtggaaacacgcatcgaaagagccaatgctccatcttttaaggcagcccgctccatctggcgcaacgcaacgatttccgactcccgctttggtgccgtcgaaatgtatgaagcaaccgtccaagctttgaaaatctctgattctaagctgtcgtttgtcaatctgcggggtgcatcgttacgggatgtgctctttgagaactgtgtcatcgacgagcttgatcttggccaagccagagcagaacgcatcgcttttaaagactgcacggtgcattcgctcacctttgatcatgccgtgctcagcaatgtggatcttcgcggtttagatatcgagcgcatcagtggcgtggagtccatgtccggaaccgtgatctcatccctgcaggctgctgacctgtcgggagcatttgcacggcatttaggaattactgtaaacgat

SEQ ID NO: 1579 - DNA, 498 bp, Corynebacterium glutamicum
atgtacctgttgaatccaccagtcactgaacccgagatcctcactgtcaacgagattccgaccgtcgtcgctgtctttgacaaccaccccatgaacgacatgcccgcagcattcgatcaaacctaccaagtgctcttccccaccttgggtgccaagggcatcgcgccaattggccccggatttgctctgtacacctccgaaccaactgacaccgtcagctttgaagtgggcatcccagtcagccaaccacttgagggagatgtttcagccgccaacggcatcgtgctgaaaaactcagtggtccctgccggaaaaattgcgcgaatcagccacatcggctcattcgacggactgagccaagcatggggttcattcgtggaagctcttgaatctgcaggccatgagatcgatatgccttgttgggaggtctatgtcaccgagccttcccccgacatggatcccgcaacactccaaactgatctatacgtcctgttgaag

SEQ ID NO: 1580 - DNA, 813 bp, Corynebacterium glutamicum
atgaatgatccagctcatcccccaattccaccagtatcaaaacgagacgctccggcgtttagcgatcttcaacatcgagcaaccagcgccagcgcttttacccaaggcagcacgacttatcacgatgtccgacctggatatccggctgaggccgtggagttagcccgtgggtttggccgagtcctggatgtcggtgcaggtaccggaaaactaaccagtgagctaacagctgatcaggtcctagcccttgatccaagcatggacatgttgcgggtgtttcgctccgcgcttccggcggttccctgctggcaagcgacagcagaacacacaggaatacgtgacaacgcggttgatctgattacgtgcgcacaaacgtggcattgggttgacgtgacggctgcctcagcggaatttgatcgggtgattgcacctgagggtgcagtcctgctcgtgtggaataacctggacacctccatcgcgtgggtacaccgactcagtcgcattatgcatgccggcgatgtactcaagccgggattcaccccagaaaccgcagctccctggataattgatcgagaaattcgcaccacgtggaatcagcacctcacccctgaagaaatcatccagctcgctcacacgaggtcctactggttaaacgcgtcagagaaaatcaaagagcgtgttgatcagaaccttcagtggtatctctacgagcatttgggtttcagtcccgacaatccagtggaacttccctatcgctgtgatgcatttttactttcacgttccggtaccctggcaggcagatcttccaatctt

SEQ ID NO: 1581 - DNA, 1554 bp, Corynebacterium glutamicum
gtgcaacaaacgaaatccacacctttagataggtataaaaacctccccgggcccggcgcgcgaccgtccaagatgccggcgttggatgccaaattatggactctcaaagtggcgttgtcgcagcggccgtggagctttgtggcgtctgctggcatggcggcgtcttttatctgcaatgggttaacgcctgtgattgtgggtaaggcggtggatgaggctattggcacgagcgatctgcagcgattgtggttctggattgccatgttggcggttcttttcttaacggcgatgacggtgaactggattgctcggtacatgttggtgcggagccagcagttggtcagccatgatttgcgcatgttggtgactgatcggattcaagatccgcgtggttttgctggaaaagagcgcactgcgggtggattgttgtcgattgcgtcatcggatacgcagcgggtgggcgatatcgtcatgatgacggtgttcccggtggcggaattggcgtcgattatttatggcgccgtggtgatgtacagcattaatccgtggttgagtgtggctgtgctgattggtggaccgctgctggttgtggtggctattcaggtctcaaagccgttgcagaagcgttcgggtgctcgtcagcaggcggtggcacaggctgcggctactgcaactgatgtggtgcagggcttgagaattttgaagggtttgggcgcgattgtcacggtgcgccgtcggtacgaggcgatttctggtgaggcttatcggaagacggttcatgcggatgctgcggaagctcgcttgaatggtgtcaccgatgcggcgggcgccatctttgtgtccgcgttgggtattggagcaggatttttggcgctgcaaggtcagatgagtattggtgatttgatcacggttgtgggactcacacagtttttgatcatgccgatgaccatgcttggtcgaaatgtggcatcgcgctgggcatcggcggaggcgtcggcaaagcgtattaggggagtgctcggtgctgattttgagagagtgtctgcgcatgatgcggacaaggctgaggagattatccaacaacttgccaaaggtttgacggttattcgaggcactgatgagcagctcgttgaggtattagagcagttgccacgtactcgggtgattgtggctcctcatgcggcggatctttttgatcaaagtgtcagggacaatgtgcatcccgtggcagaggtcgcggagaaagccattgaagttgcctcctgtgacgatattccaggtggtagttccaagattgtgggcgagggtggacggttgctctcgggtggtcagcgtcagcgcgttgcactggctcgggcgattgcttttgatccagaggtgttggtgcttcaagatcccacaacggcagtggattctgtgacggagcaaaacattgctcagcaagtggcagcacaccgtgcaggaaaagtgaccattgtgtttagtgaggcacccgcgtggagtgcggtggctgatcaacacgttgaggcagctgctttgcgggaggttatgaaa

SEQ ID NO: 1582 - DNA, 1767 bp, Corynebacterium glutamicum
atgagtggggagacgtcgaaaagcatgcgctttccgttggccagcctgccgcaagtgcggcgcgaggtggcccggcaggtgggtcgtattccgcgggcgaagtggtggtttttaggcgcgctggtgttgctgagtgcgggcgcttatgcgtcggtgctggtgccgcaggtgctggggcggattgtggatctggtgtccgatggcgcgcagatgcgtgattttgttgagctcagtgtgattctcattgcggtggcaattgccggcgcggtgctcagtgcgtgcgggttctatgtggtgtcgcggatttctgagaagattatcgccaatttgagggaagatatggtgggcaccgcgcttgggttgcccacgcaccaggtggaagatgcgggctctggcgatttggtgagccgctccaccgatgatgtctccgagctatccgcagcggtgacagagaccgtcccgattttaagttcctcactgtttaccattgccgcgacgatcattgcgctgttttctttggactggcaatttgtgctcattcctgtcgtggtggcgccggtgtactacttcgcgtccaagcactatttgagcaaggcgccggatcggtatgcggcagaacgcgcggcgatggcggagcgtgcgcgaaaggtacttgaggctattcgcgggcgtgcaactgtgcgggcgtattccatggaagatgccatgcataatcagattgatcaggcgtcgtggtctgtggtggtcaagggtattcgtgcgcgcaccaccatgttgattttgaacatgtggatgctgtttgcggaattcctcatgctcgcggtcgcgttggtgatcggctacaagctggtcattgatgatgcgctgacgatcggcgcggttaccggtgccgtgctgatgattattcgtctgcgtggcccgatgaatatgttcatgcgcgtgctcgacaccattcaatccggctatgcgtcgctggcgcgcatcgtgggagttgttgcggatccgccgattcctgtgcccgacagcggtgtgaaagcacctcagggcaaagtggaattgcgcaacgtcagctttagctatggcgattcctgggcggtgaaagacatcgacatcacgatcaattccggcgaaactgtcgcgctcgtgggcgcatctggcgcaggtaagacgacggtcgccgccttgctggcgggcttgcgggtgccagatcaagggcaagtgcttgtcgacgacttccccgtctctcacctctctgaccgcgagcgtatcgcccgcttggccatggtcagccaggaggttcatgttttctccggcacgctgcgccaggatctcaccttggctaaaccagatgcctccgatgaggaattagcgcatgctcttgggcaagttaatgcccttgactggttggagagtcttccagaaggactggacacggtcgttggtgcgcgaggaatccagctagaaccagtggtggctcagcagttggcgttggcccgggtgttgttgctcaatccggcgatcgtcatcatggatgaagccacggcagaagcaggatcggcgggtgccagcgcactggaagaggctgcagatgcagtgagcaagaaccgttccgcattggtggtggcgcaccggttggatcaggcatcgcgggctgatcagattctggtgatggataagggggaggttgtggaatccggtactcaccaggagttattggatcacgggggtatttatcagcgtctgtggactgcgtggagtgtcggaaga

SEQ ID NO: 1583 - DNA, 825 bp, Corynebacterium glutamicum
atgaacctcctggctgaccatggccaagcgggcgatacgctcgcggtcagagaggtgagagacggggaagtcgtcgacaagcacttgcccttgatctggcacccgcaagcccgccagcaaggcggcgaccgtcgtcttacctgcgccagatgcgcccacgagcgcgacagtttcgccggaattgatcgtgatgtcgatgtctttcaccgcccaggaatcgccatagctaaagctgacgttgcgcaattccactttgccctgaggtgctttcacaccgctgtcgggcacaggaatcggcggatccgcaacaactcccacgatgcgcgccagcgacgcatagccggattgaatggtgtcgagcacgcgcatgaacatattcatcgggccacgcagacgaataatcatcagcacggcaccggtaaccgcgccgatcgtcagcgcatcatcaatgaccagcttgtagccgatcaccaacgcgaccgcgagcatgaggaattccgcaaacagcatccacatgttcaaaatcaacatggtggtgcgcgcacgaatacccttgaccaccacagaccacgacgcctgatcaatctgattatgcatggcatcttccatggaatacgcccgcacagttgcacgcccgcgaatagcctcaagtacctttcgcgcacgctccgccatcgccgcgcgttctgccgcataccgatccggcgccttgctcaaatagtgcttggacgcgaagtagtacaccggcgccaccacgacaggaatgagcacaaattgccagtccaaagaaaacagcgcaatgatcgtcgcggcaatggtaaacag

SEQ ID NO: 1584 - DNA, 789 bp, Corynebacterium glutamicum
gtgttgttcgcatttggactcaccctatttgccggtcttgccaccggcatcggcggtctcatcgccgtagcgcgcaaaaccgtcaccgaaggattcctcgcaggatcactcggcttctctgtcggcgtgatgctgtacgtatcctttgtggaaattctacccggcgcctttgatgaattaaccagtgtttggggagaaaaaggcggaagttgggccgctgttatcggcttcttcggtggcatcgcgctgatcgccatcatcgaccgcttagtccccacggcgattaacccccacgagccctccaccgtgggaggcgccgttgaaggattcgagcgccgcaaccgcatgatgaaaatgggtgtgctcactgcgctggccatcgcgatccacaactttcccgaaggtttcgctacattcttggccggattgtccgatccaatgatcgcgatccctgtggccgtggcaattgccattcacaatattccagagggcattgcggtggcggtgccactgagggaagctacagggtcacgtcgaaaagcattaggttgggcgaccctctccggccttgctgagcccgccggcgccctcatcggattcctgctgctcatgccctttatcggaccagaagcactcggcctgtgcttcgccgcagttgccggcgtgatggtgttcatcagcgtcgatgaactactgcccactgccatctccagcggcaaacaccacaccgccatctacggactcatcgctggcatggcagtcatggcgatcagcctgctgctgtttatc

SEQ ID NO: 1585 - DNA, 189 bp, Corynebacterium glutamicum
atgagcatgaacaatatcgtcatgaataaggtctcttcgggtcaggtctgtcaggtttgtcagtttttcagtaaacagttcctatttttccctgattatgctgctgcatgggagagcgcacaccaattgaaagcaacttcacaggaagtgttcagttgtgagtttttggggtgtcgtgtggcgcccgtt

SEQ ID NO: 1586 - DNA, 1548 bp, Corynebacterium glutamicum
atgacgatattgttcatgctcattacattgctgctcgccaccgtgattgtggtggccatcggcgataaaaccggactcccctggcctgctttgatgactattgtcgccgcaggtggagcgttgttgccatttttgccggaatttactatcccggccgatctgatgttgcctattttcattccgccgctgctgtgggcgctggcgaggaagtcatcgtgggcggtgattaggtcgcagatgtctaccatcatcacgatgtcggtgttgttggtgttcgtgaccatcgcggcactcacgggtgcatccatgctgttgcttcctggcattggtcttgctggtgcgatcatgttggctgcggctattgctccaccggatcctgttgctgttgatgcagtggcggaacctgcgggaatcccgaagcgcatcaccaccactttgcagacggagggtctgtttaatgatgcagccagcatcgtggcgttccatgtggctttagctgccctggtcgctggtgaggatttgtcctggtcaacgggtgttttggaattcttgtggtcgtgtcttgctgccgttattttgggcttggttattggccgggcggctgcgtggtttaccgatcacgtgagttccgttgaggctcgaaatgcgtttacgtgggtgctgccgtttgccatttatgtggtggcggaagaaatcggcggttcgggcgttatcgccattgtgatcgctgcagtggagatgaattcgagggcgtcgattggtgcggaggatcgtctaacgggttctgcgttctggggaaccattgaggtgctgtttactggcgttgcctttggtttgatcggcctgaatgtgcgcgctgcgattgatgaagttggatctgagctgtggcatgccgtggtcgtgggcattgtgctctcggtggtggcgatcgttgtccgtggtgtgtggatgttcgcggcgtataagcgcaatcgtttcaagatcgataagaagggtgcgaccaatagttcattgcgggcgcctcttcgactgcaggaatcgttgctgatgacgtgggcgggcatgcgcggtttggtgacgttggcgctggtgctgtctattccggaggatattttcccgtatcaccacgagttgcaggtcattgcgctggtcgttctcttaatcaccatggtgggccctggtttgacgttgccgtggctgatgcggaagctcagcttggataagggtcccgatgctgcgggcgatgagagtatcgccgcgctgacagagagggctcacaaggccgcaacaacgtatttggtggataccacggagttgccgatggagcagatggtggcgatcaagaattggttctcgcaagaaattgacgctgatgaactgcaggagaacgtcgataagctgcatcagcgcgcgcatcatgcgcgtgtcggggcaattaaggcggcccaggaggagctgttgaaggcgcggcgggagcgcggcgttaatccggcctatgttgatgaggtgttgaccaacattgaccggatgcttgttgcggctgaacgc

SEQ ID NO: 1587 - DNA, 186 bp, Corynebacterium glutamicum
atgaaactcaccattgatatcgatcttgatgctattgcggatgatcctgccggtgaagcgggacggattttaagatattgggcaggtgcgctatcccaaatggatctttcggccgaggcggaacatgcgttgatgaactcaacctatgacgcagaggtaggaaccatcaagatcacggctgaaaag

SEQ ID NO: 1588 - DNA, 420 bp, Corynebacterium glutamicum
gtggggaaactagtcgacatctcctgtggaatagacccacgcgccgttgaccttgcggaatgtggagtcttcttcttggacgccggaggcgagccccttgtagaaggcttggaattttacggtgccggtggaatcgaagggtccaccgccggtggtctcgaggatgtcgaggcggtagaaatcaattcccatatcgaggccgagttcgcttggccgggtttctggatcccaagtgtcaagaaggtactgggaatttccaacagcaaaggcggtgaaccgagatcgcatgagcgcttcagcggtgggggccacccattcgccggagtgaaagcggtagcagcactcaccgtaggtaaggccagttccgcaggggcagcgtttacccaactcaaaatccacgctagttcacctcgtcgtcga

SEQ ID NO: 1589 - DNA, 375 bp, Corynebacterium glutamicum
ttgggtaaacgctgcccctgcggaactggccttacctacggtgagtgctgctaccgctttcactccggcgaatgggtggcccccaccgctgaagcgctcatgcgatctcggttcaccgcctttgctgttggaaattcccagtaccttcttgacacttgggatccagaaacccggccaagcgaactcggcctcgatatgggaattgatttctaccgcctcgacatcctcgagaccaccggcggtggacccttcgattccaccggcaccgtaaaattccaagccttctacaaggggctcgcctccggcgtccaagaagaagactccacattccgcaaggtcaacggcgcgtgggtctattccacaggagatgtcgac

SEQ ID NO: 1590 - DNA, 1164 bp, Corynebacterium glutamicum
gtgaaggtgccatcatcacaagggttgatgatggccgcgacgttagatcttccagatacagatcccattgcctatgcaatgtttgcccactgtttcaccggctcacggttcacgccagccgccgcgcgagtcagtaaaacactcgcagaatccggcgtcgcctgcctgcgtttcgatttcccaggactgagccaatcagaaggtgacttctccaaaaccaccttcaactccaatgtggacgatatcgtggcggcctcgcagtggttgacggaacactactccgctccacagttgctcattggacactccttgggtggtgcagcatcactgaaagctgccaccaaaatctcctgcctcaaagcagtagcaacgataggtgcaccttttgatcctgcgcacgcagtcctgcactttgctgatcgcatatgtgatgtagatgatcaaggtgctgtcactctgcagctcggaggccgggatgtcaccatttcccgcgaattcctcgaagaccttgcagaggtcaaccccgaagatcacctccgcaggctccgcaaaccactgcttttactgcattcccccaccgaccaaaccgtcggcgtggacaacgcgcagctcatcttcagagtcactcgctaccctaaatccttgatgactttggacaaggcagatcacctgctcaccaaagatggcaccgcacagcgtgcagcccggatcatcgcgaactgggtcgagccctacctggttccagaaaacgtctgtgaggatcttccggagtttgtcgccgaagcctcaaccatcaaagccagcaaatacggcgcagccatccgcaccggtggtcacaatttcatcaccgaccgcgacaaatcccagggtggcaaaaacctcggcttcacccctacttccctgctggtttccgcgcttgctgctgcaaactctcaaacgatcaaacaagcagccatcgacaaccgcatcaaaggccttgacgatgtcaaagtgacgatctcccaggaacaatcagccgaccacggccagatcaaactccgccgaaagatctctttgatcggcaacctcagcgatgctgacagtgcttcacttcgggccgcatctaattcctgctcgattacccaactgctcgcgcagggaatcgtcatcgacgacgaggtgaac

SEQ ID NO: 1591 - DNA, 2289 bp, Corynebacterium glutamicum
gtggccggttttgattggttttggaaggcccttggcggcaaatcgggcagaaaccaaaaacgtagcgtggcaattgtcaatcaggtagaaaaccatgcagcggaattagacgcgctggatgatgttgcattggcgcagcgtgccaaggatctagccagtggtggacgcattgacaatcatgcggaattcctcgccattttgggtgtggcatcgcagcggacattggggctgaagccgtatccggtgcaatcacaggcggtgttgcgtctcattgaaggcgatgtggtgcacatggctaccggtgagggcaagactttggtgggcgcgatggcggccaccggtctggggttgatgggcaagcgagtccattcgattaccgtcaatgattatttggcggtgcgcgatgccgaatggatgcggccattggtcgaatttttcggtctgagcgtggcgagcatcagcgagaagatggatgcaggggagcgtcgacaagcatataaagccgcaattgtctacggacctgtcaatgaaatcggctttgacgtgctgcgtgatcagctaattacccggcgcgaagacgccgtgcagcatggcgccgacgtcgcgattatcgatgaggccgattccgtgcttgtcgacgaggccctggtgccactcgtcctcgccggcaaccagcccggccatgcgccgcgcggcaaaatcaccgatgtggtgcgctcgttgaaagaaaacgacgattacaccatcgacgatgatcgtcgcaacgtcttcctcaccgacaagggtgccgccaaattagagcagcagctgggcatcagcagcctctacgacgatgagcacgtcggctcgacgctcgtgcaggtcaacctcgccctccacgcgcaggcactgctcatccgcgacatccactacatcgtccgcgacagcaaggtcttgcttatcgacgcctcccgcggccgtgtcgccgacctgcagcgctggcccgacggcctgcaagcagcagtggaggccaaggaaggtctcgcggtttctgaaggcggcaagatccttgacaccatcacacttcaggcgttgattggtcgctacccaatggcatgcggcatgacaggtaccgccgtggaggcaaccgatcagctacgcaccttctatgacttgcatgtttctgtcattgagcgcaatcatccgctgaagcgctttgatgaagctgaccgtatctacgccaccatggcggagaaaaaccgcgccatcatcgatgaaatcgcactccttcacagcacggggcagccagtcctggtgggtacccacgatgtggcagagtcggaagaactcgccactgcactgcgtgaactcaacatcgaagtaagcgttctcaacgccaagaatgatgccgaagaagcccagatcatcgcagaggctggcgatattggacgagtgaccgtttccactcagatggccggccgcggtaccgatattcgcctcggtggcgccgatgaagccgactacgatgaagtggtgaaactcggtggactcgccgttatcggcaccgcccgccaccgttctcagcgcctggacaaccagctgcgcggacgtgcgggacgacaaggagatccaggcctgagccttttctttgtctccctcgatgatgatgtggtggtctcaggcgggtcaggggagagcgtgagcgcgcaacccgatgccaccgggctgattgactcagatcgcatccgcgattgggtcggacactgccagcgcgtcaccgaaggacagctgctggaaatccactcccagagctggaattacaacaagctccttgccgatcaacgcgtgatcattgacgagcgccgcgaacgcctcctcgacaccgccttagcgtgggaggaactggcacagcatgcaccagcgcgggctgcagagcttgaagaccttgatcagtccgtgagggaacaggcagcacgagacatcatgctgtaccacctcgattacaactggtcagagcacctcgcgttgatggatgatgtccgcgaatccattcacctgcgcgccatcgccagggaaaccccccttgatgaataccaccgcatcgctgtgcgtgaattcaaggatttggcacaacgcgctgtcgatgatgcggtgtccacgttcaagtctgtgaccatcgatcacgagggtgcccatttggatgatgagggcttggcgcgtccatcagcaacgtggacctacatggtctctgacaacccacttgcgggtagtggtaactcagtgatcagtggcataggaaatatctttaga

SEQ ID NO: 1592 - DNA, 429 bp, Corynebacterium glutamicum
atgagcgacaacaacggcaccccggagccacaggtcgagaccacctcagtattccgcgctgatctactgaaggaaatggagtcgagcaccggtactgctccagcctccacaggagctgaaaaccttcctgcaggatctgctcttcttgtagtcaagcgtggaccaaatgcaggcgctcgattccttctggaccagccaaccacgaccgctggtcgtcacccagaaagtgacatcttccttgatgatgtcaccgtttcacgtcgccacgcagagttccgcatcaatgaaggtgaatttgaagtcgtggacgtagggtccctcaacggaacctacgttaaccgcgagccacgcaacgctcaggtcatgcagaccggtgatgagatccagattggcaagttccgcctggttttcctcgcaggccctgctgag

SEQ ID NO: 1593 - DNA, 756 bp, Corynebacterium glutamicum
gtgagtgcactccgtaaaacatccccaaacggctccatcggcgcatccgccaccagaaccgttccggtgaaaccaaccaagactatgtcaattggtgtggtacttgaacgtctaaacgcagagttccccgatgtcactgtgtccaaaattcgcttcctcgaatcagaggggctgattacccctgagcgaaccgcatctggataccgccgttttacggaatcagatgtggaacgcctccgctacatcctggtcacccagcgtgacaactaccttccgctgaaggtcatcagggaacagctggaagccatggacaacggctctgtcaccgccatccttggttcctcctcggagcctttggtcagcccggagaagtttcaggcacctgcgattactcgcctcactgactctgatgtggccgaaaaggctggcgtcaacgtcgaattggttgttgatttagtcaacgcccgattgattaagccggacgccgccggatttttcaccaacgatgacgtggcgatcgccagcaccgcagctagcctgaaagcaatgggctttgatctccgtcgactgaaatccctgggaaatgcggcatcgcgccaggcagatcttatttcccaagtggcatctccgattgcgcagggaaaaagcgatgttgcccgccagcaagctgaagaaatggcacaacaaatgtgctccctagttgtgtcaatgcacgcctccttggtgaaaaacgcaactcgcgagcagcttggatac

SEQ ID NO: 1594 - DNA, 633 bp, Corynebacterium glutamicum
atgagttttgttgaacttgaattccatggcattcacaccatggaaccagatggctttacctgcgcgctgttccgatgggatgaagggaacaaaatccttcccatctggatcgacgttgatgacgccctaaaaatccaggcatatctcgctggattcaacccacgaaggccaacggcacatgaattgctcgcggaagcattccagcgcctcactccgtgggtagccagcctgcagatcgtctcccactttgaaggcgtttacatggctaccatcactacctctgaagatgagcaatttgatgcccgcccaagcgatgtgatcatgctgtcacagctgctcgaggtgccaatttctatcgatgaggaaattctgcagcaaactgccttctatatcaatgatgaggatatggagtccatctttgacatcgtcattgatcgcagcaaggcatccggacatcctgatggggaatctgcttcaggcgacgctcaagcagatgctgatttccaacagttgatgcagagcctcggcgtttttgaagatgatctcttcagcgcaccggattctccaggcgacggacttgatggcgacttcggcgaggaaggcccctcatcggaagaaaagccagagaattcc

SEQ ID NO: 1595 - DNA, 573 bp, Corynebacterium glutamicum
gtgtacgaagacaagaactaccagggagaaatcttcaacggtgtccctgttcaggagaccttatttgaggtcggccctgacgaacaggtcggctaccgcgtcccaacagcctgccaagttgcggggatcacctaccgccagctggattactgggcacgcaccaaacttgtcgtgccaaccattcgtggtgcacgcggatcaggctctcagcgcctgtactccttcaaggacatccttgttctgaagattgttaagcggctgctggacaccggtatttctctgcagaacattcgcctcgccgtggataagctccgcgacatgggcaccaacgacctggcagagatcaccctggtttctgacggcaccaccgtctacgagtgccgatccaacgaagaggtcatcgacttgctcggtggtggacagggtgtattcggcattgcagttccaggcatcatgaaggaactcaccggcgatatttcttccttcccatctgagcgcatcgatgaggaatttcaggcagagaccatcaactttcaagatgagctcgcagcccgccggagccgacgcacctcc

SEQ ID NO: 1596 - DNA, 510 bp, Corynebacterium glutamicum
atgaacgacagggctcaccaacgaataggcgacatcgagcgatcccaagccctcgaccgacttgggtcatattttgcagacggatacctcgacatcgacgaattcgatacccgaaccggcgccgcagcaatcgcacgcacagccggtgaaatagatgtcttgttcacagatcttcccgaacaacaggcaagcaccgccgtgacacccgtgcaagacgataccgagaaagaattagacctggtcctacagcgaggaaagaagctcaagcagatcgactccgccatttgggctgtcgtgatggtctcgttcttcctaggcttgtttgttttcaacgtgccatatttctgggttgtgttcatccttggcggagcggcctccgcgggtgcgcgattcttgctcaaagtagatgacgccgatgaaaaactctttgaggaactccacagcaaggaacaaagcgaacgcgaagcacgcctacgcattgcggcacaacgtcgacgcgagttggaacaa

SEQ ID NO: 1597 - DNA, 1449 bp, Corynebacterium glutamicum
gtggcacgccattcaagtgggaattcaaacttaaggttatctaaatcgctaaccattgcgttgattgccatcgtcgctctcatcgtggcacttgtggtgtggctttttaaccgttcagatgattctggctccaccacgaccacctcacaagagtgcatctccggaaacttgagtctgcccgttggtggcgattccaccgcagccgaagaattagtgaacaaatttaatgactcatcacctgtcagccgtgatttctgtgttgaggcggaagctgtggacggcaacgtccccgctgccacgtacctgttcgctggttctcgttctgatgctgccaccgcacttgctgaaaccggtgccgtagcaagcagctctgaaagctcttggccccaggttggctccgcacaggcaggcctcgcagctgcttcaggcaccgacgcctcaacaatcacccttgaccaggtagctcttcccgttgccactaactccggagcatccgcagccgtagcgctggcgctggctgaaaccccagaagctgccgctgctgcgctcaaccgtgacgccgatgtcaccgcaactggagctgccgactcccctgcgtttgccaccgttgaaggagcagaacttccagagggctacacctttgaagcagtagacagcgcagaagtacctgtgtgggctgttgccatcaacgctggaaacggtatctctgaagaccaagcccgcgccgcctctgatttcagtagcttcagcttcgacaccggcaacgccgataactccgcgcttgaaagtgttctcacccaagcttcaagcgaatccgcggcagaaactactgaggcgcaaccaagcgagaccccggtcgagcccgccgctgcttccccatccgataccatcatcaacctggatacctcatccaacatggatcgagttgttgacggcagccaggaaacctaccacacggttacttcccggactctggccaacctcgcccgcgaaactggtgcacagggcaaccaggtagcactaaacaactactcttccccactcaacccaggagtcaccaagggatggcgcgcaaacgtttccttccctgattcctccagtggagaaaactctgccggcgcagttgttcgcctcggcaccggtggcgttccgctgacccgcgcttctgtcgttgctgcaacccagatcgccaaggaaggctcccccgatggacagccaatgcgcgttgtcatcgtgacctcaggctcagctggtgaatacaccgacgaagcattcttgaatgatctcagcgccgcattcgcagacaacatctcactccacgttgttcatgtaggccacgatccagtggattccgtgctcagtgatttcgccaccagccacaacggcaccgctacgcaggcaacaaccaccgagcagatcgatgcagctctccgcgaggcattcggactc

SEQ ID NO: 1598 - DNA, 600 bp, Corynebacterium glutamicum
atgaatcagcccgcgcgtggtgggcgcgggctagttccatccactcatcctcgctcaatacgcggaggtgaaaagtgtccaacacagttactatttctagtcgtcggagctttcgtgagtccaatcgttgacggtgcccacgtattcttcgatgagatcctccagcgtaatcacgccgagaagctcacctttgaggcgaacctgagccatgtgcgcggagcggtagtgcataaaatccaagacgtcatccatgaggccgtcggcatccacattgctcaaagggcgcagtgcagaacgcggaatggtctcggagggatccatctcaggatcagccagacgaggcaaaatatccttgatgtggatataacccaagtaggatccatcgcggccggtgacagggaagcgggagaaaccggtctcgcggactgcttcctccaactggtgcaaggtcgggccagatttaccgaacgccagcgtgcgcacgtcctcatccttaatcaccagttccttgatggaacgctgctcagagcgcagcgccttggacaggcgggcgtgctcttcagcatcaaggaggccttcggaacgggactcggaaatcat

SEQ ID NO: 1599 - DNA, 930 bp, Corynebacterium glutamicum
ttggactcacgaaagctccgacgactagaaatagtaactgtgttggacacttttcacctccgcgtattgagcgaggatgagtggatggaactagcccgcgcccaccacgcgcgggctgattcattcaccaaagaccacttgaagcgtcgacaagcgcatatcaagcaccccgtcttcgacttcctcttcgagtactaccccgtgcgcgtcgcgcacctaaaaacctggcaccccggcatcggcgtgtttctagaaggcacaccgccgcatgccaccatgcgcgattttttgcttgtcgacgcctccctccatcacgcagccggcgtccagcttgacctggcctcctatatgcaacgccgtgggtcctctgtgcgctacatccacgaactgttgtccgccacccgcgacaaccacgcccaatttgattgttttggtctgcacgaatgggcaatggtgtacaaatcaaacgatctccgccatgaccttcccctgcgccttaccccatcggaaaccgaccgtgtggtggaaagccacaacatcaaatgcacccactttgatgcctaccgattcttcaccacaccagccatcccgttgaacctcacggtgttaacccgcgaagatcagccacgcaacgatcaatgtggttgtctgcatgccacgatggatctatacaaatggtccgcaaagcttggccctcttgtgccaggtgatcttttcttggacgcgtttgaactagcccgcgacacccgcatcttggacatggaggcttcgccttacgacgtccgcggatacggctttggctacgtccccattgagaccgccgagggcaaagccgaatatgtcagtagacaacgcgagctgtctgaacgagcaaaacccatccgtgaccggcttgtctccattactaaacaagctctacaggctagtatt

SEQ ID NO: 1600 - DNA, 1062 bp, Corynebacterium glutamicum
gtgagtatttgggcaactgtccttctaattatcgtccttctttccgccaacgccttcttcgtggccgcggagttcgcactgatttcctcgcgccgggaccgcctggattccctggtatcccagggtaaaaagggagctgaaaaggttctctacgcaaccgagcacctctccatcatgttggcgggcgctcagttcggtattacggtctgttctctgattctgggtaaagtcgcagaacctgcgatcgcccacttcattgaggtgcctttcacctcctggggtgttccaaatgatttgatccacccaatttccttcgtcatcgcactggcgatcatcacctggttgcacattctctttggtgaaatggtgccaaagaacatcgctattgctggccctgaaaccttaggcatgtggcttgctccagtgctcattgcgtttgtgaagattacccgcccgttgatcgagttcatgaactggatcgcccgtctgacccttcgcgcctttggtgtggagcaaaaaaacgagctggattccaccgtggacccagagcagctggcatcaatgatttccgagtcccgttccgaaggcctccttgatgctgaagagcacgcccgcctgtccaaggcgctgcgctctgagcagcgttccatcaaggaactggtgattaaggatgaggacgtgcgcacgctggcgttcggtaaatctggcccgaccttgcaccagttggaggaagcagtccgcgagaccggtttctcccgcttccctgtcaccggccgcgatggatcctacttgggttatatccacatcaaggatattttgcctcgtctggctgatcctgagatggatccctccgagaccattccgcgttctgcactgcgccctttgagcaatgtggatgccgacggcctcatggatgacgtcttggattttatgcactaccgctccgcgcacatggctcaggttcgcctcaaaggtgagcttctcggcgtgattacgctggaggatctcatcgaagaatacgtgggcaccgtcaacgattggactcacgaaagctccgacgac

SEQ ID NO: 1601 - DNA, 1380 bp, Corynebacterium glutamicum
atggacatactcataagcatcctctcactgctaggcttcgtgcttcttaccgcgagcaccggactattcgtggccattgagttcgcactcaccggcttagaaaaatccactgtagaaacacatgtgaagcaaaaaggcgacagcagcgcccgcgcagtgcagagggatcatcaaaatctgtcgttcgtgctctctggtgcccagctgggcatcacgatcacgacacttgccacaggcttcctcgcagagccggttttggccaaattcttcaccccagcacttgagctggtgggattaaatgaatcagcaagctccgcagtagccctcatcatcgcactgttggtggcaactaccctctccatggtttttggtgagttggttcccaaaaactgggcgatcaccaacccgttgggcgtggcacgttttgttgtccaccctgtcaattggttcaacatggttctcaagccgtttattaacggcatgaacaagtctgcaaactttattgtccgcaaacttggtattgaaccagccgaagagcttgcctctgcccgttcctcccaagagctcaccgccttggtacgcagctccgcggaaagcggcggactggatcaaaacaccgcagcggtgatcaaccgatccctgcagttcggtgacgccaccgctgatgaattcatgacacctcgctccaccattgaatcattgcgtgccacagacaccgtcaatgatttgatcgagcttgccctggaaacgggtcactcccgcttcccagtcaccgaaggcgacttggatgaaaccatcggcatggtccacatcaaggacgcattctctgtagtgcaggcagaacgcgccaccaccatggtgcgcgatctagcccgcaaaattcctgtggtaccagccagccttgacggcgactctgtcctcaacgctgtccgctccgccggctcccaagttattttggttgccgatgaatacggcggaaccgcaggcatggtcaccatcgaagacgtcgtggaggaaatcctcggcgaaatccacgatgagcacgacgactccgacgccgaacgcgatttccaacaattcggcgccagctgggaagtctccggcctggtccgcatcgatgaactcgaaaaacgcgtcgggtacgtctcccctgacggcccctacgaaaccctcggcggcttgatcatgtacacagtcggcgccattcctcgcgtcggcgatgtcgccctactcccactgaccgataccccaaccatggatgaattcgaatccggcttctccggacgctggatcgcacgagtaacggtcatggaagatcgacgcatcgacaaagccgttctcacccccatcacccatgaagaagcaaaggagtacgaaaag

SEQ ID NO: 1602 - DNA, 219 bp, Corynebacterium glutamicum
gtgccgtgggggagttttagctcttgggaccgtctttccttgaagtctgacgcctcgggttggagcggcccgttgatctggatccgctttgtccgcgcctgcgtggattccggctggaacctctggaatcagaacgattatgggtatttttttgttcccgctttggctgctgctgtccaggtgctggaagagcaacgcctgacgggcgtcgtgcaccag

SEQ ID NO: 1603 - DNA, 1344 bp, Corynebacterium glutamicum
atgactacctttctagaactcaagcttcccgacgagattgtgcgcgaacttcgcagtcagggaatcaccgaggcattccccatccaagaagcagccatccccgatgcgctcgctggcaaagatgtcctcggccgtggacccaccggctctggtaaaaccttcacctttgggcttcccatgatcacccgactcgcgcgctcgggcgcctccaaaccaggtcgcccccgcgggcttgtcctggttcccacccgtgaactagcagctcaggtgcgtgaacgcctcgacgatcccgcccgcgttatgggtctgcgcgtcctcgaggtggtcggtggcgtcaacatcaaccgcaacatcaccgcacttgccacaccagtggatatcttggttgccacccctggccgcgcccaagatttgatcaaccagaagaagctctccctcgctgatgtttccgtgacagcgttggatgaagccgatcagatggccgacatgggctttttgccacaggtaaaaaagctcatggacctaacccctaaaaatggtcaacgtctgctgttttcggcaacgttggacggcgatgtgagcaaattggtcgatcgctacctccacaaccccatcacacactccaccgctcctgttcaggcagcagtggacaccatggaacactaccgacttctggttggcggacgcgatcctcgcaattccgttgtcttgagcatcgctgcacgtgaaggcaaaaccatcatgttcatgcgcaccaagcacggtgtggatcgacaggtgaagaaactgcgccgcgtgggtgtcaacgcagtgggtattcacggcgataaaggtcagtccacccgcaccaacgctttggctggtttcgccgatggatcaatccccgtcttggtggccaccgatatcgccgcccgtggcattgacgtggatgacgtctcgcttgttgtgcacgttgatcccccagcagaacacaaagcgtatttgcaccgcgctggtcgtactgcacgagccggaacttccggtacagttgtgactctagtaatggacgaacaaatcaaggaagtccgtgaacttttccaaaaagcaggcgtgacagccgctgaggtaaaagtcaacgaaaactcacctgaattggctaaaattactggtgcacgacgcccgtcaggcgttgctcttccagcacctggacagcagcagccaaagcgggaacaaaaaaatacccataatcgttctgattccagaggttccagccggaatccacgcaggcgcggacaaagcggatccagatcaacgggccgctccaacccgaggcgtcagacttcaaggaaagacggtcccaagagc

SEQ ID NO: 1604 - DNA, 735 bp, Corynebacterium glutamicum
atgggcaagggatttaccggcgctattttgaccgtcatgggcgtgaaatcgcatatcgccaccaccacgggaaaaaccgtgatcaatgaccgcatggtgaccattcattttcattccgagacgctgctcaacacggaaggtgaagtccccggcgattggctgcgtctgtggttcccgcacgagagccgacctggaaagctctaccaacgcgcctacaccttgaccaacgtggatgccgatgccggtacctttgacctggcttttgtgctgcacgagccgctggggcccgcctcggcgtgggcgacgcgctgcgaggccggggaaagcctggaagtcatgcgctacccaggaattccgttcgccatcccagatccagcgccgcgtggcttccttttcttaggcgatctcacctcttacccagcgatctgctcgattctggagaccttggacggtgaaatccctgcgaccgcgtatcttatcgcccacgatccacttgattacaccttcgattttccccagggcgagcacatcaccgcgcagtggatttccaacgaacaatccttcattgatcacatcgctgacacggattacaccgatttttatacctggatcggcgcggaatcctccgaaacccgtgcggccaagaagcatctgcagacccacgccggcatgcccaagacgcacatgaacgcgcaaggttattggaacaagggcagagccatgggtaaaagcaat

SEQ ID NO: 1605 - DNA, 1476 bp, Corynebacterium glutamicum
atgccgtcaagtacgatcaataacatgactaatggagataatctcgcacagatcggcgttgtaggcctagcagtaatgggctcaaacctcgcccgcaacttcgcccgcaacggcaacactgtcgctgtctacaaccgcagcactgacaaaaccgacaagctcatcgccgatcacggctccgaaggcaacttcatcccttctgcaaccgtcgaagagttcgtagcatccctggaaaagccacgccgcgccatcatcatggttcaggctggtaacgccaccgacgcagtcatcaaccagctggcagatgccatggacgaaggcgacatcatcatcgacggcggcaacgccctctacaccgacaccattcgtcgcgagaaggaaatctccgcacgcggtctccacttcgtcggtgctggtatctccggcggcgaagaaggcgcactcaacggcccatccatcatgcctggtggcccagcaaagtcctacgagtccctcggaccactgcttgagtccatcgctgccaacgttgacggcaccccatgtgtcacccacatcggcccagacggcgccggccacttcgtcaagatggtccacaacggcatcgagtacgccgacatgcaggtcatcggcgaggcataccaccttctccgctacgcagcaggcatgcagccagctgaaatcgctgaggttttcaaggaatggaacgcaggcgacctggattcctacctcatcgaaatcaccgcagaggttctctcccaggtggatgctgaaaccggcaagccactaatcgacgtcatcgttgacgctgcaggtcagaagggcaccggacgttggaccgtcaaggctgctcttgatctgggtattgctaccaccggcatcggcgaagctgttttcgcacgtgcactctccggcgcaaccagccagcgcgctgcagcacagggcaacctacctgcaggtgtcctcaccgatctggaagcacttggcgtggacaaggcacagttcgtcgaagacgttcgccgtgcactgtacgcatccaagcttgttgcttacgcacagggcttcgacgagatcaaggctggctccgacgagaacaactgggacgttgaccctcgcgacctcgctaccatctggcgcggcggctgcatcattcgcgctaagttcctcaaccgcatcgtcgaagcatacgatgcaaacgctgaacttgagtccctgctgctcgatccttacttcaagagcgagctcggcgacctcatcgattcatggcgtcgcgtgattgtcaccgccacccagcttggcctgccaatcccagtgttcgcttcctccctgtcctactacgacagcctgcgtgcagagcgtctgccagcagccctgatccaaggacagcgcgacttcttcggtgcgcacacctacaagcgcatcgacaaggatggctccttccacaccgagtggtccggcgaccgctccgaggttgaagct

SEQ ID NO: 1606 - DNA, 462 bp, Corynebacterium glutamicum
atgacttcccgcgatgatcaaccccaagatctgctttcgcttgcagaacttgccgccaccagagctttaaccacagacgaacttgaagcactcaacaacgccaattatggcctcgaccgcaatctggggctgcgctacaccaccatcgagcccggccgggtggtcagcgaacttcacgtggcatccaagcacctgcaagtggtgggcttggtcaacggtggtgtctacgccgccatcgccgaatccactggatcagtcgccagcatgatttccgcccctggaaaaatggtcgtcggcatcaacaacaacaccgacttcatttctgctgtgagctccggtgtcatcgtggccgaagcaacgccgattcagctaggtggccgcacccatctgtggcagatcgaatgcacccaccgcggagaagtcgtcgcacgaaccacactgcgcaccatggtgctgaacaag

SEQ ID NO: 1607 - DNA, 675 bp, Corynebacterium glutamicum
gtggcagatcgaatgcacccaccgcggagaagtcgtcgcacgaaccacactgcgcaccatggtgctgaacaagtagccctatactcgggcaccatgactacatggaaagagctcacagataacaacccagcgcactcagaaaactacgcgcagcgctggcgaaacctcgccgcagcaggcaatgatatttacggcgaagcccgcctcattgatgccatggcacccaggggagcgaaaatcttggatgctggctgcggccagggacgcatcggtggctacctgtccaagcaaggccacgatgttctaggcacagaccttgatcccatcctgattgattacgccaagcaggactttccagaagctcgctgggtggtgggagatctctctgttgatcagatctcagagactgattttgatctcattgtctccgccggcaacgtcatgggctttctcgctgaggatggtcgcgaacctgcactagccaacattcaccgcgcactgggcgccgatggccgcgctgtcatcggtttcggcgcaggacgtggatgggtctttggagacttcctcgaagtcgcagaacgcgtgggcctcgagttggaaaatgcttttgagtcttgggatcttaagccttttgtccaaggctctgagttcttagtggcggtatttaccaagaag

SEQ ID NO: 1608 - DNA, 741 bp, Corynebacterium glutamicum
atgagcaccgtaacggcagtgcaggtcaacggcctaaaagtttccatatcgtccggtttttcacgcaagaaaacaaaaacgatcttgcatgatctcgatttcaccgtagagaccggaaagatcacgggattgctggggccatcgggcagcggcaagacaactttgatgcgcgcgattgtgggagtgcaaaacttcgacggcacccttgaggtgtttgatcagcccgcaggtgctgcctctctgcgcgggaaaatcggctatgtcacccaaaacgccagcgtatatcacgatctgtcggtgatagaaaacctcaagtatttcggggctctggctaaaggaacctccactccacgcaccccggaaaagattctggaggtcttagacatcgcagatcttgctcaacgccaagtatcaacactatctggtgggcagcgcggccgagtctcccttggatgtgcgcttattgcctcaccagaactcttggtgatggatgagccaaccgtgggtttggatcccattacccggcaagcactgtgggaagagttcaccaccatcgcaaaagcaggtgctggagtggttatctccagtcacgtgttggaggaagccgcgcggtgcgacaacctcattttgttgcgtgatggtcggatcatctggaggggaacacccacacgccttctagaagatacaggcaaaagctcatacgaagatgctttcttggctgccattgacggggtaaggtca

SEQ ID NO: 1609 - DNA, 741 bp, Corynebacterium glutamicum
atgaaccctcactatctgcttgccacggtcaaacgagtcctgctgcagctgaaagccgataaacgttccatcgcgctgattcttctagcacccgtggcgttgatgtcgctgttttattacatgtattcctccacaccggcaggcacccagctgtttaagaccatttccacggtcatgatcgcagtgttccccttgatgctcatgtttttgatgacgtcggtgacgatgcaaagagaacgcaacgctggaacgctcgagcgcttgtggaccacgaacattcaccgcgttgatttgatcggtggctacggggtggccttcggcatcatggcggtggcgcaatctttgctcatggtgctcacccttcggtatctcctgggtgtggaaaccgaatcggagtggtggatttctacgctcattgctgcgatcaccggtcttatcggagtgtctcttggcctgttgagctctgcgtttgccagcactgagttccaagctatccaaacgctgccgttgcttattttgccccagttcctattgtgcggtttgctgatcccacgggatgatctgccggatgtgttgcgctgggtttctaatgtgttgccgctgtcctatgcagttgatgcagcgcttgaggcctcacggacgggaatcggacagcaagtagtggtcaacattgccatctgcgccgcgtttgccgtgagcttcctgctggtggcggcgctatcgatgccgagaatgacccgc

SEQ ID NO: 1610 - DNA, 873 bp, Corynebacterium glutamicum
gtgtcgtggcaccaagcaactgacgctccaccaagcatccgcatcaccacgcttgcgccatcgctgcagcctaatcagcgcaaagtcgccgaagtcatgcttgtcgacgcccccagcatcgtcgaactgaccgctcagggccttgcagatcgcgtgggggttgggcgtgccaccgtcatccgcaccgcccagtccttaggctacgacggattcccgcagctgcgcgtcgccctggcgcaggaactggcactggcgcagggcgcgtcgagaagcatggttgaaggagcgttaagctcctcgttgcttggtcatttgcaggcggggatctctgattttcaagcgtcgttgggcacggtggcctctgcgttgaccgaagatgatctcacgcgctgtattgaggggctggattctgcgcgccgggtactcgtggcctctcatgggctgtccgcgccgttgggtttggatttttcgcagcgtttgaactcgatgggtcgttcagctgaagtgcattctgattccatgtcggagcagattgtggctcgtcaattaggtgaaggttctgtctgcttcgcgatttctggttcaggtgccagcaaagcaacgcttgcgaccatcgaagcagcacgtgcaggtggggcaaccattatggcgatgacatgttttgcgcattccgccatcgatgtggccgctgatgtgtccttgatcgttcccccgatgacagcctcattccaagatgagctcacccgaacgtcacgggccgcgctgatgttggtctctgagcaattaatcgagctgctcatcactcaccgtggccaggcagccgctcaggcgagggccacatcgatgtcgatgattggcacctcgctggaagag

SEQ ID NO: 1611 - DNA, 846 bp, Corynebacterium glutamicum
atgagcaccttaacctctcaccgcacagtaccggcccccagctctcccccggcgcgccccaacaaactggcgcgcaatatcgttgcaattgtcgctgcgctgattgtccttatagctaccggcacgctcaagatcgagtggaatgagcttccgcagatgcccgcgcaggtgtggcattacttagagctgatgtttagcgatcccgattggtcgaagtttggccgcgccgtccaggaaatgtggcgttccatcgccatggcgtggttgggtgccattttatgcgtggtggtctctgtccctctgggaatgttggctgcccgcggggtgggaccttattggctgcgtaccgttttacggttcgtgttcgcggtgattcgtgcgttccccgaagtggttatcgcaattattttgctaactgtcaccggcctaactccttttactggtgcgctcgcattgggtatctccggtattggacaacaggcaaagtggacctatgaagccattgagtccactcccaccggcccgtcagaggcagtgcgtgcagcgggtggaactacgccggaggttctgcggtgggcgttgtggccacaggttgcgccatccattgcatcttttgccctgtaccgctttgagatcaacatccgtacctctgcggtattgggcatcgttggtgcaggtggtatcggtagtatgcttgccaattacaccaactacaggcagtgggacaccgtgggcatgctgctcatcgtcgtggttgtcgcaacgatgatcgtcgatctcatctccggcaccatccgccgccgcatcatgaagggggctagtgaccgtgtcgtggcaccaagcaac

SEQ ID NO: 1612 - DNA, 804 bp, Corynebacterium glutamicum
atgaccacgccttcttctccacttatcccacaaaagcctcgggctggggtaaagacctatctcatcatcggcgccatcgttgtcttcaccgtggcaacagcaaccccagcgctaggtggcattgagcttgatttcgcttccattgctgcgaattggcgcaatggtgccaacaaactcctgcaaatgctgcagcccaactttgcgttcttgcctcgtacgtggcttcccatgttggaaaccctgcagatggcgcttgttggagctgtcttgtctgctgccgtatcggtgcctttgacgttgtgggcagcgcaggcaaccaacaccagtgcgattggtcgtggcattgtccgcaccatcattaacgtggtgcgctctgtccccgacttggtgtatgccaccatcttggtcgccatggttggtgtcggcgcattacctggcattttgacgctgtttctgttcaacctgggcatcgtggtcaagcttgtctctgaggccattgattccactgagcatccctatatggaagcaggacgcgcagcaggtggatcacagttccaaatcaaccgagtctccgcgcttcctgaagtcatgccgctctttgccaaccaatggctctacaccctagagctgaatgtacgcatctccgccatccttggcatcgtgggcgcaggtggcatcggcaggctgcttgatgaacgccgagctttctatgcctacgcggatgtttccgtgatcattctggaaatcctcatcgtggtgattgtcattgaagtaatctccaacgcacttcgaaagaggctggta

SEQ ID NO: 1613 - DNA, 804 bp, Corynebacterium glutamicum
atgaattctgatgcttcggctaccaccaactcctgggctatcaacttcgaccatgtgtcggtgacgtatcccaatgggacgaaagccctcgatgatgtttccctcaccatcaatcccggtgagatggttgccatcgtgggtctgtcaggatcgggtaaatccacgctgattcgcacgatcaacggtcttgtccgcgctacggaaggcaccgtgacggtggggccgcatcagatcaacaccttgaaggggaaagcactgcgtgatgcccgtgggcagatcggcatgattttccaggggttcaacctgtcggaacgcagcagtgtgttccagaatgttttggtgggccgcttcgcgcacacagcgtggtggcgtaacctcctcgggtttcccacggagcacgacaagcagattgcttttcacgcgttggagtccgtgggcattttggacaaagtgtggacccgagctggtgctttgtcgggtggacagaaacagcgcgttgctattgcgcgcgccttatcgcaagatccgtctgtcatgctggcagatgagcctgtggcaagccttgatccgccaaccgcgcattccgtgatgcgcgatctagaaaacatcaacaacgtggaaggcctcaccgtgttggtgaacttgcacttgattgatttggctcgtcaatacaccacaaggcttgtgggtttgcgtgccggcaagctggtctatgacggtcctatctctgaggccaccgataaagactttgaagctatctatggtcgccccatccaggctaaagacctgctaggtgatcgcgca

SEQ ID NO: 1614 - DNA, 210 bp, Corynebacterium glutamicum
atggactcaggccactggcttgcagcatccgaagaagaagacgcagatgatgaggaagaagactcatcggaagaggaacaaccaactagagcaagggtagagatcgcaagcgtagaaacagcaacacgcatggacttggatggcttagagagcttgaacatgagatctttaaaaacctttcagcgacatgagacaagaaagttaagaaga

SEQ ID NO: 1615 - DNA, 1050 bp, Corynebacterium glutamicum
atgttcaagctctctaagccatccaagtccatgcgtgttgctgtttctacgcttgcgatctctacccttgctctagttggttgttcctcttccgatgagtcttcttcctcatcatctgcgtcttcttcttcggatgctgcaagccagtggcctgagtccattactttgtctcttgttccttctactgagggtgaggatttggctgaagcgttggctcctttgactgattacctgtctgagaaccttggtattgaggtcaatggtgtggtggcgtctgattacgctgcaaccgttgaggctttgggtgctgatcaggctcaggtgatcatcactgatgcgggttccctgtataacgcgattgagcagtacgatgcgcagctgattctgcgtgatgtgcgtttcggtgccacctcgtactctgctgtggcgtacaccaacaatcctgataagtactgcgacgatgccccagtggctgcgtcttatgctgcgtccgatgtagacatgctttactgcaacggtattgaaactgagggccaggctgctaccggtgagggcccagcagctcttgatgcgctggaaaagatcgagtccggtgacaaggtagcgctgcaggctgcaacctctcctgcgggttaccagtaccctatcgtcgctatgcaggatctgggcatggataccgattccgcttttgttcaggttccagtagagggcaacaacaacgctgtgctgtctgtcctgaacggtgacgcggaagtgtccttcggtttctgggatgcgcgttccaccgtgctgtctgaggctcctaacgcagctgaggatgtcgtagcgtttgcctacaccgagatgatccctaacggtggcgtcgcagcgtccaagtcccttccatccgacctggtggaaaagctcaccgagttgatggatgattacgcagattcctccgaggaagccaaggatgtcatgttcgacatggttggtctatctgactggactgctgataccgcacaggatgaaatcactcgttacggcgagatcctgaagaagttctccaac

SEQ ID NO: 1616 - DNA, 702 bp, Corynebacterium glutamicum
atgatgaacgcatcgtccatttcttcccgattcaaggatctttttgtgacacccagtattgtttttgatttcgatggcacgcttgccattggccatggccctgtccttgcgtatgcattgtgtgttgcaccggagggttccaaggactttctggagcgtgtgcgcagggagcttcggcgctatgacgatggtcagagtatttaccgtgatgggtatgacattgtggctaagttggcgtcggaattggggattgatgatggcacgatgtctgtcgcttatggcgagagccggaagttgcttggttcggatttagcgcctgttgagcatgtgcggggtattaaggatattttgtcctcgttgaaaggtcatgctcggttggttttagctaccaatgccccggaaaatggcgtgcatgatttgctgcgtcagtggggtgttgctgatttgtttgatcagttgcattttgtggtgggtaagcctgcagggttgatttcgatcatttctgatttgcagcttgatggtccggtgcttgcggtgggcgatatttatgaattcgatctgagtcctgcagcgcagttaggtgcagatacggctctggttggagctacagcaaccatttctgaagcgaaggtctccatgcgtggagattctatcgctgatctccctctccttgcctgggtttcttcccgggtctcatcttct

SEQ ID NO: 1617 - DNA, 1584 bp, Corynebacterium glutamicum
gtgaattcgccttctgccccacgtgtgttgtctattgcaggcactgatcccacaggtggtgcaggtattcaggctgatctgaagtccattgcagcaggtggcggctacggcatgtgcgttgtgacctcgctggtcgcgcaaaacacccacggcgtcaacacgatccacaccccacccttgacctttttggaagaacagctggaagcggtcttttccgatgtcaccgtcgatgccatcaagctcggcatgttgggctctgccgacaccgtcgatctggtggcttcatggcttggttcccacgagcacggtcccgtggtgcttgatcccgtcatgatcgccaccagcggtgatcgcctactggatgcgagcgctgaagaatcgctgcgccgcctggccgtgcacgtcgatgtggtcaccccgaatatccccgaacttgccgtgttgtgcgacagtgctcctgccatcaccatggatgaggccattgctcaggctcagggatttgcgcggactcatgacaccatcgtcattgtcaagggtggacatctgactggcgcgcttgctgataacgctgtcgtgcgccccgacggctcggtgttccaggtggaaaacctgcgtgtcaacaccaccaactcccatggcacaggctgttcgctctctgcgtcacttgccaccaagatcgccgccggcgaaagcgtggaaaaagccctcgagtggtccacgcgttggctcaacgaggcgctccgccacgccgatcacttggctgtaggtactggaaacggccctgtcgaccacggtcacctggcacgacgcatgacccacgcggcggaaaccactccctgggcacaccttcgggctccgcgcctagacggcgccaccgcggcaagtttcaccacaccctccacggtaaaaagcccagctccacgcatcgaacctgccgggcctttcacgcgcgcgctgtgggaggcaagtggcgatatcatcgcgggcatcaacagttctgacttcatcaccatgcttggcgacggcaccctccggcgcccagagttcgatttctacatcgaccaagacgcccaatacctcgcccaatattcccgagcattggcacgactctcttcgatcgcacctgattcacacgcacaaatcgaatgggctcaaagcgctgcagaatgcctggtcgtggaagccgaactgcaccgctcttatatggcagggaaagaagtctccgcaccatcacacatcacgatggcctataccgacttcctcatcgcacgcacctacactgaggactacgtctgcggtgtggcggccgtactgccgtgctactggctctacgcagagatcggattgatgctggctgaacaaaaccacgacgagcacccctacaaggactggctcaacacttactccggtgaagaattcatcgctggaacccgtgcggctatcgcacgtctagaaaaggctctagaaaatgcgggtgctgaacaacgcgtcgatgctgctcgagcattcttgagcgcctctgttcatgaacgcgagttctttgatcaggcaactcgccatggttggacaatggttggatctagc

SEQ ID NO: 1618 - DNA, 804 bp, Corynebacterium glutamicum
gtggctaactcgtttttggattctttaactcttgttcgacaaaacactccccttgttcagtgtttgaccaactctgtggtcatgcaattcacggccaatgtgttgcttgccgcgggtgcgacccctgcgatggtggatactccagctgaatcggcagaattcgccgctgtggccaatggagtgctcatcaatgcgggaactccttctgcggagcaataccaaggcatgaccaaggccattgagggtgcacgaaaagctggcacaccatgggtgttagacccagttgctgtgggtgggttgtcggagaggaccaagtatgcggagggaatcgtcgataagcagcctgccgcaattcgtggaaacgcctcagaggtcgtggcgcttgcggggctcggtgccggtgggcgcggcgtagacgcgaccgattccgtggaagtggcgttggaggcggcgcaattgttggccaagcgcactggtggcgtcgtggctgtctctggtgcggaggacttgattgtgtctgcggatcgggtgacgtggttgcgttcgggggatccgatgttgcagctggtgattggcactggatgctctttgggcgcgctgacagctgcatatctaggcgccacggttgactcagatatttccgcgcacgatgctgtgttggctgcgcatgcccatgtgggtgctgctggccagattgcagcacagaaggcatcggcgccaggcagctttgcggtggcgtttattgatgcgctttatgacgtggatgcccaggctgtggcctcgttggttgatgtgcgagaggcc

SEQ ID NO: 1619 - DNA, 1314 bp, Corynebacterium glutamicum
atggcagaggcacgtttgcgccatcttgaacccattgatgtggaagagtggcctggggtggcgtcagtgcccaacctagcgtttgctggtgcacgcgcacggcaagcagaatatcgatttgccaaggcctgcagcaacgcaggtttagttctgctaggaaatgacccggatctcattattgatcatgaggaattattctcacgtttggccgcatcgggctggctggggctcgctgagagctacatggcaggcgagtggcgcagcgagaggcttgccgacgtcttgaccgctttgttgggaactgggtttaaaccccgcggcaaactatctggatcgttcaccctgccagggcaagctgtggatgccggaggcgcactacccaatgaactcattcgtttaagttcaggtgatggcatgagcgcatttggtggagtttttgcctccggtgttccaaccactttacgtaccgcagtgaaaagccatgtgccgggagctggtcgcaatagggagcccgcatctcactttgtggatatcaccaagatctcggagcctgtggccgtggagcgtgaagacctcggcgaggctcagcgccgagcagcgtcctttttgcttgacggcgccaaagttaaagccggaagccatgtgttggagtttcccagcagtggtggagctttagctattttggctgctcgacgccagggaactgttgacgctttaacggctgatcccgcgcaagtttcaagcctggaggagacgtttgtgctcgccggtgtggaggaggatattcacatcgaggtcattccccaggcgattccctcgccacgcgaatggggtggcgcctacgattcgatagtcgccatggagaagctagaagtggtgggcaagcacggttccaagcggtttattaaagctatcgacagaatgctcaccaccggcggcaacgtagccatgcaatccttggtagctactgaccaatggagtcctgtgtgttctgaagcgatttctttgctcaaggcctatatttggcctgcgctgcattacccaactgttgatgaagttcatcagcttgttgatagggattcttctctgcgcgtggtgaaggaaacacactttgcgggccattacctaaaaagcgtgcagttgcaacgtgaagtgtttgaaggccagatacgcgaagcggcggcagatggctttgatgccgtctaccgccgcatgtgggtgtatcactacgcgcttattgaagccctgttacgcctgggatgtctcaatgcagtgcaatttgcgttgacgacaagaaacagaagggggcgtcga

SEQ ID NO: 1620 - DNA, 1386 bp, Corynebacterium glutamicum
gtgaccacaactgatcactccacggagttgaatccttctgatccaggtgggcagacggcaaccctagtgattgacaagaaaactaaacgtcgggttgcagcagcctccaccatcggcacaaccatcgagttctacgatttttatgcgtacgctgcggcagctgtcgttgttttcccaagtctgtttttccctgccaatgacaacccaaccgtgaacctgttggcatcgtttgccacctttggtcttgcgttcgttgctcgtccactcggttcaatcattttcgggcacttcggtgaccgtgtgggacgcaaagctaccttgatcggttcactgctgaccatgggcattgccaccatcttgatcggcctgctgcctacttatggtcaggtcggaatcattgcaccggcgctgttggcgctcatgcgtttctgccagggcctgggccttggcggtgaatggtctggcgctgcgttgctggctggtgaaaacgcggaaaacactcaccgcgctcgtgctgcaatgtggccacagctgggtgcaccgtttggtttcttcttggccaatggtttcatgctcattctggtcggtgtgcttgcccatcaggacggcgatcttcacggcgcgttcatgacctggggttggcgtctgccattcctgtcttcggcgatcatgatcgcagttggcctgtgggtgcgtttctcactggaggaaactccagtgttcaagcaggctgttgatcagggcaagaaggtgaagtctccgctcaaggagctgttcaagacttcccctggccctgttgtgcaggctactttgatcatgctgtccacttataccttgttctacctggttaccacgtggattctgtcgtatggcatcggtaatcgcagcaccggaaacggcctgtctattccgtactttgagttcttgcagttgcagctggccaccatcgtgttcttcgccatcatgatccctgtgtcaggctggttggctgatgtgtggggtcgtaaaaacaccctgaccttggcttctgtgctgcttctcggctttggtctgacgtttaatctgcttctcgatccagagaccgccaccaagaccaccgtgttcatcttcttgttcgtgggcatgagcatcatgggtctgatctttggacccatgtcggcaattttgccggagctcttccccaccaacgtccgctacacgggctccggaatcgcctacaatgtctcctcgatcctcggtgcagctattgcaccgttcatcgcaacgtggctggtgtccgagttttcagtggcgtacgtcggctattacctcatcatcgtcaccgcaattacctttgttgcggtgctgacgatgaaggaaaacaaaaaccacgacctccgagaggtc

SEQ ID NO: 1621 - DNA, 474 bp, Corynebacterium glutamicum
atgacagaggaacgcgagattctgacctatgagatgttcggaacagcaatgcgggagctggcccaagaaattattgatgactaccagccagattgcgtgctgtccattgcgcgtggtggtcttctaatcggtggcgcacttggttatgcgctgggtatcaagaatgtatcggtgatcaatgtggagttctacaccgatattggagagcacttggaggagccaatgatgctgcctccaactccaaaagctgttgatctctcgggaatgcgtgtgctcgtcgctgacgatgtcgcggataccggaaagactcttgagttggtcagggacttcctgggtgaccaagttgtcgaagtgcgcactgcagtgatctatcacaagccaaacagtgtgtttaagccggagtatgtgtggcgtgagactgataagtggattaacttcccatggtctaccctgcctccagtggagccttctaag

SEQ ID NO: 1622 - DNA, 699 bp, Corynebacterium glutamicum
ttgcacccggcataccacctgaacaaggccttaaaaaggggctttatcggttcaggcgagcgagaccttcggcgttcacacttcgccggggtctattttttatgcccaggcacggctcataggagaaccatgccctttctacaaatctctctgctttccatcggtgtcgccgccgatgcgtttgcttgttccgttgtccgcggcaccgccattcaagtcaaccttttcaaacgcgcacttgttctcgcgggcatctttggtgtcttccaagcggcaatgcctttaatcggctggttcattggccgtttctttgctggaatcaccttcatcgctgaaattgatcactggatcgcttttgcactattgggtattgtcggcaccaaaatgatctgggatgccttccaacctgaagatgatgaaaccattgtcgatgacggccgcgttcaatttagaccagcaattatcctggggctagccaccagcattgacgcattagccgtaggcatgggcctggcattcgtggaagtttccatcctcaaagtggcactgtccatgggcagcatcaccttcgcactttcgcttgctggcgcctggatcggacaccatggtggaggaaagtttggcaagtgggctacgattcttggcggaataatcttgatcggaatcggcgcaaacatcgtctacgaacacctcagcgcg

SEQ ID NO: 1623 - DNA, 996 bp, Corynebacterium glutamicum
ttgaaacgggtcgttgaagcgtgggatagatttcaaatcccactgtatatcacggctcttatcgccggagcactggtgggtttgcagtggccaggctctacagggggtttcgaaagcgccattaacccagcgttaatggcgctgctttatgccacttttctcggtattccgatcactcggattggtgcagcgctgaaagatctgagatttctcatagtgctcatgtccgtcaattttgttgcagtgcctctggtggcttttgcgttgagcagattcattgcgggtgatgaggcgcttctaatcggatttttactggtgattctcgcgccgtgcattgattacgtcattgtctttgctggtttggccagggccgcccaagacaagctccttgccgccacgccaatattaatgcttgtccaaatcctgctgatccccgtcttcctggctgtttttgtgggttcagatgcccttggctcaatctctttcggcccatttgtagaagcatttttcctcctgattctcattccacttgttgctgctgcgggaactcagcaagtggcaagaaagtggcaggtaggacgtacaattatggctgctgcagaagcaatcatggtgcctttaatgatgctgacgttgttcgctgtcatcgcatcgcaagtggaagctgtgagtggtcaattcaccgatatcgccacagtagtgccactatatgtcgcctttttgatggtgatgattccaattggtggcgggatatccaaactcggtggcttaggtttcaaagagcaacgagccatcgtttttagcggagcaacccgtaactctttggtcgttttacctttagcgttagcacttcccgcaggcctggaaatagcggccgtcgtagttgtcactcaaaccctcgtggaactgattggcatggttgtctacgtgcgcatcatccctttaattttccatgaaaagcagacatacaggaaactttcaggcataggggagtca

SEQ ID NO: 1624 - DNA, 483 bp, Corynebacterium glutamicum
gtgagtctttcaaacaaagctaaaggaatcgttgcagtaatcatcgtcgcctggatcgtcgcgatggctggcatggtcgcatacgcgtcaagcaataatgctgataagacatttccaactgcaggtgcgctagaacaaaccgtcgcagcatttgataggcaaggccttcaggtctctgcagtcgcactggcagacatctacggcgatgaatacgtctccgcggcgattctgtgcgaaggaactccaaccgcaacactcgagcagtcactgggcgtagacctgtctgagctgaacctggacgagtctggtgttccttcgggcgtgtcctacttggctctgtccaatcaggatggggaagttgtctacgacaagattgatcgtgccaacgttgatctctgcgcaacgccactcaatggtgctttcagcgcttattcattgatgccagttgccaaggttggcgagaactcctgggcgatcgccgct

SEQ ID NO: 1625 - DNA, 693 bp, Corynebacterium glutamicum
atgtcgcaggccgctggtaagtttaagcccatgacttcaacgctcgccgaatcaacacttacatcccttaaagaacttgaggatccaaagatcctttccgtcaatgaacgccacggcgatgatcacgcagtgaacctcaccaagcttcgcgccgttgccaaagagctgaaaaagaaccagccgctggctcgtgagctttgggcaaccgacgatacagccgcacgtttggtggcgttgcttatttgccgacccaaggaatttgatcagtctgaactcgactcgatgatccatgaggctcgcacgccgaaggttcttgattggttgatcaattatgtggtcaagaagaatcctcattggaacgatctccgtgtgctctggcttgaagatcccgccgagaatgttgcggccgccggctgggctctcaacactcatgccgttatcacaaagccggacgcattggacgattccgaaatccttgacaccattgaagctcagatgaaaactgccgagcctcgcgtacagtggtcaatgaatgaatgtttggcgcaaatcggcatccatcgtccagagcttcgtgatcgtgccattgccattggtgagcgcctggaagttctcaaagattatccgacccctccaaattgcacctcgccttttgctccgatttggatcgaagagatggttcgcaggaaaaaa

SEQ ID NO: 1626 - DNA, 1455 bp, Corynebacterium glutamicum
gtgcttgcctcgtttaggttcgcgtttagtagcccgcggaggtttcgcaccgaggttttagctggcctcgtggtggcgctcgcgctgattccggagtcgattgcgttttccgtattagctggcgtggatcctaagatgggtctttttgcgtcgtgcaccatggcaatgaccattgcgcttacaggtggacgccctgcgatgatttccgcggcgacaggcgctgtggcgctggtgattgcaccggtggttcgggatcatggcgtggaatatttcctggccacggtaattttggcgggcattattcagattgcgttgtcgttgctgggtgtagccaagctgatgcggttcattccgcgttccgttatgctcggatttgttaatgcgctggcgtgcttggtgttttttgcgcagctgccgcacctgatcgatgttccgtggatggtgtatccgctgttcgcgctgggtattggcatcatgctgttttggccgaagctgacctcggtgattccggctccgctgattgttatcgtggccttgactgcgatcgtgtgggttttcggaatcaacattccaaacgtctctgaccagggcgaactcccctcttccctaccagaattcctcattcccaacgttccgcttactcttgagactctaaaaattattgggccgtatgcgcttggaatgtcgcttgttgggttgatggaatcgctgctgaccgccaagctggtcgatgatattacggaggttcactccaataaatcccgcgaagctgcaggtcagggcatcgcaaacattatcaccgcgtttttgggcggcatgggtggctgcgcgatgatcggccagaccatgatcaacgtgaaaaactcaggagcccgcactcgcctatccaccttcttggccggcggcttcctgctgctcctggtggttttgctgggcgatgtcgtgggcaaaatccccatggcggcgctcgtggcagtcatgattatcgtctccatcgacaccgccgactggcattcgctgaacccgcgcaccctcaaattcatgccgctgagtgaaacgatcgtcatgtttataacgatcatcgcgaccctcgtcaccggaaacctggcgatcggcgtcatcctcggagtgctcaccgccatggtcatgtttgctcgccgcgtggcccacctcgtgtctgtggagcgcaccaccgacaacaacatcagcacctataccgtcaagggccagctattttgggcgtcctcgaacgatatggtgtactccttcgactactccgacgaggccgagcagatcatcatcgatctcaccgccgcagaaatctgggacgcctccacggtagccacgctggacagcatcatccacaaatacgccgcgcgcggcaagagcgtggagatcatcgggctcgacggccccagccgcgataggcttgagcgcctatcaggcaagctgggc

SEQ ID NO: 1627 - DNA, 426 bp, Corynebacterium glutamicum
atgttgttgtcggtggtgcgctccacagacacgaggtgggccacgcggcgagcaaacatgaccatggcggtgagcactccgaggatgacgccgatcgccaggtttccggtgacgagggtcgcgatgatcgttataaacatgacgatcgtttcactcagcggcatgaatttgagggtgcgcgggttcagcgaatgccagtcggcggtgtcgatggagacgataatcatgactgccacgagcgccgccatggggattttgcccacgacatcgcccagcaaaaccaccaggagcagcaggaagccgccggccaagaaggtggataggcgagtgcgggctcctgagtttttcacgttgatcatggtctggccgatcatcgcgcagccacccatgccgcccaaaaacgcggtgataatgtttgcgatgccc

SEQ ID NO: 1628 - DNA, 615 bp, Corynebacterium glutamicum
atgcacgtgagcactcttccaaacaagaaactgcgtactcgcattttcgcaggcaccgctgccgtcgcactgtcacttggtgttgcgtcttgctcaaacgcagaagatgctgtggatagcgcaacagatgctgccaactctgcaacctccgccgcgggatctgcaattaacgatgccaccggcacttccagcgcatccaccacagagccttccggaacctctggatccgactccgggtctgactctgctggaggagacaccactgaagtagaaagcgccgatgggtccaccatcagcatcccaactgccgtcgtcaccgctgcaaatgctgcaggattcagtaccccggaatccgtggaagaaggcccgaatggtgagtcattggtgacgttccctgaaggctacattgttaactctgcagaaggtggtgcacaagcactggtcggcatgatcggtgaaacctggatcggcgaaggcggactatccgcggcagtgggtctcccaactgggcctgaagaagcaacaacaaatggttggactcaacagttcacatctggagtaattagctggcttgatgatggatcaggacagttcgcagcttctgttgaacctgct

SEQ ID NO: 1629 - DNA, 207 bp, Corynebacterium glutamicum
atggggagtttgaaactcacaggtgtcttaagtgttgcgttgtttttctacttcatcgcgagttttatacgcggtccacagttgccaaccactcactgcaatgagcaagagcccaatgaggacgaagatccacatggattcccacagtacaaagccggtgaatccgatgagcacgatgagtctgaaccacagagctgggatcatccg

SEQ ID NO: 1630 - DNA, 189 bp, Corynebacterium glutamicum
atgatggcatcacggatgatcccagctctgtggttcagactcatcgtgctcatcggattcaccggctttgtactgtgggaatccatgtggatcttcgtcctcattgggctcttgctcattgcagtgagtggttggcaactgtggaccgcgtataaaactcgcgatgaagtagaaaaacaacgcaacact

SEQ ID NO: 1631 - DNA, 750 bp, Corynebacterium glutamicum
atgagcaacatgcagggaaacgattccaagaaatctagcggcgcgagtcgtgcggagagcccactgatcaagttccggacattgattatcgtcatctttgtcatcttgatcgttggtttggcatctattgcagtgggacctgtcgtgtaccagctcatcatgggacctggtgtgaaaaccgaaggaatccaggctgatggcgcagcacctgcgtccaccgacatgaacggcacctgggatgttgccccagggagtattccaaacaccacctcagctggattcaccttcgctgagatcctgccaggcgaagaaaagatcacctccggctcaaccactggtgtcactggcgaagtggtcatcgaggataactccctgatctctggtctgattaccgtcaacatgactcacatcaccaccgatcaggaaaagcgcgacatcaacgtgcgcactaagctcttccacaccgatcagtacccagaagcaacctttgaggttaccgattccgttgatctttctgcgctcccagacaccggatccattgctcaggttgtcatcccaggcgagttgaccatccacggtgaaaccaaggctgtggagcctacctttgatgtacttcgtactggtgaccaagttatcgtggcttccgatatcgaaatcaaccgcctcgacttcggtgtagaaaccccagagttcatcgccgcaaagatcaatgagaccggcgagatcaacgtccgaatcgtattggagaaa

SEQ ID NO: 1632 - DNA, 396 bp, Corynebacterium glutamicum
atggcagatcgcgttcttcgtggcagccgcatgggcgccgtgagctatgagacggatagggaccacgatctggctcctcgccagctcgtgaagtacaagaccgcagacggggaaatctatgaggttcccttcgctgatgatgcggaaatccccgaggagtggatgtgcaagaacggtaagctaggcatcctcatggaaggtgagggagtcgagtccaagccggtcaagcctccacgtactcactgggatatgttgcgtgagcgtcgctcaattgaagagctggatgtgctgctggaagagcgcatcgaggcacttcgtaagcgtcgtcgcaatgcagcgaaactgctgaaggctcagcaagaggctgaagaagcagaaaaggcagctgaagaggtt

SEQ ID NO: 1633 - DNA, 810 bp, Corynebacterium glutamicum
atgagcagtgaggcagtagatgctacgacgctggtgattattccaacgtacaacgagctggaaaaccttccactcatcgtggatcgcgtgcgcaccgcaacccctgacgttcacgtactcatcgtggacgacaacagcccagacggcaccggcgagcgcgcagacaagcttgctgctgacgacgaccacatttttgtcctccaccgcgaaggcaaaggcggcctgtgcgcagcgtacatggctggcttccagtggggcctggagcgcgactaccaggtcctgtgcgaaatggacgccgacggctcccacgcaccagaacagctgcacctgctgctcgctgagatcaccaatggcgctgacctggtcatcggctcgcgctacgtgccaggcggccgcgtagtcaactggcccaagaaccgttggctcttgtccaagggcggcaacgtctacatcagcgtcgcgctcggcgccggcttgaccgatatgaccgcagggtaccgcgcttttcgacgtgaagtgctagaagcactgccgcttgatgagctctccaacgctgggtacattttccaagttgagattgcctaccgtgcagttgaagccggattcgatgttcgtgaagttcccatcactttcaccgagcgtgagatcggcgaatccaagctggacggcagctttgtcaaggattccctgctcgaggtaaccaagtggggcctcaagcaccgcggtggccaggccaaggaactgtccaaggaaatggtcggcctgctgaactatgagtggaagcacttcaaaaagcgcaacacctggctc

SEQ ID NO: 1634 - DNA, 1635 bp, Corynebacterium glutamicum
gtgacactgtttgttcggctcgcccttgctgctgtgggcgggctttttgtctttgcttccaatgaaccgatcggctggtttgtcgcgggaattgttggcactgcattattttttatctcccttgcgccgtgggatctgggagttccccaaaagcggcggaagaagaatgagccagtcccatttttgcaacagatgtccacgggcccaactgttgtacagggcatgcttttaggttttgtccatggcctggtgacatatttgcagctgttgccgtggatcggtgagtttgttggctcactgccttatgtcgcgttgtcagttgtcgaggcgctttattccattgctcttggtgctttcggcgtgctcattgcgcgttggagggactggaaggttctcctgtttccggcgatgtatgtggctgtggagtatctaagaagctcgtggccatttgatggattcgcgtgggttcgcctggcatggggtcaaattaacggtccgttggctaatctcgcagcgcttggtggggtagcgtttgtcactttttccacggtgctggctgccgtgggtgtggccatggtgattatttccaagaagcgactggccggcgcaatcatcaccgcgagtgtgattgctatcggcgcggtgtcatccctgtacgttgaccgcaatggcacgagcgatgaaagcatcgaagtagccgcaattcagggcaatgtgcctcggatgggattggacttcaatgcacagcgccgcgcggtgctggcgaatcacgcacgggaaaccctcaagctggatgaacaagtggatttggtgatctggccggagaattcctcagacgtcaacccattttccgatgcacaagcaagagccattatcgatggagcagtggaacatgttcaggcacctattttggtgggcacgatcaccgtcgatgaggttggtccacgcaacaccatgcaggtatttgatcctgttgaaggtgccgcggagtaccacaataagaagttcttgcagccgtttggtgaatacatgccgtttcgcgaattcctgagaattttctcgccctacgttgattccgctggaaacttccagcccggtgatggcaccggcgtagtggagatgaatgctgcgaacttaggccgcgctgtgacagtgggcgtgatgacgtgttacgaggtcatcttcgaccgtgctggccgcgacgccatcgccaatggggctgaatttttgaccacgcccaccaacaacgccaccttcggattcacggacatgacgtatcagcaattagcaatgagcaggatgcgtgccatcgaatttgatagggcggtggttgttgcagctacatcgggtgtttcggctatcgtcaaccctgatggaagcatttcccaaaacacccgaatttttgaggccgccaccttgacggaatccattccactcaaggacactgtcaccatcgcagcgcgggttggtttctatgttgaattactgttggttatcattggtgtattagctggactattcgccattcgaatgaatagccgttcaaagtctgcgaaaggttccgctcggcccgcacaagttcgggttaagaaggtgcctgcgaaaaaggcagcaactaatcgtcgaaaagtaaaa

SEQ ID NO: 1635 - DNA, 741 bp, Corynebacterium glutamicum
gtgcgtttcagaccaagcagctctcatcgagtattgcgtttggtctcaaatgcacgtttgaggaaactagaccactcacattgcacatctgcagctgccaggaagtctccacccaacagttttctaggtcacagggatccattagccatttggtccttgtcgaaaggtatggtggggcatgtgcctgcagcaatagcaatcccatatttcattattgagatcctcgccttcattggtgtcgtcatgtggctcggtttcggctgggctttgggtctcctcgtattgttcttcgtcggtggacttcttctagccggcgtggagcttcgtcgcattagtaagagtgccgccattcatcaggcttcgggccagggaagtgcgggagcgatcgccggaaacattgggctgaccgcagctggtgccattttggtggccatgccggggtttgtgtcttcgattatcggtttgttgttcatttttgcaccaaccagggcgctgttccgcaaggttttggccaagcgcatgcgcagtgccatcgagaacctaggtgtgcgtggttttgaagccgttaatggttaccgcacccaggcatcctacggaaacttcggagcggcattcaatggtggtgcgcaacaaccatcaaatgagccgatcgtgattgatgaagacgagatccaagcctggacttctgatctcaaacctgaagatttcaccaaaggtaaagatgaatccgacggtgagaaa

SEQ ID NO: 1636 - DNA, 1224 bp, Corynebacterium glutamicum
gtgcagcagggaagtgaggcagtctttcggcgcatcatgggtctctcgcggcgtcctgatcggaaacctggctttgacgatgtcccacatttcggcgcagctgttcgagttcccggtctaaaacacggcacgttggtcaatgctgcacccttgaaagttttgggcgcacggggcgagcccaaccccgcgagttcgtaccgttttgaatacatcaccggtgattccgcaggtcgagccatcactgcgaccggcgctgtcctcttttccacacgcccctggacaaccggcccgcgtcccgcgatcgccatggctccatccacccaaggcgtcgcacagcactgcgatccctcccacacctgcgccatcggactcaacgcattctatgacaaacccttcgacgcaatcattgcttacgaactccccgtcatcctctggtttctagctcacggacttgacgttgtgttcatcgattacccccgcgaccccgcaaccggcgtccaatactattgcgattccatcgctgcagctaaatcgcttctcgacgccgtcctcgcctccagacaactcggcctttcaccggaagcaccgcttggcctgtggggattctcccaaggaggcggcgccactggctgggctgcacaattgcaggattacgcacctgatgtccgcccaaaggcagcggtcgtgggcgctccaccagtggatctcttccgcgtcttggacactgtcgacggcggattgctcaccggagtgattgcctacgccatcgcgggacttgcagtgaactcttcagagatgtttgaggaaatcatgtcggtgttaaatgaacgcggagtcagtgatgtgctgaaaaatatcaccagctgcgcgggaggttccttgttggccagtggctactcgtcttcccgcgggtggacacatcagggcacgccgctggcagacattctggacgatctgccacttgttgtcgctgagtttgggaagcaaaagctgggtcgtgtggcgccagaaatcccagtgctgttgtggggctctaaaaatgatgatgtcattcccattgatcccattagggaattgcgtgatagctgggcggacaagggtacgccattgacctggcatgaatcccaagcgccgcgtgtgccaggacgcacaggtctcaaccatttcgggccctattttagaaacctggaaaagtactcgggatggctcatagatcatcttgtc

SEQ ID NO: 1637 - DNA, 774 bp, Corynebacterium glutamicum
atgtcgagcgatgttgtttttcagtctgtttctgttaattctggtgtgtctgtgggtacggtttcttttcctgcggggcgtgtgggtgcgtctgagtgggagatgttggcggatgttgcggagtcgcagggggatggtgcgatttatgtgacgtcgttggcgcagtgtcaggtgcgtgggggttcgtattctcatgcggagccgtgtgcgacggtggtggcgactccggggcattttgttgcgctcgcgcgggagattgcgggcgcggtgcgccgcgagttgacggtggggttggatgctggtgacggtgcgattttaaggcagagctttgatgttggttttttgcttgtcgacgcctccttccacattcatatcaatggcgtgtctactgggcagtcggttgcgccggatgatgtagttgaggtggtgcgtggtttggctgatgcttcggagttgtccgtggaaagtgttgctgagttgtgtactcccgtggcaccggtttcattatctgaggcacaggggaatcctgcgcctattgggtggttggagcatgatggcgtggtgtcgttgggtgcgggtattccaggggggcgggtggaggctcgtttagcgcgttttattgcggtgattgaggcggagaccactattaccccatggaattcgttgatcattcatgatttgtatgagggtgttgcagaacaggtggtgaaggttctggctcccatggggttggtttttgatgctaattcaccgcttctggagtcaccggctttg

SEQ ID NO: 1638 - DNA, 1278 bp, Corynebacterium glutamicum
atgtcagcacccgactccgctccaggaacagagcgcggtcatgaacgcacccattttgcggtagtcggtgactcccaggatccagcacaggcaacagctcctagagcgccagcagaatcaattactttgattggtattggtaccgatgggtttgaggggctcggactcaaggcacagcaagcattacaacgtgcctctgtggtgattggatcatggcgccagctcaatctcgtacctgatgccattaaggcagagcgtcgcccatggccgggtaataccaagcatcctgatttagatgccttgtttaaagagttcctcggtcggcatgttgctgttctggcctctggcgatccactgttttacggcgtgggcaccgcaatggtccatgtgctggggatggatagactcacggttattccgggaccatcatccgcgtcgcttgcttgcgcccgcttgggttggacagtcaaccgcacacgggtggtgtacctaggacaagaacccattgagacactcatcccgattattgaatcaggcgctcaattcctcgtcttgggtaaagatgaattcagtacagctcaagttgccacgttgttgaatgaactcggactgggggagactccactgactgtgctcagcgatttgggcagtactgatgaggagatcacccaaggcacagcttcacatccaccagctgcagtgtctgttctcaacgtgattgctgtgggagctcgcaccgcaatgccgaaaccccactttgaaggcgacgtatcaaacgaagaccttcgggcactgaccgtggcagctctagaacccacccagggacaaatgctgtggaccttcggggatattggagcagcacttgcctgcgattggctacgcgcagccggcaacaaggcgcacgccattagttttgcctccatggttgagcaaagccaaaggaatgctcgcaaactaggtgtatccaccctcagtgtgaaagagaccctgtcacccaaaacgctcaaagatatccgctatgtacaaggaccagaatcagcaagcccacatgccatcttcatgaacaaaggcctaggcatcgatctagttcctgaaaccgcatggatgatgctgcggcctggaggaaagctcattgcgcaagcctccacagaagacaacatcgcaaagcttcacacactccaagaacaacacggcggaatcatcaaacacatccgcatcgacgacacagacgtgcaccaatggcgagttacaaagccggtgactccagaagcggtgaat

SEQ ID NO: 1639 - DNA, 366 bp, Corynebacterium glutamicum
gtgactgtgaaaccccgacaaccactgactcttatagatctctgcgatgtcatctattcagcagggcacgtattcgatgatttacagtgcacgcgggaagacaccgctgagtttcttaaagtcggttcggtaaacgccattagacataacgtcattgggcatagcggcgatgtggccttgctgcaggaccttcgtgatgtagcagcgtttattatcaaccagccgtgcgcggagttagacgcagcatacctctgtgctcttaactccacgatcacccgtagtgggccgctatatccagggcgtttacgctcaccacaccaacacattggagtgagcaccaactacgggcgccatgaaccccggcgt

SEQ ID NO: 1640 - DNA, 246 bp, Corynebacterium glutamicum
ttgaacaccaggcaactagatgcagtgtgtagacggcgcgctcttcccggtaatacggtggaaaaccgtgccatctcactatttatcgacttagcccgagcacagccgtttgaagacggtaacaagcgaaccgcgctctttgtcgccaactccatgctgattgcttccgcctcgccgtatctacttattgcgccagtagatgagaaggattcatcgatagccagaagcttcaatgaccatcttgca

SEQ ID NO: 1641 - DNA, 738 bp, Corynebacterium glutamicum
ttgagcattcttctcctaggcggaacctctgacattgccggtgagattgccacgttgacgtgtcacggcgaagacgttgttttggctgctcgtcgaccagaggctgcacagggcttagcggaagatcttcgacagcgcggtgccacatctgttcatgttttgagctttgacgcccaagtactagacacgcaccgagaacttgtgaagaaaacacaagagctagctggcgagatttcccttgccgtggttgcttttggcatcttgggagaccaagaacgcgcagaaaccgatgagacccatgcggtagagatcgccaccgtggattacaccgctcaggtctccatgctcactgtgcttgctgatgagctccgcgcacaaactactccagcagcgatcgtggcgttttcctcgattgctgggtggcgggcgcgccgggctaactatgtctatggatccaccaaggctggtctcgatgcattttgccaagggcttgcagatagcctgcatgggacacacgtgcgattgattattgcgcgtcctggctttgttattggttctatgaccacggggatgaagcctgctccgatgtcggtgtatccacgagatgttgccgcagctgttgttagtgcttatacctctaagaagaggagcacgaccttgtggattccgggacgtctgcgggttctcgcctggattatgcggatggttcctcgtccggtgtggcggaagatgccacgc

SEQ ID NO: 1642 - DNA, 1137 bp, Corynebacterium glutamicum
atgagtgatccttcaacaaacaatttccccacatcggtatatgcacagcgtcttgcggatgcacaagaaggcgcacgcaaggctggcttgaacggtttgatcatcggtacaggcgcagaacttgcgtatctaaccggcagctggatctccacccatgagcgtctaaccgctttggtgatccccagcgaaggaaccgcaaccattgttcttcccgctgtagaccgcggagacttagcactgtctgctattccaggactagacatcaatgtggccggatgggttgatggcgataatgcccatgagttggccgtagatgctctcggtgtttcagagttcgaagcattgggtattggttcctccatcacggcagatcacctgattcctatccagaacctggtgggctccacctgccgcatggagttggcagttcaagtgctgaaagaattgtttgtctctaaagacgaagcagagatcgagcagcttcgcggcgcaggtgcagccattgaccgtgtccacgccaaagtcccggagcttcttcaagacggacgcaccgaagcagaggttgcagcacagctcaacgatctcatcttggaagagcactctgaggtggacttcgtgattgtgggatccgctgaaaacggcgcgaaccctcaccacggtttctctgaccgagtcctccgcaatggcgacatcgtggtggttgatataggaggcaccttcggccctggttaccactctgactgcacacgcacctacattgtgggcggaaaccctgacgatgcggatccagagttcgctaagttctaccaagtgctctacgaagcacagctcgcagccgttgcgcatgttcgccctggcgttactgcagaatcagtggacgctgttgctcgcgatcacattgctgcggctggatacggcgaatacttcattcaccgcacaggacacggcattggtctatccacccatgaggagccattcatcatggcgggtaactcactcgtgttggaagccggaatggccttttccattgagcctggcatctacattgaaggaatccacggagcgcgcatcgaagacatcgttgtggtgaatgaagacggttgtgaaaccctcaacaaccagcccaaggaactgcgt

SEQ ID NO: 1643 - DNA, 639 bp, Corynebacterium glutamicum
gtgcgatcaaaccacactgtcagaatcaaatctgctggacgctatgccagcggattgttgatcacgaaaaagcatgtcacagacacctttgtgccttctgtagcatccatctcagagcgcgccacgtttattctcaccgccgatcactttttgcgcagctgctcgaaagtaatttatgtccggggcgaaaatttcaccgccacagcaaccaccagcctgtctgtatttggcacagatctgggtttgatcaaattagacggcaaagcccccaccatgccacttccacttttcgcagataagccacttcgcgtgggcatgaaaaccaccacgttcggattcggcggtctgccatcagccaccgttgctaaagaaatccacgggcgcgttatctctgccatcccccatggcgtatcaagaaaccgcatcacccgagtccatcacggtgccttgatctttaactccccagaaaaggcagtaaagggagactccggcggacctgtgctggttaatggacgagtagccggaatccaatcaatgatctctgaccccggtggatttaacaccggggtcgccactgccgcatcccttatccagcacatgcctgccctagctcaagcgcttgaactgctcgaacatagc

SEQ ID NO: 1644 - DNA, 2787 bp, Corynebacterium glutamicum
atgagtttttctgccgaaaagggcacccacctttcagagttcatagcagacctgggctttgatctggacgagttccaaatcaaaggctgccacgctgtggaagaagaccacggtgttttagtatgtgcgcccaccggcgcgggcaaaacaattgttggtgaattcgcagtgtccctcgcattatcgcgggggacaaagtgtttctacaccacccccatcaaagcgctgagcaaccagaagtaccacgatttggtggctaaacacggctccgatgccgttggtctgctcaccggtgatgtttccattaaccatgatgctgacatcgtggtcatgaccaccgaagtgctgcgcaacatgatttacgcgggctcttttgcgcttgagcgcttaagccacgtggtcatggatgagatccacttccttgctgatgcctcccgtggcgcggtgtgggaagaagtgatcctcaacttggatgattccgtcaacatcatcggtctatctgccacggtgtccaactcagaggagtttggtgagtggctgaccactgttcgcggcgatacccgtgtgattgttactgatcaccgccccgttccgcttgatcagtacatgatggtgcagcgcaaagtgatgccactgtttgagcctggcaccgatggacgcgtgaacaaggagttagaggcaacgattgatcgcctcaacagcaagcaaagcgaacaaggccgtgcggcataccgctctggtgaaggcttccgtgcacgcagcaaaggcgataagcaggattctcgcactggtaagccacgggaacaagaccgccacaggccactgggtcggcctgaagtgctcagcatcctcaagggcatcaacatgctgccagcgattacgtttatcttctcccgcgcgggctgtgatggtgcgctgtaccaatgcttgcgttctaagttggtcttgacggatcaagcagaatcagaagagattgcacgcattgtcgacgccggcgtggtggggatccccgaggaagaccttcaagtactgaactttaagcagtggcgtgctgcactgatgcgcggtttcgcagcccaccacgcgggtatgcttccagcgtttaggcacatcgtggaagagctctttgttaaaggtcttgtccgcgcggtgtttgccacggaaaccctggcattgggaatcaacatgccagcgcgcaccgtggtgttggaaaagatggtcaaatttgacggcgaaggccacgttgatctcacccctggccaatacacgcagctgaccggtcgtgctggtcgacgtggcatcgatgtgttgggtaatgctgtggtgcagtggtcaccagcacttgatccacgatgggtggcaggtcttgcctctacgcgtacctacccgctgatctctacgttccagccgggctacaacatgtcggttaacctgctgaaaaccattggttatgagccttcgctgcgccttttggaaaaatcttttgcacagttccaagccgatggttccgtcgtgggcgatgtgcgtgaaattgaacgtgcagaagccaaggtggcagaattgcgtgcccagctgaacaaagagattgctgccaccaaccctgcggtgcgtgaagatcaagacgcagtggaggtgtttatcgactacatggagcttcgccgtgagctcaatgaggaagaaaaactcaatcgcaagcaaagcatcgaagatcgcaacgtagaaacagtccgtgtgctgtccaagctgcaaatcggtgatgtcattgccatgcctggtagaaaacgaccagttctcgcagtagtgatgacgcctgctaatcagagcagagatccccgcccatgggtgaccaccgaatctggttggtcaggtcgtgtggatgcggaatcctttactaatccgccgatcaccattgggcatatgcgtctgcctcgccaagctattgaagagcctcgccgcaatgcccggcgcgtccaggaactgtttaggcgtgagcacttcaagcgacccaacaagatgcgggagtttgctcgggttcgtcccaatgaggcagtgaccaaactgcgtaatgctattcgggatcatgaggcgcatcattggcctgatcgggagcacttggctcgcaccgcggagcgtatgatccgtaaagaacgtgatctggctaagttgaccggcaatgtggataaagccagggaaaccctcggtaggacgtttgagcgcattttgtcgctgctcagtgaaatggactatgtggattactctaatccagataatccagtgatcactgatgaaggtgagcgtttggcgaaaatccacagtgaggcagacctgttggttgctcagtgcctcaagcgtggcatttgggacaaccttgatcccgcagagctcgccggtgtggtgagtatgtgcacgtttgaaaatcgtcgcgaaaccggtggtgaggctcaagctgtcacagaggccatggctgattccatgaatagcgtggaacgtatttggggtgagctggttgaagatgagcgccgtcaccgtctgccaattactcgccagccggaagcaggttttgccaccgcgatccaccagtgggcttcaggtgctccgctgggatattgcatggctgcggcagcggaaaacggcgcggagttgacccctggtgacttcgtgcgctggtgccgtcaagtcatcgatcttctagagcaggttgctaagactgcctactttgatgagaccacacggaatgctcgtcaggctattgatgcgattaggcgtggagttgtggcgatcggttcc

SEQ ID NO: 1645 - DNA, 1002 bp, Corynebacterium glutamicum
gtggttaagcgccctcggcgagttatctcaaaaaagaagaagaagtctcctacgggagagatgtccattgttgagcacatcaaagagtttcgacgccgacttcttatcgctctggcgggcatcctcgtgggcaccattatcggctttatttggtacgatttctcattttggcagatccccactttgggcgagctgctgagggatccgtactgttctctgcctgctgaatcccgctgggccatgagcgactcagaggaatgtcgactgctcgcaaccggcccgtttgatccattcatgcttcgccttaaagtagcggcgttggtgggtatggttcttggctcacccgtgtggctgagccagctgtggggctttatcaccccaggtttgatgaagaatgagcgccgttacaccgcaatcttcgtcacgattgctgttgtgctgtttgtcggcggtgctgttcttgcgtacttcgtcgttgcatatggtttggagttcctccttaccattggtggagacacccaggcagcggccctgactggtgataagtacttcggattcttgctcgcgttgttggcgattttcggcgtgagcttcgaagttccactggtgatcggcatgctcaacattgtgggtatcttgccttacgatgccattaaagataagcgacgcatgatcatcatgattttgttcgtgttcgctgctttcatgacacccggccaggatcctttcaccatgttggtgttggcgctttcactcaccgttctggtagagcttgccctgcagttctgtcgtttcaacgacaaacgccgggacaagaagcgcccagaatggcttgatggcgatgacctctctgcatcaccactggatacttctgctggtggagaagatgctccaagcccagtcgaaaccccagaggcggtggagccttcgcggatgctgaacccaagtggggaggcgtcgataagctataaacccgggcgcgccgacttcggtgacgtgctc

SEQ ID NO: 1646 - DNA, 315 bp, Corynebacterium glutamicum
atgtccctcggaccatgggaaattggaatcattgtcctgctgatcatcgtgctgttcggcgcgaagaagctgcctgatgcagctcgttccatcggccgttccatgcgcatcttcaagtctgaagtcaaagaaatgaacaaggacggcgataccccagaacaacagcagcagcctcagcagcagattgcgcccaaccagatcgaggctcctcagccaaactttgagcagcactaccagggacagcaggttcagcagcctcagaaccctcagacccctgactaccgtcagaactacgaggatccaaaccgcacctct

SEQ ID NO: 1647 - DNA, 981 bp, Corynebacterium glutamicum
atgccgaaatcatccaacaaaatcagcgaccttgcccgccagcttaatctgttgccgtatttcaccaggtataaaggccgtaccgtcatggaagcagcgcgcgatcttggccaaccctcctcccaaatcatggaagacctcaacagattatggatgtgtggtctgccaggacttcttccaggtgacttggtggagcttgatcattcctttaaggaagtaaaaatccacaatgctcaaggcatggataaacccttgcgcctcacaccaactgaagccggtgttttgctgctgacacttgaatccctggaatccctccccggtattgcgaaacaggaagcggtcgtatctgctgcgaacaagctacgcgccatcatgggggagtattcctcgactgttttcgactccactggagaagacctcgatgctgaagttctagagatcatccgcgacgccatggatttacaccagcaggtcagttttgaataccactcgcacagatcagacaacaccagcctgaggcaagtcagccctgctcatatcttcacccatgaaggcgaaacctacatcaaagcctgggaagaagctgtgaaccaatggcggacgtttaggcttgatcgcatccgaagcattgtgcttcttgacagcaaagcagtgcacccggcgcgaggggtttcagtatccacggacgatccttttgagttcgcaaaatcttccgatattgccacgttattgctgcgtgaggacgcaatgtggttaggcaattacatggccatggaggtggatgaaacggtggaaccgattcgcgatagcgacggattcagctggcacacagtccactttccgctgctttctagggattggttcgtccgattcgcgattggccatgctgagcatttgaaagtaactagtcccgaagatcttcggaaatgcataaagcaaaaggcttttagtggtttgtcagcgtatgatcatcacgtagag

SEQ ID NO: 1648 - DNA, 972 bp, Corynebacterium glutamicum
atgtcggatcggaaggaagatctcgagcgtcagattaatctgactttcgcgtttttaagcgccaattcctattcccggaagtttttgacccaggtgtggattcgagacaatgtcggcgattataaaggccttaccgatacggcgttccgtaagaagctgcagcgcgatcttgcctacctgcgcagagttggcgttccgattgagcagttcacggtcacctcaggcatagctgaaggccagcaggcgtaccgtctggcccaggattcttataagctccccgaggtcgaattcaccccagatgaggccgccgtgctgggcatggcaggggagatgggccataatcaggaactcggcgccttcgcgcgttcggggtggaccaaattggcggccggcggcgcgcagcgtgatctgtccacgtccacagccttgaccaatgcgggcgatttaggttccttgtctgcaaaaaccctcgatgcgatcatcaaagcccgccaattgggcaagcaaatcagcttcgaataccggcgcgcccccaaagacgccccctcgcttcgacacatggatccttggggtctggtccctgagcgcgaccgcatctacctggtcggattcgacctcgaccgccaagaagcacgcaccttccgcatcacccgcgtccgcaacatcaacctcggcgccgacgccacccaccccatgcccgcaggcaccaacctccaagacatggtgcgcgcccaactacgcagaaagagtgtgcttatcgacgccaccctgcgcatcacacccggccgcgcagtggaactgcgcgccgcaggggtagaaacctccgatggggcatggtttttagaagacgttgaccgagattggctggtgcgcaccgcagcagcccatgcgccagaagctctcgttatagaacccaaggacgtcattgacgatgtcatagccttgctgcgcaaagtcgaaaacgaggtggtg

SEQ ID NO: 1649 - DNA, 1425 bp, Corynebacterium glutamicum
ttgacccgcaggatcatgggcattgaaacggagtatggcctcacctttgttgatggtgattccaaaaagcttcgcccagatgagatagctcgaaggatgtttcgtcccatcgtggagaaatattccagctctaatatcttcatacccaatggttcccggttgtatcttgatgtgggttcccacccggagtacgccaccgccgagtgtgataatttgacccagctgatcaattttgaaaaagctggcgatgttattgcagatcgcatggctgtagatgccgaagagtcgctggcgaaagaagacattgctgggcaggtgtacctgtttaaaaacaatgtcgattccgtgggcaattcttatggctgccacgaaaactaccttgtgggtcgctccatgccgttgaaggcgttgggtaaaaggctgatgccgtttctgattacccgccagctcatctgcggcgccggcaggatccatcaccccaatcctttggataaaggcgaatccttccccttgggctactgcatatcccagcgctctgaccacgtgtgggagggcgtatcaagtgccaccactagatcacgccccattatcaacacccgtgatgagccacatgcggattcccattcttaccgcaggctgcacgtgattgtgggtgatgccaacatggcagagcccagcatcgcgttgaaggtcggctccacgttgctggttctggaaatgattgaggcagatttcggtttgcccagcttagagcttgccaatgatattgcctcaattagggaaatctcccgcgatgcaacaggatccacactgttgtccctgaaagatggcaccaccatgactgccttgcagatccagcaggtggtctttgagcatgcctcgaagtggttggagcagcgccccgaaccagaattttctggcacctccaacacagagatggcccgcgtgctggatctgtggggtcgcatgttgaaagcgattgagtccggtgatttcagcgaagtggatacagaaattgactgggtgatcaaaaagaagctcattgatcgtttcattcagcgcggcaaccttgggttggatgatccaaaacttgcccaagtggacttgacttatcacgatattaggccaggtagaggcctatttagcgtgctgcaaagccgcggcatgatcaaacggtggactactgatgaggcgattttagctgcggtggataccgctcctgatacaacacgtgctcatttgcgcgggcgaatccttaaagcggcggatactctgggagtacctgtgactgtcgattggatgcgtcacaaggtcaaccgaccggagccacaatcggtggaattgggggatcctttttccgcagtgaattccgaggttgatcagttgattgagtatatgaccgttcatgcggagagctatcgcagt

SEQ ID NO: 1650 - DNA, 249 bp, Corynebacterium glutamicum
ttgtacataggaacgaacgaattcctcggcgttgttttccaacagtccgtcgatttcatccagcaagctgtccacaccttcggtgttgatctgaacctgtccagatgcctgtgcggaatcctcggcgttgtcctcgtcacgtccgccgccacccataatttgggtttgctttgcgttcactacactcactctcctgccgtaaatcggtatttcttagttcttcagcccacgtatttagacctggccatt

SEQ ID NO: 1651 - DNA, 192 bp, Corynebacterium glutamicum
gtgaacgcaaagcaaacccaaattatgggtggcggcggacgtgacgaggacaacgccgaggattccgcacaggcatctggacaggttcagatcaacaccgaaggtgtggacagcttgctggatgaaatcgacggactgttggaaaacaacgccgaggaattcgttcgttcctatgtacaaaagggtggcgaa

SEQ ID NO: 1652 - DNA, 1542 bp, Corynebacterium glutamicum
atggcgcgttttatgggatcggaaaccgaatacggcatttccacaccgtctgcaccgtttttaagcccgatcgttacttccacgcacgcggtggtggcgtattccaccgcgcgtggatttggtgagcaccgggtgcgttgggactatgcgcaagagtccccactgcgcgatactcgtggctttgatctgcgccgataccaccaggcccctgtggtggatccgcacgccattggtgtggccaacgtgtttgtgcccaatggtgccaggttttatgtcgatcacgcgcacccggaatactcctccccagaggtcaccaatgcgtgggatgccatggtttacgacgccgctggtgaccacatcctcatgcaggccgtctctgatgttgcgagtttcaccagccagaataggtctgtgttggacggccatgatccgtgtccagctttgaaaatctacaaaaacaatgtcgacggtaagggtgctagctacgggtcccacgagaattacctctactcacgtgagacggattttgatgtgctggctcaggcattgatcccattttttgtgtgccgccaggtcatcatcggtgccggacgtgtgggattgggccctcagggcgataagccgggattccaggtcagtcagcgagctgactacattgagcaagaaatttcactggaaaccacactcaaccgcggcattatcaacacccgcgatgaaccacacaccgacgctgatcactggggtcgcctgcacgtgatcatcggcgatgccaacatgtcgcagactgcgaatttcctcaaattcggcatgacctccctagtgctggatgccattgaggctggggtggatttctctgaactcaagctgaagaacgcagtgagtgaagtagcaaaggtctcccatgatctttcccttacccaccagctgcgattggcggatggttcagagctcaccgctattgatattctgcgccgctatttggacaaggtgcagccgtttgcagaaaccccagtggaacagcgtgtcactgcgctgtggggtgaagtgctggggctcctggagaatgatctgctctccaccagccatctccttgattggactgcaaaacttgccctgatcaagtcttttgaggcgcgtgggctgtccattaacgatcccaagatgtacctcattgacctgcagtacagcgatattgatccacagaagagtctgtatcacgcactggtatccaaggggcggatgaaaacactgtgcagtgcgcaggacattgcagatgcagcggccactccaccgcaggactcgcgggcatacttccgcgggcgtgtgatggataaatttggcgaatcagtgctcgcagccaactgggaatcgctgattgttgctacctccagcgctaaggaataccgcgtgcacaccagcggtttagataccttgacccgagaggaagcaggggagttggtggagaaatccgccacaatcgatgagttaattgagggtcttgaaaaggaaaacttgaccccgctcacggccatccaagctatt

SEQ ID NO: 1653 - DNA, 480 bp, Corynebacterium glutamicum
atgtcatgtgcgccctgcttgttggggcggttgatgcgaatcttgatgtccaggcgacccgggcgcaaaatggccgggtcgatcagctcttcacggttggtagcgcccaccacgatgacattggacagatcctccacaccgtcaagctctgccaaaagctgtggcaccacggtggtttccatatcagaactcacacctgaaccacgggtacggaaaatcgattccatttcatcaaagaaaatgatcacggggcggccatcgccggcaagctcacgggcgcgctcaaaaatcactcggatctgtcgctctgtctcaccgacgtacttgttcagcagctctgggcccttgacgttgatgaagtacgaggtgccagtctcaccgatgcggttggccaaagaattagccacagccttagcaatcagcgtctttccacagccgggagggccgtacagcagcacgccctttggtggatgcaggttg

SEQ ID NO: 1654 - DNA, 1581 bp, Corynebacterium glutamicum
gtggtgaccatgagttcaccaactgattcttcgccctctaattcttttagcgacttcaaccgggaggaacagtcccggttatctgatgaggtgcgccagctcaagcgcaccaactctgatcttggggcacgtaatgccaagctcgcggagatgctgaagtcgtctcgggataaattgtctgtgctgttttctcagttggaggatatggctcagccgccatcggtgtatggcactttcttggaaaccgcgaaagacggttctaatgcggagatctttgctggtggacgtcgcatgcgtgtggctgtttctcctatgctgtgtgccgcggatttgatgccgggtgtgcaggttcgtttgggtgaaggcaatcaagttcttgaggcctgtgattttgaacaaaccggtgaattagccacgttgatggaaatgattggccgggatcgtgctttggtttcagatcgctcgggggaggagcgcgtcgtcaagcttgctggtccgttgatggatcgcaccgcaaagctgccgcgccccggtgacaccctgcttgttgaccgcaaagcgggctacgcttttgaggcgattgccaagacggaaatttcgaggcttgcgctggaagaggcgccagatgtgtcttatcaggatattggtggcttggatgatcagattgaattgattcaagatgccgttgagctgccatttttgcacccggagatgtaccgcgcctacaacctgcatccaccaaagggcgtgctgctgtacggccctcccggctgtggaaagacgctgattgctaaggctgtggctaattctttggccaaccgcatcggtgagactggcacctcgtacttcatcaacgtcaagggcccagagctgctgaacaagtacgtcggtgagacagagcgacagatccgagtgatttttgagcgcgcccgtgagcttgccggcgatggccgccccgtgatcattttctttgatgaaatggaatcgattttccgtacccgtggttcaggtgtgagttctgatatggaaaccaccgtggtgccacagcttttggcagagcttgacggtgtggaggatctgtccaatgtcatcgtggtgggcgctaccaaccgtgaagagctgatcgacccggccattttgcgcccgggtcgcctggacatcaagattcgcatcaaccgccccaacaagcagggcgcacatgacattttcacccgctacatcaatgattcgattccgctggccgaacctgccgaggatctcattgatcgcgccgtggatcacctgtacaccccgcgcccttatgtgcgtttgacgctgatcgatggttcggtggaaacactgaactaccacgactttgtctctggtgcgatgatcgccaacattgttgaccgtgctaaaaaatcagctattaaggcgcatatcgacggcaccggcgttggcctaaccgccgagcagctcatccaggcgattgatgatgaaaaccagcagagcgaagacctgccaaacacctccaacccggatgaatggtccaggatcactggacgccagggcaagcaggttactcacgcagaggtggttatc

SEQ ID NO: 1655 - DNA, 834 bp, Corynebacterium glutamicum
atgccctactcaggtccgttccaagcaggcgaccgcgttcagctcaccgacgctaaacgccgccatttcaccatcattttggaaccaggaaccacctaccacacccaccgtggacaaatcgcacacgatgacatcatcggcgccgatgagggcactgttgtccactccaccatgggctctgattacttgtgcttccgtcacctcatggttgatcacgtgctgagcatgcctcgtggcgctgcagttatttatccaaaggactctgcacagattctggtcgagggcgatattttccctggcgcccgagttctggaagctggcgctggttccggtgcactgtccatggcgctgcttcgtgcagtgggtgaaaagggcaatgtcatctcctacgaaatccgtgaggatcacctggagtacgcagtctccaacgtggaggagtacttcggtgagcgtccagcaacctgggatccacgtcttggtgacctgaaagaagtcaccgttgaggatctcggcggacctgttgaccgcatcatcttggatatgcttgagccgtgggaaatgctggagacctgcaaggatcttctcatccctggtggtgtgtttatgacgtatgtggcgaccgtgccacagctgatgaaggtcatggaaggcatccgcgagcaaaaatgcttcacggagccacgcgcgtgggaatctttggttcgtgattggaaggtggagggcttggcaacacgccctgagcaccgcatgaatgcccacaccgcgttcttggtgttgaccaggcgtttggctgatggcgtggagcctcctcgtccgcagcgtaaggcacgtcga

SEQ ID NO: 1656 - DNA, 1323 bp, Corynebacterium glutamicum
gtggattcgcattgtggattcgggggcccgcgctgtttccaagaatttggctacccttgttctatgcatgtaactgacgatttcttaagttttattgccctaagcccaagttcctatcacgcggccgcggcggtggagcgcaggttgctccatgaggggttcattcgtcaggaagataccgatgaatgggatgcccgccctggtgggcatgtgacggtgcgtgggggagcagtagtggcgtggtgggtgcctgaggatgcttcgccagattccgggttccgcatcattgggtcacatactgattcaccgggtttcaagttaaagccccgtggggatctttcctcacacggttggcagcaggccggcgtcgaggtttacggcggaccgatcctgccaagctggctggatcgcgagctggccttagcaggccgcattgtgcttgccgacgggtccgtcaagcttgtcaacaccggcccgattctgcgcatcccgcacgtggctattcatttggaccgtactgttaattcccaactcacccttaatccacagcgtcacctgcagcctgtgtttgctgttggtgagcccgacgtatcaattctggatgtcattgctggtgctgcggtagtggatcctgcagatattgtcagccatgatctgatcacggtggctacccaagatgctgaagtatttggcgcacatggggatttcttggcgtctggtcgcctggataacctgagcagcgtgcatccatccatgactgcattgattgcggcttcgcaatctgacgatactggttcggatattttggttcttgctgcattcgatcatgaagaagtgggaagtaattccacctcgggtgccgggggccccctgttggaggatgtgctcaaccgtactgctcgtgcgttgggtgcagatgaagatgagcgacgccggatgtttaaccgttccaccatggtctcagctgacgcggcacactccattcaccccaacttccccgagaagcatgatcaagctaattaccccatcattggtaaaggtcctgtattgaaggtcaacgccaaccagcgctacacctccgatgcagtcacttcaggcatgtggatcagggcatgtcagattgccggtgtgccacaccaggtgtttgccggcaacaacgatgtgccgtgtggttccaccatcggcccgatcagtgcgactcgcctgggtatcgattctgtcgatgtcggtattccattgctgtccatgcactccgcacgcgaaatggccggagtgaaggatctgatgtggtttgaacaagccctggaagcctatctggtaaat

SEQ ID NO: 1657 - DNA, 834 bp, Corynebacterium glutamicum
atgaccagcccagttgaaaacgttaagaaaaagccacgcccattggcgctgtcaccgtcgcgcgccggggattaccagcagtgtcccctgttgtatcgcttccgcgcgattgatcgcctgccagagcctaagaccgtcgcccaggtcaaaggcacgttggtgcacgctgtgttggaatatatgcacaagttgccgcgtgaagaacgcgaatatccagccatggtgaagcaactcaagcccacctgggcgcagatgtgtgaagaagacgcagagctcaaagagcttgttccagaagatgagctttatgatttcctcgtggattcccgcaccctgctgcgtggctactttgaaatggaaaatcctcaaggtttcgacgccaccgaatgcgaaatgtacgtggacactgtgctgcccaacggcgttcctgttcgtggttttatcgaccgtgtggataccgcccccaccggccaagtccgagttatcgactacaagactggcaagaaaccaaagccgcagtggagccagcaagcgcagttccagatgctgttctatgcactggtctactggcgcatgttcaatgaaatcccagctcagcttcgtttaatgtacctcaaagtcaacgattcaatgttcctcaacccatcacgggagcagctggaattcttcgaacgcgatctgggtgatctgtgggcaaagattgaaatggacggcaaagcaggccattttcgaacgaagacctccaagctgtgtggctggtgcccacaccaatcactgtgtccggagtatggtggggttccacccgagtaccccggttggcctggcagtacagcagac

SEQ ID NO: 1658 - DNA, 264 bp, Corynebacterium glutamicum
gtgttcgtggtagctccgcagtcccggaaaccgcagcaccctggtgagattttgagtgaacgtttcctcgaaccccgaggaatcagccactacgatctcgccaaaaccctccacatcaccgaagcaaccatcgccaatttcgttgaaggtcgcaccgacctcaccatcggacttgcagtacgcctctcccgctcattcgatttgagcacacaggaatggatcgcactgcagcgcacctttgatcaggctcatcgtcgatctgct

SEQ ID NO: 1659 - DNA, 1209 bp, Corynebacterium glutamicum
gtggcggtcaccgcaagaacggacataaaaccacacccatcgcaaccaacggcactgttcactccagtgtttattttgggctggctcgtcaacttgacccagtacttgagcttctacttcctgatcacagtcatggcgctgtatgcgatggaaagcttcgccgtttcagaggccgctggcggatttgcggccagctcctttgttatcggcgcaaccgtggctcgtgtgttcgcgggatgggcggccgaccgttttggtaagaagcagatcctgctcatctttgtcggcttgggaacggtagcatcactattctatattccagctgcctcactaccagcgctggttgctgtgcgttttgttcacggtttttcttattctcttgcttccaccgctgtgatggcacttgtgcagtccgtgattcctgcaagccgtagggcagagggcaccggctacttcgcgctcggatccacactggctacagctttcggcccagcaattgcgctgtttgttatcgatgacttcaactacaacaccctgttctggattaccactgcgaccagtgttttcggcctgatcctcaccgttttgatccgcaagccggagttcattaagaatgcggaacacggcagagtaaagccagtctggtctatcaagactgttgtgcacccatcggtcatgctcattggattcttcatgctcgctgtcggactggcttacgcaggcgtgatcaccttcctcaacggcttcgcgcaagacactggcctcaccgccggagcgggtcttttctttatcgcttatgcggttgcgatgctggtcatgcgtttcttccttggacgcattcaggacaaacatggtgacaacccggttatttacttcggtttgatcagcttcgccctcgcgctggggcttatggctttggcgactgaagactggcacattgttctcgctggcgcactcaccggtttgggctatggcaccatcatgccggccgcacaagccattgctgtcgattcagttccaagcactcaggttggttccggtatttctacgcttttcctgttcaccgacatcggcattggcttaggcccaatcctgctgggtggattggttgcagcgaccggatacaacgtcatgtacgcagctttggccgcagtgattgttgtggcgggcgtgctctacctggttgctttgggtaggaaagctagccac

SEQ ID NO: 1660 - DNA, 1578 bp, Corynebacterium glutamicum
atgtctaagacgagcaacaagtcttcagcagactcaaagaatgacgcaaaagccgaagacattgtgaacggcgagaaccaaatcgccacgaatgagtcgcagtcttcagacagcgctgcagtttcggaacgtgtcgtcgaaccaaaaaccacggttcagaaaaagttccgaatcgaatcggatctgcttggtgaacttcagatcccatcccacgcatattacggggtgcacacccttcgtgcggtggacaacttccaaatctcacgaaccaccatcaaccacgtcccagatttcattcgcggcatggtccaggtgaaaaaggccgcagctttagcaaaccgccgactgcacacacttccagcacaaaaagcagaagcaattgtctgggcttgtgatcagatcctcattgaggaacgctgtatggatcagttccccatcgatgtgttccagggtggcgcaggtacctcactgaacatgaacaccaacgaggttgttgccaaccttgcacttgagttcttaggccatgaaaagggcgagtaccacatcctgcaccccatggatgatgtgaacatgtcccagtccaccaacgattcctacccaactggtttccgcctgggcatttacgctggactgcagaccctcatcgctgaaattgatgagcttcaggttgcgttccgccacaagggcaatgagtttgtcgacatcatcaagatgggccgcacccagttgcaggatgctgttcccatgagcttgggcgaagagttccgagcattcgcgcacaacctcgcagaagagcagaccgtgctgcgtgaagctgccaaccgtctcctcgaggtcaatcttggtgcaaccgcaatcggtactggtgtgaacactccagcaggctaccgccaccaggttgtcgctgctctgtctgaggtcaccggactggaactaaagtccgcacgtgatctcatcgaggctacctctgacaccggtgcatatgttcatgcgcactccgcaatcaagcgtgcagccatgaaactgtccaagatctgtaacgatctacgtctgctgtcttctggtcctcgtgctggcttgaacgaaatcaacctgccaccacgccaggctggttcctccatcatgccagccaaggtcaacccagtgatcccagaagtggtcaaccaggtctgcttcaaggtcttcggtaacgatctcaccgtcaccatggctgcggaagctggccagttgcagctcaacgtcatggagccagtcattggcgaatccctcttccagtcactgcgcatcctgggcaatgcagccaagactttgcgtgagaagtgcgtcgtaggaatcaccgccaacgctgatgtttgccgtgcttacgttgataactccatcgggattatcacttacctgaacccattcctgggccacgacattggagatcagatcggtaaggaagcagccgaaactggtcgaccagtgcgtgaactcatcctggaaaagaagctcatggatgaaaagacgctcgaggcagtcctgtccaaggagaacctcatgcacccaatgttccgcggaaggctctacttggagaac

SEQ ID NO: 1661 - DNA, 843 bp, Corynebacterium glutamicum
atgttgaaaatcgctgtcccaaacaaaggctcgctgtccgagcgcgccatggaaatcctcgccgaagcaggctacgcaggccgtggagattccaaatccctcaacgtttttgatgaagcaaacaacgttgaattcttcttccttcgccctaaagatatcgccatctacgttgctggtggccagctcgatttgggtatcaccggccgcgaccttgctcgcgattcccaggctgatgtccacgaagttctttccctcggcttcggttcctccactttccgttacgcagcaccagctgatgaagagtggagcatcgaaaagctcgacggcaagcgcatcgctacctcttaccccaaccttgttcgcgatgacctcgcagcacgtgggctttccgctgaggtgctccgcctcgacggtgcagtagaggtatccatcaagcttggtgtcgcagatgccatcgccgatgttgtatccaccggccgcacgctgcgtcagcaaggtcttgcacctttcggcgaggttctgtgcacctctgaggctgtcattgttggccgcaaggatgaaaaggtcaccccagagcagcagatcctgcttcgccgcatccagggaattttgcacgcgcagaacttcctcatgctggattacaacgtcgaccgcgacaacctggacgctgccactgcagtaaccccaggcttatccggcccaacggtatccccactggcacgcgacaactgggttgctgtacgcgccatggtgccacgcaggtcagctaacgccatcatggataagcttgctggactcggcgctgaagccatcctggcttctgaaatccgcatcgcccgcatc

SEQ ID NO: 1662 - DNA, 693 bp, Corynebacterium glutamicum
atgattaaggcgattttctgggacatggacggcacgatggtggactctgagccacagtggggcattgctacctacgagctcagcgaagccatgggccgccgcctcaccccggagctccgggaactcaccgtcggctcgagcctgccgcgcaccatgcgcttatgcgcagagcacgcaggcattacattgagcgacgcggactacgagcgctaccgggctggcatgttcgcccgggtccatgagcttttcgacgaatccctcgtcccaaatccaggcgtcaccgaactcctgacagagttgaaggccctcgagatccccatgttggtcaccaccaacacagagcgcgatctcgcgacccgttcagtcgcagccgtgggaaatgagttcttcatcggttctatcgctggtgatgaagtcccaacagcaaagccagcccccgacatgtacctcgaagcagcacgacgtgtgggctttgacccatcagagtgcctcgtgttcgaagattcctacaacggcatgctgggcgctgttactgcaggttgccgcgtcattggtctgcacccagaagaagtccaagcgccagaaggtgtagtgcctttgcgttccctccacggtaaaaactctttcgaaggtgtcaccgctgagatggtcactgcctggtaccaccagatcgagccggcaggtgtcgcaaaa

SEQ ID NO: 1663 - DNA, 3663 bp, Corynebacterium glutamicum
atgtctacttcagttacttcaccagcccacaacaacgcacattcctccgaatttttggatgcgttggcaaaccatgtgttgatcggcgacggcgccatgggcacccagctccaaggctttgacctggacgtggaaaaggatttccttgatctggaggggtgtaatgagattctcaacgacacccgccctgatgtgttgaggcagattcaccgcgcctactttgaggcgggagctgacttggttgagaccaatacttttggttgcaacctgccgaacttggcggattatgacatcgctgatcgttgccgtgagcttgcctacaagggcactgcagtggctagggaagtggctgatgagatggggccgggccgaaacggcatgcggcgtttcgtggttggttccctgggacctggaacgaagcttccatcgctgggccatgcaccgtatgcagatttgcgtgggcactacaaggaagcagcgcttggcatcatcgacggtggtggcgatgcctttttgattgagactgctcaggacttgcttcaggtcaaggctgcggttcacggcgttcaagatgccatggctgaacttgatacattcttgcccattatttgccacgtcaccgtagagaccaccggcaccatgctcatgggttctgagatcggtgccgcgttgacagcgctgcagccactgggtatcgacatgattggtctgaactgcgccaccggcccagatgagatgagcgagcacctgcgttacctgtccaagcacgccgatattcctgtgtcggtgatgcctaacgcaggtcttcctgtcctgggtaaaaacggtgcagaatacccacttgaggctgaggatttggcgcaggcgctggctggattcgtctccgaatatggcctgtccatggtgggtggttgttgtggcaccacacctgagcacatccgtgcggtccgcgatgcggtggttggtgttccagagcaggaaacctccacactgaccaagatccctgcaggccctgttgagcaggcctcccgcgaggtggagaaagaggactccgtcgcgtcgctgtacacctcggtgccattgtcccaggaaaccggcatttccatgatcggtgagcgcaccaactccaacggttccaaggcattccgtgaggcaatgctgtctggcgattgggaaaagtgtgtggatattgccaagcagcaaacccgcgatggtgcacacatgctggatctttgtgtggattacgtgggacgagacggcaccgccgatatggcgaccttggcagcacttcttgctaccagctccactttgccaatcatgattgactccaccgagccagaggttattcgcacaggccttgagcacttgggtggacgaagcatcgttaactccgtcaactttgaagacggcgatggccctgagtcccgctaccagcgcatcatgaaactggtaaagcagcacggtgcggccgtggttgcgctgaccattgatgaggaaggccaggcacgtaccgctgagcacaaggtgcgcattgctaaacgactgattgacgatatcaccggcagctacggcctggatatcaaagacatcgttgtggactgcctgaccttcccgatctctactggccaggaagaaaccaggcgagatggcattgaaaccatcgaagccatccgcgagctgaagaagctctacccagaaatccacaccaccctgggtctgtccaatatttccttcggcctgaaccctgctgcacgccaggttcttaactctgtgttcctcaatgagtgcattgaggctggtctggactctgcgattgcgcacagctccaagattttgccgatgaaccgcattgatgatcgccagcgcgaagtggcgttggatatggtctatgatcgccgcaccgaggattacgatccgctgcaggaattcatgcagctgtttgagggcgtttctgctgccgatgccaaggatgctcgcgctgaacagctggccgctatgcctttgtttgagcgtttggcacagcgcatcatcgacggcgataagaatggccttgaggatgatctggaagcaggcatgaaggagaagtctcctattgcgatcatcaacgaggaccttctcaacggcatgaagaccgtgggtgagctgtttggttccggacagatgcagctgccattcgtgctgcaatcggcagaaaccatgaaaactgcggtggcctatttggaaccgttcatggaagaggaagcagaagctaccggatctgcgcaggcagagggcaagggcaaaatcgtcgtggccaccgtcaagggtgacgtgcacgatatcggcaagaacttggtggacatcattttgtccaacaacggttacgacgtggtgaacttgggcatcaagcagccactgtccgccatgttggaagcagcggaagaacacaaagcagacgtcatcggcatgtcgggacttcttgtgaagtccaccgtggtgatgaaggaaaaccttgaggagatgaacaacgccggcgcatccaattacccagtcattttgggtggcgctgcgctgacgcgtacctacgtggaaaacgatctcaacgaggtgtacaccggtgaggtgtactacgcccgtgatgctttcgagggcctgcgcctgatggatgaggtgatggcagaaaagcgtggtgaaggacttgatcccaactcaccagaagctattgagcaggcgaagaagaaggcggaacgtaaggctcgtaatgagcgttcccgcaagattgccgcggagcgtaaagctaatgcggctcccgtgattgttccggagcgttctgatgtctccaccgatactccaaccgcggcaccaccgttctggggaacccgcattgtcaagggtctgcccttggcggagttcttgggcaaccttgatgagcgcgccttgttcatggggcagtggggtctgaaatccacccgcggcaacgagggtccaagctatgaggatttggtggaaactgaaggccgaccacgcctgcgctactggctggatcgcctgaagtctgagggcattttggaccacgtggccttggtgtatggctacttcccagcggtcgcggaaggcgatgacgtggtgatcttggaatccccggatccacacgcagccgaacgcatgcgctttagcttcccacgccagcagcgcggcaggttcttgtgcatcgcggatttcattcgcccacgcgagcaagctgtcaaggacggccaagtggacgtcatgccattccagctggtcaccatgggtaatcctattgctgatttcgccaacgagttgttcgcagccaatgaataccgcgagtacttggaagttcacggcatcggcgtgcagctcaccgaagcattggccgagtactggcactcccgagtgcgcagcgaactcaagctgaacgacggtggatctgtcgctgattttgatccagaagacaagaccaagttcttcgacctggattaccgcggcgcccgcttctcctttggttacggttcttgccctgatctggaagaccgcgcaaagctggtggaattgctcgagccaggccgtatcggcgtggagttgtccgaggaactccagctgcacccagagcagtccacagacgcgtttgtgctctaccacccagaggcaaagtactttaacgtc

SEQ ID NO: 1664 - DNA, 570 bp, Corynebacterium glutamicum
atgactgactccactccgcaaggctcaacaccaggcatgtcccctgaagctatcctcaacggcaccggaaagccgtgggaagagtggctaaaattgcttgacgacgtaaaagccacctcttggactcacacccacatcgcaaagcacatcgtggacaactttgatgtcagtggctggtgggctcaaggcatcgcgattggttatgaatacgaacgtggcatgcgcaaacccgggatgaccagcgatgggttcgcggccaatgcctccaaaacccttaacctgccggtcgaaaaagtgtggaagctcttcggagacgatgacctgcgggcgcagtggctcgatcccgcactaattgagaaaacctccgcctccgaacctagaacattcaatgccaaatggttggccgatgattctcgagtgagcgtcaacttcacctccaaaggcgacaataaatccagcttcggcatccagcacagacgcctgcctgatcaagacagcatccctgtcatgaaagcattctggaaagaacgcatcgctgcattagttgaggtgtcaaaacaattttcgctt

SEQ ID NO: 1665 - DNA, 1026 bp, Corynebacterium glutamicum
atgatgagtcgtttgcaaactgaaggcgccggaaacgatcatgaccattacgaagctgtaataattggtggaggccaagctggcctggctaccgcttattatctcatgcgcgcaggagtgcagactctgattttggatgaccaacctgcctccggaggtgcatggctgcatgtgtggccttcgctgcatttgttttcgacttcagatttttctaatcttccaggttggccgatgcccaaatttgacgggtttccaacatcgtctcatgtcgtagattacctgacagaatatgaacggcgttatgaaattccagttagtcgatcagtttctgtagataaggttgattttgtaaatggtgcctttcatttacaatctggaactcgatcctggatagctaaaaacgtggttgccgctaccggtacttggtcggcgccatttgtcccaacttttccgggaaaattctctggaactcattggcactcttcaaattatccgggcgttcaccccttcgtaggtcaacgcattgcaatcgttggaggtgcaaattccggagctcaaattgcagcagagctgagtgaagtgagtgaggtgacatggttcacccgcgataaaccacggtggatgccagatgacgttgatggtagggaattgtttaggcgtaaccgtttgagagctcttgctattcaacgaggtgaacgtgacccagggccagattccgagctcggcgacattgtcatgcttccggaggtgcgcagggctcgagactccggaaagctatttgccactccgatgtttgggtcactcgacgagatacgtgctgatcacctaatttggtgcacagggtttcggccggcgattaggccagttcgtcaacttctcaaacacggacaaccaaaggttcctggtctttatttagtaggctacggagattggacgggacctgggtctgcgactatcacaggggtcgggctttatgccaagcgagcagccaaagagattgccgcgtcagtcggcaaagtcgttaaa

SEQ ID NO: 1666 - DNA, 1176 bp, Corynebacterium glutamicum
ttgacgaatgtcgatattgaaagtattttgaatatcgacaggtatcaatataccgaaaggtgtcgcatgacaaactcaactcagacgcgggccaagccagcccgaatctcatttcttgataaatacattccactttggattattttggcgatggcgtttgggctatttttaggccggagcgtttcgggactctcaggctttctaggcgcaatggaagtcggagggatctccttgccaatcgctttaggcctccttgtaatgatgtacccaccgttggccaaagttcggtatgacaaaactaaacaaattgccactgataagcatttgatgggcgtgtcactcattctcaattgggtggtgggtcctgccttaatgttcgcgctagcttggttgttcctcccagaccaaccggaattacgaaccggcctgattattgtaggactcgcacgatgtattgcgatggtcttggtttggtctgatatgtcctgtggagaccgcgaggctacagcagttctcgtagccattaattcagtttttcaagtcgcaatgtttggtgcacttggctggttctatctgcaagttttaccatcctggctaggattaccaactaccaccgctcaattctctttctggtcaattgtgacttcggttttggtgttcctcggaatacctctacttgctggagttttctcgcgaattattggcgaaaagatcaagggacgtgagtggtatgaacaaaagttccttccggcaatctctccatttgcactaatcggtctgctttatacgatcgtcttgttgttttcattgcaaggtgatcagatcgtctctcaaccatgggctgtagttcgtctcgcgataccattggttatctatttcgttggaatgtttttcatttcactcattgcgtcaaaactatctggcatgaactatgcaaagtctgcatccgtctctttcactgcagctggcaacaattttgaacttgcgattgcggtgtcgatcggaacgtttggcgcaacttctgcacaggctatggcaggaacgattggtcccttgattgaaattccagtacttgtcggcttggtctacgccatgctgtggctaggccccaagttgttcccaaatgaccccacgctgccatcatcagctcgttctaccagccaaatcatcaactca

SEQ ID NO: 1667 - DNA, 420 bp, Corynebacterium glutamicum
atgaataatcaaccatcagtacttttcgtttgcgtcggcaatggtggaaaatctcaaatggccgcagcgctagccaaaaaacatgccggggacgctctcaaagtttattcagctggcacaaagccaggtacgaaattaaatcaacagtcccttgattccattgctgaagttggcgcagatatgtctcaagggtttccaaagggcattgaccaggagttaattaagcgagtagaccgcgtggtcattcttggtgccgaagctcaactagaaatgcctatcgatgcaaacggcatactacagcgctgggtaactgacgaaccctctgaacgtggaattgaaggtatggaacgcatgcgcctggtccgagatgatattgacgcccgagtccaaaacctcgtcgctgaactaacccaaaacgca

SEQ ID NO: 1668 - DNA, 639 bp, Corynebacterium glutamicum
atgaccgggcaagctgcaccaaacttgcataccaatattttgaaccgtatcgcaaatgaactggcgttgacctatcaaggagttttctctgcagagactatcaaccgctatatttttgaatcgtatgtgtcgttggcgagaacagcaaaaatccatacgcacctgccaattttggcagaaggttttgctaaagaccggctgcacgcacttgcggtagctgaaggtaaggtggcttcacctgtgcctcaggtcctatttatttgcgtccacaacgcaggtcgttcacaaattgcttcggcgttgttgtctcactatgccggtagttctgtagaggtacgttctgcaggttctttacctgcttctgaaattcacccactggtgttggaaattttgtcagagcgaggagtgaacatttctgatgcatttccgaaaccgctaaccgatgatgttattcgcgcatctgactatgtcataacaatgggatgtggagatgtgtgcccaatgtatccaggaaagcactatcttgattgggagctcgctgatccgtcagatgaaggtgaggacaagatacaggaaataattgaggaaattgacggtcgaatccgcgagctttggaaaagcattcaattatcgcaaaac

SEQ ID NO: 1669 - DNA, 378 bp, Corynebacterium glutamicum
atgaccattcgcgccactttccagccttccgtagatgaattcatctccactctcgaagagtttgcaacaggttcataccttaaagaggacgaaaaggaattctgggacgaacctttcgatgtcaaggcacttccagatcttcgtttcatcttggaaaactaccttgattccctagataagctcggtgaagcaccagaccttgatgctgttaacgcctccgctcagtccacccttgatgagctggagaagttcaacacaaagcaccacggtgctgttgttgagcctgaagaaaaagaagagatcactaaattgatgtttgatgctgcaaagcagactggtgcagatgatctttctgcagaggctttccctgagtttgag

SEQ ID NO: 1670 - DNA, 1212 bp, Corynebacterium glutamicum
gtgcctttggaattgttcgacactgcagatcaggaagtacgcctggttgaaaccccacctgccggatccgacacaccggttggcatgtacgtctgtggcatcactccctacgactccacacacttggggcacgcggcgacatacctcgctttcgatctgatctaccgcatcctgctggacaatgatcacgatgtccactacgtccaaaacatcaccgatgtcgatgaccctctgtttgaacgcgcagcccgcgacggcgtcgactggcgcgacctcggcaccagccaaatcaacctcttccgcagcgatatggaagccctgagcatcattccgccgaaggactacatcggtgcgattgagtccatcgacgaagtcattgagatggtcaagacgcttctcgacgaaggcgccgcgtacatcgtcgaggacgccgaatatccagatgtctacgcatcaatcaacgccacagacaaatttggctacgagtccaattacgacgcagcgaccatggctgagttcttcgcagaacgcggcggcgacccagagcgtcccggcaagaaaaaccccatggatgccctcctgtggcgcgcagcccgcgaaggtgaaccaagctgggaatccccattcggcgcaggtcgtcctggctggcacatcgagtgttcagcaatcgctaccaaccgcctaggacacagctttgatatccaaggtggcggctctgacctgatcttccctcaccacgagttctccgcagcgcacgccgaagcagctcacggtgtcgagcgcatggctaagcactacgtccacgctggcatgatatcccaagatggcgtgaaaatgtccaagtctttgggcaacctggaatttgtttcccgcctcaccgctgcaggccacgagcccggcgcgatccgcctcggtgtttttgccaaccattaccgtggcaaccgtgattggaacgcagagagcctcgccaccgcagaacagcgtctagcaacctggcgtgaagcagcacgagctgcaaccaatagggaagatgccattgcagttgtcgagcagcttcgtgcacacctatctgctgaccttgatactcccggcgcgctcgccgcggtagataattgggcagcgggtatcgacaccacgaccgattcaaaagagttcaccgaggtaggaaacatcgtggtcgcagccattgatgccctcctgggcgtgcagctc

SEQ ID NO: 1671 - DNA, 879 bp, Corynebacterium glutamicum
gtgaatgaagagataaccctcctagccgcagcagcagatcctgccgcaactgaaaatattggctgggtacaaaccattgtgctctccatcgttcaaggcctcacagagttcctgccgatcagctccagcggacacctccgaatcatctctgagctgttctggggtgccgatgccggcgcgtcctttaccgccgtggttcagcttggtaccgaagccgcagtgctggtgttttttgccaaggaaatctggcaaatcatcacaggttggttcgctggcgtattcaataaggaacgccgcggatttgaataccgcatgggctggatgatcattgttgccaccattcccgtcgtgatcttgggtgtgttgggcaaggacctgatccgtgaggcgctgcgaaatatgtggatcactgcatccgtgctgatcctgttctccctggtgttcattttggccgagaagatgggcaagaaggaacgcgactacgacaaactgaccatgaaagatgccatcatcatgggtcttgcacagtgtcttgcgctgatccctggcgtgtctcgctccggcggcaccatctctgctggtttgttccttggtctcaagcgtgaagtagccaccaagttctccttcctgctggcaatccctgcagtgcttggctccggtttgtactccctgcctgacgcttttgcgccaagctccggacaagctgcctccggcctacagctcaccgtgggtaccctggttgccttcgtagttggctacatttccattgcgtggctgatgaagttcgtggcaaaccactccttcagctggtttgctgcataccgtattcctgcaggtctgctcgtgatgctgctgctcgcactgggcatgctcaaccca

SEQ ID NO: 1672 - DNA, 948 bp, Corynebacterium glutamicum
gtgaaacagcgaatggtcggttcaagtggtttgcgggtatccaggctcggtttgggcacctcaacatggggctcgggcaccgagctggctgaggcaggcgatatctttaaggcgttcatcaattctggtggcacgcttatcgacgtctcccccaactacaccaccggcgtcgcggaagaaatgctcggcacgatgttggatgcggaagtctctcgttcggctgtcgtcatttcctccagcgcaggtgtcaaccccgctctgccgctcggccgacgtgtggattgctcccgccgcaatttgattgcccaattagatgtcaccctgcgggcattaaacactgactatttggatttgtggtctgtgggctattgggatgagggcaccccaccgcatgaggtggccgatactttggattacgccgtgcgcaccggccgagtccgatatgccggtgtccgaggatattccggttggcagttagcggtcacccacgctgcatccaatcatgcagcggcctccgcccgccccgtggtcgttgcacaaaatgaatacagcctgctggaacgccgcgcagaacaagaactcctccctgccacccaacacctaggtgtcggattctttgctggcgctccgctggggcaaggcgtgctgactgctaaataccgctccgaaattccccatgattccagagctgcatccacaggacgcgacgcagaagtccaaagctacctagataatcgaggccgcatcattgtcgatgctcttgatactgcagccaaaggattaggcattagccccgctgtcacagccaccacctgggtgcgtgatcgtcccggagtgacagctgtcatcgtgggcgctcgcacacatgaacagctgtcacatcttctcaaggcggaatcggtgactttgccaacaccaatcacacaagcccttgatgatgtctccctg

SEQ ID NO: 1673 - DNA, 999 bp, Corynebacterium glutamicum
gtgtcccgtttgcttcccgccacagctttgctggcctcaactgcacttcttttaagtgcatgtacgcaaggggtaacggactccccggatatgggcaaggcaactcccgctgtctcccccgcagcaagcaacccggatggccaagtaattgagttcggcaacatcactgacatggaagtcactgatggtgacatcctcggtgtacgcaccgaagacgcactcgctattggtacagtctccgacttcgaagcgggtagccaggtggaactggacgtcgataagcaatgcggcgacctgaccgcaaccggcggcactttcgtgctcccctgcgccgatggcgtttatttgattgatgccaaggacccggatctggatgagttgcgtgcaactgacaagccagtcacggtggcagccttgaccagcgatgatcagcttctggtgggcaatggtgaagatgaagaactcaccatctaccgcgagggcgaagagccagaaaccttcaccgtcgcgggtcccaatacccagctcatcgccgttcctgtcattgatcgccacgacgccgttgtgcgcacctggaacgaaaacaccacgattcaagatgtggactaccccaacgaccgtgaaggcgcgacccttcgcgtgggactcggcgttggtcaaatggctggtggcgaagacggcctgctggtggtctctgatgaaatgggtggccaaattgccatctacaacgctgatgatgtcatccgacttcaaatgaccgcccccaccgacgagaacccatgggccgttgcctgggattcttccaacgcgctcgcctggatcacctcactgaccgaaaacaccctggtcggatacaaaatctctgaaggcgtgcctgaggaagaacagcgcttaaacaccatcgcagacgcgcaaaacctcgtggtattaagcgattccaccctcgtcgtagcatccgcaaccggcgacggcatccaaatcatcgacaacccagcatct

SEQ ID NO: 1674 - DNA, 1113 bp, Corynebacterium glutamicum
atgagcaagcaatcccccacccgcaagctgcgtcaaaccgtctacgatgccagcctcaaagtgatgttcaccctgcgccccgaacgcatccacgggataatgaacaaagcactcggagtcgtcgacggcgtcgcacctctaaaccgcaccatggaaaaaatcatcgcagtgcacgatgattccctctcccaggaagtcttcggcgtcaccttcccacgaccactaggcctcgccgcaggtttcgacaaaaacgcatcaatggctgatgcctggggtgccgttggattcggatacgccgaacttggcaccgtcaccgcctccccacagccaggaaaccccaccccgcgccttttccgcctgcctgccgacaaagctatcttgaaccgcatgggattcaacaacctgggtgcagcagaagtcgcaaaaaacctgcgcaaccggaaatccaccgatgtcatcggcatcaacatcggtaaaaccaaagtggttcccgctgaacacgcagtagatgactaccgccgttctgcatctttgttaggtgatcttgctgattacctggttgtcaacgtttcctcccccaacactccgggtctccgcgatctgcaggctgtggaatctttgcgaccaatcctcgccgcagtgcaggaatccaccaccgtcccagtcttggtgaaaatcgcaccagacctctccgacgaagacatcgacgccgtagctgacctggcagttgagctcaaactcgccggaatcgtagccaccaataccaccatttcccgcgaaggcctcaacactccttcaggtgaagtcgaagccatgggtgctggcggaatctccggtgctccagtagcagcccgatctttggaggtactcaagcgcctctacgcacgggtaggcaaagagatggtgttgatctctgtcggtggcatcagcacccctgagcaagcctgggaacgcatcacctccggcgcaacccttctgcagggatacaccccattcatctacggtggccccgattggatcagagatatccaccttggtatcgccaagcagctgaaagctcacggtctgcgcaacatcgctgacgctgtgggcagcgaattggagtggaagaac

SEQ ID NO: 1675 - DNA, 351 bp, Corynebacterium glutamicum
atgaagaagccaactctatatttaaatctcgaatatggaatccgaaactcgctgtgggcggacaaggtgccatttccgaggaaaggggtacggtttgtgacgtatcctgatgaattaggtttatcgaacgagttgagtgaaaaaatccagctgtggactcgctactggttagcaaattttgttgatgtcgaagatgctcccaaagggcgtccgcagtggaaagctggatctgatgttgagtcgtgggtagcgcaaggtgacattattgaaagcgcgctccgtgcagaattgcctgattttgcggtgttctcaaaatggagattttatggactcaatgttcgttttgtgcaa

SEQ ID NO: 1676 - DNA, 807 bp, Corynebacterium glutamicum
atgtccatccccttctcagtccttcaggactacctggatctgatcagtcccgaagccttaccccagatcccacagcccccggcccctgcccccacagcaccccagctaccaccggcgccggacccacacagcatcgagtggccgatcttcccaccagatcgaatctccgccaacgggcgacgctactacgagccacaaacacgactcgagttcatgcggatctacaccaccctgccgcacggctaccgccagcccttccttaaagccaacaacatcggccactgcaccgttcgaacctggctagcagcaataagcaccttcagccgacttccccatgcttttgatgatgcccaccgcttcgggatcgaacgcaccaccccagtcgacgatgtcaccacactaacggctgatgacaaacgtgacctggtcataggatacttagctcaaccacacggtcagggccagcaattcctcacgttttaccaactccgtaagcacaccatcatggcctggtgcgccgctatgaccgacggggacttagacgctgatatctcaccccgccagatcgggttgatgaccacccgaaccgtggtcgaaatcgttcgactacgccacatgattgcccaacaactagaaagagccacgatcatggaaaacgagtacctcaaagaaatcgcagcgctgaagaaagaactcgcgcactacaagcaaaaagaccatcagaatcaaatggtgatcgatatcttgggaaaagctattgggaccaggcccaatcctggcgagggcttagacgaggaggacgccacc

SEQ ID NO: 1677 - DNA, 1110 bp, Corynebacterium glutamicum
ttgatcacagatctcaccacctgtgccaggctgagccataacaaggcattacggctgatcaagctgtcgaaatcaacggcgtattaccgcaacaagccgcgtccccgtcctgcaccgaaacctgtcctgcaggccgtgccagcaccaacagcacctggtgtggaacccacaccagagccttggcaggggaaggagccagcagtgtcgtcggtgcgtcaagcgttggcagaacacgaacgccagttcattgttgatgcgatcaccgcgtacccacaactgagcgttagtggggtgtttaacatgttgtttaacaaaggcatctaccgcgcatcactacgtacatggtggcgtgttgccaagcagcacaagttgttacacaaagaccgagtcagtgccctgtccccggggaaacgatcaccaacgccacgggttaagccgaggttggaagcaacacagcctggtcaggtggtgtgttgggatgtgacgttcttgccgtcgctggtacgtggtaagacctatgcgttgcatctggcgattgatttgttttcccgcaagattgttggggcgaaggtcgcgccgacggaaaatacctccaccgcggtggagttgttaacgcaggtgttagcggataatccgggtgtggtgacggtgcattcggataatgggtcggcgatgacatcgacgagggtgcggcggttgttagcggatcatggtgtggcgttgtcgttgattcggccgcgggtgagtgatgataatgcgtttgtggagtcggtgtttcatacgttgaagtatcggccgttttatccgaaggtgtttgcatcgatggatcaggcccgggtgtgggtggaggagtttgtggtgtattacaacacggttcatccgcattctggtgtggctgggcatactccgcagtcggtgtttgatggtagttggagggcggctcataggttgcgtgtgcaggcgttggatgcccattaccggcagttcccgcagcggtatgtggggcggccggtggttcaggaagttgctggtgtggtgcgtcttaatggtgcgcgtgatgatgggtctgtacaggagagggttggtggtgtagcgtcgctgttaagtgct

SEQ ID NO: 1678 - DNA, 486 bp, Corynebacterium glutamicum
ttggcaggtcaattgtgtggggatggtacgagaactagtagggtatgtcacattatgagttcagcatcgggaagatcattaaaaaagctcaccagcctcgaaggccgtgccagctggcgtaaagttccggcagcaatccgcatcggtggagctttcgtagccttaggtctggttttgttggtgtttgcagcaattgagctgtttaccgccggcatgctgagcccatttgtgatcactccaggattccttctgatcctcgttgcctcgatcattctcggcgcattcgctaccaccagcaagtacgagccaagctcaaagacacagatcatttctttgagcatcgctgtagccctggtgatcgtaagtcgtttgcttccaactattcaggtttatgtcgtggagcagttctggctcaccgcgtggggagtggctgccttgctgtgcggtttggttatccgccgtgcgcagcttcctaagtcaacaaaa

SEQ ID NO: 1679 - DNA, 531 bp, Corynebacterium glutamicum
atgagcacctaccaagacgatcgtttcccaggcccagacccctacgcaccgcttggtgaaaagccaagctttaccctcacctccaccgacttggaaaacggtgcaaagctggccgaagcccaactcggtggcaccgatatttccccacagctgtcctggtcagatcttccagaaggcaccaaatccctcgcgatcacctgcctcgacccagatgccccaaccggcgctggtttctggcactgggcagtgtttaacatccccacaactgtcacggagatccccaccggtgctggcgatgaaaccctcggcggcatcgaaggcgtagtttccctcaagggtgattccggcaagcgtggcttctacggagcgcaacctccagctggccacgcaccgcaccgttacctcttcgcagttcatgcacttgatgtggaaaaactcgacatcgcccccgacgctacccccactgttctaggcttcaacctgtatttccacactcttggcaggtcaattgtgtggggatggtacgagaac

SEQ ID NO: 1680 - DNA, 729 bp, Corynebacterium glutamicum
atgatgcgatctgcgacaactgcttggtcaaggcggtgcgcaacaaccaaggtggtgcggtttcgtgcgatttctgtggcggctttttccaacatgcgggcatcatcgctgccggcttcactggtggcttcatccatgatcaacacaggtggattgcggagcacgatgcgggcaagagagatttgctgttggatttcaggggtgagttcttctgcgccggcgccaattttggtgtctaatccggatggaaagaaacgtcgaaaagcagttgtcatttgcccgagcccgaccgactcgagcgctgcgtggagctgcgcgtcggtggcgtgcgcattggccatgcgaagatcctctgccagagtgcctgcgaaaaggtggacttcctggctgatcagcgcaacctggcgggtagtccacgtgtcggtgacggtggcggtgttgatgcccccgaccaaaacggcgccggaatcagggcgctgcagccccgcaatgacgcccgcgagcgtggattttcccgcaccagaagtaccgaccagcgctgtggttgttcctgcttccaagaccagattgaaatcctccaaaatggccacgccgccgggatatttaaacgtcacgtcctgcacagtcacggagggtggttctgtgcaatcggcagactcagacagctgttcggtgcgacgagccatctgggcaagggacaccgcgcgaccaagagaagtagacgcactc

SEQ ID NO: 1681 - DNA, 603 bp, Corynebacterium glutamicum
atgctgcgccatctacttcaccccttccgaaaaatcagattgcatctgctttgcgacgccgtgccacgtcgggttcgacgtaatgacgacggttttccggcctcgacgaagcttttcgacgcgatgtgccacttcatccagggtcaccgcatccaaccccgtggtcggttcatccaaaatgagcacctcaggatcaacagccaagaatcgtgccaaagcaatcctctggcgttggccaccggagagattcaatccggcctcgccgatcaaggtatctggaagctcaaactcccccggcatgttcagatcagcacccaatcggctcaagatgtcctcacaacttgcagcatgaagagcagcgcgcagcatctccggtgcgatagtgcccatcggattcaaattatccttcagcacaccttcaaacacgctgacgcggtgaggagccacaatgacatcttcacgaacctgaagcgcctccaactcccgatcaatcacatcgcgtgcctcaggtgtcgaaggatcccacaccgtgatcccctcttcaaattcaaaggtggcaggctgaggtcgtggctcagcggccgccttatccagttcagtgac

SEQ ID NO: 1682 - DNA, 1797 bp, Corynebacterium glutamicum
atggcgcagcatgagcgcgttgcggatgcgctgcagccggcgtcgttggcggagtcgtggcgtgagctgaaaacgatgccttcggggcccaaggcctggtggtatgtgagtttcgtggttattagcgtggtcacggtcgtggcgatggtcggcacgtccaacttgttgggctattccgttgatctgatcaatgggcagtcgttgccgctgatcggttcaggatcgaccgcaatgatctggttgcttggtttggtgggcgctggaattttagcagaaactgccggtcgcgcgctgctgcaattggtgatcaacaccttggcacgtcgcctgtcggtggatctgcggaaagctgcgctgtcttcggcgttgcgtgcaccggttcctgatgtcatggaattgggcacgggaaacgtgattagccgcctgacgcaagacatcgataacactgtgcgcatcgtcggcatggtaggtgtgcgtttggtgatcaccattttgattctgcccagctccttgttcgcgttgatgaccattcactggacctttgtgatcctgttcatcgcagtgattgtggtgctgattcccagcggtcggaaagccgtgcgagctattccttcggcaacaaatattgtgtccagtacggaggcgcgtcgaaacaatctgctcctcgatacgatccgtggcattgaaacactgcgtgtgctcaagctcggtgcgtggggtgtgcagcggatgcgccaagcgtcgtggactgcggtgcaagcaacagctgatcgcgcgccgattttcactcgtctgctcgcccttggttcgattgcttatggcctgctgctaattggcgtgtttgggctcagtgcgttttgggttgcccaggatgcgatgagcattggagcggcaacggcagcagttttcgtggttgtgcgcatggaaattcacgtgttcaacgtgctgttcttcgcatcggaaattcagagtgcgtctacttctcttggtcgcgcggtgtcccttgcccagatggctcgtcgcaccgaacagctgtctgagtctgccgattgcacagaaccaccctccgtgactgtgcaggacgtgacgtttaaatatcccggcggcgtggccattttggaggatttcaatctggtcttggaagcaggaacaaccacagcgctggtcggtacttctggtgcgggaaaatccacgctcgcgggcgtcattgcggggctgcagcgccctgattccggcgccgttttggtcgggggcatcaacaccgccaccgtcaccgacacgtggactacccgccaggttgcgctgatcagccaggaagtccaccttttcgcaggcactctggcagaggatcttcgcatggccaatgcgcacgccaccgacgcgcagctccacgcagcgctcgagtcggtcgggctcgggcaaatgacaactgcttttcgacgtttctttccatccggattagacaccaaaattggcgccggcgcagaagaactcacccctgaaatccaacagcaaatctctcttgcccgcatcgtgctccgcaatccacctgtgttgatcatggatgaagccaccagtgaagccggcagcgatgatgcccgcatgttggaaaaagccgccacagaaatcgcacgaaaccgcaccaccttggttgttgcgcaccgccttgaccaagcagttgtcgcagatcgcatcatcgtgatggaacaaggcacaatcaccgaagacggcactcaccaggaattacttgcttttgagggccgctacgcgcagctgtatcaacgatggagtgctcaa

SEQ ID NO: 1683 - DNA, 249 bp, Corynebacterium glutamicum
atgctggacaccaacatgccgaataccaacagccacgtagcagcaggaaacgcccacagtaacgcccaagcacttttaactggcgtggagttctccaacttgggaagcaagggtgtgccctcatctggagaatccggaacaaaccaggaccatgtgcgcatcctggggaattcatttgtcatggcgaaaacactaccgcagctttatacggacagtacttacaaagctgtaagtacaactttgtctttt

SEQ ID NO: 1684 - DNA, 1587 bp, Corynebacterium glutamicum
atgcgcacatggtcctggtttgttccggattctccagatgagggcacacccttgcttcccaagttggagaactccacgccagttaaaagtgcttgggcgttactgtgggcgtttcctgctgctacgtggctgttggtattcggcatgttggtgtccagcatgtttggtgctgtggtgtcgctggtggttgggcgtggctcggaatgggcgtttggctcaggtgagttgatgccagtactggtggtatcggtggcgctggctgtgctgttgtgggtgatctacatcctggagggctcggctgatgcattgactgatttagcgagtgccagggtagtgcacaacttgcgccttgagctttcgggcaagttggttactacgccacgtaattcgctgactcctggtgagatgttgaatacggtcgatcaggactcggttcaaattggtgggttgaagcaggtgctgaactttcccatcatgatggtgggctatttgttgggttccactatttctattgcgccgatttctccgctgattgcggtgttactcgtggtgggtggagtgtttaccgcgttggcttcctatttcacggcaactccgttgactaagatttccgcgaaacgccgtgaggcggaatcgaagtcggtgtctttggctaccgatgtggcgcagggatccagggtggtgaaaggtttgggcgctgtttctcaaactgaggagcgctttggcgcagcggctgatgaagccttggcaatcatgttgaaggaagttcgtctgcagtcgttgctgacttttgtgcgccaacttgtcccagcggtgttttctgtgggtcttttggcttatgcgtcactgttggcttttgacggtgacataactggtggtgagatgatctcggtgacgttgctggtgccaccttcgttgactgtgttgggtgtgtcgcttggcatgatgacagagatttgggctaggggacaggcttcgacaaaaagggtccaaaacttagtcactgaactggataaggcggccgctgagccacgacctcagcctgccacctttgaatttgaagaggggatcacggtgtgggatccttcgacacctgaggcacgcgatgtgattgatcgggagttggaggcgcttcaggttcgtgaagatgtcattgtggctcctcaccgcgtcagcgtgtttgaaggtgtgctgaaggataatttgaatccgatgggcactatcgcaccggagatgctgcgcgctgctcttcatgctgcaagttgtgaggacatcttgagccgattgggtgctgatctgaacatgccgggggagtttgagcttccagataccttgatcggcgaggccggattgaatctctccggtggccaacgccagaggattgctttggcacgattcttggctgttgatcctgaggtgctcattttggatgaaccgaccacggggttggatgcggtgaccctggatgaagtggcacatcgcgtcgaaaagcttcgtcgaggccggaaaaccgtcgtcattacgtcgaacccgacgtggcacggcgtcgcaaagcagatgcaatctgatttttcggaaggggtgaag

SEQ ID NO: 1685 - DNA, 351 bp, Corynebacterium glutamicum
atgtcagaggcaaccccataccaatgtcctttcattacagctcagggaattgagttcttcgggactgaaccagcctattttggtgtcgaatcatcaggtgatcgtgatgcttttttctttcctggcgaacagctgtattcctgggagttagctcctggcaagtatcgcgaacgtgggtattcgcgttctgaaggttggagggagtacgcgggtctcggtcatccgagcagcgttggaactcgggaatatcgaaattcaggacgcagttgggattcattgccgtgtcagatcaggttagatttttggcgtgagacacaatcgcgtccgcgcaaagacatattggaacaatgg

SEQ ID NO: 1686 - DNA, 609 bp, Corynebacterium glutamicum
atgagtcccaccgttttgcctgctacacaagctgacttccctaagatcgtcgatgttctggttgaagcattcgccaacgatccagcatttttacgatggatcccgcagccggaccccggttcagcaaagcttcgagcacttttcgaactgcagattgagaagcagtatgcagtggcgggaaatattgatgtcgcgcgtgattctgagggagaaatcgtcggcgtcgcgttatgggatcggccagatggtaatcacagtgccaaagatcaagcagcgatgctcccccggctcgtctccattttcgggatcaaggctgcgcaggtggcgtggacggatttgagttcggctcgtttccaccccaaattcccccattggtacctctacaccgtggcaacatctagttctgcccgtggaacgggtgttggcagtgcgcttcttaatcacggaatcgctcgcgcgggtgatgaagctatctatttggaggcgacgtcgactcgtgcggctcaactatataaccgtctgggatttgtgcccttgggttatatcccctcagatgatgatggcactcctgaactggcgatgtggaaaccgccagcgatgccaactgtt

SEQ ID NO: 1687 - DNA, 1089 bp, Corynebacterium glutamicum
atgagtgatcacggtttcctagaagacaacctaggtaccctcaccaccaccggaggcactgatttagggcgcagcaccgcagtggctccggaggcgctcaagcgcgccaggcagcgcatcgacgtccaattgctttacgacgccgtcctccaacacgaccgcaccctcatggcgcgtgccataaccctgttggaatccactgcgccagcccatcgcgccttggcccaagaactcctggtcaagctgctgccgcattctggaaacgccctgcgcatcggcatcacaggagtccccggtgttggtaaatcaaccttcatcgaagccttcggcctgcacctgattgaacagggacacaaggtggcagtagtagcgatcgacccgtcctcgaccaaaactcgcggctcgatccttggcgataaaacccgcatgtccaagctttccaacgcagaaaacgccttcatcaggccgtcaccttctgccggaacacttggcggtgtggccaaagcaacgcgtgaagccatggtggttttcgaagctgcaggttacgacatcatcatcgtcgaaaccgtcggcgtcggccaaagcgaagtcgccgtatcgcacatggtggatatcttcaccttcctggcgctgtccggcgctggcgaccaactccaaggcatcaaaaaaggtgtcttagaaatggcagagttggtggccatcaacaaagccgacggccccaacgaaaaaccagcaaaacgagcagcccgcgacctcgcttctgcactccgcatggttcgcagccccgatgaactctggcatccaccaacaatcaccatgtcagctgtcgaaggcactggtgtggacaccttttggcatcatgtccaaaaccaccacaaaaccatggtggaggcgggggagttcgacaggcgacgacgcgaccaacaagtgggatggacttggtcgatggtccatgaaactatccgcatgcgtctcgaaaacgatcccggtgttcaagtagtgagccaagacatggaacgagccctccgcaaaggttccaccaccccgacgttggctgcccaaaacatcctggaggcgttcgacaaagcc

SEQ ID NO: 1688 - DNA, 2211 bp, Corynebacterium glutamicum
atgacgtcgatccctaatttttcagacatcccattgactgctgagacacgtgcatcggagtcacacaacgttgacgccggcaaggtgtggaacactcccgaaggcattgatgtcaagcgcgtattcacgcaggctgaccgcgacgaggcgcaagcggcgggacatccggtggattctttgccaggtcaaaagccatttatgcgcgggccgtacccaactatgtacaccaatcagccgtggacgattcgccagtacgcaggcttttcaaccgccgcggaatccaatgcgttttatcggaggaaccttgctgcgggtcaaaaaggtttgtcggttgcgttcgatctagcgacccaccgcggttatgactcggataatgagcgcgtggtcggcgatgtgggtatggccggcgtggcgattgattcgattttggatatgcgtcagctgtttgatggcattgatttgtccagcgtgtcggtgtcgatgaccatgaatggcgctgtgctgccgattcttgcgttctatatcgtggcggctgaggaacaaggtgtgggtccggagcagcttgcgggcacgatccagaatgacatcttgaaagaatttatggtgcgcaacacctatatttatccgccgaagccgtcgatgcgcatcatttccaacatctttgagtacacctccttgaagatgccacgttttaactccatttcgatttctggctatcacatccaggaagcgggagcgactgccgatttggagctggcctacactctggcggatggtattgaatacatccgtgcaggtaaagaggtaggccttgacgtggataagttcgcgcctcgtctgtccttcttctggggtatttctatgtacaccttcatggagatcgcaaagctgcgtgcgggacgactgctgtggagcgagttggtggcaaaattcgatccgaaaaacgccaagtcccagtcgctgcgcacgcactcgcagacctctggttggtcgttgaccgcgcaggatgtgtacaacaacgtcgcccgcaccgcgattgaggcgatggctgcaacccagggccacacccagtcgctgcacaccaatgcacttgatgaggcgttggcgctgcccaccgatttctctgctcgtatcgcccgaaacacccagctgttgctgcagcaggaatctggcacggtgcgtccagttgatccatgggcgggctcctattacgtggagtggttgaccaatgagctggctaaccgcgcgcgcaagcacatcgatgaggtggaggaagccggcggaatggcgcaggccaccgcgcagggaattcctaagctgcgcattgaggaatcagcggcacgcacccaggctcgcattgattccggccgccaggcgctgatcggcgtgaatcgctacgtggcggaagaagatgaggaaattgaagtcctcaaggttgacaacaccaaggttcgcgcagaacagttggctaaactcgcgcaactgaaagcagagcgcaacgatgcggaagtcaaggctgcgctggatgcgttgacagctgctgcccgcaacgagcataaagagccaggggatttggatcagaacctgctcaaacttgccgtcgatgctgcgcgcgcaaaagctaccattggagagatctccgatgctttggaagttgtctttggccgccacgaagcagaaatcaggacgctgtctggcgtgtacaaggatgaggttggaaaggaaggcacagtgagcaacgtcgaacgcgcgatcgccctggctgacgcctttgaggctgaggaaggccgccgcccacgtatctttattgccaagatgggccaggatggacatgaccgtggacagaaggttgtcgcgtctgcctatgctgacctgggcatggacgtggatgttggaccgctgtttcaaactccagccgaagctgcccgcgccgccgtggacgccgatgttcacgtggtgggtatgtcttcgctggcagcaggccacctcaccttgctgcccgagctgaagaaagaacttgcagctcttggccgcgatgacattctggtcaccgtgggcggcgtcattccgccgggcgatttccaggatctctacgatatgggtgccgccgcgatttaccctccaggaaccgtcatcgcggagtcggcgatcgatctgatcacccgactcgccgcacacctgggctttgacctggatgtggatgtgaatgag

SEQ ID NO: 1689 - DNA, 1848 bp, Corynebacterium glutamicum
ttgactgatctcacaaagactgcggtgcccgaggaactttcagagaacctcgaaacttggtacaaggctgtggccggtgttttcgcgcgcacacagaaaaaagacatcggcgacattgccgtagatgtgtggaagaaactcatcgtcactacaccggatggtgttgatatcaatccgctgtacaccagagcagatgagtcccagaggaaattcactgaggttcctggtgagtttcccttcactaggggaaccactgttgatggtgaacgcgttggttggggtgttactgagactttcggacatgacagcccgaagaatatcaacgctgcggtgctgaatgctctgaattctggcaccaccacattgggttttgagttctctgaggaattcacggcagctgatcttaaagttgctctcgaaggcgtgtatctcaacatggctccgttgctgattcatgcgggtggatccacgtcagaggttgcagcggcgttgtatacgttggcggaggaagccggaacgttttttgctgcgttgaccttgggttctcgtcctttgacggcgcaggttgatggttcgcacagtgacaccattgaagaagcagttcagttggcagtgaatgcttccaagcgtgcgaatgtgcgcgctatcttggtggatggttccagtttttccaaccagggcgcgtcggatgctcaagaaattggtctaagtatcgccgccggtgtggattatgtccgtcgcttggtcgatgcaggcctttccacggaagctgcacttaagcaggtggcgttccgttttgcggtcaccgatgagcagttcgcgcagatttctaagctgcgtgtggctcgacgtctgtgggccagggtgtgtgaggtgcttggttttccagagctggccgtagcaccacagcatgcggtgactgcacgagcgatgtttagccagcgtgatccgtgggtgaatatgctgcgcagtactgttgcagctttcgctgcaggcgtcggtggagcaaccgatgtggaggttcgtacttttgatgatgcgatcccagatggagttcctggagtgtcgaggaatttcgctcaccgcatcgcgcgcaatactaatttgttgttgctagaagagtcacatcttggtcacgtggttgatcctgctggtggatcatatttcgtggagagcttcaccgatgatctagcggagaaggcgtgggctgtgttcagtggcatcgaagctgagggcggatacagtgcagcttgtgcatccggcacggtgactgccatgcttgatcagacgtgggagcagactcgcgctgatgtggcgtcgagaaagaagaagctcactggaattaatgagttcccgaacttggcggagtctccgctgccagctgatcgtcgggtagaacctgcaggtgtgcgtcgatgggcagcggattttgaagcgctgcgcaatcgttcggatgctttcttggaaaagaacggcgcgaggccacagatcacgatgattcctctgggaccgttgtccaagcacaatattcgcactggttttacttccaacctgttggcttccggtggcattgaagcaatcaacccgggtcaacttgttcccggcactgacgcttttgcagaagctgcacaggccgcaggcattgtagtggtgtgtggaacggaccaagagtatgccgaaacgggggagggagccgtcgaaaagctccgcgaagcgggcgttgagcgcatcctgcttgctggcgcgccgaagagctttgagggcagcgcgcatgcgcccgatggttatttgaacatgacaattgatgccgcggcgacgctggctgacctgctagatgctttgggagct

SEQ ID NO: 1690 - DNA, 723 bp, Corynebacterium glutamicum
atgtcaggacgcctaaacacaccaatttccacggtctttcacttctttagctcacttttccatgacgctctgcgcagtgttgcccagtggagtgcgtggaagaaaatcgctgtatcggttgtcatcgtcgcaattatttccgtaacttttcttgtcgatgtccccccgatttcggtttatcgtgactgggcaaacaacgccggcgacgcttttgtcttagttttttgcgccttttatatcctcattactcagttccctatcccccgcacagttctcacactggcctccggcgtgctgttcgggccggttcttggatcagtcgtggcgctgggttccaccacagtgtcagcggtaatctcgctcctcattgttcggggtctgcttggcgattggatggcgccacgtttaacgcaccccgcagtctcacgcatcaatacccgacttgagcaacgtggatggctggcgattacctctttaagaatgatcgccgctatccccttttccatcctcaactatgttgcagccttgactagcgttcctgttttttcttttgccatcgctaccttgatcggatctgcaccaggaaccatcgtcaccgtcgttttgggagatgcagtcacaggttctggaaactggactgccgttgcattcacggtatttttagcgattttgggtgttttaggtatctttttagatcaaaagatgccagtcaagcctggaaag

SEQ ID NO: 1691 - DNA, 597 bp, Corynebacterium glutamicum
atgtgggcactgcatgccagataccgcggccgagacacacgacgagccgaattggttaaaagatttgcagaagctttgtccaccctcgaaggtgctggccagtttgaagtcattggtgtcgaagacatccgagcacacatcacctcaccgttaaccacatgtgatgttgtcatggcgctactcgcagctggcgattgggcaatcggaattggtgttatccccaccgttgacggaacagtcgatgaatcggatgaggccatcatcgaacaggtaaagaaaatttcctctgatgctctgcgccccaccgccaaggcgggaacggtcaaagttaggatcgccggaaccaaacgggacaatactcaagccttcaacatctccgctgcattcacgttgattgggcaagttctgtcaaagcgcaccatcgaaggacgcgaagccaccgcactcgtccgttctggactgaatcaaaatgaggcagcccaagagctcggtatttccaagcaggcaatgtcgcagcgattgcaggcggcaggttggcaggcggaatctgctggttggcaattggccgtaaacctcatcgagcaggctggcaagcgc

SEQ ID NO: 1692 - DNA, 1296 bp, Corynebacterium glutamicum
atgacaggactaatcctcgccatagttttcctggtctttgtcgccgtcgtggtgatcaagtccatagccctgattccccagggtgaagccgccgtcattgaacgccttggtagctacacccgcaccgtttcaggtggcctgaccctgctggttccattcgtggaccgagtacgcgcaaggatcgacacccgtgagcgcgtggtctcattcccaccgcaggctgttattacccaagacaacctgaccgtggccatcgatatcgtggtgaccttccaaatcaacgaaccagagcgcgccatctacggcgtggacaactacatcgtcggtgtggagcagatttctgtagcaacacttcgagacgttgtcggtggcatgaccctggaagaaaccctcacttcacgtgacgtgatcaaccgccgcctccgtggcgagctcgatgcagcaaccaccaaatggggcctgcgcatcagccgtgtggaactaaaggcaattgatccgccaccatccatccagcaatcgatggaaaagcagatgaaggcagaccgtgaaaagcgcgccaccattttgaccgcagaaggtcagcgcgaagccgacatcaaaactgccgaaggtgaaaagcaagccaagatcctccaagctgagggtgaaaagcacgcatccatcctgaacgcagaagcagaacgccaagcgatgatcctgcgcgccgaaggtgaacgcgcagcacgctacctccaggcgcagggtgaagcccgagcaatccaaaaggtcaacgcagcaatcaagtctgccaagttgaccccagaggttcttgcttatcaatacctcgaaaagcttcctaagatcgcagagggcaacgcctccaagatgtgggtcatcccaagccagttctccgattctctggaaggttttgcgaagcagttcggcgcaaaggatgcagaaggtgtcttccgctacgaaccaaacaccgtggatgaagaaacccgcgacatcgcaaacgccgacaacgtggaagactggttctccaccgaatcagaccctgaaatcgcagcagcagtcgccgcagcaaacgccgtggccaacaagccagtcgatccagaacccggtgagatcctttccaagaagaccgcacgacgcgttgaacctgaagcagtattggaggctttgcaaaacggaaccactacacaacctgaggttgaggcagcacctcctaccgcaaacttcgcccaagaattccctgcaccacaggcaaaccctgaagattactccgaccaacaccgagagaatccttacggaaac

SEQ ID NO: 1693 - DNA, 435 bp, Corynebacterium glutamicum
gtggcctgcgtgggagcaataatttggtttatcggagcattggttcttgctggcttggaattggcagtaggtgagttcaccttattgatgctcggcggtgcagctttggcaaccgccggcgtggcactcatcggtgtcccagtatgggctgaatttgtcaccttcgcggtggcctcagctgctctactgatgttcattaggccggccattagaaagcgtctgctgaaaccaaaggttctggactcttcaccacgagcacttgttggccaccgtgctgaagtgctcgaagatgtcggagcgaccagcgggcaggtccgcctggatggttcaatttggtccgcccgcagcatggatcccacacacaccttcgcggaaggtgaaattgtcagtgtcattgatatccaaggcacgaccgcgattgtatggaaagaagcc

SEQ ID NO: 1694 - DNA, 843 bp, Corynebacterium glutamicum
atgagtttttcagacccctatgcaggcaatatttttggtggacactcccgcaacaagcagccggagtatcccgatgtgcccgcaaaaccaggccttgtggtggaagttcgtggagatggcttcgtcggcgctgtgaccggttttgaacgcacctacgatggtgattttgtgcgtctcgaggaccgccgcggacgcgatgcgctgtacaagctgcgcaagggtgcgttcatgattgatgggcagatcgttaacctcacccgtttcgtggaaaaacaagcaccacgtaaatctaattctggttccaggcgtgtagaaaacgcgcaagcaaaggtcgcggcgccgtcacgcatctgggtagaaggcatccatgacgccgccatcgtggagaaagtgtggggacacgaccttcgcgttgagggcgtcgtggtggagtacctggaaggtctagacaacctggaggaacgtctcgcggaatttcagcctgggcctggacgacgcatcggagtgctcgctgatcaccttgttgagggatctaaagaaactcggatgactaaatcactacccgcggatgtcgctgtcaccggccacccctacatcgatatttgggctgctgtgaaaccagagcgtttggggcttaaggcgtggcctgaggtgccatacggggaggattggaaaaccggcatctgcaaacgagttggctggtcagaccccaaagaaggctggcaccgtgtgtataacgccgtgaattccttccgcgatttggactacaccctaattggggcagtggaacgtttggtggattttgtgaccaacctcgatttgagtaaagaggacgtcctcgcc

SEQ ID NO: 1695 - DNA, 783 bp, Corynebacterium glutamicum
atggaaattcgagcaaacgtttattcaccgcttcaaaatactgccgtctggctaggtgcgtggctctatgaattagtgcccaccgaagatgtcatcgatgcgttcgtcgatctcggcggcccgcacaccttcggcgacggcgggctgctcgatatgctgcgaactttaaaagaattaacaagcacgcttatcgacgcccccttccacggtccgattttaactctcgcactcagcggcccaggccaagtgccggcgttgccggcaggttcacgcgctgcggtcttggcctccgcctcgaaggagggggcgttggtgctgggcggcgtcgataagcagcattcttgggcgcttattcctacgcgcggtaaggatgccactgagtggaatttggtggaggtggagggctttttgccggcgattgcgactgtctcgcccggtgaggcggatcagctgctccgtcaggcgacagatcaggcggcaaatatcattgagttaagtggctacgcttcacttgcgccgaaatctttgaagaatccgcgactaaccgtgggcatgctgtcagatttttacgacaccccggggcttccctatgcagtcccagagaggtcggcgaagctttttgcgcgcgcagatcgcgtggctgccatcgcagagaccgtgcaggaaaccatcggcgatcacagcctggatccacagttgattttcctgtggagccatattcggaccgcgcgcatggctggggtgagttatgccctcgcagagtttgcgagggactatcactcc

SEQ ID NO: 1696 - DNA, 1110 bp, Corynebacterium glutamicum
atgaatgaacgcacatcggatgcatttgacgccctccttgtgctctccttcggtggtcccgaagggcacgaggaggttcgtccgtttttggagaatgtcactcacggaagggggattccgccggaacgtctagatgaagtggcggttcattaccaccacttcggtggtatcagccccatcaatgcgctgaacagggaaattatcgccaatgtggaaaaagaattggcgtctcgcgatcacaagctgcctgtttattttggtaaccgcaactggaagccgtttgataatgaggccgctgaacaaatggctgatgacggcgtgaaaaacgcgctggtgttggcaacttccgcttggggtggctactccggttgtcggcagtaccaggaagatattcagggcatgatcaagcacctggagtctcaggggcagtcgatcacgttcaccaagctgcgtcagttctacgatcaccctcgttttgtctccaccatggctcaattggttcaggattcctacgcgaagcttcccgatgagctgcgagatgaggcgcgtctggtcttcaccgcgcactccattccactgactgcggacaatgctgcgggaacccctgaggatggctccttgtattccacacaggtcaaggaagcgtcagcactgattgctgaggctgttggtgtgtcagattttgatgtggtgtggcagtcccgctcgggtagcccgcacactccgtggctggagcctgacatcgtggatcacgcagtggagctcaacgagaagggtcaaaaagcgctcgttgtctgccctgtaggctttatttctgatcatatggaagtcatttgggatcttgattccgagctgatggaagaagccgagaagcgcaacatggtggtcgagcgtgtcgctaccgttggccccaccgatgaattcgcagcccttgtggttgatctcatcgaggaggcagagctcaagcgcgttatcgagcgccttggaaagctgccagcacgcggaagttccgtcaacggcgcaccgtgtggcgacggctgctgtggtaccgccaagcataaaaccgcgcgggtgaaccccaacgctcgctcagcggcgccagctgccaac

SEQ ID NO: 1697 - DNA, 1800 bp, Corynebacterium glutamicum
ttgattgcgcttgcagtaagcggagctttgcttagttccatgactccggcggtggcgcagccacagaatccggatgacgcagccattgcacaggcagaggaaaatgtttcggcgggcgatggggaagtcgcccgcctggcaggatctttgtccagcactgacgcggaaattaaccgcgtcgagctggaaatgggtgctctgcgtgaagaagtgaacaagtccctcgtggatttgcatgatgcgcaggcaatcgccgagcaggcccgccaagatgcacttgcagccaagaaggatctcgatgattctcaagcgcagatcgaagcagcccaagagcgccttgatgagatttcacgtgcagcgtatcgccaaaacggaacctccaaggggctttcaggcatctcgggcaatggaaattctgaagatgcgctagatcgtcagacttacctgcgaaccagtgcggaaaagcagcaggcagctgttgaagagcttgatcgcctccgtacggaaaacgccaacaaggaatcggtgttgcgccaggcccgcatcgttgctgagcagcgtgaggcggaagccgtcgaaaagcaagtccagaccgaggctgcaattgccgcaaacagcgagcagctcaatgtcttgactaacaatcgcagtaccttggttgcccagcgtgatggggctgagcgcaacttggccatcgctcgtgcgcaggcggataatctgcaaggtcagcgtgctgagtacgaggaattccagcaggcagagcaggctcgcatccaggcggaagcggaagctcaggctgctgcggaggagaagcgtcgtgccgatgaggctgctgcacaggcagccgctgaagctcaagaagctgcccagcaagctcaggcggcggaggaagcccaagccgcgcaagcagctgagacagcacaagcccaagccgcgcaagctgcggaaacccaagctgcacaagccgcgcaagctcaggcagaagcgaatgatcgtgccgccgcgcaacagcgtgctgcagaggctcaagcagcagcggaacaggcgcaacgtgaggctgacgctcaggcggccaacgatgcccaagctcaggcactgcgtgaacaggcgctcaccgcagcctccatcgctgcggctgctctaattgcggcgagccagtccagccatgccactactcaaaatccttacccaactgatgaagacgcggatccgaccgatattgcggacatccaaggcccaacgcagccaggtacgggtgagtctggagattcccagagcaactccagcgacaacgattccacaggcaacgattccacaggctctgactcttcagattcagattcctccggcaacgattcttcagaggttatttccggcgatcgttccgctcagattgagactgtgattgcgcgcgccatgagccagttgggtgtgcagtacgcatggggtggcggtaacgctaatggcccaactctgggtatccgtgacggtggcgtggcggactcttacggcgattacaacaaggttggcttcgactgctctggactgaccttgtatgcgtttgcgggtgtgggaatttcacttcctcactacacgggctaccagtaccagcacggcaccaaggtgtcgccttctgagatgcaacgtggcgatctgatcttctatggtccgggagcgtctcagcacgtggcaatttacctcggtgatggtcagatgattgaggctccgaattcgggttctgtcgtgaagatttctcctgttcgctggagcggaatgaccgagagcgtggtacgcctcatt

SEQ ID NO: 1698 - DNA, 498 bp, Corynebacterium glutamicum
atgattccagaaaatattgatctcaagcagctcgcttcggagcttggtgatgatgccgtggcaatgggggagcacacaggcaaccagtttccgactttggaaaaagaccttattaatgttgtgacagatgcaaaggaatcagattttggatctttaggggtcgtgattcttgatgaaactccagtgatgacttccaacctgagggatattgcgcaggagctgttgattcaaacggatctggacaccgttgtggtgcgggctccaatgtcggctgcggtggtgagtgatgttcattcgagggcggcgcttgagtcagggcagcatgatttgcttgggaccactgattacgtgctgggaacggagcttttggtacaggatgtaacggaatcgacggtggggaatattgattggggtcaattgctgatttgggggttggttgctttggcaatcgccgtggttgttgcgggtgcgtctgtgcgtcgaaaagcaatatcttta

SEQ ID NO: 1699 - DNA, 2829 bp, Corynebacterium glutamicum
ttggagctcactgtgactgaaagcaagaactccttcaatgctaagagcacccttgaagttggcgacaagtcctatgactacttcgccctctctgcagtgcctggcatggagaagctgccgtactccctcaaggttctcggagagaaccttcttcgtaccgaagacggcgcaaacatcaccaacgagcacattgaggctatcgccaactgggatgcatcttccgatccaagcatcgaaatccagttcaccccagcccgtgttctcatgcaggacttcaccggtgtcccttgtgtagttgacctcgcaaccatgcgtgaggcagttgctgcactcggtggcgaccctaacgacgtcaacccactgaacccagccgagatggtcattgaccactccgtcatcgtggaggctttcggccgcccagatgcactggctaagaacgttgagatcgagtacgagcgcaacgaggagcgttaccagttcctgcgttggggttccgagtccttctccaacttccgcgttgttcctccaggaaccggtatcgtccaccaggtcaacattgagtacttggctcgcgtcgtcttcgacaacgagggccttgcatacccagatacctgcatcggtaccgactcccacaccaccatggaaaacggcctgggcatcctgggctggggcgttggtggcattgaggctgaagcagcaatgctcggccagccagtgtccatgctgatccctcgcgttgttggcttcaagttgaccggcgagatcccagtaggcgttaccgcaactgacgttgtgctgaccatcaccgaaatgctgcgcgaccacggcgtcgtccagaagttcgttgagttctacggctccggtgttaaggctgttccactggctaaccgtgcaaccatcggcaacatgtccccagagttcggctccacctgtgcgatgttcccaatcgacgaggagaccaccaagtacctgcgcctcaccggccgcccagaagagcaggttgcactggtcgaggcttacgccaaggcgcagggcatgtggctcgacgaggacaccgttgaagctgagtactccgagtacctcgagctggacctgtccaccgttgttccttccatcgctggccctaagcgcccacaggaccgcatccttctctccgaggcaaaggagcagttccgtaaggatctgccaacctacaccgacgacgctgtttccgtagacacctccatccctgcaacccgcatggttaacgaaggtggcggacagcctgaaggcggcgtcgaagctgacaactacaacgcttcctgggctggctccggcgagtccttggctactggcgcagaaggacgtccttccaagccagtcaccgttgcatccccacagggtggcgagtacaccatcgaccacggcatggttgcaattgcatccatcacctcttgcaccaacacctctaacccatccgtgatgatcggcgctggcctgatcgcacgtaaggcagcagaaaagggcctcaagtccaagccttgggttaagaccatctgtgcaccaggttcccaggttgtcgacggctactaccagcgcgcagacctctggaaggaccttgaggccatgggcttctacctctccggcttcggctgcaccacctgtattggtaactccggcccactgccagaggaaatctccgctgcgatcaacgagcacgacctgaccgcaaccgcagttttgtccggtaaccgtaacttcgagggacgtatctcccctgacgttaagatgaactacctggcatccccaatcatggtcattgcttacgcaatcgctggcaccatggacttcgacttcgagaacgaagctcttggacaggaccaggacggcaacgacgtcttcctgaaggacatctggccttccaccgaggaaatcgaagacaccatccagcaggcaatctcccgtgagctttacgaagctgactacgcagatgtcttcaagggtgacaagcagtggcaggaactcgatgttcctaccggtgacaccttcgagtgggacgagaactccacctacatccgcaaggcaccttacttcgacggcatgcctgtcgagccagtggcagtcaccgacatccagggcgcacgcgttctggctaagctcggcgactctgtcaccaccgaccacatctcccctgcttcctccattaagccaggtacccctgcagctcagtacttggatgagcacggtgtggaacgccacgactacaactccctgggttccaggcgtggtaaccacgaggtcatgatgcgcggcaccttcgccaacatccgcctccagaaccagctggttgacatcgcaggtggctacacccgcgacttcacccaggagggtgctccacaggcgttcatctacgacgcttccgtcaactacaaggctgctggcattccgctggtcgtcttgggcggcaaggagtacggcaccggttcttcccgtgactgggcagctaagggcactaacctgctcggaattcgcgcagttatcaccgagtccttcgagcgtattcaccgctccaacctcatcggtatgggcgttgtcccactgcagttccctgcaggcgaatcccacgagtccctgggccttgacggcaccgagaccttcgacatcaccggactgaccgcactcaacgagggcgagactcctaagactgtcaaggtcaccgcaaccaaggagaacggcgacgtcgtcgagttcgacgcagttgtccgcatcgacaccccaggtgaggctgactactaccgccacggcggcatcctgcagtacgtgctgcgtcagatggctgcttcttctaag

SEQ ID NO: 1700 - DNA, 564 bp, Corynebacterium glutamicum
gtgtccgtagcggcaggcgacaaaccaacaaatagccgtcaagaaatcctcgaaggtgcccgacggtgcttcgctgagcacggctatgaaggcgcaaccgtacgccgactggaagaagcaacaggtaaatcacgcggagcgatctttcatcacttcggtgacaaagaaaacctgttcctagccctcgcgcgggaagatgcagcccgcatggcggaggtggtgtctgaaaatggcctcgttgaagtgatgcgaggaatgctggaagatcctgaacgatatgactggatgtcagtacgcctggagatctccaagcagctgcgcaccgacccggtattccgcgcaaaatggattgatcaccaaagtgttctagacgaagctgtccgcgtgcgtttgtcccgcaacgtggataagggacaaatgcgcactgacgtcccgatcgaagtgctgcacaccttcttagagactgttctcgacggtttcatctcccgtcttgctaccggcgcatccacagaaggactgtccgaagtattggatctggtcgagggaactgtccgtaaacgcgac

SEQ ID NO: 1701 - DNA, 756 bp, Corynebacterium glutamicum
atggtttcagttcttttaattcagccccgtcagggagaagcagtcgccgcagctgagcgacgtgactttttgcaggccaccggtcttaagcctcaagaactgacctcccgaatgttggataccaccacttctcgaattggcagtctggaaggtttcgacggcgtgattgtgggcggaagcccactgaatgccaccaactttgagtacagcgattggcaacgccacgtccaccgcgaattgtccttgctgatcaatcacccactgccaacaatctttgtctgctacggcaatacctttttgaccttcttctctggcggacagattggtcgcacacaccccgaagattccggcgccaccacagtgttgctaactgacgccggcaaacgagacgtactcactcaagacctaccggatagctttacgtcctttactggtcacacggaaaactccgtagcgcccgcccctggacacgtggtgttggcaacgggaccaacctgccccatccagatgctgcgcgccaacaagaacacctggtcagttcaattccatgcggatatggatgccgtaggcatgaaaaaccgcatggatttttactccaactacggctacttctccccagaagattatgaccgcatcattgcagagctaccctctgttgactccatttatgccaacagggtgctccgcaacttcgtggaggtctgcgaaggaattcgtgttgctgatggtgctgagcaccaactcccagagcttaac

SEQ ID NO: 1702 - DNA, 663 bp, Corynebacterium glutamicum
atgactaataaaacacgagctctactcattggtggccacggcaaggtggccctcctagcaacccccatgcttatcgacgcctcggtgcaggtcacttccatgtaccgcaatccggaccacaggtccgaaattgaggcgctgggcgccacaactttagagcgtgacgtcaccacactcagcgtggaggattgggcagatctgctcaaggacttcgacgtagtggtgtggagcgccggaaacggtggcaagaacggcgcggatgcaacttatgccattgatcgtgatgccgcgatcgcatccattgatggtgcagctagcctaggggagaaggcacctcgctacatcatggtgagctacattggatcctccacgcacaccattgatccttcagcatccttctacccatatgcagaatccaaaaaggccgctgatgagcacctaagctccaccaacctggattaccttatcctcgcaccagcagccttaactctggatgaagtcaatggcgttgaggtgatcgccgataccaacgaagcagccgcaggccgcaccacatcaagagtcctcgttgcggaagttatcaccgagttcgtggttcgcgacttcccacaaacccgtgtgctgcctttcgtggatggcgaatcaccagtctcctcgattagt

SEQ ID NO: 1703 - DNA, 267 bp, Corynebacterium glutamicum
atgtttgcaatcatgactgtcacagggcaggaccacaccggaattatcgccgcagtttccaccgcgttggctgagctagatgtcaatattcacaacgtttcccaaaccatcatggatcaatggttcaccatgatcttgcacgttggtttcgatgaatcggtcttggatatcgccacagttcaggaacgcatgaagccagtggaaaaggaacagggcttggttattcgtatccagtctgaagccttgttcaacgcggttaatgagatc

SEQ ID NO: 1704 - DNA, 393 bp, Corynebacterium glutamicum
ttgacatctagctcagccaacgcggtggaaactgcggcgataattccggtgtggtcctgccctgtgacagtcatgattgcaaacatgggttcatgctacaacgagcggtggacacgacactttgggtctatcatttggggtatgccaactctatttaatcgctcgtccaagacatataaatcattgcacgctgattggttggatttgcccactgaactgcgttttccagtcattgctgtcgcggtcgcagaatttgccaccaaagtgtccgtgtgggtgtcgctgagtcggcgcgcacctgaaaaagtccgcggccccaaatgggtatgggcgcttttgaccatcgtcaatggtgttggccccgctgcctactgggctttcggcaggaaaaac

SEQ ID NO: 1705 - DNA, 1392 bp, Corynebacterium glutamicum
gtgcacatggatgatttttctgcatcgctaggttttactgaccgttcctcgaggggaattctggacaccatcgagatgattgagaagtatcgtcttgatattcgcaccgtgaccatgggaatcagcctgttggaatgcgcgcgtggctcgatggaagagaccgcgacggctgtttatgatcgcgtgacgtcacaggctgcacgtctggttgaggtttgtgaaggcattgagcgtgaattgggcattcccattgtgaataagcgcatctcggtgactccaattgccctggtgactgctggttgcagtggcgatcccgttgacgttgctcgagccttagataaggcagcaaaagatgtcggagtgaacttcatcggcgggtattcagcactggttgaaaaaggtggaaccacctccgatattcggctgatccgctccattcccgaggcattgagcacaaccgatgtggtgtgtggatccgtcaatgtggcgtcgtctcgcgcgggtatcaacatgaacgcagtcaatgagatgggcaaggtggtcaagcaagcagctgaattgaccaaagatcgctccgccatcgcatgtgcaaagctagtggtctttgccaattctgtgggcgataatccattcatggctggcgctttccacggcattgaggagccggattgtgtggtcagcgttggtgtctcaggaccaggcgtggttagtcgcgcgctgggcaatcttcaaggtgccacccttgatcaagtcgcagaagagatcaagaaagcggccttcaagatcactcgtactggacaactggttggtgcgatggcctcagaacgcctaggagttcctttcggcatcgttgatctttcgctcgctcccactgctgaagtgggcgattccgtggcaaatatccttgaggtcatgggtcttgaccaggtgggcacacatggcaccaccgcggcactcgcactgctcaacgacgcggtgaaaaagggtggcatgatggcctgctcacgtgtcggcggcttgtccggatccttcattccagtttctgaagataaaggcatgatcgatgcggttcgcacaggagcaatttctattgacaagctcgaagcgatgaccgcgatctgctcagttggtttggatatgattgcgatccctggcgacaccccggcggaaactatttcgggcatgatcgcggacgaagcagccatcggtgtgatgaatcataagactacagctgtgcgtgttattcctgttccaggaactgtccctggcgatgaggtagatttcggtggcttgctgggttacgcgccggtcattccagtaaataccgtgggaaatagtgagtttattcaccgcggcggcttcattccagcacccgttcacgggtttagaaac

SEQ ID NO: 1706 - DNA, 480 bp, Corynebacterium glutamicum
atgccgtggaaagcgccagccatgaatggattatcgcccacagaattggcaaagaccactagctttgcacatgcgatggcggagcgatctttggtcaattcagctgcttgcttgaccaccttgcccatctcattgactgcgttcatgttgatacccgcgcgagacgacgccacattgacggatccacacaccacatcggttgtgctcaatgcctcgggaatggagcggatcagccgaatatcggaggtggttccacctttttcaaccagtgctgaatacccgccgatgaagttcactccgacatcttttgctgccttatctaaggctcgagcaacgtcaacgggatcgccactgcaaccagcagtcaccagggcaattggagtcaccgagatgcgcttattcacaatgggaatgcccaattcacgctcaatgccttcacaaacctcaaccagacgtgcagcctgtgacgtcacgcgatca

SEQ ID NO: 1707 - DNA, 456 bp, Corynebacterium glutamicum
atggctgcttcgtccgcgatcatgcccgaaatagtttccgccggggtgtcgccagggatcgcaatcatatccaaaccaactgagcagatcgcggtcatcgcttcgagcttgtcaatagaaattgctcctgtgcgaaccgcatcgatcatgcctttatcttcagaaactggaatgaaggatccggacaagccgccgacacgtgagcaggccatcatgccaccctttttcaccgcgtcgttgagcagtgcgagtgccgcggtggtgccatgtgtgcccacctggtcaagacccatgacctcaaggatatttgccacggaatcgcccacttcagcagtgggagcgagcgaaagatcaacgatgccgaaaggaactcctaggcgttctgaggccatcgcaccaaccagttgtccagtacgagtgatcttgaaggccgctttcttgatctcttctgcgact

SEQ ID NO: 1708 - DNA, 2676 bp, Corynebacterium glutamicum
gtgtcgtcccctctccccgctgccgtcacatcaaaacccgcccacgcgctttcctctgatgaggtgttagaaaatctcggggtccaggacaccggattgacctccgcggaggcaacacagcgtttggaagcaaacgggccaaacgagcttcctcaaactccacctgaaacagtctggcaacggctattccgccaggtcaacgatccaatgatctacgttctcattgccgccgcggtactcacggcgtttcttgggcattggacagacaccatcgtgatcggcgccgttgtcatcatcaacatgatggttgggttcatccaagagggcaaagctgcggatgcgttggcatcgatccgcaacatgctctccccggaatccgcggcgttgcgcgatggggtcttccacaaaattgatgcggcagagctggtggtcggtgacgttgtgaaactatccgccggcgataaagtgcccgctgacctgcgcatgctcgccgccaccaatctgcacattgaggaatccgcgctcaccggcgaggcggaagcagtggtcaaaggtactgatccagttgaggccgacgccggaatcggcgaccgcacatccatggcgttttcaggaacgctggtgctcacaggcagcggcaccggcgtggtcaccgccaccggtgcaggcacagaaatcgggcacatcaccaccatgcttgccgacgtcgactccgtggataccccattgactcggtcgatgaaaaagttctcatcggcgttagcaatcgtgtgtgtattcctagcgatcctcatgctggtggttgccggtctagtccaccacacacctttggaagagctcattctttccgccatcggctttgcggtggctgccattccggagggtctacctgcggttatcgccatcacgctggcattgggtgtgcaaaagatggcagctcgaaatgcgattacgcgccggttgaattccgtggaaacacttggctctgtcaccaccatctgcacggataaaaccggcacactcacccgcaatgagatgacagtccgcgcaatcgccaccggtacgagtctttatgacgtcagtggagcaggctacgaacctctcggggaaatccgcttaaaagacggcgagcaagtatccaagcaggatttcccagatctctacgccatggcgttggtcgcagcgaacgtcaacgacgccgaaatttaccaagaagacggcatgtggaggctttccggcgaacccaccgacggcggtattcgtgcctttgcaatgaaaaccaacgctgaaatcttgacccgaacagccgaagtccccttcgattccgcatacaaatacatggcgacgcttcacaccatcgatggagcaaacaccatgctggtcaagggcgctcccgatcgtttattggatagaagtgcacagcagcgcaacggtgaaccacttgaccggccgtattgggaacagctcatcgaggacctcgcgtcccaaggcctccgcgtgctggctgcggcatataaagagcttccccacagcacgtcaacaattactccagaagatgttgaccagggcgaactcaccttcctcgggctctacggcatcatggatccgccacgcgaagaagtcatcgaagccatgaaagtggtgcaatcggcaggcgttcgcgtccgcatgatcaccggcgatcactcctccacggcccgcgcaatcgcccgcgaagtgggaatccgcggccagaacgtgctcaccggtgcggaaattactgcggctacggatgaggagctgcagggactcgtcgataatgctgatctttttgtgcgcaccagccccgagcacaagctgcgcgtcgtgcgcgcactgcaagctaacggcgaagtcgcgtccatgaccggcgacggcgtcaacgatgcgccagcgctaaaacaagccgacgtcggcgtcgccatgggcattaagggcaccgaagccaccaaagacgcggccgacatcgtgcttgccgacgacaatttcgccacaatcgccggcgccgtagaaatgggtcgcaccatctacgacaacctgcgcaaagccgtcgtcttcatgctccccaccaacggcgcccaaggcctcgtcattttcatcgcgatgctgctcggctgggaactgcccatcaccgcacttcaagtgctgtggatcaacctcatcaccgccatcacactgtccctggcgctgtccttcgagccggccgagcccggcatcatgaacagaaaacccagaaaccccaagagcgggcttatcgacgccccctccgtgcttcgcatcgtctatgtctccctgctgctcggcggagcaacgttctgggctttccttggcgcccgcgacgcaggaatcgacatcgacaccgcccgcaccatcgcggtcaccacccttgcagtcagccaagtgttctaccttttaagctcccgatacttcgaagtatccgcgctgcgaaaagaactcttcaccaccaacccgatttcctggctgtgcatcgcactcatgctgatcctgcaactggcctttgtctacctgccgttcatgcaaagcaccttcgacaccgccgcactgacgcttagagattgggtcatgccactggtgtttggtgttgttgtctttgcggtcgttgaaaccgagaaattcatcaggcgccttaaagcgtct

SEQ ID NO: 1709 - DNA, 783 bp, Corynebacterium glutamicum
atggtggtgacagagccaagtgtttccacggaattcaaccggcgcgtaatcgcatttcgagctgccatcttttgcacacccaatgccagcgtgatggcgataaccgcaggtagaccctccggaatggcagccaccgcaaagccgatggcggaaagaatgagctcttccaaaggtgtgtggtggactagaccggcaaccaccagcatgaggatcgctaggaatacacacacgattgctaacgccgatgagaactttttcatcgaccgagtcaatggggtatccacggagtcgacgtcggcaagcatggtggtgatgtgcccgatttctgtgcctgcaccggtggcggtgaccacgccggtgccgctgcctgtgagcaccagcgttcctgaaaacgccatggatgtgcggtcgccgattccggcgtcggcctcaactggatcagtacctttgaccactgcttccgcctcgccggtgagcgcggattcctcaatgtgcagattggtggcggcgagcatgcgcaggtcagcgggcactttatcgccggcggatagtttcacaacgtcaccgaccaccagctctgccgcatcaattttgtggaagaccccatcgcgcaacgccgcggattccggggagagcatgttgcggatcgatgccaacgcatccgcagctttgccctcttggatgaacccaaccatcatgttgatgatgacaacggcgccgatcacgatggtgtctgtccaatgcccaagaaacgccgtgagtaccgcggcggcaatgagaacg

SEQ ID NO: 1710 - DNA, 489 bp, Corynebacterium glutamicum
gtgaaaacatcccctttgagctaccccgagtccctgcacggtacatccgaagaccttttaatcggaaacgctaaagcatcaaaaggttggcagatcactgatcgcaaactagtgcttggttacggggaagagtgctttcaaaatgccgtccaacagttgttctcttgggaggctcatcaacacgcggggatcacagtgactgaatccgactcaatcgtggagctcaagttctggagtattcgctcgtattgcagagtcctcaagtcccatcaaggatcgcgccgggctatccttatttacggcacgctcgagaagcatgtggagcgtggggaagaggcttttgaaatcacgatggctgacaatgaccaggtcactgctcatattgtggcgttctcaaagcctgcgaagtggtgggcgaagctggctaatcctgtggtgaggttggtgcagctgaggatcaccgacaagtatcttgaggggctgaaacct

SEQ ID NO: 1711 - DNA, 1362 bp, Corynebacterium glutamicum
atgtttaccgcatccattcctacttatgaattagggtctttcagcaagggctcctacgttgagatcaaaggaacttacttctaccctgacacgctaaatactttatttagaaattctggggcaaaagacaacgaagagttctttgtagacgtaactcttgttccagaaccagataatccgcatagcactcgaggccatgccatttcagtccgctggaatgatctcgtaataggacatattgcctcggatatgactgaaaaattccaacaagtgcgacgagttgcagctagtggctacgatgctcgagtctctgctcggatttggacgaatacaaactataagaatgaacgagatttttgggtatctgttaagctccccgatccagatttccttgttcctcttaatgatcctccccatgacgggtttaccctcctcccttatggaacagcaatccaagtcaccaaggaatctgatcacatggacgtgctctcagaattcgtgcctccatctggacaaggtcagattctcgtatcgctacacatcattaacgcaggcgtgagaaaagaatgggatggcattgaagttcggctcgataatcaacggatcggagagcttacaaaggccagttcagaaaaattcgcacccgtagtgcgacatttcgatgacctaggacttagtacactatgtcgtgcgctcatcaaggggtcatcactagctgctgaagtaactctatatggagctcgtgcacatgagctttccgaagaagacttagaacctaaaagctcttccccattgcccaggttggttgaataccagtcaaatccgtttaattatcaagtccccaacaggtggcccggcgagcagaatcaacgtgctcctaagtcgcaaaagtcttcttcatcacctttcgcagcgtatcgcgggccatcgcaacctagtaaatcactcacaccgtttgtagcgcagacacctgcgcctcagcctagtgatcgatttattgattgggattcattgcttcaaccggacggaactccaagagctacgccattccaaagaggagtaacccgcgggttaattggcaagcatttttcgaatcaaaaatctccaagaattgactttgcaacggtggggcaatgtgatgcaattctccgaactttcggagagccgaccgacaagctttataaagacggcaggacttcttggcctttgtggtgggcgctcatggcgatagtcacccttctcgtcatgttgctgaactttattccaggaattggtccgatcttcccacttatcggattgatcgtacttggtcatcacttttggactcgccgaaaacttaacccaccattcggtagatcaaaa

SEQ ID NO: 1712 - DNA, 357 bp, Corynebacterium glutamicum
ttgtgtacacagtgcagaagtatgcagcgtctttcaatacttcaggggatatttcaaatcggaaggatccgctatctgtgtagatctcagcggaatctggctcacctaggtcgactggagttgggaaatcgtaatttcctgatacgggaagctctgcgtggattgacttggtttacaggagccaaccttacgagcttgttaaggagttcttcttttctattgggttcaaaagatctgataattgaagagactgtaactccacttgtcggagctggcgaatcaacctcggaatcggttgctgagcagctagttgcaaagataaatgtagtcccaacgacagagataaggcgtttcatt

SEQ ID NO: 1713 - DNA, 156 bp, Corynebacterium glutamicum
atgaattatatatcccttaaacctctgcatccgtttgcgctcatgattctgactgctgccactctcactgcttgcagcactagtggtgaaacgatgtctacggaaacagagaccacccaatccactaagtcgagttccatgatcgctcagcctatg

SEQ ID NO: 1714 - DNA, 162 bp, Corynebacterium glutamicum
atgaataccgctgagaatccaagtgcatccgctgaacatcgtctgtctacagcgtttggagaacgcgaaaaagatgaggcagtacaagattgcaaaaaccttgaaaaagtgtatggcagcgatggttgggtcgacctcccccaggagacgttcatactctcc

SEQ ID NO: 1715 - DNA, 375 bp, Corynebacterium glutamicum
ttgggtcgacctcccccaggagacgttcatactctcctagacgatatcggagcagaggaatctgaagcagataaagttccaattgaatggcaaaacgccctgactaaggcagacaggtatgcaaaccggcaacacatgtctcaggcacgactctatcgccaattaaccagtgatgttggagagggcttcactgaagaagctgcccaatacgcaatcgaaaatgtgaacgcagactggaacgctaacgccctagtaaaagcaagaaattaccaggagcgccaagcaatgtcagtagaccgcatttacaggcaacttactagtgaacacggtgaagggtttaccccagagcaggcacaatacgcgatcgacaaccta

SEQ ID NO: 1716 - DNA, 456 bp, Corynebacterium glutamicum
gtgatgcacacttcatctccgatgaacgagttgcaggccgccggagaaaggacgccacccgaaactgcaacatctgtgcgaactatccctattgccgatgacctcatcacggtgcttgaccacagagttgcggcgtccattcagggcgggatctttgaaaccgctcgcggtgctccataccgaattgcttctgccgacggtgaattaaggaagacagtgacgcgccttcgtgagtgcgtgacgttccacagtttccgccacctgtatgcgtcgaggttgatctcagcgggtgtctcggtgaagcaggttcagagagatttggggcatacgacggtatcgacaaccttggacacttatgtccccttcttccctggcctcaacaatcagccagcagctgaaatagcccgcatgatgaaattcatgcgggcaacttgcgggcggctaagtgcaggagtt

SEQ ID NO: 1717 - DNA, 1629 bp, Corynebacterium glutamicum
gtgattgtcaccaatgatttagaggtgcgcgttggcgcacgtacccttctcgatgccccaggtcagctccttcgggtgcagccaggcgaccgtattggtctggttggtagaaatggtgcgggcaaaaccaccaccatgcgaatcctctcgggcgaaaccaagccctacggaggatccgtaaccacatctggtgaaatcggttacctgccccaggactcccgcgaaggcaacatcgaacaaaccgcccgcgaccgagtcctctccgcccgtggtcttgaccagctgcgatcctccatggaacgccagcaggagatcatggaaaccgcgaccgaccccggcaagctcgacgccgcgatccgcaagtactccaggctcgaggaacaattccagtcgctcggcggctacgaagctgacgccgaagcagcccagatctgcgacaacctcggcctcgaggcacgcatcctcgaccagcagcttaaaaccctgtccggcggccagcgccgccgcgtcgagttggcgcagatcctcttcgccgccaccaacggctccggcaaatcaaaaaccacattgcttctcgacgagcccaccaaccacttggacgcagactcgatcacctggctccgtgacttcctggcgaagcacgaaggtggactgatcatgatttcgcacgacgtcgaactgcttggcgccgtatgtaacaagatttggtacctcgacgcagtacgcagcgaagccgatgtctacaacatgggctttagcaaatacgtcgatgcacgtgcactcgatgaagcacgccgacgccgtgagcgcgcaaacgccgaaaagaaggccggagccctcaaggaccaggctgcacgcctcggcgcgaaagcaaccaaggctgccgcagctaagcagatgatcgcccgtgcggaacgaatgatcgacaacctcgacgaaatccgcgtagctgaccgcgccgccaacatcgttttcccagaaccagcaccctgtggaaaaaccccactcaacgccaagggcctgaccaagatgtacggctccctcgaagtcttcgccggcgtcgacctagccatcgacaaaggctcccgcgtagtcgtcctcggattcaacggtgcaggtaaaaccaccctgctcaaactcctcgccggtgtggaacgcaccgacggcgaaggcggcatcgtcaccggatacggcctcaaaatcggctacttcgcccaggaacacgacaccatcgaccccgacaaatccgtctggcaaaacaccatcgaagcctgcgccgacgccgaccaacaaagcctccgcagcctcctcggatccttcatgttctccggcgaacaactcgaccaaccagcaggaacactctccggcggtgaaaaaacccgcctcgcactggccaccctcgtgtcctcccgcgcaaacgtcctgcttctcgacgagcccaccaacaaccttgacccgatctcccgcgaacaggtcctcgacgcactgcgcacctacaccggcgcagtcgtcctggttacccacgacccgggtgcagtcaaggcccttgagccagaacgcgtcatcgtgcttcctgatggcaccgaggatctttggaatgatcagtacatggaaatcgtggaattggcg

SEQ ID NO: 1718 - DNA, 1476 bp, Corynebacterium glutamicum
gtgactgcaggtgaaaccaccactatgaatgtcacgttgaccaatcctttcgacaacgcaatttttgaccgagcagtctcccttgaacgtcccgaaggatggcaagctgaggatgttcgtgtgtcgatcccatctggagaatctgtcacaatcccagtccaggtcacagcaccgctggtagccgacaacggtgaacttccagtggaggtgtccattcttgatggagcagaccgctacacgggtcgtctcaatctcactgttcagggtgggcaagaacctgcaccaacttcagtgaaggtgagcattccaaatctcaaggacacttatgtagcaggggagaagatcagcattaactttgcggtcaacaacccgtttgacgttacggttaattcggtgccaagcctgggggaaggcgagaactggatgcctgcaaacctacgcggatttgatccagagcagggtactcccaactgtcgttacaagaatttaggcgcgaataagagctatgactgcaccacaactacctatgaagtcagcgatttggatgtagaacgcggatacgtggatattccaacggtatggacgtttactaactccgcaggcgaaacggtatggtccaaaaacgttgatgtgcctcgagttgaactcaatggaacacaggatgctgtcactgatgcaatcgtaacggttgatcccatcaacccagttcattccaacggccagagccaaactgttgaggtccaggctaatgtcacctcagagggagatctgccagctggatctaaggtggccttttatctagattcatcgcccattgataccgcagctgttgatgcggaagggcatgccagcatctcgattgatgtggacaacatcgcaagcgagcagcctgaacgcacatttgaggttcgcgcccgactcgtcgttccagaagatgcaccacgatcaatcgcgcgtgatgccttggcacgttttacagtcctgtctgaacaagtgcagcagaactccttggtgatcatgaatcatccagatgtgttttctgatggacaaacaaagactattgtcatcgcagcgaaggcgacagcacacgatggatcgccggtggctatcggtactctcattgcatttcgcgtcaacggtattgagcgggacgtggttccaactaacgcgcaaggaacagcaaagcttcagctagacctcaagccagtaaatactgaagacgaggaatatgaagtaacagttgaagccgagctggatgaattgactgctcagaccacgttcaaagtacttgctggtgaggaagaggaacccaccagcaccgaagaacaaccgtcagaaactgagcagccttctgaacctgaagaggaatcgactggtgttgctggaagctctaacggtggcagttttgtcgcgcttttagcgctgctggcagcgcttggtggcatcgtcggtgcagtcctcggattgcttaagttg

SEQ ID NO: 1719 - DNA, 1182 bp, Corynebacterium glutamicum
atgggtcttccattcaagaaagcaggtgctttgtctcggcgtaaagcagtattctcagcgcttggtgcagccgcactcatcggcgcagcactacccaccatcccaacggcccaagctcaaacacccacgggctacggattcgatgcaacagcaagcatcagcgaagaaccagagttttcaacacaacaactcgctgacggcggaactctcggatttgattgctaccgcatcccatcgcttggcgtcgcacccaacggcaacgtcctcgcatcgtgggatggtcgcccaaacaactgttcagatgctccacaacccaactccatcgtgggcaaggtatcgaccgacaacggagcaacctggggcgaacagcacgacatttccgcaggtatcaccgccgaacccaaaactggctattccgatcccagcatcgttgtggactgggagaggggcgatgtctttaacttccacgtgaagtcattcgatgcaggatacttcacctcccaaccaggcacggacccggatgatcgcaacgttgcccatgttgcctacgccaaatcatcagataacggctcaacctgggttgcagacaccgtcattactgatcaagtggttgctgatgacacctgggacagccgatttgccacatccggaaacggcatccaactgcaatacggcgcgtacaagggacgattggtccagccatcggtaactcgcatgaccaatggtcgagtcgcagcagttgccatgctgagtgatgatcacggcgcaacgtggtaccccagtgctccttggggaaactccatggatgaaaacaaaatcgtggaactcagcgatggaaccctgatgaacaacagtcgttcatcaggagccgatacttaccgcaaggtgtcttattccaccgacggcggcgtcacttggaccgagccaactcttgatacccagctgccggatcctcgcaacaatgcttccctgattcgagtattcccgacagcacctgagggaagtgcgcaggcaaaggttctgctgttctccaacactgccaccacgagtggccgcaccaatggcaccgtccgcatgtcgtgtgatgatggtcagacctggccggtgtctaaggtgtttgaaccaggagcaatccaatatacctcgatggcaacgcttcccaacggtgacatcggcatgctg

SEQ ID NO: 1720 - DNA, 708 bp, Corynebacterium glutamicum; identical to SEQ ID NO: 1069

SEQ ID NO: 1721 - DNA, 243 bp, Corynebacterium glutamicum; identical to SEQ ID NO: 1068

SEQ ID NO: 1722 - DNA, 261 bp, Corynebacterium glutamicum
ttgccgataccaccgggtcttcttatccagctcaggagcatatttctggacccagcggtagatcgtggtgtgatcgaccggcactccccgctcggtcatcatctcttcgaggtcgcgatagctcacgccgtagcggcagtaccaccgcaccgcccacaggatgatttcacgagggaactgccgaccggagaagatgcccatggacctgattattccacgccggtcttcctactgccccaactttgcaacagcaccgttttg

SEQ ID NO: 1723 - DNA, 585 bp, Corynebacterium glutamicum
atgacctccaaaggccaggaatctagttcagactccacagcaggaatggattacatcatccgatactcgctcaacgagtttcagcgcggaagtatcgtgacgcgttttgaaactccccctgataaacgggaggtgtttggggtcttagaaagatacggcatttcttccactcaggtaagtgaatattccgtttcccctgcacgcggagttcaacaggctctgacgccggtccaccaggacattgtggaggcgcaaccttcggaggatacttccccaccgcctctagacaggcggaagaggaaaagtggttgcgggtgggtagctgtagctatcgttgtcattgcctttgtgactccagcagtgacggccgagcgttcttacaccactggtcaaagtctcgcgccgtctgcctctagaaacttaagttttggagagcgatacgatttttgtgacgcccagttgagatatatcgcggtatctgatgagaactactgggatgaggcgcctgggttctttgaagaccgcgtctccaataatcctatccaccccgccaatctttctttcctcgttggatgcatgtctgac

SEQ ID NO: 1724 - DNA, 423 bp, Corynebacterium glutamicum
ttggaggaaaccatgagcgagcacaccgagaacacgacagaggttgaagaccagaacgcttccacctttgaagcacaaagctctgagcgcccagagcagtccgaggcagacctggctaaggccagcgatgttgaggagtacatgcgcgacgttattgaccctgaactgggcattaacgttgttgacctgggccttgtctacgatatttacatcatcaacggcaacgaagctcacatcgatatgactctgacttcaccagcttgcccgctgactgacgtcatcgaagatcaggcacgcaccgcaatcgtcggcaacggcattgcagagaagatgtccctgaactgggtatggatgccaccttggggtccacacatgattaccgaagagggccgcgctcagctgcaggccctaggattcgcggtt

SEQ ID NO: 1725 - DNA, 447 bp, Corynebacterium glutamicum
atgaaccttgagcagatgtaccaggaggtgatcctggaccactacaaaaacccacagcacaagggccttcgggatcctttcgatgctgaggttcaccacgtcaacccttcttgtggcgacgaattgactctgcgcgtgaagctgtctgaggacggctccaccgtggaggacgtctcctacgaagcagttggttgctcaatcagccaggcctccacgtccgttatggccgaggagatcgtgggccaacccgtcgacaaggcgctggaaaagctcacagaatttgagaagatgatcgtttcccgcggtcagtttgttggcgatgaagatctcatcggagatggcgttgctttctccggagtcgccaagtacccggcacgcgtgaagtgcgcgctgcttgggtggaaggctttccaggcggcaaccgctgacgctgttgcgcacgcacat

SEQ ID NO: 1726 - DNA, 162 bp, Corynebacterium glutamicum
atggtgacaacttcaatcatggaaccaccagtcaaaaatggtggcagttcatccaagattggggactttgcatacacaacgcccacgcctgcaggtcccagcatcttatggccagagaatgcagagaaatctacatccagctcgtggaaattcactggcata

SEQ ID NO: 1727 - DNA, 1263 bp, Corynebacterium glutamicum
atgtccgatttcctcaatgcagatggatccctcaatgtggataaggtgcgggaagaattcccaatcctgaagcgcactgttagggatgggaaaccgcttgcttacctggactcaggtgcgacatcgcagcgacccgagcgggtgtggcgtgcagaggagcactttgtgctgcacaccaacgcccccgtgcaccgcggtgcctaccaactggctgaggaagcaacggatgcttatgaaggtgcccgcgagaagatcgctgcctttgttggtgccgagcagcatgaaattgcgttcactaagaatgcaactgaagcactcaatcttgttgcgtacaccttgggtgatgaccgttccggtaagtatcgtgtccaggccggggataccgtggtcatcacggagctagagcaccacgcaaacttggtgccatggcaggagctgtgccgtcgaaccggtgcgacattgaagtggtacaaggtgactgaagatggtcgcattgatctcgattcactcgagcttgatgaaactgtcaaggtcgttgccttcactcaccagtccaatgtgaccggtgctgtggctgatgttccagagttggttcgtcgtgccaaggctgtcggcgctctcacggtgcttgatgcgtgccagtctgttcctcatatgccagtgaatttccacgagctggatgtagatttctctgcattctctggccataagatgctgggacctgcaggcgtgggcgttgtgtatgcaaagtccccaatcttggatgaactgccaccatttttgactggtggttccatgattgaagttgtcaccatggagggttccacctacgctgccgcacctcaacgttttgaggccggcacgcagatgaccagccaggttgtgggcttgggtgctgccgtggacatgctgaatgaaatcggtatggaagcaatcgcagcgcatgagcacgcattgactgcttacgcgttggaaaagctcacggcaattaagggactaaccattgctggtcctttgactgcagagcagcgcggcggtgcaatcagcttcggtgtcgagggcattcacccacacgatctaggccaagtgcttgacgatcagggcgtgaatatccgcgtcggccaccactgcgcgtggcccgtgcaccgcagcatgaacgtacaatcgacagcaagagcatctttctatctctataacaccttcgaagaaatcgaccgcctcgcggcagcgatcgagaaggccaagcaattctttggagttgag

SEQ ID NO: 1728 - DNA, 756 bp, Corynebacterium glutamicum
atgagcactcttgaaatccgtaacctgcacgcacaggtcctgccgtccgatgagtccgctgagcctaaggaaatcctcaagggcgtcaacctcaccatcaactctggtgagatccacgccatcatgggccctaacggttccggcaagtccactcttgcttacacccttggtggacacccacgctacgaggtaaccgcaggcgaggtcctcctcgacggcgagaacatcctggagatggaagttgatgagcgtgcacgcgctggtctcttcctggccatgcagtatccaactgaaatccctggcgtttccgttgctaacttcctgcgttccgcagcgaccgcaatccgcggcgaggctcctaagcttcgcgagtgggttaaggaagtccgcaccgctcaggaagctctggcaattgaccctgagttctccaaccgctcagtcaacgaaggtttctccggtggcgagaagaagcgccacgaggttctgcagcttgatctgctgaagccaaagttcgcgatcatggatgagaccgactccggccttgacgtggatgcactgcgcattgtttccgagggcatcaactcctacaagcaggagaccgaaggtggcatcttgatgatcacccactacaagcgcatcctcaactacgttaagcctgacttcattcacgttttcgcgaatggccagattgtgaccaccggtggcgctgagcttgctgacaagctcgaggctgacggctacgaccagttcatcaag

SEQ ID NO: 1729 - DNA, 1176 bp, Corynebacterium glutamicum
atgactgaagtagcaaccgtaaaggccgcaaccccgcacaacaccaagggcgacctcttctcctcatttaatgttgaggactttgagatcccacgcggacgcgacgaagaatggcgtttcatttccctacgccgtcttcgcggactccacaacggcgagttcgcacctgcaaccacctctgacgtcaccgtcgagatccctgcagatgcagaaggcgcaagccacgaagttgtcgcaaaggacgatgctcgactgggtcgcgcaggcgcaccagtagaccgcgtcgcagctcaggcctggacctccaaggaacagggcaatgttgtcacctttgccaaaaactcccacaacccaaccccagtaaccatcacggttactggcaagggtgaaggcgttacctctttcggcgcaatctccatcgaggttgaagcgggcgcagacgctatcgtcgcactgcagtacgtcggatccggcacccacgctgacaacgtcgaattcatcgttggcgacaacgcacgcctgaccgtcatcacggacacccactggaacgctgacgcagttcacctgagcaaccagcttgcacagctgggacgcgacgcaactctacgccacaccgtggcaaccttcggtggagaagtagtccgcatcgtcccacgcgtgcgtttcaccgcaccaggtggcgacgcagaaatgctcggcgtctacttcgcagatgatggacagtacttcgagcagcgcctgctggttgaccacgctgtaccaaactgtcgctccaacgtcttgtacaagggcgcacttcagggtgacaagaactctgacaagccagatgcccgtacctgctgggttggcgatgtgctcatccgctcaaacgcccacggcactgacacctacgaagctaaccgctcactcgtcctcaccgagggtgcacgcgcagacgctattccaaacctcgagattgaaaccggccagatcgttggcgcaggacacgcagcaaccgtcggtcgtttcgacgacgagcacgtgttctacctccaggcccgtggtattcctgcagaggaagcacgccgcctcatcgtccgcggtttcttcaacgaagtgatcaacaaggtcccagttgaatccatccgcggggaattggacaaccgagtcagctcggaactcgcagttcttggcatg

SEQ ID NO: 1730 - DNA, 1443 bp, Corynebacterium glutamicum
atgacttcggcaacgacgaacccaggggttaacgagcccttgaccgatgaccagatcattgaatccatcggtccgtacaactatggttggcacgactccgacgacgctggtgcatccgcacagcgtggtctcagcgaggatgtcgtacgcgacatctctgcgaagaagagcgagccagaatggatgcttcagcagcgcctcaaggccctgagcatttttgataagaagccagttccaacctggggtgcagacctttcaggcattgacttcgacaacattaaatacttcgtccgctccactgagaagcaggcacagtcctgggaggatctcccagaagacatcaagaatacctacgacaagctgggtattcctgaggccgagaagcagcgcctcgttgcaggtgttgcagctcagtacgagtctgaggttgtctaccaccagatccgcgaggacctggaggaaaagggagttatcttccttgacaccgataccgcactgaaagagcaccctgagatcttccaggagtacttcggcaccgtcattccagcaggcgacaacaagttctccgcactgaactccgctgtctggtccggtggatctttcatctacgtgccaaagggtgtccacgtggacattcctctgcaggcttacttccgcatcaacaccgagaacatgggtcagttcgaacgcaccctgatcatcgttgatgaggatgcctacgttcactacgttgagggctgtaccgcacctatttacaagtccgactccctgcactccgcagtcgttgagatcatcgtgaagaagggtggacgctgccgctacaccaccattcagaactggtccaacaacgtctacaacctggtgaccaagcgcaccaaggttgaagagggcggcaccatggaatgggtcgatggcaacatcggctccaaggtcaccatgaagtacccagctgtctggatgactggcccacacgcaaagggcgaagttctctccgtcgctttcgcaggtgagggacagttccaggacaccggcgccaagatgacccacatggctccttacacttcctccaacatcgtgtccaagtctgtggcacgtggcggtggacgtgcggcttaccgtggtctggttcagatcaacgcaaacgctcaccactcaacctccaacgttgagtgtgacgcactgctggtcgatgacatctcccgttctgacacctacccatacaacgacatccgtaacgatcacgtgtcactcggccacgaggcaactgtttcccaggtttctgaagagcagctgttctacctcatgagccgcggacttgcggaagaagaagcaatggcaatgatcgttcgtggcttcgttgagccaatcgctaaggaactcccaatggagtacgcccttgagctcaaccgactgatcgaactgcagatggaaggatcggtgggc

SEQ ID NO: 1731 - DNA, 693 bp, Corynebacterium glutamicum
gtgacaccagtgggagatgttgtaaaaggcaacgacgcgcacaccggagacggtgatacgcgccgaaaaattcttctcatcctgttggaacgtgcaccggtgatcgcttcagatattgctgaacagcttcagctttcaactgtgggagtgcgcaggcacctagacaacttggttgaagaaaatctggcggaggcggcaaatccgcgccagaacccatatgagcccaaaatgcgcggtaggccagcaaaaacttatcggcttactgataaaggtcgctcaatcttcggccacgaatatgattcccttgctgcggcagctctagccactcttcgagaggtcggcggagatgatgcagtaaggcaatttgctagaaagcggatcgaaacaattgttgagggtattaccccagcagatgtcacagatcaatcaatcgaagatacagccaaatctttagttgaagcttttagtcggcatggttatgcagcaactgtcgatgccactcgaaacgggttgcaactctgccagcatcactgtccaatatctacagtcgccacggaatttccggaactgtgtgaggcagagcatcaagcagtctcagaacttttggggcagcacacgcaaccattggcaacaatcgcggacggccacggcatctgcacaacaaatattccattgacacccatcaaacactcc

SEQ ID NO: 1732 - DNA, 1629 bp, Corynebacterium glutamicum
gtggaagacgagcagagccctttaggggcaacgcttttcgacgtcgcgaccggcgcgagctccatcaacgaccgcgataccgacgcctcagggcttgagcctgaaaagattcgccgatttgcatggctgcgcctgatcggcaccatgggtgcgttaatgatcgcgtttggtgcgctgggcgcgggtgcacttccggtggtgaataatccgtatgtggatttccctggcggaaacttcatgagccgaatgctgcagacctcttccatgatcgtgctcatcggcgtgggatttttggtgctggcgtgggtgttaatggcaccgctggtgggtattccttttaaacgcagcggaaacagaacagccagcgtgagtttgtccatgctgcgccgcacatttggcgcctgggtagcgcccatcatgctcaccgccccactgtttactcaagacatttattcttatctggcacaaggctctgtgaccgcgcagggaatggatgcctacgccggtggaccgcttgaactattggggcccgataatcatctggcacggtccgtgccctttatttgggcccagtcgccctcgccctacggccctgttgcgctgagcatcgcggcgtcgataagcgttattactaatgacagcatcgttggaggcgtgctggcgcaccgtattgcgtcgctgctgggcgttgtggctgcaggctgggcgatcaccatgctggccaggcgctgtcgggtatctgaagaagcgtccttttacctgggcgtacttaatccgctgctgattctgcacctgatcggcggtattcacaacgaatccatcctgctgggatttttacttgttggcctggaactcggactgcgtggcaccgaccggattcaaacagggctgtgggggcctgcgtggacatatattgcactgagtggcgtattgatttcttgcgcaggcctggtcaaggtgaccggctttattgggctcggttttgtgggcatggccttggccagggcgtttcatgcacgtggacatcgacacgtcgttgcgatcggcgttgcaggcctcgttcaagtagcagccctggtgatcaccgtggttgttctcagtgtgattaccggaatcagtttggggtggatcacaggtcaaggtggcgctgcgacgatccgaagctggatgtctatgaccaccaacattggcgttatttctggattcatcggaatgaatttggggctaggcgaccacaccgcagccatgctcgttgtgacccgtgcagccggaatcgcggtagctgccgccttcatggttcgtatgttgtttgccacatatagaggtcacattcacgctgtgggcggactgggcgtggcgactttcgtcctcgttatcctcttccccgtggtgcatccgtggtacatgctgtgggctatcgtgccgctagcttcctgggcaaatagactgttcttccagctcggagtgattgcctactccactgccttcagtttctttgtgctgcctcgcgggcttgcacttccagtcggaactgtcttttccatctacttcggcgcagcgctcggattcagcattctcctattagttggatggtggagtttgaggcggaatccaacctttggtttacac

SEQ ID NO: 1733 - DNA, 1020 bp, Corynebacterium glutamicum
gtgactactgatttttcggcctctagctctaattttggagccgcagaaggcgcacttgatgccataaaccccgtcccaccaaacgatccagcaatcgtggtgaacaacgtggtaaaaagatttggcaccaaggaagcagtagccggaatctccttcgaagtcccccgcggtcaagttttggccctcctgggacctaatggcgcaggcaaaaccaccaccattgaaatgtgcgaaggttttaccgcccccacctctggcagcatccgagtcttgggcatcgatccagccacagaaccagaccaggtgcgccgacgcatcggcatcatgcttcaaggtggcggttcctacagcggaatccgcgtgtttgaaatgctcaagcttgcggcgtcctacaacgacaacccacacgatcctgaatggctgcttgatcttgtaggactgcgtgaacaacgcaaaaccacctaccgacgtctgtcaggtggccaacagcaacgcctttctttggccttagcattaattggtcgccctgagattatcttcctcgacgaacccaccgctggcatggatgcgcaatcacgcaacatggtgtgggagcttgtcaacgatctccgccgcgacggcgtcaccatcgtgctcaccacccacctgatggatgaggccgaagcactagctgaccacgtgatcatcgttgccaacggtcaaatccttgccagtggcacacctgatgaactcactgcgcaacgcgatcatcttgaaattaatgtctccgtagagaccacgagcccgcttgatcttgatcgcttggtggatgatctcagcagcttaaacatcggtgatgtgaaagcacgagccaaccggccactgcattattcacttcggacgcaacaagccaccccggattccttggcgcacatcgtccaggctgtcgcccgccaaaacgtcatgattcgctctttggatacgggacaccgctcattggaagatgtcttcctggacatcaccggaaaagaactgaggagt

SEQ ID NO: 1734 - DNA, 804 bp, Corynebacterium glutamicum
atgtctaaaccttttgaaaactctgcgctccgcggttcttctcgattcccagctggaacgttcacccctgctcccaaacgagccaccccggcaaaaatgttggctgctcagggcaagatggaatccctgctgtttcttcgccacggcgaacagcaactgctcagcatcatcattcccttggtcgcgctcatcgcactagcgaattttgatttcatccctggtgagaactccctcgacaagactttccccttcgcgctggccacagcagccatgagcgctggttttacaggtcaagccatcagcctagcttttgaccgccgctatggtgccctcaagcgcaccggcgccagcggtgttcccgcctggacgattatttttggcaaagtcatcgcagtcattgcagtcaccattgtgcagatcatctttctcggtgtgactgcactgctgttgggctggtccgcacctgtcggtggtgtgctctttggcatcgtgaccctatttgtgggtgtttccagcttcaccgcgctcggcatgctgatgggcggaacgttgtcctccgaattggtattggcactggctaacttgatttggattgtactgtccggccttgcagcatgggcggtcttttccccttccgtcaacgctgaaggagtgctgtccatcatcccatccgttgcgctgtcccaaggtatggttgacgcattcaacggcgaacttccgtggctccagctaggaattttggtgggctggctaattatcaccggcgtggccgcaaacaagctatttaacttctctgcgagccgc

SEQ ID NO: 1735 - DNA, 999 bp, Corynebacterium glutamicum
ttgaagcccattactttctgggcaccgaccatcaaagtgcagcgcattctcgcgctcctactgttgattttccagggaggcatcaccgttacgggctctatcgtccgtgtcacaggctccggcctcggttgtgatacctggccactatgccacgaaggttcactagtcccagtcgcaggcgcagcaccatggatccaccaggcagtggaatttggtaaccgcatgctcactttcgtgcttgctgccgcagcgcttgcgttgttcattgcagttcttggcgcaaaacgccgccgcgagatcctggtccattccttcatccagggtttgggcatcatcttgcaggctgtcatcggtggcatcaccgtgctggttgatttgcactggtacgccgttgctttgcacttcctgccatccatgatccttgttttcatggccgcgattttgtacacccgcatcggcgagcccgatgacggcgagattaccaccacattccccacgtggatccgcaatgtagctgtcattggtgcagtagcgctctccgtagtactgatcaccggcaccatgaccaccggcgctggcgttcactctggcgatgcatcaatcaccatggatgatcgcctcgatgtcagcatcgacttgatggcccacatccacggctacagcatgtacatctacctcttcttcaccctcatcgtggtcgccggtctgtacaaggcaaaaaccaccaagcacaacaagcagcttggcctcatgctgattctgttcattctgattcaggcaggtatcggcatcttgcagtaccgcatgggtgtgccacgctggagcatcccattccacatcgcaatgtcttctgtcgttgttgccttcacttcccttctgtgggcgcagggtcgtatacgcgtcggcggtaaagccaccgttactggttctgttgatggcgatattaagaacgagatcattacgaacccctttgagaagaaatcaaagcagcctgttaaa

SEQ ID NO: 1736 - DNA, 357 bp, Corynebacterium glutamicum
gtgcgcttccgtttgcgcgcgttgcgatggtgtcttgagcagggaagaagcgatcataagaagacatatccatgtcagggcgggagttcatggcttggcggagcatggcaaaacctaggcgccgagccagcatcgcggagattggggtatcgaaaaatatccacacgggggcgccgtcgtcggatcgagaaatttcagccaacgcatcgattccgtggtcggtgcaggctgacacgaaagcggccgcatcttgcttccaggtgccatcgtcgaaatcgcaggcgagaagtttgcacgtgtcgatggggaccatcacatagagaccgatatggtcgccgccccggcgcagatgcgcat

SEQ ID NO: 1737 - DNA, 1629 bp, Corynebacterium glutamicum
ttgatcgcgctgcccctcaacggcgactgtcgagcccgcaacaccgccgtcttcgccgattcggaaacgtgggttcccttcgaagatcctttcgcagcgctcgcggccatcacgccactagccaccgaaaaaatcgagcagatccttgccaccacgcaggaaaaatttggccccgaacccgaacacatcaaacgccccacccgcgccgaactcaaacaggttaaagccaacggcgaaaccatcaaactcaccatcaccaacgagctgagcgtccccaccgaaaggttacccgcggccgtcatcgcggagattaaacaccgggcggtaatcccaaaccctgagttttatcgtcgacaagcgcaaagattttcgaccttcggcgtgccgcgcatcgtcatccgcttcgcccaggccgagcagcgcttgctgctcccacgcgggcttgtcgacgacaccctccggatcctcaccctcgccgggtacaaagtcagcgtcatctggcctcggcaaactcggaaaaccatcgacgcgtctttcgagggcgaattgcgatccatgcaacaagagggaatcgactcgctcaaaggccaacgcaccggcgtattggtagcaccgccgggcgctggaaaaacagtgatggcctgtgcactcatcgcgaacagaaaaatccccaccgcagtgatagtcaaccgtgcagaattgatttcccaatggcgggatcgtctcgcgcaatacctgagcatcgacgcagactccatcggacagatcggcgcgggccgacgcaaaaccaccggaattatcgatctcatcaccgtccaatccttgagccgtaaagattccgatccgaaaattttggaacaatacggccaaatcatcgtcgacgagtgccacaacatcgcagccccaggcgccgaagccgcattgaaccaggtcaaggccccctactggctgggtctaaccgccacgccgtttcgttcagaccacatggatgaaatcatcaccatgcagtgcggtcctgtgcgccaccgcatggaagtggcaacagacaatgaacagcgcttgattcacatccacgaaacctctttcgactctgaggaaaccaccgaaatccaggatctctacaatgagctcgcggtcgattctgcccgaaatgcgcaaatcactgccgaagtgcacaaagcgcttgaagctggcgaccgatgtctagttttggtcaaccgaattgcagcccttgaagcactgaccagcagtattaccgaatctggcgatcacactgtcttagtgatgcatggccgccaaacccaagaggagcgagttcaccttcgtgcgcaacttgcctcattgagtgaaaagcaggatccgtttgtactggtcgcgatgaataaagtcgccggcgaaggccttgacatccccagcctcaacacgctgtttttggcagcgccggtgtccttcaaggggctggtgattcagcaaatcggccgagttactcgcgcaaccggtgatcaaaacgctcctccggtgactgccacggtccatgattttgttgattccaagattccgacactcaaacgcatgcacggtcgccgattgcgggctatgcaaaaggaaggattcgctgtttcggagcct

SEQ ID NO: 1738 - DNA, 975 bp, Corynebacterium glutamicum
gtgggaaccatgaaggcaatcttagtttcccgcaccggcggaccagaggtgttggagttcaccgacactgacgccccaaagcccactgatgatcaggttttagttgaagttgatatggctggcgtcaactttattgatacttactatcgccagggtgaatatcacgctcgcctgccgtttatcccaggttttgaaggcactggtcgggtgttggaggatccgcaggggttgattgcggcgggtaccaaggtggcgtggtgtgatgccatgggttcgtatgctcagcaggtgtgtgtgccgcgggatcgcttggtggcggttcccgagggcgtgagttcggaagtggctgcgtcgatgttgatgcagggaatcactgcgcattatctaaccaatggtgtgtatgagcttgaagagggcgattcttgcctcatcactgctggcgcgggtggtgttggattgttggctacgcagatggcggcggccaagggagtgcgcgtgtacagcgtggtgtccacggatgaaaaagctgagcttgctttggatgccggtgcttatgaggtgtttcgttattccgataatttggcggagcaggttcgtcggcacaacgggggtcgcggagttgatgtggtgtatgacggtgtcggccagtccacgttcaatgagtccttagaggctgttcgtccgcgcggcactgtgtgtttgtttggtgcggcgtcgggtcctgtggagccttttgatccgcagctgttgaacactcacggttcgatcttcttgacccgcccaagcattggcgcgtggacgtctgaggagggcgaatttgccaagcgtgcacaggcggtcacgcaggccatcgtcgaaggcaccttgcgggttcgcgttactggcacatattcgcttgccgacgcctacatcgcccaccgcgaccttcaggcgcgtagcacgagcggttctttggtcttggaaatcccgaaggac

SEQ ID NO: 1739 - DNA, 969 bp, Corynebacterium glutamicum
atgagtgatttgaaaatgcaacgttctggaggagaacccttggacacgatcaaggcctatattgcgctaacgaagcccagggttattgaactcctccttgtcgccacaatccccacaatgcttcaggctgaacgcggtgagaacaacattgtgctcatcttgctgactgtgttcggtggctggatgggtgcggccgccgccaacaccttcaacatggtggcagactccgatattgatcagcgcatgggacgcactagggctcgccctttggtgcgccacaccgtgagtaatcgcgacgcctccatttttgcgtgggtcctgacagtggccagcttcttgtggctgtggctgctgtgcgattcgatgctcgccggcatcttcgtgttgatcacgattttcttctacatttttgtctacaccaagtggctgaagcgccgcacgcacatgaatatcgtgtggggcggagccgcaggttgtatgccagtgctcgtcggctgggcagtgatcgttgatcagtttgagccaggcgttccacagcagtggtggcaggcaattgtcctgttcatggtgattttcttctggaccccacctcacacctgggctctggccatgaagtaccgcgaagactacaaggcggctggcgtcccaatgcttcctgtcgtgcgcaccccagtccaggtcaccgcacaaatcgtgtggtactccgtggcaactgtgctgaccaccttcttgctcatcccagcaactggttggatctacgcagcgatcgccgtcatttccggcgtcaccttcttgttcatggccatcaagctgcacctcggcatcaaaaacggtggcaaggtcaagcctctgaagctgtttattttgtccaacaactacttggcagtcctcttcgtggcattgtccgtcgacgcggtcctcggccttgagaccatcggcgagatgctcggctggaccaccaccttcttc

SEQ ID NO: 1740 - DNA, 2100 bp, Corynebacterium glutamicum
ttgaccaccttgacgctgtcacctgaacttcaggcgctcactgtacgcaattacccctctgattggtccgatgtggacaccaaggctgtagacactgttcgtgtcctcgctgcagacgctgtagaaaactgtggctccggccacccaggcaccgcaatgagcctggctccccttgcatacaccttgtaccagcgggttatgaacgtagatccacaggacaccaactgggcaggccgtgaccgcttcgttctttcttgtggccactcctctttgacccagtacatccagctttacttgggtggattcggccttgagatggatgacctgaaggctctgcgcacctgggattccttgaccccaggacaccctgagtaccgccacaccaagggcgttgagatcaccactggccctcttggccagggtcttgcatctgcagttggtatggccatggctgctcgtcgtgagcgtggcctattcgacccaaccgctgctgagggcgaatccccattcgaccaccacatctacgtcattgcttctgatggtgacctgcaggaaggtgtcacctctgaggcatcctccatcgctggcacccagcagctgggcaacctcatcgtgttctgggatgacaaccgcatctccatcgaagacaacactgagatcgctttcaacgaggacgttgttgctcgttacaaggcttacggctggcagaccattgaggttgaggctggcgaggacgttgcagcaatcgaagctgcagtggctgaggctaagaaggacaccaagcgacctaccttcatccgcgttcgcaccatcatcggcttcccagctccaactatgatgaacaccggtgctgtgcacggtgctgctcttggcgcagctgaggttgcagcaaccaagactgagcttggattcgatcctgaggctcacttcgcgatcgacgatgaggttatcgctcacacccgctccctcgcagagcgcgctgcacagaagaaggctgcatggcaggtcaagttcgatgagtgggcagctgccaaccctgagaacaaggctctgttcgatcgcctgaactcccgtgagcttccagcgggctacgctgacgagctcccaacatgggatgcagatgagaagggcgtcgcaactcgtaaggcttccgaggctgcacttcaggcactgggcaagacccttcctgagctgtggggcggttccgctgacctcgcaggttccaacaacaccgtgatcaagggctccccttccttcggccctgagtccatctccaccgagacctggtctgctgagccttacggccgtaacctgcacttcggtatccgtgagcacgctatgggatccatcctcaacggcatttccctccacggtggcacccgcccatacggcggaaccttcctcatcttctccgactacatgcgtcctgcagttcgtcttgcagctctcatggagaccgacgcttactacgtctggacccacgactccatcggtctgggcgaagatggcccaacccaccagcctgttgaaaccttggctgcactgcgcgccatcccaggtctgtccgtcctgcgtcctgcagatgcgaacgagaccgcccaggcttgggctgcagcacttgagtacaaggaaggccctaagggtcttgcactgacccgccagaacgttcctgttctggaaggcaccaaggagaaggctgctgaaggcgttcgccgcggtggctacgtcctggttgagggttccaaggaaaccccagatgtgatcctcatgggctccggctccgaggttcagcttgcagttaacgctgcgaaggctctggaagctgagggcgttgcagctcgcgttgtttccgttccttgcatggattggttccaggagcaggacgcagagtacatcgagtccgttctgcctgcagctgtgaccgctcgtgtgtctgttgaagctggcatcgcaatgccttggtaccgcttcttgggcacccagggccgtgctgtctcccttgagcacttcggtgcttctgcggattaccagaccctgtttgagaagttcggcatcaccaccgatgcagtcgtggcagcggccaaggactccattaacggt

SEQ ID NO: 1741 - DNA, 1080 bp, Corynebacterium glutamicum
atgtctcacattgatgatcttgcacagctcggcacttccacttggctcgacgacctctcccgcgagcgcattacttccggcaatctcagccaggttattgaggaaaagtctgtagtcggtgtcaccaccaacccagctattttcgcagcagcaatgtccaagggcgattcctacgacgctcagatcgcagagctcaaggccgctggcgcatctgttgaccaggctgtttacgccatgagcatcgacgacgttcgcaatgcttgtgatctgttcaccggcatcttcgagtcctccaacggctacgacggccgcgtgtccatcgaggttgacccacgtatctctgctgaccgcgacgcaaccctggctcaggccaaggagctgtgggcaaaggttgatcgtccaaacgtcatgatcaagatccctgcaaccccaggttctttgccagcaatcaccgacgctttggctgagggcatcagcgttaacgtcaccttgatcttctccgttgctcgctaccgcgaggtcatcgctgcgttcatcgagggcatcaagcaggctgctgcaaacggccacgacgtctccaagatccactctgtggcttccttcttcgtctcccgcgtcgacgttgagatcgacaagcgcctcgaggcaatcggatccgatgaggctttggctctgcgcggcaaggcaggcgttgccaacgctcagcgcgcttacgctgtgtacaaggagcttttcgacgccgccgagctgcctgaaggtgccaacactcagcgcccactgtgggcatccaccggcgtgaagaaccctgcgtacgctgcaactctttacgtttccgagctggctggtccaaacaccgtcaacaccatgccagaaggcaccatcgacgcggttctggagcagggcaacctgcacggtgacaccctgtccaactccgcggcagaagctgacgctgtgttctcccagcttgaggctctgggcgttgacttggcagatgtcttccaggtcctggagaccgagggtgtggacaagttcgttgcttcttggagcgaactgcttgagtccatggaagctcgcctgaag

SEQ ID NO: 1742 - DNA, 1164 bp, Corynebacterium glutamicum
gtgctgattctacttcaggcgagcttccatggactcaagcagttcgctccaagaagcaacgaacttgtccacaccctcggtctccaggacctggaagacatctgccaagtcaacgcccagagcctcaagctgggagaacacagcgtcagcttctgccgcggagttggacagggtgtcaccgtgcaggttgccctgctccagaaccgcgtcgatggtgccttctggcatggtgttgacggtgtttggaccagccagctcggaaacgtaaagagttgcagcgtacgcagggttcttcacgccggtggatgcccacagtgggcgctgagtgttggcaccttcaggcagctcggcggcgtcgaaaagctccttgtacacagcgtaagcgcgctgagcgttggcaacgcctgccttgccgcgcagagccaaagcctcatcggatccgattgcctcgaggcgcttgtcgatctcaacgtcgacgcgggagacgaagaaggaagccacagagtggatcttggagacgtcgtggccgtttgcagcagcctgcttgatgccctcgatgaacgcagcgatgacctcgcggtagcgagcaacggagaagatcaaggtgacgttaacgctgatgccctcagccaaagcgtcggtgattgctggcaaagaacctggggttgcagggatcttgatcatgacgtttggacgatcaacctttgcccacagctccttggcctgagccagggttgcgtcgcggtcagcagagatacgtgggtcaacctcgatggacacgcggccgtcgtagccgttggaggactcgaagatgccggtgaacagatcacaagcattgcgaacgtcgtcgatgctcatggcgtaaacagcctggtcaacagatgcgccagcggccttgagctctgcgatctgagcgtcgtaggaatcgcccttggacattgctgctgcgaaaatagctgggttggtggtgacaccgactacagacttttcctcaataacctggctgagattgccggaagtaatgcgctcgcgggagaggtcgtcgagccaagtggaagtgccgagctgtgcaagatcatcaatgtgagacatgaaactaaattttccttaaaagaattgttcttgaactgtgctcaaggagagcaggcaagtaagggatgtgct

SEQ ID NO: 1743 - DNA, 1452 bp, Corynebacterium glutamicum
atggtgatcttcggtgtcactggcgacttggctcgaaagaagctgctccccgccatttatgatctagcaaaccgcggattgctgcccccaggattctcgttggtaggttacggccgccgcgaatggtccaaagaagactttgaaaaatacgtacgcgatgccgcaagtgctggtgctcgtacggaattccgtgaaaatgtttgggagcgcctcgccgagggtatggaatttgttcgcggcaactttgatgatgatgcagctttcgacaacctcgctgcaacactcaagcgcatcgacaaaacccgcggcaccgccggcaactgggcttactacctgtccattccaccagattccttcacagcggtctgccaccagctggagcgttccggcatggctgaatccaccgaagaagcatggcgccgcgtgatcatcgagaagcctttcggccacaacctcgaatccgcacacgagctcaaccagctggtcaacgcagtcttcccagaatcttctgtgttccgcatcgaccactatttgggcaaggaaacagttcaaaacatcctggctctgcgttttgctaaccagctgtttgagccactgtggaactccaactacgttgaccacgtccagatcaccatggctgaagatattggcttgggtggacgtgctggttactacgacggcatcggcgcagcccgcgacgtcatccagaaccacctgatccagctcttggctctggttgccatggaagaaccaatttctttcgtgccagcgcagctgcaggcagaaaagatcaaggtgctctctgcgacaaagccgtgctacccattggataaaacctccgctcgtggtcagtacgctgccggttggcagggctctgagttagtcaagggacttcgcgaagaagatggcttcaaccctgagtccaccactgagacttttgcggcttgtaccttagagatcacgtctcgtcgctgggctggtgtgccgttctacctgcgcaccggtaagcgtcttggtcgccgtgttactgagattgccgtggtgtttaaagacgcaccacaccagcctttcgacggcgacatgactgtatcccttggccaaaacgccatcgtgattcgcgtgcagcctgatgaaggtgtgctcatccgcttcggttccaaggttccaggttctgccatggaagtccgtgacgtcaacatggacttctcctactcagaatccttcactgaagaatcacctgaagcatacgagcgcctcattttggatgcgctgttagatgaatccagcctcttccctaccaacgaggaagtggaactgagctggaagattctggatccaattcttgaagcatgggatgccgatggagaaccagaggattacccagcgggtacgtggggtccaaagagcgctgatgaaatgctttcccgcaacggtcacacctggcgcaggcca

SEQ ID NO: 1744 - DNA, 957 bp, Corynebacterium glutamicum
atgatctttgaacttccggataccaccacccagcaaatttccaagaccctaactcgactgcgtgaatcgggcacccaggtcaccaccggccgagtgctcaccctcatcgtggtcactgactccgaaagcgatgtcgctgcagttaccgagtccaccaatgaagcctcgcgcgagcacccatctcgcgtgatcattttggtggttggcgataaaactgcagaaaacaaagttgacgcagaagtccgtatcggtggcgacgctggtgcttccgagatgatcatcatgcatctcaacggacctgtcgctgacaagctccagtatgtcgtcacaccactgttgcttcctgacacccccatcgttgcttggtggccaggtgaatcaccaaagaatccttcccaggacccaattggacgcatcgcacaacgacgcatcactgatgctttgtacgaccgtgatgacgcactagaagatcgtgttgagaactatcacccaggtgataccgacatgacgtgggcgcgccttacccagtggcggggacttgttgcctcctcattggatcacccaccacacagcgaaatcacttccgtgaggctgaccggtgcaagcggcagtacctcggtggatttggctgcaggctggttggcgcggaggctgaaagtgcctgtgatccgcgaggtgacagatgctcccaccgtgccaaccgatgagtttggtactccactgctggctatccagcgcctggagatcgttcgcaccaccggctcgatcatcatcaccatctatgacgctcatacccttcaggtagagatgccggaatccggcaatgccccatcgctggtggctattggtcgtcgaagtgagtccgactgcttgtctgaggagcttcgccacatggatccagatttgggctaccagcacgcactatccggcttgtccagcgtcaagctggaaaccgtc

SEQ ID NO: 1745 - DNA, 705 bp, Corynebacterium glutamicum
atggttgatgtagtacgcgcacgcgatactgaagatttggttgcacaggctgcctccaaattcattgaggttgttgaagcagcaactgccaataatggcaccgcacaggtagtgctcaccggtggtggcgccggcatcaagttgctggaaaagctcagcgttgatgcggctgaccttgcctgggatcgcattcatgtgttcttcggcgatgagcgcaatgtccctgtcagtgattctgagtccaatgagggccaggctcgtgaggcactgttgtccaaggtttctatccctgaagccaacattcacggatatggtctcggcgacgtagatcttgcagaggcagcccgcgcttacgaagctgtgttggatgaattcgcaccaaacggctttgatcttcacctgctcggcatgggtggcgaaggccatatcaactccctgttccctcacaccgatgcagtcaaggaatcctccgcaaaggtcatcgcggtgtttgattcccctaagcctccttcagagcgtgcaactctaacccttcctgcggttcactccgcaaagcgcgtgtggttgctggtttctggtgcggagaaggctgaggcagctgcggcgatcgtcaacggtgagcctgctgttgagtggcctgctgctggagctaccggatctgaggaaacggtattgttcttggctgatgatgctgcaggaaatctc

SEQ ID NO: 1746 - DNA, 405 bp, Corynebacterium glutamicum
ttgattcttccagttcaggagggcatttcctattttcccacgccgttacacctgaatcacatcggtggatccaggttaagcgcacatgtagaagatgaagatctccgcctcgaccgggacgcagtctctgaatttggtcggaaaacccacgaactcttccccggggtcaacccagagcccaaccgtttcagcgtccactatgacacctacactgcagacaaatctccaattatcgacgcggttgacaatgtcattgtgctcaccggaggatccggacacgccttcaagctctctccagcttatggcgaactcgcagcacaactagcggtcggaaacacctcgccgctgtacagcgaagactttcggatcgcctcgcatgaaccaatcaaagaggcggtgcacgta

SEQ ID NO: 1747 - DNA, 1401 bp, Corynebacterium glutamicum
gtgcaattattacacaaccccacagcgatgtccgcatcctttgatgaccccaacctcatctcgcttgctggactggttccaaccatgcacttagccgatgctgccagcctgtccaccttggcccaggaccggttgagcatcaccggtgataaaggtgccaatgctggtgcgaagatcgcctccctagtcgcgggcatggtcgccggtgctgattccatcgatgacatggatgtactccgccacggaggtatgcgccgacttttcgaccggatctacgccccatccacattggggtcttttctgcgggccttcactttcggccacgtacgccaactcgatgctgtggcctcccgattcctggtcaacctggccaggcaggcaccacacctggtgccaccaccaccggcaggcagtggcggtaacgggtatgtgttcgttgatgttgatgacaccatcattgaagtccacggccacaccaaacaaggtgccggctttggttactccggtatccgtggactcaacgccttgctggccacggtcaccaccgcacagtccgcccccatcattgtgggccaacgattgcggaaaggatcgtgtggttccccacgaggggcccaccgcctgatcgccgatgcgatgaccaccaccaggcgcctgcccgggatggaggataagaaaatcctcgtccgggcagattcggcgtattatggtcatcccagtgtcagtgtggccctaaggtccggtgcggatgtgtccgtcacggtgcggatgaccccgaacgtcaagaaagcgatcgtcgcgatcccggaagatgcgtggcagacgattcagtacaccgatgcgatcttcgatgaggcatcacaatcgtggatctccttagcccaggtcgccgaagtgcctttcaccgcgtttacctcccggaagaaggccgaccatgttcccggacgcttggtggtacgccggattcctgagctgaataagaaggatgtgtatcagccgggcttgtttgatcttcaccgcttccatgcggtcttcaccaccgccgacccaggcgtgctggatactgttgctgcggataaaacccaccgtcagcacgcgatcattgaacaggtcaacgcagacttgaaggcaagcgcgttggcgcatctgccgtcggggacgttcaccgccaacagtgcctggctcgtatgcgcggtcatggcgtttaatctcacccgtgccaccggggttatcgctgcaggcgggatggccaaggccaccaccgcgacgatccggcggacactgatggccgttccagcccgggtcgcccgcaggtcccgccgactggtgctccaccttcccgaggggtggacgtggcaaccacagtggcagaaactgtttgatcacggccattcaccaccg

SEQ ID NO: 1748 - DNA, 840 bp, Corynebacterium glutamicum
atgaaaattgcggtaatcggccttggatcaaccggctccatggcactgtggcacttaagtaacatcccaggtgtagaggccatcggctttgaacaattcggcatctcccatggctacggcgcattcacaggggagtcccgactgtttcgcatggcctaccacgaaggcagcacctacgttccgttgctcaaacgcgcacgagcactatggtcatcactgagcgagatttccggacgcgaactcttccacaacttcggtgtcttaagcaccggcaaggaagacgaagcacccttccaacgcctggtggaatcagtggaacgttatgagctgccacatgaacgacttaccgccgcgcagatgcgcaagcgttacccaggtctagacttccgcgatgatgaagctggaattgttgatcttcaaggtggagccctgcgccccgaactagcagtgttcagtgcaatcgaaacagccaaggcaaatggtgcccaagtacgcgatcaccaaaaaatcaccagcatcgaagacaacggcgatcacgtagtcatccaagcaggcgaagaaaccacaatcgtggaccgcgttatcgtcaccaccggcagctggacaagcgagctcgtgccctccatcgcgccactgcttgaagtgcgacgcctagtgctcacctggttcctgcccaacaatccagtggacttccaaccggaaaacctgccatgcttcatccgtgaccgtgatggcttccacgtatttggagcaccatgcgtcgatgggtacagcatcaaaattgccggattggatgagtggggcgttccattaagcctcgatccaccgatgtgccctcgg

SEQ ID NO: 1749 - DNA, 174 bp, Corynebacterium glutamicum
gtgcagcaagacgaaaaccgtcatgagcaggctggcgacgacgaggatgatttgaagcgtcaatgccatgtggaaaatgttcctttgccgtttgagaacccaggtgaaccttatgcccacctgatttcgaataactttagacagtatacacgagtactacccagccggctggac

SEQ ID NO: 1750 - DNA, 687 bp, Corynebacterium glutamicum
atgaatacagcgaggtcaccgaccgcgagctcggcatcttccgcaccgcgtcggaggctgttaagaaattcgggccacggatggtgcctcactgcatcatctccatggcatcatcggtcaccgatgtgctcgagccgatggtgttgctcaaggaattcggactcatcgcagccaacggcgacaacccacgcggcaccgtcgatgtcatcccactgttcgaaaccatcgaagatctccaggccggcgccggaatcctcgacgaactgtggaaaattgatctctaccgcaactacctcctgcagcgcgacaacgtccaggaagtcatgctcggttactccgattccaacaaggatggcggatatttctccgcaaactgggcgctttacgacgcggaactgcagctcgtcgaactatgccgatcagccggggtcaagcttcgcctgttccacggccgtggtggcaccgtcggccgcggtggcggaccttcctacgacgcgattcttgcccagcccaggggggctgtccaaggttccgtgcgcatcaccgagcagggcgagatcatctccgctaagtacggcaaccccgaaaccgcgcgccgaaacctcgaagccctggtctcagccacgcttgaggcatcgcttctcgacgtctccgaactcaccgatcaccaacgcgcgtacgacatca

SEQ ID NO: 1751 - DNA, 981 bp, Corynebacterium glutamicum
atggacggcgcgtcgataaggctcatccacgcggcttggcacgtcgttgtgccctgcatctgccagcgcaagcagctgcggggtgaccttattcatgcggtccgacaggctgagctcatgctcgagggaatgcagctggcgtgcatagtacttgagcacggtttccgcagcgcggtgagtggaatactcaactgtttccgcggtgacataagggttaccgtcgtggtctccaccaatccaggaacctggcttgaccacgggcttcaaaggaacaccctcgccgaaacgctcacgaagctcaacagccacatcacggttgatacgtggaatctcttccaaaaggctcagcttgtagtagcgcagccctacttcgatctcgtcctcgatacgtgggcgggccacacgaatcaacgcggtctgccacaaaatggtgatgcgacggcggatgttcttctcgatctcatccaacttgctttgcgtacgagcggtaggctccgcagactgcaaagcgtggcgttcacgcatgtgggtggtgatccacttttgcgcatcaaaaacagtgcggcggcgagtctcagttgggtgcgcagtcagaaccggcgccacctcagcattgcgcagcacatcggccacagcttctgcgccaacattgccctcattgagtttcagccaggtggcatcaagagtgctgtccggaggggtgtcgcctgcatcgagagcctgttcacgaagctcttcatcgtagaggtcttccgccaggttagccagcagagcgaagtgggaaaatgcgcgagcaatcggtgttgccttggctggagtaatgccgtcgaaaacctgaaccaggctatccatttcggcgttgcccttggcgatatcaaaagaagtcaggcgcgcttgttcgaccagttcataaacctcctggccttcttgttccgcaattacctcaccgaggatttgaccgaggaacctgatgtcatcgcg

SEQ ID NO: 1752 - DNA, 777 bp, Corynebacterium glutamicum
atggcacgtaagccacttatcgctggtaactggaagatgaacctggatcaccagcaggcaatcggcactgttcagaagcttgcattcgcccttccaaaggaatacttcgagaaggttgacgttgcagtcaccgttcctttcactgacatccgctccgtccagactctcgttgagggcgacaagcttgaggtcactttcggtgctcaggacgtctcccagcacgagtccggtgcgtacaccggtgaagtttctgcaagcatgctggcaaagttgaactgctcttgggttgtcgttggacactccgagcgccgcgagtaccacaacgagtctgatgagttggttgctgcgaaggcaaaggcagctctgtccaacggcatcagcccgatcgtctgcgttggtgagccactggaaatccgtgaagctggcacccacgttgagtacgtcgtcgagcagacccgtaagtcccttgctggcctggatgctgctgagctggccaacaccgttatcgcgtatgagccagtgtgggctatcggcaccggtaaggttgcttccgcagctgacgctcaggaagtgtgcaaggctatccgcggtctgatcgtggagcttgcaggcgacgaggtcgctgagggcctgcgtattctttacggtggttctgttaaggcagaaaccgtcgctgagatcgtcggtcagcctgacgtcgacggcggacttgtcggtggcgcttccctcgacggtgaagcattcgccaagctggctgccaacgctgcgagcgttgct

SEQ ID NO: 1753 - DNA, 408 bp, Corynebacterium glutamicum
atgtgggagaagccgtcttcgttcaggccgagcacgcgaacggatgctgcggagtcgccaccgccaacaacggagaatgcgtcgttgcctgcagttgcatcgatgatggcctgggcgatgccgcgggtgccttcagagaatgctgcgaactcgaacacgcccattgggccgttccagaagatggtcttagcggtgctgagaacctcaccgaagttcttgacggactctggtccgatgtcaagagacatccagccttctgggatggagtccaggtcaacgatctgcttctctgcgtccttgttaaattcggatgctgcaaccaggtcaactgggagaacgatcttgtcaccgaagcgtgcgagcaggtcggtgcaggtagccttcatttcttcctgcaggagggactgc

SEQ ID NO: 1754 - DNA, 1215 bp, Corynebacterium glutamicum
atggctgttaagaccctcaaggacttgctcgacgaaggcgtagacggacgccacgtcatcgttcgatctgacttcaatgttcccctcaacgatgaccgcgagatcaccgataagggccgaatcattgcctccctaccaacccttaaagcactgagcgaaggtggcgcaaaggtcatcgtcatggctcaccttggccgcccaaagggcgaggtcaacgagaagtactccctcgcacctgtcgctgaggcactctccgatgagcttggccagtacgttgcacttgccgcagacgttgttggcgaagacgcacacgagcgcgcaaacggcctgaccgagggcgacatcctgctcctggagaacgtgcgcttcgacccacgcgaaacctccaaggacgaggcagagcgcaccgctttcgctcaggagctcgcagctcttgcagcagacaacggcgcattcgtttctgacggcttcggtgttgtccaccgcgcacagacctccgtctacgacattgcaaagttgctgccacactacgctggcggactggtagagaccgagatttccgttctggaaaagatcgcagaatcaccagaggcaccatacgtagtggttctcggtggatccaaggtctctgacaagatcggtgttattgaggcgctggctgccaaggctgacaagatcatcgtcggtggcggcatgtgctacaccttcctcgcagctcagggacacaacgttcagcagtccctcctgcaggaagaaatgaaggctacctgcaccgacctgctcgcacgcttcggtgacaagatcgttctcccagttgacctggttgcagcatccgaatttaacaaggacgcagagaagcagatcgttgacctggactccatcccagaaggctggatgtctcttgacatcggaccagagtccgtcaagaacttcggtgaggttctcagcaccgctaagaccatcttctggaacggcccaatgggcgtgttcgagttcgcagcattctctgaaggcacccgcggcatcgcccaggccatcatcgatgcaactgcaggcaacgacgcattctccgttgttggcggtggcgactccgcagcatccgttcgcgtgctcggcctgaacgaagacggcttctcccacatctccaccggtggtggcgcatccctcgagtaccttgaaggcaaggaactcccaggcgttgcaattctcgctcag

SEQ ID NO: 1755 - DNA, 1002 bp, Corynebacterium glutamicum
atgaccattcgtgttggtattaacggatttggccgtatcggacgtaacttcttccgcgcagttctggagcgcagcgacgatctcgaggtagttgcagtcaacgacctcaccgacaacaagaccctttccacccttctcaagttcgactccatcatgggccgccttggccaggaagttgaatacgacgatgactccatcaccgttggtggcaagcgcatcgctgtttacgcagagcgcgatccaaagaacctggactgggctgcacacaacgttgacatcgtgatcgagtccaccggcttcttcaccgatgcaaacgcggctaaggctcacatcgaagcaggtgccaagaaggtcatcatctccgcaccagcaagcaacgaagacgcaaccttcgtttacggtgtgaaccacgagtcctacgatcctgagaaccacaacgtgatctccggcgcatcttgcaccaccaactgcctcgcaccaatggcaaaggtcctaaacgacaagttcggcatcgagaacggcctcatgaccaccgttcacgcatacactggcgaccagcgcctgcacgatgcacctcaccgcgacctgcgtcgtgcacgtgcagcagcagtcaacatcgttcctacctccaccggtgcagctaaggctgttgctctggttctcccagagctcaagggcaagcttgacggctacgcacttcgcgttccagttatcaccggttccgcaaccgacctgaccttcaacaccaagtctgaggtcaccgttgagtccatcaacgctgcaatcaaggaagctgcagtcggcgagttcggcgagaccctggcttactccgaagagccactggtttccaccgacatcgtccacgattcccacggctccatcttcgacgctggcctgaccaaggtctccggcaacaccgtcaaggttgtttcctggtacgacaacgagtggggctacacctgccagctcctgcgtctgaccgagctcgtagcttccaagctc

SEQ ID NO: 1756 - DNA, 981 bp, Corynebacterium glutamicum
gtgtcactgacgagtgatatcaaacaagaattggcgcaggtccatgtggccaaaaacagtgttcgtgctgcggaagtgtctgcaattttaaggtttgctggtgagatgcaagctgtcggcggcaagctggtcatcgaagcaaatttggacagcatgcaagtcggtatgaggcttcaggagtttatccaaggtttgtacaactctcgagtcgatgtgcacaccgtgaacccgactgtgagcaggaaaacgccacggtatttggtgcgcatcattgacaatgccgatgaaattgcgcgacgcaccggactggtcaccaggtctggacatgtggttaaaggtctagcgccttctgtggtcagcggaacaatcagtgacgctgaagctgcatggcgcggtgcgtttctagccaatggatctttaagtgatccaggtcgttcctcttcgttggaggtgttgtgtcctggtcaagaatcagcattggcactggttggatgtgctcgaagaattgggatcgcggcgaaaacgaaagattctcgaggatttgatcgcgtcaatgttcgtgatgcggaagcaattggggcactgctcactcgaatgggtgcacagaaaactcgcatgttgtgggaagaaaaacgcatcaagcgggaaagtcgaactccggcaaaccggttggccaacttcgacgatgccaatctgcgcaggtcagcccgagcagcagttgccgctgcagcgagggtagaacgcgccatgaagattcttggtgatgatgttcctgagcatttggctgaggctggacagctgcgtgtgcagcaccgtcaggcatcgttggaggagttgggccggttggctgatcctcaaatgaccaaggatgctgtggccggtcgtattcgtcgtcttttgacgatggcagataagcgcgccgaagatctgaagattcctgatacaaattctgttgtgacggaagatttgttggaagaaatt

SEQ ID NO: 1757 - DNA, 1023 bp, Corynebacterium glutamicum
ttgacaaccttcttcgatgccccaaatggcacaccagaagaagctccacttgagcgaccacgtgtaatcaccagcttgggcggtggacatggtctttttcagacccttcgagcagctcaaatctgctcaccgacaaccatcaacgctgtggtgacagttgctgatgatggtggctcatcaggccgtattcgccgtgagctggggcagatccctccaggagatctgcgcatggcgttggcagctttgatcgccgatgccgaagaaggcggattgtgggaaaacctcctgcagcaccgcttcggtggacatggtgcgctagctggtcacgccttgggaaacctcgtgatcgtggcgttgaccgacattttgggcacctcccagcatgcgcttgatcaaatcgctcaactcgctggagccaaaggacgcatcatcccggtatgtgctgaacctttggatcttgaagcggaagtatcaggtctagactctgatgctcgagtcatgcgtcaagttcgtggtcaagtggcggtagctgcaacccccgggcaggtgcgacgcgttcgaatcattccggacaatccagaaccgaaccccgctgccatcgaggccattctcgatgcagatttggtcacccttggcccaggttcctggttctcctctgtgattccacacattttggtcccagggatcgttgatgccttggcgcagacaaaagcaaccaaaaccgtggtgttaaacctgacgtccgagccaggggagaccgcgggattctctgcagaacgacacatccatgtgctccgccagcatgctcgaaaccttcaggttgaccaagtcattgtcgatgccaagacactgtcctcacaaaccgaacgcaatcatgtagaacgagctgctcgcacccttggtgcagaagtctccttccatgatgtccaggctgaagatggccgtggtcgattcaccagtattcacgatccagcaaagctgtgtgcagcgttgctggcaagttttgctggagcacgaaagcgt

SEQ ID NO: 1758 - DNA, 927 bp, Corynebacterium glutamicum
atgattcaatccactggggtcacgcacactgataagtctgcacaagaaaatcctgtgaagtacagggacaatttcacacctgtcatcatcaccggtatgtcaggcgcaggtctgagcacagcagcccgagtcctcgaagacttgggttggtatgtggcgcacaatattccaccacagatcatcctggaattaattgatatgtgcgctcgggaagattctcccgtcgacaaagttgcagtcgtgtgcgatgtgcgctcccgtgaattccgcggaagcctcacccaggttgtttcagagctgcgtgataagcagctcgatcccacggtgttatttctggaagcacgcgatgaggtgctgatcaagcgattcgataatgtgcgccgcacccatcctttgcagggcagccaaacccttcaggtgggtattgaacgtgaacgaaccgtgctgtctcctgtgaaggaagacgcttcagtggtcatcgatacctcggatctgtccgtgcatgatttgcgccgcgccatcgaatcctcgtttaggacaatcgccacgcgcacccagcacgtcaccattgaatcattcggtttcaaacacggctcaccacgcgacgccgactttgttgtggacgtgcgtttcttgccgaacccattctgggttccagagctgcgcccatttaggggagtggacaagccagtatctgactatgtgctctcccaaaaaggcgcagaagaatttttgaacaactttgtggacatgctcaaagacatgcttccgggataccgccacgaaggaaaaaacttcatcacaatcggtgtcggctgcaccggtggacaccacagatcagttgcggtgtctgaagaactagccaaaagaatcgcagatcagaccacgctcgacgtgtctgtagtacaccgcgatattaaccgccac

SEQ ID NO: 1759 - DNA, 2088 bp, Corynebacterium glutamicum
gtggctgatccaacaacttatcgcccggctccaggaacaattccaacggagccgggtgtttataaattcagggacgaaaaccgccgcgtgatctacgtgggcaaggccaaaaacttgcgttcgcggttgtcgaactatttccaggatgtcacccaactgcatccgcgcacccgccaaatggtgttcgcagcgtcgtctgtggagtggaccgtggtgtccagcgaagtcgaggcgctgcagctggaatacacctggattaaacgttttgatccgcggtttaacgtaaaataccgcgacgataaaacctatcccatgctggcagtatccacaggggagaggttcccgcgcgcgttcttcttccgaggtccgcgccgcaaaggtgtgcgctatttcggaccgtattcccacgcgtgggcagtgcgggaaacccttgatcttctcacccgcgttttccccatgcgcacctgttcaaagggtgtgtttaaccgccacgaaagcctcggccggccgtgtttgttgggctatatcgataaatgtgcggccccgtgcgtgggccgcgtgagcgaagaggaacaccgcgaaatcgttgacggtttcacctctttcatggctggtcacaccgacaaagtcactcgcaaactcaacgccgacatgatggctgcggccgaggaactcgatttcgagcgcgcggcccgcctgcgcgatgatctggaagccattgacaaggtcatggaaaaacaggccgtcgtccttggcgatggcaccgacgccgacatcatcgcattcgccaccgatcagctagaagccgccgtgcaagtcttcaacatccgaggtggccgaatccgcggccagcgcggctgggttgtggaaaagcccggcgactacgccggattgcttgtcgacgctacgacccaacctgagggtgatgccccggaaacagatcccgcactgccatttttgatgcaagatttcctcgttcagttttatggcgacgccgtcgagcgtgctgaaactgaggctaaggaagatgctgcggtgatcgagcgacgtggcgtcgataagcattcttttgaagaggcagccccagtgacgcgcgcttcggtcgtgccccgtgaaatcctcgtgcaagttgcgcccaatgaagctgagcaaaccctgaaagtactggaggaattgcgcggtgctggcgttgatgcccgcgtgccacagcgcggtgacaagcgtgcgctcatggaaactgtggagcgcaacgccaaagagctgctgaaacaacacaagcttaagcgtgtcggtgatctcaccgcgcgttcagctgcactgcaggaattgcaggaagcgctggacatggagcaggctccgctgcgcatcgaatgtaccgatatttcccatattcagggcaccgatgtggtggcatccctggtggtttttgaagatggtttgcctcgaaaatcggactaccgacgctatcgagtcaaagaagccgcaggcgatggacattccaacgacgtggcatccattgcggaaatcaccaggcgccgcttcctgcgccacaaccaagacaaacttgctgttcccgaagccgaagagtttgacggctcgaccttcagcgatgaaaaagtcgaggaaatgagcaccgacgccaggcgttttgcataccctcctcagatttttatcgtcgatggtggtgccccgcaggtagctgcagcccaagaagtctttgatgaattaggcatcgttgacgtggtgctcattggcctagccaagcgcttggaagaaatctggctgcccggcgaccccgatcccgtcatcttgccgagaaactcccaagcactgtttttgctccagcaaatccgtgacgaagcccaccgctttgccatcacctaccaccgccagcaacgatccaagcgcatgcgtgtttccgagctagatagcatcaagggccttggccagagccgtcgcactgaactagtcaagcactttggatccgtggcaaaactgaaagaggcaagcgttgaggacatttcccaagtgaaaggcttcggcccgaaacttgcggaggctgtctatgaaggtcttcacgcgtcaaaa

SEQ ID NO: 1760 - DNA, 579 bp, Corynebacterium glutamicum
gtgacaaccaacgcccccgacggagcaacgaacaacatcaacaacgcacattcgggcgctgtcgggaagccaaaggtacagctcagcgatgcggaaattcaggaatacaccgcagctttcgctggcaccaccacaaccaagccatgggagctggaggtgaccacaaagtttctgaaaaagatcgcgtgggtagccgtggttgtcatcatggccgttcacatcttcatgggtgccgtggtggacgtcgatttcaccggtgcagcggtcacctttgttgacactctggcattcccagcgttgggcatcatcttctccgttcttgtgttcttgggactgactcgccctcgcgtgcgtgccaacgaagacggcgttgaggtgcgtaacttcatcggaactcgtttctacccatgggttgtcatctacggcatgtctttccccaagggcagcagcgtggcacgtttggagcttccagactttgaattcgttcccatgtgggctttccagtcccgcgatggagaagatgtggtgcgcgcggttgcgaccttccgcgacctcgaaaacaagtacatgccagaggac

SEQ ID NO: 1761 - DNA, 477 bp, Corynebacterium glutamicum
atggctaaagaaggattgccggcagtcgaactccccgacgccagcggattaaaagtcgccgtagtcaccgcacggtggaacgcagaaatctgcgaccgcctgcacaagcacgcagtagatgcgggacgtgcagcaggagcaacggtgagcgaataccgcgtcatcggcgccctggaacttccagtcgtagtgcaagaactggcacgcacccatgacgcagtagttgccttgggctgtgtcgttcgtggcggcaccccacactttgattacgtgtgcgactctgtcaccgaaggcctcacccgcattgctcttgatacttccaccccaatcggcaacggtgtgttgactaccaacaccgaagagcaagccgtggaacgctccggtggagaaggctctgtagaggacaaaggcgcagaggcaatggtcgctgcactcgatactgccctcgtgctttctcaaattcgtgcaactgagggt

SEQ ID NO: 1762 - DNA, 228 bp, Corynebacterium glutamicum
atgcctcgtccctcatgcccacgcatgtacaccactactccccgaccagcttcctggatcaggcgcaaagactcgtgcagctgctgtccacagtcgcagcgccgggatccaaaaacatcaccagtcaagcactcagagtggactcgaaccaggacgttttcgccaccgtcggatgccacgtcgccggcaacaatggcaacaagctcggtgccatcgatgatggaacgg

SEQ ID NO: 1763 - DNA, 714 bp, Corynebacterium glutamicum
atgcccacgcatgtacaccactactccccgaccagcttcctggatcaggcgcaaagactcgtgcagctgctgtccacagtcgcagcgccgggatccaaaaacatcaccagtcaagcactcagagtggactcgaaccaggacgttttcgccaccgtcggatgccacgtcgccggcaacaatggcaacaagctcggtgccatcgatgatggaacggtaaccaacagccttgaacgtgccgaaatcggtaggcagcacagtttccacctggcgctccaccaaaatttcattcttgcgacgccactcaatgagctgctcaatagagatcagcttcagatcgtgctcatcgcagaagcggcgcagctcaggaacccgagccatgccggtggggtcctcttcactgaccacttcgcagataacacctgctgggcgcaggcctgcagcgcgagccaaatcgacagctgcttcggtgtgtccagcgcgcaccaagacgccaccttcacgagcacgcagtggcacaacgtgtccgggacgggtgaaatccgtgcggtcggcttctggatcagcaagcaagcgcaaagtgtgggcgcggtctgttgcagaaatgcctgtggtgccggtgttggcatcaacggtcacggtgtaagcggtgccgcgggcatcctgattgtgcgcggtcatcggaggcagatcaagacgatctgcatcctttgcggt

SEQ ID NO: 1764 - DNA, 336 bp, Corynebacterium glutamicum
atgagctgctcaatagagatcagcttcagatcgtgctcatcgcagaagcggcgcagctcaggaacccgagccatgccggtggggtcctcttcactgaccacttcgcagataacacctgctgggcgcaggcctgcagcgcgagccaaatcgacagctgcttcggtgtgtccagcgcgcaccaagacgccaccttcacgagcacgcagtggcacaacgtgtccgggacgggtgaaatccgtgcggtcggcttctggatcagcaagcaagcgcaaagtgtgggcgcggtctgttgcagaaatgcctgtggtgccggtgttggcatcaacggtcacggtg

SEQ ID NO: 1765 - DNA, 1266 bp, Corynebacterium glutamicum
gtgagtgaacatgagcaggcacacagccaattagattctgttgaagaggccatcgctgacatcgctgcgggtaaagccgtcgtggtggtagatgatgaagatcgtgaaaatgaaggcgacatcatctttgccgccgaattagccactccagaattagtcgctttcatggtgcgttattcctcgggatacatctgtgcgccattaaccgcaaaggatgcagatcgtcttgatctgcctccgatgaccgcgcacaatcaggatgcccgcggcaccgcttacaccgtgaccgttgatgccaacaccggcaccacaggcatttctgcaacagaccgcgcccacactttgcgcttgcttgctgatccagaagccgaccgcacggatttcacccgtcccggacacgttgtgccactgcgtgctcgtgaaggtggcgtcttggtgcgcgctggacacaccgaagcagctgtcgatttggctcgcgctgcaggcctgcgcccagcaggtgttatctgcgaagtggtcagtgaagaggaccccaccggcatggctcgggttcctgagctgcgccgcttctgcgatgagcacgatctgaagctgatctctattgagcagctcattgagtggcgtcgcaagaatgaaattttggtggagcgccaggtggaaactgtgctgcctaccgatttcggcacgttcaaggctgttggttaccgttccatcatcgatggcaccgagcttgttgccattgttgccggcgacgtggcatccgacggtggcgaaaacgtcctggttcgagtccactctgagtgcttgactggtgatgtttttggatcccggcgctgcgactgtggacagcagctgcacgagtctttgcgcctgatccaggaagctggtcggggagtagtggtgtacatgcgtgggcatgagggacgaggcattggtctgctcgccaagctacgcgcctaccaactccaggatgaaggtgccgacaccgtcgatgccaacctcgcacttggtcttccagccgatgcccgcgaatttggcaccagcgcccagattctctacgacttgggtgtgcgctcgctcaacttgatcagcaacaacccagccaagaaggtgggacttgaaggccacggcatttccattgccagccgaacccccatccctgttgctgttcatgaagacaatgttcgatacctgaaaaccaagcgtgaccgcatgggacatgacctcccagatgtcgcactgtgggaacaagagcacccagaaaac

SEQ ID NO: 1766 - DNA, 633 bp, Corynebacterium glutamicum
atgttcacaggtattgtcgaggagcttggctccgttgcaggcgtggaacatctgggagattccatccggatgcagatttccgcgtccaccgttttagagggtgtgcatttgggggattccatttctgtcaatggtgtgtgcttgacagtggcgtcctttggcgagggacatttcactgcagacctcatgcaggaaaccttagatcgcagctccctgggcgcattatccaccggtagcaaagtcaaccttgagcgcgccatggcagccgatggccgtctgggtggacacatcatgcaaggccatgttgatgccaccacctcgctgatcaagcgcaccagctcagagaactgggatgttctgcgttttgagctgccagctgatttggctcgctatgtggtggaaaaaggctccatcgcactcaatggcacatccttgactgtatcgtctttgggtgatgattggtttgaggtttccctgattcccaccaccttgcgcgacaccacccacggcgaactggcggtaggggatatcgtaaacattgaggttgatgtgatcgctaagtacgtcgaacgcatgatgacgcgcggcgtggctggaaacactcccaatgactacaccgatttcacgagagac

SEQ ID NO: 1767 - DNA, 984 bp, Corynebacterium glutamicum
atggatgttgcgcacgcgttagatctggcccaccacgtgtcagatcaagtccgaggcaccaccagccctaatccgccagtcggcgctgtcattttggacgccgacggcgaggtcgttggcgttggcgccacggcacctcctggtggcccgcacgccgaagtggtggcgcttgcagctgccggagtgcgtgccaacgggggcacggcggtggtcaccctcgagccgtgcaaccattacggccgcacgggtccatgttccaaggcgcttctcgacgccgggatcgcacacgtgttttacgccaatgcggatcccttcccgtcagccgctgggggcggtgcctttttggcggaggcgggcgtcgatacgcattttttagatgagcggatcagggcactggagccctggctggttgcgacgcgtctgggcaggccccatgtcacgttgaagtttgcgtccaccgtggacggttttgctggtgccaccgatggcaccagccagtggattaccgggccggatgcgcgggcgtttgtgcacgaagatcgaagtaaaagagatgcgatcatcgtgggtaccggtactgcgttgactgataatccctccttgacggcgcggaccgatacgggtctttatgaaaatcaacccaggcgcgttgttattggctcccgcgaggttccagcagattccaacttggctcgcttgggatatgagcagtacgcgggaataccagaggctttatcagcgctgtgggataaagggtgccgagacattttaatcgaaggtggcccaacgttagctggggcagcgctgcgcttaggcattgttgatcaggtgcaggcctatgttgcccccgctttgttgggcgctggacgatcagtgattaactggccacaagaaaccacgatggatcagattatgcgttttgacaccacgtccgtgagacagttgggttcagatgtattgatagaaatgatgagaaaggaacac

SEQ ID NO: 1768 - DNA, 657 bp, Corynebacterium glutamicum
atggcacaacgtactccactaatcgccccatccattcttgctgctgatttctcccgcttaggggagcaggtgttggctgttcctgatgctgactggattcacgtcgacatcatggacggacacttcgttccaaacttgagctttggcgcggatatcacagctgcggtcaaccgcgttacggacaaagaactagacgtccacctgatgatcgaaaacccagagaagtgggtggacaactacatcgacgctggcgcggactgcattgttttccacgttgaagccaccgaaggtcacgttgagttggctaagtacatccgttccaagggtgtgcgtgcaggtttctccctgcgccctggaactcccatcgaggattacttggatgacctcgagcacttcgatgaagtcatcgtcatgagcgtcgagcctggattcggtggccaaagcttcatgcctgaacaactggaaaaggttcgtaccctgcgcaaggtcatcgatgagcgcggtctgaacaccgtcatcgagatcgacggcggcattagcgccaagaccatcaagcaggctgccgacgctggcgtggatgccttcgttgcaggttccgctgtgtacggcgctgaggatcccaacaaggcgatccaggagttgcgagcactcgcgcag

SEQ ID NO: 1769 - DNA, 1332 bp, Corynebacterium glutamicum
gtgagggctctgggcgtcgataagccgagagaaattgcgtttgaggtgcttgatcgtgtgcgtaccggtgaggcgtatgccaacttggtgttgccacgactgctgagcaagcacaatctttctggccgtgacgcggcctttgctacggaaattacctacggcaccttgcgtaatgtcggcttgctggatgaggtcattaaggctgcatctgggcgtgaactgtctgatattgatccagaggttttggacgtgctgcgtttgggcgcgtaccaggtgatgtttacccgcgtggaggatcacgctgcggtcgatacttcagtaaagatggtcggtgggctgaagaaattccaggccactggttttgccaatgcaattttgcgcaacatcacgcgcaaggaaccagagcagtggttgaaggaattggagcccgcggaagagttggctcgcgttgcgttccgtactgcgcacccacgctggattgcgcagagtttctcacaggtgctcccggcagatgagttggaagcagcgcttgctgcggactctgagcgcccagtggtgcacttggtggctcgcccaggtgagatcagtgcagaggaattggcgctgatcaccggtggtgacgagggcaagtattccccatacgcggtgtacctcgagggtggcgacccgggtgatattgagccagtgaaggatggtcttgcagcagtgcaagatgagggttctcagctgattgctcgcgccttggtggaaatccccgtggagggcaccgatgccggccgttggctggatatgtgtgcaggtcctggcggtaaagcggcgctcattggtgcgttggctcgcatggatcgtgccaccgttgatgccgtggaggtctctgatcaccgtgcccgactgattgaaaagtccgtgcgtggtttgcccgtcaaggttcatgtgggcgatggccgcaccatcaacttgaccggtggttacgatcgtgcgctagtcgatgcgccgtgttctggtttgggtgcactgcgtcgtcgccctgaggcgcgttggcgcaagcaggaaagcgacattgttgagctcaacaccctgcagtacgagctgcttgaatccgctgtgaacaaggtgcgttccggtggcgtgattgtgtactccacatgttcacctgatctgcgtgaaacccgcggaatcgtggacaaggcactgggggctctggagatcgaagagcttgaggctgcggagttcatgccaggcatgaccgataccggcgatgagaaatcagtgcagatgtggccacaccgccacggcaccgatgcgatgtttgtggcagtgctgcgaaagaag

SEQ ID NO: 1770 - DNA, 945 bp, Corynebacterium glutamicum
atgcgcctagtttttgccggaactccggaacctgcagtggtggcactgcaaaagctcattgattccgatcatgaggtcgtcgctgtgttgacgcaaccagatgcacgtcgcggccgtggtcgtacgctgcatccttcagctgtcgcggagcttgcacagcagcacggtattgaggtgttaaagcccacctccctgaaggctgatacggaagatggccaagcaatccgtcagcgcttggctgagcttgcccccgattgcttgccggtggtggcatacggacagctgatcaccaaggatttgctggatgttgcgccacacggttgggtgaatctgcacttttctttgcttcctgcatggcgtggggcggcgccggttcaggcgtcgatccgtgaaggcgatcagatcactggtgccacgaccttccgcattgatgagggcctggataccggcgtgattttgtccaccatcgaggacacaattcagcccaccgatactgcggatgatcttcttactcgcctggcgtattcaggcggtgacctgctggttgagaccatgactggcctggagcagggcacaatcaccccgcgcgcccaggaaggcgaggccacgtacgcctcaaaaatcaccacccaggacgcgcagattgattggtcgaagcccgccgaggtcatcgaccgccacatcagggcacataccccaggacctggcgcatggaccacgcttgtcgacgcccgcctcaaggtcgggcccatcagccactcaggcgaggtcgaagtagcagcggacttggcgcctggcgccatcctggcgcaaaagaactccgtggtggtcggaacgggcaccacaccaattgttctgggcaatatccaacccccgggaaagaaaatgatgaatgcagcagactgggcgcgtggtgtccaacttgatcaggaagcgaaattccaa

SEQ ID NO: 1771 - DNA, 507 bp, Corynebacterium glutamicum
atggcagttcgtgaagtcagattatttggagatcccgtacttgtgagtcgggcagatgaggtcgtggacttcgatgaatcactgtccaccctgatcgatgacatgtttgacaccatggaagatgccggtggcgttggtctagcagcaaaccaggtgggtgttttaaggcgcgtgttcgtgtttgatacctcccaccaggagggtggattgcgcggacatgtgatcaacccggtgtgggagcctctcactgaggacacccagactggcaaagagggctgtttgtccatccctgatgtctcggctgagaccacccgctatgaaacggttcggctgtctggccaggaccgcgacggcaatccagtggggtttgtggccaatggattgttggccaggtgcatccaacacgaaactgatcaccttgatggcgtgctgtttttgaagcgccttgatccagctgaacgtaaagcagccatgggcgttattcgcgcgtctgcatggtttaacaaa

SEQ ID NO: 1772 - DNA, 2064 bp, Corynebacterium glutamicum
atggcaaaaacccgcgtccccgctcctgaaaagtcggtggcgcgggttttacctcttttggggttacctcacctggatcgactgtttgattaccgcatcagcgaagaccaacacgatgatgtgcaacctggcgtgcgggtgcgcgtgcgttttggtggacgtttagttgatgccatcgtgatgtcacgcaccgcgcaaacctcgcacgagggaaagctgatgtggctggatcgggtgatttcgccgatcgtggtgtatccacctcaaacagcaaagctaattgagcaactcagtgatcgctatggcggggtacgttcggatctcatccgttcggcgctaccggcgcggcatgctggggcagaagaggcagatacctccacgtcgtgggagtcattgggtgaggttaaagaacccgatttatcgtcgtggtctgcgtatcagcatggtcaatcatttgttgacgccgtcttggcgggaacaactgcgcgggcgtcatggcagattgctcccggagatgattgggcgctggctttggcttctttggcggtcaaggttgtcaaagacggcggcggagcgcttctcgtagtgcctgatcagcgcgatctcgaccgcttggaagctgcgcttcgaggtttggttgcggcgaaacaaatcactgtgcttaattcaggtcttggtccgcaggcacgatatcggcgtttcctatcggtactcagtgggcagggacgactgattattggaaccagaagtgccgcttttgcacccgtgaaggatctgaaactggccgtcattttaaatgatggcgacgacaacctcgttgatcctagagcgccctatgcccacgccagggaagtgctgaccacgcgttccagtttggaagcaagctccttgattattgcgggacatgcgcggaccgcggaaacccaattgctggtggaatcgggatggatgcacaatctcatcgcaccgagggataccattcgcactaggatgccgcgtattcaggcagtgggcgattccgatttccagatggaacgcgatccaatggcccgatcagcgcggctgcctggcattgcgtttcatgcggtgcgcagcgccttagaacgtgatcaaccagcgcttatccaggtaccaaggaaaggctacgtgccaaccttggcgtgtggaaactgccgcaccccagcgcggtgccggcactgtaatgggcctgtgggacttccccagggaagctctgatctagcgggagtgcccacttgccgatggtgcggacgccctgattcgcggtttaagtgccaaaactgcggctctccaaaactgcgtgctgtggtgctgggaacggaacgcacagcagaagaactgggccgcgcgttcccgtctgtgcgggtaattacctctggtggcaacaaggtggtggattcggtggaaaaccgagccagcattgtggtgtccacgccaggtgcagaaccttttgtggccaactcgccggagagaccagagaaatcggagaaaccagagcacaagggcgcttacggtgccttgttattgctggatacctgggcgttgatgggtcggcaagatctgcgcgccatggaggacgcgctgcacaagtgggcagcggcggccacgctggtgcattctcatctgcaccagggtcaagtcatcgtggttgcagatccatcgtttcctgctgtgcaatcgttgattcggtgggatatggcaggtgctgcagcgcaagagttggctagccgacgcgaggttatgttcccgccttctgtacacatggcagcaatcgatggggctaccgctgcattggaaagtttcttggatttggcggagcttcccgatcatgctgaagtcctcggccctgttgatctgccaccgggtgtgagtttgcctggtgaatatgatgagcagcgctttggtccgccgcagcgccttctcatcagaactccattgggaccgcggtctgagttgggtagagcgctgcgctcagcccaggtggcgcgtgcggtgaggaagaatgatttgccgttgcgtattcagatggatccgattcacatcgga

SEQ ID NO: 1773 - DNA, 1221 bp, Corynebacterium glutamicum
gtggctcagccaaccgccgtccgtttgttcaccagtgaatctgtaactgagggacatccagacaaaatatgtgatgctatttccgataccattttggacgcgctgctcgaaaaagatccgcagtcgcgcgtcgcagtggaaactgtggtcaccaccggaatcgtccatgttgttggcgaggtccgtaccagcgcttacgtagagatccctcaattagtccgcaacaagctcatcgaaatcggattcaactcctctgaggttggattcgacggacgcacctgtggcgtctcagtatccatcggtgagcagtcccaggaaatcgctgacggcgtggataactccgacgaagcccgcaccaacggcgacgttgaagaagacgaccgcgcaggtgctggcgaccagggcctgatgttcggctacgccaccaacgaaaccgaagagtacatgcctcttcctatcgcgttggcgcaccgactgtcacgtcgtctgacccaggttcgtaaagagggcatcgttcctcacctgcgtccagacggaaaaacccaggtcaccttcgcatacgatgcgcaagaccgccctagccacctggataccgttgtcatctccacccagcacgacccagaagttgaccgtgcatggttggaaacccaactgcgcgaacacgtcattgattgggtaatcaaagacgcaggcattgaggatctggcaaccggtgagatcaccgtgttgatcaacccttcaggttccttcattctgggtggccccatgggtgatgcgggtctgaccggccgcaagatcatcgtggatacctacggtggcatggctcgccatggtggtggagcattctccggtaaggatccaagcaaggtggaccgctctgctgcatacgccatgcgttgggtagcaaagaacatcgtggcagcaggccttgctgatcgcgctgaagttcaggttgcatacgccattggacgcgcaaagccagtcggactttacgttgaaacctttgacaccaacaaggaaggcctgagcgacgagcagattcaggctgccgtgttggaggtctttgacctgcgtccagcagcaattatccgtgagcttgatctgcttcgtccgatctacgctgacactgctgcctacggccactttggtcgcactgatttggaccttccttgggaggctatcgaccgcgttgatgaacttcgcgcagccctcaagttggcc

SEQ ID NO: 1774 - DNA, 1260 bp, Corynebacterium glutamicum
atgactcatgtttcaagcccctccgcaccccgcaacgtggttgttggtgttgccggcggaatcgcagcgtacaaggcgtgtcacatcgtgcgcgcgtttaaagaagcgggcgataatgtgcgggtggttcctacggaatccgcgttgaagtttgtggggaaggcgacgtttgaagcgttgtctggcaatccggtgtctacaacggtgtttgatgcggtggattcggtgcagcatgtgaaagttggccaggaggctgatttgatcgtgattgcgccggcgacagccgatttgatggcgcgtgtggtggcaggtcgcggtgacgatctgttggcggcgacgctgctggtggcaacgtgccccgtggttattgcgccggccatgcatacggagatgtggtttaatccggctaccgtagccaatgtggcaacgctgaggcagcgggggattaccgtgattgagcctgcgcatggtcgactcaccggtaaagatacaggccctggccggctgccggatccagagcagattgttgatttagccaatgcggtgcacgccggggcgaggttgcctcaggatttggcgggcaagaaagtgctgatcactgctggtggcacgcatgagcatattgatcctgtgcgctttattggcaatagttcctcgggccgtcaaggttttgcgttgggtgaaatcgcagcacagcgaggtgctcatgtcagcatcgtggcgggaaatgctgcggagctgcccactccggcaggcgcagagatcgtgccggtggtgtccacacaagacatgtttgatgcagtccaggaacgagctggccaatctgatttcatcgtcatggcggcagcggtagctgatttcacgcccgcatcgcaggcgacatcgaagttgaagaagggctcagattctgatgaagacgcattgagcaccatctcgttggtggaaaacccggatattttggctaccacggtgaagcgtcgtgaagcaggagagctggacagtaatcctgtcatcgtgggttttgctgcggaaactggagacgagcacaccaccgccttggagtatgcgcgcaagaaactgcagaagaagggctgcgacctcctcatgtgtaatgaggtgggcatgggcaaagtgtttgggcaaaagcacaatgagggctggattttggatgctcacggtggggtagtcgatgtggagcacggcagcaaaatcgaggttgctgcgcaaatttgggacgcggcactggcgtatcgcgaagtc

SEQ ID NO: 1775 - DNA, 291 bp, Corynebacterium glutamicum
gtgtcagtgaccaacgtgagcaacgagaccaacgccaccaaggccgtcttcgatccgccagtgggcattaccgctcctccgatcgatgaactgctggataaggtcacttccaagtacgccctcgtgatcttcgcagccaagcgtgcgcgccagatcaacagcttctaccatcaggcagatgagggagtattcgagttcatcggaccattggttactccgcagccaggcgaaaagccactttctattgctctgcgtgagatcaatgcaggtctgttggaccacgaggaaggt

SEQ ID NO: 1776 - DNA, 627 bp, Corynebacterium glutamicum
gtgaccgtcagcgtcgcgcacttctcgagcgtttcggcttcgaggattaattcttcagtgtcgggcgataaccaactaggacggctcgtaattcttgcgggcccctcagcggtcggtaaatcgactgtggttgatcgcctccgcaatgacgttccaaacctgtatttcagtgtgtcgatgaccactagggcacctcgtcctggtgaagtcgatggacgtgactacttctatgtcactgcacaggaatttcaggacaaaatcgactgtggagagatgcttgaatgggcagatatccacggcggtttgcagcgttcaggcactccagcaggtcccgtcaatgaggctcgccaaaatggtcggccagtattggttgaggttgatcttgcaggagcccgaaacatcgctagcttaattccagatgcagaaaccatcttccttgctccaccttcatgggaagttttggttgaacgcctcactggacgtggcaccgaaagcgaagacgttattgctcgcaggctcgagaccgcacgcgaagaattggctgctcagagcgaatttaagcacgtcattatcaatgatgatgtggatacagccgtcaaggctattgaggatgttctcctcggcgct

SEQ ID NO: 1777 - DNA, 318 bp, Corynebacterium glutamicum
gtggcccttccacagttgactgatgagcagcgcaaggcagcgcttgctaaggcagcagaggcacgcaaggcacgcgcagagctcaaagagaacctgaagcgcggcaacactaacctcagggaagttctggacaaggctgagtctgacgagatcatcggcaagaccaaggtctccgctctcctcgaggctctccctaaggttggcaaggtcaaggcaaaggagattatggacgagctgggcattgctcagacccgtcgtcttcgtggactgggtgaccgtcagcgtcgcgcacttctcgagcgtttcggcttcgaggat

SEQ ID NO: 1778 - DNA, 834 bp, Corynebacterium glutamicum
atgacattcggcgagaagcttctgaacgccgcctccacccgtggcaggctatgcgtgggcattgatccccacgaaagcctgctgacgtcctgggggctgccggtaaacgtagacggacttgcggagttctcccgcgcctgcgtggaggctttcgccgacaccgtggcattggtgaagcctcaggtggcgttctatgagcgtttcggttccgctggctttgccatcttggaagaaaccattcagacgctgcgtgagcgtggctgtttggtggtctctgacgccaaacgcggcgatattggctccaccatggctggctatgcctcagcgtggttagatccagcgtcaccgctgtctagcgacgctgtgacggtctctccctaccttggttttcattccttggacccagtgttcgaacttgccgagcaacacggcaggggagtgtttgtcttggccgcgacctcaaaccctgaggcccgcgaactccaggaccagcaaaacgctgacggcgtgagcatttcccagcagatcgtggatcaggcagcggcgcttaacgcgccttatatggcccagggcaaggctggcaacattggcgtcgtcatcggcgccaccttgtccaaaccaccacgcttatcgacgctcgggggcgccattttgatgcccggcgtcggcgcccagggcggcacggcaagcgacgttgatgagattgcgggagacatggctcatcttgcattcccaaatgtctctagaagtattttggcgacaggcccagatatcgctgaaatgaagaattctgtggcaaaaaatgctgcagactttcctggtttccccaggtca

SEQ ID NO: 1779 - DNA, 3339 bp, Corynebacterium glutamicum
atgccaaagcgttcagatattaaccacgtcctcgtcatcggttccggccccatcgtcattggccaggcatgtgaattcgactactccggcacccaggcttgccgcgtgctgaaggaagagggactgcgcgtcaccctcatcaactccaacccagcaacgatcatgaccgacccagaaatggctgaccacacctacgtggagccaatcgagccggaatacatcgacaagattttcgctaaggaaatcgagcagggccacccaatcgacgccgtcctggcaacccttggtggccagactgcacttaacgcagctatccagctggatcgcctcggcatcctggaaaagtacggcgttgaactcatcggtgcagacatcgatgccattgagcgcggcgaagatcgccagaagttcaaggatattgtcaccaccatcggtggcgaatccgcgcgttcccgcgtctgccacaacatggaagaagtccacgagactgtcgcagaactcggccttccagtagtcgtgcgtccatccttcactatgggtggcctgggctccggtcttgcatacaacaccgaagaccttgagcgcatcgctggtggcggacttgctgcatctcctgaagcaaacgtcttgatcgaagaatccatccttggttggaaggaattcgagctcgagctcatgcgcgataccgcagacaacgttgtggttatctgctccattgaaaacgtcgacgcactgggcgtgcacaccggcgactctgtcaccgtggcacctgccctgaccctgactgaccgtgaattccagaagatgcgcgatcagggtatcgccatcatccgcgaggtcggcgtggacaccggtggatgtaacatccagttcgccatcaacccagttgatggccgcatcatcaccattgagatgaacccacgtgtgtctcgttcctccgctctggcatccaaggcaacgggcttcccaattgccaagatggctgccaagctggctatcggatacaccctggatgagatcaccaacgacatcactggtgaaaccccagctgcgtttgagcccaccatcgactacgtcgtggtcaaggccccacgctttgctttcgagaagtttgtcggcgctgatgacactttgaccaccaccatgaagtccgtcggtgaggtcatgtccctgggccgcaactacattgcagcactgaacaaggcactgcgttccctggaaaccaagcagcagggtttctggaccaagcctgatgagttcttcgcaggggagcgcgctaccgataaggcagctgttctggaagatctcaagcgcccaaccgaaggccgcctctacgacgttgagctggcaatgcgccttggcgcaagcgtggaagaactctacgaagcatcttctattgatccttggttcctcgccgagcttgaagctctcgtgcagttccgccagaagctcgttgacgcaccattcctaaacgaagatctcctgcgcgaagcaaagttcatgggtctgtccgacctgcagatcgcagcccttcgcccagagttcgctggcgaagacggcgtacgcaccttgcgtctgtccctaggcatccgcccagtattcaagactgtggatacctgtgcagcagagtttgaagctaagactccgtaccactactccgcatacgagctggatccagcagctgagtctgaggtcgcaccacagactgagcgtgaaaaggtcctgatcttgggctccggtccaaaccgcatcggccagggcatcgagttcgactactcctgtgttcacgcagctcttgagctctcccgcgtcggctacgaaactgtcatggtcaactgcaacccagagaccgtgtccaccgactacgacaccgctgaccgcctgtacttcgagccactgaccttcgaagacgtcatggaggtctaccacgctgaggcgcagtccggcaccgtcgcaggtgttatcgtccagcttggtggccagactcctctgggcttggcagatcgtttgaagaaggctggcgtccctgtcattggtacctccccagaggcaatcgacatggctgaggaccgtggcgagttcggtgcactgctgaaccgcgagcagcttcctgctccagcattcggcaccgcaacctctttcgaagaggctcgcacagtagccgatgagatcagctacccagtgctggttcgcccttcctacgtcttgggtggccgtggcatggagattgtctacgatgaggcttccctcgaggattacatcaaccgcgcaactgagttgtcttctgaccacccagtgctggttgaccgcttcctagacaacgctattgagatcgacgtcgacgcactgtgcgacggcgacgaggtctacctggcaggcgtcatggagcacatcgaggaagccggcattcactccggtgactccgcatgtgcacttcctccaatgactttgggcgcacaggacatcgagaaggtccgcgaagcaaccaagaagctggctctgggcatcggtgtacagggcctgatgaacgtccagtacgcactcaaggacgacatcctctacgtcatcgaggcaaacccacgtgcatcccgcaccgtgccgttcgtctccaaggcaacgggcgtcaacctggccaaggcagcatcccgtatcgcagtgggcgccaccatcaaggatctccaagatgagggcatgattcctaccgagtacgacggcggctccttgccactggacgctccaatcgctgtgaaggaagcagtgttgccgttcaaccgcttccgtcgcccagatggaaagaccctggacaccctgctttccccagagatgaagtccactggcgaggtcatgggcttggccaacaacttcggcgctgcatatgcaaaggctgaagctggcgcgtttggtgcattgccaaccgaaggcaccgtcttcgtgaccgtggctaaccgcgacaagcgcaccctgatcctgccaatccagcgcctggcgttgatgggctacaagatcctcgccaccgaaggcaccgcaggcatgctgcgccgcaacggcattgagtgtgaagttgtgctcaaggcttccgacatccgcgaaggtgtagagggcaagtccatcgtggatcgtatccgcgaaggcgaagttgacctcatcctcaacaccccagctggttctgctggcgctcgccacgatggctacgatatccgcgcagcagcagtgaccgtgggtgttccgctgatcaccactgttcagggtgtcaccgcagctgtccagggcatagaggccctgcgtgagggcgttgtcagcgtccgcgcgctgcaggaactcgaccacgcagtcaaggct

SEQ ID NO: 1780 - DNA, 1179 bp, Corynebacterium glutamicum
gtgagtaaagacaccaccacctaccagggagtcaccgagatcggatccgttccggcatacctggttcttgcagacggacgtaccttcaccggatttggctttggagctatcggcaccacccttggtgaggcagtgttcactaccgccatgaccggttaccaagaaaccatgaccgatccttcctatcaccgccagattgttgtggctaccgcaccacagatcggcaacaccggctggaacgatgaggacaacgagtcccgcgacggcaagatttgggttgcaggccttgttatccgcgacctcgcagcacgtgtgtccaactggcgcgccaccacctccttgcagcaggaaatggcaggccagggcatcgtcggcatcggcggaatcgacacccgcgcactggttcgccacctgcgcaatgaaggttccattgcagcgggcatcttctccggcgctgacgcacagcgcccagttgaagaactcgtagagatcgtcaagaatcagccagcaatgaccggcgcaaacctctccgttgaggtctctgctgatgaaacctacgtcatcgaagctgaaggcgaagagcgccacaccgtcgtggcctacgacctgggcattaagcaaaacaccccacgtcgtttctctgcacgcggtgttcgcaccgtcatcgtgcctgctgaaaccccattcgaggatatcaagcagtacaacccatcaggcgtgttcatctccaacggccctggcgatcctgcagcagcagacgtcatggttgatatcgtccgcgaagttcttgaagccgacattccattctttggcatctgcttcggcaaccagattcttggccgcgcattcggcatggagacctacaagctgaagttcggccaccgcggcatcaacgttccagtgaagaaccacatcaccggcaagatcgacatcaccgcccagaaccacggcttcgcactcaagggtgaagcaggccaggaattcgagaccgatttcggcactgcaattgtcacccacacctgcctcaacgacggcgtcgttgaaggtattgcgctgaagtccggacgcgcatactccgttcagtaccacccagaggccgctgccggcccaaatgatgcaagccccctgtttgaccagtttgttgagctgatggatgcagacgctcagaagaaaggcgca

SEQ ID NO: 1781 - DNA, 1341 bp, Corynebacterium glutamicum
gtggttgacagcaacacccagtatccagaaaccggcgcactggcaccggctcctgcagactcactcctaatcagcaacgttttggtctacggcgaaggcgagccaacgaatgtgtttgttaaagatggtgtgatcgcagctatcggcggcactcatgaggctgaccgcaccatcgacggcaatgggggagttctccttccaggtttcgtggacatgcacgttcacctgcgtgagccaggccgcgaagacactgaaaccattgccactggttctgccgccgcagccaagggcggattcaccgcagtattcaccatggcgaacaccactccagtgatggatcagccggttatcgcggaatccgtatggttcaagggccaaaacattggcctgtgcgacgtgcatccagttggatccatcaccaagggtcttgagggcaaggagcttactgagttcggcatgatggctcgctctgaagccaaggtgcgcatgttctctgatgatggcaagtgcgtcgatgatcctcaggtcatgcgccgcgcgctggaatacgccaagggcatggacgttttgatcgcccagcacgctgaggatcaccgcctgactgagggcgcttcagcacacgagggtgaaaacgcagctcgtctgggtctgcgcggctggccacgtgtggctgaggaatccatcgtggtgcgcgatgccatcatggctcgtgactacggcaaccgcgtgcacatctgccacgcctccactgaaggcaccgtggagttgcttcgttgggctaagtcccagggcattccaatcaccgcggaagtcaccccgcaccacctcaccttgaccgatgagcgcctggaaacctacgacgcggtcaacaaagtcaatccgccactgcgcgaaagccgcgatgccgaagcgctcaagaaggcgcttctcgacggcaccatcgatgttgttgcaaccgaccacgctcctcacggttccgaagataagtgctgtgaattcgaaaacgccaagccaggcatgctcggattggaaacctcactgtccatcatcgtggacaccttcgttgccaccggacttgcagactggcgctttgttgcgcgcgtgatgagtgaacgcccagcagaaatcacccgtctaccaggccagggtcgcccaatcgcagaaggtgagccagcaaacctcgcgattgttgatccaggaaaaacctggacagcatccggtgcagactttgcgtccaaggctgaaaataccccatttgagggccaagaattcagtgccaaggtcacacacaccgtgcttcgtggcaaggtgacttgtgcagacggagttgcacaaaacgct

SEQ ID NO: 1782 - DNA, 936 bp, Corynebacterium glutamicum
atgaagcacctcctatccattagcgatctttccaaagatgagattgttggattgctggatgaagcggatcgctttaaggaggtgctcgaaggacgtgaagtaaagaagctgcccacgctgcgtggtcgcaccatttttaccttgttctatgagaactccacgcgcacccgttcgtcctttgaaaccgcaggaaagtggatgagcgccgatgtgattaacatttcggcctcatcatccagcgtgaagaagggcgagtcgctgaaagataccggcttgactttgtcggcaatcggcgcggatgcgatcatcatgcgccacccagcctcaggcgccgcgcagcagcttgcgcagttcgtcgcaccaggtggcaacggccccagcgtgatcaacgcgggtgacggttcgcaccagcaccccacccaggcgcttctcgacgctttaaccatccggcagcgcaccggccgcattgagggactcaaagttgtcatcgtgggcgactgtttgcactcccgggtggtgcgctccaatgtggatctgctgtccactttgggcgcagaggtagtgctggttgctcctccgacactgcttcctattggtgtggagaactggccagtccgattctcctacgacatggacgcagaaattgccgacgccgacgtagtgatgatgctgcgcgttcagcaagaacgcatgcagggtggtttcttcccctcacaccgtgagtacgcaacgctgtacggcatgtccaaagagcgcgaagctcgcctcaaggactccgccatcatcatgcaccccggccccatgcttcgtggcatggaaattaacttccaggtggcagacgcaccacgcaccgcggtactgcagcaggtaagcaacggtgtgcacatgcgcatggccattttgttcgccctggtcgcaggctctgacgcgactatc

SEQ ID NO: 1783 - DNA, 576 bp, Corynebacterium glutamicum
atgagcgaacgtaatagtgctgtactagaactccttaatgaggacgacgtcagccgtaccatcgcacgcatcgcgcaccagattattgagaaaaccgcgcttgattccaaagacgcggatcgggtcatgttgttaggtattccctcaggtggagtcccattggcccgtaggctcgctgaaaagatcgaagaattttccggcgtttcggtagataccggcgctgttgatatcaccttgtacagggatgatcttcgaaacaaaccacaccgcgcactgcagcccacctctattccagcaggtggtatcgataacaccaccgtgattttggtggatgatgtgctgttttccggtcgtaccatccgcgctgcacttgatgctttgcgcgacgttggacgccccaactacatccagttagctgtgttggttgaccgcggtcatcgccagctgcccattcgcgctgactatgtgggcaaaaatctccccaccgcacgcgcggaagacgtttccgtcatgcttacagaaatcgacggccgcgatgcagtcacgctcacccgagaagactctgaaggggattcc

SEQ ID NO: 1784 - DNA, 1164 bp, Corynebacterium glutamicum
atgttcgcctatcgccaaactcagctcatcgaagacctaaaattcttaagtagaacaagcacgcttttcgacggctcccccctcaccgtagccatcaccggctccagggggctcgtcggccgcgcgctgacagcgcagctgcaaaccggcggccacgaagtcatccaactcgtgcgcaaagaacccaaacctggccaacgtttctgggatccactcaacccagcatccgatctcctcgacggcgcggatgttttggttcaccttgccggcgaaccgatcttcgggcgattcaacgactcccacaaagaagccatccgcgagtcccgcgtacttcccaccaaattcctcgcagaattagttgccgaatccacccagtgcaccaccatgatttccgcctctgcagttggattctatggtcacgaccgcggcgacgagatcctgaccgaagaatccgaatccggcgatgatttcctcgccgaggtctgtagggattgggaacacgccactgctcctgcctcagatgcaggaaagcgcgtagccttcattcgcaccggcgtggccctcagtggacgcggtggcatgcttcccctgctgaaaaccctgttctccaccggactaggcggaaaattcggcgatggcacctcctggttcagctggatcgccatcgatgacctcaccgacatctactaccgcgccatcgtggacgcccagatctccggccccatcaacgcggtagcccccaatccagtctccaatgcggacatgaccaagattctggccaccagcatgcaccgtcccgcattcatccaaattccttccctcggccccaaaattctgctcggaagccaaggcgctgaagagctagccctggcgtcccaacgcaccgccccagcagcactggaaaacctcagccacaccttccgctacaccgacatcggggccgccatcgcacacgaacttggctacgaacaactcgcagatttcgcccaacagcaagaaatcgaagccgaacgcaaacaggaacgagccgaactcaaagccgccaagaagatcgccaagaaagccccagtcctagaggaatcccccaccaacctggaagatcccgaagaagtagagcaaagtatcctttcatcaatcctcaatttccgccgtaagcgcaacgac

SEQ ID NO: 1785 - DNA, 477 bp, Corynebacterium glutamicum
gtgcctcaatcacccacagcacacgaccccaacgacatccaggaatttaacctcgatgccgttgcagggattctccaggacgaaaaactggactaccgcatcgatgaacacgacggcgaaaaagtaatccgcaccggattcatcaacgccgccatcagcttcatcctcttagacggcagcttaaccatggaagccatgtggcgaggagccccctccaccgatgctgccgcacaagttctcgcggccaccaacgaatggaacctcacccagttcgcacccaccattcgattcttcgaactcaacgaaggcaccctcgccatcaatgcactgcgacacgtcgttgtttccgcaggcatgagccacaaccaagtcggctcctacgttatgagctccatcgaatccgctgttcagtgcttcgaatggcttgagcagcaattcccagatctagtcacctggaaggacgaacaccatgaccac

SEQ ID NO: 1786 - DNA, 462 bp, Corynebacterium glutamicum
atgaccactgattccaattctgcgacaatcccaaccccaaagccgattccagtgaccatcgaccgaatctccctcatcatgaaagaattcggcattgacctatccatcgccgatgaacaaggcaccggatcccaagtagccagcgccaacctcaacggccatcacgtcatgttcgctgtcatcggttcagtcctgatcgttcgtgccgatcgcgccaccgaaatgccagtctccgacggcaaccccgcatggcatctcgcctgcaaccaagtcaactgtttcaacttcgctgccaaggctgtcgtagttgatcgcaccgacaacatcgtgatccgcgccgagaaggatgtccccatcgccgctgggctcaacgatattcagctttccgcaatgctgaaaaacgccatcgatcacgtcctcgcgattcaagatgccgtagccaatgcaggcaaggaaatcggc

SEQ ID NO: 1787 - DNA, 210 bp, Corynebacterium glutamicum
atgcaggcaaggaaatcggctaacatgtcggacgagtccatcgaagagcaggaaaaagaactcgcggcgctgaaggctcaaatcgatgaactggaaaagaaagacaagcagaacaagctaatcatcgagattttgtccaaggccgtcgaaaagaatgtggcagaggcagaagcgaaaagagcccgcaaatatccgcccaatcccctgtgg

SEQ ID NO: 1788 - DNA, 681 bp, Corynebacterium glutamicum
gtgagcgagcgtcgacaagattacaagcgacacggatcccgctacaaggcgcgcatgcgtgccgtagacatcctatttgaagcggaatcccgcgatgttgatcccgtggccatcatcgatgaccgccacaagttggcgcgcgataccaaccccatcgttgcaccggtagcggaatacaccgaaaccatcatcaatggcgttgccgttgaactcgataccctcgatgtcttcctcgcggaacacatcgcagaaacctggactctcggacgactcccatccgtcgaccgcgcaatcctgcgcgtcgcttcctgggaaatgatctacaacgccgacgttcctgtcaccaccgcaatcgttgaagccgtggaaattgcctccgaatactccggagacaaatccagtgcctacatcaacgcgacacttgacgccatggcatcaaaggtggagaccctccgcgagcgcgccgccaacccagaagcagttctggcggaagcttccgaatctctcgatgatgctccggtcgcgccgtgggatgactcggatgctttggatgactcggatgaagattttgaggctgtagatgctgctgaggtttttgaggctgaagagactgtagaggtttccgaagtcgcagaagactctgaagtttcaaaggtttcagaagaaaaggctgacgagagc

SEQ ID NO: 1789 - DNA, 561 bp, Corynebacterium glutamicum
gtggcaactaccgctgatttcaagaacggtctagttctcaagaacgaaggcaagctgcagcagatcatcgagttccagcacgtcaagccaggcaagggcccagcattcgtgcgaaccaaactcaaggacgtcgtgaccggcaagaccatcgacaagacctggaacgcaggcgtcaaggttgaaaccgcaaccgtcgaccgccgcgatgtcacctatttgtacaacgacggcacttccttcatcgtcatggatgacaagactttcgagcagtacgagctgtccccagacgcattcggcgacgctggccgcttcctacttgaaaacatgcgcgttcaggtctccttccacgaaggcgaggcactcttcggcgaactcccagtatctgtcgacctccgcgtcgagcacaccgatccaggcctgcagggcgaccgctccaccggcggcaccaagccagcaaccctcgagaccggcgctgaaatccaggtcccactgttcatcgagaccggaaacgtactcaaggtagacacccgcgacggttcctacctctcccgcgttaacaac

SEQ ID NO: 1790 - DNA, 1089 bp, Corynebacterium glutamicum
atggctttggctgatacccgatttgccactcgtcgtcgcgcacttgccgcaaaactggcagctcaacggatcgactcaattttggtgacaagcccgatccatgttcgctatctcagcggattcaccggctccaacggcgcactgatcgtgaacaaagatctctccgcgcagatctgcaccgacggtcgctacaccacccagatcgcagaagaagtcccggacatcgaggcgctgattgagcgtgcctcggcaacgacgctgctagcgcaggtcgaagggccgcgtcgtatagcaatcgaagccgcacaaaccaccctggaccagctagacagcctgcgtgaagcaacccaggaagacgtcgagctgatccccgtgtcaggtgttgtggaatccattcgcctgaccaaagacagcttcgaactcgaccgcctccgcgatgtcgcagcgctggcttcccaagcattcgaagatttactcgcagcaggagaactcgccgaaggccgatcagagcgccaagtcgccgccgatctggaataccgcatgcgcctgttgggagcagaacgccccagcttcgacaccatcgtggcctctggacctaactccgcgaaaccacaccacggcgcaggcgaccgcatcctccagcgcggcgatctagtcaccatcgatttcggcgcacacgcacgcggattcaactccgatatgacccgcaccctcgttatgggcgaagcaggggagttcgaagcagaaatctacgacatcgtcctgcgctcccaactcgctggtgttgaagcagcctactcaggcgccaacctcttcgacatcgacgcagcatgccgcaaaatcatcgaagacgcaggctacggcgaatacttcgtgcactccaccggccacggcatcggacttgaagtccacgaagccccaagcgcatccaaaacctcacaaggagtcctagaaaccggctccacactgaccatcgaacccggaatttacgtccccggaaagggcggcgtacgcatcgaagacaccctgattattacctcaggagcaccggaaatcatcaccaaggtgagtaaggacctcatcgtggtg

SEQ ID NO: 1791 - DNA, 1095 bp, Corynebacterium glutamicum
atgagcgcagtgcagattttcaacaccgtccacgtcaatggatcttccccctatgatgtccacattggttccggcctcaacgagctcattgttcagcgcgcagcggaatcaggcgcggagcaggtagcgattttgcaccagcccagcatggatgacattgcatccgagttggatgcagcactagtcgctgctggtttgaaggtcctgcaccttaatgttcccgatgcggaaaacggcaagtccttggaagtagcggggcagtgctgggatgaattgggtggcgcagcattcggccgccgcgatatcgtcatcggacttggtggcggtgctgccacagatctcgcgggattcgtcgctgctgcatggatgcgtggcgtgcgcgtcattcaggttccaaccaccttgttggccatggtggacgctgcggtgggcggcaagactggcatcaataccgccgcaggcaagaaccttgtgggcgcgttccacgagcctgacgcagtattcattgacaccgatcgcctagccaccctgcctgacgcggaaatcatcgcgggatccgccgaaatcatcaaaactggtttcatcgccgacccagaaatcctgcgcctttacgaaactgatcccgcagcctgcctgaagaaagaagtcgaaggctcccacctacctgaactgatttggcgctccgtcaccgtcaagggctccgtggtcggccaagacctcaaagaatctagcctgcgcgaaatcctcaactacggacacacctttgcccacgccgtcgaactccgcgaaaacttccgctggcgccacggcaatgccgttgcagtgggcatgatgttcatcgccaacctctcccacaagctcgggcttatcgacgcgcccctcctcgagcgccaccgctcaatcctggcggccatcggtctgcccacttcctacgaaggcggagccttcgacgagctttacgacggtatgacccgcgacaagaaaaaccgcgacggcaacatccgcttcgtcgcactgaccgccgtgggcgaggttacccgcattgaggggccctcaaaacaagatttacagagtgcttatgaggcaatcagccac

SEQ ID NO: 1792 - DNA, 492 bp, Corynebacterium glutamicum
gtggttcttgtgggtttgccaggagctggaaaatccaccattggacgtcgattagcgcgcgccttaaacactgaactcgtcgactccgacgaactgattgagcgcgccaccggaaaagcctgtggcgccgtgttcagcgagctcggcgagccagccttccgcgagctcgaggccatccacgtggccgaagcactgaaatcctccggagtggtgagcttgggaggcggatctgtgctgacagaatccacccgtgaactgctcaaaggccaggacgtggtctggatcgacgtgccagtagaagaaggcatcaggcgcaccgcaaacgagcgttcccgccccgtgctgcaagccgccgaccccgccgagcactaccgcaacctggtgaaagtgcgcaccccgttgtacgaagaggtggcaacctaccgacttcgcaccaacaaccgcagcccccagcaagtggtggcagcagtgttgcatcatctagaaatcgat

SEQ ID NO: 1793 - DNA, 411 bp, Corynebacterium glutamicum
atggggatttttctagttgggttgtggtgcgcagtcttggctgtcatcgatataaaataccggcgcctgcccgatgtgctcacccttcctggtgcactgttaattaatttatgggcattgactatttatccacagtggatgctcggcgggcttgtgtgggcggggatttatttcctcacggcagtgctggtgggaggaattggtgggggagatatcaagttggctctcggtttggggacagccgtagcagccttgggaatgcaggctctcatggtggcaattgtgggatcatcgttaatttctgtcttactgggtggaatttttgcggctgttaaaggggtgaaaaggcccaaatttattccacatggtccaagtatggttatcgctagtgcctgcagttatgtcgctttt

SEQ ID NO: 1794 - DNA, 303 bp, Corynebacterium glutamicum
atggagcatcaacctcatctcctgaagctcgccgatgagtgggcgccaacattcaaaatgctcggcgatcgcacgcgcctccgcctcctcatcgcgctgcattatcacggccccggtgaagccaccgtctcagaactcgcggacatcgtcggcgtcaccctgcccacggcctccgcagcgctccaactgctcgcagataacggagtggtcgagtccttcaaggaggggcgggtgacaagatataagcttgtcgacgccacgacccacaccttgcttcaccacctcgggggcacccaccgacat

SEQ ID NO: 1795 - DNA, 1074 bp, Corynebacterium glutamicum
atgcttctttccgcccgcacacacacgagtttccaagaacttggactcaatgctagtcggcgcaaagcaatcaactggacactggcactcactgtggtgctaattgcctccatgtttgttggcgtgctcatcggtgcatccgggacctcagtgttttccacgtggaccgtaattagccaccatctttttggcactgagctaggtggctccgacactgccgacgccatcatttggtacatccgcaccccacgcgtcttgctcgctgccattgtgggcgcaggccttgccctggcaggtgccatcatgcaagtactggtccgaaacatgctggcagacccctatatcctcggggtgaactcaggtgccagttgcggtgcggccgctgccttactgttcggagtgggcgctggatttggcgattacgccctccaaggcagcgcgtttctcggcgcaatggcagcttccggattgatcttcttcgtggcgcgcgcagcggggcgcatctcctcgacccgcttgttgatgtccggcgtagcgatcggatacatgctctctgcggcaacaagctttctcatcttctcctccgactccgccgaaggcagccgctccgtgttgttctggctgcttggatccttaggacttgccgcatggaatgggccgatggcgatcatcttcctcatcgtgggcattgccctggcgttgctcatggtgttgggtccgcaattggatgccttaaactccggcgatgaaaccgcacttaccttgggagtatcccctgatcgcctccgcattctcctcctggtgatcacctgcctgctggtgggatccatggttgccatggccggcagcatcggattcatcggccttgtcatcccccacctggccaggcgttttgttagtggaaaacaccgactcatgctgcctgtatccgcgttgatgggcgcaattttgctcatctgggctgatatcgccgcccgcaccctgcttgcgccccaagagattcccatcggcatcatcaccgcactcatcggagcacccttcctcctgattctggttcgccggatgcacacctac

SEQ ID NO: 1796 - DNA, 606 bp, Corynebacterium glutamicum
atgagtgcggtgatgatgccgatgggaatctcttggggcgcaagcagggtgcgggcggcgatatcagcccagatgagcaaaattgcgcccatcaacgcggatacaggcagcatgagtcggtgttttccactaacaaaacgcctggccaggtgggggatgacaaggccgatgaatccgatgctgccggccatggcaaccatggatcccaccagcaggcaggtgatcaccaggaggagaatgcggaggcgatcaggggatactcccaaggtaagtgcggtttcatcgccggagtttaaggcatccaattgcggacccaacaccatgagcaacgccagggcaatgcccacgatgaggaagatgatcgccatcggcccattccatgcggcaagtcctaaggatccaagcagccagaacaacacggagcggctgccttcggcggagtcggaggagaagatgagaaagcttgttgccgcagagagcatgtatccgatcgctacgccggacatcaacaagcgggtcgaggagatgcgccccgctgcgcgcgccacgaagaagatcaatccggaagctgccattgcgccgagaaacgcgctgccttggagggcg

SEQ ID NO: 1797 - DNA, 957 bp, Corynebacterium glutamicum
atgcgtaaattagcccttcccctggttgccttcctgacaggaggtttagctgcatgctcctctagtgatgtggtggaaagtcaagggataaccgttgaaaactgtggctcggtggtgaattttgatagtccaccatcacacatcgccttgatgaaaagcgccgccgtacccacgcttgatgctttaggtgttttggatcgcgtggtgaccaaagctggtgccttcccagctgggtattacgacgccgatttatcggaaagagtcacggacatcccaacgctgtccaacaagatcgacgccagcggacacgtgttgatctcgaaagaagtcgttgttgccgccaacccagacattgttttcggcgaaactgacaccatcaaccgcgcatccatggcatcctcgaacatcccggtcgtggaggaaccagcattctgtggcagcatcgacggcgacgtgagttttgatgatgtctggtcacaaatctccacctatggcaccatttttgatcgctcgacagaagcagacgcatacattgcaacgttgaaggaacgtgtttctgaagtatcctcgcgggttactgactccggaaaaactgtggcggtgctctaccccaccatcggcggcggagtcacctacgcatacggccgcggatccatggccaacccacttgttgccgaagcaggcctgaccaacgttttcgcagaccaatccgaacgcgtctttgaggtcacggcagaagaactgatctcccgaaaccccgactacatcatcgttttacacagcgacggttccccttcagacatcgtcgcagaggtgggcaatctccaagggtccagcgcactcactgctctgagtgagaacaaagtgctgcccatactcatgaactttgccgaacccccaaccccgctggccgtcgatggcctagaaaaaatcatcgactttgtggaaacccaccca

SEQ ID NO: 1798 - DNA, 753 bp, Corynebacterium glutamicum
atgatcgaggccacacacctacgccacagttttggcgacaacatcgtcatcgatgacgtcaccctccatctacctgcacacggcaccgtcagcttggtcggccccaacggcagtggcaaaaccaccctgctgcgtgcactatacggagcactgcaaccaaatgaagggcacatccacgtagatggcgttccactaataagcttgcaccgcaaagacatcgcaaaaaccatggccgtagtcatccaagaacatgactccgacctccccatgaccgtcgctgacctggtcttactaggcagactcccccaccaaaagatgtttgccggcaactctcaagctgatcagttactcgttaaggaagcactcacccgagtcggcgccattcacctggccgaccgacaattcggcgcactttcaggcggtgaacgccaacgcgtcctcatcgcacgagcactcgtacaaaacgccacacacatcctgctcgacgaacccaccaaccacctcgacatccgctaccagcacgaagtcctccacctcgtccgcgaactcagctcaagttccatcatcgtcctccacgacctcaacctcgcagctgcctacagcgaccacatcatcctccttgaccaaggacgtgtggttactcaaggaacgccctcagaggtattgaccccagagcatttggaacctgtgtatggcgttcgtgttgagcgctttgacctaggcgatgaagtccaccttcggttcaagcgtcac

SEQ ID NO: 1799 - DNA, 828 bp, Corynebacterium glutamicum
ttgggttctcacatcactcaccgggcggccgtactcggctcacccatcgagcattccaaatccccagtcctccacaacaccggctataaagccctcggactggaccaatgggaatacgaccgctttgagtgcaccggcgacatgctccccggcatcgtctccggcgctgatgaaacctactgcggattctccgtcaccatgccgtctaaattcgcagctcttgaattcgccgacgaagtaaccgaacgcgcctgcgccatcggctccgcaaacaccttgctgcgcacggccaccggatggcgcgccgacaacaccgacgtcgacggcatcaggggagctctcggtgaactcctcggcggcgcatcactggccggcaaacacgccatcgtcatcggctccggcggcaccgcacgccccgccatctgggcactcatcgaagccggggtcgcccggatcacggtgctcaaccgctccgatcgcaccgccgaactgcaaacgcttttcgacgaaacccccaccaccttggcctacgccccgctcgagcatctccacatcgaagccgacgtcgtagtctctacagtgccctccgcagcaatcgcaggcctcgaagacacccttgcgatcgccccagtcctcgacgtcatctacgacccctggccaacaccactcgtagaagtcacacgagccaaaggcctcaaagctgtcggaggccacgtcatgctggcacaccagtcctacggacagtttgaacaattcaccggaatggatgcaccccgcgatgccatgcgtgaggctttggaagagtctttaggcatctcagaagaacac

SEQ ID NO: 1800 - DNA, 1167 bp, Corynebacterium glutamicum
atgaaccaaatccgaaaccgccggatggagcccgtctacgtaaagcgccgccaacggtttattgccgtgacgatcgcttcactcatcctcattatcggtgccatcatctatatcggtgtagccacctcaaaccggacgccacatgactatgaaggctccggaaacggtgtggttcagctggtcgaaatccctgaaggttcctccatatcagagctcggcccagagttggaagaacgagatatcgtggccaccaactcagcgttccaaacagcggccagcaacaaccccaacgcgggtagtgtacagccaggtttctaccgtctgcaggaacaaatgaacgcagcagctgcagtgtcggctctgcttgatccagacaaccaggttgatctcctcgacattcacggcggcgccaccttgatggacgtcactgttgtcggcggaaacacccgcgcgggaatctactcccagatcgcagccgtgacctgcaccgaaggctccgccaactgcatcaccgctgaggatttgcagcaggttgcctccaccgtgtcgcctgcagaattgggtgtcccagattgggcaatcgctgctgtggaagctcgcggaactgatccaaagcgcctcgaaggcctgatcatgcctggccaatacgtggtggatccatccaacgacgcccagggaatcctcaccgatctgatcacgcgatcagcaaaccatttccaagaaaccgacatcacgggccgtgcagatgccatcggacttactccatatgagctgctcaccgcagcatctctaatcgagcgcgaagcaccagcaggagattttgataaggtcgcccgcgtcatcttgaaccgtctcgccgagccaatgcagctgcaattcgactccaccgtcaactacggtctgtctgaacaagaagtagcaaccaccgacgaagaccgtcagaccgtcaccccatggaacacttacgccatggacggcctgccacaaacccccatcgccgcagtatccaccgaagcactccaagccatggaaaaccctgcagaaggaaactggctgtactttgtcaccatcgacaccgatggaaccaccgtgttcaacgacaccttcgaagagcacgaagccgacattgagcaagctttgaacagtggcgttctagacagcaaccga

SEQ ID NO: 1801 - DNA, 546 bp, Corynebacterium glutamicum
atgaaggtttccgccgatacacccggtcacgatgatccaggcccaggccggcgccttggcttagatgtcggcaccgtgcgcatcggagtggcagcctctgaccgcgatgccaagcttgccatgcctgtggaaaccgttccgcgggaaactggattcaaagggccagacctggccgatattgatcggttggtcgccatcgttgaggaatacaacgccgtggaagtcattgttggtctacccacagatctgcagggaaatggctccgccagtgtgaagcatgcaaaggaaattgctttccgcgtccgtcggcgcctcaccaatgctggaaagaacattccggtacggcttggcgacgaacgcctcaccaccgtcgtggccacccaagccttgcgggcctcaggagtcagcgaaaaagcgggacgtaaagttattgatcaagctgccgcagtagaaatccttcaaacctggttggatgctcgcacccgagcccttgaaccacaatccacagacacccaagatttcgacgagaagggaaatttcccagga

SEQ ID NO: 1802 - DNA, 2664 bp, Corynebacterium glutamicum
gtgcagacccatgagatcagggagcgttttaccaatcacttcgtcaatgccggtcaccaggcggtacctagcgcgtcactgattctcgacgaccctaacctgctgttcgttaacgcaggcatggttccattcaagccgtacttcctgggccagcagaccccaccttttgaaaacggcactgcgacttccattcagaagtgtgttcgtaccctggatatcgaagaagtgggtatcaccactcgccacaataccttcttccagatggcaggtaacttctccttcggccagtacttcaaagaaggcgcaattacccacgcatggggccttctgactggttccgtagcagacggaggctttggccttgatccagagcgcctctgggtcactgtgtacctcgatgatgacgaggctgcagagatctgggaaaagaagatcggcgtcccatcagagcgcatccagcgcctgggtatggctgacaactactggtccatgggtgtaccaggaccttgtggcccttgctccgagatctactacgaccgcggcgagaagtacggcaaggaaggcggccctgtcgctgacgacaaccgctacatggagatctggaacctggtcttcatggagaaggaacgcggacagggtattggcaaggacaacttcgacatccttggcgatcttccaaagaagaacatcgataccggcatgggcgtcgagcgcgttgcctgcatcctccaggatgttgaaaacgtctacgaaaccgacctgctgcgcccagtcatcgacgttgcagagaccctgaccggaaccaagtatggttctgacaacacctctgacattcgcttccgcgttatcgccgaccactctcgtaccggcatgatgctcatcctcgatggtgttaccccaggcaacgaaggccgtggatacatcctgcgccgcctgcttcgccgcattatccgttccgcacgtctgctcggtgctactggtgagaccatggagcagttcatgaacaccatcatggacaccatgaccccgtcctacccagaaatcgccgacaaccgtgagcgcatcatgcgtgtggctgtcaccgaagagcgcgctttcttgaagactctggtctctggaacccacctcttcgaagaggctgcaacctccatcaaggctgcaggatccaccaaggttgccggtgctcaggcattcgcactgcacgacacctacggtttccccatcgacctcaccctcgaaatggctgcagaagcaggccttgaggttgacgttgaaggctttgattccctcatggcagagcagcgctcccgtgcaaaggctgacagccaggcaaagaagcacggccacaccgacttgagcatctaccgcgaatgggtcgacaacaacccaaccgtattcaccggctttgaggaactggattcccagtccaaggtcctcggactactttccgatggtgccaagatttctgaagccacagaaggtcaagaagttgaggtcatcctcgaccagtcacctctgtacgcagaatcaggtggacagctcggcgatcgtggtcagatcctgctcggagacaccgtgcttgatgtccatgacgtgcagaagatcggtaagaaactgtgggttcacaaggcactcgtggcaaacggtggacttgcggtaggtgatgaagtggtggcaagcgtcgataagcaatggcgccatgctgcacgccaggcacacaccgcaacccacctgattcatgccgctctgcggcaggttcttggaccaactgccctccaggcaggatccatgaacaagccaggctacctgcgcttcgacttcaactacaccgagcagctcaccccagcacaagtcgagcaaatccaggcgatcaccaacgaagccgtggacaccgactgggctgtcaacaccgtggaaacctcactcgaggaagccaaggcaatgggtgcgatggcgctcttcggcgaaaactacggaagcaccgtgcgcgttgtggaaatcggcggacctttctccatggaactctgtggcggtacgcacgttgcgcactcctcacagatcggcccagtggcactgttgggtgaatcatccatcggctccggcgtgcgccgcatcgaggcctactccggcctgaactccttcaactacctgtccaaggaacgcgcactcgccgagggtttggcaagctccctgaaggctccatccgaggaacttccagagcgcgtcgcacagctggtagacaagctgaaggcagcagagaaggaaatcgaagccctgcaccgtcagcagctcatggcacaaaccgcagacctgttgaacaacgctcaagagatcggtggcgtcaccaccttgctgctgcgcgtcaaggacaacaccaacgccggtgacctgcgcaccatcgcaaccaccctgaaggacaagctcggcgaccgcgaaggcgtcttggttattgcctccgacaacgccggcaaggttccattcgtggtagctgcaaccaaggccgctgtggctcgcggagctcactccggcaacctggttaagctcgttggttcctacatcgacggtcgcggtggcggcaaggctgacctcgcacaaggatccggcgccaacattgctggcctggaatccgcattcggcgcagtccgcgctgagatcgaggcactc

SEQ ID NO: 1803 - DNA, 1377 bp, Corynebacterium glutamicum
atggcccaggattcactttttgaaacgcccgaaacaccgggatccgcaggcaacacaagcagcgtgagcaattccaaagccgcctcgaagtattttcacccaggcggacacgcaccccttgctgcccgcatgaggccaaggacgcttgatgaagtggttggccaacagcatttgctgggggagggcaggccacttcgccggctcattgaaggttcaggggatgcctccgtcattttgtatgggcctcccggcactggaaaaacaaccattgcctcattgatttctgcagctgcaggcgatcgctttgtggcgatgtcggcgctgtcctcaggtgtgaaagaagtccgcgccgttattgaacgtgcgaggatggatctgcaattagggcagcgcaccgtgctgtttattgatgaggttcataggttttccaaaactcagcaggacgcgttgctctctgcagtggaaaaccgcaccgtgttgctcgttgcagcgaccactgagaacccctccttttcagtggtgtctccactgctgtccaggtccttgctgctccagttggaatctttaagcgatgaggatattaaaacagtccttaataaagcgcttgaagatgagcgtggacttgccggtcgaatcaccgccaccgatgaagcagttgaccagttggttcttcttgccggtggcgatgcccgccgaggcctgacctacattgaagccgctgcagaagccgtagaagatggcggcgttttagatattgacaccgtcatggccaacgtgaaccgcgcagtggtccgctatgaccgcgatggcgatcagcactatgacgtggtcagtgcctggatcaaatcaattagaggctccgatgtagacgcagccttgcactacttggcgcgcatgattgatgccggtgaagacccacggtttattgcccgccggttggtggttcactcaagtgaagacatcggtatggctgatccttcggccatgcaagtggccattgctgcagctcaagctgtccaattaatcggtatgccagaggcgcggatcaatttggcgcaagcgaccattcatttggctcttgctcccaaatccaatgctgtcatcatggccatggatgctgctttgactgatgttcagcaaggccacatcggtaccgttcctgcgcatcttcgcgatggtcactatgaaggcgccaaaaagctcggaaatgcagtgggatattcctatcctcacgatgatcccaggggagtggtccggcaagaatatttaccggagaacctgcgcgatcgggtctattacgagcccaccacacacggtggagagaagcggattgccgagtacattggcaggcttcgtcgtataatccgtggaaccaag

SEQ ID NO: 1804 - DNA, 1224 bp, Corynebacterium glutamicum
ttggcggatgtattaaggagaatgcccatgctgagccacgaagaaattgttgcgatcgcagaagatttgctgtctaaacgctacggcggtgtacaaactctttctgacgtggagcagctcaacggttccggcacctccgcggtgctgcgtgccagggtggctaactccccattcctccaacagcgctccgtggtgctgaagtacgtgcccagcaccggagacgtctttgatgattctgcgctggtgcgtgaaatcgtctcctaccagttcaccacctccttgtcggaagatgtccgcccagggccagtcattttggcctatgacattgacaagcgcatcctggtcatttcagattccggcaacggcgacacctttgcggatctgatcgatcagcgtaccggtgatcagcgcatgcagatcctgcgcaacctcggccaatcgctgggcagcctgcacgccgccaccgcagaccgcgaagaagacttcaacattctgctcaaccgtatgctggccaaatacccagccacagctgagatgcagaaaaaccgcgataggttgctgcccgcagcaattgaggtgggtaaaaagatacttgtcgacgccggggtcaccgttccagaagtcgtcgaggagtttgcccgcgtagctcggcgacgcctgatttccggacgccaccgtgccttcacaccttttgacttgtcacccgacaacatcatcgtggctgaacgcacccacttcctggactacgaagttgccggtttcagggatgccacctttgatgttgcttgtgtgatcgcaggtttcccgcaattcgtgttcagccgccccatctctgatgatgaggtagacgaactcattgaatcctgggtccaagaagtccgtggaatctggcccaatgtgaacaatgaagagcgcctccaagcacgtatcgtgaccgctctcatcggctgggcactatcgagtgttgccttcatgaagctcggctccatcagcggcatgcttaacctgctgcacgtcaccgaagatggaaacaccactttggatgtctccaaccttgatgaactgttgattccacgatctgccgaagatgacgagctggtccagcaagacctccacgacacgttctccgcgcttcagcgatttgcagcgcgcgggctggattccaggttccctgaggtggcacgattcgcagacgacgtggtgcgtttgttcctcaaaaatgac

SEQ ID NO: 1805 - DNA, 1824 bp, Corynebacterium glutamicum
gtgctgcgcactcatctctcaggcgagcttcgtaaagaaaacgcaggccagtcagttactctgaccggctgggtcaatcgtcgccgtgaccacggtggcgtgatcttcatcgatcttcgcgaccgtactggcattgcccaggttgttttccgcaatgaggacgttgctgagcgtgcacacgcactgcgcagcgaattcgtcctacgcgtcaccggcgtcgtcgaagagcgcccagaaggctctcaaaaccctaaccttgcatccggcgacattgaagtcagcgtcaccgaatttgaggtactcaacgagtccgctccacttcctttccagatcgaggattcctcctctgctggtgaagtcggcgaagagacccgtctgaagtaccgctacctggacctgcgtcgcccagttcaggcgaacgccctgcgtctgcgttctgctgccaacaaggctgcacgcaccgtgctggacagccacgatttcaccgagatcgagaccccaaccttgactcgttccaccccagaaggcgcacgtgacttcctggtgccagctcgtctgcgcccaggcactttctacgcattgccacagtccccacagctgttcaagcagctgctgcaggttgctggcatggagcgctactaccagatcgctcgttgctaccgcgatgaggatttccgtgcagaccgtcagccagagttcacccagctggacgttgaaatgtccttcgtggaccaggatgatgtcatcgcactgggcgaggagatcatctctgaggtgtggaagttgatcggatatgagatcaagactccaatcccacgcatgacctacgccgatgcaatgcgtcgctacggctccgacaagccagacctgcgcttcgacatcgaaatcaccgagtgcaccgagttcttccaggacaccacattccgtgtgttcaagaacgaatatgtcggcgcagttgtcatgaccggtggtgcttcccagcctcgccgtcagctcgacgcatggcaggaatgggccaagcagcgcggtgctaagggacttgcttacatcctcgttggtgaagacggcgagctgtccggacctgtggctaagaacatcaccgacgctgagcgcgcaggaatcgcagctcacgttggcgcacagccaggcgactgcatcttcttcgcagcaggagacaccaagtcttccctcgcactgctcggtgcagctcgtggcgagatcgctaagaagctcgacctgatcaaggaaggcgactgggcattcacctggatcgttgacgctccaatgttcgagccagcagcagacgccaccgcatccggtgacgttgcactgggtaactccaagtggaccgcagtccaccacgccttcacctcacctaagccagagttcctggacaactttgacaccaacccaggtgacgcacttgcttatgcatacgacatcgtgtgcaacggcaatgaaatcggtggcggttccatccgtatccaccagcgcgacgttcaggaacgcgttttcgaggttatgggcatcaccggtgaagaagcacgcgagaagttcggcttcctgcttgacgccttcgcattcggcgcacctccacacggcggaatcgcattcggctgggaccgcatcgtgtccctgctgggcggctttgactccatccgcgacgtcatcgcgttccctaagtccggtggcggaatcgacccactgactgatgctcctgcagcaatcaccccgcagcagcgtaaggaagctggcatcgatgccaagccaaagcctaaggcggaagcacaggcagaggcacaggctgaagagtctgctgaaaag

SEQ ID NO: 1806 - DNA, 891 bp, Corynebacterium glutamicum
atgacctttcgtgatgatgtaactcgatcaggtggaaatgcccgcaaaagtggcggcggtggccgagggatggccgttggtggcggcatcggtggcctgctactagtcgggctcttcttgctccttggcggtaaccctgccgagatcgaccaggttttaggtggcgatcaaacccagatcgagtctggagagtccaccggagccggcgactttgatcactgccaaaccggcgcagatgccaacgccagtgatgattgtcgcctttactacacctcattctccgtcaatgaaatgtggcagactttgcttccagctcaggctggtatcgaatacaccgagccgacattgactcttttcaaaaactccacccaaaccggctgcggtttcgcttctgcgtccactgggccgttttactgtccgtcagaccaagatgcttattttgacttgactttcttcgatcagatgcgtcagttcggtgcagaaaacgccccgcttgcccagatgtacatcgtggcgcacgagtacggccaccacgtccaaaacctcgagggcacactcggactgtccaattacaacgatccgggcgctgattccaacgccgtcaagatcgagttgcaggccgattgctacgcaggcatttgggctaatcactccagcgaaggcccggatccgctactccaacccatcaccgaatctgagctagattccgctctccttgctgcaagcgccgtgggcgacgacaatatccagcaacgatccggtggcgatgtcaatcctgaaagctggactcacggctcatcgcagcagcgcaaagacgcgttcctcgccggctacaacaccggccagatgagcgcctgcgacttcctcggccggggcgtctacaacgacgct

SEQ ID NO: 1807 - DNA, 2676 bp, Corynebacterium glutamicum
atggcagaatcaaacgctatggaccgggcacaaatctctgcactgctagatagagcacagcacacaatcaaccttgccgaacaagcaaacaacgtgctccgactgttgaaaacacccggaacggccacagtaggggacaacgggacactcggcaccgatacctatctgatcccatcccgcaacatcacctggcctgacaacctgtatgtcaacgtctttctagacggcatgaatgcagaagccacccttaccgattacgtcgcatcagtcgcttcgatcccacgcctatgccagatcatcaacgagggccaaggcggcatgttccgcagactattcaaccccaccaaggtccaagccggcgaccaagctgtcttcgacctcatggtcaaactcgacgagatttcatctaccacccacgaagtctcccgcatgctcgagggcgtccacgctgcccgcacccgccaacaacaaggcgttgcacttttcccaggtattcatggagtgggagagcgctacatcgaacgcgcacaacaggtactcgcctcagccctcggtatcgctggattcggtgccgaaccctgggacggacatacccttgcccaagcgcgccgggtagtccaacgctacgcccaagatcctaactccgaataccggctgaaaagcgaagccgagaaacacctcacatccatcaacgagctccgcgtacagatactcctcgaacaactccccgttgatgccctacgcatggctaccgaccaccgcctgcgctttggatccctcgattccatccacgtcgcaaccgtcgccgacgtcctaaaaacacacacctccatcctcaccaccgtgcaaggtatcggcgcccaaaccgcggggcggatgaaagccgcagcagaaacactcaaacaagaagcactacgccgccaaaacacctccatcggcgacgaacctacccaacccgccatgcgtctaatcaacgtgctggcccgcttcgaccaaaccgaaaccatcacgcccgaagaacgcgcccgccgcacccgcgtcatcgactacgtagaacacatacccccaagcctcgacccctacatcgtcatcaacccagcaacgcctgagttcaacaacttcaccgacgacctccgctggatcgacgcaaaccccaacctcttccacccacaaacaatcaccaccccacccgccgacatctgggacgactacatctcccgtcccgctcactaccaaggcctgctagccacgctgctcggccgcgacatcgaaggcgcagacgaactcctcgacgccaccaccctccaaaaaatcagagacctcaccctcgacaaaactcatctcaccgacctccacctccgcggataccaatcattcggcgcccgcttcgccatcatccaaaagaaaaccctcctcggcgacgacatgggactcggcaaaacagtccaagccctctccgcagctgcacaccttgccgccaccgaaaaagacttccgcaccctcgtcgtcgtacccgcatccgtcattgttaactggacccgcgaatgcaaacgcttcctcaacctccccgtattcatcgcccacggagacaacaaacaagacgccatcaacgcctggtctaacaccaacggaatcgcaatctgcacctacgacggcgtccgcaccatggacatccccgcgccgggtctggtcattgccgatgaagcccacctgatcaaaaacccctccaccaaacgcacccaagcactgcgcaaacttatcgacgccgccccatacacccttctgatgaccggcacaccactagaaaacaaagtggaagagtttgtaaatctcgtgcgctacatccaaccggagctgatcacccgtggcatgtccaaaatgcaggccgagaatttccgcgagcgcatcgcaccagcctatctgcgcagaaatcaagctgatgtgcttgacgaactcccagagcgcaccgactccatcgactggatcgacctcaccccagaagaccgcagcgcctacgacgaccaagtccgccaaggcagctggatgggcatgcgccgctccgccatgctctcaccaacaccacgcctaacttccgcaaaaatgcaacgcatcctagaactcttcgaagaagcagaagaacacggccgcaaagccctcatcttcacctacttcctcgacgtcctcgacgaactggaaaagcatctaggcgagcgcgtcatcggccgcatttccggcgacgtgccagccaccaagcgccaattgcttgtcgacgccctgtcccactccaaacccggatccgccctcattgcccaaatcaccgccgggggagtaggcctaaacatccaatccgcgagcctatgcattatttgtgaacctcaagtaaagccaaccatcgaacagcaggccgtcgcccgagtccaccgcatgggccaaaccgccaccgtccaagtccaccgactcatcggcgacgaaaccgcagacgaacgcatgctagaaatcctggcaggcaaaactcacgtcttcgacgtctacgcccggctatctgaaaccgcagagattccagatgctgtggatatcactgaatcacagctggcagcacgggttattgatgaggagcgtgcacggttagggcttactgaatccactggccctaaagatgaagaaacggccttaagc

SEQ ID NO: 1808 - DNA, 1857 bp, Corynebacterium glutamicum
atggcatttttacactttggctcagaactgaaacgatttggccgcggaaaactcccaccattggggtttgttgtggtcatgttgctgccgttgcttttcggcggcgtctttgtttctgcctactatgaccccatcggtggcttgtccaagcttcccgtggccgtggtcaatcaggacgaaggtgaactcgatgccggcgcccaggtggtggagaacctcctggagcaagacgacatcaaattcattgaagtcagcgccgaggaagcccgcgagggaatcaacgacggcacctactacttcggcattgaaattccgaagaacttcagcgattctattgccagcgtgaccagcgattcacccgcgccagcaaccgtcaacgcggtattcaacaacagcaacggcttcattgcctccatgctgggcaaccaggtggtcaacactgttgtggagaccatggacacggaattcggcgtccgcattgtggataacatgctcgtcggtttctccaccttgggcgacggcatgaaccaagccgccgaaggtgccactacgctcagcgatggcgtcggttccgccaacgacggtgcagttcagcttgccgacggcgcggtcaccctgcgcgacggcatcgcaagtgccaatgagggtgcgcaatcgcttgccgacggcgccagccagctcgacaccggcctcggctccgcggctacaggcagccaaacgctcgccgacggtctatccagcctgtctgcgggcaccgcccaactaggccaaggcgcaacccaggtttcagatggcgtgggccaacttgtcgaccaagtagcaccactgaccgcctatgttccagacatcaactctcagttgatcaccctgcgcgacggcgcagccaccattgcctctgaactatctgatccctccagcacctaccgctccggcgtggactccgctgtgagcgcatcccagcaactagcagccggcctgcaaaccctgaaagacggatccagccaactcagcatcggtgcacgcaccctcgctgatggcaccagccaattggccgcaggttccgaacagctagttgttggcgcacaagcactgcgcgacggcaccgtccagcttgatgaaggctccagcgaactcgccctcaaactcaccgacggcgcaagccaagtaccaaccttcgctgacggcgcagacaccaccatcgcaaccccagttgaaacagaacaagcaggagacaccacaccgctcttcggtattggtctcgcaccattcttcatggctgtcggcctgttcatgggagcaaccgttgcctggatgatcctgcacccaatcagtcgccgcgcactcgactcccgcatgggaggcttccgaggcaccctggcaagctaccttccatcaacagtcttaggccttggccaagcaaccatcatgtgggcagtactgtacttcctgctcgacctcaatccagctcacccagctggactgtggatggcgatggtcgccatctcatgggtattcatctccattacccatatgttcaacaacgtggcaggaccctccgcaggccgtgtgctgtccatcgtgatgatgtccttccagctagtctcctccggtggcctatacccaccagaaacccagccagcattcttccactggttccacacctacgacccgatcacctacgcagtcaacctcgtgcgccaaatgatcttcaacgaaaccccatccaacgacccacgcttcatacaagcaatctgggtactgctcttcatctgggcactgatgctcgccatctccaccctggcgaatagaacaaacaaggttcttcgcatgaaggactaccacccagaactgaaggtc

SEQ ID NO: 1809 - DNA, 648 bp, Corynebacterium glutamicum
atgaatacccctcttttgagaagctctgggctctccatccgcgacacacccttcgccgatgttgagatagctccagacagcggactcactttgctgagcaccgggcgcgaatcccaatccagttccttttctttggtactttccggccgcatgcgcgcctccaccggaaccatcgaattaaacggcgaacccatcaaggcaaccaagctggccaagcatgtggctttggcgggcatccctgaaatcgattcactcgagcgacttgtcactgtgcgcaccgttgtccgtgaacaactcgcttggtcaagcccttggtacctgatggtgcccagggatattagtgattcgggacggtgggttgacgtcgaaaagcatcttggcctgaacctgaaccctaaaaccttaatcggcgacctcagcgtgctcgagcgttttaagctgcgcatcgcgctggcgctgctggcgcggccagaggcgcaactgttggtcgtggatgatcccgatcaagtgcgcagcatggaattgcgtgcggaggtgttgcacgcattgaaaggcgttgcagaggatctccctgtggtcgtggtatccaccaacccagattttgattccttggccgataccgctttgaccattacgggggctggaaac

SEQ ID NO: 1810 - DNA, 594 bp, Corynebacterium glutamicum
atgagagcagacgcactaaaacgccgcgaacacatcataaccacaacctgcaatctctaccgcacacaccatcacgattcgctcaccatggaaaacattgcagaacaggcaggagtgggtgttgcaactttataccgaaacttccccgatcgcttcacactggacatggcatgcgcccaataccttttcaacgtggtgatctccctccaactccaagccatcagcaccttccccaccgacccagaaggcgtgtggacctccttcaaccaactacttttcgaccgcggcctaggctccctcgtcccagcacttgccccagaatccttagacgacctccccgacgaggtctccgccctgcgtcgcaccacagagaaaaacaccacaacactcatcaacctagccaagcagcacggactcgtacaccacgacatcgcgccgggcacctacatcgtcggtttgatcaccatttcccgcccacctatcaccgcgctggcgacaatttcagaaaactcccacaaagcactgcttggcctttatttgtccggtcttaaacacggcatgatggctaacatcggagaacatgacggaaagtcc

SEQ ID NO: 1811 - DNA, 714 bp, Corynebacterium glutamicum
atgacggaaagtcctgatctagcagtttcctttttagccgccttcaatgacatcgaagcgcaccttcgaacccagctccgcgctaaacgctccgacagtttcagatggatggtacgtatcgccgagaaacagcatctgatttccaaagaacaagcagaaacccttgatgcttttgcggagctgcgcaacgcaattagccacggccaatacaacgatctacgcccgattgccgatccccgccccgacaccgtggacaccattgagaagattcgctccctccttctcaatcctccaattgcgttaaacgtcctcccggagcaaaaggtccgctcctactcacttgaagatccagtgagtagggccttagaagttgtgcacaccacggagatctcccaattccccatatataagggaacggaatacgtggcactgctaactaccaacacaatcgctcgctgggttgcctccgatttacatgacaatgcccagctggatgcacgttctatcaaagaggttctggattatgcagaatcctctgacactgcagttttcttgccccgcacctcaactgctcaagaaattatcgacatcatgaccggccctaaactcccctggtccgtcatcctgaccgagcacggtaaaccccaccaaaagcccctgcgtgttgtcactggtcgagacatgcgaacactgatggacatgctcaaaatctat

SEQ ID NO: 1812 - DNA, 1113 bp, Corynebacterium glutamicum
atgcaattcggcatcttcaccattggcgacgtcaccgtagaccccaccaccggcaaagcccccaccgaaggcgaacgcatccacgcgatgacccaaatcgcactcaaggctgaagaagtaggcctcgatgtctttgccaccggcgagcaccacaacccaccatttgtaccctcctccccaaccacacacttagcctatattgcagcgaaaaccgagaagctcctgctctctacctctaccacgctgatcaccaccaacgacccggtaaaaatcgccgaagattacaccttcctccagcacctctccggcggccgtgttgaccttatgatgggccgtggcaacaccggacccgtttacccatggtttggcaaagacatccaccaaggcatcccactagcgattgaaaactaccacctcctgcgccgcctctggcgcgaagacgtagtcaactggcagggcaaattccgcacaccgttgcagggatacacctctaccccagcaccattagacggcgttgcaccattcgtctggcacggctccatccgctccaccgaaatcgcagagcaagcagccttctatggcgacggcttcttccacaacaacatcttctggaacaaagagcacaccgcccaaatggtcaacctctaccgccagcgtttcgaacactacggacacggccaagcagaccaggccatcgtgggactcggtggccaagtcttcatcggcgattctgaagaagaagcaaagaagaccttccgcccctacttcgacaacgcccctgtctacggacacggaccatcacttgaagatttctcccgcctgaccccactaaccgtcggtaccgctgagcaagttatcgaacgcaccatggaattcgccgactgggtaggcgattaccagcgccagctcttcctcatcgaccacgccggcctgccactagaaatggtccttgatcagatcgaacgcctcggccacgatgtcgtcccagaggtacgccgccgcatggaggagcgtcgcccagaccacgttccctccaacccaccaacccaccagagcctgaaggccaaccgaaacagccctcacttccagatcaaccctggtcagccaactgag

SEQ ID NO: 1813 - DNA, 126 bp, Corynebacterium glutamicum
atgcgaaagctcactgttgttaccgcaggcctttctaacccgtccaccactcgctccgtggcggatcaactcaccaaggcagtccaaaccgctgtttctgctcgtggcgaatcctggatattgaag

SEQ ID NO: 1814 - DNA, 495 bp, Corynebacterium glutamicum
atgagctccccagcacttgacgctgcaaaacagcgccttgctgaatccgatggcctgatcgctgttaccccagtatttaccgcgagctactccggcatcttcaagatgttctttgatgtcctggaccccaagaccattgtgggtctgcccaccatcattgcggcatctgctggaacggcacgccactcattggttctcgaccacgccatccgaccactgtttacctacttgcgagcagttgtcgtacccaccggcgtgttcgcagccacggaagatttcggcactgaagctggcgcagacattgaacgtcgcgtgaaccgcgcagctggcgaattagcgacactcatgttgcaggattactccagtgtgcaaggccttgggggcgcaaccgcgaaccaagacgctgacctttccttccgtcgcaccactggcgtgaccccgggagagaacttcagcagctttgccgatcttctcaaaggacacgacggaaacggc

SEQ ID NO: 1815 - DNA, 1347 bp, Corynebacterium glutamicum
atggctatcagtgttgttgatctatttagcatcggtatcggaccatcatcctcacataccgtcggccccatgagagccgccctcacgtatatctctgaatttcccagctcgcatgtcgatatcacgttgcacggatcccttgccgccaccggtaaaggccactgcactgaccgggcggtattactgggtctggtgggatgggaaccaacgatagttcccattgatgctgcaccctcacccggcgcgccgattcctgcgaaaggttctgtgaacgggccaaagggaacggtgtcgtattccctgacgtttgatcctcatcctcttccagaacaccccaatgccgttacctttaaaggatcaaccacaaggacttatttgtcggtgggtggtgggttcattatgacgttggaggatttccggaagctggacgatatcggatcaggtgtgtcaaccattcatccagaggcagaggtgccttgtccttttcagaagagttcccaattactcgcatatggtcgcgattttgcggaggtcatgaaggataatgagcgcttaatccacggggatcttggcacagtggatgcccatttggatcgagtgtggcagattatgcaggagtgcgtggcacaaggcatcgcaacgccggggattttaccgggtgggttgaatgtgcaacgtcgggcgccgcaggtacacgcgctgattagcaacggggatacgtgtgagctgggtgctgatcttgatgctgtggagtgggtgaatctgtacgccttggcggtgaatgaagaaaacgccgctggtggtcgtgtggttactgctccgactaatggtgctgcggggattattccggcggtgatgcactatgcgcgggattttttgacaggttttggggcggagcaggcgcggacgtttttgtataccgcgggtgcggtgggcatcatcattaaggaaaatgcctcgatctctggcgcggaggtggggtgtcagggtgaggttggttcagcgtccgcgatggcggctgccgggttgtgtgcagtcttaggtggttctccgcaacaggtggaaaacgccgcggagattgcgttggagcacaatttgggattgacgtgcgatccggtgggcgggttagtgcagattccgtgtattgaacgcaacgctattgctgccatgaagtccatcaatgcggcaaggcttgcccggattggtgatggcaacaatcgcgtgagtttggatgatgtggtggtcacgatggctgccaccggccgggacatgctgaccaaatataaggaaacgtcccttggtggtttggcaaccaccttgggcttcccggtgtcgatgacggagtgt

SEQ ID NO: 1816 - DNA, 861 bp, Corynebacterium glutamicum
atgctcaatcaccttgtaccccatcacgcgcgaagtggtccacttgccgccagagacagacaccaaaccatcaatgccgacgttggcgtgatcggaaatatcgaaacggcgagaggacgtgtaggtgtcggtgccgtcatcaacaagcgggcgcacacccaccagcgtggagatgatctctttgcgatcaagcggtgtagcgcgtaccgaatcgatggtctcaagcagcaaatcgatatcgctttcatctgcagccgcatcatcagcgtcaccgtcaatcatggtgtcggttggaccaataagggtgcgccccatccacggattcacgatcacatgcttgccgtttttgccacgcacaaacacgccactctggctgcccaaatcaccagtgagcaaatgcactcccttggattggcgcaccttcaacttggttacctccgccaaatcacccaacgcctgcgcaacccacggacccgcagcgttgatcaccacaggggcattcacctcatgcgtggtgttggtgacctgatcagtcacttctacacccttgacgcggccttcttccacgttccggagaatgcgagtgactttggcgtggttgatcgccgttccgccatctgccgcaaaagctttaatcaccgcgaggaggagtcgttctgcatggagattcaacgtatcatcgtggcgccacgctcccttcaagccctccgggtcaagccacgggacttccttgagcagtgcatttttaggaatccaccggaaacgcggcgagtggttttccttcgattgcccctggttacgctgccacgccatcgtttcatacaacgccacaccagcacccaacataggggctttcggctc

SEQ ID NO: 1817 - DNA, 1686 bp, Corynebacterium glutamicum
atgacgagcgcacactttgaatcccgccggattggccctccgcttcgcgataattatgacgtcattgtgattggcggtggtatctcaggtgtacagattgcgcgacatgctcaaggccgcggtttacgcactgtgatgtttgaggccagagattattcttctggaacatcatcgacaacctccaagatgattcatggtggtttgcgctatttggagcagtacgatttcggcgtggtccaggaagccgtgaaggaacgccggtacctaggtatcgccgctccgcatttggtggctccacgcagtttcatgctcacggcgtttgattggtcagagccgaaagcccctatgttgggtgctggtgtggcgttgtatgaaacgatggcgtggcagcgtaaccaggggcaatcgaaggaaaaccactcgccgcgtttccggtggattcctaaaaatgcactgctcaaggaagtcccgtggcttgacccggagggcttgaagggagcgtggcgccacgatgatacgttgaatctccatgcagaacgactcctcctcgcggtgattaaagcttttgcggcagatggcggaacggcgatcaaccacgccaaagtcactcgcattctccggaacgtggaagaaggccgcgtcaagggtgtagaagtgactgatcaggtcaccaacaccacgcatgaggtgaatgcccctgtggtgatcaacgctgcgggtccgtgggttgcgcaggcgttgggtgatttggcggaggtaaccaagttgaaggtgcgccaatccaagggagtgcatttgctcactggtgatttgggcagccagagtggcgtgtttgtgcgtggcaaaaacggcaagcatgtgatcgtgaatccgtggatggggcgcacccttattggtccaaccgacaccatgattgacggtgacgctgatgatgcggctgcagatgaaagcgatatcgatttgctgcttgagaccatcgattcggtacgcgctacaccgcttgatcgcaaagagatcatctccacgctggtgggtgtgcgcccgcttgttgatgacggcaccgacacctacacgtcctctcgccgtttcgatatttccgatcacgccaacgtcggcattgatggtttggtgtctgtctctggcggcaagtggaccacttcgcgcgtgatggggtacaaggtgattgagcatgtggtggagcaccaagctgcggtgttacctccgctgcgccactttgactccaggcagatgccgttgagtacttcttttggcgcgtatgagtccgtggctgattcctttgagtcagcgcttcgcagccaccccgagctggatgtggatgatgaaatccgcgtgcatctggccagactgtatggaactgagcatgaaaaagtgctggatctcgtcgcaaagcaacccgacctggggcgccgacttgacccagacaaccttgatatcgcggcgcaggccgtttttgctgtcgccgaggaggcggccgtcgacctggcggacgtgctggatcgtcgcatcgtgctcggcacgctgggttatgtgcaaccggctgccgtgcgtgcgacggccgaagcaatggcgcaggtcaccgggtggtcagctgagcttatcgacgcccagtgccagtcctacctcgccaagcaagacaaaatccaagccgtgttaaagccgtaccgc

SEQ ID NO: 1818 - DNA, 1287 bp, Corynebacterium glutamicum
gtgagtcaaaacaagtccaagtctgaaaagcttcagtcatttgctgcacccaagggtgttcctgattacgccccaccaaaatctgcagcgtttttagcagtccgtgatgcctttgttaatcaagcacataaggccgggtttgagcatattgagctgccgatctttgaagacaccggcttgtttgcgcgtggtgttggtgagtccactgacgtagtgagcaaggaaatgtacaccttcgctgatcgtggcgagcgctctgtcacgctgcgcccagaaggcactgcaggcgtgatgcgtgcagttattgaacacagcctggaccgtggacagcttcccgtaaagctgaactacgccggaccattcttccgttatgagcgtcctcaggcagggcgttaccgtcagcttcagcaagtaggcgtagaggcaattggtgtggatgatccagcgcttgatgcggagatcattgcgcttgctgatcgttcttaccgcagcttggggctgcaggatttccgtctggagctcaccagcttgggtgatcgtcactgccgtcccgagtatcgtcagaagctgcaggatttcttgtttgcacttcctttggatgaggaaacccgcaagcgcgcagagatcaacccacttcgggtgttggatgataagcgtcctgaagtccaagagatgactgcggatgcaccattgatgctggatcaccttgatgcagagtgccgtgagcactttgaaacagtgactggtttgctcgatgacatgggtgttccatatgtgattaacccacgcatggttcgtggtttggattactacaccaagacttgttttgagttcgttcacgatggcctgggcgcacagtctggcattggtggcggcggacgctacgacggtctgatggcacagcttggcggacaggatctgtctggcatcggctatggcctgggtgtggatcgcaccatgttggctctggaagctgaaggtgtgactgttggtgctgagcgtcgcgttgatgtgtacggcgttccactgggcaaggatgctaagaaggctcttgctggaatcgtgaacacgctgcgcgctgcgggtatttccaccgatatgtcttacggcgaccgtggcctgaagggtgccatgaagggcgctgaccgctccaacgcgttgtacaccttggtgctgggcgagcaggagctggagaacaacaccatcgcggtgaaggatatgcgtgcgcatgagcagcacgatgtcgcattggacgaggttgtggcctttttgcaggggaaacttatt

SEQ ID NO: 1819 - DNA, 639 bp, Corynebacterium glutamicum
atggagatcctcggattcgcggctggtccgtataaaacaaattgctatgtggtgcgcggggagaatgaggtcgcgatcattgatcctggcatgcatgcccacgatgatttggtggaatacatcaccacgaataatttgagcgtggacaagattgtgctcacccacggacacattgatcacacccgtgatgctggtgttgtggcaaagcgtttcaatgcgccggtctatatccatcctgatgatgcgtttttccttgaggtctacaagggatctggaacaaagacggccatgcttttcgacgccgacaacatggtgtcccctgatcctgagtcactgcgtgatctggttgatggtgagacaatcactttggctggcgaagaattcacgttgaagcatgcaccagggcattcacctggttgtacgctgatcgtcggcaaggaatactgctttagcggtgatgtgttgttcaagggctctattggtcgcactgattttgagtggtctgatgcagatgccatgaatgagtcactacgcacggcagtgctcccacttgatgatgcattgcagattcttcctgggcatggcccaaccaccaccatgcgtgcagaacgcactggtaaccctttcttgctggcactg

SEQ ID NO: 1820 - DNA, 507 bp, Corynebacterium glutamicum
gtgccagcaaccggcaccgtgaccgtcaacctgaccaccgcccagggcaacatcggcatggaacttgatcgctccgtatccccttgtaccgtcaacgctgttgagcacatggcttccgagggctactacaacgatactgtctgccaccgcatcaccacctctggcatttacgttctccagtgcggcgatccaagcagcaccggcgcaggcggcccagggttcagcttcgccaacgaatacccaaccgacgaagcaactgacctaaccaccccagtcatctacgagcgcggcaccatcgccatggccaacgctggcgctgacaccaacggctcccagttcttcctcaactacgaggattccccactggcaccgaactacacctacttcggccagatcaccgaagaaggccttgcaaccctcgacgccatcgcagaagttggcactgaaggtggaaccggcgacggagcaccagcgcaagaggttcgcattgaatccgcagctgttgcg

SEQ ID NO: 1821 - DNA, 237 bp, Corynebacterium glutamicum
gtgtttcttggccagctgccaagaggcacggtgtttttgctgtctttgactactatttctgctgctggatcacagattgcttttactggatgcctcttctggatgcatcgcagggcagttcactgggcatttccaggccagatccccaatcgtttacatcctgttaaatccatgttaaccggacttttatctttgttttcatccgtttttacccctaaacactctcaggtttctcag

SEQ ID NO: 1822 - DNA, 555 bp, Corynebacterium glutamicum
atgaagcttttctcccgcacctcactggttgcacttggtaccgctgcagctatcactctctccggcgtaaccgctcctgcattcgctgatgaggactccaacgcagctgtaagtgctcttaagaccgctgaagataatacccctgaggcgccaggggcttctactcccctgaagcttgagcagcctggcaccatcaccggcgtccctggcaaggcgatcaccccggtcactgttaaggtcgtcgcaggcgaagcagaatccttcacctcagacaaccttccttctggtctccttatcgacaacaccggaaagatcaccggtactccaaagaaggaattcactggttccgcaaagatcattgccaagaacgaagcaggcgttgaagcagaagtttacgttaactttgatttcaacgaagagccttccagcgaagagccttccagcggttcttccgacactgacaacatcgaaaactggatcaagatcatcacagcagtcatcggtgcactaaccaccattttaaccttcagtaccaagctggattccttcctgaag

SEQ ID NO: 1823 - DNA, 342 bp, Corynebacterium glutamicum
ttgcacaatggtgaaagtgcacataaagtaactttcgtattcgaatatttaaacctaaggggtttagcaatgaagctattttctcgtactcccctcgtcgcactcggcacagctgctgcaatggcagcaacctccatctccgttcctgcacaggctgaagaagtcgcaccagcacaggttgtgtacgtggctgacaccgtagaagaagaaacgggtagctccaacggatcttctgacattgactctgacaccattttggattacgtcgtcgttattactggcatcgttggcgtcctcagcgctggtttgaccttcgctactgctttccagcgttcattgcag

SEQ ID NO: 1824 - DNA, 2280 bp, Corynebacterium glutamicum
atgagtctggagcgcaacacacaaaaatcttccatgggtgtgcgaagcatgtcagccaggcttgcccgcagcctcacaggaaaccgcgttcgcaccaaccctgtgctggatccgctgctgagcatccaccggcaatttcacccacgcgccgacgtacaagtgttggaacgtgcatatgacaccgcggaacgtcttcatgatggtgtgattcgaaaatcgggcgatccgtatattacccacccgttggctgtcgccaccatcgccgcggaaatcggcatggacaccaccacgctcgtcgcagccttgttgcatgacacggtggaagacaccgactactctttggacgatctcacccgagatttcggagaagaagttgccaggcttgtcgacggtgtcaccaagctcgacaaagtcgcactaggtgctgccgcggaggccgaaacgattcgcaaaatgatcgtcgccatgagccaggacccccgcgtgctggtgattaaagtggccgaccgtttgcacaatatgcgcaccatgcggttcctgccgccggaaaagcaagctaaaaaagcacgccaaacccttgaagtgattgctcctttggcacaccgcctgggcatggccagcgtgaaatgggaattggaagatctatcctttgccattttgtaccccaagaagtacgaagagatcgtgcgtcttgttgccgaccgcgcgccctctagagaccggtacctcaaagaaattattgatcaagtcaccggtggcttgcgcgaaaacaacatcgcggcagaagtgcttggtcgaccaaagcactactggtctatctatcaaaagatgatcgttcgcggtcgtgattttgacgatatttttgatcttgttggcatccgcatcctggtagacaacgtgaacaactgttacgccgccatcggtgtcgtgcactccctgttcaatgctctgcctggccgattcaaagactatatttcagccccgcgcttcggtgtctaccaatccctgcacaccaccgtgatgggacctggcggtaagcctctggaagttcaggcacgtacccacgacatgcactacaacgccgaattcggcattgcagcgcactggcgatacaaagaaaccaaaggcagccacagtggcgagcaagccgaagtggatcaaatggcgtggatgcgccaacttctggactggcaaaaagaagcagccgaccccaacgagttcctggacagcctgcgctacgatctgacttccaagcagatcttcgtgttcacacccaaaggtgatgtggtcaacctgccggtgaactccaccccggtggacttcgcctacgcggtgcacaccgaagtggggcaccgctgcatcggcgccaaaatcaacggcaaactggtcgctttggaaacgaaactcaaatccggcgatcgtgttgaagtctttacctccaaggaccaaaacgctggcccaagtaggggatggcaagaatttgttgtctcacctcgtgcaaaggccaagattcgccagtggtttgccaaggaacgacgcgaagaatacctagaagccggacgcgatgcgctggcagcagttattcagcgtggcggcctgccaatgcaccgcttgttcaccgcgtcctccatgaagacggtggcaacagagctgcactacccagatgtagatgcgctctacacagccatcggctccggttctgtatctgcgcaacacgtagtcaaccgtctcatggctatctttggtgacgaagaagatgccgaagacgcattggttgcacgcaccccattcagcgagctggtcaactcccgtgccaccacggaaagcagcaccggcatcctggtcgaaggcagcccagatgtcatggctaagctcgctaaatgctgtatgccagtgccaggagatgaaatctttggattcgtcacccgtggtggcggtgtctccgtacaccgaacagactgcacgaatgtggaaaagctcaaagaagagccagaacgcattgtctccgtctcctgggcttcggaaggtcaaggttcagtattctctgccacactgcagcttgaagcacttgatcgcgcaggcctgctctttgagctcacccgcgtaatcaacgaacaaaaggtctccgttaccgcaatgaactcccattgctcagaagaccgcgtagccaccgtgcgcttcacctttgcggtctctgacaccaagcagttgggatccctgatgacacagctgcgcaatgccgaaggagtgtttgatgtctaccgagtgacctcgggtggc

SEQ ID NO: 1825 - DNA, 555 bp, Corynebacterium glutamicum
gtgagcgaacaagctctaagcaccttcgacagggcacgtgaggccctggacaagaaaacccgatatgtgcaggatttcccagaaaagggtgtgctttttgaagacctcaccccggtgttgggcgatgcagaatcatttgtggccgtggtggacgccatggctgaagctgcagaaaaactgaatgcagaaatcatcggtggcttggatgcgcgaggattcctcctcggatctgctgtcgcttacaaactcggcctaggtgtgctggctatccgcaagaagggaaagctccccccacctgtggtgacccaggagtatgaacttgaatacggcactgcagcactcgagctgcccagtgaaggaatcgacattgctggtaaaaacatcgttttgatcgacgatgtgctggcaaccggcggcaccttgggcgctgcacgtaaactaattgaatcgtgtgacggacatgtttccggatatgttcttgccattgaggtcccaggcctcggcggtagggataatcttggtgataggcccgtcattgtggtcagagatcctcag

SEQ ID NO: 1826 - DNA, 150 bp, Corynebacterium glutamicum
atgagcagtacttcgaagggacacttgacgctgttctgcgtacagtggatccacatcgggagtatgaaaatgccaataccattggaactgatgcggagtcgacgaggcgcactgaagaacaattgtgggctgaagtcccatcaattccac

SEQ ID NO: 1827 - DNA, 1743 bp, Corynebacterium glutamicum
gtgatctcgaacttaagtaacggggggagacattcggctacgggacgtcgttatataggtattgccagatttggttgtcgccggggcaaaaaccgtataattacagtcctattacgattcggggaaaggctgggtacttcacacatgttgtttcggaagtcacgcagcgcggtaatcatgttggttgcagcgttagtgatgacaagctgtggtgatggggaaccggaaccaaccagccaccaaacaagccttttcggctacgcagttaactcttcgctggctacaaccaacgcggcgtcgctgttgggagtggctaatgatgctggtcttttggctgccagagtgtatccgggtgtgtatgttcagggtccttctgggcagatgattcccaacactgatcttgcttccacgcaggtattgccgggtattaaccgccaggtgatttacactatcaatgaagatgccacctactcagatggtcagcctgtggtgtgtgatgattttctgctctctgcgacagctgggcagatgccggaactgttccagtcccatgtgccattgacctcgcagattgagcgagtggactgtgtatctggttctaaagtagccaccgtggtgttcaaggaagacctcggtgagcgttggcgttatctttttgagcagggcgatttgttgccagcccatgccgttgcttccaaagcaggtatgaccttggaggagcttaatcaggcgttgaaggataaggatcctgaagcgttgactgaacctgctcgtgtgtggagcgaaggtttccagctgtcccagtttgatccagagctgcagacggcttttggcccgtacaaggtggattctgtgggtgaattcggcgaagtcaagctggtacgcaatgagttttacagtggcgaccaggcggttgaagcagaaatcacgatgtggcctaaaggctcggatctcagcgccattgcggataatggaaaccttcagatcgcagatgttgtggcgtgggagagcgagccgtgggtaaatcgcgatgacccattgaatccttatgacattaaggaagaggtcggtgttttgactgagcagctcaccttggccagtgccggtgtgttttacgctgcggaggcccggcaggcgtttgcggcctgcgttgaccaggaagcggtggctgcggcgtcgtcaagcatctctggaatcgatgtgcctgccgtaggtgtgcactcggtgcgtcaccaaaatccggtcgtgcaccaaatcggtgatctgccagcacagcacatggcggtggatattaatgccgcatcagcgttggcgggtcaatccatccgcattggctacgacggacccgatgagcgcaaggctgcaatggtggaggcgattcgccaaagttgtgagcctgccggtatcaccgttatcgatgcgtcgcaggaggctgttagtcttaatgatctcagtcgaaccgaagtcagtgaatggggctatgagcagtacttcgaagggacacttgacgctgttctgcgtacagtggatccacatcgggagtatgaaaatgccaataccattggaactgatgcggagtcgacgaggcgcactgaagaacaattgtgggctgaagtcccatcaattccactagcagcgcaaccccgagtgtttgtgatagatcgcacagtcggtaacgttgttgttaatacagacctagccggtatcggatggaacatggaccgttggtccagaagtgaggaa

SEQ ID NO: 1828 - DNA, 1209 bp, Corynebacterium glutamicum
atgactgattcccagactgaatcactgtcaactcagagcgtaaaaccagccaaaaaacgcagttggttcaacagcctctacaccggtgacggcggcattgacttcatcgccaaaaccaaactgtggtactggatcaccggcattttgctggttatctcgatcctgttcatcgccatccgtggcttctccctgagcatcgatttccagggcggtaccaagatgagcatgccagcatcggattactccaccgaacaggtggaggaaacctttactgaagccaccggcattactccggaaatcgtgcagatcgtcggttccggcgacgcccgcaccctggagatctactccgagcgactcagcgatgaggatgtagaaaaagcccgcctggcgatctacgaggaataccaacccctaaactctgagggccagccaagcccagatgccatcggtaattccacggtgtcggaatcatggggttccaccatcacccaacgcatggtgttggctctgattgccttcctggttattgcagcgatctacattgctttccgcctcgagcgtgaaatggccatcgccgccatggcagcattggttgttgacggcatcgtcatcgccggcatctacgccgtcatcggcctcgaagtatccccagcaaccgtcatcggtctgctcaccgtgctgaccttctccatctacgacaccgtcgtggtctttgacaaggtcagagaaaacaccgaaggcttcgaaggcagccgcagacgaacctacgccgaacaagccaacctggcggtcaaccagaccttcatgcgttcgatctccacgacaatcatctctgcacttccgatcatcgctttgatggttgtcgccgtctggatgatgggtgttggcaccctcaaagacctcgcactgatccagctgatcggcgtcatcgaaggcaccttctcctccgtcttcctggcaaccccactgctggtcagcctgaaaaaccgcctgagcaaaaccaaagcgcacaccgcttccgttatgaagttgcgcgacggccaaagcacgcttatcgacgccaccccacacaccaacgccgacgcctccgcgcacggcaccgaaagcgacactgacggtgtgacccccgaagcacctgcaaaacgtacagtaagcaaacccattgtggatgatcaccgatcaagcggaacctggcgaccaggcagaagc

SEQ ID NO: 1829 - DNA, 630 bp, Corynebacterium glutamicum
atggcgatctgctgctgcaggtactggctggtcagagaggaccaagttgcagagccttcttccccatcgccggatttgaaggcaaagctgatttccatctggccggactgggcgttgaatccaccggtgatgggacggttggtatcgatctcattaccggttaggcgcgcaccattttcctcatcggtttcgccgttgagcaaaggtgcaggatcaagtacatacacgccacctacagctggatcacatgccaccaatggcaggcgtggatcatcggtgccggccaaaggatccatctcatcagtggtgcactgcatcaaagaacttgcagcgatctggacagtgggatcggtggactggcggtcggtgcgcagcatgtccgtgatttcctggcgtcgctgtgttgcctcaatggagttggctggctcatccataggggtcgccgacacggtgacgggttctggctcagttgcttcttcgccttccaccgcagtggtcgatgcaacagcggtgttcatttcctccaaggaggcatttgcctgctcttcggtgatgacgccgtattcaacccacctgttggccatctcttccagctctggcatcaacgtggtcatatcgggcattcctgcc

SEQ ID NO: 1830 - DNA, 1932 bp, Corynebacterium glutamicum
ttggaattgaaggagactttcttggctcggcaaaaaaagagtgccgctagcgcctgggaacgatggccaaaacgcgcaatagcgttgtttgtgctcatcgtcgttggtgtttatgcgttggtgctgttgacaggcgatcgttctgccacaccaaaattgggtattgatctgcaaggcggaacccgagtgaccctcgtgccgcaggggcaggatccaactcaggaccagctgaatcaggcacgcaccattctggaaaaccgtgtgaacggcatgggcgtttcaggtgcaagcgtggtcgctgacggtaacacgctggtgatcactgttcccggggaaaataccgcacaggcgcaatccctaggacagacctcccagctgctgttccgtcccgttggtcaggcaggaatgcccgatatgaccacgttgatgccagagctggaagagatggccaacaggtgggttgaatacggcgtcatcaccgaagagcaggcaaatgcctccttggaggaaatgaacaccgctgttgcatcgaccactgcggtggaaggcgaagaagcaactgagccagaacccgtcaccgtgtcggcgacccctatggatgagccagccaactccattgaggcaacacagcgacgccaggaaatcacggacatgctgcgcaccgaccgccagtccaccgatcccactgtccagatcgctgcaagttctttgatgcagtgcaccactgatgagatggatcctttggccggcaccgatgatccacgcctgccattggtggcatgtgatccagctgtaggtggcgtgtatgtacttgatcctgcacctttgctcaacggcgaaaccgatgaggaaaatggtgcgcgcctaaccggtaatgagatcgataccaaccgtcccatcaccggtggattcaacgcccagtccggccagatggaaatcagctttgccttcaaatccggcgatggggaagaaggctctgcaacttggtcctctctgaccagccagtacctgcagcagcagatcgccatcaccctggactctcaggtgatttctgcacccgtgattcagtcagcaacccctgtgggttctgcaacatccatcaccggtgacttcactcaaactgaagcccaagatctggcgaacaacctgcgctacggtgcattgcccctgagcttcgcaggtgaaaacggcgagcgcggcggaactaccaccaccgttccgccatcactaggcgcagcatccttgaaggccggactgatcgcaggcatcgtcggcatcgcgctggtcgccatcttcgtgttcgcctactaccgcgtcttcggattcgtttccctgttcaccctgtttgccgcaggcgtgttggtctacggccttctggtactgctgggacgctggatcggatattccctagaccttgctggtatcgccggtttgatcatcggtatcggtaccaccgccgactccttcgtggtgttctatgagcgcatcaaggatgagatccgtgaaggaagatcctttagatctgcagtacctcgtgcatgggaaagcgccaagcgcaccatcgtcacaggcaacatggtcactttgctcggcgctatcgtgatttacttgctcgcggtcggcgaagtcaagggctttgccttcaccctgggtctgaccaccgtattcgatctcgttgtcaccttcctgatcacggcaccactggttatcctggcatcacgcaacccattctttgccaagtcatcggtcaacggcatgggacgagtgatgaagctcgttgaagaacgccgcgccaacggtgaattggatgagcctgagtacctgaaaaagatccatgccaagaatgcggcagctgataaggcttccactgacaattcttccactgacaattctgaagcacctggcaccgatacgaaccaagaggaggagaag

SEQ ID NO: 1831 - DNA, 363 bp, Corynebacterium glutamicum
atggacatcgttttcctcataattcttctagccatttttatcgttcccactttcctcatgagccgccgccagcgcgcacggatgactgaaatccaaaagctgcaggactctgtcgtcccaggcgaccgcatcgtcaccaccgcgggacagcacgcaacggtcatttccaccactgcagaaaccgttgatctagagatcgcgccgggtatgatcagcacttttgaaaagcttgctatcgtgcgtgtgctgtccaaggccaatgaacctcagatgttggatgagccgacgctgtttgatcagccagaagacgatcagccgaacgatggtttcgatggacgcactgacggacatcctgagaatcgt

SEQ ID NO: 1832 - DNA, 1080 bp, Corynebacterium glutamicum
gtggaaagaacagagtttgaaattccgggaggaattccacctcgtcgaaacggtggtcaaggccgtgcagctgataccaacgtagatgcgaacctgaagcctgatgaatacgatgcggaagtaacacttcgtccgaagtctttgactgagtttatcggccagccgaaggtgcgcgatcagcttagtttggtgcttaccggtgcgaaaaaccgtggtgtggttcccgatcacgtgttgttgtctggccctcctggcctgggtaagaccaccatggcgatgattatcgcccaggagttgggcaccagtttgcgtatgacctcaggcccagccttggaacgcgcaggcgatctggctgccatgctgtccaacctcatggaaggggacgtgctgtttattgatgagattcaccgcatcgcacgtcctgccgaggaaatgctgtacatggcgatggaagatttccggatcgatgtcatcgtcggtaagggtcctggcgctacctcaatcccgctggagatcccaccctttaccctcgttggtgcaaccaccaggtcgggcatgctcaccggcccactgcgtgaccgtttcggttttaccgcgcagatggaattctacgatgtgcctgatctgaccaaagtggtgaaacgaacagctaagatcctcgatgtcggaatcgacaacgatgccgccgtggaaattgcctcgcggtctcgtggtactcctcgtattgctaaccgactgcttcgtcgagtccgtgacttcgctgaagttcatgcggatggtcacatcacgatgggtgctgccaatgctgcgctgattgtattcgatgtcgatgaagtcggactcgatcgcctggatagggcagtgcttgatgccttgatccgcggacatggcggaggccctgttggcgtgaacacactcgcggttgcagttggtgaagaacccggcactgtggaagaagtatgcgagccctatttggtgcgtgccggcatgattgcacgaaccggacggggacgcgtggcaaccgcagctgcatggagacacctggggctggaaccaccagaaggcaccatcggcgattat

SEQ ID NO: 1833 - DNA, 618 bp, Corynebacterium glutamicum
atgattgcctcacttcgtggcactgttatcaacattggtctgagctctgctgtcattgaatgcaatggcgtgggctatgaggttgtcaccacaccgaacaccttgtcacagttggtccgcggtgaggaagcactggtgttgaccaccatggtggtccgcgaagacgcgatgaaactctatgggtttattgacaatgaatcacgtgagatgttttccgtgttgcaaacagtatctggattgggtccacgcctggccttggcatgtgaatcggtgttgagcccactggagatttctcaggcgatcaccaatgccgatgccaaaactttgcagcgggttccgggtgtgggaaagcgcatggcagatcgtctcatcgtggagcttaaaggcaaggtcgcagcttttgctgccggtgtcgtggatgagggaggggagcaaatttccttgcctaacgcgaacattgcttctgaggtggttgtggagcaggtttctcaagcgctggtggggttgggctttagcgagaagcaatcagatgatgcagtgagctttgtgctggcggcggatccatccttggacaccagtggcgcgcttcgtgccgcattggcaaaactcagcggaaag

SEQ ID NO: 1834 - DNA, 663 bp, Corynebacterium glutamicum
atgaaccacgaagggcttcgggtaatgggcattgacccaggtcttacccgttgtggcttatctgtggttcaagcaggtcgtggtcgtaccgtgtatccagtgtcggtgggcgtggtgcgcaccccaccagatgcggagttggcggagcggttgcttcggctcagcaaagcagtgggtgagtggatggatgagtacaccccagatgtcattgctattgagcgtgtctttgagcgcggaaatgtttccaccgtgatgaacactgcgcatgcggtgggtgtgttgatcttggctgctgctgaacgcggattgccagttcacatgtacacccccagtgaggtgaaaaaggctatctccggtaatggtcgcgctgataagaaacagatgacggtcatgatcactcgaattctgggccttggtgagccacccaaacctgctgacgccgctgatgctttatcgttggcggtgtgtcactgctggcgggcgccaatgcttatgcgggcgcaatcgcagtactccgagcaagagttggaaaagcgacggcgtgtgcagcaaggaaaattgggtaaagcgaaatcaacttacaatgcggaacaagctcaatcccatgcatccgatcctgctaaagcggctcatcccagtcagtttcaacgaactgacaccaat

SEQ ID NO: 1835 - DNA, 753 bp, Corynebacterium glutamicum
atgtctggccactcaaaatgggcgactaccaagcacaagaaggctgctaacgacgccaagcgaggcaaggaatttgccaagctgatcaagaacatcgaagttgcggcacgtacaggcggtggagatccgtctgcgaacccaacgcttgatgacatgatcaagaaagccaagaaggcttctgtgccgaacgataacatcgaacgtgcacgcaagcgtggctccggcgaagaagctggtggcgctgactggatgaacatcatgtacgagggatacggccccaacggcgttgccatgcttatcgagtgtctgaccgacaaccgtaaccgcgcagctaccgaagttcgcaccgcaatgaccaaaaacggtggcaacttgggcgagtccggttccgtgtcctacatgttcacccgcaccggtgtcgtcaccgtacaaaagggcgatcttagtgaagatgacgtgctcatggctgttcttgaagctggtgctgaagaagtcaacgacaacggcgatctgttcgaggttacctgcgcaccaactgacattcaggctgttcgcgacgcactcgtggaagctggcattgaagtagaagattctgaatcagacttccgggcatctgttcaggtccccctggacgctgacggtgcacgcaagatcttcaagcttgtggacgcgttggaagattccgacgatgtgcaaaacgtctacaccaacatcgacttgagcgatgaggttttgacagagctggaaaacgac

SEQ ID NO: 1836 - DNA, 846 bp, Corynebacterium glutamicum
gtgaaaactattgaagatattttgaccttggaagaaatcgaccgcgatatttaccgtggtcccgttatcgaatcttatttagccaggactttcggtggccaggtcgctgcccaagctttagtagcagcaacgcatactgttgataaagcctttactgtgcattctttgcatggctactttatagctcctggtgatccaacagcacccgcaatttatttagtggatcgagttcgcgacggaaaaagctacgtcacccgctcggtgcgtggcatccaagacggcgaagtaatcttcagcatgcaggccagctttcatcgtggggatgaaggcattgagcacatggacaagatgcgtaaagttccagctcctgatgagatcaagggaacagtagaacgtatgccgatctcaagtaggcgagtgcttgatgaatgggcggaatgggatatccgcgttattccgcaggatcaattagaactcagcgatttcaccgctactgagcaagctgtgtggattcggtgcaccgctgatcttccggataatcccaccttccaccagtgctcactgacttatctgtccgatatgactttgctgcatagtgccctggtgccacacccaggtgagaaaatgcagatggcctcacttgatcacgctgtgtggttcctgcgtcccttccgcgtcgatgaatggttgctttatgatcagcgctctccatcggcctcaagtgggcgagccttgactcacgggcggcttttcaaccagcagggagatttggtcgctattgtcaatcaagagggaatgacccgcacactccacgagggtgcgcaatcaattccgatgcgcaaagac

SEQ ID NO: 1837 - DNA, 474 bp, Corynebacterium glutamicum
atgacgccacagaaacttcaccgttttgcagcccttttagaaatgggtacctggaccctgctgatcatcggcatgatcttaaaatacagtggagtgacagacgccgtaacccctattgccggcggtatccacggctttggcttcctctgttttgcagccatcaccatcaccgtgtggatcaataataagtggacattcccgcagggtatcgcaggtttgatcgtctctgttatcccgtgggctgcattgccatttgcattgtgggcagacaagaagggcctcgttgccggcggatggcgcttttcagatccgtccgaaaagccacacactttctttgacaagatcttggctcaattggtcaggcacccaatccgatccattttaattctgctggtgattatcgccgtcgtcttctctatcttgctggcgatgggaccaccttatgatccagatgccatcgcaaacactgtggat

SEQ ID NO: 1838 - DNA, 462 bp, Corynebacterium glutamicum
atgacccttgtttacctcctcatcgctgtcgttgtcaccgcaactgttctgtgggcgtatttcacagcacaacgcctcaaccggctccacatccgcaccgactcagcaagacaagccctgcaagcagcactggatcgccgagcagcactagtaggtgcgttgttgcccgatgcagcagaagcctcaaaacgcgctgaggcaattcccctggaatactcccgcttctcccaacgcgcccgcgccgaacgagaaatctctgaactcatcttgaaacaggggaagacccttccagattccatcgtggacgctgccacccgcgtggaattagcccaccgcttctacaacgaagccgtcagtgacacccgcgatcttcgaacccgattgatggtcagatccttccgactcggcggcaccgcacccttgccggagtacttcgaactactcgatacagatctgctgact

SEQ ID NO: 1839 - DNA, 1083 bp, Corynebacterium glutamicum
gtgcgaattggaatggtctgcccgtactccttcgatgagccgggcggtgttcaagcgcatatccttgacttagcgcgaaccttcattgcccaaggccatgaggttcaggtgcttggtccgtgtagtgcggatacgcaggtgcccgatttcgtggtgcgcggtggtggcagcatcccgattccgtacaatggctcggttgcccgcttgagctttgggccgaaaatgttcaaggccgtgcgcacgttcctccgcgaaggcaacttcgatgtgctgcatatccatgaaccgaattcaccaagtttttccatggcggcgctacgctttgcggaaggccccatcgttgctacttaccacgcctccagtagcggatcgaagctgctcaaggctttcttaccagtgctttcgcccatgctggagaaagtgcgcgcaggcatcgccgtgtctgaaatggctcggcgctggcaggtggagcaagtcggcggcgatcccgtgctgatccccaacggggtagagacctccatgttcaaagccgcgcgccaaatcgaaccgaatgatcctgtagagatcgtctttttgggtcgcctcgatgagtcccgcaaaggcctcgacatcctcctgcgcgctctgaccaggctggatcgcccgtttacctgcaccgtcattggcggcggcaccccgcgagaagtcgccggcatcaactttgtgggccgcgtcagcgatgaggaaaaggcagcaatcttaggtcgcgcagacatctatgtcgcacccaacaccggcggcgaaagcttcggcatcgtgctagttgaagcgatggccgcgggatgcgctgtcgtcgccagcgacctagaagcgttctccctggtcaccgattctgaagccgcacagccagcgggcgtgctatttaaaaccggctcagacgccgacctagccaaaaaacttcaagcgcttatcgacgacccctcctcccgttccacgcttatcgccgcggggctaaagcgcgcaaacgcctacgactggtcgacagtatccacccaggtcatggcagtctatgaaaccattgcgatcgacaaagtgaggcttgga

SEQ ID NO: 1840 - DNA, 963 bp, Corynebacterium glutamicum
atgaagccgaaggatttctgcacagcggaaaattgggcggagaatttaagcgcactgggctatctagctggttggcgttttgtccggatgctccctttgcctattgctcgccgggtgtttgaccttggggcggatctggcgtcgaaaagcggaaaaggcatggggcagctacgcgctaatctggcgcgggtggtcggtgcggaaaacgttacgcaggcgctggtgaagcaagcaacgcgcagctatgcgcggtattggctggaagcgttccggctaccggcgatcgcgcgagatcctgagctgcttgcgcggttgcgtaagggaactgttggcctagatttgttggatgaatctttggctgccggcaagggcgtagttttgacgctcccacacagcggcaactgggatatggctggcgcttttctgattagccatcatgggcaattcaccaccgttgcagaaagggtcaagccggaacgcttgtttgaagcgttcgtggagtttcgagaaagccttggatttgaggtgctgcctctcaccggtggcgagcgtccgccgtttgaaaagctgaaagagcgcctgacatctggaggtatcgtgtgccttcttggggagcgtgacctgcggcattccggcgtggagaccactttttttggtgagaagacctccatgccagcaggacctgcgcagctggccattgaaacaggtgcggcgctgcacgtggtgcatccatggttcgatgacgacggctggggtctcagcgtatccgatgccgtgaccgtggataatttatccgacacggtgcagcggatcgcacatctttttatggcaaatattacggcgcaccccgctgattggcatatgctccaacccctgtggtttggtgatttggatccggagcgtctcaagcgctctagggagcagacaaatgttcacaaaccggtggcattacaggaggacaat

SEQ ID NO: 1841 - DNA, 657 bp, Corynebacterium glutamicum
atgctgggacttcatggacgtaagcctgcgcaggttattgttgagcctgttgccaaattgatgatcaagttgaaggtgacgcctaatcagctcaccttagtcagcgctggcctcaccgttggggtggctttgctgctgattcctacggggcatttgatttgggcggcagttttgacgggcctgtttgcggctttcgacatgattgatggcacggttgctcgcatgcaaggtggtggcaccaaatttggtgccaccttggatgccacgtgtgaccgcatcactgatggtgcactatttggtgcgattacctggtggctggtgtattcctacgatgcaccacaggcattggtcgctgcctccttggtttgtttggttgcctcccaggtgatctcttacgtgaaagccaggggagaggcctccggattcaccatggacggcggtctcgtggaacgccctgagcgtctgattgtcagccttgttggtttggggctgaccggaatgggcgttccatatgccatcgatgtggcactgtgggcccttgcagctggcagtatttacactgttgtgcagcgcttggtcatggctggaaagtccccattggctaaggaatttaccaaggcaccagcaggtgcgaaggcagattacagcaacaccaaa

SEQ ID NO: 1842 - DNA, 660 bp, Corynebacterium glutamicum
ttgcagctcgcaggtagccctgagatggactcatctgacagccacgttggtcaggatgtatatgttgatcaaggtctaggggagcccgacagactggaacgtctgtgggcgccctaccggatgagctacatcaacactcgatctggcggtaagcaatcaactaccgccaagcgggaccccttcattgaggttcccaaaatgagtgatgaggacggcctgatcgttgcgcggggtgagctggtgtattgcgtactcaacttgtatccctacaacgctggacacatgatggtgatcccattccgtaaggaaaagaatctagaggatttgagcttggcagaatctgcggagttgatgctctttacccaaacggccatcaaggcgctgaagcaggtgtcaaaccctgatgctgtcaatgttggtttaaaccttggcaaagcatcgggtggctcagtgggagatcaccttcatgtccatgtggtgcctaggtggtcgggtgatgctaatttcatgactgtgattgacggtgtcaaagtgctaccgcagaccctgcgtcaaaccagggccatgcttgcgcaagcatggggcaccattgatggggcaccaggcactgtcgacccaacgctgacttcagcgatccgtaccgcagcaccgaaggagcac

SEQ ID NO: 1843 - DNA, 2058 bp, Corynebacterium glutamicum
gtgaacaccacagataccgcagtagcaaaccttgttgtttttgaggtccctgcaggcaccgcaattggtgcagcaatgcgcgaactagatctgcccaacaagggtccagaggctatcgtttgtgcaaaagacgctgaaggccaactaaaggatctttcacacgtcccagaaaccactgctacgttcaccgctgtacctgcaaatactgatgacggccgcgcagtaatccgccactcgtgcgctcacgtgctggcacaggctgtccaggcagaattcccaggaaccaagttgggcatcggcccagccattgaaaatggtttctactacgacttcgatgcggctgagcctttcactccggaagatctcaagaccattgaaaagcggatgaagaagatcatcaagaccggccagaagtttgagcgccgcgtctatgaatccgctgaagctgcagcggaagagttgaagaacgagccttacaagctggaacttatccaggacaagggcaacgttgatcccaactctgatgaagccaccgaagtgggcgcaggcgaactgaccgcgtatgacaacgtcaaccctcgcaccagtgaggtggagtggtctgatctttgccgtggaccacacatcccaaccacccgctacattccagcattcgcattgacccgatcatccgctgcttattggcgtggcgatcaggataatgctggcctgcagcgcatctacggtaccgcgtgggaggataaggaatccctcgatgcttaccagaccatgctcgctgaggcagaaaagcgcgatcaccgccgtctaggcactgaacttgatttgttctccttcccagatgatctgggctctggtctgccagtattccatcccaacggtggcatcgtgcgcaatgagatggaagatcactcccgtcgccgccacatcgcagcgggctactcctttgtgaacaccccgcacatcaccaagcaggatctctttgagcgttccggtcaccttggtttctacaaggatggcatgttccctccaatgcaggtggatgcggagttcgacgaagacggcaatgtgaccaagccgggccaagagtactacctcaagcccatgaactgcccaatgcacaacctcatcttcgattctcgtggacgttcttaccgtgagcttccactgcgtctttttgagttcggcaacgtctaccgctacgaaaagtccggtgtgatccacggcctgacccgtgcccgtggcttcacccaggacgatgctcacatctactgcaccgaggatcagctggaagcagagctcacctctgtgctggacttcatcctgtcgctgctgcgcgattacggtttggatgatttctacctggagctctccacccgcgatcctaagaagtcagtcggttctgatgagatctgggagcgttccactgaaatcttgaaccgtgtggccaccaattctggcctggaacttgttccagacccagaaggtgccgcattctacggccctaagatttctgttcaggcacgcgacgcgattggccgtacctggcagatgtccaccgtgcagctggacttcaacatgcctgagcgcttcaacttggaatacacctcatctgatggttccaagcagcagcccatcatgatccaccgcgcactgtttggttccatcgagcgcttctttggcgtgttgttggagcactacgctggtgctttcccagcatggctggcacctcaccaggtcatgggtattccagttgctgatgattgcattccacacctggagacaatcaccgcacagctgcgtgaaaagggtatccgcgcagacgtggacacctccgatgatcgcatgcagaagaagatccgcaaccacaccaccggcaaggttccattcatgctgcttgccggtgcccgcgatgtggaagcaaacgcagtgagcttccgtttcttggacggcacccaggtcaacggcgtgcccgtcgatgaggcaatcgctgtgatttcttcctggattggtgaccgcatcaatgatcagccgagcgaggactccattgcagctcgcagg

SEQ ID NO: 1844 - DNA, 1206 bp, Corynebacterium glutamicum
atggtttcccgtaggggtttcctagggggtgccggcttgattgctggtgcgtccgcgttggcggggtgcagtgcgggggaaaatgagccggacggtgcgtcgataagcttaaaaggccaggtggtggagtttgatggccgccatcaggccggcattgcgacgccgcatcaggcgaatttgaatctggttgcgtttacgctgcgtgcgggcgtggatcgcgctggcgtgacgcggttgatgcgcgtgtggaccgaagatgcccgcgcgctgtgcgctggcgagacgccgctgggcagcctggagccggagatggtgacgtcgccggcaaacctcaccattacatgtggtttcggtgcttcgcttttcgacgtgacccagcaggttgatcttcgtcccgagtggttgaagccgattcctgaatttgagcgggatcagttgcgtccggaatggggcgaggcggatcttgtgctgcagatttgtagtgatgatccggtgacgttgagtcatgcgactaggcatatgattcgctctggtgtggattatgcggctacgcggtgggtgcagcagggtttcatgaatgcccatggtgtgaatgagacggatgagactccgcggaatctctttggccaaaaagatggcactgtgaatccccgtaccgatgatgaaatccagcaaacagcctggatttctgagggtccggactgggcgattgatggcagctgcatggttgtgcgtcgcattgctatgaatttggatgaatgggaaattctggatcgcccgtcccgtgaagtttctgtggggcgcaccttggataccggcgcgccacttagtggtggcgatgagttttctgaggctgattactccgcccgcgattcctatggtctgccgcttatcgatccggcaagccacatggctagatcgcgtgcaccggaaagcaatccggagcaggtgattcttcgacgagtgttcaactatgacctgccaccagatcccacttcagaggaactgtccaatgctggtttggtgtttatctgcttccagaaaaaccccgatctgcagttcacgcccattcaacaacggctggatgaacaagaccgcctgaatcagtggattacccatattggctccgctgtattcttcatcccgccaggcaccgacccgaatgattcatctcgggatgatttttggggtgccggactccttcta

SEQ ID NO: 1845 - DNA, 564 bp, Corynebacterium glutamicum
gtggccggtttagtggccctcgtggccttcagttcccagatcgccataatcctcatcaccagcagcaatggtgcgcgccgggatcggatcaagcttaacttcagaaccatcagccaattcaagagtgaccgtcacttcatcgccagcctcgattgggttcgcaagccccatgatcatcaaatgatcgccacctggtgccagctcgatgctctcccctgcagggatcacaaaaccacctggcttttcctgcatgacgccatcaacaacctcatggacctcaaagctggcagcatcaacatcagcagtaaagccagaaacgttgatctcatcatcagaattgttcaccaacgtagcgaacactgccgtcatgtcgctgtcctccacagacgcacgaacaacagcgttttccgtggtgatcacagcatcgcttacctgcgtgctgctggaggaagtagtctccacgctcgtggaggtggaatcactttgattagcaggcgaacacgccgccataaccaacgcactgctcagtacagcacctgcgacaaaaaacttcttcatggtgaa

SEQ ID NO: 1846 - DNA, 546 bp, Corynebacterium glutamicum
atgaagaagttttttgtcgcaggtgctgtactgagcagtgcgttggttatggcggcgtgttcgcctgctaatcaaagtgattccacctccacgagcgtggagactacttcctccagcagcacgcaggtaagcgatgctgtgatcaccacggaaaacgctgttgttcgtgcgtctgtggaggacagcgacatgacggcagtgttcgctacgttggtgaacaattctgatgatgagatcaacgtttctggctttactgctgatgttgatgctgccagctttgaggtccatgaggttgttgatggcgtcatgcaggaaaagccaggtggttttgtgatccctgcaggggagagcatcgagctggcaccaggtggcgatcatttgatgatcatggggcttgcgaacccaatcgaggctggcgatgaagtgacggtcactcttgaattggctgatggttctgaagttaagcttgatccgatcccggcgcgcaccattgctgctggtgatgaggattatggcgatctgggaactgaaggccacgagggccac

SEQ ID NO: 1847 - DNA, 735 bp, Corynebacterium glutamicum
ttgatatttccctctggggaactaagtgggggaagatttcgacaactaaccgggcgcaaagatgaaactaatgcgtccgaccacggcgaaaaggaagtttcgcccatctatgagaggttgaatgtggcttcagagaagaatctaaaattgcgtaccttggcggcagctgctggggtgttgggcgttggcgcgatgtcgatgctcgtggctccgcaggctgctgcccatgatgtggtggtggattctaatcctgaaaatggcagtgtcgttgatgagttcccggagaccattgagttggagttttccggtattcctcaggatctgttcacaacagttgcattgagcaatgcggattccggagaggtgttaacttctggaactcctcagcttgaggggcagcacttgagctatgaagtgccatctgatgtgcagacgggagctggtaactacattttgggtttccagatcacttcttctgatggtcacgctactaaaggttcaatctcttttgaggtgacaggctctgctgaaacgacaacagagacaacagcagagacgacaactgagtcagcagcaaccactgacacctcagagaccaccgaagcagagacaactgaaactgctgatgaaacttctggaattcctgcgccgtggaattgggttttgagcatcgtggcggtgcttgttgttgcaagtgccatcgtcatgatgattgcaaagaatcgtaaccagaaa

SEQ ID NO: 1848 - DNA, 378 bp, Corynebacterium glutamicum
ttgacattctttattaacggtttctacagttcatattcgaataacgagaaaggtagtgtcaccatgccccatccccctatgaatcgcactcattcagctgctcggggtcgaaccacaatcacagcacaaacaactgcattacataatcacgtttccagaacgactattaaacctgttgttaatattgaattacaggacgcggatcttcgcgcctactcacgtgctgaagttcaggagcgactcggcggcatttgttcacgctcggttgatcgactcatcaactcaggccaactcaaagctgtgcctggtacccgaggtaaagggaagcggccactcattaccgcccgatcccttgcgcaatacatctactctgggggc

SEQ ID NO: 1849 - DNA, 594 bp, Corynebacterium glutamicum
ttgttaatattgaattacaggacgcggatcttcgcgcctactcacgtgctgaagttcaggagcgactcggcggcatttgttcacgctcggttgatcgactcatcaactcaggccaactcaaagctgtgcctggtacccgaggtaaagggaagcggccactcattaccgcccgatcccttgcgcaatacatctactctgggggctagagcgcgccaaagaaaacacagagcaaccaccattgcagcagtgctgcaatggtggttgtttttttggcacagtctcaggctgtgttcgatgagtgcaacatcagcagcaatcccattcgagcagtcaatgaccacggggacgagccccgaggttttctcgcacattattcataaaaaaaattgccaacctgtgcttagatcaaccgcgaaagaaaaggaacacggtaaagcaacagactggcaatcttccacacaggtattcgacgaggggtttggggaaccaagggaacgaacatctgcgagatacttaagcttgggacgacactccctcactagagaacctgttactagtgtaacaaagttaaaaccaatactcaataagattctc

SEQ ID NO: 1850 - DNA, 1407 bp, Corynebacterium glutamicum
atgaccagcgctgtgaatgtgcagaagaagaccacacagaaagtacttaagcccattaatacgaagaattactctgcgacagatgcagtacagacaggccagcacggatctgctttaggctcgaatatcggtgtctacacctataccgctggactcgatattggaaacggttatgtcaagggcattatcgaggcaaccggtgatacgactggcacgtctgttgatgttattgatatgccctctgcagcaacgcgcatgagccggccaacggaagttcccgaaccagatgacaccgctgttgctgtcaccggtgcggatttcttcaaccacattgataccaatttcaattcgcctatggtgaaaggtaattatcgttacctttgtggcacgcgcagcttgtctgcacgaggtagcttggaggaatttgatctggtgggtaaccgctccaaggcggaacaagaactgagcaaggtgctggtcatggcagtacttgcggccaaggctgtgaaagactttgtggcagcacatggtcgaatcccacaggttgctgttgagggtgatcccggtgtgctgcgtgtgcatacgtatcttgcacttgcgttaccgattaatgaatatgtgggtcaccgtcatgggtataaggcacagtttatgggtgatggggcagcgaacccggctgtgcatgtggtgacggttaacaactttgaaaccccagcaacggtgcagctcatctttgagcgtgtcgaggtcattgccgagggcgcatcggcacagtatgccattaccgcaggtggcgaagtacttatgaacggaatgctcgccgatgtacgctccaaagggcttgctctagagggcgtgacagcaggtgatgtgctacaagctcgccacacaatcggtgtggatgtgggtgaaggtactgtgaatttcccagtctttacggatgggcggtttaatcatgatgcttcacgcgcctatgacaagggttatggcaccgtcttggagtcggcgattcaggctatggacgatgctgggttggcacacaactttaactcgcgtaagcagttggctgattatttgcagcgaccaccgagtgcactcaagcggaatttctatacccgcgtggaacagcatgttgatcaggaggcagtgttctttgttcaggatgtggctgcagagttcgcacgagtgttgagcgacgtgggtgctcttaccgaagtagcctttgtctacggcggtggttccggcccgctgcgtgatcgactgcatgaagcgttgctgattaaggcagcggagatgggttcggaagatacgttcccggtgctgtatttggattcagcatattcgcgcaagctcaatcgcgaaggacttatgattgcggcacgctcgattgcagcgaaagcacgcaag

SEQ ID NO: 1851 - DNA, 615 bp, Corynebacterium glutamicum
atgcagttattgaagagaaacttcccgacacaatgtacgaaatgggggtcacacatggctcaaaaacaggacacgacacatgtatcagaggacgatgccccgtggcgtaatgtgcgtatgcgcttcccagaaacagacgctatcgttgagcggtttttggaaacacagggtgctcgtggcatctcgcttgcgatgcgacagctgatctatttgtttgtcgctgaatacggtgatgtagaggttgctaccgttattggcctcaagctggtggaaagcctgcaggcaggggctgagggtagtgatctttttgctcagctcgcggccggggttgctgacgtagacgctgtgactacacgcaagaaggcaccgcagcagatagcaccgccatcgaccacaacccgtgcacctgatcaggtaaatgagtttgttgccgaggcggagagtcagccggttgaggagtcagttgttgaggccaaagtacccaagcagcaggtagcaccacagccggcacagaagccggagcaaaaaccagaacaaaagtcggcgcaaccagcacagtcagagccagatgatggctttgatatggatgatgtcatgggccaagcgttcggtcgc

SEQ ID NO: 1852 - DNA, 399 bp, Corynebacterium glutamicum
ttgtctcctgcatacctatgcgcgcgcccgcgtacccgtgcgagtgttacctttaggccaacttgtggcgtaaatttgccttttcacgctgatcgcgcccgcacggtttccacttccaccaattccgcaacagtactgtggttgggttatcaagcaccaaattctatctccactgcggtatcaggtgcagtggccaatcacgctgcgaaagatcttcagaagtttcaaacagccctacagtcccgcaacccagaccaaagaaaagttgtgattggttatagctacggctccaccgtcgcaggtaaggccgcctcttctagcgagctcgatgttcgagcgcgccattttcggggtgatggttacagcatcgcactcaataatgcggtggagattaaaggt

SEQ ID NO: 1853 - DNA, 567 bp, Corynebacterium glutamicum
ttgcttgtgaattacgttgttcagtcggctacggaggccgacatcgatgaggctgctgcgaccctagccgtagcctttgtttcctatccttggactagatggtgccttcccgaggcggattacgactcgcgattgttgaggcttcaatcgatctatctctctcatgctttacagcacggcatgattttgataacaccaaatcgcgatggtgtggctgcgttacttcctcctaatgcacctgagccttctgaaagtgttcagcttgagatagctgagattatgggcgatcgtgtccaggaggtattcggtctggtgcttccgccaaggctcgatacgtcttgggattttgcgactcttggcgtgcgacctgaatctgccgggcggggcttgggttctgcactcatcaaagaagcattgctgcgtgtttcagagtctgatcatcgacgggtatcgcttgagacgtcagctgaaagcaatgtttcgttgtacgagcgtcatggcttcaaggtctcccatcgatcagaggttccgggtggccctgttgtttacacgatgggagtggagctg

SEQ ID NO: 1854 - DNA, 1086 bp, Corynebacterium glutamicum
ttgtcggaagccttcagacagcacgtgtggctacggactgtgtggctcgcgaatccacaaggagaagcaaaggagtgtttttactttaacaaaaggttgaggggtattttttatgctttaatcaaccacagatgtacaagccttgctgtgtatattgttctgctgtactcaacccccacttattcaccgatatttttccagaagagggcacactaccctatgactacaccgcaacccagcaaacctgcgccatggtcgcttgcctataagtatcaagccatcagcaatgatgattttgacaaccatatggatgacctcagcagtcgccaagaccatgaagcctacggcacgtacaaccccgataacggtgtcatgcccgatcatgtcatcgtgccttcaccctatgaaccatatgatgatgctgcgccgattgatcctttcgactacgacgaagatcttctcgatgagattaaagaagagcgcgctgcacaagcggctgacgcacaagtaacagaaacaactaaagctgacgcagacgttgcagagctcgcagccgctattgacgaacagaaccgcacccacaaagagcagttccctacggcagatcgcaaggaactattcgcctggttggataagcgtcgcccagaattaagcgacgatttcatcaaagcttttgatgatttccttcattcttttgcgtgcctggacaaaacaacgatcaccctattggcgcaatcaccggtgcgcacatccactggctatacaggtacttttatcggcatccccaataatgaaccactgtccgaagagcccacccccaccatttacattgtgcacgataatcacacagggataatccacagttaccccgcacgaatgattaatcttaaatctgagctcggttccgctgagatgattcacgaggcaatctgggggtcaccccatcaacagcagttaatctcatggtatgagacttactacaccaacatctactatggttttaacccacccactgaaccacataagagtcttgagatttttgctcaagacttctgtctgaccccaccagagaaacctccttttttc

SEQ ID NO: 1855 - DNA, 1101 bp, Corynebacterium glutamicum
atgtggtggaagggtgtaatcatattcttcaccattgatcgttgcagtaatggtcttgggttcatcactagtgttgaagaccacatcagtgacacccgctaccgcctcaccaacgggggtcgggcttgcagagacacctgtatcggtatcaccgatccaccagttaccgttgtcgccaatgtgtggtgtgaggccatcctcaccaggtgttccagtgccaccctgagctgggataccagtatccttttcaccgatgtaccagttaccgttgtcaccaataacagtgtgcgggatttcatattcaaattgatcaagaatgatgatggtggcctggccaccacctggataactcgattctcggatctcaatgtccacattaccggaaccctcgcccggagcgcccgtgtcaccagtgtcacccttatcgccctttggaccctgcgccttgacaccggtattttcaccattgatgtaccagtagccattaatgatctcaacggtgttagcaccgttggttccattttcaccgtcttgtccatcggctccgttggtgccattttcaccaactgccttgacaccggtattttcaccattgatgtaccagtagccattaatgatctcaacggtgttagcaccatcggctccgttggcgccatcctgaccacgagcaggaacgccggtatcaacgatgccgatccaccaattaccattatcaccgatgcgtggggtgtcaccgtctttaccgtcattgccacgtgcagcagtacaggtgttgttctcaccgatccaccagttaccatctgggccgatgtacggggtcagtccgtccttaccgtcttcgccggtatctcccttgtcgcccttctcacccttgttgatggtgatttcagtgccgttcgagaacaccacaacagtgttgccgtccgcatcgaaacgggtttcgatgaccgtaatggactcgccatctgcgccattacttccatcttcaccatcggcgccagcgtcacccttatcacccttattaatggtaataacagtgccatcggagagctcaacaagagtgttgccttcagcatcgttgctggtgttaacaacagtaat

SEQ ID NO: 1856 - DNA, 699 bp, Corynebacterium glutamicum
atggtaactggtggatcggtgagaacaacacctgtactgctgcacgtggcaatgacggtaaagacggtgacaccccacgcatcggtgataatggtaattggtggatcggcatcgttgataccggcgttcctgctcgtggtcaggatggcgccaacggagccgatggtgctaacaccgttgagatcattaatggctactggtacatcaatggtgaaaataccggtgtcaaggcagttggtgaaaatggcaccaacggagccgatggacaagacggtgaaaatggaaccaacggtgctaacaccgttgagatcattaatggctactggtacatcaatggtgaaaataccggtgtcaaggcgcagggtccaaagggcgataagggtgacactggtgacacgggcgctccgggcgagggttccggtaatgtggacattgagatccgagaatcgagttatccaggtggtggccaggccaccatcatcattcttgatcaatttgaatatgaaatcccgcacactgttattggtgacaacggtaactggtacatcggtgaaaaggatactggtatcccagctcagggtggcactggaacacctggtgaggatggcctcacaccacacattggcgacaacggtaactggtggatcggtgataccgatacaggtgtctctgcaagcccgacccccgttggtgaggcgg

SEQ ID NO: 1857 - DNA, 2580 bp, Corynebacterium glutamicum
ttgtctcttaatttgaagaagaattctgcgcgttctattaccgcgctgactgttgctggtctgggtctgtctattgttcctgcggcatctgcacaggatgttgcggatgacactaccaactccgattccacccgtgatgccatttgtgctgctgcaccgcttgttgcaggcgcagcagtgggtgttggtctgctgtctcagcagccagaattccagcatatggtgtcccagattcagtctgacgcacagcgcattgggcaggatctcagcaatcagttcaacaactctcttgaatcgctcaacattggcctcggtaacggcgtgcacggcccacagcagaacgctgtgcagggtattgatctcactgaagcagcacgaaccatggctggatggaatgacctggcggcacaggtgggccagactgcaggccctgctatcggcgctgttgctggtactgccggcctgatcgcactggttgactactgctggctggaaggcttcgacttcgcgggtggctccagtggcactgatggtgaaaatggtgttgatggtcaagatggtacctcgatcaccattactgagattaagactgatgatgacggcaataccattgttgtcttttccgatggttctgaaatcaccatcaccaatggtaaagacggcgctgctatcaccattgttaatacttaccgcgacgatgaaggtaatactgttgttgagttctctgacggttccaccattgttatcgacaagggtgaagacggtaaagatggagaagacggcaaggacggcgaagacggtaaggaccttaccgtaactgatacctacatcaacgatgatggagacaccgttgttgagctttccgatggttccacgatcattgtaaagaagggtaccgatggtaaggacggtgctgacggctctgacggtgctgatggagtcagcatcactgtggagaactcttatgttgatgcggacggcaacactgttgtcgaattctccgatggctccaatgtgaccatcaacaagggtgagaagggcgacaagggtgacgctggcgccgatggcgaagacggcgcagatggtgaatcaattactgttgttaacaccagcaacgatgctgaaggcaacactcttgttgagctctccgatggcactgttattaccattaataagggtgataagggtgacgctggcgccgatggtgaagatggaagtaatggcgcagatggcgagtccattacggtcatcgaaacccgtttcgatgcggacggcaacactgttgtggtgttctcgaacggcactgaaatcaccatcaacaagggtgagaagggcgacaagggagataccggcgaagacggtaaggacggactgaccccgtacatcggcccagatggtaactggtggatcggtgagaacaacacctgtactgctgcacgtggcaatgacggtaaagacggtgacaccccacgcatcggtgataatggtaattggtggatcggcatcgttgataccggcgttcctgctcgtggtcaggatggcgccaacggagccgatggtgctaacaccgttgagatcattaatggctactggtacatcaatggtgaaaataccggtgtcaaggcagttggtgaaaatggcaccaacggagccgatggacaagacggtgaaaatggaaccaacggtgctaacaccgttgagatcattaatggctactggtacatcaatggtgaaaataccggtgtcaaggcgcagggtccaaagggcgataagggtgacactggtgacacgggcgctccgggcgagggttccggtaatgtggacattgagatccgagaatcgagttatccaggtggtggccaggccaccatcatcattcttgatcaatttgaatatgaaatcccgcacactgttattggtgacaacggtaactggtacatcggtgaaaaggatactggtatcccagctcagggtggcactggaacacctggtgaggatggcctcacaccacacattggcgacaacggtaactggtggatcggtgataccgatacaggtgtctctgcaagcccgacccccgttggtgaggcggtagcgggtgtcactgatgtggtcttcaacactagtgatgaacccaagaccattactgcaacgatcaatggtgaagaatatgattacacccttccaccacatagtgctgttgtgttctacgctacaggttcaccaatggcatattctctaccgaatgcatcgggcctcactgttataggtactgaagagactcctggtttcaccactattcgattcagtgaccattccactgtgaccattccacatggacgagatggcaccaacggtactaacggaactgacggtaaggatggtctcaccccgcacatcggtgagaacggaaactggtggatcggcgaaaaggacactggtatttcgacaacctttggcggtggcggcaaccctggtaccggcaatgactgcatcacggtcccaggtgatgatcttggattcccagatgatgctgaggccggtgcagagaccggtgcagatgccgaaggtactattgac

SEQ ID NO: 1858 - DNA, 1113 bp, Corynebacterium glutamicum
atgtctttgaagcttaattctcgtcgtcttgcatccattgctgtcgctgttgcagtcggtgtctctggtgttgctgctgttggtgcggcaccagctacggctcagcaggtaggtgctggtaccccgattcacgttgtcaaccttgatcgcaccgttgttgatccagtgactggtgacatcaccttccacttcaccgacggcacttttgtcaccctcaaggcgggtgttgatggcaaggatggtaccgatggccaagatggtgtgatcggcaaggacgcaaccattgttgatgtcgctacggagtccaatggtgatgtcaagctcaccttctctgatggcaccgtcgtcaccattcctgcagctaaggacggtgtggatggtgaagatggcaaggatggcgaggacgctactgtggtgtctactgcgactgacgccaacggcaatatcgtcattacgttctctgatggctctgtgcttgttgttgctaacggtaaggacggcaacgatggctcagacggccaggatggtgctgatggtgaaaatggcaaggatggtgagaacggcgctaacgcgaccattgtcgatcagattgccaatgacgatggttccattaccattgtgttctccgatggttctgaggtcactatcccagcgccagctaagggtgccaccgatgagctggcacagtgtctgctgaacccgaagatgttgctgctggcagcaattcctgctgcaggtgctattgctaacgctgtggcaccggcgatcccacgtgttgttgaagatgtgcgtgcacagttcaatcttccaagcctcaacccccagtttgatcagtggctctacaacgcgaccaaggatattgatgcagggttgttgatctctggtgctaccggccttgctgtgctgtcggtgctcgctgatgatttctgtggcgacattgatgccgatgacaacgcagatggtgacgtggcggcagaaaagccaactggctcttctgggcttggatcatctgaacagagtgaaaaggttgatggtgacgacgatagtgtgatcgacactgaaactgatgcagatctcgaagtagaagaagaccctgagcttgttaacgcaggt

SEQ ID NO: 1859 - DNA, 1923 bp, Corynebacterium glutamicum
atgacttttaataaacagggtcgagaggtaggggttcgtcctcagtttgtactgggatctcggattgctcgtcctattgcgttggcgctcgccaccactgtggcgattggcggtgtggcagtggcgacatctgatcatgtggcacagtttggtatggcaactgcgtctgctgcgacgttgccggacagtattgtgaccagtgtttcttatacgttgaacgggctgtcattttctgacccggttgagctgggtatcagtgacaacgacaagcgtgaagagcttctaggagacatcaccaagggtgaactgcgattgcagatggagttttcgatcccggattcagcaactgccgaggatgagtacgtctttaatctcaccggcgatggacttcggtttttcaattcaaacgatcgcaccgtccctgtacgcaatgatgcaggtattcgtgtcgcagatcttttggtgagcaacggtggtacgcgcggtacgttgacaaactttagttcggatgctggcactacttctcgcaccgcagctcttgatatggaactgtacgggtgggtgagtagcgcccagcagacgggtgagcgaccaattcaagactggactgtgggtaagactgagggtcaggttgagaacaaggtagtccgctacggcgttgctggacacccgtggattatcagtactgtccagcacacgtgggttaagtctacgcagaccgtgtcgcatttccgaagtgaacaagactggaagattaatcaaccaccagctgttgatatgggcgcattagcatacgcagctccacttggcgtcgtggtcgggcacgccaatgttgtcattagcaataacaacggtgctggattccggggtgcgcttgtcaataccacacccaccacacgcgacgtgatacttaatttcacagccgcagacggagccactttacgcgaacgttccggaggtggatttgaggatttcgacgttttctcggaagttcctcgggtagaggaaacatcgacgaggatcagctattcttacaaaaattcatttgaatatgacgaatttgttgccgcatttcccgagtacgacgtagctgcgtgggaaccaaccgttgtgtattcagcggataagaccacagcaacagcgacgtttaagaatattccttcggatatttcctttagttggactggtattgaagcactagagccatttagccctggtaaaaccttcgaacataaggtgcaaggttctgttggtgaaccagcgggggcgttcactagggataactatttcactgagggtgagctctacaaacatcgccacgcagacgatctgctttccggtgatggcttgtttggccccaacatcaccgatggcgatggcaacctcccctctgttgatgacggcaaggacggtgacgatgggtctgatggctcagacggccgagacggtgttgtcgccattgatgttgttgacaatgctgacggcacggtgactgtcaccttgtccgatggcactacgtttactcttgatgctggtcaagacggcaaagatggtcttgacgggcttgatggtactggcctaacgctggaatctgctacccctgatgaggacggcaacatcacctatgttctttctgacggtactgagttcactgtgcgcaacggtgttgatgggtcagacggtaaggacggcaaagatggagtcaatggcacagatggcgtagacgggtcagacggtaaaggtctggtagaggtgtcccgagttaccaacgacaacggctcagtgaccattacctacgaggacggttcacagatcaccacgaagccaacgccgacaaactggctgtccaagctgcttgatttgcttctcccgctgtttaatctgttcggtcttggtggcggctccgtcattagttccagtaag

SEQ ID NO: 1860 - DNA, 483 bp, Corynebacterium glutamicum
atgactgctctaccctgcccaccaacacagaagctgctctatgcacagatgcgtgaaattgcagccgaacttacagcctgtgacgctactcgcggactccatgccgaagtggctgccgaatggcttagtgacgccataaccggcgaacccacctctatcgagattgacccccaccgcaacctgttctacgcacttaatgttgagcacccgcgactccatgaactctttgccggttacgctacacgccttgatgaactcgaccgcgcaccgcagcagtgtgagtcgcgtcaatattttcttgattatgtctgtgctgacaacccttttggctcagacaaaccagagggcattatcgtgctgctcgctgatcacgtgctggcagcagatccagtgacaaacaagccggcactcaaatcagaggcattccctactgtcacagactattgccgcactcactctgctaaaccaacagacattctcatt

SEQ ID NO: 1861 - DNA, 189 bp, Corynebacterium glutamicum
atgacgaaacacgaccatacttacacaacccctgcagagcactcagatccagctgatcagcgcatttttccgctcgctgaatcagacatagaaaaattcgacatgcagctcgatcagcctgtcaacaccaaagagatgcaggcttttccgcacgcccccaccatctttggcactgagattgtgttcgat

SEQ ID NO: 1862 - DNA, 312 bp, Corynebacterium glutamicum
ttggcactgagattgtgttcgattaactaccactgctgcacacacacatacaacacctctcacacacaaacaagaaagggtcaccccatgaccaccgttcaagtatccacccgcactgtgcgcgaacaccgttttactgtgccagtggactacgctgtcggcgccaccatttcagaaatctatgctgcctgtgccatggccgaaaagaaagccaacaaccttgggcttaacactactaaggacgattgggcacgagtcactgtcactgataatgctgttgtgttcattgtcgagaatgttatcgggaatact

SEQ ID NO: 1863 - DNA, 429 bp, Corynebacterium glutamicum
atgcagccgaggcagccccttcaggttttgagccaggtacggctattcaagttgtataatccttcattcgatgatcaaacaccttcggtgctctatcctgttgaagcaggaacggtgtctctcgttgatgtaaagaaagcggctagccgtgcctttgaacagtgggaaaagcacaacgagtccgctggtgatgtcggtgatgatctttcactgcagagtatcgtagatctcattgagcgtgacactttccccaccgacgatgagcaagagctcaataatgtggctttgcttatcggcgaactcctggtgagggaggccggtggagagtggacgtcgtacatctcaaagaaaaatgatgaagatgaatcgctggagattttcggggtttttggcaccggtggcactgaaggattatctgtagtgggtaat

SEQ ID NO: 1864 - DNA, 597 bp, Corynebacterium glutamicum
atgctttcaatttgcgcaaaaattggatattcgacgacaattgcagaagtggaaatgaacttccgaaagggacaaacatatggtatttgcggtgaaaacggatctggaaaatcgacacttcttcgcaccctgtgcggggaaatccatccaattgacgggtatgcaactatagatgaccaaagtgtcaccgaaccaagttctatcggtaaaattataaagatttctacccccgaattctatcccgatatttcaattggagagcactttaagatactgactaaaaccacaaaggtggactatgatgacgccattaaacgctggaatctggaaaaactccttgagaaatcacctaatcgagtatcgagcgggcagcaacaacgcagctttctagctttacaattgggggtgaaatgcgatgtgattgtcttggatgagccggagaggcatttagattctttctggataagaatcctatcggaggaactgaaagaccgagccaaaagtggtacgactgtgattttagccagtcattcacaagagattcttaaagtttgtgacgaggtaatctcactcgaaagatatttaaatgcaaataaa

SEQ ID NO: 1865 - DNA, 999 bp, Corynebacterium glutamicum
atgcaaataaataaagtgatcaaatttgcaatactgttggctgttgtcttaggtatttcgttttcaacggtgtcgtgggtttttgatcaatacaaattgaatgcaaatgattactccccgatatcttcatttgtctggaatctgatattcatcataggtttatcgactctagtagaaaaatttctaccgctcctatcaatctcaaaactagagtggatatatcatgtgagacccttaggccaattgtcttttggtcggtttagcccaatcttgcaactgagtgtattcgctctctttggacttcttgttggtgctgcgaatgggcatttttggatatggctcatgatcagcctcttagctagactagtcacaggcctttttaagagaaaatcaattccaaatcttctttctgcaggtagaagaaaaattttgtcggaagccagccttaacgttttggattctgcactagtcgcagatagcacaacagtcgctcatctaaaatggatagaccgaccccccaccggaaactacctcatactcacttttagaagatttttaagaagaccccatatcgctttgacaatgctagtggtcatctctttcacattctctttttccaatgtttttggaaattttaccccttgcttatttttcctactgtggtccattttaggtgccgatgtggcgcggtgcgcagacttctctaagctaaaaggaccaaaccaccttaaagtcgtgactcttattgtgcatgggttattcgcgctagcgatcatgctaataatcacagggacaatccaaatgctgccctacgggattttaatactgccaagcattctttggacaggaatagtcagaagtcgagcgaggagagtagatcaaatcacctatatagacagcggcgttataggcccaatttccccagaaatcatcaagttctatttatcaggtttactaccgactgtagtagtgtcaattattattgtttccctactaaat

SEQ ID NO: 1866 - DNA, 159 bp, Corynebacterium glutamicum
gtgcaaattacagaagaaacagtagttggtgtggtgcgaccgtctgctggtttcccagcgtctgatgcaatggagttagtagatgtgtatcgattgatattaaccatttttggttttcctgtcttgagttggggttgccatgtattggcatcatcaaat

SEQ ID NO: 1867 - DNA, 1107 bp, Corynebacterium glutamicum
atgaaccgcccccttcaaagtcaaaatttttcaataaccagcgaatgggcaaatgccacgttcaacgatatcgaagactctttggaggggtcttttgacatcgaaccaggccaatacattggacgcggagaatacttcgtagctacttctggaacgggttccaaaaagtttatcaaggtggttttgggtgacggtatcgatagcgaactaaatcgtcgcatcgaaggtgaaattcttgcaagtagtctccatcttccatccacagacctaatctctcctgtcgtaattcagtatgtgaaagagtcttctaattttcccggtgacttctacatcgtgtccgacttcaaagacgacacagaaactttagagctatctaaggcttctctacccctcactgacttagccaagatcggagcgtttctctttcgtttggaatctgtaacagttccccctcaaaatcctgcaaggcgagcaatggatgttttggatggactttctcttcttgcaaataaaggcaacattgaaacaggcgcacaattaacaaaaggaactatacaagctcttgaaatcattaatcaagaagcgaccaacatcgagaatgcacttgaaaaagtaactaaagtaggatcacggaagtttttctcgcatggagatcttaaattttctcagttcttaattaatggtgaaaccggaaagattttcctatgtgactgggaagaatgcggtagtgcacatttcgcaaatgacctatgttttctcgcaggtgatttgttctatagcacaattcgggaactggtggataccaacatcaaaaacattaaaggctcctcgatcattcaggaagcctacgataatgcaacgcttgaggctgtatcaaaagtaaatgcaatattaactggctattcctcagagaggggttactctctcacctcggacgaaaaacgaatcattagtatcagaatcggattggctggtctatttcgactttacactgtgagcgctaaatctaatgagttacgcccgcgcgaattagccttagcctccatcggaatgcaaattactttaggtcaagcacccaatctggtgtttacagatagcaaggtggtt

SEQ ID NO: 1868 - DNA, 420 bp, Corynebacterium glutamicum
atgtccgcgaaaaacgcggtagagcgaaccgaaatatttttagctactttacaaatcgctgagaatagcaatctaatatttcaggggaaaactagttggaacacatccctcctgcggactgatgatattgtattctactttccgttggaatctcatttctcggaagcacaaaggctgatcaaaaaatttttaccctttcgatcagatgacggcttagttgaatcattctttacttcctatttggcaccaggtgtgagtaaagctgttgaagtcccaactgctaagaacaatgggctcagttttggtatggaatggtccaccatttgcgcccaactaataatcgaagaattttcaggaaaatccgtcacgatcgcagaaaaactatccgaatggggtattcctcagaaggaggcccacgca

SEQ ID NO: 1869 - DNA, 591 bp, Corynebacterium glutamicum
atggggtattcctcagaaggaggcccacgcataatgaccaaagttacgaatgtgtcttggttagtaacaggttcaatgtcggccctatcaataccgggtctaattttctcacttcgctcatcacatcctaaccttaatttcactccctatctaacacaaagcgcaagtcgaatcgtcactatgaccagtatggccacgctaagtggagtgactcctagaaatagtgactgggggtcagaaccagaggctacacccagccacattcaaatcgaatcagagtcagatgcatatctgattgccccagcgacccttgattttctagctcgctttgcgcgttatgattgttcgacccctttctcccttgctcttcaatgtacgaaaaagccaattctcgtagcaccgtccttgccgcctggggggaaagattcaatagcatataagtcactaagcatggacctcttaaagtgggagaatttacggttattgagtcctatcgaaactaaaagtgcttcttccccaaacgcatcgtcatccggcttcggatctgccacacgattaatcgaattcatgttagaaaacctacagggtact

SEQ ID NO: 1870 - DNA, 864 bp, Corynebacterium glutamicum
gtgaaaaaagtttttcaaaatgaaatgcgcacaatttggcaaagagattcggccaatgatcaagaaccgtggtccgagatccgtcggtactctcctgcaaatggaaaacttcctcgcttacccgagcaacttcctcaagaaaacagttcgatctattggggtcaatcggaagatttcacatttaaaatcggcactttgattgatgaatcattctggagtggtattaacaaaaaagcaatcagtatgaccgatgatgacaagagtaagcttattttgaactactcagagaaagctattagtgctttctctgagttctctactagcgcccactgtcgatatctgccggtttttgcacagtacatccatcatctaccaagagatcttcgagaattaaaagaactcctgttggatagccatgtgcgctgtgtatttgaggacgctaacctatcagtctcctcaatattcaaagacatccagtcttttgaagattactctaaaaagtctcatcgaatagttcatggttgttttcgatttagaaatataggtttctcaggcaatggcaaactgctcgtaatctccggggatgatctaatctacgggtctgaaatatttatacaagctgcgatgctggctgatctatttgagctaagttcctccaaagtcgttgctgtaaacaaatcaatgttcgttatgtatcaaaccttcactcaaaacaaggacagtttttatgtaaataaattaaacagatttaccttcctctacctaatctcccactatgtacaatttctttttacctacaaaaaatcttttcctaagagacttctctcggaggcaacgctactgagattcaacgggcctgtcatt

SEQ ID NO: 1871 - DNA, 420 bp, Corynebacterium glutamicum
atggagcgaggccttagcaagcacaaccgctttgtgctgcactcgcatggcactgggcgccgacacagtgtcggtgcagatgcggtgtgggcgtacgtcattacagcgttgaagcaagcttatctgggtcggttctcttttgttgctgaggcactactgttaacacagccaaaccagtggccggctcacgcgcaacaacaatggcagcaactggtactacaagccgatcatgccaatctctacagcgagatttatcatcccagcgtgctcatgaagcgcaacaccggcataattgctgctgctgatctcgtgcttgctgtgattaacaagaatgccaccaccggtggcacggcacacactgttcgggaagcagaaaccatgagaaagcaggtctttaggattcacccagcaggtctggtc

SEQ ID NO: 1872 - DNA, 120 bp, Corynebacterium glutamicum
ttggagtttattttattttttgcacttttattttttactgttgcgctattgatttcgatcggcctcattgtaattttggtgaaagtggtgcaaaaacgtaagagcgacaagttggaaaaa

SEQ ID NO: 1873 - DNA, 735 bp, Corynebacterium glutamicum
gtgcttacttcaataagagcgtctactacggtaattgcattgagcgtcttaatttccacactgacttttgcctcgccttctgaggcaatagagggtgtcgatccaatacacattaccgatcaattaactattgattacacggctgagcaaattgatgaagttcgtgatggccttcggtcatacaacgtccctgaagagcaagttaatagattaataggaaaactcgaacagggtgaactgtgggattcaatcgacccacaaaaacatccggtggacattgaggactttgaaaatgaacaggggaaaggtactattgagcgttttgctgatgggtcagtcgtagtttctacacttcaagtcccgattgatgcaaataattctctgatccagccgaggtcgattgttcctggctctattcgggattgtgaggaattctttgctcaagggcatcgttttaacactaattgcttggcacaaaagactattattttggctacgatgtcatttcgttttgactactattacacagtacaagatgcgaaaattcagaagttttacaatccgtcagttactgggatcggaatgagttttgaaacaccaacatttgagcagactagtgatcgaaatgtacgcatgagtgctcttttgtcattattattccagggattccctatacaaaatatggcctggatacaggttgatgtcgataccaatggcgctcattttagcgcaaac

SEQ ID NO: 1874 - DNA, 225 bp, Corynebacterium glutamicum
atgcaggtcattgagacgcttgatcccgatcagcgcgcagcggtgctcgctgcagcgataccgcgcgaggctaagatcctggggcgaaaagtaactcttcgccctggttggggcaatatgcgcgtacacgtcgtgattgcagttatctttatcaagtttttgcaaccggatcttcgccaggcgctgctaacaacaggtgatgccgtacttgtcgaagatgatacc

SEQ ID NO: 1875 - DNA, 894 bp, Corynebacterium glutamicum
atgactgtctgtgaaattctgcacaacgtacataatccaaaggacttccccctgaggtttctttttctcccaaggacaacgacagcacagctgcgttcggagacatgctcgaccaaccacccacccgcatcctcaaaggagactgcacatcatgttcctcaccaaagatatgctcgcacgttttcctgcaagtttgaatttgccaatgcacagtgctcagaaccagaagaaatgggcgaatacttccaggtcgttcaaaacatcgccatgacactgggtgctggcgaaagcgttgatcttgttgtccgcgaatacatcaacgatgtggaaggcaacccgaccatctatcacggtatgccgctgcgtactgaataccgcgcattcatcgaccttgatcactgtgatccgtccgctggtgagcctgagcctcgcttattgggggttactccctactggcacccctccgtgatggagaaagctctcgcctttgcttcaagcgatgttggtgctgaattcggtcacatcaacgatgattaccgcacctaccgtgcccacaaagacagcctcatgtccaagttccatacacaccgtgatgatgtcatttcacgtatcactgcactactaccccagcttcgtgcacaagagctgcaaggtcaatggtctgtggacatcatgaaaaacggggaggatttctacctcattgacatggctctcatgtgcgagtccgcactgtctgaactactcactgttacagatgagtacgccacagtcgagccgagtgtcatcaatgacttcgccaaccagctggtcattgattatgacgagcacgatatgggctttgatcgagactttccagcaggtgtgtataacacccgacaagcaagtgctatcaac

SEQ ID NO: 1876 - DNA, 156 bp, Corynebacterium glutamicum
gtggccagatctttgttcatgagttcttccgaacgcagctttgctgtcgttgtcttttatgtttttgggactgttgccggcactggtgtgcaacaggtgcaacaggtgcaacaggtgcaacaggtgcaacaggtgcaacaggtgcaacaggtgcag

SEQ ID NO: 1877 - DNA, 474 bp, Corynebacterium glutamicum
gtgcaggggttgtgttttctaacaagaaaagagaccaccatgttcacagcttttaaaagcaatcctacgaccattaaaaagctggtttctgagctcattaatggcgacgatgcagcgctcaacgaactagagcgacacgtcactaatgaatcagtccgtgctcgcgaactccctaatgtccagtacaaagccactgcggggcgcaacttcgccatatccaagctggtccaaaatttgcgtcgcatcaacaaggcacaaaacaatccacgtggtgtgcccactcatgccaccgtgattctgcttaaggaagacggcagctacgacggtgaagaacagtggcgcattccagaaaaggcgatcactccgttcgacatgctacgttcgcctgacttcaaccacaacaggctgaagaaccggccgctcatggtcgagtcccaatacccctggggcgtccccggactcattaaaatgaac

SEQ ID NO: 1878 - DNA, 753 bp, Corynebacterium glutamicum
atgaaagacccccggactaccgcgaaattaacaccggtgtcggtaccggcaactgcatcattgtcgttcctgaacaagcgccgtggtttaagccagccatcatcaaacaggcttaaaaatactcaatcgtcccattcaagaaaagagcacatgaccatgtacaacgccgcaaagacccttgttccccagattgttgctttcgatgacacagcaatcatcgcactcgaccaagccgcggaagatgaattccgcaaggctaactaccccgaggttaaagccaaccaagaagctgcctatatcctggcggaagctgcccaaaacattcaacgcattgcaacagctcgtgccacaggcgatgtcccagcgactgctcgcgtggtgcgcattaagggctctgagaaatactacaccgaggagcagtggcgcattccagagaacgcctactaccctcgcagtatggctgaatctcctgatgctcaccttgatgaccgtggcatctatatcatcccagctcaatatccttggggatacgaggaaatcattaacctaccggcacgcgctacctctacacctgctgttgctcctcgcactgaggctgctccagctacagtatctgatgctgaggtccagagcctgcttgagtacttgcgtactaatgctttcgtaagtcgtcacgacggcgacaccacgaaggccgacatcttcaacaagcacgcggatactgtcaacaagcttgcagcactacgtgcaccc

SEQ ID NO: 1879 - DNA, 423 bp, Corynebacterium glutamicum
atgagcatttcgccgaagaattccggtacaccaaacgagaacgccgcagcagcgcaggtggcagcaaatctggctaatttaacgtcgcaggctacagggtccatggacgaaactaatgagcaagtcattaaaagtaacgagcatggctctgatgcttatttggcggatattaaagccagtcgagagatgtgggcaaaaattgcgctcgatccgaatcaatctgaagaaactaggaaagaagctcgggagaatatggcgcggatagatgagtacgctcgtgagcacgataaagacaacaagggtttgttgcagaagttagcgaaaaacaaagcagagctcatcgggactgttgcggttgcaaccttaggtgtagtggcagccattgctaacaatggcaagataccgatgattcagttgaaaaaa

SEQ ID NO: 1880 - DNA, 687 bp, Corynebacterium glutamicum
ttgtatcaaaatacacatattttaatgactttagctatacttctatcttgtgacttaaatgaaagtcacaaactttgttggggtttctttaaagtaaaatacagaagtttctctggcaaaaaacctcactactttctacagaaaggcgtcttcctcatgaaggcttctcagaccctcacccgcaacactcgtgcacgcaagctcggcatgggtattctcgcagcaactattatggctaccggtgcacttgctggcactgctccacaggcgacagcagcagtagataccactgcgccatacgtgtcctatgtcgttgacattcctggcaaggttggtgaaccaatcaagcctcagtacctcaccatctccgatcagtccgcctacaccgtgaccttcaagtacatgccatcctggttgaagtacgacgcaaacaagaagatgctgtacggtaccccaaccgaggttgatgtctggactcctgaggtacatgttgttgatgctcatggcaacaagactgtccgttacttcaccgttgtagcagtcccagcaaacactgcaccaaccaccaccacgccatctactccaaagccatctaccccgcaggtgaccaccccaactactccgaaggcgcctaccttgccaaagtccaccttcgactggaccttgtggggctccatctttggtttc

SEQ ID NO: 1881 - DNA, 429 bp, Corynebacterium glutamicum
ttgtactgcaccttggtgcactgcaggggttgttttctatgtgccaacgagttcttaagaaacacaacgacagcaaagctgcgttcgggagcatgtgtgaaccctcgctgtgcccgcacttgcctgcatacagctcactcaacaacacagaaagaaccttttaccatgctcaatgcactcaacgctgtccttgatgttgtcgaatctgctcaagggctggtctttgtcgtcatcactgctagcctgctcactcttgctgtcatctacatcaagaactatccccacgcgccacagcctgctacccaacacaccactgaccaaccaactgtgccagagccgctgcagattcttgacaaccctgctcagacaactgctgctggtctacgccatgaccttcatagcgatctctacgccgaagaaaagagcgca

SEQ ID NO: 1882 - DNA, 465 bp, Corynebacterium glutamicum
atgtccgaattccctacacctacgacttttcacgtcgaaccagaaacgcttagctccgccaccgatctcactgttgatgcacataaaatcgcagaactgctgctcagcaccactgattaccgtgtgttctacatgccgcgtctcgccggtgtgactcctatcgtgtcctacctctatgtctacgatggtgaaaacttcctcattgttggtcgctccactcatgtgccgtgggagtactacgttcactaccccatcaagccatcacgtgaatttggctctgctattgctgtgcctctcgatgattctgatgacccttatgatgcagcagaagttgttgctctagtaaagcagtacatgacgcccacgctcactcctggtgagggttatatgcagggcttttacaagggtctcaccttcaccaaccacctcgatatacatcgaccactgacccagattatctcagac

SEQ ID NO: 1883 - DNA, 237 bp, Corynebacterium glutamicum
ttgtgcctgagcaacaaccctgcttatgcactcgctgtccctgctgacacactcgctgttaatcccaacagcacactgccagcacaacttgccatcgttgaacacaccaccttaggtgctgttgttgcagtacacacaccagacgcccgtaccggacatcacctctatatccgatccagcgtcactgctgaatcagaggtccacaccggcacggcaacacctgttgaactggtcttt

SEQ ID NO: 1884 - DNA, 681 bp, Corynebacterium glutamicum
ttgcatcacgccgagagggtgacgtgcttttttcctacttttcctcataactacagaagggacgccctcatgtctgcttttgatgaactccgcaagaactaccgctacaagttcactgacacctggccggccaacgctgttaccggcaccggctactacgccaacccagcttttatcatcatctccgctgatgccatgacgcagaacacccatgccgattccaatctcatcacggttaaagagcaccttaacaccctgtttccgtacagcgtacaacgcaaggatcgtgcctttgtctctgagatctacacccctattaacctgctcgaagataatccagaactagctcaagaaatactcgatgtgctcgacaccctgagcaacaacgctgtttttaacgatgcgcactacagcgagcttgaactagagcgcctcaatgaatatgtcatcgacaccttggcctatgacatgaagtccgacatgatgcgcgccctcgttaaggcccgaccagaggccgatcttgaggcgatggaagaactcgacattgccaatatccagagctggattaatctccactcctccactgtgagcgaacacaacgatggcagcgttgatgatgcaccgtttaattctctcgcattagctgagatttatttgcaacagcttgcagaccacactgtc

SEQ ID NO: 1885 - DNA, 960 bp, Corynebacterium glutamicum
ttgcgcccgatcaactccacgacatctgacacagaaagaagattcaccatgtctaagaacaacgcagctcacccgcagtctgtcttccatattcatatcccagcacataccactatgcactctgaccgctttgagcacccagacaacggctatggctacaccattcgtcaggacactgatgcagagaacccgatgacccatcacgatacgaaagatgcagctctctgggttcacaaccgaccacgacgcggagataccgtcgccgataagccagaaggcaatgagattctcgacatctttgccaagttcatctgcggccagcacgataatgatgacaacccgttcgaagtctggtccgacggtgactcggatgcatcactcatccgcaccaaggcgtatgttgccgagcaccaccccgaacttatattcgacatctctgcgaaaaccatcacgggttattcccaaggcgattggctcgatgtggtctgtgttactactgccgccacttgcgacgaacttatccctgctgacagtcttattgacatctaccgccagtgggcttttggtgatgtgtggacagtgattcctgattctcagccaggtctcgcaggtatttatgctgacgatccagctgacgcccttgcgtactatcaagagaatttcgaagatgaacccatctgggatctcttaagccgccacgacgctgacaaagacgccgcagcactggcagctgcctctgctgcagaaaaccacgcactagcgcgaggtactaccccagtcgttatccgtacccaagacatcatcactaacgcgcgatacctcatgtctgatagtgctgatgacaatccagaatacgatcgcgccttggtcgaacttagtgcttatctcttaagtatcgacctcgatgatcgcgttgctgcagagatgaccattttaggtcgccctgtgcctaaagaagga

SEQ ID NO: 1886 - DNA, 480 bp, Corynebacterium glutamicum
atgtgcacagatacagttagtcgcatgtacgcattctatattctcgacaccatgcttaatcgttcgatcaaacagattgagcaatgcctggatcgacaagacaccaccatcagccacatcatcgccgatagcgtgcacgacaagctacatgaatatgcaacaactaatccaccctgtgacagcgacaaacaagcacttctcggtcatgtcgagcttgagatagctagtttacagatcatcatcacgagcatccatcctgcagagggcacagatatggtggtgtgcggcacagtctcagcatccgcatcaacatggttttataccgttgatgaggtctttacccaaggctggcgcagtcactttgggtcagtgcttgtcgaaggcagcttcgcactgttgatagaccctgacacctttgacgtgcacaatcttgatcttgtcggtcaacaacacgtgcactgggtgccagctcgacagccg

SEQ ID NO: 1887 - DNA, 681 bp, Corynebacterium glutamicum
atgctctcccaagcgaacatgggcgggagcccatgtcggggtgttgtgcgaatggctgtgtgtcaactacctcagcctgagaaaacaacacttataaagaaagaccttttactcatgacttctacaactaactccaccgccatgttcaacgaccaccttatccctatggcagagcttgatgaacaagctctgcgcgacagcgttggttcttgggcacagtacaagcacccgcttgaccagcgcaaagaaccagagctcgtccttattcgtcgcgtcaacagctcagagcgtgtgtgggtcttaagtttcactgacctgcgtgctgatgcaggtcttgtgcctcgtagcacaccgaatgctgacccctccaatatccgcaataccattttctctgtcgctgtccgcgatcttgtccttgatcgctcacttccccggctgcttaacctcaacgggcaaccaccagcaggtgaatgggaagaaggctttgtctacgtcgattatgaccagagcgacaccgtagatggctacctcattgagcacagcgaacctgtctccattgaaagtcaaaccaccggtgaaatgcactatttcgataaggtgccaggcggtgtggctgttaccaacaatcccgatggcactgaacaaggtgatgcacgccgctgggtaagccactgggaatca

SEQ ID NO: 1888 - DNA, 285 bp, Corynebacterium glutamicum
atgcctaatcacccacctatttccaccttcgatgaccgtcgctctgctatgcgcgaaggcattactgattaccttgccaatacaaatgcaaatgggttaggcggttacagcatcagcgacacccacctcgacaatcttgctgagaaattcacccgcacacatggtgaagcacagtacgatgccggctttgatcccaatgatcttgaaccagagacttttgttcgtgacattgagatgagctgggatgagcgtgctattgatcgtgccctgatccacacacaactg

SEQ ID NO: 1889 - DNA, 375 bp, Corynebacterium glutamicum
atgagagccgtaaggcagctattcgcgacgctattctcgcctatgtcaacaacaatcaaggctgctgcaccctacagccttcatgcccatgatctcgaacagcttgctgtagatctcactttagttaccacctttgatagcaatgctgcagttgatgtcacgccaacacatacagaagcacctggttttaccctgcatgagggcaccgatactgcgcctatggctccaaccctggtcgtacctatttccagcgacatctccacagccgtttcggaaatatctacattagtgcagcaggctcgcaccgacgcagcaagcgccattcatgaagcagaagctgaattttacaaccaacttgctgcggtccttgctcag

SEQ ID NO: 1890 - DNA, 612 bp, Corynebacterium glutamicum
atgtttggtagtagttttaaggaacaaacaactaacccgagaagtcaacgagtttcttatttgcgtgtctctagcaccgatcagaatctggctcgacaacgtgaagctgttaaccattccggtcatattgatcgtgagttcacagatgagctttccggtggcgccaaatcacacagacctggcttggaagactgcattaattatcttcgcgaggatgatgttcttgtcgtcgcatccattgaccgacttgcacgctcgctggttgatttacgcgtcatcattgaccgcatcacagacaaaggcgcatcggtcatttttctcaaagagaatttgactttcgctgcaggccgcgatgatcctcgagcaaacctcatgctcggtattttgggcagtttcgcagaatttgaacgctcaattattcgcgagcgccaagcagaaggtattgccctggcaaaaaaggccggcaagtatgcaggtcgcccaaaagccctcgacaaggaacaaatacaagaagcaaaagatatgatcgctcaaggtgaaacaaaatctgctgtcgccaagcattttggtattaatcgctcgaccttgtacgaatatctcaaaaatcctgac

SEQ ID NO: 1891 - DNA, 1005 bp, Corynebacterium glutamicum
atgggagactcaatgacagttgcacacaaacgaagtctgacatggatcaagagactatctgcgactacatttgcagcttttcttggcattcagcttgtgacccccgctcactcaattgaaaacacgacgcagattccagaaagcgaattgcacaacctcgggctcacagacgaagaaattcaagaattcaatcaatatctcattgacgagtcactctttcaagagactgtagaaacctctccgatcgtagtcagcgacaatgaagatgcagcccaagatcccggtttcggccttttcaccacaaatcctgtgaaacacacagatgagcacattggcgctctatacttctccgacctaccaggtatttccaatcttacgtgcactgccaactacatcggtggaaaattctggaccacagcacatcattgtgttgaaggccgcagtcgcttcgtcggcttcatcgagcagtcggacggacaatatgcaggcattgagcatgtttacacaaagtcaagtgactacgatattgccctcattaaagtgggatctggaattgacgcagaacagttcagcctcactcgatcacgccctgcggttggaaaaatgctggaagtcgttgggtttgcagttgtgaacccattctcctctagagcaacaatggaagtcaccaactcaaacacagtcgcgaactatcctatgagcaacctgtactacaaagacgtattctcggctaaacccgcaggatcattcccttatgtcatttccggaggtgattccggcgcagctgtttggtcgggtgaaaccatgtacggcattgctagtggctctaacggcagcactaaaaacctagcagcaaatgttggaccgcacgtctcttggatcgaacaaacgatgcaaaacaatagcaattcctctccctatgaaattttgcaagcgttccgaggcggccttgcaacgtcttaccccaaatataatcaaattagagacctagtcgactcaagtagt

SEQ ID NO: 1892 - DNA, 375 bp, Corynebacterium glutamicum
atgttacgaaaagtatccattgcattggtcgcatccgccgctatcttggtatctgtacctttcgcacaggcatcgacctcagtggcactgtcgtcagaaagctcagattctctgggaagtattccaaacgatttaattgggggtctagccggttactttaataaagatcttacggaggaacagcgcgatgctattcgcttcggccccaccacagcacaagaagcagaacagtgcttagcaaaatacggacttggcggtgaaggcccgtggcctactatcgcggtgtaccctaactgctctttcgagacaattgaacaagatttctatgatcaagcggtagccgagactctcgcagcaataggcatcgggagctct

SEQ ID NO: 1893 - DNA, 477 bp, Corynebacterium glutamicum
atgactgttgatctctaccaggcacgcattccttttcagcgcgatggcgtgcgctttgatcatacgatgatcacccacattcaagccggcctgcatcttggtggctgccgcgcagcaggtttactgcctataccagcacatattgatcatattgtgcgcctgacagccgcagatttctatgacacccagtcagcaccgcagctgctcagcaacactgtgcttgatgtattggacaccaccactcaagacttgaaggcattgtggcctgttgcagaacatattgctacaaccattcctgaatctgagaacgtgcttatccactgccagatgggtatcaaccgctcagctgcactcatgacacgggtgttgatgttgcgcaacgattgcaccgccgatgaagcaattgcactgctgcgtgatcgacgctcaccgtttgtactgttcaatgagcattttgtggaacaacttcgagcactg

SEQ ID NO: 1894 - DNA, 726 bp, Corynebacterium glutamicum
atgtcaccgaacttccaagctcgcggtactactgcgcccactgttgctttgtccatgcgccagatcgcgcacatccgtgaagaaattaagaaatcaccactcgctgcttccgttttcatcacacccaccaccaaacaaatggttgtccgagatctagaatcactgttccagcagctctaccacacagatctacctgaaccatccatcaaagacagtggtcttatcagtgctatcggctctagcgccggcaataccaataatccagcactcgccctagaaactcagatggcttaccacctggtgcttgctatgcaccacaccgatgttgctacctggcacaaggtggtgaccaaaaacatcaccgaatctgctgctgcacaagatgctgcggtcgagcacagtgctaaatacgatgctgtgtacgatgccgcacaacttatgggcatcactgttgaggaaggtaatgtcggtagcatcgctattgcctttagcacagcacgtgcagacggtaaatctgattggtgtgtttccggcatcagccgctacatcgaggtcaccgaagccttggatgctgcgcgagctgtcactaaaaatactgctgcgctcaataaaactgctctaccagacgtgcagccggcgccggttgtgcattcagcacagttcatgaacaagtccgcacacgatcatggggttaatactgcggaaaaagatcaaccaaccctgttt

SEQ ID NO: 1895 - DNA, 423 bp, Corynebacterium glutamicum
atggtgatgacctcaggattctctcaggaagagtggtgtgtgattatcgccgattcgcccgaacgcagcttcgctgtcgttgttttttctcttcttgcgcagacacccacatcaaccatcacccgtgcaagaaaaaagaaccccgtgaagagaatgttctcttcacggggtaatgggtctttgagcgcttacagtgctcgaagttgttccacaaaatgctcattgaacagtacaaacggtgagcgtcgatcacgcagcagtgcaattgcttcatcggcggtgcaatcgttgcgcaacatcaacacccgtgtcatgagtgcagctgagcggttgatacccatctggcagtggataagcacgttctcagattcaggaatggttgtagcaatatgttctgcaacaggccacaatgccttcaagtct

SEQ ID NO: 1896 - DNA, 738 bp, Corynebacterium glutamicum
atgtccgcagctttacctcacacagcagcagatcccgtacacaccaccccagcgaaaccgctgctcgatcatgtcttagattcactaggacgcagcatcatcagtggtgaaatggaagccggtagcacattcaaactgcaagacatcggtgaaaaattcggtatctcccgcaccgtcgccagagaagccatgcgtgccttagagcaacttgggttggtggcctcatcgagacgaattggtattacagtgctctcgcacgagcactgggctgtctttgacaaagccattattcgctggcgcctcgaagatgagcgtcaacgtgaacagcaactgcagtcactcaccgaacttcgtattgccattgaaccaattgctgcacgcagtgttgcccttcatgcatcgagcgcagagattgctatcatcggtgatcttgctgcacgaatgcgtaacctcggtgaagctggtcgtggcgcatcacaagaattcctagacgcagatgtgaaatttcatgagcttattttgcagtattgccataatgagatgttcgctgccatggcaccacccataaaagctgtactagtcgggcgcaccacacttggccttcaacccgatcgacctgccgaagaagtcttggacaatcatgatgctctcgcacacgcactaagtgttcgtaatgcagacctcgccgaaaaagcatccaggagcattctgaatgaggtgcgcgacgcactgacctcg

SEQ ID NO: 1897 - DNA, 789 bp, Corynebacterium glutamicum
atgattaacaaaaggagtatgtttatgtcgctaaaaactcgccgaatattcggcgcacttgctgtttcgctatcaatctctttctcagccattgctacacctgcagcatccgcacaagaactagtggtgagcacatcagcagtaaacgaatttggtgtagttaccagtgacatcacggctgagcaaattcttcaggcgcaagatctaatcgctgagatgaaacagtcagaggacatatatgagtatttcggtgccttgtctgacgttgaacagagatccatcattgcagctgtaaaggaaaatccatatctcattgagaacgaatcaccccgtatgagagtccaaagtgaaacacccgacgaggaaacacctgataagaaaaagccgagcaaaacctacaagctctatatgagcattctcgaaatgatgtcatgtatcaatcttgttgatgttccgtcatgtgcccaagcccttaaagcggcaaatatagctgaacgcgaggccaaggcccgttaccccgattcggtcactaatggtaaaggcgatgcccttcgtcattgtgcatggagcgctctcatgactattcgaatcggaaaagatgcagccgaaagaattggtaacgctcatgaaaccgttgtgagaggtgaacccgaagaaagagaaatggatctcatcaataacgcgctgggtagagacatcggcgaaagattcatcatcaatggcgatgaaacgggtgcgctcagtacttgtgtatccatggctaatatcgggctacttcatactctgttg

SEQ ID NO: 1898 - DNA, 456 bp, Corynebacterium glutamicum
atgaaaatcaagaaattcagcatcacagcgctagcctcagttctaatgctcacgggttgcgcgaccaatcacagctcacctctgtacagttatctgaatgcgtcaacatcaaccactgttgaacaagtacgtctcagcgatctttacggtgagcagtggaccgagttcgctcttgtctgcccctacaccacaaaagacgaggtaaaagaagagcttggtataaaaataaacacctacctcaccgattcgaccgatgacagtagtaacgatattgtgctcagggataaagacggttcatatgattggatctatttcaacagattcgacattgtgtacctctgcaacggctcagcggaaaatctaaaaatctaccccattgattcagttctagaatttgagcatagagacgactacggtacctggaaactgagcgctatcacagagccgggtaatcaa

SEQ ID NO: 1899 - DNA, 186 bp, Corynebacterium glutamicum
atgtctgttgacgatctttacgctgttgctctcgatactcacaccggtaagcctatcccctgcgtactctgtgaaaatgctccacagattgttatctacgatggttgctgctcgcttgcatatacccaagcacttggcgatctcgccgaagcggaatactacggcgccgatcttgctgcagctgcc

SEQ ID NO: 1900 - DNA, 672 bp, Corynebacterium glutamicum
atgcgccacaccacgtcagccacatcaactacatctattattaagcgtgctatgaccattagtgccgctgttcttattgccagcgctgttggtctcacaaccagcgcaagttcgctcaatactctcagcgctacatcacctgaatcacccgatcaggcagccactgtgtcacaggctgaatcagatagtgaattagatgacggcatgaaaaagcttgcaaccaagatccttaatcgcgctgacaacgctgaaaataatgatgacaccggcaaaaacctcaacaatgatgataagaagctcaacacgaagcagccgcagcgccctgctgaaaaagttgcccaggcgatcgagctaagccttgataccaccacgaatgcagaaaagcctgataaaagttttcaccatgaaaaacccgtaaacgcctatgtcacaagtgtcagctacaacaaaagcaatgacacctggactatcaaaccatcagacagcgcggtgaatacaccgaccaatgatgctgagcgcatcagcaatatcatccaagaagctcgcgacctcggtctcagcgacgatgaatccttgacgcaacagatcgcatttcacgctcatgctgctaattatttagtcaccgaatgggtacttcgcggctatcagcttgctaacccgaaggtgcttcca

SEQ ID NO: 1901 - DNA, 417 bp, Corynebacterium glutamicum
atgagaaaacaacgacgcatgatgatggctgtagggtgtgccggaatcttgagtaccctcgctgtcggcctcacggcgtgtagcaatgacgctgcgctatccgatttcttcgagtcggcatcgcttcgagatcatctcgctgcgcacacaccaggtgaatcgtctcgtgataccgcaactgtgagtgtgtctctacatgagttctacagcgtgcaatggactgacttcgccattgtatgcccaggaatctcgcgtgatgacattactgcagctcttgatagtaccgttgttggtgataattatgatgatattcccgcaacaggtttacccgacacagcaagcgcactcgtgaccaacacccatccaggagcgtaccggccagacccgcctctaatgcagagctcaccgctagacaag

SEQ ID NO: 1902 - DNA, 315 bp, Corynebacterium glutamicum
ttggaatgtgacatgaggaaactagcttcgattggtattgcaatagcattatcgcttgcaatcactcctactattcaggcgaatgaaataatcacgcctcaagccatggatcgaattgcagtaaagtgcaatgtccacaaaatttggtcggttccaagcttgaacaactatgacggttgggtcgtagttggtcatgcctattctaaggttgaggctgaaaaaagggccaatactttcgtcccatttggtcatactaaacgtcattgccttccggtacctattgaccgctttccgtttgaaggacttaaccgaagt

SEQ ID NO: 1903 - DNA, 369 bp, Corynebacterium glutamicum
atgcgaaaaacttatgtctttctaactcaatttattgtagaaaaaggcaatgaaagtaacgcctacaacagatatcgcgaacgagtgcagaatctattggctctggacggtgttgatgtaatttcagtttctaaaaaccttcagcaggctgaaaaagcttatggatgggagtcgctttccgaccaatatcaaatggagcacgacggtaaatatccagaaaaccatattctgtgcgatgtttacactgtggtcgttctaaatgacatagagaaatttgaagaagctgctgaactcttgatcatggatgaccgagacgtgagtgttgatgctttccccagtcgcgtcgacgctttcgaacaggtgctgttt

SEQ ID NO: 1904 - DNA, 207 bp, Corynebacterium glutamicum
atgagtgcgcagtggggacatggttttaataaaggactgcacaagggcagggttcagggctctgtaggagcatctttggtgctgttagcaggtgtagggctggtcggaggttctaaaaaactgatggagaaacgtcggcagaaagtatccatcgctgacagtgatcaatccacagaaggtactgcgactgattcaggatttgatgag

SEQ ID NO: 1905 - DNA, 2202 bp, Corynebacterium glutamicum
atgagcggactgtttaccccattttcagatgcggcaaaaaacaacacggtaaaaactgatggagattcagtatctggtcgagacttgcctattactaagatctctgaggatcgtttcgagcgttctgcgtattcagcccagctggcaaatataatctgcgatgtggcaccttggggagcgagcactgttttcagtcttactggtcagtggggcagtggtaagacatctcttgttaatttgattcgctcggaagaatctctatcgaacgaaaaatggacaatcgttgatttcaacccgtgggtggcctctgacccgcaatctttgattgaggagttttaccgagtaatcgttgggacggtacctgatgataagaccggccaaaagatcaaaactgttctgcagaaaacctttagcacgattgggtcaattgcaggtggggtcggagggtttggtgtcctagaagcacttgcgctctcaaaaggagtagatgctgcaaacgctgtatataagacatggaaacaggagcaagattcgtggccaacgctgtatacacgtgctgcgaaccattttaaagatctgaacaagcgaattctcattgtcgtcgatgatattgatcgcctccatactgatgaattggcgctgttaatgaaagtaatacgcttgcttggacgattcccgcaggtgaattatcttttggtttatgaagaagaatcactgttaacgacgctagccagatcgacagctgtaggtggtagcgaagatgatgctttgcgtttcatggagaaaatcgtgcagtatcctttcgatgttccgcctctgacatcatttcaaatagagaaagagctcagtgcattatttgacaagcttttccagggtgtttcgctatcgggtgatcctgaagactttgcactagtgaagtcgagaatgttcgatgtctgggaaaagactctggtcacgccgaggctgttgcaccgttttgctgctctactaaccaactggactcggatatatggatcaggtgaagttaacggcgttgatctcacaatacttgcgaccattcgaattgtttttccgtctgtgtataaacgtctttctcgagcgaaggaagtattgcttcaaggaggtcgaacgacaggctcgcagaaacccggttgggaaaagcaattatgtgaggggatgaacaacgagcagatggatcttttaaagaccatgcttttgttccttttcccacgtctttcggatcaccctagtacgagaatgcatcgtgagagggggatctcgacggaagtttattttgacacgtacctcatgtttcaaagacctggacatgtcataagtgatgaacagttggataagtatctatctaatgcggacgatgctatgggtttcgtcgatttaattaactccgatgacaatgacatggtggcatcagtgatgaaaaagcttcctctagcaattgatcgacttgatggagagggtgttaggcacatggcagttgaggtgttattcaccgctgctaatggtatgcatgataaaggtcgtcaagtgcgtatgagcggcatattcagtgacctgtattcccatgcgtgctcgattcttggtgcattgcctcaattaccagtggaacaactctatgagaaattcttttctgagatgacgcttaatgaggctgctttctggttaaaccaggtgggggaaagggctagagcctgtggtaatgatgtaagtggccttgagctttttcgtaaagttaatataaagaccgaagctagaattttaagtgtattgaagaatcaggacccctcagattgggatttaggtccatattcgcttggtattttggcgaaaagctcgaatttttcttcagtgctgaagtctctgcaaagtggtatagaggaacatcagtttgatgtgatagatattggagtgcttttcttaacgactgtgtattcttcgcgacagggaccaagcggtggtgcatggatagattcttttcagcatagtctgttttcacggtacgtacctgattctctacgggctataaccaagtctgaagtagatgtagaactaggtaagatacagttcacggattttagctgggaagggaagcgaaaagttgtcgcatatgcactggagactggaagaagtgatttcactcgagaacgattagggggctacagtatcgcagattctatagtcgat

SEQ ID NO: 1906 - DNA, 1746 bp, Corynebacterium glutamicum
atgagatgctatttacctacttttccagtggtgtgtcataagatccgaagcatgactgttttccatgattttgaaatagtagttaccccaaatcctgatgccccagaagctttgcaaaaaataggagaacaatactggataatctcggagattaacccagatctgaaaactgttcaatgggcgcagaatgtctcagatattgaccatcaaccctggtcatcttccgcctacctcgctgctgcagcagcagtggatgctacagtccctaccgcacattgtagtgcatgtgattctatcttgacgttaacgtctcgtgccgcagtgagcgaggtactacgagagcgacctataaagtgcaaaaagtgtacccccaagattgatgaacacatcaaaaaaatattagacccagcagcccaggcgagacaaaaagaacgcgctgcgcgaaaacgggaagaagactgcaaaagggcgcaacagcggcttgcagatcagaaggcgcgagaggcgcgacagctgctagatattgaacgtcagcaggtgattgcagatcgctatgggccgttggtgaatatgcatagcgacgctgtgctagcgggtgcttcaataagagcaaaaataggtgctctcgcaactatttacggtgctcaaaacttagagaatgtcattcactcagttagttttactgacagacgtatttctcccgatggacaactgtcgaaagaattatttcgcgaagcttggagcgcaaaccttcttatccctgatccatcttctgatgtggaagcgtttgcgtggagcgaaaagaattccactgagctagcgggaggcatattcgttgagaaaatgctatttactgtcccggacacaggccgctccaataaccgtgtccagagcttctcagaagaacttcgtaaccacatttctttgaaagatatgtattctacacaacgtgaagagctattagaccttgcctacgagctcatggtgggggaagcagtacgttttgctaacttccgcctttatgatcagaatctcccaccacttactgaagcaaatatagacaaattgagagcccatctacgtgaggccgcagctagtgcgtcactaggagtgttatatctaatggtgtggcgatctgtaaaagacgcagctgcagcgcacactaaacatacaagaatgagcaaagaaaatgcgacaacgcatagtgttacaaaagtttctatctttgttgaccaattattaagcggaacattcccttgttcaaagccttttcacgaatcttcacaagtcccactgagtgaagccaccaagatagtttttaatttgattatggagtcaccgccgatggaaactgagccgagtgtgctgcgaaattccctccaagaacactcggattgggagctattgcaacagtgtgatgagaagattcctgatcgggagtttctgatggagtggttatatcaagaacagacgtggactgcagagcaattttttgatgctctagctatggtttcttctagcgagtttcgtatatgtgcacctggatgtgcgcatcaagtaagtgcagacatcgctacacaagtcttagaattccacgatcgagtgtctttccatgacgatcgtaaaagcgccatgcttgctgctgaagcaactattattggtaacaaaattggttcacaagcacgggccggagactttgttttaggtgaagtaatcaccaagctgcagaacatacctggtgaggta

SEQ ID NO: 1907 - DNA, 219 bp, Corynebacterium glutamicum
atggagaagtcgtggattttcgcccgtaaccaccaagaactcgccgaggtactcctcgaacatctcgacatcacccatgacagcgatctcgtgcgcctcgcagcagcgtgtctcgactgtgaggtcgatgccgtcatgtgggtagaagacaaagacaatgaaccaccactcaacagttttttcacactcagtgcagtgacactactcaacatctatcta

SEQ ID NO: 1908 - DNA, 144 bp, Corynebacterium glutamicum
atgggaaaatctgaggcacttcataccggcacacttgatctctgtgcacatagcgatactgatgttcagttccggccactcaacacagcgctgacattccactacaatgcagactctgcagtatgggaactcgcgccatttgac

SEQ ID NO: 1909 - DNA, 429 bp, Corynebacterium glutamicum
atgtattccgacaaactgattctcttgttcctttctgagcagcattcaagctatgaatgctgcgtaggtttattagatggctcagatggacgtgattatattgaaaagcttctgaagggtaggaagctgaagaaccattttcttgaatgggaagatattaacaaggctgatgttgctcgtgaagaaatatataaagggcaattggtccatctggtgtttgtgacggctctttccacgcctggtgaaatttcttttgtttttccaggtcaatctctcatgagtgcaacactcgaagaagactttgctgcacttgtgctcgaagaggagcgcacatcatttagacctgatctgtctcacttgtggtcactccccgtagggtgggtagctccggggcttgagggtttcgtggagcgtaattcagaggcagct

SEQ ID NO: 1910 - DNA, 534 bp, Corynebacterium glutamicum
atgagacgtgtaaacgctgccgtggtcggagtgaaaaatcgcacctttgaggtttccacgctggtctttagccatgagcagcgcgtcctggaccaagctcgtgcgcatgtgatctgcgatagaaaagcccaccaacctgcgggagtaacagtcaatgaccgtggccaggtacatattcgacccatcctgaattggcagataggtgatatccccgacatagagctggttcggcttgtcagcggtgaacttccggccgacaaggtcagggaacactgtcttggttttgtccggcacggtggtggtgaccttgcgtttctttgtgtatccgaacagcttcaacgatcgcatgatccgggcaacccgcttgtggttcgcaaggtcatggccgatctggtctttgagttcagccgcgattcgtttggccccataacagccactgtgagtggtgaatacagtcttgacctggaccccaagaatagcgtcgctgagcaggcgtttttcacgcgtgaaggcggtgcttttccatttgtaata

SEQ ID NO: 1911 - DNA, 894 bp, Corynebacterium glutamicum
gtgatccgcttccgattcgttgatgacgctcgaaagacctactcggttaagcggatatgtgacgtgttgaagctcaatcgttcctcatattacaaatggaaaagcaccgccttcacgcgtgaaaaacgcctgctcagcgacgctattcttggggtccaggtcaagactgtattcaccactcacagtggctgttatggggccaaacgaatcgcggctgaactcaaagaccagatcggccatgaccttgcgaaccacaagcgggttgcccggatcatgcgatcgttgaagctgttcggatacacaaagaaacgcaaggtcaccaccaccgtgccggacaaaaccaagacagtgttccctgaccttgtcggccggaagttcaccgctgacaagccgaaccagctctatgtcggggatatcacctatctgccaattcaggatgggtcgaatatgtacctggccacggtcattgactgttactcccgcaggttggtgggcttttctatcgcagatcacatgcgcacgagcttggtccaggacgcgctgctcatggctaaagaccagcgtggaaacctcaaaggtgcgatttttcactccgaccacggcagcgtttacacgtctcatgcgtttcaggagacgtgtaagaaactagggatcaggcagtcgatgggatcaattggcaccagtgctgacaacgctttggcggagtctttcaatgccgcgatgaagcgggaagtcctgcaggattccaagacctttgaaaatcaattgtgctgtcgccgggacgtcttccgctggtgtacccgttacaacacggttcgccggcattcctggtgtagatatctggctccggtcgtgtttgaggagcgcggtcctgctatcctgagatctgcttcc

SEQ ID NO: 1912 - DNA, 294 bp, Corynebacterium glutamicum
atgccacgcaagacctacacagaggagttcaagcgcgacgctgtcgcgctctacgagaactccgccggcacctcgatccagaagatcgccaatgatctcggaatcaaccgaatgacccttaaaaactggattactaaatacggggccaactcaactccacatggcgctaacacggccaccgcgctgtccgaagctgaacggatccgccaacttgaaaaggaaaatgcactcctccgcgaagagcgtgacatcctgcggaaagcggccaaatatttcgcggaagagacgaactgg

SEQ ID NO: 1913 - DNA, 213 bp, Corynebacterium glutamicum
atgacaaccaccgaaaagatcgtggcgccagccacatcggtggttgttaggggcaccccgaaggggcacacagcggaagacgaagaggggaggaaagacagcgcagcaactgacccctctttggcttgggagctgggtgataagggccgtccgaaggacgggggtttgcgtcagcaaaccaggtgtatcggctatgccgatcggattgagaat

SEQ ID NO: 1914 - DNA, 1299 bp, Corynebacterium glutamicum
atgtccgcattatctagaccgcacaagatcgccaccggcgttgctgtcgcaactcttaccctcaccttgtgtacctctgctgccggcgttgtccatgcagcgcaacaatccatcagcggtccagaatcctcctgtgcttttaatcaacagcgttgggatgacagcaaagttaagcttgacgacaccatcgctacggccaaaaactcattggtacaaacaggcgaactgcaccgcaacgaacaggatctacttactggctatcttttccagcaaccgcacagcagcaattaccttgcactcaacaacgcttatgccgatgccgtagcaatcaaagacagctttgtccgcccaacatgtgacggttctaaagagtccaagattgccagcgaacacgccgtgtctgaggttgtgggtgcagtgaatgtactcgcccgagcacaaaaagcgctgcagattaactccgacacctacgaacagcaacgtcgttgtgatgcccttcgtctagcaagccgagatgaatcagatgttcttatgcgcattgatcgcaccatgctgcagcttcgtcgcacactagctgacattgaccaggcgtccacagacattcgcgatattcgggctcaaacaacaagctttgaacgtgatcttgcccgcgagcaaaaagaggccgacgcagcagcacgtgctcaagctgtagacacttcgaccacaccaacatcaagcacagaagatcgtgtcaacgacattcttaaagagtcccgtaccgatcacagtggcgacagttacacgcgctcaacgacaacgagcgcacaaagcactgagccggattctgcaaccaacacctcatatctgtcacgtcgtctcgacagcctggaacgcagtgcgcagcatattgatctcaatacccagtgcgacaacctcgatgatcttcgtgaactcaccaacaatgacacgcgtgatcacaccggctccgtcatttccattgccgatcaactcacagacatcaccaatgaaatcaatgaattacgcgatagcacttttgccaccagagacagtgcccaacaagcacaggatcaggtaattgctcaacgtgaagaactgcaacgagcaaaggaagcacgactagaagaacagcgactcgccaaagaagcagaagagggcgctcgcaacgcagcaattcaggaacgtgacgcggccgaagcagcactgcgtgaagcacaagacctcctcagtcgcctcgatgacacaggcaacgcaaccagtgatgacacagcagcgctagtagacggtcttctcaataac

SEQ ID NO: 1915 - DNA, 1878 bp, Corynebacterium glutamicum
ttgaaagtagatttttctatgaccgttacctcaccagcagcgctcgcactcagcgacatgtcctatgtggacatcattaagaagaagcgcggatggacaaccgagtttttccacagcaccatcaacaccggtgaaaccaccacaccgctaccagacagcgaccgtgccacagcactaatccatgaccacatcaccaaggctcaagagataaccatcatcaccgactttgatatggacggtatttcagccggtgtcattgcctatgcaggtcttgccgaactgggcgcacaggtcaatatggtggtgcccgactatcgtggcgaacgaaatgtcacagccagcgatattgatcgtgcgctagagctctaccctgcaacctcactcatcatcacctgcgatgtcggcatcggctcccatgaaggtattgcccgtgctcacgaacgcagtatcgccgtcctggtcacagatcaccacatggaggtcgaaccctgccaggccgatgtggttcttaaccccaacagaattgactctgactaccccaacaaagatatttgcggtgcgcaggtcattttcgccacattgagtgactatgcacgtcgttatcgggcggacaagattatcgacattaatttgttggctgttttctcaggcattggtgcactcgccgatgtcatgcctctcacccgtgacactcgaccaacagtgaagcaggctattgcgttgcttcggcttgctatcccacaagtaagtaaaaaccgtttcggcggttgggatacctatgctgcacgctctgttaatcctgatacgtccacactcatgcatattgtcaatgccagccagcatgatcaccgcttcattgcagccttccaaggcatctcaattcttcttggtgaactgattgcgcaaaagaagctagtaaacatcgacaatatttctgagtcattcattggcttcactcttggtccgatgtttaacgctactcgtcgtgttggtggcgacatgcacgattcatttctcgtgtttgcgccccatgccgcactagcatcacagccgtcgatgaatccaaatcgacatgctgcgatctctcgcatcattgataacaacgaacgtcgcaaagagctctccaagtcctcttatgctgccgtacacagctcagatcagccctacgcgccctttgtgtggctctctgaggcaccaagcggcattcttggtctcattgcctcacagctcactcgtgagtctgacgtgcctgccattgtcattaatccagataccttgtccggttcagctcgctcacctgagtgggcaccgatcatcacccaagtaaacaccctcagcgcacaaggtcacggcggtattcatgctgcaggccatgagtacgcctgtggtatgcgttttgataaccatgatgacattgtgacctttgttgcaacactcgacgcactcgataaaaacacgccacgggaagcacagccggcagatctgcatttggttgacattgaccacgcgcgtcctgtgcttgataacccctcactcacccaagagctcagtacggtcgatgctgcagtggatgctgcacagttgcttgttctcattgatcagcttgatcaactgcagccatttggacatggttttacctatccgcgcatcgacgtgacgttcaggccggcagaaacagaattcaaggttatgggtcagcaccatcaacatctcaaggtgatcactcactcagggttgaccttattgtggtggaataaggctcagcagctcgatgagatcgcacagtctgaattagtcaccatgtctgtggagctcgatgtcaatatgttccgtgggtttatttccccgcaaggcattgtctctgcgtgcacagttatc

SEQ ID NO: 1916 - DNA, 780 bp, Corynebacterium glutamicum
atgactgtgaccaccgcacaacgaatcgctgacgaatttcaacgtggcattagtatcggcccgtgggatctgtgcgaagtaccagcaggcgatgactatttagagcacaccaccaaggtcaggcgacgccacagcacggctgtagagattcacactgactctttgatcatttgtgcgcctgaaggcagtacgtacagccacaaccgcactaaggctggtcttgcgtccacgggcacagtcactgtgccagtgaaggggctttctgagcctgtgaagcttagtctcaatcttcttgctgattatggaaactcctttgacactgtgcacgacgatctgtggcaacgagagctgcgtgagcagacgcgggggcagttactcacacttaatgcagtctccggtcttggggatgacagcgtggcgattatgggcacgccatggggcgatggtctcaccggggaggccaacaccattaaaggtcgtgagcattttgtcatgtgggctgcagggtgccgctttgaagacggttatggtcgtcacgcacttcgagaggatcgccatgtgcgacaccaggcacgtgcgggtgaggattccactgcacatcacggttggttgcttaaaggcacagtgttcgggaaagaactcaccggtgatgctgtgacggcagccatgacagtttttagtgatgtggtggtcactgtcgatgaggggcgtatccctggcatgaaatcaggacaaccgttttctatggcaacccgtttacgcgcatcatctgcgcctgtg

SEQ ID NO: 1917 - DNA, 1650 bp, Corynebacterium glutamicum
atgattgcgcgtactgccattgatgactgcattaatcgactaggcccagatgttgtcaccatgtccagcgaagacattgctgatcaagtggtcaactccattaacgttgctattgccagagaaaacacacgtgcccaagatgccaatgctgcggtgcgttacacacctatctttaagctcgatttctcccatgtcgctgtccttatgcgcagactgcatgtgattatcaacatcgcgccatcgcataactctgatcctgacagcgatatgttggctatttacgaccccaacccacgcagcgagcattacgggatctatcgcacctcagaggctgaaatacgccgcgtagcccgtgaatactgccctgacctcacctcagcgcagtttagagaactgcagatggcactctcagatgctgcacctcgtaaagtccgccacaagcagcgtgacttgattcccgtgaaaaacggcatctttaattactcgactaaacaactagaaccgttttctcaagagtttgtctttcttgctaaatctgcagtgaactacaacccaaatgcacaaaaccctgtcatcactcatccccaggatggctctgtctgggatgttgaatcatggatgaacgatctctccgatgaccctgaagtcgttaacctgctgtgggagattatcggcgctatcgtgcgcccctatgtgtcctggaacaagtctgcctggttctactcagaggccggcaacaacggtaaaggcacgctcgttgagctcatgcgcaacatcttgggcgcagaggcctataccagtatccagctctcggacttctctaaagagttccaccttgaatcactgactcgtgcacaagcaatccttgttgatgagaacgatgtcggcgccttcttagaaaagtcagcaaaccttaaagcgattgtcaccaatgacgtcatctccattaaccgcaagcacaaaaccatgctcagctatcagttttatggctttatggtgcagtgtattaacggcttccccaaggtcaaagaccagtcggagtcatttttcaggcgccaactctttgtgccgtttgagaaaagcttcaccggtgccgagcgcaagtacatcaaagacgactacatgtcgcgcactgatgtcctcgaatatgtactgcaccgcgtactgcatatgaactacgacaatctctccacccctgctgcagctctcgctgtgctggatgaatacaaagagtttgtcgatcctgtgcgcgcattctggaatgaattcagcgatcaatttgtctgggatcttcttcccctgcaattcctctacgagttttatcgcaagtggtttgaccgtgacagcccatccgggtctgtgctcggcaaacgcagcttcattcaaaaaatcaccaccatcgccgttgatagcggtcagtgggagtatccgctgacagcacagcgtcccggtggcgatatggccgttcctgagccattagtcattgattatgacctcaccgagtggcaaaacgccactgtacctaaaggtcacgtcaacaaggggctccctctaccactcaaggctaattatcgaggactgctccgcaaacctctaacaacacctgctactccccctgcagcgccgctcaaccccacaccacccacccct

SEQ ID NO: 1918 - DNA, 3789 bp, Corynebacterium glutamicum
atgtccgctccaaccatctaccccggcaccaaaacatctattgatccgatcaccatggatgacgctcgcatcatctttttcgatattgagtcgctccacaatattttcacggtagcaacctacgattctctgtcccaccacgtcgatgtcttttacctgctcgatcacacaaccagccctcagatcacggtgctgccgcactcaatggattatttcgatcaaacgcgcagcgatgctgttatggctgccatcattgagcaaaaccctgcgttcgcagaaattaaaggctcacccattacaaccgcagatgtagccctccacaatctcggtgacaccaacgccaaccgacgctggcagtctaacgtgctgcttgcccggctactcgggggtattagtgtgcgcggagaggtacctgagcaccagagccacaaccatctcgccaagcagtttgccgaggcaaccttggtcaccagggacttcgatgtgaattatgatccaacaagcgctcacccttttactgctggcttcaactcgatcaactatgacaccaccttgctcagcctgtacttcgcaatgttgacctcaaatatcggaagtacaccgacgtatttcccggtgatcaccgcacaggaacttcgtgcgcataacgacaagctctttagccctgagttcatcaaaaacatgccaaagtatctctgggatcgcgacagcggtgctggactcagagctgcatcgggtttccgcaacgccatgctcaaatcgggtcgccacattgatattcaacgcctcaatgaaaaacagctctttgttggactcaagcgcctgcttggtctcctcggtcaccagattctcgaatctgatcgtctctctggtgatgatgcccatgttgatactaacgaggatgtacttgatctcattgcctacaacgtctcagacgtggtgggcaccagactgctcgctgaggacccggtgtactccggctctttcgatctgcgggcaggtctactgagcacctacccagagactgtttttgatcatgatggtactttccgtcagccatccacgcagatgcgtaaagatcgcctaacgattaatacctcatcagctcagttcgcagcgcgtattttggcgccatatcgcccactccgcgatgtccctgatgcgattggcgacatgccggtggtgtcttacttgtacccggatgcagcagtcgccgaagcaacaggtcaaaaacaagtcaacgtgcttgatgagtcaaagaagttcttctatgacaacatcaccgacccggaagcacgtgctgcctttgatgaggtctttgctttttacgctgatattgagggtcgcaacttcaacagtcacaatgaggctattgatacccagattaaccaattacgtgcttatctcaaccaggttgtcgcattcgatgcagctgggtatgcgctctatgatgtacgtacacgttttgagcagatcttccccaaggatcgcagctacatcaacgatgctacggatatgacccctcgcgcagtatcgagctttgacgatctggttgcactctgtgatgatattcgcggtgtacttgatcgaggtttagagatctcatctccgaatcatcatgagatggtggatgctatgcgcaagcagctgcactatattcaggcattttaccgtgcctggggacccattcaacgccgcttcaatgacgctgacccagcggtgacccatccgcatctcacagtgatctacccaccgctcacccctgcatccgcagagaaattcaacaagatcacctcagtcgctgctgtgagcaagcgcccaaccaccctgccgtatttccgtgcagatggttcacctactcgtggctttgctaacttctccacaggaggtattcacggtgcggaatacaacgaagatcgttttgaccatgatcaagatctacacacagtggcaacccgtgaattcttcgccattcttgatgcgacattagcggctctctacgcagcccaccaagccgaacctgaatcggcggactaccagattgcacaagacgcactcgcctgggcaaagaatgtacttagcgatcaaaaactcatcgctaagtcgcctcagttatacaaccccgaaaccggggtcacctatgagtgggagtttgtcgctcaagcagcatggtggattcgcaacaaaccggttgaggttattttaccaacaggtgaatcaatgaccgtaaaacacaaatctgtattggcatctgcgtcctacccactccgagacaacgtggcgtactggcgtagcgaacccaaaacaccacagctgtttcccgtagcaaaatctggtggttcctcgcttgagaagaagtacaactacacctctgtgggtactgctattcacgaggactttagcagttactatccgctcttgctcaccaatatggctgcatttaccaatgctgacttaggtattgatgagaaaaccgggcgccctcgtgaccgctaccgtgaaatctacgaacaaaaagagatctatggcgcacagcgcaaagacccctccattgatgaagaaacaaagcaacgtctagggattttgcgcgaaggtaccaagttgattcttaactcggccaccggtgctgctgatgctggtcacgacaccccgatcctcatgaacaatcgcgttattgccatgaggattattgggcagctattttcttggagaattgggcaagctcaatcactggctggtgcaacgattatttccactaacactgatggcctgtattccgtactcgatatggggactaaccagcgcgttcttgatgaacacgctacagccatcggtgtgcaaattgagcctgaagaactggatattgtctccaaggattccaactcacgtgccgaatttctcggcaatggctacatcaatgcggccggtgacttggcgtgttgggatggacccaactctcggaactcactagatcacccggcctttgttgaccatgtgctggtgaagtatttccagctcgtcgtcaacaacactgtgccagagattccagaaacacctgagcttgagggtgtaccgctggctcttgatcaacccatgaaccgccacgaagtctcgaagattgtcgccactatgcacaaggaattcgagccgaaaaagctgctgtcgttttaccaaaacattttggcctcttcacgcggttctaataccttcctattctctgtcccctatatccctgcaacagaaggagaagaaacccaccctgcaacagataccagcactattgcgacaccaaccttgagctttgatgcttatggtaataaggccgaggtcatgccgactcaatccactgtggataagcgcgtgccctctttgctgcagtattacacgcgtacattccatgtgcgacaagatacgcagcaggctgtctttgatgttattggcgccaaccccgtgctcatcgccgcagcaaaagctgcatccatatcaccggcttctgctgattcacgtagaaagaagggcctggcctccaccaacgctgacccagtagccaagcatgtactagaaattgcaggagctgatgtggaatcgctgcgccatgaaaaggatctcaaggtcaccaagcacactggccaagacccagcactgcctgtcgtggtctttaaccaaaccatttggcataaccccaacgacgatgtgattaatgcattactgggcgctattgaccaggatgcctacattgacatggcgatctcgtcctacaacaagtcctggcacaacattatcccggct

SEQ ID NO: 1919 - DNA, 447 bp, Corynebacterium glutamicum
atgtctaccaccacgtccaccaccacaaaacacgcacctgttcgacctttagagacagtcatcgaacaagccttacaggatgcttgtgcagtacacaacatcatgtacttaaagttcacctcaagtgtcaccggcgtgcctgatcgcatcctgcagggtattaacgcagcaggacaaccattaaccgtctatgtggaactcaagcgtccaggaacacacccgcgtactcgccaaaaggaggtcatgaacagacttataaatcatggcgcattagtgttcgtcgtcgatgcgagagacatcgacgtaactcatttccgacacaactatcacactgtggaatcactcttagagctcacgtttctcagcactaagatacctgttcccgagcgctttgacctgtttaattcaaacacaaaagcgaacacatatagcgctgttccagcacta

SEQ ID NO: 1920 - DNA, 534 bp, Corynebacterium glutamicum
gtgaagtgtggggttccttgcgggcgtatgtccggggtgcttgctatgcttcaaacgatttcattcaagaaacttaatttattaacaactcttaaaagaaaaggagagctggtcatcatgatcactcgtcacgatgttccctacatcatcgctccgcctgtctacgcgatctttgcgagcctgatgaccacgccaccatggttttatcgaaccacctacaccattgacggtttcgattttaagatcagctgggtctacaccatcaccatctacatcagcctcatgatcctcattatcgggttctaccaagccaatatgcgcaaagcgtgcccttatgaggaagatcctttggtcgatatttggcacaaggtgtggagcactgcactctttatcctacctatcgttttatccatcgcggtgtactcactgatcacacagcgcgggtttgactggtatgtcatggtgtttattctccctgtaggcttgatgatcgcttatggattcttcaagccctgtgattgcgacaaacaccgt

SEQ ID NO: 1921 - DNA, 1839 bp, Corynebacterium glutamicum
atgacctcaacaacccaacctggcacaacacctgagctcagcgcagacactcattctgagccctgggatgtcgtcatcgaaaacacccttgaaccttttcaaaaagtcgttcgtcaatttattattgaccgcccctattccggcattttcctcaccatgggtggcggcaaaacactcactaccctctccgcattgacctatatccagccacctggacacattctggttgtcgcgcctctaaatatctctcgactcacctggcccgaagaggttcgcaagtggaatatccctgttaacgcaatctcgctgatcaccaatgagcgcggcaccaaactcacccgcgccaaacgcctcaaactctatgaggaaacagcgaccacaccaccaacgctgtattacatcaccattaatctgctcgaagatattgtcaattactttggtgataggtggccgttttggacagtcattattgatgagtcacagacaatctctgatatatcctccaagcgcactagagcgctcttttctgtgcgaccctatatcggcagactaattctgctcaccggaacccccagcgccaacaagttcgactccatttacgcccaagtcgcagtgctagattatggtgccagcctgggtgacaacatcgacgtattccgagccagatggtgtgcgcccgacattattaccgataaacaagtgcgtcgctggaagccggctaacaagcaggctgaagcagaggtgtaccgcactattagccacctggtcatgtctgccgtcaacacggatattaagctgccaccgctgcattttgttgatcacgaggtacacatgagcgacgatgagcaccgcgactacgagctcttcaaaaaggacgcggtgcttgctgcattgctcgatatggctgaagagaatgagggtggcgaaggcgctgatgacactgacgctgctgattcagcgacaacgaccccacctgcgtcatcacagccaacaaaccctgccatccccgctggactgcttcaggcaatacaacaaacccaggacaccaatggtcgcgccatcgcgcctgtgaccacagctgaacttgatcattttgatgatctgccagtacagcgccaagaagatcttggcaccttagttgttatctctgctgttcacgcagcgactctgcgcatgaaactgctgcaatacgcaggtggtgctgtctatgtcgatccagaagattctgcgcagtcccaagacctggatgccagcactgcacgtgatgttatcgacgctaccaacaccgccatgaccactattacctctcgccccaccatgattgtgcacctgcacaaggtgcgaaaagtcattgagattttatgcaaccctgcactcggcggtgaacctgtcaatatcgaccaggacgagaccggaaaacaggtgtacacacccaccccaacgcttgtcgcctatcgctttatctctgacaaagaaatcctgcttcattacctggcgcaggcgggtgtgcagggtgtggaggtttttgacgggtcgcctgacatgctgagccgttggaatgcgggacgcattccggtcttacttttgcagcctgcgtctgctggtcacggcttgaatttccagcacggcgggcatcgcttggtgtggtacaacctgcccgataataacgagcattatatgcaagcgaatgctcgtctacatcgcattggtcaaaagaatcccgtgaccattcaccgcattattaccgctgatacttatgatgcgaatatgccggcgattctggccggtaaagcaaatagacagcaacgtctcatcgacgccgtgcgccgtgatccagtc

SEQ ID NO: 1922 - DNA, 375 bp, Corynebacterium glutamicum
atgtcagaccacgacgccccacaaacaccgatccccaaggggttttggcagcagatcgaccaccaactcgatcgcctcggcacgcagcgcccagagaccttcgcagcactgcgtgacattttgcttgatcctgcctacaccgccattgttcatgaccgtaatcgctacggcgttgtcacctttgacaccaactcagccttcttctcaggctctggcggagacaacggcttagccgacgtactcattaactgtgattggcgcatgactgactaccgcgccgagtactactacgtcatgacacataaatacaccaaggaatcgtttacctatatcgagggcgacgtgaaacgcggcgacctcatcccgcctaataat

SEQ ID NO: 1923 - DNA, 336 bp, Corynebacterium glutamicum
atgactcagatcgccatgtatctcgcaggacccatgacaggtatccctgaatacaactaccccaccttccatgcagcggctaataagttccgtgcagctggctacaccgtactctcccccgctgaagacgaatatgaatcccagctcactgcaccattgcctgagaacgctgagcacaaatacgaccactacttgcgtctcggtatcgaaaagctgctcaaggctgatgctgtccacatgcttcagggatggcagagtagcgccggtgccactcttgagcacgatattgcacagaaattgaggcttgccattacctatgaagaaccaccagcatcc

SEQ ID NO: 1924 - DNA, 366 bp, Corynebacterium glutamicum
ttggttaggactatggacatggccattattcagtcggtcgaatacacatctgatgtctcacatgagcgcatcaccaatgtcgtctctgtaggcgtggtctacgagggtaaacagtatgtagtggaccttaatggtgacgacattgatactgagctcgatatgatcacgctcaaagaagtcatcaagattggtcgtgaggaatctgcacgccagatccgtcgtggatctgtagatgcagagctgcaccgtaaggcgcgtttgtgggctattgacaatgacatggccgttggtcaacgtggtatcgtgccacaggaaatcatcgacgcgtacaaagagtactgcgaaaaagaaggcattcctttcgaa

SEQ ID NO: 1925 - DNA, 618 bp, Corynebacterium glutamicum
gtgacttttaaagtgcttattcgcatcgccgagcatcaaggccggctccatgtccatagcccctactcaaaggcttttgccgcccgcgctcgaaagctcaacggtctctggtcacccgaaacgaagacctggcatttcagccccgataaagaacaaccggtgagacgcgcactcaaggatgtctacggctgggatgaattcaccacacccgagctatgcacggtgcagctcactgtgaccccagaggcagtgctcaacaaacacacactcaccatcgctggtgttacacttctgagccgtttacgcagaaattactcggtgtggttgggtgataatgtccgcatcatcagtggcaatttcccagaagcagcaggatcaccccagtaccccctcatcatgggtgtgaaggctcaacccgttgttatccatgtgcaggaattccctgtagatgctgtttcgactattcccccgcgatttaatcctattgttatcactgcaccgccgagcattgatattgctgctcttcgagctgaacgcgaacagctcacccgacgcatcagcgaaattgacaagaaaatcgcacgtgctgtgcatccaaccattcagactgaggctgcc

SEQ ID NO: 1926 - DNA, 537 bp, Corynebacterium glutamicum
atgatgcagactctcaagcggaaaattccgctcatctcatgcaatgacctcaaagaagtgcagttactttttcttaaaggtcagatgcacacagtcggctacaagctagataccgatcttcgcaagctcactaataccgatgtgcttgatcttattaacgcgctcttcggcaccactgtgaccagcgcagatgacgaagcagcagatttcattgactctgatcctcagtttgcagtgctcgttgagctggcctaccacgactgtgcacgccgcgctgccatgggtctatccagggtacagcagctcatctatgacaatgcggctaaatcaacctactaccgcagcgtcgcagctagacatcgcaaacacatccgtgaactccacgagcaaacacagcgagatggtattcacttcgacaacccgttgtctcgtgcagtcatcaacgatctcagcatgtccatgaaccgtgctcgactaaaccgcatcgcttcatggaaatcagccggcgtacagcgctatctcaaccccactatctct

SEQ ID NO: 1927 - DNA, 528 bp, Corynebacterium glutamicum
atgaccacctcatcaccccttaagtccaaaaattcccttaacggcgcgcagaccacatttgtccgcaattgtgttgcagacggcccaaccgaggtaaaagccaccattgatgcacgtggcggtatcgaacagctccgtgacaatgagatttcacagctccccgacaagctgtggttcaatagcgcaacctccgcatccaatgacgagttcaccaccgataacatccgacttgggttgctctacaacatggcactgaataaggcatcggctcatcgctatgagcttgctgcccgctggtacgccattgttagccctcagccatcgcaagaagctagccacaagcgcatcgcgtcctggcaccttacccagctgcacgcactggtgaccctatctcgcaccctaggggtcatcattcctggtgatgagatcgacgctctagcgcagtctatggagaatgctcgtcaagttggcaccgagaattggtccactgtcaccatgcgcacctacgtgaccaaccgcaaggcatcc

SEQ ID NO: 1928 - DNA, 798 bp, Corynebacterium glutamicum
ttggtccactgtcaccatgcgcacctacgtgaccaaccgcaaggcatcctaatgactcgcgatattttccacgaggctgcaaaactcatcgcacacctggggtggagggacgcttttccagcactacagcgcactgacccagcgccaacacatgctgtgccgatcagggcctttgatctcaaggcgggcgccgtcatcaccgatgaaaatcgaagcaatgcttatatctatgacacccttgtcatcacgcagccatataagcacgagttacctcatcaaaacacccacccttttgagtgggccctggaacaaattgccacgcttgatccggcgttctcgatcaagctcgatcgctcagtgaccgtccctgaaattggactctacgcccgcacactgcatgaccttaatactcggcatcaagacttcttggcacagcgcaacgccatgttgcttgttgttgcccgtcgtggtgttgatccaaaaaatatcgcagacgtacttggtttaaccaccaatcagatacatcggattctcagtgctactccggctgattcccctactgatttaggcgttaaccccgccacaacaatgggtgatgtagtgaggtttatcaagaaacgtcgcaccactatgcaactacgcggcaccgctgtccgtgcactgctctatcacggccttacgccggcagtcatctcccgactaagcggcatgtcgcgtgcgggtgtcatcaacgcagccaaggcattccccaccaccatcaaccacaaggtcaagaaaagaaagcagcacttccatgtc

SEQ ID NO: 1929 - DNA, 186 bp, Corynebacterium glutamicum
atgtctaatctcggcacatactatgcagcacgacgtgcagttattgggcaattgctcaatgaaggtcttgatgctgagcagatcgcaacacgattgcaactcagcccggatctcattaacgcagattttgaggctctagaaaaagagaaaggtgaggcccagaaaaagtctcaacagcctggtttc

SEQ ID NO: 1930 - DNA, 372 bp, Corynebacterium glutamicum
ttgtgcatttctacacacgctttgaaaggagaaccaactatgaccacccaaccacttgtcatactcttcaccctccacgccaatccctcccatgaccacaaagaacgcgccaccactattactggctcgctgagctccatccgtcgctggttggtttcgcaggcagatctctacggctggaatctcggtaatttctctgcttggagtcttgatcgacgcgatcatgaccctggtgaaatcatccctgagctcaatcaaaataccctgctcgcctgtgcatccctggtctgggatattccaccagctcatattgcactgcaggctgtaatacccaagccagaaaatatccctctgatgagagcagcgacgctc

SEQ ID NO: 1931 - DNA, 438 bp, Corynebacterium glutamicum
ttgtgcttagagcgtcgctgctctcatcagagggatattttctggcttgggtattacagcctgcagtgcaatatgagctggtggaatatcccagaccagggatgcacaggcgagcagggtattttgattgagctcagggatgatttcaccagggtcatgatcgcgtcgatcaagactccaagcagagaaattaccgagattccagccgtagagatctgcctgcgaaaccaaccagcgacggatggagctcagcgagccagtaatagtggtggcgcgttctttgtggtcatgggagggattggcgtggagggtgaagagtatgacaagtggttgggtggtcatagttggttctcctttcaaagcgtgtgtagaaatgcacaacagcccagcaacatgatgctgctgggctgttgtggcgtgcgaattggtggttttgtt

SEQ ID NO: 1932 - DNA, 576 bp, Corynebacterium glutamicum
atggcgattaaaggcgcaatgccgaaaaatcgagtaccaggtgtggcagcaggtgcgtttattgctgctgccgttattgcaggtggatcaggcgtgacctttctcgcccaaggcggtggtgatgtcaatacagtggccgtcgtcgagccacaggacgaggtaaaaaatcaggtcgtgacagaaaccgaaattgtcacgaaggttcacgatccttcttcatctgacgccagtgatgctgacagcaacacaggcaccgccgaaggcgcagactcagatcacaaagaaccccgtgagcacgacagtgctcaagagccaacggctccgaccgaccccaccttgaccattaccggcaacggtgacacaccagtatcagcacttgatgctgtcgcaggacctgcccgtccaggtacggtgcacgtcattgagaatggcgaaaccttgtcctctatttctcaggacagtggtgtgccggttgggttgatcattgatcgcaacaagcttgttgatccagacctgatctatgcaggcacgccattggcgattccgactgagcaggaacttgctgctgcgatacag

SEQ ID NO: 1933 - DNA, 1221 bp, Corynebacterium glutamicum
atgacctacccagttacccctcaacctgtgcagccagcaccagtcgccgaaaagatcaaggcatcaagcctcaaagaaggcactcaggtatttatcaaaggtcgggttaattactcccgcatcgcaagctttattactggtaccgagcgcgaaaaccgtaatcgcgacaggcttcacccaatcgaattcgactacacctccctgactttgagccaccctgaaatcatctacggcaacccgcaacaaaagaccaatgaagaactcttccttgagcagcgaatctttgtcggcaagaagcgtcctgaagagggtccaaaattctccattgacaacaagagcaaccgtctaccacaggtttgggtgccatccaccaatgctgatggtacttatgagcagcttgaaggtctcgaaggtgagctcgacgcagggctcaacgtcattattctcatcgagttctataagccacgtacacaggttaatcgcggctcccgcctcaacgccgtgttcctgcaggagcccattcgttactacacccctggttacaatgcagataagctcgctgccctcggaatcgtacttaacgcaccgccaaaggacactattcagctcgttcctaatgaggtcgctgcaggacaagaccagtccaccaccgatgcatccggtctcccgcttccaggccagggatatagcgcacctgatcagccatatcaggcgcagcctcagtatcagcaggcaaccccagcggctgcacctcagcagtaccaggccccacagccccagtaccagcagtcagctccacaggcacaacctgcaccggcaccagttgcgcagttccagcaggcagcgcctcaggcacctgctcagccagcacagcagcagtatcaggcaccacttcctgccggtaatcctcttgcagcaggtcagccagttgcaccacaggctccactcaaccagccaactccggcagtacagcaggcaatgcctacccaagccccacaaacaccggcacaaccagttcagccaccagcaccacaagccggttctgcatttaccgatgctccgggtgctgtgccacaggcaccagcagttcaggctgctcccgctgtagctcaggcgcctgtcgcgccagtagttgatatgaccgagccagcatccccatgggatcttccagctgcacctagtcagccagcgcagccagctcagggcatcacctacccggca

SEQ ID NO: 1934 - DNA, 852 bp, Corynebacterium glutamicum
atgaagaactcttccttgagcagcgaatctttgtcggcaagaagcgtcctgaagagggtccaaaattctccattgacaacaagagcaaccgtctaccacaggtttgggtgccatccaccaatgctgatggtacttatgagcagcttgaaggtctcgaaggtgagctcgacgcagggctcaacgtcattattctcatcgagttctataagccacgtacacaggttaatcgcggctcccgcctcaacgccgtgttcctgcaggagcccattcgttactacacccctggttacaatgcagataagctcgctgccctcggaatcgtacttaacgcaccgccaaaggacactattcagctcgttcctaatgaggtcgctgcaggacaagaccagtccaccaccgatgcatccggtctcccgcttccaggccagggatatagcgcacctgatcagccatatcaggcgcagcctcagtatcagcaggcaaccccagcggctgcacctcagcagtaccaggccccacagccccagtaccagcagtcagctccacaggcacaacctgcaccggcaccagttgcgcagttccagcaggcagcgcctcaggcacctgctcagccagcacagcagcagtatcaggcaccacttcctgccggtaatcctcttgcagcaggtcagccagttgcaccacaggctccactcaaccagccaactccggcagtacagcaggcaatgcctacccaagccccacaaacaccggcacaaccagttcagccaccagcaccacaagccggttctgcatttaccgatgctccgggtgctgtgccacaggcaccagcagttcaggctgctcccgctg

SEQ ID NO: 1935 - DNA, 1395 bp, Corynebacterium glutamicum
ttgcagggtttggggtcttttttcaccagggtcgaggcgcggtctgtgtgcccacctcgacccacttttcgcccaccacttttcgtcaacctaccaacaacaaagcccaggtcacttatggtcaacccttttcacacgcttgataactcaccgtttgatccggtggcacagtttcctgcgttttatcacaacccgcttatcaatcacttgggccgccgtcgcgcctggacaatctcagacatcaacaaacgccccatcaatgtccaacagatgctgaccacggccacctacggtagccccgttattcatggtgcccgcattgaagacgcagcaacctccctacttaccctggatgaactgcgtacacagattcccaccgctgccaacaatgcgttttatctcgatgctgtccaagatggctgtcttattttagatattgaaaaaacctgtccccccgaggtcgcagccacactactcacgctctcccccaccgccttttacacagaggtgtccatgagtggtcgtggctatcacctcgttatgccgataccagagaattttgcagcgtttcctgccgtacacaacaaacccagtatcaaacaccccaagcgctggttcgaaattcttacctcacagtggatcaccttcacccgacaaccaatcccagagcatgttctccatcacagtgaatctgctaacacaagtgctgtgccatggttgaatgatcaaccacttacatgggaaaacgtctttgcagacttagctaaaactgttgcacccaacttaaaaaccggtgccggacttaccatcacacccaatgcactgatgccaccagatctcagcgatgctgagcgcattcgcgacgatgaagtcatcgactcgacctgtcgattatttgccgaacattactcgaaaacacttgcggacttctatgatgatgcatcccggttcgagttcagccaaattggtgtcattatcaatctactgctccccactatgaggatgcatcccaccacgatcagtctcgacaaacccatcaactccgatcacatcatcagacttctgttcgctgtcgctactcgcgtgatcactcaccgcagcaaacatgatgaggagcgatctggcgttccgtatctgatgtatcaggttatttcctgccttgacatgcgagaacaccccgacaatggcgactaccgtgtcgtaccctcccggcataatagagaccaacacagcaacaacccctcagctcatgtggtccaccaacaaccacaaccccagcccagcgcagcagattcgccacatcactaccgtgcactaccccaagaaaacacggtgtccgaacacagttttaaaatctataacccaccagccacaccccctctaggaggtgaaaat

SEQ ID NO: 1936 - DNA, 594 bp, Corynebacterium glutamicum
ttgaacggagcgtttttcgccatgttgaaattccgcatcatctccacagtcactactggatctcagccaactccacgaaaaagctggagccaccccgacaccactctcctggtcaccatggtcactgcaccatcgctgtgctcagccatcaacgtgtggaacgcaactgagcgtattcccgctcaaaaaatccttaatgtcgaagaagtacacgttcttggtgagtgcagcgacgccatcatctctacgtcactaaccaaaaaggacaatccgcacgcacttgtgcccgatgatttcgaccaaatcggcgatgtgtttggctatgcgcaagacaatgtagctgtttttgatgtcattgtcgcagcactgggcggtgctggttatggcctgctacccggactggtcatgcaccacattgatgagcacaccgttgcacttgtctttgatactgattcccctactgggacgcatatcctcggtgagcgctgcgtgtactccgacatcattcacatgactgacgataagtctgcccgtggctggggtgcagtcattgccatagcacgagccatcatcctcaaagtcgaacagatcatg

SEQ ID NO: 1937 - DNA, 180 bp, Corynebacterium glutamicum
atggctaaagaattcgaattcaccatccctgaccaacataatcgtttaccgcttatttacctggtcgcagcacgcacaatcaccagcgctcgcactcagcttcgtgctgaactcgatcaggacgaccccgatttgctctcaagtatcgacattgatgcgctcccctacgtcatcgtcgag

SEQ ID NO: 1938 - DNA, 1257 bp, Corynebacterium glutamicum
atgtctctctaccttgacgacactttgtctcgcatcgttgaacttgatctcaaagacacccgcattgtgccgtttcttgctggtgaaccaggtatcggtaaaacctcattcatctacggcatcggcgaacgtgcaggctacaaagtcttcagtatctcggttaacacccttgccgataagggtgacctcacgggcgctcgcaccctgcaggaccctgccgatggcaagtggaagcagatgtttttcccgcacgcgaccttcgtcgaagcaaatgactatgcactagcaaacccaaacgaaacggtcgtcattcttctcgatgagattaaccgaactgattcggatgtcacctctgcctcgatgactatctctactgagcgtcgcgttggtaccaccgatctagcacccaatgtccgccttgctgtcaccggaaacctcaccggtaatgtcacccaccttgattcagcatctctgaccaggttctccctctatgaggtcaagccatccgcagagaccttcatgaacatcatgggcggccgcctcaacaagtacatccgtaccgtgctgaccaaatacccggaatacatcttcatgaagccaactactgctactgctcttattaccactggcgatgatgatgacgaccatacaaccaatgcgaagcaaatgatggacttcaacgctgtgctcggttcagaccaagacatggttcaatttaccgcacctagaactatcgaaggtttgtccgtctggctcaacaacgccgatgatgactttcttcgtctacttctacaagaaaaggtggatggtcttgctcgatccatgagcttgctgcaggctacgctcgaatctcacaccggcgataccgcttttaccgcagaagtcctcagcgaaatgaccaatgatctgctgagctccgcatcgcaagctcctagtggtccaatcaaaccatttgtctacgaccgactcgctgctgcaccaagcaatactgtactggaacaagaggttcacacactcagtctcaatgaccgcgccgatgtcttgttgtttgccctccatgacactgtaaacaacgctgcaccaagcatcatcgctcaccttgcatctgaaggcgtacttgatgaactgcccaaagacagaatcagcaaaattgtttcactcggtcctgtaccaacggcaaactatcacgccttgaccagacaggatacaacgttgactcgaaatctcggtcccgctgtcttgggcttcttggaaagt

SEQ ID NO: 1939 - DNA, 1854 bp, Corynebacterium glutamicum
ttgacactagtaattgaaagcgatcccctcatggttaccttcagcgtcgcaaatcacgcgcctcatacttttagcccattcgatattgaaccaccactcaccggtaacgccaccaccgacgaacatggttacgaacacacctcagtgctagaaaaactagcctccaaccacctgttcaatccaatcaatccgcaacacccagtcactatcacagccaccgaaaacggatcaaccgttgatcttgatgcagcagcactagcacaacatcttgctctagcgattaccccagactcaatgctggcaaatcatcaaggctacaaccgtgacatgatgggtctactttcgcagcttactaaccatgttggctttgatcgccgattcattgttgaccaactctttatctcccaagtgctcaaagcgaatcgtctaccagcaccggcaaacaacgttatttacaccgtgcccaatgacgttatcccatctgctaaagacatcttgtccaccactgcaaaaatgaacaatccactgacagttactgcaagtgccccaattactgttgacgacattcacacagcctatgaggtatttttcgcttctcttgcctcagtgtttttcccttatacctacggtgcggtattccttaacaacgcagaattcgttgagtttgttgattaccttattaacgaagcaacaacactgcactcggcatcactcatctccaacaacacctttaataggttccaatcaatgcgtaacatctccattgataatctcaccgccgagtttctcttacgcaaaaatgaagcagagacaactgatgattattcattcccccgcgtacttgtttccctgctgcattcttgggtgaaactcaatcacgatgatgctcgtgctaacaatgatgcacccacctgtgcactagcaccgtttagtgtggctcaatggatcatgccggagaccattgtgtttattaatgctgaagctcatgctcatgcatcctcccaggacattgagaagaaatggaaggaaattaatgcggcgttaacagggtctattcgtattatgtcgccaaatgcaatttccaagctgcaatctgctcagcatctcgggatgcaagcacaaatgcaggccatgcgtgctcgaaaagatcaccacaacatgcagaagcgttcctcacaagaaaacgacttttccaaggcactcccctcaccacagactatcgtgctttctgtcgcagaggttctgcgcaaactcactcacgtacgccaatcgcacaaccctcagaaataccagaagaagtctctgaccagagcttctcgccgacacccggataaccctaatgtccctggcaccattaagagcaagctcttctaccctgacctgcatgtttatgtagatacttctggttcgattagtgaagaaagctaccgcaactctgtggttctgctcatgcagcttgccaccaaactggacatcaacctctatttctccaccttctctcacgtgctctccgaagaagtactattgccgaccaagggtaaaacaccacagcaattggcagctcttatttcggccatcccaaaggtctctggcggtactgactatcaccagatttgggattacatccagatcaatccgcagcgccaagaacgcatgaatcttgtgttaactgacttcggattcatgccgaatcgcggcttaaacatcgaccacccaagttctattttctacgtcccaatcctgcctgactacggcagctggtcaatggttcgaagagatatgtctcatttcgcaaatgaaatggttgacttcgacccctatatccacagccgactactcggcgtacacggaaaa

SEQ ID NO: 1940 - DNA, 1965 bp, Corynebacterium glutamicum
gtgaactctcgcggattgccacacaccaccaaccactacaagaaagaaccccctaccgtgccttttcacgatttcactgaccctgatagcgatcctaggcaaaatgcaccagctaaccccaccgctcaaccgccatctgcccccacctcacactcatcacagcagggtctccctccgggcgccattatgatcccttttccagggcaaccgcagcagcaaagcgcacccaatgacgagacccgtttcatcgaccttaacgaacgtcataaagatgatgaaccagccctgtttcgcgatgatgttattgatcaaactctcgctattttgatcagtaaaaataagcccaatgcgctactcgttgggcctgccggtacaggtaaatcccgtatcgcagaagatattgcgcgccgccttgccaatgatgacgtatctattcccgatcagcttgtcggccaccgtattcttgatgtctccattgcagagcttgttgctggtgctggcgttgttggtcagctcgaagaacgcattctggatctcatcaagtatgcgaccgacccgagtaacaaagtcattatctttattgacgagattcaccaaattgctggtgatcagtccagtcacagtggatcgcaagccaaagttgctcagattctcaaaccctatcttgcccgtggtgaccttcgtgttattggtgccaccaccacccaggaagctcgtgacttcgatcatgatccagccctcaaacgccgttttagcagagtaaatgtcgatgaatttgatcgagatcaaacgctcactattcttcatgctgcacgtgatggttacctcaaacatttcaacaacgctgtcacggtatctgacgacgtactgggctatgtctacacctactcgcagcaattcaacccaggcaatacagcacaacctgatgcagcactgacgctgtttgataaggcgttggcttccctaactatggagaaacagcgtctgatcaacaaccatgtcattgcgccgtcgctcaagttccctgtgtcagaaaggcacatccataacaccgctcgcaaacttgcctttggctctcaagtgccagcctccatcaatactgatgatgctcgtgacaaactcgaaacgttgtttggtcaagatcatattattgagccagtactcaccgctatcaagcgtgaacagcttggtattttccctcgcaccaaaccattgagctgggtgtttgctggttcatctggtgtgggtaaaacagaaatggcgcgtattctctctcgcgccattaatggcggcgatcccatcattatcaatggtcccgaatacattagtcctgagtccattactggccttatcggatcatccgatggctatatcggctctaattctaagcgtgctaaaccactcgacccgctgatttctaatccgcgtcaggtgattgtgctcgatgaatttgagaagtctcaccctcatttccagcaattgttcatggcagctcttgatacaggcactatggcgatggctaatggcacgacattgaatttctctcaggccattatcattgccaccaccaatgcagcccgcgacaaaatcggtcgtgacagctttggattcgattcagataattcaggtgtcctcggttctgctcaagcagcaactgatccgcgtgcacaggaacgcctcaagtcactgatgtccaaggatttccctgttgaactgctcaaccgtttccagaatatctttgccttcaaccgcattgatgcaggcacctaccgtgagattctggacaatctctaccagcgtcgccgtgacgccgtgctgcttagccacccgcattacgcagcacagatccctgcagatattgattcagacactcttgatcagctggtggaaaccacctttatctcagattttggtgcacgtcctgctgcacgcaccatcgaagaccacatcgcatccttgctgatg

SEQ ID NO: 1941 - DNA, 474 bp, Corynebacterium glutamicum
atgattgataccactgctaacagcacctcaggcaccctacctacactcactgctgaccaagctgcgtttatcaccggtttttgcgaggctgctatcttcacagccaccgtcacaatagataacgaacctatatttcttgatgaagcgttcttcttaggtcaagaaacctataccgacattctcatgaatcaactccgcaccaatgaagccattgttaaagactgtctcgacttcttccttgacaactacaccacaatgaacaagctcattgttgatggtctatgcccagattgggagcaccacggccatgatttcctactcacccgtgaccatcatggtgccggattctgggatcgtggctacgacgaatacggtgcccaactcaccgacaatgccgaaaaatattcagaaaactgtctcaatttctggattgagcctgatagtgaccctctcattatcaacttcgagtaccac

SEQ ID NO: 1942 - DNA, 156 bp, Corynebacterium glutamicum
atgtacgattttcaaactatcccgcagccacctcgtgacggctacgacaacccctcacttgatccacgcaaccctggttaccgcgagcaagagtacgaggattacctcaacgccgtgctcatgacaggtaattcaacgcgttaccctgctgcagca

SEQ ID NO: 1943 - DNA, 324 bp, Corynebacterium glutamicum
ttggtcgggtgtacgttcttgttgaggcgaccggtcctaccacctacgccagtaagatcacggtggaagaactttgccgtgagtcctttaggcttcagagcaggggctttacgctttttcttaggtttttcagctgctgcgtctacaccttcttctgtcgcgttagtgctgatggtggcgtcgccatcaaggtcagcatcagcgttaatagcatcaagtaaatcggcgtcagtgtcagggttgtattcggtggcagtgccgatggtggagtcgtcgtcagaattgaggttatcaatgataattggcatgagaatgtggctttct

SEQ ID NO: 1944 - DNA, 312 bp, Corynebacterium glutamicum
atgtcgctgacatctgtgattaccatttccacggatataacctgtgggtggattttaccccgcagactatcgctctacgatccggtaagacggtactcgatgacggtaccaccgcctctgataacaccactcatgtctattaccgcgtcaccgttcacgttattgccggtcaagatcatggatctactctgcttgatgaccagggcaaccaggtgcttgatagggatgataatcctatttctaccccaagtatcaagcgtattggcgctgtcactgatcttttcgatcacaatccttttggcttcgctagtg

SEQ ID NO: 1945 - DNA, 2355 bp, Corynebacterium glutamicum
gtggctgcttctggctaccagattcagccacacttctccacgcagcagcgtgaagcaatcaccactgataatcctctcgcgattattcaggccggtgctggtaccggtaaatccaccgtgattctggaacgcattgagtacttgtgcgctgcaggcaccaaccctgaagagattgctgtgctgtcttttactaatgctgccgccgataacatcacagcaaaaaatgacaaggtgacctctatgaccatctccaagatggttcatgagatttacgcacacaatttccctgatcatgagatctccaccatcgacaccattatcaatacgcttgatattgaatacggcgatcaaatggtgacctccgattacatgattcagctccgtgacctgctctataaggtcatgacgcagggtggcaacgccaacctgacagcgttgagcatcttcatggaatcccatatcgaggcgttcatctcggtgttggatcagatcaagcagacttctcttgagctggaaatcatcatctgctacctgctcttggataagctgatcgagcctcatgcatcgccgaagtacctcattattgatgaggtgcaggacaactcggtcttcgagttcgtctttgcacttcgttttgcggcaaagcacaatacgagtctgtacttggtgggtgactcgtcacagaccttgtatgagttccgttctgctaaccctaaggctctgaactccctggaagcatctggtgttttcggtacctaccgtttgaccaccaattaccgttccaaccaggaaattcttgacttcgctaatatccacctctcggatattgaagctaaccagttcgcaggtattcagctctacgccaactcttttgatgcacctactgcggacagcttcaaagaaaaggttgaactggacatgcaccatgtgtctaagcagtctgagtttaccgacagcattccttatttcatggagtccaataaagctcgctttgatgctgcgatcttgaacaatgagcaaaccattgtgcttgctcattctggtcgtgaaattcgtgcagcgcagcaagcgctagccgagatgtaccccagcatcacggtgcgtaacttgcagtccgataagggtttcaacaacacggtattttcgacctttattaaggatttctggtttgaggtcaccgctgtagacccagctcatgccgcatttacctttaccagccaagtcaccgctcatctagataagttggtacgcggaaagcgtgagcagatggaggatcgcgttatccggtctatggctgcatggtggcgtgaaaatgagcgtgacatccagggttgggtgcagcaaactcagtccggtgcgatcaccaacgaagagttcttctaccgtcttcgtcagtgcattcttgactatgaaatcaggaataaccgagcacgtcagtccatgctcaatgcgcgcaacaacgctaacaaggaggctgtcgcacaggagaaaccactgctcatggtctccaccattcacagtgcaaagggtctggaattcgataatgtcatcgtgcttcaaaaaccaagctccgatgcagagatgaccgaagaaggtaagcgcgcaacctatgtggcgctgacccgtgcaaaaaagcgtgaactcattattgctggttctactcgcgcatacccacgcatcgtcaccgattatgagcaaatcgttgatcttcttgaaaagcgcgatgaggagcgcaaaattaaggaggaagaggctgcagcactcgccacccttgaagctgaacaggagacgcgcgcccttgctgctgctgaggcgcaggctcaggcgttgttgcttgagcacaacccgtggttgcgtgatctcagcgatgaagaagtcactgctctaactgagcaagagatcatcaacaatgttgaggcagccctacagattgaagaagaggaggaagaggctcgtgcactcgctgcagcagagccagcaattcagcagtacttgtctcagtttgctttcgatgagttcccggacgacgacaatgtagccaacactgtcgtacatgtagcaccacagcctattctccaccaggcagtgcctgcagatgtgactgtacaatcaagcaccgcccccgtaacacctgttgttgcggatcttgaggtaaccactgttgcagctgatccagtcgaaccgactatcgttgctgcacagcctgaggtggacgacaaccttgtctacagcacgtccacccctaatagtcacagtgacgttattgcagtgaactctgatacctcagaaaacgctgctgttaatccagttctgtccgatattgaggcactccgagcaattttcaacaaccaggac

SEQ ID NO: 1946 - DNA, 558 bp, Corynebacterium glutamicum
ttgaggcactccgagcaattttcaacaaccaggactaaaacacctgctgctgttgagcgcttctcacacatcatcctcacaaccccgttgcagcaccagcataaatctatattcgctgtgacggggttgttggggcgcgccccacattcactctttttcccgattggtttctactacacacccatgacctctattactactaccgataccccgctatatacagcactgccccatacccgtatctctgatgcggaattgttgacaccaacaacaactgtgcacgagattctcgtttacggaccggctgagtgcccagggtgtacagcaacgcttgacttctttgcacgcaaaaacatgccggccaccaaagtcactgtagctgccggtgatgtagcacatacctacatcacccaagacttaggttatctccaagcaccgattgtcactgtccgtatcagttcctctgcttctaaccacgacaacgaacacaacacccagatcctgcactggtccggcgttaatcgctacctcatgcaggcactctcccgtactcatttc

SEQ ID NO: 1947 - DNA, 378 bp, Corynebacterium glutamicum
atgtctgaatctacttcttctgctaactccaccaccatcctcaacgacaccttcaacccgaagcctggcgtaccttatgcacgcgtcgataatctcgaatttgccacacgtgacgaattccgcgcttgggctaccgcagagatggaggccggtaacgttatctctgcaaccatcgccaatgccccacgcgaagaccgcatcaagtcttttgtcatggatcttgttcgagacggtattgacgacgctgctgaggaaatcgtctcacgcattgatagcggtgacttcactatgaaggaagctctcaccgcgatcgcggcatcaatcaacgacctcgatgctgacgatgtagtcagcgacatcgttgaaaaccacttcaac

SEQ ID NO: 1948 - DNA, 465 bp, Corynebacterium glutamicum
atgattgaccataaactgtggtttaacacagtaaccaacaacgcctctgtccgagaagctgcaggaaaatgcgacatacccatcagaacgctcaacgagcagcttaaccgtcgaatactccctgaaaagaccgtcatcgctctagcacgcgcttatgatctctcacctgttgatgcgctcgttcgcaccggacacctcaccgaagaagaggctggtagtcgtgaagaagatgccagcccagattcagctgacgactaccctacctgggcactgaactcgcaccttgactatggcattctcggagcttttggcgacatcgctgaagaagtaaacagcgaaagagttaaccgcgacaacgccatagagcaaattcgcgcatggctcgacgagcttccaggcagcctattcaacaacctccgcagcactaaaacaggctacatcgaactattcgagacctatctcgat

SEQ ID NO: 1949 - DNA, 264 bp, Corynebacterium glutamicum
atgtcctttaagcacctctacgacaagacaccagaaatgatcgtccatgtgtactgttccgggccactgtgtgatgcagaattagagcatgaccgtgatgggtggacatgccctgaatgtggcactttttgggttgaccccagcggcaaaggcgaacgcgcccaggttgatacacccgatgatgaactagaggggttacctgtctataacctctcaggtgaacacctctacaaccatcatgagcatccagaaagcgcggaaata

SEQ ID NO: 1950 - DNA, 777 bp, Corynebacterium glutamicum
atgaccacacctcactcccaccgcgcaccacgtctggcatccacggtcattattgcccgcgagtctgctgactcaggtaccttagaattctttatccagcagcgacaatccactatggcttatgcagcaaacgctgttgttttcccaggcggcggtgttgaggacagcgattatccctttatgctcccccaccgcgatcagcacatgtcgcctgaacacatcaagcatcatgccagccgactccacatggactcagaaactatggcagctcatatttccgctgcacgccgggaagtatgggaagaaacaggcgttgatctcggtaattacaaccatgaactcatcccgatcgaccgctggatcacacctgatattcctgcttttaggcgccgttacgacaccgccacctttgtacttattctaagcaaagacagcactaacgcagctctgcagcaccagcatcaaaccaccgaggccacccattcttattgggcaactgcagaagaactgctcactcaatggtcaacaggtcatctcaacctgttgttaccaacgtggtggcatatcaaccagctcaatcacctccacacgctaaaccagctgtatagctttgcccagcgtacccataatccgcagcacactccacccacagtgtttgctaactggactgcaccggctgatgaggccgccatgcagcactatgggttccctgatcccgatgcgtactttgaccatgccactatcgcaggaaaacaccacacactcatcacaagaaag

SEQ ID NO: 1951 - DNA, 702 bp, Corynebacterium glutamicum
atgacttttgcagaacttagctcaccgcgtaccatcatcgcttttaatggccgtgccgaatctggcaaagatactgcagcacagtatctcacccatatgcacagttttcaccgcatcgcctttgccgatggtgtccgtgacgcactctatgcgcttaacccactggtctgtgtggagcaggctatcaccacacatggtgccatttatgaccgcgtggccactgttgtggacacacttggttgggataccgcaaagcaaatccccgacatccgcgcacttatgcagcgtattggtaccgaagctggttggcgcatccacggcgagcatctgtgggtcaatcttgctatcaaaaagatcaatgaactgcccgctgaccacgccattgtcatcactgatttgcgattccccaatgagattgagtggttgaacagcctcaaagccaacccgatgaacaccattcagaccgtcaaagtcatccgaccagatcatgaatcgaccttgactgcaggatcattcggtactacctcacatatttccgaaagctttaatctcactaccgacactgtgctccgcaacgatggcaccattgacgatttgcactcaaagctggctgattttttgagcacttccccgcagcccgtgctctctcgtaacgcccctgtaccaaaacacaacgcaccggcaccaaccactgatgccatg

SEQ ID NO: 1952 - DNA, 225 bp, Corynebacterium glutamicum
atgacgaccccagatccgacaaaccgcgacacccaagagcttatgggcgtacctaagacgcaggtacgacttggagagggtggtatggacgcgaacggtgtgctcaactctgtggaccagcagcttcggatgcgtcagcgttatcaggcaatgaaccaagaagagcgacctgttatccaggaagaaacccaagttcagcagcaaaatgatggctttagctttggt

SEQ ID NO: 1953 - DNA, 2166 bp, Corynebacterium glutamicum
gtggtgacagtggctgggaatgagaagaataagatacgagaagagcgggtggctcggcgtgcccaggcagtcgtagaggcggagattagtcttgctgcacaagcaagtgagcaggtgcgtgaacaagcagaggcgcctgatgtaaatgaacaggtagaagaggttagtgtcgaggtatcttctgtccagtcattaacccagcctaagacgttggggcagctgcatgacccaaggaaaaatgtcatgagtagcagcgacttggcttctattattggtgtagagcaacagcctgttgcttatggtgagtctgaggaaccagaaacactgcgtgatgtgttgcctcggcgaaagcttcacccatctgagataacaccgagttatgaggttgctgatggtgaacagcgcagcatttttggtgaatcagctccgtctgattttgatgacctcagtgatgtcgaagaatttgataccagtcattgggtgcgtgctggacaagatgatcgtagtgatgatgatcgactcgctgatgaggctggtgtaccgcgtagtggcgcacaagatgtagctgataatgaggctaatctttctggtgtggatgagcagctgcacatgcgtgaagtccatgcacagagttttgaccctattgacgttgccaaaaaggaacgcaaagcagcggaaaagaagtatgccaagccaccaaaaagtgataatccgtacctagcacgggatgccaaagatgcagctgctcgtaagcggaagatcaatgcagctcatgataattttgcccaagagatggcacaggctgcgatgggaccactgcgcaaaggggtcaacactcaaacggtgatggccgcgtgtacgactgctgcggtgatgtggtgcatgagcccacgtatgaccggtgtgaacgtggatatgaagcgcaagtttaacaaggatctggaacaggctaaagacactaagttgtcgaagtatgtgtccaaagatttttggaagtcaaagctgacgcgcgataagacggagaaggaagcgaagtcgctctctgatgcgttcatgcagcagaaaacagcgatcatcagcaaccgtgaacgaatccccatgagtgttgcttctgccgcgcagaccgtggttcggttgtctgatcaagcgtatgaggcgatgcgtgaagtagatacggatggtcaagcgatagtggatgcgaaggatgtctctgcacaggtggcagaagatattgacatggtggtcaagcagggtgaagagcatggcctgaagtcgaaggatatttatggcgctgcccgcgatattgtgggtcgtcgcatggagcgcgatccaggctatgctgcccggtttaatgagacggcttttggcaccgtgcgcctgggtgaacaacgacgtggcatggtgatttcaaagaccccgacatggcaattccctgatggtgcaggtttgagtaaaaacgccggctggtttagtgttcgtgagccgatgggtaatgcgcagaacttcgctgacaacctggctgcgactttggcgacagaaatgcgggtagctggtgagcagtacggttccgatggcgttcgtgatgtagttgccggcttcatgacagcgactgatgtctcagaaagtggcctcgcctctgcgaagaaactgttacctgactttgatacacgtggtcgcagtgcttctcgggtgcgccagattgctatggcacagcgcacacaggcagcgatcaaggtgttgcaggatgatggtaatcagaccgcgatgacgactgagcaggtcaaggaggttcaggtatgggcgatggatcaggctgagaaggtgatgcagcgtgatcatccagcgattctggataagtttgtgcgcaaacatgggcagacatttgggcaggatgcggacgcttttgttaaatccataactatggaaaaagacacgagcagcgagtacactgatgctatggttcgacctcaagaaaatcgtggatcaggtcgagaactggcagctcgtcgtcgtgtacaagcagcgcaaatcaatcaggcagcacagctggatatgaatgttcatgatttccgtgaatcgaatctgccagaggaacgacccgcgaatccttatgaagcgtatgttcgtgagactgaagcgaaaaccaatgatccgcagtacggttat

SEQ ID NO: 1954 - DNA, 273 bp, Corynebacterium glutamicum
atggcagtagatttcagcagaaaaggaacgcggggtcagagcatgagagctacaccacgacagcagagtcgatctgttgcacgtgaggtggttgcctctgaccccgtggtagaggttgcagcgcagcctgtgtcacctttaacagataaagaattagcggctgttgtgccggcgcatgtgcgaacagcacggttgggtgccgcagaattgttgcgtcgttttgaacgcacaggtgcagcagctcagaataatcagtttgacgatatggacttt

SEQ ID NO: 1955 - DNA, 6507 bp, Corynebacterium glutamicum
atgtccaaaactttatttcgacacgcttttgaacggtcgcttgagatggcgcgctcagagtggggtcaaaaagatcactggggcaaagctccactgggtgatcacgatgctgtgcgtatctataggcaagcagaagccttgatgaaacagcgcgcagcaaacaataagggcttagacctcaatgatgaagcgacctatggcgccatcatgtttgcgtctttcgatgatgccttcgccgctgatgccgaagctcatggctgtgtacaccgaccacagttcgcgaaggtaactaggcgaaatattcttaattcaccgcaatacacggcgattaagtcatcttatgacgcgctggtgcagcaggatctcgtggcccaacagcagcaggcacaagcgctacagcaagctgcttatgagcaagagcaggcagctattttccaggcacgtgatcaagcaacattccaggctgaacaaacgctcgcgcaagagtccgttcgccaatcagagggtgtgggtttacctgtcattgatccgatggagagctatttccgggagtacgccttctatgaaggtgtcgagatgtttggtacctggggtacgcacgttgatgctggtgtgtcgcagtttagcacctctgatggccgtgcgatccgagcgcttgttgatgagcatctcgcaacctatgaaccagtagagcagcgggggagtactcaggcattcttcgcctctgtcaatgctgcctttgctgaggtggcacctcacgcagcacccatgtttagtgcgattgctcgcgagggtgagggttcaaaggggtaccaggcgctgcgtcaccgtttcgacaagatggtcggcactgcaattggacctaatggtttgcctgagggacctgatctgggtggtcgtcgtttacctatttcgccttatgatccacgctggtcagaccgcgaagtagtccgtgtgcacggtaccaagctgctatcactgtccgaagagagtgttggcatgatcagggaccttgatctagcaacgatccacctacaagataatgatgtttacgagggcactcatcgagaagacgacactaaaggcggtgtgcgaccgttgactcaatgggtcaatggtgaagctattgcctggcgcactatcaccgagaatgaccagatgcgactgcccaatattggtcagtttatgacggctaaagaataccgtgccgcagcgtcatggctgcgtgctggactcattgataccgcagatgttgcgagtcagaaaattgaccccaacaaggtcatgtctgatgagggtatcgcgcgctcggaagctattttgacgtatctgtcggatgagggtgtggattttaggatcgagccagatcgtgagccgggacagcttaaagtgcgtattgagggcacccgtattgatattcgtctcactgatactcgcgccaatgaacagtgggtgggtcgtgtctatgattctggcactgtgattaagtattccgccgaacaaacagcggaagaacgtctacgagctcgtgagcgcatggagaacggtgatggaacgtggacaccggctactgattatgaaccaagcccaactgaagttgtcgatctcgtgaaatttgctctcggtcgagaggttgagcgacaggatggcaaaggtcttgttggtgtgcctaatgctcgacacccacgtgctttagagcaggcacaggatgcatatttcactaagaatcgttccgcattcatggtgcgtgaagggctctcgatcgttcaggatgcacgtgatcgaagtgctggtcctggaaagtggtttgataatgaagcgaaagcatcggagtggcttggtaacaatatcgcccttactcgtgcgcgtgtggccgaagagctcggcgttgaagaactgattgcgctttctgcacagtacgccgatgatcctgacttcatgccggcttttgctggtgaggatgagctcatggcgataaagcaggactattgggcgatgctgcgaggtgaggaaaccgatctgcttaaccctggggttaaccgcgatgattatatggctgctatccgcgatggtgatcatgagcagattgctgcgatgacctcagcaatgaatgctgtgaccgtggaggatcgtgtgcgtcagcacgcggcccttgttcttgatgattatgtcggcacggtggagcctgatcctgttaccggcttgcgttttaatccggtgacagttgctcagcacatgccgagtgctaaatccctgtggtcaaaccatgacgatattattgccgcgttgcgagcgacttcgattactggcgatgaactgcgcggtgacgaattctataacgatgttattaatcaacagttgctcaaatttaatcctgagaccgcgcagaaaatggttaataaccctgatcttgacccgcagttggctcgatttggcactgtcattgccgagactatttcccgcaatggtgctgatgtggtcgatattgctgttgacgataacggtgtggtgcggtggaccgcacagcgacgtgttggtgcgaaggatagtcgtgcagtagatagtaaggggcaggttcgcggtgaacgcacccgtcatgtgcagggtgagataggtcagatttttactcgcggtgagcatggtgaaattgtcaccaaatttaatggtggcgagaactatatgtttgcccctggctacaccgcgtctgtggtaccacaaaagcctggtgagacaaagagtttagaagagcgtaccaagctcaaaggctatgagcaggtgatgtcagaggcgttggtgtaccgtgtgcgagaagatttgatgttcactgagcgatcccgagtgggtgctacaaccagcatcaacagtgcatataagcgactgtatgacaatcgcttccctgtggacttcttcgagcgcagcgccgaagaaggtttgagcgatgagtggcgtgctgcgttgcttgagactgcgagtttgcgtgtgcgctacgacaactctattcgtgatggtgcgaatgtgatggaggatattcgagcacagcagcgtggttttgatgcgcgtaatgataactcccgtgatgcgctggtgcttaccggtgggcgtaacatttctgtacttgatgttgatgcgggtaaaggtttctttgatcccatgatgactggtatggcggcgaaccagggttctgttcgctatttgttgccttctgcgaaggtgggcgctgatggcatgattacccctggtgatccggctgatcgagtacctgttgcagcgcatccagaatcatgggcgatgggctttgacccacatgaccgtcagaacatgactttctcgaacatcatgcaggctagcgctgtgactggtggtgcacgcactgcgatgatacagctgggcggttggaactttgaagatggcattattgtctctgccgattttgcgaatacccatgttattcgcgatacggaagatgagatgcgccccttggttgccggcgataagctgtctgattttcacggtaataagggtgtgatcgctcttgttgttgatccagcgatgagtgatgctgatgcacgtgcagcagggctggaatcagaggtggcgtttttccgagacaaccctgatctagaggttgtcatgagtccgttttctgccatttctcgttttaatggtggcacggcacgtgagctcatgaacaacccgcaggatgtggtgttcaggaataatgatggttctactcgtgttcaaccaggtgcctctggtgatctcaacttcatcgtcacgcatatggctgttgatgcgaaaaccaatgtctatgatgaagaagctgttcgtgagggccaaggacgtaaagcgtcttctcagctggcgtgggtgctccaagcccaggaatgtcatgagattatggagcacttttatggcaacaacgtctctgcattggctaacttccaggaatatcttcgcgtcacggggcttgatgtcaccccgtatggtgagttgcgcgaggggttcagcgagtccaatgagcagcgcaatatcatcgagatgccaagcatttacgatgagaacggtgagctgaataatcgtgttaatcgtgcacaggtgcgcgaagcttttgttgagcagatcagtcgcgctggtggtgttatggagattcctttccagttacagttgcgcaatggtgcacagctagaagagtcacctaataatccagacatgtatcagttgccactactgagcccgcatttgcgcagtgatgaggatttagcggacggtagtacctctcgacatgagtacaccacgcggtatatggctatttttgatacgtgctacaagctggcagaagagcaagccaagattgacgcattgcgccaggaggaagcgcagcacggcacgttgcctcgtgctgcggaaaagcgactgagcgagtcacagaagtttgttgatcaagcacagaaaaaggtgcaggcaagctttgatggaattgctaatgatattgtcgccagccggatcgagaccaagaacaatgtgttcaaggacggctttatgtcggcgcgacagtcacactccgctactgctgtgtggacaggtgatccacgcctgtcagttgatgaagtagccatgaactcttcgatggcacgtgaactcggcgttctcgataacggttatgcaatggtgtggcgtgatccggtgatccgcgatggtggtgtgcgctatttgcgtgtggttattaatgatgatctgcacggtgtggcagtcaaccctgtgtcggtgaagagctttgacggtgacttcgatggtgactctgtaggtctggtcggcaatctgccgaaaaaggcgcatgaggaggcattgtccaggctcacagttgaggcaaacatgcttgatcttggtgatggtaagcgtatggaggacggcactatgttttatgggctaactctgcatgacagcctcgatgtacaggtagcgcagcaccatgatccggcaatggccgagaacatgaaggttattgtctctgagcttaaccgctaccagcgtgaatacgaggccggcgagattagccgcgaagaattgctagaggtcaaccgtgcacacatggatgatctcaatgagcactatgcacaggcttttgccaaccgcgatggtttggtgaccttgcgttttgacggtatggaaaaccatatggcttctgttgcgcagtgcttcgagacgggtgcgaaaggttcgcctggcaagctgaaggaatatgccacctatatcggcgctgatccggcgcagggttttaaagacgtaggtcaaccaacgccagaagcgctgcgtagccactatgagggttcgcagaaggcgactgcaattaaggtgctctttaccggtgtggctggtaaaaaagagcaggaaatggtggcattgtgccgcaatcttggtctgaccaaggaagctatggctgcatcagcaccggcacagcagtcgattctgcaggcgaagcacgacccgattgacgcgctctatcgtgcagaaactcttatgggaccagtaggtgatctctaccaaggtcgcaagatgcgtcgtggtgagaatgagcaaggtcgctatgagtgggaagtcgttagggacgagaaccaccagcctatccaggccaccaaggatgaatgggtacagcagtacatggagatgtacgccgatgacaagggtatgggtgtctcggttggcgttgaccaggtggagaagatcgcggaagaattctctgatgagcagggttatatgcgtgtgcttagccatgatgagctacccactgagattaagccactagcacttgatcagcttgcctatggcgataagaagaaccgctttgatttgttgtgcgagatggcaaagcagcaggtcaacatctacgacggtgatgcttatgactttgcccctcgtgtggtgcgcgccaatatgaaggcaatggaggatgcagcgcgttttggtatccctgatgtggagattcagtcgatttctgcacagcagtcattggcgagctttgagcgagtcccacaacgttctggtttccgtattgagcgtcgtgtgccggcagaagtaggtacagggattgctgcaccagcaccgttacctgatgcaggtgtacaggggaattatgttcagcagcaggtgcctgcgaccccgccagttatgcctgtcacacctccggcacagcaacctgtttcgcctgctcagacggacttccggggcgttggtcagccactcgaccagggcggaaaaatcgggaattatggacatcagggacctgcaatgggggcgcaacagccagttgtgcctcagcagcagaatattccgcctgtgcataatccggtaccacagaattctgttccgcctactccggttgtgccgaagccaggtacaggaaacccgtttactcatggtggtgcgaacaatcagtttatgggtcgatttgatacaagccgttacaaccaacaggaaccaccacaacgacaggatggcgggtttgagctc

SEQ ID NO: 1956 - DNA, 1089 bp, Corynebacterium glutamicum
atgagtacaaaacccactattgtgtccacattttctggttgcggtggcctcgatcttggcctccaagaggtcggattcgaccccatttgggccaacgacttctcagaagaagcagtccaaacctataagcacaacatcggtgaccacattgttcacggcgacatcactgaaattgatccgtttactgatgacaccatccctgacggcgatctcgtcaccggcggcttcccgtgccaggacttctccatgatctggaagcgtcctggactcgacggcaagcgtggcaccctgtaccaaaacttccgtgactttgttgcagcaaagaagcctaaagcctttatcgcagaaaacgtgaagggcctactcactgctaaccagcacaaggctattaagaccatcattgaagacctcgaagctgttgagcctggctacatcgtcaagcctcgcctgtacaacttcgctgaatacggtgtcccacaattccgcgaacgtgtgctcattgttggcattcgccgtgacaccggctttgatttcaagcacccagctcctacccatggccctcgcggtgacatgccgtataagactgccggcgaagcgctcaaaggcgtgaaggatgtccccacaaacaacaaccacatgaagatcatgcctcgcaccgttgaagtgcttaagcgcatccctgagggcgaaaacttcaccgcgatccccaaagatgacccctactacgtcaagggcatgattagtcacgtttaccgtcgcttgcaccgtgatgagccatccaaaacccttatcgccggtggcggcgggggtacatggggataccattatgaagaaaatcgagcattgaccaaccgcgagcgggctagaattcaatcgttccccgatgactttgagtttttgggatcaaacaccgaagtccgccgccaaatcggtaatgctgttcctcctgtaggtatgcacgctgtgggtgagcgactgatgaacctgtacaccgggaattacactcccgtcgatctagaggaacagcacgcgtacctgcagacgctctccattaaggaacgtctcgcgctggctgatcaggaagctgat

SEQ ID NO: 1957 - DNA, 1074 bp, Corynebacterium glutamicum
atgaagcccaccgttaatgttgtgttcaatgcgcatcaccccaaagatacgcagccgttggataagttcttcgataaagaacttaaagacacacatcatctcgatataacggtgggttatatcagtgagaaatcactacaatatttgcttcttattgcaggcactcaccccgacctcaccatcacactcacctgtggaatgcacgctcgtgaaggcatgactgctgcccaactgcatcatgcgcgagtgctccatgactacttaagcgaccatgatcgaggcggggtgttcgttattccccgattgcgttatcacggcaaaatctatcttttccacaagaaccagcacacagatcctattgcttatatcggtagcgctaacctctcagccatcgttcctgggtacacctctacattcgagaccggcgtcatcttagaccccgcacctgaagatctcgtgcttcatctcaaccgtgatgtcgtacccctatgtgtccccattgacaccgcgcatgtccccatcattaaagatcaagaatccccgatgaagcacgtcgctgaagcaacagctgtgtccacctctgatgttgttgccatcatgtccagcccatttacttatagttttgaccttaaactcaaagccactgccagcagcaacctcaatgctcataactcaggcggtggcgcgcgcaaacagaaaaacggtagcttccttgcacgcaattggtatgagggcgaaatcattgtcggtgtcgagacaacaagactcccaggttacccacaaaacaaatccgaattcactgcggtcactgatgacggctggtcatttgtttgcaaaatcagcggaggaaacggaaagaacctacgcagcaaaggtgacctgtccatcctcggtacgtggttaaagtctcgattcattgaacaaggtgccctggaatacggcgaggatgccacccaagaaaacatcgaccgttttgggagaacacatatgaccatgcgctatcacccagatttcgatgtgtggtcattcgatctcagccaaaccccgaagccttcgacacagattgggcaggat

SEQ ID NO: 1958 - DNA, 1521 bp, Corynebacterium glutamicum
atgacgcaaacacttgctggcgagcgcagaatcgtcaccacggcagagcttaaagcgatgctggcacgaggggataaggtgtttctgcctggtgtcgcagcgcgggcgccagagatcctcgacaacttcgatccagcagatcgggcacgtctcgacgtgcccgcagcagacaatgaaatcgtctctgtagaattctcccgccgcgataccgtgcaatgcatcagcattgccgaccgtgaccatctctacatcactgacgatatgatcccgacccacaacacgtccaacattatcttcttgaaatccacagacgaaacaatgattaagacgttggtggattggtcaggtgagcgacatgttgtacgcagaaattcaaagaccgtaacccgtgacttggcacagttagttatgcgcaccgagggtaaagtgtcgtacacgtctgcaactgaaaaagagccggtggtgtcttataatgacctaaatactctgccatcgcagaacgccatcgtcttccgtgcgggtcagtatccggtgtggtcacgcaatgaaacgatttggccgatgtcgttcatgttgtttgctaaccagattatccaaccgggtcgcgaatactcgttgcagactattccaacactgtcgagcgctaatgaattcgatgtgaatcaaaatgcaccggactttatggcgatgctggaaaagcgcatggcgcagtcgattcgtactcagcgtgccgtcgatatttataaaaaggcgactgggctcgatgactctgatattgcacgcctggatatggatgtgtattcagcagaaatcatggacatcgtggacacgatgatcgcgaaagatgagtacgatgacacgccggattatgacgagggggatgagtctgtcatgaatgctcgtgatttcatggagtctgaatatgacgtttttgatgatgagttcgaagacagtgctcagggcttccccgtggctactggtacgaaggtgaaaaagaaatctctgtctgaagaagcagaggtcaatgatgaattcattcacgatcaggagaatgcagaacataagctcgctgacatgcggttgaagcgttatgccgaaggcaaggtgtcacgagatatgctggctgatcaattcggccacatcctgcaggactcactcgaagatgagctcactgcagcctatgatgagagcctgcacgcttttgctcaagatccgaatttccgggtgactgctaacaacggcttggttaatgctgtcgatggcactgtgttgattgaggcgttgtcgcaggaagatattgcacttatgcgcgcgcaagcaggagtggagcagtcgcgtgtctactctgagggtgaagaagctctatctggcacagaggatgatccgctgtctgctatgggtaaatataagaccacccgagcattccgcatcatgctggtggagcttccgcattggcgtgatctcgcccagggtcactttgataaagaagtcgcgcgagcctttaggcgtattgaagatgct

SEQ ID NO: 1959 - DNA, 717 bp, Corynebacterium glutamicum
atgagtctactattttcaggaacatttacacaaggagaaaaaagtccagtgactaataccaatagaattgaagaccactacctcaagggcggacgtggcaggggcacagacgatcctagcaatatgcaaattgcaggaagtatgttgcgcacattattcgtccgcaagattagagcgctgctgctggttttgatgattgcgccaactccattggtcgaagggctaacttcgactgcaatgattgtatccgtagtaatcctggcgatctacatggcgataacaatgtatagagtagtgcacggtcgccatgagttcgcgcatatcgcacgtcgcatggcgctttacgtcaacaagacttcttctaggttcagtgttgttattgcttatgtagtattaattgctatttatgcgctactaattcccggacttgtctactctgttacatttggattcatcgtcccaagcacacctaatacgtttagtgatgcacctgcatggattatgtgcgtatcgctgctgctcattgcagtcgccagtttcatcacatcaatcatggatgactttattgatggcatactcactgatttttatgacgaagataatgctgatagccccgatagtcctgccgaggatatagccacccgtcctgtcgagagcgcaacaacaagtgctcttgctggatttgctgttggttatatttgtgggcgctttaatcgc

SEQ ID NO: 1960 - DNA, 1818 bp, Corynebacterium glutamicum
atgccaacactgcttattgacacccatccgcatcttgcagcgcaacttcttgaccctggtttaggtgaacttcttacagccggttccaacaaaaaagtgcagtggcagtgccctaagcactccaatcacatctggacggcctcggttaataaccgcaccaatgcaaagaacccgcgctgcccctattgtgccggaacacgagtgttggcaggttttaatgatctcgccaccactcacccgcatcttgctgtacagctggttgaccaagatattgccgtcaccatttccgctggttctggcaaaagacaactgtggcagtgtgtagtaaacccaaaacaccagtggttggctacgccaaataatcgcacgagtactaaatctgcgagttctggttgcccctactgtgccaaccgagcggtattagtcggtgacaatgactttgcaacaacctaccccgaacttgcagcgcaattagtagatcaatctgcagcgacaacctttacagccggccacaacaagcctgttgagtggatctgttgcaagcatgaaccaccatttatctggaaaacctcaccaattttgcgtgtacgacagaacacccagtgccctgtgtgctcagagcgaactgtggcgccggcgcttaatgatcttgcaaccactcaccctaaacttgccgagcaaattgcagatcctcaaccaagtggtgtgagcgccgcggccattatccccaccattagcaggggttcccatacgcaattaacatggcaatgttctaaaaatcatgaccaccaatgggtcgccacagtaaaggatcgtgttcgcggaacagactgccccacctgcgcaaatacaggaacttcacgcaaagaggctgaacttattgaggtcatccgtgcattattcccaaacactgatgtccagcaaggtgcgctcattaatggacgtaccggtaatcaaggtgcatcgccgtcaaccgatgtactcataccgtccaaaaatctcgctatcgagttcaacggcctgtactggcactctgagcttttcatcaaagataagcattatcatgcgaacaaatcagctctcgcagaacaagccggtgtgcagctcattcatgtgtgggaggacgactggaatcttcgccgcgacattgtgatccgcatgatcgcacacaagcttcatgcaacccataacctcagtgctgttttgcctaccgaaactactgactcacgtgtggcaaccaccgctttcgcccgtacactcacactgtcggtggtctctggttcacgcgctgctgcattcttgaacagcaaccatattcagggtgctgtctcggccactaagcactttgccctgtgcgacaacaacgacgatattcgagcactcctgtcggtgcgctcaccaaaaaacaatgcccgcatgtatcgcaaaaaaggcacatgggaaatccagcgctatgcgacactcggtaacgtccctggcggttttactaggctgctgaagtttgccgagcacacactcaacgaacacagcacagtactcaagcaatggatctcattttctgctgctgatgtctctgacggcagcctgtatcgaactgccggttttaccgccgagcaacagcttgcaccggattatcgctatgtcggtggcgcaacaggttggcgccgaacacccaaagaaagcttccagcgcaaacgctttagagacgacccagcgttgctatggaacgaatcttggacagagcacgaagcagcgctcaacaacgagctctacagaatctacgatgccggcaaaacccggtgggttaaaaatgttgct

SEQ ID NO: 1961 - DNA, 186 bp, Corynebacterium glutamicum
gtggcctttgccgaaggctactaccaggaaatggctgaggttgtatgtgaagcacgcgaagagggtatcacccacgaggacaccctgcatatgctcaatgacatgatggcaatgaaacgatctggcgaagtactcaatacgctcgctgatgttctctatgcaaatgaatgccctgaatatcgaatc

SEQ ID NO: 1962 - DNA, 351 bp, Corynebacterium glutamicum
gtggagataagatcaaagcgttacctattgacatcattgattctgcagacactgcagcagttgactcaggtgtatggcgaagcctcagacaagattctccaaggtaatgcgcagccgttgacggcgaagatcgcaacacctgatggatgggtcacgatgggcgaagcagaagcaggtatgaaggtgcttaccccaaaggggacagtcagcgagattgacggtgtgttcccacagggtgagcgagatgtatttactgtgacacgtaaagatggctcaaccacagaggcttgtgatgagcatttgtgggaagtgattgtggttcctgccgagcaggatgcagcaagcgcagca

SEQ ID NO: 1963 - DNA, 864 bp, Corynebacterium glutamicum
atgtggcattgcagatgtacttgcggtgttgagaaagatcttgctgcggggtcactgaagaatggtgattcgaaatcgtgtggttgtctaaaaatcgagtcgctttcaaagaatagggatttagttggttccacatttggtcgatggtctgttgttcgacgtggtgaggacgtgctgcagtggggtcgcttatctaaggcgtggttttgcgagtgcgagtgtggagcgacaagggacgtattggaacagtctttgttgcggggtcggtcaatatcgtgcgggtgctatcgcatagaacagcgacgagaaactgctgtttttgaagatttgactggcaaggtatttaaccagtggactgtgctgtctcgtacggatgacaggttttaccctggtggtgggcggtctcaaatgtggttgtgccgatgtatgtgcggctccgaaaatgctgttgctgggattatgttgaggcagggtattagccaatcgtgtggttgtttgcacggatcaatccaagagtcacatgtcagggactttcttttaaagaatgattttcagtttgaatctcaaaagactttcgatggtttggtgggggttggtggaggaccactgagttatgattttttggttttcaaggataccgagccctggttgttgattgagtgccaaggtgagcagcattttagaccagttgagtatttcggtggagagagtcgtttcgcgatccaacaagagcacgacagacgaaaacgagcgtttactgtagtccgagagctaacacttttggagatcccatatacggcgagaacagcagaatcaattggcgagttattagtaagtggtccgtttcaggaagaagtttttgga

SEQ ID NO: 1964 - DNA, 330 bp, Corynebacterium glutamicum
gtggtccatttcactataaagttattaaatattggcagctatttcacgccgaatatctttcccagttccgtttcacctatccgttacatgctgcccttaggtgctcactctgaccctgctcgcctcggatgtgcctgtaacacatcagggaggttcataaattcaagtcttacttgtcccctacgagcactaacgcatttctacgccgaacaattcaagagccgtacattcgcaagttcgtcagttatctcactcgataacattctcaccctaggcagtttctggacacccggcatatcagcggcacatcagatcactctgacgctttcg

SEQ ID NO: 1965 - DNA, 1680 bp, Corynebacterium glutamicum
atgatcgacatgtggacgagggaaactcgaccgaacaatatgtgtatcaacgaccctaaaggcgagttgctgaagaaaaattatgttcggatgtctaagcgcggttttcaggttgttcagtttaacctgattaacaacctgaaaactgatatttataacccgttgggattagcagccgaagcagctcgcgaaggtaacgggatgaagtgcgcaacctatgtggaaaatatcgcagaggtgttctttccggtggacggtgccgatgatccggtatggccgaatgcggccaacaatgccttcaagcgtgcagcctatggtcttatcgacttctatttggaagaggagcgcgagatgcgcaagcaggctgcagctgagaattgggatgccaaggtgcttgatacacgtattgatcagatgtggggtaaggtcacgctctacaactgctaccagctctttgtgcagctttcggcaaagaagctgaagaatcccgttgagcgactcaatgaacgtgcacgtgccggtgaattcggtaacttagagactgatgaaaatgcagccatgatgttccaggatgctgtgacagaggccgaagagaacgaaatgtttctgtgggagggtgagaaagaaaaagacatgctcaccttgttctttagtgccacagacggtctgccaaagtccagtgttcgtactctggtgggcaacgcagataaggccctgaaagcaatgggtggcgctgaaaaaatgatggcgtcggtctacggtatcgcgattacagcgatgtccttctttacagaccccacaatttcaacgttaacctcaggcacactaagtcagaacgttgacttggccggattgtcgtttccacggcgcatgggtgttcgttttgcggccccctatgtgaagcgctacaacctggttggatcacaggtgaaatgggatgcgtatagtgacgccaagttcaccaagccgttgggtaagaattttgttcatgatgacacgctgtcggttgagggttgggcgcggttctatattaaagactcgttcccgagtaatactgcgtacctgcgtttgcggattctcaatggtacttctggcacgttgatcaagactctgtacttcaagttcaccaagggctaccaaacgaaccttaaaggccgtgcgtttattactgatccggtgaccgatgagaagatcattaagaatggtctgctgatcgagctggtgaaaaacgatgctggtgactttgttccaggtcatgtgcagtttaagacgaagaaactgaatcttgaccaactcacgcaggaacagatcaatatgccgggtcatgacatgatcaagcaggttgatgcgatggttgatgcggtgtcggctctgaatgtgcggtattcggagaagcctaaggcagtgttcttcgtaacgcctccgcatcttatgaaatatgcgaagttgattttgattctcatcaaacagcttgtggatctgaacttcgattcctcgtatatgacgcgtgagaatcagaagccggattataagactcgtttcatgttggacgagttgggaaaccttcagagtgagggtcatggtattgcgggatttgaaaccatgctctcgatcggtctgggacaagaacaacaatttagtgcgaccagttgcgtagcgaaaaactacgctcttgcagct

SEQ ID NO: 1966 - DNA, 1206 bp, Corynebacterium glutamicum
atgacaattcttcaacaggcaacagatttgtacctccgtggtttccctggtgactacatcaaaactcataccggattatctattcaatcggtattgaaacagaatttggttaagggcactcggtttagtaaagctgatgtgcaaaattatcagattagttttattgagaaacgatttaaccatgatgaagtagaagctgcctatagggagatgagttgtgaatttgatgatctataccaagctggaagatcgaagaaaattatggcgttagattgtggattcggggattacgcaaaggtattcaggtcgattctgggtgagtcccgctatagagttttgcgagatgagtgttggaagttgaagcagattgctacagtcagggagcgctacggagtcgataacgtttttgataaatcgacctttgatcggtttgtcaatgaggttgctgttgagcgtgggcgggagaaaagaacagccacgttggttgaacgttatggagtagagcacccgaatcaagatccagacatattattgagaatgcaaaatacccttagggctacgatgaatgatcgccatggtgttgattatccgactcaaatcccagaagttgcggaaaaagttcgaaagtctagacaagaaactatgacatcgctttatggtgcgccggatagtgttttggtacctgaaattcgggagaagattttcgaagctcgcagattgaacggtacattaaatgattcaaaaccagaggacgccttagaagttttgcttcaaaatcgttttggcatggacgatgtacttcgaaatgtggttgtggatgatcgttatccttttcatgttgactactacatcaaatcccgagatatgttcatcgaattgaatggggatcgtagtcataatgaccactggtttgattcatctgacgagcgtgaccagagtcttgttagattttggatgggtagagcagatgaacttgaatcggagtttggcggtcaatctagatataggagtttcattcgtgtctggaccgaaactgatgtggctaagcgcgaggccgcaagaatcaataagttgaattatttggttttttgggatggcagcagttctattgatggtgagggaagacatcctcgattaagtgatgcgcgagcgtggtttgatggtggttgtttagattcaattgattgggattctcgacaaacttat

SEQ ID NO: 1967 - DNA, 1293 bp, Corynebacterium glutamicum
ttgtgtggcgggcatttgtatagaaaaaacaacagaaaggtaagggcaatggcattattcggttcaagtaaacgcgattatgacaatgtgtctggtggcaaagccttcaaaggtggtggcaccaaagatctaaagcagactgatcggacctttgatcagctgcgaaaacagcgggtgacggataaagcccgcaaccgtgacgtacacaatgagcagcaactggcacgcggtgaaatcggagaaatgcgctcaccgatgtgggttgaggtgggtgctgcgattctgggcgtgtttgtcctggttgtgatgtggctggcctggggcggtatcgggctgctgatccagaccatgatgaatactggctcacctaatgacaaagagctttttgatgagcttggtgtgagaccctattatgttgctgtcgaacagcaaatcggcaccagtagtgctcacaccacgtgctaccaaccgcttgatgaatttggcaataattttggcgactgtacgcgtagcgtgcctaaagagccagtgtggtacgccgattatgtagctagtgtgttcgcagaacatggctttgatgcaccagaacctattgataattcggtgggtagctggctgttatttggtcatgtgggcattattcgggtgacgtttgtgattgcggttgcagcgggtgtgtatgcgatgtcacgcgcagcaatgatgcgtcagctagaaacacaaaacgtcgctgtggacaccaccgatattaaccagcacaccaatgacgcacgtttggcgattccgcaggagattgtgcgcgatttgagtctgttccccgatgtcggtgcacactcaccagtccagccctcaagcatgatttcccatgtgatgctgtcgaataagggcttgaaaaaggtggatgtaacgcagtttgcacaggagacaattatcgacaatgacactggtgaaattgtctctgaaaagggtgaagtgctctatgacggtgcaggacaaccgatcacaaagagcttgccgatgattgacaacgaatttagccatgcgatttttgacaaatcagatgtcccgaatcttcccgagctgcgacggttctttaatccagcaaagattgagtggaatcctggtggtagtaatcgtgacaagactggtaagcaagatactgtcgcgcagcacatcaatgaggattgggagtttcccgattatgagccgcagcgaccagctggtgcttatgtggttgatgaagctccggtgaatacgctggtgttggctatgactcgtgcaggtaagggtaac

SEQ ID NO: 1968 - DNA, 2493 bp, Corynebacterium glutamicum
atgctcgattcattgaaaaatcgcttcaccaaagcgaaaggttctcatggagtgggggagggggctgtttctggcgatgcagcagtaaagccactgcgcaaagaagaacgactcgcctcagtcattcaggaaaccgaaccaggtgctgcagtcgaggtcatgcgtcgcaatgacgcattcgctttgccaggtgagaccggttgggtagtcatgctgttgccaactcacgattcacaattcggtgggctcaacgctaaggaaaagaaccgcgaggataaaggcacgatcatcaacctggtggtcaacgatgatattcattccgttgtcactccagaacttcttgacagcgatgtgcttggtgtcattcctgatgcagattctttcgatcgcatggatgagtttgatttactgcgtaacaaagcacgctggcactacggagtggctgcaattgaacctgacacgggtgagctggtggtgtttaaggtgcccgcgaaaaatagcgcttcggcacgcggtgacattttttccgaggtcggcgatgtgcttagcggtgctgctgacctcgaagacgtggttgattttgaggtcattgccaccttcctagaggtgctgaatgagacctctgaggtggatattgatgacgaagatggcgacgtgccttatggtcttgagggtgtcaatgcagcgggagttatcacggatgacctcattcgcgagaagcttgatgtggattcctatccgagcagtgcagagatcattgacaatattgtgcatgtgttcaccaagttgcagggcaagcatcatgtggcaccacagccggtgcttcacagcgcagacgtagtggatgttgatgcacaggagtcccatgacacagtggttattgagagccctgatgatgtcgcactagcagaacaggtggatgtaccggatttcagtgatggatttggtattgacgatgccgaggttactgagccagaggatgaggaggttgtcgaagcaacagctgatgcagatccttttggtgatgtagcagaagacgatcctttcggcagtgatgatgaaccagattttggtgcatccgatgttgttgctgcaccggcacctgtagccggcatgtccgatgagcagatccaggcgctgattcgtggtgtgtctgagtccgtgcaagcaaagactggttcagaacttaatgctttgcgagaagaacttgcacaagcactggcttacaatccggttcaggattcacaggcagcattggcacaggtgcacgcagctgatgcccgcagctttgatgccgatcaagtgggtgatgctgtcaccaaacgttatgttaatgacgacttggggctgtatgtcgatgaggcaaacttcaataatgctttgaccagggcaccgttccaggtggcgatgccgcaattccaggagactacaccgtggttaggtgatcagcttcgtacattggtggctgtgtttaatggtcagctgcttgatcagcatcagcgtgactacgaagaagtgcgcgcgatgtacattgcgcttaatgatcgctctaatcttgagatcgctcgtgatcttggactggataataaggattccgaattctacgaggtttaccgtgccattgagcgtgaccgcgatgttatggctggtgatcaacagcgtgtggagtcagagcgtcgtcagcaattgcagcaggagtatgaggcgaaccgtgaagaatatgtcatggcaaagatcgcggagcagcgcgtggagtatgatcgccgtcatatgcctcgccataccgcatcactagaagcggtaggtcgagagctgacgagcctgcgggatcgcaccattgaggattacaccgcacgcatgaacacgctgcgtcgtgcacgtgctggtgaacgggctaacgctgcagaatctcgcattattgacgaattgcgcccgattgtggagcgccaggcagaactgcaacgagcagctttcgatggtttcattgttgatcttgacaagtttattgctgatcaccgcgaagatgacctgcgtttggcatcggtgaatgagcagaagcttgctgcagataatcgtgtggcacagttgaccaaggaagccgaagagcgcatcgagggtatccgcgtcgagaccgataagatgatcgcctcccagcgcaaggcacttgagcgtcaggaagcggaattcgcagcagagcttaagcgtcgcgacactattgtcgctgcatcggaggaacgtgctgagcgggaaattaccacagcacgtcttgatgctgaggcggcgctcaagcgcatggaagagcaaattcgtgtaaataatgaggcgcatgaggcggagattgttattgagcgcgatcgagccacccaagcagaggcgaactccatgacgtttgttgagtcagtcaagcagcaggatcgcagcaacaacatcattttgattgccgtcctcattgtggggctgattgccggcatggtcgctggcgcagccttcttc

SEQ ID NO: 1969 - DNA, 1785 bp, Corynebacterium glutamicum
atgacccaggttgtggcgggtacgttggtgggagagtcgattaatcgtgagattgatgaagacaagtacccttatttgagctcgtatgcagcgcctgttgctgtaccggtgcgtgagattattgggcgcgaagaagaagtcaataagattatggccgcgctgatgcgtccagagatttctaatgtcatgcttgtgggtcctgctggttcgggtaaaactacgttggtacagcaagcactggtgaaagatccagagcgtaactacatcgaggtcgatgtagcgaaaatggttgcggatttgagcaccccggcgcaaatggctgcgcgtattaaaggtgtgtttgaggacgccattgcctatcgcaagcacgaaggtcatgaattggtgctgttcgttgatgagtttcaccaaattgtgcagctgtctaatgctgcggtagaggcaatcaagccgattttggcgatgtctggtgtccttggtgtgcgcgttatcgctgcgacaactctcgaagaatttcacgaacacatcaggccgaaccaagcattgacggagcgtttgcaggaaattcgactaacgccgaccgatcagaagaccactgtggcgattttgcgtggtatggcagatcgttatggcgtaagtgatcagttctatgacgaccacgtttttgagcagatttactccaccactgagcgttttatgccgagttctgtccagcctcgtaaatccattcgtgtccttgatgcgatggttggttggcatcgactttccggcaagccgatggatatggatctgctcggtgatgtgctccacgatgctattggtgtcgatattgcattcaaggtcgatggtacgagcattaaagacaagcttgatgagaaggtaatggcgcaaagtcttgccaccactgtggtagcacgtcgtttgcagctggtggtggcggatcttcatgataaatcacggccactgtcgaacttcttgttcaccgggcctactggtgtcggtaaaacagagctggtcaagcaactagcacgggtgctctttggtgatgacactgggcgattgattcgttttgacatgtcagagttcgccttagaatcaagtcttgaccttttcaggtctgagctcactcgtcgtgtcgctgaccagggtaacgctattgtcctgctcgatgaggttgagaaagctgatcgagctattgcgcggttgttactgcaggtacttgatgatggccgactatctgacgattacaaccgtgaggtgagttttcttaatacctatatcgtcatgacaactaacgctggttctgagattttcgagacaatttcgaactatgccactgatgacacgggcgatggtcgggcgatcaaagactttgtgaaaaacattcacacgtcgatcaagaataagggttttccacctgagcttcttggtcgtgtagatgaaattgtgccttttcaaccgctgtcggagacgacacaggacaggattattagcaagaagctgcaggatgtggctactgaggtctatgaacgccacggcgtgaaactgcactgttcacaaaaggttatggagtttctgcttgtggatcaggtggaggaaagtgctgaatctggtggtgcccgtggtgcggtgcggtctttgcagcgggaagtggtcactgaagtggcgacctttattaatacctacccagaagtgcgtgacatttacgttgatgtcgatggtcagatgcgtaataagactaaccgtgtgtctacggcccgtgtggtgataaagcgtgtcgaaggt

SEQ ID NO: 1970 - DNA, 621 bp, Corynebacterium glutamicum
atgacgacagcgttgtgcacgttgatatggcagcgggtgtccgcgatgtctaaatcgcaggatgatcgaaaaattgcagagcttgaagcacagtttcatagtcttggtcttaacaacactgaactagttacccttgatgatgcagcgtcgctattgggtgtgccggcaggtattcatcagattgaggccgaggtgatgttggtgaatttcggtgatggtgcagatggcatgggcggtgacacgacgaagtttttgcattatcagccagatgagtcgcagccttacgtctgggtgatgaagcgggtgtattcctttgaggcgatgaaaaagctcatggtcgggttgtttattggcttgtgcatactcatcgtgggtgggccagctttagggcttatgctcggtggttttatcggtgtgcttattggtctatgtctaggtacttccgcagccatgattgttggcccttttgggcttatgcggatgaaggcgtatccaccatgtatggacagtccatgggtgtatatgtcacaagagcagtggcgcaccgctatgggtgcggcacagcagaccgaggtgtcttttgttgagcactgggacaatatttacggggataatctgcat

SEQ ID NO: 1971 - DNA, 1113 bp, Corynebacterium glutamicum
atgaaaatgggaacgccggagaatgagatcatatttcacacgtggaatcgcacaactcgttgtgaggtgacccgagatgccgcagatcaccgagtgagcgttactgagatcactgagtctcgatgggtaatccatataattgtgagcgggattcttagtgcgctcgcggttctggtgtttattattggcgccggcttgccactgttgtacgtgccgatttttgtgactgtcatcgtcatggtggtgtatgcgctattgcgctatgagcagcgcatgtcaggcacagtctacgaggaagcagatcctgtcgaaatggattcagtgatctgggagggcatcaagtgcgatattgcctcggatattgcagcccgagcagaagcgaaaaaagcgaaaaagccagttgcgtcagatgctgttgctgttggtaactatatcgcgtccttgcgtcagcatatgttggtagaaacccagcgacgttatcaccacaagcttggtcgtgagctgcataatgatccagcgcaactagaggattatggctctggtctgcgtgactgtgagtgtcgggcatgtgtggtggctcagaaattgggtgtcacggtgcacgctcatggtgtggtgcaggcgagcgcacgtaaaaaagatcgcgtcattattgggcgagccgatggtattgatgtggccggctggtggaaccaccgccaagaagctcgacgtaaaacgagcgcggctaagcagttggagcgcgatgcacaacgcaagcgaacccaagctgagcgcgataaagagattgagcgtaagcgtaaggctcaagaatttgtagcggagcagtcagggaaagctgctgcagcacaacggcgggccgagaaaaaggctgcgaagcaagcgcgtgtagatgaactggtggcgcagaaacaggctgctcaggagcagaaaactcactgtaagcgggacaagcagcgtgcgaagaaagcacaagggcgcaaagttggtgccgttgataattccgctgtggacgatgtgttggcgtatgcggagaaaacccgcagtatagctggctgtagagatgacgacagcgttgtgcacgttgatatggcagcgggtgtccgcgatgtc

SEQ ID NO: 1972 - DNA, 846 bp, Corynebacterium glutamicum
atggcatttccgcttctagcggttgctggcacagttgcccccgttgcagcaggatgggcaaaagataagtttctcagcaactctcagaataatcagcaggcccagaatcagcagatgagttttggacaggtcaacaacagcgcacagaattctggatcagaaaacagcggtttcatgggtcaatacggcaatctgggtgcaggtttggcaggtgctgctacaggcgcagggcttgcgtatagcgattttgaagatggtcaaagtttgtcctcgaaggcccgcaacatggtcggcaaagggctcgctggtgccggagctggtgtgttcaccaagcttgccaatgatgcaattcaggccgagggtggctcgatgaaggctagtgcttattctgccattgcaggcggcttgggatcgtatctcaaagacggcggtccgggtgtgattaaatccgcgatggccagcggtgcagccggttttggtgcggataaagtgcacgataaattagctgagtctggtcatgaggggttggctgattccttgtcgggcgctattcaaggaggtggtcttggttactccacgcttggcggtgtcactggtgctggtattggcggtgcgacgggcggtctcgcaggactagcacaaaactactttggtggtggcgatgactacagcaacgctggggcatctgcatcggggtttagtgccaaccaggttaatagtgagatcagcaccgagattccgcagtttgcgaatcttggtcaaccacagcgatccgagcttgaacaattagcgctacctcaagaatcacggtctgtagataagagctacgaccaaggctacgaagcg

SEQ ID NO: 1973 - DNA, 981 bp, Corynebacterium glutamicum
ttgttggggtgtggtgtattgcgccttttaaaacggtggctcgttatccatctgaggttgtgctgccggctgctgcgtctgcggtgccagagctgctgctactgctggcggctgcgtctgcggtgccagagctgctgctactgctggcggctggttaaacggattcccagcaggtgcctgcggtgcctgagctgctgctgcctgctgctgcgcggttgcatgagctaccgcgtctgcatagacaggggctcctgcatatgctggctgctggccctgtggcactggtgcctggaattgctgattctgcataactggctgcggtgccacctgtggtgcttgagcctgggtcgcttgggcttgtgcagccttctgcgcttctgctgcttggcgattcattgccacagccataaactgctgctgctgaatattcatcgcgtccgaaataggaaccccagatggctgcagagacttagtgttcatgaccgcagggagagacttgccgtccttggtcttcgggaacatgacatcagccttgaccaacatggagtaaccaactgtctcaccgtctttgctcaagagcggggtcatatggttgcgcccctgtgctgccaccgtctgcatcgcttgaatctgcgcatcagaatacgcaacacctgtgttgcgctgaccgtccttagtgtcaagatgcagatgaggcatagtctgtggtgcaagattcgcattcgcacgagtgccgtcagcgtcaatcggaatctgcgctacctgaacatccacaaagtggacagtgttacccttttcggtcacatgcttggcgctgtcgtagacgttgacaacaagatctacacctttagtagacgcgttcggattgatgacattgccatctttatccttgcttcgaaaattagccatgatacaaaccctttcacactaatttgttcgggactttttatattacttcccagaacaattcttattaagtat

SEQ ID NO: 1974 - DNA, 879 bp, Corynebacterium glutamicum
atggctaattttcgaagcaaggataaagatggcaatgtcatcaatccgaacgcgtctactaaaggtgtagatcttgttgtcaacgtctacgacagcgccaagcatgtgaccgaaaagggtaacactgtccactttgtggatgttcaggtagcgcagattccgattgacgctgacggcactcgtgcgaatgcgaatcttgcaccacagactatgcctcatctgcatcttgacactaaggacggtcagcgcaacacaggtgttgcgtattctgatgcgcagattcaagcgatgcagacggtggcagcacaggggcgcaaccatatgaccccgctcttgagcaaagacggtgagacagttggttactccatgttggtcaaggctgatgtcatgttcccgaagaccaaggacggcaagtctctccctgcggtcatgaacactaagtctctgcagccatctggggttcctatttcggacgcgatgaatattcagcagcagcagtttatggctgtggcaatgaatcgccaagcagcagaagcgcagaaggctgcacaagcccaagcgacccaggctcaagcaccacaggtggcaccgcagccagttatgcagaatcagcaattccaggcaccagtgccacagggccagcagccagcatatgcaggagcccctgtctatgcagacgcggtagctcatgcaaccgcgcagcagcaggcagcagcagctcaggcaccgcaggcacctgctgggaatccgtttaaccagccgccagcagtagcagcagctctggcaccgcagacgcagccgccagcagtagcagcagctctggcaccgcagacgcagcagccggcagcacaacctcagatggataacgagccaccgttt

SEQ ID NO: 1975 - DNA, 198 bp, Corynebacterium glutamicum
ttgctgaaatatacttttaaattaataaaagaacacttcgacttaattcatatcaaagtgttctttttttttaatcaaccgcctaccccaatccaccatcacgggtactccgcagctgtgaatccagcacagctcgatccacagcatcacgaatcagtggctgcactcgcttatctagcgcaactgttctaccccgct

SEQ ID NO: 1976 - DNA, 2766 bp, Corynebacterium glutamicum
atgagtttgaaacaagccattatcgtgcgcaatgaatatacgattaagcaggcaaatggcaaaggttcacgaggatcatcgccaggtaaatatatctctggctatatggcacgcagcgatgcggtagaagcagtagcacctattgtgcgcaataaattagatgatttcatcatgcggtatatggcacgtgatagtgccgtggagcagctcaccacggacagtaacgcagactatgaccagcaacctgaaatgaactctcgtcgtggccggcaaggtcgccgcgcgaccttgaaacaacgtcgtgcagaacgcagcgcccggcgagcagcattgcgagcgggcgtgaatacagactccgacaccaccaacccatcacaacctgtgcacccgagggaactcgcggaatttactacccaggatgggcagcgcgttcatgatctcatgctgagggctcagggtaatgggggagtggcctttgggtatggcgatgtctcgctgtcacatgatgatcttcatgcagcaagtaataacgtccaagagctctatgaaaataggcataccgtgatgaaagtggtcctatcttttacccaggattacctgaccgcgcatggccttattccagaggatctcgatattaagcgtgctggtgattatcgcggccaggttgaccaaatgaagctacgcatggctgtcatgcatggtgtggatcgtctagcccagcgtcattatgatgatttgcgctatgtcggcgtgattcaggttgatacgaagcatgtgcacgcccacttgaccatggtggatgctggttatggacaccgggctgctgatggtacgcaaaaaggcaaaatcaataagccaggtaaggctattttgcggcgtggtattgacgcctggcttgatcagcatcagcatatggcgcacttgtcagcagcagtggggtatgaaaaacgcaatgtcaccagctacgtcaagcgctgggcgtttcatcagctcacccaagaaagtgctgcgcaatttgtggtcgcttgtttgccagaggataagcgactgtggcgtgcatcgaccaatgccaaggaaatggataagccgaatagattagtgcgcgagttggtggaggcgcgacttggtgagactgattcaccgatgccggcagcactgtcgcaggtctatcagtatgcgcaaaaacgccgcgttaaagaaggtttaagcaagcaggacacccagcgtttgattgataatggccgcgaaaagatcattgagcaggccatgaacggtgtctacagtgtcctatccgcgatttccgatgagcaacgcgatgtctctacggccatgttgacagtcatgcgtcaagactatgaggatttgctcgatggtattgcgcggaagaagagcaaggatctagacgagcagggtagtagtggatcacaagaggtggggaaagaagagcctgagccaagtattgaggaatttgggctgcgtttgcggtcgtattcagcacgcttgaatcatcaccgagaacaacgagaagcctttgccgtgaaaaaacgctcgtgggaggacgctaactctcaaggtttggctgatcccacctcacaggtaatgtggagtttttatgacactgaggagcagtatcatgcgatgtgccaatccaagtaccagcactttttgacctttgccccacctgtcggtcagtgggagaagcaatgggctgaggttgctgattacggtaaaagggttgtgggtctgcgtgcactgcgggcagatcgttctttggcacgcatgagcgatgaacgtgcagctgaagctttgggtcggcaactttatgaccaacccggtggtgggttattggctcgaacaggcgctgagggtaaagctgggcgtgcggtcctggatggccgaattgagcgcatgatggtgacctatcagcaaaaaattgatgatttgcgacgagaatgggcacagctcggtgcacgtttagaggttgaaggtgatgctgtattgatggatgcagcagatctacgtgaatctgggggagagggtgcagatgaacgccagatacagcagcaaacaattgagttgccggtcgctgatgtatctgattctgtgcgcacataccttgacgaagagttacgtgatagtcgtgatgtgagcgctcatgatccagtgcacaccttgcgtggcaggtttcaggtcgtgtttcgaccggagcatgattttgagcaggtgcgtggcgctgacctgcacgatcttcactatgactggtttagcgatcagaaggtcagtcagcccattgtgcgtagttacggtgagttagtcacccagcgacgttatgcttttgaacgcgctcgggagtggatgatcagttcgcagcaggaaccagaagcagtggcagaagagcttgatcatgccggcgcggacataactcgcatggaagcaaccagtagtgaggtatcccgtacaggtattttgcgtagtgccatgcttgccagaattagagagcaggcgcgacaacgcgctcagcgtgcagcggaagagcaggctcgtcgtgagcgtgagttggtagcacagcgacaacaagaaattgatcaggagaccacgcaaccagcgttcgaggtggtgcaacgacatgtacaaccggagtcggtgcagattaagcggggtagaacagttgcgctagataagcgagtgcagccactgattcgtgatgctgtggatcgagctgtgctggattcacagctgcggagtacccgtgatggtggattgggg

SEQ ID NO: 1977 - DNA, 600 bp, Corynebacterium glutamicum
gtgaaacttgacgacgctatggtcatgatcgaacagcgcctggtcaaaggtcgcggcgcaaccaagacgcaactagcaccctatgagcatatccagcgcaatattgcagcccgagggttgagagccgatgacggaggctcgtgcttcggttatggggatgcgtcgctgagtaatgacgatgtagcaactgctgcagaagatattcaggatttgtttgcgtgcgggcatacggttatctcagcgattgtcgtttttgataagagctatctcagtgagcatggaatcatgagctttgatccgaactattttggtcaggatatttatgcggacacccatccagagattgatctcatggaattgcgtttagccgtgatgaatgggctcttggggcttgagggaacgttttttgaggatatgcgttatgtcgcatctatcgaggtgagccggagctatgtctatgcgcacataatgatggcggatgcaggcgttgacgatgcacgcggtaatgcacaggtgaagattacggacaccgaacgagtgctgtttagacgtggtgttgaatcccggtttgtggagcaagaggcacgcaacgtcgtgctt

SEQ ID NO: 1978 - DNA, 1251 bp, Corynebacterium glutamicum
atgaagcttgcaggttttaacaccaattcacccgcagcgcagcgggttgccgaacagggtgaaaaggtacagctcgatgcaccggtgtacgcggtgtttaccccagatgttgttgaagttgagtttattggcacgcagcatgagccggtattgcacgttgagggtgccatcgacagcgtgactgcattgtcgcagctaccgtacgacattcaaaaaattacgtttgattcagaaaaccaacagcgttttagtggattttataaattcagtccacagcagcataaagagctcattgataaaggtctgtatctagaaggtttccagccaccgcgcgagatgatgacgagcctgccgtgggaactacccatgaatgccgatgtcactgtcgtggcaccagagtcgcaggatgcgccaccgattgtgcttgtgggcttatctgagattcatggtgtggattttagtcaagaatcctctggctatgagctcaccagcatgtttgaggactaccgtagccagcgtgaagcgggcgaggcggacaaggatttctctgagtcaatttctcgtgcagagattgaaggcaaagatattttcgctgatgctaaccgcacccgtaccggtgtcagtgcacatgcacagcgccttgagcaggagcgagcgctgagcgcagcacagttgatggcgaaacttgctggcatttccttccagactgaacccgtgcttgttggtgcggaagagagctttgatgctgagcaattcctcgcccatgatcttgatgacaccgctggtatgagtgagtgggagcgcgaggttaccgagttctacaacgagaagattcgcgcccaggagcctgtggtggagcgggaggctgagcgggatagcgatattgagactgaggttgatgcagcaccaactgtcagtgctgcagagattaacgatgttattcatgatcttgatgagcttgaattcgatgacgtgattgatcttgatgcagatgatgttgtcaataccgccgaggtagaggcgccagcaagtgtcagtgctgcagagatttctgcgacagagcttgattttgatcgcgagtcacgggctaagaccgcgcagcgagaagccagccgacgtgttgcacagaagattcagactcaagaatctgtgcgtgaggcatatattcgcgagcaaaagcatggctatgacgcatcacctgcggaggggcgcaagtttgatgagaaaattgcagaacgcgggctagatcta

SEQ ID NO: 1979 - DNA, 696 bp, Corynebacterium glutamicum
atggcacgagcgaaaaataagaaacagcgtcaattgcagcacgctcatgatgcagcacaggctgagattgcagaagcggtagcggttaacacggttgaaccaattaatgcacgcaccggtggatggccttcgtgggtcgataaggtctggaagctcactggttcacttggtggttggtttgctttcctggtttttgccatcgccgtgtggccggtagcgatccttgcagctggcactgtggtcaccatcatcggtacgtggggagtatcagtactgccaagtctggttatttccagcatcggcgcttctgctggtgtgattatctccactactgatgggttcctctttagctgggtcatcccggtgctgtttctcatgattgtgctggcactggtggtcatgaaagtgctcaatcttatttttggtgcattgtggcgcttcaccatgactttgcgacaggggttatacgcaggtcgtgaaaagatttctcgcgacgacgcgaagcgcgcacgagcagaaaagaagctgactaagcagcaggctaaagaagccaaaaagcagcgcaaacttgatgccatttactcggctcaacaggctgaagagactctggcgcaacaggcacagtctgagccagaagagtcagacgataagaaccgacacgacgccctcaacgacgctgttgcagcagctcgcaac

SEQ ID NO: 1980 - DNA, 714 bp, Corynebacterium glutamicum
atgacgacacgaaatgtagataaccagagtggtgtaactgaggacgagccgatgttcgatcaggtcaagcgcttttttgttcgcaatatcgtcatgatcattgcgttgatcttggcagtggtggtcattattgttgccaccagcacctctgcggatcgacatgctgtacttaagcgtcaaactggtgagattatggccttgcaacaggaacgtgatgcattaaacagtaagcttgagggccaacttgagcaggtggtgcgtgacgctaccggtggtatggatattgaacacaaggctgcagatgatgctgttgttcgagaatttttgtccatggcgctgacgtgggacagcgtgcgcgactaccttgatgtgcgcgagcaagtgatgcgggtttatgacctggatgaagaatcacagtttatgtcggtgtttatgcctggtgaaatggcgggcattgctcgcaccgatccaactggcgaagtgcactatgcctatgatgcagatctgtccaaccgctttagcagcttagaatccgtggttactcgcattaatggtacagagtacagctatgtatccacggtgacgatgaagtcgaagcgctctggtggtgaggcagaaacaacctctacctcacgccttgcctatgacgtgatcgacggcaaaattcgtaacctcgaagcacgtactgtccccggtggtgtgaaatactcgggc

SEQ ID NO: 1981 - DNA, 1008 bp, Corynebacterium glutamicum
atggctgagaataatggcgggtcggatgaccttaagcccatctctgtcgatggggtcgtcaatggggaagtgcgcagcgacaaagaaaagcaggcgttcgagaagattaccggtgatgatctgcgtcgtcgtgcagaacaaatccgtaaacgtcgtttagcaaaagcgcaagaagatgcacgtaagcgtaagccattgtttggtttgggtcgtatcgctgtcacagtactggctggcgccgtatttattggtacaacgttgtggatcagtaccacctcgggcggctttgacgacaaggtgagtgcaaacaatgagcagattgtcactctgcgtaatgaagtcaacgacttaaaaaacactgcagagacaatgcccaaaaaagagactcttgctagtcaatttgacgcagcaacctcacgtgcacagaatgtggctgacttacagaatcagttagccggcattattaccagtgttgatgatgatgccgcgaccgagcagttcaagacaattgttgatgagctgaaaccgaaattcacggtctctgctggtacgacaggtgaatttcctgcggcgggtcgttggtaccagccacaagaagttgttgtcggagataacaaccgacccacctgggcgccgatgggggctgagtcctggggatggactgtgacccctacactgtcgatgtcagataccgagcacgttgtggtgatgtgggaggcccgcttgaccggaggtgagcgtgacggtgcgctgttggcgtgggtgacagccgattacaacatcaacaccggcgtgtttagctcgctggcgttggcgcatacctatgaaggacaccagcgtattggtgcaaccacctcaccaagtgaatttggtgcccacggcacaaatgcagaggcgagcgctgcacgtgctggcagtgaaggcggggggcttgagggcgaggctattttcgttgatgagctgcagcgggcactagagatcgctcagctgaacaaacaggagaacaga

SEQ ID NO: 1982 - DNA, 1659 bp, Corynebacterium glutamicum
gtggctaatgattttatagaaccaaatgatgcccccgatgcacctgataatggtgactcgggaagctcggggtttgttgatgaagcaaaagataagacccgctcagctgcacaaggcttaggttatggcgcactacgtgtaggttttggtactgcagcacttgcagccaatggtgctcgctctatgggtaatttggctaaaaacctgtggacacgaatgatggggcttgccctgtctgccggtactggtatctctgctgccacaggtggcatgatcactgcacgtgtaggcgcaatgctggcaggtacaggctcggtgttgtcgtcggtgacgactattgcgttgattgtgtcgatgattgtggtgccggcaggtcgaaaagacggcattatcgagttgtgtgagccgccagtaacggccaacccgtttaccattgacgcaggtgatatgactgagaacgcgaagttggtgtacggtgcgctgtcgtatcttgggatgaatgatcaaaatatcgccggtgtcttgggcaactttgagacagaatcaggtatcgacccgactgcggtggagggtatttttgatgaaccaaataccatcggtcctcggaagagagctgcgtgggataagaactttgaacctcagccgatgggtattgggcttgggcagtggacagcagggcgcacacagatgttgctagattttgccgccgatagaaaccgagactggcattacatcgacgtgcagcttgcatttgctattagtggcgataatgaaagcgatcgcaaggtttttctggaaatggttgataataaaaactccagtagcaatagccccaccgcagcgtccgagtacttcctgcgtgagtgggagcgcccggcagatgtcgcaggtaatgcacccattcgtgcagagcaagcatctaagtggtacgcgcagatgggtggttggcaaaagaactcaaccttgggtgagtctgtgatcgctatggctgatggtgcagcagcaaaatccacggcgcgtgatgagcaggatgctcttaatgattgtcctgaagaggaccgcacctcaggtggaaatacgtccgctgcagaagcaatggtgactatttcacatccttatctggctgattctcgtggcaatgacggtactgatatttaccgctatatccatgatgaagtgctcaccggtgatccgtattacgcatcctgtgaccgtggcgttgctaccgctattcgctggtcgggcacggatgatacgttcccagcaggtccaacagcagcacagtatgaatacgttgtgggcacaggatcgggccgttgggaggaaatcggcaatcttgccaccatgtcagagaacgatttgttacctggcgatgtgcttcttggtgcaccgaatcacgttgcgatgtatgtcagcaatgaggttgttgtggacatgttgggccctggtaatgcagagcctaatgcagctattggtcatgcatcgttgaatgaccgctcacctggtctggataccttgagtctggatggatggggcgtgaacttcaaggtgttccgcaacacccaggctgagacaaactcagtgttctctggtgtacagattccggctggtaaagaaattggcgaaatgactaacccaactcgaactactcctgcagga

SEQ ID NO: 1983 - DNA, 1488 bp, Corynebacterium glutamicum
ttgtcattaaagaaatggggtagagctatgacaaatactgtgcagagaaaagcaaagcagaaaaagtcatcatcaaataaagagggtatgcagaagaaagtcgatcgtattgtcagccgctttcgtttaggccagcactacacgatcgagcgggtagcacttatttcgggtgcagcagtggtatcagggtctttgctttttggcagcacaattgtttacgcagtgcaggccggcaacattgatttttctcaaacagccacgtacaacgccgagtttcgatcatcacgaaccaaccaggtcagcgagctcgcaggcttttggaaaaatgtagagggcacacgggcttttgctgttattaagtttgctgttcccgccaatatgtccactaatgctgaggattattttgcctatgtcaccggtgtgaaagaccttggcaccagccccaaagcagcagatgtctctcaagcaactgtgggttccatttatagctttggtgatggtcgaattgggctcatgcttgaggcccctgagggctttgatatgcaggttctcaacatcacaatgcgtgcaaagaaagagcttgtcgaagtcgatagtacaaacttgacctcggagaatatgaaggctcaaggctatgacgattcctttattgatcacgaccagtggcgcatcatgctcaatccagcggcagagactttggcgacgttgccggcattaaatgacgaacagattgatctccgtgcgttgtattggcagacctctatgacagatacggaggtgggtcaccgacaggcactagatacgtcactttcacgtatgaacgcactgcttggtcgcatcgagaattacaaggaggcgctcggcgttacgagcgcgaccattatgggtgagcgcgtgtcgctgattgagcctattccgcatgagtcaattcgcggtgatcgtatcgaaggtttggcaagtgtcgatgttaccaagcagctcgctgaggaccccaccgggaaatctgtcccaggttgggaggacaagacgttcatggctgcgtcgctggataatctgatgagtgagggctatcaatacaactcataccgcctggtcaccgatcatatttttggtggcggttatgactttgattggcgcttaggcaccacacttgatggctacctcaaggatgttgtcccagggaatcaagatgctatgacctggattacagatcacgcgtatcaaactaaagcgacatggaatgccaatcaaatggagtgggtcttaagcaacggtgatcgcctagaagatcatgtgctcagtgaaggtgccaagccacttattgatttaaaaaacaatctggcacaggcgtaccaggactatttcaatgaaaagcagcgctaccagcgccaactcctgcaacaactgttgatctcggaaacacagcttgatcaggcagtggaaaatactcaggttgcccaaggttccgatgctgttgaattccgtttc

SEQ ID NO: 1984 - DNA, 399 bp, Corynebacterium glutamicum
ttgtttattacttatgggaatagtgtggaaagtagggtgaatatgtcaattcctggaaatgttagttatgttgcacagggtggcaccggttgggatggtgctgatcagtacaccacgggtgagagttgggatctacagtcgttccttgaaaactcgactgactacctcatgattattggtggttcgctgctggcacttgttggtggtgctgctgtgatttggggctttgtcaacgtgatgcgcaagctcttcggtggtcagagtggtcagcagattcagtggttcaccactattttgctcatcattgtcggtggtgcgttcctagttggtggtatcacacttgcgctgaactttgcgtctggtgcaggcgatacggttaccggtttcggtacaggtggc

SEQ ID NO: 1985 - DNA, 1509 bp, Corynebacterium glutamicum
gtgattgatcgacctgtatggttgtttgaactttataacaccgcgaaagaagtagtatattcgctactcattgatgaagtaactggggaaaatacaatactcaagaaggatgatggttggcgagatcaattcatgattgagtctttctttgcttatgattcagaagctgacgcgacctcgtggagcggtaagaacatgaatagctactggttcgttagcgatctaatcagcaatatatccttcgctgagcgatccttggaaagcttttcttgggctcttcgagatcttgaggatctttcttctagtgaaactggatttgaagggcttgaagagctgaatctaaagtttagtgagctccaagaatggtatacgaacctggaacttccttttcagccgtcggctgctgatgttgatgaggtggagcagtatctgcaagctgaagtgacaaggcaacggggtgactatcaatggtctcctgagttttggataccaaagccggattcatactatatcgaccatgcactagcggttgtcacagatgttttgggagctattgaacaaggggagctgcgtgaagaagtagaggtgcagcaggctttagacgaggtatctgaaaattggaatcctttggaagattctgattactacttacaggatcaccgtgggcgccctgtacaagatctttcccgggaaatggaggagttggtcagatgtctaatgcttgaccaagagtggtggggtgcagaggcaaggattagaaagcttgttgaatcagttgagtgggaggatactcaggcgatcagctctttaattgaacacgagcaatattgggaggatggtcgttttcgcccacctctacataagttttcggaaggactagacgagccagagcccttgccgatgacgagaaaaatgatacttgcgacgaatcaccctgatgttttacgcgtaaacattgctgattattatcagcagcataggcgcattgctactcagaaggtggaatgttataaggaagttttggcattgtatccagagattcttaagaaatttgatgattcatctttcgtcaatcgacattggatctatagggcgtttgatcgcgaaggtcagcttttgtatatcggggagacaataaaccctcttgtacggttgagggagcatgccggcttagggtctattaaccacgcacatcataggctagtatcgccgtggttttctacgatggctacatttcatcttgaatcttgctttacccaggctgaggcaaaagagaaggaggctttatatattaagctggaacagccaagatataataagacgcataattctgctagattggcggtttctgaagaaggggtgccggtgaacgaggtgccgtcaagaaatgatccgaggaatgtcggttggaagggtcataggcacgtgccaccaatgttgccgattgttgcacgtgttgtcgatgaatcgacaacacgtgagggatatgcgttttacgaggacaaccgg

SEQ ID NO: 1986 - DNA, 360 bp, Corynebacterium glutamicum
ttggttacgcttcatctgccctacttaaaacagcggatcagaaagcaaaagattatgtccaacctgccaactgaggtttacctatcaaaccaaaatcaaaatgaaaccatcttagccctcaaaacgtggctatcacctagcgtggcaaaggtggaatatggcggatcctcaatttctgtggcaaagctactggacaatccctatgaggcattaaacatcgcccgccatgaagaacccaaatcctggcaaacggtcgcaagaattcacttcgattcttctgaagaggccactgtcattgtgacaatgaaaggtttaggtggaacagatcgtatccgactcactatttctcagtcagaaagc

SEQ ID NO: 1987 - DNA, 222 bp, Corynebacterium glutamicum
atgaccaagcgaaatatcactactgtccgcacagaagacggatggggcaaccgccgagacaatgcgtcccggctatcaaaaagcttcgacacccaatcagaagcgattgctgccgctaaagtgactgctcagcgagaaaagttggagcatcgtatccagggccgggatggaaaaatccgtgaagccaactcttatgggaatgatccacacccacctaagggc

SEQ ID NO: 1988 - DNA, 312 bp, Corynebacterium glutamicum
ttgtacttgactgggagactgatgagtggatggaggcgaagcggttcagtcgccattctctatcagagggacattcctagaatcctcgtcaagaattctttctctgagaaggcgactgaaactcttatgttgatagaaaatttttttgcttcacctgacattgacaatcctcaagttcttgagatgttgggcgaagcaagtaagaattttcctaagatgtacccggctgacagctcctattggatttcggaagttggctctaaaggggcgcaagaagtcctgaatgacttggaaacgctgctgcaatcaagc

SEQ ID NO: 1989 - DNA, 645 bp, Corynebacterium glutamicum
atgaatcccgaacgtcggctcacctcactcactgctttctattttggaagaagggttgcctcggcgcctcacagtgacgagaccatcagatctgtatgttggccagcttatcgagatgtgcagcggaccctctgggggatggggtcacaccctagagctaaggagctgaaggccacgtcttgcgacaagattgtcagttttgtgcactctttcggtggtatcaggtcccaagacgaattcgaccagcagcaccaggtttggtgcgaggatctagttgccttttttgcggagaaccctcacccggagagaccgacattccagttccactacgggcatgcgcagaagtggttgaatatgactctcaagtacctatctgtgctgggacatccagctgtggaagaagtctacgtgtttcttcatgccccgattgaccgtgacgtgtatgagcgtgcgtgggaaatacttggagtcgagcgaccgagaatcgcgtggtcaaagttggacggggatacttaccgcagctatcagttgaacatacgacacgccgtggcggggcaggggagagggtttgtacttgactgggagactgatgagtggatggaggcgaagcggttcagtcgccattctctatcagagggacattcc

SEQ ID NO: 1990 - DNA, 759 bp, Corynebacterium glutamicum
atgagtcggcataatactattgatgaaatttgtattgcgtttagtgggggcacagatagggtgttaggtatcccatttctttttacttcgaagaaggccgatttttatattacgccttcttatagcgatggtgctcaaccgattcatttgtcattgcatgataaaactgagaggcatgctgaacaacgctttcatgtaaaacgtgagaaaaaacctaccgacataaaacgtcttgttttccacaatgatatttttaaaaaaggcaccccgtttagaggaaaggaactttccgctggagtgtttcacgtggctagattgcgatattcgtgggacttgcagcgcgaaagatttagagaaacagcgactattcgtttgagtcaattgaagtcagatacttgtcgagtttatatatttgatgagaatctacctgaatattcagtggtagattttgacatagtactttctaatcatgatccgttttatttcaatcaggaagatgtgttttgccaagcgcaagaacaaggttccggaagcccatacatagagcttccacgaaataaatcaggtcaattcttaactgccacagtctctgttagaagtgaaattgattcaccgacttttgatgatgtccatttagctgcacctttagcaagagatacgcctgtattagcctgcgctggtgcaaccaacacggagggggtctattggttgtataacacagtaactagcgaagagtttattggtgctgtaaaagacggt

SEQ ID NO: 1991 - DNA, 549 bp, Corynebacterium glutamicum
ttgcccataaatttagaaagtttattaataggggtgtcaggcggtttgcttgttgctgtattcacagctgtattgaaatatgtggaccggtacttggactttagaaaagaagcgaaggtaaacctgaaggttgctcgcagcgagtttagagaaagccagcgcttggctgttattagatttttacatgctattgaaagagcgaatcatgagcatacaattgagatgaatcggttagatgcagagtttcgtgaagatttagttaaacatgctgaggggcaaagcgacaacgatttttctacttacgttaaatttaaaatggcggtagacgaactcgatctgtccctctgggcaccaattgtccgagaaagtctttcagaaataaaagaattgctgagagaaatttacaattcagcttggcgacaaaaagagatgattgatagtggccagaaagtgcgcccagctacttatattaactttccattgctagaacaggccactaacagtattttggactccgcgattagagagttctcagaatctgagcctgtg

SEQ ID NO: 1992 - DNA, 930 bp, Corynebacterium glutamicum
ttgttgattgtatacttggatgaatttgggcatgtaggcccctatatcagtccaaagcataaaaagtatcatgaaaaccctgtttttggctatggcggatttgtcatccctgaagtcgaggttcgtcgatttggtggttacttcgaacatattaaagagcgtcttttagctgaagaaattcgtgcagcaaatgttcatccgcgacgatgggaaaagaaaggggcgagtctccttactaccaaaaactataataagtatgggagtgaaatgattcccgccttgaaacgaatatcgagagagcttaagcgatctagaggaaacgtttttttctttgggcaagagaagccactcggtccagtgagcatcagctgcgaatcgactcaggagcgagaaaagcattgtttgattcaaactattaagcgcgttgggtcgattggtgcctcaaaggatgatgagattatggtcatcatggatgcgactgaggctgataaccgaacgagagcggtgtccactttaggtagcacaatttttagccgccatgcagataaagatttgagcagagtggttgatataccgcttcaggcggacagtcatttatacggaactgttcagtttgcagactggatttgtgctcttttgggtcgtctttgtcagtaccatttttctgaaagtcgagagttttcttggtctgtagatttagcgaactatatgttcaactcagaaatttttacccccaactctttcatttggactaatgagcacgggaattttaagctttcaccacaaaagatgcttcaggcagaaccgtactgggagaagcgaatcctcgctcgagagaagaataaaacgaagaggcaagagaataaaacaatgatgagtagtgtcatggaagcctgttcgccggagtttaaagagcgttattttctttcg

SEQ ID NO: 1993 - DNA, 306 bp, Corynebacterium glutamicum
gtgtttcgcgtcagcataaccaaggacattgcctccgttggcggccttactgagaatgccctcccacaccttaagaccggcgtcctcagaatcgaggaactcgttcggtccgccttcctctacaccggcagtagctgcccgaccattgccatagaacgatgccatcgcagaggccatacggtacatggagtaatcaggggctttatcaaggttctgttctttacgttgctcttcgtttttcgcatcgtagaagcacttcaagacatcttctgcttcgagacacttctcgataatgtgcatttcacc

SEQ ID NO: 1994 - DNA, 357 bp, Corynebacterium glutamicum
atgtgcatttcacctaagttctcggtgatgcacttaagaagcatctcggtgtcaccatcactgggacaaatcgcttcaaaggcaacctcgcccatagcaccgacaacctgggcaataatagcgctggcgaaagcattagcttcacgttccttgttaccaaacgcaccaaagctcaaacccactgagatcaagagcgtcatgacaacagccatcgttcggcgtcgccacgtcttgtgtcggttgtgtttaagctccatgcgcgcaatctcagcatctacgtcctgctcactaagctgtacaggttgcggttctaaaactgtcgcagtcacttgcccgccaccccctcaatattcgttt

SEQ ID NO: 1995 - DNA, 4464 bp, Corynebacterium glutamicum
gtgactgcgacagttttagaaccgcaacctgtacagcttagtgagcaggacgtagatgctgagattgcgcgcatggagcttaaacacaaccgacacaagacgtggcgacgccgaacgatggctgttgtcatgacgctcttgatctcagtgggtttgagctttggtgcgtttggtaacaaggaacgtgaagctaatgctttcgccagcgctattattgcccaggttgtcggtgctatgggcgaggttgcctttgaagcgatttgtcccagtgatggtgacaccgagatgcttcttaagtgcatcaccgagaacttaggtgaaatgcacattatcgagaagtgtctcgaagcagaagatgtcttgaagtgcttctacgatgcgaaaaacgaagagcaacgtaaagaacagaaccttgataaagcccctgattactccatgtaccgtatggcctctgcgatggcatcgttctatggcaatggtcgggcagctactgccggtgtagaggaaggcggaccgaacgagttcctcgattctgaggacgccggtcttaaggtgtgggagggcattctcagtaaggccgccaacggaggcaatgtccttggttatgctgacgcgaaacacaacgaggactctggttggttctttggtaatggtgttgccaacaacgagaaaacgtactcctatgattctctagctgatcatgcctttcaagggccttatcactttgcattatttggcgcgacactgagtggcttaggctttgatagctcaaaggcggaggattcgcagactgattttgctcagcgtaagggcatggggtacgcgatgatgatcgcgtacatcatctccggaggcattgatctggtttttaacactgtgctgaatatcttgagcaccataaacccatttagactgctcgttggaccagtatctcagaatactaacaagacattcactgagaatatggctggtgggcagaccacagaaggaacaccgtttgaaggaatgactgatttcttcgggttgatctataactggtcagtgactgtgggctggctcatcgttattcctgtctccattggtctgtttatgatgggtgcgttgatgtttcgacgcatggacaagggatcagcgtttaaaaaggttgttatccgcgtcgtgtacggtgtcgttggcctgccactgcttggtgtctcttataccggtgcgctggattccttcctcgacagcggtagttccacaagtgctggatcaaatgcgacaaagattgtgttgtccacctacgtggatttccaatcatgggcagaaaacacccgtatgcgtgttcctgacaaagtaacactggcgtggagtctggaggatcaggcgccaacagggcagtccatgcggatggtacgcaattcggcgttggaaattaatgctcaatcaaatgagagttttactacttttaagaatccaggttccatggatctaggctatagcatggactggatggaaaagatggcggatccagccaattctggcaccgatgggacctcatcaagttcggcgacgactattttccagggaaccatcgcgctactgagtcgttatatcgacaacgacagtatctcctctggcagtttcgaaacctctattcgaagtgcgatggaatctttgacctcgaaagagggaagtggcgaagctgttgccggtggtgatgtaatggcctgggttactggttacaacacagcctctggtcttaatgagatcactgctgctgaattagctgatgcgaacaatccattgcttgaggtcagcgactcagctggtctgcagggacgacctattgaccgcaatgcggtgtcatttaaatctggtgatgcgacagcgtcatgcaacaactcagtcgtgacaggttctcgtgctgtggtcggggactaccgaagtgactgcaatatgtcgcccttgacgatgtacaacttcctcaacacctcattccatccagctgatgcaagtgtcttttctacgtccacttctgcgtcaagctacacccgtgcatcgcatagcgcagtgagtcttatcggttctggtgccatgaactttgtgtactggttctctgcaatgtccctgatgggtagcttcatcgtgatcggtatcggttacgccggtgccatgctgtttaatacgattcgacgcacgctgtcgctcattggtgccgttccttttgctgcgatgggctttattgctggtgttgccaaggtcattgtgtacaccatcgctatgctcgtagaggttatcggaacgatcattttgtaccagctcattacccggttcttgatggctgtaccagcactctttgaacaacctttggctgattccttaagtagtaacgagagtgctgagctggttgccggtgctggtatggggctagtcggtatggcactagctacctcaggcaactgggcgattgccggcatggtgatcacagtggcctcatccatgggggtcatcatcttcacgattattgcgatgaaggtgcgcggatctttggtatcaggtgtcgatgaagccgtgaccagtgttattaaccgcttcttggatacacaggtctcttctgcaggtgctacctctggtgacggcatgatgcgtcgtgcagccgcaacgggtcttggtattggtgcgacacatatggtactcaaccgtgatggtgacggtggtggatctgattcaggctctggtggatcaggtggcggtagcgattcaggcttgggtgagaaggctgctggtctggcgaaggttgtcacaactgtggctggtgccggattagtcggtaagtatgctacggatgcgctcgataattatgcagatggcgttatcaacggcgacggtgatggtgcgttcgcagcaggtggtgacgctaccgttgatggcgactatgtagcagatggagatgcaattgcttctgctgatgctaacgctgattttgtagacggtgttgttgatggtgctggtcgcgcgtcatttagcaatgctgcgtatagctccgatggaaccactctcgacggtgagggtgcgagcgttgatgcacagggtaacccgcttcatgctgatggcacaccaatgagtgctgctgaagctgaaatgaagatggctggtctgagctcgtcaggaaccatgatggagaaatctggtgtgaaatcgagtggcattaccactgcagcggatgtcatggacgatcagtctctggcaagcagtgtcactgagtctggtctgtccaagattccagacacctatggtgcagatgtctcgggtgctgcgggcacagtcggaactaccggtgctgattacagtgcgaccgattcaagcgcaggtctgaacatgagcgaggctgcattgcagagtggcaccccaatgggcgctctcgctggtggatctgtgtcgagttccgatcaggccatgaatgacgcagctcttcagattgcagcgtctcagggtcttgcaccagcaggttccatagctggtatggagcaacttagtgctcaagccactgaagcacctgctggaaaggccggcaagcagcttggcgatctttctggctcagcgctcaatactcagctggcgtccatgggacagcaggtaggtgacagtgtgaacagcgcttatgctgcaggcggtatgggtggtgttgatgtggctggcaaggtcaccgaggcagcacagcacttgtctcaggttccaggtcagattcagaatgctgtgaccaatgcggatgctggttcctctggcgcaagctttggtcagatggcacagggggcagctggtattgccggtgtcgcaggtgtgatcggtgcagcgggcgcagcaagctctgcagcacaaggcgcaggtactgtccagggtgcgatgggtaatgctgcagctggtgcgggaatgatcaacaacgctgtttccggtggagctactggctcaacaggtgccgcacatgtggtcaatgcatcacatggaccagtggcgcctggtcaggctcactaccaagagtctggtcatgcacaagcatttgtgcagaacaaccaggccaacaccgcgcacacagcaaacacgcgtgcaccgtcatcagctcaaattatgggcgcgaacgttgctggctcactggcatcacaggctgtacgaggaatcggtcagcctggtcagatgggtgctaatgttcgcgacgcgatgggtggcagcggacgctctggtggccgtggtggagcaactcaaggcggtcgaggcgcacagcgcagcggtgtcagtgctaagaacggtatccgtgcacagcgaggtcagaagccttctgtgaccggccaggcgatgaatgcagcaatgcgttcagcagcggtaagcggtcgcatggcaaacatggacggcaacagtgtaggtggcactgaagcagatccacagcaggggagtggcgtaaccgagaagggtgataaaggcgttaaa

SEQ ID NO: 1996 - DNA, 579 bp, Corynebacterium glutamicum
atgttgaagaataaaactcttgcgctgctggctgtcagtacgctgatgtttggcttatctgcttgctctagtgatgctgacggcccggacagtagcggtgctagtagtagcagtactggctcatcttctgcatcggctgacacaacagattctgcagctgttgataaggatgctcaattagacacctttatgcgttctgctgtggctgatggatcatctgctgctgtggctgtggacaacgctgtaggtaagggctttgataaagctgatgcgcaggcggctgcggagcgcttgggtgatggtttccaattcgctgcggattaccaggctgttggctatttggaatcttggtactttggtggcgcgcgaagcgagaagcttgacgaggtgcgtagtgatgtcatcgctcatttgtctgaattgggatttacagatttagaggctgaatcctcggcatctcgtattacattaggtgattactgtgatggggtccctgagtattgtgagttgttttttgatggcgaatctcctgacttgtatgacatgggtacggagcttgactcgtataagcccactgaa

SEQ ID NO: 1997 - DNA, 945 bp, Corynebacterium glutamicum
atgatatttagcatgactgattctctgcttgtatccatcagaaaaggcttaatagaagagcgtccattaacggagcttcttcgggcgtgtatcttccttggaagtgatactaactcggactctttacaagagtgggcgaaaaatgaattaaatggttatggctccattgatggtattccggaatatcgcaaattgaaaggacctcctgtattcgcgaaaattcaagctggtaattcaataatgtctaatatggtactggggccacataatgttcctgaaagagctcgtaagtatttccctgaagagctgcattttgatcagccgattcaaacgctaattgaatggtcgactaggcaggatgggattaatttatcgcccccgaatttacttcgggtccgcgatcttcataatgatcagtacgcgccattaaatcaaattttgaatttaaatgtttacttagataactcttatttttcgggaattgtggaccgcatccgaactctaatgacttccatgattgccgacctcacacacgcaactcctctggatgaactaccaagcagcgaaaaggttaatgccacggtcatgaagcacattgaaaataactacgaaactacaatcactcaagccaatggagctgtagccattggtaacagcgctaaagctgtgcagaagggattgtccgtggatgacctactgaagattatgcagaccattaatcctgaaaagttcgacttaggggaagctagagctgaagccgaagaaagcattcaatccatcgcggatgagttgaagaaggagtctccgaataaaggttttatccagaatgcttttgaaaagttgaaggaactcagcataaaagccggcgataaagccttcactacaatgttaaatcttgtaggtaaacagataatcgaaaacatcccacaactggtttcaggtggc

SEQ ID NO: 1998 - DNA, 171 bp, Corynebacterium glutamicum
gtgtcaatcaatgcgttctggactgaggtgaccaccatgcaagacgaggtggacctagtgatcaccaacccgccgttttctctgttccgtgagttcctgagttggctattacacggtgacgtgttgttttctatcatcggtaacgcgaacgtaatcacatatctaggtgcc

SEQ ID NO: 1999 - DNA, 375 bp, Corynebacterium glutamicum
atgttacgaaaagcatctatcacgctaatgatatccgttacgctcttaacatgtgcctctccagcacaggcactgtcatcacaagcactctcgtcagaaagctccacttcgcagagtgattctcctacgcaatttgttgcgagtatagctgcgcccttcaataagaacttaacctatgagcagcgcaaagccattcgtttcggacctacgacagaacaagaagcagaacaatgcttggcaaagtatggtcgcgatggcgaggggccatggcctgctattgctatctatcctgactgctccttcgatactatcgaacaagatttctatgatcaagcaatatccaaagccctctcagtaatcagtctgggaagctcc

SEQ ID NO: 2000 - DNA, 1821 bp, Corynebacterium glutamicum
atgagtacatcgaaaacagagaaaactgcggttcgaaaaataggcaagatgatcgattcatgtgcgcatttagaggggttttttagtgaaaatgataaaaccacttttacagatggacacatagatattagtaatgatgcttctggagctaagcgtagctttgggggtcgggtgaatgttcagattaaagggcgaaaggttaatgccaaggctgccgacttaaatagctatccggtctcagtagttgatctacgaggcttcgtgacactggctggtctcttattttttgtggttgatattgataagaaatcaaataagaaatatccaaagtatgttcttttgaaaccgttttatattcatgatctactgagtaaagcgaagccgggccaaaagacaattagcgtccgcttaaaacggttaccatctgatgaagatcgaatggaagccataatcgcattagcgctcgcatcgaggcaagaaaagatagtcgagaaccccagtaactatctctatgaaaatatggaatcaattactgttaaatcggctgaaccccttaatagggataagctggctgtatatgatggtagttcgccagaccattcgatcattattcgtactggggatggaattgaacagttcgtcaatgccaccgtagaaataatacccccgaatatgcagtttcatcaagccaattataatgtttcgtgtaatggggtcgtctatgacaatgttttgcatcgaaacattgatgatgagcacattgaattgaaaatcggaaaggggattactctccgcctacaaaagctcgccattgatgctccggggagcgttacggttgagtttcaagatagtcttcctgaacggttaaaagacattgagttcttcctaggagtgcttcaggcgaatacgttttttattaatgaagaacctgttgtgttgaagattaactcgaaccggactgtggctgaccttaaggatgaagcgggtgttcttcgtcagttggtagaaatagctaaccatttcaatattgatccgtcccttattcgaattggtgagattacagaaaaacagttctggcagttggatattgtgtatcgaacagccgttaagggagaatacgtaaagaatttagaggttaaagatgagactagacttatattgcagccttttggtcgttggaatcttgcgttgatagctcaccctggtgatgttgcaggggagtggacttatcatgaagtaatttccaagcgtcatcattttgctatgacaccttcaacggatcggagcgactcctcaatcgagcgagtgacgccgtacgagctcattgataatcgatggcttccatcagtattgaatctgcatttggataagcttgttgatttctattcagcgcttgaagaaactgttgatgttgataatctcgccacatggatggtgcttcgcctaattaaggcagctgattctgagcagagcaggaaaactgcatttcttatagcagctcaagctctcaatgattggctcgtggaacgagatcgagaagagtcgccaatttacaggcttaatggttggcaaattttgtatcgccaaactggattactggattcacaaagaacagaaattcgatcttttaggcataatcttgatcaaacaatgcacccagacaactatagcgagattatgattggttgcgctttgcttcttgacgatagagaagaggcgaattttttgcttactcagctttcggttgatcgacgcgcagtttttaatgaatggccgatagctcaattgatgacgggtgccctaaaagaagagattgaaaaa

SEQ ID NO: 2001 - DNA, 201 bp, Corynebacterium glutamicum
atgtccatgaagtcccgccgaattatggcgttgaggcttacttatcaaggggactttatcggtttggttgtcgctgaggctgaaaaaccagagttgttaagcatgactttctttgacgaaattaaatcagcgtcgtggtttgactcggtagcgaaattgatgctttctgtgagggggtctttcgtcactcatatctcaagt

SEQ ID NO: 2002 - DNA, 468 bp, Corynebacterium glutamicum
atggacatcatgtcagcgcatctaccttctcatcatgatgagttagtgcagcacttagttcttgcggatgtaaagtatcgggagctcagtgcgttatcggtcaaaattgaggaaccatcagatcgtcctgagtttaaacttggagttactgttaacgacaagagtaaagacgaagaaggtgtgccgcgaatcattgaggtttcattgagggtgtccatcgaggttcccgacggaaagataacggtagagcctgaagcaatctatttgattcctgagaataaggtttatttaacggaatctgatgcaatggtggattattttaacaaccatgcgatttttactctggtgccatatgcacgacaggccgtgtctgatttagggcagcgtgcattccacacgcagatcctcatgcctgcgttaggtcctggtgatttggtttttagtaaatcgacggcctcacgagaatgg

SEQ ID NO: 2003 - DNA, 381 bp, Corynebacterium glutamicum
atgagaggatataaggtaaaactcatgacgcacagtaagaaagcgatgaaagctaaagctaaagctcttctggcttcccagcgtgaattccttgactcacttgtagctttgagaaagaaagctggcattagccaagacgaggtggctaatcggatgggcgtttcccagagtgctatttctcaatttgagcactacgatgcaaatcccactctgtctacgatccgacgctatgcgctagcggtagatgcttctatatcttatagggttagctcttctgccaccctctatcaagagtatgagtcgaggacaaacaatcacgtatccgtgtccggccaggaagctgccccgccctacgttgattgggaaaagcccattttggcg

SEQ ID NO: 2004 - DNA, 507 bp, Corynebacterium glutamicum
atggtcattaagcaaagcatctgcagtggtggtaaaccggtgcattatcactggcgttataactgctctgataaccatattgaagaaactgtagagaaaataatggacatattgaagagaaagtatgtcttcaatatgttgaccgaagcggatgcggaagctcttatcgaagatcgtttggagctagcggagagggggcgattgacccccgaagagcatgttaagagtatttccagtcaaccgcagctggatatgtttgagattagatggaacgacattttcgtaagagatcaagatccagtttctgggatatacagtgatggatactcaatattgatgcgactctactatgttgaaaaatcaggttgtgactggtttctgggtcttcatgcgcacgagaaagaaatcaatactgatgacacaatcaccaaacaccgtcaaaacaccgagattgaaattgctgtgaaactgtgggacgaattaagtgctgatggatcaccagtagat

SEQ ID NO: 2005 - DNA, 837 bp, Corynebacterium glutamicum
atgttggtacagtcacgcactttggttactgccattctgtcatgttcgttagtatttgggacaacggttaatggcgcgagtgttgcaattgcacaggaaaatgtacccatggcggctctttacgagccggattacgagtcgttagaaacgcgtctcggctcgataaataatgatgcaggtttgcctaattcggtctcacagaccgttgaaaactttgcggaattaccagaggggactcggttcgtccttgacagtgacacatttgcagtcgccgttagcgatggcgtagtcacctcccggctggattcacagacaggagtgatccggcatacttttggaggcgccggaactattagttacaaccctggggaagtgacgcgatcttatatagatcgagtaactgtaagagtggtctaccctgatagttctattgacatagtgacacctcattcagtagtcgaggtatcagatagtttttactacagtgttcagagcatagattctcaacgggttcgtaatggtcagagtattaaagttccgatgacggtcattgctggggatggagcgattggcggggttccgcagggagctaaggtggttcgcgatcgttatgggtcagttgaagatgcggaactcatgggggcaactattgtcattgatgagaagaccggtgagcttaccttcacagcaccggaagatcgtactgggcaaatgtggtttgctgcagaattaatttatccagatggcacgtattcggaggtgcattacttgttcgaagtgacagataagtcggtccaggacgatagcgtacctttctttgggtcttccttgagttca

SEQ ID NO: 2006 - DNA, 942 bp, Corynebacterium glutamicum
atggggaactgggcagagattactgatgaaatttctaagatttaccaagataatcagtacaagattagacaaataaatgatgttgacgcagtaagcgataaacgtagagaagcgctacaagcactgtttgaacatactggtcgaaatgtaatcgtctattattcagcgtggttagaaaatggtcgacgattttccgggcaatctacggatttttcggtaaatgatactgataaaaacagttttatgactgcgctccataagttggatcagagtaaaggtctcgatcttatcctccacactccgggtggagatgttgctgcgacagagtcgttagtagattacattcacgcactctttggtcaagatttcagagtcattgtcccccaactcgcaatgtcagcaggaacaatgatcgcactttcgtccaaagagattgttatggggaagcattctagtcttggccccattgatcctcagtttaacggcctaccggcacacgggttattggaagaatttgagcaagcgaagaaagaggtctctgagaatccgcagactgctcatatatggcaggtgatcttgaataaatacaaccccacgatgttgggtgaagctaaaaaagctattcagtggtccaactcgatggttaagcagtggcttgaaaagggtatgtttttagacgagcctgacaaagaagaaaaagccactcgcgctatcaaagagctcgctgatcattccgttactcttgcgcataatcgacacatttcggtcagtaaagcacttgagctgggattgaatatcaaagaacttgagagcgatccaaagcttcaagatttagttcttactcttcaccacctgtccgttattgctgcgcaacgaggaccattaattaagtttgtcgtcaatcatgacaaccgtggcacttttctgcaggggcatgaaaac

SEQ ID NO: 2007 - DNA, 624 bp, Corynebacterium glutamicum
ttgcgtgggaagcagcgggtcaccctactcccaccaacaaagacccggtgtgctggaatggacagtgtgaaaacgttccatgtctcacctcttcagtgcacagtattgcttattgctccatttctcgcggtaacactaaccgcatgcgccgatagcgctgagcaccctgtatcccaagatctaccaagcatcatcacaagcacggtcactacgacagtgtcccctgagcagaatctcgacgtcaataacgaccaaagcagtgtcaacgacaatgacaatcagaacctacacgtcacgtcagagggcgccggtgtactcttcttgcggttagacaacaacgtaccttccacagatgctgctaacacaacgattgagggaaaactgatctccggccctggcggttgtctttctgttcaaccaggtggtcgaccagaactactcatttttaacaccgacacccgatttagtgaccatccaccacaggtaaccttgggtgagaaaacaatcaaaatcggagagcgattttccttaaacgcaatcgaagtatcttctacggaccttaccggaatccctgataaatgctctaacggtgccgccgacagggcttggattgtcggtacgaag

SEQ ID NO: 2008 - DNA, 210 bp, Corynebacterium glutamicum
atggggtacctgggaattgatagagacaacgaagaacacaacatccacatttgtaccactgcagatgcactctatgaagcacaggtatcggtttacgagatccatagagttttagcaaaattttggaatttgacatgccatcaaattgaagaaatcctcgacattgtcgatgaagcgcggcgagatcgtagagcgctaggagtcgatatc

SEQ ID NO: 2009 - DNA, 534 bp, Corynebacterium glutamicum
gtgtcaatgcttagtgatatgaggatgatgccctggttggttctatccgttagcgtgtcaatgtggggcgttgcgagttgcgcttcctccgatgccccaaacagtgtttcacccttgaacgacgacgaatctgatgtgcaatggacaacgttgacacctagcccactacgtgagtcacctgatatagacccagaacgaatggcactatacgagttggcttacgggttgactcaacaagagttatatcgcgtgcgctttgaacatggagaaatacgtcaaggtatgtctcaagcgcgcagataccttgtccaggatcgaggggtttccctcagcgatgctgatggtgttttagtggatctcaatttcacatgcacccaggttaatgagtctaacgacacagatgatctatctgttttctgtagtaccgccatcgctggaaaagatccgtccgaattacggaaagagctagaagcagaattctattttttgccggacggtgcagacgatgcagacgatgcagacgatgcaatgggc

SEQ ID NO: 2010 - DNA, 1191 bp, Corynebacterium glutamicum
ttggtacacaccgaccgcgtcagcatccatagggccaagaatggtgtacgacgcacgcggaaacatattaaaaccatctgtattaagcatcccatcggcagatccgtacagataagccactcgcccaccgcgttatctgatgcggaaaacaatgctgaactcaccactgcacagattctgcacattgaccccgtcaccggtgtggccatcccacgtcaaaacattctgctgggtgaggattttcagactatggccagctcttttagtcaaatccgccatggatggggtatcacccagctcatcggacaagaccccaacagaaaccaaccaatccgctctgctgatacgtggacagtgactggatcgactggactcaccggctttaatactgctacgcataatacagatgacacagacgccactgccgcatataccatgccggcaagcgatcctgccgtaggactatgcgcactggaatccaacaaagacgcaccggtggatgaatttcgcgatctcagcctcagtgctttacgtaccgctacggtcatgtcaagctctggctccgccgtgattactatgcatgatcctatggtcatgagcaccactggcgcattggaagcacgtgcatacgttgacggcgaagtcatcaaccagcacgatcttgactcactgcgtgaccagctaggtattactacagacagcgcagataccacccctgccctacctgctgatcccttggcagcattgggcttgagcacaccaactacatcagctcttgtcccaggtcttgccgagctggactgcctcaacactgatcaagctcgcacctggcatgaccgtgacaacagcattggcactggtaaaccagctattcttgccgtgattaacgccgagctcgctgatgattacaccctgcagatcctcaaaaatagcactgcgacccccaccgactccaccgactccagcgatactgctgaacgcttcgtagcgcagctacctgcggaaacagcctttgtgcttattgatccggacatcggcgctgtgaccgatctgttctttatcaacagcataaatcaggatctccccgcaccgacaacccagatcaactcagtagcggtagatcaacgtgaccccaacatcatctacgcgacctttgccaatgatgaccgcgtgtaccagctcatgctgggt

SEQ ID NO: 2011 - DNA, 534 bp, Corynebacterium glutamicum
gtggcttatctgtacggatctgccgatgggatgcttaatacagatggttttaatatgtttccgcgtgcgtcgtacaccattcttggccctatggatgctgacgcggtcggtgtgtaccaacagctactgaacagcacgattcccatggatttggcacgtcttgtaaccacgcataattccggtgcaagttatcttcgccgcggtgctaccaacgtagtttttgaaacgaatcttgccctcggtgtgaatccgtatatgaagaaacgccgagcaacagaagcacaacgtggtaagaagcgttttaaacgagacagtcattacggcggtggcactgtgaccacaggtactgctgatttggatgtggtggcgatgcaggcgcgggcagagcaccgggaagaaaggttgggagaaaaatctacccgcaagaaagaggagcttgctgcagtagaggcgaaagagttagctgcgaagaagggtccgcagactgtggaagaaggtcttgctgcggtggagaagaaacacctggcgaagcgg

SEQ ID NO: 2012 - DNA, 588 bp, Corynebacterium glutamicum
atgacatttttgcaccgttccgccagtttccaccctcgtacccacgatcacctcagcgagctcggtcttgatccttataagctctctcaagacatccccactgttatttatgaagtccagccgcacagtgtgttcattttaaaattcaacactgccgatgttcgggtctatcaggaacactccgatctctttgtgcgacatgctgtgcttgttgatccagaacagcgtaaacatgagcatgaccagctccttaaagagattctcgacctcgatgcccctcgtgtcaacgatgatattagtggtcgcacgacagtgtttctccacgataaaacagttgttacgcacagtggtggccccattgcgattattccgcacaatcccgatgtcgccagcgccgctgcgtcagctaataaacacaaacaatctgtgatgacaacatccaggcatccttatgcgcagatgtctctcagcgacatgctgaaacaaggcttcacgctcacacctctagagttcccctactgcgctgttgatgaccccgacagctcacgccacacaatgcacgtcatcaacgttcgagatcatacagtg

SEQ ID NO: 2013 - DNA, 444 bp, Corynebacterium glutamicum
atgacttacttcgcactcgttgctcgcaattacgctgagacaggtgtctctgttgaattccatgaggtcgatgatgacgcagataactcaaatggccccaacaacacaagcaatttacctctaaaacttcttcgagatcactcttttgatgccactgttgtctatggtgacctggtgcttcacacctcagcacatctcagagatacggctatcgccaactcagacaaccgtccgcgagtagtgaccacagctcaaaaattctttgattacatccgcttagccaccagacacggtgctatccacgacatgatcaataacgcgccagataccggcactgacatcgttgttattacggccactaatgatgctcttattagtgatgaatcagaatactatgacgagctttttcatattctcgaatccgcacagggtgtgattcttaaa

SEQ ID NO: 2014 - DNA, 753 bp, Corynebacterium glutamicum
gtgagtcaatcatacagtcagatgtggtcatcggcaaaacagaaaggaatcccgatgttacgaaaaacagttaccggtggaattgttgctcttattgcgactgccactctcatgaattctgtctcttctgctgaagaggtatccggagatgtctcagcagtagatctcgcatttgcagaattcgaacgtacaactgcagaggacgtggccaatggagtgccagaggctatagctaatgcagaaaaaatttccaatttcactccgagcgaactagagggcttcaagagtcttttagctagtgatgcagtgctgaggtcggtctctggagaagaaattctcccagataatgttgaagtggttcagacggacaacgtaggcgacgaagatccaaatgtcatttctccagcagcctggcagggttctgattatattgaggggtgtttaacgaatactctctacggaattgaagtcctaaaggtttgtactggtggaacctactactccaatgtaggaatcgctacttctgtcagcaatcctcgcagttacgtaaagtataacagtgctccaggattggcagtgacgacaagcaatccacgtggaggtatagagggtggtcttgcggccttctatggtgatgttaaccttgttgcttttccaaatattccatgggtgggaccaattagttcttctgcaggaactcaccgcgttgtcgctagatcatttccgaattcagtggtgcttaacgtctactac

SEQ ID NO: 2015 - DNA, 303 bp, Corynebacterium glutamicum
atgttacaaatgatcgaaacgtatgaccactacattgtcgaaaagcaggggagtaaaccacaggtgaatgtcgctaacgaaatcaatacgtcaaacaatatcccccttccggaaatgtattcagttttccttcttgctttcgtggttttagtcatcgcaaccgccctgctcaccgcgattttagagtggcgaaactctcattctttaccgttagcaaccctatggggtctcatcagctgcgccttaccttttgcggggccacttttctggattgttataagctactttaagaatagaaaaaaa

SEQ ID NO: 2016 - DNA, 216 bp, Corynebacterium glutamicum
gtgattacttacttctcagctatagacatactttcgctacttattctcagcgtcattatgctcatctgcagtgcgccagtcttattagtcatctttcgcagcaacagtcctgacgacctcatcgcagcactcatcctgacagcgttgttgggttttctcgctgtcaattttgtactccccacactcgcagacatcggctgcacgctgtgcgagctt

SEQ ID NO: 2017 - DNA, 309 bp, Corynebacterium glutamicum
atgagcgcaaaatcccctaccccacagcctccgtacgaaataccatcattccggaaaagacgcctaatcactaccggattattaacaatcacaacattgtggttcatctacttttatgtggatctagtaagcgccactacgctacttacgctgccggtgattatcgctgcaccattgatcatggtctacatctggtaccacgaattcacatactatgctcgtgtccgcaaaaacaataagctttacaaggctctctatgggcacctccaaaaccatcaacatcctgaaaatacggatactccacccatg

SEQ ID NO: 2018 - DNA, 885 bp, Corynebacterium glutamicum
gtgactgtaatggctcaagcctctacaacaccttcaacacaaaaaacaccccggttgaaaactcttaaccggggtgttgctcatatctcaaaaaagaaaggaccaacaatcatgctttattatctcgctgctgctgtggacacaacaccccgtgacaccatgaccatgggtgaagtcttcattatgacctgcctaacatttattgtgatcataagctttttcggaatggtatacgccatagcacgcctaattgaacatttaatttaccaacaatggcgctcgttcatgacgtctgcgtgttggctcataattagctcggtcgtttccctcatcagttatggtatagctttaaacaaaagcgataacaatgaaccgatggtgtctacgacagaaccgactcccccacccactaacaccccaccagaaaataacacctcgaccgaacctatggactggtcgatcattattaatgtgcttgccgttgctactgtcgtgatactcacccttatcatcgcagctgcattatataggggtttcacacgcaacaaaataaaaaaacttgaagctatacgagaagcccagcaacacgaacgcgacaatcccactatccgcattgctgatcttcgcggcatcatggatactcaccactacatctacaccgacgtcatggttacacgtgcacatgaactcatgattactgcacccgcattctttgatgtcactctccccgaagcagtgctctacgaagatactaaacgtgctgctcatgatgcccttaacggctataaagacaccactgtcgctagtgcagagaagatcatgcttgtagatgcagtcaccgcagcatggactctctattccacaaaagcaaacaccggatccacg

SEQ ID NO: 2019 - DNA, 828 bp, Corynebacterium glutamicum
atgttggtacgttcacgcacgttggttaccgctgcactgtcatgttcactgttgttcggagcaacggtaaatggcacgggtgttgcgattgcatatgaaaatgtgtctatggctgctcagtatgaaccacggtatgaatccttagaaacgcgtctcggttctagtggagtctttcccaagtcggttgaacagtctgttgaaaaccttgctgaattaccagaggagactcgatttttacttgagggtgattcgttttcaattattattgatgatggtctgctcgcttctcgattggacccaaatacaggggagattcgacatactcttggggcttcggggatcagctacacccctggtgaaatgaaacgatcttatacagatcgagtgactgtcaaggtggtctaccctgatgggtcatttgatagagtgacaccccattcagtggtttatgtggctgacagtatttactacggcattgaaagcacgggttatcctaaagtccgcaatggtcagactgtcaagatcccattgagggtgacggatggtggtacaggagcggttggtggggtcccacagggatcgaaggtggtccgagatcgttacggctcaattgagaatgcggagttgatgggtgcaatcattctcatagatgagaagactggcgatctcaccttcacggcgcctgatgatcgaaccggtcaactgtggtttcgtacagaagtgactttcccggatggttcggactcagaggttcaatatgtgatcgaggtgacggatcagcctgaacctgtggatgtcattcgtcctgccggatcgtctctgagttct

SEQ ID NO: 2020 - DNA, 297 bp, Corynebacterium glutamicum
ttgagggtgatggacggcacaggagtgattggcggggtcccacagggatcgaaggtggtccgagatcgctatggctcaattgacaatgcggagttgatgggtgcaattgtcgttattgatgagaaaaccggtgagcttactttcacagcacgggaagatcgaactggtcaactgtggtttgctgcagaattaatttatccagatggcacatatgcgacggcctcttattccatcgaggtgacggatcagcctgaacctgtggatgatattcgccccgtaggatcgtctctgagttct

SEQ ID NO: 2021 - DNA, 381 bp, Corynebacterium glutamicum
atgatgaaggaacgacgaatcaagactttggcagccttagtaatctgcggcctgactgtttcaggatgcggcaattatttgggagacattaatgtcaaagggcgcgctggtttttcagtatctgaagcaggtgatctcattgttcgtgtacaaccatgtgggttgcctattgatacagtagacatggccggcccaatgccacaggatcaaccaccccaagcaaacccggtgtatcttcaattgagtgatcccgacggtcgtactgatcctttcatagtagatcctgaaaacttagacccgagctgggcaattatagcaggtgacggcctgccattagctttgcacattgatatttccgttggcagcatatttctgagtagc

SEQ ID NO: 2022 - DNA, 429 bp, Corynebacterium glutamicum
atgtattccgacaagctgattctcttgttcctttctgagcaggattcaagctatgaatgctgcgtaggtttattagatggctcagatggacgtgattatattgaaaagcttctgaagggtaggaagctgaagaaccattttcttgaatgggaagatattaacaaggctgatgttgctcgtgaagaaatatataaagggcaattggtgcatctggtgtttgtgacggctctttccacgcctggtgaaatttcttttgtttttccaggtcaatctcttatgagtgcaacactcgaagaagactttgctgcgcttgtgctcgaagaggagcgcacatcatttagacctgaactgtctcacctgtggtcactccccgtagggtgggtagctccggggcttgagggtttcgtggagcgtaattccgaggcagct

SEQ ID NO: 2023 - DNA, 1581 bp, Corynebacterium glutamicum
atgaaactgttttccaaggctgcaggcgtcattgctgcagcacttcttgttgcaggtggtatagcacctgtggcacaggggcaagctagtcaggtggtcacacctgaagaccaagatgcgtatgttcaacagttccaccacgaagggaataccccacctgtggtagacggggtgggtggctacactgagcaagaaatcgccgagatccacgaggctatccgacaagcccaagaatctggcgcacctaatgaagagctcattccgggtgagatgtggtcagataaggtggagctgccagtaactattgataaagcagccgctgatgaggcagagatagctattgcacagcaacaatctcagccacagacgcgaggccttgctgcggctgcggcgtgtcagacgttttggccgtcacctcatcaggtttgtggtgctattttagagcgctatattcagcagggtgcccagtttgggtggatgttgtttccgagtgaaggccaaacgttaaatcctgatggtcaggggtatcgtcagcggtttatgaatgggtttgtttattggcatccgacaactggtgcgcatgctgttaataattacagtgcgcaggtgtgggagcgtaatgggtgggagtctgggtggatgggttatcccactggtggtgaagtccctgtgaatggttccaatccgattgatggtgagttgagtgggtgggtgcaaactttccaaggtgggcgagtgtatcgcagtccggtattggacggtttccaggtggccagtattaatgggctgatcttggataaatggcttgaattgggtggtcctgatagtgaccttggttttcccattgcggatgaggctgtgacagctgacggtgtgggcagattttctgttttccagaacggagttgtctactggcatccgcaacacggagctcaccctatattaggggatatatacagcatctggagagaagaaggagctgagagtggggaattcggttaccctatcggcgatccagaaaagtatacagaaaacatggctaatcaggtattcgaaaaaggcgaacttgcagctaacctataccccaatcctcttgaggcttttattgagtttttaccctttgctaatcttgaggaagcaatagagtattttgagaacggattgtcaaattctcgtgtagaggcgaattcacttaacgccaagaaagattcgattcaatgtcaatcgcaatccgctaacattcatgtgagaacgaagagtgacggagtcgggattagggttccaaagattgggtttaaggctaggatggattgcgaccttcctggaactgtctcagatgtagtggggtatggatggatttactacgactattggggacgatgggctcaagcagcatatgcacaacaattcttcggtaataggaattctgttgtgcaaaccaatttagaggcgggttgcagcggggagaagaatacattattttggggtacttcatattttcaggtgacttatgaaggtcagccgtatttcggtcagtcagcaactaattacgcttatcttccgtgtacgatagaccgtagt

SEQ ID NO: 2024 - DNA, 2430 bp, Corynebacterium glutamicum
atgaaactttttaacaagctcaagaacaaacgggcacaagaacctgctgcatcacttactacggaggctgaagaaaccactaccactgctgtagaagcaccgctcccagcaccttcgttaggagctcgcatcattggtcgcacctccgaatcagacccgatcccacctgtacctgcgcgcaccgcgcgcacactgagtggatcatttggttttggtgaatttgatgatcgtgccaccgataccgatgcgcatgacgtggaagaaattagtgatgagctcgatgacgagacgatgactcgtcagcagaaaaaggacgctcaggcagcgctgggcaccatggaaaatcacggtcacctcatggtgattaagccgagggagcactatgttttccactcggattattttgaggtggatgatgaaatcggcactattttgtcgtttttccacaatgaggatgccaaggatgaattcggtgctttctggggcgtcaaccgcattccacgcaatctgcctgagggtgtctcagctgtgctttttgagcaagtggagcggatgaagcagtcatggattgatgacaatctgaaaaatactgaccgactagctaagacagaagaatcagacttggctgattcttccactaagtccaaccgccgcaagactgttaagcgtggacttgatcttgatgaggtgatcgccgagcttgatgatggtgcatcatatttgactgtgcacaaccgtctgctgctgcgtggaccaaaccttgagatcttggattcgactgttgagaaaattcgacgcagttttatcgagcacttatcgcgaatggatattgctgcacaccacggtgagcaacgtcaagaactgtcacagatttttggcaaaaatagcaaaaagcgaggtaaaggattccacttcacctcgactgagtttgccggttcttattctttggtcaccaatggtcttaacgatgttgctggcgaatacgtcggtgtcatgcgtggcgatgtcaacaactccgctgtgctttttgatgtggatcgctggtcgggacatgtcgtatgcgcagatagctcgattaatacatcaccactacttaagcgtccccgtgtcgttgacatgtgggggtcgaagatttctcaggcagcgctactgaataaccgtcgcgtagtgcacctggtgctcaatggtgccaagctcgatgaaatgggaccaaagctagaatccatgaccgctcatgtggatatgactagcggagatctcaacatgttcgagctgtttggtaagcaagaagatgagctgtcgctgtattccacacacatggacaaaatcgtgtttatgaccgagcaggcattgggcgataagacctctgagctggcgctattgcgcggaaagctcaaagaaattattacagccttttatgtggatatgaaaatgtgggctcttaatgccggtgaaaaccgtgacaagctgcgtcttgttggtgtgcctcatgagcagatcccgttgctctctgtcttcgtgtcctatttggatcaagaatatgagcgccagaaatatgagggaaccaaagaccctgaaatgtttcgtgccatttctgtgctgcgactgacctataaggatttgctcgatactcatggcgatctgtttaatcagcacacggcagatggcattgattctgtgaactctgcacgccgcgtgatctatgatttttctggagtgctgcgacgtggcgcaggtgtcgcgatggcacagctggttaacgtgattggttttgctgtggagacgcttggtcaaggcgatgtggtcatcattcacggtgctgatggcattgtcgatgttgatgttcaggattatttggctaatcagttcgcatatatggctgagcgtggtgggcgagtggcgtatctctacagctcgatggacgcgatgcttggcactgttggcttcaatcaattccaacgtgctgcgtacaccattttgggcccgatgaacgttgactcggtggatacttatcaatctctgattaatagtcagatcccgatggacttggcacggttggtgacaacgcagaattctggtgcgagctatttgcgccgaggatctaccaatgtggtgtttgaaaccaaccttgcgttgggcgttaatccttatatggagcagcgtcgcaagattgaagcacagcgaggtcagcgacgatccaagcgagacaagcactacggtggtggcacgacgatggtgggcacagcggatcttgatgttgtcgcaattcaggcgaaggccgagcaccgcgaagagcgctttgatgagaaatctgcgcgcaagatgaaggagcttgatgatgtagaagcgaaagaactagctttgaaaactgggccgaagaatcttgatgatgcgcttgcacaggtggagaagaagcgcctggcgaagcgg

SEQ ID NO: 2025 - DNA, 867 bp, Corynebacterium glutamicum
atggcaaaagcagagtacaaagttccaccgtctctagcacgcagtgtgctggattatgagactccgattactaccaagtcgtttagccttggtgttatccctgttaaagtcttgctgttttggtttgtagtgtttatttccactgcagctgtgattatgacaccaccggtcaagcactcaccggtgtggctgaaaatcattatcgtgctgtgggtgattggttttgctgcgtatttcggacagtggactaagaccaaggaaatgaagtttatgcagctgccggctctgttcggctatctgcagaaacaacaccgtagaatttctacacgacgtgataccgcaccatacccatttatgcagcttgtcggtattaaaagtgttgatgaagatggctatgtgcgttatttggacggcagcgtcggttatttctactctgtcgtaggcacggcctcagcactgttgttttctggtgatcgcggccaaatcgttgaccgcgtagattctttttggcaaaaggtggaaacagatacgcagtggaatttcatcacgacgaaagaatctcaagccgtatttagccaggtcgccaacgtcgagcgtaaaaatcagaacttagtgtatcgacaccctgagctcaccaaactcatggaggaatcgcttgatattttgcgttatgacgtaggtggaaaattcagctcaattcaccagtatttgacgctgcattcacccaatgacgctgcactgcatactgcgcaagagattttgctctctgaggtagaaaactcaagtgcgatgtataaacagtgccgccagctcaacggttttgaggttaatgacctgttgcgcagcatttacggacataagaaaaag

SEQ ID NO: 2026 - DNA, 2277 bp, Corynebacterium glutamicum
ttgacaattggaattttgacggagaaagcttcggctgcgaaaaactttgcgaaagccctcggtggaccctctggcacttataacggcgagaagtacgttattgctgcagccagcgggcacctttatgaatttgtcgagccagaagagatggtgccaccaagctatgccgataagatcggcggctactgggatctggctaagctgccgtgggatgagacgcagtttttgtggtcacgcgagcaaaagcacggtgcagctaacacgattgcacgcattaagaaaaccttgagcagctgcaccaccattgtgatcggatcagatattgatcccacgggcgaaggtgatctgttggcgtgggagattatcgctgagctggggttagacaccaagaagattcagcgtatggaatttgttgatgaggcgccggcctcgattcagcaggcgtttatcaaccgccgcgatgtgacctccatgcatgacgagcccaattatcttaaggcggaattccgatcacgctttgatttgctgtcgatgcagtggactcgcggtgccaccaaagtgctagagaccactggtcggcgtgcagtgttgcgcaatggtcgcctgaaatctgccatggttgcgattgtggggcagggcttagatgcgtacaacgattataaaaagattcctttttatcaaaaccgcttcattgatgatcacggtgtaagttacgtcaaccccgaggaaccgcgttataagacttgcgacgaggtaccacagctttataaggctagtgcggtcgaatgctatgagaagagcatgaaaaagaccgcgccaccacgtctacttgacctggcgagcctgtcggccctgctgtctaaagagggctttagcgcaaagaacgtgcttaagacttatcagcagatgtacgaggcgcaggtcgtgtcttatccgcgtaccgaggataagacgattacccctgagcagtttaaggaactagcgccgttggtcgataagatcgccggcctggttggtgtgaacccggctgaccttacgcaccgacagccacggtccacgcatgttaagcccaagggtgcacacggcgccaaccgtccgggtttgaatgtgccgaccagtattgcagcggtgaaaaccacctacggtgtgctcggacagcgcatttatgaagtgctcgctaagagctatctcacgatgctggcagaggattacctctatgagcaccaaaaaggccgcgtcgtggattacccagcgtttctcggtacagcaaatgtgccaaagtccttgggttggaaaggtattttcgacgtagacgctgaggctgatgatgatgctgccggcagtgatgcagcacagcaggggattggtactcgtgctgagccagaagtgtttgagggttttccgcagcgaccaccgcatccgtcaatgacgtggttgatgaaacagctcgataagcatgatgtcggtaccggtgcgacacgaacgagcacctatgccgaggtcacagccggcaagtcagcattgctcaaagaaacgcgtggcaaagtcactatgactgacgcagggcaactgaattatctgctgcttcctggcacccacattggcgacctcaaacttaccgagcgcgtttatgccgatatggcagcggttgctgctggtgaaaagactgcagagcaggcactggaaccagttaaacagtgggtcgaagaagatattgcgaccatgacccgtaacgcaaaaaacatcccccaagaactaggaaagaaactcatgactactacttttaccccttctgtcaagcactccggcacctggaacggtgagcaggtgagctttaagaaggtctactgcgggcatgaatttagcgatgcagaatgcgaggcgttgctgcgcggtgaggagctcaccattaccgatgccatgattggtggacagatcacgacagtcaccggcaagctggcgcatcaaagctttaacaaagacggcaagaccattaagttctttgggtttaaggggcaggttgatcgcattgcctctgcagacccagctgtgtacgcggtgggtgtgtggaaggttgagggtgaaaagattcgcttcaagcgcgtatggggtggtcacaagttcaccgacaaggagatcgccgatctgcttgagggccgcgagattgcttttgatgccatgtcgaaggccaagaagccgtacaccgctcggggatcgctgcagcgcggcgagtacaacggtaattcgttcgtcggcttccagctcgcaccacgcgat

SEQ ID NO: 2027 - DNA, 2085 bp, Corynebacterium glutamicum
atgataaatatgatgtcgttgggtaatccagcagcaatgctcgctgcgtacaacaccagcacgcaggtggcaccgcagccacagctgggaccacgtgctggagaagttcaactcagtagcgaacagcaagccatgattgattatgtacttgctggcaaagatgtcattgttgatgccaccgtaggctcgggcaaaactaccgctattcaacgactgtgttcgatcatgggtgcagaccatgacgtgctgtatttgacgtattcgaagttgttgaaggtcgatgcacagcagcgcgttcgtggcgccaaggtgcagaactatcacggcattgtctatccgcatctactcaaggccggcatcaagtgtggtattagcgagtcgattcgggagtttaacaagaacttcaaacacatttctcgcacgttccccagttacgacctgctggttattgatgagtaccaggacatcaatgaggactatgcagaactgctgcgcaacattaagtctgtgaatccgcttatgcagattgtcatggtgggtgatttggaacaaaaagtccggtctgacaccacgttagatccacaagaatttgcagcacaattgtgtgaagatccagtcttcgcgccgtttacacagtcgtttcgaattggcgaggctatggcagcgggtttggctgatgcctggaataaaccgattgtgggtgccaataccgcacagcagattgaatataggtctttcgctgaggcagtggtgttgatccaaagcaccgagccgagcaaactgttgtgtttgggtagccgcaatgggcagatgtcagatgcgcttaatgtcgtggagaggaagtcgccggcaaagttcaataagaaaactgtgttcgcctctattcgcgatggtgattcccagattgcacaccctaatgacgctgcggtgtttaccacctttgattccagtaaaggtctagagcgcgatacctgcgtggtctttgactatgacgaagaattctgggacatgcgtcttggttaccccaatgttgatccagtggtcatgcgcaatgtgtttttggtggcagcatcacgcggtaaaaacaaggttgtttttgtacgtagcgattctcttcaagcagcgtatgaggctggtgcggactgggctgcagggctcgctgtgggtgtggtggacaacaatactgaggttgcacctgaggtagatgcccatacgccggcagaagaaagtaagggtgatgtgggtgaggttcagtcacagattgagcgcatgatgggttttatccctgtttcagtgtttaaagaactacctgagttggcgccgagcgaatatgcgcgaccgatctctgtgactgaagcctttgattttaagtacgcagagaatgtcgaagcatgttttgacctgcttgatgtcaagcgtctcgacaacggcaagggtgcagccattgaggtcaatcgcagtgacgggcttattgatctctcacccacagtgggaaactttcaggaagcagtgttcttcaaggactacaacgttcatacagcactatcggcgtacccgagtcagttcgcgaaaaatcttaaacgtttggtgaagaaaaacaatagcgtatggcgtaactgccttattgtcacagcagcgtccacagagcagatgcggtatgtcgatcaggtgcgcagctctatcccggttgctgcggagaaggcattggtctcacggctgagtacgaggctgaatgctgattcacgtaatcagattccactgatccttgacggcgaggcagtacagagcaaagtagtgcgcacgccaatgtcttttgcaggtgtcgcagatgcggtgcacaagggtgtgctttatgaattgaaattcgtctctgagttgacacatccgatgtttttgcagctcgcaatgtatttggtcatgtctgggatgaaggacggtattttgtggaacacccggacagatgaggcgtggcaggtgcgtgttcctgacccgaagcgttttcttaatgctgtggtgttgtgtgtctccaagcaggattaccgggtcggtaactttgatctgccgagcactggtggaggtgcgcgc

SEQ ID NO: 2028 - DNA, 891 bp, Corynebacterium glutamicum
atgaacaagactgatgaagctttccttcttgaaggcgatatttttgctcccttgattgcgggtttaagtagcgataacagcgcgatccgctctgccacagttcaacatgcgtttagatccatggatcgcgctgcagcaacgggtacaacttatggagcgagtatcgttcagtcactgtgtgacattgttgttacgcatatgtttgtcgaatcagattttccacggaaatacggttggtctgagattactgtaggacggcaaatatttgagcaactggggcggaggttagggcgcgcgtctgatgaatcccccgaaaggtttgaggcacaggcggtaccatcaacacatgttttccatgctcctttggacaaaaccccgtcgtttgaagttgaggtcagtcttcggctatatgccttagaaacagattcggtgagtgtgtcggaatgctgtttttcgggtgctaattttagtgagtgttcgtggcattatgcacgattaacgaattgcgatctttcctactgcaactttattggcgctcagttgggcgataccgtaatttcgggcgatttatcgcatagtcgatttcgtgaagcggtaatgagttgtgcggagatttctgcggacatcactaatgcattctttgggaatgtcgatttgcaagcaagtcggtgtgtgttcaataaagccactggcgctagtttttatgcgtgcagtctgaaaggagcagatttacacggctcagataatgccatagatctgtccgacgcagttgtagattatgagactgtgtttcctgatgggtccacactcgagcgaaagcattacgatgactatcagaatatttcgaccaagtggggcgaagtgctatttgttgctaatcgctatcaacca

SEQ ID NO: 2029 - DNA, 432 bp, Corynebacterium glutamicum
atgggatttagcgcgttggagatgtggtcgaccgagctgggcataactgtttcggtcgcccctgagccacagaacagtgattatgaatcaggattagcacaggttgaaggtcatgagtggcatgtccggactggccggaacacgccgtcgaagccgggtgcctttgttgccttttggcagcgaggcgtgggagggcagacccagccgtttagtgacgacgggatgaatgctggtcttcttgtctttgtgaggaacgatgttcggcgcggattgtttaggttttccgctggtcatcttgcagaattggggattaccgcagcagacggacagccgggtaaacgtggatttcgtgtttacccctcctggtgcgaagggctcaattcgcaggccagggccatgcagcgagcacaatcgagtgcattcgaggagtat

SEQ ID NO: 2030 - DNA, 744 bp, Corynebacterium glutamicum
atgacagaaccccatcaactgtgcatctacactagaggctataaaacttccggatttcgctttatcgggccatcgctaagtctagattttctactcatcaacatcatgggaaagtggaatgcattttctagagtgacaaaaagggacggtagttcactaccattcccaggtaatgtatttactaatcagcgcatagccggagctgttcggcagtgtctttttcaagcgatcgttgctgaaaagtggtcacttttctcgtccaatataagatccttagtagctgatctaccggatgtgctcactgtatctgagttacaggaatggttagagttctttgtgcagcacaccggaattgatgtcaaggttgggcgtgcgctgattgttgatcctgatcaggagtgggcgcagtcggctggacgttgtgagcttgtgggatattgtgcactgagtcctggttcgcctagtcctattagctcggttttcgaaaagacagatcttgaattgtgggagtcagcattagcgacgagttggatgatgctggggccttctacagctgaacgttatgcctatcaaatgccggttgaggaattttattggagtcatgatgcagagttgcggtggtgggagagctttgtcaacggctgttttgacgatttaacaagtttgcagaagcttttgagtctgttactggccaaacactatttatcgagagattacctaatggtgcgcgttttcaaaattgat

SEQ ID NO: 2031 - DNA, 1887 bp, Corynebacterium glutamicum
ttggtacgaagactagtgggtgtttctgctgtcatgttgctggccatcggggttgcatctccggtagctcaagcacaagtggaagatcaatttgagcttgtaaaagaaatcagtgatgagcagtttgctgatgatggtgttgactatgttcccaataggaatgctccgactgttaaggaacaacttgaggatttcgaatcagcacatccagaagtagtcattgagtatcacgagcacgtcaacgatagtaaagacaatgttgaggaacttccgctacctaagcgggacatcgttgcaggggaaatgcgctcagatgtcatcgagttaccggagggggtgagcaaggacgaagctgatcaggtggaggttgcggaagcgcgacttaatgagggcgcacgattgatggctgcaactgggtgtgaggctatgtggccaacaggtttctcagtttgtggccggattcttgacgcttatcggcaggttggaggtcagttgtcatggcttgggccaccaaagtcaaacgagttgaccaatcccgacggtgttggcaaaagaagtgaatttgttgggggtgccatctattggcatccagacacaggcgcttatgcagtgaccctggacggtttgaggcagtgggggaccttgaactgggaatcagggccattggggtacccaacctctggtccgatggatacaaactatccccttactcagcgacagacttttcaaggtggtgacaactattacaacccattgactggcggtgctgtgtggggcgatattaaacagcgctacgaagaacttggcggctcgaatcatgccattggcatcccgatcactaatgagctacctagcggtactgagtatttttacaataatttctccaatggaacaatttcgtggcgaaatgatcgtcagacacggtttatgtatttggctacgcagcgggtgtgggatgcgttgggtcgggagacgggtcgtttaggttttcctgaagcagatgaaacacctgaggtttctggtctattccatgtggtgaattttgcggagcgcggggtgattgcgtggaatggaatcctaggcgccagagagctgtatggtgatgtttactccctgtggctgcaataccaaaataccgatactcctttagggtggccgataccatcattgacatcattaaatgagtcactcgaacaagaattcaccagaggtgttgttttaggctcaggtgatgcactgacatggattcctgacgatgaagaaagaagtttggaggatttcctcccaattggaagtagcggctcatcctcatcgagccaagagatgaccctgttttcccagcgtgcacaatacgtggattgcaagaatcttcccgatttagatgagcagagaaaaactgaaaacaacattgaaaagaatggtggcccgatcaaaaaagagtatagttcgcgaggtttccccaccgagttcagatttgtcgtgagaaaagggcattatgaccgttacaggaatgaaggctggggatatttaaaaaactattgcaaacacaacttcgccaaccacgctatggctgaggccgtagtagataaagcggtgattgattatggctcatcgccaggaaccagctattacaagttcgagaaaacggtgtactttctagattgcagaacttatacattcaataagaactcaggatgtaaagaaatgcacgctccgcaatgggtgactattatttacaatcctcatactttcactggagcaaattcgaacagacccaagggggtaatttcagcatggtgtaattcaaccccacctggtggaatcgaacacgagcctgaaatttcccaatgtcctgatcatgtgaatctttataataagcttcgcata

SEQ ID NO: 2032 - DNA, 291 bp, Corynebacterium glutamicum
atggcacagacgagaactgctggcgagatcatcaaagatcagcagaagcagattcataacttggcagctgaggtaaagcgtcttcgtgagcgtgacgatgcacgagatcagcagctaggagtgcttaatgaagccatgttttcactactaggagatggacttgaccgttttcgtgaatctggcgatgaggcatccttcaatgctgcattgaactatcaggcagtggtggcaccagaaatgtttaagaccgtgtatggtgtcgatccgtctaccggagagcctattcccact

SEQ ID NO: 2033 - DNA, 1230 bp, Corynebacterium glutamicum
gtggtggtgatcatgactaaggccgtgacaccaattgtggtgaccgatggtgttcgttttgatgaggtggatcttgtcgctggtaatgcacggctacacagtgtgctgtcacagctgtgggacaagctgtctttaggctcagataagttaaggaatctgcttcttggtgatagcacacatccggcttatgggcgctcatgggtgaccttaactgagagcattaacaagggtgttgctgccggtacggtgacaagagcgcaggagcagctttttcagcagatgctgggattgcgcgatatttaccagggtgtcactgatgctcagacatggttggggcagtcagcagtgtcaggtggagagagggtgcaatcagagataaaggttgtgacagaggtagcacaggcgcctgtgttgcatgaggcggttgcagaatctgcagaggtgacccagggggcgccagctgttgaagtagttgcggatctagacgccgcgaaagagcaccaactagcacaggagcccaagcgatctggcaaaaaatctgtgaaacaggcaccgcgacgacaacgtagcgctcgcacaaccaccgatgcagcagcgtgtacaccgcgtgcaggtgtggtggcctttaagtcaagcattacgttgcgtgatggcgatggtgtggatctagaggatgaactgcgtactgtgcacaggacgagtgccaggctgaccgatctactgcaggatcatgtgcacaagaagcttgcacagcagggtgtgacgtttcgaggccctattcctttcgggatcttggtgaacctcgggattgtgtcactgctggcgaatcacgaagatgtccaaggattagtgtctttaagtgacgatgaccagcttgtgctcgacattctcaatgaacaccgatctgtaggttggcaggaaagtgtcaatgacgcgcttgatgaacaggcgcagcagatggcgcagatcaacaagacactgggctttttgcacaagcgcagcgtacaaaacgaacgcgacaatttcttttttgagcatttgctcagtgcgtttttcgcagaacgcctcatgatcggtgatattgcgactggttcagcagtagaagacattgatctacacagtgaaaagcatgagaaagtgcttgctgtattgaaaaagtcatcggagcatgagtggcagcgggggaaagacgtagccgggagacagttccatgcggtgcgaaatgatgac

SEQ ID NO: 2034 - DNA, 1176 bp, Corynebacterium glutamicum
atgaacgagcaggaacgagaagccttagaggatgctgcccttgaggaagctgccttagccgatgaattagctgcattagaggctgaagctggcgtacaagggtcagtcgagccttatgactatgcagcagaccttgatgatgaggacgagtttgatgaggacccttttgctcaggatgaaccccgtgacgctggtccgctaggtgagttgagcagtgataaccatgtctctgaggctgttgctgaagacactgggacaagtacagaagagtctgcacaagagggcagtcacgaagagtcggtagacaatccccgtgatttcaccggcactgcgacagcggtgcgatcttttcgacccagacttcccgtacccaatgcactgcgaccaggaccacccatccgaacacaaccggcagtgaacaccgacatagatgatggcgggcaagagaatacagctggcgcgactgccgcagatgtgggggcgggagtgttttttggtacgcattttgagctggcttttgggcaggttgatgttcaccgccacataaggcatgagcaggctatgcgagatggacaccaggatctcagcgtctttgtcggtgctgatggggcgatcatgctggaagaacttaaaaatcgttaccagcgcccaccggagaacgagccccatgatgatgatgtcaccgaaatgataaagaccaccgaggaaacagagaaggagaacgtagagatggatcaggatatagctgtagtagacaacgttgatgaacaggttgtggtgacacctgctcatgacgctgacagcgtagcggttgttgctgaacaggtcgttgcgtcagaaccaacgccagagccggtacccaaggttgagcacgtagagatgagtgtcgatctagcgggtgagactattacaccgattgatcaggcaattcggtcttttatgcagctcaacggtattgagcacagcgtggtgttgcgacgcttggggctgatgactcaggtggcacataataaggaacttgatgaggtctacgctaaggcacttgccgagggtgaatcccatgctcagcagcagcatgaattagaagcagaaaatgaacggcttaaaaaagaagttgatgcgctcgctgcagagcttagtgctgcgttgatgggcgagggtggtggtgatcatgac

SEQ ID NO: 2035 - DNA, 357 bp, Corynebacterium glutamicum
atggattttcggagaatagggatagacatggcagacgagaaaaaggttcatgtacgtgccacactgcgctttgattcagacacccaccagcgggcaatttattgggcagatcgaaaaggtatctcgctgagcgcgtatgcagaagaggcgatcagagagaagattgatcgtgataacggtgtgcacgttattccgaattcactgttggataaccgcatgaaccaaatcattgatcagctcagctcgtttggtcgtgagttggcgaacaacacgacagttgtaactagtggtttcaacaccattatcggtatgactcgtggcgactcgtatctctctgatgatctcgatgacctgggt

SEQ ID NO: 2036 - DNA, 684 bp, Corynebacterium glutamicum
ttgattaacttatccactacccagacctctacaagaaagttccccagaatgtcactatctattagttttcataaaattgcactctctgccaccaccttgcttggcgctgtcgcaatctctgcctgtgcgctagtaactcaagcacctcctattaacgcagccccggttactggcagcagctcattaagctccaccctcgacctgggcaccaccacccctaccagcatcgacacagtaaaactcactcagcaagcacaaaatcaagcggcaccacgcgttgcagcgagcctggtgcgcgtggttgacggcgacaccattgtcgtgaactatcagggtgctcagaaaactgttcgtatgatcggtattgattcccccgaaaccaaacaccccaccaagcctgtgggcttctacggaccagaatcttcacagaatctcaccaccatgctgcgcggtgccaccatcacactagaatttgattccacccaagcccgcgaagatcaatacggacgcctgcttgcttatgtctggtacaccaagggcgatagcggtcttaagcttgccaatttggaacaaattgcctcaggctctgctgctgaatacagcttcgacacccgctacaaccaccgcaatattttcctacgtgcacaaacccttgccaaggcaagcagtctaggtatgtggggt

SEQ ID NO: 2037 - DNA, 147 bp, Corynebacterium glutamicum
gtggtgatgatgcttagtgcagtgctggaaggtctgctcagcgccagtgcgatctcgcaggtgcttggttttggggatctgcttgaccttggtggtttgatctctactgaacttggtgtcgaaggctacggcgaggcatttagcgcc

SEQ ID NO: 2038 - DNA, 564 bp, Corynebacterium glutamicum
atgtcctattcactcattatttctaaagcaccaacccactccatgccttttaatgaggctgaactcctagagcttgtcgatgaactgcactccgacaacaccgtgaaaaagccggttattgtgccactccccgatgatttctcctacaccgtagatagcgccgtgcgactacatgatttgggtgttgaccaggaactgactgactggattactgcacaagttgctgcagcctatccaaaccagatcgtctcagagattgctgctgcccctgatccgcaagccaagaccttattctccgccaatgcgtataacaccaggtcttttggtactttttggactgagcaccctattacacagctccaatacaagcgctgctaccaaattgtcatcgagaacgttacgggtgtctatcatccgttacctgttgataactaccgctacgtaccccctgtcacgccctcattgccacagccggtctaccacgaagctatcgccttaaatgagtctgatgtcgctgatcacggtactcgtgcagccaagcacgcaatgatcaaccgcaacgta

SEQ ID NO: 2039 - DNA, 1452 bp, Corynebacterium glutamicum
atgacccacactgataccccagcccctgcacacggcgtaacaccgagtgaattcgctgttacctcacacgaactcaccacctcaccaacacctagtccgacacaggtcgctattgcagcccaggaaaaaattcgccagcgcaagctcgaagagcttaaagcaaaaaagcgcacagacacgacagctcaaccacttctacctgcacctgtgctgcatacacgcccactcccctcaccgaatccaccgcgaccatctccaccggcacctaccactggacactgggaacttcttattgtcaggtcacagcagaagaaaatgaccgcagccaatccctttctcaaattccttcatctcggtaaagccttcaacgtgaaagacctagggctcacctgcgatcgcaccactgatgttgacctctcacggctaggcaagctcaatccgcccagctcacttatccttgaactagcaacggcacttgacctgcatccattcctctcagtcgcactctcttcgcacagtgcggtcaacgcccgtcgcaaccaacttgaattaaccctgcacaaccatgacactcagggcacagcattaggtcacagcgttactatggtccagctacccgaggtcattaatcgagctgctgtagagccctatatcaaacccaagggctcgggcaatgacccgcttgaccaaagcctgaaccaccgcgcacccaccgtaagtgacgtgcaaaaagcccttgtgcaggaaaacacaggcacggcaacagacagcaacaactacctgcttccttttgatcctgattctggtgcaccaaaaaccaccgcgcttaatgcgcctaataaggatctcctacaggccaggcatgagcttgcctatattcccgagatccccgccattgcatcgtggctcgatcaccttgaccccatcatgcgtgtgcaccgtagtcttgcgctttcaattttcccagtgcagcttctacgtgctgccgttgagaatctccctcataacgtaaccgatctgcataatcaccttgatcctgaggatctgctccctgaggaactcaccacctggctcgatcacctcttcgatgcagacttaaccgctctcgcttcatgcccacagcttgcaccacctatcgtgcgcagccacaatcacgccaaagcgatcgcagctatcaccgtgacctctgtcatggacgctctcatcgccaaaactcttgatgcgcatgacgatccactgccctcactaccggagtttgtagaactactgcgtgacgctgtagcccagctcgcagcgcattttaagcagcagcgcggcgaggtactaccgcagcccaatggcttgcgatacgccaccgactttggcctgctctcttatattgccgatggcttacatgaatatgcacttgccatcgacttcgggctgatctacccgaatgaactcatcaccgag

SEQ ID NO: 2040 - DNA, 459 bp, Corynebacterium glutamicum
atgtctcgtatcatcactgctcccgtccacaagccttatattattgctcgtgaagtcaagggggtctcccatgtccacgacactgttggcggcaagtggcaggccaccttgcacacacttaaaccggggccctcctggccgaaaccgtcacagttcactgcgcctaaatccacgtccatctggtttattgcggtagcaacccacccacgtaacccacgggcacgcaaaggtaccctacttggtcgcggtggtctttacgaactcaaagacactgatctgaactttctcacagagcgacaggatttgctcgccacatctacctctcgtgacccagaggattgccgtttacgctttaattcgcgtcacgatgcagcagcatttttacatgctaacgcccgccacatcaacaagctttttcatccagcactaggtcatgctcgctacgatctcatagatgtg

SEQ ID NO: 2041 - DNA, 1221 bp, Corynebacterium glutamicum
gtgtggggtagctgtaacaactaccccacaatctcagccggtcttccatacataactgcgaaattggttagagtctttttcatgatgctctaccaacacaccacacgcgggctgatcattagtgacgcgatcatcgcgaaaatcagccaagtcaaccaactgctgctactaagacccacgctgttgcaagacaaagatatgcaccatgcgacattgagtagcgacaccccatcaattcgcagtcgccgtcgctcctatcgcgagaataaagccgcctatgcgaccacgagcaccatcagaaaccgtgagacctttttcagcacatctgatattgatttcgccatactcatgattcaggacgtacaagaatctctcgtatcttttgaccccaccttggctcaagatatgaagccaagaaccaacgcagtcatttctgcactcaatgagctacgcgagccactggataccttctaccgtgcccatgaatacggtgacatcatcagcgatggtgcttatgagttcgatcatgctgccattgatgcacaacacagccttagtgaactcgttgccggtctgcataattatgacaacctcatgtttccccaggaaaccgctccgttgatgagtgaatccaatggcattcagctggctcagtactataagtccaccaaactcgatgagtcacaattgacggtggaacctaatgagcctggtatcagcattatgtggcacgcccatgatttcacctggtcttgcctagtgcgctatgacgacatgaaccgttaccctgagcatttcagcatttcttttaaagacatgctgatccctgaacagatctatactttccacttcaccccacgtgaggcaatgcaactgcgcaaggtactttttaatgccatcgctgcctacaagtctcagacatggggtgatgagaacactgatctcaccaaggctgaactcgaatttggtggcacctccatgaccttccgcgccggcctctcacagcttagcgtcaccggacctcctgatcaccgccaggtgttctgcttgtcgtcttctggtcgtgaggatcacaacaccccgccaaacatgcgagacggacatgtcattgatattgcggttactcaattgtccaccctgcgtaacctcattcgggtactgtgcaccactcacccggatcattcaccagcactgctaccttatggtcagcagtacaccatc

SEQ ID NO: 2042 - DNA, 1419 bp, Corynebacterium glutamicum
atgcgttatactccccgtacccaccgcgcactcggacttgctgcacttaccgctacagctctcctactgagctcatgctcgaccaccgctgaccttctcggcgccgattctgtggcgcaggctgtcaccgatggtggctctgcccttgatcccactgcagctcatgtgctcaccatcaccaatgccactgcaatgactcttgctgagctaccagaaaacaccgaccctgacgcagccaataacacggagccaacaatggcccaaagcgccctcaagcgtatttacggtctcgaaattgccgccgatggcactctgattgctgtcgcagcgccattaacctcgcgaaatagtggttctgagcagcctactgtcgcagcaatggctgatccagaaaacaatgctgaactcaccacagcacatattcttgagatcgacccagccacaggaactgccacaccacgtcaagatattgctctgactgaagattttcagaccatggctagctcttttagccagatccgtaatggctggggtactacccaactcatcggacaacaccctgatgatcccaagcaacctattcgttcagctgatacctggactgtcaccggctccactcagatcaccggctttaacaccaacaccccaacgggaaccgaagatgctgcctacaccatgccggcgactgagccagctgtgggactgtgcgctctagaatcaggctccgatgcaccactggatgaacaccgtgagctcagcaccagtgcattgcgtaccgcatcagtattgtcgagctctggatctgccaccctcaagctgcatgatcctatggtcatgtctgctactggcattgtccaagcacgcgcctatgtcgatggcgaagtcattaaccagcacgagattggcgatctccgcgagcagctcggtatcaacatcgaagaatctgaggctgctcaagcagaatcggatgcccaagcagccaccgatcacccacttgcagccctgggcttaagcaaccccaccagctcagcgttggttccaggtcttgctgagcttgattgtctcagtgctgaccaggctgccacctggcataaccgcgacaccagcattggcaccggtaagcccagcgtgcttgctgtcatcaacgcggaaatggccgatgactttaccctgcagctgttgagctcaggtgccaccactgccgaaacgcagcttgcccagctgccggatgaaaccgcgttcgtgctcattgacccatcatctggtgctgttactgacctgttctttatccaaagtctcaacactgatctgccggcaccaacaacccagattaattctattgctgttgatgagcgcgaccccaacatcatctacgccacttttagcggcgatgaccacctgtaccaaatgatgctgggt

SEQ ID NO: 2043 - DNA, 591 bp, Corynebacterium glutamicum
atgacttttctccaccccaaggctgcgttctaccctctcaccatggatcatcttaccgatctcggtcttgatcctgagcaactcattaatgagttgccgacgattacctacgacgttcaaccacacaatgtctttgttctacagttcagcaccgccgatgtgcgcgtctaccaggaaggtaataccctttttatccgcagtgctgaattaatcaaccctgaactacgacaacgacagcgcacacagctcaacgacgatctcaacaaccctgcttcacttcgcgtctgtgatgagatcagtggccgcagcaccgtgttcctcaaagacaaaagtgttgtcactcacgatcacggaccaattgctgtgattccgcataatcctgatgaagccagcgccaaggctgtcgctaccaaacataagcacaccttgtccggcgctacctctgatcacccttatgccggcatgacgcttaaagacatgattgaacagggctttacgctcacaccgctggaattcccgctctgtgctgtcgatgatccaacagattctgatcgcaccatgcacgtgatcaatgttcgcgagcacagtatg

SEQ ID NO: 2044 - DNA, 396 bp, Corynebacterium glutamicum
atgaccaccttcgcccttattgctagccccaacaatgttgatcccactgctgagtccccactcgccattgaaatccataccgatgaggacagcagctatccactagggcttattgactcagaccacctggttcctgctgtgatttacggcgatatggtgatctacaccaaaacactgctcgcacagaccccaccagatgatgtgtccactgctagcgccttcttcgacaaactcaccgcacttgacgctcagggtcgcacccgtgatctggtctacagcgccacctacagccaacttgttattgccggccacaaccgcactgtattaactgacgactcagagttctacgatgagttttaccaggttattgaggctgctcctggggtgatcttgaaa

SEQ ID NO: 2045 - DNA, 237 bp, Corynebacterium glutamicum
atgatcaatctttttgctgcagccctgcccgcattcgagcctttgagtattacctccatactcgtgctcggtgctgtggcattgatctgtggcctccctgtttttctcgcactggaaaaaagcgctgagctcgatgatctcttcgcagcactcatcatcgctgtacttttaggttttgctgcttatacgtttgtgctccccaagctcgttgaattgggctgtactatttgccagctc

SEQ ID NO: 2046 - DNA, 624 bp, Corynebacterium glutamicum
atgtctgctaatccttccaataacttcaacgtcatcggccgtcttgctgctgatccaaagatcttcaccaacccagatggctcccgcaacatccagatcgccgtatactccaccaacaactttgctaaccgcaatggtgtctatgaggactccatcgttccgctcacccagttctactccgcatccaaggaaggtaacggaatctactcctacctcaaggaaggtgaccaggttgcggtcaacggctacatccaccaggatcagttcactgacaagtccactggcgctaaacgctacgagttgaacctatctatcgactccatccagccgcttgaaaccaagtctgctgctgacgctcgccgtgctcgcaagcaggtcgttgaggcaaacaaggcgcaggctgctgcacagcaggcacctgcaccagttcagcagttcgctgctcaggacgcacctcagtacgcaggtaaccctttcgctggtctctctcagacccaggcaccagttgcagcccaggttgcaccacagccacagtacgtaaacgatccttacgcacagccacaggcaggttttgttccacctgcaccagttgctccacaggttgatattgacccacgcttcatc

SEQ ID NO: 2047 - DNA, 579 bp, Corynebacterium glutamicum
atgtctacaaccactatcaacatcatcatcaccaatggcgctgcaccacacccaactaatctcaatcgcgcagaaattcatgatcacctacccctcactgcctctgattcggagctaacccgcccctcccaggaatcagttctctatgaccatgaatccgaaactgtcttgcgcaccatggtcatccctgcagacctgcacgtcgctatgaagcatctagctaaaaaacacaacctcacggtcacagagatctcgcgcatccttctgcagcgctacatcgaccgcaatattaaccatgtagagcaaaaccaggctgaatccgacatggtggaagtctttgccagccaaccaaccaatgcaaccgcaatgatccctgtacctggaaccagcttcaggcaaatatttatcaagcacagcactggtttctggaaaaacattgatcatgatcttgtcgatctcgacgcctctaagaccccgcgtgtacgcgaccgcagtgtcttaccacaacctcaactccacagagcgttgttatcagatgctgatatggctcgccttgcagcacaactgaccgacaaacac

SEQ ID NO: 2048 - DNA, 462 bp, Corynebacterium glutamicum
atgactactcgcaccgtatctacttctgcaccccatgtcactgtcaacatcaataccgcgcacaacaaaacacgcactgttaccaatggcgccagaaaaactaatgcagagcgtggcaagagctgcatctcatttcgtgtagggccagaattgtttgatgaattcaaagcgacctgcatcgacaacgatatttccatgaccaaggcgtttgagaaagagcttcgcacctgggttgatgagcacaacgctggtgcaacaaagaaaagaaacacccatcgcacctacgtacaagcacccgttggtactgtcgccaccagctctattccaggtcttgggttatttactgtgttcaagaagagctctgatcagatgtggtacgacctggaaagcagcccgctgatcgcacaagagcccatgtcgaatatggacatgcatcgtaacggctcttttgagctgcacctg

SEQ ID NO: 2049 - DNA, 507 bp, Corynebacterium glutamicum
atgtctaaaaaacgcgaccacctcaccgtcattcctgaccttgagtcacgcacccatcacagccgcagtacacaaccgccaactacgctgcccgcaccacagctgactattatcaccgcaccagacaagcatcaaccacagcttcgggttgttaaaaacaccaccaccccatcttctgtgcagccctcgccgatcaactacagctttactgatcctgtacttcgcgaggctcactatgcattccagcacagcgaacttgccaggccaacagtcctggactcacactgggttcgtcgcgcacaagaagaattcgacactgagcataatgctgcctatgtccgtgccgctgaccagctcttatccccttttgatgcctacatgctcgacaacggcgatgtttacaccaagaccccacgtgccatcagtgctgctgaacaagaagaaatacttgagcacttgcacgaacaccatatctgctgggacgaagaagctgaattcctgctgcgc

SEQ ID NO: 2050 - DNA, 588 bp, Corynebacterium glutamicum
ttgaccattcttgtgcaagaaagtacacctatgccccacgacgtttacgatgtcgaacacatcatttccaagcaacctttctgctccatctttttccagctccccgctgcagcgctgaaacctactattcaaaaagctgccaccaaccgcgaccttactaagctcaacaccgaacagatcgctgagaacctacagcgctacctcgacacctacagtgtcatgtctcaccagcgtgtcaccattgaagaggtcactcatgtgcgcaaccctcatgagcctgattatgagttttcaccacagtacggtgcacatatctcgctcatcggtgagtcttatgctgtgaacacggccaccaacgagccttatgccaccgactccgagggccatcctctcgcactgtattttgaaatgagtctcgcgcccgagctacatggcgtcatccataagttcttccctggctttaatctcggtggcgagtatctgccggctgattctcgcgacatctacaccgagctcaatgacctgcttgattctgatgatctcgtcggcacagacatcacgatccagattgatcgtgccaacaaagac

SEQ ID NO: 2051 - DNA, 333 bp, Corynebacterium glutamicum
atggggtgttttgctatgccgcaacacttttctcaagaaaactacagaaaggcccccgtcattatgtctgcaccgctcaccattcatgatctgctgtccaccaattcgaagcttaacctcaagtggctgacctgcactgtcttgaacagcccaaatctcaccgaaccctgcatcacggtttctgtgaaccacaccgaaggcatgtccctggtctctttcgaaggtggtcacgggctcaccgagattgccaacacccagctagtgcctgtgcttgagctaccaaagttcaatccttttgaggcacttgctatccaccttgaagccgccaacaac

SEQ ID NO: 2052 - DNA, 558 bp, Corynebacterium glutamicum
ttgagctaccaaagttcaatccttttgaggcacttgctatccaccttgaagccgccaacaactaagaaagcatccttcatgactgacaacgctgacaacaccacagataacgtaaccaataactcagacaccaatctcgattacagcttcgacccgctccctgacgagccctatgcctacggctttgaactggtcgctgctgatgcacactctgactcaacaacaaccagcaccgataccccagagactgtcgctgtggcacttaaaacccgcgaggacactatcaactgggtcaacacccagcgtgccgaaggtaaacccgatgaaattcgtatcaataacccaattcgatcagagcgtattgctgagtttgtccacgaaatgatcatgcatcacggcctcgtagcctgcatggaagatctcgcaatacttatcaagcgcgacaagctcacccagctggaagccgaaaacgctatcacagcctggcacaacctcaccaaagaatcccttggtcagatcatggggctcttctatcagtacgtcgaaaacaacacaaaa

SEQ ID NO: 2053 - DNA, 570 bp, Corynebacterium glutamicum
atgtctgacaacactcaggacaaccctttctccatccgctacgcacaccctgaccaccagctcgctcttaatgagcttgttgatactgccgatctacctgcaccaacaagctatatgaaaaatccctggtccggggacaacacgcctatcgccgagtggcgacgcgagcgcatcacccagtggcagcgcaccgagatcattgtcaatcaacgcgatgatgacgatctcattcacgtcagcttcccgaagctcggccagcacattcagctcaacaccgacgatattctcgcattggtcgcagcctgcgtcacacccactgctaacgacattgaggcaactatcgaagaaaatctccactcatatccgcacgatacggtcatcatgtttaacgcagatgatctagatgatgcccttggtctcgttgttgccgtcaaagacgcgagcggggaacactcaccgcgcgctgtctggcgcaccaacaccgatcatggagctcttgacgagactgaactcgcgcggctcattctcaaattcggtggcagcttcgatgactacggcgtgctgcaacat

SEQ ID NO: 2054 - DNA, 912 bp, Corynebacterium glutamicum
atgaaaaaccgtaaaaaaatcatgtctaccctcaccactgtctgcgccgtactgggtatagttgcagctcatccattccacgcctctgctgtcatcggcggctctgtcccatcaactgattccgttgccaacgctgtcgcaaaaatcggaccaggcgcattgaactgcagcggtgtcatgatctcaccatcgtgggcactcaccgcacgccactgtgtcgatgacatcaacatactcggcgacatcgacaccatcacgcctattactccaggtattcatcgcaatgaaggtaactatatgggtgaggtttaccgcgcaccgtccggtgatctagcgctcattaatatcaacggcgtgcacaagggcaccattgcgcagctccccacacaagaatatccactgggaaccgctgcacagtcagtcggttttggtggcggtggtgtcaatatccgcaccgctgaatcggtcaacatgattctcaccgacatatatagcgtgaggtcagggaaattccatcacggtgtcggtcgatcacactatctcctctttgattatgacagtgctgaaactggtcgaatccacaaaggtgattctgggggccccatcttcattggtgacgaggttgtgggcattatgtctcacggcacaataaataagaacgacgggtcttttgatgacgaatccggcgctgatgtatttgcctctcttgagtggattctcgacaccaccggcatcacagtgacagacactgccgaggacaacaacgataactctgacaacgacgatgttgactcaaaagaaggtcctgcatcaaatacatcacttgtactcactgataacggaccgtcacgcattggtagcaacacttcttcagcactcatcggattatcctcagaagcactattttcttct

SEQ ID NO: 2055 - DNA, 693 bp, Corynebacterium glutamicum
atgagcaacaatgctcttttagtagcaaacgaagccgacatcggtctctacctccactggaatggtggtcgcgactcgattgaggcgtttctcgcctacgccgcatacgcgcagttaccacccatcaacgaaaataacgattggttgccaccgtttattactgtgctgaagaacttcttcggcaatgatggttctggcgtctacctcgaacctgtcaatcaggattatctcgacggcatcgactatgacaacggtgtttacatgcttgacgattatgagatcactgagcgtattaatccacccgctgttgagcaagactcccacgatctccacgacatgttgatcaaaattgataaagctcaaccacctgtcgatcaactcgggagttttctccatggcctagagacctctgtcgcagatttgggggttggtgatcgcgtatttttgccacgttttagcacctttgataagaaactcggtcgctaccgcatccacactgttctcggattcgctgagaacgatccgtttaaccctatgaccagcagcgagcgatttaaaggtaagccctatgtcgatatgttcgacaatcaagacaacgcctttaacccaaattcctatatcactacagataccgtgcgcatcgttgtcgatcctgtaccggaaactaatcccgacgatgagaaagcaggacgc

SEQ ID NO: 2056 - DNA, 366 bp, Corynebacterium glutamicum
atgtctcgcagctaccccatctacatcatttcttttgccccagcggatgatctccacggcgttggaggattcgagtgggttccagcatcaacaccagaaaacaaagctgccgccttcacgacctttgatcgtcaattcgatgattctcgtaacaatggtggctcgcatattgtgcgtctactcaatatctctgatcccaatatcacagcggatatgacccaagacgatattaccgcgtacctcgactcaaacatcgaccgctgggaatccacggaacatgcgctcaagcagtttgtcccacttaacgcgggtgctgatcgcgtacctaccggtggtgccgacgagcacattacccacgcctgccgc

SEQ ID NO: 2057 - DNA, 747 bp, Corynebacterium glutamicum
gtggatgcatcccaacaccacaacaccgcccctagtgccataaatgctaggggtgtttttttcatacccacaacaccgttcttctctagaaagagactcgatactatgcctcataaccccatcgaacttcacactaatgatgtactcgatgctctcgacattgacgccatctgcgacgatgtgtttctctacaccgacttcgagcacaccccaggtcagcttgatcgcttcgagcaactcgccttcacaaaaatctacgacatgctggaaacagctgctgaaaaattcccagatgtagcaattaatgacactttaagcactggcaaccacgctgctgaacagtactttcttgccaatcccggcaacatcatcgtgctgaccagcttcgcgctcaatcagaccgatctccgcgacctcataatctcaccgtgcattaagtacacagcacatgcacgagcactcatgcgtgcggtgacacgaacattgtgcactgcaaacaaccctgtagaacgcgcgactatcttccctgtgtctgtcgctaatgccttaagcatcgaagcgctgtgttccgaatatcatgcgttccgcaccaagcaggtgctcaacactgctgcactcatcaatcctgataacactcttatacccatgttgttgagcaaagcgtatgaggcatacgcctggcacaagggtgtcgaatccgcgcaacgaggtagcaacctagctcgtgagtactacgcaggacttatc

SEQ ID NO: 2058 - DNA, 180 bp, Corynebacterium glutamicum
gtggtgttgggatgcatccacagcgcaggtgaatccgtgtgcagctacgctgcacagttattagcggcaggcgtgggtaatgtgctcgtcggcaccaccggtaggtacgcgatcagcacccgcgttaagtgggacaaactgcttgagcgcatgttccgtggattcccagcggtcgatgtt

SEQ ID NO: 2059 - DNA, 363 bp, Corynebacterium glutamicum
atgacctcccccaccacgttaaagccctggtctattcgcggacccatcgacggtgaatacaccatgcttgaggcatatccgtttcagtatgtagcaaatactcgcccggccatcatgctctacgcactcgatgaaaacggtgtaccggaacaatatgccgacctcaccatcaaccttgccgatgtggagctcaagcaacttaaccacgtcatcattaacccagatctgcacgctgatgttaccgaactgtgcattagcgccggcctgctgcgacctggtgttctgggccagcaccaagtcggtagcaccaccgccaaggtctaccgactcactgagcgtgctgatggctggctacagctgttt

SEQ ID NO: 2060 - DNA, 273 bp, Corynebacterium glutamicum
atgcctcagtacaccatcacaatcaccgacgagcagaaagctgttctacacagcctcaccaacccccatatcgccactgctgaacacggcgctatcaccgcaatcgagattcatgacgaccacgatgttgttgtctatcacgttcaaccagacggcacactaacttacgagcgccttgttgaaggcttccattacggctggacacgttttgacagcgaaggttttgagatcgactccgacaataaccgcgttgtagacggactccgcgacgaa

SEQ ID NO: 2061 - DNA, 264 bp, Corynebacterium glutamicum
atgtctacaaccaagacacctagatccactatcaccgcccccatcgaccagctcagccccataatgcggtgggtgtttcaagcaacaaactttctcggttcgctcatcaagccactacttattgtcacagcactagtgctggtagtagcagcacttacccctgagcgcttccatgaaacgctggtactaaatatcctcgccttctctgcaggctacgcagtgctgcgcctagttcgcagcctgcgccgacttttgcagcgccac

SEQ ID NO: 2062 - DNA, 234 bp, Corynebacterium glutamicum
atggcacaataccgcgtcagttttatcgcgctcgccgagtcaaccatcgaggtcgaagcagacagtcctgaagaagcactcgacctagccaatgcagaatttgactacccggtcaccttggccggcgatccctatgagctgcacgactgggaagcacgcgctgaaattgaatggctcgataccagctcgaccccgcagcaacgccttggagaacatgtcgtcaagatcgaagat

SEQ ID NO: 2063 - DNA, 342 bp, Corynebacterium glutamicum
atggctcgataccagctcgaccccgcagcaacgccttggagaacatgtcgtcaagatcgaagattaaactcgatcattaaacacactcttaagataaggacactaattatggcaacccaccgcgttcattttgtcgcaaccgcatccgcctacatcgacgttgaggcagattcccccgaagatgctatagaaaaagcgtatgatctcgccggtgatctgcccggcctcatcgccgacaacgaatttgatctcggtgaatgggaggtacaggccgatgtccagtggcctgataactctgtacctcgcgagcaacgccttgaagagggcgttgacctgctcgat

SEQ ID NO: 2064 - DNA, 273 bp, Corynebacterium glutamicum
atgttcgtcgcatttatgatccctattgttatggcacttggtgccatggctgttattaccctctttgggcaaaacccatcccagcgccgcaagcgcgcccaacagcaatccaaagatcgctacgagggcgctattcgctccggtcaatttattgaccactgcaactgcccacgttgccgacgcaactgccgtcgccggcacaagaagctcaaaggcttcagcggataccccgatgaaattctggggaagtatcctgttaaatacctttccagt

SEQ ID NO: 2065 - DNA, 303 bp, Corynebacterium glutamicum
gtgttgttaactggaaaggtatttaacaggatacttccccagaatttcatcggggtatccgctgaagcctttgagcttcttgtgccggcgacggcagttgcgtcggcaacgtgggcagttgcagtggtcaataaattgaccggagcgaatagcgccctcgtagcgatctttggattgctgttgggcgcgcttgcggcgctgggatgggttttgcccaaagagggtaataacagccatggcaccaagtgccataacaatagggatcataaatgcgacgaacatggtgattgtttcctttgtggt

SEQ ID NO: 2066 - DNA, 1149 bp, Corynebacterium glutamicum
atgtcacgatcgaggaattggggagagatcgagaagttgcgctcggggaggtacagggcacgcttcatgcacgagggtaggcgatactctgccccgtataccttcggtaccaagggtgaggcgcaggagttcttggcctctgaacgcacggccatcatcaatggcacatggatggattttgagatgcgggagaggttcgagcaggcacagcgcgaagccgaagaacgcatgatggagaccttcttcagttatgcatcgaggtggatagaaacccggacaaatgcccaaggaaagaaactcagccaaggggtgaaagatgattactttcgttatataaaatcagatcgactaagttattgggctgattatgcgctctgtgaaatcactgtcgctgatgtccgtgagtggtatagcgatactattcaggacggtaaattgacctcaatggcgcggagttacagcatgatgaagtctgtcatggagactgcagtggaggatggcattatcccgatgaatccgtgcaaagtccgtggcgggggtaatacgaaaacaggcaaaaaggttgatgtcccaaccgatgccgagcttgaggcgatcattggtgcactgccgagtaagtacttttgtttggctattgttgctgccgctggtgcacttcgattcggtgaaatcgttgcgctgcgtaccactgatgtggatgtttattttgatcgcagcggatttgtagattgtgttcgaataaggatttctcggagcattaggcacacgagataccatggccgagttgaaggtccgcctaaaactgaagctggtgttcgtagcctctatatctatggcaaagatgcagcagaaattgccaagcatgtggacacgattgatgtgggtttgcgactatggagctcgatgagagatcctgatgaacccatgccgtatcacacctttaagcacaactgggatagggcgcgggaaagtgtccacagtaaagcgaccgttcactcgatgaggcattattcgggtacgaagtatgcacaggttggggcgacactcaaggaggtgatggcgcggctggggcactcaacacctagtgcagcactgcgttatcagcactcaggcgagcgtgatgaagagctagcaaagcgcatggcgcgc

SEQ ID NO: 2067 - DNA, 390 bp, Corynebacterium glutamicum
ttgctattcttagcacggttggtgggttttgcctttgcggatcatatgcgcacgtcattggtgcaggaggcgttgatgatggcgaagagtcagcgaggcagtctacagggtgctgtttttcattcggatcacggcagtgtgtacacctcgcaggcgtttcaggacacttgtaaaaagttgggtgttcgtcagtcgatgggtgctgttggtaccagtgcggataattcgctagcggagtcgtttaatgccgcgctcaagcgggaagtgctgcaggattccaagacgtttgctaatcagttggtgtgccgtcgggaggtatttcggtggtgtgacctagtacaacacggtgcgcagacattcttggtgtggctatgtggcgcctgcggtgtt

SEQ ID NO: 2068 - DNA, 417 bp, Corynebacterium glutamicum
ttgaaaattaaccgttcctcgtattacaaatggaaaaagactgctctgacgaggaagaaactcctgctcagcgacgcagtcctgggagcgaagatcaagtccatcttcactaaagaacgcggctgttatggtgcgaaacgtattacggccgagcttaatgacgggccaggtacaacaactccggttaaccacaagcgagtcgctcgagtgatgtcttcgatgaagcttgttggttttacgaagaaacgcaaggtcatcaccacaatcccagcagctgtcaagccggtgttcccggacttggtgaagcgtcaattcaacgctttggctgccaatgaagtttacgtcggggatattacttatctgccgattgctgatgggtcgaatatgtatttgacgacggtcattgattgctattct

SEQ ID NO: 2069 - DNA, 207 bp, Corynebacterium glutamicum
ttgccgggaaaatatttagcagccttgcgcaaaatgtcgcgttcttcacgcagtagtgcgttttccttctttagctgtctgatttgttcagcttccgacattgctgttgcttctttggtgttggttgaggcatgcgcaccgtatttattgatcgaagtttttcagggttactcggttgatgccgagatcgttggcgatctgttggag

SEQ ID NO: 2070 - DNA, 114 bp, Corynebacterium glutamicum
atgtcggaagctgaacaaatcagacagctaaagaaggaaaacgcactactgcgtgaagaacgcgacattttgcgcaaggctgctaaatattttcccggcaagaggcaagactta

SEQ ID NO: 2071 - DNA, 135 bp, Corynebacterium glutamicum
atgccaaccaagacctactccgaggagttcaaacgcgacgccgttgctttgtacgagaactccgatggggcctcactccaacagatcgccaacgatctcggcatcaaccgagtaaccctgaaaaacttcgatcaa

SEQ ID NO: 2072 - DNA, 828 bp, Corynebacterium glutamicum
gtgcctgcccttccatcatctatcatcgaccccctctggcgccagttctccgccttaatcccaccggttatcatcacccacccactagggtgccaccgtgcacgcattgctgaccggatcatcgtcgacaaactcatcgcagtgcttgtcctcggtgtctcctatatcaagatttccgattccacctgctcagccaccacgatacgcacccgccgagacgagtggatcactgccgggattttcaagaatttagaacagatctgtctggagtcctacgaccgtttcatcgggttagacctagaaaacttaaatgttgatggctgcattgttaaagctccctgcggcggagaggtagccggcagattcccggttgaccgggaaaaaggcaccaaacgctcgttaatggtcgatggacatggaatcccgatcgggtgcgtggtcgccggagccaatcggcatgatttaccgttgttagctgcaaccttggacacgctcggccggtttgggggctctcttcccgatcagatcacggtgcatctcgatgctgggtatgactcgaagaaaacccgcaggctactcagcgaatttggttatagctgggtgatcagcattaaaggtgagccgctgcaggctgggactcggtgggtggtggagcgtactaactcttggcataaccggggttttaagaaacttagtatctgcaccgaacgttgtacccgggttgtggaagcgtttatcgctttagccaacgcggtgattattctgcgtcggcttatcaaacaggcctggactagttaccgctgggacacccgaccgggccacagacct

SEQ ID NO: 2073 - DNA, 354 bp, Corynebacterium glutamicum
gtggcagagcggatcgcgctgttaacgctacttaaacccgcaatcaagggagcaaaaatatcgccttcaagaaggaaagcttcatcagtcttgttcatcccagtccatgcctttcttctggttcatgtggggaagtgctttcctcatacctgctttctaaaagccctcaagcttcaagccttaagccctaagaaagaactattctcaggagctttccgtgtactaactcgcgttgttcataccgcaggagctttcacaacaataccgtgcccaaaaacgctaaagtgtgtgaccaaaatttttggagttcctgcactaaacgctcatgtgcatgcagtgagacgtgatcgccaa

SEQ ID NO: 2074 - DNA, 891 bp, Corynebacterium glutamicum
atgaacaagactgatgaagctttccttcttgaaggcgatatttttgctcccttgattgcgggtttaagtagcgttaacagcgcgatccgctctgccacagttcaacatgcgtttagatccatggatcgcgctgcagcaacgggtacaacttatggagcgagtatcgttcagtcactgtgtgacattgttgttacgcatatgtttgtcgaatcagattttccacggaaatacggttggtctgagattactgtaggacggcaaatatttgagcaactggggcggaggttagggcgcgcgtctgatgaatcccccgaaaggtttgaggcacaggcggtaccatcaacacatgttttccatgctcctttggacaagaccccgtcgtttgaagttgaggtcagtcttcggctatatgccttaaaaacagattcggtgaatgtgtcggattgttgtttttctggtgcaaattttggtgagtgttcatggcaatatgcacgattaacgaattgcgatctttcctactgcagctttattggcgctcagttgggcgatactgtaatttcgggtgatttgtcgcatagtcggtttcgtgaagcggtgataaattttgctgatatttctgcggacatcactaatgccttctttgggaatgctgatttacaagggagtcggtgtgtgtttaagaacgcttcggacgccatcttccggggatgtaatctaaaaggggcgaatttggaggggtccgatgatgctattaatctctccgaggcggttgtagatcatgagactgtgtttccagatgggtcgcttttagagcgaaaacgttacagtgattatgagactatttcgacgaagtggggtgaggtgcagtttgttgccgatcgctattgttcg

SEQ ID NO: 2075 - DNA, 432 bp, Corynebacterium glutamicum
atgggatttagcgcgttggagatgtggtcgaccgagctgggcataactgtttcggtcgcccctgagccacagaacagtgattatgaatcaggattagcacaggttgaaggtcatgagtggcatgtccggactggccggaacacgccgtcgaagccgggtgcctttgttgccttttggcagcgaggcgtgggagggcagacccagccgtttagtgacgacgggatgaatgctggtcttcttgtctttgtgaggaacgatgttcggcgcggagtgtttaggttttccgctggtcatcttgcagaattggggattaccgcagcagacggacagccgggtaaacgtggatttcgtgtttacccctcctggtgcgaagggctcaattcgcaggccagggccatgcagcgagcacaatcgagtgcattcgaggagtat

SEQ ID NO: 2076 - DNA, 744 bp, Corynebacterium glutamicum; identical to SEQ ID NO: 2030

SEQ ID NO: 2077 - DNA, 1584 bp, Corynebacterium glutamicum
atgcgttcagatgttatcgagttaccggagggggtaagcaaggagaaagctgaccagctagaagttgcggaagcgcgacttaacgagggtgcacgactgatggcaaccaccgggtgtgaggttatgtggccaacgggcttctcagtttgtggccgaattcttgacacctatcgccaggttggaggtcagttgtcatggcttgggccaccgaagtcaaacgagttgaccaatcccgacggtgttggcaaaagaagtgaattttttggtggagccatctattggcacccagacacaggcgcttatgcagtgaccttggacggtttgcgacagtgggggaccttgaactgggaatcagggccattggggtacccaacctctggtccgatggatacaaactatccccttactcagcgacagacttttcaaggtggtgacaactactacaacccattgactggcggtgctgtgtggggcgatattaaacagcgctacgaagaacttggcggctcgaatcatgccattggcatcccgatcactaatgagctacctagcggtactgagtatttttacaataatttctccaatggaacaatttcgtggcgaaatgatcgtcagacacggtttatgtatttggctacgcagcgggtgtgggatgcgttgggtcgggagacgggtcgtttaggttttcctgaagcagatgaaacacctgaggtttctggtctattccatgtggtgaattttgcggagcgcggggtgattgcgtggaatggaatcctaggcgccagagagctgtatggtgatgtttactccctgtggctgcaataccaaaataccgatactcctttagggtggccgataccatcattgacatcattaaatgagtcactcgaacaagaattcaccagaggtgttgttttaggctcaggtgatgcactgacatggattcctgacgatgaagaaagaagtttggaggatttcctcccaattggaagtagcggctcatcctcatcgagccaagagatgaccctgttttcccagcgtgcacaatacgtggattgcaagaatcttcccgatttagatgagcagagaaaaactgaaaacaacattgaaaagaatggtggcccgatcaaaaaagagtatagttcgcgaggtttccccaccgagttcagatttgtggtgagaaaagggcattatgaccgttacaggaatgaaggctggggatatttaaaaaactattgcaaacacaacttcgccaaccacgctatggctgaggccgtagtagataaagcggtgattgattatggctcatcgccaggaaccagctattacaagttcgagaaaacggtgtactttctagattgcagaacttatacattcaataagaactcaggatgtaaagaaatgcacgctccgcaatgggtgactattatttacaatcctcatactttcactggagcaaattcgaacagacccaagggggtaatttcagcatggtgtaattcaaccccacctggtggaatcgaacacgagccggaaatttcccaatgtcctgatcatgtgaatctttataataagcttcgcata

SEQ ID NO: 2078 - DNA, 687 bp, Corynebacterium glutamicum
ttgcgctcggagaggtacagggcacgcttcatgcacgagggtaggcgatactctgccccgtacactttcggtaccaagggtgaggctaatgagttcttggcctctgaacgcacagccatcatcaatggcacatggatggattttgagatgcgggagaggtttgagcgggcacagcttgaggctgaagaacgcatgatggagaccttctttagttatgcatcgaggtggatagaaacccggacaaatgcccaaggaaagaaacttagccaaggggtgaaagatgattactttcgttatataaaatcagatcgactaagttattgggctgattatgcgctctgcgcaatcaccgtcgctgatgtccgtgagtggtatagcgacaccattcaggatgggaaattgacctcaatggcacggagttacagcatgatgaagtctgtcatggagactgcggtagaggatggcatcattccgacgaatccgtgcaaagtacgtggcgggggtaataccaaaacaggaaaaaggttgatcccccaaccgatgccgagcttgaagcgaacattggtgcactgccgagtaagtacttttgtttggctattgttgctgctgccggcgcacttcgattcggtgaaatcgttgcgctacgaaccaccgatgtcgatgtttattttgatcgcagcggatttg

SEQ ID NO: 2079 - DNA, 306 bp, Corynebacterium glutamicum
ttgctgcatcgacacctaatttctgaaactacgagtaataccgcagcggcagcagttaccgttcccatcgtggttccacttgccatagcggccggtattgatccagttatcccggctatggcggctgcattcggtgcttcatttgggttcatgcttccgatttccacaccgcagaacgccatcgtctacggttcgggctgcgtatccattgctcgaatgatccgcactggaattagctttgacatcatcgggggagcgctcatcgtatttttcctcccaactgtggcaaccatggttggaattggc

SEQ ID NO: 2080 - DNA, 432 bp, Corynebacterium glutamicum
gtgtttgaacaagctctcgggctcaccacccttgcacaaacagctggagcgggcgcagcggggggcttgggtttcatggcaatggcgttgttgtctgcagggatgcgctccggcgtggacatgattcttaatgaaaccgggggtgaaaagatgcttgcacaggcagatttagtcatcactggagaaggacgcattgatgcacagaccctcagcgggaaagctcctactggaatcgccaaacgggcacgtgcgaaaggaattccagtactggcggtttgtgggcagagcctattgggtccagcaatctcaaatgagctatttgaagacatctacagctttaccgatttcgaatctgacatcaatgaatgcattcgaaacccgctcccaattttggaaggtatcggttttaacatcgccaaacatcatctgagt

SEQ ID NO: 2081 - DNA, 345 bp, Corynebacterium glutamicum
atgtcttcattcacacgtcgtctcaatatcactgcggtaaccgttgcaatagccgctacttctctcctcgcagccacaacaccagcatcagccgcctgcctcgatgcaaatggtcagcagattggaccactccgagtacatgcttcaagtgaaaataccagccgcgtaaatgattgcgagaaagtttatctcggtaccttctgggaagggaccaacggcgagccggggaacttcggcatcttcaatttcaaatatgccaacaacaaatacttcgtcgtaggaatcaatgacatcactggtcttggtcttggatcctctgatcagaatcccctaggaaccttcgga

SEQ ID NO: 2082 - DNA, 336 bp, Corynebacterium glutamicum
atgtcttcattcacacgtcgtctccctgtcaccgcagttactgcagtacttgcctcgtccacccttctcgctgcggcaacacctgcttcagttaaatgcgtgcaccctcactcagaacacgtgggcccattgcatgtttatggatctagtgaaaactcagatcgatttgatgtgtgcgggaagattgatttcggaacccattgggaaggcactggaatccacactggccagtttgggttatttaatgttaagtatgcagacaataagtttttcgttgtcaccattgatgatgccggcctaggctcctccgaccagaaccccactggcacctttgga

SEQ ID NO: 2083 - DNA, 696 bp, Corynebacterium glutamicum
atggtcgatatcttggaactcatcggtcccctaccttctgtgtctacgccagagttaagggcaattgtcgtgactgccattaatggttccaccactattaatggcacgtctggtcagcttggaaattccacggatacggaacttctgttggcgcttcgcaggtggtcggacgtggtgttggttgggtcgagcacggtgaaggctgaaaattatggtggcgtggaggtttcgcctgaaatccagaagcaacgccaggagttgggtcaggaagcgattccgccgattgcggtgatgtcagggtcgttgaattttgatgtggatactcgctttttccttgaggccgaagtgccgccgatcatcatcacggataattccgatcaagcaaagcagcagcggcttgtggatgctggggctcaggttattgaggtggagacgttgacggcggaggttggcgtcgaaaagcttaggtctttgggttacgcccgcattgattgtgagggcggtgcaacgttgtatgggcagatgttggccgccgatcttgttgatgtgtggcatcacacgattgatccgacgttgtcgggcagcgtggagcgccccacggtgaagggcggcgatgatgcgccgcgccgattcgcgttggagcacgtctttgtcgatgatgacagcaccctattcttgcggtataagcgcgccaag

SEQ ID NO: 2084 - DNA, 1254 bp, Corynebacterium glutamicum
gtgagtttctccccggtagcaccttctatatcagcccccacgccgcgtcggagcaggtgggatagcatcggcaacgcggttgcatggccgttggccatgttgttgatggcgcatcgcttcttcgtgcttgcgattaacggcgcagtcaccgacgatttcacgacggtttatagtgctttacgacgtttcgttgaaggtattccggtctacaacgaggtctaccacttcgtcgatccgcactacctctataacccgggcgccaccctcctattggcaccattgggatatatcacccatttcacgttggctcggtggatgttcatcgcggtgaacctccttgccattgttttagcgttcgggctgctgaccagactctccggttgggcgctgcgcagcatggtgtggccgattgcgatcgccttggcgatgctgacagaaaccgtgcaaaacaccctcattttctccaacatcaacggcatcctgctgctcatgttggcgattttcctgtggtgcgtggtgcacaaaaaatcctggttgggcggactagtcattggtttggccattttgatcaaacccatgttcctgccacttctcttcctacctttggtgaaaaagcaatggggatcgctcatcctcggcattttaaccccagtgattttcaatgcagtggcctggttcttagttccgggagcatctgaatacgtcacccgcacgatgccctaccttggtgaaactcgagattttgccaacagctcactcccaggcttggccatctatttcggaatgcccacctggatggaaatcacctggttcctcatcttcggcgcaatggtcggcctcgcagtgctggcactcctgagattccgtaacaccgagccatacttctgggcagcaaccaccaccggtgtactcctgactggcgtattcttcctgtcctcactgggacagatgtactactccatgatgatcttccctatgatcttcaccctgctcggaagccgatccgtattccacaactgggttgcctgggtcgccgcctacttcttcctctcccctgacactttcacctcccagcgactacccgatgtagcccgctggatggaatttttcagcgcgaccgttggttggggactattgatagtggttacatttgtctcggcgctaatctggtttattggtgatatccgagccaagggaactccgagctcacccattaccactgatccaacgcacgaccatcttgagaggacagca

SEQ ID NO: 2085 - DNA, 408 bp, Corynebacterium glutamicum
atgacagacttcaaactcatcagcgataccgagtggcgcgaacgcctcaccccgcaggaattccatgtcctccgcgaagccggcaccgaaccacctcacgtcggtgaatacaccaacaccaccaccgaaggtgtgtactcctgtcgcgcctgtggtgaagagttattccgctccaccgagaagtttgaatcccactgcggttggccttccttcttctccccacttgctggcgacaaaatcattgagaaggaagatctttccctcggtatgcgtcgcgttgagattctgtgcgctaactgcggctctcacatgggtcacgtcttcgaaggcgaaggctacgacacccccaccgatcttcgttactgcattaactccatcagcttgaagctggaagaaaagccagtttcc

SEQ ID NO: 2086 - DNA, 426 bp, Corynebacterium glutamicum
ttggtccgccccaaatcctgccccggtgcccatgaaaagtgccctctcagaatcgcgtctaagcgcctgaacgcactgaatccatacaagaacccatcccaaaaattgggcctcttaaatagcgccagaatgagaaaaagcctcagccataaggccaaggctcgtttcgtgctcggaagcttaggaaactggcttttcttccagcttcaagctgatggagttaatgcagtaacgaagatcggtgggggtgtcgtagccttcgccttcgaagacgtgacccatgtgagagccgcagttagcgcacagaatctcaacgcgacgcataccgagggaaagatcttccttctcaatgattttgtcgccagcaagtggggagaagaaggaaggccaaccgcagtgggattcaaacttctcggtggagcggaa

SEQ ID NO: 2087 - DNA, 696 bp, Corynebacterium glutamicum
gtgagcgagctcgatattaaacagctcaacaaactgcagcgctactctcagtgggcggtgttccgtgctattcctggagcgctcgatgatgatcgcacagaagtcactgaccaagcagccaagttctttgccgaccttgaagcagaaggcaaagtcactgtccgtggcatttacaacgcctccggcctgcgcgcagacgctgactacatgatctggtggcacgcagaagaattcgaagacattcagaaggccttcgctgatttccgccgcaccaccattttgggtcaggtttctgaggtcttctggatcggaaacgctctccaccgtccatctgagttcaacaaggctcacttgccttcattcatcatgggtgaagaagcaaaggactggatcactgtttacccgttcgtgcgcagctacgactggtacatcatggagcccttgaagcgttcccgcattctccgcgagcacggacaagctgctgtggaattcccagatgttcgtgccaacactgtgccggctttcgcactgggtgactacgaatgggtgctggctttcgaggctgatgagttgcaccgcattgtcgatttgatgcacaagatgcgttacaccgaggctcgcctccacgtccgtgaggagctgccatttatttctggacagcgcgtcgacattgcagatctgattaaggttcttcct

SEQ ID NO: 2088 - DNA, 624 bp, Corynebacterium glutamicum
ttgcagattgtgatcgattccgaagcgacctctcagcacaagacctcagctaccccggcagagagcactcccgcggagttttccgaagcggttgagtctatgcacagagcgcgcctgcgcccagaacttactttgggcacgattaggccgcctcagcgcctggcgccgttttcgcacgccattggactcgaagtcggaaatcaagaagagtcagacgatgtctccaccaacagcgaaggtgattcctttggtcgtttgattctgctccacgatccgggtgccgaagaaacctgggaaggagcaatgcgccttgtcgcctatattcaagctgacatggatcacgctgttgcttccgacccgctattgccggaagtagcgtggcaatggcttaacgaaggtttggaacaagccggcgcaggatttaccaacctaggcggaaccgtaacctccacaacctcggtgcgctttggtgaaatcggtggaccgccaagtgcctaccaagtggaaatgcgtgcgtcctggaccgcgactggcaccgacctcaccgcgcatgttgaagcgttcgcagcagtgcttgcctctgttgctggacttcccccagagggcgtcaccgaactacgaagg

SEQ ID NO: 2089 - DNA, 1263 bp, Corynebacterium glutamicum
ttgctggacttcccccagagggcgtcaccgaactacgaaggtagattggacaccatggtttccgatctccttcaaccccgcgacggcattccgcctttgctatctacccctggtgagttcactgctgcggcagatctcttggctagcggaactgggcccttcgccattgatacggaacgcgcgtccggttttagatacgatgaccgcgcatttttgattcagatccggcgccgtggcagcggaactctcctattcgacccggagcagttccgtcctgaattaactcaggcgttaaagccggtgctcaatggtcaagagtggatcattcacgcagcaagcaccgatttgccgagccttgcgtggcttgatcttcaccccggattactctttgatacagaacttgctggccgcttagccggatttgatcacgttaatctcgctgccatggtggaacagatttttgatctccacttgctcaaaggccacggttcggaagattggtccaagcgtcctctgccggaatcttggctcaactacgcagcactcgatgtggagatgctgctggagcttgccgatgtcatggctgaaatcctggatcagcagggaaaactcccctgggctgaacaggaatttgtccatattgtggatcaattcgccacgatgaccgaaccttccgaaacgtcctggcaggaccttaaagggctgtccactctcaaacgaccagaccaattagttgtggcccgtgaaatgtggttggaacgcgactctttcgcagcctcccgcgacctggcgcccggtaaagtgctgtccaacaaagtcatcgtggaagtcgcccgtgttctcccccgcaccccggcagaattagcgcaggtcaagggattccccggtcgatcccagggtgccaccaaacgctggttccgcatcatcacccgggcgctcaaatcccctcgcaggaactggccaaagcctcagcagcgcaaggacggcatccccgatcgtcgcgcgtgggcgtcctactacccagaagagcacgaagtgctccaagagattagagcgcttatcgacgacctcgccgccgatatcaacgttcccggcgagaatatccttcagccttcaactctgcgagtagctgtgtggatggctaaacacaccggcgagatccataatgctgaaacactcaacgctgtacttcgcgattatggtgcccgccagtggcaaattgaccagacttttccgattctgtccgccaacttgctgaagctc

SEQ ID NO: 2090 - DNA, 1908 bp, Corynebacterium glutamicum
atgggaattctgaacagtatttcaacacctgctgacttaaaggcccttaatgatgaggatttggacgctcttgccaaagaaatccgaactttcctggtcgataaagtcgcagcaactggtggccacttaggtccaaatttgggcgtagtggaattaaccatcggtcttcatcgagttttcgattcgcctcaagacccgatcatctttgatacttctcaccagtcctatgtgcataagatcctgacgggtcgcgctaaagattttgattctttgcgtcaaaaagatggcctttctggttacacctgccgtgctgaaagtgagcacgattggactgagtcttcgcatgcttcggcggccttgtcttatgcggatggtttgtctaaagccaagcagttggatggcgataccacgcatagtgtggttgctgtcgttggtgatggcgctctaactggcggcatgtgttgggaagcactgaacaatattgctgctggtaaagaccgcaaagttgttgtcgtagtcaatgacaatggccggagttattctccaaccattggcggatttgcggaaaaccttgcgggccttcgcatgcagcctttctatgatcgcttcatggaaaagggcaagacgtccctgaaatccatggggtgggtaggggagcgtacttttgaagcgctccatgcatttaaagaaggtgtgaagagcaccgtcattcccaccgaaatgttccctgaactgggcatgaaatacgtgggtccggttgatggacataaccaaaaagctgtcgacaatgcgctgaaatacgctcatgattatgatggccccatcatcgtgcacatggtcaccgaaaagggtcgtggttacgcgcctgctgagcaggatttggacgaattgatgcactccacgggcgtcatcgatccgctcacaggagctcctaaatctgcatcaaagcccggttggacctctgtgttcagcgatgagctggtcaagattggtgcgcagaatgaaaacgttgttgccatcaccgccgcgatggcaggtcctaccggtctgtccaagttcgaagccaatttccccaaccgattctttgatgtcggcattgctgagcagcacgcggtaacttctgccgcaggcctcgcattgggtggaaaacaccctgtggtggctatttactccacgttcttgaaccgcgcttttgatcagctgctcatggatgtgggcatgctcaaccagcctgttactttggtgcttgatcgctcaggtgtcacgggttcggatggagcgagccacaatggcgtctgggatatggcgctgacctcgatcgttccaggcgtgcaggtggcggcaccacgtgatgaggattccttgcgtgagctgctcaatgaggctatttccatcgatgatggccccacagttgtgcgtttccccaagggcgacttgccaactccaattgttgctatcgacaccttggaagacggcgtggatgtcctcgcatatgaagacgccactgacgttgaatcaaccgacgatgcgccatcagttctcatcattgcggtaggcgagcgcgcaactgttgcacttgacgttgcttccaggattaaacagcacggcgtgaacgtcacggttgttgacccccgctggattgtccccatcccgcagtccttggtcgcgctgtctgatgatcatgacctcgtgatcaccatcgaagacggcgtcatccacggcggcgtgggatccttgctctctgatgcgcttaacgcctctgaggtggatacccctcgccgacaaatcgccgtgccccagaagtacctggatcacgcgtcccgcaatgaagtgctcgccgattatggcctcgacgccgacggcattgaaaccactgttgttggatggctggattccctgttcggggaa

SEQ ID NO: 2091 - DNA, 1236 bp, Corynebacterium glutamicum
atgactgacaccgtcgaactcgccaaaggcgacatcatctccgttgaggtgctcaggccggctcacggcggcgaaggcatcggacaccacgatggccgcgtcatcttcgtgaaaggtggcattcccggggatgtcgtggatgtagaaatcgcacagttgaagaagaaatgggcacgcggtgaagtggttaaggtaaccaccgcgtctgctgatcgtgtcgattcccgttgcccagcagcggcagcaggtgctggttgctgtgactatgcagaactcaacccaactgtggagcttgagatcaagtcccgcgtgcttcgtgatcagttggagcgcatcggtggaatcgatgagcttcctgaatttgagcttcaagatctggagccaacagctggttggcgtacccgcgttcgcctcggcgttgatgcgtctggtcgtgccgggttccgcaagctgaagtccaatgagttggttactgaggttgcgtgttctcaggttgtgccagagcttcttgagggccttgtgggtgagggcgctcgtcgtttcacccctggcgtggagatcattgcagctattgatgatgcgggtcagcgccacgttgtggaatcccgtaaggctcctcgtggtcgtcgtactgaaactgtgttgaaggtgctggaaggcactggcgaggtggagcagaaggtaggcgattacacctggaagttcccagtttcttccttctggcaggcgcacaccaaggcccctgcggcgtattcagagttcatcgccgaagcgttaaccggattggaactggttgacgtcgataagcgtggccctgttgcgtgggacctttatggcggcgtcggcctgttcgcgccgattatcaccagcaagctgcaggcagctgtccactctgtggagctgtccccaggttcagcggaggctggcgaagaggcgttggctggtttgcctgtcactttccacactggtcgggtagagggcatggcgtcccagctgccttcgccaaacgtggttgttttggatcctcctcgcaccggtgcaggcagtgacgtgttgaagagcatcgcggaggctaagcctcagctggttatccacattggttgtgacccggcgactttcgctcgcgacgttgccgattggaagctcaacggctacgaaatggatcaattggctgtttttaacgcgttccctggaactcaccactttgagacgattggtgtatttgtccgcgtttcc

SEQ ID NO: 2092 - DNA, 282 bp, Corynebacterium glutamicum
gtgagtgtagtcctcgtttcacttgaaaaagtttctgtcccgttacttggagcgggacagcgcaaagagtttaaccctactctgcgttgggggtatttccctgatcggggttctgatctggggttccgttacctgctgcaggttgctgtgttgcattttgctgcgctgctcgctgagccatggcctgctgaacctgctccgccagctgctttggaagtgccactggaagtgggctgccagccaggattggggcgtcgccacggttcacaaaggtacgagcaa

SEQ ID NO: 2093 - DNA, 861 bp, Corynebacterium glutamicum
atggctctgtggccttttggtaagaaaaaagaagtagtcgacgagaccccggcagcgcctgaggtatctgaggtacctgccgctcctgaggctccggtagaagcagacagcgctgaggcgtccgtgcctgaagctctgcgctccctgggcgagcagcctgtcttggatgaagatccatcagcaggtgaacccgatccagtacatgacgccatcaacggcgatatgggaccttttgatgctggttccgtcaacatccaagattttgatttctcggacttttccaaaggcgtcctagatcttggttccattcaggttccacttccacaaaactctgaagtacaagtggaaatgggcgagcaaggcccccgcatgctccacgtggtcacccaatttggtcgcatcaccccagtggctttcgcagcaccaacttccgcaggacagtggcgcgaagccaccaaggaaatcgcagaaggcatgcgtcgcgacggcctgaccgtgcatgtggaaaaaggcccatggggcagggaagtcgtcggtgaggcgaacgaccgcaagatccgcatcgcaggtgtagatggaccacgatggatgctgcgcatgaccatgatcagcccatccgatcgcgccgacgatatgcgcgatcttggtcgggaagttattgctcgtacctttgtgaaccgtggcgacgccccaatcctggctggcagcccacttccagtggcacttccaaagcagctggcggagcaggttcagcaggccatggctcagcgagcagcgcagcaaaatgcaacacagcaacctgcagcaggtaacggaaccccagatcagaaccccgatcagggaaatacccccaacgcagag

SEQ ID NO: 2094 - DNA, 447 bp, Corynebacterium glutamicum
gtgactgatttagcagctattaaaattgtccgactcgataaagaacttccactgcctaagcgcgctcaccgtggcgatgctggcgttgatcttcatgccaccacagatgctgtgattgctccgggacatcgcgaaatcgtcggcactggcattgcaattgctttgcccttgggaaccgtcggattggttcacccccgttcgggtcttgctgcacgcgaaggcctcagcattgtcaacgcgccgggaaccattgatgctgattaccgcggagagatcaaggtctgcctgatcaatcttgatccagaaaagcccatcatgattactcgtggcgaccgcatcgcgcagcttgtgatccaaaaggtggaacttgtggatttcgaagaagtcgaagaattagacgacaccgtgcgcggtgaccagggatacggttccaccggaaaaacagcc

SEQ ID NO: 2095 - DNA, 549 bp, Corynebacterium glutamicum
gtgactgattcccgacaatctgattctgcatcttctgctccctccagcaatagcgctgatggagtaaccacaatttacagggaacggcagtgggtgccttggtactggtggctagcaatggcgtttgtggtcgccctgctcaccgcccaatttggtctcaaccgaaacgaatattggatctatattccagctgtgttgttgtccattgttggcgtgtgggtgctggtctcaatgtccaatacggtgatcaccgtcgagcaagacgccgatggcaccaggtggctgatcgcaggccaagcaaacttaccgtccgatgtggtgtcacgctctctagcggtgcctgcaacggcaaagcgcaacgcgatgggtcggcagcttgacccggcagcctttgtggtttcccacggttgggtgccagaaatggtgatgttagtacttgacgatcctgaggattccacaccttactggctcatcggttgcaaggacccagaagcgctgttgcgtgcttttgttcctgaacaagccgatgctgcgctagcggatttccgc

SEQ ID NO: 2096 - DNA, 207 bp, Corynebacterium glutamicum
atgaacatcaacaaccacacctaccaagtgtcctggtctgaagatgatcaggagtttctcgctacggtggccgaatttccttcactgtcttggctgttttctgatcagcaggaagctgaggctggtctgcggaacttagtcgctgaagtactcgacgatatgaagcagacaggggagcagattccgacttcggttggaagaaacctc

SEQ ID NO: 2097 - DNA, 291 bp, Corynebacterium glutamicum
atggctaccgattacgacgcaccccgtcgacgtgtagaagacgaactagagactgactctctcgaaggtttgaaggcagtagaaaacgcgaacagcgacatggacgacgatggcgaaatcgtcgagtcttttgagatccccaacgttgatctctccggcgaagaactcaacgtagacgttgttccacgccgcgcggatgaattcacctgtgcaagctgcttccttgtacagcgcaacaaccgcaaatcacacgtcgagccagatggatccatcatctgccttgactgtgca

SEQ ID NO: 2098 - DNA, 816 bp, Corynebacterium glutamicum
ttgcgtgccatcgccgcggaaactgccacgcttaccgctgtacgtatcagggataagcgtgctgaactcaccaatttgtgggactacaccaacaccaaaagttcgacagtcgatccggtgacgatagtagatactttggctgaagattttatcgccaataggttgcaggaacttcggcctaaagacgggctgataggcgaggaagggacggggacggcgtcgataagcggagttacctggatcgtcgaccccattgacggcaccgtcaacttcctttatgacctgccccaatacgccgtctcgatcgctgcggcgatcgacggcgaggtcgtggcaggtgctgtgatcaatgtggtcaccggggtgctgtacaccgccgcgcgccacgaaggtgccaccaaatatctgcccgagcgcgatgaaatcgtgccgctcaaggcctcagcagccaccgtggtcagtgagtcgctggttgctacggggttcagctattccgctttacgacgttccctccaagccgatttattaacaaaaatcttgcctactgtgcgcgacattcgccgcatgggaagcgccgctttggacctgtgccacctcgctgatggacaagtagatatttactacgaacatggcctgaactgctgggacttcgcagctggcagccttatcgccgctgaagcgggcgcctttgtgcgggccccagggctctccattccaggctcctctggagagatttgcttcggcgctgcccccggagttttcgacgacgccaacgcccattttgatgtagtcggcgcatttaaggctttagaccgt

SEQ ID NO: 2099 - DNA, 828 bp, Corynebacterium glutamicum
ttgttccataagaccatcatcgttgtttttttagaaaattgcctgccaaaagccgaagtaatttgtacacttgggcgcatgactgagactggatttggaattgatatcggtggctccggcatcaaaggcgcccgcgttaaccttaagaccggtgagtttattgatgaacgcataaaaatcgccacccctaagccagcaaccccagaggctgtcgccgaagtagtcgcagagattatttctcaagccgaatgggagggtccggtcggaattaccctgccgtcggtcgttcgcgggcagatcgcgctatccgcagccaacattgacaagtcctggatcggcaccgatgtgcacgaactttttgaccgccacctaaatggccgagagatcaccgttctcaatgacgcagacgccgccggcatcgccgaagcaacctttggcaaccctgccgcacgcgaaggcgcagtcatcctgctgacccttggtacaggtattggatccgcattccttgtggatggccaactgttccccaacacagaactcggtcacatgatcgttgacggcgaggaagcagaacaccttgcagcagcatccgtcaaagaaaacgaagatctgtcatggaagaaatgggcgaagcacctgaacaaggtgctgagcgaatacgagaaacttttctccccatccgtcttcatcatcggtggcggaatttccagaaagcacgaaaagtggcttccattgatggagctagacactgacattgtcccagctgagctgcgcaatcgagccggaatcgtaggagctgccatggcagtaaaccaacacctcacccca

SEQ ID NO: 2100 - DNA, 1494 bp, Corynebacterium glutamicum
gtggagagcagcatggtagaaaacaacgtagcaaaaaagacggtcgctaaaaagaccgcacgcaagaccgcacgcaaagcagccccgcgcgtggcaaccccattgggagtcgcatctgagtctcccatttcggccacccctgcgcgcagcatcgatggaacctcaacccctgttgaagctgctgacaccatagagaccaccgcccctgcagcgaaggctcctgcggccaaggctcccgctaaaaaggttgccaagaagacagctcgcaaggcacctgcgaaaaagactgtcgccaagaaagccacaaccgccaaggctgcacctgcaactgccaaggacgaaaacgcacctgttgatgacgacgaggagaacctcgctcaggatgaacaggacttcgacggcgatgacttcgtagacggcatcgaagacgaagaagatgaagacggcgtcgaagccctcggtgaagaaagcgaagacgacgaagaggacggctcatccgtttgggatgaagacgaatccgcaaccctgcgtcaggcacgtaaagatgccgagctcaccgcttccgccgactctgttcgcgcttacctgaagcaaatcggtaaagttgccctgctgaacgctgaacaggaagtctccctggcaaagcgcatcgaagcaggcctttacgccacccaccgcatggaggaaatggaagaagctttcgcagccggtgacaaggacgcgaaactcaccccagccgtcaagcgtgacctccgcgccatcgctcgtgacggccgcaaggcgaaaaaccacctcctggaagccaaccttcgtctggttgtctccctggcaaagcgctacaccggccgtggcatggcattcctggacctcatccaggaaggcaacctcggtctgattcgtgccgtagagaagttcgactactccaagggctacaagttctccacctacgcaacctggtggatccgtcaggcaatcacccgcgccatggccgaccaagcacgaaccatccgtatcccagtccacatggttgaagtgatcaacaaacttggtcgcatccaacgtgaactccttcaggaactcggccgcgaaccaaccccacaggaactgtccaaagaaatggacatctccgaggaaaaggtactggaaatccagcagtacgcccgcgaaccaatctccctggaccaaaccatcggcgacgaaggcgacagccagctcggcgacttcatcgaagactccgaagccgtcgtcgcagtcgacgccgtctcattcaccctgctgcaagaccagctacaggacgtcctagagaccctctccgaacgtgaagccggcgtggttaaactccgcttcggactcaccgacggaatgccacgcactttagacgaaatcggccaagtttacggtgtcacccgtgagcgcatccgccagattgagtccaagaccatgtctaagctgcgccacccatcacgctcccaggtccttcgcgactacctggac

SEQ ID NO: 2101 - DNA, 1335 bp, Corynebacterium glutamicum
atgtctgactcagcgccaacgacacacaccaaagccgtgcgcactgcacagaaaaccagaatcctctcaccagatattgcccgaggtatcgcactgctcggcattgcgctggccaacgtttccacagcatggattgctgctcctgcgggatccacagcggcctcacttggtggcattgttcatgactccatctttgaaaagatctacgctgtcttttccgccatgttcatccatgtccgaggcctaccgatgttctccacgcttctaggatatggcgtcggaatgatcgtgtacagcctctggcgacgtcaataccccgacacagcagccaggggagtgctgcttcggcgatacggatttctcgcactcttcggcgttatccacatggtgtttctcttctggggtgacatcatgttcttctacggtgtcgcaggcatgatttttgccatgctcatgaccctcaaagacaaaacactgtggtggatcgcaggttccatgtcagcaatctatgtcatcgttggcatcacactcggagttgttctacctctgtacttcggtgtgtccactgataccatggctagccttgacctgacctttgattcctacctggaatacctaggcatgggtctgctctctgttccaattcaaatcggatcagttcctgtggaaatcctcatgctcatgccagtgatgattgttggctacatcgcagcacgccaccgagtcctctctcgggtcgatgaatttagaaaacccctatggattgcaacgtggatctttatcgcaatcgcagtcctggttggcgtcccctggggactagccgaaattggagtattttctgcacagacagccacggtctttagcggtctcaatcaagctgttggctctttgacaggaccaggcatcgttgcagcagtggcactgctcgtccagccactacaaagaaaaatcaataaaggaaatgggcacctcccacttcccatcaaaatgatcgcagccctcggtgcccgatccatgagcggttacgtcggacaatccatcctgttcctgatcctcacgcaaacctacaccttaggactcggccaaggtggaggaatacttgccgaagccggcgtagccacctgcgtatggcttctcaccctcatcggagcatacggtctcgaactagctggcaaacgaggcccattcgaatcgatgcaccgctacatcgcctacggcaaaaaaggactccaagatccctacgtacctaaacaactcccaaccccagctgcatatccacagattcctggcacaactccactagacaaagcctccgacaaatacactcaaggcaac

SEQ ID NO: 2102 - DNA, 537 bp, Corynebacterium glutamicum
atgaccactccgaattacccctatggtgaacccaacaacaatggcggaaactcgaatgatccgttcaacgccaaccagggggaaccctacggagcgccttacggggaatcgtttgggccttcttctggagcacagcagtctggatatcaagatccttacggatcgggctataccggaggctttgaaaactcacctctgaatgcaccaaagaacaccgcagcagcgtgggcactcggcttaggtattgcctccatcgtaactctggtgactgtatttggtgctttcctctctccattcctcgctctcgcaggcgtcatcgtggccattatcgcgctggtgaaagcaaagaacttcgtgccagcaaacaggcgcaagggctttgccattaccggtctgatcctgtcgattctgaccttgatcctccttgcgattggcgtcatattgatactcgttgttttcagcagttctggactttctgagtgtgcaacgctcacggatcccgcggctcaagaacaatgcattcaagagctcttcgct

SEQ ID NO: 2103 - DNA, 1710 bp, Corynebacterium glutamicum
gtgagttctaatctaagagcgtggcagcgcgcagctctggataattttctagcaaacaaaccccgtgacttcctcgccgtggcaacccccggcgcaggtaaaactacgtttgcgttgcgcgtagccacggaactaaaagcatcccgcactgttgaccgcatcatcgttgtggtccccaccgagcacctgaaagtgcagtggtcgcaggcggccgcccgagtggggttggcgctggacccagagtttaaaaactccggcagcattaatcccgcatacgacggcatctgtgtgacctatgcgcaggtgtccatgcacccgttcaagcactatcagttgaccatggcacgccgcagtttagtgatcttggatgagatccaccacggcggcgacgccaagagctggggcgacggcatcagccaggcttaccgcgatgcagagcaccgcctcgcgctgaccggtacaccgtttcgttctgatgattcacaaattccatttgtgcgctatcaggaagacgacgaaggccatctggtttccaagtccgaccacacttacggttattcggaagcgcttgccgacggcgtcgtccgcccagttgtcttcctggcctactcgggtgaagcacgctggagagacagtgcaggtgaagagtacgcagcccggttgggcgaaccgctcaatgcggaacaaacagccaaagcttggcgtaccgcactagaccccaaaggtgactggatcccagccgtgttgtcagctgcccacacccggttgatgcagctgcgccaaaacattcccgatgcaggtggtctggtgatcgcctcagacaccaagacagcgcgtgcctacgccaaaatcttgggcaccttatcatctactcccgtggccgtgattttgtccgatgaagccggagcttccgagcgcatcgatgaattctctgcctccaccgacgagtggatggtcgccgtgcgcatggtgtcagaaggcgtggacgtcccgcgtctcgcagttggtgtgtacgccacatccgcctccacaccactgttcttcgctcaggcaattggccgcttcgtgcgatcacgcatgcccggtgaaactgcatccgtgttcctgccttcggtaccagtactcctggaactcgcagaaaagctggaagtctcccgcgaccacgtccttggaaaaccacaccgccccaaagaaggatgggacgatgaactcctccaagaagccaaccgcaaggaatccgaaccggatgacatgccgaagtacgaatccttgggcgccgaagccgaactagattccctcatctatgacggttccacctacggcaccggcactttctctggctccgccgaagaagccgactacctgggactcccaggactgttggacgcagaacaaatgcgtgagcttctccgcaaacgccaagaagaacaactcgacgcccgcgacgctgccgaaaaacgccgcaaggaattggaaaaacaacagcaacgcgaagccgaaatccacgaaaaacccgtggaagaagtagccagtgatgagatcccgcgtctgcgcaaagaactcaacaccatcgtgtctatcacctctggacgcaccggccgcccacacggcgcaatccacaccgaagcacgtaaacactgcggtggcccaccaacggcactttgtagcgccgaacaactccgggcacgcattgactacctgcgaaagtgg

SEQ ID NO: 2104 - DNA, 636 bp, Corynebacterium glutamicum
gtggaagaacttcggggtgtcgtcgcttgtcgcgttatcttccctgacatcgggacgttcaatggtctttgttgttgttctcacttaacccatcatgccccagattcctccgttgtcactaaacggactaccctgttcggtatgaaccagcgaaaagaccgacccgacggaacgtccgacgagtcggagcattcgccaaagaagcgactacggaagttgtttcaccgcaacgaagtgcttctgattaccgacaagaagcgcacgcccatgcaagatatgcgccatcggcggcgtatttacaacgtgattcaggcgttgcgtatccccttgcttattttggcgggtgtgtcgtgggttatgtggcatgcgtgggttttgtcgatcatcatatttattatctcaataccccttccgtgggtggctgtggtgatcgccaatgggcatgggtctccgcgtgatccgcgtgagaaaaatgtttataagccggggctggtgcgtgagatgaatgaacgcgcgcaactggaggctcaacaggcgcagcagctagaaaatcgctcgaccgaggtagatatcaggcgcacttttgatggaatcatcatcgatgctcaggaagaaaaagacaccaatgacaatgac

SEQ ID NO: 2105 - DNA, 237 bp, Corynebacterium glutamicum
gtgagaacaacaacaaagaccattgaacgtcccgatgtcagggaagataacgcgacaagcgacgacaccccgaagttcttccactacgtgaagaaggaccaaatcgtggagtccgccgttagtggtcgcatggttgttgccctatgcggtgaaaccttcccagttaccaaacaagcaaagccaggctccccagtgtgcccggactgtgagcgaatctttaagggcatgcgtaagaag

SEQ ID NO: 2106 - DNA, 1533 bp, Corynebacterium glutamicum
atgacaatgactagaactccgctcactcaggctgcagcgacgctgaaggcacggttccgtgagatcggctacaccacttcgggcatcaataatgtgctgggcccggatttcgtggctgccatgcacgccggtcagccggccgcagtgcgctttcacctcgattccttgccggaatcagacctcaacctcgccctacgggcgttcgtgttgagggaccaggtgcgcgtcgaaaagcttgctgctttgctcggggaagcactcaagacgcttgtcgacgcctctctcgttgaaatttccggtgagtacgcccaattcttaattgatattcgtccgcatttgattgctgggcgtcagcagtgggtattttctgatgctgatgcgtccatgactcaacatgttccaggccctgatcatgtgttgggtgtcggtgcggccagcctgtcgttgttgcaagcaacgccgacctcccccactggttccgtgttggatttgggtactggttcgggtattcaggtgcttggtcaggcaggtgccgcgcaggaaatcatcgccaccgatgtgcatccgcgcgctctcgatttcgctgaagccacgcttgttgattccggcattcccacgcagttggtggagggcagctggtttgaaccggttcgcgggcgcacctttgaccgcatcatcgccaacccgccgttcgtggtgggaccaccggaaattgggcatgtgtaccgcgattccggcatggatctagacggcgcgaccgcgttggtggtcaaagaagcctgcgcgcatctcaaccctggtggcaccgctcacctgctcggcgcatgggtgcattccgcggatcaatcgtggcagcagcgcgttgcagaatggttgccggataacggttatgttgcttgggttattgagcgcgacgccgtgagccccgcgcagtatgtgggcacgtggcttagtgatgagtccctcgatctgcgtagccccgaggcagcagcacgcaccaccgcgtggcttaaccactttgaaaaagccaaggttcaaggcgttggttttggtttcatcgccatccaacgtctggaggaagacgaggcggatgagaaatccgatatcttggctgaatccatgacccagtacttcgaggatcctctcggccctgaaattgaggagtacttcacccgcaccgcatggcttcgtgaacaaactcgcgattccattctgagctcccgcttcaaagttcgccctggcgtggcccgggaacaaatcagcctggccgatgcggaagaaggcatgggctttagtcctgtcacgttgaggctcacccgcaccgatggtcctcgttggtcccatgatgttgatgagcatgtggcttccatcgtcgcaggacttaacccacatggactcccctttgaagaaatcctggaaatgtacgcgatggctcaaggtatcgagggagaatccctgcacaacggcgccattgcggcgttggtggatctcatccgccacggattggtgttgcccgctgatcttctcgattct

SEQ ID NO: 2107 - DNA, 432 bp, Corynebacterium glutamicum
gtgaaagccgttttaacccgtgtgagttccgccagcgtcagcgtggatgatgaaattgttggagccatcgattgccccgacaccggaggcattttggcgctggttggagtcggcgctgctgatagcgacgacgcctgggaaaccatggtgcgaaaaattgctgagctgcgcatcttggatggcgaacaatccgtcagtgatgtcaatgctcccgtactgcttgttagccaattcaccctgcatggtcgcaccgcaaaaggccggcgcccatcgtggtctgatgcagcacctggtgaggtggctgagccggtgattgaaaagattgcacaaggtttacgtgagcgcggaatcaccgtggaacaaggacgattcggcgcaatgatgaaggtcacatcggttaacgaaggccccttcaccgttttggtcgagtgc

SEQ ID NO: 2108 - DNA, 684 bp, Corynebacterium glutamicum
gtgaaggatctggtcgataccaccgaaatgtatctgcgcactatttacgagctggaagaagagggcattgttcctctgcgtgctcgtatcgcagaacgccttgagcagtccggcccaactgtcagccagactgtcgcccgtatggaacgcgacggtcttgtgcacgtcagccccgaccgcagcctcgaaatgactccagagggacgttccctcgccatcgccgtgatgcgtaagcaccgcctagcagaacgcctccttaccgacatcatcggcttggacatccacaaagtccacgacgaagcatgccgctgggagcacgtgatgagtgatgaggttgaacgtcgcctcgttgaagttcttgacgatgtgcatcgctcccctttcggtaacccaattcctggcctcggcgaaatcggtttggatcaagcagatgagcctgattccggcgttcgtgccatcgatctgcctctcggtgagaacctgaaggctcgcatcgtacagctcaacgagatcctgcaggtagatcttgagcagttccaggcactcaccgacgcgggtgttgaaatcggtaccgaagtagacatcatcaatgagcagggccgggtcgtgatcacccacaacggctccagcgtagaactgattgacgatcttgcacatgcagtccgcgtagaaaaggttgagggc

SEQ ID NO: 2109 - DNA, 234 bp, Corynebacterium glutamicum
atgtccaagccgatgatgtcggtaaggaggcgttctgctaggcggtgcttacgcatcacggcgatggcgagggaacgtccctctggagtcatttcgaggctgcggtcggggctgacgtgcacaagaccgtcgcgttccatacgggcgacagtctggctgacagttgggccggactgctcaaggcgttctgcgatacgagcacgcagaggaacaatgccctcttcttccagctcg

SEQ ID NO: 2110 - DNA, 987 bp, Corynebacterium glutamicum
atgaagcttctggttaccggtggcgctggctatgttggcagcgttgctgccgctgttcttctagaacatgggcacgatgtcacaatcattgacaatttcagtaccggcaaccgtgaagcagtccctgctgacgctcgcctgatagaaggtgacgtcaacgatgtcgttgaggaagtcctttctgaaggcggattcgagggtgtcgtccacttcgctgctcgctcattggtaggcgaatcagtggaaaagcccaatgaatactggcacgacaatgtggtcacggcgctcaccttgctcgatgcaatgcgtgcccatggggtgaacaaccttgtgttctcctccactgctgctacctacggtgaaccagacgttgttcccatcaccgaggacatgcccacccagcccaccaatgcttatggcgcaacgaagctgtccatcgactacgcaattacgtcctacgctgctgcctttggtctggctgcaaccagcttgcgctacttcaacgttgctggcgcatacggaaacatcggtgaaaatcgtgaagttgaaactcacctcattccactagtgctgcaggtagcaaccggtcaccgcgagaaaaccttcatgttcggcgatgactggccaactcccgatggaaccgcggtccgcgattacatccacattcttgatcttgccaaagcacacgtgttggctttggaatccaacgaagccggtaagcaccgcattttcaaccttggttccggagatggctacagcgtgaaacaggttgtggagatgtgccgtgaagtaaccggacatcccatcccggcagaggtcgcacccaggcgtgcaggagatccagcaacactaattgcatcttctgagaaggcaaagcaagaactgggttggacccctgagcacactgatctgcgcaccatcgttgaggacgcttgggcgtttacatccgcactgggcgatcgttcccatgctgcaaagaagaaagct

SEQ ID NO: 2111 - DNA, 1323 bp, Corynebacterium glutamicum
gtgaatttcgccaagtctaaactccaaacctggttttcgtccaccaatttcatgaaacgggaactcgatctacgtgcgggtttggtggaaatcgaaaaggtgcctgtggataacttcagttatccacagttttcgcgctcgccgcaggaagcaggggagacatctccacaaagtccggacatactgtgcagcatgaccgctaaagcacaccgaaacgaaccaacaaccgtccttcaaacccccggccaattgctggccaatattcctggaatcctcggtttctacccttctgaatccatcgtgttggcctgcatgatgcaggaagatgatgccacaactttaacgctgggtcctgtgatccgacttgatgtgggagacaccagattgttgcccgatgtgggtcaagcagtagattctttcaatccaactcggattttcgctttccttattaccaaagagcttccgcccaatgcactcgatgacaccctcgagcagcttttagccaccgctgagcaggggatcgtcaacatcactggttgctggtacaccaaggaagtgatcagcagtgagccatacatgctgtgcttcggtccggagccagaggcactagcagcagatgatcacggaatctctgaatgggaatttgggcggattgcaccgattagttctgccgctgcaacaaagaggatgcttcaggaagggcaattgccggagcttaatcgacatgaagcgtacgccctgtttgagcaaaataatccgcatgtgtcggcgtcgaaacgcaaaaagcttgaaaaagacgcccgcacgctggccgaggacattcagcaccagattaatgccgatgattcgggctattactacctcacttcgcttgatgtacttacccgtgcgctcgaattcgtcaaagccaactacattgattcatcatctggcgccgaaaattttgatggccttttgggggaggtggatattttacagacggtagccacctatatggcagggagttttctccgcgacgccgtccttcacctgtgcgtcgacttccctcgggaagccacgctgctcctgcgcgctgcggcatgtaccttcacaggcgagttccgatctaatgctctgtgcctttacgcattgtcggtcatcgccatggggctgagcatgaaggcctcaccggcgctggaagcagccatcgaagccacgccgcggcacaacttgagcaatctgctgcgcgaagggttgttcaacggcgaaacaacaaagcttatcgacgcctgcctccgcggcaaccagcaattgcgggactttcacgtccccgatccgaaagct

SEQ ID NO: 2112 - DNA, 957 bp, Corynebacterium glutamicum
atgtcggataacaatgatcgtatgtacgagcttgagtacccgtcaccggaggtgagtggacaaacggccggtggcccgacgctcatcgttgccctccaaggctatgccgatgccggacacgccgtggagtccagctcatcacacttaatggacgctctagaccaccgcttgatcgcatcgtttaacaatgatgaacttattgattaccgttcccgccgccccgtggttgtcattgaacacaatgaagtgaccagcatggatgagctcaacctgggtttgcatgtggtgcgcgacaatgacaataagccgttcctcatgctttctggccctgaaccagacttaagatggggtgactttagcaatgctgttgtcgatctggtggagaaattcggtgtggaaaacaccatttgtctctacgcagctcccatgacggttcctcacactcgccccaccgtggtgaccgcacacggtaattcaactgaccgcttgaaagaccaggtgtcgttggatacgcggatgactgtgcctggttcagcctcgctgatgttagagaagctgctaaaggataagggtaagaatgtctccggttacacggtgcatgtcccccattatgtttctgcttctccttatcctgcggctaccttgaagttgctgcagtccattgcggattcagccgacctcaaccttcctctgttggctttggaacgcgacgcagaaaaggtgcaccgccagttgatggagcaaaccgaggagtcttcagagattcagcgtgtggttggcgcattagaacagcaatatgacagtgaactggagcgttaccgcaacaggcaccctcaggcagtgatgcctggtgaatctgagcttccaagcggtgatgagattggtgcggagtttgaaaaattcctcgctgatctagatgatcaaggcggatcggatcacaaagaaactccggaagct

SEQ ID NO: 2113 - DNA, 2550 bp, Corynebacterium glutamicum
gtgtggttgattgtgaacctttctgagatgcttcctgatctttccgatgtccccgagagcttgatggatgagtccatttttgacagctttttaagttggacccgtgagcggggaatttcgctgtacccggctcaggaagaagcagctttaggaatcttggccggggacaatgtcatcctggcaacgcctactggctcgggtaagtccatggtggctatcgccgcccactttattgccatggccagaggccagcgcagtttttacaccgcccccatcaaggcgttggtgagcgagaagttctttgcgctgtgtgagatctttggtgcggaaaacgtcggcatgatgactggtgatgcaacagtcaacggcaaggcgccgattatttgtgcaacggcggagattgtcgccaatattgccttgcgtgatggctctggcgctgcgattgatcaagtagtgatggatgaattccactactactcagagccagaccgcggttgggcatggcaggtaccactgctggaactatcacgcgcgcaattcctgctgatgtcagccaccttgggtgataccgaatggttggaaaaggacctgcagcaacgcactggccgcacagcaaactttgttggaggcaccgagcgtcctgttcccttggagttttcctatgtgtacaccccagtgcacgaaaccatcgaggagctgctgaaagattccaaggcacccatctatgttgtgcacttcacccagcgtgatgcgattgaacgagcccaagcattaacgtccctcacggtggtgaacaaggaagaaaaagagcgcatcgctgaagagatcggcgatttccgcttcagcaccacctttggaaaaacgctatccaagctcctgcgccgaggcatcggagtccaccacgctggcatgcttcccaagtaccgtcgtttggtggaaaagctctcccaaacgggtctgctgaaggttatttgcggtactgacaccttgggtgtgggcatcaacgtgcctattcgcaccgtgctcatgaccggcttggtcaagtttgatgggtcgcgggaacgtgtattgaagtcccgtgaattccaccagatcgctggccgtgcgggacgcgctggctatgacacgatcggcaccgtagttatccaagccccggagcatgagattgagaaccaccgcctgcgtgaaaaggctggacaagaccccaagaagctcaagaagctacgtcttaaagccactcgccccggtgaggtgacgtggaccaagaagacctatgaacgcctcaccactgcagaaccagagcaactgaccagctacttcaaggtcagtaactccatgctgctcaatgttattgcccgacctggcgatggctaccagcacatgaagcacttgttgcggaccaaccatgacacccgcaccaagcagaacaaggacatcctcactgctgttgagctattcaagggcttgatcaatgcgggcatcgtggaaaaagtcccagatggacccgacgctacgggtcgcatctatgccctcacggaagaacttcagcgagatttcgcgctcaaccagccccttgcgcctttcgctttggctgcactgactctgctggacaaagaatctgaaacctacaccctcgacgtgatcagtgtgtttgaagcaatcctggaagatccccgacagatcctccttgcgcagcaaaaagcacagcgcggtgaagagattgaagctcttaaagccgaaggcgttgattacaacgaacgcatggccatcattgaggatgtcacctggccaaagccactggaagaggaactggaaagcgccttcgagaccttccgtgaaggacacccgtgggcaaaggaatttgagctcaaacccaaatccgttgtgcgcgacatgatcgaacacggcatgaccttctctgatttggtggctacctacggtgtggccaggtcagagggtgttgcgctgcgctacctcaccgatgcctggcgtactctccaacactcactgcctacggaagctcgcaccgaggaacttgatgatgttgtggtgtggttgggcgaactgatcaaacaggtcgactcctccctggtggatgagtgggctcagatggcggatccagaagcaccgatcagcaaggaagcgctggaacgagagctcgccttcggcgtggaagacccaacagcacttaccgccaaccgcagggcatttaccatcatggtgcgcaacgccatgttccgccttgtggagctatttgcttatgaaaaggaagatcagcttagtcagatgactgaatacctggatgaggctcctgatttcggtgctgcgatggatgcgtactttgatgaatatgcggatcttgataccggcccggcagctcgtggaccagagttcttcaaggtagagcacacgggaagaatgtgggaggtgcgtcaggtggtgaaggatccagaaggtgataattccttcgcgtttgttgccaccattgatcttgatgcctctgatgatgcaggtgaggtgcgttttggatcgctgtcgattgaccacaac

SEQ ID NO: 2114 - DNA, 981 bp, Corynebacterium glutamicum
atgagcaataaagagtaccggcccacactcgcccagcttcgcacctttgtcaccatcgcagaatgcaagcactttggtactgctgccaccaagctgtccatttcgcagccatccctctcccaggcacttgtcgcattagaaacaggcctgggagttcagctgattgaacgctccacccgcaaggtcattgtcaccccagcgggcgagaagttgctgccattcgccaaatccacccttgacgcggcggagtctttcctctcccacgccaagggcgccaacggttcgctcactggaccgttgaccgtaggcatcatccccacggcggctccttacattttgccgtcaatgctgtccatcgtggatgaagaatatccagatctggaacctcacatcgtcgaggaccaaaccaagcatcttctcgcgttgctgcgcgacggcgccatcgacgtcgccatgatggccctgccttctgaggcaccaggcatgaaggaaatccccctctacgacgaagactttatcgtcgttacagctagcgatcaccccttcgccggccgccaagacttagaactatccgccttagaagacctcgatctgctgcttctcgacgacggacactgcctccacgaccaaattgtggacctgtgccgccgcggagacatcaaccccattagctccactactgctgtcacccgcgcatccagccttaccaccgtcatgcagctcgtcgtcgccggccttggatccaccttggtcccaatcagcgcaatcccatgggaatgcacccgaccaggactggcaacagccaacttcaactctgatgtcaccgcaaaccgccgcattggattggtgtaccgttcctcttcttctcgcgccgaagagttcgaacagtttgcactcattttgcagcgcgctttccaagaagccgtcgcgcttgctgcctcaactggcatcaccttgaagcaaaatgtcgcggtagcgcag

SEQ ID NO: 2115 - DNA, 1089 bp, Corynebacterium glutamicum
atgagccgcgacgaccagacgaacaacaacggtgagggcgacgacacatcgcgcgagcagtcctgggatcaatcctggcagaacctaaataaggattcccagtacggtccgacctcgcatccggaggacgcgccgggaggattccagggaaacggccagggtaacagccggggcaacgctcagggcaatggtcagggcaatggtcagggctttggcccgggtaatgcttcgggatatggaggctacggtcagccatacccgcagactccgtaccagaattcctaccaaggttatggcgctacttcaccgcagaacgacgtggcgctggaagcgagcaacggcaaagtcgacatcatgcgggcgattcgcttcggattcaaagccacgtttgccaatccagcagtgtggattttgggcaccgtcggtcttggccttgcgttcatgattgtgagtgggttgcttggctacttatcatttttgatcgaccctaatgcgggcacgacgacttctggtttttcggtttccgagaccctgttgaacgtagctatcggaatcatcaccttcgcaataaccatttgcgtcatgcgcggtgcactgctttctgttgatggacacaaagttcgcttcggtgatttctttaaacccatcaatgttggtcaaacagtgattctgatggtggggctgggtatcttcggcatcatcctgggcaccttcaccacttttctcactcaaaatctggtgtcgtttaatgacgctgccggtaccgttgaggtcaataacagcggtttaggcatgttcttcatcgtctacctggtgttgttcttcatcaatcctctgtactcctactgggtgtactacacagctgatggtcaccacactgcaggaagcgctgttcaaactggtttcaaggactcgctgcgcaactacccaatgttgttgctgttctccctggttggcgggtttgccacactcatcatcggtattttcacgatcggtttcggcctgatcatcgtgctgccagtaatgatgctgtctaccgttcatatttaccgccagatcagtggtggaaatattccggtggagcgccgc

SEQ ID NO: 2116 - DNA, 3906 bp, Corynebacterium glutamicum
atgactacttctgaaactgccccatcaaaggcttccctgtatgaacttttagagggcgtatccctctccgacgagcgcacgtttaggcgccgactgtccaaagcccgcgcgcccaaggcgcttggtgcgattaaggctgatatcgataaggcacgcttgcttatcgacgaaaagagccagttaattccgtctatcacctacccagaaaaccttccggtgagttcccggcgcgatgatatcgccgaggctatccgtgataatcaggtggttattatcgccggtgagactggttcgggtaagacgactcagattcctaagatttgtttggacctaggccgtggccggcgtgggctcattggccacacacagccacgtcgattagcagctaggaccgtcgccgagcgcatcgccgatgaattggggcaagacatcggcgaatcggtgggttatgcgattcgttttgatgatcgagtttcctcgcatacatccgtgaagttgatgacggatggtattttgcttgctgaaatgcagcgggatcgtttcctcaatgcgtatgacaccatcatcatcgatgaggcgcatgaacgttccctcaacattgacttcattctgggttatttgcgccagttgttgcctaagcgccctgatcttaaagtcattattacctccgcaacgattgaccctgagcgtttcgcggagcactttgctgatgcttctggaaaaccagcaccaattatcgaggtctccggccgcaccttcccggtagagatccgttatcgcccacttgaggtattagacggcgataaaattatcgataccgatccccttgacggcttgtgttctgctttggaagagctcatggctgaaggcgacggcgatatcctctgcttctttgccggtgagcgtgatatccgcgatgccatggaggcaatcgaggcccgacgctggaaaggtgtggaagtcactcccctgtttggccgcctgtccaaccaggagcagcaccgtgtatttagcccgcactctggtcgacgcattgtgctttccaccaatatcgcagagacatccctgacggttccgggcattcactacgtggttgataccggtacggcgcgtatctctcgttattcagtgcgcaccaaggtgcagcgccttccgattgagaacatttcccaggccagcgcaaaccagcgttctggtcgttgtggtcgtgtcgcagacggtattgcgattcgtttgtattccgaagatgatttcaactctcgcccagagttcaccgatccggaaattctgcgcaccaacttggcgagcgttattttgcgcatggcgtcgctgcgtcttggcgatattaatgatttccccttcgtccaagccccagagcaacgctccatcagggatggtattttgctgctccacgagttgggcgcactcaccgacgacacccaagccgatggttcaccgcagctcacccagatcggtaaagacttagccaacatcccagtcgatccccgcatggcccgcatgctcgtagaagccaacactctaggctgcctgcattctgtcatggtcattgtgtccgctctgacgattcaagatgttcgcgaacgccccctggaattccaagcccaagctgatcaagcccacgctaggttcaaggacaccacctcagatttcttaggctttttgaaactgtgggagtacatcgccgatcagcgcaatcaaagcagcggcaattccttccgcaagcagatgaaaaaagaattcctccactacatgcgtatccgcgagtggtgggatttggtgcgccaattagagcagattggccagcaacttggttgggcaaagaaggagcaggttgcaggcaccgccagccctgacatcattcaccaatccttgctcaccggtctgctctcgcaaatcggttcccgtgatggtgagagcaaagaattcactggagccagaggtaccaaattcttggtctttcctggttctgcgctaaccaagaagccgccacagttcatcatggctggccaattggtagaaacctcacgtttgtgggctcgcgatgtagccaagattgaaccagagtgggtggaaaaagcagccggcccattgctcaagcaccaatactctgaaccgtattggtcctcaaagcgtggcgctgccatggtgcaccgcaaatcaacgctctacggtgtgacaattgttgccgacaaggtagttccctaccacacggttgatcccgtggctgcgcgcgatatgttcatccgccatgccctcatcgaaggcgattggtccactcaccaccgcttctaccacgacaacgtggccaaattggaggcaatcggagaacttgaagccaaggcgcgtcgccgcgacatcgtcgtagatgaagacaccctgtttgatttctacgatgccaagcttccaagcaacgccaccaccacccgcaatttcgattcctggtggaagaaaacatcacgcgtcacaccagatcttctcgatttcgacccagatagtctgatcaacgaagacgctgacggcgttaacgaagaagccttccccgacaagtggattaaaggcagcctgatcttcgatctcagctaccacttcgaacccggccaccgcgatgacggcgtcacagtcctcatccccattccagtgctgggtggacttgataccgaaggcttcgattggctagttccaggcttaaggcttgatttggtgaccgagttaatccgcaccatgcctaaggctttacgacgcaccgttgtccctgccccggatttcgccgagcgggtcttgccgttactgcgtccctacatgacaccactgaccacccaacttgccgatgcactccataccctgggcggccaaggaatcaacgcctctgatttcgatcctgccaaactccccgatcacctgcgcatttcctatgcagcagtagatcgtcgtggcaagatcatcgaccgcgaccgtgacctcgaagcactaaagaaacgccgcgcgaaccaaatcagggcatctgtttctagcgttgctaaggcatccgaacaagatgaaactacgcagtggaccacagataccttgggcaccatcgatgaagaaatcgagaccactgtcgatggacagtccgtcaccgcgtaccccgccttggttgtcaccccgactggcgtatccgtcaaggtcatgcccaccaaggctgctgctgatgcctcgatgatcaccgcaacattgacactgttgatgcgtgagattgaagtatccacaaagcaaatggtcaagggactacccttgcaacaacgagtcgcagtggacaactatccccacggcggtgccgaaggactggtttctgatgcccgtatcgccgcaattcgcgatttgatgtttgaacacggcggagctgtgcgttcaccggaagagttcgacgttcttctagccaaggtgaagccggaaacaccaggagttgttcgtcgaactgtcgttgagctagccccagcattggttcactatgcatccgttgtgtcagagctggagtcctggtctggacctgccattgacgatatgaccgcccagttggatttcctcttgccaaagcaggccatcagcattcacggcatcagtaggttgaggcaccttccgaggtatctgcaggcgttgacgattcgcctagaagagatgaaccaaaatccggatcgtgacgccgaccgtcaagatgaagtgaacttcgttgaagagcagctggagaaacagctcagtaagctacccgctgcgcgagccaacaccaaggaagccaaggatattgcctggcagattcaggaactaaggatcagcctctttgcacagcggttaggcactccccgacctgtatcggcgcagagaatccagaaggctattgccaagcttcga

SEQ ID NO: 2117 - DNA, 450 bp, Corynebacterium glutamicum
gtgtactgcccattttgccaacatgatcattcaaaagtcattgactcccgcgtcattgacgccggaagcgccattcgcaggcgccgcgagtgcagcaaatgcgaaggccgtttcaccaccatcgaaaaagctgttctcctcgttgttaaaagaaacggcgtcactgaaccgttcagtcgagaaaaagtagtcaccggtgtccgtcgtgcatgccaaggccgcgacgtatcagatgacgcgttgaaacgcctagctcagcaagtggaagaaacagtccgcagcaacggaagctctcaagtacgcgctaacgatattggtttagccattctcgatccactgagagaactcgacgaggtagcgtacctacgctttgcctctgtgtataagtcttttgacagtgctgacgactttgaaaaagaaatccgcctcatgcgcagacgcggaagggac

SEQ ID NO: 2118 - DNA, 420 bp, Corynebacterium glutamicum
atgactgtttatgcgggtaaagagctagattcacgtaagctgcgtcaaggtgtggtcgtaccttccgctgctgtctggatgggggaaggcgccggtcttaaatcagctaataagaggcatgttcgaacgattgactgttcgaatggagatcgttttcatcagccatcaagtcttcgcattcttccacacggtgaaagaaattatcgaacatcacagcaacaggtgcgtgaacaagacccagaaaacaccacaggtggcaatagtgacgcgcgttcgattaaagaatccctcaaacaatgggcgggcggaggactgtttgggctggttattttcgccggaattttgctctcccaatcaggggaagaagaagtgagccagaactactacgaaacccagatggtgggtgtcagtctcgggcgc

SEQ ID NO: 2119 - DNA, 696 bp, Corynebacterium glutamicum
ttgcccaacggaaaaccagatccagcaagtttgtcagataggcagcgcaggattttagaggttatccgagatgctgtggttttgaggggttatccaccaagcattagggaaattggtgatgctgcaggacttcaatccacttcttccgttgcttaccagcttaaagagctagagaagaagggcttcctgcgcagggaccctaataagcctcgcgcggtggatgttcgccaccttccagaaactgaaagccgttcctccaaggctgctacacaggcaaagagcaaggcccctcaggccggggtccatgatcctgagttagctggccagacctcatttgtcccagtggtgggcaaaattgccgctggtagcccgatcaccgctgagcagaacatcgaagagtactacccactccccgcagaaatcgtcggagacggtgacttgttcatgctccaggttgttggcgagtccatgagggatgctggcatcctcaccggcgactgggttgttgttcgttcccagccggtcgctgagcagggcgagttcgtcgcggcaatgattgacggtgaagccaccgtgaaggaattccacaaggattcatctggcatctggctcctgccacacaacgatacgtttgccccaattcctgctgagaatgcagaaatcatgggcaaggttgtttccgtgatgcgcaagctt

SEQ ID NO: 2120 - DNA, 777 bp, Corynebacterium glutamicum
atgtacgcagaggagcgccgtcgacagattgcctcattaacggcagttgagggacgtgtaaatgtcacagaattagcgggccgattcgatgtcactgcagagacgattcgacgagaccttgcggtgctagaccgcgagggaattgttcaccgcgttcacggtggcgcagtagccacccaatctttccaaaccacagagttgagcttggatactcgtttcaggtctgcatcgtcagcaaagtactccattgccaaggcagcgatgcagttcctgcccgctgagcatggcggactgttcctcgatgcgggaactactgttactgctttggccgatctcatttctgagcatcctagctccaagcagtggtcgatcgtgaccaactgcctccccatcgcacttaatctggccaacgccgggcttgatgatgtccagctgcttggaggaagcgttcgcgcgatcacccaggctgttgtgggtgacactgcgcttcgtactctcgcgctgatgcgtgcggatgtagtgttcatcggcaccaacgcgttgacgttggatcacggattgtctacggccgattcccaagaggctgccatgaaatctgcgatgatcaccaacgcccacaaggtggtggtgttgtgtgactccaccaagatgggcaccgactacctcgtgagctttggcgcaatcagcgatatcgatgtggtggtcaccgatgcgggtgcaccagcaagtttcgttgagcagttgcgagaacgcgatgtagaagttgtgattgcagaa

SEQ ID NO: 2121 - DNA, 960 bp, Corynebacterium glutamicum
atgattcttacagtcactgcaagtccgtatctgttgagcaccaatgagcttgacggcaccatcgaaattggcgaagcaaacaaaatccggcaggtttccactgttgccggtggttttggcaccggtgtggctgccaccttgttttatggcggcaatgaaacttttgcagtttttcccgctccagaaatctctcattacatgcgcctggtgacgtttgctgggttgcctcatgaaattattccggtggcaggtcccatccccatgcatttgaccatgcgtgatgcagagggcaatgagactaagttcaaagactcccccatgcctttggatgtgtcccagttggcaattcttcgtgatctagtggtgcgtcgagccgaagatgccgcgtgggtgttgttgggtggcaatttgccgtctatcgcgcctgctgcgtggtttgtggatgtggtgagatcacttcgcttgtaccaccctcatgtgaaggtagctatcgcagcaactggtgctgcgttgcgtgcggttattcgacagcttgcagctacgtccccggatgcgctgattgtggctgcggaagaaatcgaaattgccactggattagaacccaaaaccttgagaggtccatgggtagagggagatctctccccgactgtggcggcagcgcgcgctttaattgatagcggtgtcaccgaggtgttggttaccaacaagcggacggaatctttgtatgtttccgagtctgaatcactgttagccagctacgacagcacccctggtaagcagggcgtgaattggcgggaatcttttactgcaggattcttggcagcatccaatgatggaaaatccactgaggacagcgtgatcaacgcggttgcttacgccaacgctgaaggcagtgagtgggacaactacattcccacacccgataagcttcgggcggagcacgtggtcatcaaatcgctt

SEQ ID NO: 2122 - DNA, 1704 bp, Corynebacterium glutamicum
gtggctactgtggctgatgtgaatcaagacactgtactgaagggcaccggcgttgtcggtggagtccgttatgcaagcgcggtgtggattaccccacgccccgaactaccccaagcaggcgaagtcgtcgccgaagaaaaccgtgaagcagagcaggagcgtttcgacgccgctgcagccacagtctcttctcgtttgcttgagcgctccgaagctgctgaaggaccagcagctgaggtgcttaaagctactgctggcatggtcaatgaccgtggctggcgtaaggctgtcatcaagggtgtcaagggtggtcaccctgcggaatacgccgtggttgcagcaacaaccaagttcatctccatgttcgaagccgcaggcggcctgatcgcggagcgcaccacagacttgcgcgacatccgcgaccgcgtcatcgcagaacttcgtggcgatgaagagccaggtctgccagctgtttccggacaggtcattctctttgcagatgacctctccccagcagacaccgcggcactagacacagatctctttgtgggacttgtcactgagctgggtggcccaacgagccacaccgcgatcatcgcacgccagctcaacgtgccttgcatcgtcgcatccggcgccggcatcaaggacatcaagtccggcgaaaaggtgcttatcgacggcagcctcggcaccattgaccgcaacgcggacgaagctgaagcaaccaagctcgtctccgagtccctcgagcgcgctgctcgcatcgccgagtggaagggtcctgcacaaaccaaggacggctaccgcgttcagctgttggccaacgtccaagacggcaactctgcacagcaggctgcacagaccgaagcagaaggcatcggcctgttccgcaccgaactgtgcttcctttccgccaccgaagagccaagcgttgatgagcaggctgcggtctactcaaaggtgcttgaagcattcccagagtccaaggtcgttgtccgctccctcgacgcaggttctgacaagccagttccattcgcatcgatggctgatgagatgaacccagcactgggtgttcgtggcctgcgtatcgcacgtggacaggttgatctgctgactcgccagctcgacgcaattgcgaaggccagcgaagaactcggccgtggcgacgacgccccaacctgggttatggctccaatggtggctaccgcttatgaagcaaagtggtttgctgacatgtgccgtgagcgtggcctaatcgccggcgccatgatcgaagttccagcagcatccctgatggcagacaagatcatgcctcacctggactttgtttccatcggtaccaacgacctgacccagtacaccatggcagcggaccgcatgtctcctgagcttgcctacctgaccgatccttggcagccagcagtcctgcgcctgatcaagcacacctgtgacgaaggtgctcgctttaacaccccggtcggtgtttgtggtgaagcagcagcagacccactgttggcaactgtcctcaccggtcttggcgtgaactccctgtccgcagcatccactgctctcgcagcagtcggtgcaaagctgtcagaggtcaccctggaaacctgtaagaaggcagcagaagcagcacttgacgctgaaggtgcaactgaagcacgcgatgctgtacgcgcagtgatcgacgcagcagtc

SEQ ID NO: 2123 - DNA, 792 bp, Corynebacterium glutamicum
atggtcagccaaacggaaagacagcatgcaattgcttctttactggcaccaactggtgcggtgtctgtaggagatttagccgagcatttccatgtgacaaccgaaacagtgcgacgtgatcttcggatcatggagtcactgggtttgttgcaacgagttcacggtggcgccattagcccagagcccatgggtacgtctccccctcggctgaaacctgccttgggtaaaggaatgccaccggaaccccgtgttttagaacttgcagaaactgcagtttccctcatcacacctctagcacgcagcattttcctggattcaggtttagcgtgcacggcgattgccacggtgttgggggatcctccagaagatgccaggtggactgttgttacaagttcccccggcgctgtgattgccttgtccgcgacagatgccacctccacggtggtgctgcacgggcaggttcacggtaattgttcttcaatcattgggtccacggcagtagacatgatttcgcagttgcgcgctgatatcgccttcgtggaggttgatgcgattcaatccgatacaagtctgtgcacgtttttcccggagacgattcccatcaagcaagccatgatcaaaaacgcggctttcacagttgctgttctcagcccgagatctccccaagatcaagaacttcaacttttgaagcaccctttttccaccttggctgattttgatgcccttgttaccgatgaccacacgctagattttccagttttgcccgaccacaactttcaggtggtaacccca

SEQ ID NO: 2124 - DNA, 990 bp, Corynebacterium glutamicum
atgatcatcacattcaccccaaacccgagtattgattccacgctgtcgctcggcgaagagctctcccgtggatccgtccaacgacttgattccgtcaccgctgtcgcaggtggtaaaggcatcaatgtcgcccacgctgtcttgcttgcgggctttgaaaccttggctgtgttcccagccggcaagctcgaccccttcgtcccactggtccgcgacatcggcttgcccgtggaaactgttgtgatcaacaagaacgtccgcaccaacaccacagtcaccgaaccggacggcaccaccaccaagctcaacggccccggcgcgccgctcagcgagcagaagctccgtagcttggaaaaggtgcttatcgacgcgctccgccccgaagtcacctgggttgtcctggcgggctcgctgccaccaggggcaccagttgactggtacgcgcgtctcaccgcgttgatccattcagcacgccctgacgttcgcgtggctgtcgatacctcagacaagccactgatggcgttgggcgagagcttggatacacctggcgctgctccgaacctgattaagccaaatggtctggaactgggccagctggctaacactgatggtgaagagctggaggcgcgtgctgcgcaaggcgattacgacgccatcatcgcagctgcggacgtactggttaaccgtggcatcgaacaggtgcttgtcaccttgggtgccgcaggagcggtgttggtcaacgcagaaggtgcgtggactgctacttctccaaagattgatgttgtatccaccgttggagctggagactgtgctcttgcaggttttgttatggcacgttcccagaagaaaacactggaggaatctctgctgaatgccgtgtcttacggctcgactgcggcgtctcttcctggcactaccattcctcgtcctgaccaactcgccacagctggtgcaacggtcacccaagtcaaaggattgaaagaatcagca

SEQ ID NO: 2125 - DNA, 1836 bp, Corynebacterium glutamicum
ttgggctttgctcgcctgagcaagggtgtggacttcagcggacctgatggcgatgccaacttggtgttcctcattgcagcacctgctggcggcggcaaagagcacctgaagatcctgtccaagcttgctcgctccttggtgaagaaggatttcatcaaggctctgcaggaagccaccaccgagcaggaaatcgtcgacgttgtcgatgccgtgctcaacccagcaccaaaaaccaccgagccagctgcagctccggctgcggcggcggttgctgagagtggggcggcgtcgacaagcgttactcgtatcgtggcaatcaccgcatgcccaaccggtatcgcacacacctacatggctgcggattccctgacgcaaaacgcggaaggccgcgatgatgtggaactcgttgtggagactcagggctcttccgctgtcaccccagtcgatccgaagatcatcgaagctgccgacgccgtcatcttcgccaccgacgtgggagttaaagaccgcgagcgtttcgctggcaagccagtcattgaatccggcgtcaagcgcgcgatcaatgagccagccaagatgatcgacgaggccatcgcagcctccaagaacccaaacgcccgcaaggtttccggttccggtgtcgcggcatctgctgaaaccaccggcgagaagctcggctggggcaagcgcatccagcaggcagtcatgaccggcgtgtcctacatggttccattcgtagctgccggcggcctcctgttggctctcggcttcgcattcggtggatacgacatggcgaacggctggcaagcaatcgccacccagttctctctgaccaacctgccaggcaacaccgtcgatgttgacggcgtggccatgaccttcgagcgttcaggcttcctgttgtacttcggcgcagtcctgttcgccaccggccaagcagccatgggcttcatcgtggcagccctgtctggctacaccgcatacgcacttgctggacgcccaggcatcgcgccgggcttcgtcggtggcgccatctccgtcaccatcggcgctggcttcattggtggtctggttaccggtatcttggctggtctcattgccctgtggattggctcctggaaggtgccacgcgtggtgcagtcactgatgcctgtggtcatcatcccgctacttacctcagtggttgttggtctcgtcatgtacctcctgctgggtcgcccactcgcatccatcatgactggtttgcaggactggctatcgtcaatgtccggaagctccgccatcttgctgggtatcatcttgggcctcatgatgtgtttcgacctcggcggaccagtaaacaaggcagcctacctctttggtaccgcaggcctgtctaccggcgaccaagcttccatggaaatcatggccgcgatcatggcagctggcatggtcccaccaatcgcgttgtccattgctaccctgctgcgcaagaagctgttcaccccagcagagcaagaaaacggcaagtcttcctggctgcttggcctggcattcgtctccgaaggtgccatcccattcgccgcagctgacccattccgtgtgatcccagcaatgatggctggcggtgcaaccactggtgcaatctccatggcactgggcgtcggctctcgggctccacacggcggtatcttcgtggtctgggcaatcgaaccatggtggggctggctcatcgcacttgcagcaggcaccatcgtgtccaccatcgttgtcatcgcactgaagcagttctggccaaacaaggccgtcgctgcagaagtcgcgaagcaagaagcacaacaagcagctgtaaacgca

SEQ ID NO: 2126 - DNA, 267 bp, Corynebacterium glutamicum
atggcttccaagactgtaaccgtcggttcctccgttggcctgcacgcacgtccagcatccatcatcgctgaagcggctgctgagtacgacgacgaaatcttgctgaccctggttggctccgatgatgacgaagagaccgacgcgtcctcttccctcatgatcatggcgctgggcgcagagcacggcaacgaagttaccgtcacctccgacaacgctgaagctgttgagaagatcgctgcgcttatcgcacaggaccttgacgctgag

SEQ ID NO: 2127 - DNA, 582 bp, Corynebacterium glutamicum
ttggcccgcacggtttccgcgtgcgggacgtgttcatttctgtataggaaaactaccttgatcgttgatacccagtttgagaagatccctgctcacgacgtcgtgggcatccgggtaatcctttcctctgaggatctccctgagctctttaaacgcggctacgcggaagtaaagaaattcctccgcctagaaggcatcgaacctaaaggtcctgcccgcgcctactactttggcgatgtctctgacaccgtagacatcctgattggtttccccgtcagccccgcgcaagcagaatccctgcgccgcggcgcattgagccaatccggtggcgacatcgatgacgttgtcctccaccacttccgcgacatgaaaaccatgcacagccgccactccggccccttcgatggagtcgagcgcgtctgggacgaaatcctcgatgaagtcgaagacctcggatgcactctgccatccagcagcatcggttgggaagaatacatcgagggcccagccaccgctgatacctgcgaccaactggcctctgaagtttatgttcaggtgtgccaagcaccggtgaagtctgca

SEQ ID NO: 2128 - DNA, 1287 bp, Corynebacterium glutamicum
gtgctcgtgacttcaacatggggatggaccgtccacggagacggcaaaaagatcgaacccggcgcagttgtcgctcctaaagagcgcctgagctgggggcgcacaattggaatcggtatgcagcacgtgatcgccatgttcggcgccacgctcctggttcccacactcaccggatttccggtcaacaccacacttttattctctggtctgggaacaatcctgttcctgttgatcaccagaaaccgactaccctcgtacctgggtagttcttttgctttcattgcacctttaaccgcaacccaagtccatggcattggcgtgcagatcggtggcattcttgtcgcaggtctcgtgctcgtcgccattggatttgtggtgaaagcagcgggcaaacgcgttattgatgctgtcatgccacccgctgtcaccggtgcgatcgtggcactcatcggcctgaacctggcaccaaccgcggcaggaaacttctccagccaaccactggttgccacggcgaccctctttgccattttgatcgctaccgttgcaggccgcggaatgattgctcgcctgggcattttgatcggtgtggtgatcggctgggttttcgcagctatcaccggcaacctctcagaaggcgcagcagacaccatccgtgaagcagcatggttcggactgccacagttccacaagccggaattccagctctctgccattttggtgacactgccagtcatcatcgtgctcatcgctgaaaacgtcggccacgtcaaagcagtctcagagatgacaggggaggacctcgacgacctcgccggcgacgcacttatcgcagacggattcggcaccaccctcgcaggtgccttcggcggatccggcaccaccacctacgcagaaaacatcggcgtcatggcggccacccgcgtatattccaccgctgcgtactgggttgccgcgtgcactgccatcgcccttgccttcatccccaaattcggtgcactgatcttcaccatccccgccggcgtgctgggtggggcatgtttggttctttacggcctaatcggtatgctcggcattcgtatctggcaagacaacaaggtcaacttcaacaatccagtgaatctgaccatggctgccgttgctttggttgcaggcattggtaacctcaccctcaccgttttcggagtcactcttgaaggcatcgcatggggctctgtaggcatcattgtgctgtacccaatcatgaagcgcctgtacctttccattggggaaggcaagaacgcaaagttc

SEQ ID NO: 2129 - DNA, 1458 bp, Corynebacterium glutamicum
gtgcgcccaggatctgacgagacctcaggttttgatctcagtggttttatccgagctgaagaaccatcaactggtgatctcgacctagaggcccgcgatgcccaacgtcgccgggacaccgaaatccacgctgatgaagcagcagatggctacgaggttgagtaccgaaagctgcgacttgagcgcgttatcttagtgggcgtgtggaccgaaggtaccaccgcagaaattgacgccagccttgcggaacttgcagcgttggctgataccgccggcgctgaggttattgaaacgctgtaccaaaagcgcgataaaccagatcctggaacctacattggttccggcaaggttcgggagttaaaggagatcatcgaagccactagtgcagataccgtggtgtgcgatggtgaacttagcccttcccagctcgtggcattagagcgcgaacttgatatcaaggtcattgaccgcaccatgctgattctggatatcttcgcccagcacgctaaatcgcgcgaaggtaaagcccaagtcgcgttggcgcagatggaatacctgattagccgtgtgcgtggttggggtggaaacctctccaggcaggccggtggtcgtgcaggttctaatggtggtgtgggtctgcgtggtccaggtgaaaccaaaattgaagcagaccgccgtcgtcttcgatcggatatggctcgcctgcgcagggaactttcggggctggatacgtcgagaagcattaaaagagcgcaacgcgcagcctccctggtgccgcagatcgccatcgctggctacacgaacgccggcaaatcttcgctgattaacgcgatgaccggcgcgggtgtgctggtggagaacgcgctgttcgccacgcttgatccaacaaccagaaaagccgagcttgccgacggccgacacgtcgtgttcacggacaccgtcggctttgtgcgacacctgccgacctctctggttgaggcgttcaaatctacgctggaagaagtcgtggaggcggacctcatgctgcacgtggtggatggatccgatccgttcccgctgaagcagatcgacgctgtgaacaccgtgattagcgatattgtgcgatccaccggtgcggtgccaccaccagagatcatcgtggtgaacaaaattgaccaagctgatccgctgacgctggcagaactacgccacgccgtcgacgatgtggtgtttgtctctgcgctgacaggggagggaattaaggagctggaagctcgcatcgaactattcctcaactccagggacgcgcacctactgctgaaaatcccgttcacccgtggcgatattgtgtcccgcctgcaccagcatggcaccgttctcagcgaagactacgccgaagacggcaccttgatggatgtgcgtatccccacccaattggcccaagagctgcagagttacgttgtagaacccacctctgcc

SEQ ID NO: 2130 - DNA, 786 bp, Corynebacterium glutamicum
ttgcctgttaagggagttagactaatcgccatgactagcgatctgaagacaatcggtatggatttcgccaagtggcaagatgcagtggaagcagcaattgcttcacagcgtctcgaggtaacaggcgaggtccgtggcggccagctcatccagttctcggatgattccggcgcccaaattaacattctggctgtcgagccttttgccaccttcgccggctttaactccgcaacagtcgcttacggccacgtcagcatgatcaatgatgtgctgtccctggtcgatatcatcgatcctttcggcacccctgttgccaccattacctgcaaccttgctcaaggcccactgcttgttgatgaaccagtgcagcgctggcagcagatccgcattactgccctgggcattgatgttgaggtccacgacaatgcagatgcttacatccgcaatggtggcgaaactgtcggcatgctggtttctgaaggtgcagagaagattgccagcggcagcggcgctgtcatcccggacgcatccgcagagttttccgcacgcgtgttgtctgcggagtaccgcaccaacactcttaccggccagcgttttatccacgcaacagttgatggcctcttcgcttttgatgtgtgccttcctgatgcaccagaactacctgcccgtgacagcgtgttgtctggcaaagtcatgctgactgctgccgttatccccactgaggtcaccggctgcggtggctccggtggcggctgtggctcaggtagctgtggctgcggcggacac

SEQ ID NO: 2131 - DNA, 537 bp, Corynebacterium glutamicum
atgggagaacaacttccgtttgctaatggttcacgctccaacaaactgccgctcatcgtcatcggtttgtgctgcataatgctgatcctgtggcttaaacttcccggcgtactgcttgccaccatcattggggttgccacgatgagtgtgatgcggatgcgcacctccaccccagaaactgcctcgctggttacttctattcggctgtctgcggaagatatttccgatgtgcaacatgagtggcagcagtttttgacctcccccgaggccgatgcgctggctgatcgcacgcttgtccgtcccgcactggcggatccagattgtggcgataaggctatcgagaaatttcattatgaaatcagcaatgccaatcgcttcttgggcaggttggacgctcgtctgcaacaaaacctcgtggtcagtgagctagaaacacttctcaaagtaacggacgagcgcgcactagagctgcgggaaacgtggctggatgcgcgtaaagcggcccagaaacttgggccgaactacaatcgcgaatct

SEQ ID NO: 2132 - DNA, 831 bp, Corynebacterium glutamicum
gtgaatttgaccatcccctttgccaaaggccacgccaccgaaaacgacttcatcatcatccccgatgaggatgcgcgcctagatttaactccagaaatggtggtcacgctgtgtgaccgccgcgccgggatcggtgctgatggtatcctccgcgtggttaaagctgcagacgtagaaggctccacggtcgacccatcgctgtggttcatggattaccgcaacgccgatggatctttggctgaaatgtgcggcaatggtgtgcgcctgttcgcgcactggctgtactcccgcggtcttgttgataatacgagctttgatatcggtacccgcgccggtgtccgccacgttgatattttgcaggcagatcaacattctgcgcaggtccgcgttgatatgggcatccctgacgtcacgggattatccacctgcgacatcaacggccaagtattcgctggccttggcgttgatatgggtaacccacacctagcgtgcgttgtgccgggcttaagtgcgtcggctcttgccgatatggaactgcgcgcacctacgtttgatcaggaattcttcccccacggtgtgaacgtagaaatcgtcacagaattagaagatgacgcagtatcgatgcgcgtgtgggaacgcggagtgggcgaaacccgctcctgtggcacgggaaccgttgctgcagcgtgtgctgctttagctgatgctggattgggagaaggcacagttaaagtgtgcgttccaggtggggaagtagaagtccagatctttgacgacggctccacactcaccggcccaagcgccatcatcgcactcggtgaggtgcagatc

SEQ ID NO: 2133 - DNA, 903 bp, Corynebacterium glutamicum
gtggtaacaccgatcgcagtggttggacccactgcatctggaaaatcagctttgggaattgctctagcccacaagcttgacggtgaagtagtcaatgtggattccatgcagctgtacaaaggcatggacatcggcacggcaaagctgactgtcgaagaacgcgaaggcattgcgcatcatcagctcgatgtctgggacgttaccgaaactgcgtcagtggcgaggtttcaatccgacgccgttgccgatgtggaagatattatgtcccgtggcaaaacccccatcttggttggcggctccatgttgtacgtccaatctttggtcgatgattggcaattcccacctaccgacagcgctgttcgcgcacgctttgaggcccgcttggcagacatcggtgtcgaagcactacacgctgaacttactcagcttgacccagaagcagcagccgtcatcgaaagcaatgatccccgacgcaccgtccgagcattagaagtcattgaactaaccggccagcccttccaagcaagccaaccgcccaaagacgcgccacctcgctggggaactcgaatcattggcctgaaaaccactccagaatggctaaatccacgcatcgagcagcgcaccgccaggatgtttgaacaaggctttgtcgccgaagtggaacaccttgtgcagcaaggactcatcgctgactccaccgcgggacgagcaatcggctactcccaagtactggcagccatggcaggggagatgacctgggaagacgccttcgaacgcacggtcaccggaaccagacgctatgtcaggcgccaacgcagctggttcaacagagaccaccgcgtgtcctgggtcgacgcctctggcgatcccaccgcacaagccttggagattttgggtctacaa

SEQ ID NO: 2134 - DNA, 675 bp, Corynebacterium glutamicum
ttgaaaaaccgcgctcaggagaggtgtttgcccagcaatttcggtgggcaggatagggtggaagacgtgaatgcaacgctgattatcatgcctggaagtccggcgctggtacctgaactggcaccagcggatgctgcgggggcgcgcttgttggcgtcgttacgtgcagtttttgatgcggaactggctaatgatgatcgcccgatcgagttggttggctcccgggatgaggcgtggtttaccaagcatgcgggaaatctgcgggcctggggtgcaccgagcgtgcaggtttctgacggacattatttgccggaaattttgcagcgtgtcgcgctgggtggtttcgaatcgcgtgtaactcatgtgcgcgatcggttgggtagcgtcaacgacaacacggttacggtgcttgcccttgacggccccacgggcttgaccacccgcgcgccgtccgcactcgtgcccggcgcgtccaacatcgacgcctggtgccgctcattgctgtctggaaagcccggggaagtgcccagcaccagcacgcttatcgacgcctccctccgcgaaccacagctctggctcgacttatccgccgtggcaacagaagcgtcaactgctcaacttctcgacagcgacgacacacacggcgtgggacgctacgttgctcgctggactttt

SEQ ID NO: 2135 - DNA, 1359 bp, Corynebacterium glutamicum
atgactgagaaccagactcccagctccacctctgcaccgaagccgggacctcgcccgggcccacggccaggcccccgacctggggctcaggttgctgcaaagaaagctgcggttgctacacctgcgccgatcgccaaaacttctaacgatcctgcaaagtttggtcgcgttgaggcagacggatctgcatatgtcaccacctctgctggcgagcgtctgattggttcttggcaggccggcacccctgaggaaggtcttgctcactacggcgcccgttttgatgatctggccaccgaagttgagctcatggaacagcgcctaatctcccaccctgatgatgcgacctccatccgcacgaaggctgaagaactcaaggcaaccctgcccaccatcgctgcgatcggtgaccttgatggcgttgaagctcgcctgtccaagatcatcaacaactccgaggaagccaacgagcgcgccaaggaacaaaaggctaaaaaccgtgagcgcgcagtagctcgcaaggaagagctcgctgttgaggctgaaaccttggcagaaaactcctccgactggaaggttgctggcgaccgcatccgcgccatcctggatgagtggaagtccatccacggcatcgaccgcaagaccgatgatgaactgtggaaacgctactcccgtgcgcgtgactccttcaaccgtcgccgcggcgcacacttcgcagagctggatcgcacccgcgcatctgcacgcaaactcaaggaagaactcgttgagcgcgccaatgctctcaaggaatccactgagtggaacgacaccgcccgcgcattccgcgatctcatgaccgaatggaaagccgccggccgcgcaccacgcgaaatcgacgacaagctgtgggcagcattcaagggcgcccaggactacttctttgataagcgcaacgccgtagccaaggaacgcgaccaggaattcgaagccaacgcaaccgcaaagcagcagctcatcgacgaatacgacgcacagatcaaccccgagcagggcctcgatggagcgcgcagcaagctccgcgaactgcaggaaaagtgggaagaaatcggcttcgttccacgtggcgttgtccgcgaattcgaagagaagatcgccgtgctggaaaagcgcgtctccgctgctgaggaatcccagtggcgccgcaccgacccagaagcacaggcacgcgcagaccagttctccgcgaaggtcgccgagttcaacgctcaagcagacgccgccgaagccaagggcaactccaagaaggctgagaagctgcgcgcacaggctgcacagtgggcagaatggtcccgcgccgcacatgaggcagttgaccagctg

SEQ ID NO: 2136 - DNA, 1020 bp, Corynebacterium glutamicum
atgtgcggcgcgggaccattctgcccactgtgcagcctgtgcgcgcagcttctcagccttcttggagttgcccttggcttcggcggcgtctgcttgagcgttgaactcggcgaccttcgcggagaactggtctgcgcgtgcctgtgcttctgggtcggtgcggcgccactgggattcctcagcagcggagacgcgcttttccagcacggcgatcttctcttcgaattcgcggacaacgccacgtggaacgaagccgatttcttcccacttttcctgcagttcgcggagcttgctgcgcgctccatcgaggccctgctcggggttgatctgtgcgtcgtattcgtcgatgagctgctgctttgcggttgcgttggcttcgaattcctggtcgcgttccttggctacggcgttgcgcttatcaaagaagtagtcctgggcgcccttgaatgctgcccacagcttgtcgtcgatttcgcgtggtgcgcggccggcggctttccattcggtcatgagatcgcggaatgcgcgggcggtgtcgttccactcagtggattccttgagagcattggcgcgctcaacgagttcttccttgagtttgcgtgcagatgcgcgggtgcgatccagctctgcgaagtgtgcgccgcggcgacggttgaaggagtcacgcgcacgggagtagcgtttccacagttcatcatcggtcttgcggtcgatgccgtggatggacttccactcatccaggatggcgcggatgcggtcgccagcaaccttccagtcggaggagttttctgccaaggtttcagcctcaacagcgagctcttccttgcgagctactgcgcgctcacggtttttagccttttgttccttggcgcgctcgttggcttcctcggagttgttgatgatcttggacaggcgagcttcaacgccatcaaggtcaccgatcgcagcgatggtgggcagggttgccttgagttcttcagccttcgtgcggatggaggtcgcatcatcagggtgggagat

SEQ ID NO: 2137 - DNA, 1023 bp, Corynebacterium glutamicum
atgaagttctccaaattagcggaccaggtctggggcgaagaacccgatgatcaggtccgctcctttgtgttcatgtccaacctggatgcccaagaaaccgccaacaccatggacgtgtccgtctccgtggagcgcatccacgccgatctttgcggcaacactgagctcgcctccgaactgcactacacgcccgatgaatgggacgaggcccaaggctgggtaaaaatcaactacccgcttatcgacgacaccgcctcagccagcctcgacgtcgtcctcgacgccaccttccagcccctaccgggccagccctttgagggcgaggctttaacgcttatcgacgccctcctccaccacgccgaaaacgtcgcagcctccaacccctggaagcgcaccaccttccacaccgctcacatgcaccctccagggagtaatgcggattgtgactactgcctggtgctgcaacgccgcggatacgttaaagcccacgaagaaatccaacaaaccatcccgcttccttcaggtgactggtccgctggagaattcaccgtggtggacgttgaaggcaccgccttcccaagcgcgctgatccccagcatcgtggaactccaacaccgcgcagccctcgatgtgccccacggaaacttaagtgttgcgcctgcacagtgggatgaacaccgcttggcgcagcaatctgaaagaatccttaaaacaggaacgaaactgttcaccgtactgtttgccgaaggatccacagtcgctgccatgtcctccatcgcgattcccccaggctccaaccctgacatcgccgaacagggactgaccatcgtgcacccagatttcagaggccgtggtcttggaaccgctgtgaaattagcgggactgtcactactttcgaggtgccacccagaaattcaacgcgtagccacctcaaatgcagtagacaaccatgcgatgctggcgattaaccgctccataggggcaacagagatcgcccgaaccaccctgtgggagaagaaactc

SEQ ID NO: 2138 - DNA, 669 bp, Corynebacterium glutamicum
atgaacaacaacgtgagtgatcaaaagctaagtggtaaagagcttgcggcactagagaaacaagccgcaaaaactctcgaacttggtgataagaagtggtatctcatcgcgggagtcgtgcttttcgccatcgcactcgtcctcccacatatccgtggagtgatgggctggcaggttctgacgctgtcgaatgtcgcggaggatgccggcattacccttggtgagtacggtttctactggttgggcaccatcggtgtattcctgctttctttgggcactgtcgtgtttaagcgcacgtggatggcgtggatttcatggattttctcctgcgtcactcttgtgttcgctgtgtttgccatctggatgcgccaaacaaccaccagcacccaagtgaatttcgtcaacattggcatgatgcttgctgtgattgcagcgatccttgctgtgtggggtctatcttcggtgattttggcccgcagtgatcgccaaatggagatcgctgaaatgcgcgccgagaacccagaccttgatggtgttgcagctacccagcgcgcacttcttgagcagcagcaaagcaacccagaagataatcctttgcttgtcgacgatcgtcgcgcccgcatcgcccgccgccgcgagcgtgaacaggatgcacaaggggagcaggct

SEQ ID NO: 2139 - DNA, 1566 bp, Corynebacterium glutamicum
ttgaaccacgcaaaggtaaatcaacatcccggtcaagccaccctcccagaaaccgcagaggggcaggttcgcacctacgaggtaaaaacctacggctgtcagatgaatgtgcacgattctgagcgcctttcgggcctgctcgaggaggctggatacgttgctgctccggaggacaccactccggatcttgtcgtatttaatacgtgcgccgtgcgtgaaaacgccgatatgcgcctctatggcactttgggcaacctgcgcagcgtgaaagaaaagaacccaggcatgcaaatcgctgtcggtggttgtttggctcaaaaagacaaagataccgtggtgaaaaaagcaccgtgggtggacgtggtgtttggtacccacaacattggttccttgccaaccttgcttcagcgcgcggagcacaatgcccaagcggaagtcgaaattgtcgattccctcgagcagttcccgtcagtactttctgcaaagcgcgagtctgcttacgctggttgggtgtccgtatcagtcggatgtaacaacacctgtactttctgcatcgttccgtcgctgcgcggtaaagagcaggaccgtcgaccaggagacatcctcgcagaggtacaagcactggtggatcagggagttaccgaggtaactctacttggccaaaacgtaaatgcttacggcgtgaactttgttgatcctgagctagagcgcgatcgcagtgcattttccaagctgcttcgtgcctgtggtgagatcgaaggcctcgagcgggttcgcttcaccagccctcaccctgcagaattcacctctgatgtcattgacgccatggcagagaccccaaacatctgcccgcagctgcacatgccactgcagtccggatctgacaaggtgctcaaagagatgcgccgttcctaccgatccaagaagttcctctccatcttggatgaggtccgtgcgaagatccctcacgcctctatcaccaccgatattattgtcggattccctggcgaaacagaggaggatttccaagcaaccctcgacgttgtcaagaaggcacgctttacttctgcttacaccttccaatacagcccacgccctggcacccctgcagcggaatatgaaaaccagcttccaaaagaagttgtgcaggaacgctacgagcgcctcatggtcgttcaggaacaagtctgcgaagaagaaaaccaaaagctcatcggcaccaccgtcgaattgctggtccaggctggcggaggccgcaagaacgatgccaccaagcgcatgagtggtcgcgcacgcgatggacgcctcgtgcactttgcgccagagggcgacattgatggtgagatccgccccggcgattttgtcactgtcacggtgactgaggccaagcctttcttcctcatcgcagactccggtgtgcagacccaccgccgcaccaaagctggtgacaactctgcagttggtcaagttccaaccacagcaccgatcggtgtgggcttgggactgccacaaatcggcgcaccaaaggtggctcctgccacagaatctgcctgctgctccattaac

SEQ ID NO: 2140 - DNA, 726 bp, Corynebacterium glutamicum
atgatcaagatgacgggagtgcaaaaatacttcggcgactttcatgcccttacggatattgatcttgaaattcccagaggacaagttgtcgtcgtacttggaccatccggatccggcaagtcaaccctttgccgcacgatcaaccgtctcgaaaccatcgaggaaggcaccatcgaaatcgatggaaaggttctcccagaagaaggtaaaggcttagccaatctccgcgccgatgtcggaatggtattccagtccttcaacctcttcccccacctcaccatcaaagacaacgtcactcttgcacccatcaaagtgcgaaagatgaaaaagtctgaagccgaaaagcttgcgatgagcctgttggaacgcgtcggcatcgcaaaccaagctgataaatatccggcgcaactgtccggcggtcagcaacagcgtgtggccatcgcgcgcgcacttgcgatgaacccaaagatcatgcttttcgacgagcccacctccgcccttgaccctgaaatggtcaacgaagtgttggacgtcatggcaagccttgccaaggaaggcatgacgatggtgtgtgttacccacgagatgggattcgcacgcaaagcagccgatcgtgtgttgttcatggcggatgggctcattgtggaagatacggaaccagattccttcttcaccaaccctaagtctgatcgtgcaaaagacttcctcggcaagatccttgcccac

SEQ ID NO: 2141 - DNA, 219 bp, Corynebacterium glutamicum
atgagcccatccgccatgaacaacacacgatcggctgctttgcgtgcgaatcccatctcgtgggtaacacacaccatcgtcatgccttccttggcaaggcttgccatgacgtccaacacttcgttgaccatttcagggtcaagggcggaggtgggctcgtcgaaaagcatgatctttgggttcatcgcaagtgcgcgcgcgatggccacacgctgttgc

SEQ ID NO: 2142 - DNA, 684 bp, Corynebacterium glutamicum
atgagcactttgtgggcggatctgggtccgtctctacttccagctttttgggtgaccatcaaactcaccatttattccgccatcggcgccatgattttcggaaccatcctcaccacaatgagggtctcgcccgttaaaatcctccgcacgttgtccacggcgtacatcaacacagtccgaaataccccacttactcttgtggtgctgttttgctcctttggcctttaccaaaacctcgggttgactttggcgggccgtgaaagctccacattcttggtggataataacttccgcttggccgtacttggcttcattttgtacacctcaaccttcgttgccgagtccctgcgttcgggtattaacaccgtgcactttgggcaagcagaagctgcgcgttccctaggactgggctttggcgcgactttccgttccattattttcccgcaggctgtgcgcgccgcgatcgtccctttgggcaacacactgatcgcactgactaagaacaccaccatcgcctctgtcattggagttggcgaagcctccctgctgatgaaagccaccatcgaaaatcacgccaacatgctatttgtcgtgttcgcgatcttcgccgttggcttcatgattctgaccctgcctatgggccttggcttgggcaaactctctgagcgtttggcggtgaagaag

SEQ ID NO: 2143 - DNA, 819 bp, Corynebacterium glutamicum
atgctttcaggcaacggccaactcgatgccaacaaatggactccgttcatcaattcccaaacctggaccacctacattcttcctggtttgtggggcacgctgaaatctgccgtgttctcggtgatcttggctctggtcatgggtaccgcactgggtcttggccgtatctctgaaatcaggattctccgctggttctgcgccgtcatcatcgagactttccgagccattccggttctgatcctcatgattttcgcctaccagatgttcgcccagtacaacatcgtgccgtcgagccagctcgcgttcgccgccgtggtattcggtctgaccatgtacaacggttctgtgatcgcagagattctgcgttctggtatcgcttccctgcctaaggggcagaaggaagcagcgattgcgttgggtatgtcttctaggcaaaccacctggtcaatcttgttgcctcaggccgtggctgcaatgctcccagcgttgatctctcagatggttattgcactgaaggactccgcacttggttaccagatcggctacattgaagtggttcgttccggtattcagtccgcgtctgtcaaccgcaactaccttgcagcgctgtttgttgttgcgctgatcatgattgttctgaacttctccctcaccgctctggcttctcgcatcgagcgccagttgcgtgcaggtagggctcgtaagaacattgttgccaaggtccctgagcagccagatcaaggtctggagaccaaggacaatgtcaatgtcgactggcaggatcctgattataaggatctgaaaacccctggagttcag

SEQ ID NO: 2144 - DNA, 597 bp, Corynebacterium glutamicum
atggatatccaagccgaaaagattgaaaagctcagaaaagcactcgacaactttgaacgcgctcatgcgcgaggcgaatcagacttctttgaccatgaaaaagaagaaaagaaagccaacgtacgcagacgtgccctgctgctgcttaaccaacgcgcacgatcagtcaacgaactaagcaccagacttaaagcactggagtttgaggaagacatcatcaatgaggtcattggcgatctcaccagatccaaactgcttgatgatgaagtttttgccactgagtgggttcggcaacgtgctgccaggcgaggaaaatcttcgcgtgcgctggaccgcgaactgcaggaaaaaggcgtcgacaagcaaacgcgtgctgcggcgcttgagcaaatcgaccaggccgatgagcgggacacggcgcgggcggtggccgtgaaaaaggcgcgctcagagaccaagattccgcaggaccgcgccgactacgacaaagcgcttcggcgcgtggttggtgcgctggcacggcggggatttccggctggaatgtccatggaccttgcgcgggaagcgctagacgcgcgaatcgaggatttgaaaaac

SEQ ID NO: 2145 - DNA, 234 bp, Corynebacterium glutamicum
ttgcgctgtattatcgtccccatgcgtttatcggagtttcggcaactcattgaagatgaattcggagaagccaaaggggagtggattgcacactcgcatgtgattggtgccctcggcgtcactgcagatgttgcagtagataccggggttgatctgcgcgatgtatgggaacaactgtgcattgatttcagtgttcccgaagagcgacgacttggtaaagatgaaccagggttc

SEQ ID NO: 2146 - DNA, 738 bp, Corynebacterium glutamicum
atgtgtcagtggagtatctttgtgaatttacttaaatcttataaacgatcggcaagaaatatgaattttgatccagtgggaaaatgggtagcagccaacattcgctgtgatgtggacgaatcgccagtcacgcgggatgaggttctgggaatatgcatgaagctcaggagtggaaagccgaagttggagtatcgcatttcgggttctgttgaagactttggagaagaatctactaggtttagttttcgatgtaatccacagacaggtgcacagcacaaggtcacaacctatgccaatggtgaatcgagagaatccttcgatactcccaaactcacttctgaaggctggtttgaatcagatcagttcattattcgtccgagaggtgctcctggcttgatggtgatgtggaaggactttgtaatgcacgagctttactctccgccacctccaaatggattttcgatgaccatgcataatcttcggtacctgaagattactcaagatctcacagatgaggatgctggttggggtctttttgttgaccttgaaaccgattgcgctttgtattattgccagtacgtcgaagaacacacgatgtttaaagaaacggtagtatcctccgtccatgtacttttttcgggggaaactagttttcatgagtttgagagaaatgacgtcggtgaactaacgcgtgtggattcatccgccctggaagacggtcatgacggggacccttct

SEQ ID NO: 2147 - DNA, 576 bp, Corynebacterium glutamicum
gtgactccgctaaagaagcagtcttcacgtaaacagctccaagacatcgcgcttattgcagtttttgcagcactgatcattgtgcttgcttttgtttccatcccagttggcacagcgggagtgcctattgttttgcagaatgcctccatcgttttggctggcctgattcttggtggtcgacgtggttttctcactgctttgctgttcctggcactcggcctgattggcctgcctgtccttgcaggtggtcgtaccactttggccgcacttgctggcccaacagctggctacatcgtgggttacctcatttccccacttgttgcaggcatcatcgcttacctcgcacctaaaaagcgtggcgctggaatgttcatcgttttaggcctggcgggtctcgcgggtctgatcacccaatacgcttgcggcatcgtgggtctcgtccttcgtgcgggtctaagcttgagtgaagcaacaattgctcaaggtgcctttgtgctgccagatttggccaagatcaccgtcatggtcataatcgccgctggagttcatgcagcattccctgacatccgtaagaaa

SEQ ID NO: 2148 - DNA, 699 bp, Corynebacterium glutamicum
ttgcagttcatgcccgagatcatttttgacaacactgaagtacgctacgatgactcgctcattttagagcccctatcgttaaaactgacagaacaacgcattggcatcatcggggctaacggcggtggaaaatccacgctcatcagaatgatcaatggtctcggcgaaccaaccacagggcgtgttctagttgatggccttgacgtctcgcattccggacgggaagttcgcaagaaggttggatttgtcttctctgacgctgaaaaccagatcgtgatgccaactgtgcgtgaggatattgccttctcgcttcgccggcacaaaatgccacgcgctgaaaaggcgcaacgtgtcgacgagatgatggcgcgattcaacttgagcgagcatgcagatcaatcaccgcacaccctatccggtggtcaaaagcagttgttagcgctggctgcagtactgattttggagccagaagtgatcatcgctgatgagcccactaccctgctggatctgcgcaataggctgatgatcaaagacgtgttcaataaactcgagcagcaattaatcgttgtcagccatgatttagatttcctcagcgattttgagcgggtcatttgcatcaatgatcataaaatcgctgctgatggccctccgcaaaagtccattgacctgtacgtatcgcttatggcggaacctgcgaaa

SEQ ID NO: 2149 - DNA, 609 bp, Corynebacterium glutamicum
atgaacagtattcctttaggtttttacgtcgataagcaatctgttgttcattcttttcctgctttgtggaaattcccacttctgctgtttttcatcatcggcggctccatcgcggcttctaccccggttcatgggttgattttggtggggattgcagtggtgttttacgtgctggcgaagattccgctgaaggtcgcgtgggagcagttgtggccagtgctgccgattttgatcatgctcggtgcgtttcagtggtggcagcgcggctttgatttcgcggcaaccacagtgctcacgctgttttccgcggtgatggccgccatgttgttgacgttgaccacgcggttggaagcgctcatgaatgcagttgagcggatgttgcagccttttgcacgttttggcctgccagtagagacgatcaccttggctatttctctcacgattcggctcattccgctgcaattagccacggtgaaggaagtcctcgatgcccgtaaagctcgtggtgccggtttttctatcgccgcgtttggcacgcctgtgatcatcagatcaataaagagggcccgcaatatcggcgatgctcttctcgcacgtggtgccggcgat

SEQ ID NO: 2150 - DNA, 690 bp, Corynebacterium glutamicum
gtgtccagccatctgaacgccagcctgctcaacctcagccatgcggccctcaacagagttggacgcaagctcagcctggccaagcgcgttagcgtaacgacgctcaatcttctcacgaacttgatccaggttaggagtgctgccggaggtcaaagaatccatggacttcagggactcggaaaccttttcctgcatcttcgcctgctccagctggctcagaagcttggtgcgctcagcaaccttctgctgcaaagccatggagttacgctccacagccttcttagcctgatcagcctgctgcagagcctggtcgtggagctgcttggtatcttcaacggactgctcagcagtaaccagctgtgcagcgaaagcctcagcggcgttttcgtactcagtagccttcttgacatcaccgtcagcgcgagccttgtcagccagctggatagcctggcgggtgttgccctgcagcttctcaatttcagccagacggcggttcagctgcatttcaagctgacgctggttaccaataacagctgctgcctgctgggagagctcctgatgctggcgctgagcatcttcgatggcttgctggatctgtaccttaggatccgcgttctcctcaatcttggagtcgaacaacgccatgaggtacttccatgccttggagaatggattagccatgttgaaaag

SEQ ID NO: 2151 - DNA, 828 bp, Corynebacterium glutamicum
atggctaatccattctccaaggcatggaagtacctcatggcgttgttcgactccaagattgaggagaacgcggatcctaaggtacagatccagcaagccatcgaagatgctcagcgccagcatcaggagctctcccagcaggcagcagctgttattggtaaccagcgtcagcttgaaatgcagctgaaccgccgtctggctgaaattgagaagctgcagggcaacacccgccaggctatccagctggctgacaaggctcgcgctgacggtgatgtcaagaaggctactgagtacgaaaacgccgctgaggctttcgctgcacagctggttactgctgagcagtccgttgaagataccaagcagctccacgaccaggctctgcagcaggctgatcaggctaagaaggctgtggagcgtaactccatggctttgcagcagaaggttgctgagcgcaccaagcttctgagccagctggagcaggcgaagatgcaggaaaaggtttccgagtccctgaagtccatggattctttgacctccggcagcactcctaacctggatcaagttcgtgagaagattgagcgtcgttacgctaacgcgcttggccaggctgagcttgcgtccaactctgttgagggccgcatggctgaggttgagcaggctggcgttcagatggctggacactcccgccttgagcagatccgcgctgagatggctggtggttccctgaccgctggtaacaagcaggagtccattgaggctcctgcagcgggcaacaacgtcactgatgacgcagttgcacagcgcatgcgtgagctgcgcggcgaggct

SEQ ID NO: 2152 - DNA, 321 bp, Corynebacterium glutamicum
atggttacttatacaacccttctagacaagccgatttcagaatctgccccacggaaagctccagagccacttctccgcgaagctctgggtgcagctcttcgttctttccgtgctgacaagggcgttactttgcgtgagctggcggaagcttcacgtgtgtcacctggttatctttcagaattggaacgcggccgcaaagaggtgtcctctgagcttcttgcctccgtgtgccacgctttgggggccagcgttgcggatgtgttgatcgaagctgcaggttccatggcgctgcaagcagcgcaggaagacctcgctcgcgtc

SEQ ID NO: 2153 - DNA, 516 bp, Corynebacterium glutamicum
atgtcggagaatctggcggggcgagtggtggagctgttgaaatcgcgcggtgaaacgctggcgttttgtgaatccctcaccgccggccttgccagtgcgacgatcgcagagatccccggcgcctcagtggtacttaaaggcgggctggtcacctatgccaccgagcttaaggttgcgcttgccggtgtgccgcaggagcttatcgacgcgcacggcgttgtttccccgcagtgcgcccgtgcgatggcaacgggggccgcacacagatgccaggcagattgggcggtttcgctcacgggcgttgctggccccagcaaacaagatggtcatccggtgggggaagtgtggatcggagtggctggtcctgcgcattttggggcgtcgggaacaattgacgcgtatcgtgcgtttgaaagtgaacaacaggtaatattggctgaattgggacggcatcatattagagagtctgctgtgcagcaaagctttcgcctgctgattgaccatattgagtcgcag

SEQ ID NO: 2154 - DNA, 603 bp, Corynebacterium glutamicum
gtgagtgatgtatcagcaggcgtaaatggcgcacaagatccaagcaatcaagcggtcaagccttccaactggaaccttccgaacttcttgaccagcttgcgtatcattgtcatccctttgtttgcgtggcttacgcttaaaggtgagacggaaaacaatgcttttgcctggtgggcgttggttgttttcattttgctcatgatcaccgacaagcttgacggcgatattgcgcgagcacgtggcctggtcactgactttggcaagatcgcggatccgattgccgataaggcgttgatgaccacagcatttgtctgtttcaacatcatcggcattttgccctggtgggtcactgcgttgattgtgcttcgagagttcggcattaccatctggcgtttcttccaactgcgcgctggaaatgttgtgcctgcatcaaaggggggcaagcttaagactgctctgcagactgttgccgttgctctgtatctgtgccctttcccaagttggatggatattccaagccagatcgtcatgtatgcagcgctgatcgtcaccgtggtcacgggtctgcagtacctgtgggattcacgaaagtccgcagaaagc

SEQ ID NO: 2155 - DNA, 285 bp, Corynebacterium glutamicum
atgacttattttgccgtgctttacacatacaacccagacagcgagaaagtcgctgaagttcgtaccgtccaccgcgagttcattgccaaccttcatgcggagggcaaaatcgttggctccggtcctttcgtggacggcgacggtggcgcgctgattgtcatcaagttggaagaaggctccaaccttgttgatgctgaaaccctgatgaacaatgatccattccacgtagaaaacgtgctggacaaccgcgtcatccgtagctggaaccctgtgaccaaagatttc

SEQ ID NO: 2156 - DNA, 117 bp, Corynebacterium glutamicum
ttggcgcttggcttgtatgaaagtcaggtgccttctcgcttgcctaaaccagcgttgctgcctaaaccagcgttgctgcctaaaccagcgttgctgcctaaaccagcgtcgtatggc

SEQ ID NO: 2157 - DNA, 813 bp, Corynebacterium glutamicum
atgcagaccaagctttgcaccaatgaacagcaggataagacccaagccataaggcaggtagaccaggcggtcaagcaggccgtcaagcaggaagtacatttggcgcagacccagcagggcgaatgcgttagtggtgaacacgatgtaaggctccgtggtgatgccgtaaatcgctgggatagagtccagtgcgaacatcaggtcaaccatgccgatggatacaagtgcaacgaacagtggggtcaggtgcagcttgcctccgaagcggtgagtgagcttgtcgccgtggtagccctcagtaaccggaatgaccttgcgcagcgccttaatgatgaacatgtcgttcgggtcggtctcaggggtgtctcgaacttcgtcccacaggagcttcacagcggtgtagatcagccagatggagaagatgtagaagacatcggaccaggcttcgataactgcagcacctgcgaggatgaatgccaggcggaagaccagtgccagcgcgataccgatgagcagaaccttctgctggtacttgcgaggaatcttgaaagaacccatgatcagcgcgaagatgaagaggttatcaacactcaacgccttctctgtcacgtaaccggtgaagaactcaatgccgtgctggtgtgggttacctggctcgccccaagcaaaccagaggaacacgccgaaaacacaggcgagggctacgtagaagaggctccaccatgcggattctttgatagtgggctcgtgtggggtgcggacgtgggaatagaaatcgaaaatgaagaagccagcaatcactgcgatagtgat

SEQ ID NO: 2158 - DNA, 1107 bp, Corynebacterium glutamicum
atggaagtaaacttagccacatggctaatcactatcgcagtgattgctggcttcttcattttcgatttctattcccacgtccgcaccccacacgagcccactatcaaagaatccgcatggtggagcctcttctacgtagccctcgcctgtgttttcggcgtgttcctctggtttgcttggggcgagccaggtaacccacaccagcacggcattgagttcttcaccggttacgtgacagagaaggcgttgagtgttgataacctcttcatcttcgcgctgatcatgggttctttcaagattcctcgcaagtaccagcagaaggttctgctcatcggtatcgcgctggcactggtcttccgcctggcattcatcctcgcaggtgctgcagttatcgaagcctggtccgatgtcttctacatcttctccatctggctgatctacaccgctgtgaagctcctgtgggacgaagttcgagacacccctgagaccgacccgaacgacatgttcatcattaaggcgctgcgcaaggtcattccggttactgagggctaccacggcgacaagctcactcaccgcttcggaggcaagctgcacctgaccccactgttcgttgcacttgtatccatcggcatggttgacctgatgttcgcactggactctatcccagcgatttacggcatcaccacggagccttacatcgtgttcaccactaacgcattcgccctgctgggtctgcgccaaatgtacttcctgcttgacggcctgcttgaccgcctggtctacctgccttatggcttgggtcttatcctgctgttcattggtgcaaagcttggtctgcatgcactgcacgaaaacaacctgccattcatcaacggtggtgaaaacgtctccgtacctgaggtttccaccgtgttctccttggtcttcatcattggtgtcctgacaatcaccgtcatcgcatccatcatcaagaacaaacgcgacgaaaaccagggcggtattccaccaaagtggaacgctgcaaagtatgagggcgacaactgggagaccggtgaggagcctgaaaccggatccgccaccgttaccgatatctcctcagagaagaag

SEQ ID NO: 2159 - DNA, 2763 bp, Corynebacterium glutamicum
atgacccgttccattggtgaacttggtcgtcgtcgaaacgaagatgtactcgacgattttgatgatttcgaggaggagatcgcaacgaaacccgccacacgaaaatcgcggagcaaggctgttgaacctgagccggaattcgatgaggattttgatgagcaatcaggaaaccgcacttctgcctacgtggaagagcacgcagacggcattgcattaagcctggttggaattgcaattgtcttgggcgctgcggtgtggctgggcattggtggaccgattggcacgttcatcgccgatatcgttcacctcgctattggcgctggtgcttggatcttgccggtcggcctcattgggtgggctgtcgcgctcatgcttcgttacactccagagcgtcaagctcagggcagggtgatgttgggcatcggtgtgatcatcgtgtgcatgctggccttgattcacctctttgctggtaacccagctgagtgggagggccgaaagactgctggcggtgccatcggtgcgtggattggaaccccgttggaactgggattctccgtgttcttggcggtgccgatcctgcttctgctgctgttctggggagcgttgaaaaccacgggaatttcgattcgtgagttcatcgaatttgcgggtggcttctttggcttcgcaggatttaaccgcgatgaagatgaattcgacgaggaagacgatgatctctacggacacgtggaacgcgagctggaatcccgcgcgagcggtcgtgcaccaagtagaacccctagccgagcgctgcctaaggctgcgccacgtcgcaccccacctctgactccgccaccggcaccagttcctgcgccagccccaacacctgcgcgccgcccagcggcctcgctggataagtatcccgtggatgacgcgaaggccgaggcccccgcggaaccgcaggtgaagcagagggaggcgtcgacaagcatcttgaagaagcccagcgtcaccgaaactgatgagttcccagcggtgaccgaggaagatctggcgccggcgccggcgtcggatgcggtggcagcgtcgagggaaagcatgcgtcaggcgattattgcgcgatcgggcaaggatcccgtcgtggagaagaagcctgcggcacctgctcctgtagcgccgacccctgccgacattgtcagcgatggcgacagcacttatgtgttgccgagtgccgatctgctgattccaggcgagccagcgaagcttcactcagagaccaacgatcgcatgatcgaggccattactgacgtgttcagtgagttcaatgttgatgcgaccgtgactggtttctcccgtggcccgacagtcacgcgctatgaaattgagctgggacctggtgtgaaggtttctaaaatcaccaacctgcaatccaatattgcctacgctgtggcgactgagaatgttcgtctgctgaccccaattccaggtaaatcagcagtcggtattgaggtgccaaactctgaccgtgagatggttcgcctgggtgatgtgctcaatgcgcgtgccaccgtggaaaacaaagactccatgctcattggtttgggtaaggatattgaaggcgacttcgtgtcctactccgtgcagaaaatgcctcaccttcttgtggctggttccaccggttctggtaagtcggcgttcgtgaactcgctgctggtgtcactgctcacgcgtgcaaagccagaagaagtccgtctgattctggtggacccaaagatggtggaactcacaccatacgagggcattccacacctgattacgccgatcattacccaaccaaagaaggccgcggcagcactgcagtggctggttgaggaaatggaacagcgctacatggacatgaaacaaacccgtgtgcgccacatcaaggacttcaaccgcaagattaaatctggcgaaattgagacccctccaggatccaagcgcgaataccgtgcgtacccatacatcgtgtgtgtggtcgacgagctcgctgacctgatgatgaccgcaccgaaggaaatcgaagagtccatcgtgcgcatcacccagaaggcacgtgccgccggtatccacctcgtgctggcaacgcagcgcccatccgtggacgttgtgaccggtctgatcaagaccaacgttccttcacgtttggctttcgcaacctcatcgctaactgactcccgcgttattttggaccagggtggcgctgaaaagctgatcggcatgggcgacgcgctgttcatcccacagggtgccggcaagccacaacgtatccagggtgcctttgtcaccgatgaagaaatccaagcggtcgtggacatggccaaggctcagcgccagcctgaatacaccgacggtgtcaccgaagataaggcttccgaagctaagaagatcgatgccgatatcggaaacgatctggaagatctcctcgaagcagtcgaactcgtggtgacctcacaaatgggatccacctccatgctgcagcgcaaactgcgcatcggttttgccaaggccggacgcctcatggacctcatggaaacccgcggtgtggtgggcccatccgaaggctctaaggctcgtgaagttttggtcaagccagaagagctggaaaccattttgtggatgcttaaaggtgcagaccccgccgacgcaccgaaggaagagacctgggatgacgaggtggcagcggaagctgaagaagcggctaacaccaccgtcgtgcaggctgatccttccaagggagtgtgt

SEQ ID NO: 2160 - DNA, 633 bp, Corynebacterium glutamicum
atgaatctcgcacaaacagaacgagcagcacttcaagcatcactgttggaaaaggggccagacgcaccaaccttgtgcggcgaatggaccaccaaagatcttgcggcacacctttatgtccgtgagcaaaagccaggagcagcgctgcgcagcatgcttcctggaaagcaggatcctgcaaaggaagagtttgaagaagcgcttacccgaccatatgaggatgttgtcaacgcgtgggctgaaggcccgcaggggctgaatccatggcgagcccttgactctattggcaatagcatggagcatttcatccatcatgaagatgtcctgcgtggcgcgttgcagccaggtgatgaggtagaagtacgccccatggagcacgcacatggcaaagagctgcaccgcattttaaaacttcttgctccacgcatgattaaatcaccgcgtccagtggttctagctccggtgggttttccgcggattgttcttcatgaaggtcggggagtgtcggccgatggtgaaaacgtctgtcggattagcggtggggtaggggagctgctgttgtggctgtctggccgtgatgttgtgaaactaacatttgaaggcaatcaagagggtgttgttcggggaagttta

SEQ ID NO: 2161 - DNA, 2154 bp, Corynebacterium glutamicum
atgaatgattcccgaaatcgcggccggaaggttacccgcaaggcgggcccaccagaagctggtcaggaaaaccatctggatacccctgtctttcaggcaccagatgcttcctctaaccagagcgctgtaaaagctgagaccgccggaaacgacaatcgggatgctgcgcaaggtgctcaaggatcccaagattctcagggttcccagaacgctcaaggttcccagaaccgcgagtccggaaacaacaaccgcaaccgttccaacaacaaccgtcgcggtggtcgtggacgtcgtggatccggaaacgccaatgagggcgcgaacaacaacagcggtaaccagaaccgtcagggcggaaaccgtggcaaccgcggtggcggacgccgaaacgttgttaagtcgatgcagggtgcggatctgacccagcgcctgccagagccaccaaaggcaccggcaaacggtctgcgtatttacgcacttggtggcatttccgaaatcggtcgcaacatgaccgtgtttgagtacaacaaccgtctgctcatcgtggactgtggtgtgctcttcccatcttcaggtgagccaggcgttgacctgattcttcctgacttcggcccaattgaggatcacctgcaccgcgtcgatgcattggtggttactcacggacacgaagaccacattggtgctattccctggctgctgaagctgcgcaacgatatcccaatcttggcatcccgtttcaccttggctctgattgcagctaagtgtaaggaacaccgtcagcgtccgaagctgatcgaggtcaacgagcagtccaatgaggaccgcggaccgttcaacattcgcttctgggctgttaaccactccatcccagactgccttggtcttgctatcaagactcctgctggtttggtcatccacaccggtgacatcaagctggatcagactcctcctgatggacgcccaactgacctgcctgcattgtcccgtttcggtgacgagggcgtggacttgatgctgtgtgactccaccaacgccaccacccctggtgtttctggatctgaagctgatgttgctccaaccctgaagcgtttggtcggcgatgctaagcagcgcgtcattttggcgtcgtttgcttccaacgtgtaccgcgttcaggcagctgtggatgctgccgttgcgtccaaccgtaaggttgcattcaacggtcgttccatgattcgcaacatggagattgcggagaagcttggttacctgaaggcacctcgcggaaccattatttccatggatgatgcttctcgtatggctcctcacaaggtcatgctgattaccactggtactcagggtgagcctatggctgcgctgtctcgcatggcgcgtcgtgagcaccgacagatcactgtccgtgatggagacttgattatcctttcttcctccctggttccaggtaacgaagaagcagtgttcggtgtcatcaacatgctggctcagatcggtgcaactgttgttaccggtcgcgacgccaaggtgcacacctcgggccacggctactccggagagctgttgttcttgtacaacgccgctcgtccgaagaacgctatgcctgtccacggcgagtggcgccacctgcgcgccaacaaggaactggctatctccactggtgttaaccgcgacaacgttgtgcttgcacaaaacggtgttgtggttgatatggtcaacggtcgcgcacaggttgttggtcagattccagttggtaacctttacgtcgacggtgtcaccatgggtgatattgacgcggacatccttgcagaccgtacctcgcttggtgagggtggcttgatctcgatcactgctgtcatcgacaaccgcactggccgtctgttggagcgcccaaccgttcagaccagcggtttctctgaggatgcaaagtccatgatgggtgaggtcactgagctgtccgaaaccaccatgaatgatcttgcagctgaaggtgaaaacgatccttaccgcatggttcagcagctgcgccgcaagctctctcgcttcgtcgagcagaagtggaagcgccagccggtcatcatgccaaccgtcattccgatgactgcggaaaccacgcacatcggtgacgatgaggttcgcgcttcacgcgagtccctg

SEQ ID NO: 2162 - DNA, 750 bp, Corynebacterium glutamicum
gtggccgaacaagttaaattgagcgtggagttgatagcgtgcagttcttttactccacccgctgatgttgagtggtcaactgatgttgagggcgcggaagcactcgtcgagtttgcgggtcgtgcctgctacgaaacttttgataagccgaaccctcgaactgcttccaatgctgcgtatctgcgccacatcatggaagtggggcacactgctttgcttgagcatgccaatgccacgatgtatatccgaggcatttctcggtccgcgacccatgaattggtccgacaccgccatttttccttctctcaactgtctcagcgtttcgtgcacagcggagaatcggaagtagtggtgcccactctcatcgatgaagatccgcagttgcgtgaacttttcatgcacgccatggatgagtctcggttcgctttcaatgagctgcttaatgcgctggaagaaaaacttggcgatgaaccgaatgcacttttaaggaaaaagcaggctcgtcaagcagctcgcgctgtgctgcccaacgctacagagtccagaatcgtggtgtctggaaacttccgcacctggaggcatttcattggcatgcgagccagtgaacatgcagacgtcgaaatccgcgaagtagcggtagaatgtttaagaaagctgcaggtagcagcgccaactgttttcggtgattttgagattgaaactttggcagacggatcgcaaatggcaacaagcccgtatgtcatggacttt

SEQ ID NO: 2163 - DNA, 699 bp, Corynebacterium glutamicum
atgagacttaagttgcccttcaccgcccgttccgcaggtagttccttggcgcttgtggtttccgcctctttacttttaagtgcttgtgatggaagcggctcaacgcctacaacctctgctagtcctgctccagttgtgacagaaactgaaaccgctaacccggtcaccacaactcgcacgccttcagatgctgccccgtcgcctaccacttcagagcccactggttcagagtccaccaactccccttcccccactgctttgccgccgttgggttccccgtcgatggatcagaagcagcaggctcaagttggtgactccgatatgtcgatcgctggcatccgcgttgccgagcacgaaacgttcacacgagttgtttttgatatcgccggtaatggccaacctggttggtgggtcgattgggccactgatccaattcagcaggcgtcaggtcttccagttgagatggctggtgattccttcctcaacgtcaatattcaaggcactggatatcctgatcaggttgtcgttccaggtatcgataccggatcatatcctggtgcaggcattgttgaagacatcaacttcaccagtatttttgaagcccgttcccaagttctcattggtgtatctggtcaaccccgaaattactcggtctcattgctgcaggaaccaaccaggcttgtggtggacatcgttcac

SEQ ID NO: 2164 - DNA, 264 bp, Corynebacterium glutamicum
gtgggggaaggggagttggtggactctgaaccagtgggctctgaagtggtaggcgacggggcagcatctgaaggcgtgcgagttgtggtgaccgggttagcggtttcagtttctgtcacaactggagcaggactagcagaggttgtaggcgttgagccgcttccatcacaagcacttaaaagtaaagaggcggaaaccacaagcgccaaggaactacctgcggaacgggcggtgaagggcaacttaagtctcatatttcaaaca

SEQ ID NO: 2165 - DNA, 2259 bp, Corynebacterium glutamicum
atgagcgatgtaaagtacttcgaagacaccgaatttggcctgatcgaggccgtcgcaaccatcgacaacggtgacttcggaacccgcaccatccgttttgaaaccggccaacttgcccgccaggcagatggtgcagtgaccacctacctcgacgatgacacgatgctgctggcaaccaccaccgcatccaaccagccacgcgagggctttgacttcttcccactgaccgtggacgttgaagagcgtatgtacgcagctggtcgcatccctggctctttcttccgtcgggagggtcgcccatccaccgaagctatcctggcttgccgtctcatcgaccgcccactgcgcccaacctttgttaagggcctgcgcaatgaggttcagatcgttgtcaccgtcatgtccatgaaccctgaggattactacgatgtcgtagcaatcaacggagcttccgcagcaacccgcatctccggacttcctgtctccggcgctgtcggtggcgttcgcatggcactggttgttgatgaaaagcacccagaaggccaatgggttgcattcccaacccacgctcaacatgagcagtccgtatttgaaatcgttgtggctggtcgcctcgtcgagcgcaagcgcggcaacaagaccttctccgacgtcgcagtgatgatggtggaagctggcgcttccgaaaacgttgtcaaccgcgtcaaggacggtgcaccagcaccaaccgaaaagatcgtctccgacggccttgaagcagctaagccattcatcgacatcctgtgccgcgcacaggaaggtctggcacagcgcgttggaaacgcagccaaggaattcccactgttccctccatacaccgacgaggtgtactccgcagtggagcgcaaggtatccaagaagctagcttctttgctgaccctgaaggcaaagcaagagcgcgacgacgctaccaacgcctacatggaagaaatcgaagccgaactgcttccaaagttcgaggcttcctacagctcagcagctgaagcgtccaaggaaatccgtgcaggatacaacgctgtcatgaaggccatcgtgcgccgcatgatcctcaccgatcacttccgcatcgacggccgcggagtcaccgacatccgtgacctggcagtagaagttgagctcatcccacgtgcgcacggttcctccctcttcgagcgtggcgagacccagatccttggtgtcaccaccctggacatgctcaagatggaacagcaaatcgactccctggcaccaggcgatgcgaagcgctacatgcaccactacaacttccctccatactccaccggtgaaaccggacgtgtgggctcaccaaagcgccgcgaaatcggccacggtgcacttgcagaacgcgcagttttgccagtaatcccatcccgtgaggaattcccatacgcaatccgtcaggtctctgaagctctgggctccaacggctccacctccatgggctctgtctgtgcatccactctgtccctgtacaacgctggtgttccactgaaggcacctgttgcaggtatcgccatgggacttgtttccggtgaaatcgacggcaagaccgagtacgttgcactgaccgacatcctcggcgcagaagacgcattcggcgacatggacttcaaggttgccggcaccgcagacttcatcaccgcacttcagctggacaccaagctggacggcattccttccaaggtgctctccgatgcgcttgagcaggcacgcgatgcccgactgaccatcctgaacaccatggctgatgtcatcaacggacctgatgagatgagcaagttcgctcctcgcatcaccaccgtgaagatcccagtggcaaagatcggtgagctgatcggaccaaagggtaagaacatcaacgctcttaccgaagagaccggcgcaaacatctccatcgaagatgacggcaccgtgttcatctctgcagctgacggcgcatctgctgaagcggcgatcgaaaagatcaacgctctggcgaacccacagctgccaaaggttggcgagcgcttcctcggaaccgtcgtcaagaccaccgcattcggagcattcgtttccttgctcccaggccgcgacggccttgttcacatctccaagctgggtaacggcaagcgagtagaaaaggtcgacgatgtggtgaaggttggcgagaagattcaggtcgaaatcgctgacatcgacaaccgcggcaagatctccttggtcccagttgttgaagaggac

SEQ ID NO: 2166 - DNA, 267 bp, Corynebacterium glutamicum
atggctcttacttctgagcagaagaagtccatcctttccgagttcggcctccacgagaccgacaccggttccccagaagcacagatcgcgcttctgaccaaccgcatcaacaacctcaccgagcacctcaagttccacaagcacgatcaccactcccgtcgtggtctgctgctgctcgttggtcgtcgtcgtggtctgctgaagtacctggctgacaacaacgttgatcgctaccgtgatctgatcgcacgcctcggcctgcgtcga

SEQ ID NO: 2167 - DNA, 948 bp, Corynebacterium glutamicum
atgagcaaaaaagccatccttgatatcgacaccggcatcgatgatgccctcgcacttgcctacgcactgggctcacctgaactagagctcattggtgtcaccaccacctacggtaacgtgctactcgaaaccggtgcagtcaatgacctggcactgcttgatctgttcggtgcaccagaagtacctgtgtacttgggtgagccacacgcacagaccaaggatggctttgaagttcttgagatctccgcgttcattcacggacaaaacggcatcggcgaagtcgagctgccagcaagcgagtcaaaggcactccccggcgcagtggatttcctcattgattccgtcaacacccacggcgatgacctggtgatcatcgcaactggtcccatgaccaacctgtctgcggcaatcgcaaaggatccaagctttgcttccaaggctcacgtggtcatcatgggtggcgccttgactgtcccaggcaacgtcagcacatgggcagaagcaaacatcaaccaggacccagatgcagcaaacgatctgttccgttccggtgcagatgtcaccatgatcggtcttgatgtcaccctgcagacccttcttaccaagaagcacactgcgcagtggcgcgaactgggcactccagctgctatcgcactggccgacatgactgattactacatcaaggcatatgagaccaccgcaccacacctgggcggttgcggcctgcacgacccactggcagtaggcgttgcagtggacccaagcctggtcactttgctccccatcaacctcaaggtagacattgagggcgagacccgtggacgcaccattggcgatgaagtccgcctcaacgatccagtgcgcacctcccgcgcagctgtcgccgtagacgtggatcgtttcctttctgaattcatgacccgcatcggccgagtcgcagcacagcag

SEQ ID NO: 2168 - DNA, 1023 bp, Corynebacterium glutamicum
gtggatatttggagtggactagacagcgttccggctgatcttcaaggatcagtagtcaccattggtgtgtttgatgggctccaccgggggcatcaaagtttaatcggcgaggccaagaagcaggccgaggagctgggtgtgccttgtgtcatggtgacctttgacccgcatccgatcgctgtgtttttgccaggtaaagagccaacccgtttggctcctttggattatcgccttaatttggctgcggaatgtggcgtcgatgctgcgttggttattgatttcactaaagaactcgcaggtctgagcgctgaagagtatttcacaaccatgatcgtggatacgctgcatgcgcgttcagttgtggtgggggagaacttcaccttcggtgtcaatggcgctggcactgagtccacgatgcgggaattgggacaaaagtttggcgtgaatgtcacgattgctccgctgctgcatgatgatgaccagcgtatttgctccaccttggtgcgcgattacttggatcagggcgaggttgagcgcgcgaactgggcgcttggtcgacgctatgccgtgcgcggcgaagttgtccgtggtgctggccgtggcggcaaagaattgggctatcccaccgcgaatctctacctgccgacctctgtggcgctgcccgccgatggcgtgtatgcaggctggttcaccatcaccgatgaccgcgaaatcgacaaggaaatctcccgcgatatcgacggcaccatggttccaggcgtgcgttaccaaactgccatttccgtgggcaccaatcccaccttcggcgatgagcgacgcagcgtcgaggcattcatcctcgaccaggaagccgacctgtacggtcaccatgtcatggtggaattcgtgggacacttgcgcgacatggtcaaattcaacggcgtcgacgagctactagacgccatggcccgagatgtcaccaacgcccgcgacatccttgccaaagacaaattgcttctcgacgccgacacccagcccagcgct

SEQ ID NO: 2169 - DNA, 891 bp, Corynebacterium glutamicum
atgaatgctcctgcccctaaacctggactcgtgatcgtcgacaagcccgccggaatgacatcccatgacgtggtgtccaaattgcgccgcgcattttccacccgcaaagtaggccacgcaggcaccctcgaccccatggcaaccggcgtgttagtcgtcggaattgagcgcggaacccgcttcctggcacacatggtggcctccaccaaagcctacgacgccaccattcgactcggcgccgccaccagcaccgatgatgcagaaggcgaggttatctccacaacagacgcatccggcctcgaccacagcaccatccttgctgaaatcgtcaacctcaccggcgacatcatgcaaaaacccaccaaagtctccgccatcaaaatcgacggcaaacgcgcccacgaacgcgtccgcgacggcgaagaagtagacattcccgcacgtcccgtcaccgtcagcgtctttgacgtgctcgactaccacgtcgacggtgaattttatgacttagatgtgcgcgtccactgctcctccggcacctacatccgcgcgctcgcccgcgacctcggcaacgctttgcaggtcggcggccacctgaccgcgcttaggcgcacagaggtcggcccttttacgcttaacgacgcgacccccctctccaaactccaagagaatccagaactctccctcaacctcgaccaggcactcacccgcagttacccagtccttgacatcaccgaagacgaaggcgttgacctgtccatgggcaaatggttggaacctcgcggactgaaaggcgtccacgctgcagtaacaccatcaggaaaagccgtggcgctcatcgaagaaaagggcaaacgcctggccaccgtgtttgttgctcaccccaacactctt

SEQ ID NO: 2170 - DNA, 228 bp, Corynebacterium glutamicum
ttggtggaggccaccatgtgtgccaggaagcgggttccgcgctcaattccgacgactaacacgccggttgccatggggtcgagggtgcctgcgtggcctactttgcgggtggaaaatgcgcggcgcaatttggacaccacgtcatgggatgtcattccggcgggcttgtcgacgatcacgagtccaggtttaggggcaggagcattcatgtctgttgagtctatgccg

SEQ ID NO: 2171 - DNA, 651 bp, Corynebacterium glutamicum
atgctggatgagtctttgtttccaaattcggcaaagttttctttcattaaaactggcgatgctgttaatttagaccatttccatcagttgcatccgttggaaaaggcactggtagcgcactcggttgatattagaaaagcagagtttggagatgccaggtggtgtgcacatcaggcactccaagctttgggacgagatagcggtgatcccattttgcgtggggaacgaggaatgccattgtggccttcttcggtgtctggttcattgacccacactgacggattccgagctgctgttgtggcgccacgattgttggtgcgttctatgggattggatgccgaacctgcggagccgttgcccaaggatgttttgggttcaatcgctcgggtgggggagattcctcaacttaagcgcttggaggaacaaggtgtgcactgcgcggatcgcctgctgttttgtgccaaggaagcaacatacaaagcgtggttcccgctgacgcataggtggcttggttttgaacaagctgagatcgacttgcgtgatgatggcacttttgtgtcctatttgctggttcgaccaactccagtgccgtttatttcaggtaaatgggtactgcgtgatggttatgtcatagctgcgactgcagtgact

SEQ ID NO: 2172 - DNA, 804 bp, Corynebacterium glutamicum
gtgaccacaactctgtgggcggtttctgacctccatgcagcggtgaaagctaacgctgatccaattgagaatattcagcctaaggatccgtctgactggttgattgttgcaggtgacgtggcggaacgtaccgaattggtgctggaaattttggcacgtttgcgcaggcgctttgccaaggtgatctgggttccgggtaaccatgagttgttttctcgctccgcggaccgctatcaggggcgcgataagtactctgaactcgttgaaggctgccgcaagattgatgtgttgactccggaggacccttacttaacctttggtggggttactatcgttccgttgtttacactctatgactactcgttccgtcgacctggtttcaccgtggagcaggctgtgcaagcggcgcgggatcgtcaagtgatgatgactgatgagttttctattgcgccttttgttgatatccgagcgtggtgctgggatcgcttagcctattccattaagcgtttgagcaagatcaacgggccaacaattttgattaaccactggccgctggtggtggaaccgacttatcagatgcgctggcaggaacttgcattgtggtgcggtactcgccacaccaggggatgggccgaacgctacaacgcggaagccgttatttacggtcatctgcatatgcccggaataaccaacgtcaacggtgtgaaacacattgaagtgtcgttgggttatccgcgcgaatgggagcattggtctgggcagcatgtgtggccatatccagtgatggaggtggacaatgctgga

SEQ ID NO: 2173 - DNA, 1305 bp, Corynebacterium glutamicum
atgtctaacaacgactttgagcatgagtcccatgatgtttctgcaaagcagatcttcgggctcgcgttccccgcactgggtgttctagctgcgatgccgctgtatctcttgttggatacagcggttgttggcactttgggtggcttcgaattggctgcgttgggcgcagcaacaacaattcaagctcaagtgacaacacagctgacattcttgtcctatggaactaccgcgagatcatcgagaattttcggaatgggtgatcgccggggagcaattgccgaaggtgtgcaagcaacctgggtggcactctttgtaggcttgggcatcttaacgctgatgctcattggagccccgactttcgcgttgtggctcagtggtgatgaagctctagcccaagaagcagggcattggctccgggtcgctgcttttgcggtgccactaattctcatgatcatggctggcaacggttggttaagaggtattcaaaacaccaagctgccactctatttcaccttggcgggagtcatccccggcgcgatcttgattccgatattcgtggctaagtttggacttgtgggctctgcctgggcaaacctcattgcagaagcaattactgcttcgctgtttttgggtgcattgatcaagcaccacgaaggttcgtggaagccgagctggacggtgatgaaaaatcagttggttcttggacgtgatttgatcatgcggtcaatgtcgttccaggttgcttttctttccgcggccgctgtggctgcacgatttggcacggcatccttggcggcccaccaggtgttgcttcagctgtggaatttcatcacattggtgctggattctctagctatcgcggcgcagaccttaactggtgcagccctgggcgctggaactgcgaaggtcgcccgcagggtgggtaatcaggtgattaagtactctctgattttcgctggtggcttaggtttggtgttcgtggtcttacactcgtggattccgcgtattttcactcaggacgccgacgttttagatgcgattgcttccccgtggtggatcatggtcgcgatgatcattttgggtggcattgtctttgctattgatggtgtgctgttgggtgctgctgacgcggtgttcctccgaaatgcctctatcttggcggttgtggtcggattcttaccaggcgtctggatttcctatgcattagatgcagggctgacaggcgtgtggtgtggtttgctggcgtttattctgatccgactatttgcggtgatttggcggtttaagtctatgaagtgggcgcgt

SEQ ID NO: 2174 - DNA, 996 bp, Corynebacterium glutamicum
gtgacggataatagtcagtttcatgctgcttcagcattagtccaggcagctcacacggttagcgttgtggggcatctgcgacccgatgctgatgcaatcggcagtgtagctgccacagtggcggcactacagcaacttggtaaagacgccgtaggtgcaatcggccagctagattcgatgcccgagaacttgtacaccattcctggggcatcaaacattaagtttggcgattcactgccggaatctgacctcatcattgttgttgattgtgggtcaatcgaacgcaccggtgcgtttgaaagcatcatcgtcaacaatcctgacaaagtattggtggttgatcaccacgccaccaatcctgggtttggtgccgtcaacttaatcgatgtggaggcagaatccaccaccacgattttatatgactggtttgatgcgatgtcggtgcaaattactcccgatatcgcccacggcctttatgctggactgctcaccgataccgggtgcttcaggtggggtcgaccagtcatgcatgacatggctaaagaactcatggagttcggtctagacattcgtgccatttcatcagcattgcttgatcaaacctccgtggatgatttgcgtcttgttggccagattgtctctcggatcgagctgcgggaagcagggccatatactcttgctgttctcgtggcagacttcgataccatcaacggccgttcacgcgccgttgtggaaggcttgatcgaaatggttcgcgctgtggaaggcgcagacttcggagcagtattcaaagaatatgaacgtggcgtctataccgtgtcactgcgttcctccaatttgagtgtcgcttccttggcagtgcatcttggcggtggcggacacattcctgctgcaggctataccgctcgtggtacggaaatcgaagccctcgatacgttgattgaagcaaccgttaccttgggggagtctttgcgaagctcggcgcatgtcgatgtc

SEQ ID NO: 2175 - DNA, 447 bp, Corynebacterium glutamicum
atggctgacaacgcccgcgcggctcgtatggcaaagcgcattcaaactatcgtggccagcgccattgaacgcgatatcaaggaccgccgacttgagttcgtcacaattactgatgtgaccatgaccggtgacctgcacgatgcaaaggtgttttacaccgttcgtggagcttccattgaagaagaaccagatcttgaggcagcagcagaggctcttcaccgagcacgcggccagctgaggaagatcgttggccagcagctgggtgttcggtttaccccgaccctgacttacagcatcgataccgtcccagaggcatccgcacacatggaagctttgttggatcgtgctcgcaagcgcgatgaggagctggctaaattgcgcgaaggtgcagcgcctgcaggtgatgcagatccttacaagacttcatccaagtctgaatctgaggaa

SEQ ID NO: 2176 - DNA, 3012 bp, Corynebacterium glutamicum
gtgcccggaaagctacgtgtacatgagcttgctaagcaactcggtattaccagcaaggaactacttgccacccttaaggataaaggcgagtttgttaaaaccgcatcatccacaattgaacccccagttgtgaagaggatgcaggagcactacggttcgagcggttcggataagtccgacaccgctgcgaagcctgcagcggcaaagcctgctgcgccaaaaccagctgcgtcagcagctccaaagccaggtgctccagcaaaacctgcagcacctgcagcaaagcctgccccagctgctccttctgcagcttctgcagcaaagccaggcgcagcacctaagccaggcgttcaggcaaagcctgcagcagccgctaagccaggcgctccagcaaagccagcagcacctgcagctccttctgccgctaagtcaggttcagctccaaagcctgcagcagcagctaagccagcattttctggcccaactccaggcgatgcagctaagaaggcagagccagcagctaagccaggcgcggaagcacctcgcccaggcggcatgccacgtccaatgggcaagcctgctccaaagccaggcgcacgtgcaccacgtgtagctaacaacccattctccaccggtggtggcgagcgtccagctcctcgcccaggtggcggcccacgtcctggtggcggacctcgcccaggcggtggaccacgtccacagggccagggtcgtccaggtggccagcgagatggtcagcgcgacggacagcgtgatggtcagggtaaccgcggcggtcagcgtcaaggcgctggcgcaggtggaccacgcccacagggtggaccacgccctcagggcggttcacgcccacagggtggctccgctcagggtgctcagggagcaccttcccaggagcgtcaaggtggcggacgtcgtccatccccagcaatgatgcctccaaccccaggtcagatgcctgctaaggcacctggcaagggtggtcgtggtggccaagccggcggtggcgctggtggcggattcaaccgtggtggcggaaccggtggcggcgcaggccgtggcggtcgtcgtggcggtaccgcaggtgcattcggccgtccaggtggtgctccacgcaggggacgtaagtcgaagcgtcagaagcgcaacgagtacgaatcaatgcaggcaccgaacgtcattggtggcgttcgtttgccagacggcaagggtgcaaccatccgcctcgcgcgcggtgcatctttggctgacttcgctgacaagatcggcgcagacgcagcagcattggttcaggctctgttcaacttgggtgaaatggtcaccgcaactgcatcggtttctgatgaaaccttgcagctgctcggtgaggaaatgaactacaaggttcaggttgtttccccagaagatgaagaccgtgagctgctcgaaagcttcgaccttcagttcggtgaggacgaaggtggcgaggctgaccttgctaagcgtcctccagtggttaccgtcatgggtcacgttgaccacggtaagactcgtttgctggatactatccgtaaggcaaatgtgggctccgacgaagccggcggcattacccagggcattggtgcataccaggtcaaggtaaatgtcgaggacactgagcgcacgatcaccttcctggataccccaggtcacgaggccttcaccgcaatgcgtgcccgtggtgcaaagtccacagatatcgcggttctggttgttgcagcagacgacggcgttatgcctcagactgtggaagcaatcaaccacgctaaggctgcagatgtaccaatcgtggttgcagtgaacaagattgataagccagaagcttctccagagaagatccgtggtcagctgaccgaatacggattgatccctgaagagtacggtggcgacaccatcttcgttgacatctctgcaaagcagggactgaacatcgatgagctgctcgcttctgtctgcctgaccgcagacgctgagcttgaccttgttgctaacccagaaatggacgcacagggtgttgcaattgaagctcacctcgaccgtggtcgtggaccagtggcaaccgttatcgtccagcgcggtaccctgcgcgtcggtgactccatcgttgcaggcgatacctacggacgtgttcgccgcatggtggacgaatacggacgcgacgttgaagaggccggaccttcccgtcctgttcaggttcagggtcttaacggtgtcccaggcgccggcgacaaccttctggttgttgaagatgaccgcattgcacgtcagattgctaaccagcgcaacgcccgcaagcgtaacgctctggcagcacgctcccgtaagcgcgtctccctcgaggatctggattcagttcttaaggaacatagcacccttaacctcattcttaagggcgacaacgcaggttccgtggaagcactggaagaagcattgctaaagattgagatggacgatgaagtccagctcaacatcatcgaccgcggtgtgggtgcagttacccagaccaacgtcacccttgcagctgcatccgacgctgtcatcatcgccttcaacgttcgcgctgaaggtaaggcaactgaggaagcaaacgcagaaggcgtcgatgttcgttactacacgatcatctaccgtgctatcgaagaggtcgaggcggccctcaagggcatgctcaagccaatctacgaagagcgcgttatcggacatgctgagatccgtgcgatcttcaaggcttcctctgtcggcctcatcgcaggttgcatggttgaagacggcaaggtgcgccgaaacgccacagtccgcattattcgcgacggcaacgtcatcgccgagaatgcaaagatcgtgtcccttcgccgtgagaaggacgatgccaccgaagtctctgcaggctacgagtgcggtatggttctgtcttacccagacatctccgtcgacgacaagatcgaggtctacgaaatggttgaggttccacgcgaagct

SEQ ID NO: 2177 - DNA, 336 bp, Corynebacterium glutamicum
atgttccatgacgatgcattaaaagcttcatctggacaactgtctcgcttcaacccaattcggatccgtacttgcattgccaccagggaacgtaaacctgattctgaactgctccgcgtagttcaatccccggagcttccgggagttatccttccagatccgaaacgtcggatgcctggcaggggagcatggttgaccccttccatcgacgcactggaccttgctgaacagcgtcgcgcctttggccgagcgctgagggtgtccacaaccgtggatacaggtcacgtacgcacgtacctggcggaaaacgccggacccgatttttgtaaggaagac

SEQ ID NO: 2178 - DNA, 996 bp, Corynebacterium glutamicum
gtgaatattgatgtccaggctttaaaagccatcgagtctgaaaaaggaatcccagttccagacttgctgcgcaccatcgcctctgcacttttgcattcgtacatggataatcgcgaaactgttgcgtctgcgaacctgaaaccacgcgtggacatcgattccacaactggcacggtcaacgtcatcgtctcagaattcgacgaaaacggagagctcgcttccgaatacgacgacaccccatccaacttcggacgagtcagcgcccgcgctgttcgcgacgcgatcgttaagtccctgcgcgaagcagaagcaagccgagcattcgatgcgtacgcagattatgaaggcaccgttgtgtccggcatcgttcaagcagatgcccgcgcagctgaacgcggaatcatcatcgtgcagctgggtaccgaagcggacaaccaagacggcgttttgctcccagccgagcagatccctggcgaaaagctcaagcacggcgaccgcgtcaagtgcttcgtcgttggcgtgggcaagggcaacactgacatccagatcaacctgtctcgtactcaccctgagctggtgcgccgactgtttgaactggaaatcccagaagttgctgacggatccgtggaaattgttgctatctcccgcgaagccggacaccgctccaaggttgctgttcaagccaaggtgaagaacctcaacgccaagggcgcttgcattggcccacgtggacagcgtgtgtccaacatcatgcgtgaactcggtggagaaaaaatcgacatcatcgattactccgaagatccagcaaccttcgttggaaatgcactggcaccatccaaggttgtcaacgtagaggtcaccgatcttgaagctcaaaccgcgcgcgtaactgtccctgactaccagctttcactagcaatcggtaaagaaggtcaaaacgcccgcttggctgcccgcctgaccggctggaagatcgacatccactctgacatcgat

SEQ ID NO: 2179 - DNA, 1254 bp, Corynebacterium glutamicum
gtgagtttcggcgtcgttaagcgccccgatgcgtgctacgcgctttttgccatcctgatcaagcgcaaccaggcgaccgcggtttctgcgccaatggcgcggcagcgtcagtgggttgtccacgcccggcgtggacacttcgagcgtgtaacccgctccgaagttgagctctccgcgctgctcggcggcgtcgaaaagctctccgatttcttggctgaatacttccagctggtcgagatcggggcgggaatccgaatctaccttgatggcgacggcggattttggacctgctttggtcactttcaggccctcgaggtcgaatttgtgggatgcggcgagcggctcgatgagcgcagacagaatttcagtggttggaaaagccataaagacaaggataacctgccggcaaaaatcatcgggctattacactgtgaagccatgcgtaggcgtatcccctctgtccttggtgtttctcttctggctgcctttttggtggcgtgcaccccctcccccaatccgaatgcggcgttggcccagatgtatcaggatgcgctttttgattcccaggcgatgtcagaggccgagcctgagcttgccactttgcgcagtcagcacgcagatgaattattggccgagattcggcgtatttgtggctttgatgaaggccaggttccggaatcgtgccaggtaacggttcctgcgatcgctattctgcccaccgatgatccagagaagtatgtcaacgacagtcaggcgttgatccttgataatttggatgacattccggaagattccgtggctttagtggttgagcaatacatcgcgcaggcggaatttgctgaaggatctgaggtgtccgttcctgttgatttggagctcaccgaggcagaattagctgctgcgaaggacttggcggaccgcgagttttccgccgcgtggtctttgggcgtggctttggctcagcttccggaaaccgaccgcgaggaggtggaaacggcgatcagcaaccaccatgaccgcgcgtcgcagctgcaaattattacctccggcactaccccagcgccaggttacgtgagcgagctgcccgaccccaccgacgagacttcagcgcgaagcaacattgaaaccgtcgaaaacaacgtcacccaggcctggcatgcagctgcaagcgccgcaaccaccgacgcctggcgtgtcttctgcgcgcacatcgccggcgataccgcacgcgaattaacgcttatcgacgtctcc

SEQ ID NO: 2180 - DNA, 534 bp, Corynebacterium glutamicum
atggcttttccaaccactgaaattctgtctgcgctcatcgagccgctcgccgcatcccacaaattcgacctcgagggcctgaaagtgaccaaagcaggtccaaaatccgccgtcgccatcaaggtagattcggattcccgccccgatctcgaccagctggaagtattcagccaagaaatcggagagcttttcgacgccgccgagcagcgcggagagctcaacttcggagcgggttacacgctcgaagtgtccacgccgggcgtggacaacccactgacgctgccgcgccattggcgcagaaaccgcggtcgcctggttgcgcttgatcaggatggcaaaaagcgcgtagcacgcatcggggcgcttaacgacgccgaaactcacgttgttttgatcgagcggaataaaaagttgctcgaggtcacaacccttgaattagcacattcccctcgagcagtggtagaaattgaattcgctaaacctgcgcaggatgagactgccctcgcagaaagcacattcgacgaagccaccgcg

SEQ ID NO: 2181 - DNA, 1602 bp, Corynebacterium glutamicum
atgactttgaagaagtctctcgctgtaaccacggcggctgcacttgctttgagccttgccgcttgctcgtccgactcctcgtccgacagctcctcatcctcatcaggcagcgaaggcggcgacaactacgtcctcgtcaacggcactgagccacagaacccgctcgtcccaggcaacaccaacgaagtaggtggcggtcgcatcgtcgacagcatcttctccggcctggtctactacgacgtcgacggctcccctgtcaacgatgttgcagagtccatcgaactcgaaggtgacaagacctaccgcatcaccatcaaagacggccagaccttcaccgatggcaccccagttaccgctgagagctttgtcaacgcatggaactacaacgtagctaacagcacgctgtcctcctacttctttgagtccatcctcggctacgaagaaggcgtcgagtccatggaaggcctccaggtcgtcgacgacaccaccttcaccgtcgagctcacccagcctgagtccgacttcccactgcgcctgggatactccgcattcttcccgcttcctgaatccgcatttgacgacatggacgcattcggtgagaacccaatcggcaacggtccatacaagctccaagagtggaaccacaaccaggacgccaccatcgttcctaacgcggactacaccggtggacgccaggctcagaacgacggcgtgaagttcatcttctacccaaccttcgactccgcttacgcggacctgctctccgacaacttggatgtgctggacgctatcccagactccgcgttctcctccttcgaggacgagctctctggccgttccatcaaccagccttccgctgtgttccagtccttcaccatcccggagagccttgagcacttctccggcgaagaaggcgtgctgcgtcgccaggccatctccttggccgtcaaccgcgacgagatcacccaaaccatcttcgaaggcacccgcaccccagcgacggacttcacctcccctgtcatcgacggacactctgattccctccagggcgcagatgtcttgacctacgatccagagcgcgctcaggaactgtgggcacaggcagacgagatcagcccttggtccggcgagttctccatctcctacaacgcagacggtggacaccaggcatgggtggacgcaaccgccaattccatccgcaacaccctgggtatcgacgccatcggcaacccatacccagacttcaagtccctgcgtgacgatgtcaccaaccgcaccatcaacggcgcattccgcaccggctggcaggcagactacccgtccttgggcaacttcctcggacctttgtacggcaccggtgcaggctccaacgatggtgactactccaacccagatttcgatgccaagctcgccgaagcagcaaacgcggccgatgttgacgcatcaaccccgctatacaacgaagcacaggaaatcctgctccaggatctcccagcgatcccaacttggtactccaacgcagttggtggatactccaccaacgtggacaacgtggaattccagtggaactcgcaacctgcgtactaccagatcaccaagaac

SEQ ID NO: 2182 - DNA, 924 bp, Corynebacterium glutamicum
atgcttcgttacgtcgggcgacgtttgctccaaatgattccggtctttttcggagcgaccttactgatttacgccctcgtgttcctcatgcctggtgacccagtccaggcattgggaggtgaccgcggcctaaccgaggctgcggccgagaaaatccgtcaagaatacaatcttgataaacccttcatcgttcaatacctcctgtacatcaagggcatcttcgtcttagattttggaacaaccttctctggtcagccagttattgatgtgatggccagggccttccccgtcaccatcaaactcgccatcatggccctgctgtttgaatcaatcctcggcattatctttggtgtcatcgcaggtattcgccgcggaggaatcttcgactccaccgtgctggtcctttctctgatagtcatcgcagtccccaccttcgtcattggtttcgtgctgcagttcttagtcggcgtgaaatggggcttactgcccgtcaccgtaggttccaacacatcaataacggcgctgatcatgccggctgtcgtactgggtgcagtatcgttcgcctacgttcttcgcctcaccagacaatccgtgagcgaaaacctccgcgctgattacgttcgaaccgctcgagcaaaaggcatgtccggattcaacgtgatgaaccgccatgtgcttcgaaactcactgattcccgttgccaccttcctgggcgccgatctcggtgcactgatgggtggagcgattgtcaccgaaggtatcttcggcatcaacggtgtcggtggaacgctctaccaggccattttgaaaggtgaacccaccacggttgtctccattgtcactgtgctggtcatcgtctacatcatcgccaaccttctcgtggacttgatctacgccgttctcgatccgaggatccgctatgcc

SEQ ID NO: 2183 - DNA, 999 bp, Corynebacterium glutamicum
ttgggccaagatgatcaaaccccagatcaggctcatttcttcccacaaggacgaggcgaggctctagttcgaccaggtcaagagcacttcatcgcagccactgatgaaaccggacttggtgccgtcgatgctgttgctgatgactctgcaccaacctccatgtggggcgaagcgtggcgagaccttcgtcgtcgaccactgttctgggtctctgcggtgttgattattttggcgcttctcctggccgcagttccgcagctgtttacctcaacggatccccagttctgtgtgctggcaaactctcttgatggtccacagtctggacatcccttcggattcgaccgtcaaggttgcgatatttttgctcgtaccgtctacggtgctcgtgcctcggtcgccgtcggtgtgttgaccacgttactggtcgccctcatcggtactgtatttggtgctttggctggcttctttggtggcatcatggataccatcctctcccgcatcaccgacatgttcttcgccattccactggttctggcagccatcgttgtgatgcagatgttcaaggaacaccgcaccatcgtcaccgtggttttggtgcttgggcttttcggctggaccaacattgcgcgtattacccgtggagcggtgatgaccgcaaagaatgaagagtatgtcacctccgcacgtgcgcttggtgcatcaaaagccaagatactgctgtctcacatcatgccaaacgccgcagcacccatcattgtgtatgcaactgtggcactgggaacattcatcgtggcagaggcgacgctctccttcctgggcattggccttccaccatcaattgtctcctggggtgctgatatcgcgaaggcacaaacctcccttcgtacccaacccatggtgctgttctaccccgcaatggcacttgcactaaccgttttgagcttcatcatgatgggcgatgtcgtccgcgacgctctggatcctaagtcgaggaagcga

SEQ ID NO: 2184 - DNA, 1731 bp, Corynebacterium glutamicum
atgaccaccaacatcccacaaacccccaaccacgagggtgaacagccactgctcgagctgaaggatctaaagatttccttcacctcctccaccggtgttgtcgacgctgtccgtggcgcaaacctcaccatttatcctggccaatctgttgccatcgtgggtgaatccggttcaggtaaatcgaccacggcaatgtcgatcatcggtctgcttccaggcaccggcaaagtgaccgaaggttccatcatgtttgatggccaagacatcacaggcttgagtaacaagcagatggaaaagtaccgcggttcagaaatcggactggtcccccaggatccgatgaccaacttgaacccggtgtggcgcatcggcacccaggtcaaggaatccctccgagccaaccacgtggttccaggctcagagatggacaagcgcgtggcagaagttctggccgaggcaggtcttcctgatgctgagcgtcgcgcaaagcagtacccacatgagttctctggcggtatgcgccagcgcgcactgatcgccattggtttggcggcacgcccgaagctcttgatcgccgacgagcccacctctgcgctggatgtcaccgtgcagcgccaaatccttgatcaccttgaaacactgaccaaggatctcggcaccgcagtgctatttattacccacgacttgggccttgccgctgagcgcgcggagcacctcgtggtgatgcaccgcggacgcatcgtggagtccgggccatcattgaagattctgcgcaatccacagcacccatatacccaacgcttggttaaggctgcgccgtctctggcttctgcacgtattcaaagtgcgcaggaacaaggcattgaatctgcagaactgctctctgcaacggccgttgctgagggcactattccagagatggaagaaaaagttatcgaggtgaaaaacctcacccgcgaatttgatatccgcggtgcccgtggcgataagaagaagctgaaggccgttgatgatgtgtccttcttcgtacgtaaaggcaccaccaccgcacttgtgggtgaatccggttcgggtaaatccaccgtggccaacatggtgctcaaccttctcgagccaaccagcggagaggtgctctacaacggcaccgatcttacgtccttgagccacaaggaaatcttccaaatgcgacgcaaactgcaggtggtgttccagaacccctacggctcgcttgatccgatgtactccatctaccggtgtattgaggaaccgctgaccatccacaaggttggtggagaccgcaaggcacgcgaagctcgcgtcgctgaacttctcgatatggtgtccatgcccaggtccaccatgcgccgctaccccaacgagctttccggtggccaacgtcagcgcatcgccatcgcccgtgcattggcactgaatccagaagtgatcgtgttggatgaagcggtttccgctttggacgtgttggttcagaaccagatcctcaccctgcttgcagaacttcagcaggaactgaagctcacctatttgttcatcacccacgacttggccgttgttcgacaaaccgccgacgatgttgtggtgatgcaaaagggacgaatcgttgaaaagggtcgtaccgacgacatcttcaacgatcctcagcagcactacacccgcgatttgatcaatgcggtacctggtctgggaatcgagttgggtactggagaaaacctggtt

SEQ ID NO: 2185 - DNA, 1764 bp, Corynebacterium glutamicum
atgatcacacgtctttccacgctgtttttgcgcaccctgcgcgaagaccctgcagatgcagaagttccaagccacaagctgcttgtccgtgcaggatatatccgccgagttgccccaggtatctactcctggttgccactgggtttgcgcgcagtgcgcaacattgaagctgtcgtacgcgaggaaatggatgcgatcggaggacaggagctgctcttcccagcactcctgccacgtgagccttatgaaaccacacagcgttggacagaatacggcgattcgctgttccgtctgaaggaccgcaagggtgccgactacctgctcggaccaacccacgaggaaatgttcgccgccacggtgaaggatctgtacaactcctacaaggacttcccagtcaccttgtaccagatccagaccaagtaccgcgatgaggaacgcccacgcgcaggcgtgctccgcggacgcgaatttgtgatgaaggattcttactccttcgacatctcggatgctggtttggacgagtcctacgcaaagcaccgcgcagcgtatcagcgcatctttgaccgccttggcttggaatacgccatctgccaggcaacctctggtgccatgggcggatccgcttccgaggaattccttgcagtatctgaaaacggcgaagataccttcgtgcgctctacctccggcaattacgccgcaaacgtggaagctgttgttacccagccaggcgttgagcgtgacatcgaaggcctgccagaagcagtcacctacgaaactcctgtttctgaaaccatcgatgctttggttgattgggctaactccatcgacgtgcagatcgagggccgcgaggtcaccgcagctgacaccctcaagtgcatcgtggtgaaggtccgcgagccaggtgccgaagaagcagaactcactggaatcttgcttccaggtgaccgcgaagtagacatgaagcgcctcgaggcatcacttgagccagcagaagttgaactcgcagtggaatccgactttgccgacaacccattcctggtcaagggctacgtcggaccagttggcctggccaagaacggcgtgaaggtccttgccgatcctcgcgttgtcaccggtacctcctggatcaccggcgccgatgaaaaggaacgccacgtcgtaggcctcgtcgccggacgcgatttcaccccagacggcttcatcgaagctgcagaaatcaaggaaggcgacccagcgccagcaggcgagggcaccctcacccttgctcgcggcatcgaaattggccatatcttccagctcggccgcaagtacaccgaagccttcgacgtccaaatcctggacgaaaacggcaagcgcgccatcccaaccatgggctcctacggcctcggtgtcacccgcctgctcgccgtcctggcagaacagcgccacgatgacgctggcctcaactggtccgtcgaagtcgctccgtaccaggtccatgtcgtcgcagctaacaaagacgccgcagccatcgaggcagcagagcgctttgcggctgagctgtctgccgcaggcttggacgtgcttttcgacgaccgacccaaggttagccctggcgtaaagttcaaagacgccgaacttcttggcatgccattcgccttgattcttggccgtggctacgccgaaggcaaggttgaactccgtgtccgcggtggcgagaagtccgaactcgacgcagatcaggctgtcgcccagatcgtcgagatggttgctcaagcccgcaac

SEQ ID NO: 2186 - DNA, 735 bp, Corynebacterium glutamicum
atgcttattgtgttgcctccctcagaaactaagacccacggcggttcaggaaaacctctggattttcaccatttgagtttcccgtcgctcaccaaggcacgccaaacaatactcgctgacctgcaagctttggaggtagatgaggcgctgaaagttttgggcatttctgaaaagctccgccctgaggccgaatccaatcgcgcgctggagaccagccctacgatgcctgcgatttttcggtattccggagtgctttatgatgcgctcgacgctgcaacgctgccggagaaagcactggaacgcctcgccatcggctcggcacttttcggcgtcatccacgccaccgatccgatcccgcattaccgcctgtccggcggcacaaaactgcccaccaaaagcggcgagctgcccaccatgaaggcgcgttggggcacaagcatcagcgaagcgcttatcgacgtcaaccagctggtgattgatcttcgcagcgggacctaccaacagttgggtcgcgtaaaagacgccgtcacggtacgcgtggaatcagtcatggaggatggctcccgcaaagtagtcagccactttaacaaacactacaaaggtgaactcgcccgcgtgctcgcgctctctgaaaaagaagcacacaacgcagaggacgtaatgagcattgcgcaggctgcgggccttgtggtggaggaaaaccccaaccacaaggaaaccctcactctggttgtc

SEQ ID NO: 2187 - DNA, 759 bp, Corynebacterium glutamicum
ttgcgcctggcgtccatgggggaggaggactccaccccaggtaggcgttccaaggcgtattcgcgccagggcgctgatgtccgccccatgaagggtggacacggcatcaacttagtgggcacgctcatggcggctacggaacgcggcgccaacattgttgaaggcgtggtcgatttccggcccacggacctgcggggttcgctgcgccgtgggcgcgaagccaacctcatcgtgttcgtcgtcgacacatcggggtcgatggctgcgcgttccagggtgcgtgcggtcaccgggactattacctctatgcttaacgacgcctaccagcgccgcgacaaggttgcggttatcgcggtcaacggcaacaagccgacactggtgttgaatccaacaaattctgtggagcaagctcagcagaaattaaaggatatgccgatgggtggtcgcactccactggcagaggggctgctcatggccaaggatctcatggcaagggaactccgaaaggaacccggccgacgcgcgatcctcatggtgatgaccgatggccaagacacctccgatgccggcgaagcaggcattgccaccgcggcggaaacagtggtgaaatcacgactgtccggcaacgtggtcatcgactgcgaaggccgactcaaagtgcgcaaagagcgcgccggggtgttggctgaaatgctcggtggtgtgtgcgtgagattgcgtgatcttaactccgagcacatcaaaatggtgattaacgcc

SEQ ID NO: 2188 - DNA, 1101 bp, Corynebacterium glutamicum
atggcgtcacaacagatccgctatccattctccgcggttgtgggacaagacgagcttcggcttgcgttgatcctcactgcgatttccccacgcattggtggcgtggtgattcgaggtgagaagggtacagcgaaaactaccactgtgcgtgcttttgctggtcttttaggtgatgcccctttggtgaacttgcctctcggatccacggaggatcgtgtggtgggttccctcaacatggaaactgtgttgaccaccggccgtgcggaatatcagccaggtttgctcgcgcaggctgatggcggtgtgctgtatgtcgatgaggtcaacctcttggcggatcacctggtggatgctctgctcgatgcagctgcaagcggtcgcgtcagcattgagcgtgacggtatttcgcattcttcaccagcaaactttgtgttggtgggcaccatgaatccggaggaaggcgagctgcgcccgcagctgctggaccgtttcggtttggctgtggacgttgctgcgtctacgaaccctgaggtgcgcgtggagatcattcgccgccggcttgattttgaaaacgctcctgagcagttcatggctaagtgggctgagcaagatgcggacacctccaaccgtattttggcggctaaggatttgctgcctggtgtggagctgccggatctgatcttgtcgcagattgcgtggttgtgtgcacgtattgaagtcgacggtatgcgcgctgacctggtgatcacgcgtaccgcacttgctcacgccgcgtgggctggacgcactgtggttacggaagaagacgtggagatcgcagctcgcctagcgttgccgcaccgccgtcgccgtaatcctttcgatgctccagaaatggaggagcgcaagcttcaggaaaccctgcaggaagctcgggacttcttcaaagacaatgaagataaaggacctgccgccaagatcaccgatgaggaaaccggtgcagaggcctttaccgataccgacaatcccaccgaggaagacggtctgcaaggaactgcgcaggcgaaggcgcagactactggaaaggtaggtactgccggatccggcgacccctttcgctcc

SEQ ID NO: 2189 - DNA, 750 bp, Corynebacterium glutamicum
atgacgatttcccaagaaaaccagccaataatccagccagtctccttaattggtggaggtcctggtgcatgggacttaattacggtgcgtgggatgaatcgccttcaggaggctgatgtcattttggctgatcacttggggcccactgatgagttggaaaaattgtgcgacatcagctcgaagactgttgttgatgtgtccaagcttccgtatgggcggcaggtcactcaggagcgtactaatgagatgcttgttgaatacgcacagcagggactaaaggtggttcgccttaaaggtggtgacccttatgtcttcggtcggggttttgaagagttggagtttttgggcgagcatggaattgaatgcgaggtcattccgggtgtgaccagtgcggtgtccgttccagcggcggcaggtattcctattactaatcggggagtggtgcattcctttaccgtggtgtctggacatttgcctccaggccatccgaagtcactggttgattgggctgcgttggccaaatcgggtggcaccttgtccatcatcatgggtgtgaaaaatgcgggtgcgattgccgaggcgctcatggacggcgggcttgatgcagatactccagcagctgttattcaggaaggcactactgatgcacaacgctcagttcggtgcaccttgggcacattgggtgcagtcatggtggaggaagagattaagcctccagctgtgtatgtcattggacaagttgctggcctc

SEQ ID NO: 2190 - DNA, 1422 bp, Corynebacterium glutamicum
atgaatactgcacctttcaaactcgaagctgacttcgcatcagccctgcccaccatggcagccccctggcaaggtgaggaagcccccaaccctgagctcgtgattttaaatgacgacctcgcctacagcctcgggcttgatccgacatggcttcgcacacctgagggcgttcaatttcttctcggactcaaccccgagcccttaacaaaagcagttgcgcaggcctattccggccaccaattcggacagtttgtggcaagccttggtgatggccgagcgcttcttctcggcgaagcccgctcagctgacggcgtactgcatgatatccacctcaaaggatctggacgaacccaattctcccgaggagccgatggacgcgccgtccttggccccgtcttacgcgaatacatcatctccgaagcgatgcatgcacttggtgttcccaccaccaggtcacttgcagtaattagcaccggtaggaaaatccaacgaggaagcgtagccccaggcgcagtccttgttcgagtagcaaccagcctcattcgagtcggatccttccaatactccaacatctctggtggcatcgaactatctcaacacctggcgaactatacgatcaccaggcatttcccttcgttggtagctgaactatccgcaccaacccccgcaacttatgtatcactgtttaaagcgattcttcagcgccaagcagacaccgttggaaaatggaccaggctgggtttcgttcacggagccctcaacacagacaacacgttgatatccggagaaactgttgactacggcccatgcgctttcatggagcgctaccgtggcgacgcgaaatttagctccatcgacacttatggtcgctacaaatttgaaaaccaacctatgatcctcggatggaacatggcccgcctcgtagaaaccctcctcccactcctgggcgccacaccagacgaaggcatgacagcagcccaagaagctctcgtagaattcgatgacctctgcgaacaagcaatccgaaaagaattcgccactgcactgggccttgacgagtcagacaccggcacggtagagcagttccgtgaactgctctacctccataaccccgacatcaccacgctgctgcgcgcactcaccgacaacaccgcaccaccgagtggctttgaagcattcgttcacgactggaaaacccaagacccagatatcgaagcaatgcgagcagtaaatccacttttcattccacgcaatcacctcgtggaagctgctctcgcagacgcagttgaagggaatctagaaaagttccacgaactcctcgctgctgtcaccaatccttttgatccaactgcgggccccgatgaactacgcctgccaagcgaagaaggatttgaagaagactacatgaccttctgcggtacc

SEQ ID NO: 2191 - DNA, 900 bp, Corynebacterium glutamicum
atgcaaaaaatcaccccaaacatctggtgccaaggcaccgcagacgaagcagccgaattctacgtcaatgcgttttctgagtttccgggtggcgcagaagtactcaccacagttaagtatcccgaagctggcttgctggacttccaggagcctttcgcaggaaaaaccttgacggtggaactcgctatctcaggctttaagatcatcttgatcaatgctggtgaagagttcactcccaacccatcgatcagcttcatggtgaattttgatgcggtgcgtgatgaaaatgccaaagagcaccttgatgcggtgtgggaaaaactccatgaaggcggcagcacactgatgccagtcgatacttacccattttcggaatactacgggtgggtacaagacaaatatggtgtgagctggcaattgatgctcagccgcccagaagaaaagccaggtcccgcagtaatcccaacgctcttatttggtggggcagctcaaaatcaggcaggcccagctcaagaaaactacgttgaggtgttcccgaactcccaacttggtgatcgtgcaccttatggacagcaaacaggtcctgccactcctgaggccctcatgttttcccagttccaactcgacggtcagtggattttcgcgatggattccggagttgagcaagatttcaccttcagtgagggtgtctcattgatgtatgaagctcatggtcaagaagaactcgatgccatctggaatgcactctcggcagttccagaagctgaggcttgtggttggttgaaggacaagttcggcgtgagctggcagattgttcccgacaacatggaggagctcatggctaaacccggcgcgtatgaaaagcttcttgcgatgaagaagatcaatatcgcggagttc

SEQ ID NO: 2192 - DNA, 1014 bp, Corynebacterium glutamicum
atgcagcagtggaaaccagacttcctgggagagggctaccaaaacctcaccatcgagctcggcgacgacccggataatgaaacagatgttgtgacaacggttgtgcgctacaacccagacaatcacgcggacgagtcttttgctgcccgcccagcgttgctgtgggttcacggcatgacggactacttcttccacactgaattcgcggagtttttccacaatgccggttttgctgtgtacggcattgatcttagaaaatgtggacgctcctaccgtccaggacagcagtggcactacacctctgatcttgcccattacttccctgacttaacagctgctgccgaggtcatctcttccacccaccctgagctagtccccgtcgcccattccactggtggactcatcgttcctctgtggatgtcccagatgcgcacaagcaatccagctgccattgagaagattccagcgctggtcctcaacagtccgtggctggacatgatgtatccaccactgttcatcaagctgatcacccctatggtgagggtgttgggcaaacgctcccccacaaccatcatcccaggcggaggtttgggagcatacggaaaatcgatccataagaacttttacggcgaatgggactttgacaccaccatcaagcctgtagaaggacataaaaagagcatcggatggcttcgggcagtcatggctggccaagcagaaatccatcacgaccacgtgaatgtcggagtggacgtgctcacgctgtgttcaaataagtcctggttgaagtctgaatacacagaggacaccaacacttcagacgcggttttggatgtgaaacacattcaaaagtgggctcctcatttgagctcgccatcgtccagggttgatgttgagatcatcgacaacgctcgccacgatattttcctctcaaggaaacccgccagagatcacgcctctgaagtactcaacaactggctgcaatcgaagctttccagcctcaaaccatctcaa

SEQ ID NO: 2193 - DNA, 1395 bp, Corynebacterium glutamicum
atgtctgagcagccagcttccattaagcattatgacctcatcatcattggtaccggctctggaaactccattcctggaccagagtttgatgataaatcaattgccatcgtggaaaagggtgctttcggcggaacttgcctcaatgtgggctgcatccctaccaagatgtacgtttacgctgcggatatcgctcaagaaattcaggagtctgctcgcctgggtatcgatgcgacggtcaacagcgtggattggccttccatcgtcagccgcgttttcgacaagcgcatcgacctcatcgcgcaaggcggcgaggcttatcgacgtggccccgaaactccaaacatcgatgtgtatgacatgcacgcatcgtttgttgattccaagacaatctccactggtattgccggccaagaacagctgatcagcggtactgacattgtaatcgcaaccggctcccgcccttacatccctgaagctattgcagagtccggcgcacgctactacaccaacgaagacatcatgcgcctggcacagcagcctgaatctttggtgattgttggtggcggtttcatcgctttggaatttgctcacgtttttgaagcgcttggcaccaaggtcaccatcctcaaccgctctgacgtgctgctgcgcgaggcagatgcagacatctccgcgaaaatcctcgagctttccaaaaagcgtttcgacgtccgcctcagcactgcggtcaccgcagtacacaacaaggccgacggcggcgtgaagatctccaccgacaccggcgacgacatcgaggcagatattttgctcgttgccactggtcgcacccctaacggcaaccaaatgaacttggacgccgcaggcatcgagatgaacggtcgttccatcaaggttgatgaattcggtcgcaccagtgttgaaggcgtgtgggcgcttggcgatgtctcctccccttacaagctcaagcacgtagccaatgcggaaatgcgagcaatcaagcacaaccttgccaaccctaatgacctgcagaagatgccacatgatttcgtgccatcagctgttttcaccaaccctcagatctcgcaggtcggcatgactgagcaggaggcgcgtgaagctggcctcgacatcactgtgaagatccagaactactctgatgtggcttatggctgggccatggaagataaggatggattcgttaagctcattgccgataaggacaccggcaagttggtcggcgcgcacatcattggtgctcaagcctcaacactgatccagcaactgatcactgtcatggcatttggaatcgatgcacgagaagctgcaaccaagcagtactggattcaccctgctcttccagaagtcatcgaaaacgctcttctggggctagagttt

SEQ ID NO: 2194 - DNA, 942 bp, Corynebacterium glutamicum
atgtggcatcttctgcaggtcattagggttggcaaggttgtgcttgattgctcgcatttccgcattggctacgtgcttgagcttgtaaggggaggagacatcgccaagcgcccacacgccttcaacactggtgcgaccgaattcatcaaccttgatggaacgaccgttcatctcgatgcctgcggcgtccaagttcatttggttgccgttaggggtgcgaccagtggcaacgagcaaaatatctgcctcgatgtcgtcgccggtgtcggtggagatcttcacgccgccgtcggccttgttgtgtactgcggtgaccgcagtgctgaggcggacgtcgaaacgctttttggaaagctcgaggattttcgcggagatgtctgcatctgcctcgcgcagcagcacgtcagagcggttgaggatggtgaccttggtgccaagcgcttcaaaaacgtgagcaaattccaaagcgatgaaaccgccaccaacaatcaccaaagattcaggctgctgtgccaggcgcatgatgtcttcgttggtgtagtagcgtgcgccggactctgcaatagcttcagggatgtaagggcgggagccggttgcgattacaatgtcagtaccgctgatcagctgttcttggccggcaataccagtggagattgtcttggaatcaacaaacgatgcgtgcatgtcatacacatcgatgtttggagtttcggggccacgtcgataagcctcgccgccttgcgcgatgaggtcgatgcgcttgtcgaaaacgcggctgacgatggaaggccaatccacgctgttgaccgtcgcatcgatacccaggcgagcagactcctgaatttcttgagcgatatccgcagcgtaaacgtacatcttggtagggatgcagcccacattgaggcaagttccgccgaaagcacccttttccacgatggcaat

SEQ ID NO: 2195 - DNA, 474 bp, Corynebacterium glutamicum
ttgaatgcactacttgctagcagtcatctgaaaaaacgacgttggttcgtagtcgctggaaatttaataattcctccgtccccttcaactagggggtggaaacccgactatttccgaaggactattctcatgcgttctttccgtaccgcggcagttgcaggccttactgcagttgcactttccgtaggttccgccaccgtggcaactgcggaagaatctgatcaaaacctctcatccggcttctcagcactttcttccggtggcgcagcggccgtaggtgaggactgggatgcagaccagcccgtcacaggtgaagacatctttggtgaagagcacgagcgcgataacgaaaacaccccagcgtgggctaagaacatgtacgatctaaccgtcttgggtggcattgcttcccttctcggtgtcatcgtattccccgcttacaactacttggtttacaccggtgttatcaagggc

SEQ ID NO: 2196 - DNA, 357 bp, Corynebacterium glutamicum
atgcgtaaattccgcaacactgcaattgcactagtttctgcagctgcaatcaccttgggtggcgttaccgctgctaccgctcaggaagacgaaactcctcctgcagcagagaccgagaccacttctccttccggttcctcaggctcttcctggaacgactacaacgaagagtacgaaggcgaccaagagggctacggaatcgacggctttggttcttcccgcgatgactccggagaagaagttccacgttggttggagacctggggcaaggtatttgacgctttgaccattacctccgttcttggtcttgttgtcttccctgttgttaacttcctgaagtacaacggcctcattaag

SEQ ID NO: 2197 - DNA, 729 bp, Corynebacterium glutamicum
gtgtccggttttcttactcccccagctacaccccatattcggacggcaactgccagtattgctaccgcagttgccgtagcactgtcagtgttcgctgctgcactcattccaggaagcgctctgtattctgtgctgaccgctggaggggtggcacttggagcagcatcaggcgttgccgcgttacgccatcgcggagggcttcgcatttttcaatggctgtctgcgcttggtggaatcgtcattttgctgatcggtatcgtagtggcagttgcaaagtttggggcctcggcaaaacttgccacgttaggcctggtgacctcgtattatctcatgccgtctgcggcattggcctgttatatcggagggcttggccagctaccagccaaatggattgcgccagcgtttatggctacggctggtgcaggtgctgcgggatggttttcattgggggcaggcaccggttttgaacggttcctcattgctgttgcagcggtgttttcactgatgggatgtgtatacccagtgtggggatgcgtcgtaaagcgtccacgtcaagtggctgcatggctggtcgcgctggcggccctggtgcttggggcgctcatgctttttatggtgagcatggtggtggcgccgggtttgctgtggctgcagcccacgacggtcgcatggggttttatgattgccggggttcttgcgacggtcgcaggcttgtggcctaggcgtttt

SEQ ID NO: 2198 - DNA, 789 bp, Corynebacterium glutamicum
gtgtggaaggacgaagtccaagaagcaatcggtgagccttttgtgcaggcccctgaggtcatcgagaagatgcgtgagacatctcgcatcgctgcaaactcactgaaaatcgcgggcgaagccgtcaagccaggcgtgaccactgatgaacttgatcgcattgtgcatgagtacacctgcgatatgggcgcatacccttcagatcttggttaccggggattcaccaagtcctcatgcatttccctcaatgagatcgtgtgccacggtattcctgattccaccgtcattgaagagggcgatattgttaacatcgatgtcaccgcgttcaagcacggcgtccacggcgactgcaatgccaccttcttagcgggtgatgtttctgaagaacaccgcctgctggttgagcgcaccgaagaagccatgatgcgttccatccgtgcagcaaagcctggacgtgaaatcaacgtcattgggcgtgtcattgagtcttacgccaagcgttttggctacaacgtggtccgcgatttcaccggacacggcatcggcccaactttccacaacggccttgtggtgctgcactacgacaacactcagtaccgcgatctgctcgtgccaggcatgaccttgaccatcgagccaatgatcaaccttggttccctcgactacgagatctgggaagatgattggactgtccaaaacgttgaccgtaagttcagcgcgcagttcgagcacaccattgtcatcaccgaagacggcaatgagatcctcaccctcccagacgattccgtc

SEQ ID NO: 2199 - DNA, 1866 bp, Corynebacterium glutamicum
atgaacaaggtgcagcgcaggtcactgatggcgttgtgcatgacggtggcatttgctggaggaagcctgaccgcgtgcacacctcgtcctgataccgcagaccccatcgcagaggaattccttcaagcttgggcatcgcaagatttcgacactattgcggacatcaccgaccaagctgaccttgccacagaaatgctcagcaccagtttcgatggtctgcaagcagacagcgttgaactgactttggattccgtggattcccgggacaccatcgccaccgccaatttctccgtggtgtggaagcttccccgagacagagaagtttcctacgactcatcgatgacgctgaccaagatgcgcaacgaatggacagtgcgttgggaaccttccctcgtgcaccccaaactgggcgccaaccagcacctggaattgcgcgccattgaagcgcagcgagccaacgtaatttcctccgatggagctccggttctcgcgccgggaagtatctaccgagttttggttgatcccagcgcaggggatgccgatgtggtggtcaagagggtggcagattatttgaatgaagcccatgcgactgatgagaatgtgaacacccttgatgtcgaagacattatgagcaatcttggcgattccacctattcactcaccacagttgatgccaatttgggtgcccgcatggaacaggatctagcggggattccggggctgacgttcaatgaggaagcatccatggtagccaccgacccaggttttgctccggatattgtgtctcgcgttgcgcgcattgtggaagatgaattagaaggatccaatggttggcgcgcctccattgtcacttccaatggtgcggtgattgatgatatcgcctacgacgccccagagcttgcccccagcgtgaggatcagcctggatcacaacgttcaacgagcagcggaagaagccgtagacctgcgcgctgagatgaaagccatgatggtggtcatgaggccatccactggtgaaatcctcgcagtggcccaaacagatgaagctgacaaagacggcgatgttgcgctgatgggacaatacccaccgggatcgacattcaagatcatcactgcagccgcggggttggcgcatgaaggattaactccagacagcattgtgccatgccctggcaccatgaatatctacggccgaattgtcaccaactacaacagcttctccttgggcaacacctcattggatgatgcttttgccaattcatgcaacaccactttcgcggatatttccaccaacttggagccaggccaactgaaaaatgtggctaagcagtttggcctcggaattgattatcaaatcccaggccttgacaccatgacgggatcggtgcctgaaggtgacatcgtgttggaccgtaccgaatctggttacggccagggtcttgacctagcaagtccctttggcatggcgttggtcgcctccactgcagccaccggttcagttcccacgccaacgctgatttctggacatgaaactgttgccagtgaagaagttctggcgcttgatccagaagtccttgccaatgtgcagcggatgatgaaatccgtggtcaatgacggtaccgctcgtggcatgcgccaaaccggtggccagatctacgcaaagacaggtgaagccgaaatcaacgaaggctcccatgcgtggttcaccggctaccgcgaagatgacatcgcttttgccaccctcgtggtgttgggcggaggctccgaagcggctgccgctgtgacagatcagttctttgtgaaactcgatgagcttcgcgcagggggagaagttgcagtcagtgaagctgaagagcagccagtcggc

SEQ ID NO: 2200 - DNA, 630 bp, Corynebacterium glutamicum
gtgatccgtattctgttggctgatgatcatcccgttgttcgcgcaggccttgcctccttgctggtgagtgaagatgattttgagatagtggacatggtgggcaccccagatgatgccgttgcgcgcgccgcggaaggcggggtggatgtggtgttgatggatctgcgttttggtgatcaaccaggcatcgaggtcgccggcggggtagaggcaacgcgtcgcatccgtgcgctggacaacccgccacaggtactggtggtgaccaactactccacagacggcgatgtggtgggcgcagtatctgctggtgccgtggggtatttgctcaaagatagctccccagaagatctcattgccggtgttcgcgatgccgcgcggggagaatcagtgctttcaaagcaggtcgccagcaagatcatggggcggatgaacaaccccatgactgctctcagtgccagagaaattgaagtgctgtccttggtggcgcaagggcaaagcaatagagaaatcggcaagaaacttttcctcactgaggccacggtgaaaagtcacatggggcatgtgttcaacaagctggatgtcacctctagaacagctgcggtagctgaagccagacagcgcggaattatc

SEQ ID NO: 2201 - DNA, 1149 bp, Corynebacterium glutamicum
ttgatctatcgtggtggcgtgaaaactagccaagcgaccatcgcccgaattgagagagttctcatttggggattgcatttactcattgccgttttgttggtgttggtgtgttggcgtgccagccattggggtgtgtgggtgctcgcttttggctatggcgtggtttatgtggcgggtgtggtcccgaattcgccgtttaagaatcaccctatggcgtggtttcttgtgctgagtttgttgtgggcgagcctgatttgggatggaccggagcctgcgtatttggtgtttccgatgtttttcctcgcagtgttgatcacgacaccgctgaaatccgcgatcatcattgcaatactgacggcgatcgcggtggttacgttggctatgcacctggggttttctgttggcgttgtcaccggtccgatccttggcgcgttggtggcgtgggtaatgggtacgtgttttcagttattggcacaagccttaaaggagcttgtcgacgcacgtgcgtcggcgatccgggcgtcgaaaagcgctggcgagcaggcagaacgagcccgcatagcgggcgaaatacatgacactgtggcgcaggggttgtcctcgattcagatgttgttgcatgcggcggaaaaacgggtggatgatccgcaggcgttaagccatatacggttggccaggcaaacgacagctgataatttggcggagaccaggcagatcattgctgcgctgcaaccgactccactcattggggcggatctgccggtggcgttggccagactgtcgtcgaccaccccgatgggacagaacatcacgtttgaagtcgacggatccccacgggtattacctgatgcgatggaggcagagatcgtacgaattgcccaaacgctgctgggaaatgtggtgcggcatgcacaggcagattctgcaaaaatgaccctgacatatcaagatgatcaaatacttctagatgtcatcgataatgggcagggatttgatgtggcagaagtgatccgtaaaaaatccattggactgcccacagcgcaacgccgggctgaagggctgggcggaacaataattattgaatctacaatcggatcgggaactggaatttccgcccgttttccctatccacaaaaggaccaagataag

SEQ ID NO: 2202 - DNA, 957 bp, Corynebacterium glutamicum
atgtttcaaggactaaaagaactcaccgcagcaaaaggccgcacgctgctgatcaccgtcaccgtcgggctgatcgccgtgctggttactttcctctctgccctcaccgccgggcttggccaccaatcagtatccgcactgaaatacctagcgggtgataatgaacttatcctcgccgattccggatccaccacgctttccgcgtccacgctttctgatcaagcagttgcccaactcgaagacgaaggcgcacagatgctgtggcaggtccgcgaccgagtagcagacacccccaccatgctcctcaactcccctgaccttgcgcctggtgaagtatcccttcctgccgaactcgctgattcggaactcgctactgcgcatgatgtagtggattcttccaacgatctgtacctcgatcacctgcccgtggtattgatgaacacctccgatttagcctcactcgcgcaagtccgaggcgtgacaggaccagcaggcgcattcgcctctgacgttgcgctcccctccgacaccgttgcgctctctggatccgaacggtggaacgcatccgcctcctaccagggcgaacagatgtcactcaacctcatgatcgtcatgctgtatgtcatctccgcactcgtgctcggcgcattcttcaccgtctggaccatccaacgcctccgcggcatcgccatctctagtgctttgggagcagcccgccgagtacttatcgccgacgctctcggccaagccatcatcgtcttaggaatcggcatcaccgcaggcacattgatcacagtcatctccgcattcggcatgggagacgcaatgcccgtggtcatctcctcctccaccacgctcttccccgcacttatcctcgccgcagcaggactcatcggtgccgccatttcactcggccccatccttcgcgtcgaaccacgctccgcactcatgaacgca

SEQ ID NO: 2203 - DNA, 690 bp, Corynebacterium glutamicum
atgactctccacgtttcaaatctcaatctgaccgtcgccgacggatccacctcacgcaccctgctcaacaacatcacttttgatgtccaaccaggcgaagtcgtcggtatcaccggcccatccggctccggaaaatccaccctactcgccgtcctcggctgcctccaaagcgccgattccggcaccgcgacgctcggcgacatcgacctgctcaacccccaaaaccgagctgctttacgacgcaaccacctaggaattgtcttccaacagccaaacctgctcccctcgttgactgtcctcgaccaactgctgctcattccccggctcggcaggatcctcccgcccagccgcagcgcacgcacccaacacaaagacaaagccctttcacttctgaactccatcggactcggcgacttagcaaaacgcaaggtcagcgaactatccggtggacaacaagcccgcgtcaacttggcccgcgcgctgatgaactcccccaagctcctgcttgtcgatgaacccaccgccgccctcgatcaacattccgccagcgaagtcaccgaactaatcgtctcgatggcccaccaatacaacgcccccacactgtttgtcagccacgacatggatgcagtcaacacccttgaccgcagcatcgaacttgtcgacggtcacctcctcacaccccacaccctg

SEQ ID NO: 2204 - DNA, 162 bp, Corynebacterium glutamicum
gtgaccaagaaaagttcccgagggaattcttggtcacctggtttggttttggctgagcaataccgtcctatatggccgaaaatcgatcggcggaagtttttcggtcacctggtttggtctgtggcgggacttcagaaaaactgcaccggagcctggaaaaag

SEQ ID NO: 2205 - DNA, 1134 bp, Corynebacterium glutamicum
gtgttggcgccacgtcgtaaaacacgccaactcatggtcggcaaagtgggcgttggttcggatcacccgatttccgtccagtcgatgaccaccaccaaaacccacgacatcaacggcaccctgcaacagatcgcacagttgacagccaccggttgtgacatcgtccgcgttgcctgcccaaagactgttgatgcggaagcactgccgatcatcgcaaagaagtctccgatcccagtgatcgcagatatccacttccagcccaagtacatcttcgcggcaatcgatgcaggttgcgccgccgttcgtgtgaacccaggcaacatcaaggaattcgatggtcgcgttaaagaagtagcaaaagctgcaggcgatgccggaattccaattcgtattggtgtcaacggcggatccctggataagcgcatcctggacaaataccacggcaaagccaccccagaagctctcgtggaatccgcaatgtgggaagccggcctgtttgaagagcacggcttcggcgacatcgcaatctctgtgaagcactccgacccagtactcatggtggaggcctaccgccagctcgctgaacaaagcgactacccactgcacctcggtgttactgaagctggtcccaagttcatgggaacaatcaagtcttccgtagcattcggcgctctgctgtcccagggcatcggcgacactatccgtgtgtctctttctgctgacccagtggaagaaatcaaggttggcgaccagattctgcagtccctcaacctgcgcccacgcaagctggaaatcgtgtcctgcccatcatgtggccgcgcacaggtcgatgtgtactcacttgctgaagaagtcaccgaagcactcgacggcatggaagttccactgcgcgtcgctgtcatgggttgcgttgttaacggcccaggtgaggctcgcgacgctgacctcggtgttgcatccggtaacggcaagggccagatctttgtcaagggcgaagtcatcaagactgtcccagaatcccagatcgtggaaaccctcatcgaagaagcaatgcgtatcgcagaggaaatggacccagaagtcctcgctgcagcaagtgcttccggtatgaaggctgaagtgaaggtaaccaag

SEQ ID NO: 2206 - DNA, 612 bp, Corynebacterium glutamicum
atgtgtccgccatcaagtggtggcagcggcacgaggttaaacagcgcgaggaagaagttcaggctggccagcatcatcatgaacatgtcccacatggaacgttcgacaaattcgccgccgatgcgtgacgcgcccaccacactcatggggctttctacatctcgttctgcaccgaagatggatgcgacgacccctgggattttcgccgggaaggctttgaggccatcccacgtggcgctgatcatgtcgccggtgaaacgtgcagttgctcccacaccctcgattgggccgtattttttgtacacatcggtcggtggaaggctcgacatgcccaccgcgccgacggtaatttctgaaccgtcagaggcgagacgggtgacagaggcaacctggaggtcgacgtcgaaaagcgttccctcccgttcaatcgtcagcgttgccgtttcgcctgggagctcgaggatcgcatcgcggatggcggtgaagcttgccatctcttggccgttgacggccaaaatcttatcgccgtgctcaatgccggcgtcgcccgctgggcctgaacctacgcaggaggacagttcagttgcggaaatttgggtttccggcacgcac

SEQ ID NO: 2207 - DNA, 1212 bp, Corynebacterium glutamicum
gtggcagcctatcttcttggtgtcgtattatttttcctcggcatcgcagtaaccatcgcgcttcacgagtgggggcacttcatcacagcgcgcattttcggaatgaaagtgcggcgtttcttcatcggtttcggcccgacggtgtttgccaaaagacgcggcgaaaccgtgtacggccttaaagcgattccggtcggcggtttttgtgacatcgcggggatgactgcccaagatgaacttgatccggaagacctgccgcgcgccatgtatctaaagccctggtggcagcgcataattgtgctttccggcggcgtgatcatgaatctgatcgtcggctttttggtgctttacggcgtggcggtgagctccggaatcccgaatccggatgtggataccaccgcgacagtcgacaccgttcagtgcgtgccggaaacccaaatttccgcaactgaactgtcctcctgcgtaggttcaggcccagcgggcgacgccggcattgagcacggcgataagattttggccgtcaacggccaagagatggcaagcttcaccgccatccgcgatgcgatcctcgagctcccaggcgaaacggcaacgctgacgattgaacgggagggaacgcttttcgacgtcgacctccaggttgcctctgtcacccgtctcgcctctgacggttcagaaattaccgtcggcgcggtgggcatgtcgagccttccaccgaccgatgtgtacaaaaaatacggcccaatcgagggtgtgggagcaactgcacgtttcaccggcgacatgatcagcgccacgtgggatggcctcaaagccttcccggcgaaaatcccaggggtcgtcgcatccatcttcggtgcagaacgagatgtagaaagccccatgagtgtggtgggcgcgtcacgcatcggcggcgaatttgtcgaacgttccatgtgggacatgttcatgatgatgctggccagcctgaacttcttcctcgcgctgtttaacctcgtgccgctgccaccacttgatggcggacacattgccgtggtgatctatgaaaaaatccgcgacttcttccgcaaactgcgcggaaaaccagcgggcggcccagcggattacaccaaactaatgcccgtcaccgtagctgtcgcagccttgctgatgacagtgggaggcctggtcattgtcgccgatgtggtcaatcccatccgactctttggc

SEQ ID NO: 2208 - DNA, 645 bp, Corynebacterium glutamicum
atggtcgcaccatccgtaaacgtgatcatggagtggatgatcgactgcggatgcaccgtcacatcaatgagatccgcatccgtttcaaacagcagggtcgcctcgatgagttcgaggcctttattaataagggtggcggagttcaacgtgttcatctgccccatcgcccacgttgggtgcgctgctgcctgctcgggagtcacctcccacatcttctccctggtccagcccctgaaaggtccgcccgaagctgtcagcacaatccgcgcaacctcatcacgagtacccgaacgcaaacactgcgccatggcagagtgctccgaatcgaccggaatgatctgccccagctttgcctttgaggtaacaaactcaccaccggcaaccagcgattctttgttagccaaggcaagatgcgcaccagattccagagtggccagcgttgccgcaagccccaaagaaccaaccagagcattaagcacagtgtcggcctttgtggtttccaccagaatcttcgcagcatcggttccagagatgatctcgccgccgagagccttcgaaattactgcggcagcctgtgcatcagcaaccgcaaccttgtctgcagccagccccaactgctgcgcctgcgaaataacgaggtctggc

SEQ ID NO: 2209 - DNA, 1176 bp, Corynebacterium glutamicum
atgggagtcgtgactaaaaagatccttattttgggaagcactggttcgattggaactcaggcgctggacgttattgctgataattcagacaagtttgaggtggtgggtatcgctgcgggcggttctcagccagacctcgttatttcgcaggcgcagcagttggggctggctgcagacaaggttgcggttgctgatgcacaggctgccgcagtaatttcgaaggctctcggcggcgagatcatctctggaaccgatgctgcgaagattctggtggaaaccacaaaggccgacactgtgcttaatgctctggttggttctttggggcttgcggcaacgctggccactctggaatctggtgcgcatcttgccttggctaacaaagaatcgctggttgccggtggtgagtttgttacctcaaaggcaaagctggggcagatcattccggtcgattcggagcactctgccatggcgcagtgtttgcgttcgggtactcgtgatgaggttgcgcggattgtgctgacagcttcgggcggacctttcaggggctggaccagggagaagatgtgggaggtgactcccgagcaggcagcagcgcacccaacgtgggcgatggggcagatgaacacgttgaactccgccacccttattaataaaggcctcgaactcatcgaggcgaccctgctgtttgaaacggatgcggatctcattgatgtgacggtgcatccgcagtcgatcatccactccatgatcacgtttacggatggtgcgaccatcgcgcaggcgtcgccaccatcgatgaaactgccgatcgcgttggcgcttgattggccacatcgggtgccgaaggctcagccggcgctggatttcaccgctgctcatacctgggcttttgagccggtggatgatgccgcattccctgcggtgcagctggctaggcacgtcgcaaagcaaaaaggcacgtaccccgcggtgtataacgccgccaacgaggaggcggctgaggcgtttttgcgcgggcgaatcaagtttccgcagatcgtggacgtggtggacgaggtcctccaaggagcttctcagtttgctggtgtagcatcacacgtcgatgatattttggcaaccgaatctgaggcacgcgcgcgtgcgaatgctttgatcaaccggttggcaaccaacttg

SEQ ID NO: 2210 - DNA, 441 bp, Corynebacterium glutamicum
gtggctggttcctcccacacgattgagcctgagatctaccgcggtgtatccacccttgatgagccttcggctgcatggggatggcacggtctcaagcgcaacaccatccaactcgctggctggatttccgttctgttcatgcttggatacaacttcggtaaccacaagggccacgttgaaaccatctggcttctcgtcatcaccgcccttctggtcatcggcctgctgatccacctgttcgagccaaagctctcccaggttcgcaccatcacttcccgcaacaagcctgtcggccacgtcgagccagactggacctacgaccaggcaaccctcaccggcacctggggtaacctcactgactcccagcttcgctccgtcaacatcgagccaagccgtgtcgctcacctgcgtgctgcagattctgcgaaagaactagacaac

SEQ ID NO: 2211 - DNA, 480 bp, Corynebacterium glutamicum
gtgagcgacacggcttggctcgatgttgacggagcgaagctgggagtcagtgaggttaccccaggtgccggtgagggttgcctggtcgtaggtccagtctggctcgacgtggccgacaggcttgttgcgggaagtgatggtgcgaacctgggagagctttggctcgaacaggtggatcagcaggccgatgaccagaagggcggtgatgacgagaagccagatggtttcaacgtggcccttgtggttaccgaagttgtatccaagcatgaacagaacggaaatccagccagcgagttggatggtgttgcgcttgagaccgtgccatccccatgcagccgaaggctcatcaagggtggatacaccgcggtagatctcaggctcaatcgtgtgggaggaaccagccacgttttactcctttattcgcaagttgcagtggtacgccttcgcgcccgctgcaacaagcacctacagaacttggtt

SEQ ID NO: 2212 - DNA, 1578 bp, Corynebacterium glutamicum
atgactaaaacacttctgaaactacagctgacgttgtggggaagaactattaaaggaaataaagcggcaatagtgatgatgtcgctgatatctttttacgccttgatgggtttgtttggtttcggcatctttttggctcttgggcttgggcaagaccacatgggcatccttgctggtgttgtctcggtcggcatggtggcttattgcattgctgcgtttatgtggccgtcaggtgaggggcagctggatccgactgcattttccaccatgccgctatcggcgaagcaattattgcctggattcgctatcggtacgctcctgcagtcacgggggattattgcggtgatttgtacggtggcgacatccattattgctgcggtgtttttacctgttggttcgtggccgatgatcgtgttcatgatggcggtatcgctggttactacgttgcttttgggtgagttgcttggggcgttgacctcgggttcttcttctagggtgagtaatgatcgccgtacagttcttacttccgttgtcttcatggtgtttgttgttggctataacatgctgattggcgcggatggaatgagtcgaatcgatgccattggggcttatacaaagtggacaccatttggggcgggtgcaggtgctattgaggcttttgctgttggtttgtggggtgaggcaggcctgttaacattgctggcttttgtttatgttgctgctggtttctggttatggtcacagctgattaatcgcgcgctcactgcgccgctggaccaaggtgggcaagggcaaagcgctaaagacagcgccggtgaaggcaagaaggttctctttctgccaggtattccttggtcagttggaggtgccattttctcgaggtcgctgcgttatatgttcagggactccaggttgttgggatcaatgattgtgttcccgcttcttggcgtgctgtttattttccagagcttcaccgttgagtttttcatgatctatgttgggttgatcatgatggcagtgttcgcaggatccgttgctaccaatgattttggctatgacggcccttcgttgtggctaaatatcgttgctggtgtcaaagcccgaacgttgttgatgcccaggcactgggcatcaatgctgccgggaagtgtgtcaattgtggtgtttatgatcatcaccattgtgctcgcggagaataagaccaccgctgtgctgatctgttttattggcctggggatctttatctccagtgcggctgtagcgttgttggtcaccacatttaatccgtatccgacttctaagccaggcacgagtccttggggcgatcgaagtggctattccggtgctgcgttcgtgggagcatttgccgcactgttactgggatggatcccgacgattcctactatcgcattgggtatctttggtctggttaccgatcagatgtggatgatcatcctcgcggaggtgctggccattattctcccagtagctgtgtacatcggcgttgctaaggtgtgtattcgcaaggtggagaaggatcttccggagatcttcgacaaggtgaaaactcacgtgaaa

SEQ ID NO: 2213 - DNA, 855 bp, Corynebacterium glutamicum
atgactgatcctgaaaactcgcaaggaaccccacagatttgtccgactgatccgactacgcaagcattagcagttcggggcttaaccaagtcctatggtgatgcaacagtagtgaacaatatcaatctggacatccccaaaggagccatttacggcatcgttggacctaatggtgcaggtaaaaccaccatgctgtccatggcaacgggtttactgaggccgaataaaggcaccgcgtggatttcgggtttcaatgtgtgggaagagccaaacgatgcaaaacgaagcatgggattgttggcagatggcttgcccatctttgatcgcttgactggcaaagaactgctcacatatgtcggggcattgcgtgagttggatgaaggcattgttgatcaacgtagtgaggaattgctggaggccctcgggcttaaagaagcagcgggcaagagagtcgtcgactattccgccggcatgacgaagaagattcttttggcccaggccctcattcacaatccgaaagtgctcatccttgatgaacctttggaagcggttgatccggtgtctggtcgtttgattcagcagattttgaagaactttgcgcaaacgggtggaaccgtcgttttgagttcgcatgtcatggaattggttgaggggttgtgcgatcacgttgccatcatcaacaggggagtggtggagattgccggacatgtggatgaggttcgtcggggcagatctttgacggatgtcttcgttgatgcggttggaggcgctgctcttcaagaggggtcactatcttggttgggtgcgtccgaaggccatagcgaaggccaaaatcagaacgaggatcgggctgag

SEQ ID NO: 2214 - DNA, 1098 bp, Corynebacterium glutamicum
atggctacacctgtaccactggtttttaacgcacctaagcgtggcatgcccccaacccactttgcggatcttaatgatgaggctcgcattgaggctcttaaagagctcggcttgcccaaattccgactcaatcagatcgctcgacactactatggtcgcctcgaggctgacccactcactatgacggacctgcctgaaggtgctcgtcaagaagtcaaggatgctctttttccaacgttgatgtctcctctgcgcgtcgtcgaaaccgatgacgatacaactcagaagacgttatggaagctccatgatggcactttgcttgagtctgttctcatgcgctattcagatcgctccacgctgtgtatttcttcgcaggctggttgcggcatggcgtgcccattctgtgcaactggtcagggcggtttggaccgtaacctttcaatcggtgagatcgtggatcaggttcgtaatgctgctgcaacgatgcagtcagagggcggtcgtctgtccaacattgtgttcatgggaatgggcgagcctctcgctaactacaagcgcgtggtgtcggctgttcgtcagatcacgcagccaagccctgcgggcttcggcatttcccagcgcagtgtgactgtctccaccgtgggcctcgctccagctatcaggaagcttgccgacgaagagatgtccgtaactttggcagtttccttgcacactccagacgatgagttgcgtgacactctcgtgccagtcaacaatcgttggcctgtcgctgaggtactggacgctgctcgttactacgcagataagtctggccgtcgcgtctccatcgagtatgcgctcattcgcgatgtgaatgaccaggattggcgcgcagatatgctgggcgagaagctgcataaggctttgggctcccgtgtgcacgtcaacttgattccattgaacccaactcctggttctaagtgggatgctgcaccaaaggctcgtcaggatgagtttgtgcgtcgtgtgatcgccaagggtgttccatgcactgtgcgtgataccaagggacaagaaatcgctgcggcttgtggacagcttgctgcggaggaatctgct

SEQ ID NO: 2215 - DNA, 258 bp, Corynebacterium glutamicum
gtggctccaaaacaaacacttgccggtggcacgtgggtagctctcatcgtaggcgcacttttgctaatcctactgttggtcttcatcatgcagaaccaaaccaccgtagagcttaacctttttgcgtggaccttccaattcccagccggaatcggtttcctactagcagccattaccggtgcattgattatggcgcttgttggtggcgtgcgcatgtttgagtaccgtcgccagttaagaaaaatccgtaaagccctt

SEQ ID NO: 2216 - DNA, 855 bp, Corynebacterium glutamicum
atgcccaaacccaaaaataatgcgggtcgagatctcaaagctgccattgctgtggggatcggactgggggtcctggttcttttggggattgtcctaagcccatggggttggtacatcctcgttgcaggttttatggctgcagcaacatgggaagttggtagcagacttaaagaaggcggctatcatttgccactgccgattatgatcatcggcggtcaggcaatcatctggctgtcatggccatttggcacgatgggcattttggcgtcttttgtggccactgtgttggtgctgatgtatttccgaattttctacaatggcacggaaaaagaagcccgcaactatttgagggacacctctgtgggcatcttcgtgctcacctggattccattgttcggaagcttcgctgcgatgctgtcgctgatgcaaaacaattccatcccgggtacatatttcattttgacgttcatgctgtgtgtgatcgcatcggatgtgggcgggtatatcgcgggtgtgttctttggatcgcacccaatggcgccgttggtgagtccgaagaagtcttgggaaggctttgccggctccattgtcttaggatcggtcactggtgcactcagtgttcacttcctgctcgatcaccactggtggatgggtgtgatcttgggttgtgccctagttgtgtgcgccacgttgggtgacttggttgagtcgcagttcaaacgcgatttgggcatcaaggatatgtcgaaccttcttccaggccacggcggattgatggaccgtttggatggcatgctcccggccgcgatggtgacgtggttgatcctgagtgtgatcagcagctcgtatccgtcg

SEQ ID NO: 2217 - DNA, 555 bp, Corynebacterium glutamicum
atgattgatgaaattctgttcgaagcggaagagcgcatgaccgcaacggtcgagcacacccgcgaagacttgaccaccattcgtaccggtcgcgcaaacccggctatgttcaacggtgtcatggctgaatactacggcgtgcctactcctattactcagatgtcaggcatcactgttccagagcctcgcatgctgctgatcaagccttatgagatgtcttccatgcaggtcattgagaatgctatccgtaactctgaccttggtgttaaccccaccaacgatggccaggtgctgcgtgtgaccatcccacagcttactgaagagcgtcgtaaggacatggtcaagcttgctaagggtaagggcgaagacggcaagattgccattcgtaacatccgccgcaagggcatggaccagctaaagaagctgcaaaaagatggcgacgctggcgaagatgaagtacaggcagcagaaaaagaactagataaagtcaccgctggttttgttgcgcaggtcgatgaagtcgttgctcgcaaggaaaaggaactgatggaggtc

SEQ ID NO: 2218 - DNA, 729 bp, Corynebacterium glutamicum
gtgaccacctcgagtgaacaaccccgtacaggatacaagcgagtgatgttaaagctcggaggtgaaatgtttggtggtggcaaagtcggcgtcgatcctgatgtagtagacaatgttgcacgtcagatcgctgaagttgctaaaactggagcagagattgccgttgttatcggtggcggaaacttcttccgcggagctgagcttcagcagcgtggcatggaccgcgcacggtccgattacatgggtatgctcggcacagtcatgaactgcctcgccttgcaggacttcctcggtcagcatggcgttgaatgccgtgtccagaccgccatcaacatggcacaggtcgcagaaccatatctgccactgcgcgcagaacgccacctggaaaagggccgcgttgtcatcttcggtgctggcatgggtatgccgtacttttccacggacaccactgctgcacagcgtgcgttggaaatcggctgtgacgtcctactgatggctaaggctgttgacggtgtgtacagcgatgatcctcgtaccaacccagatgctgagctcttcaccgaaattactccaaaggaagtaattgagaagggcctgaaggttgccgatgcaactgcattcagcctctgcatggacaacaagatgcctatcttggtgtttaacctgcttactgaaggcaacattgctcgcgccatcagcggtgaacgtatcggtactctggtcgagtcc

SEQ ID NO: 2219 - DNA, 861 bp, Corynebacterium glutamicum
gtggccttaagcctggccgacctcgaagcgagcgaaggaggtgacggtaacgccagcctcgtccagaagagccttaacggtcttcttgctgtcagctaccgaggactgctcaagaagtacgttctccttgtagaagccattcaaacgaccctcaacgatcttagggatagcctgctctggcttgccctcttcgcgagtgatctgctcagcgatggagcgctccttctcgatgatctctgcaggaacgtcctcacgggtgaggtaagaagccttcagagcagcaatctgcattgcagcctgacgtgcagctgcctcagctgcttcaccttcaccggtgaaagcaaccaaaacgccaactgctggtggcaggtcagcggaacgctggtggaggtaaacagcggtcttgtcgccctcgagggttactgcgcgacgaagctcaagcttctcgccgatctttgcggagaactcctgcagagctgcgtctgcggtctgtccgtccacgtcaactgctgcgagctcttcctgggagttagcctttgcagctgctgctgcgtctgcaacctttgcagcgaattccttgaagtcagagttctttgcaacgaagtcggtctcagagttgacctcgaccatggtgttgccagaaactgcaacgagaccttcggtagcgttacgctctgcacgctttccgacgtcctttgcgcccttgacgcgcaggatctcaacagccttgtcgaagtcgccagcggactcctccagagccttcttgcaatcgagcatgccggaaccggtgagttcgcggagcttcttaacatccgcagcggtgtagttcgccattacggggcgatcctccttatgtatgga

SEQ ID NO: 2220 - DNA, 825 bp, Corynebacterium glutamicum
atggcgaactacaccgctgcggatgttaagaagctccgcgaactcaccggttccggcatgctcgattgcaagaaggctctggaggagtccgctggcgacttcgacaaggctgttgagatcctgcgcgtcaagggcgcaaaggacgtcggaaagcgtgcagagcgtaacgctaccgaaggtctcgttgcagtttctggcaacaccatggtcgaggtcaactctgagaccgacttcgttgcaaagaactctgacttcaaggaattcgctgcaaaggttgcagacgcagcagcagctgcaaaggctaactcccaggaagagctcgcagcagttgacgtggacggacagaccgcagacgcagctctgcaggagttctccgcaaagatcggcgagaagcttgagcttcgtcgcgcagtaaccctcgagggcgacaagaccgctgtttacctccaccagcgttccgctgacctgccaccagcagttggcgttttggttgctttcaccggtgaaggtgaagcagctgaggcagctgcacgtcaggctgcaatgcagattgctgctctgaaggcttcttacctcacccgtgaggacgttcctgcagagatcatcgagaaggagcgctccatcgctgagcagatcactcgcgaagagggcaagccagagcaggctatccctaagatcgttgagggtcgtttgaatggcttctacaaggagaacgtacttcttgagcagtcctcggtagctgacagcaagaagaccgttaaggctcttctggacgaggctggcgttaccgtcacctccttcgctcgcttcgaggtcggccaggct

SEQ ID NO: 2221 - DNA, 816 bp, Corynebacterium glutamicum
atggcagtcgtaaccatgcgagagcttctcgatgctggtgtgcactttggccaccagacccgccgctggaacccaaagatgcgtcgtttcatcttcaccgagcgtaacggcatctacatcattgaccttcagcagaccctgacctacatcgatcaggctttcgagttcgtcaaggaaaccgttgctcacggtggcaccgttcttttcgttggtaccaagaagcaggctcaggaagctgttcaggttgaggcagaccgcgttggtatgccttacgtgaaccaccgttggctcggcggcatgctgaccaacttccagaccgtttccaagcgtctgaaccgcatgaaggaactgcaggcaatggatgctgcagaaaacggctacgagggtcgcaccaagcgcgaagttctcatgctgacccgtgagcgcaccaagctggagcgcgtcctcggtggtatcgcagagatgacccgcgtgccttccgcactgtggatcattgacaccaacaaggagcacatcgctgtcgctgaggctcacaagctgaacatcccagttgttgccatcctggacaccaactgtgacccagacgttgttgacttcccagttcctggtaacgacgacgcaatccgctccaccgcactgctttcccgcgttatctccaccgctgtggaagagggtaagaaggcacgcgaggagcgtcagctggcagctgctaaggatgcagcaggcgacgcaaagcctgaggcagaggaagcaccagcagcagctgaggctgaagaggcacctgcagctgaggctgaagaggcacctgcagctgag

SEQ ID NO: 2222 - DNA, 504 bp, Corynebacterium glutamicum
ttgagtccagcaatgctgaatttcatgccctttcgactgatgtggattctggcccttacgttcaccctcaccctgctcacatccccagcgttggcccacccttacgtaaatcctgcgacaggcagtgaccgtgcaggccctattcttcggggctttgataagcccgagaagaattggcttccaggtcaccgcggcgtggatctacccctaaacattggagaaacagtgttggccagtggctcgggcactgtcgcttttgccggcatcgttgttggaactccgaccatttccattgatcacgccgatggcgttcgaaccacataccaaccagttcacgcccacgtgtcagttggcgaacacgtggaagaaggcgatgccataggcatccttggccatccaaccactaaattccctggacttcagtggggcgcaaaaataggtgaagaatatatcaatcccctatcgctacttccccggccaaccattcgccttaaacctcttaac

SEQ ID NO: 2223 - DNA, 924 bp, Corynebacterium glutamicum
gtggcgcgttccgggcggaacgcgccaccttctggtatttccggcgccgacgcgccgtccaagctgcatacgcttatcgacgatttctgtgagcatctagaccttgtggtgggtcgttcagccgcaacaattcgcggatatcgatcagacctttatgccatggctgacacaatcgaagatatcgacaatttctccctgccgactctgcgccaatggcttggtatagcggtagatgagggaaagtccagggcaacactcgccagaagaactgcatctgtcaaggcgttttcttcatgggctcagaaaaacggccacctcaaagctgatgaagcagcccgactcatttcaccgaagatcacgagggatctacctaagattctcggggaacagcaggcaggagactttgtggaaaacgcagcttccacaaatgaagaagagttcctgcgtgattccgcgattctggagcttctttatgccacgggaatgcgtgttgctgaactctgtggaatcgatctttcagacattgactacgaccgcaaaatggtacgagtgctgggtaaaggaaataaagagcgcgttgtcccattcggggaatcggcacacaaggcgttaagaaattggctagatgtgcgcgatgagatgacggaagatcccaaagcgctctttgttggggtgcggggtcagcgaattaatgcgcgccaagttcgaaggattgttgatcgagcggcaaaagtcactggcgttgaccatttgtcaccacactcgctgcggcatactgcggcaactcacttgctggacggtggggcggaccttcgccaggttcaagaactattagggcactcgtcaatgcaaacgacgcagatctatacccacgtcagtaataagagactgcttgaagcgtttaataaagcgcatccacgtgcc

SEQ ID NO: 2224 - DNA, 1182 bp, Corynebacterium glutamicum
atgattgactcccgcttgctggcatgggcgtatctctcaaaagtggtggagggtcccaatgcacacctgcaaaagctcctgaaagaaggtcatgatgtagagcggatcgcatttggtattaaacaccgcgaagagtggattggcgaaggtctgctgaaaaacaccgattcccggtactcgattgataccgcgcaaactgatctggaaactatcgccaaactcggtgggcggctcatcacacctgaagacgacgaatggccgatggaagaattagaccatgcttttggatttgccgcttctggcatgagtgatcatgtgcgtacctatcaagatgatgcgctgccaccgcatgcgttgtggattaggggaggaaatctcagaacactcagtgcacagtccgtcacactcgtgggcaccagggcaataagccaatatggcacggaagtaactcgggaattcacccaaaaccttgtgtctcatcagtggacaatcatctcaggtggtgccttgggagttgatagcgtcgcccatagtgaagccgtacgtgcacaaggctccaccatcgcgatcgcagcatgcggattggatcgctcgtaccccagccacaatcgagatctgttcaaccagattgccaaatccggaaagggggcgttggtgagtgaatatccaccgggaactccacctcaacgccaccgctttctcactcgcaatcgtctcgttgctgctctatctcaaggaactgtcgtggtggaggcagcctggaggtcaggcgcgctaaacactttgagctggtgtgctggtttaggcaggattgctatggcggtccctgggccggtaaatactgctggatcacttgggtgccacgaaaggattcgaaacggcagcgcacaaatggtcaccagtgcggatgacgttcggtcacttctgggtgcagtgggtgcaatggatagccaaactcagtatgaattaaacttcgcggccactccagtacagggtttaaccagaaatgagctgcgagtttttgatgcgttagacgaccgaggagaggggagggaagcggcgagtatcgctaccgaagccgggttgaccttgcagttaacaattttccttctcattgcattgaacaagcgcggaatcgtgaaacgcgacggaactgcttggtcgagaaatgcggaaatgcca

SEQ ID NO: 2225 - DNA, 1521 bp, Corynebacterium glutamicum
atggcgctcggtagaactatatccactgcgcaattaggtgtgcaggcaaaaatcgttcgtgtggaggctaatgttggcccaggattgcctggtacctacattgttggattagcagatactgccatttcagaatctcgggatcgtattaaaactgcggtgcaaaacagtggcttgatgtggccaaagaccaaagtgatcattaacctctcgccggcttccatgcgtaaacaaggttcgcagtgtgatctcgcgatgaccgttgcagttctcgttgcccatggctctaaccccaaagcgaagtttcatgcgcagaacacgttatttctgggtgaggtggcgcttgatggaaccttgctccctgttactggagttcttccagcgctgttggccgcgaaggaggaaggtattggcaagattgtgatcccggagggaaatgcccaagaagcaggactggttgaggatccttcagtctttttggcacattccatcgaccaggtcttgcgatggcttgatggggaagaggcgttgcctcagcctggactattcaatgatgaaaatagcctcaaactgcctgatatgcgtgatgtggtgggacaaccagaagctaggtttgctgcagaagtagctgctgccggtggtcaccacatgctgatgattggccctcccggttctggaaaatccatgatcgccgagcggattcccagcttgcttcccgaactgtcgccccaacaaatgatcgaggcgacggcagtgcattccgttgtggggcgaaccttttcagggccggtgtcgagggctccgtttatttccccacaccacaatgtcagcaaggctgctctgctcggaggtggctcgggatctcctcttccgggtgctatcagcctggcgcatcatggtgtgttgttcctggatgaggttagtgagattccagcgtcaatccttgattctttgaggactccattggaatacggctcgatccgcatcatcagatcccgccatgatgtcaccttccccgcacagttccagctcatcctcgcggccaatccgtgtagatgcggtgcagaacagcctcaagaatgtgtctgttctggctcagctcgcgcgacgtaccttaataatctttcgggtccgttgagggatcgcttggacatggttgttgccacccactctaaaggtgcagtgctgcgtagtgatgacgttgaggcatctgctcccattgctgatcgggtggcacaagctcgtgagagggcagctttccgatggcgccgttctggactgggaaatcttgttaatgcacacgtagatccacacttcttgcggaggaattttgccgcaacagaagacgccatggtgtacctcggcgcgttcctggcggaaggaacaatctcccaacgtggctgcgatcgggccataaaactgggttggaccttgtgcgatttggatggggaacagcagcccaatcttgaccatattgcgcgagccatggagcttcggggcactacatacagtgaggtagcagca

SEQ ID NO: 2226 - DNA, 366 bp, Corynebacterium glutamicum
atgaaaacacaaaaacaatatctgggcgcgttcggggaagatgttgcgctacaacaatatttagatgatcaagcaacgctgctagatcgaaatgttcgctattcatgtggcgaacttgacctcattgttcgctcggcaagcggagttgttgtttttgtagaagtgaagactcggcgggggtcggcttttgattcagcagcggctgtgaacaatcagaaaatgttgcggatgaggcgtgcagctgcactgtggctggagggtaaaccttatactccgattcgttttgatgtggtggcaatcgttttggatccgcacacggggcgcccagagatcactgtttatgaggatgtggaacatggcgctcgg

SEQ ID NO: 2227 - DNA, 303 bp, Corynebacterium glutamicum
atgagcgctgaagaactcgacaactacgaagcagaggttgaactctctctttaccgcgaataccgcgacgtagtcagccagttttcctatgttgtagaaactgaacgtcgcttctacttagcaaatgcagtgcagcttattccacacaacagcggaaacgatgtctactacgaagtccgcatgtctgacgcctgggtatgggacatgtaccgctcagcacgcttcgttcgctacgtccgagtgatcacctacaaggacgtcaacatcgaagaattagataagcctgacatcatcatgcctgag

SEQ ID NO: 2228 - DNA, 627 bp, Corynebacterium glutamicum
ttgtcacgcaacgggctagggcccgttgcaggagtagacgaagctggacgcggtgcctgctgcggacccatttcaattgccgcatgcatactcccggacaaacccatccaggagctagccgcactgacagactccaaaaagctcagtgccagcacccgcgaaaaactcatgccactgatcaaaaaacacgcactcgcttggtcagtcatcgtgatctccgcccaagacatcgaccgatttggcatccaacacgcaaacatctccggcatgcgacgagccgtagccgccctaggcacccaacccggctacgtacttaccgacgccatgaaagtccccggcttcacagtcccatacctacccatcatcggcggagacgcctccgcccgatgcatcgccgccgcaagtgtattagccaaacaaacccgcgacgacatcatgaccgacatggccaacgactacccgcactacggtctcgaaattcacaaaggctacagtacgaagatccacatggatgcggtgcgccaccacggcgcaagtcccgagcacagatatagttatgcaaatgtggccaaggcacaccaagaatggctacacgctgcagataatgacacgacggaaggtggagca

SEQ ID NO: 2229 - DNA, 792 bp, Corynebacterium glutamicum
ttgaggggggcgtcgaaaagcgaattactagcctttgatggcagggtcgtcgacgccaccgattcggctaaatggcaggataattgcttgaactttgcccttgatgttttcctcagggatggttccttggtactgatcgcccaggtggtagcgggaatccatggagttggtgcggttgtcacccatcatgaagtagttgccgccaggcacggtgatggggccgaaatagttgccgccgcattcggtggaaccggaggtctcatcgatggggaattgcgcaggttgcagcgtgtagctgtcatcgacttccttgccgtcaaccatgattccaggatcaccggcttggcacgaaacagtctgaccgccggtggcgataatgcgcttgaccaggtcattttcatcaggtgcgacaagacccacgtaagaacccaggttctgcaggccgcggatcaccgaattatcggaacgctgcgtagtgaatccaacgttccaggaatcagtacccttgaacaccacaacatcgcccggctctggatccgtgaagtagtaagaaaccttctccaccaggatgcggtcacccgtgcagccctcacatccgtgcaaagtaggttccatcgaaccactcggaatcatgtacatgcgtccgacaaacgtctggagcacgaaaatcagcgcgagggtcaaaaccacaaccactggaatttcgatgtaccacggagttggcttcgattccttcttagactttccagcacgtcgaccaggacgaccgtcctgcgtggaatcgtcagcatt

SEQ ID NO: 2230 - DNA, 786 bp, Corynebacterium glutamicum
gtgactgatttttctagtgcttcaaatgctgacgattccacgcaggacggtcgtcctggtcgacgtgctggaaagtctaagaaggaatcgaagccaactccgtggtacatcgaaattccagtggttgtggttttgaccctcgcgctgattttcgtgctccagacgtttgtcggacgcatgtacatgattccgagtggttcgatggaacctactttgcacggatgtgagggctgcacgggtgaccgcatcctggtggagaaggtttcttactacttcacggatccagagccgggcgatgttgtggtgttcaagggtactgattcctggaacgttggattcactacgcagcgttccgataattcggtgatccgcggcctgcagaacctgggttcttacgtgggtcttgtcgcacctgatgaaaatgacctggtcaagcgcattatcgccaccggcggtcagactgtttcgtgccaagccggtgatcctggaatcatggttgacggcaaggaagtcgatgacagctacacgctgcaacctgcgcaattccccatcgatgagacctccggttccaccgaatgcggcggcaactatttcggccccatcaccgtgcctggcggcaactacttcatgatgggtgacaaccgcaccaactccatggattcccgctaccacctgggcgatcagtaccaaggaaccatccctgaggaaaacatcaagggcaaagttcaagcaattatcctgccatttagccgaatcggtggcgtcgacgaccctgccatcaaaggc

SEQ ID NO: 2231 - DNA, 936 bp, Corynebacterium glutamicum
atgaagattagccggcgcgcattcctcggcacactgctcggcgccaccacccttgctgtaactgcctgcgcgcaatcctctcaaaaccaaaactcctccgcttcctcatcttcttcatcctcagcggaatcaagcacctcttcatcctcctccgatgaacagcgcatcgtcgccctcaacaccggtcagttggacaacctcctccttctcggcatcaccccagtgggcgtcgccgctgcaaaaaactctgacctgatcccacagttcctcaaggatcgcttcggtgcagacatggacttggacagcatcgccgactgcggtctccgccaatctccagacatcgaagccatcgcgaacctcaaccccaccctgatctgcgcaaactcccgcgccgacgaagaggtcctcaacaaactccgcacgatcgcccccgtggtcaccggcgaaggtggcggtgaaaactggaagcaagacctcctcaccatcgcagaggcagcaggccagaaggaaaaggctgaaaccctcctgaaatcatacgaggactcagcagccgaaatcgccgcaaaccagcctgcgaacccaccaaccgtttccttcctgcgcaccaaagatcaggaattccagatgtacggcgcacaatccatggccggaacggttgctgccgattgcggttacgcccgcccagaaaaccagcagttcaccgacacggcaggtcaagacctctccgctgagctcattgcccaagctgatgccgactggcttttctacggcatcaaagaaggcaacatcaaccctgaagacaccccattgtggacttcactcaaagcggttcagtccaaccaagcaatcccagttgacggcgattcctggtacctcaacgcatccctcgtgtcggctgaaatcatcctccaaggcctcaaagacaacgtcaccgtc

SEQ ID NO: 2232 - DNA, 213 bp, Corynebacterium glutamicum
gtgattggttgggggtttctttgtttcttggggtgggttttgtggggttttgtggggtttatcccgcatttatcccgcgttcatcccgcaggaaactcggataagacttgggtggggtcatttcggggcgaccaaaaggaaaaaccaaacaggggtgccaaaacttccgtgatttgggggatttgggcacgcctgtttggtttgaggctccga

SEQ ID NO: 2233 - DNA, 339 bp, Corynebacterium glutamicum
atgaacattctggataagatcgacgcagcatccctgcgcgacgacgttcctgcattccgcgccggcgacaccctcgacgtacacgtcaaggtcatcgaaggcaccaccacccgtacccagctgttcaagggtgttgtcattcgccgtcagggcggcggaatccgcgagaccttcaccgtacgtaaggtttccttcggcatcggtgttgagcgtaccttcccagtacactccccaaacatcgagaagatcgaggtcattcgtcgtggtgacgttcgtcgtgcgaagctgtactacctgcgcgaactgcgcggcaaggctgcacgtattaaggagaagcgc

SEQ ID NO: 2234 - DNA, 663 bp, Corynebacterium glutamicum
gtgtttgaaaatcgttttgacctgcgttgttatgttgtgactggtgcgggctcggtggatgaggttgtgcacactgcgtctgctgcggctcgtggtggcgcgggtgtggtgcaggtgcgttcaaagcctatttcgccagaagcgatgagggagttggcatcaaaggttgcgcttgaggttgcgcggtgcagcccaacaacgagggtgcttatcgacgaccacctccacgttgcttcttccttaatgcgcgaaggactcccgattcacggtgtgcatcttgggcaggatgatatgtcggtgcttgaggctcgtgagttgttggggcctgaggcgatcattgggttgactactggaaccctagaacttgtggcggcggcgaatgagctgtccgatgtgttggattacatcggtgctgggccgtttcggaagactcccaccaaggattcaggtcggccaccgattggccttgcgggttatccccctttggtggaattgtccaaggtgccgatcgttgcgattggtgatgtcacccctgccgatgtgcgcgctctcagcgcaaccggtgtggctggcgttgccatggtgcgggctttttctgaatctgatgatccacagcaggtcgctgaaaatgtggtggctaactttgaattaggaaggctctca

SEQ ID NO: 2235 - DNA, 1080 bp, Corynebacterium glutamicum
ttgaccacctgctttgaattccaggaggctggttaccaagtcacgttgattgatcctgacccaatttccggtgcgactcatcatgccggcggaatgttggcccccaccgcggaggtgcagtatcagcaacatgatctgattttgttgatgaaggaatccgctcgcctatacccagacctcctccaaagagtgtctaaatacactgacttgcccactgggtatcgcactgatggaacccttcttatcggtgcggaccgcgcggatggcatgcatgttgcggagttgattaagtacatgcatttgaaggatttgcctgtcgatgtgttgactactcgtcaggcaagggctgcggagccagcgttgtcgccgaggatttctaaggtggtcagcattgatggggatcatcagctgtcgccgcgtctgtatgcccgggcgttattggatgccattttgcaacgcggtgcggagcatattgccgacgctgtgatctctattgatggccacgatccgtgtttgaccgtgacgatgaattcgggggtgagggttgcgtcgaaaagcgttgttgttttggcggcgggcctgggcgccgcaagcattcccggctggtttgagggcgcgaacccattgcagttgaggccggtgtacggcgatattgtgcgcgtgcgcgtgccggagcgactgcagccgatggtcaccaaggtggtgcgcgggtttgtggaagatcgtcagatttatatcattccgcgtaccgatggcaccctcgcgatcggcgcgacaagccgtgaggatcacccgcaacctcgaacgggcgcagtgcatgatttgctacgcgatgctatccgtttgattccgggcattgaagaaaccgaatttatcgaagtcacctgcggcgcccgccccggcaccccggatgacctgccgtacctgggatgggttggatccaatgtgattgcgtccacaggatatttccgccatggaattttgctgtcagcccttggtgcacgcgctgccgttgatatggcaaccaaccagccactgttccccactcttgatgtgtgcgatccgtttcgccaccaaatt

SEQ ID NO: 2236 - DNA, 195 bp, Corynebacterium glutamicum
gtgattacctacaccttcaatggcacatctatgcgctcttccgaattgaccgtggagcaattggtccaccaagaaatcggccacgacactggagtcgccgtggcaatcaacgccgcggtcgtacccagatcccagtggtcacgcgccatttgtgacaacgattccgtagaagttctcaccgcaattcagggaggt

SEQ ID NO: 2237 - DNA, 780 bp, Corynebacterium glutamicum
atgctgcatattgctgataaaactttcgattcccacctcatcatgggcaccggcggagccacctctcaggcgttgctggaggaatcccttgtcgccagtggaactcaattgaccaccgtggcgatgcgtcgacaccaagcaaccacctctagcggagaatccatctttgccatgctgcgccgcctcgagatcgcccttctccccaatactgcaggctgccgcactgcccgcgacgccgtcctcactgcacaattggctcgggaagccctcgataccaactgggtgaaagtggaggtcatcgccgatgaacacacattgctgcccgacaccgttgagcttcttgatgcctgcgaactcctcgtccacgacggcttcaccgttctggcttacacctctgacgatcccatcactgccagccgactagaagactgtggcgttgcagctgtcatgccattgggctccccgatcggaaccggcctgggcattctcaacccgcacaacattgaactgatttgcagccgcgcgagcgtacccgtgatcctcgacgccggtgtaggcactgcctctgatgccacactcgcaatggaactcggctgcgacggcgtccttctggcctccgctatcaaccgcgcccaaaatcccgtcgcgatggccgaatccatgttccacgccgttgaagccggaagattagccgcccaagcaggccggatcccgcaacgccaacatgcggtggcctcatcaagttttgaaggtttggcatcctgggcggagcaggtgctt

SEQ ID NO: 2238 - DNA, 1134 bp, Corynebacterium glutamicum
atgcggtggcctcatcaagttttgaaggtttggcatcctgggcggagcaggtgctttaacatggcgcagcttcccacatctgagcttcaccgcacggcccgccaactcgcgctccccggatatggtattgagcagcaggaacgacttttcaacgcccacgttctagtcatcggcgcaggcggtctcggctgcccagtcatgcagtcgctggcttccgcaggcgttggaaccatcacggtcatcgatgacgacaccgtcgacatttccaacattcaccgccaaatcctcttcggcgcaagcgatgtcggtcgacccaaggtcgaggttgccgccgagcgcctcaaagaactccaaccagacatcaccgtcaacgcgttgcacgaacggatcactccagaaaacgcctgcgagctgctcaattccgtggacctcgtcttagacggctccgattctttctccacaaaatacttagtgtctgatgccgccgaaatcaccggaactcccctcatctgggcaacggtactgcgctttcacggcgaactggcactcttcaactctggccccgaccaccgcggagtcggcctgcgcgacgtcttccccgaacaaccctccgccgatttcgtccctgactgcgccaccgctggtgttcttggcgccaccacagccaccatcggcgcactcatggccactcacgccatcggatttctcacagaaatcggcgacgtccaaccaggcacaatcctctcctacgacgcattccccgccgccacgcgcagcttccgcgtctccgccgacccggcgcgcccactggtcacccgcctccgcgcctcctacgaggcagcgcgcaccgatacaacttcgcttatcgacgccaccctcaacggctccctcaccgccctcgatatccgagagccacatgaagttctgctcaaagacctccccgagggcgcaacgtcactgaagctccccttaagccagatcacctcggacagcgacattttagaggcactgtctggaatcgacggcgacattttggtctactgcgcttcgggaatccgcagttccgacttcatcgacaactactcccacctcggccacaaatttgtgaatcttcccggtggggtcaacgcgctg

SEQ ID NO: 2239 - DNA, 2274 bp, Corynebacterium glutamicum
atgtcatcaatttctcgaacgattgctctcgaactcggcgtcaaagatgaacaagtcgaggccgccatcaagctcttggatgaaggaaacaccgttccgttcatcgccaggtaccgcaaggaaatcactgggggactcgatgatacccaactgcgtgacctggaagaacgcctcagttacctccgtgagctggaggatcgtaaacaaagcatcctcgccgcgattgaggaacaaggcaaactcaccgacgatttacgctcgctgattttgggatgcgacaccaaggctcgcctggaggatctgtacctgccgttcaaaaaacggcgcaagacgaaggccgatatcgctagggaggcgggcctggaggggctcgtcgataagcttatcgacgccccgtccctcgacgccgcagcgcaggcagctgcatttacgactgagggctttgaggattccaaaaaagttttggatggcgctcgcgccattttgattgaccgcttcgcgctcgatgccgatttggtgggcgaggtgcgtgagcaaatgtatcgcgcgggttccatggcggcatcggtggtggcgggcaaggagcaggaaggcgcaaagttcaaggactactttgagttttccgaaccttttgacaagcttccatctcaccgaattttggcgctgctgcgcggtgaaaacgaaggtgtgctgagcctcaacctcgatgcgggcgacgacataatctacgaaggtttgatcgccgaccgattctccctggacacccacacttctagctggctggctgaggctgtgcgctggggttggcgcaccaaactgtatgtgtcctccggattggatgtgcgcatgcgtctgaaagaaaaagcagaggaaggcgcactcgatgtgtttgccaccaacctccgcgacgttctccttgcagctcccgctggtcagcgctccacaattggccttgacccgggattccgcaacggtgtgaaagtagctgtcgtggattccaccggtaaggatgttgccaccacgatcgtctacccacaccagccccaaaaccgctggaaggaagccgtatccgaactggctaacctgtgcgcgacccacggtgtggaactcatggcgatcggcaacggaaccgcctcgagggaaacggaaaaactcgccggcgaagtagctgacatgatcaaagccgcaggtggcacgcgaccaacccccgtggtggtctccgaatcgggcgcatccgtgtactcggcatcaccgatcgcagccgaagaattccccgacatggacgtctccctccgcggtgcagtttctatcgcgaggcgactccaggatccactggcggagctcgtcaagattgagcccaaagccatcggagtcggccagtaccaacacgatgtcaaccaggttgcacttgccaaaacccttgatggtgtcgtcgaagacgcagtaaacgcagtcggagttaacctcaacaccgcatccgcaccacttcttacccgagttgccggagtgacctccaccttggcaaacaatatcgtggcctaccgcaacgaaaacggtggattctcctcccgaaaagaactgaacaaagttcctcgcctgggacccaaagcctttgaacagtgtgctggcttcctccgcatttctggatccaccgaccctctcgacgcctccgctgttcaccccgaggcgtacccagttgttcgcaacattgcgaaagccacaggattggatgtctcgggactgatcggaaactctgcggtgctcaccaaattgaagcccgctgatttcgctgatgaacgattcggcatccccaccgtcaccgacatcatcgccgagctggataaacccggacgtgacccccgcccagaattcaaaaccgccagcttcaaagaaggcgtggagaaaatctccgacctcacacccggcatgatcctggaaggaactgtcaccaacgttgcggcgttcggcgcattcgttgacgtgggagtgcaccaagatggcctcgttcacgtttccgcgatgagcgacaaattcatctccaacccccacgaagttgttcgctctggtgaggtcgtgaaggtaaaggtcatggaagttgacgtcgaccgcaaacgcatcggcctttccctccgcttgaccgatgaacccggtgccccagctccgcaaaagcgcggaaaccgaccagccaaacagcagcgagctccgcaaaaacagtccgctaagcccgccacaggttccatggcagatgctttacgacgcgccggcctcggtggc

SEQ ID NO: 2240 - DNA, 975 bp, Corynebacterium glutamicum
atgtcagcaaaatcgagcctcaaggaagttgctgagttagctggagtcggttatgccacagcctcgagggcactatctggcaaggggtatgtgtccccgcagacgcgggagaaagttcaggcggcggctaaagagctgaactatgtaccaaatcagctggccaaggcgttgcgggaacatcgcagtgccttggtgggggtcattgttccggatttgtccaatgagtattattcggaatcgctgcagactattcagcaggatctgaaagctgctggctatcaaatgctggttgcggaggccaacagtgtgcaggcgcaggacgtggtgatggaatcgttgatctcgattcaagctgcaggaattatccacgttccagtggtcggctcaattgctcctgaaggaatccccatggtgcagttgactcgtggtgaattgggtcctggtttccctcgggtgttgtgtgatgatgaggctgggttttttcagctgaccgagtcggtgctgggcggcagcggaatgaacattgctgctttggttggtgaagaatcactttccaccacgcaggaacgaatgcgcggtattagtcatgcggcgtcgatatatggggctgaggtgacgttccattttggccactattctgtcgaatctggcgaagagatggctcaggtggtgtttaacaacggccttcccgatgcattgattgtggcgtctcctcggctgatggctggggtgatgcgtgcttttactcgcctgaatgtccgcgttccccacgatgtggtgattggtggttatgacgatcctgagtggtacagctttgtcggcgcggggattaccacgtttgttccaccgcatgaggagatggggaaagaggccgtgcgcttgttggtagatctgattgaaaatcccgaacttcccaccggcgatgtggttttgcaggggcaggtgatccttcgggggtcgagcacacattccggg

SEQ ID NO: 2241 - DNA, 1428 bp, Corynebacterium glutamicum
ttggagcaatcttttaatcaagttgggaattccagcgttgattgtggttgccatgtggtttgcccgcaccctgaagcactcacggatcaagcgtggcggatgtttggcctgttcatcgcgacgattgtggcgattattctcaagccaatgccaatgggtgccgtgacaattatcggcatgatcgccgcggtgttgactggtttggtgccgttgacggcgtcttctgatgatcccggcgcggtgtatggccttattggtttcagtaacggcaccatttggctgattgtgatggcgttcctgatttcgcgtggattcatcaagacggggcttggacgtcgaatagcgttgttctttgtgtctaaagtcggcggaaaaatgctgggtgtgacctatggtttggcgctcgctgatttggtgttggctcctgcgattccatcagcaactgcccgaggtggtggcattatggctccgattatgaagtcggtggcattgacttatgattccactcctggcccaactcgtcgcagggctggcgcgttcttggcgctgaatgtgggacaggtaaatgcgattacgtgcgcgatgtttctaactgcaatggcaggaaaccccttgatcgcctctttggcttcgcagatggatgtcaatatcacgtggacaaactgggctgtgggtgcgattgtgcctggtctggtggcgcttattgtggtgccgtgggtggtatacaagatctatccacctgagttgaaggacacccctgaggtcaagaaaatggcttctgatgagctcaagcaattgggtgggtttacttatggtgagaaggtgctggcgggaacctttgttgtgttgctgctgctctggacaggtggcgatttggtcttgggaatctcggcaactaccaccgctttcgttggcgtcatcatcttgctagtggctcacgtgctgacgtgggaggacatcattcaagaaaagactgcgtgggacaccatggtgtggttcgcggtgctatacatgatggcaacagcgttatcgcagtacggattcatcgcatggatctctgaggtaattgcttccagtttgggtggcatgaactgggtcgttgctttggttgtgttggtgctgatttacttcttcagtcactatttctttgcctcggcaacagcgcatatttctgcgatgtacttggccttcctgggtgctgcgattgcgattggtgcacccccgttgatggcggccctggtgttggcgtacacctccaatttgttctcttcactcactcagtattctggtggtccttcgccaacattgtttggtttgaactacatcacggtgggtgagtggtggcggacctcggcaattgctggcgcggtatcgattacaatctggttggttatcggtggtttgtggatgaatgtcatcggactctgg

SEQ ID NO: 2242 - DNA, 219 bp, Corynebacterium glutamicum
atgagtacaccgatcaagaaccaatcccaaggtgttaatgcacctgccaggtcccattggagcaatcttttaatcaagttgggaattccagcgttgattgtggttgccatgtggtttgcccgcaccctgaagcactcacggatcaagcgtggcggatgtttggcctgttcatcgcgacgattgtggcgattattctcaagccaatgccaatgggtgccg

SEQ ID NO: 2243 - DNA, 1251 bp, Corynebacterium glutamicum
ttggctgcggagagagcactctcaactgctcaagcccgccatggtgtgatcactgaagacgatgctgcacagatcaaccaggcggcagtcctttccaacattgaccgcgagaagctgtgggaagatgccaaaaatgtcggctaccccatccttggcttggtaagacaaatcgccagtcaccttccagaaggccccaacgggcgagtccactacggcgccacgacccaagtcatcatggacactggactggtgttgcaaatgactgcctctttgaacgcccttgataaacagatcgtgcgtctggggaatgcactggcagcacgggctgaagagcacaaagacaccgtgatgccgggacgcacccatgctcagcaggcaattcccactacatttggagcaaccctcgctacctttttggatcaaatccgcaggcagagggaacgacttgaggaagcactcgagcgcgtgcgagtcatttcgctgtttggtgctggtggaaacaacgcagcacaaggcgaacaagcggcaacggttcgtgcagagatggcccgcctgttggatctgaaggacccggtggtgtcatggcatgtggaacgcgatgtgcttggggacttcggatgggtgtgctcaacgctgtgtggatcgatggcaaaatttggccgaaacatcgtggatctttcccgaactgaaatcggagaagtttttgagccttacaactcccatcggggtgcatcttccatgatgcctcagaaagtcaacccgatttcttccgagctcatgattggtatttcagtggtggcgggtgccttgacctcgactttgccacggcttcaggaatcgggacatgaacgagcagcaggagagtggcagggagaatggcttgtcattccaacgttggccaatctagctggcgctgcactcgatgaagccattgtggtggctgaaggaatgcgagtggatacagatcgtatgtcctcgaacttggcttttgctggtggattgatcatggcggaagctcagatgattcaactagctccagctctggggcgtgagaaagctcatgacttggtttatgaagcatccacaaagactcgtgaagagcacaccacgctggcagaagaactgccgataattgcagttcaacatggggtcgaagacctgttgcctaagaattttgcgcagcctgcagactacgtcggcgaagcacaatccatggtgaatgcagctgtcgccgcctggaatgcccaactt

SEQ ID NO: 2244 - DNA, 99 bp, Corynebacterium glutamicum
gtggaatcgtatccacaaaggtatgatgatcgttattcctggagccgaaaagtaggaaaactcacacctgccccacgcggcgttttaagcgctcagatt

SEQ ID NO: 2245 - DNA, 393 bp, Corynebacterium glutamicum
atggttgaaaggaatatgaccaccatgcgagaagtttcaaccgacctcaacatcctcatcgtccccagcgaatgggaaaaagtactagaaaacctaccagcgacattgagtgagtccggattcgtagcctctgaaatccactcccagatcgtcgacctcacctgcgaacccgacaacatgcttgtcacccagttctcccagctagagggccacccaccaattgtggaagtgctccaccgcctagtaattaacggctcctccgacctggagcttaaagacctcaccaaaaaggtggtgggggcgttgcctcaggggacctactggtatggaacttcccttgaaggtgcgaccgaacctggcgttaacgcatcatgcgcgtggcagcatcggggc

SEQ ID NO: 2246 - DNA, 690 bp, Corynebacterium glutamicum
atgacagagaccacacctcaacccccaaagccagagcccgagctcccgaaatttctcagcaacccagaacgcgccgacatcattttgttcatcgcactcattgtgatgggcattttctccctctgcatgatcccactgcgcgcctggatgctcacccaacctctggcctacaccctcatcgtcggtggttacaccagtgcagtcgtgggcggcgcgaacgcttcggtagaaaacggcatctggtgggtctactggctctgcaccctgatcggcgcgctgaagttcatgcccgtctattggctgatgggtaagcgctggggcatggaatttatcgacatgtccctccaatacatgccccgcttccaccgcatgttcaaaaaatccgtcgactccgaatccacccgcctctacgcctggatcatcggcctcattccactcgcatacctcccaggaccagtgccgggaaccatcctcaacgcagtggctggcctggtgaaaatccgcttctggatcatcatggcctggaatgcgatctgcgtactatcggtcaacggactattcatctggctgggatacaccttcggcgaacaagtcctcgacatcgtcaacgtggtcaaccgctacatgctttggataaccttaggattgctggcgctgatgtttttccgcgcacggaagcaatttgccaag

SEQ ID NO: 2247 - DNA, 819 bp, Corynebacterium glutamicum
gtgaccattttccccgaatacctggatcctctgcgccatgccctgctgggtaaggcgattgaggatggcattttggaagtcggtgttcatgatcttcggaattgggcgaccggcggacacaaggccgtcgacgataccccgtatggcggtggcccgggcatggtgatgaagccagaggtctgggggccagcgcttgatgatgtcgccgcaggccgggtgagcggtgcggaactcgattcggcctcgctgcacctgaaaaatgtgcgccatgatgagctgggtggcgtcgaaaagcgtgcttatgtcgtggaagaagaccgcgacctgccgctgttgctggtgcccaccccggctggcaagccgttcacgcaggcggatgcgcaggcgtggtccaacgaggagcacattgtgttcgcgtgcgggcgctacgagggcattgaccagcgcgttattgatgatgccgccaaccgctaccgcgtgcgcgaggtatcgatcggcgattatgtgctgatcggcggggaagtggcagtcctggtcatcgcggaagccgtcgtgcgcctgatccctggcgtgctcggaaaccgtcgtagccacgaagaagacagcttctccgatggcctgctcgaaggcccgtcgtacacaaagccgcgcacctggcgcggacttgacgtccccgaagtactattctcgggcaaccacgccaaggtcgatcgctggcgacgcgatcaggcgctcctacgcacccaggcaattaggcctgagcttatcgacgcatccctcctcgattccaccgacctcaaagtattgggactggacaaa

SEQ ID NO: 2248 - DNA, 648 bp, Corynebacterium glutamicum
atgaagcctcacacacttttgcgacaagctttagcaatcggcagcgtgggtgggctcttggtgctcagtgcctgtggcaattctgattcaacttctcctactgtttcggaaactgtcacagaaattgtcactgaaacttcggcccctgattccacggcagccccgatagaatcctcgcctgctacctcttcagatgctgtgccttcagaagttgtgccttcagaaggcgtgcccaagcaatgcacaacctcggaactcaacatctcaaccggtacgcaacaaggcgctgcaggaagcgtgctgattgacctgaacttcaccaatgctggctccacagactgcacactccatggctttccgggcgtgagctttgtgggaatggataacggcacgcagattggcgcgccagcggttcgggaaggagacgccttccctgcggtcacgcttggacccggtgagaacacaatcgccgctctgaaaatttccagggcagaaaactacgactcggacgcatgctcactgcaaccagttgatgggctacgcgtctacccgccaggtgaaaccgcatccgaatatcttccgctggaaggattcaatggatgcgacaatgatggtcttaagctgctgactattaaatctgtcggagcc

SEQ ID NO: 2249 - DNA, 513 bp, Corynebacterium glutamicum
atgagtacagagcaggaactgcaaatcggaaaagttgtaaaatcccacggcattcggggtgaagtcgtggtggaattgagcaccgatgatccagacattcgcttcgccattggggaagttctcaacggcaagcaggcaggcaaggagcattcactgaccatcgatgcagcgcgcatgcaccaaggtcgactcttggtgaagttcgcagaggtcccagatcgtaccgctgctgattctttgcgtggaactcgattctttgcggcacctcttgaggatgaagacgatgaggatggcttctacgaccatgagttggaaggtctgcgcgtcattcacgagggcgaggatatcggtgaagtcaccggcgtgatgcatggcccagccggtgagatcctggaagtccgcctgacctcaggcaaggaaacactgattccttttgtgcacgccattgttcctgaggtggatctggaagaaggaaccgcaacgatcacccctccagagggcttgttagatctt

SEQ ID NO: 2250 - DNA, 348 bp, Corynebacterium glutamicum
atgactgttttcaatgttctccatgacgcacccgcaccacagccggataaaaaccgccccggtgtcaaacgtctcctccaaggtgatggcgcaaacctcatcgccttcactttcagccctggacagtcacttcccgaccaccgcgccgcacatcccatcaccgtgaccgcattttctggccagctcaccttcagctatggcgaggaaacctttgagctctcccccggtgtgacagtgcacttggaagcaggagttacccaccgcgtggactgcccgccagaagcaccaggcgatgcagtaatgctgttaactatgctcactggtgaaaaacactcagtcaaccaggcc

SEQ ID NO: 2251 - DNA, 495 bp, Corynebacterium glutamicum
atggctgtaaagattaagctccagcgcctcggcaagatccgtaccccgcactaccgcgttgtcatcgctgatgcacgcaccaagcgcgacggcaaggttatcgagaacatcggtatctacgagccaaaggctgagccttccgtaatcaagatcaactccgagcgtgcgcagcactggctctccgttggcgctcagccaaccgaggctgttgcagcgctgctcaaggtgaccggcgactggcagaagttcaagggcatcgagggcgcagaaggcaccctccgtgttgcagagcctaagccatccaagcttgagctgttcaaccaggctctttctgaggctaacaacggcccaaccgctgaagccatcactgaaaagaagaagaaggctcgcgaggacaaggaagctaaggaagcagctgagaaggctgctgctgaaaaggctgccgctgcagagtccgaagaggctccagctgaggaagctgctgcagaagaggca

SEQ ID NO: 2252 - DNA, 576 bp, Corynebacterium glutamicum
gtggtgtcttcttgtcaaataaccactgtttatagggcaattctttggcaatgtacccaactcattacccacctgctgattcaaagagtagatttaaatagtgtgcttccgattgcctccggtaacgatgaccggaatttaatccgttatgtcgacggtggtcgatttgatgaaatcatgctcaccggagacctcactggcctgagcagttttcttaccaacgctggcccgaacgcccgggatgattttgatctcacggtgctcatgcgcgctgccgaggcaggcaacctcatggttgttgcccgcttgttagatttaggtgccaatccccgactcaccaatcctcgtggtgtcacggccctacatatcgcagcgatcgccggggacgatggcattgtggaatgcctcattgatgcaggcgctgaagtcgatgctgtagatgatcaaggtcgcactcccctatggaacgcagcggctcatcatctgcctgattctgcggtggtggatgtgctgcttcgcgcaggtgcgaatgtgaatctgcgcgattgcaatggagtcagcccagaagacatgctg

SEQ ID NO: 2253 - DNA, 867 bp, Corynebacterium glutamicum
atgattacagttctgacacgcagacacttgcgctgctttttccgcgaccgcatggcagtgctgttttccatcatgggtgcgctcatccttttggtcctgtacgtgctgtttttaggaaaactgcaaattgacggtctcatggtggatctacctgactcagcccgagacgatgttgaaggattcgtcttcaattgggtgttttccggaattctcatcacgtccgcaatcactgttccgcaagcagcacttggagtgctggttgaagatcgcacccgcggaggcatcaaagatttcctcgtggcacccgtatccagaacgacgctgacggtgtcctatatcttcgcagcagtcattgtcgccatgacgattttgatctttgaaatcgtggtgggaagtattggtttagctattttggggcacttcagcatgagcattgctcgcgtgctcgaattggtagtcgccttgcttctgctcaccctggtgttttccgcaattgcagcatttctgatcaccttggtgaaatctcaaggcggaatgtctgcgctttcaagcctggtaggcaccctggcgggctttttatctgctgcttatattccacccatcgcattgcctgaagcagtgacaaacgtgttgaacttcctcccgtttaccccagctggaatgttgatcagacaaattgtggttgccccagcattggacgcgatttcacttccacccgaagccttcgatatcttccaattcggatacggactcaaactggaaatgtttggggaacccgtttctacatgggtggcagtaggaattgttgcctcatggggagtggtgtttggactcattgccgcgttcaaaatgaaaagcgtggtgcga

SEQ ID NO: 2254 - DNA, 876 bp, Corynebacterium glutamicum
atgtcacccatcctaaaagtgcgggacctcgtcaaacgctatggcgacaccgttgcggttgacggtttaaattttgatgtttcacaaggggaaatttttgcctttctaggggagaacggcgcaggaaaaacaaccacgatttcatgcctgattggcattgatcaagccacctctggggagatcgaactgcagggtggccaagtagattctgaaaaacttggagtggtgtttcaacaatccgtcttagaccctttgctgagtgccaaagaaaacttggaaacacgcggacagctgtacccaggggtggggaagcagcgggttgcacagctcattgagcaaatcgggatggaagggtttgcggaccgccgatacggagtgttgtcgggcggtgaaaaacgtcgcaccgacatcgcacgagctttactgcacagcccagacattctttttcttgatgaacccacagcaggcctcgaccccagatcacgacgccaagtttgggacaccatcaattccctgcgtaacgatgtgggcctcactgtctttttgaccactcactacatggaagaaacagaactggctgattcagttctaatcattgaccgtggcaaagaggtcgcatcaggaaccccgatggaactgcgcgcccgttacaccacaacagaattgactcttagaacaaacgaccctactcattcgggtaaagagttggcccacttgagcccagaaatcgacggtgaccgactgcggatcaagttggaaaatgggctcgaagctgcgcgcctggcaacagaactagatggggttctcgacgtagagatccgccacggttccatggacgatgtatttctagcagttacagctgaacggaaacgatca

SEQ ID NO: 2255 - DNA, 1641 bp, Corynebacterium glutamicum
gtgtttgagtcactgtccgatcggttgaatagcgcgctttccggcctgcgcggcaaaggaaagctcaccgaggcagacatcaatgcaaccacacgcgagatccgtctcgcgctgctggaagctgacgtttcattaacggttgttcgtgccttcattaaccgaatcaaggaacgcgccgttggtgcagaagtttctcaggcactcaaccccgcgcagcaagtcatcaagatcgtcaacgaggaactggttcagatcctcggtggcgaaacccgccgactgtcactggccaaaaacccaccgaccgtcatcatgctggcaggtctgcagggtgcaggtaagaccaccctcgcaggtaaactgtccaagcacctggtcaagcagggtcacactcctatgcttgttgcctgtgaccttcagcgtccaggcgcagttcagcagctgcaaattgtgggtgaacgcgcaggcgttaccactttcgcaccggatccaggcaccagcatcgactccctcgagcacgaaatgggcacctcccacggtgatccagtcgaggtagcgcgcgcaggtatcgaagaagccaagcgcacccagcacgacatcgtgatcgtggataccgcaggtcgcctcggtatcgatgaaaccctgatgactcaggcacgcaacatccgcgaagccatcaaccctgatgaagtgctctttgtcattgactccatgattggtcaagacgccgtagacaccgccgaagcattccgcgacggcgtcgacttcaccggtgttgtcctgaccaagcttgatggcgacgcccgcggtggtgctgcactatccatccgtgaagtcaccggcaagcccatcatgtttgcctccactggtgaaaaactcgacgacttcgacgtcttccacccagagcgcatggccagccgaatcctgggcatgggtgacgtactgtcactcatcgagcaggccgaagcagtcatggatcaggaaaaggcagaggtcgctgcccagaagttgggctccggcgagctcaccctggaagacttccttgaccaaatgctgatgatccgccgcatgggaccaatcggcaacatcctcaagatgctgcctggtggcaagcagatgtcccaaatggcggacatggttgatgagaagcaactcgaccgcatccaggcgattatccgcggtatgaccccggccgagcgcgataatccaaagatcctcaacgcttccaggcgcaagcgcatcgccaacggttccggtgtgaccgtgtccgaagtaaacaaacttgttgaacgcttcttcgaggctcgcaagatgatgggtcaaatggctggccagtttggcatgggtcctggatcccgcagtgcaaccaagaagcaagccaagggccgcaagggtaagaacggcaagcgtaaaccagccaagaagggcccaacccagccaaagatgccaatgggcggtatgccaggaatgcctgggatgccgggtatgggtggagccggaatgcctgaccttgctgaactacagaagcagcttggtggagcaggtggcggtatgggaggccttggtggcggactcccgggcatgccaaagccgcctaaaggcatggagaacatagatctcaacaacctagacttcggtaagaag

SEQ ID NO: 2256 - DNA, 633 bp, Corynebacterium glutamicum
atgcggcttgcagccctcgccaccatctctgcacctacttgttcgtgtggacgcgggaagcccttgccaatgtcgtggtacaaggctcccaaaactaaaagatcggggcgcgcgacggtcacagtttctagcgcacatcctgcaacagtgttcagactatgttcatcgatggtggaaatatggctgggttcacggggcataagccctttgatgcggtcccattctggaacaaaacgcgaccacaatccgtggcgatccatatttttcaccactcggcgtgagtttttcggactggagagaatccgaaagaagtcccctgctgcattggcaggccatggctcaggaagtggcgggcattcattaagtcgaacccaggttgattctgccaccggaagtccggtggttgctgcggctgcggccactcgaagtggaagtgcgggatcattaagatctggttttttggacaattcgatggtgccgttggcgtcgacgacatcaagatcaagtgggcgtcgagaagcattcctgaatgcaaaacctgtgcgacgtggcaaaatgccacgggcggtggccagcgcggtggtcaggccatcatcaatggcgcgggctgcatcggcgatctcccggcccagg

SEQ ID NO: 2257 - DNA, 417 bp, Corynebacterium glutamicum
ttggcgcagctgggctggattattcataagtttttaaagggctgcttcgccgcgctcaccggtacgaacacgaaccagctcttcgatgttagtcatccacactttgccgtcgccgactttgccggtgcgtgcggtctcgacgataatgttgatgacttcctcagcctgagcatcggagataataacttcaatcttgaccttaggcacaaaatcgacagcgtattcagcaccacggtacacctcggtgtggcctttctgctggccaaagccttgggtttcggtgacagtcatgccctgcacacctgcctgctcgagagcatctttaatgtcggtgagggtaaacggcttgacaattgcggtgatgagtttcatgatcgtctccttcaaaaagacattcggaataatgtcagagtggtt

SEQ ID NO: 2258 - DNA, 669 bp, Corynebacterium glutamicum
atgccttgctgctccacatcatcatcaacgcgccatcctactgtggccttcagggcgaatgcgatgagcgcagtaatcacacctgcgaaaactacagcgactagcgcgatgacgatctggacaataaagagtttaagtccatccatgccaccaccactaaaccatccgatgtcagtggcaagaagtcctacacccacggtgccccacaggccagcgaccaggtgcacaccaactacgtcgagggagtcatcgaaaccgaagcggtacttcagccccacgcccaagcacgccaagatgccgccgattgcaccgaggatcagggaggtcactggggtcagtgcgccagctgctggagtaattgcgaccagaccggcgacgacaccagaagcagcacccaaggaggttgcgtgtccatcgcggaatttttcagtagccaaccagccaagcatcgcagctgcggttgccgccgtggtgttcacccaggccaggcccgcaaggccgtcggctgcgaacgccgagccaccgttgaacccgaaccaaccaaaccacaacagcgcagcgccgagcatgaccatgggcaggttgtgcggcctggcaattgccttgccaaacgtctttcgcttgccgacgataaaagccagcacaagggccgctgtgcccgccgaaatg

SEQ ID NO: 2259 - DNA, 1530 bp, Corynebacterium glutamicum
gtgctgcgtgaaggccaagatcttggcgcaccaaaggctgaaacaacaccgattgttccaccagtagttattccgccggcagctcctgaagaggaaaaggcgccggagcaatcgactgaaactttcgcagctcaaaagcctgctgaagaagcacctgcaactcctgaaccagaaacctctgatgatgttgtcgaggaaccagaagttaaggagcctgaggttaaagaagttgtcgctgttgagccagaggtcgaaactgaagagccagcagttgttgaagaacctgcagtagcagaggaaccagcaattgttgaggaacctgcagtagcagaggaacctgcagtagcagaggaacctgcagtagcagaggaaccagcaattgttgaggaacctgcagtagcagaggaacctgcagttgttgaggaacctgcagtagcggaagttcccgaaacaatcgaagaacctgcagttgaagaacttgcggcagttgctgaggtcaccgaggctgcagaggctgctcaggttgctgtggaatctgcggaagctgcgctggaggaaactccagttccagatgtggagccggagccagctgcggagcctattgatgagatcgtgccggcggcgggtcgtatcggtaagctgcgtggtcgtctttctcggtcacagagtgttttcggtaagtcagtgttgggcattttgtctgcgggtgacttggatgaagacgcatgggaagacatcgaagcgatgttgatcaaggcggatttgggcgccaagatcactgcgcgtgtggtggatgagctgcgtgacaagatcgcagagcatggtgttggtagtgaggcagaggcgcgtgcgatgctgcgtgcttcgctgattgatgcttgccgtcctgaccttgatcgctccattaaggctatgccgtatgagggtaagccagcggtggtgttggttgttggtgtgaacggtaccggtaagacgacgactactggcaagcttgctcgtgtgttggtgtccatgggtcataaggtgattcttggtgctgcggatacgttccgtgcggcggctgcggatcagttggagacgtggggtcgccgtgtgggtgcggagactgttcgtggcgctgagggcgcggatcctgcatctattgcgtttgatgctgtggctaagggtgttgagcgtcaggcggatgtcgttttggttgacactgcgggtcgtttgcacacgtcgactggtttgatggatcagttgggcaaggttaagcgcgtggtggagaagaaggcagtggtggatgaagtgctgctggttttggatgccacggttggtcagaacggtatgcagcaggctcgtattttccgtgaagttgtggatattacgggtgtggtgttgaccaagctggatggtactgcgaagggcggaatcgtgttccaggtgcaggaagagttgggtgttcctgtgaagcttgttggtcttggtgaaggtgcggatgatttggcaccgtttgaggttgagggcttcgtggacgctttgctgggc

SEQ ID NO: 2260 - DNA, 159 bp, Corynebacterium glutamicum
ttgtcggaagttttggcacgcctgtccggttttttgtttgataaaccggacacacgtgacaaaaacagtggaatttcagattcgttggcatgcttgtctggtctgattgggtattggcaagccgagaccaaaccacagtgcccaccaaacgctgatttc

SEQ ID NO: 2261 - DNA, 702 bp, Corynebacterium glutamicum
atggcacgaagaagttctacagcggtcttaatcaagccttcagtctggagaacctcacggagtgcatcgcgcttcttgaaggtttcgaacactgccatgaggcgggtgttgtcttccattagtggtccaggaacgatgtcggcgttgctgaagaacatgtccagcagggctttttgctgggtttcgttcatgccggcaatcgcaacggtggattggtcgatgcatgcggtgtccaaagtggagtcacggccagttgcaagggtggacaggatgttcttgccggcgacttcctcaagttgtccgaggattggcagcagtggtgtgcggttgccaagctcttcggcttccttgaatgcgcttggcagtgcacccaggagttgcagggttccgatccatgcggtgcggtgcacttctgttgctggtgattccgtggtgaacggtgaggctgccagtccggaggaaatgacttttccaggtagtgcctgtgcgggaaccagcgaagcggacagacccttcagtgctgcggctggtgaggagcgcagggcggcatggactactggaagatgctcggtgtttccctgttcggtccagatatgggaaacatcccaaagtgcggggaccacagcgtcactgattggtggttcttctacttccccaccgaagaatgctgaaagctgtgcatattcttcggtttgtgctgag

SEQ ID NO: 2262 - DNA, 3393 bp, Corynebacterium glutamicum
ttgcgcggggagagtgtatacatgccggctggcatcgcagacatgacagattcattgctcggatgggcatcacaaactgagctggatctgaaccagcgtcttgcaggggtagagtactttccacaaattcagctgcgacacgatgagctcgagcgcattcatcggttttacggcacctttttgtcccgccaggtaggcgcgggcgcaagccttggggatctttttgaaatgaccccatgcctgacagtcaccaccttggtgtctcgggcgtcacggatcagcgatccagcagatttcttcggtgaatacatcggaggactgggacttagcgcagaacacgcagcagttgttgaagggttgaccgaaaagctcttcgcacaggctggcctgctcgttcctgagggaattgcatctccattggagttgttatccatccacgcaggcattagtaaccacgaagtggccgcagtgctgaccgaagtggaaaacggcaccaccgaatatccattcatgttcgacgctgtcctgcgcctaacccctgagtgggcacagacccttatcggcggagttcaagaactcattgaatttgccaccacccaccgaacttcttggtcagaccgccagcgcgaatcctcactgccagccatgatcgatgagatcgttgtggcggaacttcgggaacgcccagttggtactgccgaccgtgaaaactccgttggtgtggcacttcgtgagcttcgcccacgcctcatcctggatgcagaacgccgcaaagtctgcctgcgtctacctgaacagcgcgtcagcgacgatgaaatcaactggcgagtcagcctagaaggcaccacccggattttctccacccgccgagcatggggcgatacttctggatactccgaagccctcgacatcactgtcgagcgtcaaatccgcgaaaccaccgtcaccgacacctcaaaccaaatcacctgggttgtcccagtcgtggacttcaacgacccagtgctggtgttttccgcgcgcggtgaaaacctcaccgacaaggtctccctgcaccatcaagagatttacgttctcgcgccagcggaagcaaaactcgaagacatggtcactggccagccagtaccagttattgagcaattcctcgtagagggctggaactcatgggtgtgctcccgcgtggacgcccgtggcctgtcctctctgaaggtcaacaaagaagtccgatgcattgacccacgtcgacgcgttgccttccaccacccagccgaattggtccctcacgtacgatccatttccggactccccgtacacgcgcagtccctgatcgccgagttcccaccaaccctgagcggacaagacgaaacctggatgctctccatctcggctttcgcaggtgtaggcgctgctggtgaagaaatcgccgagccagagcctttggaagtccctgccgacggtggccttttcgccatcttcgacccagaaatatacgacgccccatgggtgggtgaatacctggtccgactccgcggcccacgcaatgaatccttccgacacgaattcgccatcgtcgaagacatgaccaccgaattcgaagtcgcctcaggtgcatcatttcgaatcccaaccaccactggtctcagcgaagccagcctacgcgtgcgttccggtgaaaagcacttcaccgcagagccacgcctggtcaccgttgaagcaaccgaccccaacgcatcattcgtggtcaccaccgatgaaggcgatcaaatgccattgcgatttgtgccaccacaaatcgccatcgaacttccactgaccaccgagccaccaacctggcgcgtcacccgtactgtctgtggaccacgcgacctcgacggtgcaggcgaactccgcatccgcaccggtgtcgatgtcggcgatccaaaggtcagtgtgcgcaaccaccacggttcaccactgcgaaccgtgaaaatggtcacccctgacaacggccgtacctggattgccagcatgaaggaaatcgcagccagtacctttgtgatgccacgcggatccatcgaatttgagtggactgaccgcaaggttgaccgtcgcgtttccgtgacgattgctgtcattgacaaaactgagaactttactggcatcaccatcgaagatggaaagctcgtattcgaagaactcgcagccggtcgccaactcgctgcatgggtgtggccacaaaccgcaccgtgggtaagcgcagtggaacttgctgtcaccggaccagagctggaactccctgaagttctcgtcggcgcaggcaacctgattgttcaactccacaccgctgacccattcactacctccgtgaccccactgtcaccaggaaaagctgcggtcaccgttgagcaagaaggctactactcagcacaaaccgaagaatatgcacagctttcagcattcttcggtggggaagtagaagaaccaccaatcagtgacgctgtggtccccgcactttgggatgtttcccatatctggaccgaacagggaaacaccgagcatcttccagtagtccatgccgccctgcgctcctcaccagccgcagcactgaagggtctgtccgcttcgctggttcccgcacaggcactacctggaaaagtcatttcctccggactggcagcctcaccgttcaccacggaatcaccagcaacagaagtgcaccgcaccgcatggatcggaaccctgcaactcctgggtgcactgccaagcgcattcaaggaagccgaagagcttggcaaccgcacaccactgctgccaatcctcggacaacttgaggaagtcgccggcaagaacatcctgtccacccttgcaactggccgtgactccactttggacaccgcatgcatcgaccaatccaccgttgcgattgccggcatgaacgaaacccagcaaaaagccctgctggacatgttcttcagcaacgccgacatcgttcctggaccactaatggaagacaacacccgcctcatggcagtgttcgaaaccttcaagaagcgcgatgcactccgtgaggttctccagactgaaggcttgattaagaccgctgtagaacttcttcgtgccatgcgtggaacccagcgtcagctgtattcctccgcacgtattcgattcgacaagctcgatggtgtcaacactgacaacccagaaaacatgtgggcactcaccccagttgtgtcactggtgttcgcgttgtcatcccgtttgcatgcacacgaattgatcggcaagacccgaactctcgatcgtgcatctgccggttggggtcgaatcgctgatctggtgccagaccttgtcaccggtgacttgatctccgcggaggcaatggttttgggagctcgaaacccaggactcgtcgat

SEQ ID NO: 2263 - DNA, 963 bp, Corynebacterium glutamicum
atgcaggcgtccaacatggcggacgcgctcggattcggcggcctcatgttgtttgtccaagcgcgcgagatcgcgggtgatggaatccctggtcatgtcgagttcgcgcagggctgcggtgcgggcagccacctcgacgcgagtgttgtcggcagcgtggagggcgccatcaaaagtgccggcaatgtcgtccaaggcggcagaggccgcagcaagttgagcttctgcttcctcaatttgagctgtgatttccacagtcgaggtttcggtgccgacctgaatccacccagcgccgatgagcacaccattgcggtcaacggcacgcagacggggatcatcctcgattgcttggcggccgagggaggggtcgtcgacaagcacaacgtcggcaagcagccggtttaccgggccggcaatcgccggatccagatcaacatggtcgagcagccagctcgccccggccggaatgttcgcgtccaggcgccatgcgccgccagcctgcgtgccatcaacgatgatggtgcgtgcaacgccggcgtcgataagcttctcgacgagcccttccgcagcctcgccagccagcgcctcggcatgcgcacccagggcggcagcgagagccttatcgacgtttcgttgcggtcgaatcaacgtggccagctgcgggtaatccaccacatcagcagcatcggaacgtggcctattttggttaagcgtctcaatgcgcgactgcaacctggatacttctttttccagatcgctgcgcttagtacgaagctcctcaagacgagtctctgctgcttcggcttcatgttttgcctgtttgagggcttcttccaagggcgcacgatccgtgtcaacgccctgtttacgctcatcggtgaggcgacgttcacgttccacatccaaaatgcggccgatgaactcctcaagctgctcactgagtcgctcagcttcctcctctgc

SEQ ID NO: 2264 - DNA, 3465 bp, Corynebacterium glutamicum
atgtatttgaaatcgttgacgctcaaggggtttaagtctttcgcgtctgcgacgaccctgaaatttgagccaggcatttgtgccgtggtgggtccgaatggttcaggcaaatccaatgtggttgatgcgctggcctgggtgatgggtgaaggttctgcgaagaccttgcgtggcggcaaaatggaagatgtcatttttgctggcgcgggcgatcgtaaaccgttgggtcgcgcagaagtcacgctgaccattgataactctgatggcgcactgcccattgagtacaccgaagtgtcggtgaccagacggatgttccgtgatggtgcaagtgaatatgagatcaatggggcgaaagctcgattgatggatatccaggagctgttgtcggataccggtattggccgtgaaatgcacatcatggtggggcagggaaagctcgcagagattttggagtcccgccccgaagagcgccgagcgtatatcgaagaagctgcgggtgtgctcaagcaccggcgcaggaaagaaaaggcgcagcgcaaacttcagggcatgcaggtcaatcttgatcgtttgcaggatctgacccatgagttggccaagcagctcaagccgttggctaggcaggcggaagcagcgcagcgtgcggcgacggtgcaggctgatttgcgtgatgcgcgtttccagattgctggctttgagatcgtgaagctctcggaaaagctggaaacctctactgagcgcgagaaaatgattcgtgagcaggcggaagcagcacaagagcagctggaagaagccaccacaactcagatggaagtggagatggagttggcggagatcactccgcaggctgaagctgcgcaacagttgtggtttgatttgtcttcgctggctgagcgggtgtcggcaacgatgcgtattgctgcagaccgtgcgagttcaggtgccgcggatgtgccgtatgcgggccaggatcctgatgagttgcttggtcgggccgaaactgctgacaaagaattagaagaactcgagatggccgtggaaatgaccaccgagcgtttgacctccattcaagaggaagccgaggataaggccgcgcaggctcgtgaggctgagcgtgaacacttggcgcaggtcagggcgatttctgatcgtcgtgaaggtgttgtgcgcctgcttgcatctgaggaatctttgcgcacccagcacacgtcagcagaggaggaagctgagcgactcagtgagcagcttgaggagttcatcggccgcattttggatgtggaacgtgaacgtcgcctcaccgatgagcgtaaacagggcgttgacacggatcgtgcgcccttggaagaagccctcaaacaggcaaaacatgaagccgaagcagcagagactcgtcttgaggagcttcgtactaagcgcagcgatctggaaaaagaagtatccaggttgcagtcgcgcattgagacgcttaaccaaaataggccacgttccgatgctgctgatgtggtggattacccgcagctggccacgttgattcgaccgcaacgaaacgtcgataaggctctcgctgccgccctgggtgcgcatgccgaggcgctggctggcgaggctgcggaagggctcgtcgagaagcttatcgacgccggcgttgcacgcaccatcatcgttgatggcacgcaggctggcggcgcatggcgcctggacgcgaacattccggccggggcgagctggctgctcgaccatgttgatctggatccggcgattgccggcccggtaaaccggctgcttgccgacgttgtgcttgtcgacgacccctccctcggccgccaagcaatcgaggatgatccccgtctgcgtgccgttgaccgcaatggtgtgctcatcggcgctgggtggattcaggtcggcaccgaaacctcgactgtggaaatcacagctcaaattgaggaagcagaagctcaacttgctgcggcctctgccgccttggacgacattgccggcacttttgatggcgccctccacgctgccgacaacactcgcgtcgaggtggctgcccgcaccgcagccctgcgcgaactcgacatgaccagggattccatcacccgcgatctcgcgcgcttggacaaacaacatgaggccgccgaatccgagcgcgtccgccatgttggacgcctgcatgctgcggaaacacgccgtgaagagctgcgcgaacagttagaagacatcgtcgatcgactctcccgcgtggaagacgaagaagacgctgacgaaccctcaaccaccgcccgcgaccaagcaaatgccgagctgcaacaaatccgcgccatggaaatggaagcacgccttgcccaacgcaccgccgaagagcgcgccgggcagcagcggggcaagggcgatagtctgcgacgccaggccgagcatgagcgccaagccaaaatccggcatgaacaagccatggaagcccgtcgcaggcgcacccaattggctgcagccgtgcaaaatggcgcacgcgatgtggccgagcgtgtctcagctgcccttgcccaagcagccatcgaaagagatcagcacaaccgcgacaaagcgctgctgacctcacacttagcgcgcgccaaagatgctgtgagtgctgcacgccagcacctcaatcgactcagcgacaacgcccactccatggaacttgcgcgcagccaagctcaagtgcgcatggaggaagccgttgccaaaatcaccgagcaacttggcattccggtcgcagaattgctgcgcgattacaccccagatgaaaactttgatgaaaagttccaacgggcacgcctcaaacaagccgaaaaagacctcgccgcactaggcaaagtcaaccccctggccttggaagaattcaaagccttggaagagcgctacgagttcctctccacccaattggccgatgtggaacaagcccgcgccgatctgagcggcgtgattgaagaagtcgatgcgaaaattctgcagcttttcaccgatgcctggaacgacgtggaagcagaattcccacgcgtgttcaacaccttgttcccaggtggcgaaggcaaactgatcctcaccgagcccgatgatttgctggcaaccggcatcgaagtggaagcccgcccaccaggaaaacgcgtcaagcgcctatcgctgctatccggtggcgaaaaatccctcaccgcactagccatgctcgtcgcgattttccgcgcccgacccagccctttctacgtgatggatgaggtggaagcagcactcgatgatgtcaaccttcgccgacttatcgcactgtttgaagagttgcgccgcgactcccagctcattgtgatcacccaccaaaaacccaccatggatgtggctaacgtactctacggcgtcaccatgcgtggcgatggcgttacccgcgtgatctcccaacgcatggaacctgcttctgcaatggaaactgtggcgggg

SEQ ID NO: 2265 - DNA, 282 bp, Corynebacterium glutamicum
atggagaaagttcgtctgactgcttttgttcatggtcatgtccagggcgtgggttttcgatggtggactacctcgcaggcacgagaattaaaacttgcaggttctgccagtaatttaagtgacggccgggtgtgcgtggttgctgaagggccacaaacacagtgcgaagaactgctgagaaggttgaaggaaaaccccagctcgtatcgcagaccaggtcatgtggacacagttattgagcaatggggcgagccgcgtgacgttgaaggctttgtggagcgc

SEQ ID NO: 2266 - DNA, 1854 bp, Corynebacterium glutamicum
gtggaaagtggggcaattgtgacaacaccaactcttgtctatttgcatggggtgggtcggggagatctcaaacaagagtggaaagaccagctttcgcaggggttggccaggattgggtttccgagcctggatgatgtcactgtcttaaatccggtatacgcagatgatttgtgggaagatccggaagctcaacataattttgcggtgccaccggtacaaaaacatatgacgttaagtggcttggagcttttagagttcgagcgtcgaacagctgcgatggaaaccaggcttggtcggcataatcggggagcgggtggcgcatttcctgaggcggtggtgtctcgaagcgtggagttgccactttttgtacaggcccggaatttcctcaacaatcagcagatcagagctcaagtgcatcgccgtattttggagcagcttccaaccgagggagagattgtgctgttggggcacagtttggggtcggtaattgctgcagaccttttgaggcgattgccgccagagcttacggtgaagggatttgtcaccatcggtagtccgttggcaaatggtcaattcaatgtggatgatttgtttaagttgctgcgcacgccgttgagcaatgtgtcgtggtgggtgaatttttggagtggatctgatcctgttgcagcaaaacgcggagtgtcggtggctgttccgtgggtattggattttcgtgtgaaaacctcactggtcccaggccctgggcattcttcgcgggaatactgtgccaatgatgcagtggcggaagcaattgggtttgggctgttcggatcgcgcagcaaagaaatcgtccttgcggagaaaaatctgcagattccgctcaatgacgcggagatttttgtgctgcaggcgctgcgttattgttacctcattttgcaacggctcaaaggcgatgaagccttaaggtatgagtacgcacttcgggagactcaggatcgcctgattgaggagattaaatccagaaacgccgaagagggccggccgattccgaaggaaatcgcacgcctggattttgataacggtgatccaaacgcagcagctcctgttccaggtttgagcccatttatgcccaaagagcaggcaattgagcggcttttagagatcattggacagaacctgctgctgccttttgagatcgaggtgccggagaaaattcagcgggaagcactgagggatttcacggcggaaactcaattgggttccaccgtgggcgctgatatttttgatgcattgcaaatggctgttggggtggtgtcgggaagcgcgaagagcaattggcgcaaatggggagcgtttggtgtgggggctgcagctttgaccgctgcaacgggtggtttggctttggcggctgtgccgactgttgctggagtagccactgttgcctcgacactcgcagcatttggtccaggtgggatgatgggcggtttggtcactgcaggaacactgctcacagttggtggcggcagtttaaccgctggggtgttgagctcggtgaacaccacggaagagatcgaagcgctcgttgtacagaagctaagtttggctattttgtggcagcgccatgagatagatagaactcatgaggtgtgggaagaattcgcggaggcagaacgtctgattgtgcgggagcacacgcgtgtgaaaaacgtgtcggatagttcttcgcccattttgaaagctttcgagcagcagcgttcgactattgagcgggcgttgaagtatttgagcgatcatgggatggaacctggctggtttgaagaactcgaaccaccagccccaacaccgtttctaaaactgcgggctaagaaaactgat

SEQ ID NO: 2267 - DNA, 858 bp, Corynebacterium glutamicum
gtgagcatcgatctgcgagacattaagcttttggtagctgccgtggattgtaggtcgattacaggaggtgcccaggcagtggggctttcactgtcggcagctagctccaggatcacggctctggagaagaaacatggtgtgtccctattgcagagactacgtagcggagtggttcccactgaagctggcgaagtagtcctaattcaaagccggagacttcttgagcaagccgacctgctcactagtgctttccaacagcaccaaaaaacgcacatcaaattggtgagtaatacctccgcggtggattcactgacagagtttctggcagcaacgcttaataagtatccagagctcaacgttgatttggaagaagagtcaagcagtgaggttgcacgacgggttcgagaaggcactgctgatttaggggtggtgtcagtgctggagtctcgaacaggtttagaagcacacttattatgggaagatcctttgatgattgtcagcacgtcagctaagacatcagtggaagcactaaagggtccaatgattggtttatctgctgggatcccacttcaaacctatattgatgcgcaccttagaagagatggaatcactcccaactaccgagtccgtttgcccacgttaagtgcggtttatgcggttgctagtactggagcaggatcggcaattcttccgcttggaactacgagaagattagggatccggacaaagaatgtacttcccatcgaggaaccttgggcacaacgcgatgcatggatgttggtgaaggaaggacgcacattagctgacgtagaaaaatcttttatagacgccctgttgagctttcgggacgaggaatcc

SEQ ID NO: 2268 - DNA, 831 bp, Corynebacterium glutamicum
ttgtgcaggaattcggaggcggacatgtcaatcgagtggttacaaattgttgaattaggagcgatctttggtgcaggtttcctcgcaggaagcatcaatgtaattgtcggagcaggaacattagtgtcgtttcctattctcgtgttcctgggccttccaccgttgactgccaccatcgccaacaccatcggcatcgttcctggaagtatttcgggtgtggttgcttatagacgtgaactacacgcccatgtaaaaaccatcagatttctgctgccagcatcaatcctcggagggatcaccggcgcctcgctcttgctgcatttctccgcagatgtttttacagcagtaattccctggctgattggattcggcacgctgttggttatcgcaggtccatcaattaagaagcatgttggcgctcatacttcaggtggcatctctgctgggtttaggcaattgcctttcccgagccgaaccaccttcatcgtctcagtatgtggtgccctgttgctgggcatgtatggagggtacttcagcgcagctcaaggcattcttctcatcgcattgcttggcatcacatcaacgctgcagatgcaggaactcaacgccatcaaaaacctcacagtggcggcagttaatctcatcgcagccagtgtttttataatcatctcccctgagttgatctcctggccgaccgttgccttaatcgcgcttggctcagctttaggtggatacatcggcggacggtacgcccgccgacttcgccccagtgtttttagagcatttgtggtcatcgtcggaatcaccacggtcatcgttatgacgatcggt

SEQ ID NO: 2269 - DNA, 183 bp, Corynebacterium glutamicum
gtgaagggaactacctcgatgctggcggttccaacaagcgtgatcaacgcaagaacaacatctagagcaattactgcagcagctcaaaagagggcgtctgaatcgcttgagttttcttcgcctgagcattcaaattgccactccaacttggatatacccgaaatccccgtttaccgggacgct

SEQ ID NO: 2270 - DNA, 447 bp, Corynebacterium glutamicum
atgagcttttctggatttgagcagtttattgggctcgttgcaaatcgctatggcaagccaggtacaccgcacagcgaagaacagcacagcgattatgaagcggggactgttctcttaggatcggagacctggcatatcagaaccgctcgagtcaccccgacaaaacctggtgccttcgttgcattttggatgcgcaatgaacaaggcgaaatttgcccgtttgattcctctgaggcctgcgcaggccttctgatttttgtccaagatgagagtaatttcggagtatttcgattcacgcgagagcagcttgaacagcagggaattactcgttccactaagcgtcccggtaaacggggatttcgggtatatccaagttggagtggcaatttgaatgctcaggcgaagaaaactcaagcgattcagacgccctcttttgagctgctgcag

SEQ ID NO: 2271 - DNA, 615 bp, Corynebacterium glutamicum
atgagcgaagcttttgatgcaaccaaagtgcgcaaagctgtgctcaccgtcgcgctgcttaacttcgcttatttctttgtagaattctttattgcattaagcgcaggctccgtttctctactggctgacagtgtcgattttcttgaagacacctccatcaacctgctcattttcattgccctaggatggccgttggcgaggcgcgcagtgatgggcaaacttatggcgattgtgattcttgcacctgctgcttttgctgcgtgggcagcgattcaacggttttccgcaccgcaagcgcccgaagtgtttccgatcatcgtcgcttctctgggcgccgtcgtgatcaacggcgcgagtgccatcattatttctcgagtgcgacaacatggtggctcgcttggccaagctgccttcctatccgcccgaaatgacgtcctgatcaacattgccatcatcatgatggccttaattaccgcatggacgacgtctggatggccagatttgatcctaggttgtttcatcattctgctcgcactgcacgccgctcacgaggtgtgggaagtcagtgaggaagaacgcctcgcctccaaagcccttgctggggaagccatcgat

SEQ ID NO: 2272 - DNA, 858 bp, Corynebacterium glutamicum
gtgcctgaactgcctgaagttgaggtggtgcgccgcggtttagaagatcatatggtcggccacaccatcgtgtccgccacagtgcttcacccgcgcgcagcccgcaatcaactcggcggtggccccgaaatcgaggccaacatcgcagggcttagggtcagcgctgccaagcgacgcggcaaattcctctggcttgagcttatcgacgcaccctccggcgaaacccgtcccgatttagggctactggttcaccttgggatgagtggacaaatgctcatcaaagaaccagatgcaccaattagtccacaccttcgagccaaagtcgagctagataatggcgatgaagtgtggtttgtcgatcaacgcaccttcggttattggtggctcggcgacctagttgatggagtacccgaacgcgtctctcacattgccacagatgtattggatgagtctgctgatttctctgcgattgcgcggaatttgaaatctcggaaatcggagatcaaacgcctcctgcttaaccaagagatcgtctccggcatcggaaatatctatgccgatgaaatgctctggcaagcaaaaattcacccattgcaacgtgccgatcgactgtccctagctcgcttggaagaacttcttcaagctggcaaagacgtgatgaccaaagcacttgctcaaggtggcacctctttcgacgcgctctatgtcaacgtcaatggcaactccggctactttgcgctgtcattgaatgcttatgcgcaaaccggggagccgtgcggacgctgcggaacattaatcatccgggagagtttcatgaaccgcggctcccactactgcccaaactgccagaagcggcgc

SEQ ID NO: 2273 - DNA, 741 bp, Corynebacterium glutamicum
gtgagcaggaaaaagaatcgcctcaccggggtagacgcactcaatgaagcattcgatgcagtagatcatcagccgctgcttgaccaccttggtgtggacatccagcgcgatctgttggtgcttgcgttgactcaccgctctttcgccaacgaaaacggcatgctgcccaataatgagcgcttggagttcctcggcgacgccgtcttgggtctctccgtggccaacaagctctatgagcagtaccccagcagccctgaatctgatgtctccaagatgcgcgcttcaattgtcagccgttacggcctggcagatatcgctcgcgaaattgatcttggcaaccacattttgctgggcaaaggcgaattgctcaccgaaggtcgcagtaaggattccattcttgcggacaccacagaggcgttgttcggcgcgattttccgccagcacggttttgaaaccgcccgcgacgtaattttgcgcctgtttgcctacaagatcgataacgcatcggccaggggcattcaccaggactggaagaccacgctgcaggaggaacttgctcagcgcaagcgccccatggctgaatattccgccacctcagtcggtccggatcacgatctagtgttcaccgccatcgtgacgctggaaggtgaagaaatgggtcggggagaaggcccgaacaagaagctggccgagcaggaagcagcgcaccaggcattccgaaagcttcgggagtcccgtgcc

SEQ ID NO: 2274 - DNA, 534 bp, Corynebacterium glutamicum
atgaaatctccatttatttttgatgtcgccgcactccttcgtggaagtgcccttccggaacacctcacccaatcaggtccaagcccgacccgcattggtccggaaatgatcgcgatccccgagggcggaaaagttatcgtagaagcccagatcattccactcggtggaggcctggccgtcgaagcagatatcgaagcgcagcttctgggacagtgctcccgctgcctccgcgaactcaccccaaccaagacgctgcacgtctctgaggtttttgctgccgatccagactttgttactggtgaagatgcagcagatgacgaagatgagctgccaatggttaaccaagaccagattgatctgcttcagtctgtcattgatgaagctggtctgaccttgccgtttaaccctgtctgcgaagaacttgggtacggcgcatgccaggatgatgaaacgccagctcctgacggtgtctctgaagaagtagaagacgaggaaaaggtcgatccgcgctgggctggtttggagaagttcctg

SEQ ID NO: 2275 - DNA, 789 bp, Corynebacterium glutamicum
atgtacaaggtcttcgaagcactggatgatttagttcaagccgttcaacgcgcatacggcgttcccatgaccggaaattgcgtggttccccgtcaggaagtgcttgcgcttctcgatgatttacgtgatgcgcttcctgtagaacttgatgatgcacaagatgtgctggaccaccgtgatggtgtgatccgtgaagctgaagaaaaggccattgccttggtcgacgatgcagaaaacgaggcccgaaacctccttgcacgcgcaactgaggagtcagatgccatggtggaagacgccaccaagcatgcgcattctgtcgttgctaaggctaatgacacagcggatcgcatcgtgagtgacgctcgtcgagaagcaaacagcgtcaccgagcgcgcccaggctgaatctgagcgcctggtcaactccggcaatgatgcgtatcgccgcgcggttgctgaaggccaggccgagcaggatcgcctggtcagcgaggcagaagtggtgcgtcgctccacggaagaagcacaccgcattgtggatgcagcgcacgctgactccaacaagctgcgcaatgaatgcgatgactacgtggataccaagttggcagagtttgaaacctcgctgtccaccacgttgcgttctgtcactgctgatcgttccgcactacgccgaggagctggagctactggccgcgagctgcgcgatgagcaaccggcagcgcgtggtgaatatgagcgggactacgagcgtgattatgaacgaggctacgaacgcgacgatcgagactac

SEQ ID NO: 2276 - DNA, 1644 bp, Corynebacterium glutamicum
gtgcagaaaggttgtggattgatgcgctccctgcttcgtgatatccctgcggtgggttggctaatcaccgcgacgattgttgtgcgcacgctcgttgttgcgctggtcatcgttgggatcggcttgcttatcgacgtcccctcgcccgctcattcagccatgttgtggtgggttctggcaggtgccacggcagcagctgcgctgctgtgcgcggaagcggtgctcccccaacgtattcgtgcacgagttgaacgatcctggcggcggcagttggctgctaaaaatctggagctgaattccagttcgtcagatgatgcccagttgatcacactggcaactgaagccacctcaaaagcatccacttacacagtgatgtttctggggccttactttgcagtatttttggccccactgacagttattgccgttgtcggcgcggctatttcctggccgattgcggggatactgtgcctcgggttgtgcgtgatacctttcgttatttcttgggcacagcgcatgttgaaaggcgctggcgcgggatacgggcgagcatctgggcagttggcaggcgtgtttttggaatcggtgcgcacactaggcaccacgatgatgctgaatgccgctgggcagcgcaggcagatcatcacacagcgcgcagagaatatgcgctcccaagtgatgtcattgctgtaccgaaatcagttgatgattctggtgaccgacggcgtgtttggagttgccaccacaatggttgctgcggtgtttgccattggaggattcttttcaggctctcttactctcggccaagctgtagcactcgtattgctggccaggctgcttattgatcccatcaaccgcatgggtcgcacgttttacaccggcatggcaggcaaaccctcgctgatcgccattgaaaaagccctcgcgacaacctttactgatcagccaactcaacagggacagcgccacgatggggatctggtggtcaacaacttgaagatcgcccgcgatcacagggacattgtgcacggtatctctttcagcattccccgcggttcccacatcgcggtggtaggtcccagtggcgctggtaaatcctctgtggctctagcgttgtccggacttttagagtttgatggtgcgatttccctcggcggccacaactgtgagatgttagatcttcgcgcctcagtcagtttcgtgccccaatcccccacgctgtttagcggaagcatcaaaagcaatatcgatctggcgcgcacgggtgttgattctgatcacatccacgcagcacttttaggcgaagaactccccgcggacctcaaagtcggtgaaaccggcaaaggtgtctccggcggccaagcagcacgcatttccattgcccgaggtttagtaaagaatgctgccgtgattgttctcgacgaggcgaccgcacaactcgactacaccaacgcccgccaggttcgacatcttgccaaatcccttgagtgcacgttggttgagatcacccaccgcccatcagaagccctcgatgcagacttcatcattgttttagaggatggccaattgaccatgatggatacacccagcaacgtttcccagcacaatgcgtttttccgcaccgctgtgatggaggaagaacaa

SEQ ID NO: 2277 - DNA, 1530 bp, Corynebacterium glutamicum
atgatttcccgacttctccaattggctaagaaagtatggccggaacttggagcctccacgctcctgcgactgctcaatcagctactcaccgcagcactcattgtgttccccgcctgggtgctaagccgcaaaccagacatctccctgctcgccgtcgccatcatcatggcgctcatcgcgctgacagcagctgtctgtcgctggggtgagcaggtatgcggccaccgcgctgcctttgggctgcttgcccacatgcgcgttatgctttacgacgccctcgtccacaaaggttccccctcgccgatccacggcagcggttcgatcatgtctgttgccacccgtgacattaactccatcgaagtattcttcgcgcacaccattgggcctacagtcaccgcagtgctgctcagtgcgggaggcgtgatcacgctggcaacgctcgatcccgttgctggtctaattggtttactcggtgtcctcatcgcgtggttgatccccttgattggaaaacaatcctcaagcagtgaagccacatcacgtggacacatcgcccagcacctcaccgaagatgccgccggcaggcttgaaatcaactcacatggagcgcaagccacacggttaaatgcgctcgaggtgaaagagcaacaactggaacaagttgtgacccgacagggcttgatcgtcggtatccgtcagggcgcagcacttttatggccgtggatatcagctgtgttgttggttgctctggttcctcatgtgggcattgttgcagccgcgattatcctgggcatctcccctgcgttggatgcagttgagggatttgctcgcaccatgcctaccgcgttaaacagtgcgcagcggtatttccagatcatcgatgcccctgttgctatcgctgaacctgacgagccgaagcctttgcccaaaggcccgcttaagctgcgaatttctagagttccagtcagcgcaaagggcaccgtgtctttagaggttgcagctggtgaacacatcggcatcatcggatccagcggtagtggaaaatccactttggccaaactcatcctcaagctggcgcaactacggtctggaaccatcaccatcggtggtgttgatatcgcagaggtttcatcggcggagcttcgcaaatccgtcacgctggttgagcagaaatctgtgctgtttagagcaagcgtgctggagaatttacggatgggcaatccagagctgtctgaagatgaagcaagggaagccttgaggttggcgtcgataagcgaactgcctttagatgctgacgccctgcgcctatctggcggacagcaacaacggctctgcctggcgcgtgctttggcacgcacccctcaggtactgattgtcgatgaagccaccagccaccaagatgcgctcaatcaagcggatctttcccagactctggccacgcttaaagacaccacggtgatcatcattgcgcaccgcacagctgcattaacccatgtggatcggataattgacctggaagaaatcaaaaatccc

SEQ ID NO: 2278 - DNA, 1122 bp, Corynebacterium glutamicum
atgtccaactcccccaccgacgtttcaacgagcgcacctcgaattatgatcgcgccagattcctacaaaggaaccgctaccgcatcagaagctgcgcaatacttaggcgaaggcgtgttggaaattttgcccaacgcctccattacgttggcacccatggccgacggtggcgaaggaacatcctcagttttcggcgggcaggtcataacattacccacgacaaatgccgcgggacgcctcaccgaagccagctacaccttagattccgaaacaaacactgcctacattgacatcgccgcagcctccggtttgcccgccgttgcagacgatctagtccccaccaccggcgatacctacggcaccggcgttttgatcgcagacgcggtcacccgtggcgcaactcgcattgctttaggccttggcggatcagccacaactgacgccggctcaggaattctcatcgccctcggcgccgtcccacgcaacaaagagggctacgcactacgaaccggtggcgccgacctcatcaacctcgattacatcgataccgccgaactcaacatccccgcagccgccgtcgaatggatcctgctcaccgatgtcgacgcccccgccaccggcccgcagggcgcggccaccgtattcgggccccaaaaaggtgccaccgaaaaagacatttcgcttctcgacgccgccctccaccacgcctgcgcccaactggaagttgatggcacaaagccaggtatgggcgcagccgggggcattgcaatcggactgacgtggctgtccaccctcatgcacggcaacgaccaacagatccatatcctccccggcgcgccactgattgcccgctccaacggaatcgaggatgcgctgccagaaactgacttgttgatcaccggtgaaggccgactagattcccaatcgttcaccggaaaggttgtgggcaccctccacggtttagctaaagcccacgatgtggatctcgctgttgcggccggcatcgtggaaggcggtattcccgatgatttcctagcggtagaaatgattaaatcctccgacgttgcagcacaattacgtgatgcaggccgaaggatcgctcaagaatacgtagctcaaaac

SEQ ID NO: 2279 - DNA, 441 bp, Corynebacterium glutamicum
atgggggctagtcataacaccaaggctattgtctactgtggtgttatgccgaagattcagtttgatgttttagtccccgacacagattccatcgcactagcgggacgttttaccgtagtcgccaaccttttgatcgaaaaaggcctcatggatcatggcgttgttgtccatgatccagcagcgaaaatcgcagaagctgtggaagagcagcttcgccagacttaccgcgacgagcatgaagatgcagacttggaagaatcctcggtcaaccgttacctcattgaagttgatggagttaaaggctccgttaaccaagtgaccatgatttttgcccgtttgctcaccccgccagcagagttgccaaaggacgctttcctcctggagcaggaacttgcctatgaagttcctgcagtctacccatggactgtggagatccttcgc

SEQ ID NO: 2280 - DNA, 1284 bp, Corynebacterium glutamicum
atggctgacggcacgatcaaacagattcaccctttcacaggcaccgaagtgtggacggtccctgggcgtggaaatcgacctctgtcacatcccgcttctacgatcgtcgaactatctgcacacgatcacacctcttactgtgcattttgttccgacaatatgctctccactccgcctgagaaatcgcgcatcatcattgatagctccggcgactttgacatccttcccggagcattgcctggtgagctttcagaaaccactccggaatttcgacgagtccccaatctgtttgagattgtctcttttgactactggcaccagaattttggtttcgatatggattcagaaaccgccatgcgcatggcgcaatacttggcgattccagaaggtcgcgaacatgttttagccattgtgcgcacccgactttctgccgctggtgaagatcccgcgcacatgaccgatggcgagttgttagaaaaagctcccagctactttgctggtggtcatgacgtcatcatcggacgccgacactttgtcgatgacgcaaccaccagtgatcaattggcctcatctggaacactgaccgttaaagagcatgaggcgttcatccgcctgactgtcgatggcatcagggatttgtaccaccgcaaccgttacgcaccgtatgtagtggcgtttcaaaactggttgaaacccgccggcgcgtcttttgaccatcttcataaacagctcgtcgccattgatgaacgcggccgacttattgccgatgaactgcatcatctacgtggcaatcccaatatgtacaacgaacttgctgttgattacgccggataccacaacctgatcatcgcggaaaacgatcacgccgtggccttcgcaggtttcggtcaccgctaccccaccattgagatttactctaagtccgctattcctgaaccctggcttcaaagcgacgaggaaatccaagcgatgagcaacctcatccatgcatgccatgctgcaaccggcgcagatgtaccctgcaatgaggaatgggtacacaaaccaatcgatgttgatatgccaatgccctggcatgtgatgatcaaatggcgtgtttctaccctggcaggttttgaaggtggcaccaaggtgtatctcaatacgctgtctccacacaaggtccgagaccgtgtggtgaaagaaatgtaccgactacgcgatgaagaactcatcgcatctgatctgcgcatcgccatggaatgctccgttgaacgcaacagccttaaatacaatcccctccta

SEQ ID NO: 2281 - DNA, 1263 bp, Corynebacterium glutamicum
atgagccgcatttcagaacttctaaacaatcatggtgttgatctgtcgtggcaagaggccgcatatcaggatttccacgaacatcctgagctctccggcttcgaatcagagaccgcagatcgcattcagaaatacctcgagcgttttgattgtgaggtgattccaaatgttggcggttacggcattctggccgtgttccgaaatgggtcgacagatcctggtgcccctgttgcgttaatgcgcgcagatttcgatggccttcccgtcaaggaaatcaccggagttccgtttgcttccactcgtatgcgtccgcatgatggggcaaatgtccatgtcatgcacgcatgcggccacgatgtccacgtcaccgcgctgcttggtgcgtgtgccattttagatgagcgtcgcgatgcatgggaaggcacgttcatcgcgttgttccagccatcggaggaaaactcccaaggcgctaacaagatggtcgccggcggtttagttgatctgatcccacgccctgatgtgtgctttggccagcatgtagtccccggtgctgcaggaaccgtgatgagcatgcctggcggtgctctcgctgcctgcgattccattgaaatccgcattcagggtcgcagcgcccatggttccatgcctcataattccatcgatcccacttatgttgcagcgatgattgtcgtgcgactccaaggaatcgtgggccgcgaggtttctccagaggatttcgccgttatttctgtgggcaccctccagtcgggcaacaccaacaacaccattccagcaagtgctcgtttggtgttgaactgccgtttctacaacgacaaagtcaagcacaaggtctaccgagccatcgaacgtgttgtccgtggtgaatgccttgcttccggtattgaggaagaacctgtcattgagtacttcgcccacggtgatctcaccaacaacacccctgttgtcttcgatactgtgcgccctgtcttcgacgatgttttcggcgaggattctattgacgcttaccggtggactgcgtcggaggatttcccctccattcctaaggcattcaacagcccttacctgtactggacgattggtgtcacgccgcgcgatcagtggacagaagccgtagaaagagaccgcgtggcatcggatgtgccagccaatcacatgggagatttcctccctgattatgcgccgacgatgtccgctgccacccgcgcagccgcagccgcgctgctgacctacttgggaactaac

SEQ ID NO: 2282 - DNA, 336 bp, Corynebacterium glutamicum
gtgaatatcttgttcatccctattctggcagcgctcatcggttattttgttcggtctcggttgagcgctgtagtgctcttcctcgcgatcgaatcaatcttcttcacgttccagacactagccgtgtttctggcgtggatggcaggagacggcggtttcggcggggccacagatcaaggggctttcgggctgacgccatcgggccttccactgaaattcaatgaccttgatctgtggctttatggtctagttaatttcgccctcatcgccattggagtggcgctgaccattgccgttgtctcttttcgaatccgtcgtcgcagaaaactagatgat

SEQ ID NO: 2283 - DNA, 135 bp, Corynebacterium glutamicum
gtgtccaaagcgggaagttacgtggctgtcgcaaaagacgtgcttagtttttcacgacccattcccgcacttcacgccatcatcggcgcgcttggatggtttggaatgttcgcagtttgtctgtggagcacgctg

SEQ ID NO: 2284 - DNA, 276 bp, Corynebacterium glutamicum
atgttcccgattgggttcttcgcgggagtggtgctcatcttccttggcgcaacagcaggacttggaattgcatcgctagccaagtggtggcaacaccgatcacaggattttccagaaaagaaagtcaccactcacattgtgctgcaaagtaccagcatcgtgatgtgggtggtttttatggttttcatgcaaccgtggattgcgtggctgacgttcgcaaccatcacggtaggtcaggtatttggagatctgctgatgttttccagttaccgtgca

SEQ ID NO: 2285 - DNA, 2550 bp, Corynebacterium glutamicum
ttgaaaccagtaggcacagtacagttcaagaatcagctcccaactcaactccagccactcgtgaagctggcgcataatctgcgctggtcatggcgtgaggaagcaaagcagcttttccgcgacatcgacccagaattgtgggaacagctcgacgaagatcctaagcagatgcttctccaggcaccagcaactcgtttgcagttcctcgcaggcgatgatgagtacctaggtcgagtcaacgccgaggagcaaaacctcagcgaatacctcagcgacaagctgtggtaccaggacaccgcagatgcaaccgatgctgtcggagatccactcgttgcgtacttctccatggagtttggcattcacccaagcctgccaatctactctggcggacttggtgtgcttgcgggcgagaacatgaagtctgcatctgacttgggtgtgccactgatcggtgttggtttgctctacacccacggctacttcacccagtcactgtccggtgacggttggcagcaggaagagtacaagtaccacgatccagcagaactgccgattgaggcagttaaagataagaacggcgagcaggtcactgtttctgtcacctacccaggtgcgcaggaagtaaagattgcactgtgggtagcaaacgttggccgcatcccattgctgctgcttgataccaacatcgaggcaaacccagaagagctccgcaacgttactgaccgcctgtacggtggcgacaatgagcaccgcatcaagcaggaactcgttctcggtgttggtggcgtccgcgctgtcaacgcattctgcgaagctcgtggtctgaagcgctcatctgttgcacacctcaacgaaggccacgcaggtttcctgaccctggagcgtatccgcgagcgcatcgcagagggcatggagtacccagcagcattcgagcaggttcgtgcgtccaacatcttcaccacccacaccccagtcccagcaggcatcgaccgcttcgacatggagatggtgcgtcgttatctcggtggcggtcagccagaagatcagcagctgtgcgttggtgttccaattgagaaggcacttgagcttggtcaagagtccgatccacaccgcttcaacatggctcatatgggccttcgcgcgagccaacatgctaatggcgtcgcaaagcttcatggtgaagtaagccgtgacatgttcgccggcctgtaccccggatatgagcctcgtgaagtgcccatcgggcacgtcaccaacggtgttcacctgccgacgtgggtcaagccagagatgaaggaactcatcgatcgcgtcactggcggcgctgatcttgcggttgctgattcttggtcaaacccacaggctgtcgagtctgagaagatctggaaggtgcgcaacaagttccgtgctgacctagtggaggttgctcgcgctgcaactgcaaagtcctggtctcaccgtggacacaccgaagcagaacttgcgtggacctcccgcgttctggatccaaacgtgctgaccattggtttcgcacgtcgcgtatccacctacaagcgcttgaccttgatgctgcgcaaccctgaacgcctgcgttccatcttgcttaatgaggaacgcccagttcagttcgttattgctggtaaggcacacccacatgacatgggtggcaagaagctcatgcaggaaatcgtccacttcgctgatcaagctggtgtccgtgaccgtttcctcttcctgcctgattacgacatcaacctggccagctacctgatctctggtgctgacgtgtggctgaacaacccagtgcgccctcaggaagcatcgggaacctccggtatgaaggccgtcatgaatggtggcctgaccctgtccatctctgatggttggtgggatgaaatgcctaaggagaccaccggctggaccatcccaaccgttgagtcccaggacttggaatgccgcgaccacctggaatcccaggcgctgtacgacctgctggaaaacgaagttgcaccgctgttttacaagcgcgacaagaacggcatcccacaggactggctggacctggttcgcgaatcctggaccaccctgtcaccaatggtcacctccacccgcatggtgcgcgactacaccacccagtactaccgcccaaccaaacaccaggcagagctcattgcgcagcctgcagaagcagcggattacgcggcatggcttgagcacatcaaagcagagtgggctggcgtcaaggtctcagacctgaagatcagcgagagcgccatcacggcgcaggagcttgaagtcagcgttcgcgttgattccggttcgcttaacgacgacgagttccaagctcaggcactctttggtgcgctcggacacaacggtgacatcgaagatccagaaatcaccgttttgaccccacgcggcgatggcgcctacgcggcaaaggtcagcactgacctgccaggcaactacggcatcactgcccgcgttgttccaaacaacaggatgctggtcagcccagcggaaacccgcctgatcacctacttggagaac

SEQ ID NO: 2286 - DNA, 900 bp, Corynebacterium glutamicum
atggcacttcttgagcagagcatcaatagcgacaccttcatggatgcagttagccttcgcgtcggcgacctagagggtatgactagttactactcttcaatccttagcgttgaaccaatggaagaaaaagttcacggaaaagaagttcaccgtgtactcggtcgcaatggcaccccactgcttcgcctgatttctaccccaggtcttcctgcggtagatcctcgtcaagctggcctttatcacaccgctttcctcttcgatacccaagagagcttggctgccaccgtttaccgcgcagcgcaagaatcacgctcacgttttgtgggttcttcagatcacctagtctctgaagctttttacttcaccgatcctgagggaaacggcattgagctctatgttgaccgccctcgaagtgcatggaagtatgcagacaacggcgatgtccgcatggacaccatctacttggatccaaaccagtaccttcagagtcatctcagcgaaaccgttttgaacaacaccgctattctccctgcgagcatcggacacgttcaccttcaggtaggcaacgtcgagcgagcccgtcaattctatgtggacaagattggttttgatgccaccacatcaatccccaatgcactgtttgcctccgcaggtggatatcaccaccatgtggccatgaacacctggaactcagcaggtgcaggtccacgcgcagcaaccttgggtcttgctgatgtagcagtgatcgttccagtccgtgaggatctggacatgctggtctcacgcctaaagggggaggaattctttgacaacggcacctctgttgtgacccgtgatccatggggaacgcacatcaccgtttcacttccgggtgtctcaacagatgaacttctgaaccga

SEQ ID NO: 2287 - DNA, 948 bp, Corynebacterium glutamicum
atgactttggccacgattccctcaccaccgcagggtgtgtggtacttgggtcccattccgattagggcctatgcgatgtgcatcatcgctggcattattgttgccatttggctgacgagaaagcgctacgccgcccgcggtggaaaccctgaaatcgtccttgatgcagcgatcgtggcagttcctgccggaatcatcggtggacgcatttatcacgtcattaccgacaaccaaaagtacttctgcgatacctgtaaccccgtcgacgccttcaaaatcaccaacggtggtctgggcatctggggtgcagtgatcctcggtggcctggcagtggccgtattcttccggtacaaaaagcttcctcttgcacctttcgcagatgccgtggcacctgcagttatcctggcgcagggaattggtcgtctgggcaactggtttaaccaggagctctacggtgcagaaactaccgttccatgggctttggaaatctactatcgggtagatgaaaatggaaaattcgcaccggtgacaggaacatccaccggtgaagtaatggctactgttcatccaacattcctctatgaactgttgtggaacctactgatcttcgctttgttgatgtgggctgacaagcgattcaagctgggacatggccgagtatttgcactctacgtagctggttataccttgggccgtttctggattgaacaaatgcgcgttgatgaagccacgcttattggcggcatccgaatcaacaccatcgtctccgcagtagtgtttgccggcgcgatcatcgtgttcttcctgttgaagaagggtagggaaactcccgaagaggtagatccgactttcgcagcgtctgttgcagcagatgctgtagcttcgccggatggaaaacccttgccgaaagcaggggagggcattgatggagaaacgccctcaacgcga

SEQ ID NO: 2288 - DNA, 801 bp, Corynebacterium glutamicum
ttggaaggaggttggggcatggttgcaacagagaaccgcatgttgatggaaatcgctgcggaaatatcggctcgggaagcaacgcttggttttcaagaagtcaaaactaaatctcgatcagcaggtctcacggcggctttcgatattgcttcagtctttttttcgtctggatgtaatgtcgtagtcgcctttgatcgttttgcatccaattggtctgatcattcggatcatgtggactacgctgcacaggttgcgggttttggcgcatcaatgcttgcatatacggtgcgcaggggacagtttgataccgcagtacgcgatatcagggacatcaaatctgaagtagacattcccattctgcttcatgatcccatcatcgatccgtatcaaatccacgaagcccgcgtcatgggcatcgacgctcttcaattccccgtatgggcgatggaacaagctcgactggaatctttggtggaccgcaccgaatcattgggcatgacagccatcgtgtctgtgcgaaaccacgaagaagcgcatcgtgcagtggacgcaggagcgacagtggtagcaattgatattactggttataccggctcactcactttgcctgaagcgttttcgggtatcacccaattcatgcccaaagaggtagcccgcattgtgctcggaggttgcagcagccctaaagaactcatgcggtttgcacgacattctgcagacgccatctttgttccacatgcagacctcgccaccacaaaatctcttgtgacagcaggtatgcatccagcgtgcccatcgcgt

SEQ ID NO: 2289 - DNA, 657 bp, Corynebacterium glutamicum
atgaagccacgcgtgctgtcagcattaggcattggagctggcgccctggttgtctggatcagctcacgcatgaactgggtaaccatcgaggctttcgacgataaatcaggtagtgtcacccaatctattgtgggtgcaacctggtctacagaaatcatggcgcttgcacttgctttgctcgctgccttcgccgccgcgttggtgctcaagcgcatgggtcggcgcatcattggtggtatttcggcgctgatcgcggtgggtgccagcctgtctccactcgcgcttctcacccaagacccagacgcagaacgggcccgaaccctgctgacctccggtgtggcctcacagaaggctaattccggaaccctgctgtctgattgggcggagatcatcaataccaccacccatccactggcggcagtggtagccatgattggctgcgcgctagccctagtcggtggcgttgtccttgccatgcgccctggcgaggacacagcgaaaagcaatcagtatgagcgtaaacaggctcgcgctgagaaaatccacaccgatttggcccaagatccagactccggtcgtgtgatgtgggacgcactcgatgaagacattgacttcaccgagaagactcagaaatccaaagaaaccccaggtcaaagc

SEQ ID NO: 2290 - DNA, 354 bp, Corynebacterium glutamicum
atgagtgacaatccacaagagtatgagctggattgggacgtcgaaaagcgattaaagcttaacgacgccggcctggtgccggcaatcgtccaggccgacgggaccaacgaggtcctcatgatggcctggatggatacccacgcgctagcctatactttggcgacccgccgtggaacctatttttctaggtcccgcaacgagtactggatcaagggcctgacctctggaaacgtccaagaagtcaccggacttgccctcgactgcgacggcgacaccgtccttctgaccgtgaaacaaaccggcggtgcgtgccacactggtgcccacacatgtttcgacaatgacgttttgctg

SEQ ID NO: 2291 - DNA, 774 bp, Corynebacterium glutamicum
atgggcgtggcaattcgagttattccttgcctggacgtggacaacggccgggttgttaaaggcgtgaactttgaaaacctccgcgatgctggcgatcctgtggagttggcaaagcgctatgacgaggaaggggcagatgagctgaccttcctggatgtcaccgcctcgaagcatggtcgcggcaccatgctggatgttgttcgacgcaccgctgatcaggtgttcatccctctgactgtcggtggcggcgtgcgcagcgaagaagatgttgatcaattgctgcgcgctggcgccgacaaggtttcggtgaacacgtctgcgattgcccgtccagaactgctgtcagagctgtccaagcgttttggtgctcagtgcatcgtgttgtctgtggatgccaggcgcgttcctgaaggtggaactcctcagccatctggttttgaagtcaccacccacggcggttccaagtccgcagaacttgatgcaatcgagtgggcaaagcgcggcgaagagctgggcgttggcgaaattctgctcaactccatggacggcgacggcaccaaaaacggctttgacctagagctgctggaaaaagttcgcgcagccgtatccattcctgtaatcgcctccggcggcgctggcaaggcggagcatttcccaccagctgttgcagctggcgccaacgcagtgcttgccgcgaccattttccacttccgcgaagtaaccatcgccgaagtaaagggagccattaaagatgcaggatttgaggtgcggaaa

SEQ ID NO: 2292 - DNA, 825 bp, Corynebacterium glutamicum
atggatgctcgtgggatgttggccattgcggaggccgttgtagatgatgccgaagccctcttcatgcagggcttcggagctgcacctgcccatatgaaatccccgggggattttgccacggaagtggatatggccatcgaatcccatatgcgttcgatgctgaacatgatgacaggcattgctgtcatcggtgaagaaggtggcggtgcgacctccggcacgcgctgggtgattgatcccatcgacggcaccgccaacttcgcggcgtccaacccgatgagcgcgatcctggtgtctttgcttgtcgacgaccagcccgtcctgggtattacctccatgcccatgctgggtaaacgcctcaccgcttttgaaggttcaccgctgatgatcaacggtgaacctcaggaaccattgcaagaacaatccagtttggtatcccacattggttttagttccatggcctccccgcgcaatacagcgtttcctgtggagttgcgtcgggatcttctgaccgagctcacggaatcgtatcttcgtccccgcattacaggttcggtgggtgttgatctcgcgttcactgcgcagggcatttttggagcatgcgtatcgtttagtcctcatgtttgggacaattccgcaggcgtgatgttgatgcgcgctgctggtgcacaagttactgacaccgaaggccatccgtgggcaccaggtaggggagtcgtggccggaacaaaaagggctcacgatgtgctgttaagtaagattgaaaaagttcggttgatgcatgcagatgcaggtaatgaccagtcgttaaatgaggagtacaag

SEQ ID NO: 2293 - DNA, 738 bp, Corynebacterium glutamicum
atgaccttcactattcttcctgcagtcgatgtagttaacggacaagcagttcgcctagatcagggcgaggccggcactgaaaagtcttatggcacccctttggaatccgcactgaagtggcaggagcagggtgcaaagtggttgcactttgtggacctggacgcagcgttcaaccgtggttccaaccatgagatgatggcggaaattgtcggcaagctcgatgttgatgtggagctcactggcggtatccgtgatgatgagtctctggagcgcgcgctggcaaccggtgcacgtcgtgtaaacattggtaccgctgctctggagaagccagagtggattgcttctgcgattcaacgctatggcgagaagattgctgtcgatatcgctgtgcgtttggaagatggtgaatggcgcacccgtggaaacggttgggtctccgatggtggcgatctgtgggaagttctcgagcgtttggattcccaaggttgtgcacgtttcgtggttaccgatgtgtccaaggacggcaccttgagtggtccaaatgttgagctgctgcgtgaggttgctgcagctacagacgcacctatcgtggcatctggtggaatttctgttttggaagatgttttggaactagccaagtaccaggatgagggcattgattccgtcatcattggcaaggcactttatgagcacaagttcaccctcgaagaggctttggctgcagtagaaaagctcggt

SEQ ID NO: 2294 - DNA, 633 bp, Corynebacterium glutamicum
atgaccaaaactgtcgcccttctcgactacggatctggaaaccttcgttctgctcaacgcgcactagagcgtgccggtgcagaagttatcgtgagctccgatccagaagtttgcaccaacgctgatggcctcctagttcctggagtgggcgcatttgatgcctgcatgaagggtttgaaaaacgtcttcggacatcgcattatcggacagcgtcttgctggtggacgtccagtgatgggtatttgtgtgggcatgcagatcctgttcgatgaaggcgatgagcacggcattaagtcagctggttgcggcgagtggcctggcaaagtggaacgcctccaagcggagatcctgcctcacatggggtggaacacacttgaaatgcctaccaactcaccaatgtttgagggaatttcacctgatgagcgtttctacttcgtgcactcctatggtgtgcgcaagtggacgttggaaaccgacgatctgaccacgcctccagaggttgtgtgggcgaagcacgaaaatgatcgttttgtggcagctgtggaaaacggcacgctgtgggctactcaattccacccagaaaaatcaggtgacgcaggcgcacagctactgcgaaactggatcaactacatc

SEQ ID NO: 2295 - DNA, 1266 bp, Corynebacterium glutamicum
atgtggaaaagcccaggtttcgtggctgtcctcgtggcggttgcagcagcgttcggcagttggtcactccttcttcccgtcgtaccgctagcggtcctcaacaacggcggatcaagcgctgtcgccggtgccaccactggcatcttcatggcagctacagtgatcactcagattttcactcccgctgcgctgcggaaaattggctacaccccagtgatggctttcgccgcattcatgctgggtgtgccagccatcgggtacatcttcagcgtcgagccaattccagtgctggtagtgtccgcacttcgaggaattgggttcggtgcgctcaccgtcgcagaatctgcgttggtggctgaactcgttcccgtacgcttcttgggcaaagcttctggaatgttgggcgtatttattggcctttcccaaatgcttttcctgcctgccgggttggcgttaggtgaccaatttggctacaacgtggtctatgttttaggtgccgttatcgcactagttgcagcggtgatgtgtctgcgtattccgcaggttaaggcagcggcaaagcagcaaccacaggtgagcgaacaggagcgttctgtttccacctggaagttggtgctggttccctccttggctgttaccagtttgtcaatgacttttggcgcagtgtcttcattccttccagctgcagtcattgagttagatccaggattaggtgctgcattagcgggtattattttatccattaccggtggttcttcaatggtgttccgctacctgtccggcgttatcgctgaccgccgcggtgtgcctggtaccacgatgattcctgctcagatcattgggttcttaggtgtcgttttaatcaccgtcacaatcttccaaggctggtccgtgtggcttttgattataggtgcagtgatgtttggtggtgcttttggcatggtgcaaaacgaagcgttgctttcaatgtttttccggcttcctcgcactagagtctccgaagcctccgccatctggaatatcgcctttgattcgggaacaggaatcggaagcttcctccttggcatagttgccgcatcgcttgcttacagtggtgcttttggttccggagccgtggtgattttgtttggaatcgttttgaccaccgccgatcgaatcattgggcggcaccgcattactgaatacaacaacacccgcgcgcgtttgcgccaggtgccagtcgctcggcgtgcagtgcaagggctgcgcaacaggcgcaaagatcgc

SEQ ID NO: 2296 - DNA, 225 bp, Corynebacterium glutamicum
atgaactcttctcccatctctgatatggtcactgcggctgtgcagaacgaaccagatgcgggcgaccgatggtttatttatggtttgttcctcatcgccgggcttttctttggcggtgcctggtctgcatataaatcagaaaacaaaatcctcatggttgcagccggcctcatcgcagtgctggcagtggctggaggaattctatggttgttgggagagatgact

SEQ ID NO: 2297 - DNA, 606 bp, Corynebacterium glutamicum
atgactgtcgcaccaagaattggtaccgcaacccgcaccaccagcgaatccgacatcaccgtcgagatcaacctggacggcaccggcaaagtagatatcgataccggcctgccatttttcgaccacatgctcactgcattcggcgtgcacggcagttttgatctgaaagtccatgccaagggcgacatcgagatcgacgcacaccacaccgtggaagataccgccatcgtgctcggccaagcactccttgacgctattggcgacaagaaaggcatccgccgtttcgcatcctgccagctgcccatggatgaggcattagtggagtccgtggtggatatctccggtcgcccatacttcgtgatctccggcgaaccagaccacatgatcacctccgtgatcggtggacactacgcaaccgtgatcaacgagcacttctttgaaaccctcgcgctcaactcccgaatcaccctccacgtgatctgccactacggccgcgaccctcaccacatcaccgaagcagagtacaaggctgttgcccgtgcgctgcgcggtgccgtagagatggatcctcgtcaaacaggaatcccatccactaagggagcgctc

SEQ ID NO: 2298 - DNA, 1098 bp, Corynebacterium glutamicum
atgaccaaaattactttgagcgatttgccattgcgtgaagaactgcgcggtgagcacgcttacggcgcaccccagctcaacgttgatattcgcctcaacaccaacgaaaacccttacccaccgtcagaggcattggtcgctgacttggttgccaccgtggataagatcgccaccgagctgaaccgctacccagagcgcgatgctgtggaactgcgtgatgagttggctgcgtacatcaccaagcaaaccggcgtggctgtcaccagggataacctgtgggctgccaatggttccaatgaaattctgcagcagctgctgcaggcttttggtggacctggacgcaccgcgttgggattccaacccagctattccatgcacccaattttggctaaaggcacccacactgaattcattgcggtgtcccgaggtgctgatttccgcatcgatatggatgtggcgctggaagaaattcgtgcaaagcagcctgacattgtttttgtcaccaccccgaacaacccgaccggtgatgtgacctcgctggacgatgttgagcgcatcatcaacgttgccccaggcatcgtgatcgtggatgaagcttatgcggaattctccccatcaccttcagcaaccactcttctggagaagtacccaaccaagctggtggtgtcccgcaccatgagtaaggcttttgatttcgcaggtggacgcctcggctacttcgtggccaacccagcgtttatcgacgccgtgatgctagtccgccttccgtatcatctttcagcgctgagccaagcagccgcaatcgtagcgctgcgtcactccgctgacacgctgggaaccgtcgaaaagctctctgtagagcgtgttcgcgtggcagcacgcttggaggaactgggctacgctgtggttccaagtgagtccaactttgtgttctttggagatttctccgatcagcacgcggcatggcaggcatttttggataggggagtgctcatccgcgatgtgggaatcgctgggcacttgcgcactaccattggtgtgcctgaggaaaatgatgcgtttttggacgcagctgcagagatcatcaagctgaacctg

SEQ ID NO: 2299 - DNA, 1326 bp, Corynebacterium glutamicum
atgttgaatgtcactgacctgcgaggtcaaacaccatccaagagcgacatccgacgtgctttgccacgtggtggcactgacgtgtggtctgtgcttcccatagtgcagcctgttgtagaagatgtccaaaaccgcggcgctgaagctgctttggattacggcgagaagttcgaccatattcgccccgcctcggtgcgggtgccagctgaggttattgctgcagcagaaaacaccttagatccgttggtgcgtgaatcgattgaagagtcgattcgtcgcgtccgcaaggttcacgctgagcaaaagccatccgagcacaccactgaactttcaccaggtggcaccgtcactgagcgtttcatgccgattgatcgcgtgggactgtacgttccaggcggcaatgcggtgtacccatcaagcgtgattatgaatactgtcccagctcaagaggctggtgtgaactcccttgtggttgcgtcgcctcctcaggctgagcacggtggctggcctcaccccaccattttggcggcgtgttccatcttgggtgttgatgaggtgtgggctgtcggcggcggtcaggccgtggcgttgctggcttatggtgatgacgctgcaggtctcgagcctgtggatatgatcactggacctggcaatatctttgtcaccgctgcgaagcgcctggtcaggggagtggtaggtactgattctgaggctggccctacagaaatcgctgtgcttgctgatgcctctgccaacgccgtcaacgttgcctacgatctgatcagccaagcagaacacgatgtcatggctgcgtccgtgctcatcactgactccgagcagcttgccaaggacgtaaacagggaaatcgaggcgcgttactcaatcacgcgcaacgccgagcgcgtcgcagaagctttgcgcggggcccagagtggcatcgtgcttgtcgacgacatttccgtgggtatccaagtagccgatcaatacgcagcggaacacctggaaatccacactgagaacgcgcgcgccgtagcagagcagatcaccaacgcgggtgcgatcttcgtgggcgatttctcaccagtaccactgggtgattactccgcaggatccaaccacgtgctgccaacctctggatccgctcgtttctccgcaggtctatccacgcacacgttccttcgcccagtcaacctcattgaatacgatgaggctgctctgaaggacgtctcgcaggttgtcatcaactttgccaacgccgaagatcttccagcgcacggcgaagcaatccgtgcacgctttgaaaacctccccaccaccgacgaggcc

SEQ ID NO: 2300 - DNA, 1200 bp, Corynebacterium glutamicum
atggatttcacctctgtgaatgatcgaaacgtccctgcacccaacacctccattcctttcccagttgacctgaatcgagtgacggaggctgttgattccttgggctaccactatttgagctcagaagatcgcatcatcgtgccgtggcaagatcaccgcatttcgatgtacttcagccacgaatcagggcaaatgctcaccatccttggtcgcacgcgccttaatttggacatgtttgccatcaacgatgcggcgcgagctgtcaccgaatggaatgccgaacgcatcgggccaacagccctcgtccatctgggcaacgacggcgaagtggaattgaaattccgcacgaccatctgcatcgatgaagggttaagcacccaacagctacgccaattcatcaacctgtccttggacaccaccgccatggctgtgacctatattctggagcgtttttcagaacttaacttcagcgacaccggaagccctgacgacacgaacaatgccgatgaactcagcgacgaacaagaccaagcagatctcgtagagaaaatccgggggctgtacgttcccactccagttgaagagctcatcgaatccctagaagacgcagagtgggaagaatcagacatggcagacgaggatgcagaagacgactacctagacgatgactcagaaatcgaatgggaaacagacgatgactacttcgaacctgaagaagtcgacatggacgaactcctcaacggtttcctcgaagattctgacatcccccaggaagtcaccttggaacgcattcgggcacaactgcatgccatcggcgtggtaaaaaccagcggcgaagacgatttcatcatcgcgtggatcaacgaagtgtttttaggcttcttcgttgataatggccccactttcctggtgaaaggtcactgggatcccagcatggaccccacacgcgacttcatgaaactgttcatgatgtgcaatcagtggaacgaaaactctctgactaccaaagctttttgccatactgatgacaagggtctccaggtccgggtagagttcgcggtctctgtcgctgaaggcctcaacgacgatcaactacagcacaacatcgcactgtcaattcatcatattttgcaagcgattgattccatcagcacagaagccactggatcatcaacggtggaatggccggagaaaaaccgc

SEQ ID NO: 2301 - DNA, 651 bp, Corynebacterium glutamicum
atgacataccccggcatcacctctgaccacaatccttatgatggatacacaggcgatgacggggccggaaacaagcgcaacctcccaaaccgaaagaaaataaacaaatcggtgggagtttacgctggtgtgtttgccctaacattggctttatacgccattgggggagccgcatggggactgctccgacccacttataccgcttatgttgaagacgctgaaacagcctccatagcggtggaaaccaacacttcttttgccggctatgcctggtttgcgatcgccaccggtgtgcttgcagcagcaatcgcattattcgttttcctgcgcacccctcaacatcgaggcccagttatgctcctatggctgggaattgtatctatcgcaggttccgtggcattcctggtgtttggaaacgtggcctcgacgatgcttcatggttcaccatctgattacgcctcagcgatcggtgcgtctttccaggtagcacccactattacccctggtgttgcgtttggggtcgctccatttttgagtgtgtgcatgtattggtgcgcggcatttgtgacacctgaagaagagatagaccaggacgacgcaggccaggggacttcgaaagcatcggggtctgagatgactggggctagtggc

SEQ ID NO: 2302 - DNA, 309 bp, Corynebacterium glutamicum
ttgatggttgttgcttcggaagattcagattcggacgaggtggtttctgctgcttccgccgaggtcgctgcgctggatgaggaagaatttgtcgtcgtcgctgcgctggatgaggctgcttcagtatcagatgaatcactgccacatgcggtcaagagaagtggggtgaccatgagtgctgcgaaagcaaccttctttgaggaaaggctaatagacaaagttctgctcctgataaatcatcgacatgctccggaaaacttaaaaattcccggacggttcacgcagattaccctagcaaagcaatctagc

SEQ ID NO: 2303 - DNA, 642 bp, Corynebacterium glutamicum
ttgtctattagcctttcctcaaagaaggttgctttcgcagcactcatggtcaccccacttctcttgaccgcatgtggcagtgattcatctgatactgaagcagcctcatccagcgcagcgacgacgacaaattcttcctcatccagcgcagcgacctcggcggaagcagcagaaaccacctcgtccgaatctgaatcttccgaagcaacaaccatcaacgaagagcagcaagcacagcttgatgtactgtctcaagagctgtctgagaacccaattaccttcgctgaagctgcgccagttgaaaacggcgagaccgcttccccagaagacacagctgccatcgaggctctggttcgcggatacactgacaccaacaccttgcgtagctcccttgcgtacaccatcaacaacacctgcacccgcgttcttgaagccagcggcgctgacgctacccagcttgatctcaacaccatccctgatatcccactgggtggcgaaggcaccggaactgttgattccatcaccgatgttgtggtcaacggccaggaagcatccgcatgggtcgtagcaaccgccggtggaaccaccgactctgcaacccagcgcttcttcaacgaaggtggccagtggaagttctgcgac

SEQ ID NO: 2304 - DNA, 561 bp, Corynebacterium glutamicum
gtgcagctatcaaaagaatctattattggcgcagccgtttcgatcttgagcgaattcggtttgtcggatatgaccatgcgccgcgtcgcaaagcagttaaatgtcgcgccgggcgcgctgtattggcattttaaaaataagcaggagcttatcgacgccacctcgcgctatctcctcgcgcctgtcttggggcgcaacgacgagcagcgagcaagcatttccgcgcaggaaacctgcgcggaaatgcgttcgctgatgatgcaaaccaaagatggtgcggaagtcatcagtgccgcactgagtaatcagcaattgcgccaagaattggaatcactcatttctgactctttaaaggaacctaatgaggttggcgcttttacgctgctacattttgtggtgggtgcagtattaacagaacaaactcagctgcagatgcacgagttcacggctggcgcgggagatgacacgcaagaaaaccctgccgatgcaaactttgaggagagattcaatcaaggaatagaaatcattctggtgggtctagacgcgcttgggcatataaga

SEQ ID NO: 2305 - DNA, 2508 bp, Corynebacterium glutamicum
atgacatcaacgattgagcactcgtaccaagtttggcctggacatgcttatcctctgggttcaacctatgacggtgctggaacgaacttcgcactcttctccgacgttgcagagcgtgttgagctgtgtctattagatgcagataacaacgagactcgaattccactcgaagagcgcgatgcccacatttggcattgctaccttcctggcgttcaacctggacagcgctacggattccgagttcatggcccgtggaacccagatgagggtaagcggtgcgacgcgaacaaacttctagttgatccctatgctcgtgctttcgatggagattttgatggacatccgtcactattttcttacgacatcaccaatccaaatgaccccaacggtcgcaataccgaagacagcattgatcacacaatgaagtctgtcgtggtgaacccattcttcgactggggcaacgatcgtgcaccgcgtattccttacaacgaaacagtcatttacgaagcccacgtcaagggcatgacgatgacccacccggatgttcctgaagaactccgtggcacctacgcgggccttgcccacccaaccatcattcaatacttgagtgatctgggagtgactgccattgaattgatgccggtccaccagttcctgcaggatgatcgtctccgcgacctaggaatgcgcaactactggggctacaactctttcggcttctttgcgccctacaacgattacgctgccaacaagaaccccggtggcgccgtggccgagttcaaaggcttggtgcgcagctaccacgaagcgggcctcgaagtaattttggatgtggtctacaaccacaccgccgagggcaaccacatgggccccaccatcgcgttccgaggcattgacaacgaggcgtactaccgactggttgagggcgatcgccgtcattacatggactacaccggtactggtaactccctcaatgtccgcgacccgcactcactgcagctgattatggattcgctgcgctactgggtcaccgagatgcatgtcgacggcttccgcttcgaccttgcctctacccttgctcgtgaatttgatgatgttgaccgcctggcaaccttcttcgacctggtccaacaagacccggtggtctcccaggtcaagctcattgctgagccgtgggatgttggcgaaggcggataccaagtgggtaacttcccaccactgtggactgagtggaacggtaaataccgcgacactgtccgtgatttctggcgtggtgagccagcaaccttgggtgaattcgcttcccgactaactggttcctctgatttgtatgcaaacaacggccgtcgccccactgcatcgatcaactttgtgactgctcacgacggcttcaccctcaatgacttggtcagttacaacgagaagcacaacatggccaacggtgaagacggtcgggacggtgaatcacacaaccgttcctggaactgtggcgtcgaaggaccaactgacgatcctgagattatgcagctgcgtgctcagcaacgacgcaacttcctcaccaccttgttgctgtcccagggcacccctatgttgtcccacggtgatgaaatggcccgtacccaaaacggcaacaacaacgtctactgccaagacaatgaactggcgtgggtgaattgggatcaggctgaagaaaacgctgacttggtgagcttcaccaggcgtttgctgcgtatccgagcaaaccacccagtatttaggcgcaggcagttccttgccggtggccctttgggcgccgatgttcgtgaccgcgatatcgcatggctggtaccaaatggaaccttgatgactcaagatgactgggacttcgctttcggtaaatcactgcaggtgttcttcaacggcgatgccatcgaagagcctgattatcgaggacagaaaatccacgatgactccttcatcttgatgttcaacgctcacttcgaacctatcgatttcaatctccctcctgagcatttcggtatgaagtggaagcttttggtcgataccaccgaagcggtgggccacccgctggaggatctcaccatcgaagctggcggaaccatcactgttcctgcccgttccacgatgctgctgcgccaggtggaggctccggactacaccaagcttgaggaaaagatcgctgctgaaaagcgtgagcaagaacttgcggcagagaaggaagctgctgagaagcgcgaattggaactggcggcagcaaaggaagctgaagatgctgctgaggctctccaccttgcggcagaacgtgcttcgactcaggaagctgaattggcccatcaacacggtgctgatgcgattgccgatgaggtagcggaagaaccacaagagctgccacaagatgaagtagcggcagaggtcgagactgagcccgacaccgagcctgacactgaatctgactccgagcaggctgaggtagcttcagaggagcctgaagcggacgaagaagagaag

SEQ ID NO: 2306 - DNA, 801 bp, Corynebacterium glutamicum
atgactacgaaacctatcatcccagaatcaacccactccgcagaacgtgctggtggacattggatccttgccaggcttggaaagaaagtgctgcgccctggaggtcgtgaaacaacgcagttcctgctggagaacctttctttgaccggtgctaccgtggtggaatttgctccaggacttggcgtgactgcacgtgacatccttggcaagggtccggctcgctacatcggagtggatagcgacgcggatgcatgcgcgaatgtacgtgcgatcttacctgcgggtcctcacgaggtgcgcaatacaaatgccaccgatactggccttgaaagcgactcgtttgatgttgtcatcggcgaagcgatgttgaccatgcagaccgataagcacaagttggagctgatgcgcgaggcagctcgaattctgaaaccaggcgggctgtacggcattcacgagctgtcgctggtgcctgacaatgtctccactgcggtgaaagaggatattgctaaggcgctggctcgttccatcaaagtcaatgcccgccccatcacggtgccggaatgggctgcgttggcgcgtgaggcagggttcgatgtgattaatattcgccaagccgacatggcccttctatccctcaagcggaacctgaaggatgaagggctaaaaggtgtcttcacgattgtgaggaacgtgattagccaaccggatctgcgcaagcgagtgctcggaatgcgaaagactttcaccgagcataaagatcacttaggtgcggttggcatcattttgcagaagagagcccaa

SEQ ID NO: 2307 - DNA, 774 bp, Corynebacterium glutamicum
atgacttttaaactcgcagcatgcgcagagatgatctaccaggacctgcctttcgaggagagggtcaagacgatctctgatcagggattcctcgtggaaatttgggactggtccacaaaagacatcgatgcgctcgtggcaacaggcgcggaattttcctccatgacgggctacctgcgcggggatctgattactgaacagggccgcgcggagctcttggcaaccgcttcggagtccttggcggtggcggaaaagctcaactgcccccggctgaatctgcatggaactggccttggaccgcagggactacctgttactcccattgaagtggttaccccagaaatgtggctctacgctgctgaaacgctccgccagatcgctgagctgggggagcgcgcaggcaaggttttcgtgctggaaaacctcaacctcgcagtcgatcaccccggcactccttttgccaaggccactgacactttggcgctggtcaaggctgtcaatcacccgaatctgcgcctcaacctggatttgtaccacgcccagattggcgaaggaaacctcattgagctgctccgtgaggcgcagccattcatcggcgaaatccaggttgccgatgtccccggccgcatggaacccggcaccggcgagatcaactaccagggcgtcgcgaaagctctcgccgcgatgggctacgacggcgtcatcggcatggaggcgtgggcatcgggcgactccagcgacgcgctgcaggcgttgaagtcagcgttcacggtc

SEQ ID NO: 2308 - DNA, 1011 bp, Corynebacterium glutamicum
atgtcagtcaaacttgccctcatcggtgctggacgcatcggatcaaatcacgcacgcctgatcacaaaccacgtgatcggctctgaactggtcgccgtcgttgacccaactcccaacgcagaaaccctcgctgatgaattgggcgccgttgcgttctctaacccagatgacgtcctgacccgcgatgacattgacgcggttttgattgctacaccagcacgaacccacgcggatctcgtggtcaaagcagcggcagcgggcaagcacgtgtttgtggaaaagcccatggccgtcaccctcgaggacgcagatcgtgccatcaacgcagcacgcgaagcaaacactgtcctgcaggtgggcttcaatcgtcgtttcgcggcaggtttcgctgcagcacgcgcacgcattgacgcaggcgatatcggcaccccacagctgcttcgttccgtgacccgcgatccaggaccattcaccgctgaccccaacaagatccctcagtggaccatcttcctggaaaccctcatccacgatttcgatgcgctgtgctacctcaacccaggcgcaaccccagtggaagtaaccgctcacgctgattgcctcgtcgttccagaagctgctggcactggcttcctcgacaccgcagtggtgactgtccgttttgataacggagcaattggtactgcagaagcaagcttcagcgcagcctatggttatgacgttcgcggtgaagtcttcggatccaagggcatgatgaccgcaggcgacgcgcgcgcaaccaacatgactttctacggcgctgagggcatcgcggctgccacctcacgcgcggataccgatctgctctccgatgcttaccgagctgaattccaagctttcgtcgactccatccgtaccaacaccccttccaaggttccaggcgaagctgcacgcaccgcactactcatcgcactcggcgccatccgaagcgtagaaaccggcgcaaccatcaaccttgctgaaagcatcgaggtt

SEQ ID NO: 2309 - DNA, 996 bp, Corynebacterium glutamicum
atggcgtcaaagcgaccgacaatggctgatgtggcaaaagctgctggagtatccactgcgctggtctccatcgtgtttcgcgatgcccccggagcaagtgaatccacccgcaaccatgtgaaagaaaaagccgccgaactcggatacattcctgatcgacgagcccaaaaacttcgccaaaaccgctccggactcatcggtgtggcattcgaaatgcaccaagcattccacggcgatatcgtcgaacacctctatcccaccgcccgaaaacatggcttcgacctgtaccttagcgcgatcacaccgactcgcactgaaaaagatgccgtcaacgccctgatcagggaacgatgcgaagcagtaattcttctaggatctcgcatgtcacctagtgatttggaaacaatcgcacagcaacttcccgtccaagtaattgcccgcggttccggaacccccaaagtcagttccgtccatgtcgacgacgcagttggcgcccaattagccctcaaccacctcatcgaattaggccacgaacacatcatctacatcgatggtggcgacgcccctggcacccaggaacgatcagaagtgttcaaagcgcacattgattccttcgccggcaccacccgcatagtccctggtggcagcagcgaagcagcaggagcccaagcaatctcagagattctggattccggaactgacgccaccgccatcctcgcattcaatgaccgagtagccctcggcgtgctcgacatcttatggcagcgcggcatccacgtccccgaagaaatctccgtggtgggatacgacaactcaagccttgccagcctcgaccacatcggcttgaccaccatcgcgcaggactccgaagcaatcgcggcgaaagccattgatgtcacgatcaatcagatcaacaatcacaccgaaacttctgcggtgctgaccccaacattgatcacacggcgcaccacaggccctcggccacagaaggcgatt

SEQ ID NO: 2310 - DNA, 798 bp, Corynebacterium glutamicum
gtggcgatcattgaatgcgaagacatcacggttcgccacccacatgcgcccacacctgcggtttctgggttgagcacctttgtagaacaaggggaatggcttaatatcgtaggtcccaacggctgcggaaagagtacgttgctgcacgcttttgctcaggtactgtcactggaatcgggaaggctgaaaatgggggagggggacgtcgaaaagcattttgcttttggtcttaaagctgcgaagcagcgtcgctttttcgcgcgtaccgtggccctcatgccacagaatcctactattcctgcaggtctgagcgtttttgattatgtgctgctggggcgtcatccgcacagttacgcgccggggcgtgctgatgatgagatcgtgaagcggtgcctcgctgatctgaaattggagcatttcagcgaccgcggcttagacgaattgtccggcggcgagcgtcaacgcgtcagccttgcccgcgcgctcgcccaagaaccgcgcatcgtgcttctcgacgagccgacctccgcgcttgacatcggccatgcgcaggaaacgcttgagcttatcgacgccatccggcaccgactcggcctcaccgtgatcgcggcgatgcatgacctcaccctgactgcgcaatacggcgatcgggtgctcatgatgaatggtggccgcaaagttttcgagggcactgcagccgaagtgctcaccgcgcagcggatttcggagatttatgatgccactgtgattgttgaggttattgatgggcgtcccgtggtgattccgcagcggtcgcac

SEQ ID NO: 2311 - DNA, 1038 bp, Corynebacterium glutamicum
gtgctgaagagaattttcctcaacccctgggtggctaccgcgttgtcggtagtcattttggggtttgtggtgctgttttcaggttttagcggtgttattgatttaagccccacagcagtgattagacatttgagtgggcaggacacgctcacccctcgagatcaggccatcttctttgatatccggctgcctcgaattatcgctggtgtcattgtcggagcaacgctggctatttctggtgcttcttaccaagcggtatttagaaacccgctggctgatccttatttgttgggtgtgtccgcaggttctggccttggtgtcacggcagtgattgttggcggtaccgtgctgggattttctgcaccgagcatcggcgtgattggtgcagcatttgtaggtggtgttgccgcagtacttgccacgctgatggtgagtcggggagtaggacagggatcatcaaccaccgtggttattttggcgggcgtggcggttgctgcttttgccagttccatccagacctatattcagcaacgacacatcgatacggtggcgcgcgtatatgtgtggatgttgggcaacctcaatgtcaccaactggatgtcgatcttcatcgtggctgtggtggcgggactatgcgcggccgtgatcatgtcctgcgccaggttgttagacgtgatggctgttggtgatgtggaagcccgcacattgggcgtcgatccaggcctcgtacgcattggcattgtcatcgtggcaacccttggtacagctgcagtggtatccatttccggtctcatcgggtttgtgggcatcattgttccgcacgccctgcgcctaattgttggcccggggcatcggattttactgccactgtctttcgtatggggtgccattttcctcgtgttggcagataccgcagggcgaacattgatggctcctcaggaacttcccgtgggtgtggtgacagctgcactcggcgcaccgttcttcttatttattttgcgcagaaccagcagacaacgagttccaaaaaggagtgct

SEQ ID NO: 2312 - DNA, 348 bp, Corynebacterium glutamicum
ttgttcactgtgtcagagcaaacctacatcggtcagatttacgacatgtttggtctcacctctattgctgacggtggcgacgcttactcgcagctatccaacgaagcaatcattgcggcaaaccctgatctgattttcctcagcgatgccaaggccgaaaacctcactgcagaagatattgcggcgcgtccaggctgggacaccattgatgcagtagccaatggacgtatctacattttggacgatgatattgcttccaggtggggacctcgcgtatcccagctggtggaagaaatcgcagcgcagttgaatcagcttgcttcttctgaagctgtgccggccgctgct

SEQ ID NO: 2313 - DNA, 594 bp, Corynebacterium glutamicum
atggtttcaaccacaacatctcgctcaatcgctggactgtcagtgcttgtggcaacagcactaatcgctggctgtagttccgcagaggatgggacggttgactcggggagcagcacagaggtcaccacaacccaaagcaaggaaggttttcctgtcaccgtcacgtttgccccagaagcacctgtgaccattgaggatcaaccagagcgcatcgtcagtttgtccccagcgattacagaaaccttgttcgctgtcggggcaggggatcatgtcgtcgcagtggatgaatactcaaactacccagaggacgcaccgctggtgcagggtctgtctggttttactcccaatgtggagtccatcttggattacgatcctgacctggtcgtgttgatgtctgcagatgattccattttgaccggcctggatgctgcaggagtggatactttagtgatccccgcagcagagaacttggatgagacctactcccagattgaacaagtaggtcgagccaccggatttgaagatcaagcaacaacggttgttgatcagatgaaaaccgccattgatgctgcagttgccacattcctgaagagg

SEQ ID NO: 2314 - DNA, 441 bp, Corynebacterium glutamicum
atgaacgtacagtttgaatcagacatggccgtccaaccaggaaacaccatggaagctaccgtcaccgacattcgtgatgccaagcgtaaaacaacccagcttgattcagtaacgccgtttaagaagaattgcccgagccgcaccttgctcgacaccatcagtgacaagtgggcggtgctgatcctgctcagcatggaaaatggtccacagcgcaatggtgaaatcaaagatcaggtccaaggaattaccccaaagatgctcacccagcgtcttggagtgttggtggaagacggactggtcactcgcacctcccacgcagttgtgccgcctcgtgtggattatcagctcaccgatctgggtgcttctgtcattgagccttgccgtgcgatgtattcctgggcagtggagaacattaagcaagtggaggcctaccgctcagca

SEQ ID NO: 2315 - DNA, 1143 bp, Corynebacterium glutamicum
gtgttgaagggtgaaaagccacagcacctgggtggcggagccccagtagtgccttcagctccatctactgttgctggtctgaatttcgtgggctttgacgtagagacggccaatgatgattggggttccatctgccagattggtttggtcaagtacgtcgatggtgtggaggaatcttcggagtcatggttgtgtactcctcctgagagcctgaatttcttcaatgagatcaacattggtattcacggcatcaccccagagatggttgctgatcagcctcgttttgcagaccttgtgcccaagatggtggagttcgttggggatttgccgttggttgctcacaatgcgcagtttgatttcaccgcattgtcgcgcgcgtgtgctgcctcagggatcgatgtcccagagatgatttatggctgctcgttgacgttggcacgcaatgagaagctgcaggtggaaaaccataagcttccaacggtggctagtcatttagggtttgagctgaaaaaccaccacgatgctgctgaagatgctcgcgcgtgtgctgcgattaccattgcgttggcaaagcgccacagctttgagggcagctttgtggatttcgttcacagccgtggtttcaccatgggaaccgtggataacgcccgggtgtatccggtgctgaaggatcgttctggagctaacgttgcgttgcagcgtcgaaactttggtttggatgcaggcaagaccgaagtccccgtgcagccagctgttgatccagcgtgggaaaccccgaaggcggagccaaaaaagcaatctggccgccgtgcaccgtgggacaaggtggctacccctgaggtcattccagatcccaatcccgatgctgatccgtcgagcattctctatggccagaatgtgaccttgactggtgatttcgagccatatgaaaagggtgcgctgtggcagcggatcgctgatcaaggtgcgctgatcggtaagaacgtgactaagaagaccaccattttggttgctggcccgtgggcaacgattaccagtaagcaaaaacgtgctgaggagttgaaagaaaaaggacaggacatccagatctgggatgaaaagcagctgtttacggctctggggttagatgaacagcccccgttt

SEQ ID NO: 2316 - DNA, 606 bp, Corynebacterium glutamicum
atgaaagtacctattcgagcatcaaagattcagcctcgactgcacaatcaccaatgggcccacaccgcacgtttaagcacagatggtttctgcgataacccagcaatgctgaacctttcccacgatctgtgtatggggttgcacagcgggaaagtcacactcagttaccgggctctcgctgaagtggggctgaccaccaggcaagcgtgggatcaatcagccaccaatttattaaagtgtgctactactcctgagggtattcgatttgatcttcgggacgcagaaacgaccacaaccatcgcctcgtctgcattagaaatcagagttcccggcgcgccaattactgcatggttggcgcatcctcaaacctttacagtgttgaatcgtcatcttgaattacgactgggaccagcaccgctgtatcttgctccgaattcacacacactcatcgctattcctgctggtgatccagggatctttgaatttgaacggtgggcgcgaagcttgctggaagtgggtggtgtggagggtatcgtcgataagcttcttgtttataggcacggctttccttgcccttaccagccagcctttgtagcacttgctgcg

SEQ ID NO: 2317 - DNA, 2433 bp, Corynebacterium glutamicum
atggcacgtccaatttccgcaacgtacaggcttcaaatgcgaggacctcaagcagatagcgccgggcgttcatttggttttgcgcaggccaaagcccagcttccctatctgaagaagctaggcatcagccacctgtacctctcccctatttttacggccatgccagattccaatcatggctacgatgtcattgatcccaccaccatcaatgaagagctcggtggcatggagggtcttcgagatcttgccgcagctacacacgagttgggcatgggcatcatcattgatattgttcccaaccatttaggtgttgccgttccacatttgaatccttggtggtgggatgttctaaaaaacggcaaagattccgcttttgagttctatttcgatattgactggcacgaagacaacggttctggtggcaagctgggcatgccgattctgggtgctgaaggcgatgaagacaagctggaattcgcggagcttgatggagagaaagtgctcaaatattttgaccacctcttcccaatcgcgcctggtaccgaagaagggacaccgcaagaagtctacaagcgccagcattaccgcctgcagttctggcgcgatggcgtgatcaacttccgtcgcttcttttccgtgaatacgttggctggcatcaggcaagaagatcccttagtgtttgaacatactcatcgtctgctgcgcgaattggtggcggaagacctcattgacggcgtgcgcgtcgatcaccccgacgggctttccgatccttttggatatctgcacagactccgcgacctcattggacctgaccgctggctgatcatcgaaaagatcttgagcgttgatgaaccactcgatccccgcctggccgttgatggcaccactggctacgacgccctccgtgaactcgacggcgtgtttatctcccgagaatctgaggacaaattctccatgctggcgctgacccacagtggatccacctgggatgaacgcgccctcaaatccacggaggaaagcctcaaacgagtcgtcgcccaacaagaactcgcagccgaaatcttaaggctcgcccgcgccatgcgccgcgataacttctccaccgcaggcaccaacgtcaccgaagacaaacttagcgaaaccatcatcgaattagtcgccgccatgcccgtctaccgcgccgactacatctccctctcacgcaccaccgccaccgtcatcgcggagatgtccaaacgcttcccctcccggcgtgacgcactcgacctcatcgcggccgccctacttggcaatggcgaggccaaaatccgcttcgctcaagtctgcggcgccgtcatggctaaaggtgtggaagacaccaccttctaccgcgcatctaggctcgttgcattgcaagaagtcggtggcgcgccggggagattcggcgtctccgctgcagaattccacttgctgcaggaagaacgcagcctgctgtggccacgcaccatgaccaccttgtccacgcatgacaccaaacgtggcgaagatacccgcgcccgcatcatctccctgtctgaagtccccgatatgtactccgagctggtcaatcgtgttttcgcggtgctccccgcgccagacggcgcaacgggcagtttcctcctacaaaacctgctgggcgtatggcccgccgacggcgtgatcaccgatgcgctgcgcgatcgattcagggaatacgccctaaaagctatccgcgaagcatccacaaaaaccacgtgggtggaccccaacgagtccttcgaggctgcggtctgcgattgggtggaagcgcttttcgacggaccctccacctcactaatcaccgaatttgtctcccacatcaaccgtggctctgtgcaaatctccttaggcaggaaactgctgcaaatggtgggcgctggaatccccgacacttaccaaggaactgagtttttagaagactccctggtagatcccgataaccgacgctttgttgattacaccgccagagaacaagtcctggagcgcctgcaaacctgggattggacgcaggttaattcggtagaagacttggtggataacgccgacatcgccaaaatggccgtggtccataaatccctcgagttgcgtgctgaatttcgtgcaagctttgttggtggagatcatcaggcagtatttggcgaaggtcgcgcagaatcccacatcatgggcatcgcccgcggtacagaccgaaaccacctcaacatcattgctcttgctacccgtcgaccactgatcttggaagaccgtggcggatggtatgacaccaccgtcacgcttcctggtggacaatgggaagacaggctcaccgggcaacgcttcagtggtgttgtcccagccaccgatttgttctcacatctacccgtatctttgttggttttagtacccgatagtgagttt

SEQ ID NO: 2318 - DNA, 1023 bp, Corynebacterium glutamicum
atgtctgacaacactctctcccaatttggcagttactaccacgaattccgacgtgcccatcccatggccgacgtcgaattcctcctagcaattgaagaattacttacggacggtggtgtcaccttcgatcgcgtcaccacacgcatcaaagaatggtcaagcctgaaagccaaggctcgcaagcgtcgcaacgatggctcgttgatctaccctgatccgcgcaaagacatccacgacatgatcggtgttcggatcaccacgtaccactccacggaaatacccgtggccctaaaagtgctccaagactccttcatcgtccacaaatccgtagacaaagccgctgaaactcgcatctcaggcggctttggttacggctcccaccacctgattctggaagtcgatgacacctccgatgacctccaggactacaaaggcctcgtctttgaagttcaggtgcgcaccgtgctgcaacacgcctgggcagagttcgaacacgatatccgctataaacgcgccgatgtgtccaacccagaagacttcagcgcagaagtagaccgcatgttcaccctcgctgccggactcatcgaattagcggaccaacaattcgaccaaatcgccgcactcaaagaaaccagccgagttgctgatgaatccgtcgaactcaccgcagagacacttcccggcgttcttgccatgctcattggcaaccgcttcccccgcccacgctccacaaactaccgcttcctcgaagacatcctggtggccaactccattacctctgtggtgcagctgcgcgagctgctcaaccccaccgacattgaagtgctgttgaaagtaatgaactaccgcttccacccaggccagatccgcatcatcgacgatttactactcaaacgatttggccaatcacacatcgatgccaccgtcgccaccgactcccaaccactcaacgccaaacgccacaggcagctaaaacgcaagctagagctcatgacccaagctcatcttgtggaaccaccaaac

SEQ ID NO: 2319 - DNA, 399 bp, Corynebacterium glutamicum
ttgaaaagcataggaatgtggaagttcatgaagactcaatacgtatgtaccacttatttcatcgctgcacccgaggatgaagacgaggcgtaccaaacttatcgcagccgaatgaactctttggcagcattgaacggcgctgacgtagtttcagtggcagatggcctacggatggaagtagaccaggatatttggggaagccttgctgagcagtatcagattgagcaagaaggcctgtatcccactggtcacaacttgtactttgttgtcaccgtggtgaacctagatgattcagatgaggtttatgaccgaacaatggagcatctgattatggatgacccttatgtgcgagtggatcgtttcccaagcactgtccatgccagcacccagatcatgttg

SEQ ID NO: 2320 - DNA, 198 bp, Corynebacterium glutamicum
atggcgggtggaggaaatgaatccatctttatggtggtcaacgccaccacagacactgatccggacctctgggaagttggaagacaggattccagggagtttacgattcgtggaagatggcttcggatggaacacaggacagatacggcaagccacaatattgcccgaagctcaggtatttacaatcaatggaccaga

SEQ ID NO: 2321 - DNA, 189 bp, Corynebacterium glutamicum
ttggcaaccgctgacgaatacagatttactcttggctactcggcccatgagaccaggtcttcgtcgcatcgctttgcacttgcagcgatcaccacttttgaagtcatgggcagagcagtttcgtccaggtgggcaatccagcgtgagttggaaggctacggggtccaatcatcgaccgtcatcagtcca

SEQ ID NO: 2322 - DNA, 1056 bp, Corynebacterium glutamicum
gtgcctaaggtgggggctgtgaaagcagcaaacgatatggtttgggggccacggggacgaaacttcctgatgaaccttgcagtggcttttgacgacggttccgttgaaggatcaggacttcgcccgctagaacatgcctcgtggtggttagacagggaagctgaatacaacacgcggagacgcggaattgcacctcaatacaccgtgttagctagagctaagaaggttgcaccgttattagagcaggttccgttgatcgagctgactccgaagctgatgtacgacgcgcttgactctacggtgactaacgctgcgtattggcaaccgctgacgaatacagatttactcttggctactcggcccatgagaccaggtcttcgtcgcatcgctttgcacttgcagcgatcaccacttttgaagtcatgggcagagcagtttcgtccaggtgggcaatccagcgtgagttggaaggctacggggtccaatcatcgaccgtcatcagtccatgaggttctaaacacatggcgggtggaggaaatgaatccatctttatggtggtcaacgccaccacagacactgatccggacctctgggaagttggaagacaggattccagggagtttacgattcgtggaagatggcttcggatggaacacaggacagatacggcaagccacaatattgcccgaagctcaggtatttacaatcaatggaccagatgattgggcatccttatgcagacgcttcccactcgatttaccaatgtccaacgcgccaaattggacgatggcaactggctatcctcacaaatgggttatcccagactatgtacaagtagccaagcattatgatggcgtgcatttgaacattcaaggctatctagctacagctgggcgagtggttgttaccgatggcaatcgagccggaatactggctggctgggatcctgggcaaacctattggcttactgatgtagttgagctaggggagccggtaacctggagaaaccatagccagacccaggaagatcaagactggagacccctaaaaatgcat

SEQ ID NO: 2323 - DNA, 1044 bp, Corynebacterium glutamicum
atgaaaaacgtctccttcggcctcgacaccttcggcgacaacgccatcgacctgcagggcaacccggtctcccctgcacaaacacttcgaaacatcattgatgaagccaagatggcagacaaagtcggggtggatatcatcggcatcggagagcaccaccgtgaggaatactcagtttctgcacctgacatcgtcatgacagctatcctcgcatccactgagcgactcaaagtcacctcttccgtgactgtgctgtcctctgatgatcctgttcgcctgtttgagcgttattccaccatgaatgcactgtccaacggtcgcgccgaaatcaccttgggacgcggttccttcattgagtctttcccattgtttggttttgatcttcaggactacgagcagctgtttagtgaacgccttgatttgttcgcgaagattcttgaggccgacagccgtggtcagggcgtgacctggcatggtgagacccgctcggcgttggaaaaccagatgctttacccaccaactgagaatggcattcacgcttgggttgcagtgggtggcagcccagaatcagtcgtgcgcgctgctaagtatcgtttcccgttgatgcttgccatcatcggcggtgctcctgagcgtttccgcccgtatgtggatctgtacaagcgtgccaacgaacagttcgggcagcctcaaaagcccattggtgtgcactcccctggactcattgcggcaactgatgaggaagcccgtgagctagcacttaatgattggttggaactccaacgcaagatcggtgctgaacgcggttgggctcctgcggatgcaatgcagtttgaacgcgaaatcgatcacggttccttatacatcggttcccctgagacggtcgcaaagaagatcgccaaaaccatttcagtgcttgatcttgatcgctttaccctcaaatacgccagtggccagacccctcatgagtacttgctgaagtccattgagttgtatggcactgaggttattccgctggtgaaggacatcttgaccaagcaggct

SEQ ID NO: 2324 - DNA, 378 bp, Corynebacterium glutamicum
atgtcagacactgatggattacctgtccgcatcgacgcgtgggtgtgggcagttcgtttatataaaacccggtcagaggctgccgaagcctgcagggcagggcacgtcaagctaaacaacaacgcggtcaaacctgcccaacaagtggtgccaggtgaccgcgtgcgcgtgtgggtaaaccaccgcgagtttgatgtggaggtgctgcgcaccatcaagaagcgagtcggagcctcggtggcccgaacctgctacgttgaccacaccccgccaccaccaccgatggaagtgctggcgtcgattcctcgccgtgaccgtggagccggacggcccaccaagaaggaacggcgagaaatggaacagttcaggggaatgtcc

SEQ ID NO: 2325 - DNA, 231 bp, Corynebacterium glutamicum
atgagcatgcaaccatacccccgcaacccaatcgaaaaacgtaagcaagaagtacgcaagaactcccgcaacgcagttgtcagtgttggcggtggcatcgtaggcggtgcggctctgtggctagtgttcggctctgcattctttatgggacttggattgatcatcgccgtggtcggcggtttttattactacaacaaggtccaaaagatcattaacgaaaaagaccgttac

SEQ ID NO: 2326 - DNA, 1785 bp, Corynebacterium glutamicum
atgtgccatagcatctcacatcttagctcgccaaccggcagcattttcactagcctggtggccatgttgacctcgcaaagcttttcagtgtgggctccacttccccacgatgtacatctgatcctcaacggcgaaaccctccccatgcacaaaacggagggcagctggtggcgcgccgagatcgcgcccaaggccggcgatcgttacggtttttcgcttttcgacggctcctcctggtcaaaaaccctccccgatccccgctccacatctcaaccagacggggttcatggtttaagtgaagtctccgatgattcctatctgtggggtgaccagcagtggactggccgaattctccctggctcggtgttatatgagctgcatgtgggcacctttagtgaagatggaacgtttgagggagtcgtcgacaagcttccttatctgcgcgacctcggcgtgaccgccatcgaacttttacccgtgcagccctttggcggcaaccgcaattggggctacgacggggtgctgtggcacgccgtccatgcaggctacggcggtccggcgggcttgaaaaagcttatcgacgcctcccaccaggccggcatcgccgtctacttagacgtcgtgtacaaccacttcggccccgacggcaactacaacgggcaatttggcccctacacctctggcggcagcaccggctggggcgacgtggtcaacatcaacggccatgattcagatgaagtccgcaattatattctcgacgccgcacgccagtggttcgaagattttcacgttgatgggctccgcctcgatgcggtgcattctctcgatgatcgcggcgcctattccctacttgcgcagctgaccatggtggccgaggatgtctccgcacaaacaggcatcccacgctcattgattgcagaatctgaactcaatgaccccaagttcgttacctcccgcgaggccggcggttttggcctggatgcacagtgggttgacgatatccaccacgccctccatgccctcgtttctggcgaacgcaatggttattacagcgatttcggatctgtcgacacattagccaaaaccctgcgtgaagtatttgaacacaccggaaactactccacgtaccgcggacgcaaccacggccgccctgtgcaccccgatatcacccctgcctcgcgctttgtcacctacaccaccacccatgatcagaccggcaaccgcgcaatcggcgaccgtccttccacgactctcaccccggaacagcaggtgttgaaggcagccattatctacagctcgccgtataccccgatgttgtttatgggtgaagaattcggagccaccaccccattcgccttcttttgctcccacaccgaccccgagctcaaccgcctaacctccgagggccgcaaacgggaattcgcacgccttggctggaacgccgacgacatcccctcccccgagctggaatccaccttcacctcctccaaactcgattgggagttcactgcggagcagcgccgcatcaacgacgcttacaagcagctgttgcacctgcggcacaccttgggcttctcccaaccaaacttgctcacactcgaggttgagcacggcgagaactggctatcgatggccaatggtcgcggccgaattctggcgaatttctccgacgacaccatcaccgtcccgcttggcggcgagctgatttacagcttcacttcccccaccgtcaccgacacctccacaacccttcagccgtggggctttgcgatcctgacccgaaac

SEQ ID NO: 2327 - DNA, 651 bp, Corynebacterium glutamicum
atggcacatctcacgcaataccaactccctcaggccggtcaagtctttgagcatgaactagagatcaagcgctcgcgatttctgacctatatcacgcgtgtgcaagatcaggagcaggctcgcgaatttattcactccatcaaggagctgtatccggatgcgcgtcatcattgcagtgcctttattttccatgtggatggctcaaatgatgtggagcgttcctctgatgatggcgaaccttccggtaccgcgggaaaacccatgctagaggcgttgcgtggctcgggaatgaaagatattgccgctgtggtggtgcgttatttcggtggcgtaaaactgggcactggcggattagttaatgcctacaccaacgcggtgacggagcttctacctgaggttttgcaagtcacccgctctgttcgggagattttcaagattgaccttccgcattctgatgcggggcgcattgaagcgaatctgcgcggcatgggcatcatcattactgacactgaatatggtgcagaagtcacatacaccttggctttattgcctggtgaacaggctgcggtggaatctcaattgtcatccatgatgggtgcagaaattgaattgaaagaatccgggcacatgtgggtggaatccccgagtgac

SEQ ID NO: 2328 - DNA, 1308 bp, Corynebacterium glutamicum
atgagtgaaacatacgtgtctgagaaaagtccaggagtgatggctagcggagcggagctgattcgtgccgccgacattcaaacggcgcaggcacgaatttcctccgtcattgcaccaactccattgcagtattgccctcgtctttctgaggaaaccggagcggaaatctaccttaagcgtgaggatctgcaggatgttcgttcctacaagatccgcggtgcgctgaactctggagcgcagctcacccaagagcagcgcgatgcaggtatcgttgccgcatctgcaggtaaccatgcccagggcgtggcctatgtgtgcaagtccttgggcgttcagggacgcatctatgttcctgtgcagactccaaagcaaaagcgtgaccgcatcatggttcacggcggagagtttgtctccttggtggtcactggcaataacttcgacgaagcatcggctgcagcgcatgaagatgcagagcgcaccggcgcaacgctgatcgagcctttcgatgctcgcaacaccgtcatcggtcagggcaccgtggctgctgagatcttgtcgcagctgacttccatgggcaagagtgcagatcacgtgatggttccagtcggcggtggcggacttcttgcaggtgtggtcagctacatggctgatatggcacctcgcactgcgatcgttggtatcgaaccagcgggagcagcatccatgcaggctgcattgcacaatggtggaccaatcactttggagactgttgatccctttgtggacggcgcagcagtcaaacgtgtcggagatctcaactacaccatcgtggagaagaaccagggtcgcgtgcacatgatgagcgcgaccgagggcgctgtgtgtactgagatgctcgatctttaccaaaacgaaggcatcatcgcggagcctgctggcgcgctgtctatcgctgggttgaaggaaatgtcctttgcacctggttctgtcgtggtgtgcatcatctctggtggcaacaacgatgtgctgcgttatgcggaaatcgctgagcgctccttggtgcaccgcggtttgaagcactacttcttggtgaacttcccgcaaaagcctggtcagttgcgtcacttcctggaagatatcctgggaccggatgatgacatcacgctgtttgagtacctcaagcgcaacaaccgtgagaccggtactgcgttggtgggtattcacttgagtgaagcatcaggattggattctttgctggaacgtatggaggaatcggcaattgattcccgtcgcctcgagccgggcacccctgagtacgaatacttgacc

SEQ ID NO: 2329 - DNA, 507 bp, Corynebacterium glutamicum
ttgtctttgcgtcgaagtactttgacccttgttacagcaagcgctgtggcattgtccgtgttcactccagttgcccaggctcagtcctctgacgcactgacacagctctcagacaacatcacctcatcacagatccttgatgatgatggaaatccagtcgatggaaacgaaacctggccaggcagctctgaaggcagctcaatgctcagcaatggcgacattcctgcggccccaagcttgagctcctccggcaaagacaccagcgatgatgacgatgaaatcagcgaagagcagcaagcactgatcgatcggttgtccgaaatgccagtgattggttccattgtctccccaccagaatggcttgccattccttttgcggtactgcagggattgctcgcaatcaccactcttgcttccaccgcagcatccttcatggtgaccgtcgacccatcgttcaagcagactctgcgtgacatgctcacccagtttggcatcaacgtcgacgct

SEQ ID NO: 2330 - DNA, 156 bp, Corynebacterium glutamicum
gtgaacacggacaatgccacagcgcttgctgtaacaagggtcaaagtacttcgacgcaaagacaaaacttttctcctggcaataaatatgcggatttactatggaaacaagatagaagattggatagcgaaagctatcctcaactcgtggaaagtg

SEQ ID NO: 2331 - DNA, 1203 bp, Corynebacterium glutamicum
atgagccagaaccgcatcaggaccactcacgttggttccttgccccgtaccccagagctacttgatgcaaacatcaagcgttctaacggtgagattggggaggaggaattcttccagattctgcagtcttctgtagatgacgtgatcaagcgccaggttgacctgggtatcgacatccttaacgagggcgaatacggccacgtcacctccggtgcagttgacttcggtgcatggtggaactactccttcacccgcctgggcggactgaccatgaccgataccgaccgttgggcaagccaggaagcagtgcgttccacccctggcaacatcaagctgaccagcttctctgatcgtcgcgaccgcgcattgttcagcgaagcatacgaggatccagtatctggcatcttcaccggtcgcgcttctgtgggcaacccagagttcaccggacctattacctacattggccaggaagaaactcagacggatgttgatctgctgaagaagggcatgaacgcagcgggagctaccgacggcttcgttgcagcactatccccaggatctgcagctcgattgaccaacaagttctacgacactgatgaagaagtcgtcgcagcatgtgctgatgcgctttcccaggaatacaagatcatcaccgatgcaggtctgaccgttcagctcgacgcaccggacttggcagaagcatgggatcagatcaacccagagccaagcgtgaaggattacttggactggatcggtacacgcatcgatgccatcaacagtgcagtgaagggccttccaaaggaacagacccgcctgcacatctgctggggctcttggcacggaccacacgtcactgacatcccattcggtgacatcattggtgagatcctgcgcgcagaggtcggtggcttctccttcgaaggcgcatctcctcgtcacgcacacgagtggcgtgtatgggaagaaaacaagcttcctgaaggctctgttatctaccctggtgttgtgtctcactccatcaacgctgtggagcacccacgcctggttgctgatcgtatcgttcagttcgccaagcttgttggccctgagaacgtcattgcgtccactgactgtggtctgggcggacgtctgcattcccagatcgcatgggcaaagctggagtccctagtagagggcgctcgcattgcatcaaaggaactgttc

SEQ ID NO: 2332 - DNA, 3582 bp, Corynebacterium glutamicum
atggctagactgtcccacatggccaagcaatcctcatttgtacatcttcacaaccacaccgagttttccatgcttgatggaatggccaagatcgatatgttggccgatgaggttaaagcccagggaatgcctgcggtcggaatcaccgaccacggcaatatgtatggctccaaccccttttatcgcaagatgacagagatgggcattaagcccatcattggcattgaaacgtatatggcacctgagtctcgttttaagaaagagcgtgtgcgttggggcgaaccacaccaaaaatcagatgatgtttctggttccggtgcgtatttgcaccagacgatgcttgcagaaaacaccacaggtttaagaaacctcttttatctatcttcgatggcatcgtacgaaggccagctaggcaagtggccccgcatggacgccgatatcatcgctgagcacgccgaaggcatcatcgccaccacgggttgcccttccggcgatgtgcaaacacgcctgcgcttgggccagttcgacgaagcccttgaagcagccgccatgtggcaggacatctatggtcgcgacaactacttcctcgagttgatggaccacgggctcgacattgaaacccgtgtgcgcagtgagctgctcgaaatcggacgcaagctcaatttgccacccctggtcaccaacgactgccactatgtgctggaatctcaggcgcaagcccacgaggcaatgctctgcgtgcaaacaggcaagacgcttcatgatgaagaccgattcaaattcggcggaaccggctattacgttaaatctgcagaacaaatgcgtgcactctgggacgacatggttccagatggctgcgacaacaccctgtggatcgctgaacgtgtgcagtcctatgacgaaatctgggaagaacactcacacgaccgcatgcctatcgctgatgttccagaaggctacaccccaaccacttggttgcaccatgaagtgatggctggcttggaggatcgtttctctggacagcaagttcctgaggattatattgagcgcgcggagtatgagatctccgttattgatatgaagggctacccttcctacttcctcatcgttgctgaaattatcaagcacgctcgttccattggcatccgtgtaggacctggccgtggttcggctgcaggtgcattggttgcctacgcgttgaccatcaccaacattgaccccatggaacacggattgctgttcgagagattcctcaacccagaacgaccatccgcacccgatatcgatattgacttcgatgatcgccgccgcggtgaaatgatccgttacgcagctgaccgttggggcgaggacaagattgctcaggtgatcaccttcggtacggtgaaaacaaagcaggcactgaaagactccgcccgtgtgcaaatggggcagccaggctatcaaatcgctgaccgcgtgatcaaggagcttccacctgccattatggcgaaggatattccgttgtccggtatcaccgatccggatcaccctcgttttaatgaagcaggtgcggtgcgccagctgatcgaaaccgaccctgatgtgaagcgcatttacgacaccgctcgtggtttggaaggcgtggtgcgccaatctggcgtgcacgcgtgtgccgtgattatgtcttctgtaccgctgctggactgcattccgatgtggaagcggccagccgacggcgcactgattacaggctgggattacccagcatgtgaggccattggcctgttgaagatggacttcctgggacttcgaaaccttaccgttattggcgatgcgattgaaaacattaaggccaaccgcgatggggaagtgcttgatctagaaaacctagcgatcgaggatgaagaaacctacaagctgctaggccgtggagaaacccttggtgtgttccagcttgatggtggtggcatgcaggagctgctgaagcgtatgcagccaaccggcttcaatgacatcgtcgcagcgcttgcgctgtatcgcccaggccccatgggtgtgaacgcgcactgggattacgccgaccgtaaaaacggacgcaagcccattactccaattcacccagagttggaggaagctctggaagaaatccttggtgaaacctatggtctgattgtgtaccaggagcagatcatgaggatctcccagaaggtcgcaaactacaccgctggtcaagcagatggtttccgtaaagccatgggtaagaagaagcccgaggtcctggaaaaggagttcgcaaacttcgaaggtggaatgaaggcgaacggctattcagatgccgcgattaagactttgtgggataccattctgccgttcgccggctacgcgttcaacaagtctcacgccgcaggttatggacttgtatccttctggactgcctatttgaaggcgcactacgcgccggaatacatggcagcactgctgacttctgtgggtgataacaaggacaaatcggcgatctacctttctgattgccgacaccttggaattcgagtgctttcgccggatattaacgagtcctcgttgaacttccttcctgttggcaccgatattcgctatggcctgggagccattagaaacgtgggtgctgaagttgtggattccattttggatacccgcaaggaaaagggcctatttaaggacttctcagactacttggacaagatcgataccctgccgtgtaacaagcgcatcaccgagtctttgatcaagggtggcgcttttgactcccttggacacgcacgaaaaggcctcatgctggtcttcgaagatgccgttgattccgtcatcgctaccaaaaaagctgctgacaagggacaatttgatctctttgcagctttcgactcggataacaacgacgatgtggcaagtttcttccagatcaccgttcctgatgacgaatgggaccgtaagcatgagctcgcactcgagcgagaaatgctgggtctgtatgtttctggacacccactcgatggctatgaagatgccattgctgcccaggttgatacagcactgaccaccattgttgccggtgaactcaagcacggcgcagaagtgaccgtgggtggcattatctctggtgtggatcgacggttctccaagaaggacggttccccttgggcgattgtcaccattgaagatcacaacggcgcgtccgttgaattgttggtcttcaacaaggtgtattccatcgttggatccatgattgtggaagacaacatcatcttggccaaggcacacatctccattcgagatgatcgtatgagccttttctgtgatgatctccgcgttccagagcttgggccaggaaacgggcaaggacttccgcttcgtttgtccatgcgtactgatcagtgcaccatgtccaacattgccaagctcaagcaggtgctggtggacaacaagggtgaatctgatgtgtacctcaatttgatcgatggggataactccacggtcatgattttgggtgatcacttaagagtcaaccgatccgcaagtttgatgggcgacctcaaggcaacgatggggccaggcatcctcggt

SEQ ID NO: 2333 - DNA, 840 bp, Corynebacterium glutamicum
atgattttcggcgtactcgcatacttgggatggggcatgttcccggcctttttcccactacttcttccggcaggaccgttcgaaattttagcgcatcggatcctatggactgctgtattaatgatgattatcattagtttcacgtcgggatggaaagagcttaagtccgctgatcgcggtacatggttacgcattatattgtcatcgttgtttattgccgggaactggctgatctatgtcatcgctgtcaattctgggcaagttactgaagccgctctcggatactttattaaccccctgttaagtgtcgtgcttggcattgtgttcttcaaagaacagttacgaaaactgcaaattagtgcggtggttattgctgctgcgggggttttggtactaacatttctaggtgataagccaccgtatttagcgataacactagcatttacattcggcatctatggagcgttgaaaaaacaagtcaagatgtctgctgctagttctttgtgcgctgaaactttagtactgctgcccatcgcagtcatatacctgattgggctcgaagcttccggtcacagtacctttttcaacaatggcagtgggcacatggcgttattaatctgctcgggtttggtcacagccgtcccgctgttgatgtttgcattggccgccaaggcaatacctctttccactgtcggcatgctgcaatatctgaccccaacgatgcagatgctgtgggcattgtttgtggtcaacgaatcagtagaaccaatgcgttggttcggattcgttttcatttggatcgcagttactatttacatcacagatagcctacttaagaag

SEQ ID NO: 2334 - DNA, 468 bp, Corynebacterium glutamicum
atgaataagtccagctttcgtagagccttttatataataatttgctctatatctctctactcctgtgcttccttccctgtagattcggaaggcactttggatcgtgctcgcggcgatgaactcgtagttggaatatcggaaaacaaaccttggacgcagactagcggaactggtagatattcaggcatagaagtcgatctcattgaaggcttcgcagacacaatcgacgcagatgtgcaatggctacatgccccagaatcagtactggccgagaaaatcaaaaatggccaacttgatctcatgattggggggttatcttcttcatctccttggtcttctcatatggcactgtctcgcccataccaccaattcgatggagaagaaaaagtcatgggggtcaggctaggagaaaatgatctcatgatggctttggaacggtacctcgctcacgagtttggtgaaattaga

SEQ ID NO: 2335 - DNA, 918 bp, Corynebacterium glutamicum
gtgctacgtaaagcgattaagttggaatgggcaacgatcgcatgggttcttttttcgatcgttttggtaggtgttgtcgctggtcaatcgcaggccatgcgtagtgcatggattgaagacatgctttctttggtaccacctatcgcttttcttttagcctcccgaatcagcaaagctgtggcaaccagaaaacatccatacggcaagcaccggtcgattgctatcgggcaccaagctgcagcactggccctgcttatcatgggaagccttttaatttatgaagcggtatctgcactgatcaagggagaaaggcctccgataggtttagctattttatttggccatgacgtgtggtcaggttggttaatgatcggggttatgatttcagtgtcgatcccgatggtgattgtagggcgagtaaaaataaacttagctaaagatctccacgataaactcctctatgcagacgcggatatggccaaggctgactggggcacagcagtcgctagcacagtaggcgtgctcggaataggactgggtttttggtgggcggatgcagttgcagctctagtaatatcagcttcaattctcagagatggcgtgataaatatgaaagctgctatatctgacttaggtgatggacgagccatgacttatgacaattccgcccctcacccattaaatgatgatgtggaaaaggctgccctagagatgcattgggtcaaacacgcccgcgctaggatacgcgaccaaggccgctgtttccacacagagttatttgtcgaaccagtagaaggatacacacctgctccggaagaaataacttctctagttaagcgaatccaaaaccttgactggaagctgcaagatgtcgtagcttccgtcgtcgaaaaaatcgaccggtttcaggccccttcg

SEQ ID NO: 2336 - DNA, 876 bp, Corynebacterium glutamicum
ttgctaaatgatccacgtacgctattcccgaaagtcgatcccccaaagcaaagccagccggaaccaggcctagatataaaactttccccccaagccgatattggtctctccagctatcaaggaagtggaaggcttaagggccgcaaggctcttattactggtggcgattctgggattggagctgccgtagcaatcgcttatgctcgcgagggggcagatgttgcgatcgcttacttgcccgaagaacaagccgatgctgacagagtgctccaagcaatcgaggaaacaggtcaaaaagctttttctttccctggtgatctccgtgatccagaatactgtcgctcgctggtccaagagacggtgaacgctttaggtggcctagacatcttggtcaacaacgcgtcacgtcaggtgtgggcacctggtttgaccgaaattaccgacgaaaacttcgaccagactttgcaggttaacctctatggtagttttcgggttaccaaagcagctatacctcatctgaagcccggatcatcgataatctttacatcgtccattcaggcgtaccaaccttcggaaaccctcttggattacgccatgactaaggcggcattgaacaatttgtcaaagggcttggcaagtagtctgataggcgatggcattcgggtaaattctgtagccccaggtcctttctggacgccgttgcaacccagccatggtcagccacaagagaaaatagaaggatttggccagcacgctccgattggaagagcgggtcaccctgttgagttggcaggtgcgtacgtttttctcgcttctgacgaagccagctatgtggtaggagaaaccctgggagtcacaggtgggacgcccacccca

SEQ ID NO: 2337 - DNA, 1287 bp, Corynebacterium glutamicum
ttggaaccctgggcggaaaagctcacttcagatccggccacatgccgccacctgattgaagaattcgggagtcctgtgaatgtactccattcaggttctatgcctcgtaatataaatgagttggttgacgccggcattcagatgggggtggatactcgaatattttttgcccgcaaagcgaataagggtcttaccttcgttgatgccgttaaagacaccggtcatggtgtagatgtagccagtgaacgagagttatctcaggtgcttaatcgtggagtcccaggagagcggatcattctatccgcagctatcaaaccggacagactattggcattagcgatcgaaaatggcgtgatcatctctgtggattcgcgtgatgaattagatcgcatttcggctttggttggtgaccgcgttgcacgagttgcgcctagagtagctccagatcctgcagtcttacctccaactagatttggtgagcgtgctgcagactggggtaatcggcttaccgaggtgatacccggcgtggatattgtgggtcttcacgttcacctccatggctatgctgcaaaagaccgtgctctggctctgcaggaatgttgccaactcgtcgattctctcagagaatgcgggcattccccacagtttattgaccttggaggaggggtgcctatgagctacattgaatctgaggaagattggatccgttatcaatccgctaaatctgcgacttcagccgggtatgccgaatcctttacgtggaaagacgatccgttatctaatacgtacccgttctatcagaccccagtgcgcggtaattggttgaaagacgtgctttctaagggggtagctcagatgctcattgaccggggattgcggttacacctagagcctggtcgaagtttactagatgggtgtggcgtcactcttgccgaagttgcttttgtgaaaacccgaagtgacgggttgcctctagtgggactggctatgaaccgaacgcagtgccggactacatccgatgattttctcattgatcccctgcatatcactgacggtgatgtaggcgaggaaatcgaagcatatctagtgggtgcctactgcatcgaagatgagctgattttacgccggcgaatccgcttcccgagaggagtcaaaccaggagatatcatcggaattcctaacaccgcaggatacttcatgcatatcttggaaagtgcatcgcaccaaatcccgttggcgaaaaatgtagtgtggccggaggggcagttagacgatatcgatgcggat

SEQ ID NO: 2338 - DNA, 951 bp, Corynebacterium glutamicum
atgaacagggactcatttcaaagcatcgatgagttgatcggaaaaacccctctcgttaggttgggccgattcaatgcaaacacgagtatcaatttgtgggcgaagatggagtcctataacccaggtgggagtgctaaagaccgtacggctcatgcaatggtactggccagcgatctccgcccgggtgacaccgtagtggaatcaagttctggcaatctaggaattgccttgtctcgagaagcggtcctaggtggctggacttttcattgcgttgtagattcgcgtgctaaccgcaacacaatagcgcacatgaaggcactaggaaccatagtgcatgagattacagaaccagattacgaaactggagattggctggtagcacgaagaaaacgtgtggcgcagctacgtgctcagatgtctgaagcgatctgtcttgaccaatattcaaacacagcggcttttcaggcacacgaacaaggaacaatgactgaaatcgtcgaacagcttggcggtgcccctgattatcttctagtggcggtaagcaccacgggaacgattgggggttgtttagggtacgtagctgcacacgggttgtccactcaagttatagcagttgatgcggtgggatcagttctgtttgatggaaatgctggcccacgccatttaccaggtttcggtgctggcatggtcccggaattatcgaaacacttatcgccccacagggtttttcgtattgatgataggacttcagtagaagcagcccgaaagatggctcagacagaagccatcttgcccggagcgtctggtggggccgtcctcgctgctatggagatattacgccccgacatccctgcgggtagcaatgtagtagtaattcttcatgatgacggaaataagtatttagatacgatttataacgacgaatgggtggaggaaaacctttgttcaagg

SEQ ID NO: 2339 - DNA, 579 bp, Corynebacterium glutamicum
atggatggtgtcgataaagggcgacgcatcgtcgccctcctagcaattctcgcattggttgtcgtggttgcgatcttgagtttcagcgaccgcaccgcgaaacccatgcagctcaacggtgacatgctcggccaagacaacacggaaacttccgtcgagtaccgtcagcgggcatcggaatcattggaaaatgccgcggtcggcgaagaagcctattcactggtgacgttcacacagccgctttcgccttccgaggcctctaaccttcttaaaggagtcggtcgcgtcaatgccatggttatgctctcggctcctgccatggatctacccgaacccatcgcaggcgagacccgtgaagatgtttttaaccgtcaaataaagcttgtcgacgcccagttatccggtatcggcaacgtccgcgcgccgggcgaactcaacggggtagtggtttgggatattcctcagaaagttcgtgtgttgtccgagagctcgctggtttatagtgtcgaaaccctgccacctgacgcggcgtggggcagtttcggtattcgaccagtcgatacttcgggtactaatttt

SEQ ID NO: 2340 - DNA, 930 bp, Corynebacterium glutamicum
atgaacaaccgacaaagcagaacccttcccgtaccagaaggactggcaggcatgcgtgtggacgcagcactgtccaagttgctgggaatttcacgcaccgtagctgcagaactcgccaccgccggcgatgtcagcgttgatggggctgtggtaggtaaaagcgagcggctcgttgccgattccatgctggatgtcttgctgcctgaaccagcagctccgttgatgcccaaggaagaaatcgttcccggcctggatattttgtactctgatgacgatgtcatcgcagtcaacaaacccgtcggcgtggcggcacatcccaccgtgggttgggaaggcccaactgtggtgggcggacttgcagctgcaggtttccgcatttccacctccggcccaccagagcgcaagggtattgtgcagcgccttgacgttggcacgtctggcgtgatggtggttgctgcctctgaacgtggatacaccgtgctcaagcgcgctttccgggaccgcaccgtggacaagacctaccacgcgttggtgcaaggccaccctgatccgctgaccggaaccatcgaagcaccgatcggccgccacccctcagcaggttggcgtttcgcagtaacaactgaaggcaaacacgccgtcacacactacgaaaccctggaggccttccaagaggcaaccctgctgaaaatccacctggaaactggccgcacccaccagatccgcgtgcatttctccgcgctgcaccacccatgctgtggcgaccccatgtacggctctgatcctgcgttgtccgagcgccttggccttaaccgtcagtggctgcacgccgtctcgcttggattcaaccacccagcagatggccgatggatggaaatcgtctccccatatccaactgatctccaacacgctttagacgttctccgcgagcaa

SEQ ID NO: 2341 - DNA, 534 bp, Corynebacterium glutamicum
atgagtaagaaagaaaagaggacaaccgttaaacaggtggttgccttgatggccgccatcgttgtggtgattgcgtccctagaccaaatagtcaagcagattatgcttagttggttggaacctggcgttcccgttcccatcattggggattggttccgcttctacctcctgtttaaccccggagccgcattttcgatgggtggggaaaacagcacctggatctttacaaccatccagttgagcttcgtcatcggtatcgcaatttatgccccacgcatcaaacacaagtggatcgcggcaggacttgcccttgttgccggtggagccttgggaaacgtgttggaccggttgttcagagatccttccttcttcttcggacatgttgttgattacatctccgtaggaaactttgcagtatttaatatcgccgatgcctcgatttcttgcggcgtcgtggtgttcctgatcggaatgttccttgaggaccgtgaaaacgcccagcatgccaaagcaactgacgagaaggatgaggcc

SEQ ID NO: 2342 - DNA, 1002 bp, Corynebacterium glutamicum
gtgctaaaacgattctctcaccactccagcccgcaagttctttcacggaaagttgtcgcgtccgcattagctttaacaaccgcgctggctttagccgcgtgtagttcctcagccgagccggactcccctgaagttgagcaggcggtgggtcttgcggtggatacgccacgtgtggtggttgtggatccaggcactggcgatttgcagcgcttgcaatacaaagacatcgcccctgatgccacacaggaacagaccatcaatattgctgaaggttttgcccaatcggtggtgaatgcggacagcgtggatccgcaggcaccagccggtggcgatgtcaccacattccaccttcctgttaaagccaccaccgaggaagcggagttcagcgatcaggaaatggtgagcgcgactcgcgatatctctctacttttcggtaaacctacctacaccgatctttcccaagttgaagatgtgaattccaccgagggattcacgctgggaatccgcgcaacagatagtggacagcacaccaccttaagtttcgcagcccctgttgattccactgaaactggtcgcatgctcatggagcaatacttactcacgtttacgtcccttcccattgtgttcccctctgacgatattggcgtgggcgcgaagtggactgtggatagccgtgtgacaggcgaatcaacgctgctacaaaccgtgacctacacgatcacagggatcgacggcgacaaagtaaacctcgatgtggaagtctctcagcgccccagcatgggtgcgttggagatcaccgatgaagaatcggacgagaccaccgggcagctcactgtccttaattccaacaccacctccgtgggcaccttggaagtcgatctgactcagcctttacccacgtcaggacaggtttcttggaccactcgcgtgatttacggcggttccaatgagcaggtgcgtgtggtgcaggattccacctcttcggtgagcttcggagaccag

SEQ ID NO: 2343 - DNA, 1650 bp, Corynebacterium glutamicum
atgcgcacttttgccgcttatattgccattgatggcctcagcttttcctaccccaacacccacgttttaagcgatatttcgctcaccgttgccaatggcgatatcgccggactgattggtgaaaacggcgcaggaaaatccaccctgctcagcctcatcgctggcgtcatggaacccgaccagggcaggatttacctccccgaacgcaccggattcatcgcccaagaaacagacttaccgtttgaacaacccgtgcagtcgcttatcgacgccgccgtcgccccagtgcgcgcggtcgatgccgcgattacagatttgtccaccaagcttggcgacgcctccctcagcgccgaagagcaggcgcaagtcgccacagatttcgatgcagcgctaggcgctgcagaagaactcggactgtgggaattagatgcacgtattgaaaccatcgtcgcgggtctcggccttgccgaggtggatcgcagcactcccattggtgagctttccggcggtcagcgccgcagattcgcattggcagcgctgctgttggaaccacacgatgctctgattttcgatgagcccaccaaccacctcgacgacacagccgtagatttcctcatctcggagatttcccgtttcaaaggtccagtgctgatcgccagccacgatcgcttcttcctcgactccgtctgtaccgagttaatcgacctcgatcctgcacttggacctgagggcggatccggcgaagaagtaaaacaagccgtgtcttttggtggtggattttctgaatacatcaaagaacgcgagacccgccgcacccgctgggctcagttgtacaccgcacaagaaaccgagcgggaaaaactcgaagaaaccaccggcaccaccgaatcggatattttccacagctcggtttccaaatcggaagctaaaatcaccgcgaaattttacgcagaccgggcagctaaaactcaaggcaaccgcgtccgctccgccaaaaaccgcctgaaggaattggaacgctatgaaatcccagcacctccaaagccactggaattccaaggcatcccagaagcctccggaaacggtcacggtgaaacactagaagtgcgggctattgctgtggaaaacaggcttcaacccttgactttccacatcgatcccggcgaccacatcctggtcgaaggccccaacggtgtcggtaaatccaccctgctgagcgttctggaaggcgtgcttgaaccaaccgaaggtgaattgatcgtccccgaagggctgaaagttgcgcgcctgaaacaggacgatcagtggacggaaaagcagttgaacacccccgtcgacgaactgttcgccgccctatcgaaaggtccggtcggactcaacctcgtggagatggggctgttgagggagacgtcgcaaagcagcccgctacgggccctatcgctcggccaacgccggcgcgtctcgctcgggctcatcctggcgagcccaccagatcttttgcttcttgacgagcccaccaaccacctctccctcgcgctgagcgaagaactcgagtcggcgatagaaaaattccccggtcgcgttattctggccagccacgataggtggatcagaaaacgttggacggggaagaaaatcagcctgagccgt

SEQ ID NO: 2344 - DNA, 303 bp, Corynebacterium glutamicum
gtggaagaagaggtgcttgactccgaagaggaatcatcactgctggagcacgcgctgagcgccaatgctgctgcaacagtaaaagtaactgcggttgccttgaaaagcttcacgatgaaaatgatcctttgctctaatctctggtcaccaaatatctatcagcattcgacagctacccattctatggaaccgacgatggatgatctcgtgcctcatccccacactaaatgcacccagtttaggttatctgcacaatttaggcgtgcgccttctgcatgcgacttaggtgtgcgacgttttcaa

SEQ ID NO: 2345 - DNA, 600 bp, Corynebacterium glutamicum
gtgaagcttttcaaggcaaccgcagttacttttactgttgcagcagcattggcgctcagcgcgtgctccagcagtgatgattcctcttcggagtcaagcacctcttcttccacctcttcggctgcgtctgatgctgcgactcagtacccaactgctgaggaactgaatgcaattttggctgtggcaaccgaccctgaggcaccaatcgaggagaaggtgaagactgttcagggttctgagaacgctcctgagctgtttgagaccatgactcaggcaaaggtggagtcgggtgctgagttccaggttgttggttctgtgcttcctggctatgacccaacctctgaggttctgaccaccgtcatgttccagcttccggaccgcgctgagcaggaagctgaaggcgtggagtttgtgaacactgatggtaattggcagctgtcccaggattgggcttgtatcttgatcaccaatactgttgctcctgagcaggttcctgcaatgtgtgttggaactgatgcttcttccgctggtattgaagaggccccagctgaagagggtgctgttgttgaggaagcccctgttgaagaggttcctgttcag

SEQ ID NO: 2346 - DNA, 975 bp, Corynebacterium glutamicum
atgtcgaagcagcactccacaccattaaacaatgatgaagaacacacttccgctcctcaaaaggttgcggtaatcaccacgggcggaaccatcgcctgtacttccgacgcaaatgggcatctgcttcccaccgtcagcggtgcagacctgcttgcgccaatcgcaccacggttcaatggagcgcagatcgctttcgaaatccacgaaatcaaccgccttgattcctcctccatgacgtttgaggatctcgattccatcatcgccacggttcataaggtgttggaggatccggatgttgttggcgtagtagttacccacggcaccgattccatggaagagtccgccatcgccgtagacaccttccttgatgatccccgcccagtcattttcaccggcgcccaaaaacccttcgatcatcccgaagccgacggcccaaacaaccttttcgaagcctgcctcatcgcatccgacccctccgctcgcggaattggtgcactcattgtcttcggtcacgccgtcatccctgctcgcggctgcgttaaatggcacacctctgatgagctggcgtttgcaaccaacggccctgaagaaccagagcgccccgatgcgctgcccgtagctaaattggcggatgtctctgtcgaaatcatccccgcataccctggtgccaccggcgcaatggtggaagctgccatcgctgccggtgctcaaggacttgtagtggaagcaatgggatcaggcaatgttggttcccgcatgggtgatgccctaggtaaagcacttgacgctggaattcccgtggtgatgagcactagggttcctcgtggtgaagtatccggagtgtatggcggtgcaggtggaggtgcgactttggctgcgaagggcgctgtgggatctcgctacttcagagctggtcaggcacgtattttgctcgcgattgccattgcgacgggcgcacatccggtgacgctttac

SEQ ID NO: 2347 - DNA, 1401 bp, Corynebacterium glutamicum
atgcaacgctgggtgcttcacatcgatatggatgccttcttcgcatcctgcgaacaactgacccggcccactttaagaggccgccccgtcttggtcggtggagtctccggtaggggagttgtcgccggagcatcctatgaagccagaaaatttggcgcccgctcagcgatgcccatgcaccaagccaaagcccgagtaggttttggggcagtggtggtgacaccccgtcatatcgtttactccgcagcctcgcgccgggtgttccaaatcgtggaaaaacgcgccggaattgtcgaacgcctcagcatcgatgaaggcttcatggaaccagaggctctcgttggagccaccccagaagaggtgaaacagtgggcggaagaattacgcgcggaaattaaagaagttactggcttaccctcctcggttggtgctggctccggtaagcagatcgccaaaattggttcaggcgaagcaaagccagatggtgtgtttgtcgtgccagtagacaagcaacatgacttgcttgatccacttcctgtgggcgcactttggggagtgggtcctgtgacaggctccaagcttgcctcaatgggggtggaaacaattggtgatctagcagcgctaacccaaaaagaagtagaaatcagcctcggtgcaaccatcggaatatcactgtggaaccttgcccgaggaatcgacgaccgccctgtggaaccccgcgccgaagcaaaacagatctcccaagagcacacctatgaaaaagacctcctcaccaggcaacaagtagatgctgccatcattcgatcagccgaaggcgcacaccgacggctcctcaaagacggacgcggtgccagaactgtcagcgtgaaactgcggatggccgactttcgtattgagtctcgttcctacaccttgtcctatgccaccgatgattacgcaactcttgaggcaacagcattccgacttgcccgctaccccggagaagtaggccccatccgccttgtcggagtaagtttttctggtttggaagaatcccgccaagacatcctcttcccggaacttgaccaacaaatcatcgtaccaccagcacccgacaccgattatgaggtaggcgtgcaatcctcttctagttccgaaagtactcaagttgaagcgccgcaagatgtcgcgttgagtatgtggtgcgcaacgcaagatgtctaccacccagaatatggccacggttgggtacaaggtgccggtcacggtgttgtatcagtacgttttgaaacccgcagcaccacaaaagggcgaactaaaagtttttccatggatgacccggacctcaccccggcagaccctctagatagtttggattgggctgactggtttgctgaaaatggtgaaacgggggatgacgaa

SEQ ID NO: 2348 - DNA, 858 bp, Corynebacterium glutamicum
gtgaatgatgctggcttgaagacgcgaaacccggtgcttgcccccattttgatggtggttaacggcgtgtccctttatgccggagcagcgttggcggtggggctgtttgagagtttcccacccgcgttggttgcgtggatgcgagtagcagcggctgcggtgattttgcttgtgctgtatcggcctgcagtgcgaaattttattgggcagaccgggttttatgcggcggtgtatggcgtttccacgcttgccatgaacatcacgttctatgaggcgatcgcccgcattccgatgggtaccgcggtggccattgagttcttgggacctattgcagtggccgcgttgggcagtaagacgctgcgggattgggctgcgttggttttagctggcatcggagtgataattattagcggtgcgcagtggtcggccaacagcgtgggcgtcatgtttgcactggcagcagcattactgtgggctgcgtacatcatcgcgggaaaccgcattgcaggcgatgcctcctcaagtagaaccggcatggcggtgggattcacgtgggcatcagtgttgtctttgccgttggcgatctggtggtggccgggtctgggagcaacggaacttacgttaatcgaggtcatcggattagcacttggtttgggcgtgctgtcggcggtgattccttatggccttgaccagattgtgctccgcatggccgggcgatcctactttgcgctgctcctggctattttgccgatcagcgccgcgctcatgggagcgcttgcgctgggccaaatgttgtcggtggctgagcttgtcggcattgtgctggttgtcatcgcagttgctttgcgacgcccctcc

SEQ ID NO: 2349 - DNA, 1002 bp, Corynebacterium glutamicum
atgctgatcggtgaggtgtccaagctcagtggggtgagtgcgcgcatgttgcggcactacgaaaagctgggtttggtcgagccgaagcagtcgacggcggggtatcgggaatactcagaaggcgatgtgcgcaggattttccatatcgaaggtttgcgcagcttgggtcttagtttgaagcaggttggagacgcgcttgaggatccagactttgatcctcaggcagtcatttccgagatgattgctgagacttctgcgcggatttctatggaacgggagttgcttgccaggctgaaagcggtgcgtcatgcgcaggcctcggattgggaatcggcgttggatgcggtgcagattttacgtcgcctgcgatcgggggatccggcgcaacgtcaagccgtggcctatgactctgtctctggtaaagaagcagttgcgctagaaaccttggtggaatcggcgctcggtgagtcgcatttgaacgcggagggggcgctgtcgtgggcggttgtgcagcgtggtgaggaagctgttgcattggcggcacgaggtttgcgctcaagggatgcggcggtgcggctgcgggctgtaaggattgtggcgagcgcgccgagtgctgttgcggatcgagtagagtggctacggccaatgattcgcgatcccgatgctctcgtgcgtgctgaaactgcgttggcgttgggaaaatcaggcgatgagagtgcagttgagcagctcgtgtccatggttctcaccggtcttcgggacgtggaggcagccgaattgcttgccggatttggggagcccgtgcagttagatgtgttcaagaaatttgcgcggacgctggatgatgaggaaacaatgtccccgacgcgtggtcggattgcgcaagcgttggcggagtttaatcttgcgcctgtggcgtttttggttgagcagctagttgatgatgacaatccgacggttgcttttactgcggctgcgattatcaaagccaaggggctgaag

SEQ ID NO: 2350 - DNA, 132 bp, Corynebacterium glutamicum
atgaaatcggagtccggatccgcaatgagcttggcggtggccaccgcgtgcgcgctcgttaaagcgcctagaagcacgcttatcgacgcctccctcccctccaattccgccatcgcccgacttaaactccgc

SEQ ID NO: 2351 - DNA, 627 bp, Corynebacterium glutamicum
atgaacataagtgccatggacaacttcgaacattcaaatgcatctatccgtttacaagcagcgttggccgcaggaactgctgaggacaccactgcgatcgatattcttttgtaccgcagtggggtagaagaagacttctttgtgcgcgacatgatcacgtgggcgctcacccgcatgccagttgatgacgtgtttacctcactggtcgctgatttggattctgaggtacctgatcgaccattcggtgcaagtcaagcactccacacactctccaagttaagggtcgcgcagtcgtggcaggaattgcaagcacggccttggcttttgcaccgggaggacaccgcccaaactgcgtggcgaacctttgtgggactggtcccagatgatcagaccgcatggttggcgcaccaattgctccaagaattggataaaggaacgcctgaaattcagcggagtttaagtcgggcgatggcggaattggaggggagggaggcgtcgataagcgtgcttctaggcgctttaacgagcgcgcacgcggtggccaccgccaagctcattgcggatccggactccgatttcatggctgatctggaggaagcgcggcgcgtggataatatgggtgcatgc

SEQ ID NO: 2352 - DNA, 3162 bp, Corynebacterium glutamicum
atgtctgaagccgttggcggagtttacccacaggttgatttatctggtgggtcatccagatttccagagatggaagagaatgtactgagctactggaagaaggatgacaccttccaggccagcatcgatcagcgcgatggtgctgaagactacgtcttttacgatggccctccttttgcaaacggtctgccacactacggccacctactgactggttacgtcaaggacattgttcctcgctaccagaccatgcgtggctaccgcgttcctcgtgtcttcggttgggatacccacggtctgccagctgaacttgaggctgaaaagcagctcggcatcaaggacaagggcgagatcgaggccatgggtcttgccaagttcaacgagtactgtgcaacctccgtgttgcagtacaccaaggaatgggaagagtacgtcacccgccaggctcgttgggtggactttgaaaacggctacaagaccatggacctttctttcatggagtccgtgatctgggcgttcaaggaactctacgacaagggcctgatctaccagggtttccgcgttcttccttactcctgggcagagcacaccccactgtccaaccaggaaacccgactggatgactcctacaagctgcgccaggatccaaccctgaccgtcacgttcccagtcaccggtgtcgtcgaaggttcttctgcaaacgctggcctggtgggagcgttggctcttgcgtggacgactaccccgtggacccttccatccaaccttgcgttggctgtgaacccagcggtgacctacgcattggttgaggttgctgaagacggtgaggcagaattcgtcggcaagcgtgtgcttttggctaaggacctcgttggttcctacgccaaggaactcggtgctgaggctgttatcgtttctgagcacccaggctctgaactggtcggactgacctacgagccaatctttggatatttccgcgatcacgcgaacggattccagatcctcggtgcagagtacgtcaccaccgaagacggcaccggtatcgtccaccaggcaccagctttcggtgaagacgatatgaacacctgtaacgctgccggcattgagccagtcatcccagtggacatcgacggcaagttcaccggtttggttcctgaataccaaggtcagcttgttttcgatgccaacaaggacatcatcaaggacttgaaggctgcaggtcgcgtggttcgccaccagaccatcgaacactcctacccacactcttggcgttccggtgagccactgatctacatggctctgccatcttggtttgtgaatgtcaccgaaatccgcgaccgcatggttgaggtcaaccaggacatcgagtggatgccagcgcacatccgcgacggccagttcggcaagtggctagaaggtgcccgcgactggaacatctcccgttcccgttactggggttcaccaattccagcatgggtctccgacaacgacgaatacccacgcgttgatgtttatggttccctcgatgagcttgaggctgactttggcgtgcgtccaaagtccctgcaccgtccagacatcgatgaactaactcgtccaaacccagacgatccaaccggcaagtccaccatgcgacgcgtcaccgatgttttggacgtgtggttcgactccggttccatgccgtttgcccaggtgcactacccattcgagaacaaagaatggtttgatacccacgcaccagcagacttcatcgtggagtacatcggtcagacccgcggttggttctacctgctgcacgtgctgtccaccgcactgtttgaccgcccagctttcaagaaggttgtcgcacacggcatcgtcttgggtgatgacggactgaagatgtccaagtccaagggcaactacccgaacgtcaacgaggtcttcgaccgcgacggttccgacgccatgcgttggttcctcatgagttccccaatcctgcgcggcggcaacttgattgtcaccgaaaagggcatccgcgaaggtgtgcgccaagcacagcttccaatgtggaacgcatactccttcctgcagctgtacacctccaagaacgcaacctggtcagtcgactccactgacgtgctggaccgctacatcctggcgaagctgcacgatttggtggcagagacccaggcggcactcgacggcactgacattgcaaaggcttgcgacttggttcgtaacttctgtgatgcgttgaccaactggtacgtgcgtcgttcccgcgaccgtttctgggctggtgatgaagcacacccagaggctttcaacaccttgtacaccgtgctggaaaccctcacccgcgtggcagctccactgctgccaatgaccaccgaagtgatctggcgtggactgaccggcgagcgttctgtgcacctgactgatttcccatccgctgagtctttcccagcagatgctgatttggttcgcaccatggatgagatccgtggcgtgtgctctgcggcttcctctgttcgtaaggctcacaagctgcgtaaccgtctgccacttccaggcctgactgttgctcttccagactctgctcgcctggcagacttcgcttcgatcatccgcgatgaggtcaacgtgaagaacgtggatctgacctctgacgtggattccgtgggaaccttcgaggttgttgttaacgctaaggttgcaggtcctcgcttgggcaaggacgtccagcgcgtgatcaaggctgtgaaggctggcaactacacccgcgaaggcgacgtcgttgttgccgatggcatcgagctcaacgagggtgaattcaccgagcgtctcgtagcagcaaaccctgattccaccgcgcagatcgacggcgtggatggactcgtggttctggacatggaagtcacggaagaacttgaagcagaaggctgggcagcggacgcgatccgtggcctgcaggatgctcgaaagaactccggctttgaggtttctgaccgcatttctgttgtcgtcagcgttcctgaggacaagaaggaatggatcaccactcacgctgatcacatcgcagcggaagttttggcaacctcctttgagatcgtcactgatgccctcgacggcgaaacccacgacattgtcgctggtgtgaccgcgaaggttactaagaac

SEQ ID NO: 2353 - DNA, 216 bp, Corynebacterium glutamicum
ttgttcggctttcattccaacatcgtccatatcgcactccaaggaactgtgactctggtgttcttcgccgcaataattttgtctcttgtcggttttattctgttggtcatcaccgtgatcgaaccctcccatacgtggacggtgttgctgattatcgtcgtggtagctggacttatatgttttggcatagacatgtggaacaagcgtaaagcccac

SEQ ID NO: 2354 - DNA, 1095 bp, Corynebacterium glutamicum
atgccgttgactccagctgatgtgcataacgtcgcttttaataagccgcctatcggcaagcgtggctacaacgaagacgaggttgatcagttcctagatctcgttgaggacgccctcgttcagttccaagaggaaaacgaagacctaaagcagcaggtcgaagagctagaggcgcaggttgccggtggtacttcttccgctgctagttcctcaactgcaggtgcagccacagctgcagcttccaagtctgttgacgaggcagcgctgcgcaaggaaatcgaagagaagctgcgctccgaatacgcatccaagctcgatgatgcctccaaggccgctcagaaggctcaaaacgatgcgaagtccgctcaagatcagctacagcgtgcacaagctgacgcaaaggcagctcgcgacgaagctgaaaaggccaaggctgaagctaagtcagcagcatcctccagcaccactaaggcagcagcggttggcgctgtcggcgctggcaccggagcagcagttgctacaggtgctgcaaatgtggacacccacatgcaggcagcgaaggttctgggactcgcacaggaaatggcagaccgcctgacctcagaggctcgctccgaatccaagtccatgctggacgaggctcgcgaagcagcagagaagcagatcgaggaagcaaacagcacctccaaccgcactctggaagatgctcgcgcaaacgctgagaagcagatcgctgaagcgcagaaccgcgctgacactctggtcaacgaagctgacgctaaggctaagaacctggtttccgaagccgagaagaagtccgcagccaccctggccgcatccacctctcgtgcagaagctcagatccgtcaagccgaggacaaggcaaacgccctccaggcagacgcagagcgcaagcacaccgaaaccatggctgcagtcaaggaacagcagaatgctctggagacccgcatcgcggaactgcagaccttcgagcgtgagtaccgcacccgtctgaagtccctcctcgagggccagctggaagaactcaacgcacgtggctcctctgcaccaaccaacaacaagccatctggtgag

SEQ ID NO: 2355 - DNA, 285 bp, Corynebacterium glutamicum
gtgggtaacattgcaatattgatcgcctggctcatcggtatttacacatgggtgcttgtggcacgcatcgtgatcgagatgatccagtcattttctagatcgttcacgccaccaaagtggttctactacattgccgagccagttttcatggtcaccgatccaccggtgaaactgcttcgccgggtcattccaccgctgccgctaggtaatgtgcgccttgatctttccgtccttgtgctctttttcatcctttcgatcctgcggtcggtagttctggttttggct

SEQ ID NO: 2356 - DNA, 456 bp, Corynebacterium glutamicum
atgtccatgctcaagaagactaaagaattcttcggactcgctccatacgaagcggagcacgaggatgcttactatgcagatgaaccacgttacgagggcaccgctgcgtacgcacctgaataccgtgagcgtgactacggctatgcaccagaggcaccagcccctgttgctccatcgccagcacctcgctcttaccagtccaccatcgttccagtagagcttcattcctttgaagacgctcaggttattggtggagcatttcgcgacggcgacgcagttgttttcgacatgagcttgctttcccgtgaggaagcacgccgcattgtggacttcgctgcaggcctgtgcttcgcattgcgtggcaagatgcagaagattgacagcgtcaccttcgctgtcgttccagagctgtccaacatcagcacttccgagctcgagcgcgccgcacgcatccgc

SEQ ID NO: 2357 - DNA, 663 bp, Corynebacterium glutamicum
gtgcaagcgcgtatcgacgcgaccctcaacgaacacaaccgccccgagggcagtgtacgtctgttgccggtcaccaaattccaccccgtggaagacatcaagatcttacaagagtttggtgtcaccgcagtgggagagaaccgcgaacaagaagcacgcgccaaagcactcgaacttcccgacatggactttcatatgattggccaaatccaatcaaagaaagccaactcgatcgccaggtgggcagctgcagtgcactccgttgatagcgagaaaatcgccgaagcattgggcaggggagtagcccttgcattggatagaggcgaccgcaccagtgacgagcttccgtgttttattcaactgagtttggatggtgacccgagccgaggtggaactccattgagccaggtcacacaacttgccgattgcatcagtgacaccacacatctgcgttttgagggcctcatgtgcgtcccaccgcttggttggggccctgaaaaagctttttcccaggcaagagacgtactttcaggtttagaggaacactttgacaggtctttggaattttcggcaggtatgtctggagacctagttgctgcgattaaacacggctcaacaatcgtgcgtgtcggaactgaaattcttgggaaccgaccgctagcg

SEQ ID NO: 2358 - DNA, 738 bp, Corynebacterium glutamicum
atggatagtcttgacccccgcaaccgccccgtccgcaaggtcttcacgacccgtgccggcggggtttcgcagtccccgtatgcttccttcaaccttggtgatcacgtcggcgacgatcctcaagctgtggcatccaaccgcaatcgcttggctgacatcatcggtttgtccccagacaaggtggtgtacatggagcaaattcattccaataccgtcacagtcattgatgaagccccagcggatggccaggctgtagaggccaccgatgcgctagtgaccacgcaacgagggctagcgctggccgttttggttgctgattgcgtgccagtgctgctgtcagacaccgacgctggcgtgattgcggcagtgcatgcaggccgcatgggagcccgcaatggcatcgtagctaaaaccattgcgaagatggaggagctcggcgcgaaacccagccgcattcatgcgctcatgggtgcagcggcatcgggtgcgaactacgaggtcccagaggccatggcgcgcgatgtggaagccaaacttccaggttccattgcgcgtacgacaaaaggcaccacaggactggacatccgcgcagggctgctgcgtcaaatgctcagcctgggtgtgcaaatgattgattctgatccacgctgcaccatcgaagacgaagatctgttttcttaccgccgcgaaggcacgacaggccgccaggccggcgtggtgtggctgccaaaggaggca

SEQ ID NO: 2359 - DNA, 486 bp, Corynebacterium glutamicum
atgctttccttctctggtggaagggttgcgttggtggttgggacctgctgctggactggctcagctgcaggtgcagctgagatgcctgcgcggcggttctcagcggcgcttgcgcgagctgcgtcaaaaccggtcgcgatgacggttacgcggacttcgtcgcccaggttgtcgtcgatgatggtaccgaagatgaggttgacatcttcatcggaacgctcacggaccatggatgcagctgcgttgacttccatgaggcccaggtcggatccaccagcaaaggacagcaggacgccagttgcgccgtccattgttgcttcgagaagtggagagttgatggcctgctcggttgcagagacaacgcggttgtccccacgtgcagagcccacacccatgagtgcggaaccagcttcggacatgacggagcgaacgtccgcgaagtccacgttgatcacaccagggatggtgatcaggttggtaataccc

SEQ ID NO: 2360 - DNA, 1326 bp, Corynebacterium glutamicum
atgacctcaccgaacaactacctcgccaagattaaggtcgtcggcgtgggcggcggcggagtcaacgccgtcaaccgcatgattgaagaaggcctcaaaggcgtggagttcatcgcggtgaacaccgactcgcaggctctcatgttctctgatgccgacgtaaagctcgatatcggacgtgaagctacccgtggtcttggtgccggcgcgaacccagaagttggacgtgcctcggcagaggatcacaagaacgaaatcgaagaaaccatcaagggcgccgacatggtcttcgttaccgccggcgaaggtggtggcaccggaactggtgctgcaccagtcgtggcagggatcgccaagaagatgggcgcactgaccattggtgttgtgaccaagcctttcgagttcgaaggccgtcgccgtactcgccaggcagaagaaggcatcgcagcactgaaggaggtctgcgacaccctcatcgttattccaaacgaccgcctgcttgagctgggcgatgcgaacctgtccatcatggaagcgttccgcgcagccgatgaagttctccacaatggtgttcagggtattaccaacctgatcaccatccctggtgtgatcaacgtggacttcgcggacgttcgctccgtcatgtccgaagctggttccgcactcatgggtgtgggctctgcacgtggggacaaccgcgttgtctctgcaaccgagcaggccatcaactctccacttctcgaagcaacaatggacggcgcaactggcgtcctgctgtcctttgctggtggatccgacctgggcctcatggaagtcaacgcagctgcatccatggtccgtgagcgttccgatgaagatgtcaacctcatcttcggtaccatcatcgacgacaacctgggcgacgaagtccgcgtaaccgtcatcgcgaccggttttgacgcagctcgcgcaagcgccgctgagaaccgccgcgcaggcatctcagctgcacctgcagctgagccagtccagcagcaggtcccaaccaccaacgcaacccttccaccagagaaggaaagcatcttcggtggtgcacgtgaggagaacgatccttacctgtcccgctctgctggtgcacgtcatcgcattgaggagacccgctccggcggtggactcttcaccaccggcaatgatcgcgattaccgtcgtgatgagcgccgcgaagatcaccgtgacgagcgccgcgatgagcgccgcgatgaccgttcctacgaccgccgtgatgatcgtcgtgacgatcgccgcgatgaccgcggagacgacctggatgtacccagcttcctccag

SEQ ID NO: 2361 - DNA, 666 bp, Corynebacterium glutamicum
gtgaacaaaaaagtcatcgccattgttgtgggtgtggttgttgtcctcgtggcaatcctgggcgttgttgcctggttcgttcccatcctcaaggtgggaaacattgaagtaaccggtgcaacgcgcacagatccggatcaagtactggaagtctccgggattgttgagggcgaaaacctcttccgcgtcgatgcgactgcagcagggcaaaacattgtggaattgccctgggtgaaatcggtgaccgttaaccgtgccctgccaagcaccatcaccgtggagctgacagagcgtgagcctgcagtgttcatcaagcgtgctgatggtgaccatgtcattgacaccgagggtaaagaaattatcattggaacacccccggtgggaacagtagaagtttctggcgcggatgaaggaaactcagaagtgcttcctgcggttattgctgtaatcaacgcaattaaagcgcaagatgcgcagatgacagaaagtatccaggtagtggaagctccggatcaatttgatatcttgctgaaaatgaatgatggccgggaaatctactggggatcctcggaaaacaaccacgataaagcggtggcaatgtcgactgttttgaagcgggaaggccaacgttggaacattagctcaccctcaatggtgacagtccgc

SEQ ID NO: 2362 - DNA, 1458 bp, Corynebacterium glutamicum
gtgaccactccacacttggattctgcacaagatattgatctgtcccgcgtccacctcatcggtattggcggagccggaatgtctggcgttgcccgaatcctgcttgcccgcggtaagacagtcactggttccgatgccaaagattcccgcaccttgcttccactccgcgccgtgggagccaccatcgcagtgggacacgctgcggaaaaccttgagctttccggcgaacttcccaccgtcgtggtgacctcttttgccgccattccgcaagacaacccggaacttgttcgtgcacgtgaagaaggcattccggttattcgtcgctccgatctgttgggcgaattgctggaaggctccacccaggtcttgatcgcgggtacccacggtaagacctccaccacctctatgtctgtggtagctatgcaggcagcgggcatggatccaagctttgctatcggcggacagctcaacaaggctggcaccaatgcgcaccatggaactggtgaggtctttatcgctgaagcagatgaatctgacgcatcgctgctgcgctacaagccaaatgttgcagtggtcaccaatgtggaaccagaccacctggacttctttaaaacccctgaagcctacttccaagtgttcgacgatttcgcaggacgcatcaccccgaacggcaagctggttgtgtgcctgaacgatcctcacgcagcggagctgggggagaggtctgtccgcaagggtatcaagactgttggttacggtaccgctgacgccgtacaggcacaccctgaggttccagcgatggctaccatcgtggattcccaagttgtcgcagaaggcacccgcgccaccatcaacatcgatggacaggaagtatctgtgattcttcaaatccctggtgatcacatggtactcaacggtgcagccgccctgctggccggatacctggtgggtggggacgtcgacaagcttgttgaaggcttgtcggatttctccggcgtgcgacgccgctttgagttccacggtgctatcgagggcggcaaatttaatggcgctgctatttatgatgattacgcacaccacccaacggaagtaactgcagtgctcagcgctgcgcgcacccgggtgaaggccgctggaaagggccgtgtcatcgtcgcgttccaaccacatttatactcacgcaccatagaattccaaaaggagttcgcgggggcactgtcactggcagacgctgccgtggtgcttgagatttacggagcgcgcgaacaaccggtggatggcgtgtcctcggaaatcatcaccgatgcgatgaccattccagtggtgtacgaacctaatttctctgcagtcccagaacgcattgcagaaatcgcaggacctaatgacatcgtgctcaccatgggtgcaggttccgtgaccatgcttgctccagaaatcctggatcagctgcaaaacaat

SEQ ID NO: 2363 - DNA, 1116 bp, Corynebacterium glutamicum
gtgaaatcaggagaactacgaataaagatggctaactccccaaaacccatgcgggttgtcgttgctggtggcggtaccgcaggacatattgagcctgcgttggcagtggctgaagcgctgcgcgataagcacggtgcaacagtttcggctttaggtactgctcgtggtttggaaacaaccctggtgcctgatcgtgggtttgagcttcatctcatcgagccggttccagtcccacgcaagcccaatatggatttgttgaagctcccattccgggtagctaaggcattaggccaagcacgcaaggcactgaaggacacagacgctcaagcggtcatcggctttggcggttatgtatctgctccggcttatatggcggcgaagtctttgggcttgccattttttgtccacgaagccaacgcccgtgcaggcatggccaacaaattgggcgtcaagctcggtggcgttggccttaatgctgttgctggttccggcatggacggcgacgtggtgggcattccgattcgtgctgttttaagtggcgcgcgggatgagtccgcagctgaccgagccagggacacttggggtttggacaaggaccgccaaaccatttttgtcaccggtggttcgcagggctctgtgagtatcaacaaggccgtcgagcaagctgtagatcagctggtggaggcaggtttccaggtgctccacgccgtgggtaagaaaaacgagttgcctgcagcgaaacccggctaccatcccgttccgtttatcgacgatatgcaggctgcctacaccgttgctgatcttatcgtgtgccgctccggcgcgatgacggttgcagaggtcaccgccgccggcgtccccgcgatttatgtcccgctgcctcacggcaacggtgagcaggctctcaacgcccaggctgtcattaaagctggtgccgcacgccagatcgacgacgcggacttcaccgcccagacgcttatcgacgccacccttgacattctccttcatccctccacacaccaatcgatgtcggacgcagctaaaacctccaccgcaggtaacgcctccacggtgattgcagacatgattgctgcaactatcaatagccaacacaac

SEQ ID NO: 2364 - DNA, 1650 bp, Corynebacterium glutamicum
atgaccaccggagcctcaaaaaaacccgcacgtccgaacactggcgctaaaaccagaacggggctgggaattagggagcgtatttccggtgcatggaatgatcttctcgcgcgccctttaactgactacatcatgatcttgtgcatcgtggtcattttgtcgtgcctcggtgtagtcatggtgtattcctcctcaatgacatggtcgttgagggaaggtggctccgtgtggggtactgccgtgcgccagggcatcatgatcgtgttgggtttctttgccatgtgggtggcgttgatgacgcgcccgcaaaccattagaaacctatccaacctgatattgattgtgtctattgtcttgctgcttgccgtgcagattcctggcattggtacaggtaaagaagaggtcgggtcgcagtcgtggattgctcttggacctattcagtttcagccttcggagatcgccaaagtggccattgccgtgtggggagcgcactacctcgcaggcaagggccctgtgcagcactggttcaataatcacttgatgcgttttggtggcgtcggtgcattcatggcgtttttgatcttcatggaaggcgacgccggcatggcgatgtctttcgtgctggttgtattgttcatgctgttttttgcgggcatcgccatgggttggatcgcgattgccggcgtactgattatcgcagccctcgcagtcctggcattgggcggaggcttccgttcaagccgattcgaggtgtatttcgatgcgctgtttggcaatttccacgatgtgcgaggcattgccttccagtcctatcagggcttcctctctcttgcagatggttccggcttgggagttggtttgggccaatcaagggcgaagtggttctacctgcccgaagctaaaaatgacttcatctttgccatcattggtgaggagctggggctgtggggtggcgctctggtcatcgcacttttcgcggggctgctgtacttcggtctgcgcacagccaagaagagccacgatccattcttgggcttgatggctgcaaccttgacggcatccgtggtgtcgcaggcgttcatcaacattggctacgtggttggtctgctgccagttaccggtattcagctgcccatgatttccgccggtggtacctccgcgatcattaccttggcttccatgggcttgctcattagctgtgcacgccacgaaccagagacagtttctgcgatggcttcctatggacgccccgcaatcgatcgacttctgggattgcgtgagccttcaagtactttgaccaccagtaatgcatccttgcgttccaacaaaaccaaggccgctaaacaaaagccgagtcctcagaaagagtctcgggaccgcttcggcgagcctgtgaccgcacgccgagcgcaggcgccacgaagtgggcgagctggagtacaatcggaagctccgcgacgctcgactggtagcgtcaaaggtcgaagcagtggtcaggacaacggtcgaagcaacgaaggtacggcgcgtagccaatcaactactggtgggcgcgcagccgatcgcagcgttgatcgaagtcgtcaaagcaggcctaccgagcgccgttccgagtcgcgcgatgattggcgtgacaaccgcaaccgcaga

SEQ ID NO: 2365 - DNA, 468 bp, Corynebacterium glutamicum
gtggcaggccaccgtggccaggtcgtcgccgagcatgacggtgttcatttcattgacaactccaaggcgaccaacccccacgctgctgattctgcgctagctgggcatgattcagtcatttgggttgtcggcggacagctcaaaggcgcggacattgcgccactggtgaaaaagcacgaacagcgcatcaaggcagcattggtgttgggcgcagatcgtgctgaaatcgtggcagcgttgaaggaacacgcgtcgcaggcctctgtatttgtcactgacaagacggagccatttgaggcaatggaagaaatcgtcactgaggcatttagcatcagcgaacccggcgataccgtgttgcttgcccctgccgctgcgtctttggacatgttcaaaggcatgggccagcgtggcgacctctttgcacacaacatcattggcacaatcaaaggattaacggaagagaaaggc

SEQ ID NO: 2366 - DNA, 384 bp, Corynebacterium glutamicum
ttgagcaccacgccagcatcaggggtgaaggttggagaccagtgcaattggaaactagacagctctgcaactaacacatcaatgcggtttttcgctaccaaagcctcagacaccgggatgccgatattgcccactgccttggcagtaaaaccgccctcattcatcatcgcggcgagcattgatgtggtggtggttttaccgttggtgccggtgactgcgagccacgtatgtggctcgccgaaaacacctgcctggtccaggcgccaagcaagctcgacgtcaccgataacctcaaggccctggcggtgggcgtcgacaagcaaagtgcttgttgggcgccagcccggggaggtgaccacaatggagaaagaatccagctgttcc

SEQ ID NO: 2367 - DNA, 333 bp, Corynebacterium glutamicum
atgtggctcgccgaaaacacctgcctggtccaggcgccaagcaagctcgacgtcaccgataacctcaaggccctggcggtgggcgtcgacaagcaaagtgcttgttgggcgccagcccggggaggtgaccacaatggagaaagaatccagctgttcctgagcctgcgcggtgctgatatctgcaacgtctactacttcaatgagcatgtgacgtgcagtttcgttatcgtcggcgaccacaacatcgcaatgcaactcactgagcatctttgcaatggacaggccggaaacaccagcgccggccacaagaatacggccctgcagcgcctgagg

SEQ ID NO: 2368 - DNA, 1098 bp, Corynebacterium glutamicum
atgcaacagattatggtcagtggaacggttgcgttcctcgtctcaatctttctcaccccggtgttgatccgttatttcactaaccgccagttgggccaggaaatccgtgaagaaggcctgcagtctcacttgcgtaagcgtggcactccaaccatgggtggcattgcgattatcgcgggcattgttgtggcctatgtgtttaccaatatcttggccatgatccaaggcgttggtggattcacagtctccggcttgctcgtgttgggtctgaccttgggccttggtgccactggtttcgccgatgacttcatcaagctgtacatgaaccgaaaccttggtttgaacaagaccgctaagctggtgtctcagctggccattgcgttgatctttggttttttggtactgcagtttcccgatgaaaacggtctgaccccagcatcaacccacctgtcattcattcgcgatatcgacaccattgaccttggcttcgggggcagcgtttttggcatcatcgtgttcctcatctttatctacgttgtggtcagcgcgtggtcgaatgccgtgaacatcactgacggtttggatggtttggccgcaggtaccacagcatttgtcatgggtgcttacaccttgatcacgttctggcagttccgaaactcctgcgatactgcagtggaagcgggttgctatacggtgcgtgatccactggatttgtccgtgttgtgtgctgctggtctgggcgccaccttgggctttctgtggtggaatgcggcgccggcaaagatcttcatgggcgatactggttctttggcactgggcggtttggttgcaggtatttctgtggttagtcgcaccgagctgctcatggttatcatcggcgcgctgtttgtcattgagatcgcttctgttgcgatccagatcggcgtgtttaagacccgcggtaagcgtgtgttcaaaatggctccgatccaccaccacttcgaggcccttgggtgggctgaaactaccgtgaccatccgtttctggctgatcgcgatcatggctgtgttggcgggtgtcggtgtgttttacagcgactggctccacttagcggaggta

SEQ ID NO: 2369 - DNA, 1542 bp, Corynebacterium glutamicum
atgatcacaatgacccttggggaaatcgctgacatcgttggaggcaggcttactggcggtgctcaagaagatacgcttgtgagctccagcgtggagtttgattctcgatccctcacaccgggtggcttgtttttagcacttccgggtgctcgtgtagacggccatgattttgctgcaactgcaattgagaaaggtgcggttgcagtattggcagcccgtgaggttgacgtacctgcgatcgtcgtgcctccagtaaaaatccaggaatccaatgctgacatttatgctcatgatccagatgggcatggcgcggcggtagtggaggcgttgtctcggttggctcgccacgtggtggatatctgcgtggctggccatcaattgaacgttgtggctattactggttctgcgggaaagacttctacgaaggatttcatcgcgacggttcttgaccaagatgggccaactgtggctcctccgggctcgtttaacaatgagcttggtttgccacacaccgcgctccgctgcacaaccgatactaagtatttggtggctgagatgtccgcgcgtggcattggacatattaagcacctgacagagattgctccgccacggattgcagctgtgctcaacgtcggccatgcgcacctgggtgaatttggatcccgcgagaatatcgcgcaggcaaaaggcgagatcattgaagcgctgccctcgaagaaaacgggtggggtagcagtccttaacgctgacgatccttttgtcgcccggatggctccacgcactaaggcgcgcgtggtgtggtttaccaccgatgcaggccaagcaaaaaagtctgattattgggcaacgagtatttcactggacgctgttgcgcgggcaagctttacgctgaacacgaaggacggctcttggccggtcaccctgcaggtttttggtgagcaccaggttgctaatgcacttgctgctgctgccattgccatggaagctggcgtcgccccagaattggtggttgctggattggaagcacattcagctgcttccgcgcaccgcatggatgtaaagacccgtgccgacggcgtgaccatcatcaacgattcttacaacgcgaatcctgattctatgcgtgcaggtatcgcggctcttgcgtacacagctagtggtcgttctgaagcaacaagctgggcagtgcttggccaaatgggtgagcttggcgatgacgcctcggaagcccatgccgaacttggtgctgagctggctaaatacaatgttcaagaacttgtcgcagtgggggagaaccctaactgtgcagcacttgcagagtccgcagcgagcctgggtgtgagtactcacgtagtttcagacgttgatgcagcgctcgagttgctcgcaggccatattaagcgggatgatgtagtgctggttaaggcttcaaatgctgatcgcctgtggagggtcgcagaagcactacatggcatggtgccgggcctcaaaaacacaggtggctcggtcaacgacgattctcgtcggaacgtggaaggacag

SEQ ID NO: 2370 - DNA, 1551 bp, Corynebacterium glutamicum
ttgctggacctcaccaaacttatcgatggcatcctcaagggctctgcccagggcgttcccgctcacgcagtaggggaacaagcaatcgcggctattggtcttgactcctccagcttacctacctcggacgctatttttgctgcagttccaggaacccgcactcacggcgcacagtttgcaggtacggataacgctgcgaaagctgtggccattttgactgacgcagctggacttgaggtgctcaacgaagcaggagagacccgcccagtcatcgttgttgatgatgtccgcgcagtacttggcgcagcatcatcaagcatttatggcgatccttcaaaagatttcacgctcattggagtcactggaacctcaggtaaaaccaccaccagctacctcttggaaaaaggactcatggaggcaggccacaaagttggtttgatcggcaccacaggtacacgtattgacggggaagaagtacccacaaagctcaccactccagaagcgccgactctgcaggcattgtttgctcgaatgcgcgatcacggtgtcacccacgtggtgatggaagtatccagccatgcattgtcattgggcagagttgcgggttcccactttgatgtagctgcgtttaccaacctgtcgcaggatcaccttgatttccaccccaccatggatgattactttgacgcgaaggcattgttcttccgcgcagattctccacttgtggctgacaaacaggtcgtgtgcgtggatgattcttggggtcagcgcatggccagcgtggcagcggatgtgcaaacagtatccacccttgggcaagaagcagacttcagcgctacagacatcaatgtcagcgactctggcgcccagagttttaagatcaacgccccctcaaaccagtcctaccaggtcgagctagctcttccaggtgcgttcaacgttgctaacgccacgttggcatttgccgctgcggcacgcgtgggtgttgatggcgaagcgtttgctcgaggcatgtccaaggtcgcggttccaggccgtatggaacgcattgatgagggacaagacttccttgcagtggtggattatgcccacaagcctgctgcagtggctgctgtgttggatacgttgaggacccagattgacgggcgcctcggagtggttatcggtgctggtggagaccgcgattccaccaagcgtggccccatggggcagttgtccgcacagcgtgctgatctagttattgtcactgatgacaaccctcgttcagaggtgcctgccacgattcgcgcagcagtcactgcaggagcacagcagggtgcttcagagtccgaacgaccggtggaagtcctagaaattggtgaccgtgcagaagcaattcgcgttttggtcgagtgggcacagcctggagatggcattgtagtagctggaaaaggccatgaagttggacaactagttgctggtgtcacccaccattttgatgaccgcgaagaagttcgcgctgctttgacagaaaagctcaacaataaacttccccttactacggaagaagga

SEQ ID NO: 2371 - DNA, 225 bp, Corynebacterium glutamicum
gtgtcttttgtagaatttcataatctgaacttttgtttgaactcttttcggcatcacccacgtgccgcgtccgaattattaacacctagaaacctgtggaggagagaaaaccatggcaaccacgttgctggacctcaccaaacttatcgatggcatcctcaagggctctgcccagggcgttcccgctcacgcagtaggggaacaagcaatcgcggctattggtct

SEQ ID NO: 2372 - DNA, 1953 bp, Corynebacterium glutamicum
gtgacctaccggcctaaatcttcaacccagggcggcgcacgcaagcgacgtgtgaacatggttaccgctatcgcattggtcatcgctggcgtactgatcattcgcctcggctgggtccaagttgtctggggaccagaactgtccctcaatgcttcggaacagcgcacccgcgtgtacgtagatcctgcacgtcgtggaagcatcgtggaccgcgaaggaaaccagatggcgtacacgatgcaggcacgttcgctgacggtttctccgaacatcatgcgtgaggaattaaagaccggaactgatttggccttgcgtttggcggctgaagaaaccgatccggaaaacgtggccagctatgtgaccatcgaagaaggcaacgcgtatgtttttgcgtctgaagaacagcgcgaaaccattctgtccgacaaggtagaagagcgcattcaaagcattgcggatcggatccctgagatcatcaaatcccatgaccaagatgtcactggaatttcctctgaggagatcctggacaagctcaatgctgatagccagtatgaggtgctcgtccgcaatgttgatcccgatgtagcgtcagaaatcaccgatgagatgcccagcgtcgcagctgatcatcaagacatccgccaatacccaaacggcgcgattggtgaaaacatcatcggtcgaatcagcatggacggcgaaggccagttcggctttgaggcttccaacgattccctgttggcaggaaacaacggtcgctcaacccaggacatgtccattttgggacaagcaatcccgggcacgttgagggatcaaattccagccattgatggtgccagcgttgaactcaccgttgatctggatctgcaaacctatgtgcagcaggcattggagcaggcgaaagctaactccggtgcagaaaacgcctccgctgtggttcttgatgccaagaccgctgaggttttggcgatggcaaacaccgataccatcaaccccaacgaagacacgggaaagcagattgagcagggcaagagctttgacaatccttctgtcacccaccccttcgagcctggttctgtagccaaggtgattactgcagcaggcgtaattcaagagggcttgactactccagatgaagtgttgcaggtaccgggcagtattgaaatggccggtgtttctgtcggtgatgcgtgggaccacggtgtcgttccctacaccactgcaggaatttttggtaagtcctcgaatgtaggcactctgatgcttgcgcagcgtcttggtgaagataaatttgctgattacctggaacgattcggtgtgggacagccaacgggtattgagcttccgagcgaatcccaaggcctgctgcccgcacgtgagcagtggtctggcggtacttttgctaacctgcccatcggtcagggtatgtcgatcaccacgttgcaaatggctggaatctaccaagccttggccaacgatggtgaacgcattcaaccgcggatcatcaagagcgtgactgattctgacggaacagtcctagagcagccagaacccgataaaatccaggttgtcagcgctgaagctgcccgcaccacggtggatatgtttaggtctgtcacccaggttgatccaactggagtgcaacaaggtaccgctccagacgcctccattgagggttatcaaatctcaggtaagacaggtacggcgcagaaagttgaccccaacacgggcgcgtactctaactcgcaatactggattaccttcgcgggtattgcacccgctgatgatcctcgatttgttgtagccatcatgcttgatgagccagaacgcggagtccacggtggtggcggccaaaccgcagcacctttgttcaaagacatcgccacctggttgctcaaccgcgacaacatcccactgtctgcagccaccgaaccgatcatccttcaagctcaa

SEQ ID NO: 2373 - DNA, 795 bp, Corynebacterium glutamicum
atgaccatgacaaatggctcccgcacagagtcgggaaagattcgcgatcgacgtgtcgctgacgctgatccacggtatggccgtcgcgtctcggtgagtagggatttctccacagcggaagcttcggggaggggcgcgtcgataagcacgcaacctcgtcgtgacatggcgccggaaaggcgccacacaacccgggccctagtgaaccctggcgtgcaaccaacgcgtaagcgtttgatgcagcacaagctgggctctcagcaggttatgtcggtgcgtggtcgccgcgttgaggcaaaacgtgctgatcctaaggtgatccagctgtctgtgctggtggttatcctgctgtgcgttggtgttggcgcgaccatgggtctgtccggaacgtctacacagcagactttccagttgcaggaacttcaggcaactgaaacggatttgagcaatcgcattgagtcgctcaaccgagatgtggaagatgctcgctcagcagcaaccttggcagcgaatgctacggagatgggcttggtatccccagtggaacctggcgtgctcgcagtgcaggaaaacggtgatgttgtggaggagcgcgaagcaaatccagagacacgccctatagttgacatcaatggacaacagacccgaccaaatcgggcatcaagcaaccctgacgagactaacgcagtgactgaaaacctccaggcgattccacaagaagcagcagctccgccgtatcagaccaacactgttccttatgctgcaaccaccggacaagcaggtggcgcagggcag

SEQ ID NO: 2374 - DNA, 1011 bp, Corynebacterium glutamicum
atggaagatttttccttggatggcaaccacggacacgttcccgtaatgcgtgatcgtatggcggctttgatcgccgaacacgtggaagcattgggagaaaacgctgtcattgttgacgcaacccttggcgcaggcgggcatgcggagttcttcctgaacacgttccccaaagcgcgcctgattggccttgatcgtgaccaaaatgcgttgcgggatgctcgcgcgcgacttgctcctttcggggagcggttcattggcgtccagacgcgtttcgacggactccgcgaggtgttggaatctgtcgagggcgacatcattgatttagctcgcgagcacggtatcgctggcgctctgtttgatctgggtgtctcctcgatgcagcttgatcaggtggagcgtggctttgcctaccgcacggacgcgcctctggacatgcgcatggatgcaactcagggtattacggctgcagatatcctcaacacttattcgcatggtgacatcgctcgaatcttgaagacttacggcgatgaacgcttcgccggcaagattgcttctgcggtgctgaaagaacgtgaaaaagagccgttcactacctctgctcgtttggtggagcttctgtacgacgccatccctgcagcgacccgccgaaccggtggacaccccgcgaaacgtactttccaggcgttgcgcgttgaggtgaacaacgagcttgattccctgaagaatgtgcttcctcaaatcactgacgccctcaatgttgggggacgtgcagtgtttatgagctaccagtctcatgaggacaagctggtgaagaagttcttcacggatctgaccacctctaagacccctccgggcttgcctgttgatcttcctggaactgcaccacagtttaagcaggttactcgcggtgctgaaacggcttcggaagctgaaattgaagaaaacccacgtgccgcacctgtgaaggtgcgcgcaatcgaaagaatcggcaacaactcaggagacctctca

SEQ ID NO: 2375 - DNA, 429 bp, Corynebacterium glutamicum
atgttccttggtacctataccccgaaactcgatgacaaaggcaggctgactcttccagcaaagttccgtgaggaccttgcggggggattgatggtcactaaaggtcaagaccacagtctcgcggtttatccgaaggaagaatttgcagcaagggctcgcaaggcagctgcagtttctaggacaaaccctgaggctcgtgcgtttatccgaaaccttgcagcaagcgcggatgaacaacgacccgacggccaggggcgcatcaccctttcggcagcgcaccgcacatatgcggggctgacaaaagagtgtgtcgttatcggttcggtggattttctggagatttgggacgctcaagcctgggccgcgtatcaggaagagacggaggctgccttctcagcagctgaagatgacgtccttggaggattgctc

SEQ ID NO: 2376 - DNA, 387 bp, Corynebacterium glutamicum
gtgtcgctttcagagcaggagcaacgcgcactgcgcgaaattgagcaagcgctcatggcagatgatccgaaatttggaaaagcggttgcaagtaacaatggcctagcaggcggtgggtttacccttcggggaatcgcacttttcgtactcggacttgtccttcttgttgccggcgtcgcattaagccagcaaacattgtggttcgttgcgctcggaattatcggattcttagtcatgttcggatcgggagtgtggatgctgcgcggggggcggctccaacaaaatctccgtcacatcccgcacttccaatgcgaagaatcgccaacagggcaattccaccattggggacaaaatggaagaaaacttccgtcgacgattcgagggcaa

SEQ ID NO: 2377 - DNA, 423 bp, Corynebacterium glutamicum
atgggtgacgtaatttcagcaacaacgaggtttgagagagtgggaggaaaaagggcccagtttttctccaaggcgcacatccttttagagcaggcacatacctaccgcggcgaaggtgatcttctgctggctctagagatgtcctatcaatccgctctccgaacggccggtgcggtggtggcgggaagcgacgtagctgccagaaagcggaagcctaagagtgcttgggatcagctccaattggtgggagatgaggcagcggagtgggcggctgaactttcccaattctccaccattagatcaagagcaagcagtgggctggatatcaccctttctgcggcggacttagatcgctttatggctcgagttgccctgttcctggaggaggcgcaacacggctttagtccaagcgtggatgctgca

SEQ ID NO: 2378 - DNA, 573 bp, Corynebacterium glutamicum
ttgatggggagcgtgtcaccgatcattcgtaaattgagtatccccgagttcaccaccaacaccccagtgttggtggatatctacatcgcagcgatgaactatgacaaagcaatcagggatacccggatcgaagtctggcggagaaactcccagaaccccggattcacagcagtggcagcgctgatggatgatcaggtcgtgggcgtggcctatggcttcaatggcagcccagatcattggtggcaacaccaattacgccggggactccgacaacaaggaggcccgacggaagaggaaatccatatcatccacaactactttgaggttgcggaagttcatgttcagcctggcttccaaggtcacggcattggccgaaagctgatgcatgaactgttaaaagacaaacaaaacacttttgccattttgtctacacccgaggtcgacgatgaggcgaaccatgcgtttagcctgtatcgctctctcggcttcactgacttgctcaggcagtttaggtttgacggggatcaacggccgtttgccgtattgatcaccgccctcccccttcatgattcc

SEQ ID NO: 2379 - DNA, 978 bp, Corynebacterium glutamicum
atgtccctaacgaacatcccagcctcatctcaatgggcaattagcgacgttttgaagcgtccttcacccggccgagtacctttttctgtcgagtttatgccaccccgcgacgatgcagctgaagagcgtctttaccgcgcagcagaggtcttccatgacctcggtgcatcgtttgtctccgtgacttatggtgctggcggatcaacccgtgagagaacctcacgtattgctcgacgattagcgaaacaaccgttgaccactctggtgcacctgaccctggttaaccacactcgcgaagagatgaaggcaattcttcgggaatacctagagctgggattaacaaacctgttggcgcttcgaggagatccgcctggagacccattaggcgattgggtgagcaccgatggaggactgaactatgcctctgagctcatcgatcttattaagtccactcctgagttccgggaattcgacctcggtatcgcctccttccccgaagggcatttccgggcgaaaactctagaagaagacaccaaatacactctggcgaagctgcgtggaggggcagagtactccatcacgcagatgttctttgatgtggaagactacctgcgacttcgtgatcgccttgtcgctgcagaccccattcatggtgcgaagccaatcattcctggcatcatgcccattacgagcctgcggtctgtgcgtcgacaggtcgaactctctggtgctcaattgccgagccaactagaagaatcacttgttcgagctgcaaacggcaatgaagaagcgaacaaagacgagatccgcaaggtgggcattgaatattccaccaatatggcagagcgactcattgccgaaggtgcggaagatctgcacttcatgacgcttaacttcacccgtgcaacccaagaagtgttgtacaaccttggcatggcgcctgcttggggagcagagcacggccaagacgcggtgcgt

SEQ ID NO: 2380 - DNA, 1113 bp, Corynebacterium glutamicum
ttgaaggacgtctccttgagcagtttcgatgcccatgaccttgacctcgacaaatttccggaggtcgtgcgagatcgtttgacgcagttcctcgatgctcaagagctaacaattgctgatatcggcgctcctgtcacagatgctgtggcccatcttcgcagtttcgtgctcaatggaggaaagcgaatccgtcctctttatgcgtgggctggtttcctggcggcgcaaggccataagaattcttctgaaaaacttgagtccgtccttgacgccgcagcgagtctcgaattcatccaggcttgtgccttgattcatgacgatattatcgattcttctgatacccggcgcggagcccccacagttcaccgggctgtggaagctgatcaccgcgccaataatttcgaaggcgatcccgagcactttggcgtttcagtctcgattttggctggcgatatggcattggtgtgggcagaagacatgctgcaggattccggtttgagtgcagaggcattggcccgcacgagggatgcttggcgtggcatgcgtactgaggttattggcggccagctgcttgatatttatctagagtcgcacgccaacgagtcggtggagcttgcggattctgtcaaccgcttcaaaacggccgcttacacgattgcgcgcccattgcacctgggcgcctccattgctggcggttcgccgcagcttatcgacgcgctcctccactacggccacgacatcggcattgcattccagttgagggatgatctgcttggtgtgtttggggatcccgctatcaccggcaaaccagctggagacgatatccgtgaaggcaagcgcactgttcttcttgcgctcgctctacaacgcgctgataagcaatctcctgaagctgcaacggccattcgcgcaggtgttggaaaggtgacttcaccagaagatattgctgtcattacagagcatattcgagctactggtgctgaagaagaagttgagcagcgaatttcccagctgactgaatccggtttggctcacctcgatgatgtagacatccccgatgaggtgcgcgcacagttgcgggcactggctatccgctcaaccgaacgtcggatg

SEQ ID NO: 2381 - DNA, 1470 bp, Corynebacterium glutamicum
ttgcttctgctcggctctttcggtggcggtgccattcggtaccgtggcggagtgctcgatgcgttggggcttaacttccttgcttttggccacgcgcagggtatttccaataccgtgttgtgggttgggcagctgctgctgattggcgcgtgggttcaccttggacgtcggttgttcaagaaaaaagtcgctgatgacaccgcagacgctgctgacttaggtcttgtaaagcgcacgttgtatgccatggtggtgcccctcatttttgcggcaccaatgatgtcgcgtgatgtttattcctatctcatgcagggcgcgatgctgcgtgatggcttcgatccctacactgagggcgctgcggtaaaccctggccccatgttgcttgaggtctctcatgattggcgcaacaccacgacgccgtatggtccactacacctgtggattggagacatgatcaccacggttgtgggcgataatgtcaccttgggcgtcgtcgcttacaagatcttgtcgatcattggccttgctgtgacaggctggagcattgtccgcattgcacaacattttggagccaacccagcaattgcattgtggattggtgtggccaatcctgtgatgatcatccacatgatcggcggcatgcacaatgaatccctcatggtgggattggtcagcgtcggcttgttgctagcactgaagaagcgtttcgtggcaggtgtggcactcattgcagtggctgtgtcgctgaaagctacagcggcgattgcacttccttttgtggtgtggatcggcatgcatcatttcgcaggattcttagccaccaaaaagggcaaagactcccctacccttaagcaacaggtccccgcgttctttgccactggagctgcaggtgttgctgtcactggtgttgttgtcagtgcgatcacttgggcgtctggcgcttcgtggggctggatcagtgagatcagtggcaacagcaaggtaatcaacccgctggctttcccttctttggtggccagtgtgatcaccatggtggctgaagtgttcgttgacgatttcgactacaacgcagtggttaatgttgtgcgctcaatctccatgctgatcatgcttggcgggttggtcgtatgttggtggctgttccgccagaacgaacgcagggcggtcactggtacagcagcggcttatgccgtggcttttgtgttcaattctgtgaccttgccgtggtactacgccagcttgatctctttgctcggcacatttaaaccaccgatgtggttgattcgcttcgcagcgggtgcttcggtgtttatcgcgctgatgtttaccggaagtggaaaccaccagctgtacaacatcgttacggtgatcatcgcagcaattatcgcgtggcttgccaccgtggtgatctttgatgacactgaccctgcaacaacggccacggagaaaccctccccgcataccgtttcc

SEQ ID NO: 2382 - DNA, 507 bp, Corynebacterium glutamicum
ttgcataaggtaaaccgccaccccactaacaaaatgggatggcggttttttagatcttttagaaagcgcttagaacgccattgcttgagcgcgtcgcataacttcacgagccaactggccatgaagtgcatcgatggggcgaccaggaagggtctcgtcttcggtaaacaggaacgcgaggatttcctcgtcgctgaagccaccgtcggcaagcaaggcaataactccagggatgaaacggttggtgttttccttcttggtgctcaggaaagcttctggaatgtagcgaataccgtcgcgccggaccacgatcaatttgtgttcattgaccagatccatcaccttggtgacaacaacgccgaggcgctcggctgtctccggaagggtcagcaatggttcattgtcgggcagggcgaaggaagattcattgttggaactcacagtcttaatttagctggttcgagctctaatggagaatctttagggtatttctgcgcgtgccgggaa

SEQ ID NO: 2383 - DNA, 369 bp, Corynebacterium glutamicum
gtgagttccaacaatgaatcttccttcgccctgcccgacaatgaaccattgctgacccttccggagacagccgagcgcctcggcgttgttgtcaccaaggtgatggatctggtcaatgaacacaaattgatcgtggtccggcgcgacggtattcgctacattccagaagctttcctgagcaccaagaaggaaaacaccaaccgtttcatccctggagttattgccttgcttgccgacggtggcttcagcgacgaggaaatcctcgcgttcctgtttaccgaagacgagacccttcctggtcgccccatcgatgcacttcatggccagttggctcgtgaagttatgcgacgcgctcaagcaatggcgttc

SEQ ID NO: 2384 - DNA, 2148 bp, Corynebacterium glutamicum
atgtctaccgtgtacaggtgccttgatcttcgtttaggacgttccatggcgcttaaagtcatggaagaagatttcgttgatgatcccattttccggcagcgtttccgtagggaagctcggtcaatggcgcagctaaatcatccaaatttggtcaatgtgtatgatttttccgctactgacggtttggtgtatctggtgatggagttaatcactggtggcaccttgcgtgagttgctggctgagcggggacctatgcccccgcatgctgctgtgggcgttatgcgtggggtgctcacgggtctcgcggctgcccaccgggcgggcatggtgcaccgggatatcaagcctgacaacgtgttgatcaatagtgatcaccaggtgaaactgtctgatttcggcttggttcgagcggctcacgccggccagtctcaggacaatcagattgtgggcacggtggcttatctttcccctgagcaggttgagggcggtgagatcgggccggccagcgacgtgtattcggcaggcattgtgctctttgagctgctcacaggcaccacgcctttttcgggcgaggatgatctcgaccatgcatacgcccgccttacggaagtcgtgccggcaccgagttcgcttatcgacggcgtcccctccctcatcgatgagcttgtcgcgacagctacctccattaatcctgaggatcgtttcgatgattctggagagtttttgtccgcactggaagatgtcgcaacagagttgagcttgccggctttccgggtccctgtgccggttaattccgcagccaatagggctaatgcccaggtcccggatgctcagccaactgatatgtttaccacccatatccccaagactcctgagcctgatcacactgcgatcattccggtggcctcagcaaatgagacgtcgattctgcctgcgcaaaacatggcacaaaatatggcgcagaatccgctgcaacctccggaacctgatttcgccccggagccacctccggacacagcgctgaatattcaagatcaagagcttgcgcgcgccgatgagccagaaattaataccgtcagcaatcgttccaaattgaagctgacgttgtggtcaattttcgtggtcgcagtgatcgctgctgttgctgttggcggttggtggttcggttcaggccgttacggtgagattccgcaggtgttgggcatggatgaggtccaggcagtagctgttgtagaggaagctggtttcgtggcagtggctgaacctcagtatgacaatgaggttcccactggttcgattattgggactgaaccttcttttggtgagcgccttcctcgcggcgaggatgtttctgtcctcgtctctcaagggcgtcccgtggtgccggatcttagcgaggatcgatccttaagcaccgttcgtgaagagttggaacagcgcacgttcgtctgggttgatggcccaggtgaatattctgacgatgttccagaaggacaagtagtttcttttacaccgtcgtcaggcacgcagcttgatgttggtgaaaccgtgcagatccatttgagccgaggccccgccccggttgagattcctgatgtctctggcatgggagtggatcaggcaacacgtgtgttggagcgcgcaggtttgagcgtcgagcgtactgaagaaggctttgatgctgagacaccaaatggtgatgtctacgggacttcgcccaaggtatctactgaggtcaagcgcggaacctctgttgtgctgcaggtgtccaatgctatttcggtaccggatgtggtgggtatgaccaaggacgaagccaccgcggcgcttgcggaagaaggattggtcgtggcgtcgacaagcattattcctggtgaggcggcgagctccgctgacgccgtcgtgaccgtcgagcctgaatccggcagccgcgttgatccagcgcatccgcaggtcagcctcgggttagctggggagattcaagttccaagcgtggttggacgtaaggttagcgatgctcgaagcattctggaagaagccggtttaacgctgacaactgatgcggacgacaacgatcgaatttatagtcaaacccctcgtgcacgcagcgaagtctcggtagggggagaagttacagtaagggcgttt

SEQ ID NO: 2385 - DNA, 651 bp, Corynebacterium glutamicum
atgggtggtaaacatatcagttggctgagcatccgggacctgggcattagccctattggctgcggaattaaccggcacagggacccggaaagccggcaagctcaactctgttgcgacatcttccagtgcggacaaaaactctccagaatcatcgaaacgatcctcaggattaatggaggtagctgtcgcgacaagctcatcgatgagggaggggacgccgtcgataagcgaactcggtgccggcacgacttccgtaaggcgggcgtatgcatggtcgagatcatcctcgcccgaaaaaggcgtggtgcctgtgagcagctcaaagagcacaatgcctgccgaatacacgtcgctggccggcccgatctcaccgccctcaacctgctcaggggaaagataagccaccgtgcccacaatctgattgtcctgagactggccggcgtgagccgctcgaaccaagccgaaatcagacagtttcacctggtgatcactattgatcaacacgttgtcaggcttgatatcccggtgcaccatgcccgcccggtgggcagccgcgagacccgtgagcaccccacgcataacgcccacagcagcatgcgggggcataggtccccgctcagccagcaactcacgcaaggtgccaccagtgat

SEQ ID NO: 2386 - DNA, 1236 bp, Corynebacterium glutamicum
gtggttccctcgttgcagcaatggcgaaaacctgctctcatcctggccattttgacggtgctaggcgtactcctgacccattggttcgcctggccactcacctggccgctggggctgcgtcttcccgttgatgtagaggtgtactggcagggtgcgcgcgagttttggctcgccgatgatctctacgacatcaggtatgacaccactttcgacaacttgccgttcacctatccccctttcggtgcgttggtgttcaccccattgtggtggattcatgacctctttggtcttctcgtcaccgaacgtgtcttcgcgctaatcacgctgctcaccacctacgctgtggcagttttcctgctccgcctggccggcgtgcgcgatcgtgtgtgggaattcgtcgcattcgcagccctgctcgtgtccgcgccggtgtatttcacactcaatattgggcaaataaacgtcatgctcatggctttaacgcttttcgacgtcgccctcccccgcagcacgcgccattcaggcgtgctcaaatacgtgccactcggcgtactcaccggcattgccgctgcgatcaaactaaccccactagtgttcgggctgtatttcctcatcctgtgggtcgtgactaaatcaccacgcggactgtttggaatgattggtggcttcctcggggcatccgggcttgcaattattttccgaccatccattagcatccaatatttcaccgacgtgctgtttaccgcagaacgcatcggcgacctccacttcgcacgcaatgtctccatccgtgcggttttggaacgactccccgaacttggttccgcagcatctatcatgtggcttgttgctgtggcgctagtgatcatcgcagtcgcagttgctgcttaccgaatcctgcggacggatctctccgcgcacaatcgtctgctggctgtttccctcgtgtcgctcgttgcactgttgtgctcccccgtcagttggtaccaccactgggtgtggcttggtccgttaatcgtcgctctctggctaactcaacaccgctggctggctctatggggcgcattcgccgtgacattcggatcattccacaatttcctaccctcagaaaacaatatggagctcacctggccgtggtggatgcatgtcctcgcagcacattatttgatcttctccgcagtggttactgccgtatttagttgtgggaaaatgccccaaaaaacagagctttcccac

SEQ ID NO: 2387 - DNA, 1308 bp, Corynebacterium glutamicum
ttgacgaacccccagacagcacatgctgccgcgtctgactccgcatcccagaaggaggctcctaatccttcactctccatcactgtaggtattaaagatctgctggggctgctttcagttcttggcattgcagcggggctgatagccaacaagattctcatcgaacgctacaactggcgcatcgatgccgcagtttaccgcgaaggcgcgttagcgctggtcaacggggaatcactgtacgcgcagccgtttgatatgggtgatatttcactaccctttatctacccaccgattggtgccatcctgtttgcgccttgggggtactttgatttcatcacagttgaacttgcgggaaaccttgttgtcataggctcatccctgctgttattactgtgcctgtatcttgtcaccaacgctgttcttagcggtcgagacaagctgttggccttcaccatcgctgcgatttcctggccgatcgctctctttgcagagccagtgtttttgaacgctgacttgggccaaatcaacattttgatcatggctttggttgtcatggacctgcttccgattaagcgcagaatcccccgaggtgtcctgattggccttgcagccgccatcaaaatcactccgctggccatgctgttgtatttcctggtgaagaaggatttccgcggaatcatcaatgcggtgatctcactacttgccttcactgctatcggtgctgtgctcgcatgggaaaacaccaaagagttcttctcttcaacccttctcaacttaagtgctgaaggcgattcaggcgtagacaccacgttccaatccaacagctcgattcaggccatgctgtatcgctggtggacctcaaaggcagatgccgaagcatcctcactgcccaccatcttgtggatcgtactgtccctgattgctgtggcggccgttgcctacctaatgcaccaactcttctccagaggattgcacgttgaggcagtcatggttaacgccatgctcatgctacttatctcccccatctcatggtctcaccactgggtgtggctaccgctgtgggctgtggtgttcttcgttcgataccgccagcaccgctctcacccgaagttcttgttgtggagcggagttatcttgagcgtcatgctgctgatgctgccaccaaaatggtggtttggccgcgatggcgtcaacgtcttcgaactgaatttctgggagaaactactcatctctgactggacgtggctctccatcgggctcatgatcaccttgggtcttgggctgaaagcatttcccaaaatatccaaa

SEQ ID NO: 2388 - DNA, 1386 bp, Corynebacterium glutamicum
gtgagttggacagttgatatccctaaagaagttctccctgatttgccaccattgccagaaggcatgcagcagcagttcgaggacaccatttcccgtgacgctaagcagcaacctacgtgggatcgtgcacaggcagaaaacgtgcgcaagatccttgagtcggttcctccaatcgttgttgcccctgaggtacttgagctgaagcagaagcttgctgatgttgccaacggtaaggccttcctcttgcagggtggtgactgtgcggaaactttcgagtcaaacactgagccgcacattcgcgccaacgtaaagactctgctgcagatggcagttgttttgacctacggtgcatccactcctgtgatcaagatggctcgtattgctggtcagtacgcaaagcctcgctcttctgatctggatggaaatggtctgccaaactaccgtggcgatatcgtcaacggtgtggaggcaaccccagaggctcgtcgccacgatcctgcccgcatgatccgtgcttacgctaacgcttctgctgcgatgaacttggtgcgcgcgctcaccagctctggcaccgctgatctttaccgtctcagcgagtggaaccgcgagttcgttgcgaactccccagctggtgcacgctacgaggctcttgctcgtgagatcgactccggtctgcgcttcatggaagcatgtggcgtgtccgatgagtccctgcgtgctgcagatatctactgctcccacgaggctttgctggtggattacgagcgttccatgctgcgtcttgcaaccgatgaggaaggcaacgaggaactttacgatctttcagctcaccagctgtggatcggcgagcgcacccgtggcatggatgatttccatgtgaacttcgcatccatgatctctaacccaatcggcatcaagattggtcctggtatcacccctgaagaggctgttgcatacgctgacaagctcgatccgaacttcgagcctggccgtttgaccatcgttgctcgcatgggccacgacaaggttcgctccgtacttcctggtgttatccaggctgttgaggcatccggacacaaggttatttggcagtccgatccgatgcacggcaacactttcaccgcatccaatggctacaagacccgtcacttcgacaaggttatcgatgaggtccagggcttcttcgaggtccaccgcgcattgggcacccacccaggcggaatccacattgagttcactggtgaagatgtcaccgagtgcctcggtggcgctgaagacatcaccgatgttgatctgccaggccgctacgagtccgcatgcgatcctcgcctgaacactcagcagtctttggagttggctttcctcgttgcagaaatgctgcgtaac

SEQ ID NO: 2389 - DNA, 504 bp, Corynebacterium glutamicum
gtgcgttatttttacgatactgagttcattgaagatgggcgcacgatcgaattggtctctattggaatcgtcgcagaagacggtcgcgagtattacgcagttagcacacagtttgattcctccaaggcgaacgcttgggtgcgcgccaacgtgttggacaaattgcctaatccttcctccaaagtgtggaaatctgcagacactataaagcgcgaagtttatgagtttctcacctccaccggaccaacccctgaactgtgggcctgggtgggcgcatatgaccacgtgttgttggcacaaatgtggggcgatatggcggggcttcctcgggagatccctcgttttacccgcgagcttcgccagtattgggacatggctggccgcccaacgctgccagagctgccgaacggcaaccacgatgcgttgattgatgcgcgtcataatttagccaagttcaaagtgtgcatggcagcgctgcctttgggtaaaagggatcgcgtctct

SEQ ID NO: 2390 - DNA, 2418 bp, Corynebacterium glutamicum
gtggatggcactgagggaaatctcagtcaattccaatggcgcgatatggctacaaatcagacgctgagaaaagcactgttagtgctttctaccatcgctctactcttgactttatggccttcaattttcaatgttcgggccatcgagtcttttgttttcttcttccatattgatactgacgtgtaccgcgccggtgctaatgcattcttgcatggcgagaatctgtatacccaggactaccaagttggtagcattcaacttcccttcacgtacccaccgatttctgctgcgctgtttgttccacttgcaatccttgcaagcagtgtagccggaatagcattaacgcttatttccacggtgttgctgtggtggagcgtagctatcgtcttgcgccgagtgctcaagggtctcacggatgctgattccaggtttgtgtcctatttgattctgcctatggcattgtccacggaacctgtattccagaccctgcagtttggccaggtcaacatcattttgatggcgctggttctcatggataccttcaccaaaaagccctggttgccacgtggtttttggattggtttggcggcatccatcaagctgacccccgcagtctttggcctttacttcctagtgaagaaggactggaagggcgctggagtagcaattgcttctggcgtaggtttttccgccttggcgtttatcctctcaccttcaagttccaagatttactggactgaaacactcaacgacccttctcgcatcggcaacctatcttatattgctaaccaatctgtgcgtggaacgctcagccgaatgatgcatgaacagcaggatctcgtcgaaaagctttggcttgtggcagttgtcttgtgccttgccgctgtcgccgtcgccatgtggcgcgtggtacgcgccggcaacccgtacggcgccgtcatgctcaactcgttgattgctctgctgtgctcccctgtttcatggtctcaccactgggtatggctgattccaatcgctattggtttgggggcaagtgcgtggaaccagcggcggactgctccaggaattgccgcgacggctggagtcttggcgcttctgaccacgattccgatgttcatcacaacattttggaacatgccatacgattcagagtcttacccattttggccattgattctgcagccgtcgggcaacgcgtatgtagtagtggtcatcgctattttgatcgtcgcgattgtgaatccaacagttttgggcagtggcaataaagctgtttcaggccaggcagagaagaagtcctcccctgcgttgcttgttgttttagcgattgccattttctacctctttgccaatatttggtttaagggaaacaatcaaaacaaagcgctcattcagtacccactgcagactatggaaggtcgcggtctcactgacttcggcgagcttatttttgaattcgcggcttcctccaaccagcttgtttccctctggataatcggcgccctcaacgccatcgcattggctattaccctgtggttcctccttcagcgttttgctgggaagaagagctcctggctgatttatctcagcaccgtggctgttgcgctgatgatgttctcagtgcaggatgccttgcagtttggttcgctgactctcgttgcactcgcattgatcactgttgatgtgttgagtgtcagagagattggccgccgcgggctgctcacaggacttgcagcagccctgtttggatggccaattctgattgttatcggattcctcattcaccgacgttatgcagcaacaatcacaaccactgtcaccgcagctgtgctgtggatcttaggaattctgctcaatccagacgccttcaacctcaacctgctgcgtcaatggttcagcgggcgcgatggtcgggacaatttgtccttctatgctttccttgccaggtgggtcagcgaatccccagtcatgatgttcgtatggttcatcgtcgccctaggacttggtgcctgggcaatccaccgcacctggtcacatggattcaaggacctctccgctgcactgagcatcgcactaccaaccttggtgctccccatagtggaactccaccacctcgtgctacttcttccactgatcgcagtgttgcttcgtcaaggacgcgtggcaatttcctacctcatcggatttatctacctagtctcatggactccgcaacacctgtcctactccacggtattcccacttaatgatccagcaccagaagggtacgtcgcccactttggatggtatttactcgttgaaccaatggcggtagcaccggcagctataatcctcggagcatttattgcctgtgctgcaaccacacctaaaacaagtcagctcgtgcaggtcgacaagtcaagcgcggaaaacaccaag

SEQ ID NO: 2391 - DNA, 1449 bp, Corynebacterium glutamicum
gtgcgtaaaggaatttcccgcgtcctctcggtagcggttgctagttcaatcggattcggaactgtactgacaggcaccggcatcgcagcagctcaagactctgcatttgactacggtatggatccaaacatgaactacaacccgatcgatgacatcaaggatcgtcccgaaggattgtccaatcttccctacttcggaagtaaattgaccagctggggctcatcagatgccaccgcctcatccggcgtcgtgacctccgcgctcccgcagtacaccgatccgcgctaccccctcggcaaagacgacctgcccaaggcaaccatcgacatggagccagaagttcttgcgcgccttgagcgattcgtcggcgttgacggtgatcgcatccgccaaatcaacgcgtactcgccatcaatgggacgcaccattcctctagtctgggttgttccagaagacaacaccgtgcctggcccaacggtctacgcactcggcggcggtgacggtggacaaggcggccagaactgggtcacccgcaccgaccttgaggaattaaccagtgacaacaacatcaacctcatcatgccgatgctcggatcttttagtttctacgctgactgggcaggcgaaagcgaatccatgggtggtgcgcaacagtgggaaacattcctcatgcacgaactgccagagccgctagaagcggccatcggcgcagacgggcaacgcagcatcgtcggcatgtccatgtccgggggatcagtgctgaactttgcgacgcatgaccccaacttttactcctcggtcggctcattttctggatgtgccgaaaccaactcctggatgggacgccgtggcatcgcagccaccgcctacaacggcaatgtcgtgcctgagcaaatctttggtgaagtagacagtgattactcccgctataacgatcctttgctcaacgctgcgaagctcgaagaacaagacaacctctacatcttcgccggttccggtgtgttctctgaactagatgtcattggtgacaacgcaccgattgatgaggatgcgtttaaaaaccgcgttctggtcggatttgaaatcgaagctatgtccaacacctgcacccataatcttaaggctgcgactgatcaaatgggcattgacaacattaactatgatttccgaccaaccggtactcatgcttgggactattggaatgaggcactgcaccgtttcttcccgttgatgatgcagggcttcgggcttgatggtggtccgatcccggtttataaccctaacggtgtgtcctctagtgagtcttcttctgagctgtcgtctgatgtgagtcttggcaccgtgatcggtagtgtggcgggaagctccggatcaagtgaaggcagcagcgtccgagagttccttgcaggaagttccggatcaagccaatcaacaggaagcttctacgaa

SEQ ID NO: 2392 - DNA, 204 bp, Corynebacterium glutamicum
atgagaaaacctctgacatcaaatgtgtcagaggttttgacgtttcccagctttcaagatttcagcagcgtgcagaaggcctattctttgtcagcagactgcttcttttttgaaccccgtgggacaaacacagcggccgcgacaccgacaatgatgaacggtgcgacgatctcccgcgataagtccaacgctgcaacaatcaca

SEQ ID NO: 2393 - DNA, 177 bp, Corynebacterium glutamicum
gtgaataagttcatgcgtatccgacttctcattgttgcaatcctgattgtgctttatgtgattgttgcagcgttggacttatcgcgggagatcgtcgcaccgttcatcattgtcggtgtcgcggccgctgtgtttgtcccacggggttcaaaaaagaagcagtctgctgacaaagaa

SEQ ID NO: 2394 - DNA, 1188 bp, Corynebacterium glutamicum
atggattggccagacatcgccaagggaatatccatcctaggtgtcgtgttactacacgtgtcgttggcaattccaggtggccaggacaccatgatgtcccacctgaacgcactgcttgatccacttcggatgccattattttttatggtgagtggattttttgcagttaaagttctgaatcaaagctttggtgaacttttccgcgggcgactgtggttctacctggttccatatttgctgtggactccagtgaatctttatctacaccgcctcgagggcacagtttttaccggtagagcaccgggaacatgggaatggtacagcggctcgatgctctcggccaccaatatgtactggttcctctacttcttggtcatcttcaacctatttttatgggcaacgagaaaactcccagcttgggcaattgtggcgttggtggcctcactgtggctacttatgccggcttatagcgagattgagattctacgcaagtccattatttacttgcctacattcctcattggcgcttacttccgcccactgatttcgcgttttgcagaagccgcaacaaggccaaaagcaatagtgtttgcagcggtcctttatgtctcgggacttgctttgggcgtgatctcaaatgggctgcgcgacagcgaaaaccatggcgcaagcgtgctgtggctgatgaacctccgcgatacttttgctcatgcactcggcggcaacctcactggattcgatatggatcaccttcctggaatgatcattcggattgtttccctgcctgcaggaattgtgttgtgcgtatggcttggccgaataaagccagtaggggagtttttgaaacttattggtaggcacacccttcccatctacattgggcatgcaacaggactatcgctgatttttggtttcggcttgcgctggaatttcatggagattgataacttctctgacagtttgtggcaccacaccaatacgtggatggtcatcgcgtttgcctgcgcgatgctcggcgggtacctgacctatctgatctcgcgagttccagtgctgggatggactcttgttccccctaaactgccagaaccagataaaactccagctaaagcacaagctgattctcacgttaaagctcagtctgcgaagcctatgaatgcttctacctcttctaagacgtacggtata

SEQ ID NO: 2395 - DNA, 735 bp, Corynebacterium glutamicum
atgaaaaacaactggtatcggcttttcaagtatgtgctaattggcccgtttttgcgtgtgtacaaccgcccggagatcgaaggcaaagaaaacatccctgcagaaggtgccgcgatcatggcgtccaaccacgaagcagtgatggattccttttattttcccctgctgtgcccacggcagctgaccttcccagcgaaggccgaatacttcacatcaccaggtattaaaggcaagatgcagaagtggttttttacttctgtggggcaagtacccctggaccgcaccgcagataatgccatggattctttgatgaataccgccaaaatggtgctggatcggggagacctcttcggtatttaccctgaaggatctcgttcgcccgatggtcgcatctacaagggcaaaaccggaatggcctatgttgcgatggaaactggtacgacagttatccccgttgccatgattggcagccgggacgcgaaccctatcggaagttggtttccgaaacccgcaaaagtcaggatcaaggtaggaagcccaattgatcccctcgcattcgtcaaagaacatgggttgaagcctggaacctacgaagcagcgcgcaagctgacagatcacgttatgttcattcttgctgatctcactggtcagccgtatgttgatgcgtactctaaagatgtgaaaaacgctctggaggaaggaaaaggatacccggagggcacagctccttcacag

SEQ ID NO: 2396 - DNA, 1143 bp, Corynebacterium glutamicum
gtgtctgcatcccgaaaaactctcgttgtgaccaatgattttcctccacggatcggcggaatccaaagctatttgagggatttcatcgctactcaagatcctgagtcgatcgtggtgtttgcgtcgactcaaaacgctgaggaagcgcatgcctacgacaagactttggactatgaggtcattaggtggcctcgttcggtgatgctgcccaccccaacaacggcacacgctatggcggagatcattcgtgagcgagagatcgataatgtgtggttcggtgctgcggctccgttggcgttgatggcaggcacagcgaagcaggcaggtgcgagcaaggttattgcctccactcatgggcatgaggtggggtggtcaatgcttcctggatcgagacaatcgttgcgcaaaatcggcactgaggtggacgtgctgacttatatctcgcagtacacgctgcgcagattcaaaagtgcttttggatcgcacccgacttttgaacatttgccttccggcgtggacgttaagagattcactccggccacgccagaggacaaaagcgcaacaaggaaaaagctaggattcacggacaccaccccggttattgcctgtaactcgcgtttagtgccgaggaaaggccaggactcgctgatcaaggcgatgccacaggtgattgcggcgcgcccagatgcgcagttgctcattgtgggcagtgggcgatacgagtcgactttgcggcgccttgccactgacgtgagccagaacgtgaaattccttgggcgccttgaatatcaagatatgatcaacacgcttgccgccgcagatattttcgcgatgccagcgcgcacccgcggtggcggacttgatgttgaaggcttgggcattgtctatctcgaggcacaagcctgcggagtgccggtgatagccggcacctctggcggcgcgccagagacggtgactccggcaactggcctggttgtggaggggtcggacgtcgataagctgtctgagcttttaattgagcttctcgacgatccgatccgccgcgccgcgatgggcgctgcaggtagggcgcatgtggaggccgaatggtcgtgggaaatcatgggggagcggttgaccaatattttgcagagtgaaccacga

SEQ ID NO: 2397 - DNA, 1047 bp, Corynebacterium glutamicum
ttgaatgaggttgataggggatttttgaagatgtttggtcgccgttgggtgagcgttgtggcgtcatgtgttatcgcaagcacgctgattctggtgccttcgcattccggtgcggaggaagtcgatcaactgattgctgatatcgagcatgtctctcaggaaacgtctgcccagaatgaggaagtcaaacagcttgagattgatattgaggctcgtgaggtcacgatcaaggaagttcaggagcagtcggtaagctaccgtgaggcggctgatcaagcatcggagaatgtcgaagcttatcgttcggagatcaatcggatcgctcaggcgaagtatcgtggcacagtcacggatcctttgagcattgcggtgtctgcagaagatccacaaaacgtgattgatcggatgagctacctttcaacgttgactaagtccactagtgatgtggttgaatccctcaacgcggagactgagaagtccgcagaagctgtgtatcaagcaaaccgtactaaggcggaagcggagttccagttggggcagctgaaggtacgccaggcggagcttgaatctgaaaaggaagcattggatggtcgaaaatcggagatccgagaccgggtggatgccctgacgccacaggagcgggaaatgtgggttgctaagaatggtccattggacattgatctgactgatttgcttggtctttccgctgcgacttcgggtgcggtggatgctgccttgtctaagttgggaagcccttatggttggggtggcattggcccaaatgagtttgattgctcaggtttgatctattgggcgtatcagcagatgggtaagactttgccacgtacgtctcaagctcagatggctggcggaacgccggtgagcagagatgagctgcagcctggcgatgtcattggatattacccaggtgctactcacgtgggactgtatattggggacggaaagattgtgcacgcctcagactacggaatccctgtgcaggtggtatctgttgattcagcaccgttttatggtgcgcgtcgctac

SEQ ID NO: 2398 - DNA, 627 bp, Corynebacterium glutamicum
gtgggtaagcaccgtcgcaacaattcaaacgcaactcgcaaggctgtagcagcatctgcagttgcgcttggagcaaccgcagctatcgcctccccagcacaggcagctgaggttgttgttcctggcaccggaatcagcgttgacatcgctggcatcgagaccactccaggtcttaacaacgttccaggaatcgatcagtggatcccttcccttagcagccaggcagctcctactgcttacgcagccgtcattgatgcacctgcagcacaggctgcacctgcagcaagcaccggtcaggcaatcgttgatgcagcgcgcaccaagattggttccccatacggttggggtgctaccggtcctaacgctttcgactgctccggccttacctcatgggcatacagccaggttggcaagtccatcccacgtacctcccaggctcaggctgcacagggcacccctgttgcttactctgaccttcaggctggcgacatcgttgcgttctactccggcgctacccacgttggtatctactccggccacggcaccgttatccacgcactgaacagcagcacccctctgtctgagcactccttggattacatgccattccactctgcagttcgtttc

SEQ ID NO: 2399 - DNA, 1602 bp, Corynebacterium glutamicum
gtgggaaacaatcttgattcccgttacaccatggcgtcgggtatccgtcgccagatcaacaaggtcttcccaactcactggtccttcatgctcggcgagattgcgctttacagcttcatcgtcttgctgctgactggtgtctacctgaccctgttcttcgacccatcaatcaccaaggtcatttatgacggcggctacctcccactgaacggtgtggagatgtcccgtgcatacgcaactgcgttggatatttccttcgaggttcgcggtggtctgttcatccgccagatgcaccactgggcagccctgctgttcgttgtatccatgctggttcacatgctccgtattttcttcaccggtgcgttccgtcgcccacgtgaagcaaactggatcatcggtgttgttctgatcatcctgggtatggctgaaggcttcatgggttactccctgcctgatgacctgctctctggtgttggtcttcgaatcatgtccgccatcatcgttggtcttccgatcataggtacctggatgcactggctgatcttcggtggagacttcccatccgatctgatgctggaccgcttctacatcgcacacgttctaatcatcccagctatcctgcttggcttgatcgcagctcacctggcacttgtttggtaccagaagcacacccagttcccaggcgctggccgcactgagaacaacgtgatcggtatccgaatcatgcctctgttcgcagttaaggctgttgctttcggcctcatcgtcttcggtttcctcgcactgcttgctggtgtcaccaccattaacgcaatttggaatcttggaccgtacaacccttcacaggtgtctgctggttcccagcctgacgtttacatgctgtggacagatggtgctgctcgtgtcatgccggcatgggagctctacctcggtaactacactattccagcagtcttctgggttgctgtgatgctgggtatcctcgtggttctgcttgtgacttacccattcattgagcgtaagttcaccggcgacgatgcacaccacaacttgctgcagcgtcctcgcgatgttccagtccgcacctcactcggtgtcatggcgcttgtcttctacatcctgcttaccgtttctggtggtaacgatgtttacgcaatgcagttccatgtttcactgaacgcgatgacctggatcggtcgtatcggcctcatcgttggaccagctattgcatacttcatcacttaccgactgtgcatcggcttgcagcgctctgaccgcgaggtcctggagcacggcatcgagaccggtatcatcaagcagatgccaaatggtgccttcattgaagttcaccagccacttggcccagttgatgaccatggtcacccaatcccactgccatacgctggcgctgcggttccaaagcagatgaaccagcttggttacgctgaggttgaaacccgcggtggattcttcggacctgatccagaagacatccgtgcgaaggctaaggaaattgagcacgcaaaccacattgaggaagcgaacactcttcgtgcactcaacgaggcaaacattgagcgtgacaagaatgagggcaagaac

SEQ ID NO: 2400 - DNA, 672 bp, Corynebacterium glutamicum
atgatcaagaacccttggaatcctaaggaaggcccaatggacgttcagggtgacggcaccctgtggacttccggttggactctcgttgagaacgacgtcaaggtttacctcggccgcgacactgcagcaattgcggagtcccacaccgatgcaaccggtgagcactggtcaaccactggtgtttcccgcctggttcgtatgcgcccagaagatctggcagcagcatccatggaaactgtcttcccacttccagctgaaatggtgaacgacggtgctgaatacgatcctgcgaaggacgtctacgagcaccaaatgcactcggtgcacggcccacgcaacgcagttatgttgatccgtctccgtaccgctgacgctgaaaaggttatcgaacgcgaaggccaggagtccttccactacggtgactactacgcttactccaagatttgtacacacattggttgcccaacctcactgtacgaggctcagaccaatcgtattctgtgcccatgtcaccagtcgcagtttgacgcattgcactacggaaagccagtctttggacctgctgcccgtgcactgccacagctgccaattaccgttgatgaagagggctacctcatcgccgctggtaacttcattgagccactcggccctgcattctgggagcgtaagtca

SEQ ID NO: 2401 - DNA, 885 bp, Corynebacterium glutamicum
atggaaaccaacccgcagaccccagagggaaatagcatggctaaaccctctgctaagaaggtcaagaatcgccgcaaggtccggcgcaccgtcgcaggtgcattggctctgaccattggactgagcggagcaggaatcctcgcaaccgcgatcactccagatgctcaagttgctaccgctcagcgtgacgatcaggcacttatctccgagggtaaagacctctacgatgtcgcctgcatcacctgccacggcgtaaacctccaaggtgttgaggaccgcggtccttccctcgtaggtgttggcgaaggcgcagtgtacttccaagttcactccggccgtatgccaatactgcgtaacgaggctcaggctgagcgcaaggctcctcgttacaccgaggcacagacccttgcgatcgctgcatatgttgcagctaatggcggtggcccaggactcgtttacaacgaggacggcaccctcgccatggaggagctccgtggcgaaaactacgacggacagattacctccgccgacgtcgctcgcggcggagatctgttccgcctgaactgtgcatcctgccacaacttcactggtcgtggtggcgcactgtcctctggtaagtacgcaccaaacctggatgctgcaaacgagcaggaaatctaccaggctatgcttaccggtcctcagaacatgcctaagttctccgatcgtcagctctccgcagatgagaagaaggacatcatcgccttcatcaagtccaccaaggagaccccatcaccaggtggttactcactcggtagcttgggcccagtggctgagggtctgttcatgtgggtattcggcatcttggtcctcgtggccgccgctatgtggattggatcacgttca

SEQ ID NO: 2402 - DNA, 615 bp, Corynebacterium glutamicum
gtgacgagcgcagttggaaatacaggtatggcagcaccacaacgtgttgcggcactgaaccgtccgaatatggtcagtgtcggcaccattgtgttcctgtctcaggaattaatgttcttcgccgggctattcgcgatgtacttcgtgtcccgtgcgaacggactggcaaatggatcatggggagagcagacagatcacctcaacgtgccctacgcactgttgattacggtcattctggtgtcttcctcagtgacttgccagttcggagtttttgcggctgaaaggggtgacgtttacggcctccgcaagtggttcttggtcacgattatcctcggatcaatcttcgtgatcggacagggctacgagtacatcactctcgtaggtcacggacttacaatccagagcagtgtctacggatcggcattctttattacaaccggtttccacgcactgcacgtgatcgcgggtgttatggccttcgttgtggttcttatgagaatccataagtcgaagttcactccggcacaggcaaccgcagcaatggttgtgtcttattactggcacttcgttgacgtggtctggatcggcctcttcatcactatttacttcattcag

SEQ ID NO: 2403 - DNA, 153 bp, Corynebacterium glutamicum
gtgggggagtgggcggacatgaatcgcattaagctgcaaaaacgccttttattcgggttcaaccaaaagttgtatgtggggctccaatggggtgaaaaactctgtgacgtgtctctcaggcaaaaacctgcggaaaccactttgggcacactc

SEQ ID NO: 2404 - DNA, 429 bp, Corynebacterium glutamicum
atgaagtcttcagcaaaactcatgtacggcccgaccgtattcatggccgcaatggctgtcatctacatcttcgcaacaatgcacgttagtgatggcggcagcgttaaaggtgttgagtgggtcggttctgtggccctggtcctgtcagcaggtctgacgcttatgctcggtgtctaccttcacttcactgaagtccgcgtagatgttcttccagaggactgggaagaggctgaggttgccgacaaggcaggaaccctcgggttcttcagcccaagctccatttggccggcagctatgtccggtgcggttggattccttgcattcggcgttgtgtacttccactactggatgatcgcagttggtctgatgctcctgatcttcacgatcaccaagctcaaccttcagtacggcgtgccaaaagaaaagcac

SEQ ID NO: 2405 - DNA, 1077 bp, Corynebacterium glutamicum
gtggaacagcaaaataagcgtggtttaaagcgcaaggccctgcttggcggtgtcttgggcttaggtggcctcgccatggcaggctgtgaagtcgcccctcctggcggtgtgcttggagatttcctacgtatgggttggcctgatggcattacccctgaagcagtggccatgggtaacttctggtcatgggtctgggttgctgcctggatcatcggcatcatcatgtggggtctattcctcaccgccatctttgcctggggcgcaaagagggctgaaaagcgcggcgagggtgaattccctaagcagctccagtacaacgttccacttgagctcgttctgacgatcgttccgatcatcattgttatggtgctgttcttcttcaccgttcaaactcaggacaaggtcaccgctctggataagaacccagaggttaccgtggacgtcaccgcttaccagtggaactggaagttcggatactccgaaattgatggctcactggcacctggtggacaggattaccaaggaagcgacccggagcgtcaggcagctgccgaggcttccaagaaggatccttctggagataacccaattcacggcaactcaaagtctgacgtttcttaccttgagttcaaccgaattgaaaccctcggaaccactgatgaaatcccagtgatggttcttcctgtgaacaccccaatcgagttcaacctcgcatctgctgacgttgcacactccttctgggttccagagttcctcttcaagcgagatgcttacgcacaccctgaggcaaacaagtcccagcgtgtcttccagattgaagagatcactgaggaaggcgcattcgttggtcgctgtgcagaaatgtgcggtacttaccacgcaatgatgaacttcgagcttcgtgtcgtcgatcgcgattccttcgctgagtacatcagcttccgtgactccaacccagacgcaaccaacgctcaggcacttgagcacattggtcaagctccttacgctacttccactagcccattcgtttccgatcgcaccgcaacccgcgacggcgaaaacactcagagcaacgct

SEQ ID NO: 2406 - DNA, 1920 bp, Corynebacterium glutamicum
atgtgcggccttcttggcatattgactgcaaatgggaacgctgaagcattcgttcctgcactcgagcgggccttgccatgcatgcgccaccgtggtcctgacgatgccggcacttggcatgacgccgatgcagcgtttggattcaaccgcctctccatcattgatattgcacactcccaccaaccactgcgttggggacctgcggatgaacccgaccgctacgcaatgactttcaacggtgagatctacaactacgttgagctgcgtaaagagctctcggatttgggatatgcctttaatacttctggcgatggcgagccaattgttgtcggtttccaccactggggcgagtccgtggtcgagcatctccgcggaatgttcggcattgccatttgggatacaaaggaaaagtcgcttttccttgcgcgtgatcagttcggcattaagccactgttctacgcaaccaccgagcatggcaccgtgttctcctcagagaagaagaccatcttggagatggccgaggagatgaatctagatctgggccttgataagcgcaccattgagcactacgtggacttgcagtacgtgcccgagccagatacccttcacgcgcagatttcccgcttggagtcaggctgcaccgcaacagttcgtccgggcggcaagctggaacagaagcgttacttcaagcctcagttcccagtacagaaggtcgtaaagggtaaggagcaggacctcttcgatcgcattgcccaggtgttggaggatagcgtcgaaaagcatatgcgtgccgacgtgaccgtaggctcgttcctttccggcggcattgactcaaccgcaattgcggcgcttgcaaagcgccacaaccctgacctgctcaccttcaccaccggtttcgagcgtgaaggctactcggaggtcgatgtggctgcggagtccgccgctgcgattggcgctgagcacatcgtgaagattgtctcgcctgaggaatacgccaacgcgattcctaagatcatgtggtacttggatgatcctgtagctgacccatcattggtcccgctgtacttcgtggcagcggaagcacgtaagcacgtcaaggttgtgctgtctggcgagggcgcagatgagctgttcggtggatacaccatttacaaggagccgctatcgcttgctccatttgagaagatcccttccccactacgtaaaggcctgggaaagctcagcaaggttctgccagacggcatgaagggcaagtcccttcttgagcgtggctccatgaccatggaagagcgctactacggcaacgctcgctccttcaatttcgagcagatgcaacgcgttattccatgggcaaagcgcgaatgggaccaccgcgaagtcactgcgccgatctacgcacagtcccgcaactttgatccagtagcccgcatgcaacacctggatctgttcacctggatgcgcggcgacatcctggtcaaggctgacaagatcaacatggcgaactcccttgagctgcgagttccattcttggataaggaagttttcaaggttgcagagaccattccttacgacctgaagattgccaacggtaccaccaagtacgcgctgcgcagggcactcgagcagattgttccgcctcacgttttgcaccgcaagaagctgggcttccctgttcccatgcgccactggcttgccggcgatgagctgttcggttgggcgcaggacaccatcaaggaatccggtactgaagatatcttcaacaagcaggctgtgctggatatgctgaacgagcaccgcgatggcgtgtcagatcattcccgtcgactgtggactgttctgtcatttatggtgtggcacggcatttttgtggaaaaccgcattgatccacagattgaggaccgctcctacccagtcgagctt

SEQ ID NO: 2407 - DNA, 342 bp, Corynebacterium glutamicum
atgaccgctccatcaaccaacaccggtgttatcttgaccgagtccgcagcgtccaaagctaaggcactcatcgatcaggaaggccgcgacgacctctctctgcgtatcgccgttcagcctggcggctgctctggccttcgttaccagctttacttcgacgaccgcacccttgatggcgataaggaagacatcgtcggtggcgttcgccttgtcgttgacaagatgagcaccccatacttgctcggcgctcagatcgacttcgctgacaccatcgagcagcagggcttcaccatcgacaacccaaacgcaggcagctcttgcgcttgtggtgactccttcaac

SEQ ID NO: 2408 - DNA, 768 bp, Corynebacterium glutamicum
gtgtgcacccctattcccgatttgggaggttttccttgtagcctattgagtgtgaaacttccttgggataaaaataagaacaacgaaggggctgacgctgcaggccaagacgccagctccacccctgagaccgctacgcctgacgctactgagcagaaattgccaaaggggcacacggcaccgaagggccgtcccactccgaagcgtcgtgaagttgagttagagcgaggtgtcgttggcggccagtctttggcgcctactgatacttatgcgcagcagcgccagaagcgtaaagaatttaaagcttctatgaccaaggaagaattcaaggcatacaagcagaaagagcgcgatgcccgagttaagcgtcagcgcgaaacccaagctgcaatggatcgcggcgaagatgcttatttgatggatcgcgataagggcgaggttcgccgttttgcgcgtgactgggtggattcccgcaggttcttgtctaactttgtgatgccagtagctattgctttgctggttgtcatgctgatcggtaacttcaacccatcattcgctgcgacttcttccatggttgccatggttttgatgttgggcttcctgattgagggcatcaccactggtcgtcgtgtgaacaaggctgctcgcacgaggttccctggtaccaccgagactggttttggtctgggttactacgcgtattcccgcaccattcagcctcgtaagtggcgtacccctcgtgcacgcgttgaaattggtgctgaagtc

SEQ ID NO: 2409 - DNA, 522 bp, Corynebacterium glutamicum
atgcgcacgttagttcttggcggggccaggtctggtaagtctgcttttgcagaatcacttgttggatctggtcccgttttgtatgtcgcaacggcaaggccttcgggagatgatcctgaattcgccgagcgcattgcggttcatgcggagcggcgcccaacgtcttgggtgttggacgaggagggggacgtcgataagcttcttgcctcgccaccggccatgccggtgctcgttgatgacctgggcacctggctcacgcacgccaccgatgcgtgcgacggttgggaggcgagttcggcgcagcttgaggccaagatggatttgcttatcgacgccatcctccactttcagggcgaagatctggtaattgtttcacctgaagttggtatgggaatcgtcccggaatataaatctgggcgcctttttcgtgatcgcatcggcacacttaatcagcgtgtcgcagcgatttgcgagagggttgtcttcgtggttgctggtctgccactagagttgaaaacgttt

SEQ ID NO: 2410 - DNA, 1089 bp, Corynebacterium glutamicum
ttgaaggagttgttaatggttccagcagagctttttgcgcgtgtggaatttccggatcataaaatcctggctcagacgaaggatttccatgactccctcaccaagccacccggatctttgggcaagttggagcagatcggctgtttcatttccgcatgccagggccagattccgccacgtccactcaacaactcaaagatcgttgttttcgctggcgatcacggcgttgcaactaaaggcgtgtccgcgtacccatcctcagtaagcttgcagatggctgaaaacattacaaacggtggcgccgccatcaacgtgattgcacgcaccaccggcacgtccgtccgacttattgatacctccctcgaccacgaagcatggggcgacgagcgcgtatctaggtcctgcggatccatcgatgttgaagacgccatgacccaagaacaggtcgaacgcgcactgaagatcggtaagcgcattgcggatcaagaagtggacgcaggcgccgacattttaatccccggcgatttaggaattggcaacaccaccaccgccgctgccctcgttggaacgttcaccctcgcagagcctgttgttgtcgtaggccgcggcaccggaatcgacgatgaagcctggaaactcaaagtctccgcgatccgcgacgccatgttccgcgcccgcgacctgcgccaagaccccatcgccatcgcccggaaaatctcttccccagaccttgcagccatggcagcattcattgcccaagcagcagttcgacgcacccccgtgcttctcgacggcgttgtagtcaccgccgcagccctcctagccaacaaactggccccaggtgccaggcgttggttcatcgcaggacaccgctccaccgaaccagcgcattccgtagctctaaacgcactggcccttgatcccatcctggaacttggaatgtcccttggcgaaggctccggcgcagccaccgcactccccctggtcaagattgccgttgacctgatgaacgacatgtcgacattttcttccgccggcgtcgatggacccctaaacgcctcttccgaagcgcccgagcaaaacacggag

SEQ ID NO: 2411 - DNA, 921 bp, Corynebacterium glutamicum
atgtccggcaaagcaggctttacccccgaagatcccgaagactcagacaaccgccacgggaacccccttttcgaaggtatctttaccgcacttaattggatgaccgttctccccgtccccggcgcatcagtttttgatcgcaccacgggcgcccgggtaatggcctctttgccctttgttggcttcgttttcggaatgttcaccgcgatcatcatgtgggctatcggccccatttcaggggtgatccacgtcgatggacttttagttgccgttctgatcgtcgcgttctgggaacttcttaatcggtttatgcacctcgacggcctcgcagatgtctccgatgctttgggttcctacgcagccccaccacgcgcacgagaaatccttgccgatccccgcaccggacttttcggcctcgccaccgccatgctttccgttctcctgcaggtcgctgcagtcgcatcgcttgtcgattcaaccgtgtggtggatgatctgcttcatccccgttctcggccgcatcgctggacaagtaaccgcactgaaaaaccacaacgccttctcccccaccggctttggcgcactagtcatcggaacggtgaaattttggtggatcgcgctgtggctcttggttactgctgcgttggctttttggtgcgcagaattaatttctccactttcaccgctgaccagtgttaacactccctttgtcgctggacctttccccgctgcaatcaaccccgcctggcttggaggctgggttgcgataaccgcagtcgtggcatgtgttttcgcagcacttttcagccgccgcttatcacgaagtttcggtggactcaacggagactgcatcggcgcatgcattcatctcggggcgtcgatttctgcagtgatgtttgctgttgtcgccaatgcaatggtg

SEQ ID NO: 2412 - DNA, 237 bp, Corynebacterium glutamicum
ttgcttcggaaacaactcacttttcacgcgaggactggtaaaagtaggcctctcagaatggcgtctaagcgaccaacaaagctaaagctaagggaatacacctgggacaaactggcacggcctaaatcgacccagggagatgtcatgaaatccacccattcccaaaagacgccaccgctttacaccattgcattggcgacaacagcaaacatcactgcagaaatcgacgccccgaga

SEQ ID NO: 2413 - DNA, 714 bp, Corynebacterium glutamicum
gtggctgaaaatgggcaaaaagttgcggtcgtaactggtggatcaagcggaattggcgcagcttcagctcgagcattggcagctgacggttggaaagtaattgtggcagcacgtcgcctcgagcgcttggaagcactcgctcaggaaatcggcggaactgcagtggcactcgatgtcactgaccaagaatcagtcaacgcattttcagtcaccgttggggaagtcgatctgttggtcaacaacgcaggcggtgccaaaggcctagacagcatccatgacgccaacattgatgattggacctggatgtacgaaaccaacgtgctgggcactttgcgcgtcaccaaagccctcatggacggcctcatcgcacgtgacggtcacgtgatcaacattggttccattgcaggagaaaacccctacattggcggagctggatacaacgcagcaaaattcggtgtagcagcattcaaccgtgtgcttcgcttggaaacccaccagcagacccttcgcgtatctgagatcgatccaggtcgagttgccacggaagaattctccctcgttcgtttcggcggagataaagaacgcgcagaagcagtctatgacgacgtcctcaacctcaccgctgaagacatcgcagagtctgtgcgttgggtcgcgagccttccaaagcacatgaacattgaccgcatgcgtattacacctcgcgatcaggtc

SEQ ID NO: 2414 - DNA, 1137 bp, Corynebacterium glutamicum
gtgtatctgtcaggtagcaggtgtaccttaaaatccatgacgtcattagagttcacagtaacccgtaccgaaaatccgacgtcacccgatcgtctgaaggaaattcttgccgcaccgaagttcggtaagttcttcaccgaccacatggtgaccattgactggaacgagtcggaaggctggcacaacgcccaattagtgccatacgcgccgattcctatggatcctgccaccaccgtattccactacggacaggcaatttttgagggaattaaggcctaccgccattcggacgaaaccatcaagactttccgtcctgatgaaaacgccgagcgtatgcagcgttcagcagctcgaatggcaatgccacagttgccaaccgaggactttattaaagcacttgaactgctggtagacgcggatcaggattgggttcctgagtacggcggagaagcttccctctacctgcgcccattcatgatctccaccgaaattggcttgggtgtcagcccagctgatgcctacaagttcctggtcatcgcatccccagtcggcgcttacttcaccggtggaatcaagcctgtttccgtctggctgagcgaagattacgtccgcgctgcacccggcggaactggtgacgccaaatttgctggcaactacgcggcttctttgcttgcccagtcccaggctgcggaaaagggctgtgaccaggtcgtatggttggatgccatcgagcacaagtacatcgaagaaatgggtggcatgaaccttgggttcatctaccgcaacggcgaccaagtcaagctagtcacccctgaactttccggctcactacttccaggcatcacccgcaagtcacttctacaagtagcacgcgacttgggatacgaagtagaagagcgaaagatcaccaccaccgagtgggaagaagacgcaaagtctggcgccatgaccgaggcatttgcttgcggtactgcagctgttatcacccctgttggcaccgtgaaatcagctcacggcaccttcgaagtgaacaacaatgaagtcggagaaatcacgatgaagcttcgtgaaaccctcaccggaattcagcaaggaaacgttgaagaccaaaacggatggctttacccactggttggc

SEQ ID NO: 2415 - DNA, 1500 bp, Corynebacterium glutamicum
gtgtccaaggatgccactcttccagttcgtggaacggtcgctgaactcaagctcgaaaagaagttgccaaagaagattgatgccatcatcgtcgcgatttttgaaggcgaagattccatcgaactcgccggcggcgaaatcctcgatttcatcttcagtaccgagcagcaggccgacatcctcactcagctcgaagctgtcggcgcaaaggccaccgcaaacagcatcacccgcgtcccaggcaccgacgttgcgcctgtcattgcggttggtttgggcaaggctgatttgcttgacgacgagaccctccgccgcgcttccggcacggcggcccgctccctcggtggttttgaaaatgtcgccaccaccattggcgatttgggacttgcagcagcggttaccggtttcggcctcggttcttactcctacgcgggtctgcgcaaagaaaccgaagaatccaaggacaagaccaccacagtcactttcatcagcaccggcaaggacgacaaggatgtctttgtggaagctcagatcatcgtggaatctgtcctgctcgctcgcgacttggtgaacaccccttcatcacacctgtacccagagtcctactcagtaattgcatccaacgaagcgtccaagcacggcttgcagaccaccatcctggatgagaagcagcttgctgatcaaggtttcggcggcatcctcgcagtcggtaacggctcctcccgcaagcctcgtctgctgcgcatcgattggaagccacgcaaggctaagaagtcgatcgctttggttggcaagggcatcacctttgacaccggcggaatttccatcaagcctggcgcaagcatggagaacatgatctccgacatgggtggatccgcatccgtattggccaccattatcgctgcagctcgtttgaacctgtcgatcaacgtctccgcgttcctaccaatggctgagaacatgccatccggtgacgctttccgccccggcgatgtcatcactcatttcggtggtatcacctccgaaatcttgaacaccgacgctgaaggccgcctcattctggcagatgccattgcttacgcttctgaagataagcctgactacctcattgatgcggcaaccctgactggtgctcaattagtcgctttaggcctgcgtacttcaggtgtcatgggtaccgatgagttccgcgacagcgttgccaagactggccgcgaggttggcgagcaagcatgggcaatgcctcttcctgaagagctcgatgagcaggttaagtcccctgtcgctgacctgcgcaatgtcaccaattcccgtttcgcaggaatgtctgctgcgggtcgttacttgcaggaattcgttggtgccgacatcgagtgggctcacgtcgatatcgctggccctgcatacaacactgctggtgaattcggttacacgccaaagcgcgcaaccggacaaccagtgcgcaccttcgttcaggttctgaaggatctgtcggaaagc

SEQ ID NO: 2416 - DNA, 393 bp, Corynebacterium glutamicum
gtgttcaatttatttggtcgtaaaactcctcgctctaacctccgcccaccacgcggtccgggcgatactgtgcgcccggaagatttaaaattcttgatgcaatgggtgcaggataagccatttgttgaggcattcgttgaaccggaaacgctggtcaatgagatgtctgtcgttttggttgatgctcatggggtttttgtccgccgaaggatcggcggtcccaaagggattgatgttatcgcgaaaaagctcggcgttccggtttatgatgttgaggagaccggttacccccaaaggatgcgcgaacgcattgaatatgagcgcatcttaagaaagcgtgaggaacaaaaagctcgccgcgctaaatttgagcgcggcgagaatcctgatctt

SEQ ID NO: 2417 - DNA, 2025 bp, Corynebacterium glutamicum
atggcgttctccgtagagatgcccgagctgggcgaatcagtaaccgaaggcacgatcacccagtggttgaagtctgttggtgacactgttgaggtagatgagccgttgctcgaggtctcaactgacaaggtcgacaccgagattccctctcctgtcgccggtgtcatcctagagattaaggctgaagaggatgacaccgtcgacgtcggcggtgtcattgcaataatcggcgatgctgatgagactcctgccaacgaagctcctgccgacgaggcaccagctcctgccgaagaggaagaaccagttaaggaagagccaaagaaggaggcagctcctgaagctccagcagcaactggcgccgcaaccgatgtggaaatgccagaactcggcgaatccgtcaccgaaggcaccattacccagtggctcaaggctgtcggcgacaccgtcgaagtagacgaaccacttcttgaggtctccaccgacaaggtcgacaccgaaatcccatccccagtagcaggcaccatcgtggagatccttgcagacgaagacgacaccgtcgacgtcggcgcagtcatcgcccgcatcggtgacgcaaacgcagctgcagcacctgccgaagaggaagcagctcctgccgaagaggaagaaccagttaaggaagagccaaagaaggaggcagctcctgaagctccagcagcaactggcgccgcaaccgatgtggaaatgccagaactcggcgaatccgtcaccgaaggcaccattacccagtggctcaaggctgtcggcgacaccgtcgaagtagacgaaccacttcttgaggtctccaccgacaaggtcgacaccgaaatcccatccccagtagcaggcaccatcgtggagatccttgcagacgaagacgacaccgtcgacgtcggcgcagtcatcgcccgcatcggtgacgcaaacgcagctgcagcacctgccgaagaggaagcagctcctgccgaagaggaggaaccagttaaggaagagccaaagaaggaagagcccaagaaggaagagcccaagaaggaagcagctactacacctgctgcggcatccgcaactgtgtccgcttctggcgacaacgttccatacgtcaccccactggtgcgcaagcttgctgaaaagcacggcgttgacttgaacaccgtgaccggtaccggtatcggtggccgtatccgcaagcaggatgttttggctgctgcgaacggcgaggctgcacctgctgaggctgctgctcctgtttccgcttggtccactaagtctgttgaccctgagaaggctaagctccgtggtaccactcagaaggtcaaccgcatccgtgagatcaccgcgatgaagaccgtcgaggctctgcagatttctgctcagctcacccagctgcacgaggtcgatatgactcgcgttgctgagctgcgtaagaagaacaagcccgcgttcatcgagaagcacggtgtgaacctcacttacctgccattcttcgtgaaggcagttgtcgaggctttggtttcccatccaaacgtcaacgcgtctttcaacgcgaagaccaaggagatgacctaccactcctccgttaacctctccatcgctgttgataccccagctggtctgttgaccccagtcattcacgatgctcaggatctctccatcccagagatcgcaaaggcaattgttgacctggctgatcgttcacgcaacaacaagctgaagccaaacgatctgtccggtggcaccttcaccatcaccaacattggttctgaaggcgcactgtctgataccccaatcctggttccaccacaggctggcatcttgggcaccggcgcgatcgtgaagcgtccagttgtcatcaccgaggatggaattgattccatcgcgatccgtcagatggtcttcctaccactgacctacgaccaccaggttgtagatggcgcagatgctggtcgcttcctgaccaccatcaaggaccgccttgagaccgctaacttcgaaggcgatctgcagctc

SEQ ID NO: 2418 - DNA, 1365 bp, Corynebacterium glutamicum
atgggaaaccaaagcctcgacaactgccttcacgaagaatggcaggtaagtgaggttcacaccgtgcttctcgatgaacgcgggcttgttcttcttacgcagctcagcaacgcgagtcatatcgacctcgtgcagctgggtgagctgagcagaaatctgcagagcctcgacggtcttcatcgcggtgatctcacggatgcggttgaccttctgagtggtaccacggagcttagccttctcagggtcaacagacttagtggaccaagcggaaacaggagcagcagcctcagcaggtgcagcctcgccgttcgcagcagccaaaacatcctgcttgcggatacggccaccgataccggtaccggtcacggtgttcaagtcaacgccgtgcttttcagcaagcttgcgcaccagtggggtgacgtatggaacgttgtcgccagaagcggacacagttgcggatgccgcagcaggtgtagtagctgcttccttcttgggctcttccttcttgggctcttccttctttggctcttccttaactggttcctcctcttcggcaggagctgcttcctcttcggcaggtgctgcagctgcgtttgcgtcaccgatgcgggcgatgactgcgccgacgtcgacggtgtcgtcttcgtctgcaaggatctccacgatggtgcctgctactggggatgggatttcggtgtcgaccttgtcggtggagacctcaagaagtggttcgtctacttcgacggtgtcgccgacagccttgagccactgggtaatggtgccttcggtgacggattcgccgagttctggcatttccacatcggttgcggcgccagttgctgctggagcttcaggagctgcctccttctttggctcttccttaactggttcttcctcttcggcaggagctgcttcctcttcggcaggtgctgcagctgcgtttgcgtcaccgatgcgggcgatgactgcgccgacgtcgacggtgtcgtcttcgtctgcaaggatctccacgatggtgcctgctactggggatgggatttcggtgtcgaccttgtcggtggagacctcaagaagtggttcgtctacttcgacggtgtcgccgacagccttgagccactgggtaatggtgccttcggtgacggattcgccgagttctggcatttccacatcggttgcggcgccagttgctgctggagcttcaggagctgcctccttctttggctcttccttaactggttcttcctcttcggcaggagctggtgcctcgtcggcaggagcttcgttggcaggagtctcatcagcatcgccgattattgcaatgacaccgccgacgtcgacggtgtcatcctcttcagccttaatctc

SEQ ID NO: 2419 - DNA, 753 bp, Corynebacterium glutamicum
atgactgcaccaagagatccttttttccccgcagatctttctatccgcgcgtctgcagagcccattgaaattcagcggttgggtttgatcgattatcaagaggcctgggattatcaagcagagcttgctacccgtagggctaatgatgaaatccctgatcagctgcttattttggagcacccgtcggtgtataccgcaggtaagcgcacccagccggaagatcttcccaccaacggactgccggtgatcaatgctgatcgtggtggtcgcatcacgtggcatggtcctggccaattggtgatctatccgatcatcaaattagccgatccgatcgatgtggttgattacgtaagacgcctcgaggaagcgctcatccaagttgtcggcgatatgggtgttgccggcgctgggcgcattgatgggcgttcgggtgtgtgggtgccagctcatgatggttgggtggacagcaaggttgcggccatcggcattcgaataactcgtggtgttgcaatgcacggtgtggccatcaactgcaacaacacgttggatttctatgagcacatcattccgtgtggcattgctgatgcaggcttgagcacactctcgagggaactgaaaagggacgtttcagttgaggaattagtcgagccatcgatccgcgcattggatgatgctttggctggtcggctggttgtttctgatcattctttcggcagcgcgcccgacccaactaagaatctccctaaacggggg

SEQ ID NO: 2420 - DNA, 1044 bp, Corynebacterium glutamicum
gtgactatcgcacctgaaggacgacgactgctacgcgtcgaagctcgaaactcagaaaccccgattgagacgaagcctcgatggattagaaaccaggtcaaaaacggacctgagtatcaggatatgaaggaacgtgtcgctggcgcatcactacacactgtgtgtcaggaggctggctgtcctaatatccatgagtgttgggaatcccgtgaggcaaccttcctcattggtggcgccaactgctctcgccgctgtgatttctgcatgatcaactcggctcgccctgagccactcgaccgcggtgagccactgcgtgtcgctgagtctgttcgtgagatgcagctgaattactccaccatcaccggtgttacccgtgatgatctggatgatgaaggcgcatggctgtactcagaagtggttcgtaagatccacgagctgaacccacacaccggtgtggaaaacctggtgcctgatttctccggcaagaaggatctgctgcaggaagtttttgaatcccgcccagaggttttcgctcacaacgtggaaactgtgccacgtattttcaagcgcattcgcccagcattccgctacgagcgttcacttgatgtgatccgtcaggctcgcgatttcggtctggtgaccaagtccaacctgattttgggcatgggtgaaaccaaggaagaaatcaccgaggcgctgcaggatctgcacgacgctggctgtgacatcatcaccatcacccagtacctgcgtcctggtcctttgttccaccccatcgagcgttgggtgaagcctgaggagttcctcgagcacgctgatgctgcaaaggaaatgggcttcgctgctgttatgtccggcccattggttcgttcctcttaccgtgcaggccgtctgtacgcgcaggccatggagttccgtggcgaggaaatcccagcacacctcgcgcacctgaaggatacttccggaggatccaccgcccaggaagcatctacacttctggagcgttacggtgcttccgaagacaccccagtggtgtccttcaac

SEQ ID NO: 2421 - DNA, 780 bp, Corynebacterium glutamicum
atggcagacgcgaaaaagcaggcggataaagccgccaagaagcaggtaagagcagccaagaaggcacagcgcaaggagactcgctcacaaatgtggcaggtcttcaacatgcaacgcaagcaggataaggctcttattccgcttctgttgctcgctattcttggtatcccgctggtccttttcctcatcggtttgatttggggtggtcagtggtggatgcttccgatcggcattgctgcaggtgttgtagctgcaatgtttattttcacccgtcgcgttgagcgtgacgtgtacaagcgcgccgaaggtcagcagggtgctgctggttgggctgtggagaacctccgctctggcgtgggcatgacctggcgcaccaagaccgctgttgcagtgaccactcagatggatgcagtgcaccgcgtcattggtctgtgtggtgttgtgctggtcggcgagggctcccctcaccgcctgaagccaatgcttgcgcagcaaaagaagcgcctgaaccgcgtggcacctggtgttccagtgtatgaaatcatcacgggcaacggcgaaggccagacccctatcgcgaagctgcagcgtgaactggtcaagctgcctcgcaactacaagaagaacgacgtcgctgccctggccgctcgcattgaggctatggacaatgtcggaaacgctcctggcggatctttgcctaagggtccattgccaaagggcgcaagcatgtccggtatgaaccgccgcgctcgccgacaggctgaacgcaagggcgaggct

SEQ ID NO: 2422 - DNA, 1617 bp, Corynebacterium glutamicum
gtgagcttccttgtagaaaatcaattactcgcgttggttgtcatcatgacggtcggactattgctcggccgcatcaaaattttcgggttccgtctcggcgtcgccgctgtactgtttgtaggtctagcgctatccaccattgagccggatatttccgtcccatccctcatttacgtggttggactgtcgctttttgtctacacgatcggtctggaagccggccctggattcttcacctccatgaaaaccactggtctgcgcaacaacgcactgaccttgggcgccatcatcgccaccacggcactcgcatgggcactcatcacagttttgaacatcgatgccgcctccggcgccggcatgctcaccggcgcgctcaccaacaccccagccatggccgcagttgttgacgcacttccttcgcttatcgacgacaccggccagcttcacctcatcgccgagctgcccgtcgtcgcatattccttggcataccccctcggtgtgctcatcgttattctctccatcgccatcttcagctctgtgttcaaagtcgaccacaacaaagaagccgaagaagcgggcgttgcggtccaggaactcaaaggccgtcgcatccgcgtcaccgtcgctgatcttccagccctggagaacatcccagagctgctcaacctccacgtcattgtgtcccgagtggaacgagacggtgagcaattcatcccgctttatggcgaacacgcacgcatcggcgatgtcttaacagtggtgggtgccgatgaagaactcaaccgcgcggaaaaagccatcggtgaactcattgacggcgacccctacagcaatgtggaacttgattaccgacgcatcttcgtctcaaacacagcagtcgtgggcactcccctatccaagctccagccactgtttaaagacatgctgatcacccgcatcaggcgcggcgacacagatttggtggcctcctccgacatgactttgcagctcggtgaccgtgtccgcgttgtcgcaccagcagaaaaactccgcgaagcaacccaattgctcggcgattcctacaagaaactctccgatttcaacctgctcccactcgctgccggcctcatgatcggtgtgcttgtcggcatggtggagttcccactaccaggtggaagctccctgaaactgggtaacgcaggtggaccgctagttgttgcgctgctgctcggcatgatcaatcgcacaggcaagttcgtctggcaaatcccctacggagcaaaccttgcccttcgccaactgggcatcacactatttttggctgccatcggtacctcagcgggcgcaggatttcgatcagcgatcagcgacccccaatcactcaccatcatcggcttcggtgcgctgctcactttgttcatctccatcacggtgctgttcgttggccacaaactgatgaaaatccccttcggtgaaaccgctggcatcctcgccggtacgcaaacccaccctgctgtgctgagttatgtgtcagatgcctcccgcaacgagctccctgccatgggttatacctctgtgtatccgctggcgatgatcgcaaagatcctggccgcccaaacgttgttgttcctacttatc

SEQ ID NO: 2423 - DNA, 1203 bp, Corynebacterium glutamicum; identical to SEQ ID NO: 205

SEQ ID NO: 2424 - DNA, 300 bp, Corynebacterium glutamicum; identical to SEQ ID NO: 204

SEQ ID NO: 2425 - DNA, 471 bp, Corynebacterium glutamicum
atggcaaagccgaagagaagttggcttgacggacccgaaattccagctgattttgacgatcctgatgcacccggcaggtggcctggcgaaaagttggggcttcctcaagaaggggccggctctctgtcctcagtggctcgtcgtatcggcggggtctgcgtggactggggtgtttcctgggttattgctattgtgctgtccaatttcacggatgtgctgggcgatgtagcgacatccacgctcattattttcgtgatcctgggttggcttaccggttggatctttgctcgcaccccaggtcatgccgtgtttggcatgggccttgcgcgtgtggatgcagaggaacgtgtgggctggtggcgtgcgctggttcgcccactgctgacgatcttgattctgcctgccgtgatggtggatgctgacggccgtgggctccacgacaaggcaacgggaactgcagttatccgcggg

SEQ ID NO: 2426 - DNA, 213 bp, Corynebacterium glutamicum
ttgaaccacaaactttttggttcgaaacagtttcgaaaggagaaggaaatgggattacgaattcgcccaaatgaaatgaaggtctgggagacattcaccctggaacgccagttggaagtaattatcaacgctgatcaccttctcctgttccgtggcgaaccacacggaaccgtctcactgtccgatgtagttgcatctgaactgatcggcatc

SEQ ID NO: 2427 - DNA, 975 bp, Corynebacterium glutamicum
gtgcaccagacacggcgccgtgccagtggcgaaccccggcggctgcgaaaacaacatcgccaggctccaggagtcgagcaggctccccctccgcctcataaatgcccaagcccgacagcacaattatgttttgaccgactgggtgagtgtgccaattggtgcgaccgcctgcctcaaaagacacgttcacagtctcaatctgcacgttgtcatcaagcttggccatatggacctcgccagaaaaccactgtgcaggcgctggattacctaacggaaattcaatactcatcgtgcattccttttctcatatcccatgcggggcttataaccttgcggatgcttcaactgtgccaccgcatcagcgatgaccatgcggaaacgctgattagtgacaggcatcttagaaatcgggaaccatgcaacatccacgttctcgtcatcgccgacgtgaggctcatcggaatcaccagaaacaacgcaacgcatggtcgtatccatgtagctcgccacatcaccattttgataggtcacaggccccaccgcgcccacgccaagcaacgcctcaacgctgacatcaaggccggtttcctccttgacttcacgcaccgcagtcacatgaggctgctcatccggatcacaaataccggtcggtggagtccactcaccagtatcagcgcgcttgaccaacaacacatccggaaccacatggaaaggagaccccggaggaacatcacgaataacaaccgcagttacagccggcaaccacaacggatcctgaccgaccttctcccgcaaactaacaatgaactctggaaccgccatgcagcaaaacctctccaattggtaatctttgactcccaggttacgccagccctgcgacaccaccatctagggttagagtatggccttcaacaaagcgtacgatgcacttcgcgcccctcaaatcaccctcggactcatgacaccaaacggccc

SEQ ID NO: 2428 - DNA, 399 bp, Corynebacterium glutamicum
atgagtattgaatttccgttaggtaatccagcgcctgcacagtggttttctggcgaggtccatatggccaagcttgatgacaacgtgcagattgagactgtgaacgtgtcttttgaggcaggcggtcgcaccaattggcacactcacccagtcggtcaaaacataattgtgctgtcgggcttgggcatttatgaggcggagggggagcctgctcgactcctggagcctggcgatgttgttttcgcagccgccggggttcgccactggcacggcgccgtgtctggtgcaccgatgttccacgtggtggttaacctcaaaggcatcgacggcgagaccgtcgattgggaggagccggtcgacgaggagcactaccgcagcgtgagcgcggagctacaaaga

SEQ ID NO: 2429 - DNA, 600 bp, Corynebacterium glutamicum
atggtggtgtcgcagggctggcgtaacctgggagtcaaagattaccaattggagaggttttgctgcatggcggttccagagttcattgttagtttgcgggagaaggtcggtcaggatccgttgtggttgccggctgtaactgcggttgttattcgtgatgttcctccggggtctcctttccatgtggttccggatgtgttgttggtcaagcgcgctgatactggtgagtggactccaccgaccggtatttgtgatccggatgagcagcctcatgtgactgcggtgcgtgaagtcaaggaggaaaccggccttgatgtcagcgttgaggcgttgcttggcgtgggcgcggtggggcctgtgacctatcaaaatggtgatgtggcgagctacatggatacgaccatgcgttgcgttgtttctggtgattccgatgagcctcacgtcggcgatgacgagaacgtggatgttgcatggttcccgatttctaagatgcctgtcactaatcagcgtttccgcatggtcatcgctgatgcggtggcacagttgaagcatccgcaaggttataagccccgcatgggatatgagaaaaggaatgcacga

SEQ ID NO: 2430 - DNA, 849 bp, Corynebacterium glutamicum
atgacaccaaacggccctgaactagggcgcagtgaaatggttccaaccgaaaatagcatcgaactagccatacaagcagaagctcaaggattcagaggcatgtgggttcgagacgttccactcgcagttcctcaaggaatcactgttaccgataaacaggctacgtatttagatgatccattcttaatgctcggtgcgatggcctctgtgacctctacaatcgcgctgggcactgcagcgaccgtgcttccactcagacatccgctacatgtggcgaaatccgcgctcacccttgatcgactcagccacggacgtttcgttttaggcatcggctctggcgacaggcctgaagaattcgagatttttggcaaaagcttagacaatcgacgcgctgatattcagtctgggtgggcaattttgcgtgcagctttgtcgccggatcctgcgatgcgggccgaccttgaatttgcgccaaccacgccacctgaagctcagatccccatgatcgctgtaggttctgcccgacaaacagtgcaatggatcgcccgaaacgccgacggatgggcaacctactaccgccccgctgaagctcaagtcggacgcctcgatctctgggacaaagcccgtggtggcacccgccccttgttgatttcctccatggggctcaacctcaccgaaggaaacacccacaaagaaatcactctgggcgtagaggtaggcagccaggaactcatcgaacacctccaccgcctttcggaacttggcatcgaccacgtcatcttcaacatccagcgccgaccagcaagcgaagtactgacccagatttacgaagaagtgctcccccacctc

SEQ ID NO: 2431 - DNA, 393 bp, Corynebacterium glutamicum
atgcctgttccggcacttcccttcggggaaacagctatggttggccacatgtcgaatgatcacccatactcccccgcaaaacgcgtcggaaatttcatcttcgtctccggcgctctttcagtagacaaggactaccaaccagtcgtcggtcgtaaagaagcagttgatgcagcacttgaacgcatgcgtgaacgcctcgccaccgctggtggtgaactcaaagacgttgtgaaactcacttactttgtcaccgacatcagcctgcgcgaagaatgcaacgagcaattccgagagcatttcctcgaaggccgcccggcacgctctttcgtgggtgcatcatcgcttccttatggtgcaactgtggaaattgatgcgattgcgatgatcgaggac

SEQ ID NO: 2432 - DNA, 243 bp, Corynebacterium glutamicum
ttgtcggttttaggatgtgctttaaagatgacagctcccgattaccccagcttctcgaaactcgaggacaacaacaagaagaatctcaccgcagttgaaatccttaatccagcgccggtgtccaagtggaacctgtatgttctcattggttgttcggtgctcgcggtcgggctggtgctgctcgggccgtggctttacccctacgttgaggcacacatcgacggtttctgggctcaattccag

SEQ ID NO: 2433 - DNA, 261 bp, Corynebacterium glutamicum
ttgttcgatcgaccgaatgaaatcacccgttatggagacctactggaattgagcccagaaaccgtcgatgtgtgcctcaacgtaggggtaaagccacggcccgagcagcaccagcccgaccgcgagcaccgaacaaccaatgagaacatacaggttccacttggacaccggcgctggattaaggatttcaactgcggtgagattcttcttgttgttgtcctcgagtttcgagaagctggggtaatcgggagctgtcatctt

SEQ ID NO: 2434 - DNA, 1323 bp, Corynebacterium glutamicum
gtgaagaacaatgatcaacggccttcgccaagaccgcatcccagagagaaagtaactacccgcgccctcatagtttgggcagcagcctgtcttgtgtatatggcagccattaccagccgcaccagctttggtgtggctggagtggaggccattgatcgttttcaggtagacgccacacgcattgcagtattcacttctgttcaggttggtgtgtacgcgtttgctcagattccgatgggcattttgatcgataagtttggtcctcggaagctccttgccattggtgctttggtgatgggtatcggccagctcattttgggctttacggatagctattccatcgcgattattgcccgcgtgtttatcggcgccggcgatgcatcgatcttcctttcggttatgcgcatcctgccgttttggttcccactgaagcacacccctattttcacgcagttaactacctgccttggccagttgggccagttcttttctgcggtgcctttcatggcgttgttgggtgcgcagggttggcctgtggcgtttgtcagccttggttccgtggtggcactcattgcgatcgcagcgctggtggccgttcgggatactccagatcctcagccaaaacctgtcgaatcagctcaggaagcagataaaccaagcctgcgcgcgagtttgaagttgattgtccgcaatccgattacgtggcagggtttcttcattcactacgtattgatggtgtggcagaccgtgttctccatgatgtggggcgtcccgctgatgactttgggcatgggactgtctgcaacgacggctggtttggtgttgagcatcaacacgctgtgcatggtggtatcggcgccaatcatcggaataatttccgcacgccttgggtatcgccgtgacgtggtcgccattgcgctgtcgtttgttcaatccgcagtatggctggtgttcttggcctccgatgcacctcgtggtttgatggctatcatcttggtcaacatcgtcatgggtctgactactgcggcttctggttatggctttgacaccattcgtgagcgcctagatcgcaagattttggctgcgggcacgggactggcaaacatgggtggattcttgtcatcgatggttgcagcgcaggttatggggttccttcttgatcacagcgcgcatggtagcacctatacttgggtggacttccgttttggtttccttgcgattcttgtcacatgggccgtcggagtcacgggatttgttgtagcccgactcaagggtggaccgggccgcagattactcgcccagattaggtctaccaaggacttt

SEQ ID NO: 2435 - DNA, 561 bp, Corynebacterium glutamicum
gtggaccgggccgcagattactcgcccagattaggtctaccaaggacttttaaagatcgggtaaaacctgtgggcgttgaaaggggcaaggtctctgccaaggcactagttgtctggttgacggcaatgtgcgtgtacatcgtggccattgctggtcgaacatcatttggtgtcgccggagtgcatgcgatcgatcgctttgatatcgacgcctcccggttggccgtgttcacttctgttcaggttggagtctatgttctcgcgcagattcccatgggcatgctggtggacaggttcgacgcccggaaactcttgctggctggcgctttaattttggcagctggccagctcattttgggtttcactgattcttatatgatcgccatttttgcccgagtgctcatcagtgttggcgattcttctgcatttttgtccgtgatgcgactgttgcccaactggttcccgatgtcttggacacctgtgttgcagcagctcacgggcgcttttggctttgtggggcagttttctccgcggtgccgtttttgcacatactcaacacct

SEQ ID NO: 2436 - DNA, 444 bp, Corynebacterium glutamicum
ttggacacctgtgttgcagcagctcacgggcgcttttggctttgtggggcagttttctccgcggtgccgtttttgcacatactcaacaccttagggtggacaattcctttcgcatcccttggcgcggtaggcatcatcgtggcgatcgcggcggccatcttggtgcgcgacgctcctgcaagcagtgagcctgtgaggcgtggggaggcgtcgataagcatcgcttttaggcttaaatccgtgctgaccagcctttattgctggcagggcgtgtttaatcactgggtgagcatgggacctgtgatggtatttttgctactgtggggcacgccgacgctgacgctggggctggacataagcagcggcgaagtgggcacggttctaacgattttcgccgtcgcaaccgtgatcaccggtcgctttccggcatcgtgtcgtcgcggc

SEQ ID NO: 2437 - DNA, 195 bp, Corynebacterium glutamicum
atgcttatcgacgcctccccacgcctcacaggctcactgcttgcaggagcgtcgcgcaccaagatggccgccgcgatcgccacgatgatgcctaccgcgccaagggatgcgaaaggaattgtccaccctaaggtgttgagtatgtgcaaaaacggcaccgcggagaaaactgccccacaaagccaaaagcgcccg

SEQ ID NO: 2438 - DNA, 405 bp, Corynebacterium glutamicum
atgattgggtttgtcacgccgatgattcaggcggcgttgtggatcgtgctctttttattcgctgatcgcctgtccaatccgctggtttttgtcagcgccatcatgttcgcgatttcctttagctcccccgtggcgaacttcggtttcgatacgatctgcgaaaaactcgaccgccgcgtcatggtcgccggcaccggcatggccaacatgagcgcctacatttgcgcgatgctggccacacaaatcatcggatttttactcgactggaacgccgacggccacgcctacacctggtcgaatttccaggtggcgtggcttggtctgggcgcggtgtggctggcaggcatgatcgggcttgcagtctgcctcctgctgcagcgtcgaaaaaatattgcttttcgacgc

SEQ ID NO: 2439 - DNA, 543 bp, Corynebacterium glutamicum
atggtacgtagtctcgggtgtaaagcacacttcggtactcgacaggaagttaggaattccaccatggcaatcaagctgtccattgacctatcagatgcaacattcgcagaactttcggcagtcatcggttacgcacatcagttgggtgttgatgcggatgagaagctcacctttgaaggtacagtccttaacattgaattcgacggcgaccttcagtttgatgatgtttttgatgcctttgatgaggcggaaattgagctcgacaaccctcgcgaagacggccccatctacgcagatgatctgatcgatgaggatgaggactaccgcgcacagaccaagagccagatcaacgacgaggttatcaacgagatccgcgatggtatttcaagcttcgttgatggcatcgtaaatggccttggccagggtcgccgcggtggacgttacggtgatttcggtgggccacgcggccctcgcggtccacgcaatgacggtccattcggcccatttggaccattcggtccgggataccgcggtccgcgtttc

SEQ ID NO: 2440 - DNA, 645 bp, Corynebacterium glutamicum
atgacaagcattattgcaagcaacagcgacctatcggaggcgctgcgcacccacactgcgcaggcccatgaagaggccgagcactcaacgtttatgaatgatctgctcaccgggaagctcgatgcgcaggcatttatcaagttgcaggagcaatcatggttgttctacaccgctttggaagctgcagctcgtgcatgtgcagaggattcccgtgcggctggtctgctggacccacgcctcgagcgcaaggaaacgttggaagctgatctggataagctgcacgaaaacaccacctggcgtgacaacgtcacggccactgcagcgacagcgtcttatgtggaacgtcttgaaagcatcgaagcggccaaggatttccctcgtttggttgctcatcactatgtccgctacctgggtgatttgtccggtgggcaggttattgcacgtctggtgaacagggaatatggagtttcggaagaggcgttgagcttctactgctttgaagatcttggcaagctcaaaccgtacaaggataattaccgtgcagagcttgatgctttggaattaacagcagaggagcgtgctgcgttgctggatgaagcatctgatgcgttcaggtttaatcagcaagtttttcaggctcttgct

SEQ ID NO: 2441 - DNA, 3135 bp, Corynebacterium glutamicum
atgtcaggaccgttaagaagtgaacgtaaagtcgttggctttgtcagagacccactgccaaaagttggttctttatcgctgaaatctgagcatgcccaagcagatctagagcatttgggttggcgcaatgttgagtctttggatttgttgtggggcttgtcaggtgcaggcgatcccgatgtcgcgctgaaccttcttattcggctgtatcaggcacttgaagcaatcggcgaggatgctcgaaacgagcttgatcaagagattcgccaggatgaaaaactacgagtccgcctttttgcattgttgggtggttcctcggctgtcggtgatcacttggtcgccaatcctttgcagtggaaactcttaaaacttgatgcgccatcgagggaagagatgtttcaggcgctgctggaatctgtgaaagctcagcctgctgtgcttgaggttgaggatttcagcgatgcacacaacattgcccgagacgatttgagcacgcctggtttttacacggctagtgttaccgggcctgaagcagagcgagtcttgaaatggacttatcgcacgttgctgacccggattgctgcgcatgatttagcgggtacctatcccaccgacatgcggagaaaaggtggcgatcctgttccgtttagcacagtgaccatgcagctcagcgacctagctgatgctgctttgactgctgctttagctgtggcaattgccaatgtttatggtgaaaagccggttgattcagctttatctgtcatcgcgatgggcaaatgtggcgcgcaggaattgaactacatttcagatgtggacgtggtgtttgttgcagagccggcaaactctaaatcaacacgcaccgcagcagagctcattcgcatcggtagcaactcgttctttgaggtggatgcagcacttcgcccagaaggtaaaagtggcgctcttgtgcgctctttggattcccatatggcgtattacaagcgctgggcggaaacctgggagtttcaggcactgctgaaagctcgtcccatgacgggtgatattaaccttgggcagtcctatgtggatgctctttcaccgttgatttggacggctagccagcgggaatcatttgtcacagatgtccaagctatgcgccgtcgagtgttggacaatgttccggaagacttgcgtgatcgtgagctgaagcttggtcgcggtggtttgagggatgtggagtttgctgtccagctccttcagatggtgcatggtcgcattgatgagacgttgcgggttcggtcaacggtaaatgctttgcatgtgttggttgatcagggatatgtgggtcgtgaagacgggcataatctcattgagtcgtatgagtttttgcgtctgttggagcatcgccttcaattggagcggatcaagcgcactcacttgttaccgaaacctgatgaccgaatgaatatgcgctggttggcgcgcgcttctgggtttactggttcgatggagcaaagttcggccaaagctatggaacggcatttgcgtaaggttcgtttgcagattcagtcgttgcatagtcagctgttttatcggccactgctgaactctgtggtcaacttgagcgcggatgccatcaggttgtctccggatgctgcaaagctacaattggcggcattgggatacctgcatccatcacgtgcttatgaacacctgactgctcttgcatcaggagctagccgtaaagccaagattcaggcgatgttgctgcccacgttgatggagtggctgtctcaaacagctgaaccagatgcgggattgctgaattaccgcaagctttctgatgcttcctatgatcgcagctggtttttgcgcatgctgcgtgatgagggcgtagtggggcagcggttgatgcgtattttgggaaattctccctatatttctgaactgattatctccactccggactttatgaaacagctgggtgatgcggcgtctggtcctaaattgcttgctactgcaccgactcaggttgtgaaagcaatcaaggcaacggtgtcgcgtcatgagtcacctgatcgggcgatccaggctgcacgatcgctgaggaggcaggagctggcacgcattgcctctgctgatttgctcaacatgctcactgttcaggaagtatgccaaagcttgtcactagtctgggatgcggtgttggatgctgccttggatgcggaaatccgtgctgcacttaacgatccacagaaaccagatcagcctctggccaatatttctgtgatcggcatgggccgtttgggtggagcagaacttggatacggttctgatgccgatgtgatgtttgtatgcgagccggtagccggtgtggaagagcatgaggccgtcacatggtctattgctatctgtgattccatgcggtcgaggcttgcgcagccttccggtgatccacctttggaggtggatctggggctgcgtcctgaagggagatctggtgcgattgtgcgcaccgttgattcctatgtgaagtactacgaaaagtggggtgaaacttgggagattcaggcgctgctgagggctgcgtgggttgctggtgatcgtgagctgggtattaagttcttggagtcgattgatcgtttccgctacccagttgacggggcaacgcaggcgcagcttcgtgaagttcgtcgaattaaggcgagggtggataatgagaggcttccgcgcggggctgatcgaaatacccataccaagctgggtcggggagcgttaactgacatcgagtggactgtgcagttgttgaccatgatgcatgctcatgagattccggagctgcacaatacgtcgacgttggaagttcttgaagtgctggaaaagcatcagattattaaccctgtgcaggtgcagacgcttcgggaagcgtggctgacggcaacggctgctaggaatgcgcttgtgctggtcaggggtaagagattagatcagttacctactcctggtccgcaccttgcgcaggtggctggtgcgtctggttgggatccaaatgagtaccaggagtatttggaaaactatctgaaagtgaccaggaagagtcgtcaggttgttgatgaagtcttctggggtgtggactctatggagcaacgtgagttt

SEQ ID NO: 2442 - DNA, 1338 bp, Corynebacterium glutamicum
atgaacagcgaacaggaatttgtactcagcgccattgaagaacgcgacattaagtttgtgcgtctatggttcactgacattcttggccacttgaagtcagtggttgtggctcctgcagaactagagtctgcgttggaagaaggcatcggattcgatggctcagccattgagggctacgcgcgtatctcggaagcggacaccattgcccgcccagatccatcgacattccaggtcctcccactagaagcgggcatctcaaaactgcaggcagcacgcctgttttgcgatgtcacgatgccagacggacagccatctttttctgacccgcgccaagtgctgcgcaggcaggtccaactagctgcagatgaaggcttgacctgcatgatctcaccagagattgagttctatttggtgcaaagccttcgcaccaacggactgccacctgtgcccactgacaacggcggatatttcgaccaagccacattcaatgaggcgccgaatttccgtcgaaacgcgatggtagcgctggaggaactcggcatccctgtcgagttctcccaccatgaaactgcacctggccagcaagaaatcgatttacgccatgcggatgcgctcaccatggccgacaacatcatgaccttccgctacatcatgaaacaggtggcaagggaccaaggcgtcggggcatcatttatgcccaagccattccaagaacatgcaggctccgccatgcacacgcacatgtccttatttgagggcgataccaacgcgttccacgatccagacgattcttacatgctgtccaaaaccgcaaaacagttcatcgctggaatcttgcatcacgctccagaattcaccgctgtgaccaaccagtgggtcaattcctacaaacgcatcgtgtacggaaacgaagctccaactgcggcaacctggggtgtatctaatcgttctgcgctggttcgtgttcctacctaccgtttgaataaggaggagtcgcgccgggtggaggtgcgtcttcctgataccgcttgtaacccatatttggcgttttcagtgatgctcggcgctggtttgaaaggcattaaagaaggttatgagctcgacgagccagctgaggacgatatctccaacttgagcttccgggaacgtcgcgccatgggctacaacgatctgccaagcagccttgatcaggcactgcgccaaatggaaaagtcagagcttgttgctgacatcctcggtgagcacgtttttgagtttttcttgcgcaataagtggcgtgaatggcgtgactaccaagagcagatcactccgtgggagctccgaaacaatcttgattac

SEQ ID NO: 2443 - DNA, 1104 bp, Corynebacterium glutamicum
atgactctctcccacttctccgacaacgtcaccgacgcacaagactcttaccgtcagattttagaagaaagcatcatcagccacctaggtttctgtgcgcttcgtgggtggactcccgccgatctccgccatgagttttccgccgatattgatccactcctgtttcacgcgctacctgagattgcttactcctgctccgatgagatgtacacactgtgggtgaacggaacgcgtgccgccgaaactagccacttgccggtgatgaccctggagaagattctcaccgagctaccgaagctaagtaccttgcctgactgggcaatgctcgcagagctccacgccttagacaatcaagacaccagcccaatgaccccggcacaggccaaagcgcatcatcgtatcaccgcacttttgaaaaaggcagagtccaccaacttcgaagaagaagccgaagcattgatccttaaagcagagacacttcgacagcagtaccggattgaatcactgctgattaattcctatgaccaagatgtccaagctcgatcttctacgattcgtgcatctcgggtgtatctggaagctccatggatccgacaccaatacaaactgctcaatgccattgctcgggtgcattccagcgaagcgctgctgatcaccaaatctggcatctgcaccctcttcggcgagcaagatgacgtagcccacattattgatctgttcaacagtcttaatcgacaacgtgcccacttcatgaaaacgtcagcaggtgcccgaattgcccaattaaatggcgaaacaagctcatatcgccgtagttttatgatctcctacgccagccaaatctctagacttctcatctcagcaaaagaggatgcattcaacgaactagctggtcaggcaccactagctcacagcgccatcgttcctgtcctagagaacagaagtgtgaggtcaaaggaagcactgaaggaaaccttcccgaatatgcggacaatgaccttcaaatcgaccaaccgacgaggcattattgacggatttaatgctgccaatgaatcccaccttggcggggaatctgccagcttggaagactcaacattcatgttc

SEQ ID NO: 2444 - DNA, 1827 bp, Corynebacterium glutamicum
atggatacaacaatgggccagcatctagaagtggaaactaagttttccgtcagtgaatcaactcagattccacaacttgaggctatcgcagaagtcgaccacattgatcgcaccgaaatccaccaactaagcgctgtttactttgacaccgtagatttgcgcctcacccgcgcaaaaattaccctccgtcgccgcaccggtggaaacgatgccggctggcacattaagttccccggaaccatcggtcgccgtgaagtccaagccccacttgatggcgaaggcgcaacagaaaccctccctccacgtgagctcttgggacacatccgagcgctgatccaaggccgtgagctgacccctatcgcccaggtggataatgaacgccacatgtcttacctcgcggatgaggacggcgcagtcatcgcagaattctgcgacgatcatgtatccaccgtgtcccaccttccaggtggcgtgcgcaagcagtggcgtgagtgggaattcgaactcgctgatggcaccctcgccgaagaagccatctcagtactgctgcaatctgcacagtcagtcctgaccgcagctggagcttttgtctccaacagcccatccaaacttgtttcggcgctggacgaatcagtcaaccacgcgccaaagcctccacagatggcgcagctggacaagaatgacccagcacgtggtgttcttgcagcaatcgcagccaacgcctcaaagatcgccgaatacgatcctcgagtacgcgccgatgaatatgattcagtccaccagatgcgcgtagctacccgagaactacgcagccacctccaaacctttgagggcatcctcggcggcgaagactacctcaacctggaaaaggaactgaaggttctcgccaacatcttgggtcgcgcacgcgatgctgaagttgtggaagagcgcctcagcaacctgattaacactgaggttggcgactccatcgaggaggagactaagaaggaactgcttgaagatcttggtgcagaataccgtcgtgagcatgagcgagtagttcgtgcgctggataatgatcgctacactgatcttcttcaggcactggaaaacctccttgttgatccaccgctgatcacagaagtcgaagaacccgaagctaccgaagcccctgagtccgctgagactaccgagtccactgacgtctctgaagcaaccgaagaagcagacgcagaagctgagtctgtcgaagaagctactgagcaggaagaatcagcagacgcgcctgaatctgcagatctggacgctctcgatgaggagtactcccctggttcccaagcgccggtggaggagccgaaggaaccgaagaaggttgatgctgctctcgtacttctagagcaccttgataaggcgcacgtgaagctcgtcaagctggaaaagaaggctcgctcacagtgggatgatctcagcattccgatgctggagcgggaagaaaacttccacaacctgcgcaaggctgccaagaagcttcgctacagtgcagaggcagtgggcaaagcaaccaccgttgagacgaagaaactgtacaaggcgtgcagtggtttgcagtcagttcttggcgattaccaagatgccattacttcccgtaatgagctgttgcgccgagctcaggttgcccgccgccaaggccgggataccttcgcatacggaatcctctaccagcacgaacaaaccctgtcgagggaatacctgactggttattccgatgcgttcaagagcgtagaaaaagcctatgcaaagctggctgaagataccgccaagcgttcaaagaagaacaagcgtaag

SEQ ID NO: 2445 - DNA, 180 bp, Corynebacterium glutamicum
atggctaaagaagatttgaagtggttctacgatctggcaaccggcaaggtttttcaaggcaaggtttccggctttgaaacccgcatgggcccatatgacactgaagaggaagcccatcacgccatctccattgcggcagcccgaaccaaggcagccgaaatttgggacgacaaggaagac

SEQ ID NO: 2446 - DNA, 1293 bp, Corynebacterium glutamicum
atggccatttggcagccaactctcaccggcccgcacggcgcacaagttggatcgtctcccactgaacttcttgaagcctgcgtggctttccaccgcactttctttgacgtcaatcccaaaggcgctgctaccgcaccggcaacatggacgcttattggtgagcattcggattacgccggtggtgtggtgctggcggctaatgcgaattggcggactgcggttgccgtcaataagaaccgcgacgatgttgttaacgtatgcgttgtggatgtggagggaggcgtcgaaaagcattctttaagcactgcggacattgcagctcgcgcacacgcccatatgaaatcccatgatgttttggggcggcagactacgccgcctcagccggagggcggcgttgctgcccggttgggcgggattgcgtggacaatgatccataagcaaatgctttcgcgtgacacaaaaggcctggatatcaccgtgttgagcaccattcctgagggggtggggctgggtgaaaattccgccatggatgtggcgctcgcattggcgctgtatcgggaaaatattgaggaagcccccacgaaggcgcgcattgcggagatttgttcgcagtccgcattcatgttcagtgagacttcagtgttgcgtgcgcggcacaccgtggcgttgcggggtgaaactggacagatttcggtggttgattacgccgatggttcggtcactcaggcgccacatccggtgagtcgttccgctggtttgtcggcatttgttgttgctgcgcaaactgaaactgatccgagcatttaccgcgagatctatgctcgacatgcgtttatcgatgaagctgcgcgcgctttcagtgtggaatctttgcggttgcttcccgacgcttccactcgtgttgtggattggttgcaggccgtgattgaggtgactggtcgagaggatctgccctcgattgaacaagcccagcgctggttgaatctgtgggaaaacgaaacccggcgcgctcagaggacagccaatgccctgcgttcgagaaggctgagtgagttttctgagctgctgatggaatcccaagatgatttgagcgacaccttcgatttcccccctgctgatttggcgcttgctcgtttgtgcgtcgagcggggtgccacagctgctcggtccacgtcagcgcgcggtgtgattgcgttggttgatgcccatcatgcgcacaattttgctgcggatctcagcgaggatggcttgttggtggttcctctcgggcacggggacgtcgcggaacagggc

SEQ ID NO: 2447 - DNA, 1266 bp, Corynebacterium glutamicum
atgccctttgtcaccatcgatcccgtaggttccagagacctcgatcaagctgtgctgattgaggagatcgacagcggatttcgggtgcattacgcgattgcagatgtcgcagccttcgtggagccgggcagtgaattggaaaagatttcccttcaccgcgggcagactatttatctgccggattccccagcgcgactgcaccctgaggaattatccgaagatgcggcaagcctgctggagggacaaacgagaccagcggttgtgtggtcgattgatctagatgaacgtggcgaagtcacagccaccaaggtgcgtcgcgggttggtgaaatcccgggcgcgtttggattatgatcaggctcaaatagatgccgagaatggtcggttgcatccgtcgataagcttattgcccaaggtcgggcagctgaggcaggaaagcgcgctacggcgcgaagccgtgaatctttctattcccagccagcgagtggtgaaagtgcccaatgatgacgccggtgaacactatgaaattgtcatcgagccacgcccgcacatcatggattacaattccgagatttccctgctcacaggcatggtagcgggggagatgatggtgaaagcggggcacggtttgctgcgtacactcgccccggcgaccaaagaatccgaagctactttcagatcagaggcgcaagcccttggttttgagatcgcgcccgaacaacccatcggtgagtttcttcaaagtgtggatcccaatacgcccaaagggatggccattcagagggaagcacagaaactcttgcggggctccggctacgccagcgtgaaaaatggggactcggaagtgcattccggtgttggtggttactatgctcacgtcaccgcaccgctgcgccgacttatcgaccgtttcgccaccgaacattgccttgcgattgcctccggaacggacgttcctgaatgggtgaccagggtggaagagcaagttctcgacaccatgaaatactcctccattttggccagccaagtggataatgcctgcctcgacctcacagaagccaccgtgttgaaatactgggagggccaaaacttcaacgcggtggttgtagcgagcgaacctgaaaagaactctgctcgactttttgtgtacaaaccgccagtgttggcaaagtgtattggcgccccagaacagggaacaaaccaagatgtcacactggtgactgcgaacttgaagaagcgtgaagttttgtttgcgtggccggctgac

SEQ ID NO: 2448 - DNA, 486 bp, Corynebacterium glutamicum
ttgacgcggcttcgtcgtggatatgagggtcaaaacctcgctccacaccgaactcttgtgccactggttcaaagtcgaggactgctgcatagagcttcatgcgctcccattgttccacagcggaaaagtatatgcaggggtgttgagtttccttgggcacagaagggtcgaggttccccagataggtcttggtatgggtcgagctcatttagcccgttaaaagcgattctgagagggttccattttgggactggtggggcaaatgtgatttctgcaggtttactgatcaaggactcaccacattcccgtggtcagaccttcaaatcgaacatatttttgcagtcaaatgacccaaacttgcaaaaatccacgacaatcggccaagtcaaggcgatttgtggtgtatattcgcacattcattccactcccggcaagcccaaggatgagcattccatcccccagcaaccagagcgccaaaaacacaaa

SEQ ID NO: 2449 - DNA, 1146 bp, Corynebacterium glutamicum
gtgaaattagtcatcgaggccgacggcggctcccgcggaaaccccggcgtcgccggctccggcaccgtggtgtactccgacaacaaagcagaagttctcaaagaaatcgcctatgttgtcggaacaaaagccaccaacaacgtcgccgaataccgcggactactcgaaggcctcaaagcagcccgcgagctcggcgctacctccgtggatgtctacatggactccaaacttgtcgttgaacaaatgtccggccggtggaaaatcaaacaccccgacatgaaagttctagcgatcgaagccaaggagattgcttccgaaatcgggtccgtttcttatacgtggattccgcgtgagaaaaacaaacgagctgacgcattgtccaacgtggcgatggatgctgcagcggcaggtaagccggtaggtgttgtaggggattctgcttctgtatcttctgcttcttcggttgcgggctcagagaaagaagacctcaactgcaccgaaaccaaacccaccaactggaacggcgcaaccacagatcccactcgtttcttgttgcttcgccacggccaaactgctatgtcagtggcacgcctttactccggtaggtccaacccagagctgtctgaacttggtgaaaaacaagcagcagcggcagcacgacgactcgctcaaaccggtggcatcgacgctattgtgagttctccgctcacccgcacgatgcaaaccgcagaagcagcagcggccgcactgggaatgaaagtacgtgttatcgatgatctcatcgaaactgactttggactgtgggatggaaaatcattttcagaagcccacgaacaagatccagaactgcacaccaagtggctcactgactcatctgtagccccacccggtggtgagtccctgcagacggttaatcgacgtgtgaaaaaggctcgtgaaagcctccaacgcgaatacggtgcagcgaatgttttggtggtcagccacgtcaccccaatcaaagccatcatgaggcaagcattggacgcaggcccatccttctttcagaaggcacaccttgacttggcgtcgctgtcgatcgcagagttttacgaagacggcccaacctgcgtaagactgttcaacgacacctcacacctggaagcg

SEQ ID NO: 2450 - DNA, 729 bp, Corynebacterium glutamicum
gtggtctttctaagagatgtcagtgatgaggtaagagccacattctgggcactgtggaacctcatctttgggggtgttgcggatgtcggagataccggttgcagggagaaccatggcgcatccgctgcaggagcggccgttgaagagtgctgcgcctacgccgttttcgaggcgttgtgcatggaattctgccagtgcttcggagggaagtttctcttccaggtgtgcgatgactactgctgggtcttcaccttctggggttgctgctgcggcggcttctgcggctgcgcgggcgtcggcaactttgcgttcggtgtctttgacgcgagactgtgcgaggtcgcggttgttgcgcagcgcatggatttcattgtgagcttcttgcagttcgctcatgaggtcagcgatgcgggacttcgcagtgtagacgtcgtggttgaggtcgcggcgacgctcttcgtcagtttctgcaccgagtgcgtcctggccgtctttcttgcggcggcgcagtttgcgttcgtcggactgaatgcgcaggatttcgttttccatgtcatcgacagccatttgtgcagcggatgcagcgtcgcggttgcgggaaagttcagcgacagccttgtctacagcttcctgctccggggtggtcttcggtgcggagttggcgttttgggtgcgcagggtggtggcgagctgcagcagggttttgtgcagagatgggtccagcttcat

SEQ ID NO: 2451 - DNA, 717 bp, Corynebacterium glutamicum
atgaagctggacccatctctgcacaaaaccctgctgcagctcgccaccaccctgcgcacccaaaacgccaactccgcaccgaagaccaccccggagcaggaagctgtagacaaggctgtcgctgaactttcccgcaaccgcgacgctgcatccgctgcacaaatggctgtcgatgacatggaaaacgaaatcctgcgcattcagtccgacgaacgcaaactgcgccgccgcaagaaagacggccaggacgcactcggtgcagaaactgacgaagagcgtcgccgcgacctcaaccacgacgtctacactgcgaagtcccgcatcgctgacctcatgagcgaactgcaagaagctcacaatgaaatccatgcgctgcgcaacaaccgcgacctcgcacagtctcgcgtcaaagacaccgaacgcaaagttgccgacgcccgcgcagccgcagaagccgccgcagcagcaaccccagaaggtgaagacccagcagtagtcatcgcacacctggaagagaaacttccctccgaagcactggcagaattccatgcacaacgcctcgaaaacggcgtaggcgcagcactcttcaacggccgctcctgcagcggatgcgccatggttctccctgcaaccggtatctccgacatccgcaacacccccaaagatgaggttccacagtgcccagaatgtggctcttacctcatcactgacatctct

SEQ ID NO: 2452 - DNA, 1140 bp, Corynebacterium glutamicum
gtgagtgatgtaaccgttggcgatattcgccgcattttggatgaggcttatccgccggcgttggcggaaagctgggacaaagtggggctgatctgcggtgatccaacagagtcggtgaagcgtgtcggtttagcactcgattgcacccaggcagtggccgacaaggctgtggacatgggtttggacatgctgatcattcaccacccattgctgctgcgtggggtgacgtctgttgctgcggatgagccaaaaggcaaggtcattcacaccctaattcgcggcggggtggcactgttttccgcgcacactaatgcggattccgcgcgcccaggtgtcaacgataaactcgccgagctcgtcggcatcacggccgggcgacccatcgcgacacggcttttaggcggcatggacaaatggggcgtgcacgttctgcccaaggatgcagcgtacctaaagaagatgcttttcgacgcaggtgccggtgcgatcggcgactaccgagagtgtgcctttgagatcgaaggaaccgggcagtttaggcccgtggagggggcgaatccggcagagggggacgtcgataagctttttaaatcccttgagctgcgcatcgagtttgttgcaccgcgcaacctgcgcgcccggctcacgtcggtgctgcgggaggctcatccgtatgaggagcctgccttcgatattgttgaaatgcacagcgctgagagtttagaaaatgcgaccggattgggtcgtgtgggtgaattgccggagccgatgcgcctcgcggatttcgtgcaacaagtggccaacaacctgcctgtcaccgaatggggcgtgcgcgctaccggcgatcctgaacaaatggtgtcccgtgtggcggtttcatcagggtcgggtgacagtttcttaaacgatgtgattaagctcggagtggacgtttatgtcacttctgatctgcgccaccatccagttgatgaatatctccgagaaggtggccctgcagtaatcgatactgcacactgggccagcgaatttccatggacttcccaagcccaagaaattttgcaggacaaagccccacaggttgaagttgatgtgatttcgatccgcacagacccctggaccatgtctgcgcgagcagtgaac

SEQ ID NO: 2453 - DNA, 654 bp, Corynebacterium glutamicum
gtgactacgccttctaagaaaactctgctctttgatctcgacggaaccctcgtcgattctttccccggtatccgcacttcattccttcacaccctgcacgaaaagaactgggaaatcccctctgaggaacgcatctcgcaagttccaggacctcccatggaatggacgttccaggatttgggcatgactccagagcaggcacaagacgctctgcagacctaccttgagcattacggccaggtgggttgggatctttccgaagcattccccggcatgcgagatttgctgatccgcttgaaatacgaaggtttccgtctgtgcaccgccacctccaagggcgagttctttgcggagaaggtacttcgcaaattcgagatgttcgatctcttcgaattcatgggtgccgccaccgacaacggcaaccgacgcagcaaatctgccgtgatcaaacatgtcctcgacagcgttgggttggacgaaccaaatgatattttgatgattggtgatcgatcacacgatattgaaggttcgagtgaattcggcatcgattgtgttgccgtaacctggggctacggcagcaaaactgaatgggacgctgcccgctacaccgtgagcaccgcagaagaattagaaaggatcatccatgactgggcc

SEQ ID NO: 2454 - DNA, 471 bp, Corynebacterium glutamicum
gtggaaattgttttcgtatgcaccggaaacatttgccgatcccccatgtcggaagtcatcgcgaaggcaaaagcggaagaagctggcttggaagacaacgtcattttctcctcctgtggcatgggcaattggcacgttggccaacctgctgacaagcgagctctcgcggaactgaaatcagccggttacaacggcgacacccaccgcgcagcacaacttggtcccgagcacatgcgcgcagatctcttcgtcgcgctagattccggccacgccggtgagctcgccgcaacgggtgttcccaacgacaaaatccgcctcatgcgttccttcgacccagagtccaaccccaccgacgatgtcgcagacccttactacggcacatcccaggatttcgtgctcacccgtgaaaacatcgaagatgctatgccgggccttttggagtgggtcagagatcacatccgcactgattct

SEQ ID NO: 2455 - DNA, 954 bp, Corynebacterium glutamicum
gtgagctcccgctattccggaaattcacggtcaagaaccaaaccaaagggttggagagcattcctctcccccggttggattatctctgccttgctcatcgtctccttctcctacgcggcaatttccatgctggcgccatggcagctccacaaagacgacgacatcgtcgcccgcaacgagcagatcaccgaagccttcgagcgcgacgtcgtcccatacgcggagcttttcgacgcctccggccagattccttcatcgcaggagttcttccgcgtgtcactcaccggacagtatcttccagacagtgaggttttgctgcgccttcgccccgtcgactccggcccagcattccaatcgttaacccccttcgaacttgaaaacggacagattgtcctcgtcaaccgtggttacgaatcatcagagggcacaatcgtcccagagatcgagcctgctccttccacaccagtaaccatcaccggattcgcccgcaagaacgagggcctcccaggttctgcacctatggaagacagcggctacacccaggtctacggaattaacaccgaacagatcagtgacgtcaccggccttgatcttggcaccgactacgtccaggtcgcagaaggcgaacctggtgttttgaacccaatgccactgcctcaaatggaccgcggtaaccacctctcatacggcttccagtggatcgccttcggcatcatggcacctttagggcttggatacttcatctgggctgaaatgcgcgaacgacgccgcgacaaagcagaacgcgaacagatggccgagctaaacactcttgaaccagtggtggaaacccctgaagttgttgaaactgcagaaccaaccatcaccccggctgcatccaaacgacgttcacgctacggcgatcaacaccgcaatcactacgagaagatctccaaacgagaccaagagcgcttc

SEQ ID NO: 2456 - DNA, 393 bp, Corynebacterium glutamicum
gtggtcgccggagccaatcggcatgattcaccgttgttagctgcaaccttggacacgctcggccggtttggaggttgtcttcccgatcagatcacggtgcatctcgatgctgggtatgactcgaagaaaacccgcaggctactcagcgaacgtggttatagctgggtgatcagcactaaaggtaagccgctgcaggctggggctcggtgggtggtggagcgtactaactcttggcataaccggggttttaagaaacttagtatctgcaccgaacgatgtacccgggtcgtggaagcgtttatcgctttagccaacgcggtgatcattctgcgtcggcttatcaaacaggcctggactagttaccgctgggacacccgaccgggccacagacct

SEQ ID NO: 2457 - DNA, 243 bp, Corynebacterium glutamicum
gtgcctgccctttcatcatctatcatcgaccccctctggcgccagttctccgccttaatcccaccggttatcaacacccacccactagggtgccaccgtccacgcattgctgaccggatcatcttcgacaaactcatcgcagtgcttgtcctcggtgcctcctatatcaagatttttcgattccacatgctcagccaccacgctacgcacccgccgagacgagtggatcactgccgggatatt

SEQ ID NO: 2458 - DNA, 378 bp, Corynebacterium glutamicum
gtgactaactccgccgaatccacatcgtctaaaaggcctgggcgaccacgtaaagacgggcacgacgagaagatcatcgacgcaactttacggctcatcgacagcaatcgtcccgtcacggtcaatgcagttgtcaaagaaagcggagtgtcacgtgcagcggtttatcgacgctggcccgggctagtggatctagtagcggaagctttagatgccgggcgagctccagttgaaatagatacctcaggggacatcaaagagaccttgattgatgggctgtttacaaatcaggcgaaaaccactggagtctcctatcctcgtcagcgatttcgcaaacggctcgagttggtgatgtcagatcaagaattacagctcgcc

SEQ ID NO: 2459 - DNA, 198 bp, Corynebacterium glutamicum
gtgaggagacgtcgagaagcaaatattcgcgcgctgcaagtcgtgcaagaaaaaggccaaatccgggcggatctagacatcgaggcgtgcctcgatgcaatccttggggtgttttattaccaatcggtcgcgcgtggagtaaatttcaccgaccaaggcacaatgcaacgatgcaacgatgcagagaagctttcgagg

SEQ ID NO: 2460 - DNA, 429 bp, Corynebacterium glutamicum
gtggccgacgctccgggcgcagtcaagcaaggtgcccaggattatgctcaactactcggcattcaatcgggtcatatcgttcaagaaattggatgggatgaagattccgacacgctgatcagcgagtccatcgaagatgcaatcggtgaggaactactcgatgaagaaaccgacgagctgtgcgatgtcgtgctgctctggtggcgcgaggatgacggcgatctcgtcgacggacttgtggattccatccgctccctcgctgagaatggtcgtatctgggtgttgactcctggcattggtaaagaaggagccctggctcctggagttatctctgaatcagctcaactggcaggtctcgtgcagaccaaggcagaacgtctcggtaattggcaaggttcttgcctcgtccagcgtggaaacaagaagcct

SEQ ID NO: 2461 - DNA, 345 bp, Corynebacterium glutamicum
ttgaaccacctttccctggaattttttccttttcctccccctttacgctcaagaatcaatgaattcaatcactggccagcgattaacttttcgagttttcagtcttggatttccacaattctcttcaaaataatggtggctagatttttcatcaaaccctcaccaaaaggacatcagacctgtagttttatgcgattcgcgtcaaacgtgagagaaacatcacatctcgcgggaaactacccgataattctttgcaaaactttgcaaagcggaatgaacatgcagctagtttccgtagaaatgttctttaaaaaatccacaacaattgccaggaagcacaccgat

SEQ ID NO: 2462 - DNA, 2712 bp, Corynebacterium glutamicum
atgatccgcgatggcgtggcatcttatttgaacgactcagatccggaggagaccaacgagtggatggattcactcgacggattactccaggagtcttctccagaacgtgctcgttacctcatgcttcgtttgcttgagcgtgcatctgcaaagcgcgtatctcttcccccaatgacgtcaaccgactacgtcaacaccattccaacctctatggaacctgaattcccaggcgatgaggaaatggagaagcgttaccgtcgttggattcgctggaacgcagccatcatggttcaccgcgctcagcgaccaggcatcggcgtcggcggacacatttccacttacgcaggcgcagcccctctgtacgaagttggcttcaaccacttcttccgcggcaaggatcacccaggcggcggcgaccagatcttcttccagggccacgcatcaccaggtatgtacgcacgtgcattcatggagggtcgcctttctgaagacgatctcgatggcttccgtcaggaagtttcccgtgagcagggtggcattccgtcctaccctcacccacacggtatgaaggacttctgggagttcccaactgtgtccatgggtcttggcccaatggatgccatttaccaggcacgtttcaaccgctacctcgaaaaccgtggcatcaaggacacctctgaccagcacgtctgggccttccttggcgacggcgaaatggacgagccagaatcacgtggtctcatccagcaggctgcactgaacaacctggacaacctgaccttcgtggttaactgcaacctgcagcgtctcgacggacctgtccgcggtaacaccaagatcatccaggaactcgagtccttcttccgtggcgcaggctggtctgtgatcaaggttgtttggggtcgcgagtgggatgaacttctggagaaggaccaggatggtgcacttgttgagatcatgaacaacacctccgatggtgactaccagaccttcaaggctaacgacggcgcatatgttcgtgagcacttcttcggacgtgacccacgcaccgcaaagctcgttgagaacatgaccgacgaagaaatctggaagcttccacgtggcggccacgattaccgcaaggtttacgcagcctacaagcgagctcttgagaccaaggatcgcccaaccgtcatccttgctcacaccattaagggctacggactcggccacaacttcgaaggccgtaacgcaacccaccagatgaagaagctgacgcttgatgatctgaagttgttccgcgacaagcagggcatcccaatcaccgatgagcagctggagaaggatccttaccttcctccttactaccacccaggtgaagacgctcctgaaatcaagtacatgaaggaacgtcgcgcagcgctcggtggctacctgccagagcgtcgtgagaactacgatccaattcaggttccaccactggataagcttcgctctgtccgtaagggctccggcaagcagcagatcgctaccaccatggcgactgttcgtaccttcaaggaactgatgcgcgataagggcttggctgatcgccttgtcccaatcattcctgatgaggcacgtaccttcggtcttgactcttggttcccaaccttgaagatctacaacccgcacggtcagaactacgtgcctgttgaccacgacctgatgctctcctaccgtgaggcacctgaaggacagatcctgcacgaaggcatcaacgaggctggttccgtggcatcgttcatcgctgcgggtacctcctacgccacccacggcaaggccatgattccgctgtacatcttctactcgatgttcggattccagcgcaccggtgactccatctgggcagcagccgatcagatggcacgtggcttcctcttgggcgctaccgcaggtcgcaccaccctgaccggtgaaggcctccagcacatggatggacactcccctgtcttggcttccaccaacgagggtgtcgagacctacgacccatcctttgcgtacgagatcgcacacctggttcaccgtggcatcgaccgcatgtacggcccaggcaagggtgaagatgttatctactacatcaccatctacaacgagccaaccccacagccagctgagccagaaggactggacgtagaaggcctgcacaagggcatctacctctactcccgcggtgaaggcaccggccatgaggcaaacatcttggcttccggtgttggtatgcagtgggctctcaaggctgcatccatccttgaggctgactacggagttcgtgccaacatttactccgctacttcttgggttaacttggctcgcgatggcgctgctcgtaacaaggcacagctgcgcaacccaggtgcagatgctggcgaggcattcgtaaccacccagctgaagcagacctccggcccatacgttgcagtgtctgacttctccactgatctgccaaaccagatccgtgaatgggtcccaggcgactacaccgttctcggtgcagatggcttcggtttctctgatacccgcccagctgctcgtcgcttcttcaacatcgacgctgagtccattgttgttgcagtgctgaactccctggcacgcgaaggcaagatcgacgtctccgttgctgctcaggctgctgagaagttcaagttggatgatcctacgagtgtttccgtagatccaaacgctcctgaggaa

SEQ ID NO: 2463 - DNA, 1476 bp, Corynebacterium glutamicum
atggccggtgccttcaccgcgggagtagaggtagatgcccttgtgcaggccttctacgtccagtccttctggctcagctggctgtggggttggctcgttgtagatggtgatgtagtagataacatcttcacccttgcctgggccgtacatgcggtcgatgccacggtgaaccaggtgtgcgatctcgtacgcaaaggatgggtcgtaggtctcgacaccctcgttggtggaagccaagacaggggagtgtccatccatgtgctggaggccttcaccggtcagggtggtgcgacctgcggtagcgcccaagaggaagccacgtgccatctgatcggctgctgcccagatggagtcaccggtgcgctggaatccgaacatcgagtagaagatgtacagcggaatcatggccttgccgtgggtggcgtaggaggtacccgcagcgatgaacgatgccacggaaccagcctcgttgatgccttcgtgcaggatctgtccttcaggtgcctcacggtaggagagcatcaggtcgtggtcaacaggcacgtagttctgaccgtgcgggttgtagatcttcaaggttgggaaccaagagtcaagaccgaaggtacgtgcctcatcaggaatgattgggacaaggcgatcagccaagcccttatcgcgcatcagttccttgaaggtacgaacagtcgccatggtggtagcgatctgctgcttgccggagcccttacggacagagcgaagcttatccagtggtggaacctgaattggatcgtagttctcacgacgctctggcaggtagccaccgagcgctgcgcgacgttccttcatgtacttgatttcaggagcgtcttcacctgggtggtagtaaggaggaaggtaaggatccttctccagctgctcatcggtgattgggatgccctgcttgtcgcggaacaacttcagatcatcaagcgtcagcttcttcatctggtgggttgcgttacggccttcgaagttgtggccgagtccgtagcccttaatggtgtgagcaaggatgacggttgggcgatccttggtctcaagagctcgcttgtaggctgcgtaaaccttgcggtaatcgtggccgccacgtggaagcttccagatttcttcgtcggtcatgttctcaacgagctttgcggtgcgtgggtcacgtccgaagaagtgctcacgaacatatgcgccgtcgttagccttgaaggtctggtagtcaccatcggaggtgttgttcatgatctcaacaagtgcaccatcctggtccttctccagaagttcatcccactcgcgaccccaaacaaccttgatcacagaccagcctgcgccacggaagaaggactcgagttcctggatgatcttggtgttaccgcggacaggtccgtcgagacgctgcaggttgcagttaaccacgaaggtcaggttgtccaggttgttcagtgcagcctgctggatgagaccacg

SEQ ID NO: 2464 - DNA, 789 bp, Corynebacterium glutamicum
atgttatccatcaacggaatttctaagacgttcttccccggcactgtgaatgagcgccgcgcgttgcagcagctcaaactcgatatggctgagggcgattttgtcaccgtcatcggttctaacggtgcgggtaaatccacgctgctcaacgctgtttctggccgtttgcttgttgattccggcgagatttccatcgacggcaacaaggtaaacaagatgtcagagcacaagcgtgcccgctacatcggccgcgttttccaggatcctctggccggcaccgcgccgaatctcaccattgaagagaatctggccatcgcgttgctgcgcggcaagcgccgtggattgggctttgcactgacctcgaagcgccgtgagcaattcaagcaggaacttgagcgccttgagctgggtctggaaaacaggctcactgccaaagttggtttgctctctggcggtcagcgtcaggcattgtccctgctgatggctggttttactcaacctaaaatcatgctgttggatgagcacaccgcagcgcttgatccacagcgtgcagagcttgtgaccaccttgaccgaaaagatcgtggcagatggaaatctgactacgcttatggtcacgcacaacatggaacaggcaattcgcctgggcaatcgcctgatcatgatgcatgaaggccagattgtctaccaggcagatcaggctaccaagtcgaagttgactgtgcgcgatttgctgcaggagttcgccaacatcaagggcgcaacattgtctgacaaggcgttcctcggc

SEQ ID NO: 2465 - DNA, 963 bp, Corynebacterium glutamicum
atgcgacaactccgtacaacaatccgaactcaaaagcgccgatcatacgcgttcggccttatccaaaatctcttgagggatctccacgccctggcgctctgctgcatcttcgttgatcacgtaggtgaactcagttgcagtctccacaggcatggttgctgggtcttcgccgtcctgcagaatacgcagagccatctcaccagtctggcggccaagctcggtgtaatcgatacccagggttgccagtgcgccaccctcaacagtgccggactcagcgccgatcacagggatctgcttctgctcagcaacctgaaccagagaagaaataccggaaacaaccatgttgtcagttggaacgtagatgacatcaacatcgccgagagcttcaacagcctgctgaatctcgttcacggtagtgacagtctgagtattaacggacagccccagtggctcagcagccttggtgacctcatcgacctgcacctgagagttgacctcaccagacgcgtagacgatgccgatggactttgcgtcaggaaccagctgctgcaaaagctccaactgctgctcaatcggtgcgatatcagaagtaccggtgacgtttccgccaggtgcttcattagaatccaccagctctgccgacactgcatcggtaactgcggtgaacaggactgggatatcagtgatattctgcgcagttgcctgtgctgctggagttgcaacagccaacacgagatccaaattgtcagaagcgaactgctgagaaatagtcagtgcagtgccctgctcgccgttagcgttttgctcatcaaaggtgacgtcaacgcctgcctcttcaaaagcttccttgaaaccagtggtcgctgcatcaagtgcagggtgctgaacaagctggttgatgccaactcggtaagagtcgccacctgcagcatcagtggaggtggagctgtcactggaatcgct

SEQ ID NO: 2466 - DNA, 888 bp, Corynebacterium glutamicum
atgatcggcgcttttgagttcggattgttgtacggagttgtcgcattgggcgtctatttgacgttccgtgtgctcaactttcccgacctcaccgttgacggcagcctgaccactggcgcggcaacagctgcgacagctcttatgtctggctggcctccccttatggctactgccgctggtttcgttactggctttatcgctggcatgatcaccggtttgctgcacaccaagggcaagatcgatggtttgctcgcaggtattttgaccatgattgcgttgtggtcggttaacttgcgcatcatgggtggcgcgaacgtgccattgttgcgcaccgataacctcttcaccccgcttcgcgacgccggcctcctcggcacatgggcaggcccggcgatcctcgccgttgcagtgggaattttgggactcatcgtcatctggttcctcaacactgatatcggactgtcgctgcgatccaccggcgacaacgggccgatggtgcagtcctttggtgtttcaacggatttcaccaaaatcctcaccatctccctgtccaatggttttgttggtcttgccggtgcactcatcgctcagtaccagggcttcgcagatatttcgatgggtattggcctcatcgtgatcggtctcgcatcggttattttgggccaggccatcttcggtcagcgtcgcgtgtggttggctgtgttggctgtcatcgtcggtgccatcgcgtaccgcctgatcattttcgcagcactgcgcgttggccttgaccccaacgatatgaaggcaatttctgcgatcttggtggttgtcgccatgctgctgccgaggtggcgtgcgaagttctccaaggcaccgaagcctaagcaaccagtagcagtggaggct

SEQ ID NO: 2467 - DNA, 939 bp, Corynebacterium glutamicum
ttggcgttggcttcgtgctcaagcgattccagtgacagctccacctccactgatgctgcaggtggcgactcttaccgagttggcatcaaccagcttgttcagcaccctgcacttgatgcagcgaccactggtttcaaggaagcttttgaagaggcaggcgttgacgtcacctttgatgagcaaaacgctaacggcgagcagggcactgcactgactatttctcagcagttcgcttctgacaatttggatctcgtgttggctgttgcaactccagcagcacaggcaactgcgcagaatatcactgatatcccagtcctgttcaccgcagttaccgatgcagtgtcggcagagctggtggattctaatgaagcacctggcggaaacgtcaccggtacttctgatatcgcaccgattgagcagcagttggagcttttgcagcagctggttcctgacgcaaagtccatcggcatcgtctacgcgtctggtgaggtcaactctcaggtgcaggtcgatgaggtcaccaaggctgctgagccactggggctgtccgttaatactcagactgtcactaccgtgaacgagattcagcaggctgttgaagctctcggcgatgttgatgtcatctacgttccaactgacaacatggttgtttccggtatttcttctctggttcaggttgctgagcagaagcagatccctgtgatcggcgctgagtccggcactgttgagggtggcgcactggcaaccctgggtatcgattacaccgagcttggccgccagactggtgagatggctctgcgtattctgcaggacggcgaagacccagcaaccatgcctgtggagactgcaactgagttcacctacgtgatcaacgaagatgcagcagagcgccagggcgtggagatccctcaagagattttggataaggccgaacgcgta

SEQ ID NO: 2468 - DNA, 810 bp, Corynebacterium glutamicum
gtggggaacaccatgaacgtttcctcaaataaacccagtgactctgaccgcgaatatcttcaatcagaactcacccggctcgttggccaggggcgactcgatctagatacttaccaagacgtggttgataccgtttggtctactgatgatctaggcgagttgatgaggatccgtgcccgcttcctgggagggccgcaggtttcgcagcagcggccccagcagccgccacagcattatggacaacccggctacggccaatcacctcaatatccaccgcagcagcctccgcataatcagcccggctattaccccgatcccggccctggccagcagcaaccaccgatgcaccagccaccaacgcgtccaaatcaatatcagcctggcccacaaggtggaattccagtgggtggccatctgccacaaccaggtgcagggcacatgccggaaccagaaacctccacgatgggctccatccaaaagtccggtgaatggctcgttcctgcatattcggcatacaagctcaacggtgctgaccttttcttagatatccgccatgccaccgcggctgctcctgtcattacctttgatgtcaacatgaccatgggttctatgacgctgattgttccaccgggtgtgtatgtggaagtgcagatggcttccaagaactggtcggatttcaaggttcaaacaaccaatcctctccccggtgctccccgagtgttcatcactggtgttgcacgcgcatcagggttgaaggttttcaccaagcatcctcatgagccttttgggttctggcagaaaatgtttgag

SEQ ID NO: 2469 - DNA, 372 bp, Corynebacterium glutamicum
atgccgaatatgcaggaacgagccattcaccggacttttggatggagcccatcgtggaggtttctggttccggcatgtgccctgcacctggttgtggcagatggccacccactggaattccaccttgtgggccaggctgatattgatttggacgcgttggtggctggtgcatcggtggttgctgctggccagggccgggatcggggtaatagccgggctgattatgcggaggctgctgcggtggatattgaggtgattggccgtagccgggttgtccataatgctgtggcggctgctggggccgctgctgcgaaacctgcggccctcccaggaagcgggcacggatcctcatcaactcgcctagatcatcag

SEQ ID NO: 2470 - DNA, 1014 bp, Corynebacterium glutamicum
atggatacacaacgcggctcattgcggggaaaagctcataaagcaaggctaaagatgacgccaaatggtcgcaggcaactcctcctggagcgtggcgcagcatttagcaaaaaccgtaccccgggtctaaaacacgtcgaccgccacaccatcgtggactccgacggcctcagcatccacacgtacatggttggccatgccgaaaatgccacggcaacggtcgtgttcatccacggcttcaccctcgccgccgaagtgtattacatgcaggtcgactacctacaaaccttttacccaaatattaaaagcgtgcttatcgacgcccgcggccacggcgccaccggccagatccgcccagagctctgcaccatcgaaggaacagcgaacgatgttctcgcagccatccacgaacacgcaccgaccggcccgctcattttggttgggcattccctcggcggactcacggcacttaacctggttaaacgggcagatcactcacttcggaagaggatcgtcggcatggttctagtcgccacatcgatcgaatcattatccacccaaggtctaccacaagtcctggcatcaccccttgccgacaacatcaaaaacgccgtcgaagcagcccccaacgatgcccaaaaattccgccaatacgccaccacatttctagcccccaccctggccaccgcagtcttccaacgagacacaaacgatgaagtcatcgatttccacgccgccatgatccacgaaacccccttggataccttcgtcggtttcttcgacgacctccaagaacacgacgaactcgatgccgcaccagcattggaaggcctcaaaggctacgtccttgccggcgaattagatgatgtcaccccaattagccaagccgaccgcatctgcgaagtctggcccggcgcacgccttcaaatcgcagaaggagcaggtcatatgcttccgcttgaagcgccaggaatcctcaataatgcgatcggcaacattttggacgggctgggc

SEQ ID NO: 2471 - DNA, 291 bp, Corynebacterium glutamicum
atggatttcaacgacaaagccgcttcagaaaacgctgtaaagactggcgcagaaggccccaacgttttcgcgagcgtggccaagattttgcaggatgttggcggaatttcagccgaagacgtcactccggaatctcgttttactgaggatttggcagtgagctcactcaattacatcgagttgattgtcaatgcggaggacgcatttggtgttcgcattgaggacgccgatgccaaggatttgaccaccgtgcaggatttgattgactttattaacaccaataaggctgat

SEQ ID NO: 2472 - DNA, 825 bp, Corynebacterium glutamicum
atgacagtgaacatttcatatctgaccgacatggacggcgtcctcatcaaagagggcgagataattccgggtgcagatcgttttcttcagtctctcaccgataacaatgtggagtttatggttttgaccaacaactccattttcaccccgagggatctttctgcacgtcttaagacttccggtttggatatcccgccggagcgtatttggacttctgcaaccgccactgctcacttcctgaaatcccaggtcaaggagggcacagcctatgttgttggcgagtccggtctgaccactgcgttgcataccgcgggttggattttgacggatgcaaatcctgagtttgttgtcctgggcgaaacccgcacatattccttcgaggcaatcactactgcgataaatctgattttgggtggcgctcgctttatttgcaccaacccggatgtcactggaccttcaccaagtggcattttgcctgctactggctctgtcgccgcacttattaccgcagctactggcgctgagccttattacatcggcaagccaaaccctgtgatgatgcgcagtgcgctgaacaccatcggggcgcattccgagcacactgtcatgatcggcgaccgcatggacaccgacgtgaaatctggtttggaagccggcctgagcaccgtgctggttcgaagcggaatttccgacgacgccgagatccgccgctaccccttccgcccaactcacgtgatcaattccatcgccgatcttgccgattgctgggacgatcctttcggtgacggtgcatttcacgtaccagatgagcagcagttcactgac

SEQ ID NO: 2473 - DNA, 1032 bp, Corynebacterium glutamicum
atggcatttgcagacattgtgcgcagcgtcgaaaaccgcaccaacgcagcgaccctcaactggtccatcaaaaatggctggaagcccgaagtcaccggattttccgggtacggctccgggcgtcgagtgcgcgtccttgcgcgcgtgctcatgtccaaccccgaaaatttgcttgtcgacgccccctcccaatcaattacccaacaagcacagcgcggttggcgccagttcttcaccatccaagtgcccaacctgccagtaactgtcaccgttggtgggaaaacagttacctcatccaccaacgacaacggctacgttgacctcctggtggaagaccacaaccttgaccccggctggcacaccatccagatccaagccgaaggttccacccccgccgaagcccgcgtcctcatcgtggaaaacaccgcccgaatcggactcatctccgacatcgacgacaccatcatggtcacctggcttccccgagcactcctcgccgcatggaactcgtgggttttgcacaccaacacccgcaaaccagtccccggaatgaaccgcttctacgaagaactcctcaaagaccaccccgacgcacccgtgttctacctctccaccggcgcatggaacacctttgaaaccctccaagagttcatcaacaaacacgcactccccgacggccccatgctgctcaccgactggggaccaacccccacaggactattccgctcaggtcaagagcacaagaaagtccaactgcgcaacctgtttatcgaataccccgacatgaaatggatcctcgtcggcgacgatggccaacacgatcccctcatctacggcgaagcagtcgaagaacaccccaaccgcatcgcaggcgttgcaatccgtgagctctcccccggcgaacatgtgctctcccacggaacaactgcgtcactgtccaccatcacgaccaacgggggccaaggagtcccagtagttcacggccgcgatggatatgagttgctgcagcgctacgagacgaagccgttcgcc

SEQ ID NO: 2474 - DNA, 471 bp, Corynebacterium glutamicum
gtgcgggaattgaaggcagttaagtgttgccgaaggaaaccgaacatgacgaacaatgcattaaccgtgccaacccggacccgtcatcaggcggatttgctcacggcagacttctgggaagacatggggttgccccaactgaaaactaccatcgaagaatccatcgacgatgtagccctcccaatgcataccgctgttctagaaatcagcggaatgccaaaggaactgcgtcagaccgtggaatccgcaatggttgtgtgtattccgagtccttcggagctgtccggctccaacagggacccgctcaccgcacgatggttcactgcatggcgccgtgacccattcgaacttggcctcactgagtgtcgagaggtgatcaccggaactccacgcgaactcgacaaacttcgaggagtgctggaatctctggctgatgaataccgttttgaagttgagctgcgaatcgttgac

SEQ ID NO: 2475 - DNA, 825 bp, Corynebacterium glutamicum
ttgctaaggtctgtctccatgcagagttttaagacgcttgaatcttggcctgtcgacaatgtttcggccagtgtcatctccgacggcgccgtgcacttttacggcgacgtcgatcgtgtttttgaactcatgagtgtgacaaaactcctggccacctacggtttccttgttgccatcgaagaaggtgtttttgagctcgattcaccgatgggtcctgaaggatccacagtgaggcatctgctctcacatgcttccggcgtggcattcgataagccggtagcggaaaagggagtgggggagcgccgcatttactcctctgctggcatggacatcttggcggatgctgttgccgctgaagctgaaatgccgtttgcagagtatctccgcgaggctgtgttcgagcctttgggaatggagaactctgaactatggggttctgcgggccacgaggcgcgcagcacagtggctgatctgaccaagttcggccaagagctcaccgcaccaactctgatctcaccagaaacccttgcagaggctttccaggtgcaattcccggaactgattggcaccgtccccggttatggcatgcagaagccgtgtccgtggggattgggctttgaaattaagggacagaagtcgccgcactggacaggtgacttgatgccggagaacactgctggacactttggacagtcgggaacattcttttggactgttccaggctcaggtcaagtcggggttgttttgactgaccgaaatttcggtccttgggctaaaccgttgtggactgccttcaatgacgaagtctgggccgagttaaattca

SEQ ID NO: 2476 - DNA, 492 bp, Corynebacterium glutamicum
gtggaaaccgtcgcggaaaaatggaggatcctcgccatgaaccaagcaaacctgcctgccgaaatcgcggacctctccgatgaaaccgcactgtgggaaatcatcaacgaatacaactgggacgacggcttcgcggttccccttgcagtagtccgacaccccaaatgcgaccgagcgctagcccttcgcctgttttgggacatcgatgaaaccgcccaaatccaccactccgacgaagaatcagcgatcgccgagttgtacgccagcaccgcagaaaacgacccagcagaattcgacagaatcatggactactgcaccacactggtcgaagggctccgcaagcagacctatcctcggggcgccaaccgtttcgacacgggatttttcaacctcgaggacccttctttgaccgaccgtcagcgcaaaatccgcgccgggaaaaccaaatttgcgctcaagaatttcgaggaagctttcctccaaccagagcta

SEQ ID NO: 2477 - DNA, 771 bp, Corynebacterium glutamicum
gtgcttatgactgacatcggtgatgtcgatcaaatagtctgggaattcatccatttccacgatgactcgataaatccattctttgagttcatcaagagtgattgcatcaacgatgaggcaatcgaacgcaaaacccagatcctcggaatcatcttgggtaacgagccatgcgggagtgttattcacgcccgccagaatacaataaagcccatgagccatacggtctcttttggcgacggctggatccaagtccttgaggatgctgcagaaaccgtgtcgatcaccgacacgttggatgccctccgattttctcccgagcaagcggaatgggctgcagaattcggaccactactgtgcggcccagcgaaccaaccgccggcgtatctcacggctttagacgggcacacaaagctaccgcttagcccgcagctgacggagttctatagctacgcccgatcctggacaaacagtgaggccttgggaaacgtcattgatcccgatgactacctcgatcatctcaccgaccctcgccttcatttgcaggatcttctggataatgagtttgaacgggtgggggtgctcgtcgataagcaaaatcgcccgctcgaccctgcccggtgcgcgctgttctcgctcgacgcacttgcacgcgcgccctacaaccgcgcctacttcgtcttcgccgcgcccgagcctgagatctgggcgtttgagaacgagcacgtccacgcgccggacttgcgcgcctatttacaagcacgcttatcgacg

SEQ ID NO: 2478 - DNA, 546 bp, Corynebacterium glutamicum
ttggtgggaattgcttacgcccgtttccctgatacccgcgacgattccatcagccgcggcaaagcacgatcagcgttggagaaatccacgggccttaaagagcgtttcgcgcgtcattttcctgcaatttccatacctgtcgatacgggtgatgctgcagatattctcgtatcgggttggtggctttcaggttctaaaaagaagatcctgactgcagcggaaatccagaccttatttatcaaccgattggccacaggtccattgagcactcaattggaaactgctaccgggttgaaactgcaggtggtgaccaatcgagagcgtatgaagatcactctcattgaacccaaaggcacatcaggacatgccatcgacccccaagctggcaagggttcaaggggtggcttcctcctggacaatggccaagaagatgaatacgacgatgtcgacaccgtcacaatccccgatgcactcaatgtcatcggttacattcttacccatggaactccacctcaagaaggctggaaggtagacgtgttggagcgt

SEQ ID NO: 2479 - DNA, 465 bp, Corynebacterium glutamicum
gtgcacattggattcacacccgtagtagtttttgggggaatgagcatccaagggttttccgcaggtgactattctgcatgttttgaaccgcgcatcgatgcgtgggttgatattcgcggtccgcggaagcccgagtggttggcggaaaatatcgataatccgctgagacactggggcgataatcctcatatcccggtgtctgctgcgaaaaaggctggaaatatttacaaagagacccttcgaaccatgagagcctcaacaaagaccccagaccaggatcccttaaaagaaaccctgcgcagcttcatcgcaagcatcaaccagctcgccgcaaagaagaatttcattgatgccggggtgcgcgaagatatcgttgttgcgctggaaaaactatgcgaagcagcagaagctagcccagaagaaattcagcaggcgatcgtgatgggagaagaattcatcgaggac

SEQ ID NO: 2480 - DNA, 342 bp, Corynebacterium glutamicum
atgagcgattcaccgtgcaccgtcgtcatcctgaaccgcacagctactgcgacttccatcctgagagatattaaagccctcaccggttacggcctgtctgagatcaggtcgcgcatcgttgcgggacttcccgtcgtgatcgaggagatgttctcaaacgcctggtacgacgaacgcgcacaactgttgctggcactgctgaccaaatggcagaacgaaggaatcacattcgagattcgggaagtcgctgaggatgatcccatcgaagcaggggcattgatctctctagaagtgctgcgaaacatcattgagccagacgataatgaatcgagggacggtatc

SEQ ID NO: 2481 - DNA, 1560 bp, Corynebacterium glutamicum
ttgaggagcctcatgccacagttaagcagacgccagttcttgcagacaaccgccgttactgcaggtctagccacttttgcgggcacacctgcacgcgctgaagaacgccaattccagcatggcgtggcttccggggaccccaccgcaacctctgccattttgtggactcggctgaccccaattcccgacgccacacctggaagtggccttggccccgactctcctgtcacctgggaagtctcccccactcctgatttcgccagcatcacgcgctcgggaaccgtaatcacctccgcagcaagcgatcacaccgtccacgcgcacgccacgggtttgagcccatccacccgctatttctaccgcttcatctcctccaccggcgaggtctcccctgtggggcgcacgcaaacaacatcgcttgtcgacgctcccctcccgcaccttcgctttgcccttgcgtcgtgtgccaattgggaggcaggattttttgccgcctacggcgacatcgcccggcgcgctgacgccggcgaattggagatgttgatttttttgggtgattacatctacgagtacgccaccggtatgttcgccggaaaggacggtgtggtgcgcccgcatcagcctcttcatgaaaccatcacgttggagcactaccgcactcgttatggccattaccgcagtgacaatcacttgcaggcagcgcatgcggcgttgccgtggattgtcatgtgggatgaccatgagtcggccaacaactctaatcgtgagggcgcgcagaatcattccgctgatgagggttcgtgggtggatcgtcaaaatgctgctcggcaggtctttttggagtggatgccgatccgccaggaggacacgctctatcgttccttcacttttggtgacctcgccacgctgtcacttcttgatcttcgaagtttcagagatccagcaccctcccagcaacagtggctggagggtcaacgtgcggacaccatgatggggtcgcagcagtttgagtggctgaaatccaacgtggaacacaccaccacgacgtggaatatcatcggcagctcagtgatgtttgcccccatggcaattaccgggcagcctcttttccagatccctgaacctattcccgccaatttggatcagtgggacggctactcccgtgagcgcgaccgactcctagctgtacttgccgatttcgccactccaacgctttttctatctggcgatatccactccgaatgggcaaacgccatccggtttaatggtcgagaaatcggtgtcgaggcagtatgcagctccatcacctcagctaatgtcaacgacttcgccaaactccctgaggacaatccggtctccctgcaagcggaacaagtaatccgagccaacagttcgcatgtgcgccacgttgatcttgacgcccacggctacgccacggtgaatctcacccaagatggcgcgcacatggtctggcaccgcgtcgccgatctctcccttccggactcagaagttgctccggcaattgcacttgagtggaaaccaggcgtcggattcactact

SEQ ID NO: 2482 - DNA, 714 bp, Corynebacterium glutamicum
atgattctgcgcgccctcacgattagagttgttggccgactcatggtcatcccacatgacaatccacggcaacgccgcatgcgctgcctgcaagtgattgtcactgcggtaatggccataacgagtgcggtagtgctccaacgtgatggtttcatgaagaggctgatgcgggcgcaccacaccgtcctttccggcgaacataccggtggcgtactcgtagatgtaatcacccaaaaaaatcaacatctccaattcgccggcgtcagcgcgccgggcgatgtcgccgtaggcggcaaaaaatcctgcctcccaattggcacacgacgcaagggcaaagcgaaggtgcgggaggggagcgtcgacaagcgatgttgtttgcgtgcgccccacaggggagacctcgccggtggaggagatgaagcggtagaaatagcgggtggatgggctcaaacccgtggcgtgcgcgtggacggtgtgatcgcttgctgcggaggtgattacggttcccgagcgcgtgatgctggcgaaatcaggagtgggggagacttcccaggtgacaggagagtcggggccaaggccacttccaggtgtggcgtcgggaattggggtcagccgagtccacaaaatggcagaggttgcggtggggtccccggaagccacgccatgctggaattggcgttcttcagcgcgtgcaggtgtgcccgcaaaagtggc

SEQ ID NO: 2483 - DNA, 1836 bp, Corynebacterium glutamicum
atgaccattccaggagcttccacacagactgatatccctctggacacacttcttgaggattacgcgctactgtcagacactcacaccggcgctctgctgtccaacatgggcagtttggactggttgtgcctgcctcgttttgattcccaagccatgttcaccaggctgcttggtgatcgcgagcacggacactggagtttgcgtgtcccaggtggtgaggtgatcagccaaaactacctcggcgattccttcgtggtgcagaccgtgtggcgttcagagaccggtactgcccgggttgttgatttcatgccaattcacggtcaagaacaacccgatatcaccgacctggtgcgctctgtgcactgcgtggaaggcgaagtggatgtggaatcgatcctgcgcctgcgttttgattatggcgagtccactccgtatttccgcaccagcactgtcgacggcatcagcatcgtgcaggctgtcgccggccccaatgcggtatatgttcgtggacctgagatgccacaccgccctgcaaaggattgtcacagtggcaccttccacctgacggccggcgaatccgtggaatgggttctcacctgggcaccgtcgttcgaaccgcatccccccatgccggattacacccgctctttggagagcaccttgagcttctgggcatcatgggttgaagagctcccccaccagcgcctctacgacgctgaagtccgccgctccatgctcgtactgcgcgccttgaccgatctacaaaccggtggcatcgtggccgcaccgaccacctcactaccagaggatttcggaggcatccgtaactgggactaccgctacgtgtggctgcgcgactccgcactcaccattgaagccctcgtggaatacggattctcccaagcagccctccaatggcgcacctggctgctgcgcgccatcgcaggcgacccggaaaacctccgcatcatgtatggcctcggcggcgaacgacacctccctgaacgcgaactccaacacctgcgcggatacgaaaactccgtgcctgttcgcgttggcaatggagccgccgaacaataccaagcagatgtcgtcggcgaagtaatggtcgcgcttgaaaccatccgccgcgccgggtgcctcgaggacgaattctcctggggcatgcaaaaagccatcctcgatttccaagaagccaacttcgaccgcaaggatcaaggcatctgggaaatgcgctccgaaccgcaatatttcacccacggccgcgccatgatgtgggccggcttcgaccgcggcatcaaagccatcgaagaattcaacctcgacggccccatcgagcgctggcgtgaactccgcgccaaactccgcgaagaaatcatgaccaacggcttcaacgaagagatccaatccttcacccagtgctacgacaacacccaagtcgacgcctcgctgcttcagctcgcccaaataggcttcatcggcttcgacgatccaaaaatgctcagcaccgtagcgcgcattgagcaagagcttctcgacgcccacggctttcttcacaggtaccacaccgacgggtctgacggccttgccggcgacgaataccccttcctcatctgttcattctggctggtagaacaatacgcaagctccaaccgcctcgacgaggccaaagaaaagatgaaccgcatccttgccgtccaaagcccacttggcctactggctgaggaatactccacccaccatggcaggctcgctggaaactaccctcaggccttttcccacattggtctgatcagcgctgcccgtgccataaatttcgaagaagcgcgaaacagg

SEQ ID NO: 2484 - DNA, 240 bp, Corynebacterium glutamicum
atgatccagttagtgataggcgctgcagcaggctacgtgcttggcacaaaggccggccgcaagcgttaccaccagatcaaaaagggatatgaggcagcgattaactcccctgccaccaaatctgcagtaaacgccgcccgcaaagccattgccaacaagctggatccgcagccccgcatgaaggaagtaaaaaacctgcggactgcggacgggcatgaagtcctcgagcaagaccaggac

SEQ ID NO: 2485 - DNA, 675 bp, Corynebacterium glutamicum
atggtgatgaggccggccagaaggccgccatgcgtgcctttgagggcgatcagaagttcacaggacaatcatttgtgtctgtggcacccaacggcatggatccgtgtgatctgcgccttgagcgtggcgatgcggcggtgcgtgatcttgtggcacgacgcatcccgatgtttgagttcgtcatccaatcgatcatcagcgaatacaccctcgacaccgtggaaggccgtctggctgcgcttcgtcgggcagtccccatcgtggcggatattcgcgataagacgctgcagtctgaatacgcccgcctgctgtctggttgggtcggctggtctgatccttcagaggtgctgcgtcaggttcacgaggaagcacgtcgccccaagcgcgataagaagcctgtgcgtgcaaagcgtttcgatcaaccgctcgaggatcaaagcctgcgacccaccatggcgctgcctaatccgcggaaccctgtgctgtggcaggaacgggaatcactcaagatcgccctgcaatatccggagctcgcgggatcgtactttgatggactgccaaccgatagcttcaccaaccctgcctaccgcatggtacgcgatgccatttcggctgctgggggatgtgaacgtgccctcgatggcactgattggttgcctgccgtatcggaaaata

SEQ ID NO: 2486 - DNA, 1899 bp, Corynebacterium glutamicum
atggtcatggcaaagggacgtattccggaaagtgacattcaggcaatccgcgagcgcaccccgatcgaggagatcgtgggtgattatgtgcagctgaaatcggcaggtgctgattcgctcaaggggctttctccctttaaagatgaaaaaacaccatcgttccatgtgcgccccaaccgtggttactaccactgtttctccaccggcaaaggtggagatgtgttctccttcctcatggagatggaacacatctctttccctgaggctgtggaagtgtgtgcggagaaaattggttatcagatcaattaccaaggtggtggcccggggcgccgtgaggaacctggaactcgccagcgccttattttggctaataaggctgcgcaccagttttatcgcgagcaattagaaacccccgaagcacaacctggcagggagtttttgctgcagcgtggattcggacagcagcacatttatcatttcgaatgtggctatgcgcctgccggctgggataccttgaccaagcatttgctgaagaagggctttgagttcaaggaattagaagctgccggtctaagcaagatgggtaagcgcggtccgattgatcagttccagcgcaggttgctgtggccgatcaagaacctgtctggtgatgtcattggttttggcgcccgcaagcttttcgatgacgacaaaatgggcaagtacatgaatacgcctgagacgttgttgtacaaaaagtccaaggtgctctttggtctagattctgcaaagaaggccattgcagctggccaccaagcagtagtggtggaaggctacaccgatgtgatggccatgcatgccgcgggcattgatacagccgtggcatcgtgtggcactgcgtttggtgaagaacacttgcagatgcttcgtcgactcatgctggatgataactacttccgcggtgaactgatttacaccttcgatggtgatgaggccggccagaaggccgccatgcgtgcctttgagggcgatcagaagttcacaggacaatcatttgtgtctgtggcacccaacggcatggatccgtgtgatctgcgccttgagcgtggcgatgcggcggtgcgtgatcttgtggcacgacgcatcccgatgtttgagttcgtcatccaatcgatcatcagcgaatacaccctcgacaccgtggaaggccgtctggctgcgcttcgtcgggcagtccccatcgtggcggatattcgcgataagacgctgcagtctgaatacgcccgcctgctgtctggttgggtcggctggtctgatccttcagaggtgctgcgtcaggttcacgaggaagcacgtcgccccaagcgcgataagaagcctgtgcgtgcaaagcgtttcgatcaaccgctcgaggatcaaagcctgcgacccaccatggcgctgcctaatccgcggaaccctgtgctgtggcaggaacgggaatcactcaagatcgccctgcaatatccggagctcgcgggatcgtactttgatggactgccaaccgatagcttcaccaaccctgcctaccgcatggtacgcgatgccatttcggctgctgggggatgtgaacgtgccctcgatggcactgattggttgcctgccgtatcggaaaatatgactgatattttgggcacgtcgttggtgtcagagctggcgatggaacccatcgaggtggaagcgcaagacctggaatcatataccgatggtgtgttgtccaggctgcaggaaacacgagtgggcaaccagatcgccatcttgaaaggacagctgcaaagaatgcgtccgtctgaagatgagcaagcctacaactcgctgttttccgatctggttgccctggaacaggcgcgccgggagctgttggcccgggcgtttagaggg

SEQ ID NO: 2487 - DNA, 462 bp, Corynebacterium glutamicum
gtgctcggagtcatcgttgtcctcgctgctgcatggtttggaattgatctgtccacttcaggtgaagccaccagccaagcatcaagctcagcaactactaccactattactagctctaacactccaacatctgagtccatctccagcaacagcgacttagacggtgacagctgctccatgagtgagctgccacaagaagctgatgaggtggtcgacgatatcctcgccggtggtccttttgattacccagacaatgacggcgtgcgctttggaaactacgaaggcgtactaccgaaagagtccagcaactactaccgcgaatacaccgtggaaaccccaggacttagccaccgcggtccactgcgcattgtcaccggtggatcaaacccaactgatccagaggtgtggtactacacctcagatcactatgaaactttctgtgccatcaccgatgcggagaac

SEQ ID NO: 2488 - DNA, 243 bp, Corynebacterium glutamicum
atgaatatcgtcttgcagggatcgtttagcactcgacaggagttctttgatctcctcggtgccgctgcctggggtgtggaacgaccagcgccaaccaatctggacggcatggtcgatctgatccgggaaactggactggacacaatcaccgtcaaaggtcactggcttgtaccggcagaggaaacagaacggattgaagaagtctgcgatgatctaggcgttgatctgcgcttcaaccgtcgc

SEQ ID NO: 2489 - DNA, 636 bp, Corynebacterium glutamicum
atgaagatggcaagctcgttcttgatgagctgcgcatcgatgaagctattctgcgtagtgtcgacaagatcgtcattgttgcttgtggtactgcagcttatgcaggccaggttgctcgttacgccattgagcactggtgccgcatcccaaccgaggtggagctggctcacgagttccgttaccgcgacccaatcctcaacgagaagacccttgttgtggcattgtcccagtccggcgagaccatggataccctcatggctgttcgccacgcacgtgagcagggtgccaaggttgttgctatttgtaacactgttggatccactcttccacgtgaagcagatgcgtccctgtacacctacgctggccctgagatcgctgtggcgtccaccaaggcgttcttggctcagatcactgcttcttacttgcttggcctgtacttggctcagctgcgcggcaacaagttcgctgatgaggtttcttccattctggacagcctgcgtgagatgcctgagaagattcagcaggtcatcgatgcagaagagcagatcaagaagcttggccaagatatggcagatgctaagtctgtgctgttcctgggccgccacgttggtttcccagttgcgcttgagggtgcgt

SEQ ID NO: 2490 - DNA, 1869 bp, Corynebacterium glutamicum
atgtgtggaattgttggatatattggccaagcgggcgactcccgtgattactttgctctagatgtagttgttgaaggactacgtcgcctggaataccgcggatatgactccgcaggtattgctattcacgccaatggtgagattagctaccgaaagaaggccggaaaggttgctgcactagatgcagaaatcgctaaagcacctcttccagattctattttgggaattggacacacccgttgggcaactcatggtggcccaaccgatgtcaacgctcacccccacgttgtttccaatggcaagcttgccgtagtacacaacggcatcatcgaaaactttgcggaactgcgctctgagctttccgctaagggctacaactttgtatccgataccgataccgaagttgctgcttctttgcttgctgaaatttacaatactcaggcaaacggtgacctcacccttgctatgcagctgaccggtcagcgccttgagggtgctttcaccctgctagctattcatgctgatcacgatgaccgcatcgttgcagctcgtcgtaactctcctttggttatcggcgtcggcgagggcgagaacttcctcggatctgacgtttctggctttattgattacacccgcaaggctgtagagctggctaatgaccaggttgttaccatcaccgctgatgattacgccatcaccaactttgatggatcagaagcagttggcaagcctttcgacgtggagtgggacgctgcagctgctgaaaagggtggcttcggttccttcatggagaaggaaatccacgatcagccagcagctgttcgcgataccctgatgggccgtcttgatgaagatggcaagctcgttcttgatgagctgcgcatcgatgaagctattctgcgtagtgtcgacaagatcgtcattgttgcttgtggtactgcagcttatgcaggccaggttgctcgttacgccattgagcactggtgccgcatcccaaccgaggtggagctggctcacgagttccgttaccgcgacccaatcctcaacgagaagacccttgttgtggcattgtcccagtccggcgagaccatggataccctcatggctgttcgccacgcacgtgagcagggtgccaaggttgttgctatttgtaacactgttggatccactcttccacgtgaagcagatgcgtccctgtacacctacgctggccctgagatcgctgtggcgtccaccaaggcgttcttggctcagatcactgcttcttacttgcttggcctgtacttggctcagctgcgcggcaacaagttcgctgatgaggtttcttccattctggacagcctgcgtgagatgcctgagaagattcagcaggtcatcgatgcagaagagcagatcaagaagcttggccaagatatggcagatgctaagtctgtgctgttcctgggccgccacgttggtttcccagttgcgcttgagggtgcgttgaagctcaaggagatcgcatacctgcacgctgaaggtttcgctgcaggcgagctcaagcacggcccaattgctttggttgaggaaggccagccgatcttcgttatcgtgccttcacctcgtggtcgcgattccctgcactccaaggttgtctccaacattcaggagatccgtgcacgtggcgctgtcaccatcgtgattgcagaggaaggcgatgaggctgtcaacgattacgccaacttcatcatccgcattcctcaggccccaaccctgatgcagcctctgctgtccaccgtgcctctgcagatctttgcgtgcgctgtggcaaccgcaaagggctacaacgtggatcagcctcgtaacctggcaaagtctgtcaccgtcgaa

SEQ ID NO: 2491 - DNA, 324 bp, Corynebacterium glutamicum
atgcaggatcttttctacataagcctttcgaacctccggttcaaatcggaaaccgtggccgaagatttgagacccacaaaatttataaaattttatttacttggcagaaaccgactgatccgacaaatcacttttctaaaccctcgatatgtaagcaataagctaaatgggtttgacccgcttctggggaattgtgacttttggggtttcgacccagaacgaacgcccgatcacaccagggtgcataacgtgctgatactttacagcggtaaacgactcagacacccacaaaccttaaaggcgaaatttttgggcagcgtgatt

SEQ ID NO: 2492 - DNA, 1152 bp, Corynebacterium glutamicum
atggccttgtctaatccaagcgaggatttctgcgtcctcgtcataagcactgtatttcttattgacactgccatccgcatttgttttagcccacggatacttacatgcagcatcaagagcagcccgcgacaagttcagcccaaagctctccccctcatcagagacaatttttggctccagacgcgtgagaatacgcaaggtttgggcgttgccctcaaatcctccacaggccgcagcaacttcattcaacgcgttttcaccgttgtgtccatacggcggatgcccaatgtcatggcacagccctgccagatcgcacagatcaggatccaaatccagtccagctccgattccccgtgcaatttgagctacttccaaagagtgcgtcagccgggtgcgcggagtatcaccatcattggggccaaccacttgggttttatccgcgaggcgtcgaagagcagcagaatgcagcacgcgagcccggtcgcgggcgaacgcgctgcgggtgtctacggcgctggtacgcagttggctggacttggcgcgctcaggctggcgtcgaaaagcgtctgcgtcggaataggggtacatctactttttcagcctccgaagttgctcatggcgtgcacgccgcgaagggcgcagcagaccttggattgcgcgcaaagatgcttccaccttatcggccacccgttcacccaagagccgcgacacgtcctgtactactaccccgccccactcatgggacaaggtcagaaaataaactatcgacggaaacttcgcgggactataggttgtcggggaaggtttcgcgtcaaagcccatgcgtcgcgcgatgcgcaccgcccgatacgaatggttcggatcagtaacaatcagcacccgaccaagcttttccggatcaagcgcctcataggaggagacagtgtcattgccaactgcagagacaaaaatcagatccggatccacgccctctttgatcaaatactcccgcgcgacttctgcttcggtgaaacgatcgccaggaagttttccgccgacagtatatacatgctggatttcatgaagacgccacagcttcgcggcatgcctcaaacgagcagcaaactgcctcgatggaactccatcatattgagctgtgcccaacaccaaaat

SEQ ID NO: 2493 - DNA, 1272 bp, Corynebacterium glutamicum
atgtacccctattccgacgcagacgcttttcgacgccagcctgagcgcgccaagtccagccaactgcgtaccagcgccgtagacacccgcagcgcgttcgcccgcgaccgggctcgcgtgctgcattctgctgctcttcgacgcctcgcggataaaacccaagtggttggccccaatgatggtgatactccgcgcacccggctgacgcactctttggaagtagctcaaattgcacggggaatcggagctggactggatttggatcctgatctgtgcgatctggcagggctgtgccatgacattgggcatccgccgtatggacacaacggtgaaaacgcgttgaatgaagttgctgcggcctgtggaggatttgagggcaacgcccaaaccttgcgtattctcacgcgtctggagccaaaaattgtctctgatgagggggagagctttgggctgaacttgtcgcgggctgctcttgatgctgcatgtaagtatccgtgggctaaaacaaatgcggatggcagtgtcaataagaaatacagtgcttatgacgaggacgcagaaatcctcgcttggattagacaaggccatgaggatcttcgcccaccgatcgaagcgcaggtcatggacttttctgatgacattgcctactcggtgcacgatgtggaagacggtattgtatccgggcgtatcgacttaaaagtgctgtgggacctggttgaattagcagctttggcagacaaaggagcagctgctttcggaggttcgcctgcagagctcatcgagggtgcagcatcgttgcgggaacttccggtggtggctgccgctgcggattttgatttctcactgcgttcctacgctgcgctgaaggcgatgacttcagaactagtgggaagatacgttggctctaccatcgagtcaacaaagaaaacacacgctggcattgatgtgggacgcatgcacggcgatttgatcattccagaaacagcggccagtgaagtaaaactgctcaaaacgttagcggttctctacgtgatggatgacccagggcaccttgcgcgccaaaacaggcaacgggatcgtatcttccgggtttttgactacctggtgctgggggctccgggatcgttggatccgatgtatcgccagtggtttattgaagcggattcagaatcggaacagatccgtgtgattgttgatcagattgcgtcgatgacggagtctcgtctggaacgccttgcccggaatgctgctgacatctcaggatttttggga

SEQ ID NO: 2494 - DNA, 675 bp, Corynebacterium glutamicum
gtgagaagatttttagccaagagtttactcttaaccgcagtagtgcagccagccctgagggtggtggcgtattcgatgctcagaacgcctaataatcggcacaaaattgattcaattttggtgttgggcacagctcaatatgatggagttccatcgaggcagtttgctgctcgtttgaggcatgccgcgaagctgtggcgtcttcatgaaatccagcatgtatatactgtcggcggaaaacttcctggcgatcgtttcaccgaagcagaagtcgcgcgggagtatttgatcaaagagggcgtggatccggatctgatttttgtctctgcagttggcaatgacactgtctcctcctatgaggcgcttgatccggaaaagcttggtcgggtgctgattgttactgatccgaaccattcgtatcgggcggtgcgcatcgcgcgacgcatgggctttgacgcgaaaccttccccgacaacctatagtcccgcgaagtttccgtcgatagtttattttctgaccttgtcccatgagtggggcggggtagtagtacaggacgtgtcgcggctcttgggtgaacgggtggccgataaggtggaagcatctttgcgcgcaatccaaggtctgctgcgcccttcgcggcgtgcacgccatgagcaacttcggaggctgaaaaag

SEQ ID NO: 2495 - DNA, 2037 bp, Corynebacterium glutamicum
gtgcatcttcgggaaaacgtccgccgtgtatcggtcactgtggcaattggagctggcgcgctccttatcagtggaccattttttactgctcacactgcagaagccacagaaacatatgtcttggctgaatcaccagaattttaccaagacaatgtcactgactacaccggccagatttcctcgtccgatatcaccaacattcaggctgccatcgatgatgtaaaggcatctgaacaaaaggttattttcgttgttttcctaagctctttcgacggagttgaccctgaaacgtggacgcagcaagcactccaagccaacggcggcggaaacgtcttgatttatgcactcgctcccgaggaacggcagtacggcatccaaggtggtactcaatggaccgacgctgaactcgacgccgccaacaacgctgctttccaggcactttcccaagaagattgggcaggctctgcactagcgctggcagaatcagttggttctagttcttccagctcttcgggctcgtccagctcttccgatttttccggcgcttggttggctgctgcgggcgttggcacagtggccgctggtggcggaatttgggcctattcccgcagccgcaagaagaaaacaagtgctgcaaccttggaagatgcacgcgaaatcgacccgcgcgataccaaccgcctcatgcagcttcccatggaaactctcgaacaccttgcccaagaagagctcacctccactgatgactccatccgtcgcggaaaagaagagctcgctatcgctacctccgagttcggaccagagcgcacccgcagcttcaaccgcgccatgaaccactccaccggcaccctgcaaaaagcctttgagattcagcagcgcctcaacgattctatcccagaatccgaagccgaacgtcaatccatgctggtagaaatcatttcatcctgtggccaagccgacgatgccctcgacgccgaagcccaaaactttgccgatatgcgcaacctgctgatcaacgcgggcagcaaattggatgctctcacccaaaaatccgtcgacctgcgcacccgcctccccaaggcccaagaaacactcgctggcctgcgcactcgctactcagcagaggtccttgaaagcatcgacgacaacgtcgacctcgccagcgcttcgctcgacgaagcagaagaagtcctgccacaggcgtacgagatagagtccatgcccgcaggcgagcagggcgggcttatcgacgcgatccgtcacatcgagcacgccatcactaccgcagacaaactcctcgcgggcgtcgagcatgccgatgaaaacatctccacagccaaagcaaacgttgccgatctgatccaagaaatctcagacgaaatcaacgaagccggccaactcaaacaaagcgcaggagccgacggtgcccgtgccgactgggcctccctcgacgatgctgtccgcgcagccagcgcagcactaatcaccgcatcagcagacgccgaaaaggatccgctcggaacctacacagaacttgtcgatgtcgactccgccctcgacactcaacttgacacacttcgcgccaccgcagctgatcaagcccgccagctacgcgtattcgaccaacagctgcaatctgcaagaagccaaatccaaaaggccgaagacctcatctccacccgcggtcgcatcgtaaaatccgaagcccgcacccacctggccaacgcacaaaagctgtacgccatggcacaacaaaaccgcacccgcgacacccgtgcaggaattgattacggacgtcaagcagcagtcgcagcccaacgcgccagcaagtcagcacaaaacgacatcaccacctacaacaatcgccacaattccggtggcggaaccaccggtgcgattgtcaccggcatggtgatcaactcgattctcaacagcggccgcggtggcggtttcggtggaggcggaggctttggtggaggcggtggcggcttcagcggtggtggcggtggcggaggagggttccgcggaggccgcttc

SEQ ID NO: 2496 - DNA, 486 bp, Corynebacterium glutamicum
atggtagacgctcagcgccccaaagcaggcatcttcggtagccacacagaagaaacatgggtgtggctcggtaatgaacttttcgacgagtccggcgaggtcatcgccgacgttcgctccgacgtcctctacgtggatcgcgaacgactactcatcgaatccacccccggcaccatgcgttttcgttgccgcgcaacactgtccgggggtgaggtctatacgatgactcagaattctttcactgtgggggatctcactgcggtgtgcgggcgccggacgtattcactaaaaagggtgtcgccgtggcgtaaagaacgcctgatcaccaacaatggggtggaagtggcgcggcttcgcccgatgaccagcggtaaagtcgaattcattgtgggcaccgcgggcagcgaggcgttgccgttcgtcgacgcagtatttttgagctgggcgtgcgtcctggtggattcggccgtgcgccggccgaaaatt

SEQ ID NO: 2497 - DNA, 582 bp, Corynebacterium glutamicum
atgacttcgaaggatctgattgtgacctcctatacgtcttggggcaagcgtttcaagaatgacgggaagctttttattaacctacttcgcagcaccactgatagtgctgatgaaaaggttttagccactttcggtgaagttcccagcaaatcatttgaaaccaccgcaacggttgatgagcagcagtgggaactgtccttcagtattgatggaacggcaactgccaagcttcctgatggtcgtgtgttcagcgcgaatgcaggtgagaagacctttaccaagtccaagcggattgaaatcgacatggacggcaccgcgatggctgctgttaatgaagataaaaacaattggattatcgacgattctgaagagaataaagtcgctcagtttaccggtatgaacaacggtgtgcgtcgcgcgattgtggagtttgagcctgacgtagaagtcacccaggagcaggaaattttcttgtcgtgggttgctcggaaaactctggaatcccgcatgttgggctccagttggggactgactctgtttttgatcattttgacgccaatcattattttcctcactttcagc

SEQ ID NO: 2498 - DNA, 1383 bp, Corynebacterium glutamicum
gtggctcagcaatcgatcatcgacaccgtggttaacctgtgtaaacgacgtggactggtgtacccctgtggtgagatctacggcggtacccgctctgcgtgggactacggcccgctgggtgtggagctgaaggaaaacatcaagcgccagtggtggcgttctatggttacttcccgcccagatgttgtgggtgttgatacttctgtcatccttcctcgccaggtgtgggtaacttccggccacgttgaggtcttcactgacccactggttgagtctttgaacacccacaagcgttaccgtgcggaccacctgctggagcagtacgaagagaagcatggtcacccacctgtaaacggcttggctgacatcaacgatccagagaccggccagccaggtaactggactgagcctaaggcgttctctggtcttctgaagactttcttgggacctgtggacgacgaagagggtctgcactacctgcgccctgaaactgctcagggtatcttcgtgaacttcaagaacgtgatgaacacttcacgtatgaagccacctttcggtatcgcgaacatcggtaagtctttccgtaacgagatcaccccaggtaacttcattttccgtactcgtgagttcgagcagatggagatggagttcttcgtcaagcctggtgaggacgaagagtggcaccagcactggattgatactcgcctgcagtggtacatcaacctgggcattaagcctgagaacctgcgtctgtacgagcaccctcaggagaagctgtctcactactccaagcgcactgttgatattgagtacgcattcaactttgctaacaccaagtggggcgagttggaggggatcgcgaaccgtactgattacgatcttcgcgtgcactctgagggctctggtgaggacctgtcattcttcgatcaggagaccaatgagcgttggattcctttcgtaatcgagcctgctgcaggtcttggtcgcgcaatgatgatgttcctgatggatgcttatcacgaggacgaagcaccaaactcaaagggtggcgtcgataagcgtgttgttctgaagcttgaccgtcgccttgcgccggttaaggttgcggtcttgccgctgtcaaagaaggacactttgacgcctttggcggaaaagctcgcagcagagctgcgtgaattctggaacgttgattacgacacttcaggtgcgattggtcgccgttaccgtcgtcaggacgagatcggtactccattctgcgtcaccgttgactttgattctctcgaggacaacgctgtgaccgtgcgtgagcgcgacaccatggagcaggttcgtgttccacttgatgagctgcagggttacttggctcagcgcctcatcggctgc

SEQ ID NO: 2499 - DNA, 369 bp, Corynebacterium glutamicum
gtggctcaacactcaaatcggaatttcgtcacccctgcagaagagtccgaatccacagcatcagctgagcttcagaaacttgcaacagcaaaaaacatcaaagcgatcagcctgctgattagggcactagattcccccttaagaatcgaaatcatcctcgccctcaatgaaaggccccactacgtccacgaattggtcaagctagtaaaaagttcgcaaccactagtgagccagcacctcaaagtccttaaaactgcaggtatcgtcgacgcagaacgtcaaggccggcaaatgacttattcacttgccgaaccactcgtcctcgacatacttctcctggcactaaacgcaggggttgacacatctggg

SEQ ID NO: 2500 - DNA, 432 bp, Corynebacterium glutamicum
gtgggtatcaatcgcatcagccaaggctctgccccgaagctgggagtgcgaagcaccagacagcgaaaagccgtaattgacgttcttgaggaaatcgataacttcgcttccgccaaagaaatccatcacgagctatccaccagggaacacaacgtcggcctcacaaccgtctaccgaaccctccaatccctcgccgacatcggagcagtcgacgtacttaccgtcacgggtggagaaactctgtaccgccaatgccacgacgagggacaccaccatcacctggtctgcaccaattgcggtcgcacagtcgaaatcgatggcggtccagtagagacatgggcacaggaaattgccactaaaaacggctttgctctcagtagtcacgaggctgaaatctttggactttgcgctgattgtaaggaaaaagttacg

SEQ ID NO: 2501 - DNA, 1551 bp, Corynebacterium glutamicum
atgagcatcaccacacacgtccaagcactcaccacagcactcaacgccatcgacaaccatttggccagcatgcttgaccatggtgtcaccccagaccaatacaaggccatcgagcccgacctcatcgccctagaacacaccatcaaccaccacgccaccatcgccgcccaaaccaccgccctcgccgaacgcaccaatgctgcgcagtcgattggctccacccacctcatcgactacctcaccaccaccttcggcctatctaaagcacgcgcccaccaccgcatcaatctcgcccactccctctaccccataccgaagccaaactctggatctggcaacggcggtaatggtggcaatcccgatggcggtcctgatggtggcgactcgggtgatgacgactccggcgatgatgaccccgaccccgaaccggacaagcctgaagacggcaaacctgatagtgataagccccgtaggccacggatcagcgcggaaaaacacgccatcatcaccgacgaactcgcccgcctcaacccgaataccacacccagcgccgaggaactacgcacccaagccctgagtcaagcgatctggcgcaccccagaagacctccgcacgtggctacgccaccaggtcaccaccgcgaacaaaaacaaccccaaccccatcaccgccatgaaaaggcgctacctctcagtaggtaaacccgatgccgacaacatggtccgcatcagcggcctcgtgcccgcagccaccgcagcactgatcaccgcgaacaccgcaccgttaaccaaacgtggcaacctcgtggatctaccagcagcagaagatatgcgcacccgcgggcaacgccatgcggatgcgttgcatcacatcatggagatctacaaccacggtattgtcaccccagctcgtggtggaacagccagcatcatcatctccatgaccaccgatgatcttgacgagatcaaccacggtgatcatggcgatggcagtctacttaacaacctgtaccccacgaacacgggttactcattgaacttggcggagatcatgaacctcatcgctgcgaaatacgacttcgctgtgctcctcgatggtgagacggggcagccgttgaacgtcaataggatgcagcgctcagcgaacctgactcaacgcatcgcgttgtttgcttctgagttggtgtgctcggcacccaattgtgacaggccgcagttagagtgcgaggttcatcatttagatccctggatgagaggtgggctgaccaacctggtcaatctcacgcatcagtgctttaatcaccacccacgcaacgatgattccaggagtggggtcaatggtaaagggtttatggaccgcgatcctgctactggaagagtggggcactacccagtgggtggtgaggggccggtgtttaaccggtcggctgctgctgatagttcgggtggtgcgtgggccagacgtaaacatcatggcccaccacccgaaccgccgagcccgccggatccacctggtcctgagccggatcctggtgatgagggcagattgttc

SEQ ID NO: 2502 - DNA, 792 bp, Corynebacterium glutamicum
atgcagtccgccgaaacgcgcagcccctacgacgacgatgccgacgcctcccgccaaatcagcgccgacgaacgcatccacgccgaagtcgttcgaggcctagccagccgcggcagagaacgcatgagcggcaacttccgtgccgccgtattcggaatcaacgacggcctggtctccaacgtcgccctcgtcatgggtgtcatggccaccggcgtgcccgcccaaattgttctcatcaccggcatttccggtctgctctccggcgcgctatccatggccgccggcgaatacatctcagtgcgctcccaaacagagcttctcgacgcctccctcccagaccccaaagcccgcgaagccctccacgccctcgacgtcgaatccaacgaactggaactcgtctaccgagcccgcggaatgagcgaagacgaagcgcgggcaaaagcgtcacaagttttccaaagaatcagcgaccaaaaacgcatcagcgacaacgtcctcggcagcaccgaaatccaaagcgccggctccgctcgttcggccgccacattcagcttcctgtcctttgccatcggcgcattcctcccgatcgtcccatacgtcttcggcatggaaggcctcgccggggcagtggtgtccctagtcctcgtcggactatcactgatggcaacgggcgcgaccaccggcctgctatcgggaaagccaccgggaatccgcgcggtgcgtcagctgtcgatcggctacggcgcggcgctggtcacctacgtgctcggcctcctgttcggcatgatcctt

SEQ ID NO: 2503 - DNA, 729 bp, Corynebacterium glutamicum
gtgagtgaattccaagtacccgaaatccctgcccaattcctacccaagcatattgcgcttgtcatggatggaaatggacgctgggctaccgagcgtggcatgaagcgcaccgaaggccataagcgtggcgaggcagtcctgcttgatgttgttgatgcatgcattgaacttggtgttccgtacctttctgcttatgccttctctactgaaaactggcgtcgttccaccgatgaggtccgtttcctcatgggattcaaccgagatgtgctgcgacgacaacgcgatgacctacatgaaaagggcgttcgtgtgcgttgggttggccgtcgtccccgcctgtggcgttcggttatccgtgagctggaaactgcggaagagctaaccaaagacaacaccaccatgaccttggccatgtgtgtgaactatggtggacgcgccgaaatcatcgacgcagcccgcgacatcgcccgccttgcagctgaaggcaaactgcgcccggaacaaatcactgagaagaccttcccgaacttcctcgacgaacctgacatgccagacgtcgacctgttcctgcgcccatccggtgagaagcgcacgtcaaacttcctgctgtggcagtctgcctacgcggaaatggtctaccaagacaagctgttccctgatttcacgcagcaagatctgtacgacgcggtcctggaatacgccaagcgggatcgcagattcggaagcgca

SEQ ID NO: 2504 - DNA, 726 bp, Corynebacterium glutamicum
atgcgtagggacagttttcgggaccgcgcgctagtagtcaaaacttatgattttggcgaagccgaccgcattattgtgctgctcacccgagaccacggcatcgtgcgcggagttgccaaaggagtacgccgatccaaatcccggtttgggtcaaggctgcagctttttgtggaactcgacgtgcagctctacccaggtagaaaactgtccaccatctctggcgcggacaccgtcggctactacgcatcaggcatcatcgaggacttcactcggtattcctgtgcgtccgccatcctggaaatcgccacccacatcgcaggactggaaaacgatccgcacctgtttgaagaaaccacccgggcgttgaaaaacattcaggactccccagaacccatcctcaacctagacgagttcatgctccgcgccatgaaccacgccggctgggcaccaagccttttcgactgcgcagcctgcggccgaccaggacctcacaacgcattccacccaggcgtcggcggggcagtgtgcctgtactgccgaccgccgggaagcgccgaagtcccaccagaagcactacacatgatgtggttggtcgccaacggccaagcagcccgcattccccgggaacacccagagcagcaaaccaccattcaccaactgacaaccgcgcatctgcagtggcatattgaaagaaagctgcccacgctggcggtgctggatcaggcc

SEQ ID NO: 2505 - DNA, 915 bp, Corynebacterium glutamicum
atgagctttaccgatacccctgatggcttccgctccggcttcgtcagcttcgtgggacgtcccaacaccggcaagtccaccctgaccaacgcgctggtcggcgagaaaatcgccatcaccgcaaaccagccagaaaccacccgccacccaatccgtggcttggtccaccgcgacaacgcacagatcatcgtcgtggacaccccaggcctgcaccgcccacgcaccttgctgggtgagcgcctcaacgaagcagttaaagacacctacgctgacgtcgacctgatcggtttcaccgttccagcaaacgagaagattggtcctggcgaccgctggatccttgaagcagtccgcaaggtatcgcctaaaactcctatcctcggcatcatcaccaaagcagacagcgtctcacgtgacttggttgcggcccaactgatggctgtccatgagctgctcggcggaaacagcgaggtagtcccagtgtcttccacctcgggggaaaacgtcgaaacgcttattaaggtcatgaccgacctgctgcctgaaggccccaagttctacccggatgatcacatcaccgatgaggacaccaacacccgcatcgcggaagccatccgcgaagcagcactgtctggcttgaagaacgaactgccgcactccgtcgcagttgaggttgatgaaatcctgccagacccagaacgcaacggtgtcctggctgtgcacgccatcatctacgtcgagcgtgttggtcagaaagacatcatcgtcggacacaagggacagcgcctggggcgcatcatccacacctcacgccaagacatcatcaagatcctcggccaaaacgtattccttgacctgcgcatcaaggtgctgaagaactggcaatccgatccaaaggctttgaaccgcctgggcttc

SEQ ID NO: 2506 - DNA, 1320 bp, Corynebacterium glutamicum
gtggaatcctcagttatatggttgagcatcgccacagtcgttgcgttgctcttctccggtttattaggtgcggttgaatctgcgctttcttctgtttcccgcgcccgcgttgaacaaatgctcaaggatgaagcctccgggtccgcgtccttgctgcgagtcatcgacgaacgcgcactccacatcaacatgctcatcatgttgcgcaccttgctggatgcctccgcagcagtcttcgccggggcaatcgcagtcaatgtgatggacagctgggcgtggggcatcgtcctggccatcgtggtggtttccctcctgaccttcgcagtagtgggcgtgtttggccgcaccgttggccgcaaaaacccatattcagtgatgcttcgctccgcagtcgtgctgagcggtttagctaaaatccttggccccattgcacgtggcctcatctggatcggcaacatcatcgcgcccggcccaggtttccgcaatggcccttacgccactgaagtggaactgcgtgagatggtcgatatcgcccaagaacacggcatcgtggaaattgaagagcgccgcatgatccagtcggtgttcgacctggcatccacgacggttcgccaggtgatggtgccacgtcctgaaatgatctggattgaatctggaaaaacagccgggcaagcaaccgcgctgtgcgtgcgctctggtcattcgcgcatcccagtcatcggtgaaaacgtcgacgacatcatcggcatcgtctacctcaaagacttggtccaaaaaacctactacgccactgatggcggaaagtctgtgcttgtagacgaggtcatgcgcgaagctaccttcgtgccagactccaagtcccttgatgcgctgctgcaggaaatgcaggaagaccacaaacacatcgcaatcctggttgatgaatacggcggcgtggcaggtcttatttccattgaggatattttggaagaaatcgtcggtgaaatcgctgatgaatatgacgcccgcgaagtagcccccatcgagaaaatcggcgaccgcacctaccgcgtggtctcccgactctcgctggaagatctcaaagaccacatcgaagaagaactcgacctagaaatcgaattcggtgatgaaattgaagatcaggtcgacactgtcggtggccttattgcctttgaacttggccgagtgcctctgccgggtgccactgtggaaacctgcggactaaagctcaccgccgagggagccaagaaccgccggggtcgtttgcgcatgcattcagcagtcgtagaagttggcgagcccagcgaggacaacgaaggt

SEQ ID NO: 2507 - DNA, 588 bp, Corynebacterium glutamicum
atgagcattgaggtattcaacgaatcaggatacgacggcgtcaatgaagaaatgctcattgatgtcctctccttcgcactcggggaaatggacatccaccccgacgccgaagcatccatccacatcgtcgacgtcgacaccatcgccgatctccacgtgaaatggcttgatcttgaaggcccaaccgacgtgatgagcttcccgatggatgagctcacccccggctactcccgccccgacggcgccacccccggccccgccatgctgggcgacattgtgctgtgcccagagttcgcggcaaagcaagcgaccaaagcaggccacgacttagcccacgagctagctttgctgaccgtgcacggcagcctgcacctgcttggctacgaccacgtcgatccagccgaagagcgtgaaatgttcgcccttcaaaacgagctgcttgccgattggtacgacaacgtcgaagcccgtggcgtcacctaccagccaaaaccatccggcgccggtgcattccccaccgctgctgatcgtctggaattggacgaaaagatggaagcggatgactctggctttggaggcgttgagtcc

SEQ ID NO: 2508 - DNA, 264 bp, Corynebacterium glutamicum
atgtgtccaaccagttggtggcggaccacgtcggatgaggtgagctcggagaagtgcacatcgtctactccgcgcaggatgtggcgaaccaggcgcaggccggacttttggcctcctgggaggtccacctgggtgatgtcacctgtgactaccattttggaaccgaatcccaggcgggtgaggaacatcttcatctgtgctggggtggtgttctgggcttcatccaggatcacgaatgcatcgttgagggtgcgtccgcgcatg

SEQ ID NO: 2509 - DNA, 1050 bp, Corynebacterium glutamicum
ttgaacattccgaaagcaggccgaactagcactgtgactgccccgcgaaaaacccgcacagaagtaatcaccactgtcctcaatctagaacgcacgctcgcgcaaaccgttttaggaatcaacgacgaaaacctgcgtgtgttggacaatcaaattgattgcgatattcacgtgcgtggcacccacgtggaactcaccgggccagcccacgaagtctcccgcgcctcgaaaatatttgaggaactgcaggcgattgcccgtcgaggacatgtgattagccctgagacagtaaaaaatgtcatcagcatgattaacgtggagacgccgcaaaccgtctctgaaatcttgaccggcgatatccttgctcgccgtggcaaagtgatccgccctaagacgcttggccaaaagcactacgtggacgcgattgataccaacacgattgtgttcggtctgggcccagccggttccggtaaaacctatctggccatggcaaaagccgtccaagcgctgcaatcaaagcaggtcagccgcatcatcttgacccgccccgcagtggaagccggcgagaaactcggcttcttgcccggcaccctgaacgaaaagatcgacccctacctgcgcccgcttcacgacgcgctgcgcgacatggtcgaaccagaagtcattccaaaactcatggaagccggcatcgtagaagtcgccccacttgcctacatgcgcggacgcaccctcaacgatgcattcgtgatcctggatgaagcccagaacaccaccccagcacagatgaagatgttcctcacccgcctgggattcggttccaaaatggtagtcacaggtgacatcacccaggtggacctcccaggaggccaaaagtccggcctgcgcctggttcgccacatcctgcgcggagtagacgatgtgcacttctccgagctcacctcatccgacgtggtccgccaccaactggttggacacattgtggatgcatacgaagactatgaagaacgcgaggcccgcgaattgaaacgcaaacgccaggagacacggcca

SEQ ID NO: 2510 - DNA, 723 bp, Corynebacterium glutamicum
atgtcactgccagtatttatctctgattccgcagccggaccaggcgaaaccattgagctcgccggtccggaaggccggcacgccgtcaccgtcaaacggatccaggtaggcgaaaagatttcgcttatcgacggccggggtacagcgcgcacctgcacggtcaccgccttgcagggcaaagaccgcctgaacgctgtggtggatttggtcgaggaaatccccgcaccgaacccacaggtcaccatcgtgcaggctatccccaaatcagagcgttccgagctgaccatcgacctgctcacccaagctggcgccgatcggattgttgcgtggcaagcatcgcgctgcgtagcaaaatggggcggcaaggaagcaaaatcactggctaaatggcaggtggctgcggaagcagccgccaagcaatcgcggcgcgcaacgatccctgaaattcttggcgtagtgggggaggagggcgtcgaaaagcttatcgacgaatccgacctggccatcatcctgcacgaagaagcaaccgccgcgatccgtgaactggaattttccggcaacgtcgtggtgatcatcggacccgaaggtggcgtcgcgccatcggaaatttcacgcttcgtcgacgctggcgcacacaccgtgaaactaggccctgaggtgttgcgcactgcctccgcaggcatggtggcgctcgcagctatcggcgtgctgtctgaccgctgg

SEQ ID NO: 2511 - DNA, 942 bp, Corynebacterium glutamicum
atgcgccatgaggttgccgtggccttctgcgcgcagcttcggcatgccttcaccatccaaggtgatcacatcgttgggctgagtacctgcagggatggtaattttcacctcttcgccggtgagggattccacgtccaattcggtgccaagcgctgcatcgaacattggaaccttgatgctggcgtgcagatcgtcgccatcgcgggtgaagatggcgtgcgggcgcaccatgacttcaatgtagaggtcacccgcaggaccgccaccagcgccaacctcaccttggcctgccatgcggatgcgcatgccggactggatgccagctgggatgttggccacgatgtcgcggcgagcacgcacacgaccatctcctgcacactcagtgcaaggatctgggatgatctcaccggtgccatcgcaggtgtggcatgggcgggacgtcatgacgttgcccaggaagctgcgctgcacttcctgaatttcaccagcgccattacaggtgccacaggtaacaggcttcttgtcggatgcagatccagaaccatgacacttggtacacagcactgcggtgtcaagggtgagatctttcttagcgcccttgtaagcctcttccaaggtgatggaggtgcgccacaaggtgtcactgcctggctgcacgcgggaacgtggtccacgggaaccgcccgcgccaccgccgaagaaggcatcgaagatatcgcccagtccaccgctgccgccgaagcctccaccgaagccaccagcgccagctccgccgccttgctccattgggtcaccgcccatatcaacaatgcggcgcttatccggatcagtgagtacctcatgcgcaacagaagcctcgcggaatttctccgctgcttcctcacctgggtttacgtccgggtggtatttgcgggcaagctttcggtatgcctttttgatctc

SEQ ID NO: 2512 - DNA, 1146 bp, Corynebacterium glutamicum
gtggcacgtgactattacggcattctcggcgtcgatcgcaatgcaaccgaatcagagatcaaaaaggcataccgaaagcttgcccgcaaataccacccggacgtaaacccaggtgaggaagcagcggagaaattccgcgaggcttctgttgcgcatgaggtactcactgatccggataagcgccgcattgttgatatgggcggtgacccaatggagcaaggcggcggagctggcgctggtggcttcggtggaggcttcggcggcagcggtggactgggcgatatcttcgatgccttcttcggcggtggcgcgggcggttcccgtggaccacgttcccgcgtgcagccaggcagtgacaccttgtggcgcacctccatcaccttggaagaggcttacaagggcgctaagaaagatctcacccttgacaccgcagtgctgtgtaccaagtgtcatggttctggatctgcatccgacaagaagcctgttacctgtggcacctgtaatggcgctggtgaaattcaggaagtgcagcgcagcttcctgggcaacgtcatgacgtcccgcccatgccacacctgcgatggcaccggtgagatcatcccagatccttgcactgagtgtgcaggagatggtcgtgtgcgtgctcgccgcgacatcgtggccaacatcccagctggcatccagtccggcatgcgcatccgcatggcaggccaaggtgaggttggcgctggtggcggtcctgcgggtgacctctacattgaagtcatggtgcgcccgcacgccatcttcacccgcgatggcgacgatctgcacgccagcatcaaggttccaatgttcgatgcagcgcttggcaccgaattggacgtggaatccctcaccggcgaagaggtgaaaattaccatccctgcaggtactcagcccaacgatgtgatcaccttggatggtgaaggcatgccgaagctgcgcgcagaaggccacggcaacctcatggcgcatgtcgatctatttgtgccaaccgatttggatgaccgcacccgcgaattgcttgaagaaatccgcaaccatcgcagcgacaacgcttccgtgcatcgcgaaggcggagaagaatccggtttctttgacaagctccgaaacaagttccgcaaa

SEQ ID NO: 2513 - DNA, 1023 bp, Corynebacterium glutamicum
gtgagtgcaacagagaaacgtagatacgaagtgttgcgggccatcgtcgctgattacattgcgtctcaggaacctgtcggatcgaagtcactcctcgagcgccataagctcaacgtgagttctgcgacgatccgcaacgatatgtcggtgctggaatccgatggctttatcgtccaggagcatgcaagttctggccgggtaccaaccgaaaggggttaccgcctttttgttgattccatccatgacatcaaaccgctgtcgctggcggaacggcgcgctattttgggcttccttgaagggggagtggacttagaggacgtgctgcgcagatctgtgcagctgttgtctcagctcacccatcaggctgccgtggtgcagctgcccaccctgaaaacagcgcgcgtgaagcactgcgaggtggtgccgctgtcgccgatgcgcttgctgctggtgctcattaccgatactggccgtgtagatcagcgcaacgtggaacttgaggaaccgctggcggcggaagaagttaatgtgctgcgcgatctgctcaacggcgcgctaggggagaaaacgctgacggctgcatcagatgcgctggaagagttggctcagcaagccccaaccgatattcgtgatgccatgcgccgctgctgcgatgtgctggtgaacacgcttgtcgatcaaccctctgaccgcctgatcctcgccggcacctcaaacctcacccgcttaagccgggaaacctccgcgagcctgcccatggttttagaagccttggaagagcaggtggtcatgttgaaactgctgtccaatgtcactgatcttgaccaagtgcgcgtgcatattggcggcgaaaatgaagacattgagctgcgcagcgcaacggtgattaccaccggttacggctcccagggcagcgcactgggcggattgggggtggttggccccacctatatggactactcgggaacaatttctaaggtgtccgccgttgctaagtatgttggtcgtgtgctcgctggcgaa

SEQ ID NO: 2514 - DNA, 990 bp, Corynebacterium glutamicum
gtggcttcgctggataatcctcggcaggcggaaactatctttattggcgggggtaccccgtcgttgattggtgcggacggtttggccagggttttgggggctgtgcgcaatacttttggcattgcggatggtgcggaagtcaccacggagtccaatccggagtctacctcgcctgagtttttcgatggcctgcgtgaggcgggctacaacaggatttcgttagggatgcagtcggcgtcgtcaagcgttttgaaggtgctggaccgcacgcacaccccagggcgcccggtggcggcggccaaggaggcacgtgaggcggggtttgagcatgtcaatttggacatgatttatggcacgccgacagagaccgatgatgatgtccgcaagacgctggatgcggtgctcgaagcgaacgtggatcacgtgtctgcctattccttgatcgtggaagatggcacggcgatggcgcgcaaggtgcgcaagggcgagctgccagcgccggacgaggatgtctacgctgatcgttttgagcttatcgacgctcgcctgcgctcagctggtttcgattggtacgaggtgtccaactgggcgaaacccggcggagaatgcaagcacaacatgggctattgggtcgacggcgactggtggggcgcgggcccgggcgcgcactcgcacatcggcgaccgccgcttctacaacatcaagcacccagcgcgttactccgcgcagattgcggccggcgagctgcccattaaggaaacagagcggctgacggcggaagatcaccacaccgagcgcgtcatgcttggtttgcgcctgaaacaaggcgtgccgctgaaccttttcgcacccgcagcgcgcccggtcatcgaccgtcatatcgcagggggcctgctgcacgtcaatgcgctgggcaacctggcggtgaccgatgcgggacgtttgcttgccgacggcatcatcgccgacattttgcttagtgaagaagac

SEQ ID NO: 2515 - DNA, 519 bp, Corynebacterium glutamicum
gtgcagggtatgaaacggaagatggtcgcagcggcgctggcaacagcgcttctttttggggctgcacctgcgcacgcttccgaattggtagagcccaccacagttgcagagtcagtggcactcgatcccaacaaagcaatcaatattctcaccccagatctctgggaagacattgaggcaaaaccaggcgatatcgtccacatcccctaccagggcacccgaaactacgaggacctcaccgtagaagtcgcgaaacctttcgaagatttccaaatcctcgtcggactcgacaacagcatcgtcatcgcagtgccaaagaacttaagtggcgcagcatcagtcgccccagttttcactgtctctgacaaaaacggtgagatcgactctttcaccatcaaagtaagcgtcgagccacgccgccaaagcgacgaagaaaagcgctccgcactatttgatgtcatctctgagcttgcctaccgcatgcctcatctgccattcgtgtcagagttgctgaagtac

SEQ ID NO: 2516 - DNA, 693 bp, Corynebacterium glutamicum
gtgtgttggaacgcgatgagcagtacaaccgcacagctacgccaccgagagctgacccaggagatctacaacatcggcgacgaggtcgctgaatacattgagcacatcatggaagcagtctccgactgggatctggagctcgtggaagattgcctcgctgaattcgatgagatcatcactgaagcccgcgatgactcccgcactgttgtggctgaactttcaggcctgcgtcacgcactaaccactggtatccgtcagggcaccgtgagcgctagagccacggtggaggtggacgtcgataagccggaacgcctgaccgcctccgagctggagcgcgacttcgatattgatgccggcctcgttgatgtacgcgatctgtcgaccgcgctcaatgcgcgcacagacgctgtggttaagcgcctggaggccactgtggagtgggtgctggcggaaactgacaaggtggccaacgatctggattccctgtctctgccactgctttatggccgcgttgcagcggtgatcgaaagcgccaccagcgcatggatcaacgcagtgggcaccgccaatccggcgtatgtgcgcaccatgcgaggcagcaacccgccacgtttcctgcttgagcgtgcgcgtatcgacgctgtcgtggcccgggttgcagacaagcttgcgcaaaagcgcaacgctgtttcc

SEQ ID NO: 2517 - DNA, 378 bp, Corynebacterium glutamicum
atgagtaacacagagacccaatttgattgggatggatcgacatggacccgcaccgaagtcggcgaagcaccaacacgcttcgctgtgggcgtgatggaggatttcgcctacattgcagccactggcacggacggggatgaagagttctttactttgggctcaaatccgggtctgacgtttggtgatcccgagtggcttttcgctcaggataatccgcagtatgtggtggagtgcattggccagcagggaaccgagccggcagccctgaaggttgtagataaatatttgtcgcgactatctgatgaggagtcacgtggcgaacccacgcggattctcaatgaattggtctcggcgatggagttgccggcattgccgtgg

SEQ ID NO: 2518 - DNA, 1845 bp, Corynebacterium glutamicum
atgacttcacctaataccctgcaggaatacactgaacctgccaagtacaccatcggagaatctgaaacctgcctgaccgcccttctagatcagattaagactcgaccttacggagttttgttcagcaagcctgccaactatgagtgggtgaatgtaactgccaaagaatttcaggacgaggtttttgcggttgcaaaaggaattatttcagtcggcgtagagcagggagaccgtgtcgcgctgctgtccaatactcgctatgagtgggctgtgcttgatttcgctatctgggccgctggcgcagtgagcgtgcctatctacagctcctcttcactgtcccaaattgagtggatcattgaggattccggcgctgttttggccattaccgaaacccctgatcataccgacttgatgaagaacctggtcatcggtgaagacggaactccagcgattaagggttcaccttccaagctgcgccgcattctagagatcaactcttcggcgttggagaccttgaagtttgagggccgcgagctttctgatgagctggtgtgggaacgcattcatgcaaccaaggccgctgacctggcgtctttggtgtacacctctggcacaactggtaggccgaagggctgcgagttgtcccactaccactggttggctgaggtccgagcgctgatcaccaatgacatcggagcgatcgcgatgccaggttcaaggttgctcaccttccttcctttggcgcacgttcttgctcgcgcagtgcacttggccttcgctgtcaccggtgcaacccagtcccactggtctgatttcagcacccttactttggaactgcagcgttcccgcccgaacctgattttgggtgttccacgcgtgtttgaaaaggtccgcaacgccgctgctgctaatgctgctgacggtggcgcaatcaagcgcatcatgtttgagcgtgccgaaaaggcggccattgaatactccatggctcttgatactgcagaaggcccaagcaagtcccaggttatggcacataaagcgtttgacaagctggtgtactccaagatccgtgcagctgtcggtggcgatgtgcagtacgccatcaccggtggttcagcgatggggcaggagctgctgcacttcttccgcggtgtgggcatgaccatctacgaaggttatggtctgacggaatctgcggctgctgcagcggtggacttcactgatcaaaagatcggcactgtgggtaagccgatgggtggcatgaccatcaagatcaatgaagatggcgaaatcatgctaaaaggcgagatgttgttccagggatattggaacaacccagaagccacagcagaagccctccacgacggttggttcaacaccggcgatctgggtgagctgttggagtctggacacctggtgatcaccggacgtaagaaagatctgatcgtgaccgcgggcggcaagaacgtttccccaggacccatggaagacatcatccgcgcacacccactggtcagccaggccatggtggtgggcgatggtaaaccattcgttggcctgctggtgaccttggatccagatatgttgaagcggtggaagctgaaccacaacattgcggaatcccgcacggtttctgagattgctactgatcctgcactgcgtgcggaaatccaggatgcagtcaacaacgctaatgccacggtgtctcattcagaggcgatcaagcggttctacatccttgatcgcgacctgaccgaggaagccgacgagctgaccccaacgctgaaggtcaagcgcaacgttgttgttcgccgttacgcagacgccatcgaccacatctacaaccga

SEQ ID NO: 2519 - DNA, 2118 bp, Corynebacterium glutamicum
gtgactgctcgcagatttttgaatgaactcgccgatctctacggcgtagcaacttcctacactgattacaaaggtgcccatattgaggtcagcgatgacacattagtgaaaatcctgcgtgctctgggtgtgaatttagatacaagcaacctccccaacgatgacgctatccaacgccaaattgccctcttccatgatcgagagttcactcgcccactgcctccatcggtggttgcagttgaaggtgatgaactagttttcccggtgcatgtgcacgacggttcccctgcagatgtccacatcgaattggaagacggcacgcagcgggatgtttctcaggtggaaaactggacagcgccacgggaaattgatgggattaggtggggcgaggcatcgtttaagattcctggtgatctccccttgggttggcacaagcttcaccttaaatccaatgaacgctcagctgagtgcggtttgatcatcaccccggctcgtctgtctactgctgataagtatcttgattcccctcgcagtggtgtcatggcgcagatctactctgtgcgttccacgttgtcgtggggcatgggtgatttcaatgatttaggaaacttggcaagtgtggttgcccaggatggagcagacttcctgctcatcaaccccatgcacgctgcagagccgctgcctcctactgaggactctccttatctgcccacaaccaggcgctttatcaacccgatctacattcgggtagaagatattccggagtttaatcagcttgagattgatctacgcgatgatatcgcagagatggctgcggaattccgcgaacgcaatctgacctcagacatcattgagcgcaatgacgtctacgctgcaaagcttcaagtgctgcgcgccatttttgaaatgcctcgttccagcgaacgtgaagccaactttgtctccttcgtgcaacgggaaggccaaggtcttattgatttcgccacctggtgcgcggaccgcgaaactgcacagtctgaatctgtccacggaactgagccagaccgcgatgagctgaccatgttctacatgtggttgcagtggctatgtgatgagcagctggcggcagctcaaaagcgcgctgtcgatgccggaatgtcgatcggcatcatggcagacctggcagttggtgtgcatccaggtggtgctgatgcccagaacctcagccacgtacttgctccggatgcgtcagtgggcgccccaccagatggatacaaccagcagggccaagactggtcccagccaccatggcatccagtgcgtcttgcagaggaaggctacattccgtggcgtaatctgctgcgcactgtgctgcgtcactccggcggaatccgcgtggaccacgttcttggtttgttcaggctctttgtcatgccacgcatgcaatcccctgctacgggcacctatatccgcttcgaccataatgcgttggtaggcattctagccctagaagcagaactcgcaggcgccgttgtcattggtgaagatctgggaacgtttgagccttgggtacaagatgcattggctcagcgtggcatcatgggcacctcgatcctatggttcgagcattccccaagccagccgggtcctcgccgccaggaagagtatcgtccgctggccttgaccactgtgaccactcatgatctccctccgactgctggttatttggagggcgagcacattgctcttcgtgagcgattgggggtgctcaacactgatcctgctgcagaactcgctgaggatctgcagtggcaagcggagatccttgatgtcgcagcatctgccaacgcattgccagcccgggaatacgtgggactcgaacgcgatcagcgcggtgagttggctgagctgttggaaggcctgcacactttcgttgcgaaaaccccttcagcactgacctgtgtctgcttggtagacatggtcggtgaaaagcgggcacagaatcagccgggcacaacgagggatatgtatcccaactggtgtatcccactgtgtgacagcgaaggcaactccgtgctcattgaatcgctgcgtgaaaatgagctgtatcaccgtgtggcaaaggcaagcaagcgagat

SEQ ID NO: 2520 - DNA, 1863 bp, Corynebacterium glutamicum
atgcgacttcttggtcgaattttaaaaaccacgtctgcgctttggccctactatctcggaattatcgtcgtatccattgtgatcgcggcgttgtcgctgctgtcgccgtttattctccgcgaagcaacagattccattgtttctgcagtaaccggatctaacaccgtcgatgcagttactcgcactattattttcttagctttagccctgtttgtcgcaagcttcctcaatacggtgatgaccaacatcggtggctacatcggtgatgtcatggcatctcgtatgcgccagattctggccacgcgctattacgcaaagctgttggcgctgcctcagaagtattttgataatcaggtcaccggcaccatcatcgcccgccttgatcgatcaatcaacggcatcacgcagttcatgcagagcttctccaacaacttcttccccatgctcatcaccatggtggcagtgctgattatttccgcgattttctactggcctctggcaattctgctggccatgttgttcccgatttacatgtggctgacggcgttgacatcgaaacgctggcagaaatatgagggcgagaaaaaccatgaaatcgacgtggctaacggccgcttcgctgaggttgtcggccaggtcaaggttgttaaatcattcgtcgcagagacccgcgagctggctgatttcggtgggcgttacggcaaaacagtagcgattacccggccgcaatccggttggtggcaccgcatggatactctccgtggcgcggcactaaatatcatcttcctggccattcacctgctgattttctaccgcaccttgcacggccatttcaccatcggcgacatggtcatgctcatccagcttgtcaccatggcgcagcaaccggtgtacatgatgagctacatcgtcgactccgcgcagcgcgccatcgccggctcccgcgactacttcgaggtcatggcgcagcaggtcgagcccaccgccaataaggagcttgtcgacgccaccctcgcctcagacactccacgcatcagtgtgggcacgcccgccgcgctgcccgctggagaaccagcgatggaattcaaaaacgtcaccttcgcctacgaagaaggcaagccggttatttccgacgtgtccattaccgcccgccacggcgagcgcatcgcgttggtcggtgaatccggcggcggtaaatccaccctggtcaaccttctgttaggtctgtacaaaccaaacagcggcagccttgcagtatgtggcgtggatgttaaagatctgacttccgaggaacttcgcgcatccgtgggtgtggtcttccaggacgccagcttgttctctggatctattgcagaaaacatcgcctacggtcgcccaggtgccacccgcgaagagatcatcgaagtggctaagaaagccaacgcacatgagttcatttccgccttccctgaaggatatgaaaccgtcgtcggtgaacgcggactcaaactttctggtggccagaagcagcgcgtctctgtggcacgggccatgcttaaagatgccccacttcttgttctcgatgaagccacctctgcactggataccaagtctgagcaggcagtccaagccggtttggaacagctgatggaaaaccgcaccaccttaatgatcgcccaccgcctgtccaccatcgcaggcgtcgataccatcgtgaccatccaaaacggacgggttgaagaggtcggatctcctaccgagctcgcagtctcaggcggtatctattccgaactgctgcgcctgaccaactccacagcagaagccgaccgggagcgtctgcgcgcctttggtttcactggcgatgcaccagctgaagaagaggac

SEQ ID NO: 2521 - DNA, 255 bp, Corynebacterium glutamicum
atgttttctgcaatagatccagagaacaagctggcgtcctggaagaccacacccacggatgcgcgaagttcctcggaagtcagatctttaacatccacgccacatactgcaaggctgccgctgtttggtttgtacagacctaacagaaggttgaccagggtggatttaccgccgccggattcaccgaccaacgcgatgcgctcgccgtggcgggcggtaatggacacgtcggaaataaccggcttgccttcttcg

SEQ ID NO: 2522 - DNA, 333 bp, Corynebacterium glutamicum
atggtcacgatggtatcgacgcctgcgatggtggacaggcggtgggcgatcattaaggtggtgcggttttccatcagctgttccaaaccggcttggactgcctgctcagacttggtatccagtgcagaggtggcttcatcgagaacaagaagtggggcatctttaagcatggcccgtgccacagagacgcgctgcttctggccaccagaaagtttgagtccgcgttcaccgacgacggtttcatatccttcagggaaggcggaaatgaactcatgtgcgttggctttcttagccacttcgatgatctcttcgcgggtggcacctgggcgaccg

SEQ ID NO: 2523 - DNA, 180 bp, Corynebacterium glutamicum
ttggaacaccacaatcctccggaaagggacaagaaccacaccatggctaacccagaagagctccgcaagagagaccaagaactcccgaagcgtaagcgcaagtacccacagtcacgcgttacccaagcgctcgtggtgttgctggtcatcgttgttattgcgtggcttgtttccttgatc

SEQ ID NO: 2524 - DNA, 204 bp, Corynebacterium glutamicum
atgactgcattcctcgaccggatctcacagctgcttacaacatcaccgctgtggatccagtcaccgatcgtcatcctaggatcagtagtggtctgcgcgttgctagcagtacttctgctccgcgtagtcgacatcctcggcgcctgggtgcagcgaattggaacaccacaatcctccggaaagggacaagaaccacaccatggc

SEQ ID NO: 2525 - DNA, 2034 bp, Corynebacterium glutamicum
atgactgttgaacacctgctcaagcccagcaccttgccctaccagctgcccgatttcgcagcgatcaaggtggctgatttcccgcccgccttcgaactcgcattagctgaacacgatgctgaaattacagcgatcgctaccaatgaggacgctcctacctgggagaacaccattgaggccctggaacgcgcaggcctgtccctcaaccgcgtcgccgccgtattcttcaacttgcagggcaccgattcctcccctgaaatggatgaaatcgcagccactatcgcgccgaaactctccgcgcattcggatgcgattttccacaatgctgcgcttttcgcgcgcattgaggccgtagaagcaccggccgacgaggaatcgcaacgcctgttgtcccacaccaagcgcgcttttcgacgtcgcggtgcagcactcaacgccgacggcaaggcccgactgagcaccatcaaccagcgcctatcggcactgtccgaacagttcggccgcaacctgcttcaggacacccgcgatctggcggtcaactttgaagaatctgaacttgccggttttagcgaagcccgcatatccgccgccgctgactacgcagcagcagttggcaccgaaggctacgtggttccactggaactgcccaccgtgcagtcagagcaggcagtattaaccgaatccgcctcgcgtgcaaagctttatgaagcctcccagaagcgtggcgccagcctgaacaaggacgtgctgctcgaaaccgtgcgtctgcgtgctgaacgcgccacacttttaggctacgacacccacgccgattacgtcatcgaagaagaaaccgccgatgacgtcgcagccgtgcgcgccttgctttatgatctcgccccagccgcctctgccaatgcgaaagccgaatacaaactctccgcagaagaagcagaagaacacggccaaaaagtcggcgcagctgactggagcttctgggaagccaaagtccgcgcccgcgactacgccctggacgaaaccgaactgcgcaactacttcccattgaaccaagtactccgtgacggcgtcttcttcgctgctaaccgcctctacggaatcaccgtggaaccacgccctgacctgcgcggttacgccgagggcgtggacgtctgggaagtcctcgattctgacggctccggcatcggcctgatccttaccgactactacggccgaccatccaagcggggcggcgcttggatgtccagctttgtcgaccaatccgagctgctaggcaccaagccagtcgtggtcaacgttatgggtattaccaaaccaaccaccggcgaagcactactcagcctcgatgaagtaaccaccatcttccacgaattcggccacggcctgcacggcttgctgtccaaggtgcgctacccaagcttctccggaacctccgtgccccgcgactacgtagaattcccctcccagatcaacgaaaactgggcattcgaccctgcagtagtccgcaactacgcccgccacgtggacaccggcgacatcattccagactccctgcttgaggcagtggaagcatcccgccaattcggacaaggttttgccacctccgaatacttggcagcatcgattatcgacctggcctggcactccctgtccacagcggaagccgcagcagtcaatgacattgaccaattcgaagccgacgcactagccgcagcaggcctcgacgtggacaacattgcaccgcgctaccgatccacctacttcaaccacatctttgctggcggctactcagccggctactactcctacctgtgggcggaagcactcgacgccgacggcttcgactggtttcgcgaagaaggcgcagccggatccgtggcttccctcgacgcagcccgcaccgccggccagaaattccgtgacctggtcttatcccgcggcgcagcctccgactacagcaacgccttcgaagaactccgtggccgttccaaagacctcggcccacttctgcgccgccgaggtctggctggggcaatc

SEQ ID NO: 2526 - DNA, 1179 bp, Corynebacterium glutamicum
atgtctgccacctcttccgtcaccgttgaatgcccggcgggaaccatcaccggcgagccccattatttccgctcgattccctacgcaaaggcgcgcccgtttgctgatgccgaaaagctagaacccctgcgcattgatgcgaccggcaagcacgagggtctctatttaacgttggcaaccccggaggcacggttcggcgcggatgccccggtgatcgtttatatccacggcggaggatatgacggtggcacgcgtttcgatgcccgcaccgagcccactttcttccgtgagcagggctttgtggtggtctccatcgattaccgcgtcggcctggagggctttgcgcgcttccacgacgacgaggccaatcgttaccgcggcatcgatgattgcgtgctcgcgctggagtgggtgcagaaaaacatcgagcatttcggcggcgatcccaccaacgtcaccctcatcgggcagtccgcgggcgccggcatcgcgctctggctcacgcgcctagaccactataaaggtgcttttcgacgcctggttgcgctctcccccagcttcccgcgccagccattcgctgcccgaaaaggtgctttacgacgcgccctgggcaaacccgtcacccgcgcctcgctggcgggcatcaagcccgcacgcttggacaaaggctaccgtcgctttgctcgccgctacttcaccgacctggcactcggccctaccccatacgacccgaatgagctggccgacatcgatttgatcatctcctccacccgcgatgaaatgtacggacaccgcgcaggcttatggttcgaccagcgtggcttcggcgcaaaactggccgcgcgactttttggcctggagaattcggatacctatattaaggaagcccgcaagatcgacaaccgcgttgtaggccgcatgattggtgatgccgtgatccgccgctacgtcgcgcaaaccgaaaaaggttggtggatggaatttcccggcaagcactgcgatgacctgtccttggtcttcttggaagattccgaagcacatcaccacatcgcctccttcgcccgcggggctacgccatcgtggcctcaatattccgaagaaaaccgcgcagctctctcactagtctcaggtgaggcgaaagtggtgaaagacccgctacgcatggtgcgcctggctttt

SEQ ID NO: 2527 - DNA, 1794 bp, Corynebacterium glutamicum
ttgaattctcagccgagtgcagatcaccaccctgatcacgcggctcgcccagttcttgatgcccacggcttgatcgttgagcacgaatcggaagagtttccagtccccgcacccgctcccggtgaacagccctgggagaagaaaaaccgcgagtggtacaaagacgccgttttctacgaagtgctggttcgtgccttctacgatccagaaggcaacggagtcggatcgttgaaaggcctgaccgaaaaactggattacatccagtggctcggcgtggattgcatttggatcccaccgttttatgattccccactgcgcgacggcggttacgatatccgcaacttccgtgaaatcctgcccgaattcggcaccgtcgatgacttcgtggaactcgttgaccacgcccaccgccgtggcctgcgtgttatcaccgacttggtcatgaatcacacctccgaccagcacgcatggttccaagaatcccggcgcgacccaaccggcccctacggagatttctatgtgtggagcgatgatcccaccctgtacaacgaagcccgcatcatctttgtagatacagaagaatccaactggacctatgatccggtgcgtggccagtacttctggcaccgcttcttctcccaccaaccagacctcaactacgacaaccccgcagtccaagaggccatgctagatgtcttgcgtttctggctggacctgggacttgatggtttccgactagatgccgttccttatctttttgaacgcgaaggcaccaacggcgaaaacctcaaagaaacccacgatttcctcaaactgtgtcgctctgtcattgagaaggaataccccggccgaatcctgctcgcagaagccaaccaatggccccaagatgtggtcgaatacttcggtgaaaaagacaaaggcgatgaatgccacatggccttccacttccctttgatgccgcgcatcttcatgggagttcgccaaggttcacgcaccccgatcagtgagatcctggccaacaccccggagattcccaagactgcccaatggggtattttcctgcgtaatcatgatgagctcacccttgaaatggtctccgatgaggaacgcagctacatgtactcccaattcgcctccgaacctcgcatgcgcgccaacgtaggaatccgcaggcgcctttccccactgcttgaaggcgaccgcaaccagctggaactccttcacggtttgttgctgtctctacctggctcacccgtgttgtattacggtgatgaaattggcatgggcgacaatatctggctccacgaccgcgacggagtgcgcacccccatgcagtggtccaacgaccgcaacggtggtttctccaaagctgatcctgaacgcctgtaccttccagcgatccaaaatgatcaatacggctacgcccaagtaaacgtggaaagccaactcaaccgcgaaaactccctgctgcgctggctccgaaaccaaatccttatccgcaagcagtaccgcgcatttggtgccggaacctaccgtgaagtgtcctccaccaatgagtcagtgttgacatttttacgagaacacaagggccaaaccattttgtgtgtcaacaacatgagcaaatatcctcaggcagtctcgcttgatttgcgtgaatttgcaggacacacccctcgagagatgtcgggcgggcagctgttccctaccattgctgaacgggagtggattgtcactttagcccctcacggattcttctggtttgatctcaccgccgatgaaaaggacgatatggaa

SEQ ID NO: 2528 - DNA, 1089 bp, Corynebacterium glutamicum
atgagcattggccaacacatcatcaccgagcgtttctacggcgccaagtcccacaccatcgacaacgtagatattgtgttgtcccgcgaatgtggcgagaacactttggctgtagtgcgcatcaacaatgcgctgtatcagttgttggtcaatgatgatggcaaagatgttctcaacgaccacgtagaagaggtcggtgcgagtttcggagcatggactggcagctctgcttttcccattggccctttcactccactcggcacagaacaatccaatagctctttcatcaccgccgacaataaagcgatcgtgaaatacttccgcaaattagaatccgggcaaaaccccgatgtggagctaatttctaaaatttcctcctgccccaacatcgcgcccatcctgggtttttcctccgctgagatctccggggctaactacaccctggtcatggcgcagcagtacgttccaggtttggatggctggtcacacgcgctgactactacctctggcagctttgcagaggatgcagaaaagatcggcgaagccacccgcaatgttcacactgctcttgcatcggccttccctactcgggtagttcccgtagaagcactcgccgatgcgctcactacccgccttaatgaactaatctcccaagcacccgaaatcgcccgcttcaaagaagcagccatcgacctctaccaatcgttggaaggcgaagcccacatccaacgcatccacggtgacctccacttggggcagctcatcaaaacccccgaacgctacatcctcatcgatttcgaaggcgaacctgcccgcccacttaatcaacgacgcctccccgactctcccctgaaagatctcgccggcatcatcagatccatcgactacgcagcctacttcgacggcgaacacacccaatgggccaacgaagccaccgcgctattcctcgacggctacggatcaattgaagaccaagaactcctcaatgcctacattctggacaaggcgttgtacgaggttgcctatgaaataaacaaccgccccgactgggtgaaaatcccactcgaggcggtcgaaaggcttctagac

SEQ ID NO: 2529 - DNA, 585 bp, Corynebacterium glutamicum
gtgtctaagcttaggggcatgactactgaggttgaactggttgttttagctgattccgagggcaatcctattggtactgcgccgaaagctacggtgcacactaaggacacgcctctgcatttcgcgttttccacctatattttgaacccgcgtggggagctgttggtgacgcgtcgtgcattgtcgaagaagacatggcctggtgtgtggacgaactctatgtgtgggcaccctggtccggatgagacaaacgcggatgcgattcgtcgcaggggtgtcgatgagttggggctggaggtagattctttcttggatattcaagagattctgcctgattaccagtaccgtgctgtcgacgcgtccggcattgtggagtgggagttgtgcccggtccacctcgtgcgtttagcggtgggggaatttgtggagccactggatgatgaggtggaggagttcgagtgggcggaaccgcagaagcttttcgacgctgttgatgccacaccatttgtgttttctccatggctagtggatcagcttagcgcccctgagctgcgccaagccatcctggaagcgtttgacgcagag

SEQ ID NO: 2530 - DNA, 222 bp, Corynebacterium glutamicum
ttgcggtcttcctccaccgcagacgtcaccgttttcaccttgccggtattcttctgcccaccgccggcgcctcccatgggcatcatgggcatcatcggcatcatgccgcgcccaaaattgcttatcgacggcttcccactccctgatcccaccatccccaggccagaacccgactgcgaactagatccaaccgacgatccagtctggcgcgcatacttgctc

SEQ ID NO: 2531 - DNA, 438 bp, Corynebacterium glutamicum
ttgaaccgctgcatccggcgcgatactgcccgcattggcgacaccaccctgcgcagcccccgacggagtcaaccccgccgcagaccatgcctgcccactgccagcaatctcatccatccccagagcaatttcccccgcagaaccattcgcccccttcatctgcatcaaattgctcacaggaggcatacccgtcaacacatccgcctgaaaagtagcctgaaacgacgccaaaaacgccctctccgcagcaagcctctgcaccggatccaaaatcgccttaatcgacgtcgcagccataaacacctgcatgcgatgccccatataaatccgattcagcgtccccaccgacgcccccatcattttcgcattcgcagcaaacgtcgcccccgcagccgccacctcattaatccgagcagcagcctgctcaaacgtttcgcc

SEQ ID NO: 2532 - DNA, 1755 bp, Corynebacterium glutamicum
atgacattgaaaattgatccctcgtccatcagtagtgctgtgtctcgcttgaatgagcttcagcatcaagctattactgcatctcaagtgggaatgaaatcaacaattctatccgcgttttcgcccgtctctggactcgatcaattgggttccggtcacgggaatgtgattaatggtggggcaggcgcagcaaactctgtgctgaattcctatgccgaacaaatcgagtggttgtctgcggctttgcaggcttctggtgcggctttgactggccaggatgaattattcgctaggggtatggatgtagcggataccggtggcagggttgtagaagagtcagtaatgttcccggcgcggccggcacctcggtttgagtctttcgtttttaatccaccagctgttagtccttcgttgtcgttggatgcgttgtgtagtcagttttccggaaccaactcgggggcggttttggaggcgcaggggtcttggggctctatggcgtcggctattagcaatgtgtcggcttcgttgtcgtcgattgctggtgagattttggcggagaactcaggcgaaacgtttgagcaggctgctgctcggattaatgaggtggcggctgcgggggcgacgtttgctgcgaatgcgaaaatgatgggggcgtcggtggggacgctgaatcggatttatatggggcatcgcatgcaggtgtttatggctgcgacgtcgattaaggcgattttggatccggtgcagaggcttgctgcggagagggcgtttttggcgtcgtttcaggctacttttcaggcggatgtgttgacgggtatgcctcctgtgagcaatttgatgcagatgaagggggcgaatggttctgcgggggaaattgctctggggatggatgagattgctggcagtgggcaggcatggtctgcggcggggttgactccgtcgggggctgcgcagggtggtgtcgccaatgcgggcagtatcgcgccggatgcagcggttcaaggtgctgcggggcagagtggggttggaagttttggcactgtcactgatcagttggatggcatcaatattggggatatgttgacctctgctgcctcagctgggcagagccttgcgaatggtttggcgatgcctacttctacgcctaattcggcgtccggtgcgattccttcctcgatgtctgcggcatcgccgcttggtgcgtttggcagcggtgcagggttgggcgcacagggtggctcgattggatcttcggcacctggagcgatcagtagtcgagcggccggatccgcaggtggttcggtaccgggaatgactggtggtcctggcgcgccggggattacctcggattcgttgatgggagctcgaactcatggtgcttcttccgcgggagctgtcgctccgatgatgggtggtgctggcggaatgtctggtggcgtcgttggtgcaggtggtactggttctcagagcaagtatgcgcgccagactggatcgtcggttggatctagttcgcagtcgggttctggcctggggatggtgggatcagggagtgggaagccgtcgataagcaattttgggcgcggcatgatgccgatgatgcccatgatgcccatgggaggcgccggcggtgggcagaagaataccggcaaggtgaaaacggtgacgtctgcggtggaggaagaccgcaatttggcggcgctgctgggtgatcgggggccggttgttccgggtgtgattggtgactgggtgaggggc

SEQ ID NO: 2533 - DNA, 660 bp, Corynebacterium glutamicum
ttgaattttagggaacctaccccgaacttttgcagtctaacgcttatgagtgccttttcacggccctcgttacgactacaaagatcggggtattttatgcgacgaatctggctgctcgtatgcggcatcgcattgactgtcgccggctgcacgagtggatccaccactcccacaaccgtcacggtaaccgcaacgccaacgtcggaggaggctgcatccacggagccgaccaacgacatacttgccagccaatttcatccgtgtgaagtactcacgcaggaacagttcgaagaagtcggattgggagtcttgattgttgaagacgcttacctcggctcgacaggtttaggttgcagtttcgggaaagcagacagagaggatttttcaggtacgtggctcatttcaactgaccaagcaaaccgacaatttgttgaaaaccaagatctagagacattggattggggatccaatgacaatccagatctgtatgtgcatcaaatgtccgagacgggtcgtcaatgtgaggcagcagttgactatgactggggccggcttacggttgactatctcgaattaggtgagggctgggagccagaaattttgtgctctgatgctgttgaaattttagaaaatctcatcaaggaactaaggggaattcca

SEQ ID NO: 2534 - DNA, 519 bp, Corynebacterium glutamicum
gtgaagttgaggacaatcccagccctgttagccgtcgcacttcttgcaggctgttcgggtgaaagtgctgatagccaagccgtttccgctgaggaaaccatggaagtaaccactacctcaaccccggtgttcgaagccaaagaggtaagcccaatcacagtcccaagcggcgatatcagggttgaagacccaggtctcaatgttgaatttatcttccgaggcacccgctacggcaccaacggtggctcaattattcacatcgcggtgaaaaacctaaacgacgtagccctgccagccgacgccatcgatccacccaccctggacatcgaagactacaacggcaacaaaaccaacatcgaaaccctctccggcgacgacaacatcccactcgacctaccactgggtgccggcgcgacaacgaacctgcaatacgcgttcaacacctcaaacggctcattgtcgaatgctaaattccagatcggaaacgtcatctactcaggcaatttgaacagcttggcg

SEQ ID NO: 2535 - DNA, 975 bp, Corynebacterium glutamicum
atggcagatgccgttgagcgcgaggtcttcggatacccaccagatgctactgggttgaatgatgcgttgactggattctacgagcgtcgctatgggtttggcccaaatccggaaagtgttttcgccattccggatgtggttcgtggcctgaagcttgccattgagcatttcactaagcctggttcggcgatcattgtgccgttgcctgcataccctcctttcattgagttgcctaaggtgactggtcgtcaggcgatctacattgatgcgcatgagtacgatttgaaggaaattgagaaggccttcgctgacggtgcgggatcactgttgttctgcaatccacacaacccactgggcacggtcttttctgaagagtacatccgcgagctcaccgatattgcggcgaagtacgatgcccgcatcatcgtcgatgagatccacgcgccactggtttatgaaggcacccatgtggttgctgctggtgtttctgagaacgctgcaaacacttgcatcaccatcaccgcaacttctaaggcgtggaacactgctggtttgaagtgtgctcagatcttcttcagtaatgaagccgatgtgaaggcctggaagaatttgtcggatattacccgtgacggtgtgtccatccttggattgatcgctgcggagacagtgtacaacgagggcgaagaattccttgatgagtcaattcagattctcaaggacaaccgtgactttgcggctgctgaactggaaaagcttggcgtgaaggtctacgcaccggactccacttatttgatgtggttggacttcgctggcaccaagatcgaagaggcgccttctaaaattcttcgtgaggagggtaaggtcatgctgaatgatggcgcagcttttggtggtttcaccacctgcgctcgtcttaattttgcgtgttccagagagacccttgaggaggggctgcgccgtatcgccagcgtgttg

SEQ ID NO: 2536 - DNA, 1278 bp, Corynebacterium glutamicum
atgagtaaaaagtctgtcctgattacttctttgatgctgttttccatgttcttcggagctggaaacctcatcttcccgccgatgcttggattgtcggcaggaaccaactatctaccagctatcttaggatttctagcaacgagtgttctgctcccggtgctggcgattatcgcggtggtgttgtcgggagaaaatgtcaaggacatggcttctcgtggcggtaagatctttggcctggtgtttcctattgctgcctatttgtctatcggcgcgttttacgcgctgccgaggactggggcggtgagctattcgacggcggttggcgtcgataatgcgctttattcgggcttgtttaactttgtgttttttgcggtggcactggcgttgtcgtggaatccgaatggcattgcagacaagttgggtaagtggctcacgccagcgttgctcacgttgattgtggtgctggtggtgttgtcggtagccaagttggatggcacgccaggtgagccaagtagtgcgtatgcgcagcagcctgcgggggcgggtttgcttgagggctacatgacgatggatgcgattgctgcgttggcgtttggcatcgtggtgatttctgcgttcaagtaccaaaaggttaacaaggtccgcacggcaactgtcgtgtcggcgttcattgccggaattttgttggcgctggtttatcttggtttgggctcaatcggtcaagtagtaaacggtgagttcgctgatggcaccgcaattttgaactacgctgcactgtccacgatgggtcaggctggtcgcatcatgttcgtggctattttgatccttgcatgtatgaccaccgcagttggtctgatcagtgcgacgtctgagtttttcaattcgctgctgccaggtgtcaagtaccacgtctgggccactgttttcgcgctgatttcctttggcgttgccaccatgggtttggatacggtgttggccgttgcggctccagtgattagtttcatttacccatcggccatcaccttggtgttcttgtcgctcatcgagcccctgctgttccgtctcaagtggacctacctattcggcatttggactgcagttgtgtgggcgctgttcatgtctatccctgcgctgaatccattcatcgaatgggcgccgctgcacagcatgtctttgggttgggttgtcccagttctcgtggcctctgccatcggtttggctattgattggaacaagaaaggtgcccagtctgttgcaaagaaggaatccatttccgtc

SEQ ID NO: 2537 - DNA, 978 bp, Corynebacterium glutamicum
atgtctatcccactttcactgattgattttgccaccatttttgagggcgaaaggcctggtgacagcttcaaacgatcagtggcattggcgcaaaaagctgaaggtttaggcttcaagcgcatttggtacgcagagcatcacaacatggagagcatttcttcagctgctcctgcagtgcttatttctcacatcggtgcgaacaccaagactattcgtctgggtgccggcggcgtcatgctgcccaaccactccccatatgtcatcgctgagcagttcggcaccttggcggagttgtacccagaccgcatcgacctcggcctgggccgtgcccctggcacggacatgaataccttgcgcgctttacgacgcgaccctcagtccgccgagaacttcccgtccgacgttgtcgagctgaactcttacctcaccggccgttcccgtctcccaggggttaacgcaattccaggcaagggcaccaacgtaccgctgtacatcttgggttcatccctctttggtgcacaattggcagcacagttgggtatgccttattccttcgcatcccacttcgcaccaactcaccttgagcacgcggtgcaaacctaccgggataactaccagccttcagagcagcatcctgagccttatgtcattgcggccgtcaatgtcaccgcatctgattccactgaacaagcccacgatgatttctacaaggtagcgcgtgcacgcgtgaagaacatggcattgcgtggccgacaagttactgatgagcaacttgatgaactcatggattcaccagctgctcgccaaattgtcgacatgcttcactacaccgctataggcactggatccgaagttaaagaatacctagacggttttgtaaagacggcacaggctgatgaactgatgatctccctgcaatcccccaacactgaagcaaccacgcgcaatatggaaattcttgcggatgcgtggattaat

SEQ ID NO: 2538 - DNA, 522 bp, Corynebacterium glutamicum
gtggtcatgaatgcagtcaaagtgcgcaccggtgtgccggcgctgatgagatctaaagcgatgtttacgtgcatcctttttgtgctcatgtgcgcgccttttctgctgtttttcctcatcgctctccaaagcgctgaaggaaccatgcataccctttatttggtggcagctacgctgccgggctgcggcattgtggccgccatcgggtctatgtgcgtggtgtgggggcggcgtcgacaagcagtattaatcgttgatgatcaggtgcggatccccggcagtggcataagctttgctatagaagaattagatacagtgcaattatggtcagacctgaaatcaggttcgtatatggcgctactgcctcaccacatcaaggaacgtgcaaatgtgacaggtgtacattcggtacaaccatatattgttaattttccgtccggtgcacaaccacagccgtttgagttggcggagattttgttaagtgaaaaacctgagttaaatttggatcgcttggggcgactt

SEQ ID NO: 2539 - DNA, 927 bp, Corynebacterium glutamicum
atgcaacaggtgctcatgggtttcacggtggtgttcatcgtcatcggaataggttggattctcggtagaagagacaccttgggcacacatgcccagaaacctttgagcctgtttgtctattacgtggccaccccagcgttgttgtttgatcgggtcaccaagtcagatacctcgacgattttctctctgaacttcgtggtcattgcactctctgcgttgatcgtaggtttcctgtttttcctactcatgcggttcgtgatcaaaagaactgccgcagtatcggtgatcggcatgctagctgcgtcctacgccaacgccggtaacctgggtatccctttggcagcctatattttggatgatttcaccgtggtgattcccgtgattttgttccaggtggcgttctacgcaccgatcaccatgaccatcatggagatgctgaccaacaagaaatccaccaacttggtgcgcaacctcctggtcacgccactaaccaacaccatggtgctcgcagcgattgccggtattgctgtgtctttgacttcgatgagcgtgcccgtggtgattgctcagccagtggaaatgttggcgaatgcttcagtgccactggctttggtggtgttcggactgtccttgtccaagagcaagatcctggaaaaggggcaggtatccaggcgcgatgtgtttacggcggcactgttcaagaatgttctgcacccaattgttgcgggacttttagccttagcctttggtatggaaggtactgccttgttgtcggcggtgattctcggtgcactgccaacagcgcagaatgtctacacctacgcgttgcgatttagaacagctgaatcgatggcgagagacacaggggtggtcaccacactcatttccttccccgtattggtggcggtctccattatctttggatct

SEQ ID NO: 2540 - DNA, 2844 bp, Corynebacterium glutamicum
atgactcacaccatcaaattcaacagactcgacccagaagtatttagccagcattctcgcgcgaagctgcgcacggatatgacaacccgtgcagcatattcttctgatgcaggaatttttagacgcgtccctgcagctgtagctgaaccagaaaatgtggaacaaattcgtgatgccattgctgttgcggtggcacgagggtggtctgttgttgggcgcggtggaggaagctcggttgctggaaatgcgatcggtgaaggtttgatcatcgatacgtcacgctatttcaaccgcattttagatattgatccagttgcacaaactgcagttgtggaacccggtgtggtgtgtgatgccttgcgcgatgcagccgcagaattcggattaacttacggcccggatccttccacgcattcccggtgcacgatcggtggcatggttgccaacaatgcgtgtggttcacactcggttgcattcggtacagctgcggaaaatctcgtggatgtcacgctcatgctcagcgatggccgagaagtcactgtgacaaaagatggctgcgatgatgctgagatcaatcagaagctcaccgacttagcgtccaagaatcaggaccttattagtaaagaactgggtcgtttccctcgccaagtgtcgggctacggtttgcattatcttgcccacgacatggccaaagcaatggcgggcaccgagggaaccattggaatcattactcggttgacggtgaagttggttccaacacccaaagtgaaagcgcttgctgtcctggctttcgacacggtttttgacgccgcccgagcagccgccaaattgcgactgcctggggtagcaaccattgaaggcatgggcggagatctcctcgctgcgctgcgcagtaaacagggacaatcagaagctgggcagaatcttccaggaaaccgcatcggcattgaagccggcggatggttgtactgcgagacaggaagtgacaccctgcaggccgcggtacaagccgccgaggaagtcgcaaccgccgttgacaccattgattacgtggtcgtgtctgagccttctgaaatgcgggaattgtggcgcatccgtgaatcctcggcgggcattgtcacgcgcttagctgatggtggggaagcgtggccgaattgggaagactcggcggtgcctccagagaatttagctgattatctccgcgatctttatgcgctgatggataagttcgattaccagggtattccatttggacactttggagaaggctgcgtccacgttcgcatcagttttgatttctctaccaaggaaggcctgaagaaattcgaggcgttcatgaatgaagcctccaccttggtggcgtcttatggtggcagcctctcgggcgagcatggagacggtcgcgcccgctcatccttccttgaccgcatgtattcagcagaaatgcgtgcactcttcgaagaattcaagctgattttcgatccccagcgcatcttcaatccgggagtgttggtctgggcagatcctgtcatgcaaggacttcgcatggacccgggccagcgcgccctcgacatcacgcccgtacacaaattctctaaagacaaaggttccatgatcaacgcggtgaatcgctgcgtgggtgtatccgcatgccgctcagaatccgacgcgatgtgcccgtccttccaaatcaccggcgacgaagtacattccaccagaggccgcgcccgcttgctctctgagatgttccgcggtgaatccatcgccgacggctaccgcagcgaagaagtcaatgaagcccttgacctgtgcctttcctgcaaagcatgcgcatcggaatgtccagtcaacgtcgacatgtccacctacaaagccgaattcctggacaaacactacgccggccgacttcgccccatggcccattacgtcatgggctggctgccgcttctgggacacgttgcccataaaataccgcttcttcctacgcttatcgacgccaccatgcagtcagcactcaccgccccagtggtgcgcaaggtcggcgggctcgctgatcgcccgttgatttccttcgcccaccgctcgctgcgcaagtacaagccgaagaaaaactcaggtgaaacggtggtgctgtggcccgattccttcaacaccaacctcgacaccggaccagctcacgcagcgatcaaaactcttgaagccctcggttacaacgtggtcatcccagatggcttcgtctgctgtggactcacctggcattccaccggccaattgagcatgacaaagaaagtcctagaacaaacggcgaaagtgatgaaaccctacctggaccaaggtctaacagtcgttggtttggaaccttcgtgcaccgtcatgcttcaagatgaggcaacagaactctccgataaccctgatctggcacgccttgcagcactgaccaaaccattcgctgaggtcatcgcaccaaagatcaccgagctagtcgagtctggaagcctccagctaacagaatcaactgcgcttacccaggtgcactgccacgagcgttcgctaggcgacccacaacaatcggcactcgttcttgaagctttgggtgtaaaagatgaacaaattgccactggttgttgcgggcttgccggaaactggggctttgaaaaagaccacgctgaaatgtccttcgcacttggtgaacgagagctgttccccaaggtcagaaaagcagaaggacatgtgattgctgacggtttctcctgccgcacccagatcgaacaaggcaccggaaaacaagcaacgcaccttgcagaggtggtcttaagcatcttggagcaaaacaacatggcacaa

SEQ ID NO: 2541 - DNA, 711 bp, Corynebacterium glutamicum
atgccaacaaaaagggttgcccccgcacgctcactcaccgaccaagtcatggatttcgtccgcgaatccacccttgataaaacaatggtcaccggagagtggtacagcgtttaccaggtcagcgaccaattaggcatttcccgctcccccgtcagagacgcgctgctccgcctggaagaagcagggctcatccgcttcaccaggaaccgcggattccaaattgtcgaaaccaaaccctctgatgtcgccgaaatttttgcccttcgtctaggcattgaacccgccgcagcataccgggcagcacagctacgcaccgaagaacagctccacgaagcagatgacatcattgcactcatggcgcaagccgaggccgacaatgacgaagaagcatttttcacccatgaccggcagtttcaccgacaaattatgaccatgggacactcccaacgcggggctgacctggtagaaaaactacgcgcacacacccgtatcctcggtgcttctactgccgggaacaaacgcacccttggcgatattttggaagaacacgaaccaatcttggatgccatcaaacgacaatcagcagaaatggcacgagccaccatgcgggagcatatccaagtcaccggaaagctactactagaacaagcagtggaaaaatccggcgaaggagctgctcagaagatttgggatcagtacacggcgggagtt

SEQ ID NO: 2542 - DNA, 282 bp, Corynebacterium glutamicum
ttgttcctacgggttaaaggggtaaaaatgaactcaattttcaaactatttagtgttctgtttgccgtatttctagtggctttcctcattggtggcacccttattgtcggtgttcaaacagtgggagtgatcttgctgagtgaagacctagttactggtgccactcggaatattgctccgtgggcgtttggctccgcgacactttgtgcagtgtgcgcatttgtgttgaggtaccggcccggccgtccaactggctccgatactgttcagcatgaaattgat

SEQ ID NO: 2543 - DNA, 1347 bp, Corynebacterium glutamicum
atgggaatcattgctctgctcgtttttatcgcaattgccgtgatattgaatgtgtttttgaaacgagatatttcagaagcattgctagttggattagtaggaactgcgcttgtcggcggtgtaaatgcaccgacattactgattgatgctgtagtggatgctgctcagtcggaagttactttcgcaggtatggcctttgttttcatgggcatcgttgtgcaatcaactggattgattgatcgattaatcgcaatccttaactcgatttttggtcggcttcgaggtggcgcaggttatgtttccactcttggatctgcgctcattggactcatcgctggatcaacggctggaaactccgcgacggttggctcagtgacgatcccttggatgaaaaagacgggatggactgctgaaaggtccgcaacgttagtcgcgggcaactctggccttggtgttgcgttgcctcccaattcaacaatgttcatcattttggcattgccagctgcagcagcttcttcggcctctcaggtgtacattgctttggcttgtggtggtgcgtatgcagtgctctaccgcttagcggtcgtcttttactggacacgtaaagataaaattcctgccacccctgatgatcaacgggtgtcattcggtgaggcaatgaagactggatggcgttcaccgttgatcttccttggaattttgatccccgtaatcctcacaatcggcccattgtctgaatggttaaagacacatggagttggggagtctggtgttaaatcgatgtcgatcatcgtgtgggtgccaattctgattacggcaattgctctgattgaagggcgtaaacgaattgctaacaacatggcacactttagggttcagatctccaaggacttgccacaatttgccaccgtaggaatttcgttgttttctgcgcttgcagcagcgaacatcatggaagaactgggtgttggcccgcagttgtctaactggcttgattccatggacctacctaagtctgtcatggtgatcattgtctgcatcatgtgcattgtggtggcaacgccactgtcgtcaacagcaaccgcggctgcgattggtgctcccgctgtcgctgcgttggctgcggtaggtattgatccaactgtggcgatcgtagtgatcttgctgtgcacttccactgaaggtgcatccccgccggtgggcgcgccgatttacctttctgctgcgatcgccgatgcaaacccaacgaaaatgttcgtaccactgattacgtactttgttgtccccatgattctgcttgcttggctagttggaatgggattcttaccagtgattgttcctacgggt

SEQ ID NO: 2544 - DNA, 423 bp, Corynebacterium glutamicum
ttgccctcatctctgctgcagtggcggctctcggagggtggtgtgcatattccttttgggcacctcgccgacaccgtctcctgggactgcgggggaggcagctgcgccaccaacgatttggtatccctgttcatgccggccgccttcatgagtaccctcgccgcctgcgtatttggcgcgtgggccataggtttgatcgctcccgcactattcatcgcggtgactgcctgggcatttcgctccggcgtgcaggctgcgattgccgacggctacacgtccgcgacttccgtcggcttcgaaatgactgtctcgctcattcttttcatcatcgcaggtctgtgctttctgggctggatccccatgttcatcaacaaccgccaagtcgcgcgcaaggtccgcgagagggctgcgggcttgagcaat

SEQ ID NO: 2545 - DNA, 1509 bp, Corynebacterium glutamicum
atgaagatcacgcgcggactcctgccatcattgctgttggcaagcacaatcgtggtgtcgtcatgctctgctggatcgactgcgtatcagcagccccctgctgttgatcaatcatccattgtcattgctaccacggctgctgcggcgtcacttgatttcaccaatgctgcgggcgctgctattccgcaggcgatgatgtccaatatttacgaggggcttgtgcgcatcgatgcggagggtgagattcagccgctgcttgccacgtcgtgggatatttcagacgatcgcaccgagtacattttccatttgcgggagggtgtgctgttttccaacggcgatcccttcaatgctgattctgcgaagttttccattgatcgggtaaaaactgactggaccaatggtttgaaaagtggcatggatgtggtggagtccaccgaggtgattgacgatcacacgctgaaagtttcgctggtcaggccgtccaaccaatggttgtggagcatgggtaccgcgatcggtgccatgatgacggaggggggcgtcgataagctggcaactgatcccgttggcaccggcccgtacacggtgacgcactgggcgccgggccgcgcaattgggttcggcgcgcgggccgattattgggggcagaagccgcttaacgacgccgcaaccatccgctacttcagcgatgcgacggcctcgaccaatgcgctgcaaagcggtgacgtggacgtgatttgggcgatgcaagcgcccgaacagctggctacgctgcaggaatacaccgtggaagtgggcacaaccaatggtgagatgttgctgtcgatgaataatcagcgtgcaccttttgatgatgtgcgtgtgcgccaggcggtgatgtttgcgattgatcgccaagccgtcattgataccgcgttggaaggttacggcaccgacactggtggcgtgcctgttccgccgactgatccgtggtacgagaaatccacgatgtacccctacgatccggaccgcgcacgggcattgttagaggaggccggcgccgagggaacgcggatcaccatgtccattccttcgttgccgtacgctcaggcagcctctgaaatcctgtactcgcaactgcgagatgttggttttgatcctgtgattgaatcaaccgagttcccagccgtctggttggcacaggtcatggggcaaaaagactacgacatgtcactaatcgcgcatgtggaaccccgcgacatccccacgctgtttagccccaactactatttgggctttgacgacaccgaaacccaagccctcctcgcagaggcagacagttcagcaaacgaagtggaattgatgcaacaagctgtcgatcgaatcatggaacaagccgtcgccgacaacctcatgaacgtggccaacatcgtggtgatgtcaccagagatcaccggcattgatcccaacgtggtgtccggggcgttggaattgtcgttgattggtcggaaagaatccggggtagcgcag

SEQ ID NO: 2546 - DNA, 966 bp, Corynebacterium glutamicum
gtgagtaaaacaatcgcttggactgtgctgcggtacaccctgacttttgtgatcgccagcatcatcatttttgtgctgattcgagtcatccccggtgaccccgccgctgttgccctgggaattaccgcgacaccagaagcaatcgctgcgttgcaatcacaattaggtactgatcaaccgcttttccaacagtacttttcctggataggtggaatgctcactggcgatttcggcacctcgctgagctctggccaagacctttcccccatcatttttgaccgcttacaagtgagcctcattttggtgggatgctccattgtgttgtcgttgctcattgccattccacttggtgtgctttcggcccggcgcggtggcgtgatcatttccggcatcagccagattggcattgcgatccctagtttcctcgccggtattttgttggtcgctgtcttcgccgttggtttggggtggctgcccgccaatggctggattccgccgtcggaaaactttggaggtttcttagccaggctgatcctcccggttctggctcttactgctgttcaagcagcaattttgacccgctatgtccgctctgcagtaatggatgtaatggggcaagatttcatgcgcaccgcgaggtcgaaaggtatgagcttcaaccgcgcgttgatcatccacggtcttcggaatgctgctcttcctgtccttaccgtcactggtttgcagctaacaaccttggttatcggcgccgtggtgattgaacaagtctttgtcatccccggaatcggttcgatgctgctggagtccgtgtccaaccgtgatctcatcgctgtgcaatctattgtcatgctgctggtggcgttcacgttgctggttaatttggtggttgatctgctgtatcaggtggttgatccaagagtcggtgctgttggggttgctagcactaaggttccagggagcgtggct

SEQ ID NO: 2547 - DNA, 828 bp, Corynebacterium glutamicum
gtgacaacgatcaaaaacatgcccctttcagggaaaatcggcggcttcatcgttgccgttgtatttgttcttgctgcgctgtctttcatttggactccgtttgatccagttcaagctttcccacaggagcgccttgagggaagttctttgaggcacctgttgggaacggatcgttatggtcgcgatgttttatcccagatcatggttggttcccgcgtcacgttgttggtgggcatcattgcggtggcgatcgcagcattaatcggcacgccactgggtattgctgcgggaatgcgccgtggcatggtggaaacctttgtcatgcgtggtgccgatttaatgttggcgttcccagcactgttgttggcgattatttccggcgccgttttcggcgcctccacgtggtccgcgatggtcgcgatcggcatcgcaggcatccctagttttgcccgcgtggctcgtgcaggcacattgcaggtgaccagtcaggatttcatcgcagctgctcggctatcaaaagtaagttccgcccggatcgcgcttcgccatattttgcccaacatcaccagcatgttgatcgttcaggcatcagtagcttttgccctggcgatcctggcggaagccgcattgagtttcctcggtttgggcaccactcccccggatcccagctggggtcgcatgttgcaaaccgctcaagcatccatcggcgtcacccccatgttggcggtgtggcccggtgctgcgatcgctttgacggtccttggttttaatcttttcggtgatggtttacgcgatgccatcgatccaaagcgggaggtcggccgtgct

SEQ ID NO: 2548 - DNA, 1437 bp, Corynebacterium glutamicum
gtgcttaaagtttctgatttaacggttggcaacaattttgtccacaacgtctccttcgaggtcaaccccggcgaacgcgtcggcatcatcggcgagtccggctcaggcaaatcactcaccgcgctatccatcatgggtttaactgacctgccgaccaccggccagatcaccttcaacggcaaaccctccgctacattccgtggcacccgcatcgccatggttttccaagaaccaatgagcgcactcaacccgctcatgcgcatcggccgccaaatcgaagaaatgatgaccctgcacggggcaagcaaaaaagacgcgcgggcgcgcttaaaaagcttgcttatcgacgtctccctccccgaacgcaccgcttcggcctacccacacgaactttcaggcgggcaacgccaacgcgcactaatcgcaatggcgctggccaatgatcctgacctgttgatctgcgatgaacccaccacggctttggatgtggttgtgcaaaaacaaatcgtcgatctgctgctgcgtctcaccaaagaacgtggcaccgctttattgttcatcacccacgatcttggactcatcgcgcgcacctgcgaacgcttattggtgatgaaatccggcgaaaccgtagaacgcggcgacaccgaggcaattcttcgctcccccgcccattcgtatacccaacagctccttgatgcttcaatccttgaccagccagaaatcgcctcagattctggcgcgccggtagtgattgatgtggaggaggcgtcgaaaagctttaaagaaaccaccgccctccacaaggtttcattggcggtgcgcaaaggtgacctgcttggaatagtcggcggatcaggttccggcaaaacgactctgctgaagctcatcgccggtttggataagcccacaaccggtaccgttgcggtaaccggtggtgtgcagatggtgtttcaggatccccaatcaagcctcaacccacggatgaaaatcaaagacattgtcgccgaaccactgcttggttggaacgcggcggagaaaaccacacgggttgcggaagtcatcacccaagtgggactgagccccgatgtcttagatcgctacccccacgaattctccggaggacagcgccaacgaatctccatcgccagagccctcgccatcaaaccagcgatcctgcttgccgacgaacctgtctccgccctcgatgtgtccgtacgtaaacaagtactggatcttctccaacaactcgtcgaagaatacggcatcaccttggtgttcgtctcccacgatctggcagtggtgagacacctgtgcacaaccgtgtgggtgatggaacagggacgagtccttgagcaagggcccatcgattcggtttatgatcacccacagaccgaatacaccaaggagctgcttgatgccgttccgcggttgagcctt

SEQ ID NO: 2549 - DNA, 507 bp, Corynebacterium glutamicum
atgagcttcagcagagtcgttttgccggaacctgatccgccgactattccaagcaggtcacctttgcgcaccgccaatgaaaccttgtggagggcggtggtttctttaaagcttttcgacgcctcctccacatcaatcactaccggcgcgccagaatctgaggcgatttctggctggtcaaggattgaagcatcaaggagctgttgggtatacgaatgggcgggggagcgaagaattgcctcggtgtcgccgcgttctacggtttcgccggatttcatcaccaataagcgttcgcaggtgcgcgcgatgagtccaagatcgtgggtgatgaacaataaagcggtgccacgttctttggtgagacgcagcagcagatcgacgatttgtttttgcacaaccacatccaaagccgtggtgggttcatcgcagatcaacaggtcaggatcattggccagcgccattgcgattagtgcgcgttggcgttgcccgcctgaaagttcgtgtggg

SEQ ID NO: 2550 - DNA, 549 bp, Corynebacterium glutamicum
atgagactgttcgcgtctatcactccgccgattgaagtcaccgagcatctgatcaacgcgcttcgtccctacaaggatgatctgcggtggtctgatccagacaattggcacatcacgttggcgttctatggagaattacctgatggggcagtcgaagatctcattgagcatctgacaagtgcagcccgaatcaatgaagaattcaccatcagaatcaaaggcgcaggctcatttaatcggaagaatttgtggatgggtgttggtggtgacaccaaagatctgcggcgactgatggctgattgtctgattgatcctgaggaacgccgacgccagcgtgcacacctgaccgtggcgaaaccaacgcagcgacagcgcagccgcgattgggatcctgtcatccccgatctggtccacgctctctctatatacgaaggccccgaatggccagtcgatgagattgaactggtgtcttctgaacctggaaaaggcagaagcggtgggccactgtatacaaccgtggccaccattgcgttgtcatctgcgctggtt

SEQ ID NO: 2551 - DNA, 903 bp, Corynebacterium glutamicum
atgaataatcgaattgtcgtagtcggctccatcaacgctgatcttaatgttctcgttgaccgccacccagcacctggcgaaacactgttgggcagtggtggacacatcactgcaggaggcaaaggcgccaaccaggcagtagctgccgctcttcaaggtgcagacgtcgcctttgtcggcgctgtgggcaaggatccttacgctgccccagccttagaattccttcgttcgtcaggcgtcgaccttacggcagtatccgaagtagatgacaccaccgggcttgcagttatcaccgttgccaaagacggcgagaacaatatcgttgtcatccccggcgcgaattccctggtcaattgtgattatgtaagcagccaatccgctcttttagctgaagctggaatcctgttgctgcaaggtgagatccctgcggatggcttcaaagaggccattcaccacaccatgggtcgcgtcgtggtgaatctagcgcccgtcatcgaggtagagaagtccgcgttacttgaggctgatccgatcatcgccaatgagcacgaggccggcctgattctggatcaattcggggcaggcatcgattccatggatccccacgagctcgcgcaagctctcctcgacgccggtttcgcctctgttgttttaacgcttggatccgcaggcgcgttggtcgccgatgccaccggtatcacggacatcgccacaccaacggtgcaggcagttgacaccacgggagccggtgacgcttttgccggagccttctgcgcacgactaattaaaggcgattcgcttatcgacgccgccacccacgcagcacgcgtcggcgcttactcggtgcaaaccgccggagcgcaagcgtcctatccggacgcgagcgtttcacttccctctgtt

SEQ ID NO: 2552 - DNA, 1425 bp, Corynebacterium glutamicum
atgcggtctgtactcgactactggatcatgactcttgcaccttccaccaatgcggtttcgcagcaaacaagaaggaacccttcccaagcgccgcgacttcttcatcgacttcacttctttgccggcattatctgcgcaccgttgattttcatcgctgcgctcaccggactggtgtatgcgttctcccccaccattgaaagcatctctaatcaggaaatgctcacggtctccaagtcggctagcgacacagctcttccggtgcgtgaacaagtgagcatcgcccaagaactccaccccgatttagatctctcaggtgtccggcttggcgatgattcctccaccacccgcgtcctcttcgccgacgagacgcttgctgaatccacagtccgcgccgtgtttgttgatccctacaccggcgagatcaccggtgataccacccaatacggaagctcagctgcactgccgtttcggcaatgggtctcgcaaggtcaccgcatgttgtggcttggtgaacctggacgtatttattccgaacttgcggcaagttggctcggagttttagccgtaggcggtttcgcattattgtggttgcgcaacaaaaagcccggccgcttgagaaagatggtgcgaactggtggccgtggtcgagtgaaaacgtatcgccgacatgcagcattgggcaccgtagcgggcttgggttttgtgttcctcacctttactggcctgacctggtcaacttatgcgggatccaacatcacggatttacgcacccaactcaattggacgcagccttccgttaacgcttctctaacagctgccccacaagtggacatgcatgatgaacacgcaggtcatcacatgcatatggagtcggcaacctcaggctcaggttctatagatctggtagcggccacggctatctccgaattacgcactcccctcaccattactcccccagcacaagatggcctcgcgtggactgccacagaaaaccgcgacgcctaccgattcaccactgacaccatcgctgttgatggcgacaccggaatgctgaccaaccgtttgaattccactgattggccattagctgctcaagcgagtgcatggctcatccagcttcacatgggcaccctgtttggccttcccaaccaggttgtacttgggctgttggctgcctcaataatcgtgatgatcggccttgggtattggatgctgtggcagcatcggccacgggaaggttggcctagcgctcccaagcgtgcaggatttgaaaaacccacctggggaactatcgcgttgggtgttgtggtgatcgcgtatgggcttctcgcgccactttttgcagtttcactgctcgtgtttattggattaagccttggagtgcggtttatttctcgtatgtccgggcgcgcggacacgtccaac

SEQ ID NO: 2553 - DNA, 303 bp, Corynebacterium glutamicum
ttggacgtgtccgcgcgcccggacatacgagaaataaaccgcactccaaggcttaatccaataaacacgagcagtgaaactgcaaaaagtggcgcgagaagcccatacgcgatcaccacaacacccaacgcgatagttccccaggtgggtttttcaaatcctgcacgcttgggagcgctaggccaaccttcccgtggccgatgctgccacagcatccaatacccaaggccgatcatcacgattattgaggcagccaacagcccaagtacaacctggttgggaaggccaaacagggtgcccatg

SEQ ID NO: 2554 - DNA, 972 bp, Corynebacterium glutamicum
gtgtccaaaacagaagaaggccgttcagcggccataattatttacgcgtttccaactttcattctgctgggcgcgatcattgcgtttatcttcccggaaccattcattccgctgacaaactacattaatatcttcctcacgatcatcatgttcaccatgggtttgaccttgacggtgcccgattttcagatggtgcttaaacgtccactgcctatcttgatcggtgtagtagcgcagtttgtcatcatgccattcctggcgatcgtggttgcgaaaatgttcaacctcaacccagcactcgccgttggccttctcatgctgggatccgttccgggtggcacctcctccaatgtgattgcgtttctcgcccgaggagatgtcgcgctatcggtcaccatgacctctgtgtccaccattgtttccccaatcatgacgcctttcctcatgctcatgctggcaggtactgaaaccgccgtcgatggtggaggcatggcgtggactttggtacaaacagtgctgctgcctgtgatcatcggcctagttctgcgtgtcttcttgaacaagtggatcgacaagattttgccgatccttccttatctctccatcctcggtatcggtggcgtggtgttcggcgcagtcgcagccaacgcggaacgactcgtgtctgtcggactcatcgtgttcgttgcagttatcgtgcacaacgtacttggatacgttgtgggatacctcaccggccgtgtattcaaattcccagaagcagcaaaccgcaccatggcgattgaaatcggaacccaatccgcaggcctcgcatcgggaatggcaggacgattcttcaccccagaagcagcccttccaggtgctgtcgctgccttggtccacaacatcaccggcgcagtttatgttgggctggtacgaaacaggcctttgactaaggcatcaaggaagaaggaatccgtcgcggtttccagc

SEQ ID NO: 2555 - DNA, 846 bp, Corynebacterium glutamicum
gtgtgcgaactttcataccttaacgcagtagtgatgcttaaggcacaacgtgggggcaattccggcctatactttggaagtatgactacttttattacctccggtggcttggaaatctcccccgctggcgctcatattgttcacgccgaatcacctgaaggtgagctgttgtttgttagctccgcttcccaatatggggagggaaatgcaattaggggtggtgtgcccatcattgctccatggtttggtggactgcttggtttggaccctgcacatggttgggcgaagcgttccgcgtgggacgtgactgaacatgacggccaaattcacgctgaatatggccgcgatggtttactgctggatattcgtgcgaacagcactaagaatggttttgagatcaccctgcgcgcttacaacgacaccgatgaggcacgcactgtgcagttggccttccacccttatttcaaggtggatgatgtagaaaagatcgaggtccgtggccttgatggggtggacattctcaatcgcctgaacaatgaggtggagacccaagatggtcccgttacttttgatggcgagttcgatcgcattgcgctagggactccggttgtgaggatttttgataccgatcgcatcatcaccattgagggcgatggtcatgattccactgtggtgtggaatccaggcgaaagtcgcgcctccaccgtggccgatattggcgaaggtgaatggcgcgactttgtgtgtgttgaaccggcgcttttgggtgctgaccaaaaaggagtgagggtggctccggggcagtcagtcaccgttgggatgcaggtaagcgtcgaaaagcgtgct

SEQ ID NO: 2556 - DNA, 366 bp, Corynebacterium glutamicum
gtgtttggcgatgtgatcagactaagtgatcaccgtcaccagcaaaaggggtttgcgaactttactaagtcattacccccgcctaaccccgacttttatctaggtcacaccttcgaaacctacggaacgttgcggtgcctgcattttcccatttcagagcatttgcccagtacatccgtactagcaactcccccgcccactttttctgcgaagccagaactttgcaaacttcacaacaggggtgaccacccccgcacaaaacttaaaaacccaaaccgattgacgcaccaatgcccgatggagcaatgtgtgaaccacgccaccacgcaaaccgatgcacatcacgtcgaaacagtgacagtgcat

SEQ ID NO: 2557 - DNA, 570 bp, Corynebacterium glutamicum
atgtctatttcccgcaccgtcttcggcatcgcagccaccgcagccctgtctgcagctctcgttgcgtgttctccacctcaccagcaggattccccagtccagcgcaccaatgagatcttgactacttctcagaacccaacttctgcgagcagcacctcaacctcttccgcaacgactacttcctcagctcctgtggaagaggacgtagagatcgttgtttcaccagcagcgttggtggacggtgagcaggttaccttcgaaatctctggacttgatccagagggcggctactacgcagcgatctgcgattccgtagcgaaccctggtaacccagttccttcttgcaccggcgaaatggctgatttcacgtcccaggcatggttgagcaactcccagcccggcgcgactgtagagatcgcagaagacggcaccgcaactgtggagcttgaagctaccgcaaccggcactggcttggactgcaccactcaggcttgtgtagcgaaggtcttcggcgatcataccgaaggtttccgcgatgttgctgaagtcccagttactttcgcagccgct

SEQ ID NO: 2558 - DNA, 588 bp, Corynebacterium glutamicum
atgactgacatgtggtttagctctgaccttcatttaggtcacaaattcgtggcatcgatgcggggtttcgacgatccagatgaacacgatgaagtaatactgagcaattttgagaacacgatcggcccagatgatgtgctgtggattctgggagatctttcctctggtgcccatcgcgctgaagagcgcgcgctgggcttaattgctgagcggctgggcggcgtcgtcaagcatcttgttcctggaaaccacgattcttgccacccgatgtaccggcatgcgtacaagcgacagcggcggtttttggaggtttttgattcggttcaggcgtttcagcggatgaaatgggacgacgaggatgtctacttgtcgcatttccctcggccgggccaagatcatccggggatggaatcgcggtttgatgatctccgcctgcgtgtgcctttgctgattcatgggcatttgcattcccagttccccatgacggggccggggcaggttgatgttggggtagaggcgtggggtttgaagccggcacctcgtgaattagtgcagctcaagctgtgggaatcgctgagcgagaagatt

SEQ ID NO: 2559 - DNA, 1890 bp, Corynebacterium glutamicum
atgtccaccaactctggcaataacttgcctgaatcccaagagtcacccgaggaacctcattatcctcacgacacccacccaggcctagttcctggcatttcggtcgatgctcaacgcaacaagttcggactcgacaaaaccgttttcggcgtcaccgcagcattaattctggcgttcatcgcctggggcatttccagccctgattcggtttcttcagtatcgtccacgatgttcagttgggctatgacgaatactggttggctcctcaactttgtcatgctgatcggcattggcaccatgctctacatcgctttttcgcgctacggccgcatcaagctgggcacggacgaagacgaaccagaattctctcgcttttcctggattgcgatgatgttcggcgccggcatcggtgtcggtatcttcttcttcggtccttccgaaccgctgtggcattatctcagtcccccacctcacaccgtggaaggatctacacctgagtccttgcaccaagcacttgcgcagtcccacttccactggggcttatccgcctgggggctgtatgccttggtcggcggcgcgttggcgtactccagttaccgacgcggccgcgtaaccttgatcagctccaccttccggtcacttttcggtgagaaaaccgaaggtatcgcgggtcgcctcatcgacatgatggcgatcatcgccacgctgtttggaacggctgcaaccttgggcctttcagcaattcaggttggtcagggcgtgcagattatttctggcgcttcggaaatcaccaacaacatcttgatcgccatcatcgcgatcttgaccattggcttcatcatctcctcagtatctggcgtgtccaagggcattcgttatctttccaacctcaatatttccttgacgcttggattggtcctgtttgtgttcatcaccggccccaccttgttcctgctcaacttgatcccatcgagtgtgttggaatatggcagtgagttcttgtcaatggctggcaagtctttgtcgtggggtgaggaaaccattgaattccaagctggttggacggcgttctactgggcatggtggatcgcatggactccattcgtgggtatgttcatcgcgcgtatttctcgcggccgcaccttgcgtgaattcgcgctcatcaccatggctatcccctccttcattttgatcctggcgttcaccattttcggtggaactgccatcacgatgaaccgcgagaacgtagatggttttgacggcagttcatccaaggaacaggtgctgtttgatatgttcagcaaccttccgctgtactcgatcacaccgttcattttgatctttgtgctggcagtattctttgttacctctgccgattccgcctccgtggtgatgggaacgatgagctcccaaggtaaccctgcaccaaacaaattaatcgtggtgttctggggactgtgcatgatgggcatcgcggtggtcatgctgcttactggtggcgaatccgcgctgactggtctgcagaacctcaccattttgatcgccattccgtttgcgctggtgttgatcgtgatggctattgcctttattaaggacttatccacagacccagccgctattcgacaacgctatgcaaaggcagccatctctaacgcggtggttcgtggcttggaagaacacggcgacgacttcgagctctccatcgaacctgcagaggaaggtcgtggagcgggtgctaccttcgattccaccgctgatcacatcaccgactggtatcagcgcaccgacgaagaaggcaatgatgttgattatgacttcaccaccggcaaatgggccgatggttggacaccggaatcgaccgaagaaggcgaagtggacgcgaaaaaggat

SEQ ID NO: 2560 - DNA, 996 bp, Corynebacterium glutamicum
atgaatgatttcgaaacaaccatcgatcggatctctaaagaacaagatcccgcagcccgaagccgcgtggaacagttcattgtggaaacagtacgtgcactacccaacttgaccaccaaacaaggtgcatcgttggctatccaacttcttgatgcggtacagctcgcggatgcggcgggaaccaaggggggtgcgtcgacaagcaatgcttcatcgctgcctgacacctttgacgcgctgaccagcctgattggcaagctcgatgtgcgcagcgattctgaatggcgctcgtttgggttccagccttctgaaactgcgcacccgctaatgatcgctatccctgagattgagattttttatcagcacaccgatgtggagccgggaagcgatgacgccgtggcgccggactttcaggaaaatcaggatatgtggcgcaggcgtctcggatctgtcaccgaaccaaaccttatatataaagagttttccggacccggcaaagcgcagcgtgccgtagaaatgctgggcaatctgtggaagatcggcgtggtggtgagtaggaatacggaaagtcgccttgggttaactcgtgtggaatacacccccacccctggcgaagtacccgtgccgctgatgtcggagaagaactgttggtacagcattcgggtgtctgaaaccattggtgagaaccaggttccggaaattgtgcgctgcttaggcgagattttctgtggctatcttccccagatgtggctcaaagaaccagtaaaggccggcaagttgcgaatccaagaatcggaagcagcagcgtatatcgcgatggcgcgactagatctttccccacgcaccggcaacaccacttggaccaacagctatatttccacgcgtcctctctcccccgcttttaggtgggacgtggtgctggaggcttcccaccaattggagaacctgctgcgtggagacacagggccggtcactgccacacaatcggcagctggt

SEQ ID NO: 2561 - DNA, 1608 bp, Corynebacterium glutamicum
ttgaaagtggttgaagtgaagaagcgtaatctcctcgtagctcccctcactgcttccctggtgttctgtaacttggctgttgcagcaaacgccgttgaagttgaggccgaatcaccagttgtcatcaatgaagttgaatccaacagcgacccagttggtgactgggtggagttggctaacaccgacaacaacaactccatcgacatttccggttggtccttagtcgatgacaaggaagacctggaaaatgccctcgtccttcctgaaggcactgagattgagtccggtggatactttgttatctacaccgactctgctgattacgtgcctaccaacaacacctttggtggccaggaatacttcggcctcggcaaagatgacactgttactctgcgcaacgctgaaggcgaagtagttgctacctattcctggaaggatctgggcgagcacgcagaaaacacctatggtcgcatcccagatatgactggtgatttcgcaaacaccggcgttccaaccccaggtgcaaagaatgttgctgctgaaggctccggcgaagaagaaggcgttgttgcaaacgcccagcttccattccacaacgttgaaatcaccccaattcacctcggtggagatttcaccggtgaagatatgtccggcgttgatttcgatgcaaacagcaccgcatggatcgccaacaatgacattggaaagatctactccctcgcccacgacatagctaacaacacctacaagctgactggcgaatgggaaaccggctacccagaaggcggcggagagccagacgctgaaggcatcgtcgcagctaccaacggtgacatctacctgtccaccgagcgcaacaacgctgacaagaacgtctctcgcccatccatcctgcgttttgctaccccaactggcaagactggcgtacaaaacgcagttcaggaatgggacctgtctgagttcgtcggcgacattcagcccaatggtggtcttgaggcaatcgcgcagctcgaggacaacatcttcgttgtcggtgtcgaagagacaggtgatgtcatcgttgttgatctttccgctgaccagccagttctggttcaaaggtacgaatcttccttcgacggtgtcatgtcgcttgattacaacgcagcaaccaagcagctcagcgttgtgtgcgacgaagcatgtgacggcttgtctgaaatcctcgaatgggatggcgagaagctgtacaagtccgacgacaagatctacgagcgtccagcaaacctgggcaactgggctaacgaaggcttcggcacctacacctcagagcttaaatgcgagaacggcaacaccgtttctgtcaccagctacctctgggctgacgatgcagcaaccaacgaaggcacctccctcaactccgcacaggtcatcaacggagattgcggcgacgtcaacatccctggagagtcctcttccgacaattcctcttctgactttgcaaccggcagcatcgcaggcgcctttgcaaccgcagtgctcgcagtcgtaggcattgcgggcgcactgggtggattcttccagcagatcctcgcagcgttcccagcattgcagcaggtcatccgtttc

SEQ ID NO: 2562 - DNA, 384 bp, Corynebacterium glutamicum
gtgccaccttcatttttcccacgccgccgcaaatcagaacccgaccttctggcactccccgctcaaatccgggacgtccatgccgacgttttagacatcttcatggcggaatctttagtgattatcaacatcgacgagaaaagcgccaagctgcttatcgacgccgcccgccaccacatccccacccgcttcaccgggcccaacgcccggccgctcagcgtcatccccatcgaggatccccgctcacgcccgacgctccacccagatcatggttggatgatgccgctaagcccaccagtggtggatgaactgcttggcggtggcttgaaaattggagaaacagaactagaaagcaccaacattgcgttcattgttgatgcttcc

SEQ ID NO: 2563 - DNA, 1311 bp, Corynebacterium glutamicum
atgttgtcgccagcagctgtagcagctttaattcttgtcatcggcattgtggtgctcatcatcgcatcagtgcccgttgccattgccatcggtttgccatcactttttgccgcgatggccgtgcttggcccagaaaacgccgcgcaggccgtcgcgcagcgcatgtttaccggcacaaactcctttacactccttgccattccgttcttcgtgttggcgggtttgctgatgaactcgggtggtattgccacgcggcttatcgacgccgcgaaggtgcttgtcggccgcatgcctgcctccatggccaatacgaatatcgcagcaaatggtctcttcggagcagtttcaggggcagcggtagcatcagcttctgccgtgggaaccgtcatgacaccaaaaatgaaggaagagggctactcgcgcgcttacgcagcggccgtcaacgtggcttcagcacctgcgggcatgctgatcccgccatcaaacacttttattgtgtattccttggtgtcctcgacatcaattgcagcactatttatggccggtgttggacccggtctgctctggattctggcctgtgtcatcgtgggaacttggttagcgcgaaaggaaaactacaagcgcgagcagattcatccaacattcaagcagtcgctcgttgtgctgtggagggcgctgccttcactgctcatgatcgtcattgttgttggaggtatcttgctgggctggttcactccaactgaatccgctgctattgctgtagtgtactgcctggtcttgggctttatttaccgcacaatcaaggtgggagatctggcagatattttgctcaaggcaactcgcaccacatcaattgtcatgttgctcattgcagtttctgcagcactgtcgtgggtgatggcctttgccaagatccctcagatgatctctgatgcgcttctttcggtatccgattccaaggttgtcatcttgttgatcatgatgttcatcctgttactcatcggtaccgtaatggacccaacaccagcaattttgatcttcgtcccgatcttccttccagtggttaccgaacttggtgtggacccagtccacttcggtgcgatggtggtaatgaacctgtccgtgggcgtgattaccccaccagtaggcaacgtgttgttcgttggttcgcaagtggcagggctgcgtgtggaaactgtgatcagacgactgtggccgtatctcattgccattattgttgcgctgttcgtggttgttttcgtaccgcagatctctatctggctgcccacaacaatgggattgatgggaggc

SEQ ID NO: 2564 - DNA, 480 bp, Corynebacterium glutamicum
gtgtttagccgccaggtgctgcacagcccatcaacgtggtctgaagaactatccaagctgttgttcgtgtggctatctttcgcaggtagtgcgttcctctttggagagcgtggacatattgcggttgatttcatcgcgcgcaaactgcctgtttctgcgcagcgggtcctgcaggtcattgttcagttgttgattgttgtttttgcgatcctcggcatgatctggggtggctacttggctgcatcaatcgcgtggaatcagcagctcactgcgctgccacttaccttgggatgggtgtatgttgtcatcccgatcgcgggtgtgttcatcgcgttgttcgcgatcatcgatctcatcgaagtggccacaggcaaggaagagccttacccccttgttgatgaatcagaagaacctcgagatttggacgagctagaggcccaaagcgctatagattctgcaagttcagcggaaggtaggaac

SEQ ID NO: 2565 - DNA, 747 bp, Corynebacterium glutamicum
gtgtgggggagcgtcgaaaagcgaaagtatctaaggtcgtttgattggtttactacccccgaagtgggggttattggcagcatcgagcaccaaatgagcgtgatccgggatcaggatctgatggagccactgttccaaagtcttgcggaatcggacaatatttctgtcattggtggatttacccaaggcacccgaaatctgtacaccactgatgcgccggtgaaaagacccgctgacctggctggaaagaagattcgcgtccaggaatccgccatgcacatccgcatgattgaactcatgggtggctcggcaaccccgttgacttacggcgaggtatataccgcgatgcagtctggtgtgctggatggcgcggaaaataacgagatcagttacgttacccaaaaccacttcgaggttgctcgctacaacagcaacaccaatcaccttgtcggtttggattacatggtcatgcgacacgatctgcttgacgccatgagcgagccagaccgtgaattgttcctggaagaatgggacgccgcgatgactgagcacacggatctgtggaacacagaaactgatgccgttattgaaaaggcgaaagctgggggagcggagttcgttgaggtggatgcgcaagcatttaccgatgcactggctcccatcaaagacgaattcttgacctcagaattccagcgtgaactctacgaagcagtgcgcgccgctgatacttcaggaggtgcggcatca

SEQ ID NO: 2566 - DNA, 243 bp, Corynebacterium glutamicum
atgccagttttaccggacacgcgcaacacatcttcaggttcacaacccacaatgttggcgatctccaacgcgtacttgtctggatccgccgctggaaggtcaatcttgttcagcacagggatgatctcaagatcgttttccatagccaagtacaagtttgccaaggtctgggcttcaatgccctgcgctgcatcaacaagcaaaatcgcgccttcacacgcttcaagcgcccgagacacttca

SEQ ID NO: 2567 - DNA, 1845 bp, Corynebacterium glutamicum
atggcagagaaatttgcagaaacaacatttacggatccagccaggattcgtaacttctgcatcattgcccacattgaccacggtaaatctacgctcgctgaccgtatcctgcagctgtctaacgttgtggatgcccgcgatatgcgtgatcagtacctggacaacatggacatcgaacgtgaacgtggcattaccattaaggctcagaacgttcgcctgccatggattcctcgcagtggtgagtacgagggccagcagatcgtcatgcagatgatcgatacgccaggccacgtggacttcacctatgaagtgtctcgggcgcttgaagcgtgtgaaggcgcgattttgcttgttgatgcagcgcagggcattgaagcccagaccttggcaaacttgtacttggctatggaaaacgatcttgagatcatccctgtgctgaacaagattgaccttccagcggcggatccagacaagtacgcgttggagatcgccaacattgtgggttgtgaacctgaagatgtgttgcgcgtgtccggtaaaactggcatgggtgtccctgagcttctggataaggtcgttgaacttatcccagcacctacctctgaatttgaggaagacgccccagctcgtgcgatgattttcgactctgtctatgacacctaccgcggcgtggttacctacatccgcatgatggacggcaagctgacacctcgccaaaagatcaagatgatgtccaccggcgccacccacgagttgctggaaatcggcatcgtgagccccacccctaaaaagtgtgtgggtcttggacctggcgaggttggttacctgatcaccggtgtgaaggacgtgcgccaatctaaggtgggcgataccgtcacgtgggcaattcatggagctgagcagccactgcgcggttaccaggaaccaacaccgatggtttactcgggcttgttcccgatttcccaagcggatttccccgacttgcgcgatgcgcttgaaaagctgcagcttaacgacgcctccctcacgtacgaacccgaaacgtccgtagcactgggctttggtttccgatgtggcttcctcggactgctgcacatggaaatcacccgtgaccgactcgaacgtgagtttggccttgatctgatttctaccgcgccatctgttaactaccgcgttattgatgaggcgggcaaggaattccgcgtccacaacccatctgactggcctggcggaaagctcagtgaagtttacgagcccatcgtgaaggtcaccatcattgttcctagcgaatttgtgggaccgacaatggagctgtgccagactaagcgtggtcagatgggtggcatggactacctttcggaggaccgcgtggagctgcgctacaccatgcctttgggtgagatcatctttgacttcttcgatatgttgaagtctcgcaccaagggttacgcttcgctgaactacgaggaagctggcgagcagactgccgacctggtcaaggtagatatcttgctccaaggtgaacctgtggatgcattctctgcgatcgtgcaccgcgataatgcgcagtggtacggaaacaagatgactgtgaagctgaaggaactgatccctcgccagcagttcgaagttcctgtgcaggcagccattggttccaaggttatcgctcgtgaaaacattcgtgcactgcgcaaggacgtgttggcgaagtgttacggtggcgatatttcccgtaagcgcaagcttctggaaaagcagaaggctggtaagaagcgcatgaagaacatcggttcggtcgaggttcctcaggaagcattcgtagcagcactgtctaccgacgaggca

SEQ ID NO: 2568 - DNA, 609 bp, Corynebacterium glutamicum
atgagctccacgctcgcacgaaaagcttcaggcgacggttccgaaaagaagaagcctggcttgtttagacgtgcgcttcgtttcctcacccacccacctcacaaacaggtagacaacagccttgcggatatccgtgaaggattaggcctcggggtggacgattcccacgaaggatccaaacccagcaacgatcattctttgctgcatgaaaagcctgaaatttccgtcatgccgaccgaatcaatggcacggctgatcttttatgcgcctgatatggatgggcaaacagaccccggtgaagtagtgtggatttgggcaccagccgatggcccccagcaaccaccccgtaaacgtgccatcgttgttgttggaagaaaccgaaacgccattttaggtctgctcatttcctgcaaccccgagcaccgcactgatgaagactggatcgacattggatctggcagctgggaccctcgaggtcgccaaagttgggtacgactcgaccgcgttctggaggtacccgaattgggtatccggcgccaaggaacagtcgtccccccggggcgctttgagcgtatcgccaaccgcctccgcaacgatttcaactgggtc

SEQ ID NO: 2569 - DNA, 261 bp, Corynebacterium glutamicum
atggcaaacatcaagtctcagatcaagcgtaacaagaccaacgagaaggctcgtctgcgtaaccaggcagttcgctccgcagtccgcaccgagatccgcaagttcaacgctgcgattgaagcaggcgacaaggatgcagctcaggctcagctccgtaccgcttcccgcgcactggacaaggcagtaaccaagggtgtcttccacatcaacaacgctgctaacaagaagtccaacatggctaccgctttcaacaagcttggc

SEQ ID NO: 2570 - DNA, 669 bp, Corynebacterium glutamicum
gtggagtggaccgcttttggcaccctgattctgctcaatttggtgggcagtttatccccggggcctgatacctttttcctcctccgcttagccacccgctccagagcgcacgcgatcgctggcgtcgccggcatcgtcaccggactcacggtgtgggtgacgctgacggtcgtgggagcagcggcgctgctcaccacttatccgtcgattctcggaatcatccagctcgtcggcggcacgtacctaagcttcattgggtacaagttgctgcgctcggcgtcgagagagcttatcgacgcccgccagttccgtttcaacgccgatgcccgacctatcccggatgcggtagaagcactgggaacccgcactcaggtatatcgacaaggtttggccaccaacctgtcaaaccctaaagttgtcatgtacttcgcggcaattctggctccgttgatgccagcgcacccatcaccggtgctggcgttctctatcatcgtggcgattttagtgcagacctttgttaccttctctgctgtgtgcctcattgtctctacggagcgtgtgcgcaaagcaatgctgcgtgcaggtccctggtttgacctgcttgctggcgttgtcttcctcgttgtgggtgtgactctgctgtatgaaggcctgaccggtttactcggg

SEQ ID NO: 2571 - DNA, 405 bp, Corynebacterium glutamicum
ttgagcatgacacaatcagatttacccgatgatgttcaggaattggtcactaagatctttggactggcacgtgatgggggagcagaatccgcagcaaccctcggtgcatatgtcgacaacggcgttgacgttaacctgtccaaccaagatggcaacactttgctcatgctcgcagcatatgcaggacatgctgatgtcgtgcaggcgttgattgagcgtggcgccgatgtggatcgcgtgaacaaccgcaatcagacgccgctggcgggcgcgatctttaagaaggaagaagccgtcattgaggcactgcttgctggtggtgctgacccatacgctggaactccaactgctgttgataccgccaagatgtttggccgcgaggatctcgtagctcgcttcgagtca

SEQ ID NO: 2572 - DNA, 975 bp, Corynebacterium glutamicum
gtggcttcagcacctatttcagttcaaccagcggtccatcttgttctcggcgaggatgagttccttgccgaacgcgcgcgtatcaacatcgtgcatgacatccgttcatcgatggctagccccgattcgcttcaggtcaccaccttgaaggccagcgaaattactcagggtgaattgttggatgcgttaagcccatccttgtttgctgaagaccgtgtggtggtgcttaccaacatggatcaagcaggccaagatgctgtagatctagccttatccgcagcagttgatcccagccctggtacctacttgatcgtcatgcactctggcggtggacgctctaagtcgatggtgaagaagctggaaaaagtcgcggtggtgcacgatgccgcaaagctgaaagaccgggatcgtccaggttgggtaaaacaagagttcaaaaaccacaaagtccaggtcaccccagatgtcattcatgctcttttagagggcgtgggttcagatcttagagagctggcgtccgccgtatcccaattggttgaggacacccaaggcaacgtgacggtggaaaaagtccgtgcctattacgtgggtgttgctgaggtatcgggtttcgacatcgccgattctgcatgcgccggtcaaatgtcaaaggccgtggccagcaccagacgtgcccttcaattgggtaccagcccggttgcattggcagctgcgttgagtatgaaagttggccagatcgccaggctgtattccaccaggggacgcatcaacggttttgagctggccaaagaattgggcatgccgccgttcgtggtggagaagactgcgaaagtggcccgaaactggtcgggagatgcggtcagcgaggccgtgattttgatggccgatctggatgccgctgtaaaaggacaaagtggcgatcctgaatttgccatcgaatctgccgtgagaagagttgcagagctggcgaggcgg

SEQ ID NO: 2573 - DNA, 1539 bp, Corynebacterium glutamicum
gtgtttaaacactggggtcaagctgtggtgatagctgcactgggcgttggtgccgtagtgatggctgcgttgagaatcagcagcgcgaaggcatttgaagcaccgcaaacctgggtgggtaccgcagaaaccatcaagtttttagacagcggtgatcaactaatcggtttgagagtagaaggctatccagcgccgattccagtgttttactctggtagcgacaccattgagaaagcctctctcattgcagtgtccggtcggattaaaccagatagtttccctggggtgggtgatctgaccatttccactgaagacattgatcagttggaaccgaccactggttatagcgcatgggtgaaccaggtgcgtgacgggttttcccaagccgtggaagaaaccgtgggggagtcttcccgtggactgattccaggcatggtgttgggggatacgcggttgcaggggtcaattgaagcccaaacctatattgatacggggttgtctcacctgtcagctgttagtggaagcaatgtagccattgtggtgtcctctgtggtggtgttgtcgtattttctcaccgctgggccacgcatcagggtggtggcgtcattgctgtccttagttatttttgtctccctcgtggggtttgaaccaagtgtgcttcgtgcttcggtcacaggcatcgtggggcttctggcaatcatcaactcttctcggatggagccgatgcatgggttgagtctttcggtgatttgcttactgttttatgattccaacctggcggtgcattacggattcttactctcgtgtgcagcaactgctggcattgtgatgcttcaaccactgctgtaccgtgccatcggtccaccactggcggtgtggaaagtaccagacatcgtggtgcgcgctttcgcggtgtccattgccgctgatctggtgaccatcccgattatcgctctgatggctcgccaaatatccctcgtggcagtgctggccaacgtgttggttgaattagctgttccacccatcacgttgcttgggttgattgccgtgctggcaagccttcttccctggccagtggaatacccactcttgaaaatcattgagcccttcacctggtggattcatcacgtggccaagtggtgccaacaattacccaattcgacgctggaaataagtgctggttgggcagggattgcctgggcgtgtatggcagcggtgtgggtggtggtgattatctacaaaggatatgtgcgcacccttgcagtgtgttgtgtctgcttctttcttttcggcgcgtggaataacagactgccagcccaaatagatccgacagagctgcggtttgtcatcatcgccgatgattctgagctcactgatgtgcccgaacatgcagaattgatcatcgtggaagacccccacggcagcatgtccgatcgccccatcgtcaccagagaaggaatccctgtgctgtatccataccgcgatggggaggtcagccttcatattgatggcacccagcatgcagcggacgggagattt

SEQ ID NO: 2574 - DNA, 582 bp, Corynebacterium glutamicum
gtgaactatcccacgcctcggtttcagatttccatcaagcatgcgttgatcgtgtgcatcgttctcgttgtggcttttgtcggttggtttttcacccgtgagaaacccgtgaatccacccaccatggcggcgttggcggaaacctatcaaacaccggcgccgagttcgcaggtggtggtgtctgtggtggggcacgtggctaaacccggcctggtcacgctcgctgagggctcgcgggtggctgatgccctggccattgcaggtgccttgccagacgccgatctgacggcgctcaacttggcgcaattgcttgtcgacggcacccagatccatgttttagctatcggcgaggtacaacctatttcggttgatgctgctgcgacttctgcttctgggttgatttccttgaataccgccactgttgctgatttggtgacgctgcctggggtgggggagaagacagcgcaggcgatcattgactttcgggagagcaacggtgggtttagcaccgtggaggatttactgcaggtcaaggggattgggccctcaaagtttgagcagatctctggattggtgtcccca

SEQ ID NO: 2575 - DNA, 822 bp, Corynebacterium glutamicum
atgcagcgcaagcacaccgtcatcgccaccgcgttcaagctggcgggcgtaacttgctgcaagttccaacgacgacaacccggatgtactgcgttcttcaccgttattcatcacgtgcaagttaatcaccgtgatgtcgaggtcctcggccacatgcgttggcaagcatgcggaggaatcaacaattacccgaactggcatcgcctttactcctccacatttttattgccatcttctttactgcgtaacacccatgttccagccgtcaagataccactgggcgttttccacattgttgccctcaaaatgagggctgttggaaaccgccgaagaaatcttgaggtcatcttctgggttctcactacctgcataatagcgaggtcgggcggtcaattgtgcccaacaggtatttccaagtccagagaacatggggtactgatcatacgccaggtccaaaagattcgaggtcagcgcattaatcgtgccaccgtgagccacgatgagcacggtgccttcatcccaatcatcaagcgacaccatcaactcgtcgacaacttggcgtgcccggcgcgcaacatccacgcgcgattcgccgccgggtggtgcccactgcggatcgtggcgccattgagcgcgcgcacctggatattcggaatccacctcagtgtgggttttggcctgccactcacccaaatgcgtttcccgaagacgcttatcgacgcgcacctccgcgtcaatcagcgccgcaaccgcgcttgcggtgttgaaggcgcgggaaagatccgagctgaacacatgggtgatgtttttttgaaccagcac

SEQ ID NO: 2576 - DNA, 822 bp, Corynebacterium glutamicum
atgccagttcgggtaattgttgattcctccgcatgcttgccaacgcatgtggccgaggacctcgacatcacggtgattaacttgcacgtgatgaataacggtgaagaacgcagtacatccgggttgtcgtcgttggaacttgcagcaagttacgcccgccagcttgaacgcggtggcgatgacggtgtgcttgcgctgcatatttctaaagagctctcgtccacgtggtccgcagcggtgacagcagccgctgtgtttgatgatgattctgtgcgcgtggtggataccagttcgctcggtatggctgtgggtgctgccgcgatggctgctgcccgcatggctaaagatggcgcgtctttgcaggaatgctacgacatcgcggtggataccttgaagcgttcagaaacctggatctacctgcaccgcattgatgaaatctggaagtcgggacggatttccactgcaaccgccatggtgtcaacggctctggcaacccgccccatcatgcgtttcaacggtggtcgcatggagatcgccgctaagacccgcacccaatctaaagcgtttgccaaattggtggaattagcccagatcagggcagatggtgaacccgtattcattgcgattggccaaaacgaggcccgcgaagcagcaaagcagttggaagaattgctgcgaaacgcactgcctgaaggctccagcttcatgagcgtggacatcgatcccactcttgccgtgcattccggccccggcgcggtatcagtttctgcggtgtttgccaaccaggccccggagttgtccacaggtaaagccggcgcgaaa

SEQ ID NO: 2577 - DNA, 708 bp, Corynebacterium glutamicum
gtgactcgtcgcctgattctgctccgacacgggcagactgaatacaacgccacgtcccgaatgcagggacaattggacacagagctgtctgacctgggctttcaacaggcggccagcgcagcctcagtgctggttcaaaaaaacatcacccatgtgttcagctcggatctttcccgcgccttcaacaccgcaagcgcggttgcggcgctgattgacgcggaggtgcgcgtcgataagcgtcttcgggaaacgcatttgggtgagtggcaggccaaaacccacactgaggtggattccgaatatccaggtgcgcgcgctcaatggcgccacgatccgcagtgggcaccacccggcggcgaatcgcgcgtggatgttgcgcgccgggcacgccaagttgtcgacgagttgatggtgtcgcttgatgattgggatgaaggcaccgtgctcatcgtggctcacggtggcacgattaatgcgctgacctcgaatcttttggacctggcgtatgatcagtaccccatgttctctggacttggaaatacctgttgggcacaattgaccgcccgacctcgctattatgcaggtagtgagaacccagaagatgacctcaagatttcttcggcggtttccaacagccctcattttgagggcaacaatgtggaaaacgcccagtggtatcttgacggctggaacatgggtgttacgcag

SEQ ID NO: 2578 - DNA, 471 bp, Corynebacterium glutamicum
gtgtctgcacttgaagagtcgatccgcatcgcgaccatcgcggcgaaagcagcggatgaaaagaaggccgatgacatcgctgtcatcgatgtctctgacatgatcgcaatcaccgattgctttgttgttgcatctgctgacaatgagcgccaggtgggcgccattgttgaggagatcgaagatgagatgaccaaggctggtttcgagcctaagcgccgtgaaggcaaccgcgaaaaccgttgggttctccttgactacggattggttgttatccacgttcagcgacaggcagagcgcgagttctacggactggatcgtctgtaccgcgactgcccactcattgaaattgaaggacttgaaaccttcaagcgtgaatcctcctggtctgatgaggcggatatccgcaacatcgacagcattgatgaactcccacctttgccagctgaatacgagcctggctacgaggacgat

SEQ ID NO: 2579 - DNA, 678 bp, Corynebacterium glutamicum
gtgcgaacactatactgtccactcatgactacaacggtgaaacgccgcgctcgcattggcatcatgggtggcacatttgaccccattcataatggtcaccttgtggcgggctcagaggtagcggatcgattcgatcttgatctggtggtgtacgttcccaccggacagccatggcaaaaggcgaacaagaaagtcagcccagcggaagatcgttacctgatgacggtgatcgccactgcctctaatccacggtttatggtatcgcgggttgatattgatcggggaggggatacttacacgatcgataccctgcaagatttgagcaagcaatacccggacgcccagctgtacttcatcaccggtgccgatgcactggcacagatcgtgacgtggcgcgattgggagaaaaccttcgaacttgcccacttcgttggagtgactcgacccggttatgaattggatggaaacatcattccggaaatgcaccaagatcgagtctcattggtggatatccccgccatggctatttcctccacggactgcagagaacgctccagcgaagaacgccctgtttggtatcttgtccctgatggcgtggtgcaatacattgccaaacgccaactctatcgacctgaaggatccgataaggatatggatcccaagggccaaaaccaagca

SEQ ID NO: 2580 - DNA, 1023 bp, Corynebacterium glutamicum
atgtctgtcacaaacttccgtcggtttcttgctggcatagcggtcatcgcggcgtgtgttgctgcgactccaacagctcaggcacaaagcagtggctcttctggatcctctggttcttcagcgggatctagcgggctgtgggatttactttttccagaatcccatgagtcttttatcgagcggcttcttgatcctttggatgacagccatatatctattcaccctgacctcaccccagacctgtatgaagaggtgtttgatccaccgcaaattggtgaatgcccagccgttgttgctgtggtcgcacgaggcagtgaacaaaaccttcaaatccgacccgcgcgatacagcgaggaatctccatggacatccaatggatttgaggaaaaaaactttcgtagtttctttggccgaatggaaaaacactaccgtgaatcgactggcgagtcgttgatgaaagacgtctacgtgatgggtctgaataatatcgaataccctgcttctttgccactgtcttcggagggaagcagcgccattgaattgggcacttccatttctagtggtcgcgacaatgtcatcagcgcgattgatcgctttgaatcagcgacagggtgcacgccgaagtacctgttggcgggttattctcaaggtgtcctcatcgttgatggctatgaagaggagttgattgcgagggatcagtacctcggcaccctgcacatcgcgaatccagcgcaacaagttgatgatccaacacttgttgggcatgaagtaaccacgggaggcttggctagttccgtggagcccgtcgaggacaatcctttcaaggtgagctactgcctgcctggagacatcgtgtgcgatcgttcttttgaacagttctctgctgcgggatcctctatagcagctgcgcaattgagcaccggaaatatccgtccaggtcgagtacacgtgcaatacttcgttaccacccaaccgtgggatgagcagatttttgacgaagtcgcatcgtggattgaagctgcc

SEQ ID NO: 2581 - DNA, 1296 bp, Corynebacterium glutamicum
atgagttcaacgaccctaactgatgaccaaattcgcgacaatgagcggaccgaagttctagctaaagcaactgcagctaagaacatcgtcccggatattgcagtgttgggcaccggaccgaagaacgcaatcctgcgtgcggcggcagatgaactcgttgcacgcagcgcagaaatcatcgaagccaacgcttccgatatcgaagcgggtcgcgcaaacggcatggaagaatccatgattgatcgccttgcccttgatgaatctcgcattgagggcatcgctggcggtttgcgccaggttgctggcctgaccgacccagtgggtgaagtactgcgcggacatgtcatggaaaacggcattcagatgaagcaggtccgtgtgcctttgggcgtgatgggcatggtctatgaagcccgccctaacgtcaccgtcgacgccttcggcctggcactcaagtccggaaacgtagctttgctgcgcggttcctccacagctgtgcattccaacaccaagctcgtggaaatcctgcaggacgtcctcgagcgtttcgagctgccacgcgaaaccgtgcagttgctgccttgccaaacccgcggatccgtccaagatttgatcaccgcacgcggcctcgttgacgtggtcatcccacgcggcggcgcaggactaatcaacgcagtggtcaccggtgcgaccgtgcccaccattgaaaccggcaccggcaactgccacttctacatcgatgccgaagccaagcttgatcaggcaatcgccatggtcatcaacggcaagacccgccgctgcagcgtgtgcaacgctactgaaaccgcgcttctcgacgccgccctcagcgactcagacaagcttgcagtcgtccaggcgctccaggaagcaggagtcacaattcatggacgggtggccgaattggaagcattcggtgcaaccgacgtggtggaagcaactgaaactgactgggattctgagtacctgtccttcgatatcgctgtcgctgtggttgacggtgtggatggagctctggcacacatcgctaagtacagcaccaagcacaccgaagcgatcgccacccaaaacattgaaaccgctcagcgctttgcagatcgcgtcgatgcagcagcggtgatgataaacgcatccaccgcctacaccgatggggagcagtacggcatgggcgcggagatcggcatttccacccagaaactgcatgcacgtggaccaatggccctgccagagctgacctccaccaagtggattctgcagggcacaggacaaattaggcct

SEQ ID NO: 2582 - DNA, 912 bp, Corynebacterium glutamicum
atgaagtttgttatgtatccgcatttgtgggagtccacgaccgctgtcattgagggtggcggacatgagcgggttgaggatattaaagatgcagacttcattttctttaatggttcagcgccggagttcccggatttgccggagaacatcaagttcgtgcaggcctccatggcgggtattgatgcgctggtcaagcgtggtgtcgtcaatgagaaggcacgttgggcaaacgcggctggcctgtacgctgacaccgttgctgagtccaccattggtttaattctggcgcagatgcacatgcatgcgacgactcgtttggctaagtcgtggagcgtgcggcctgaggtggaaaacaacaagtcatggctgcatgacaataaaactgtcgctattttgggcgccggtggcattggcgtgcgtctgctggaaatgctcaagccgttcaacgtgaagaccattgcggttaataactctggtcgtccggtggaaggtgcagatgaaaccttcgccatggataaggctgagcacgtgtgggctgaggctgatgtgtttgtgctcatcctgccgctgactgatgccacttatcagatcgtcaatgcagaaactttgggcaagatgaagccttctgccgtggtggtcaatgtggggcgtggcccgctgatcaacaccgatgatctggtggatgcattgaacaacggcaccattgcgggtgctgcgctggacgttaccgatcctgagccacttcctgacagccacccgctgtgggagatggacaatgtggttatcactcctcatactgcaaacacgaatgagaggattcgtgctttgaccggcgaactcaccttgcgcaacattgagttgtttgaggcaggcgagcagatggccaccgaggtcgatgtggtggctggctac

SEQ ID NO: 2583 - DNA, 711 bp, Corynebacterium glutamicum
atgatttggccggcaggtcccaagatctccacgatctcaccctgctggaaatcaccaatgatttcagtaatgcccacagccagcaaagatttaccaccggaggtcactgcttccaccgcgccgtcatcgagtcggatctttcctgcagtatctgcggcatacaaagcccagaacttccacgcggagaggcggttgtccttggggtggaatacagtgcccacctgggcgtcttccagtgctgggccaatgtttgccgcagaggtcaacagcacaggcacgccacttcgggaagccaaacgtgcagcagacacctttgatgccatgccaccggtgcccacttttccgccgtcgccggcaatgacacctttcaaatcattgccgtcacgaacctcggaaataaacttcgcggtgggatcagtagggtttttatcaaaaagtccatccacgtcactgagcagcaccaaagcatcagccgacaccaggtgcgccacaattgcagcaagtcggtcgttgtcaccaaaattcacaccggtggttgccacggtgtcattttcattgacgataggaaccgcgcccaaaatgcgcagcttgtcgatggtacgctgcgcattcctcgcacgatcacgctttcctgcatcagctgcggtaagaagcacctggccgatggggcgaccataccgggcaaaagaacgtccccactggtgcatgagg

SEQ ID NO: 2584 - DNA, 1503 bp, Corynebacterium glutamicum
atgaaccgatttattgaccgcgttgtgctacacctcgccgcaggtgacggcggcaatggttgtgtctcggtgcaccgcgaaaaattcaagccacttggtggaccagacggcggcaacggcggccacggtggagacatcatcttggaagtcaccgcacaggtccacaccctgcttgacttccacttccacccacacgtgaaggccgagcgcggcgctaacggcgctggcgatcatcgcaacggtgcccgaggcaaggaccttgtcttggaagttccaccaggaactgtcgtgcttaatgaaaagggcgagactctggcagacctgaccagcgtgggcatgaagttcatcgctgctgctggcggtaacggcggtttgggtaacgcagcgcttgcctccaaggctcgtaaggccccaggcttcgccctgatcggtgagccaggcgaggcccacgacttgattcttgaactcaaatccatggcagatgtgggattggtgggcttcccatcagccggcaaatcatcactgatttctgtgatgtctgcagcaaagccaaagatcggtgattacccattcaccaccctgcagccaaacctcggcgtagttaacgttggtcatgagactttcaccatggcagacgtgcctggtttgatccctggtgcttctgagggcaagggcttgggtctggatttcttgcgccacattgagcgcacctccgtgctggttcacgttgtcgataccgcaacgatggatccaggccgcgatccgatctctgatattgaggctttggaagcagaacttgccgcctaccagtcggctttggatgaagacaccggacttggtgacttgagccagcgccctcgccttgttgtgttgaacaaggctgatgtccctgaggctgaagagcttgctgagttcctcaaagaagatattgagaagcaattcggatggcccgtgttcattatctccgcagtggcacgcaagggcttggatcctttgaagtacaagctgctggaaatcgtccaggatgcccgaaagaagcgtccaaaggagaaggctgagtctgtcatcattaagcctaaggctgttgatcaccgcactaaggggcagttccagatcaagcctgacccagaggttcagggcggattcatcatcaccggcgaaaagccagagcgctggattttgcagaccgactttgaaaacgacgaagcagttggctacctggctgaccgtctggccaagttgggcattgaggacgggcttcgtaaggcaggagcacatgtgggtgcaaacgtcaccatcggaggcatttccttcgagtgggagccaatgaccaccgctggcgacgatccagtccttaccggacgtggcaccgatgtgcgccttgaacagacctctcgtatctctgctgcagagcgtaaacgcgcatctcaggtacgtcgtggcctcatcgatgagttggattatggcgaggaccaagaggcttcccgcgaacgctgggaagga

SEQ ID NO: 2585 - DNA, 1887 bp, Corynebacterium glutamicum
gtgccacccgcacccaaacttgcagccctagggctccaacacgttcttgctttctacgcaggagccgtcattgttccgctgctgattgcacagtcgctgaacttggacactgcgaccaccattcacctgattaacgctgacttgttgacatgtggcatcgccacgttgattcagtctgtgggcattggtcgccacattggtgtgcgcctaccgatcgttcaaggtgtcaccactactgctgttgctcccatcatcgccattggtttgggcgttactgatggtcaaggtggcgttgcgtcgctgcctgccatttacggtgcagtcattgtctccggcattttcacgttctttgcagcgccggtgtttgcgcgtttcctcaagttcttcccaccagttgtcaccggtactgtgctgttggttatgggtgcttccctgctgtcggtatctgcaaatgactttgtgaactacgccgatggggtgcctgctgcccgcgatcttgcttacggttttggcaccttggcggtgatcattttggcgcagcgcttcttccgtggattcatgggcaccttggctgtgttgatcggcctggttggtggcaccgcagttgctctgatcttgggcgatgccaacttggatgaggtgggaaatgctgaagcgttcgacatcaccactccgttttattttggtgttccagaatttaacgctgttgccattttctccatgattatcgtcatgatcatcaccatggtggagaccaccggtgatgtgtttgcaacgggggaaatcgtcggcaagcgaactcgccgcagtgatgtcacccgcgcactgcgcgctgacggcctgtccaccctgatgggtggcgtcatgaactccttcccgtacacgtgcttcgcgcaaaacgttggcctggtgcgcatcacgggcgtgaaatctcgctgggttgcggcagctgctgccggcttcatgatcatcctcggtgtgctgcccaaggctggcgcgatcgtcgcttccatcccttccccagtcctcggtggcgcatccttggcactgttcgccaacgttgcatgggtgggcatccagaccatcgccaagtctgacctcgctgatagccgcaactccgtcatcgtgacctccgcacttggcctagccatgctggtgtccttccgccccgatgttgctcaggcgttccctgagtgggcgcgtatcttcgtctcctccggcatgtccgtcggcgcgatcaccgcgatcctgcttaacctgctgttcttccacgtcggacgccaatccggtggacaagtcgctacctcaaaatccggtgagcgcatcaatttggatgcggtcaacaagatggatcgcaccgacttcgtagaaaccttcgcaccgctgttcaacagcaagacctggcctttggaaaccgcatgggaatcccagccattcgccaacgtcacggaactgcgcgaagccatccaagtcgctgtgctcaccgcaccgttgtccgaccgcgaagagctcatccacgactaccccgacatggcacagctcattttggccaccgaagaggaagccgccaccatctctcaagaccgtggttcgatcggtcttgatgatctcgatgacgtggatcaagaaaagctcatcaccgtcaccgagcagtaccgcgaacggttcaacatgccgtatgttgcgtacttcgacaccatggattctgtggataccgtcgtagccgccggcttgcgccgcctcgacaactccgacgagcaggagcaccgccaagcgctatcggaaatcattgagattgccaatgaccgcttcgatatattgcttgccgacgctaacccagcccgttcagctttcgatcgcaagtttaccgagactgacttcctcggc

SEQ ID NO: 2586 - DNA, 843 bp, Corynebacterium glutamicum
atggatcagaagaataagctttcgaagtctgaaggtatcccattggtcaccttgaatgatggaaaaaccattcctcagcttggttttggtgtgttcaaggtagatcccgatgaagcagagcgcgtagttaccgaagcacttgaggtaggttaccgccacatcgatactgctgcgatttacggcaatgaggaaggtgtcggccgagctattgctaagtccggcattcctcgtgaagagctgtttattactaccaagttgtggaacgatcgccacctggatgtagaagctgcttttgaggagtctctgcagaagctgggcttggattatgtagatctgtacttggtgcactggccggcaccgaagaacgataattatgttgctgcatggaagggcttggaaaagctcggtgaccgtgctcgttccatcggtgtgtgcaacttcctgccagagcacctagaaaagctgctggcagaggcaaccactgtgcctgccattaaccagattgagctgcacccagctttgcagcagcgcgatgctgttgaggcatctcttgcagcaggcatcactgtggagtcgtggggtcctctgggacaggggcgttttgatcttggcgctgaggaaccaatcgcagctgcagcgaagaaccatggaaagaccccagctcaggttgttatccgttggcacctgcagaacggtttcgttgtgttccccaagactgtgactaagagccgcatggtggaaaacatcgacgtgtttgatttcgaactcagtgatgaggagatggctgcgatcactgctcttgagcgcaatgatcgtggtggttcacacccgaatgatctgaac

SEQ ID NO: 2587 - DNA, 621 bp, Corynebacterium glutamicum
atgagctatgactttgtcctctttgaaaccgatggcgacccaggtagcgcccgtatttccaaaaccccactgaccgaacgcatcgatttcgccacgccatctacaacccctgtgttggaatctctttcggcagggcttgccgaaacggtgccagacaccgtcaagcttgaagaagacgccatccacttatccggtgatcgttgcctttacgttgtgaccaactacaactccgccgaagaagcagccgaatggctcaccgccatcgctttcgattacggactgggccttgccgacatgaacgcggacaccatcctgcttttcggcgatgaagattccgacgctgtcgtccaaatcgatgactggttctcccccgctttctctgcgtacggccttccccacctcctggtggaagtcatgcgcctgaaggattccaaaaccccttatcttcgagtcacacttgctgcagatgactcgaaatttatccaaaccctttacgaaaccgacaacaaacaatggttggtggaaacctcttcctccacaggcacggacgaaacccacgtgaagaccattaatgatgtgctggaacgcatcgagacatggttcaaccaggagactgctgtc

SEQ ID NO: 2588 - DNA, 396 bp, Corynebacterium glutamicum
ttgttgtacattacacagagcccccaaaagaaccccaaaaacaaaaaactgcccctcaccttcccaaaaggaaagcaaggagcagttttaaactcgttgagtgagtgtgacttaagcgtcaacagcctcggtctcgacgatgttcaccaagcgacggttgcgcttggtggaaaactggacagcgccagtcttcagtgcgaagagagtgtcgtcgccaccgcgaccaacattctcacctgggtggaacttggtgccgcgctgacgaacaaggatctcgcctgcggaaacctgctgaccaccgaaacgcttgacgccaaggcgcttagcctcggaatcacgaccgttgctggagctagatgcacccttcttgtgtgccatgtggtaattccctccttc

SEQ ID NO: 2589 - DNA, 264 bp, Corynebacterium glutamicum
atggcacacaagaagggtgcatctagctccagcaacggtcgtgattccgaggctaagcgccttggcgtcaagcgtttcggtggtcagcaggtttccgcaggcgagatccttgttcgtcagcgcggcaccaagttccacccaggtgagaatgttggtcgcggtggcgacgacactctcttcgcactgaagactggcgctgtccagttttccaccaagcgcaaccgtcgcttggtgaacatcgtcgagaccgaggctgttgacgct

SEQ ID NO: 2590 - DNA, 303 bp, Corynebacterium glutamicum
atgtacgcgatcgtcaagaccggcggaaagcagtacaaggttgccgaaggtgacctcgttaaggtcgagaagatcgagggtgagccgggtgcatccgtggctctcaccccggttctgctcgtcgatggcgccgatgtaaccaccgccgctgacaagctcgcttctgtgagcgtcaacaccgagatcgtcgagcacaccaagggcccgaagatcaagatcctgaagtacaagaacaagaccggatacaagaagcgccagggacaccgtcagcccctgaccgttctgaaggtaaccggaatcaag

SEQ ID NO: 2591 - DNA, 2268 bp, Corynebacterium glutamicum
atggaacgtcgcatgattgtgcgcgagcgccaacgccacgatcacccaggtctggtcactcaggttggtgtgctggaagacgatcagctggttgagcagtttgttacctctgatgcgcagatgtctatggtgggcaatatttatctggggcgcgttcaaaatgtgctgccaagcatggaagctgccttcattgacattggaaaaggtcgcaacggtgtgttgtatgccggcgaagtcgactggaaagctgctggacttggcggacgtggacgtcgcattgagcaggcgctgaaagccggcgaccaggttctcgtccaggtctccaaggatccattgggccataagggtgcgcgtttgaccacccaaatttccctggcgggacgttacctggtgtacgttccaggtggtcgcagcgctggcatttcccgcaaactgcctggacctgagcgcaagcgtctgaaggaaatccttggccgcgttgtcccagcgcagggtggaaccatcatccgaactgctgctgaaggtgtgtcggaagaaaacatcgcagctgacgtgaaccgtctgcacaccctgtgggagcagatcaaggaacgcactgcggaggaaaagaagtcccgcggttctaagccgatcaccatgtatgaagagccagacatgctggtgaaggtgatccgtgacctcttcaatgaagatttcacctcactgatcgttgacggcgaccgtgcctggaacaccgtgcgtgcctacatccaatcagtcgctcctgatttggtgtcccgcgtggaacacttcaatcgcgcagactttgacggcaaggatgctttcgaagcattcgacctgaacacccagcttgaggaagcgctgtcccgaaaggtgaacctgccatcgggtggatcgctgatcatcgaccgcaccgaagccatgacggtgatcgatgtgaacaccggacgctacaccggcaagggtggtggcaacttggaagaaaccgtcacgctcaacaacattgaagctgccgaagaaatcgtgcgccaaatgcgcctgcgggatctcggtggcatgatcgttgtcgacttcatcgatatggtgctgccagaaaaccaagaattggtcctgcgccgactcaatgaagcgctagaaaacgatcgcacccgccaccaagtctctgaggtaacctcactgggacttgttcagatgacccgcaaacgcatcggcgcgggcctgctggaaaccttctcttcaccgtgtgagcactgtgaaggccgaggcatcatcgttcatgttgatccagtagacaccgttgacgagcgcgttgaggcgaaagcggaagagcgtagccgtcgtcaccagcgttccaatagcactaacaaggcagctgcggagcacccgatggttgttgccatgcgtgatctcgtggaaagcgatgaacacgatctggatcaagaatttgaggaactcgctgcatcagtgatcgtcctcgatgactccgatctagatgatgtggtcaacgacaagctcgacgagcctgagcgcattcttgctgaatccaccgtggaaccagaggaaggaccacgcaggagggcccgccgtcaacgtcaggaatctgctgcggatgatattgccgcgattgcagctgctgccgtggacattgcttctgaagaagaccctgatgagccttcgggatcgtcgtatgtgtctgactttgaggcagagcctattgcacctgtagttgagaaggctgctgaacctgtggctgagccaaccgctgattatgaaaaggcacgtgccgaatttgaggcaagcccacgcaggcgccgcaagactcgtggcaattcacgttcggatcatgctccaaagccagaggatttcgcacctgtagttgaagaggttgctgagactccagtgaagacacctgcgcggaaggctccacgccgtaaccgtccaagtgagctcagttccggtgcgccgtcctctgcaccatcgaccaggaaccgtcgccgcgcagtgcgccgtcaactggtggaagctcctgagaccgtcgttgagatagcacctgaagcagcaccagaacaggttgcagagcctcaggttgaattcgaccagccagacaaccgccgaaagcgtcgtcgtgctgtgcgcgtgacagcggcgccggtggagaagaaggtggcgtcgacaagcaatgcgcgggcgccgaagaaggaacctcaggcggcgagcaccaccaacccaggccgccgtaggcgggctacccgacgaggcccacgaagc

SEQ ID NO: 2592 - DNA, 549 bp, Corynebacterium glutamicum
atgaactcctgggtgctgaccacatggcggcgttttttgttttcttcgcgcatttccgtgcgacggcggcgttgcgcctccaagcgagtggagcccttaattccgattggctcgtttacctcttctacttcgcttgtcgacgcctcctcactcacttcggtgacggtttcagcttcagctccacgtccgcggccggtgccacgacgcccacggcgcttccgcgccgtgcgttcgcggacctgttcatcgtcggtgtcttggacgttttcagtaggtacaactgcaggtgccacaaagatcggcgtgtacacagatgcttccaccggcgccggggtgatctctgggacgatatcttccagcagttctgcagtggcttcttcgcgggctgccgcctcgaagtcagtaggttgcgcgactgccgcgagttcgcgctctactttttcttcgatttggtggatttcattttccacattcttctcaacgcgtcgacgaatcttctccaccggttcaacgtcggggacggcagctggggcagcgttgagtacgggc

SEQ ID NO: 2593 - DNA, 573 bp, Corynebacterium glutamicum
atggcggcgttttttgttttcttcgcgcatttccgtgcgacggcggcgttgcgcctccaagcgagtggagcccttaattccgattggctcgtttacctcttctacttcgcttgtcgacgcctcctcactcacttcggtgacggtttcagcttcagctccacgtccgcggccggtgccacgacgcccacggcgcttccgcgccgtgcgttcgcggacctgttcatcgtcggtgtcttggacgttttcagtaggtacaactgcaggtgccacaaagatcggcgtgtacacagatgcttccaccggcgccggggtgatctctgggacgatatcttccagcagttctgcagtggcttcttcgcgggctgccgcctcgaagtcagtaggttgcgcgactgccgcgagttcgcgctctactttttcttcgatttggtggatttcattttccacattcttctcaacgcgtcgacgaatcttctccaccggttcaacgtcggggacggcagctggggcagcgttgagtacgggctgagacagggcgtcgagaagcttttctacttcttctttgctcaggtt

SEQ ID NO: 2594 - DNA, 747 bp, Corynebacterium glutamicum
gtgtcggaaatcatgggagatttagcaaagcacatgggcagtgaaccaccagcatggtggaagtttttaccgatgattgtcctcgctggagccactcgagttacctatgaagtagaaccttggctggcgatcccattattcattttggcttttgcatcgatattgatcccattcccgatctctaagacaaaaggactccgtgatatcgatgcctggaaaatccacaccacgcaaggcgataaaaagcgtgccatccgccaactgatcattccggctacggctttggccatcgacatcattgggctgccgacattatttaatgcccctccccttgcttccgctgcactttttggcggtgtttacggcgcttccctagcttgggctgcgtacagagctgatcagcttccacgcattcgaacgaaggaacgcctcgcagaactttcacaaaatgcatctctggatgatgtgcgctcagatgacttagatgttctagagcagccggaatcccgtgaattagtgcgctgtctgcttgcccacggtgcgatggatggcactcgggtgatggccagacaggtcgcgcgagtactggataccgaggtagacgaagtacatcaggtagcacgctcactagaacagcatggtttggttagtcgctccaccatcatgccgggtggggatccaggaaaagtattcatcgaagtttccctgaaagggatctcagccatcaaggcacttgaatccggacgc

SEQ ID NO: 2595 - DNA, 609 bp, Corynebacterium glutamicum
atgtcaaacgcagaaattaatcccgttgaatatgaaatcaacaaccacgcccctggtaccgcgctaaacccacagtgcgaagacggcgccaacgtagaaatcatcacctcccgtgaagtccccctcggcggaccacgcgccatgaccgtgcaccgcacactcccccaacgccagcgctccctcatcggtgcctggtgttttgtggatcattacggccccgatgatgtctcactaaccggtggcatggatatggcctcccacccgcacaccggattgcaaacagtcacgtggctttttgaaggcgaagtcacccaccatgattccggcggaaatcacgcagtcgtgcttcctggcgaagtcaacctcatgaccgccggcgcaggcatctgtcacaccgaagtttccgccacctccaccacgattctgcatggtctgcagttgtggacagttcttcccgacaaagaccgcgaaggaccacgccgctttgatcactacgctccagaagaaatcacactcgaaggcggaagtgcacgcgttttcctaggttcgctatttggtcaaacctcccctgttcatacgtttactggctcttcctgttttagagtgcat

SEQ ID NO: 2596 - DNA, 1308 bp, Corynebacterium glutamicum
atgaagtctaccggcaacatcatcgctgacaccatctgccgcactgcggaactaggactcaccatcaccggcgcttccgatgcaggtgattacaccctgatcgaagcagacgcactcaactacacctccacctgcccagaatgctcccaacctggggtgtttcgtcatcacacccaccggatgctcattgatttacccatcgtcgggtttcccaccaaactgtttatccgtctacctcgctaccgctgcaccaaccccacatgtaagcaaaagtatttccaagcagaactaagctgcgctgaccacggtaaaaaggtcacccaccgggtcacccgctggattttacaacgccttgctattgaccggatgagtgttcacgcaaccgcgaaagcacttgggctagggtgggatttaacctgccaactagccctcgatatgtgccgtgagctggtctataacgatcctcaccatcttgatggagtgtatgtcattggggtggatgagcataagtggtcacataatagggctaagcatggtgatgggtttgtcaccgtgattgtcgatatgaccgggcatcggtatgactcacggtgtcctgcccggttattagatgtcgtcccaggtcgtagtgctgatgctttacggtcctggcttggctcccgcggtgaacagttccgcaatcagatacggatcgtgtccatggatggattccaaggctacgccacagcaagtaaagaactcattccttctgctcgtcgcgtgatggatccattccatgttgtgcggcttgctggtgacaagctcaccgcctgccggcaacgcctccagcgggagaaataccagcgtcgtggtttaagccaggatccgttgtataaaaaccggaagaccttgttgaccacgcacaagtggttgagtcctcgtcagcaagaaagcttggagcagttgtgggcgtatgacaaagactacggggcgttaaagcttgcgtggcttgcgtatcaggcgattattgattgttatcagatgggtaataagcgtgaagcgaagaagaaaatgcggaccattattgatcagcttcgggtgttgaaggggccgaataaggaactcgcgcagttgggtcgtagtttgtttaaacgacttggtgatgtgttggcgtatttcgatgttggtgtctccaacggtccggtcgaagcgatcaacggacggttggaacatttgcgtgggattgctctaggtttccgtaatttgaaccactacattctgcggtgccttatccattcagggcagttggtccataagatcaatgcactc

SEQ ID NO: 2597 - DNA, 378 bp, Corynebacterium glutamicum
ttgcttgtcgattccggcgacgtccaactagaaggcgtcaccgtcgagcccacccagctggcctacaccggcatcaatgaaacccaactccgaatccgtaacatcggcaccacaccggcgcgtactgtactgctaggtggcgaaccatttaccgaagacatcgtgatgtggtggaacttcattggccgcagccatgaagaaattgccgagtaccgtaaacagtggcaggccgaagctgatcgttttggtatcacccacggatatatcagccaccacaaagatgggctcaccaggcttccagcacccgagcttcccaacgctgctatcaaggcacgtaaaaacccagcaccaactgcacgaccagaaacgagaattgat

SEQ ID NO: 2598 - DNA, 450 bp, Corynebacterium glutamicum
atgcgctccgctcacggcccatacattgataagttcttccccgagccatacaagaacatgctcgagctcaccaagactctgcgaaagatctacccggacgttgatctgcctacctcattgattgagctggtcaatgtccgcgtttctcaaatcaacggatgtggcacctgcttaagtttacatgttcccgctgctcgccgtgccggcgttccagagaagaaactcgatgctctggcagcgtggcaaatggtggatgaattcaccgtggaggaaaaggcagcactacagctagcagaatccttaaccttgctggaatcccgcgaaggtcacctggctgcacgcacagcctgcagtgtgtttgccgaagagcaggtagctgccctggaatgggctatcattgcgatcaatgctttcaaccgcatttctattgccagtgggcacccactgctc

SEQ ID NO: 2599 - DNA, 408 bp, Corynebacterium glutamicum
atgactgaacgtactctcatccttatcaagccagacggtgttaccaacggacacgtcggcgaaatcatcgcacgtattgagcgcaagggcctgaagctcgctgctctggatctgcgtgttgcagaccgcgagaccgctgaaaagcactacgaagagcacgctgacaagccattcttcggtgagctcgttgaattcatcacctctgcacctctgatcgcaggcatcgtcgaaggcgagcgtgcaatcgatgcatggcgtcagcttgctggtggcaccgacccagttgctaaggcaaccccaggcaccatccgcggcgatttcgcactgactgttggagagaacgttgttcacggttctgattccccagagtccgctgagcgcgagatctccatctggttccctaacctg

SEQ ID NO: 2600 - DNA, 360 bp, Corynebacterium glutamicum
ttgggtggcggtgttatcaaagtagtcgtagcgttgagaactatgcgaaactctaagtctggcctggccttttccgcagctgcactattttgtgtcgtcgcggtaatcactcgtattgcaggttccccatcatttatcgctattgtggcgatcatcgtggctgcgatcgcactttttgtgggtctgaacagtcgtgtgggaacaaagcttgttgatcagccagtggtgttcacccaggaacaaattgatcaattgaaagagttgaaatcccgcgaccaggaggcggcagcgatccgtcaggcgcagctgtggagtaggggatcgtccagcgaagcggtcgcagaggctgtgaggaagctc

SEQ ID NO: 2601 - DNA, 342 bp, Corynebacterium glutamicum
atgactttaaaagataagtacgacactgaagtagctgtttctaataatcaggacaagcaccaatttgaggtcagttaccctgaagatgccgtgactgctggctttgctgcataccttgataaaggtgattcgcggatcttctatcacaccgttgttggcgatgaattcggtggcaagggacttgcgtcaattcttgtttcagaggcgttaaaagccacaaaagaagctggtcttaccgtggttccggtatgtccctttgttaaaggattcgtggaaaagaacgcattcgagggttaccgcaaaccaaaccatgaggatatggagctggtgaagagccagatg

SEQ ID NO: 2602 - DNA, 465 bp, Corynebacterium glutamicum
atgcctaaatctctgacctttgaagacagcattaacatcgcagcgcccatcaatcaggtctacgcactagtttctgacatcactcgaactggagaatggtcgcccgtgtgtgagaaatgctggtgggatgaagacgaaggccccgtcgtgggtgcgcactttactggccgaaacgtcacacctgagcgcacctgggagacacggagcgaggttatcgtcgcagagccaaatcgttgctttggttggagcgtgactgatggaaacgtcaagtggatttattccatggaaccgttagaagaaggcacagtattgactgaatcatgggaatttacccccaaaggtcaacgattcttccacgacaaattcggcgacaaatcaattgaagaaattgaaaagcgacgcttggcagctataaccggaattccagaaacactggttgccattcagcgcattctggaagttgag

SEQ ID NO: 2603 - DNA, 423 bp, Corynebacterium glutamicum
atgagcaagcgtgaagaatcaattgagtacggaccattaggcaaaggccacgatccattaaaggatcccatgaagggtatccgaggtgtcatggccggcaccttagtgatggaagcaatcaccttaggtcttgttctcaccgtgattctgcgcgtggacgacggcatctactggaccaccttcaactgggtctatgtatcagcagtcgcgatcgcacactttgttgctgcatttctgcaaaggtttagttggtccatcccgatgaacatcgtgctgcaggttcttgcacttgccggtttctttgttcaccccgcgatgggcttcgccgccatcatcttcatcatcgcgtgggcgtacctgttctacctgcgctctaatctgattgatcgcatgaaacgcgggctgcttaccacgcagcacagc

SEQ ID NO: 2604 - DNA, 1374 bp, Corynebacterium glutamicum
ttgctgcgccttgcccaggtggaagcagagttggatcaacgttggttggaaaccaaaattgatcccactttccgacgcatgagctacatgatggatctcatgggccaaccacagaattccttcccagcaattcacgtggctggcaccaacggtaagacctccaccacccgcatgatcgagtcgttgctgcgcgcattccaccgccgcaccggccggaccaccagcccgcacctgcagctggtaaccgaacgcatcgcgattgatggcaagcccatccacccgcgtgatttcgtgcggatctacgaagagattaagccctacatggagatgaccgacgcctggtcagaggccgagggcggaccgaagatgagcaagtttgaggcactcgtggccctcgcttacgcaggttttgccgacgctcctgttgacgtcgccgtcgttgaggttggtcttggcggacgctgggatgccactaacgtgatcaacgcagctgtttccgtgatcaccccggtgggcatggaccacgtggatcgcctgggcaacaccattggtgaaatcgctggtgaaaaggccggcatcatcaaggctcgtcctgcatctgaggatggcaccgagcctgagggcaacgttgtcatcgtgggcaagcaggagccagaagcaatgaacgtgattctgcagcaagccgtggacgtggacgcagctgttgctcgtttgaacatggaattcggcgtggtggaatccgccattgccgttggtggacagcagctcaccctgaagggtttgggcggcgaatacaccgacatcttcctcccactgtctggcgcgcaccaagcagataatgccgcggttgctctcgcagcagtggaagcatttttcggtgcatccgccggacgcccattggatatcgacacggtgcgcgaaggcttcgcacaagttcagtccccaggtcgcctcgagcgcctgcgctctgcaccaaccgtgttcatcgacgcagctcacaacccacacggtgccgcagcacttggtgcagcactagaccgtgactttgagttccgtcgcctcatcggtgtcatcggagtgctctgcgacaaggatgcccgcggcatcttggaatcacttgagccatacctgcatgaaattgtgtgcacccagactgcctcagagcgcgcattggacgcatacgatttagctgaatatgctcgagagatctacggcgatgagcgtgtgcacgtccaagaagatcttgctggcgcggtagaactcgctattgaactagcagaagacaccgatgtacagtccggatcaggtgttgtgatcaccggttcaatcgtgaccgccggcgatgcgcgcacgctgtttggaaaggaacctgca

SEQ ID NO: 2605 - DNA, 612 bp, Corynebacterium glutamicum
atgcgctcaacttcttcttgggcaatctgcgcacggccacggatcttgtctaccactgcatcaggtgccttggacaggaaagcctcattacccagcttctttgcggtggtttccaattccttctgtgcgttagccaggtccttttccaggcgcttgcgctctgctgcaacgtcaacagttccagaggtgtcaagctccaccgtgatggttgcttggctcaggcggatctccaggctggcagaagctgcgaaatcatcttctggttgctcgatgcgaaccagggagcgcacggaatcttccagatcctgcaggtcacatgccacgaaatcaaggcgtgctggaaccttctgggaaggcttcacaccctggtcagcgcggaaacgacgaacctcagtaacaagcttctcgacgtcgccaatgcgcctagctgcatcagcgtccacggcgactccgccgttggtgtcagctgcggttggccaggaggccaccacgatggaggtgcgatcagtaagtgcctgccacagaacttcggtgacgaaaggcatagctgggtgcagcagacgaagcagtgcatccaagacatggccaagcaccttttgggtgttttcaccc

SEQ ID NO: 2606 - DNA, 714 bp, Corynebacterium glutamicum
atggccaagcaccttttgggtgttttcaccctgagcggaggtgccttcgcgtgggatctgaaccttcgcgatttccaggtaccagtcacagaactcgttccacgcgaagtggtagagctcctcgttggccttcgcgaactggtagttgtccaggtaagcatcaacgtcgaggcgaacctgctcaaggaggtccacgatccagcggtcagcgtcggtgagttcttcacgtgctggcaggccttcggacactgcaccgttcatcagcgcaaacttggttgcgttgaacagcttggtggcaaagttacgggagctctgtgcagagtcttcaccgacaggcaggtcgacgcctgggttagcgccacgggcaagggtgaagcgcagcgcatccgcgccgtagttctccacccaatccatcggatcgatgccgttgcccaaagacttggacatcttgcggccgtgctcatcgcgaaccaggccgtgcaggaagaggtcggtgaatggaacctgtgggcgtccatccttgccttcgcccagaagttctggggtttccttggctgcaaaggtgccgaacatcatcatgcgggcaacccagaagaacaggatgtcgtaggcggtgaccagcacggaggttgggtagaacttctccagctcaggggtcttttctggccaacccattgtagaaaatggccacagcgcagaagagaaccaggtatc

SEQ ID NO: 2607 - DNA, 663 bp, Corynebacterium glutamicum
atgcatgttgtcaacccagtcaaagtagcgaggctccagggacttcgggtggatggtggtgtcgccttcgcgcacggcatcgccggacatcttggccagctcttcgaccttgacgaaccactgcagagacagacgaggctcaatagcttcgccggaacgctcggagtgtccgacggagtggacgtatgggcgaatttccttgacaatgcgaccctgggctgcgagttcttcgcggaccttgatgcgtgcttcttcgcgggtcaggccatcaaactgggttccggtatcggcaatgcgtccggtcttgtccatgatggtaggcatgtccaggttgtggcgcaggccaagagcgtagtcattagggtcgtgtgctggggtgatcttgacggcaccggagccgaactctgggtcgacgtaatcatcagcaacaaccttcaggctcaggtcatcgcggaatgggtgaggcagggtctgtccgaccaaatccttgtagcgctcatcgtctgggtgcacggcaacagcgacgtcgccgagcatggtttccacacgggtggtggcaacaatgacatgtggttcatcgtcgttgagggaaccatagcgaatggataccagttcgccttcgacatccttgtagataacttcgatgtcagaaaccgcggtttc

SEQ ID NO: 2608 - DNA, 2700 bp, Corynebacterium glutamicum
gtgactgaccagaataatgagaccaccagccagaaccgcgcagacaagctgcccaagtcctgggatcctaaagctgtagaagctgatttgtaccagggctgggtagacgccggttatttcactgccgatcctgctagcgacaagccaggattctccattgttctgcctccaccaaacgtgaccggccagctgcacatgggacacgcacttgaccacaccctgatggatgctcttgcacgtcgcaagcgcatgcagggctttgaggttttgtggctgccaggtatggaccacgcgggtatcgcgacccagaccaaggtcgaggagatgctgaaggaaactgaaggcaaaactcgctacgactatgaccgcgaagagttcatcgccaaggtctgggagtggaagcaagaatatggtggaaagatcggcgagcagatgcgcgccatcggcgattccgtggactggtcccgcgagcgtttcaccttggatgacggcttgtcccgcgccgtccaaacgattttcaagaagcttttcgacgccggcctcatctatcaggccaaccgcctcgtcaactggtcgcccgtactagaaaccgcggtttctgacatcgaagttatctacaaggatgtcgaaggcgaactggtatccattcgctatggttccctcaacgacgatgaaccacatgtcattgttgccaccacccgtgtggaaaccatgctcggcgacgtcgctgttgccgtgcacccagacgatgagcgctacaaggatttggtcggacagaccctgcctcacccattccgcgatgacctgagcctgaaggttgttgctgatgattacgtcgacccagagttcggctccggtgccgtcaagatcaccccagcacacgaccctaatgactacgctcttggcctgcgccacaacctggacatgcctaccatcatggacaagaccggacgcattgccgataccggaacccagtttgatggcctgacccgcgaagaagcacgcatcaaggtccgcgaagaactcgcagcccagggtcgcattgtcaaggaaattcgcccatacgtccactccgtcggacactccgagcgttccggcgaagctattgagcctcgtctgtctctgcagtggttcgtcaaggtcgaagagctggccaagatgtccggcgatgccgtgcgcgaaggcgacaccaccatccacccgaagtccctggagcctcgctactttgactgggttgacaacatgcatgactggaccatttcccgtcagctgtggtggggacaccgcatcccaatttggtatggaccaaacgatgaaatcatctgcgttgggcctgatgagcaggcacctgagggctacgtccaagacccagatgttctagatacctggttctcttctgcgctgtggccattttctacaatgggttggccagaaaagacccctgagctggagaagttctacccaacctccgtgctggtcaccgcctacgacatcctgttcttctgggttgcccgcatgatgatgttcggcacctttgcagccaaggaaaccccagaacttctgggcgaaggcaaggatggacgcccacaggttccattcaccgacctcttcctgcacggcctggttcgcgatgagcacggccgcaagatgtccaagtctttgggcaacggcatcgatccgatggattgggtggagaactacggcgcggatgcgctgcgcttcacccttgcccgtggcgctaacccaggcgtcgacctgcctgtcggtgaagactctgcacagagctcccgtaactttgccaccaagctgttcaacgcaaccaagtttgcgctgatgaacggtgcagtgtccgaaggcctgccagcacgtgaagaactcaccgacgctgaccgctggatcgtggacctccttgagcaggttcgcctcgacgttgatgcttacctggacaactaccagttcgcgaaggccaacgaggagctctaccacttcgcgtggaacgagttctgtgactggtacctggaaatcgcgaaggttcagatcccacgcgaaggcacctccgctcagggtgaaaacacccaaaaggtgcttggccatgtcttggatgcactgcttcgtctgctgcacccagctatgcctttcgtcaccgaagttctgtggcaggcacttactgatcgcacctccatcgtggtggcctcctggccaaccgcagctgacaccaacggcggagtcgccgtggacgctgatgcagctaggcgcattggcgacgtcgagaagcttgttactgaggttcgtcgtttccgcgctgaccagggtgtgaagccttcccagaaggttccagcacgccttgatttcgtggcatgtgacctgcaggatctggaagattccgtgcgctccctggttcgcatcgagcaaccagaagatgatttcgcagcttctgccagcctggagatccgcctgagccaagcaaccatcacggtggagcttgacacctctggaactgttgacgttgcagcagagcgcaagcgcctggaaaaggacctggctaacgcacagaaggaattggaaaccaccgcaaagaagctgggtaatgaggctttcctgtccaaggcacctgatgcagtggtagacaagatccgtggccgtgcgcagattgcccaagaagaagttgagcgcattaacaagcgtctggaggaattggcc

SEQ ID NO: 2609 - DNA, 1575 bp, Corynebacterium glutamicum
atgcgcacagccacaaaagtcatcgcaacagtgatggcctcaaccctggctatcgggctggcatcttgttccagctctagtggcaccccagacgtgaattacgtatccgtcaacggcaccgaacctcagcgcggactcatcccgggcgacaccaatgaaaacggcggtgggcgagtggtggacatgctgtactccgggctcgtctactttgatgaagctggcgttgctcaaaatgacctggcggcatcaattgaccaggaaacagacaccacctacaaaatcactttgcgtgatggcatcaaattcagtgacggatcggatattactgccactgattttgtggatacctggaattttgtagtggaaaatggactgctcaacacttctttcttctcaccgattaaagggtatgaggagggcgtggaaacgctcgagggtttgaatgtggtggatgatcgcacatttaccatcgagcttgcccaaccggattctgagttcacccaacgcattggctactacggttttgcaccgatgccagcttcggctcgcgatgatattgacgcctttggtgaaaaccccgtgtcctctggcccttacaaactagagcagtgggatcacaacgcagaactgaaagtggtggccaatgaacactacgatggcccgcgcgcagccaacaacgatggcttgaagtacgtgttctacgcccaaaatgatgcagcttattcagatctgttggctggaaacctagatgtgctggatctcattccaccatcggcgtacaccacctatgaagaggaactgtcgggtcgatccattaatcaacctgcggcctcctatctggaactctccattcgcatggaatcccccaactttgaagggcaacagggacagttgcgtcgacaagcaatttctatggcgattaaccgtgaagaaatcgctgagcagatcttcgccggcacctacacgcctgcgctcgacttcaccgcgcccgtgctcgacggctggcgcgatgatttgaacggcaatgacgtgctgactttccagcctgacaaggcccgtgagctgtgggaagacgctgaggagatcgcaccttttgagggcgaattgcagatcagttacaacgcggatgttcccaaccgggaatgggtggatgcggtagcaaacagcatcagcaacgaattagacgtcaacgccactggcaatcctttccccgattttaaatccttccgcgacacataccgcaccaccggattggatggcgcctaccgcaccgcgtggtttgcggactacccaagcatcggcaacttccttggacctaactacacctcgggcgtggcctccaacgatgccaagtacgaaaacccagaatttgatcaattgattgccgacgccgcagcagcctccaccaaggaggaaaccttccaggcatatgcgcaggcccaggaaatgttgttgcgcgatcttcccgcaatcccactgtggtacccgaatgtggttggcggctactcagaatccgtggacaacgtctccgtaaactggaaggccatacctgtttattgggcaattacaaagcaa

SEQ ID NO: 2610 - DNA, 1452 bp, Corynebacterium glutamicum
atgcgttttggacttgacttgggaactacccgcacaatcgcggccgccgtggaccgcggaaactatcccatcgtcactgtggaagattctttaggcgacacccacgatttcattccatctgtggtggccctcaaggcagataggattgtcgcgggttgggatgctattgaggttgggcaggaccacccttccttcgtacgttctttcaaacgcctactctctgaacccaatgtcacggaagccaccccggtctacttgggcgatcatgtacaccctttgggcgccgtcctggaggcttttgcggaaaacgtggtcactgcgctgcgtgcatttcagacgcaattgggagatacctccccgatcgaagtagtcattggtgtgcccgccaactcccacagcgcccagcgactgctcaccatgtccgccttcagcgccacaggcatcaccgttgtcggtttggtcaatgagcccagcgccgcagctttcgagtacacccaccgccacgcccgcaccttaaactccaagcgccaagccatcgtggtttatgatttgggaggcggaacattcgactcctcgctcatccgcatcgacggcacccaccacgaggttgtgtcctccattggcatttcacgccttggtggcgatgatttcgatgaaatcctcctccaatgcgcgctcaaggccgcaggcagacagcacgatgcgtttggcaagcgtgctaaaaacacgcttctcgacgaatcccgcaacgcgaaggaagctcttgttccgcaatcccgtcgcttggttctagaaattggcgacgacgacatcaccgttccagtgaacaagttctacgaggctgccactcccctggtggaaaaatccttgtccatcatggaacccctcatcggcgtcgatgatcttaaagattccgacatcgcaggcatctaccttgttggtggaggatcctcgctcccactcgtttccaggttgctccgcgagcgtttcggccgccgtgtccaccgctccccattcccctcaggttccactgcggtgggtctggccatcgcggctgacccttcctctggtttccacctaagggaccgcgttgcgcgaggcatcggtgtgttccgtgagcacgattctggtcgtgccgtgagctttgacccgctgatcgccccggacaccgattctgcgaccgtggcgaaacgatgctacaaggcggtgcacaacattggttggttcaggttcgtggaatactccaccgtgtccgaggatggcagccccggagatatttccctgctcagtgaaatcaagattccttttgatagctccatcaccgatgtggatgctaccgagatttcacgtttcgatggcccagaagtagaagaaaccatcacagtcaatgacaacggcgtggcttccatttccatcaagatactcggcggcgttaccgtcgagcacacaatt

SEQ ID NO: 2611 - DNA, 585 bp, Corynebacterium glutamicum
atgacttcgcttttcgacgccccaaccctccaacgcgtcaccgttttcacgggctcggcgctcggcagttcctcgctgtacacgcaagcggctcaaaccttggcgaaaaccgcggtagaccgcggcatcgacttggtttacggtggcggaaaagtggggctcatgggtatcgtcgcggatgcgttcctggaatcaggtggcgaagcctttggcgtcatcacggaatcacttatgaagggtgagcttgggcatgaaaagctcaccgaacttgaaatcgttcctgatatgcacatccgcaagcgtcgcatggcagaacttggcgatggttttatcgccatgcccggtggcgccggcaccttggaagaacttttcgaggtctggacctggcaacagctgggcattcatcaaaagcccgtcgcactttatgatgtcgatggtttttggcagcccctgctggaaatgcttgagcagatgacccagcgtggatttatcaagcgagacttctttgagtgcctcatcgtggaatccgacccgcatgccctgctaaaggcaatgcagacctggactccaccagcaccaaaatgg

SEQ ID NO: 2612 - DNA, 984 bp, Corynebacterium glutamicum
atgaattccccgcagaacgtctccaccaagaaggtcaccgtcaccggcgcagctggtcaaatctcttattcactgttgtggcgcatcgccaacggtgaagtattcggcaccgacacccctgtagaactgaaacttctggagatccctcaggctcttggcggggcagagggtgtggctatggaacttctggattctgccttccccctcctgcgaaacatcaccatcaccgcggatgccaatgaggcattcgacggcgctaatgcggcgtttttggtcggtgcgaagcctcgcggaaaaggcgaagagcgcgcagatttgctggctaacaacggcaagattttcggacctcaaggtaaagctatcaatgacaacgccgcagatgacattcgtgtcctagttgttggaaacccagcgaacaccaacgcgttgattgcttcagctgcggccccagatgttccagcatcccgcttcaacgcaatgatgcgccttgatcacaaccgtgcgatctcccagctggccaccaagcttggccgtggatctgcggaatttaacaacattgtggtctggggaaatcactccgcaacccagttcccagacatcacctacgcaaccgttggtggagaaaaggtcactgacctggttgatcacgattggtatgtggaggagttcattcctcgcgtggctaaccgtggcgctgaaatcattgaggtccgtggaaagtcttctgcagcttctgcagcatcctctgcgattgatcacatgcgcgattgggtacagggcaccgaggcgtggtcctctgcggcaattccttccaccggtgcatacggcattcctgagggcatttttgtcggtctgccaaccgtatcccgcaacggtgagtgggaaatcgttgaaggcctggagatttccgatttccagcgcgcccgcatcgacgcgaatgctcaggaattgcaggccgagcgcgaggcagtgcgcgacttgctc

SEQ ID NO: 2613 - DNA, 777 bp, Corynebacterium glutamicum
atggcgacatcacgtcgagatgccgaaaacatagaccaggccggtagcgaattcattgaatctgattcaggacacaccgcaacccctgaagaggtagtagccaccgctctgacattttttgcagaggatggttttagcgaaaccaaattggagaaaatcgcgaaggcatctggcatgtccaagcgcatgatccactatcactttggcgataagaaaggcctgtacatcaaggctgtttcctacgcgttgcgattgctgcgcccagaggctgaagcgatgcaacttgattccgcggtaccagttgatggtgtccgcaaaatcgtcgaggctttatatacctgcatcaccaagcacccagaagcagtgcgcctgctattgatggaaaacctgcatagccaagacagcgtggattccaccgcggcatattccgatgaatccaatgtgctgctcaacctggataagctgctcatgcttggccaggatgccggcgccttccgtcctggaatctccgcagaagacgtactggttcttattagctccctggcctacttccgcgtatccaacaaggtcacgttgaagaacctctactcccttgatttggaatcagaggccaatattgaaggcatgaagcgcatcgtcgttgacacggtgctggcattcttgacctcaaatattcaaaattctggcaactccagctacctggttgttggtggcaagactgcagaaccagaaactgatgacagcgtctacagctttgatacggacgtgttcgaaaac

SEQ ID NO: 2614 - DNA, 576 bp, Corynebacterium glutamicum
gtgactctacgatctgcattacttgcgctactaagttccggaccattgactgggtatgacgcctcccagcgatttggggcctcggtgggctttgtgtggagtggttccgattcgcagatttatcccgaacttcgaaaaatggaagccgaagaactcctcgtgggatccgatgttccctggggctccaaaggcgccaccaaaaccgaatacgccttgagtgaaaaaggctgggaagcgctaagaaaagcgtggtacgagccagtaacctacggtcccaccagagatcctgccaggcttaaagccgcctattttgaggtcggtacaaatggcgatgcacgccgacatttaagggcgcacatcgctcattttgaacagcagaaaattcaatcagaatcaatgattgatgagctgaaagcaaaaactcatccaaccttggcacggcgacttgagcgctccccgaaaaaggagcacgagcgaatagtcgcgtttaaagtgcttgcctatgaggggcagattgcacgcgctcaggcagagattgaatgggcggaaaagggcttgaaactactcgataccctt

SEQ ID NO: 2615 - DNA, 1128 bp, Corynebacterium glutamicum
atgacactgtccgaacgcaagctcaccaccaccgccaagattcttccccacccactcaacgcctggtacgtcgccgcttgggattatgaagtcacatctaaaaagcccatggccaggacaatcgccaacaaaccactcgctttgtaccgcaccaaagatggccgagccgttgcccttgcagacgcctgctggcaccgcctcgcaccgctatccaagggaaaactcgtgggcacagacggaatccaatgcccttatcacggcttggagtacaactccgcgggccgctgcatgaaaatgcccgcgcaggaaaccctcaacccgtcagcagccgtcaactcctaccccgtggtggaagcccaccgctttgtgtgggtgtggctgggcgatcccacattggcagatcccacccaagtacccgatatgcaccagatgagccaccccgaatgggcaggcgatggacgcaccatctccgctgactgcaactaccaattagtgctggacaacttgatggacctcacccacgaagagttcgtgcactcctccagcatcggacaagacgaacttagtgaatcagagttcgtggtcacccacactgaagattccgtgacggtcacccgctggatgcatgacatagatgcaccaccgttttggcaaaagaacatgaatgataagttcccaggatttgaaggcaaggtggatcgttggcagatcatccactactactacccttccaccatctgcattgatgttggtgtagcaaaggctggaactggcgcgcaggaaggcgaccgcagccagggcgttaatgggtatgtcatgaacaccattaccccagattcagatcgttcctctcattacttctgggcattcatgcgcaactaccgcctggaaagccaaaccatcaccacccagctgcgcgacggtgtatccggtgtattcaaagaagacgaagacatgctgaccgctcagcaagatgccatcgacgccaacaccgactacgagttttacagcctcaacattgatgccggtggcatgtgggtgcgccgaatcctcgaggaagcactctccaaggaaggccgactggatatccccaccacattcccccgcgcaacaccgaagccggaggca

SEQ ID NO: 2616 - DNA, 975 bp, Corynebacterium glutamicum
atgaactcgcaatggcaagatgcacatgttgtttccagcgaaatcatcgctgcagacattcggcgaatagaactatccccgaaatttgcgattccagtaaaacccggcgaacatctcaagatcatggtgcccctaaaaactggacaggaaaagagatcgtactccatcgttgacgctcgtcacgacggttcgactctcgccctgagcgtactcaaaaccagaaactcccgtggaggatctgagttcatgcatacgcttcgagctggagacacagttactgtctccaggccgtctcaggattttcctctccgcgtgggtgcgcctgagtatgtacttgttgccggcggaattggaatcacagcgatccgttcaatggcatctttattaaagaaattgggagcgaactaccgcatccatttcgcagcacgcagccttgatgccatggcttacaaagatgagctcgtggcagaacacggcgacaagctgcacctgcatctagattctgaaggcaccaccatcgatgtcccagcattgatcgaaaccttaaacccccacactgagctttatatgtgcggccccatccgcttgatggatgccatccggcgcgcatggaacacccgcggacttgaccccaccaatctgcgtttcgaaacgtttggaaacagtggatggttctccccagaggttttccacatccaagtaccagagctggggcttcacgccacagtcaacaaggatgaaagcatgctggaggctttgcaaaaggctggggcgaatatgatgtttgattgtcgaaaaggcgaatgtggtttgtgccaggttcgcgttctagaagtcgatggccaggttgatcaccgcgatgtgttcttctctgatcgtcaaaaagaatccgacgcaaaggcatgcgcctgcgtgtctcgagtagtctcctccccttcctcgtccccaacctcgaccattacggtcgccctctcc

SEQ ID NO: 2617 - DNA, 1425 bp, Corynebacterium glutamicum
atgcgcctgcgtgtctcgagtagtctcctccccttcctcgtccccaacctcgaccattacggtcgccctctcctaaaggagcctggcatggatatccgccaaacaattaacgacacagcaatgtcgagatatcagtggttcattgtatttatcgcagtgctgctcaacgcactggacggctttgatgtcctcgccatgtcttttactgcgaatgcagtgaccgaagaatttggactgagtggcagccagcttggtgtgctgctgagttccgcgctgttcggcatgaccgctggatctttgctgttcggtccgatcggtgaccgtttcggccgtaagaatgccctgatgatcgcgctgctgttcaacgtggtgggattggtattgtccgccaccgcgcagtccgcaggccagttgggcgtgtggcgtttgatcactggtatcggcatcggcggaatcctcgcctgcatcacagtggtgatcagtgagttctccaacaacaaaaaccgcggcatggccatgtccatctacgctgctggttacggcatcggcgcgtccttgggcggtttcggcgcagcgcagctcatcccaacatttggatggcgctccgtgttcgcagccggtgcgatcgcaactggtatcgccaccatcgctactttcttcttcctgccagaatccgttgattggctgagcactcgccgccctgcgggcgctcgcgacaagatcaattacattgcgcgccgcctgggcaaagtcggtacctttgagcttccaggcgaacaaagcttgtcgacgaaaaaagccggtctccaatcgtatgcagtgctcgttaacaaagagaaccgtggaaccagcatcaagctgtgggttgcgttcggcatcgtgatgttcggcttctacttcgccaacacttggaccccgaagctgctcgtggaaaccggaatgtcagaacagcagggcatcatcggtggtttgatgttgtccatgggtggagcattcggctccctgctctacggtttcctcaccaccaagttcagctcccgaaacacactgatgaccttcatggtgctgtccggcctgacgctgatcctgttcatttcctccacctctgttccatccatcgcgtttgccagcggcgttgtcgtgggcatgctgatcaatggttgtgtggctggtctgtacaccctgtccccacagctgtactccgctgaagtacgcaccactggtgtgggcgctgcgattggtatgggtcgtgtcggtgcgatttccgcgccactgctggtgggtggcctgctggattctggctggtccccaacgcagctgtatgttggtgtggcagtgattgttattgccggtgcaaccgcattgattgggatgcgcactcaggcggtagccgtcgaaaagcagcctgaagccctagcgaccaaa

SEQ ID NO: 2618 - DNA, 930 bp, Corynebacterium glutamicum
ttggcaggagttatcaccggctttgccatcatcctgtcggttatcggcgttggatttcttctggcaaagctgggggtcatcaatgatgacaaacagcgcttggtgttaaaccgcattgctttttatgcggcaactccagcgctgcttttcaatgtcgttgcccgatcagatcccagcgcgttgatctcaccggtcattgtggtgacatttgtggccacgatcgtcacagcagctgtgtactgcgtgatttcggcgattttctttaagaaggatatcgccactacggcgacaggagctgcggcttctgcctacgtgaactccaacaacattggcctgccggtgtctatttatgtgctgggaacaggcgcatatgtggcaccgattctggtcatgcagatggtgattttcgcgcccatgatcctggccgcgctgacctctggtgatgtgaaaggctcgcgcgggcaaaaaatatgggctgcggtgaaaggttcactgctcagcccaattgtgttggcctctatcgcgggcctgatcgtgtgtctgttagaaattcagctgccagccgcagtcatggaacccaccatcattttgggcggcgcatccattccgttgattctgatgagcttcggcgcatcattgccctcaaccaacgtgctggcttccaaggcggatcgccccagcgttcttactgctactgcgataaaaattgtgggtatgcccgccatcacttggctgatcgccaaggcgtttggtctggagggcgattacctctacgccgctgttattttggcggcgctgcccgccgcgcagaatgtgtacaactacgcggcgacgtaccgcaagggcgagatcgtcgcccgcgatacggtcttcctcaccacgttcctagcgctgctgggcatgctaggaatcgcggccctatttggtcgc

SEQ ID NO: 2619 - DNA, 1278 bp, Corynebacterium glutamicum
atggcacgtatgcaggaaagcgccgatctgctcaaatgttccttctgcggaaagagccaaaagcaggtaaaaaaactcatcgcgggtggcgccgtatatatctgtgatgagtgcattgagctgtgcaacgagattattgaagaagaactcggtcaagctcaacacgacgagcaggagcgcaacgagctccccaagccgtcggagatttcagccttccttgatacttatgtcatcgggcaggacccagcaaaacgtatcctgtcggttgcggtgtacaaccattacaagcgtctccgcgcatcggaaaccatcggtcgtcgcaggaatgacgagcctgaaaccgaactggttaagtccaatattttgatgctcggccccactggctccggcaagactttccttgcccagactttggcaaagctgctggatgttccttttgctatcgcggatgccacctcactgaccgaggctggttatgtgggcgaggatgtggaaaacatcttgctcaagctgcttcaggctgctgattttgatgtggaacgtgcacagcgcggcatcatttacatcgatgaagtggacaagatttcccgcaagtctgaaaacccatcgatcactcgcgatgtttccggtgaaggcgtgcagcaggcactgctgaaaattttggaaggcactgtcgccgcaatcccaccgcagggaggacgcaagcaccccaaccaggatttcatccagctggataccaccaacattttgttcatcgttgctggtgcgttctctggtctggagaaggtcatcgcggaccgcaatggcaagaaaggcttgggcttcggtgtggaggtctcttccaagaaggaagaagccaacattgtggatatcttcaaggatgtcctccctgaggacctggtgaagtttggtctcatcccagaattcattgggcgtctgccagtcgttgccaccgtatccaacctggatcagaaatctctggtcaaggttctcacggagcctcgtaactcattggtgaagcagtatcgacgtctgtttgaaatggatgacgctgtgttgacctttactgatgatgctttggaggagatcgctaatcaggcactcgagcgcaaaactggcgcccgtggcctgcgcgcgatcatggaagagatcctggttccgatcatgtatgacctcccagaccgtaaagacgttggcgaagtcatcatcaacggtgccgttgcccgtggcgaagccgaaccagagatgttggaagctgtcgcagaagaaaagaccgcg

SEQ ID NO: 2620 - DNA, 1086 bp, Corynebacterium glutamicum
atgaatcccgaatttattcacggcgcaaccgaaattgaaaccacaaacaggggccttcgcccgcatcgactcagcaaagaaatagtagaacgctactgtgatccccagtttagcgcgatggaacgccaaccatcgggcgtgcgcgttgtgtgtcgcaccaccgccacctccgtcacgctgaccacgtattccacgcgggtggtgtacctcgattccggccggccgggcggcaagattgatgtgcttatcgacggcgcccccacatcttccacgccaacttccgggggcgagaccacggaagtcaatttcatcaccggcgccacggaacggcgcctgaaagatccgcaggtgctcacagtggatggactttcagagcaggaaaaggtggtggagttctggctgcctcacaatgaagaaattgaagtgatctcccttaaagccaacgcagctttaaacactgtcgaagacacccgtcccgtgtggatcaattacggcagctccattagccacggttcggttgccactgccccaaccaaaatttggccagccattgttgcccagtccaaaaactacaacctgcgtaacttcggttttggtggcagcgccatgttggatccttttatggcgaggctaatcagggatactccagctgatctgatcaccttggaaattggcatcaatattgtcaatggtgatgtgatgcgtcgccgcggactagaggctgctgtggatgggttcatcaataccatccgcgatggccaccccaccacgccgatcaagattgtgtcgccgttctactgccccattcatgagaaaactccaggacccggcgcgtttgatacctcatcgtttggcagtggtcagattaggttcatcgccactggtgaacctgatgagcatggtcgactgacgctggagatggtgcgtgaggtgttggaggggttcgtcgaaaagcaaaaagacccgcacctgacctacgtcgatggtgcgagcctttatcaggccagcgatgcgccgttgctggataatttgcacccagacgaggcgtcgcacgccttaattgcgcagcgtttgcttaagcaactt

SEQ ID NO: 2621 - DNA, 633 bp, Corynebacterium glutamicum
atgacttgggatcataaccaaatggcagcccgcgttgcccaggaacttgaagacggccagtacgtcaacctcggcatcggcatgcctacacttatccccggctacctgcctgagggactagaggttatccttcactccgaaaacggtgtgctgggcgttggaccttacccaactgaagaggaacttgatcctgagctgatcaacgccggcaaggaaaccatcacggttgcacctggcgcatcctacttctcctcttctgattctttcgccatgatccgctccaagtctgtcgacgttgcagtcttgggcgttatggaagtctcccagtacggcgacctggccaactggatgattcccggcaagctggtcaagggtatgggtggcgcaatggatctggtgcacggcgcatccaagatcatcgccatgaccgatcacatcaccaagaagggcgctccgaagatccttaaggagtgtcgcctcccactgactggcgcgaagtgcgtggacatgattgtcaccacccacgctgtgttctctgtggaccctgaagaaggcctcacgctcatcgagtgcgccgacggtgtcaccgttgaggaactccgcgaaatcaccgaagccgatttcaaagttgct

SEQ ID NO: 2622 - DNA, 750 bp, Corynebacterium glutamicum
atgtctcacatgattaacaagagcatttcttccactgctgaagcggtggccgatatcccagacggtgcgtccatcgccgtcggtggtttcggcctcgtgggcatccccactgcattgatcctcgccctccgcgaacaaggcgcaggcgatctgaccatcatttccaacaacctaggcaccgacggtttcggcctcggactgttgcttttggataagaagatctccaagtccatcggctcctaccttggctccaacaaggaatatgcacgccagtacctggaaggagaactcaccgtcgagttcaccccgcagggcaccttggctgaacgcctccgcgcaggtggcgccggcatccctgcgttttacaccaccgcaggcgtgggcacccaggtcgcagaaggcggactcccacagcgctacaacaccgacggcaccgtcgccgtggtgtcccagccaaaggaaacccgcgaattcaacggccagctctacgtcatggaagagggcatccgcgccgattacgcactcgtgcacgcacacaaagcagatcgctttggcaacctggtgttccgcaagaccgcgcagaacttcaacccagatgcagcaatgagcggcaagatcaccattgctcaggtcgagcactttgtagacgaactccacccagatgagatcgatctgccaggaatttacgtcaaccgcgtcgtccacgttggaccgcaggaaaccggaatcgaaaacaggacggtgtctaac

SEQ ID NO: 2623 - DNA, 792 bp, Corynebacterium glutamicum
atgcgaacaaaaagaggagttgatgggatggtcgaacaatcgccagatttcgtacaatcatttgcccgcggcttatctgtgatccgaagtttcagcgcagataatccatcgcaaacactgtccgaagtcgccagccaaactggactctcaagggccaccgctaggcgctttctccacaccttgaccgaccttggatatgcggtaaacaacgattcccggttccagctcacaccacgtgttttggagcttggagcaagctacctttccgcattgtccctgcctgcgatcgcgcagccccgcctggaggtactctcccgccaggtcggcgaatcaagctccatgtccgtactcgacggcactgacatcatctacgtttgccgcgttccggtgcgccgcatcatgacggtgaacatcaccatcggcacccgtttccctgcgtacgccacctccatgggacgcatcatgctggccaaccttcccgaagaagaattagatgaaatgctggcggcggcaccccctgaacagttgaccacccggtcactgacctccatcgcctcaatccgggaagagatcattgctacccgcgaaagggggtggtcattggtggatcaggagctcgagccgggcctgcgttcgctcgcggcgccgatcaccaatgcccagggcgaagtggttgcttccatcaatgtgtcgacccaatcggcatcacattcggtggaagatatccgcaagctggtgctgccgcagcttttagaaacggctcaagcaatttcgacagatctctctgcactc

SEQ ID NO: 2624 - DNA, 1224 bp, Corynebacterium glutamicum
atgaaccctcaagatattgtcatctgttccccattgcgcaccccagttggtgcttacggcggatccttcaccggcgtccctgttgaagaattggccaccaccgtgatcaacgcgatcgttgaggcaaccggcatcaccggcgacgatgtggacgatctgatcctcggccaggcatcccccaacggtgcggctccagcactgggccgtgttgttgctctagattccaagcttggccaaaacgttccaggcatgcagcttgatcgccgctgtggttccggcctgcaggcaatcgtcaccgctgctgcacacgttgcatccggcgctgctgatctgatcatcgcaggtggcgcagaatccatgagccgcgttgagtacaccgtgtccggcgatatccgttggggtgtcaagggcggcgacatgcagcttcgtgaccgccttgcagaagcacgcgaaaccgctggcggacgcaaccacccgatccctggtggcatgatcgagaccgctgagaacctgcgtcgcgaatacggcatctcccgcgaggagcaggacaagatctccgcagcgtcccagcagcgttggggcaaggctgctgatgcggggcttttcgacgacgagatcgtgccagtcaccgtccctgccaagaagcgcggccaggagccaaccatcgtttctcgagacgagcatggtcgaccaggaacaaccgtcgaaaagcttgctgctttgcgccccatcatgggccgccaggatgcggaagcaaccgtcaccgctggcaacgcgtccggccaaaatgatggcgctgctgccgtcatcgtgaccactcgcgccaaggccgaggagaagggcctgcgcccagtcatgcgtttggctggctggtctgtggctgctgttcccccagagaccatgggtattggacctgttcctgccaccaagaaggtcctggatcgtttgggccttaccctggaggacatcggcgcgatcgaactcaacgaagctttcgcagctcaggcactgtctgtgctgaaggaatggaacatttcttgggaagatgagcgcgtcaacccactgggttccggtatttccatgggacacccagtcggtgccaccggtgctcgcatggcagtaaccttggctcaccgcatgcagcgtgaaaacactcagtacggactggccaccatgtgcatcggtggcggccagggtcttgcagctgtctttgaaaaggagaac

SEQ ID NO: 2625 - DNA, 912 bp, Corynebacterium glutamicum
atgtcctccagggtaaggcccaaacgatccaggaccttcttggtggcaggaacaggtccaatacccatggtctctgggggaacagcagccacagaccagccagccaaacgcatgactgggcgcaggcccttctcctcggccttggcgcgagtggtcacgatgacggcagcagcgccatcattttggccggacgcgttgccagcggtgacggttgcttccgcatcctggcggcccatgatggggcgcaaagcagcaagcttttcgacggttgttcctggtcgaccatgctcgtctcgagaaacgatggttggctcctggccgcgcttcttggcagggacggtgactggcacgatctcgtcgtcgaaaagccccgcatcagcagccttgccccaacgctgctgggacgctgcggagatcttgtcctgctcctcgcgggagatgccgtattcgcgacgcaggttctcagcggtctcgatcatgccaccagggatcgggtggttgcgtccgccagcggtttcgcgtgcttctgcaaggcggtcacgaagctgcatgtcgccgcccttgacaccccaacggatatcgccggacacggtgtactcaacgcggctcatggattctgcgccacctgcgatgatcagatcagcagcgccggatgcaacgtgtgcagcagcggtgacgattgcctgcaggccggaaccacagcggcgatcaagctgcatgcctggaacgttttggccaagcttggaatctagagcaacaacacggcccagtgctggagccgcaccgttgggggatgcctggccgaggatcagatcgtccacatcgtcgccggtgatgccggttgcctcaacgatcgcgttgatcacggtggtggccaattcttcaacagggacgccggtgaaggatccgccg

SEQ ID NO: 2626 - DNA, 753 bp, Corynebacterium glutamicum
atggctattttgcacagcgtttcctacggaacttccgacaacaccttggtgttcattggctcgttgggttccaccaccgacatgtggctgccacagctggatgccttgcataaggatttccgcgtcatcgctgttgatcaccgcggacatggtctgtctgaactcatcgaaggcacccccactgtggcggatctggcgcaggatgtgctggataccctcgatgacctgggtgtcggaaacttcggcgtcatcggactatctctcggcggagcggttgcacaatacttggcggccacctctgatcgtgtcaccaaggcagcattcatgtgtaccgctgcaaaattcggcgagccccagggctggctagatcgcgccgcagcgtgccgcgaaaacggcactggttctctgtccgaagctgtgatccagcgctggttctcccccacttggttggagaacaacccagcgtcccgcgagcacttcgaagccatggttgccggcaccccatctgagggttacgcgctgtgctgcgaggcgttggcaacctgggatttcaccgatcgcctgggagaaatcaccgtgccagtgctcaccatcgcaggtgccgatgacccctccactcctccagcaaccgtgcagatcattgccgatggcgttggcggcgagtcccgcgcagaggtcctaagcccagccgcgcacgtaccaaccgtggaacgtccaaacgaggtaaatgaactgctagcacagcatttcgct

SEQ ID NO: 2627 - DNA, 2061 bp, Corynebacterium glutamicum
atgttcacaaccagtctcctgccccgtcgtcagttgttgcttaggcgtttactcgctgagttcaccactgatcggcggggcaggtttcttgttgtcaccggcccgcacggcgtgaacaaagagcatttcaccagggagttcgccgccgagttgggagaatttgaggtcaacccgttcctcaagaaacgtccccgcgcaagcatcgtggttgtggatgatgtccatttggccgacaaggacgacatccaaaaaacactcaatttggtgcacaccaaagggctcaccgtactcgccaccgcaccgcaccgtatccccggcgccaccgacctgctagccttgccgccgctcacagtcccggaaaccgcgctgctcgcgcgccaaatcgtcggccactgcacacccaccaccgcccaccgcctcaacgacgctgcgggtgggttgccacaactgatcagagagcttctcgacgcgacccccatcgatcactggtccaacgatcggcctactctcacgctgccagagcactgggtgacagacatcgacattaagaaccctgtgcttcgggaagtcgcctcccatcccttcttcgatggctgcccgatcggagatttagatgccgatgcctttgtggaggatggcaccctcattcacgaaaacgggactttaagattccgcagccctgaggaacgcaccttggttcgggcttctactcccccatcgatggcaagaagcccgcgggagtgggaatcgacggagggaggcgtcgataagctaattgccgcaggaaacctgcccctggcccgactgcatgtagaggaactaccccgtgccgatgagcagcgcgcatttttggcgctgtacggcgggcagtcgtttgaggcggcctcggcgtcgccgttttatgcgctggccacctggaatccggaggcgttgcggggcgatccgaccttcgatatgttcgccgatgcgctagacactgggcattacagggaagtcccgcgtccggatgcccctgaagaaagccagatccacgatttcatcagtggctggctggcgttggtttacgatgatcccctcaccgcccgccgtctgctctccaggaggggcccctccgatttggtgggactgtggcagtcggcgtttttggcgcgagcgcactacgtgctgggagaattccaagaagcctccgccgttgtcgaacgcggcctagccaccggcgaccgcaccggagcctccctactcgaacccgtgcacctgtggaccggcgcccaagtcgcagccatgactgggcgcaccgaattggccaaccactatttacagcgcctgaccgtgcccgacgatgcgttcctcatccaaaaactcagcgcatccatgggcaaattgatcaccgcatccatgacctcagacacccgcgcagcaaccttggccggcgaccgcatggcgtcggtcgtatacaccaccaatacccagcagcccggattttgggcctgggaagacatgtatgcgatctcattgatccgaacgggacgcatcgacgccgcagccgccgtcatggatggcatccctgactccaccatcccctcgctgcgtgcccgaaatttggtgccccaagcaaacatcgaaatccaacgaggctccacagcacgaggcgtaaaaatgctctccgaagccgtcgacctcatttcctccgtcaacatgccagcatatgaagcccgcatcctcttcgaatacgggctggttctacgacgcatgggcaggcgcagccaagcagccgaaatgttcacccacgccgaagaagtcttcaccgccatgggtgcggtcactctggctgcccgctgccacggcgaacgacgagtcgcaggcgttgggccacgcagatcagcgcagggactcacccctcaagaggaacaaatcactgcgctggttgtcgacggctgctccaaccaagaagtcgcccgtgagctttccctctccgccaaaacggtggaatatcacctcacgagggtgtacaaaaagctcggggtgagctcccgtggagagcttcgagaattactgaaggtc

SEQ ID NO: 2628 - DNA, 366 bp, Corynebacterium glutamicum
atggatcgctatgaaaccggaatgaaaaaccgccgcgaggtactgggagatgcccatgtggatcgcgccgtggcgaacaccaccgaggtgactgagaagtttcaggatttcatcactcgcacagcgtggggcgatatttgggaacgtccaggccttgatcacactcagcgtcgcctgctcaccatcgcgattttgaccgcggtgggcaatgacggcgagttggacatgcacattcgtgctgctctgcgcgctggcgtggatcaggaaaccatcggcgaggtcatcctgcacactgcggtgtatgcgggtgtgccgaactccaaccatggtttcaagctgctgaacaacgctgtgtcagaccttcag

SEQ ID NO: 2629 - DNA, 678 bp, Corynebacterium glutamicum
atggtggccttcgccattgctgcgtgctcgggggcagctgcaaccgccaaagcggcctccacgacaagaagattctttaggaaagtctcgtcggaaaggctgctgaggtgttctccactaccagcaaggtcggagtataaagatcgggtcaatttagagtccaaaaaatggggtttcattgtcttcagcctggacagtgatgtcgaagcggaatccatcatcggtcttttgagccaccaggaggtcacgtcgatcagctgggaccacagccaaaactgggtcggtgctcaaatcggcgtctggcaggtatgcgcgagtgtacagacgctccagcatgccacgggcgaacacaccaaccttgaagtgtggtgcctcatctgcgaatgctcccggaaccaaagtggtgaacgttgcctcaccctgcgcgtttgccatcgcgcgaccaagcccgcggaagccatctgcggttgctggtgctgtgcggtttggatccaaatcagagttgtggatgccctctggatcggcctgccacagttcaaacatggcatccgcgatggggtcgccgttgccatcagttgcggaaacagtaaaggacaccgcgccttccgaacctggctccacgagatgctccgcaccttcaagggtcaaaccgatgtggacgtaagggcccacggtctg

SEQ ID NO: 2630 - DNA, 1116 bp, Corynebacterium glutamicum
atgaaaccccattttttggactctaaattgacccgatctttatactccgaccttgctggtagtggagaacacctcagcagcctttccgacgagactttcctaaagaatcttcttgtcgtggaggccgctttggcggttgcagctgcccccgagcacgcagcaatggcgaaggccaccattgattcttatcagttggatgtggaggagctttcccgtcgcgcagccgagggcggtaatccgctcattccgctggtcactgacctcaaggccatcaatccggcaggcatccacattggcgcaacgagccaggacatcattgattctgcgttaatgctgtgcatgaaggaaggggtgggggaggtcgtcgacaagcttaaaaagcttgcgcgagatttggccgagctcaccgcggagcataaagcaaccccgatcatggggcgcacgttggggcagatcgcgacgccgacgacgttcggcgcgctgaccggcggctggctggttgcggtggacaatgcggcacgcgccctggaggcgctggagtttccggtgtcgtatggcggtgccagcggaaatatgacggcggtgcacccgcgtggcttcgagattcaggcgaagctggccgaggagttgggcctttttgatccgcagtgggtgtggcattccgatcgcacgccgatcactgcgatcgcgtcggcgctggcaacggccgctggtgtggtacgcaaaattgctggtgacgtggtgttttactcacaaaccgaggtcggcgagttgcgggagaaatcccccggcggcagctccgcgatgccccacaaagccaatccggccgctgcgattgcgtgcgacggttacgcgcgccgggcacctggccttcttgcaacgcttttcgacgccctcgactgccgtttgcagcgcggcaccggcagctggcacgcggagtgggcaacgctgcgcgagttggctgctgtcactcactcagcagtgagcagggctgcaaccagcatcgatggcatcaccgtcaacgttgatgtgatggcaagtcgcgtcaatggaccaaccgggcacgccgaagatttggcggagcgggcactagaaatttatggaaaaggacgcagt

SEQ ID NO: 2631 - DNA, 612 bp, Corynebacterium glutamicum
atgattgatacagggaagaacggcgagttccgctacgagcagtcgaatatcatcgatcagaacgaagccgagttcggcatcactccttcacagaccgtgggcccttacgtccacatcggtttgacccttgaaggtgcggagcatctcgtggagccaggttcggaaggcgcggtgtcctttactgtttccgcaactgatggcaacggcgaccccatcgcggatgccatgtttgaactgtggcaggccgatccagagggcatccacaactctgatttggatccaaaccgcacagcaccagcaaccgcagatggcttccgcgggcttggtcgcgcgatggcaaacgcgcagggtgaggcaacgttcaccactttggttccgggagcattcgcagatgaggcaccacacttcaaggttggtgtgttcgcccgtggcatgctggagcgtctgtacactcgcgcatacctgccagacgccgatttgagcaccgacccagttttggctgtggtcccagctgatcgacgtgacctcctggtggctcaaaagaccgatgatggattccgcttcgacatcactgtccaggctgaagacaatgaaaccccattttttggactc

SEQ ID NO: 2632 - DNA, 690 bp, Corynebacterium glutamicum
atggacatcccacacttcgccccgacgggaggcgaatactccccactgcacttcccggagtaccggaccaccatcaagcgcaacccaagcaacgatctcatcatggttcctagtcgcctcggcgagtccacgggacctgtcttcggcgaccgcgacttgggagacatcgacaacgacatgaccaaggtgaacggtggcgaggctatcggccagcgcatcttcgttcacggccgtgtcctcggtttcgatggcaagccagttccgcacaccttggtcgaggcgtggcaggcaaacgccgcaggccgttaccgccacaagaatgactcctggccagcgccactggatccacacttcaacggtgttgcacgtactctcaccgacaaggacggccagtaccacttctggaccgttatgccaggtaattacccttggggtaaccaccacaacgcatggcgcccggcgcacattcacttctcgctctatggtcgtcagtttacggagcgtctggtcacccagatgtacttcccgaacgatccattgttcttccaggatccgatctacaacgcggtgccaaagggtgcacgtgagcgcatgatcgcaacgttcgactatgacgagacccgtgaaaacttcgcgcttggttacaagttcgacatcgtccttcgtggccgcaacgccaccccatttgag

SEQ ID NO: 2633 - DNA, 1164 bp, Corynebacterium glutamicum
atggaaatgtcatacttcagccatcaggacccaaataatccagagagtcacatcaacttcaccatggcgcaaatggagatccagcgctggactttgctgatctcaaacccagaggcggacgctagcactcttgtcatggagttgaaaaccgtcacgggggaatccaagcattttatcaaccaggctattaacgccatgtgggctttaatgaagctgcccattttaagagtggtggtagaaactcacttccacgttcggattccgtacctggcccgcattatgcaggcagtcaagcaggctaaaccggagttgtgggatgagttggaccatcgcattgccgaaaagctgacaccgcgcattgctggccaggcactgatggaagcctccgcacttgcagggctgattactcgctggatcaaggaactggatccaaccttcacaggaaagaagcgtgggccaaaggggagtgatggcaccttgactttccgccacgtggacgggcgtacgtacatcagtggaaatattgacggtgtcaccggcaagctgttccaaaaagctctggaaaaagtgaaacagaagggcgaggacctcgcgcgggccctggtcaccttcctggcggggcggaccaaagtgaaaatcgtcagcgcggtatacacgcccctggtgggtggcgtgtcctggattccgggggtgggattcctgagtcaagaggagtcccggaagctgggtaagactgcctcgaaggtcattgacctggatacgatcgccactcgtgtggaaaatggctacaccccaagtcccgagctacgcctttatgtgatggggcgggacggcacctgtaggcatccgggctgcacggtgtctgccgacaactgccagatcgatcacgtgatcccgttcggtgagggtgggttgactgtggcctggaacttgcagtgcctctgcgcgcatcatcacaatatgaagactgatgggcgcatccaggcggcgattgattccatgggtcgggtcgcctggattgggccgtgcaatcgcacagtggtaaccgaacctgtcggaccgttggcgcaagagatgcccacggggcagtgggggcagactctggaagcacggatggagaagacttttgaaaagctccgcagttcactcgaggtattggatgac

SEQ ID NO: 2634 - DNA, 291 bp, Corynebacterium glutamicum
atgctgtttctagcacgcatggacgtcgtcttccctgattccatggacgccgatgtgatggcagatttccaggctaaggaaaaggcctactccggagacctgcaatcccgtggaatcatgaaagcaatctggcgagtcgtcggcgagtatgcaaactactccattttcgatgtcgatgaccacgacgagctgcatgcaattcttagtggctttccgatgttcaaatacatgaatgtcaagatcactccactggcaaaacaccccaatgctctggagtattacctcaaggga

SEQ ID NO: 2635 - DNA, 771 bp, Corynebacterium glutamicum
atggcaggccagcccgccggcttcggcgatagcggcgatcttcttggattccagcagaccaccgtgcttagtggttttcagtgcgataacatccgcagcctgggctttcaccaccgcgagagcttcagctggggtccacacggattcatctgccatgaccgaaacgttggtgcggcgggtgatttcgcgcagggtttccaggtcgtcggccggggtgggctgctcgaacagctcgacgccagcctccgcgagaatcggcaagtaatgcagagcggtgcggcgatcccaacgtgcgttaatatcaatgcgcagagaaacgcggtcgccaacttcgcgcgccaattctgctacacggcgagtatcttccgcaggatcgccagcacccatcttcaacttgaaggaacggttaccaaactcctcgatgcgctcttcaatttccgccaccgcaacatcaagcggcaaaacgcccagcgcccaggtgacatccaccttgtcgcgcacggtgccaccaagcaggtcgcggacgggcacattgaggctgcgtgcccaggcatcatgcattgcgacgtcaacagccgccttggcataacgcgcacgtgcaacaacacgctcaaggtctgccataattcctgcaagctcggagacagcacggccgatgagcactggggcgaggtagccgtcgacaagcgccttcatggtctcaaccgactcgccgccccaccatggaccgccgggcacaacgccctcaccgtagccgatgacaccgttttc

SEQ ID NO: 2636 - DNA, 1119 bp, Corynebacterium glutamicum
ttgtctgatttaaccatccaaaaagtcgaatcccgtatcctcgacgttcccctcattcgcccacacggcttcgcaactaccacctccactgagcagcacattctgctggtcagcgtgcacttagaaaacggtgtcatcggctacggtgagggcgttgtgcccggcggtccatggtggggcggcgagtcggttgagaccatgaaggcgcttgtcgacggctacctcgccccagtgctcatcggccgtgctgtctccgagcttgcaggaattatggcagaccttgagcgtgttgttgcacgtgcgcgttatgccaaggcggctgttgacgtcgcaatgcatgatgcctgggcacgcagcctcaatgtgcccgtccgcgacctgcttggtggcaccgtgcgcgacaaggtggatgtcacctgggcgctgggcgttttgccgcttgatgttgcggtggcggaaattgaagagcgcatcgaggagtttggtaaccgttccttcaagttgaagatgggtgctggcgatcctgcggaagatactcgccgtgtagcagaattggcgcgcgaagttggcgaccgcgtttctctgcgcattgatattaacgcacgttgggatcgccgcaccgctctgcattacttgccgattctcgcggaggctggcgtcgagctgttcgagcagcccaccccggccgacgacctggaaaccctgcgcgaaatcacccgccgcaccaacgtttcggtcatggcagatgaatccgtgtggaccccagctgaagctctcgcggtggtgaaagcccaggctgcggatgttatcgcactgaaaaccactaagcacggtggtctgctggaatccaagaagatcgccgctatcgccgaagccggcgggctggcctgccatggtgcaaccagtctggaaggtccaatcggcaccgcagcatccctgcagtttgcggcatccaccaaggcgatctcctacggtacagaactgttcggaccgcagttgctcaaagatacctatattgtccaagaatttgagtacaaggacggccaggttgctattccacaaggcccaggtttgggcgtcgatgtggacatggacaaagtcaacttctacacccgtaaa

SEQ ID NO: 2637 - DNA, 606 bp, Corynebacterium glutamicum
atgagggatctggtaaggcgcaggctgcagggtcttgatcttgtagcggccttcctcatcggtaacgatggtgccacgcaggttccactctgggattccaggcgcgaactgggagtagtatccgtcctcatctgcgtgccagagctcaacttctgctccatcaagaccgttgccgtcgaggtcagtaacctgcccctcgaagatcagtggggtgcatgcgcggtccttgtcacgcattggcatttcagcatcccaagggagcttcggagagttctctacgtaataagggccttcgatggaacccttggttccggtgtagtcgtggcggttgtagttgatctcttcgatctcatgctcaacgaaaacgtccaaccacagtggccactcgccgtattctccaacgtcgatcatccactgcttgagcactgcgtactcttcgtaggtgacttcgtgcttgtgagcaacctgggcgatcgccgcgagcagatctacgtagatcgcgtttgcgcgttccttggaggtatcggaggaaacgcggtttgccttgaacttgtcagttgccttgttgcccgaatcgtgggctgttggatcaacgatctgttcagc

SEQ ID NO: 2638 - DNA, 855 bp, Corynebacterium glutamicum
atgacttcagctgaacagatcgttgatccaacagcccacgattcgggcaacaaggcaactgacaagttcaaggcaaaccgcgtttcctccgatacctccaaggaacgcgcaaacgcgatctacgtagatctgctcgcggcgatcgcccaggttgctcacaagcacgaagtcacctacgaagagtacgcagtgctcaagcagtggatgatcgacgttggagaatacggcgagtggccactgtggttggacgttttcgttgagcatgagatcgaagagatcaactacaaccgccacgactacaccggaaccaagggttccatcgaaggcccttattacgtagagaactctccgaagctcccttgggatgctgaaatgccaatgcgtgacaaggaccgcgcatgcaccccactgatcttcgaggggcaggttactgacctcgacggcaacggtcttgatggagcagaagttgagctctggcacgcagatgaggacggatactactcccagttcgcgcctggaatcccagagtggaacctgcgtggcaccatcgttaccgatgaggaaggccgctacaagatcaagaccctgcagcctgcgccttaccagatccctcatgatggcccaaccggttggttcattgagtcttacggtgggcacccatggcgcccagcccacctccacttgcgcgtttcccacccgggctaccgcaccatcaccacccagctttacttcgagggtggcgagtgggtcgaaaacgacgttgcaaccgctgtgaagccagaactggtcctgcaccctgagactggcgaggatggtaaccacgttcactacccattcgtcctggataaggaagac

SEQ ID NO: 2639 - DNA, 141 bp, Corynebacterium glutamicum
gtgggattatgtggaaaaatttatacttctaaaggttcccttattgtttttaaggtttttgggatgttgacggattcgatgattcaggccacagtgttgttatcgagttcagccgatcacaaagatttttccgctaggcag

SEQ ID NO: 2640 - DNA, 1470 bp, Corynebacterium glutamicum
ttggcaagcgttcagaaaactctggaccatgcgcttgaggaccgccctgaagagggaatcgtccgcgtcaaccgcaacatcttcactgaccctgagatcttcgagctggagatgcgccacatcttcgaaggcaactggatctacctggctcacgagtcccagatccctaacgctggcgactacttcaccacctacattggccgccagccgatcatgatcacccgttccaaggacggcacactcaactgcctgatcaacgcgtgttctcaccgtggcgccatgctctgccgtcgcaagactgacaaccgcaccaccttgacctgcccattccacggctggacattcagcaacgacggcgcactgctcaaggtcaaggacgaaaaagaaggcgcctacccagagaatttccgcaccgacggctcccacgatctgcgtcgcgttcctaagttcgagtcctaccgtggcttcctcttcggctccctcaacgatgatgtcgtttctttggaagagcacctcggcgacacccgtaccgtcattgacatgctggttgaccaatccccagaaggcctcgaagtactgcgcggatcctccacctacacctacgacggcaactggaagctccagaccgaaaacggtgcagacggctaccacgtttcctccacccactggaactacgctgcaaccacctcccgccgtggcactggtgaatccgcgaacgaaaccaaggcaatggacgctggtacctggggcaagcagggtggcggatacttctcctacccttacggccacatgctgctgtggatgtggtggggcaacccagaagaccgcccactgttcgagcgccgcgacgagttcaagaaggaattcggcgaagaaaagggcgagttcatggttggtgcttcccgcaatctgtgcctctaccccaatgtttacctgatggatcagttctcctcacagatccgccacatccgcccaatctcagttgatcagaccgaagtcaccatctactgcatcgcacctaagggcgagtccgcggaagcacgtgcaaaccgcatccgccagtacgaagacttcttcaacgcaacgggcatggcaaccccagatgacctggaggaattccgctcctgccagaagacctaccaggcatctgccttcccatggaatgacatgacccgcggtttgggccaccaggtacagggaccaaacgaggttgccaagggcctaggcatgaacgaagttctttcctccggagcacgcaccgaagatgaaggcctctacccaatccagcacggcttctggcatgaactcatgcaggaggctgtgaataagcagagcatcaaggaaaaggaattggctgacgataccgcttcttcccttgccaccgtagctgcagccaaaatccgtgaggaagcaaaggcagccgcgaagtccgacgctggagagcctcgccgccgtcgtcgcacccgcggt

SEQ ID NO: 2641 - DNA, 492 bp, Corynebacterium glutamicum
atgtctgaaatcacccgctctgagatcgaagctttcctctactacgaggctcgcctgctcgatgaccgtaaatttgaagaatggctcgaatgctaccgcgaggacgccgagttttggatgccagcctgggacgacaacggtgaactgactgaagatccacagtctgaaatttccctcatctactacccaaaccgtggtggacttgaggaccgcgtcttccgcatccgcaccgaacgctcctctgcaacttccctacctgaaccacgcaccggccacagcaccaccaacgtggaaatcctggagcgccgcgacggcgaagtagatatccgcttcaactggatcaccttctactaccgttacaacaccaccgacacctacttcggcaccacgtttatcacccttgatgtcagtggtgaaaccccgaagatcgtcaagaagaaggtcgttttgaagaacgactacatccaccacatcgtcgatatttaccacgtc

SEQ ID NO: 2642 - DNA, 1536 bp, Corynebacterium glutamicum
atgactcaccaagttgcacttgcctttgaagacggcatcacccgattcatcgactgcgaagatgaccaaactgttgcagatgccgcctaccaggcacgcatcaacattcctttcgactgccgcgacggcgcctgcggaacctgcaaagcgttctgcgaatccggcgactttgacgaaggcgactacatcgacgacgccctgtccgaagatgaagcagccgacggctactgcctgccttgccagatgaccccaaagaccgacctcatcttgcagatcgccaccacctccgtgctggcaaagaccggcgcatccactttcgatggcgagttgaaggagatcaatcacttctctgattccaccatcggcattgagatcgaactggaaaaccgccaagatttggcgttcctccctggtcaatacatgaacatccaggttccaggcagcgaccagactcgttcctactctttctcctgcgctcaagattccggcaacgtgcagttcctgatcaaggtaaccccaggtggactcatgaccacctatctcaccgatcacgcgaaggtcggcgacaagctcaccttgaccggcccgatgggttccttcttcctgcgtgaacctgtccgcccgatcctgctgctcgccggcggaactggacttgcaccgatcttggctattttggaaaagctttcccgcgatgagcttctcgacgtcccaatccgcctggtttacggcgcgaacttcacccacgatctggtggaattggatcgacttgatgccttcaaggacaagttcgacttcgattacatcaccgtgctttccgacaaggacaccgagcatccacgcaagggctacgtcccagcacacctgaccggcgaatatgagccagatgaggacactgatgtgtacctctgcggccctcctccaatggtcgaggccgtgcgccaattcctgggcaccctggagcatcctccgctggacttttattacgagaagttcacttccgccgctgcccctgctgctggtaagccagagatcaccgtggagaccagcgaagttgcagaggatttcaacctggtcgaggtgtccactccaggcatgtcttccggcgaggtgcactcttctgcaacccagctgcaggcccgcatggctctggagctcggcgcgctggagcttgcgatcaacaaactcggcgagcgcgacatcgagcgattccgcaacttggccgacatcgcgaactccttcatcgacggcgataagtttatcgacgcggtgaagttcaccgaggccaacgccgatttccacgagttcctcttccgccgcgcaaacaacgaggcgctgcttgcggcgtaccagaacctccaggttgttcaagaaatgaacgcaacccttccaggcgccgagtggattgatccggcaattgccaccgagcacttggcgcttgtcgacgccgtctcccagaatgatctcgagaccgcgagaacaatcattcgtgaacacgcggagcacggcattgacactatggttaaggccctcgagaaa

SEQ ID NO: 2643 - DNA, 828 bp, Corynebacterium glutamicum
atgagcgcgccagtaggacaaggcatcgaaggtcgccccactcacgtcaccccggaacgcttctttggccagggtgttgtggttaccggagcggctcaaggcatcggcatggcagtggcacaccgcatcgcatatgaggatggcaacctagtgttggtggaccgttccccgctggtgcatgaagttgccgaagagctgcgtaaagcaggcgccggaacggtggattctttcatcgccgatctggaaacctttgaaggcgcaactgatgctttggaatttgccgggcagaagttgaagaaccttgatgtggtgatcaacaacgttggtggcaccatctgggcgaagccttatcaggaatactctgaggaagagatccgcaaggaaatcaaccgaagcctcttccccaccttgtggatgtgccgggccgcgttgccaattctgatcggaaatggtggtggaacgatcgttaatgtgtcctccatcgcgaccggtggtatcaaccgtgttccttatgctgcagcaaagggtggcgtcaacggcattgtttctgccatggcccgcgaagctgcaccgcataatgtgcgcgtggtggcaacggctcccggtggcacgctcgctccggaacgtgccgtcaaacgaggccctgggccagagggcgaattggaagaaaagtggtatcagcaaatcgttgatcaaaccattgattccagtttgatgaagcgctacggcaccctagaggagcaggtcgcgccgatctgtttcctcgcttctgaggaagcttcctacatcactggatcagtcatgccagtcggtggaggcgaccaggga

SEQ ID NO: 2644 - DNA, 2685 bp, Corynebacterium glutamicum
atggttgcctcagtctctttcaccccgtcatcgtcccaaacgttcctaccgcgggcgtcgatcatcgtgcaagaagtcagcacacagatcaaaagattagaatccggcgaaggcaaactcttccacatcagtggccagcccggcgcgggtaaaacagagttcggcatgcagcttatcgacgagctccaaggctggaccgtggtacgtgccacttccctgtcgtggctgaaaaacagcccccgaaacctccttggacacatcgcccacaaattgggtgcgcactccgccaactccatccgtggtgtgatcgaccgtctcgatgcctccaccgtggtgatcgttgacgatgtccactgggccgacgtggaatccatgcaaaaactcatcgaatattccatgcgcatggtttctggccgtttcgcactcatcatgattggccttgatgaagagaacttagtgttccacgatgaggtggtctcgctcccctccatcgcagactccacctacgtattgccgccgatgagtattgaagaaatccgccagcttgcgcttaccgatgtccgcggccgcatcagcaccaccaccgccacagacatccagcgcatcaccggcggcatctacgggcgagtcaaagaagtcctccactcggaatcccccgatcactggcgaatgcccaacccaaatattcccatcccacaaagctggcatgccaacctgttgagacgcatcaccaacgaagaagtctggcatgtactactcgccgtcgctgtccttccctccggaggccccattgacctggtaaaactcctaggcaacgaccccacgggcatgctttgcgacgacgccgtccgctcaggcctgctccgcgtgctgccgtctgacggccaaccacaagtggatttggtcctgccgatcgaccgcgccgtactgcaatcacgcactccgctcaacattctggcgcagttgcaccacaaggcagccgaatattacggcaagtggaatcaaaaagatgcccaactggagcacgaagcatttgctgcaattgatccaaatgatccagcagtgcgagccctagcgcagcgcggatatgcgttgggtaggactggccactggatggaatcggcacacgccctatctcttgccgcgaaccgcactgcacaccaagaagaatcaaataagtacttgctggagtccatcgattcactgatcgccgccgccgatctcccccaagctcgatccagagcatccacccttgatcttggagaaaccggcattcaacaagactcaatgctgggctacctggcaatccacgaaggccggcgcctcgaagcacgcaatctccttcatcgtgcttctgaagaattgctggcgcagcacccgattgatccgatccacggcccccgcatggctcagcgcaaagtactgttaaacttagtggactggaatccagaagaactcctggtgtgggctgatagagcagtcgcatggactgaagaggatgctggcgaaaaggttgaggcccaagctatttccctcattggacaatccatcctcgatggctgcctccccgaagataaacccatccccggtgaaaccacccttcacgcacaacgccgccacatggcaatgggctggctttccatggttcacgatgatccagtaactgcacgtcaaaagcttgaacgtcgcacatccatcaatggttcagaacgcatcagtttgtggcaagacggatggctggctcggtccctactgctgctcggcgaatgggagtccgcagcacgcaccgtagaaatcggtctggcccgcgccgaacagtttggcatccgcttcctcgaaccactgttactgtggtcgggcgccacaattgcaacagcccgcggaaactctgacttggcacgaaattacatgagcagactgtccaccgatcaagactccttcatcgtccaatctatgccatctgcgatgtgtcgcatgtgggtccaccgccatagaaatgaaatccccggtgcgatcgtggccggagaacaattggaaaaaatcgccgcacacaaacacgtcaacgcacctggattctggccatggcaagacgtccacgcaacgcatctcatccgcatcggcgaaactgagcgcgcccaggagttagtgaactccacgcttgaggagctcagaggctccgatatcatgtctgcccacgcaaaaattgccgttcccgacgccatgttgatgatccaccacggagatgtgaaaaagggatttaagcgtttcgacgacgccctcgatatgctcgatcccctcaccctcccctactatcgggcacgcatctgctttgaatacggccaggccctgagacgccaggggcaacgtcgacgtgctgatgaacaatttgcccgtgcagcttccctattccaagacatgggcgccgacgcgatggtcaccctagccaaccgagaacgccgggtgggtggccttggtcaacgatccgagcaagccggtgggctcacccctcaggaatatgaaattgcccgattagtgtcatctgggcatgccaaccgagaggtcgcacaggagcttttcctctcgcctaagaccgtggaataccatctcacccgggtgtacaaaaagctcggaatacgcaatcggatggaacttgccgaggctttgaagaagtactcacacgacgcc

SEQ ID NO: 2645 - DNA, 1380 bp, Corynebacterium glutamicum
gtgacaatgtgcgattacttcacaagctcaaggagaatttctgtggcttcccaaatttctggcggctggcaaagtgccaaacaccgcaccactgtttacatggtcctcgtagttgtgggcatttctattctttttgacggctacgatctagtgatctacggcgccgtgctgtcaacactacttgaagatccaacccagatcggtgcgctcagcccagcagtcgccggcacccttggttcctacgccatgatcggcgtgatgatcggtgctctatctgcaggtgccgttggtgaccgccttggtcgtcgcaaagttatgctcaccgcaatcgtctggttctctgtgggcatggcgctgaccgcgttcgcgtcctcgattgcgctgttcggtttcttgcgcttcctcaccggacttggcgtgggcatgatcgttgcaaccggcggcgcaatcatcgcggagttcgctccagcgaataggcgcaacttgttcaacgcaatcgtgtactccggtgtcccagccggtggcgtgctggcttctatccttgcactgctctttgaagatgtcatcggctggcgcggactcttcctcatcggtggatccccactactgttcctcctgccacttgcatacttcttcctcccagagtccccgcgctggctcacctcccgcggccgtgctgcggacgccaaagccctctgcgcacgctatgggctgccgacggaggaatttgtcgtcgaaaagcagcaggaaacaaagggcaccggattcgctggaattttctcctccaagtacctcatgggcaccattctcatcggcgcaatgagcttcatcgggctgctttcgacctacggcctgaacacctggttgccaaagatcatggaatccaacggcgcaacctcacatgattccctgtactccctgctgttcctcaacggcggcgcagtgttcggtggcctcatcgcatcctggttcgctgaccgcatcggcgcgaagaccgtgatcacctccaccttcgctctcgccgcgatctgcctcggagtcctgccaaacatctcctcctggccaatgatgtacaccgcaatcgcattcgcaggcgtcggcgtcctgggcacccaggttctcacctacggcctgacctcgaacttcttcggaaccgaatgccgcgcagcgggagttgcatggtgtgcaggattcggccgactcggcggaatcgtcggaccagcaatcggtggcctgatcatcggcgcaggattcggaccaagctccgcattcctcatcttcgcagcagctgccgcaatcggcgcggtctgcaccttgctgatcccgcgctccccagcagaagtagaggtcaaggtcgcgcaggaaccacttgcacgtgtc

SEQ ID NO: 2646 - DNA, 1242 bp, Corynebacterium glutamicum
atggcaagctcagtattattagctgtcgaaaaaccagaactcccccggcctactttcgctgagatcaaacgagacctcggcccccaagaaattggcaacgggcttgtcgcactgattttctccgcatccggacccatcgcagtgatcctggctgctgctgcagcgggaaacctttcgcctgatcaaacatcttcatggatcttcggagcatttttaggcaacggactgctcacgctgtggcttacctatatgtaccgcagcccgcaggcatacttctggacgattcccggaaccgtcatcgtgggcgactcacttacccacttaagtttcgctgaagttatcggcgcataccttgttaccggcgttgtggtgtttgcgctcggatggaccggtctcatcggacggatcatggcggtactgccaccaaccatcgtgatggccatggtcgcaggcattttcctccgcttcggactcgacctcatcgacgccagcgtgaccgacccgctcattgcacttcccatggtcatagtttttgtggcattgagcatgagtccccgcttggcaagcatcgccccacccgttgcagtagccgcagtagtgggaaccatcgttgccatcgcatccggcaaactagcgtccggaattctagacaacggaattatctcccgccccgtctttaccgccccagaattttccttcgccgccatcatggaactcgttgttcccttggcgatcaccgtagtcattgtccaaaacggccaaggcgtcgcagtgcttaaagcagcaggtcaccgccccggagtaaaccttgccgccgcggcctccggactgtggtccctacccatggcgttgatcggcaacatcaccacctgcctcaccggccccaccaacgcgctgatcgtcgccggagcaaaatcacacaggcactacaccgcagcaatggtcaccgccatcggcgccatcatcgtgggcctgttctccccaactttcgtcggattcatgctggccatgcccatatccttcatcgctgcactcgccggcatcgccatgctcaccccactcaaaaacgccttcatcgcaggattctccggtgattattccactggcgcactagtctgctttttagtcacagtgtcggaaatcagcatcctcggaatcaccgccccgttttggggaattgtcttcggatggctcatcggatggctgctggatagcaagcttctagaaaacaaaaaacgggct

SEQ ID NO: 2647 - DNA, 624 bp, Corynebacterium glutamicum
atgagcaacggattccaaatgccaacgtcccgttacgtgctgccttccttcattgagcagtccgcatacggcaccaaagagaccaacccttacgcaaaactctttgaagagcgcatcatcttcctgggcacccaggtcgacgacacctctgcaaacgacatcatggcgcagctccttgtcctcgaaggcatggacccagaccgcgatatcaccctgtacatcaactcacctggtggatccttcaccgcgttgatggcaatttacgacaccatgcagtacgtccgcccagacgttcagaccgtctgccttggtcaggcagcatccgcagccgcagttcttcttgcagccggtgcaccaggtaagcgcgctgttcttcctaactcccgcgtgctgatccaccagccagcaacccagggcacccagggtcaggtttctgacctcgagatccaggcagctgaaatcgagcgcatgcgtcgtttgatggaaaccaccttggctgagcacaccggcaagaccgcggagcagatccgcatcgataccgaccgtgacaagatcctcaccgctgaggaagcactcgagtatggcatcgttgaccaggtcttcgattaccgcaagctcaagcgc

SEQ ID NO: 2648 - DNA, 603 bp, Corynebacterium glutamicum
ttgactgttttcatgagcgatattcgtatggcagcccagggtgggcctggtttcggaaatgacgtctttgatcgcctcctgagtgagcgcatcattttcctgggaagccaggtagacgatgagattgcaaacaagctatgcgctcagatcctgctgctgtccgctgaggatccaaccagggacatctccctgtacattaactccccaggtggctccgtcaccgcaggcatggcaatttatgacaccatgaaatactccccatgcgacatcgcaacctacggcatgggcctggcagcatccatgggccagttcctgctttccggtggcactaagggcaagcgtttcgcattgccacacgcacgtatcatgatgcaccagccttccgctggtgttggtggtaccgcagctgatatcgctatccaggctgagcagttcgcagccaccaagcgtgaaatggcccagctgatcgctgagcacaccggccagacctttgagcagatctccaaggattccgatcgtgaccgctggttcactgcacaggaagctaaggattacggacttgttgaccacgtgattaccttggctgaaggcccaatcagcaac

SEQ ID NO: 2649 - DNA, 150 bp, Corynebacterium glutamicum
ttgggtacgttcatttggttcaatgtcaccagactacccgcgtatttccatgaaaccgcctctgttcgctatcagcgttttcaccgtttaaaaaagcaaaaaaataacgcttctcgacgtccagtggcgcgtcgaaaagcgttatttctt

SEQ ID NO: 2650 - DNA, 1347 bp, Corynebacterium glutamicum
gtgaagagttctgtcgagaagctgagcgacacccgttcaaagatcaccgttgaggttccattttctgaactgaagccagagatcgaccaggcatacgccgctctagcgcagcaagtccagatccctggtttccgtaagggcaaggcaccgcgtcagcttatcgacgcacgcttcggccgtggtgcggttctggagcaggttgtcaacgacatgcttcctaaccgctacgcacaggcaatcgaagctgagggcatcaaggcaatcggccagcctaacgtagaggtcaccaagatcgaagacaacgagctcgttgagttcgtcgctgaggttgacgttcgcccagagttcgagcttcctaagttcgaggacatcactgttgaggtcccagctatcaaggctgacgaagaggcaatcgaagcagagctcgagaccctgcgtgcacgtttctccaccttgaaggatcacaaccacaagctgaagaagggtgagttcgtcaccatcaacatcaccgcaagcattgacggtgagaagattgaagaggcaaccactgagggtctgtcctacgaaatcggatctgacgatctgattgacggcctggacaaggctctgatcggcgctaagaaggatgaaaccgtagagttcacctctgagctggcaaacggcgagcacaagggcaaggaagctcaaatcagcgttgagatcaccgcaaccaagcagcgcgagctgcctgagctggatgatgagttcgcacagctggcttctgagttcgacaccatcgaagagcttcgtgagtccaccgtgtctgacgttgaggctaagcagaagaacgagcaggctgctgcaatccgcgacgaagttctcgctgcggctcttggcgaggctgacttcgctctgccacagtccatcgttgacgagcaggcacactcccagctgcaccagctcctcggcgagcttgcacacgacgatgctgcactgaactccctccttgaggctcagggcaccactcgtgaagagttcgacaagaagaacgtcgaagatgctgagaaggctgttcgcacccagctgttcctggacaccctctctgaggttgaggagcctgaggtttcccagcaggagctcaccgaccacatcctgttcaccgcacagtcttacggcatggacccaaaccagttcatcggtcagctgcagcagtccggccagatcgcgaacctcttctccgacgttcgccgtggcaaggctcttgcacaggctatctgccgcgtaaacgtgaaggactccgagggtaacgagatcgaccctaaggaatacttcggtgaagaagaagtagctgagactgagtctgaagct

SEQ ID NO: 2651 - DNA, 495 bp, Corynebacterium glutamicum
atggacaaatttttccccactgatcagaatgaccgcgatgctctatttcagagactcgaagccatagaggcagtgatcgctcggcacgaggcactgtttgcaaaagaaggccactcaatcaacgactcccctgaaactacggacggagcgattcatttctccggacagtttgaaaacgcttcaggttccatctcctattcatggtcgcgacccccacatcatctcctcgaagaagcctgggattcgtcattcacccgactcgcagcattggcccaccctcaacggggtctgattctgaaacagttacttaatgacccctgctcggtctctaccctttgtcagctcggagtgacatcctctaccggcaccgcctaccaccatctcaatgaacttgaatctgccggctgggtaagaaaaggtcgtggcggcgtttatgaagtccccactgagcggatcatcccgctactaaccatcatttctgccagtgagaatcac

SEQ ID NO: 2652 - DNA, 975 bp, Corynebacterium glutamicum
ttgtccatcgccgtagcaaccaccaaacaacaaaaaggcttcgtcacaggtcagcccaccggtgcgcttaacctctccgacatcctcgactccgaagaacttggcgagtatcacctcatgtcagccgccatcatcactggtaacactgtagatttcagcgggctcggcgcaggtccagacgacccttttgaaatcgcatcgattacgaagatcttcaccggtgagctgcttcgacttcagattgagcgaggagagatcacagaatccacggccgtcggagacgttcttggagaacgtgtagccgactccctcatccgggacataaccgtggaagaactagccaatcacaccagcggactaccccgtctaggcaatgtaggacttagaccttttatggctacgttctttgacaagaatccttacaaagacctctctgcagatcgagtcatctctatcagcacaacgtccaaattgaattcgcgcggagaatttcactactcaaatcttggttttgctctgcttggccaagtccttgcccgcaatgccggtttaacgtttgaccagctcttagaccgtgatttactggcaccactcaacctcaataacaccaagctcatgaccccagaatccctcgctcaagatgcacctcaagggttctcaacacctggcaaacaagtcgaagcgtgggagatggatggctttctccccgcagctggcctgcgttccaccgcgcgcgacatggcagttttctgtcagtacttattcacaaaaggccccgcccctttcacctggcaatcccttgaatcggcccctgaaatcgtctggcataacggagagtcctttggatatagttccgtactcttctttaacaccgctacaactactgccatcttcgttgctgccgacgttgccacatctgtcttcccaattggtcacgagcttttaatggcaaactccactaggcaggaatcaaaa

SEQ ID NO: 2653 - DNA, 456 bp, Corynebacterium glutamicum
atgatcgattcccccgcctctatccatcggcgaatcgttgcaaccttggccgattacagcatcgcgctcctcattggaggaggcattgctctggctttcggaactagtatcctcaacccgctcttttcaactgttctcacgattgccttttggctttccaaatctttattagaagcagccttcggaactacaccaggaaaaatgctcacacacctgcacgtcaaccacgacatacatggtgagcgcctaagcatctactactcctcagcaagaaacgcgtggatcttgttggagatcatcccacttgtcggcctagtactattcagctttgtagccattttcctcgtcgctagttgcattcgcgcttgcaacttcatgggtttacatgacaaatttgcacatgtaaatgtcttgcggaaaaacgaaaaacaccctctcaactgctttaaatgcaac

SEQ ID NO: 2654 - DNA, 249 bp, Corynebacterium glutamicum
atgaagccaaaaattatcgatgccgaatcgggcagagagctctggactgcaattgaatgtgcagagttctccggtactgctcgaggtactttcactagctacgcaggtcgaggacgtgctccaaagccagttgcaaagctccatgggctcactttgtgggactcccaaaccattgaggaatgggtcgacgaccgcgctgcaggaaacaagggattaattaattccgaagagactgtcgcagtcgccaac

SEQ ID NO: 2655 - DNA, 438 bp, Corynebacterium glutamicum
atggcaggtcacacccacaaaacccaccggactgcttataagcagttggaagccttggcccgcaatgggcatttgtttacctatattgatccaccagcagaggttgacggggtggtgaaatcaacaacgaactgtttggaaggtggtatcaacgctcagattaaagcgttggcgagaaaccatcgggggatgtttgatgaacatcaacgtatcgcggtggattggtggttattgatgcatacgcagttgcctggcgatccggttgagatcgccaggcaacaaaactggggtcaagacggactcgccaaagtccccgacttgatccaacaagaacaaccacacgaccacgacgggcgcccggctacctatgacaccggaatcgatgccacaccgaataactctagcggtatccggcagggatgggcaggtcgtttcaac

SEQ ID NO: 2656 - DNA, 150 bp, Corynebacterium glutamicum
gtgcttttcggcgagctcagcacgggtcttagggtgacgtgtttttggacgttgcgtttgacgtggacgaggcagcgttggattttcgttgtcggccaggtcgtggtgatggctttgagtgcgccttttttgtccgtcggtggtcacgat

SEQ ID NO: 2657 - DNA, 126 bp, Corynebacterium glutamicum
gtgctgagctcgccgaaaagcactccggggtctctccttgaaactgctgaaagtcaccacaccggaacaagccgccgactggcgcaaactcctccaagagttctacctcacctacggggactggct

SEQ ID NO: 2658 - DNA, 264 bp, Corynebacterium glutamicum
gtggcctacaccttcgaccacgtcgtcgcctggcgctggtgcaccaaagaagacgcctacaactacacccacctcttcgatcaactccaaccacccttaatcgtgaccaccgacggacaaaaaaggcgcactcaaagccatcaccacgacctggccgacaacgaaaatccaacgctgcctcgtccacgtcaaacgcaacgtccaaaaacacgtcaccctaagacccgtgctgagctcgccgaaaagcactccggggtctctcct

SEQ ID NO: 2659 - DNA, 390 bp, Corynebacterium glutamicum
gtgttctgccaaccacaaacccatcaaaaccaggcaacatccccaccccaacaccaacctgtgatacacgcggggactacaccaaacaaggtgaaaagaacacgacccaactgcccggtatgcaccggccccatgagaaaaaacagccactacaacaaaaggcaccacccgatggcgctgcaccacctgcaacgccaccaccaccaacacccgacccaacgaccaccacgcccaccgattccaactctttatcaactggatcctcaactcccatcacgcaccaacctcgccaaccaactaggcgtgacccgtcgtaccctcaccaactggttccacgactactggttcgtacaagtcccccgcaacaccgaccgcttccgtgtctatgac

SEQ ID NO: 2660 - DNA, 885 bp, Corynebacterium glutamicum
gtggttgaaatcttgccatcaaaattatcgagtgagttgaagcattccgtggaagtactactacttatcgcaatcgtcgttggtggtggcgtttttgtcgcctcaaagatgggatccaataacaataagaagcaagaagaagccaagtttgctgacgcacaggcagatgcgcgtcggtggattgagcgtcttggttcccaggttttgaccatcgcaggtacagatgctgcgtcgacccaggctattgctgacgcctcagagcgctataccgctgcgtcttctcagatttcttctgccactactcctcgtcaggcagagttggctcgagaatctgcactagagggtctgcattatatgaacgcggctcgtgagatcatgggtatgactgctggccctgagctgcctcctctggaaggtcagcgcaatgctggtcgcgttacagaaaagcgcaccattgagcaggagggtcgccagatcactgcttcccccgtcgcaacagatgaaactccgaactactaccctggcggtaacgttgcgggtcgcccagtccctgctggttggtactccgagccttggtgggcaagcgcattgcgttccggtctgtggactgcaggttcggtcatgatgttctcagcaatgtttaacggcatggctggtgtcggctactccgctgcagcctttgaaaatggctatggcgagggctaccaagatggcctggacgcagctggcggagacatgggcgatgctggcgatatgggtgacgccggagctgacatgggcgatgttggtggtgatgctggcggagacggtggcggattcttcgacggactctttggtggtggagacggcggcgatggcggcggattcgattttgacttcgatttc

SEQ ID NO: 2661 - DNA, 471 bp, Corynebacterium glutamicum
atgcgcgtataccttggagcagaccacgctggtttcgaaactaaaaatgcaatcgcagaacaccttaaggcccacggccacgaagtgatcgactgcggagcccacacctatgatgcagaagatgactacccagccttctgcatcgaagcagctagccgcacagtaaacgacccaggctcactcggcatcgtcctgggtggatccggaaacggcgagcagatcgccgccaacaaggtcaagggtgcacgttgtgcacttgcttggtctgttgaaactgcacgcctcgcccgcgagcacaacaatgcgaacctcatcggcatcggcggccgcatgcactcagaggaagaggcattggcaattgtcgacgccttcctcgagcaggaatggagcaacgccgagcgccaccagcgtcgtatcgacatcctcgctgattacgagcgcactggaatcgcacctgtcgttcctaacgaa

SEQ ID NO: 2662 - DNA, 696 bp, Corynebacterium glutamicum
ttgataccgctcggcatcatccaccaaattctccagccgggtgaagcattgttgccgtatgcaatagtcggcctggtcattttgctgccatcctcctggttgcctcgttgggctgtcgcagtccttggcgaagtgtcgcttgtgccagcggtggttttcggtggcgggttcctgcttatcccctcaatgttcctgatcggttcagcgctcgttaggtatggagtagtcgatcgggcagagaacgcaccgcgggctatgggagtctttttcgccgtaagcgcagcaatcgctatacctacgctgatcatccaggcacgtgacatcacttcttcaggcttctcgatcgtttccacagtggcgggactcgcgcttggcggcgtctacatttctttagtgttgctggccttgcatacaccgattcgcggtgcactcgctgcagttttcgcacctttagggcgtatggcgctaaccaactacattggtgcaacgatcctcatgctcattggcgggctaatcgtggatcttccacacagcacatcatggacagctacggtgctcctagctgcgggtattctcattattcaagagctactttctgctttatggttgcgccactacacacaggggccacttgggtatctatggcgttgggtgacttggggaagccgttcccccttccttacccgttccgcatca

SEQ ID NO: 2663 - DNA, 609 bp, Corynebacterium glutamicum
atggctcaaaaagtaaccttctggttcgataccacctgcccattctgctgggtcacctcccgctggattaaggaagtcgaacaagtccgcgatattgaaatccagtgggttccaatgagcctcgctgtcctaaacgaaggccgtgatctcccagaggattacaaggagcgcatgaaggctgcatggggaccagcacgcgttttcgcagctgtcgccaccgaccatgctgacaagctcggcgacctgtacaccgcaatgggtacccgcatccacaacgacggtcgcggaccaatcgaaggttccttcaatgatgtcatcgcagaggcacttgaagaggtcggcctagacgctgcacttggtgaagttgcagacaccaccgaatgggacgacgcacttcgcgcattccaccagaccgcaatggacgaggtcggcaacgatgtcggaaccccagtggtcaagctcggcgacaccgctttcttcggcccagtgctcacccgcatcccacgcggcgaggaagcaggagagatcttcgacgcttccttcaagctcgcaagctatccccacttctttgaaatcaagcgcagccgcactgagaacccacagttcgac

SEQ ID NO: 2664 - DNA, 2601 bp, Corynebacterium glutamicum
ttgacgtccactaatctcacccgacaggaagcttcggatcgttcgaggttactgagtgtagaaaactatgacattgcacttgatctcaacaacggtgatgagttttttagttcctccaccgttgtcagcttcactgtcaggaaggctggcgatacctttattgatctccgcgcagcaagcgttgaggaggttcgcctggacaatgtgtccatcaaagatgaggctctaacccttggcaagaacggctacgacgagacgttcggcatcgccctgaagggtcttactcccggcgcgcacaccttgcgggtaacggcgtctatcccctattcccgcaccggtgaaggcctgcaccgcatggtggatccagcagacaatgaggtgtatttgtacacccagtttgagaccgccgatgccaagcgtatgttcgcgtgtttcgatcagccagacctcaaggctacctatgatctgaacatcaaaactcctaagggttggaagatcatttccaactctgagcagcaggtttccactcagcacactgattacgatacccacatttcccgagtggactatcccctctccacctacctgattgcggtgtgcgcgggtcgttaccacgaggtgtgcgatgtctggaagggtacgctcacccaccatgcagaaacacctgccgatcagccaactgagctgactgttccgcttgctctctactgccgcagttctttggctaaagatcttgatgcggtgcgtctgtttaccgaaacgaagcagggctttgattggtaccaccgcaacttcggtgtggcgtacccattcggcaagtacgatcagatcttcgtccctgaatttaatgctggcgcgatggagaacgccggcgctgtcaccatccgcgatgagtacgtttttgcatccaaggcaacccgttaccgctacgagcgccgcgctgaaaccatccttcacgagctcgctcacatgtggttcggtgacctggtgaccatgcagtggtgggatgatctgtggctcaacgagtccttcgccacttggtccgcggcaatttctcaggctgaggaaactgaatacaacactgcatgggtgactttcgccaatgtggagaagtcgtgggcgtaccagcaggatcagctgccttccacccacccggtgttctctgacggatacgacattgagactgtcgaccagaacttcgacggcatcacctacgcaaagggcgcctcggtgctcaagcagctgcaggcatacgttggccgtgaggaattcctggcaggcgtacgcaggcactttgccaaccacgcatggggcaacgccagctttgatgatctgctcggcgccctcgagcagtcctccggccgcgacctctccgactgggcaaaccagtggctcaagaccaccggcatcaacaccctcggcgcaaagttcaccaccgacaacggcaaatacacctccttctccgtcacccagaccggcgccgcgccgggtgccggtgagctgcggactcaccgcatcgcggtgggtctttataagcttgtcgacggatccctcaaccgctacgcacgagtagaacttgactgcagtggcgcgtcgacaagcgttgaagagatcgttggacttgagcaggctgacttcgtgctggtcaacgatgatgatctgacgtatgcgctgctggatctggatgatgattcacgcaattttgtcatcgacaatattgataagttcagcgaccctatgcctcgcacgctggtgtggtccgctgcgtgggagatgactcgcgctggtcagatgaaggctcgtgatttcatcgcgctggttgctcgtggcgctgctgcggaaactgaaattgctgtgctggagcgcattctcgcgcaggctacctctgcgctgaagagctacgccgacccagcgtgggcagaagcaactggaaatgacctgctggccgatgctttccttgagggtgctcgctccgcagaaccagactccgacactcagttggcgttcattcaggctctggcaaaagcaacgctcaatgatgctgctgccgattacttccgcgacattcttgccggcaacgtcgaaggcctgaccgtggatcctgacctgcgttggtgggcactgactgcgcttatcgcccgtggtgacatcgaggctgtcgaagatgcaatcgccgctgaactttcccgcgacaactccagtgcctccttcctcgcatcacttcgagccggtgccgctgtgaacactgaagaagtgaaggctgctgcatacaagcatgtcacggcagttgatagtggcctatccaacctggagctgcgccacaagattgaaggcctcacattcactggctcttctgaactgctgcaagcctacaacgagcagtacttcgaaatccttgatgatgtgtgggcgaacttctccggcgaaatggcacagcagatcgtcctcggactgttcccttcatggaacgtttccgaagagggtctcaagcgtaccgacgagtttcttgatggcgaacatgtcgcaggcatcaagcgaattgtttccgaatccctcgaccgcactgcccgtgctctgcgcaaccgtgcggcagatgctgcg

SEQ ID NO: 2665 - DNA, 1083 bp, Corynebacterium glutamicum
atgtccatcgagcaagcaatcacttcactctccgcaagagtgcgggaactaaagcccatcatcgagactgaagaagccaccaaaaccgcactgatcatcccctttatcagcaacgttctcggctacgacgtcactgatcctcgtgaagtcattccggaatacactgctgatgttggcgtcaaaaagggtgagaaggtcgacttcgctatcaaaaccggcgatgatttccacttcctcatcgaatgcaaaaaggtcggctccccactcagcctcgatcacgctaaccagctcgtccgctatttcaatgtcacagacaccgaatttgccattctcaccaacggcgaaatctaccaattctatggacaactcgatgcagccaaccgcatggatgcaaaaccattcatgaccttggatttgaacaatattgatgcccgtcagttccctcatttggaaatgtgtacccgcaagcatttcaacccacaagcgctagccgccaacgctgaagaactgaagtacattgctgaattgaagaaagtcatcgcgaatcaattccaagaacctgacgtagaaatcgtcaagatgcttgcggcgacagtcaccacaaagcgtatgactgcacaaaatctggaattcttcacccgcttggttaatactgcgtcttcccagttcctcaaagacgaggtcaatcgtagattgcgctccgcccaagtctttgaggatcctgtccaaacacaaggtgctgatgcagaaacaccagcagaggacgaagcagtaatcgaagaagtggtttcagaaatcgtgacgacagaagaggaaatccacggtcattcaattgtccgtgcaatttgctgctcagaggtatcggcacaagaaatcaccatgcgtgacgcaaaatcctactgcgctattctcttccaagacaacaaccgaaagccaatcgcccgtttctactttgatcgcaagattccacgcatcggcatcttcaatgctgaaggcgagcaggaacactttgatttggaatccatcgaagatatctacaaccacgctgatcttctgcattcccgcgtcgtagcattgaacgct

SEQ ID NO: 2666 - DNA, 1152 bp, Corynebacterium glutamicum
atgagtcttgctggagtgctgtacccccgaaaaggagcggtatcccttcattcctttcctcaacgaacgcaagtgaatttctggtgttaccctcgggtaattgtaaaaaattcattgattaaaaacgatcagccaattggcatgctcagactccttgtgaagaaagtgacagtttcgatgaccgaaaatcttgataatgcgttgctatccatgcggatgaaacctgtacaaatggcgcttatgacactgggctacaaccatgacatggcggtgaccgattccggtatggaacttatagtgcgccgcccagggctgaccgtgaacttcaacttggattcggtcaccttgtgcatcgtcgctgatttcatgtggcatggctgtgtccctgcaaagaaacaggcagagtacctgcgggccgctaatgaattcaacaggccaacccgtgatctgcaggtggttttagatgaagctgattcaaagaacatgactgtgcgaggtcgtgaattcttcttctcaagcgtcggcgcaacgtgggaacagtcggcagagttcgtgcactactgcatgaatgatgtggcaacgactttcgtgtcttggtgcgaacaaatctggccgaagttttcccctgaacgcgtagagttcaacgcaactcctccagatgtggatttcgagttctctgaagatcaactcaaagaaggcaatcccttcgggctgattgacgaacccaccccgctggtttctttggatcgtatctaccaacaatacgaattaatgggtgcggatcaactcaagatgggggaggacttcgttgagtatctgcatatgggtcaacgtgtcagtgcatggttgaccgatggcaacaacggcagcgatcgaaaaaccctagcggtgtcttccggtacaggtgtgaaaatcaaaaacaagaagcaacttcaggaacttcttggactgtgcaacctgtactcgaaagaacatgtactggtcacagtatttgcggaagagatcgaaaacggcgcaaggtggggtattttcgccgaagcacgcatcgatctaccggcagggttaaacgatcatcagttgtgggtattcctcgccaactccagcaaatggactgcagaggtgtgcctgaccgtggcacaccgactgcagaac

SEQ ID NO: 2667 - DNA, 666 bp, Corynebacterium glutamicum
atgtctacgattcctgatgttttcaccagtgaagtgttccctgaaatcagtggcaccaaagaattccgtggcctgacttatatgttctttgatcaattcactttgcccaccgcagaacagcttgagcaagctaaagcagctggctggtcactgatcacctggggatggtggaatagcgacaccgatcttgaggatgtcgaattggaagacatcactaatgaaggcgacagcctaccaaaactcacggatgaattcgctgtgtcttcactgagcaccttcgatctaaattcccaaggtctgcccaatgatgatcgtgagccgcaaccaattgaagaagccgactcactagatgacatcttctccgaggaagagggctggggtctaatggcaatcaattgcccgaattggcaagtcccagcagcgtgtgaatggctcggctgcatgaatgttggtgaaccatttgaaatgtcacacgtacttagggtgtggcagaacagttggggcgtcgaggccctggcttttggtggtgaagaagacgacgcggatctgctgcttcgagtccctgaagaaagcgaagagctactgaaggctctcgcagtcgcttctgaccaagtcactacctacaagcatgaagatctgggattcttagctagtctttggtttgac

SEQ ID NO: 2668 - DNA, 156 bp, Corynebacterium glutamicum
atgaccagcggtgatccaaaattaattacgcttcgttcccgcaataacaaagttgtcgaaataacagatgcccgtgatcgtgctttcattaagcaggctgatgagctgatcgtgaagatcgacaaactgcttgagagcaaaagaaaaaagtcccgt

SEQ ID NO: 2669 - DNA, 327 bp, Corynebacterium glutamicum
atggtgggccggatcgcaatagcagcagtggctcaaattgggcgatgggctggcattgatggtttggaaagccgcattgttgtgcagcgcaccatcggccctgccgacttcgcagaccgatacaactcctggagcggcgggtccattggcccctcacacaccctggcacaatcggcgttctttaggggttctaacaaatcccgcaaagtagatggcctgtatgacgcaggtgacaccacagttccaggggtgggcgtatctatgtgtttgatctctgcagaaaacgtgctcaagcgtctccgcggggacaacagtgtggatcggact

SEQ ID NO: 2670 - DNA, 171 bp, Corynebacterium glutamicum
gtgcgcgaagccggagacgagctggaagaacaaacaacccggcctcagtactgtgctggttttggcaggcgtgaagggggagcacaccctgctttttcctccgactgggacgaagatttccgcaaagttttcgacggctccaccccagaattcccggcttcagaatccatc

SEQ ID NO: 2671 - DNA, 378 bp, Corynebacterium glutamicum
atgaagtccacctcgtcgaacaaaacgagcacctcggcggccgcgccgggaccttcgaactcgacggcttccgctgggacaccggccccagctggtacctcatgcccgacgccatgtcccacttctttaagctctgcggcacctccatcgacgaccacctcgacctcgtgccacttgaacccgcctaccgcgtcatcgacgaccacggcgaattcatcgacgtcacctccgacatcgatgcgatggccgagcttttcgaatcccgcgaacccggcgccggcgccaaactgcgcacctatatcgactccgccacacaggtctacaacctggccatcgacggcttcctctacaccaacttcaccaacttcatcccatact

SEQ ID NO: 2672 - DNA, 1206 bp, Corynebacterium glutamicum
gtggaaagaagtgtttcaaaaatgacaaaagcagtggtcatcggcgggggactagcaggactagccaccaccgcactgctcttacgcgaaggatatgaagtccacctcgtcgaacaaaacgagcacctcggcggccgcgccgggaccttcgaactcgacggcttccgctgggacaccggccccagctggtacctcatgcccgacgccatgtcccacttctttaagctctgcggcacctccatcgacgaccacctcgacctcgtgccacttgaacccgcctaccgcgtcatcgacgaccacggcgaattcatcgacgtcacctccgacatcgatgcgatggccgagcttttcgaatcccgcgaacccggcgccggcgccaaactgcgcacctatatcgactccgccacacaggtctacaacctggccatcgacggcttcctctacaccaacttcaccaacttcatcccatacttaagccccggcatgctgcgccttttacccaaacttctagcaagcctgtcgacctcgctaaaagtcaaggtcaacacccaattccgcgatacaaaactgcgccaaatcttaagctaccccgcagttttcctctcctcagacccttcgcacaccccggcgctctatcacctcatgagccacaccgacctcgtccaaggcgtctcctatccccgaggcggcttcaccgccttcatcaaggcactaatttcgcttatcgacgacgccgtcctccacctcggcacccccgtcagcgcaatcaccacccaaggccgaaacgccacaggcgtccaagtcggctcagagttcatcgaagccgatatcgtgatcagctgcgctgatcagcaccacaccgaaacccaactcctacctgcttcgttgtgcgcgaagccggagacgagctggaagaacaaacaacccggcctcagtactgtgctggttttggcaggcgtgaagggggagcacaccctgctttttcctccgactgggacgaagatttccgcaaagttttcgacggctccaccccagaattcccggcttcagaatccatctagatctccaagacctccgcaacagattccgatgccgcacccgaaggccacgagaacctcttcatcctggtcccagtacccgccgatgtctccattggtcacgggtccgcttacggagaagaatctgacatggtgggccggatcgcaa

SEQ ID NO: 2673 - DNA, 876 bp, Corynebacterium glutamicum
gtgaaggaggcgagtgtggctgatcagcaagattttttgggccgttttgatgcgatgagctcaaaggcgacggccacggtaatcgcccattattcctccagttttactctggcatcgaagctgttgtcgccgaaaattcgtcgcgatattgaggcattgtacgcaatggtgcgagtggccgatgaggttgtggacggcgctgctgctgccgcggggtgtgcgccggacgccgttgcggagattttggacaattacgaacgccaggttctgctcagtttgtccgttccttttcataccgatccagtgatccatgcgtttggcaataccgcccgcaaatgtggttttgagcaggctcacatcgtggcgttttttgattccatgcgccgcgatctctcccaaacctcctatgatccgactcagttggatgagtacatttacggctccgctgaggtcatcgggttgatgtgtttgaaaattttcctccaagattccactgccagcccgcaggatcgggccacgatggaacacggcgccaggcgtttgggtgcggcatttcaaaaggtaaatttcctgcgagatctagctgaagaccgcgaaggcctaggccgttcttatttgccggtattcaccgaagaaatgcgcgatgagatcgttactgatatccgagaggatttggatgccgcccggctgagcattccgctgctgccatttggcgcgcgaaccggtgtgcgcgccgcgaccgatctctacggttgcctcgtggacaacctggaatccgcgtccctcgaagacttaaaaaacgggcggattcgggtgccgtctatgaaaaaagccagcctggcaaccaaagcaatgtggaaagaagtgtttcaaaaa

SEQ ID NO: 2674 - DNA, 1119 bp, Corynebacterium glutamicum
atgaagaaactgcaaatggcggccattttggtcggaggctttgtggggccgtttactggccaagctctatcagtggtcttgccggaatttgcagacacctttgatatcagtgtcagccaggcagcgctgaccatgaccgcatacttgttgccctttgccaccatgatgttgttttcggggcgcatcaccagaaagatccatccgcataaggtggtgcaggcggcttatattgtcacactgccacttgcgctgttgctcctagttacaccatcgtgggggctgtttatggctgcgtatgccacgattggtatcgctaatgcatttaccactccggtgctgcaaattatgttgcgtgagcttgttccgccgcgttctttgggtaaggcattgggcacctatgctgcgatgcaatcactcggcatgttgtcggcgccactgatcgcaggtgtgtcttcggtggtgtcgtggaggttgaccttcctggtcactgcagcagcgtcactgtttattttggtggcgcgactccccgttgttccaccaccatcagcatcgaagcaaaacgttagtggcaaggtgcagtggggaccgaccatcatccacatggtttccggctttgtggtgggcatcggcatcatcggcattggattcatgacatcgctgcacgttggcgagcaattcggacttgatgctgcagcgcgtggtttggtggtcatgtgtggtggcctggctgcgttctttgcctcccgcaagattggcgatttggcagacaaatttggtgtgcgcgcggtgctcattgtcagtgctgtcatcggtaccatcgcactcgcactgctgccgatcgcaccgtggatcattgtggtggccgtactgtgggccttcgcagtagcagcagcacaaggaatccaagcaaccgtcaacttggctgtcatcggaagccccggtggatcatcgctgctttctaccgtgcaggctttccgattcttcggatcagcggcagcaccagtgacattccttcctatctatatgggcatcggctcgggggcgttttgggtcagcgcggtagcgctgttcttcgttgccatcgcccagtggctcaacccgcagcgggtggagcggggc

SEQ ID NO: 2675 - DNA, 1233 bp, Corynebacterium glutamicum
atgtcagatctcatcgacatgctggttggagaagacctcccacagctgcgtgacaaccgtccccaagctcgcgacaatgcacaaaagagcttcgaagctctgctcgaaccggtcaacccaggaaccttcagcttcggcgagcgttacgccgtggccacctatgttgcaggtttgcaccaattcgcgccagctgtagatctctaccaagatttgcttctcgacgacgccccaaccaccctggcaaacgccgtctccgatgccatcgacgagggcctatccgcaggcccatacggcacctaccgtgaacctggacttgagtccgaatcagagccaggcggatctgtgcgcaacgatgccgccaagcttggcgagcgacttgcagcagcatttgattacgcacacctactagttttccacccccgtgattcccgccccgaggtccttggtcgactctccggcgctggctggagcgcggatgacaccgtgacattggctcagctggtgtcgttcctggcattccagctgcgtgttgcctacggcctgcgcaccctcaaaggtgaagacattcaggtgaaagctcctcgcctgagtattcctgaagcgaagtgggaactgtccaacaacggctttgagatctccacctatgaagaactcaaccgccctgaagcgtttgtgaaccactctttgggctggaagccatgggtaccaccagtagcaaaggcagatctcaccgaagaacagctggattctttgatccagcctgagcgcgctgatatgccatacttccgtctcttggcacgcgatcctgcagcattgaaggcgcgtaccctgaccgatctggatatcttcttcaacactgacggcgaaggcctaggacgtgcagagcgtgaactcggcgccaccgttacttcccgctacaacggctgcgtgtactgcgcatccgtgcacgcaggacgtgctcaggaagaatccggtcgagctgatgatgtcaacgcactgttggcaagcatcgactccgatctgggttctgaccagtggaatgtcatccgtgacgctgctcgcgcactgagctccacccctgctgctttcaaccagggatgcatcaccaagctgcgtggcgttggattcagcgacctgcagatcgtggacttgatcaactctgtggcgttcttcaactgggcgaaccgcctgatgttgtcactgggtgaacccgaagtgccaaagcgtttcctg

SEQ ID NO: 2676 - DNA, 1641 bp, Corynebacterium glutamicum
atgactactcccttgttagagatcaacgatctggttgtctcctatcaaactgctaaaggtttggtgcatgctgtcaacaatgtcagcctggaggtgcaccctggccaaatcaccgcgattgttggtgagtccggttctggtaagtccaccaccgctcaggccgtgattggtttgctggctgataatgctgaagtggattctggtcggatttctttcaacggccgttcccttgttggcttgaacgcacgtgagtggaaaaacgttcgcggtaccaaaattggtttgattccgcaggaccccaacaactctctgaacccggtgaaaactatcggcgcttcagtgggggagggcttggctatccacaagcgtggaaccgccgccgagcgcaaaaagaaggtcattgagcttctagagcgcgtgggtattgataacccagaggtccgctatgaccagtacccgcatgagctgtctggtggcatgaagcagcgcgcgttgattgccgctgccattgcacttgaaccagagctgatcattgccgatgagcccacatctgcgctggatgtgaccgtgcagaaaattattctcgatctgctggaagacatgcagcgtgaattgggcatgggtattttgttcattactcacgatctagccgtggcaggcgatcgggcggatcgcatcgtcgtcatgcaaaaaggcgaggtgcgcgaaagtggttacgcggcttcggtcttgaccgacccccagcatgagtattccaagaagttgcttgccgacgcgccctccctcaccatcggcgagatccccacgcgagttccggccgtagatccggaggtagcgcaggccaaaggcccgcttctggtagtggataaattccgcaaggaacaccaacgaggcaaagaaggagcatttgttgccgcaaatgatatttccttcgaagtactgcctggcaccacgcatgccatcgtcggtgaatccggttctggtaaaaccacgcttggccgcgcgatcgcgatgtttaatacgccgacctctggttccatttcagtaagtggcaaggacatcaccaacctgtccaaggcccagcagcgggaactgcgccagcaaatccagctggtgtaccaaaacccgtattcttccctggatcctcgccaaaccattggctccaccatcgcggaacctctgcgcaatttcaccaaggtgagcaagcaggaagccgacgaaaaggtggcacactacctggaactggtggcgcttgacccggctcttgccacccgtcgcccacgtgagctctctggtggtcagcgccagcgcgtcgccattgctcgtgccatgattttggaacctgaattggtggttttcgacgaagccgtatccgcgttggatgtgactgtgcaggcacaaatcctgcgcctgctcgacgatctgcaacgagagctaggcttgacttacgtgtttatttcccacgacctggctgtggtccgtgaaatctctgacactgtgtctgtgatgagtcgcggcaaccaggtggaacttggaaaaaccgcagaagtatttaacaacccgcaaaccgatttcactcgccgactcatcgacgcgatcccaggatcgcgctatcgtggtggcgaactcaatcttggacta

SEQ ID NO: 2677 - DNA, 882 bp, Corynebacterium glutamicum
atgagtaatcctcctatttcacccaaaaaaccggtatccgctaatcctcgaactggatccgctgacccggcacgcaagcgtaaagcgttgggcaatccttggacgaggcctgctgctgttatttccatcgtggtactcgccgttgcggtgctgatggcacttgttcctggactgtttacctcccaggatccgttcactggcgatgatgtggcgctgcttgggccaagtggcacccactggtttggtaccgattccgtgggacgcgatctctacagtcgtgttgtttacggcgcgagggaaaccctgctcggtgcactgatcgcagtgctggttggtctgatcgtgggaaccctgatcggactgctcgcaggtgcacagcgcggttgggttgacactgtattaatgcgtttcgtggatgtgctgttgtccatcccggcactgctgctcagcttgactgtcattatccttttgggattcggcaccatgaacgcagcgatcgcagtcggtattacctctgttgccaccttcgcgcgtctggcgcgttcccaggtgatgactgttgcaggttccgatttcgtggaagctgcatacggttccggtggcacccaggcgcaggtgttgttccgccacattctgcctaactctctgaccccagtgtttgctcttgcagcactgcagttcggttccgcgattttgcagctgtccgtgttgggcttcttgggctacggcgctccggcaccaacaccagagtggggtctgctgatctctgatgcccgcgactacatggcgacctcatggtggctgactgtgctgcctggttttgtcatcatcgccgtggttatgtctgccaactacctaagccgcatcattcagaaggaggca

SEQ ID NO: 2678 - DNA, 939 bp, Corynebacterium glutamicum
atgactacctcgcagattctgcgccgcatcggccaagccgtcttggtcttgttggtcacctttaccttggcgttcatcatgctttccgccctccctggcgatgctgtgtccgcccgctattccagccctgatttgggtctgtcacctgagcagatcgcacagatccgtgaatcctatggtgccgatgaatccctgatcgctcagtacttctccaccttgggtggcttccttgtaggtaacttcggttactccgtacaaaccggaactgccgtggcaacccagctggcagaagccctaccaggcaccttgaccttggctattttggcattcttgctcgcagccattttggcactggttatttccattcttgccaccatggatcgctttgcatggatcaagggcatcttccaggctctgcctccattctttgtgtcccttccaagtttctggttgggcatcatcttgatccagatcgtgtccttccgccttggttgggtccccgttattgggaccaccccggcacaaggactgatcctgccgaccatcaccttgtccatcccaattaccgctccgcttgcacaggtgctcatccgctcgattgaagaggtcaaggcacaaccgttcatcgcggctgttcgtgctcgcggtgcgggtgaaatgtggatcttcttccgcaacatcattcgcaacgcccttttgccaaccctgacgattgccggcatcttgtttggtgaactagtcggtggggccgtggtcaccgaggcagtgttcggccgcgctggacttggccaaatgaccgtcaacgcagtggccaaccgcgatatgccagtgatgcttgccatcgtggtgatcgcagctgctgtttatgttttgatcaacctcatcgtggatttgttgtacccagtcctcgatgcccgtctgcgccgcagggaaagggca

SEQ ID NO: 2679 - DNA, 1707 bp, Corynebacterium glutamicum
gtgtttaaaaagcacagacacggtctcggctcccccgaaaccaaaccacgctcaataacccgccggtttttcaccgcggccgccgctacgctggcaggattggcagtcctgtccggctgcacagcacaaccctcacaagcagaagacaacacgctcacttacttagagccacagttcttccgcaccctgtacccaccatcagcgggcttttaccccaacggcagtgtggtgaacaacattgcagaccgcttgctctaccaggatcctgaaaccttggaactcaagccgtggatcgccaccgaactcccagaagtaaacgaagacgccacggaatttaccttcaacatccgcaccgatgtcacctactccgatggcaccccgctgacggctgaaaacgtggtgaaaaacttcgatctctatggcctcggcgatcaagatcgacgcctcaccatctctgagcagatcaccaactacgaccacggcgaagtagtagatgaggacaccgtccgattccacttctctgagcctgcacctggttttgctcaggccaccagctccttcaacgctggcctttatgccgattccaccttggagttcgccaatgaggatttcgccccaggcaacgcccaaaacgtcatcggctccggtcctttcgtgatcaccgatgaaaccctaggcaccaacctcaccttgactgcgcgtgaggattacgattgggcaccaccatcacgcgaacatcaaggtcgcgcgaagcttgacgccgtcaattatgtcctcgcgggtgaagaatccgtccgcatcggagccatcgttgctggccaaggtgatatcgcccgccagatcgaagcgccagtggaggcacacctgaaggatgcaggcatcccgatcatctccgcagccaccaacggtgtgaacaacagcttcaacttccgcttcaaaaacgagctgctctcagacatccgtgttcgccaagctctgatccacgcgatcgaccgcgaaaagatcatgcgtgtgctgtttagtgattcctatccgctggcaacttctgtgcttgcgcaaaatgcactgggctacaaagaacaagtagatgcctatgtctacgacctagacaaagcaacagctctgcttgacgaagccggctggacccttgatagcgacggcatgcgtcgcaaggacggtgaacttctagagctcaccttcaacgaagccctcccacagcctcgttcacgcgaagttgtcaccatggtccaagaacagctcggtgatctgggcatcaaggtcaacctcaacccaggtgaccaagcagcccaggacgctgactccaaggatctcaacaagatccaggttcgccacaccatggtgggtcgcgcagactatgacgtgctgaaatcccagctgtactccaccaaccgcaacgagctgttgaacatgaccgtggaaggggagaccgccgatattggcgatcctcatttggaggaactcctcatggctattgcatccagcccacgcgaagaggaccgtgcagcagcatctgccgcagcacaggattacatcaccgagcaggcatatgttcttccactgtttgaagagccagttgtctacggcgtgcagccttacgtgaagggctttagccccgaagtgatcggccgccccagcttctatgagacctacattgaccattccagcgaccattccagtgaggaggac

SEQ ID NO: 2680 - DNA, 1941 bp, Corynebacterium glutamicum
gtgagcacaaccgataagcaggtagccatcgttggagttggccccagaggtatttccatactcgaaaggatcgcagcagctctcaacacagtttcccgccccaaacaaggcttgaccatccacctgattgaggatgcccagatgggtgcaggcaacgtgtggcgcactgatcaaacccgcacgctgtgcatgaatactctggccggtgcggtgacattattcacagagccaggctctacggtgagcgctccagtggtggaaggaccactgcaatttgattggattcgcctgctgcgcggcgatgaggatttgagcggcattcctacaaaagccatcgagctgttccgcacctaccccccagctgcatccgtggcggaggatttcaaggaagagctagcagccactgttatccagtccaatccttcccgtgctctttatggcgcatatctgcggtgggctttcgatgtcgctttgcagctgttgccacagtgggtcaaggtcgagcagcaccatgcgcgcgcgattggcatccgcgaagatggtgaccgcgatgtgatcaccttagataattctgagatgatttccgccgattccactgtgttggctgtcggctggcaaacccccgcccccaatgcggaggagctgtccatcgcggctgctttggaggagaaccctgatctggtgtgggtcaagcccggcaaccctgtcgagcaggatgccagcctcattcccgctggcgaacaggtgcttgtccgcgggctgggcatgggatttttcgatatcatggcgctgaccaccatcgatcgtggcggcatcttccacgaggatcccagcacccgttccggtttgcgctacgaggcatctggtgaggaaccacactttgttatttcctccgggcgcggctacccctacctgcctaaatccgattacaaatcgctgccaccaggggcaaagctagcgcgactcaaggctgttatcgcggcgatcaacgcgcaaaatcgtggtgtcgcatccatcaactatgatgcggaagtgtggccagctgttgctcgcgacgcctacgaagcctattacgaaacccttgatcgcgtaagcccagaatctatccggaccggtctggataaaattgtggaaattattgatgaggtggacgtcgataagcttcctaaagcactcgccgcgcacaccgatgacgtctttgacctgcatgcttgggaatttccgctcgcgggaattaatgaaagcgtcgaggcgctgaccgcacgcatcgcggacggcatggcccgcgatattcgccatgcagtaacggcctgggacagcccgctgaaatccgcgctgtggtccatttccgccgcgcgcaaacccagctccatcctgggcgcggaaggccgcctgaccttcgaatcgcgccgcaaccgcttcgccgccgtcatggcgatcggccagatggtcggctccggcccaccgcttttccgcacccgcgaacttcttgcgcttgtcgacgccggcctcgctcacttcgccggcgcccgcccccgcctcagcgtgagcgacggtcaatggcagatctcctcgcccaccaccggcgatacgccgctgagatcgaaagtgcttgtcgacgcgtggatgcacaacccagatgtgcgtcgcaacgccgacccgctagcactgtctttggaagatgccgaccgggtacgccccttcaacgactattccgtcgacggaaccgctgcccccacaggctcccccgaagttgatccggcaacccgacttttggttcaccccaacggcaacctcgatccgcgcgtgcacctgattggcatcccaacctatgggcagctggccgacaccaccatctcgccgatgcctggaaccaacccgctcatgctgcaagaaaccgacaaaacagccgttcacgtgctaaagcagctcggcttgatc

SEQ ID NO: 2681 - DNA, 1314 bp, Corynebacterium glutamicum
gtgcaagcaaaagaagaggaaaaacgggcattcgacaacgatcgcgcgcacgttttccactcctggtccgcgcaggacaaaatcagccccaaagtatgggcagctgccgaaggttccacgctgtacgacttcgacggcaacgccttcatcgacatgggttcccaacttgtctcggcaaacttaggccacaacaaccctcgattagttgaggcgatccagcgccaagcagcccggttgaccaacatcaacccggccttcggcaatgatgtgcgctctgatgttgctgcaaagatcgtgtcgatggcccgtggcgaattctcccacgtgtttttcaccaacggcggcgccgacgccatcgagcactccatccgcatggctcgcctgcacaccggacgcaacaaaattctgtccgcataccgcagctaccacggcgcaaccggatccgcgatgatgctcaccggcgaacaccgccgcctgggcaaccccaccaccgacccagatatctaccacttctgggcaccattcctgcaccactcctcattctttgccaccacccaagaagaagaatgcgaacgcgcactcaagcacttggaagatgtcatcgcgtttgaaggtgctggcatgatcgcagcgatcgtcctggagccagtggtgggatcatcaggaatcatcctgccaccagcaggttacttaaatggcgtgcgcgaactttgcaacaagcacggcatcctcttcatcgccgacgaagtcatggtcggattcggacgcaccggaaaactgtttgcttacgagcatgctggcgacgatttccagccagacatgatcaccttcgccaagggtgttaacgcaggttacgccccactcggtggcatcgtgatgacccaatcaatccgcgataccttcggatcagaggcatactccggcggactcacctactccggacacccacttgcagtagcacccgccaaggcagcgctggagatttacgcggaaggagagatcattccacgcgtagctcgacttggcgctgaactgatcgaacctcgccttcgtgaactagcggaagaaaacgtagcgatcgctgacgtgcggggcatcggattcttctgggcagtggagttcaatgcagacgccactgccatggctgccggtgctgcagaattcaaggaacgcggcgtgtggccgatgatctccggcaaccgattccacatcgcgccgccgctgaccaccactgatgacgaattggtagcactgctggacgcggtggaagctgcagcccaagctgtcgagctgaccttcgctggggcgttgttc

SEQ ID NO: 2682 - DNA, 1584 bp, Corynebacterium glutamicum
gtggtaacaacacggggaaagggggaagacaccatgagcatcaccacacacgtccaagcactcaccacagcactcaacgccatcgacaaccatttggccagcatgctcgaccatggtgtcaccccagaccaatacaaggccatcgagcccgacctcatcgccctagaacacaccatcaaccaccacgccaccatcgccgcccaaaccacagccctcgccgaacgcaccaacgccgcccacaccattggctccacccacctcatcgactacctcaccaccaccttcggactatccaaagcacgcgcccaccaccgcatcaatctcgcccactccctctaccccataccgaagccaaaccctggatctggcaacggcggtaatggtggcaatcccgacggcggtcctgatggtggcgactcgggtgatgacgactccggcgacgatgaccccgaccccgaaccggacaagcctgaagacggcaaacctgatggtgataagcctcgtgggccacggatcagcgcggaaaaacacgccatcatcaccgacgaactcgcccgcctcaacccgaataccacacccagcgccgaggagctacgcacccaagccctgagtcaagcgatctggcgcaccccagaagacctccgcacgtggctacgccaccacgtcaccaccgccaataaaaacaaccccaaccccatcaccgccatgaaaaggcgctacctcgctgtaggtaaacccgatgccgacaacatggtccgcatcagcggcctcgtgcccgcagccaccgcagcactgatcaccgcgaacaccgcaccgttaaccaaacgcggcaacctcgtggatctacccgcagcagaagatatgcgcacccgcgggcaacgccatgcggacgcgttgcatcacatcatggagatctacaaccacggtattgtcaccccagctcgtggtggaacagccagcatcatcatctccatgaccaccgatgatcttgatgagatcaaccacggtgatcatggcgatggcagtctacttaacaacctgtaccccaccaatacgggttactcattgaacttggcggagatcatgaacctcatcgctgcgaaatacgacttcgctgtgctcctcgatggtgagacggggcagccgttgaacgtcaataggatgcagcgctcagcgaacctgactcaacgcatcgcgttgtttgcttctgagttggtgtgctcggcacccaattgtgacaggccgcagttagagtgcgaggttcatcatttagatccctggatgagaggtgggctgaccaacctggtcaatctcacgcatcagtgctttaatcaccacccacgcaacgatgattccaggagtggggtcaatggtaaagggtttatggaccgcgatcccgttactggcagagtaggtcactactcagcaagtggtgaggggccggtgtttaaccggtcggctgctgctgatcgttccggtggtgcgtgggccagacgtaagcatcatggcccaccaccggaaccgccgagcccgccggatccacctggtcctgagccggatcctggtgatgagggcagattgttc

SEQ ID NO: 2683 - DNA, 747 bp, Corynebacterium glutamicum
atggtttttactcttgcggactccgtctcccaggttgcgctaggtccgtcctggctggaccctatggaacttctttccggctccggcccgttcggtagcttcattcttccggcgatgcttgccattgtctttatcgaatcaggcctacttttcccacttctaccaggtgattctctccttttcaccggtggtctcctagctaaccaggctgacccttttgcaccgctgtggctggtgctgatcctctgccctatcgccgcaattcttggcgatcaggtgggttactggattggccacaagttccaccctcgcctggtcaatcgtccggatggcaggattttcaagcaggaatacctcaagcagactgaggatttctttgagaagcatggccccgtgacgatcattttgtgccgtttcgtgcccatcgtccgtacttacgcacctctggtcgcaggtatggctggcatgcgttaccgcacgttcattatttacaacatgatcggtggcattttgtggggttccggcgtggtggctttgggtgctgcgttgggtcagttcgatttcgtccgcaacaatattgatctgattttcttgctgatcgtgttcatttcggtggttcctggtttggtcggcatggcccgcaagctggctgacggccacaagcaagccaacaccgagccacaagaaaaccccgcagtccagacagccccagtaaaaacccaggaagcccaggaagccccccagaac

SEQ ID NO: 2684 - DNA, 708 bp, Corynebacterium glutamicum
atgaagaagaagattgcggtcgttaccggagcgaccggaggcatgggaattgagatcgtcaaagacctctcccgcgaccacattgtctacgccttgggccgaaatccagagcatctggcagctctcgcagagatcgagggagtagagcctatcgagtccgatatcgtgaaggaagtgttggaagagggaggcgtcgacaagctaaaaaacctcgaccacgtggatacgctggtgcacgccgcggcggtggcgcgtgacacgaccatcgaagccggcagtgtggccgaatggcacgcacaccttgatctcaacgtcattgtcccggccgagttgagtcgccaactcttgcccgccctccgcgcggcatccggctgcgtcatctacatcaactccggcgccggcaacggaccacaccccggcaacaccatctacgccgccagcaaacacgccctccgcggactcgccgacgccttccgcaaagaagaagccaacaacggcatccgcgtcagcactgtcagccccggccccaccaacacccccatgctgcaaggcctcatggactcacaaggcaccaacttccgcccagagatctacatcgaaccaaaagaaatcgccaacgcaatcagattcgtgattgacgctggcgaaaccacccagatcaccaacgtggacgtacgaccacgtatcgaactggcggaccggaaagat

SEQ ID NO: 2685 - DNA, 738 bp, Corynebacterium glutamicum
atgcctagcgaaactatgaaaccagccgtagcgtcaactctggcggccacttccacgggacgtcgtcctggacgccccacccaacgtatcctttccgtcgaatccatagtggagcgcactttaaacattgccggccgcgaaggattcgctgccgtgaccatgaaccgcctcgcccgagacatgggtgtcacccctcgcgcactgtataaccatgtgctaaatcgtcaagaaatcattgatcgcgtctgggtgcgcatcatcgatgatatcaaggtgcccgatcttgatccggacaattggcggcaatctattcatacgctgtggagctcattgcgcgaccaattccgtgagactccacgtgttcttctggtcgcgctggatgaacagatctctactcagggcacttccccactgcgaatcgcgggtgcggaggagtccttgaagttcttgactgatatcgggctgtccctcaaggaagcaaccatcatccgggagatgatgatggctgatgtcttcagcttcaccctgacttctgactacacctttgacaatcgtccagagggcgaaaagccggatgtgtttgctccggttcctaagccatggcttgatgagaacccagatgtggaagcgccactgacccgtaaagcagtcgaagagtccgtctcaacttctgacgaactcttcggctacatggtggaggctcgcattgcttatattgaaaagctgcttgccgccaaa

SEQ ID NO: 2686 - DNA, 441 bp, Corynebacterium glutamicum
atgcgcactgcaagggtcttgaggccacgggcggtcaggtatgcatcgaaaactgatgggatcggtccgatgccgccctgcatgaacagcagttcttcgtccatttcctggtcgttggtaaccacaaggccgccaacaacgtcggagtgtcctccgatgtacttggtggtggagtgcaggactgcgtgtgcgccgagttttagtggctgctgcaggtatggggatgcgaaggtgttgtcaacaaccagcttggcgttggtgccttcggtgagctttgctactgcttcgatgtcggtgatgccaagtgctgggttggttggggtttccacccagatcagcttggtgttgtccttgatcgctgccttgacctcttccacgacggaggtatcaacaacggtgtattcgacgccccatgcggtgaatacggtgtcgatcaggcgg

SEQ ID NO: 2687 - DNA, 792 bp, Corynebacterium glutamicum
gtgttacccatgcgcgaactagcactcaacatggccggcgtcaccgtgcggcgcggcgagaaattgcttctcgacgatatctccctctcaattccgcaagggtcgcactgggccgtacttggtccaaatggcgccggtaaaaccaccatgctgaagatcgcagccaccttgctgtacccatcggaaggcaccgtggacatcctggggcatcgctttggtcgggtggatactcgtgagctgcggaaaacaatcggcctggtggacccgaagcaaagatttaccaacctgccggcccacgaaattgtgctgtcggggttaaccgcctccaacgggttgttgccacggtggtcggcttcggcttcggagttggagcggtgcgctttgatgttggagttggtgggcatgacagcgcgtgccgatcgttactgggccgatatgagccagggcgaaaaagcccgcaccctgattgctcgtgcgctgattatctcaccgaccctactgctgcttgatgaacccaccaccggccttgacctgcccggacgtgaaactttgctcagtgtgattgatggtttgcgagccgctcttcctggtctgacgacagtgatgatcacccaccacgtcgaagagatcgccgcctccacgacagatatcctcatgatcaaggacgcccgcatactggcttcggggactgtttcagaagtgatgactcctgaaaatttgggcgcgctgtatgacatgtcggtgtcgttggaaactgtgcgcagccggtggttcgcgttcgatgctctgcat

SEQ ID NO: 2688 - DNA, 393 bp, Corynebacterium glutamicum
atgacaacctcagaaaatttttatgattctgtgggcggcgaggaaacgttttccctcatcgtccaccgtttttatgaacaggtccccaacgacgatattttaggcccgatgtatccgccggatgattttgagggcgccgagcagcgtctaaagatgttcctcagccagtactggggcggcccgaaggattatcaggagcagcgtggacaccctcgtctgcgcatgcgtcacgtcaattaccccatcggcgtcaccgcagcggagcgttggctgcagctcatgtccaatgcactcgacggcgtggatttgaccgcggagcagcgtgaagcgatttgggagcatatggtgcgcgcggccgatatgctgatcaattccaaccccgatccgcacgct

SEQ ID NO: 2689 - DNA, 1128 bp, Corynebacterium glutamicum
gtgaatcgaattgcagaaatcgcacgcagtttcggcgtgctgggcttcagcgctttcggcggccccaccgcgcacctcggatatttccgcacggaattcgtggagcggcggcgctggctggatgatcgccaatattccgagatcgtagcgctcagccaactacttcccggacctggatcgtcgcaggtcggtatgatgctgggctaccaccgcgccggtttttccggcatggcgatcgcctggctcatgtttacctggccctcattggcgctcatggcggcgttcgccctgctttttgatgcgacctccgccagctggacgctcggcctgctcgccgcagcggtcgccgtcgtcttccacgcagtcaccggcatggcgcgctccatggcctccacgccgcgcgccgccaccatcgcggtcgcctccggcatcgcggtgctcgccctccccaacgcgtttacacacctcggcgtcatcattctcgctggcctcatcggtgccttcagcttcaattcgcttatcgacgccaccccacccccttccccgctacgcgccataccggcttgggcgggcatcggatcactagtggtgtttttgggcgcacttctcggcgccgtaatcatgggcgggttttatccagcattcattcaagccggatccacagtgttcggcggcggccacgtggttttgccactgctggaaaagctcgttgttgcgcccggttttattaaagaaaccgacttcctatccggctactccgcagcgcaggcagtgcctggccccatgttcagcttcgccagctacctcggcgcaatctacggtggcatcggtggtgcagtgctggccagcctggcgatcttcttccccgccgcactcttgagcatcagcggaatgtacttttggggacgctggcgaaaagcaccgcgcatccaagcagcagtcaccggcatcaacgccggtgtggtggggcttttgggcgcagcgctctacgatcccgtattcacccacggcatcaccagcgtttccgcattagctatcgcaacggtgtgttggctggggctagcccactggaaaattccgccgtgggccatcgccgcgggtgcggcccttgcaggctgggtcttgctt

SEQ ID NO: 2690 - DNA, 627 bp, Corynebacterium glutamicum
gtggttgagactctttctatcacctcaggtgcggctggcctgcaggcgcttgttgcgcgtgcggttggtttggatgagttggcgagcgcgcgtttccgccagctcacgccagaggtcgttgatgtttttgtcaccactccgttcaacgtgacggcgtcgcgccgggtatttggtgtggcgggtcgcgatggcgctgcagttggcgcgaaggatttgctgcaggcactcagcgagggccgggaagacgtaggcacctcccgcgacgccagctggccgggctcattgccgccagccacgggctttacgcttgtcgacgaactccccacccacgtggtgcgcactttggctgatcagggtcaggcattggctcgccagttctccggcccgcttggccctccggcttcgttgatggatcaggaagttatttcagcagaaggcaatggcaagaaggccggaatcccgatgcgcacggtatttacctgcacttcgcttggtttgatcccaggttttgaggcagccaatgatgtgccgaggcacctgcgggtatcggtgaatggtcgttggacccgcgttgatgctccctatggcagtgtttatcactcgtcaggtttgggtctgagcgttttc

SEQ ID NO: 2691 - DNA, 465 bp, Corynebacterium glutamicum
atggcagccaacaatgtcaacgacgacacccaaaataatcttcacgtgacggaggtggatctccgctgggctgatttcgatcgttttgggcacgtcaacaacgcggcgttcattgagatcgcgcaggaagctcgattggcgtttgcggaggatcagttccgtgagcgtggctatgagatccctgctgtgtttgtgcgccacttggaagttgattatttgcgtgcgatcttgccggataccacccaggctgtcgtggagacacaggtgaccaagatcggtaatacttccttcagcactcgtcaagaggtcaaggatcgtaacggtcgtgtgtgctgcgtggttgagtgcgtgcaggtggctgtcaatgtgcagactgctgcgccccgttccatcagcaaggtggagcgcaaggtgctgaccgctgtcgctactgatgaggtgcagtcgcaggaagctctagaaaag

SEQ ID NO: 2692 - DNA, 621 bp, Corynebacterium glutamicum
gtgacagataattccctggtgggcaagcgtctgtggaactacccggattttctggcaagggctttttatcaggaccaatccacgcgtactattgccacagcaagttggcctgtattagcggatccccatggtttaggcccaattattcatcctcggatggagcagcaattcgctgggcttcataacgtcatcgtgcgtgatggtgaaaccctgggatatgagcgcatcgatgcggaaatcgcttcgatcgctacagctgcgctccggcagaaggggtttgatgcgggatttgtgtacttcggtgaaatcgatgatgctggccatattttcggcctggcaggcgacgaataccgagatgcgattcgcagggtcgacacccacgtgaagaaggttctttctgaagtgtcacgacgctccgacgagctcggggaggactggctggtagtgatcacaactgatcatggtcaccttgatgagggcgggcacggcggcaccaccgatcgggagcgagaatcctggatcatcacgtggagcccgcaccgggaactgccagagtggcctgaagaaattgcgccgcatgagctggcagaactgatgcttgtggagcgccgaaccttgagg

SEQ ID NO: 2693 - DNA, 162 bp, Corynebacterium glutamicum
atgcttctgcttggtttgcatggagttcgttgggacatcattgcagaagatggtgttggtgagtttttgcaggaaacggcacaacagggtgcgttccgaatcatggtgatggagccacccacgctttctggtccggggtggtcatcaatccttacaggatat

SEQ ID NO: 2694 - DNA, 1668 bp, Corynebacterium glutamicum
ttgggcgagttcatctacacgatgaagaacgtgcgtaaggcaatcggtgacaaggtcatcttggacaatgtctacatgtccttctacccaggcgccaagatcggtgtcgtcggacccaacggtgccggtaagtcatcgatcttgaagatcatggctgggttggatcagccttccaacggtgaagcattcctggatccaggtgcaaccgtgggcatcctgttgcaggagccaccactaaacgaagaaaagactgttcgccagaacgtcgaagaaggtcttggtgagatcttcgaaaagaagcagcgcttcgacgccatcgcagaagaaatggcaaccaactacaccgacgagctcatggaagaaatgggcgttctgcaggaggctctcgacgcagctgatgcgtgggagatcgactccaagatcgaccaggcaatggatgcattgcgttgccctccaagcgatgagccagttacccacctctccggtggtgagcgtcgccgcgtcgcactggcaaagcttctgcttgcagagccagatctgctgctgctcgatgagcctactaaccaccttgacgccgagtccgtcctgtggctggagaagcacctcgctgactacaagggcgctgtccttgccgtcacacacgaccgttacttcctcgaccacgttgcacagtggatctgtgaagttgaccgtggtcagctgcacccttacgaaggcaactactccacctacctggagaagaaggcagagcgcctcgaagtttctggcaagaaggatcagaagctgcagaagcgcctgaaggacgaactcgcatgggttcgttccggcgctaaggcacgtcaggctaagaacaaggctcgtctgcagcgttacgacgagatggttgcggaagctgagaagtaccgcaagctcgacttcgaagaaattcagatcccaaccccaccacgcctgggcaacaaggtcgtggaggtcaaggacctggagaagggcttcgatggccgcgtgctgatcaaggacctgtccttcaccttgcctcgtaacggcatcgtcggcgtgatcggacctaacggtgtgggtaagtccaccctgttcaagaccatcgttggccttgaaaacccagacgcaggcagcgttgaaatcggcgacaccgtccagttgtcctacgtggaccagggccgtgaaaacattgatccagaaaagaccgtttgggaaaccgtttccgacggactcgactacatcattgtcggacagaacgaaatgccatcccgcgcatacctgtccgccttcggattcaagggcgcagatcagcagaagccatccaaggtcctctccggtggtgagcgcaaccgcctcaacctcgcgctgaccttgaagcagggcggaaacctgatcctcctcgatgagcctacaaacgacctcgacgtggaaactctgggctccctggaaaatgcactccagaacttccctggctgtgcagtggtcatttcccacgaccgttggttcctggaccgcacctgtacccacatcctcgcgtgggaaggcaacatcgcggaaggccagtggtactggttcgaaggcaacttcgaagactacgagaagaacaaggtggagcgcctcggtgctgacgccgcacgtccttcccgtgtcactcaccgcaagctgactcgc

SEQ ID NO: 2695 - DNA, 615 bp, Corynebacterium glutamicum
atgatcaacacaccagtaaccatcgccggccgcatcgtcagtgactccgtatatattggccgtaaagacaacctcgacggcgtcctaagaatccgcgtggccagctcccgctcctacaagcagggcgaaaaatggcacaacgtggacaaagtcttcatcaacgttgaagcctggggaaaactcggcgtcaactcccacatttccctcaaaccaggcgtctctgtgatcgtccaaggcttcctgtacaccaatgaatgggaagtggaatccgctgatcccaatgttaaaaagctagaaaagcgccaagaaatcaggatgcgagcaacctccatcggcattgacatgaaccactacatcgttggcttcaaggaaagtaagcccaacgcatccaacagccccgagggcgtggagatgccagatgcaaacttggaagactatccagatgtagatcagaagcggggagcgaagcaggtggcggcttcggatgcttcggaggaggggacagaggcttcggaagctgacgaggctcctgagactcctgaggaaaaacgcgaattagctatggctggtgtgggagcaggttcaggctctgattcaggcgaggaagcgcctttt

SEQ ID NO: 2696 - DNA, 2103 bp, Corynebacterium glutamicum
gtgaataaatcgcaggtaaagagcagcaaggtgagaatcacctggcctttctacgttttgtttgcgtttgtggctggtttggtgggtgtcattttggcgtggggtttcctgtcggaatctcttgctgcattgggcatccctgatccgggcccgatgactactgctggtttgccgtttttgcgtgcggtgggctggattgttgctgcgttgtcagcgggtagtttcatggcgacgaccttctttattagtccgcgagaaattaagcgcagcgcggaagatgggcctcagaaggctagttatctgaatcgttcgtatttgtcggtggatggttccatcgcggcgcgtacgggttcgtttgcggctatttgttttggccttgtggcgattgtgatgatcccgatggtgatgtcagacttgtcggggcaaccgtttactgaggcgctgaagttgcagaactgggcgatcgcattcgagcaggttgcgttggctaaggcgtgggcgtgggttgctggttttgccttcatcaccggtatcgctggtctgttttgtcgtacatggttggcacagccgttgctgtttgcgggttccatcatcatgactgttccacttggtttggaaggtcactcagctgccggtggcgaccacgattacggcacgaactccctgttgtggcacttggttttgatgctgctgtgggtgggtggcctgatggcgttgattgcgcacgctcgccgcattggtcccaacatggatatggcagtgaagcgttattccatcatcgcaacctacgcagttattggtatggcgatttctggcgtcgtgaatgcgttgctgcgcatggacttctcagatctgttcaccactaattatggtttgctggtctttgctaaggctgttggtgttgtcgtggtgggcatgttcggtttggcccaccgcactttcaccatcccgaagctagagaaggatccaaagaactcagcgctgtttactcgcatcgcgatcgtggaagttcttgccatggctgcggtcaccggcgttgctatttccatgggacgcaccccgccacctgcaccagagattcaagacctttcagtgatggctttggaaatgggctactccctggagaaggaaccaactcttctcaacgtgttcaccatgtggcgttttgatttgatgctgggcaccatcggcatcatgttattggccttctatatgtatggccttgtggctttgcgtcgacaagcaaaaaagtggaaccacatgcgcaccttctggtgggtgctgggctgtatcaccctggtggtcaccgtttcttccggcatcggcatgaatatgccggcgacgttctccatgcacatggtcgcgcacatgctgttgtccatggtcgtgccggtgttcctggtgctgggcgcgccgttgtcgctgatcatggaggccgttgcgcctggagagccgggccgacctgggctgcacgaatgggctgcggtgatgactgataatccgctgctgaaattcatcatgcacccagcggtgaacacgattcagttcatcatcattttctacgcgctctacctgacgccgctgtatgacatcatggtgtccgagcacgccggacacctgatcatgaacttcgtgttcgtgatttccggttacgtctattactgggaaatgatcggtcctgaccccaagccggaggaacgcacgcatgtgtcgcgtctggcgtggctgactttctcgatgccattccacctcttcttcggcgtgtacctcatgcagctccaggtcattttggcggaggatttctacaccaaactcaacctgccatgggaggtcgatctggcctacgaccagctcgttggcggcggcatcgcctgggcgtcgggttccttcccgctgattgtcgtgttcggttacctcttccgtggttggttccgtgaggaaagaatcgtggagaaaaactaccaggcccgcgccgaagccactggttacgctgacgccgaggaatacaacaggatgctcgcacgcatgaacgagggccacgacatgcacggcgactactaccaggaaaccttcgagcccaaagacaaagacaaagacaaagaa

SEQ ID NO: 2697 - DNA, 1419 bp, Corynebacterium glutamicum
atgtctttcaagcgtcgttcgcttgcaatcacttgcgccatcacctccagcattgttctcgctggaatctccggcaccgctgccgcccagtcctcctacgtttctggatcctcaggactgctgtcctccagcgagctccatcctgaaactccagcacctctggatgctccaaagaacatcatctacatgatcggtgacggcatgggttacaaccatgtctccgcaaccaacctgtttgaaaccggccagaccatgcaccaggtcgaaggcgagccaggttctgtcaccccagttgagggtggcactccagttcaggcatttgaaggcgctgagtggacccagcttgcacagtccaccttccaggatggaaactcctacgaccctgagcgcgcgtgggctgatcacaactatgtcaatgagaacttcaccgactccgctgctgcaggaaccgcaatggcaaccggcgttaagaccaccaacggcatgatcggcatcaacccagccaacgagcctgcgaagaacacctctgagtacgcaattgaaaagggcaaggcagccggcgttgtttcctctgttcctttcaaccacgcaactcctgcggcttgggcagctcacaactccaaccgcaatgatctgcacgcgatggccgaagagatgatcaacagtgatctcaacgtcatcatgggtgctggccacccattcttcgacaacaacggcaacccaatcacagaagccgacgaagactacatgcaggcttcccagtacgagcgcctcgcaagtggcgaaaccgacttcaccttcgtcgaagaggacgcagacttcgaggctctcgcaaacggccaagttgaaagtgacaagtacttcggtctcgcgcaggtcgaagacccccttcagcacgaccgcgatggcgactctgtcactccttacgacgttccactcaacgacgtcgtcgacctttccaccatgtccaaggcagccctcaacgttcttaaccaggacgaagacggattccacatcatgatcgaaggtggcgcaatcgactgggcaggccacgcaaatgacatggctcgcgacattgaagaagtccaagagttcaacaaggccgttgaaactgtcatcgagtgggttgagaccaactcctcttgggatgaaaccctcgtgatcgtcaccgccgaccacgaaaccggctacatgaccggccctaacgatgatccaaactggtccgcaatgaccggcgctgcaggcatcgttccaaaccacggctggcactccggtaaccacatcaaccagctcgtcccagtgttcgctcgtggcgcaggtgtctccgatatcgttgctgctgccgatcaagttgacccaattcgcgggaattacatcgacaacattgagatcgcgaacctgactttcaacaagtggtgg

SEQ ID NO: 2698 - DNA, 930 bp, Corynebacterium glutamicum
atgcgattcatggttttatcctatcgcaaccttctaacccttcacggcaccggcagccacaccttcgatgatgtgcctctgcgtggagaagtagaagatgacgatggggatgatggccaagaccagcatggccatcatggcacccgtatcgcggttaccgttggagccaacgaaggattggatgaccaccgggatggtcttgtatcgcgtggacaggccaatgaccaagtatggcagcaggtagtcgttccacacccacatggcattgagaatggccacggtgatggcagttggcttgagcataggccagactacccggaagtagttctggagcggaccacagccgtcgatcatcgcagcttcctcaacatccagaggaatggacttgacgaagcccgcaaacatgaacaccgacagaccggaaccgaaaccgaggtagagcaccacgatgccgatcgggttgttgaggtggagcatgtctgcaatcttgaccgtcgggaacatgaccatctggaaggggatgatcatggagaccacgaagaggtagtacagaaggtttgtccaccaggtcttgacgcgcgtgatgtagtaggcggtcatcgcggagaagaacacgatgacgatgacggagaggatcgtgatgatgaaggaccacaatgtggcctccaagaagccctgcttggtcaagcccaccatgaagttctcgaagccgacccaggtttcaccgatgggaagggagaaaggatcggaggagatggcgaacttggacttaaaggagttgatgaagatgaagaggatcggccccaagaagacgatggtgaagaacgccagaatggcgtagaccacgaacttggcgctgccagacatgtgggtcttattatccgagggaagctggtgatccttcttcttcgaggccggagcggcctgcgc

SEQ ID NO: 2699 - DNA, 639 bp, Corynebacterium glutamicum
atgaatcgcatactcggccccgaatcgaagttctatgctgctctgagcctcttcgctgacctagtcatcgtgaatgttctcttggtgataacgtgctttcccgtattcaccgggggaatgtccttgcgcaccgcccacgcggtgaccggccagatggtccgcgaggaaggttctcgccgcggctcggccttcgttcggggccttttgacgcgtcccggggtcaacaccgcatggtggctcatttccctcgccgtcgccgccttagccgcgtatgaattcgctatcattgccaaggcagatctgggttcaatgggcctgatactgcgcgcagccttgatctcggggcttatcgtattgggctctgtcagcgtatggttcttccatctcgatgcaccggggctcggcttccgccaaagaatcacacaggccatgatgaaggcggtagggcacctaccgcgtactcttttggcaatattgcctggcatagtgcttgttttgtaccccgtctttttcccagcgcagtggggaggctacctgttcttcctcgcagtgctcggcccggctctcgcggtctatctcgccgagctagtgctgcagtggcccgaactcaattcgcaaacgcccgatagcccctctgca

SEQ ID NO: 2700 - DNA, 912 bp, Corynebacterium glutamicum
atgactaccagcacttcagcgcaggccgctccggcctcgaagaagaaggatcaccagcttccctcggataataagacccacatgtctggcagcgccaagttcgtggtctacgccattctggcgttcttcaccatcgtcttcttggggccgatcctcttcatcttcatcaactcctttaagtccaagttcgccatctcctccgatcctttctcccttcccatcggtgaaacctgggtcggcttcgagaacttcatggtgggcttgaccaagcagggcttcttggaggccacattgtggtccttcatcatcacgatcctctccgtcatcgtcatcgtgttcttctccgcgatgaccgcctactacatcacgcgcgtcaagacctggtggacaaaccttctgtactacctcttcgtggtctccatgatcatccccttccagatggtcatgttcccgacggtcaagattgcagacatgctccacctcaacaacccgatcggcatcgtggtgctctacctcggtttcggttccggtctgtcggtgttcatgtttgcgggcttcgtcaagtccattcctctggatgttgaggaagctgcgatgatcgacggctgtggtccgctccagaactacttccgggtagtctggcctatgctcaagccaactgccatcaccgtggccattctcaatgccatgtgggtgtggaacgactacctgctgccatacttggtcattggcctgtccacgcgatacaagaccatcccggtggtcatccaatccttcgttggctccaacggtaaccgcgatacgggtgccatgatggccatgctggtcttggccatcatccccatcgtcatcttctacttctccacgcagaggcacatcatcgaaggtgtggctgccggtgccgtgaagggt

SEQ ID NO: 2701 - DNA, 843 bp, Corynebacterium glutamicum
atgcaagcaacgctgaagaagtacttcccagtctttgtcttgcccacccttctggcattcatgattgccttcttggtgccgttcatcgtgggtttcttcctctcctttacgaagttcaccactatcaccaacgccaagtgggttggcatagacaactacgtcaaagctttctcccaacgcgaaggtttcatctcagccttcggtttcaccgtcctcgtggtcatcgtctccgtgatcacagtcaacatcttcgccttcctcttggcgtggttgctgacccgcaaactccgcggtaccaactttttccgcacagtcttctttatgccgaaccttatcggcggcattgtgctgggttatacctggcagaccatgatcaacgccgtgctttcgcactatgccacgactattagcgcggactggaaattcggctacgccggcctcatcatgctacttaactggcagctcatcggctacatgatgatcatttacatcgccggcctgcaaaacgtcccaccagagctcattgaggctgccgaactcgacggcgtcaacaagtgggagatgctgcggcacgtcactattccgatggtcatgccatccatcaccatctgcctctttttgactttgtcgaactcctttaagctcttcgaccagaacctggcgctgaccaacggcgctcctggcgggcaaactgagatggtggcgctcaacatcatcaacacgctgtttaaccgtatgaatgtcgagggcgtcggtcaggccaaggccgttatcttcgtcgtcgttgtggtcgtcatcgcgtacttccagctgcgcgcgacccgctccaaggaaatcgaggct

SEQ ID NO: 2702 - DNA, 1674 bp, Corynebacterium glutamicum
atgtggaataactgctcgcgcacaagctcgcgacgcgggccacaaccctcacctactcccctccccgccctccgctattggaaggagtgtggcgagggggacgggaatagagctttagccccagttggattccttctcagcagcccagttgtcattgaagtgcttgacgacgtcctcccacttcagctttccggaggcgtactgcgacagatcctggccgaagtcatccttgaactgctgggacgggaagtactggaagttccacgggtaggtggtcagatccttgttagcgatagcttccgcgacttgctcagaaagggggtcattcggggtgttctcagcggtgtagctttcgaacggtgcgatgaagccaaggtccttcaccacgtgctccttgccagcttcagaggtaaacagccaatccacgaagtccttggtggcctgctggtcgacctcggaggcctcagagttcacgcccaaatagttctcggtaccgacgttgatgccgtgcttttcttcatctggcagacccatgtacatgggcaggaacttgatcttgtcttccttgaccacgttgccagaagtctcggaaatctgggaccatgcccagttaccgttctgaaccatagcggccttgccctgtgcgaactcagccatggaatcagacaccgtcttagacggcgcaagagacttttctacggtggagttctcaaggtagagatcgaaaaggttcttgtactccttgttgtaggagaactcgatctcgttggtgtcctcgactcccttgtcctggtactcctgccagatcggagcgttggccaggtgggtctgccaacgccagtcctcaccggatgtcagcgaggtggaggcgaaggcgccttcgataccgagctcgtccttctttgcctgcatatcctcggcgacttccttgagcttctggtagctcgtgatctcatccgtggacttgatctttgcgccggacgtggcgatgtacttgtcgaagatctcgtcgttgtagatgatgccgaagccctcgacggcgaacggaacgccacgtacctcgccatcctcggtggtcagcggcggaatgtcgtcggtcagctgcttagctacctcggtgtccgacatatctgccatgtagtcctgccaagtgatgaagccggctgggccattgacctggaagagagtcggggcttcgtccttgccaatctcggccttgagggtctgctcataggagccggaggcggcagtaacgaccttgaccttaacgccggtctcttcagtgtaggcctttgcgatttcctggtatgccacgtcctgttcaggcttgaagttcaggaagtaaacatcgccttcctcgtcggtggagccggagcacgcgacgagacttgcggcggcgagcatggaggccatgctgatggatgcgatgcgagtaagacgcttcaagaggtcctcatctttcttgataaaaagcggggtgatgagccgagatggatatccggcccgtattcgattgtgtctgggagacctcccataacgaaggcttcttcccagcgccaccaagtacttcatagcggattgcagtccgactatgaactggttagccttccttccaccttagtgaggtattccacatattcacaagtaatcgggcctaaaacatacaaatacata

SEQ ID NO: 2703 - DNA, 1329 bp, Corynebacterium glutamicum
ttgaagcgtcttactcgcatcgcatccatcagcatggcctccatgctcgccgccgcaagtctcgtcgcgtgctccggctccaccgacgaggaaggcgatgtttacttcctgaacttcaagcctgaacaggacgtggcataccaggaaatcgcaaaggcctacactgaagagaccggcgttaaggtcaaggtcgttactgccgcctccggctcctatgagcagaccctcaaggccgagattggcaaggacgaagccccgactctcttccaggtcaatggcccagccggcttcatcacttggcaggactacatggcagatatgtcggacaccgaggtagctaagcagctgaccgacgacattccgccgctgaccaccgaggatggcgaggtacgtggcgttccgttcgccgtcgagggcttcggcatcatctacaacgacgagatcttcgacaagtacatcgccacgtccggcgcaaagatcaagtccacggatgagatcacgagctaccagaagctcaaggaagtcgccgaggatatgcaggcaaagaaggacgagctcggtatcgaaggcgccttcgcctccacctcgctgacatccggtgaggactggcgttggcagacccacctggccaacgctccgatctggcaggagtaccaggacaagggagtcgaggacaccaacgagatcgagttctcctacaacaaggagtacaagaaccttttcgatctctaccttgagaactccaccgtagaaaagtctcttgcgccgtctaagacggtgtctgattccatggctgagttcgcacagggcaaggccgctatggttcagaacggtaactgggcatggtcccagatttccgagacttctggcaacgtggtcaaggaagacaagatcaagttcctgcccatgtacatgggtctgccagatgaagaaaagcacggcatcaacgtcggtaccgagaactatttgggcgtgaactctgaggcctccgaggtcgaccagcaggccaccaaggacttcgtggattggctgtttacctctgaagctggcaaggagcacgtggtgaaggaccttggcttcatcgcaccgttcgaaagctacaccgctgagaacaccccgaatgaccccctttctgagcaagtcgcggaagctatcgctaacaaggatctgaccacctacccgtggaacttccagtacttcccgtcccagcagttcaaggatgacttcggccaggatctgtcgcagtacgcctccggaaagctgaagtgggaggacgtcgtcaagcacttcaatgacaactgggctgctgagaaggaatccaactggggc

SEQ ID NO: 2704 - DNA, 1242 bp, Corynebacterium glutamicum
atgaaagagtccatgagcatcacctcgtcgacgtacgcgtcggcactgctgacactgccctggggtacacccctggaacagtggcccgataatctcatcgccgcgctgcccaggggtatttcccggcacatcgtgcgtttcgtggggatcaaccgtggcatcgtcgcggtcaaagaaattggtgcgcgtaccgcccaccacgagtacaagatgctgcgtgaactgcagcgccttggtgcccccagtgtgcgccccgtagccgtgatcaccggacgccatccggcagaggaagactacggggagctcaccgcagctttggtgaccgagcacttggagttttccctgccctatcgcgagatcttttctcggcacctcacggtcgtggaatcggagaagctcatccgcgccctgtccgtgctgttggtgcggatgcatctgctcaacttctactggggagatgtgtcactgtctaatactctctttcgtcgcgatgctgaaacctattccgcctatctcgtcgatgccgaaaccggggagttccagcccaacctctctgaatcacgcaggctttacgacgtcgacatcgcccgcgtcaacatcattggcgaactcatggacctacaggcgggtgaatgcctagataagtccatcgatgtcatcgccctaggaggccttgtcgaaagctcttatcttgaattgtggacggagctcaccgcggaggaatccgtcgatgccagtgaatattggcgcctctctgagagaattgaccggctcaatcaactgggctttgacgtaggggagctcaaggtcacgaaggacgattcgcggcaggttgtgcgcattcgccctgtagtggtggatccgggccactatcgtgcagagctattgagcttaaccgggctgagcgtcgaggaacaccaggcccaacgcctattgggctcgatccaggcctatcaggccgtcgaatgcggaccgcatgtaggtcttacccaagccgcgcatctctggatgacgaatgaatacgaaccgactatcgccgccgtccccgtggagatgttagacaagctggagccagcacaaatcttccacgaaatcgtcgaccaccgctggttcctcgcccaagaaaggggaggggctgtcaccctcccagaggccacggcatcctatcttgaatccgtgcttccggcccgccgcgacgaggctcgcctcctcagcacaaacccttcagacgaagacttgtca

SEQ ID NO: 2705 - DNA, 1128 bp, Corynebacterium glutamicum
atggcaaccgtaacgttcaaagatgcttccctaagctacccgggagcaaaggaacccaccgtcaagaaattcaacctggaaatcgccgatggcgagttcctcgtcctcgtcggcccttccggctgtggtaaatccaccacgctgcgcatgctggccggtttggaaaacgttactgacggtgccattttcatcggagacaaggacgttacccacgttgcaccgcgtgaccgtgacatcgccatggttttccagaactatgctctctacccccacatgaccgtgggcgagaacatgggcttcgcactgaagatcgccggcaagtcccaagacgagatcaataagcgcgtcgacgaagccgccgccactttgggcctgaccgaattcttggagcgcaagccgaaggccctgtccggtggtcagcgtcagcgtgtggccatgggccgcgccattgttcgcaacccgcaggtctttctcatggatgagccgctgtctaacctcgatgccaagctgcgtgttcagacccgtacccagattgcagccctgcagcgcaagcttggggttaccaccgtttacgtcacccacgaccagacggaggccttgaccatgggtgaccgcatcgcggtgctgaaggatggctacctgcagcaggttggcgcgccccgagagctttatgaccgccccgccaacgtcttcgtcgccggcttcatcggctccccagccatgaacttgggcaccttctcggtcaaggatggtgacgctacctctggtcacgctcgcatcaagctttccccggaaaccctcgccgccatgacgccggaggataatggccgcatcaccattggtttccgcccggaggcactggagatcattccggaaggcgagtccaccgatctttccatcccaatcaagctcgacttcgtggaggaactcggttccgattccttcctctacggcaagctggtaggcgagggcgaccttggatcctccagcgaggatgtccccgagtccggccaaatcgtcgtccgcgctgctccgaacgccgcgcctgctccgggcagtgttttccacgcacgcatcgtggagggcggccagcacaacttctcggcgtcgactggcaagcgcctccct

SEQ ID NO: 2706 - DNA, 750 bp, Corynebacterium glutamicum
gtgcagcacgtgcaggtgagaatcctcagcagcgagcttgtctgcagcctctccggtgccatccggggcgtgaacctagatattgcagcaccgaagcccaagaagtcaggccgccgcacactcacaaaacccgaatgggatgccgtcattaagcatctgttaacgcgggataccgagccactgttaacccccaccaagcacaagaacatccgacaaagcaccaagaacatccatgcccgcattgtgcggctcactctcctccaagccgtttcagggctgagaattgccgaagccaatcaattgcagtggaagcacatcatcgacggtgacgatggcatgctcattaatgccagcgccgatattgtcaaggggcgaaaaggcaaggaaagagggcggtatatccctatcctgagggccgacgtagcggaatacctgcgtacacaccgcgaggacgacgagcatttcatcgtaggctcaccgacgacgaccgcgaggccctgggacgcgacgaacgcagatgacaaggtgcccgagctataccggcaaattgcagaagctacaggcgtgaagactcttcaagacctccgaagccactcctggcgtgcgacgctgcacggtgtgtacgcggacgtgatggacccagctacacgcgccgccattttcggccacaccgagcaggtagctgaggagtactacaacgaccgccaaaatattgaatcactcatgagacaagtcaagcgcgcctacgcg

SEQ ID NO: 2707 - DNA, 684 bp, Corynebacterium glutamicum
gtgctgcaccgcgaaggcaagggtggccttcttggcgcttatatcgccggcttcgagtggggcctagagaaggattaccatgttctgtgcgaaatggatgccgacggctcccacgcaccagaacagctccacctcttgcttgaggaaattgaaaagggcgcagatctggtcattggctcccgctacgtaccgggtggagagacagtgaactggcctgccaaccgcgaactgctgtcccgcttgggcaacaagtacatttctgttgccctgggtgccggcatcaatgacatgactgccggctaccgtgctttccggcgtgagctgcttgagcacctcgactttgaggagctttccaacgccggatacatcttccaggtggacgttgccttccgcgccatcaaggatggcttcgatgtccgcgaggttccgatcaccttcaccgagcgcgagcttggtgaatccaagctggacggctcctttgtcaaggattccctgctcgaagtaaccaagtggggagtggctcaccgctccgagcagatcagcgatttcacatcggaagtatccaagatcgcctcccgcacggtcaaggacatggagcttggccctaaggccaccacggccaagaacgctgtaccggacttcgtttccgaagtctctaacctagctaaaggcaccttcaagaag

SEQ ID NO: 2708 - DNA, 690 bp, Corynebacterium glutamicum
atgtttttaattaaacgtcctggcctgctttgttgtctgtggccggtttttggccacatttgggccacaactgcggtgcgctccgcgatagccatgaagtcgctgatcatcttgttcgaagcgctcatcattggcctttctgacctgccactgccaagaggtcgttcattcatccagtggcgtcaaaacagcgatcttccagtcatccccagtgcggatgagttggtacatgttccgctcgttcggtgctccgccctgatgattccaagtgacatcagcccagatactatgactggttgctgcgacgacctccacgactgcccgtgtaaccctgactccctcgtactggtcaaaagcaccggcaaagaactcttcggtctggttggcatcggataccgcgatagccagttcaggaaactcgatcagcgcaggcaccgcgtagaaatcagagatagccttcgcatcacgatcgagcagggcacgggtatatccgtcaaaaactctcgggcaatgttgtacgcgctcataaactcaacgttatgcccgcaacgtcaggtcaaaagattcttcgcttatcgacgcccacctccagcgccacgcttgcggtgccctcaagcagcgctattaatataccctcggcgaaactctgccggcggtaccccatatttagcgcgaaacagtcttgttaaa

SEQ ID NO: 2709 - DNA, 789 bp, Corynebacterium glutamicum
ttgcagtcgcaaatctggctctccatcccgggtgagcaccatggtctcggatttcagtgcacatactttaacagagtgcgtttcaatgcctgtagtgttccggcaattttgaatgtcgttacgttacccaaggctgaattcctgagctcaccttgtacaagatcagtggaagcccagttcacctctcccctgctcaacaatgggcaaacctgtttccttggtacccgaatccttgctccaaaatcacgttacgcggaagtagtcgatgcattcaccgctttcgctggcagcctgcaggttggagtcacgtcctcccctgacactcagatcggaccgatggcgactgcccggcagcgtgagcgcgtggaatcctacatttcccaaggcaaaaatgctggagcccgcatcactgtcggtggcagccgtccacgagatcttgacgccggattcttcgttgagccaacagtgttcgccgatgtagacaatcgcgcagccattgcccaagatgaaatcttcggaccggtgccctctgttgtttcctaccaagacgatgaacacgccatccaactagccaacgattccgaattcggtctcggcggaactgtctggacgagcgatcccgagcgcggcgctgcattggcccgccgagttcacacaggaaccattggcatcaaccgctatatccctgatcccgccgcaccatttggaggtgtgaaaaacagtggccttggcagagaactcggccccgaaggtcttgcttcctaccaagaaacccaaaccatttatctc

SEQ ID NO: 2710 - DNA, 762 bp, Corynebacterium glutamicum
gtgcgccacactgacgcaattgttcgtgatcagatttacccaacttttcttcccgcagttttcggccacgaaggcgccggagtagttgtcgccgtgggttctgcagtcacctcggtgaaaccagatgacaaggtagtgctgggattcaactcttgtggccagtgcttgaagtgtttgggcggtaagcctgcgtactgtgagaaattctatgaccgcaacttcgcatgcacccgcgatgccgggcacactactttgtttacccgtgcaacaaaagagcaggcagaggccatcatcgacacccttgatgatgttttctacgatgcggatgcgggtttcctggcatacccagcaactcccccagaggcttcgggagtaagcgtgttggttgtcgcggctggtacctctgatctcccccaagcaaaggaagcactacacactgcctcctacttggggcgctccacctcactgattgttgattttggagtggctggcatccaccgcctgctttcatacgaagaagaactccgcgctgcgggcgtgctcatcgttgccgctggaatggatggtgcgctacccggagttgtcgcaggcttagtgtccgcacctgtcgtcgcactgccaacctccgtgggatacggcgcaggtgctggaggaatcgcaccacttctgaccatgcttaacgcctgcgcgccgggagttggagtggtcaacattgataacggctatggagcaggacacctggctgcgcagattgcggcgagg

SEQ ID NO: 2711 - DNA, 345 bp, Corynebacterium glutamicum
ttgtcattgacaacatgctccgatcaaggtgacacgcacagggcccgtcgactgttggaacccgaacctcaaaccgagagtggagaccggaaggcgtttactgcatcgcatccaccacaagttgcccgaagcttccttaactccactgcggaggtcgtcgtcctcattcttgcggacaggctcttggagaacggacgctcctgccttaatagcccgtgtggaagcggatcgggcgtcctgaacatacggtgtatatgtgcagcagtcgatactgcagcggtagcgccaccaccactcataacaacactgtcatcgatgctgaactcggcatgcatcaacgttccg

SEQ ID NO: 2712 - DNA, 1182 bp, Corynebacterium glutamicum
atgggactgtggatcgatgcaaccgctggcgttgcaggggatatgttgctgggagcactcattgatgcaggtgcagaactagaaaaaatccaacaggttgtggaagcagtcatccccggtgacgtgctcttgcgcaccgaagaggtagtgcgccaaggccaacgaggcatcaagctgcatgtggacgcacaacatgaacaccatcatcaccgccacttaagcaccattaaagaactgcttgtcaatgctgacatccctgaacaaaccaagcaggatgccttaggcgtttttgaactcatcgctatcgctgaaggaaaagtccacggcatcgagccggagaaaatccacttccatgaggtaggagcttgggattccatcgcagacattgtgggtgtgtgcgaagcgatcaggcagcttaacccaggtttgattgctgcatctccgattgctttaggattcggacgcatcaaggcagctcacggagatattccagtgccagttccagccgtggcagagctggtgaaaggctggcccacccaaaccggagctcttatggagagcaccgaacctgttggtgaattagccaccccaactggtgttgcgttgatccgtcactttgccacccaagatggccctttcccaggtggcatcatcaatgaagttggcattggtgcaggaacaaaagatacagaaggccgtccaaatatagtgcgcgcaattttgttcaacacctctaggagtaacccagatacccgcacactggtgcaattagaagccaatgttgatgatcaagacccacggctgtggccaggagtaatagagatcctctttgccgctggcgcagtagatgcatggctgactccaattttgatgaagaagggccgtcctgcacatagggtgtcagcattggtggatagctccgaggtggaagcagtgaaaaccgcattatttgcagccaccacgacttttgggatcagatcatgggaagtcgaacgagaaggcttggaccgtcgtttcgaacaagtcgaggtggacggacacaccatcaacatcaaaatcggttcccgtgatgatcaagtaatcagtgcacagtccgagtttgaagatattcggtctgcagcggtggccttgggaatttcagagcgggaagttgtggcaagaattccgcaaggcaccaccgag

SEQ ID NO: 2713 - DNA, 750 bp, Corynebacterium glutamicum
ttgtctcgatttgctgccaacctgtcattgacttttactgagctagatttcctggatcgttttgatgccgcttcgaagcatgctttcagtgccgtggagtttcagtacccttacgatttcgatgttcaagagattaaacagcgtgctgattccgcaggtctgcccattgaactgttcaatgccccacctggggatacttttggtcttgcggcactggcttcccctgaagactttcaacaatccatcgagcaggccatcacgtacgccacagtgttgaagccaaagaagatgcatgtcatggctggcatcgcggacgtaacctcagaaaccacggcgcgctatgtggagaatattcgctgggctgcgcagcaactagacaagctcgacgttgtcgttgttattgaaccaattaatcactattcggttcccggttatttcctgcacactttagagcaggcgtattggcttatcgacagcattgcccaccccaatgtgaagatcttattcgatactttccaccttcagcagattcatggcaatctcacccgccgcctgcgcgaggttcatggcgcaggtcttttgggacacgtgcaagtggcctcagttcctgatcgacacgaacctggcactggcgaagtcaatgcggcgtatatcttccaactcctaagcgaactgggatatgacggtgtcatcgctggcgaataccaccctgctggtgaaactacagccggtttgggctggttggagctc

SEQ ID NO: 2714 - DNA, 798 bp, Corynebacterium glutamicum
atggcgttaccactacccagcaagagcgctcgagcacttgttactggggcaagccaaggcattggcctcgccatcgccaaagatttggcgcggtatgggcacaacctcattttggttgctcgccgcgaggatgtcctcaaagagatcgccgcagatctagagaagaagcacggcgtgatcgttgaggtccgcccggtggatttgagtgatgagccagcccgcaaggtgttgatcgatgagatcaagacaagggaaatcaacatcatcattaactctgctggcatcgcaagctttgggccgttcaaggaccaggattggtcttatgagactgcccagttctcacttaatgccacagccgtttttgagctcacccacgcggtgttgggtggcatgattgaccgtggcacgggcgctatttgcaatgtgggatctgcggctggcaatgtgccaatccccaacaacgccacgtatgtgctcaccaaggctggcgtgaacgcgttcaccgaggcaatgcattatgagctgcgcggaactggtgtggcgtgtactttgctcgcaccgggacctgtccgtgaggcggagatccctgagtctgagaagtcgatcgtggacaaggttgtccctgatttcttgtggaccacctatgagtcctgctccgcagagaccttgcgtgcgctgtctaagaatcagcgtcgcgttgttccaggtccgctgtccaaggccatgaattttgtgtcctctgttgctccaaccgctgtgctctcccctgttatgggctgggtttataagaagatgggt

SEQ ID NO: 2715 - DNA, 657 bp, Corynebacterium glutamicum
gtgtctgaatctgaaaacaacacaacaccagcagtcgcagctcgcgatgaccgtctggtctgggtcgatctggaaatgactggtctagatttgaagcgccacgtgatcgtggaggttgcggcgttggtcactgacgctaacctcaacgttttgggcgagggcgtggacttggttgttcacgcaactgaagaagagctcgcgcagatggatgattttgtcaccaacatgcacgaatcctctgggctgactgagcagatccgggaatccgcggtcacgttgaaggaagccgaagatgctgtgctcgcattgattgaaaagcactgcgatccagcccatcctgcaccgctagctggtaactccattgccactgaccgcgcgtttatccgcgaacatatgccacgtcttgatgaggccctgcattaccgcatggtggatgtgtcctcggtgaaggaattggcgcgtcgctggtacccacgcgtgtactacaagcagccggagaagggtttggcgcaccgcgcgttggcggacattgtggagtcgattcgggagttggattactaccgtcgctcattttttgttgcagagcctggtcctacctctgagcagtgcgcagatgatgcgcaggcagcggtggaccgttttgcaccctactttgat

SEQ ID NO: 2716 - DNA, 1188 bp, Corynebacterium glutamicum
gtggagttgtcgccaaccgtgccaccgcaaacccccaaacgtcacatgcgcatccaaagccccatggaaatttcctggagtgaagcggtgcgcgaaggcggggagcattccgctcgccgctgtggtgacatggctgtgtccgcgttggctaagccgaatcccatcattgacgatgatccggaaggcaaccccgatgtttgcatgtatacctggatcgttgagtgtcccggcgctaccgcagtgctgctatggatcaatggggtttttgatcacgagcgcattgaagaatctgaaatgacccgcctcgagggctctgatctgtggattctcagcttgcgtatgccttccgattggcgagccagctacaccgtcaacgcctggtctggcgacggggttgcgccatggcgtgaggcgggcgatcggatgcatatccgcaaagccgcgatgtcgggtgggcgtccggattcccgcgcgatgggtcatatcatggattcctcgctcgttgaaggccctgatgcgttgccggactgctgggttgcggcgtcgacaagcgtaaaagtcgtggaagaaaccgtcgccggcgagcatttctggttctatgaggcgccggtcaaggcgccgctgctggtgctgtttgatggccaacactggaacaacagcatgaatctgcctgcgcaggtcgatgcggccatcgccatcggcttgctgccgccggtcagcctgctcatgatcgattccgtcaacaccgaacgccgctgggatagtgtcggcgtgccaggtgggcaggttgatgtgcttatcgacgccctcctcccgcacgtccgcgaaacctacaacgtttccgcgcgcggcgaagacaccattgtcaccggtgcaagcttcggcggcctggcgtccctgtgggctcttgcgctttccgacggcgaagtcggccacgcaatcgcgcaatcgccaagcctgtggcgcttcaacgttgccgacgcgctttctgcagcagagcagtggagctcaatccacctgcaagctggaaaatacgaaggtgaaatgctgcgcctgtcgcatcagctcgccgaagatctctccggcgacatccgcgaggttcgtgtgcgcggcgtgcatggcggccacgattgggcctggtggcgggtgcatatgctcaccgaactcaccaggctgcttaaaaccctc

SEQ ID NO: 2717 - DNA, 1209 bp, Corynebacterium glutamicum
gtgcgggtttttcgtggtaggcgcggagcagtagcaggatcttttcttgcagtgctggcaattggttcactggcgcttacgggttgcacaattgaacgaagcgatgcgcaggagcaatcctcgcagcaaagtacagaagttgaagctgaagaagctcaagctcctgtgatttctgttgatgatggtgatgaggatgtggacccttcggaatctgtcatcgtaaagtcgatgggtgacggtctgagcaaggtcaccatgactaatgaagaaggctatgaggttgagtcagagctttctgacgatggccgtagctggaccactgcggaaacccttggctacaaccgcacgtacaccattaaggcaaccgataagaacggcgagaccgctactgcgtcttttagtactgcaacccctgcagctaccacaaacgtggcgctttctccgctggctgattctgtcgttggtgttggccagactatcggtttccgttttggttcccctgtgaaggatcgcaaggcggctcaggatgctattactgtgacaacttcaccaaaggtggagggtggcttttactggttgaacaacagtgagttgcgctggcgtccagcggagtactgggagccaggtactgaagttacggtcgaggctgacatttacggcaaggatctcggcggcggtgtctggggcgaaactgataacgccaccaacttcaccattggtgacaaggttgaggctgtggcagatgatgccaccaagaccatgagtgtgtacaagaacggtgagttgctgcgcactatgccggtatcctttggtcgtgacacctctgagtgggcaacgccaaacggtacctacatcattggtgatcgcaatgagtcgatgatcatggactccaccaccttcggtctgggatatgaggagggtggctaccgcactccggtgaagtacgcgacccagatgtcctattctggaatttacgtgcacgcagcaccgtggtctgtaggtgcgcaaggtagctacaacacctcacatggttgcatcaatgtatccaccgaaaatgctcagtggttccaggaggccgtgaagcgcggtgacattgtgaccgtgaaaaacaccatcggtgagactttgagtggctacgacggactgggggactggaacattccatggtctgaatggagcaaggggaacgcggatcaaacttcggcgtgg

SEQ ID NO: 2718 - DNA, 645 bp, Corynebacterium glutamicum
atgaacagccactggtccggaataacagacccagaaaaactacactcaggtttcgttgacctggtcgatcagcttgcagaccagtcaagagatggaaattgggatgcaatacttcaacttttgggcacacacgccaacctctcccccaatcaatggcggattggaggcacatcctggtttacgccactgcaccaaactgcatggttgggtgcaccagtagaagttgttgatgagctaatcaatcagggcgcctggtgctcactccgaaatgccgacggtgaccgtgcaattgatatcgcacgaagccgtggccattcccacctgctcgatgcacttcacgtgcgtgacctcaatgaaccagaacgcgaaaaattccaagcttgggatcaacatctcgccgatctcatagtgcagagaaccaagagtctcggcccagttaacttccgtccagtgcccaccgaagtgattaccttggaagagctggaaagcctctggtttgggtatcccggcatgtatggcgggttcctcatatccatccacagagaccgactatttattgaaagctggtctcgtgtggttggaggatccgggcaagcacacgtcatcaccaaaggtggatgtgtgcttgtggaagaaggctttgtt

SEQ ID NO: 2719 - DNA, 150 bp, Corynebacterium glutamicum
atgaccttcctgacgttgactttcaacctggataatccatcatttttgactcctccgcagccacccgtcgcagaaccagcattggcagagcaagaggaagaaatcgtgacggaacaacagcagttagaaactggtgaatccgacagaact

SEQ ID NO: 2720 - DNA, 246 bp, Corynebacterium glutamicum
ttgttgaaacggcaacaatttagttacatctatatttttctcacgatatggcactattgggggcactatgaaacccttgatccgcacgaaaattacatgcgtttgagacttttccaagaagacgtcatcacagagtgcagtatttatgaattcctgtggttctttggcatcaaagacgcgctgactcttcgggaacagttcagggtgtggagcacaactggagctcttaagtggctcttcctgttt

SEQ ID NO: 2721 - DNA, 1308 bp, Corynebacterium glutamicum; identical to SEQ ID NO: 1187

SEQ ID NO: 2722 - DNA, 207 bp, Corynebacterium glutamicum
atgaaatcagatgaggcatggatcgctgggtataaggcggcggcgccgtttctattgattgcagcaatcgggattgttgcgtctggggtggcctcaatttttgtgccgtttgatgcggtcgcaactgtatcaatgattggcacagcctggatggctattttcttagggttgggcgcatttaaagccacccaagctgccaaatctgtt

SEQ ID NO: 2723 - DNA, 639 bp, Corynebacterium glutamicum
gtgaaaaagaagcttatgttgcctttgattgttgcagctttggggttaagtgcctgcagctccgaacctgcagcagccccactcgaagcagagccattacataacctgctcattgatggttcagagtccggcttggacaatgccactgaaggaaacgacacctcattaagtggccaacccatcaatcttacagtggtcaacggtgccttagatatcgatggctcctgcggaaaagccctccaagctgtagaggacgtcaatctggacagcgtagctagcgcatccagggcactggcatccggcgacaaacaagtaggcatcgccatgtactcaaccgccgaagacaacgacatctcaccaatggacctctacgcagacatcgcgaatgcttgcgaagaccccgtcgtcgattcttccgacaccacctacaccttcggcaaactcgatgatgctcccgacggcgccgttggattcaccctcgacattgaagtcacccctgacaatcaaggctccaccgtgatgatgatccaagaattaggaaaccaccacatcatcgtcgcaggacttgaaaccaccccagaagaaaccgccactgtcttcgaagcacaacgcaccaaactcgaagaaggcctcgcagct

SEQ ID NO: 2724 - DNA, 453 bp, Corynebacterium glutamicum
gtggaaactcaggcttttcagcgccaaaacaccggcctcatcgctatggttgccgccgatgcgtcgaatcccttcttcttggaaattttccggggcgcgcagcacgccgcaagcactcagggctatacggttgcgcttgtcgacgcccgggagtcggcgattaagtccagggaggtgctggacaagatcgtcccccacgccgatggcttattgctcgctgcttcaaggatggattctggtgagatccacaaagtcgcgcgggaaattcccactgtattaatgagccgtgaagtgcaaggtattcccagcgtgatggtggataactacgacggtgcgccgaaggctgtggtgcatttggtggatcaggggtgccgctccattacctatatcgccggtcctaataaatcctgggctgatgccacgcgctggcacaggctcgctggcggctgccgt

SEQ ID NO: 2725 - DNA, 1629 bp, Corynebacterium glutamicum
gtgggggacgatcttgtccagcacctccctggacttaatcgccgactcccgggcgtcgacaagcgcaaccgtatagccctgagtgcttgcggcgtgctgcgcgccccggaaaatttccaagaagaagggattcgacgcatcggcggcaaccatagcgatgaggccggtgttttggcgctgaaaagcctgagtttccacacgcgttgcggattttctccgcagtggaaaaactcactcgcccaggctgcgaaaacgcccgcgacacagtggaaggggagacgccagcgacttttgcgacatcataaatggtggcttttgagtcgctgtgagccccagaatctgtcatgcacaagagtatatagcgcaaaagaaatcactagtcttgattctatgttgacgatgccgatacccgagtacctgcacgaaattttagatgatgtccgcgacaccacctccggcgagttggccgattacatcccggaactaaaatctgcggacccaaacccgctggcagtagccctgtgcaccgttaacggacacatctacagcgcaggcgatgacgacatcgaattcaccatgcaaagtatttccaagccatttgcctacgcactcgcactccaagaatgcggctttgatgaggtctctgcatccgtggccttggagccctccggtgaggccttcaacgaactttccctcgacggcgaaaaccgccccatgaaccccatgatcaacgccggcgcgatcgccatcaaccagctgatcaacggctccgattccaccgtggaagaccgcgtggaaaaaatccgacactacttctctgaacttgctggacgcgaactcaccatcgaccgcgtgcttgccgaatccgaactcgccggcgccgaccgcaacctctccatcgcccacatgctgcgcaattacggcgtcatcgaagacgaagcccacgacgccgtcctcagctacacgctgcaatgcgccatcaaagtaaccacgcgcgacctcgcagtcatgaccgccacgctcgccgccggcggcacacacccaattaccggcaagaagcttctcgacgcccgcgtctgccgcctcaccctctccgtcatggcttcagcaggcatgtacgacgaggcagggcagtggctctccaccgtaggcatccccgcgaaatcaggagtcgccggcggactcatcggcattctgccaggtcagctgggcatcgccacattttccccacgcctgaaccccaaaggcaacagcgtgcgcggcgtaaaaatattcaaacagctttccgacgacatgggcctccacctcatgtccaccgagcaggtatccggccacgcagtacgatccatcacgcgggacggcgacaccaccttcatccaaatgcagggcgccatgaacttctccgccagcgaaagcttcctccacgccatcgtggaacacaactttgaaggcaccgaagttgttcttgatctcacccgagtacttagcttccaccccgtagccatccgcatgatcaaagaaggcctcaaacgcatccgcgacgcaggctttgaggtgttcatcctcgacccagatgacgtactgcccgatttcatgttttccgacggcaccatctgcaaagaacgagtg

SEQ ID NO: 2726 - DNA, 477 bp, Corynebacterium glutamicum
ttgagggtggcgtcgacaagcgctatttcaatttctcgaagcgtgacggtgcagccgggccgaatgaggcatttgatcaagccaaagatgaagacgatttcggtggattcgccggattttgtgggcgggcggcgtgcgtttgaggcgtggtcgaaggatcggaccgatgcggtgatttgtttcaacgacatggtggcgcttggtttcatacaacaggcgaggctttctggggtacgtgtgccgcatgatgttgcagttgtcggttttgataatacggagaattcggtgctcagtaccccgtctctgaccacggttgcggggccgcttcgggcagtgggtcgagtggcgacagcgaacctgattgccctgttaaaaggcatgaaagcacctctgatggcgaagccccgcgaactgcccacgcgtctcattgttcgggaatcttcactgaaaacagcggtggatttgaaacgcagctcg

SEQ ID NO: 2727 - DNA, 555 bp, Corynebacterium glutamicum
ttgttgcaaccagggcgcttttactacgagctgcgtttcaaatccaccgctgttttcagtgaagattcccgaacaatgagacgcgtgggcagttcgcggggcttcgccatcagaggtgctttcatgccttttaacagggcaatcaggttcgctgtcgccactcgacccactgcccgaagcggccccgcaaccgtggtcagagacggggtactgagcaccgaattctccgtattatcaaaaccgacaactgcaacatcatgcggcacacgtaccccagaaagcctcgcctgttgtatgaaaccaagcgccaccatgtcgttgaaacaaatcaccgcatcggtccgatccttcgaccacgcctcaaacgcacgccgcccgcccacaaaatccggcgaatccaccgaaatcgtcttcatctttggcttgatcaaatgcctcattcggcccggctgcaccgtcacgcttcgagaaattgaaatagcgcttgtcgacgccaccctcaacggcagccgccagcgagcctgtgccagcgcgtggcatcagcccaggatttat

SEQ ID NO: 2728 - DNA, 1554 bp, Corynebacterium glutamicum
atgactacttcacatgcatcacaccccgatcggttgctgccagctgatcctggtacccgtgacatcgcccgtcgcctactcgcgcacgttgaagatttacccatcatctcccctcacggacacttggaagcttccatgtttgtcaaggatgaggctttccctgatccaactagcttgctgatcagccctgaccactacctcacccgcatgatgcactccgctggcgttgacctggcagatctgcgtgttggcggacatgagggtaagagtgctcgtgaggcatggcgcattttcatgtcccactgggatctctacgcaggaaccgcaactggctactgggtggagcaggaatttgagcacgttttcggcatcaacgcggagcgcctgaatgttggcaccccagaacatgctgacgccatctttgatgagctgaccgatattcttgccaagccagatttccgaccacgcgcactggctgagcagttcaacttggaagttctagccaccaccgacgatccgctcgatgacctggcagatcacaaggcactggcagatgatccaaccttctcccctcgtgtgctccctaccttccgcccagacgcatacaccaagatgtacaacgctggttgggcagaaaaaaccaccaagcttatcgataccgcaggtgacggcaaggcaggctgggagggttacctccaggcaatgcgcaaccgccgccagtacttcatcaatcacggtgcaacctccgcggaccacggtctccacgacaccgacaccaccccactgagccacaaagatgcccagaagatcttggacaagggtctcgctggcacagcaaccttggctgaaatgcatgccttcgaagccaacaccacctaccgtttcgcggaaatgtcccaagaagacggcctggtcatgaccatccacccaggtgtgtaccgcaaccactccgcatccgcgcagaagaagttcggggctgacatcggagcggacatcccattccagatggaattcaccaacggtctgcgcccactgctcagcgatttcggtgagaacaaagatctcatctctgacagcagtttcaaccgctggctgcgtacggtttccctcggatcgacccaggatgccgatatggctgcagcttccaacttggcagccaattctaaaatggcccgccagaacacccgcgatatcctcgacgcagtctctgatggtggcgtcatgctcggccgaaacggtgccctagtgttgggacctgtggttggaactctccacattaaattcattgcgcctttgaacaagcgtgtggaaagagtcatgtacaaaactggactctcagaagctgctgcagctgagcaatgtgctttggaggatcgtctccgcgaagagatggcccacgctttgtatcaatggaatccgggacgcgatgaaaactatgacctcgtgatcaacaccggttcgatgacatacgaacaaatcgttgatctagttgtggaaacttacgccaggaagtatccgctccacgtgagaatcattccgaacggaaaagaccaa

SEQ ID NO: 2729 - DNA, 501 bp, Corynebacterium glutamicum
atgtcagcagccgaaggcttacatattgtcgtcatgggcgtttctggctgcggcaaatcctccgtcggtaaagccctagcagcggagctcggaatcgaatacaaagacggcgacgaacttcacccccaggaaaacatcgacaagatggcctccggccaggcacttgacgacgacgaccgtgcatggtggctagtccaggttggcaagtggctccgcgaccgaccaagcggcgtcatcgcatgctccgccctcaagcgctcctaccgcgatctcctgcgcaccaaatgcccaggaaccgtcttcgtccacctccacggcgactacgatctcctactttcccgcatgaaggcccgcgaagatcacttcatgccatccaccttgctagattcccaatttgcaaccctcgagccgctcgaagatgacgaagatggcaaggttttcgacgttgcccacaccatcagcgaactggccgcccaatctgcagagtgggttcgcaacaaa

SEQ ID NO: 2730 - DNA, 1197 bp, Corynebacterium glutamicum
atggcaagaacacatgaatccagggggatactcatgaccactgacatctacttcagccacaacaacccacacgacccatacgcccaccacaccaccgaactcaaccgcgacacccaccacctctgggtcaccctcaccaccgactccaacgacttcgacgcagactccttcaccaccgaagtcatccggatcaccggctactcccgccacgaagtcaacaacggccttaacgccatggctgcgatgaccaacctcccacacctacgcgccatccaagaacgctactacttcctgagcatccgctacctcgcctccatcatgatcgccgtggccaaagcagaccccaccctgtgggaagaactcgacctgcgcatcaccgacgccttaacaccagtcaccgcaggggaagtcatgatccaatcctccaccctgtccaaacgcatcgccgcctggatcaaagaactcgaccccgaacccacaccagagcccacaccgaaagaggactatgttcacgtccacaccactgatgaggcgacctatgtccgcatcaaaatcagcggccccaaccgcctgatcctcaatgacatcatcacccaactcaaagacacagacaccgaggacagcctgcctgaagcgctcatggcgttcctgacagagaaaatccagttaaagatcaccaaatacctcttcaccccacataagcaccctgagcaggtgtggtcaccggactacggtgacattgatcccgaagcctatgccaacgccaccctcgtgtgcgccaaggacttagatgagctcgctggagccacggagaagagctacaccccgagtgagaagatgaaagccctgatcagagctcgggatgggcattgccgcttcccagggtgttgcgttccggcgagtaagtgccaggtcgatcacattatcccgtgggcggagggcggcccgacagcggcgtggaacctgcagttgttgtgccagcggcatcacaatatgaaaaccgatggtcgctttactgctgatgctaatggattggcggagattagatggattgggccgatggatgtaccagcggtgaccaggccgacgggtccgttggtgaaagcgatgccgcgggggatttggggtcaggtgttgagggatcggatccaggctaggtttgagcggatccgcgaccgcgccctcaacaaagaagac

SEQ ID NO: 2731 - DNA, 558 bp, Corynebacterium glutamicum
atggcacgcgcactcattctggttgatgttcaaaaagacttctgccccggtggcagcctagccaccgaacgaggcgatgaagtggcgggaaaaatcggtgcctatcagctgtcccacggctcagagtacgacgtcgttgtggcgacccaagattggcacatcgatccaggcgagcacttttcagaaaccccagactttaaaaactcctggccaatccactgcgtcgcggattccgatggtgccgccatgcatgaccgcatcaacaccgattcaatcgatgagttcttccgcaaaggccattacaccgcggcgtattccgggttcgagggaactgcagtcagtgaagaactcctcatgtctccatggctgaagaacaagggagtcactgatgtagacatcgtagggatcgctacggatcactgcgttcgagccacagcacttgatgctctcaaggagggcttcaacgtctccattttgacgtcgatgtgttctgcggtggatttccatgcgggagaccacgctttggaggaactacatgaagccggggcgattctgatt

SEQ ID NO: 2732 - DNA, 273 bp, Corynebacterium glutamicum
gtggcacgcaacattgaagacatccagcgcgatattgagcgcacccgccgtcagttggcttccaccctcgacgagctggcagaccgcagcaagccttccaacttggtcgatgacgccaagaaccaggcaaccgcgaagctgcaggaatcaaacgtacagaaggtgctcctgggcgtcgctgctgtcgtcgtcggtgctgttgtattcagcgttgtgcgtggccgtaagaaggcaaacgatctgaaggaaatccagcgcctgctctccgagcgt

SEQ ID NO: 2733 - DNA, 465 bp, Corynebacterium glutamicum
gtgaagcgccttgacgttggagataccccacccgcattttcattgcctaatgattcgggttcgaccacctcacttagtgatttcgccggaaagcaagttctggtgtacttctaccccaaagccaacaccccaggttgcaccaaggaagcatgcgatttccgtgattctttgagcaacctcaacgatctcgacattgctgttgttggcatttccccggatccggtggacaagctggtgaagttccgtgaggaccatgagctgaacttccctcttctttccgatgaggacaagtctgtgatgactgcgtggggtgcgtttggtgagaagaagaattacggcaagattgttcagggtgtaattcgttccacattcctcatcaatgctgacggaactgttggcatggcgaagtacaatgttcgtgcaactggtcacgtggagcgcatcgtccgcgaaatcaccgcggcg

SEQ ID NO: 2734 - DNA, 636 bp, Corynebacterium glutamicum
ttggaagcggcaggcactgaaattttaatgcctcgccgccgtccggcacagcagcgcagtcgtgaacgattcaatcgaatcctcaccgctgcgcgttcagtgcttgtcgatctaggttttgaatcgttcacgtttgatgaagtcgctaagcgtgcagaggtaccgatcggcacgctgtaccaattctttgccaataagtatgtattgatctgcgaattggatcgtgtggataccgcagaagctgtcgcggagttgaagaaattctccgatcaggttcctgcgttgcagtggccggatatccttgatgaattcattgagcacttggctaggctctggcgcgatgatccgtctcggcgggccgtgtggcatgccatccagtccacgccggcaactcgtgcgacagctgcggcgacggaaaaagagatgctggaaatcatcgcggaagttatgcgcccgcttgcccgcggtgccggctacgaggagcgcatgtcactggcgggattgctggtgcacacggtaagttccctgcttaactatgccgtgcgtgatgtcaatagttccgaagaggatttcgacagcatcgtggaagaaatcaaacgaatgctgatttcttacctcttctccgtggctactgga

SEQ ID NO: 2735 - DNA, 405 bp, Corynebacterium glutamicum
atgatcagcattggaaccgacctcgttcacatttcggcgttcgcagagcagcttgcacagccgggaagttccttcatggaggtgttttccgcaggggagcgtcgtaaagcaaatgaacgccaggcaagccgctacgccgagcatttggcggggcggtgggcggcaaaagaatcctttattaaggcctggtcacaggccatttatggccagccacccgtgatcgccgaagaagccgtggtgtggcgggacatcgaagttcgcgcagacgcgtgggggcgcgtcgcgatcgaattggcgcccgaattggccgcagtggtccgggaatccatcggggagttttccagcagcttgagcatcagccacgacggcgactacgcggtggcgacgtgcgtgttgactatccag

SEQ ID NO: 2736 - DNA, 1425 bp, Corynebacterium glutamicum
ttgtcttcctccagcaatcccacaacggagcaggttgggatcccgagaaatgttgtcatcatcttggctgtattagtttttacagcctttgtcatgatgttgaatgagactactctggcagtcgcgttgccgtcgatcatggcggactttgacattgaggcgaatactgcgcagtggttgctcactggttttatgttgaccatggctgtggttcttccagctactggttggatgttggaacgttttaccactcgtagtgtgtttattttcgccacggtggtcttcctgatcggtactgtgacggctgcgttgtctcctacttttgcgattatgcttgcagcccgcgtcgctcaggcgattggtaccgctgtgatcatgccgctgctgatgactgtcgcgatgaccgttgttcctccagagcgccgtggcgccgtcatgggtttgattgcggtcgtgatggccgttggtcctgctcttggacctagtgtggctggtttcgtactcagcttgtcttcgtggcacgcgattttctgggtcatggttccgttggtgtttgtggcaagcctgatcggtaccctgcgtctgaccaacgtcagtgagcctaaaaagactcctttggatgttatttccttcctgatttccgcagtggctttcggtggccttgtgtacgccttgagctcgattggcatcattttggaaggtgacagaagcgctttggtcgtgttggctgtcggcatcattgcgttggtggtgtttgtgtggcgccagattgccatgggtaagcaggataaggcgctgttggatctgcgtccgttggcgattcgtgagtacaccattccgctggttgtgcttttgacgctgttcggtgcgctgctcggtgtcatgaatacactgccgctctacctgcagggatccttgatggtcaccgccttggtcgcgggtctagtgctgttgccaggtggtcttttggaaggtgtgctgtcgccatttgtgggtcgaatttatgatcgtcatggtccacgcggactcgtgatcggcggtatgtcactcgttgtgatctccctgtttgcactgtccaccgtcgatgagttcgccaacgtgtggttcatcatcggcgtacacatcgtgttctccatcggccttgcgctgctgttcaccccactgatgacagtcgcgctcgcatccgtccccgacaacatgtacggccacggctccgcgatcctcaacaccctccaacagctcgccggcgccgcaggcaccgcggtcatgattgcggtttattccaccgtcagcaacaacgcgcttatcgacggcgcaacccaacaaaccgccctcgccgacggcgccaactctgcattcttcgcctcagcgtgcgtggcagtgtttgcactgatcgtgggcttctttgtaaagaggccagcccgc

SEQ ID NO: 2737 - DNA, 324 bp, Corynebacterium glutamicum
gtgacctcaactaacaagcagatgcgaaaagcagtcattttcctacttttcctgcttggattagttatcggattttttcttcgctatagtctggtcccactcgaatcagttcttgaacagaaattgttgtggcttttaggattcttcatccaccaggcaatcttgttcagcgttgtagttggcacagctatagttctgtaccgttatcgtcgggggcattatgctatccgtgctctgggatggggaatttgggcagggttcctgatttctaacctcttttttatggcgttgattctagctgtggctttaggtggacttactccc

SEQ ID NO: 2738 - DNA, 414 bp, Corynebacterium glutamicum
atggttgcgatgaaatacaacgtcgatgtctctcgtgaaagcgaggactggctcgccaccgtcaccaatctcgaaggcgtatccacgtgggcgacaaccttcgccaaccttgatcgcaacggccgggaagccattgctctagctgaagatctccccgaaggtgcggaaagctcactgaccatctcttggtcggttcctacagattcccaccccgaactggacactgcaattcaaattgctcaacagcgtcgctatctagtgcaagcccaacaagacttagagcccaaagttcgatccgctatttccgctctcacccaagctgcgctgctaggtatgactgcaggtcgagtatccccaactcacaacccgggtagcagagctatctcattggatcaggtgtcaggagttttaaac

SEQ ID NO: 2739 - DNA, 8979 bp, Corynebacterium glutamicum
ttgagcaggaacttcggggccagccgactgattaaccgctttggccaggagccttttgccttcgctttcgccggccaaggatatgactggttgaagacccttcgtgccgcggttgccgcaggtgcaggcaccaatgttagtgacatcgtcgagcgcgcaaatgcgctgcttgcactagttgcagatgatctcattggcacccttccatttggtttcgatccagtggcttgggctaacaactccgaagatccagctttcgatactgcacaatctgcagtgagcgtgccgggtatctttgtctcccagatcgcaaccctggattcccttgaggcgcagcgccttgatgtggatcaggctgtgtccagcattggtcattcccagggcgtattgggcgtgcacctgctcaatgatgcgactcgtgctgatgaactcgttgccattgcgcagttgatcggtgcagcgatcacccgcaccgcacgcatgacgggcctgatcgcgcagggcgacaacatgccgatgctgtcgatcgccggaatttcccgcgaacagcttcagcaagctatcgacgcggcctgcgccgaagtccctgcggagatccgcccggttatcggtctgcgcaactcacgcgattcttatgttttggttggccgcccagacgacaacgctcgcgttgttaaggtcattgaggcaatggctgccaaggataagaaggccattgaagataagctgcgcggcggttccgcgttcagcccccgtattactccgctgaaggtgcaggctgctttccatcacccagctatgaacatggctgtggagcagaccgtggcgtgggcaaccactgctggtttggatgtggaactcacccgcgagatcgccgctgatgttttggttaaccctgtcgattgggtagcacgcgtcaacgaagcgtatgaggctggcgctcgctggttcctcgacgttggaccagatggtggcatcgttaagctgactgccaacatccttgagggccgcggcgcggattccttctatgttggtgacgccgcaggccaggccaagatatttgatgctggcatggcacctgaacttccagtggattaccaggagttcgcaccacgcgttgagcacgttgatggaaccccacgcctggttaccaagttcactgagctgaccggccgcaccccaatgatgctggctggcatgaccccaaccaccgttgaccctgccattgttgcagccgctgcaaacggtggacactgggctgagctcgctggtggcggacaggttaccccagagctgctggaaacccacatcgcacagctcaccgacatgcttgagccaggtatcaacgcccagttcaactccatgttcttggatccatacctgtggaagatgcagattggtggcaagcgccttgttcctaaggcccgcgctaatggtgcatccatcgacggcatcgtcatcaccgccggcattcctgaaaaggatgaagctgttgcattggtcaaggaactgatgcgtgatggtttcccttggatcgcattcaagccaggtgccatcaagcaggttaactctgtgttggctatcgctaaggaagttccagaactccccatcatcattcagattgagggtggcgttgcaggtggacaccactcttgggaagacctcgatgagctgctgatcgccacctacggcaaggtccgcgcactggataacgtggtgctgtgtgtcggcggtggcattggctcacctgagcgcgctgctgattacgtcaccggttcctggtccacttcctacggcctgccagctatgcctgttgatggcatcttggtgggtaccgctgcgatggcaaccaaggaagcaaccacctcccaggccgtcaaggaacttcttgtttccacccagggctctgatgaatgggttcctgctggtggcgcaaagaacggaatggcatctggccgttcccagcttggcgcagacatccacgagatcgacaactcctttgctaaggctggacgccttcttgatgaggttgcaggcgatgagacggctgtgcaggcgcgccgggatgagatcattgaagcgattggcaagaccgccaaggtgtacttcggtgacatcggatccatgacttacgagcagtggctcaaccgctacctcgagctgtctggccctgttgatggtcagtggattgatgcttcctgggctgcacgttttgcccagatgctggagcgtgccgaggcgcgtttgatcgagcaggatcatggccaatttgagccaagcctgacggtggaggatggcgtcgacaagcttgttgctgcttacccgcatgccgcaaccgacctgctcaccccggctgatgtcgcctggttcttgggcctgtgccgcacgccgggcaagcctgtgaactttgtgcccgtcattgataaggacgtgcgtcgctggtggcgctcggactccctgtggcagtcccacgatgatcgctacaccgctgatcaggtggctattatccctggtgtcgtcgccgttgctggcatcaccaaggccaacgaacctgtcgctgacctgcttgatcgctttgtcgacgccaccatcgagcgcatcgatgagcacgattcccgctcccgcgacatcatgggcaaagtgctttcctcacctggcacattctgggctggccgcaacatcccatcggtgatccacagccttgggcatgctgacaagtggtcccgctccgaattcgaagcattccatagcccaaccggcgccaacttggtgtacgaagacgccgagcacgcgatgctgactgtgcctttggcgggttccaccgcattcggcaccaccgctgagctgaaaatccgtttcaccagccccatcgacgctctgccaagcgctgtcccactggtcacccaggaagacgctgaagccgcgatgggtgaactgacccgcatcgcagctggcggcaccctggcaactgtgaacaatggcaccgctacctgggaaacctccgtcgatgccggcgtcatcgctgactacaacaacgtcaccgcaggctacctgccagcatccgttgttcctgcacacaccgcacctgacgtgctggttggccgcgcatggccagcagttttcgctgccgtaaagtccgcagtcatcccaggcaccgattccgcatccgttgtggaaggcatgctgtccctggttcacctggagcaccacattgtgctcaagtccgatgtcccaaccgacggcgcgctgaaggtttccgcgactgccgatgaggtagtcgataccgacctgggtcgcctcgtgatcgtgcgcgcagaaatcgccgacgcagaaggcaacctgattgctacgttggctgagcgtttcgcgatccgcggacgcaagggcaacgctgtcgcacgcaccaacacctccgcactgccaaccaccgtggacaccccacgctcagctcgcgcagtggcaaccgttgttgcacctgaatccatgcgcccattcgctgtgatctccggtgaccgcaacccaattcacgtctctgatgttgcggcttccctggctggtctgccaggtgtgatcgtgcacggcatgtggacctctgccatcggtgaactgatcgccggtgcagcattcaacgatgagcagatccaaactcccgcagccaaggtcgtggaatacaccgcaaccatgctggcaccagttcttccaggtgaagaaattgagttcagcgttgagcgctccgcagtggacaaccgcccaggaatgggagaggtccgcaccgttaccgcaaccgtcaacggcaacttagtgcttaccgccaccgctgttgtggcagctccatctactttctacgcattcccaggccagggcattcagtcccagggcatgggtatggaagcacgccgtaactctcaggcagctcgcgctatctgggaccgcgccgatgcacacacccgcaataagctgggcttctccatcgtggaaatcgtggaaaacaacccacgcgaagtaaccgtggcaggggagaagttcttccacccagacggcgttttgtacctcacccagttcacccaggtgggcatggcaactctgggcgttgctcagatcgctgaaatgcgtgaagcacatgccttgaaccagcgtgcatactttgctggacactccgttggtgagtacaacgcgcttgctgcatatgctggtgtgctgtccctggaatccgttctggagatcgtttaccgtcgtggcttgaccatgcaccgcttggtggatcgcgatgaaaacggtctgtccaactacgcgctcgcagctcttcgccccaacaagatgggtctgaccgcagacaacgttttcgattacgttgcgtctgtttccgaagcttccggtgaattcctggagatcgttaactacaacttggctggcctgcagtacgcagttgctggaacccaggctggtcttgccgcccttcgtgccgatgttgagaaccgtgcaccaggtcagcgtgccttcattttgatccctggcattgacgtgccattccactcctccaagctgcgcgacggtgtgggcgcgttccgtgagcaccttgattccctgatcccagctgagctggatctggatgtgctggttggccgctacattccaaacttggtggctcgcccattcgaactcactgaagagttcgtggcatccatggcagaagtggtggagtccacctatgtcaatgagatcttggctgatttcaaggctgcttccgccgataagcagaagcttgcccgcacgttgcttattgagctgcttgcatggcagttcgcatcacctgtgcgctggatcgagactcaggatctgttgatcaagggccttcaagctgagcgtttcgtggaggtcggtgttggctctgctccaacgcttgccaacatgatgggccagaccctgcgccttcctcagtacgcggacgccaccattgaggtgttaaacattgagcgcgatcgcccagttgtgttcgctaccgatgaggttgtgcgtgaagtggcggttgaagagaccccagcagctcctgcagaaaccactgaaaccccagcaaccccagcaaccccagcccctgttgcagctgcagcccctgccaccggcggccctcgcccagatgacatcagcttcactccttctgatgccactgaaatgctcatcgctatctggaccaaggttcgcccagatcagatgggtgccactgattccatcgagaccctggttgagggcgtgtcctctcgccgtaaccagctcctgctggatcttggtgtggagttcggcctcggcgcaattgacggagcagccgatgctgagctcggtgatctaaaggtcaccgtgtccaagatggctaagggctacaaggcgtttggccctgtgctctccgatgctgcagctgatgccctgcgtcgcctcactggtcctaccggtaagcgcccgggatacatcgcagagcgcgtcaccggcacgtgggaattgggccagggctgggctgaccacgtggtcgctgaagttgtgatcggcgcccgcgaaggcgcatccctgcgcggcggcgacctggcgtcactgtctcctgcaagcccagcgtctgcatcagatcttgattcgcttatcgacgcagccgtccaggccgtagcctcccgccgcggcgttgcggtctccctgccttcagcaggcggcgctgccggtggcgtggttgattccgcagctcttggcgagtttgcagagcaggtcaccggacacgatggtgtgcttgctcaggcagcccgcaccatcttgacccagttgggtcttgataagccagcaaccgtttccgtggaagacaccgcagaggaagacctctacgagttggtctccaaggaactcggttctgattggccacgtcaggttgcaccaagcttcgatgaagaaaaggttgttctgcttgatgaccgttgggcttctgcgcgtgaggatctctcccgcgttgctcttggcgaactcgcagcaactgatatcgatgtcacaggcgcaggcgaagctgttgcagcacaggctgaattctttggacttgatgatctcgcagctcaggctcgcgaccaaagctccttggactacgccgacgatgttgcggtcgtaaccggcggatcgccgaactcgatcgcggcggcagtcgtcgaaaagcttcttgctggcggtgcaactgtcattgctacgacctccaacctcggccatgaccgcctggagttctacaaggatctctacgcacgttccgcacgcggcacggcagcactgtggatcgtggcggctaacttgagctcctactcagacatcgacgccatcatcaactgggtcggatccgagcagaccaccaccgtcaacggcgcatccaagctggtcaagccagctttggtccctaccttgctgttcccattcgcggcacctcgcgtgtccggatccatggcagatgcaggcccacaggcagaatcccagatgcgacttctgctctggtctgttgagcgcctcatcgcaggtcttgcgccattgggctcctccatcaacgtgggtcaccgcctgcacgtggtcatcccaggttcaccaaaccgtggacgcttcggtggcgatggtgcatacggtgaatccaaggcagctctcgacgccgtggttacccgttggaacgcagagcaagctgcatggggagcacacacctccctcgtgcacgctcacatcggttgggttcgcggcaccggcctcatgggcggcaacgatcctttggtcaaggcagctgaagaagcaggcgtggaaacctactccacccaagaaattgcagagaaactgctgtcccaggcaacttccactgttcgcgagcaggcagcatccgcgccaatcaccgtcgacttcactggcggacttggtgaatctgatctgaacctggcggaaatggcacgtgcagaagcagctaaggcagctaacgcaccagtggttgaggctccacgcacagtggcagcactgccaactccttaccgaccagtggttcaaaccacccctgatttcgcaggtcaagtcacccaaaaccttgacgagatggtcgtcatcgttggcgccggcgagctcggcccactgggttctgcacgtacgcgtttcgacgccgaactcaacggttccctctccgccgcgggtgtcatcgaacttgcatggacgatgggacttatccactgggatgaagatccaaagccaggctggtacgacgactccgacgacgcagtggccgaagaagacatcttcgaccgctaccacgacgaagtcatggcacgcgttggtgtccgcaagtacaatgacatgcctgagtacggcatgatcgacaactttgcaccagagctgaccaccgtctacctcgaccaggacctcaccttcaacgtgggatcccgcgaagaggcactgacctacgtcgactccgagccagaactcacctttgcttctttcgacgaagcagcaggggagtggaaggtcactcgcaaggcaggctccgcaatccgcgtacctcgccgcatggcgatgacccgcttcgttggtggacaggttcctaaggacttcgacccagctgtgtggggcattccagctgacatggtggacaacctggacaccgtcgcgctgtggaacattgtctgtactgtcgacgccttcctgtccgctggattcaccccagcagagctgcttgcttccgttcacccagcacgcgtgtcctctacccaaggcaccggcatgggcggcatggaatccctccgtggcatctacgtcgaccgcattctggcagagccacgcgccaacgacgttctgcaggaagcactgcccaacgttgttgcagctcacgtcatgcagtcctacgtcggtggctacggacagatgatccacccagtcgcagcttgtgcaaccgcagctgtttctgtggaagaagcactggacaagatccgcatcggcaagtccgacttcgttgtcgcaggtggcttcgatgccctgtccgttgaaggcatcaccggcttcggcgacatggcagcaaccgccgactccgcagagatggaaggcaagggaattgagcaccgcttcttctcccgcgccaacgaccgccgccgcggtggattcatcgaatccgaaggtggcggaaccgtccttctggcacgcggatcactcgcagctgacctgggccttccagtactcggtgtcatcggattcgcagagtcctttgcagatggtgcccacacctccatcccagccccaggcctcggtgcccttggtgctgctcgcgatggtgtggaatctcgccttgcagtagcactgcgttccgtcggtgtctctgctgatgagatctccattatctccaagcacgacacctccaccaacgcgaatgatccaaacgagtccgacctgcacgagcgcatcgcatccgctatcggtcgtgcagacggcaacccgatgtacgtgatttcccagaagtcactcaccggacacgccaagggtggtgcagcagcattccagatgatcggtctcacccaggtcctccgatccggactggtgccagccaaccgcgcactcgactgcgttgacccagtactgtccaagcattcccacctcgtctggctgcgcaagccactagaccttcgtgcgaaggcaccaaaggcaggtcttgttacctcccttggcttcggacacgtctccgctctggttgcgattgttcacccagacgccttctatgaggcagttcgtgtggcacgtggtgctgaggcagctgacgtatggcgcgcatccgcgatcgctcgcgaagaagcaggccttcgtaccatcgtcgccggtatgcacggtggcgtactgtacgaacgcccagtcgagcgcaacctcggtgtccacggagacgcagctaaggaagttgaagctgcagtcctcctggattcccgcgcccgcctagttgacggtgtcctccgcgccgaaggc

SEQ ID NO: 2740 - DNA, 1182 bp, Corynebacterium glutamicum
atggagaatgttagttccgtcacgtcggatggttcggtagcggatgtgcatgccgaacggtggcaagaattgctcgcacgtttggatgccgatgcgccggatattgcggagggcaccgccgcaaagttgctcgctacgatcccgggctatgagctcgttgacgcggggccgatcagggagtcgtcgatacgcaatacggccttgattattcgcgtgattaacgcgggcaccgagccaaaggccgaggacttgcctgaggctttaaggcttgccgacgaacgtatagcgcaaaatgtgccgctgggaagtgtgctgcacggttttcggatgtctctgggggaaattctggagcatttggtgcagttgggcccggaatacaatattgatcccggcagaatgctgcgctggtccacactgatgtgggcggtcaatgatgccttttctacgcgtgccacaagggtgtaccgcgatcacgaggtcgccacggcgatcgccgattcggtgcgaaggtcagaatggatcggcaaagcggtctcggaaggctctgaactgtcagagcttttatggggtgctgcgatgtatgacgttcccgccgacactcctctaagagcattggcagccacctcacctgatcatgcgaaagctgaaacacagatccagaagtggactcagcgcgccggagtgcgggtgctggcatcggtgcagccaagcgtgatcgtggggatcgtgattggggagccgaagcgaaacgtggacggccctggttttgctgtgggtttgggtagggcagaggtgctctcaaagctggcggactcatataaggatgcatcccttgtattgaaggctgccgataatctgaaacttaatgaggtgcagcgggcacaagatttgtcatggaagttggctatccatgcaagcccacgggtgacggagattcttgcgcagaaatatgtgaagccactaagggaatctggcgagtttgctcatgagatcgtggaatctttgcgggcatatgtggacaaccagatgaatattcctgctgctgcgcgcagtattcctgtgcatgtgaatacgcttcgctatcggttgcgccggtttgaggagttaacgggctgctatttggaggatacatccacggtcattgaagtgtcgtgggtgctggaagtctttggccgggagctg

SEQ ID NO: 2741 - DNA, 615 bp, Corynebacterium glutamicum
atggccaatctgaccattttaacctccataaaaaggattctcatgctaaacatcgcacgcaaccgcaacatgaagcgtcgactagcaattgctgctttcgtcgccaccgcaaccgctaccgccaccatggcaccagcatccgcgcaaaccgactacgcaggcctttcctccggcgttgccgacaccgtcgcagaagctgcaggagtcgcaaccaccgccgtcgcaccagccgccaccgtagcgcgcccagcaaacggcaccttcacctcaggattcggaccacgttggggaaccttccacaacggcatcgacatcgcaaactcaatcggcaccccaatctacgccgtcatggccggcactgtcatcagctctggcccagcatccggctatggacagtggatccgcatccagcacgacgacggatccatctccatctacggacacatggaatacctctacgtctccgtcggcgaacgcgtcgcagcaggccaggaaatcgcaggaatgggcagccaaggattctccaccggctcccacctccacttcgagatccacccagacggcgtcaccccagtcgacccacaggcatggctcgcaaaccacggcatctacgtt

SEQ ID NO: 2742 - DNA, 462 bp, Corynebacterium glutamicum
atgagcgagccagggccatccggggttaaagaaaagaagaaagtaaaggcaagtcacattgtctttcttctcatttgttttatcgcagcctgcgcgttggcgtggtggcagtggtcaagattccagtccgggtctggaactttccaaaaccttggctatgccttccagtggcctcttatcggagcattctttgtttatgcctaccgcaagtatttgcagtatgagaatgagtccattgagttagaaaacatggaagccaaaatgatggcggagcaaggcaaaacaccagttgcgcaatcagagcaggaagatagcttcgttcagctctctcaccgtccgagcctggtggaagatgacagcgtcaaggaaatcgacgaatccttcctgccgtctcgcccgacgatggatgtggaagagttcaacaggttgaatgatccgcatgcacggagacgtcgaaaagca

SEQ ID NO: 2743 - DNA, 354 bp, Corynebacterium glutamicum
gtgtctaccaccaccccaatccaccctgagcgcaagaaacgcgttcgtcaggccctcaccatgttctccatcgctgcgtgggtgactggtgtgtttttgctggcgctggtggcggagatgatcatgaagtacataattggcatggatcttcctgagtgggcacgattcgttccgattgcacatggatgggtttacattgttttcttgatgaccaccctgaacctgggtctgaaggcgcgttggaatccgactcgttgggtgaccaccgctatcgcaggtgtggttccgctgctgtcgttttttgttgagcacaaccgccgcaaggaagttactcagacattccagctgaactca

SEQ ID NO: 2744 - DNA, 618 bp, Corynebacterium glutamicum
atgaaacttcttcttgcatccaacaacgcaaagaaactcaaagaactccagcggattttggatcaagcaggcctggattccgttgaattgcttgcgctgcgtgatgtcgaggcatacgacgagccgatcgaagacggccgcacttttgccgacaacgcacagatcaaagcgcgcgccggggtaacccacacaggcatcgccacgatcgccgatgattccggcatcgctgtcgaagaactcaacggaatgcccggcgttttgtccgcacgctggtccggcgcacacggcaacgacaccgccaacaacgagctgcttcttgcccaaatggaacatgttcccgacgagcgccgcaacgcagccttcgtgtccgtatgcgtgcttgcacttccggacggccaagaatttgttcaggaaggccgttgggaaggccaactcctacgcggacctaagggcgaaaacggtttcggatacgatccactgttcattccagcagaggaaatcgatggacaaggacgcagctccgctgaactttccgcagaggaaaaggacgctttgtcccaccgaggtcaagcgctgcgcggattggttgagaagatcgcacaggtagctgcggctagc

SEQ ID NO: 2745 - DNA, 735 bp, Corynebacterium glutamicum
atgacttcttcttccagcttttctcgttttgatggccgcgcacaggatcagatgcgtgccgtcaaaatcacccgtggatttacttccaaccctgcaggcagcgtgcttgtagaattcggcaatactcgtgtcatgtgcaccgcttctgtggaattgggtgtgcctcgtttcaagcgtgattcaggtgaaggctggttgaccgcagagtacgcgatgcttcctgctgcgactgcggagcgtaaccgtcgtgaatccatggccggcaaggtcaagggacgcactcatgaaatttctcgtctgattggtcgttctttgcgtgcagctgtggatctttcccagctgggtgagaacaccattgcgattgactgcgatgttctgcaagctgacggcggtactcgtactgcatcgatcaccggtgcgtatgtggcgctggctgatgccatcaaggttctgcaggagcgcggggttgttccaggcagcccacttcttgcaccagttgctgctgtttccgttggtctggtcgacggtaatgtatgccttgacttgccatatgaagaagattcccgcgccgatgttgacctcaacgttgttatgaccgaacacggtgaattcgtggaaattcagggcaccggcgaagaaactaccttcacccgcgcgcagctcaacgacatgcttgaccacgctgaaaagggctgccgcgaattggttgctgcccaaaaagctgcactgggaatc

SEQ ID NO: 2746 - DNA, 246 bp, Corynebacterium glutamicum
gtggtgttgttcccaacgacattcagctttgatcgaatgactgtgggggctgatgacacggtaactatcactgttcgttctggttatggtggcgagaatcagttggcagtgtatgaggctggcaagacaggttcagcgaatgttctgggctggtccactctgacaattgctggggagattcctgttgtcccagaagaccctgagactccggtagctactggatcgactcttggttcagttctggat

SEQ ID NO: 2747 - DNA, 693 bp, Corynebacterium glutamicum
ttgaggttgggcttttcgaccctggcccaactttgcaacagcaccatccacagtgatggcactaccaatactgagcctgactacgcatctaaggcggcgcacattagtgatgcaactgtggatcagttcgttgagttcggcggtggacaagcaaacattaaccctgatggatcagcgaccgttgattgggagggttctttcagcatcaacttctacgatggtttggtgccgtttaccatcacgaatccgcacctcgaggtttctgtagctggtactggtgttttgactggtgacctcactagctatgcagtggagatgtcgaacccgaatgagaaaaccccgttgactgacttgtatgaggatgtcacgatcacaacgtttgggggagtgaaccttgatcctgaaggtgttgtgacaagcaatcctgattatgacggagtgattgttgatgtcccactggatgccacctctcaggttacttccggtgcaggttggggagcgtggccgcagggcttccttgatttccactttgataccaacttgccttcctactggtattcctcagatggcgcaggtgatcctaagaaggcgcctatgagctttaatgttgatttcactaatggtccaggtctggtgaacagccaattgctccacaggcaagtgatctcaatgccggaaaccaaggcagtctcg

SEQ ID NO: 2748 - DNA, 582 bp, Corynebacterium glutamicum
atgatgactgaacgtggtgtgccagtcgatcacaccaccatctaccgctgggtccagaaatacgcccctgagctggataagcagactcgctggtaccggcaggttcctgactggcaggccagttcctggcgggtggatgagacctatatccgggtcggcggcacgtggtgctatctctaccgggctattaccgcgggtgggcagaccctggagttttatctctcaccaaaacggaatgtggctgcggccaagcgtttcctggccaagacgctgcgatcgaatacgacagccgggtccccgcgggtcatcaacaccgacaaggcaccagctctggccaaggcaatatccgagctgaaggcggagggaatctgccctcagacggtggagcaccggcaggtgaaatacctcaacaacgttatcgagggagatcatggccgacttaaaagaatcctggggccgaagggagcgttcaaaaaccgaatttccgcctaccggacgttgaaagggatggaagcgatgcattcattacggaaaggccagggcacgatgtttgacctcacgggcacccgaacccagacgcgg

SEQ ID NO: 2749 - DNA, 1362 bp, Corynebacterium glutamicum
gtgcgcactgagaaccgtcgtcaatgccataatggtgtggtgaagaaaaacgaccacggtactactggtacctccgagagtttccgcatccgcggttcgatcccggacgttccccgggagacgcggtgggaccggctgtggcggcccttctgggcgataccggctgccagcgtggtcgcggccctggttttcggtttcctgcttcccacgtgggaacgtgggttgtccgacgccgcgctcaaattcgtttttgagggtgggcctgatgccgcccgcgaggtgctgggcaccatcgccgcctccacgatctcagtgaccggtctcatcttctccatcactctcgttgttctgcagctggtgagcagccagttcagcccgcgaatgctcaacggctttctgcgcaaccgcatcgtgcaggccaccctggcgatgttcctggggacgttcgtgttctccctgacggtcatccggtacgtgtggagcgaggacgaggacatcaccggattcgtcccccgtgcttcagtgtcggttgccttcctgctggtgctcgggtgtctgggactgttcctggcgttcatccggctcatcaccttctcgatgcgggtggccaacgccatctccgagatcggggaggagacgatggctctggccgcacgtatctatcccgtgcagagcgacgacgcaggcccagtccaggggccgggctggtcaccgcggcccggtgacccccgggaagaaatccgggtgggcagccatggttcgctggtgtggatcgactaccggaagctggtgtcctggtcgacggaacaccaggcggtgatcacggtcgaccggccggtgggggacttcctcgtcgagggccagccgctgctgcgggtctggtgggacggggaactcagcgaccgggaccgacgcgttctgcactcggccatcgaggtgcggaccgagcgggaacttcaccaggatgtggcgttcggactgcgtcaactggtcgacattgccgatcgtgcgttgtccccgggcatcaatgatccggccacggcggcccagtgtgtccaggagatccaccggatcttccgctatttggtcaccgtcatcgagcccagcccctacatcgccgatgacgacggtcgggtccgtgtggtgcaccagccgcaacgtatcgcggacatgctctatgaggtgatccgtgagatccatctctacggggcggattctgcgatgattccgaggctgctgcgcaccatggtcgaggacctggtgacggccgctgccgatcattccctgcctgccgtcgagcgtgcccgcggcatcctggacgatgagacggacgaggaccgcgacagtgacaccgcgaacgtc

SEQ ID NO: 2750 - DNA, 534 bp, Corynebacterium glutamicum
gtgccggtcgatcacaccaccatctaccgctgggtccagaaatacgcccctgagctggataagcagactcgctggtaccggcaggttcctgactggcaggccagttcctggcgggtggatgagacctatatccgggtcggcggcacgtggtgctatctctaccgggctattaccgcgggtgggcagaccctggagttttatctctcaccaaaacggaatgtggctgcggccaagcgtttcctggccaagacgctgcgatcgaatacgacagccgggtccccgcgggtcatcaacaccgacaaggcaccagctctggccaaggcaatatccgagctgaaggcggagggaatctgccctcagacggtggagcaccggcaggtgaaatacctcaacaacgttatcgagggagatcatggccgactcaaaagaatcctggggccgaagggagcgttcaaaaaccgaatttccgcctaccggacgttgaaagggatggaggcgatgcattcattgcggaaagggtcagggaacgatgtt

SEQ ID NO: 2751 - DNA, 660 bp, Corynebacterium glutamicum
atggattatttagccccggaaggggctatttttgtgtctaaacccgagggtaatttgggaggagcgttaagtactactgacaggttaaacaaaggttttgccaggtgtcgggacccgctcgaagctgaaaatgtctactgggaataccgcaacaatggagtctggatcaggattaacaccgacaacaacttccaggtcactacggcagatggactcacctccttaaccgtgactgatacggcagttgatcagtctggagcaaggttatgtgccgttgctactaatgcttctggccccacgatgtcgagggaagctgttctcacggtgcgttctgcaaccgagatccctgatgatggtctgagcattgatgatgttgtactgcgttggggtattagtgaggaagtacaatcacgaccactatttggtgactccaactacctatccgctggtgtgtctgatggatctgcattgacctacgagtcaactgatagggatgtacgcatcatccacagggtgctgttgcaaagttgggccagggtcgaaaagcccaacctcaagacattagttgtccttgctccggggtgcttaagctgtctcgaatatccggctgacgatcaccgcgtctgggttcgggtgcccgtgaggtcaaacatcgttccc

SEQ ID NO: 2752 - DNA, 765 bp, Corynebacterium glutamicum
atgagactgaccatccttggaagctctggtagcgtgcccgctccaggtaaccccgcatccggatatctgttaacttctccggacgcccctgccgtgattatggacatgggcccaggtgtccttgcagcagttcaagaaattcaagatcctgctgatgcgcatgttattttctcccatttgcacaccgatcactgcgctgattttgcgtccttgatggtgtggcgcaggttccacccaacgctggccgccaagagccgcaatcttttgtttggacctgaagatacccccaacaggcttggtcgtttgagctccgatgagcctgatggcgttgacgatatgtcagatacttttgctttcgacgcctgggaagagcgcaagccagagctcattgataatttcacggtcacgccgttccgcgttgtgcaccccattgagacctacgcgcttcgcgtagaggagcaccgcaccggcgcctcaattacgtattccggtgacagcgcgtacaccgaagcgcttatcgacgccgcccgcaacgttgacattttcttgtgcgaggcaacttggggcacctcttgcgatgacaaagcaccaggaatgcatatgtgtggccaagacgccggaagaattgcggcagcagctggcgtaaagaaactgattatcactcatgttccaccatggattgatgcagaggccacagtggcagcagctgcggaacactttgatggtcctatcgaattggcacgatcaggaatggttatcgagttt

SEQ ID NO: 2753 - DNA, 852 bp, Corynebacterium glutamicum
atgatggcaaccgtgactgatttcagtggatctatgattgaacgccccgtgccaggtgctgatgcgccgattggaatttttgattctggagttggcggattaaccgtagctcgcacaatcatcgatcaattgccacatgaatcagttatttatatcggtgatactgccaatggcccttatggtccgttgcctatcgctaaggtccgtgagcacgccatccgcattgccgatgagttggtggaacgcggatgcaagatgattgtcattgcctgcaacactgcgtccgctgcgtttctccgagatgcccgtgaacgatacagtgtgccagtcgtggaagttattcttcccgcagtaaggcgtgcggtggcatccacccgcaatggcaaagtgggcgtgatcggcacagtgggaaccattaactccggtgcgtaccaggatcttttctctgcaagcccctccattgtggtcaacgcagtggcatgcccacggtttgtggatttcgtggaacgcggaattaccagcggcaggcagatcctcaacattgcgcaggattatttagagcctttgcaagcagaaggggtggacaccctcgtgcttggatgcacccactatccactgctttccggtgtcattcagttggcaatgggggaccacgtaagtttggtctctagcgcggaagaaactgcgaaagacgtgctgagaattttgagccagcaagatcttttagccgatccggacatgcatcctgagccaagttatagctttgaatcaacaggcgatccggaaatctttgcgcaattaagccgccgattccttggaccaattgtttcccaagtgagacaaaacgaggga

SEQ ID NO: 2754 - DNA, 636 bp, Corynebacterium glutamicum
atgtgtcacaatatggcaatggctgattcacccgatcaagaaaccagacgattcgctgcggtgcgagcaacctcggagaccattggctctcctacagctgtggcatccgcgaaacgttcacccaaaggcagtctcattgggttgatcttgatcttggtggccatcatcgtgattgcgtttgtcttgttgttcaacagcctcgttgcaccaaataattcctcgagccctgtggcaagtccaagcacctctgaatctgtggagcaaactatttcggaatcccctgagtcaccgagcgcgacagaggatcagcccccaagcagtgcaacggaaactccccgaaaccgccctgcgcaaccatcacttcctgcgggagcatcaccagccaatgatgctgctgccacccagaccgatgccggcaatttaaacaatgtgtacaccgggtcagcgtccacctcagcaggttttgctcaagccgtccgagatgcttttgtaaaccactatttagacaccaatgaactatccggcagggtgacagccaccagccctgtcactggcggaaactacaccatgaactgcgaagacaacggcgagtacgtcacctgcacaggtggcaacaacgccgttgtctacatttct

SEQ ID NO: 2755 - DNA, 492 bp, Corynebacterium glutamicum
atgacaagtgagaattccgaatcccaggacatttggctaaccgatgagcaacaagatgtgtggctcgatgtgtggacaatgcgaatcggcctgcctgctcgcttggatgctcaactgaaagaagctgcgggtgtcagccactttgagtacttcaccatggcgcagatttctatggccccggaacatcgggtgcgcatgagtgagcttgctgagctgtccgatatgacgctatcgcatctatctagagtggttactcgcctagaaaaggctggctgggtgaagcgtgttcccgatcctgatgatggtcgcgccaccgttgctgtgctcacggactctgggtgggagaaagttaaagcaacagcccctggtcatgtgaaggaagtgcgtcgtttggtgtttgacgatctcactccagaagaactcaaggtaatgggcaccgcaatgaagaagattgtgaaccgactcgatatgtccaacaggctgccccgggtg

SEQ ID NO: 2756 - DNA, 747 bp, Corynebacterium glutamicum
atgagttacaacagcccgtataacaacacgaatttcagcaccactggcgcgttccaacctgctggtgggccggtgaagccgtggaataagcccgatgccagcctgaatcagcagctgaaaaacaaatcccgtgtgcgcacaggtcttaccatcgccatcggttatgtagtggtgatttgggcggtgcatttggcatccatcgtcattgcgctgctcactggcttcaacctgaccaactttggtattcatccgctggataccagtgcactgtggggtattttcacctcaccgctgttgcatggaagcttcagccacctcattggaaataccgttccaggctttatattcagtttcctcatcggtatgagtggcaagcgcgtgttctgggaagtcacgattatcgcaggtctcatcggcggtcttggtacatggattttcggtggaatcggcaccaaccacatcggtgcgtccggcctgatttatggctggcttggctacctgatcgtgcgtggaattttcaacaaggatattaaacagttcctgcttggcatagttttggcgttcatttactccggtttgttctggggtctgctacctactcaaatcggtgtgtcctggcagggccaccttttcggtgcacttggtggaatcggtgcgggtgcttttatcgcctcggatgacccggcagcgttgaaagcgaagaagcaacagaagaaattagaaaagcaacaacgccaaagaggctta

SEQ ID NO: 2757 - DNA, 891 bp, Corynebacterium glutamicum
atggcgaaaaatgtgtcaccgtccatcggtgaatgcgacggccgcactgccctcgccaaaccatcatgggccaccagcgccaagcgcttcgcttgggcttttgtcaccggcgcgtcagttgccacgacgccgatggtcgtgttcagcgtctctgccgcgctttttagcttatcgacgcccacccccatcacttcgggcctaccaaacaaagctccagttgttaggtccacgacttccccaacaggattcgccacgacccctgccgcgatggtgtactttccgacccggcgcgagctttggccaaaaccgccacgcagccgacctgctgtagcacccgttcctgcaccgacgctgcccgaaccgttgtgtgtaccagcgaaagcgttttcaactgcttgttccccatcagctgccgtgggcctgtttttgggatcgcccaccaacaaatcaaaaatcacagcgcctggaacgattggcacgataggcccttcgggacggacagggaaaccaataccgcggttttctagggctgtcatcactccatcggcagcagccaacccgaacgccgaaccgccacacaacaccacggcatgtgcttgctgcacagaattgtgtggttctagaaggtcggtttccctggtgcctgggcctcccccacggacatcgacgcccgcaaatgcaccgttaggtgcaatgaccactgagcaacccgtatcccccttcgtgacgtggcctaaaaggaagcccgcgacgtcgataagcattaattcatcatcgcttccagcaaggactcttgattgtaggcaagccactgcacgaggttttcgcggtcttcctcggcggcttccccgccgcgtacatcaccggaggcaacgtacaggcggatgtcat

SEQ ID NO: 2758 - DNA, 960 bp, Corynebacterium glutamicum
gtggcttgcctacaatcaagagtccttgctggaagcgatgatgaattaatgcttatcgacgtcgcgggcttccttttaggccacgtcacgaagggggatacgggttgctcagtggtcattgcacctaacggtgcatttgcgggcgtcgatgtccgtgggggaggcccaggcaccagggaaaccgaccttctagaaccacacaattctgtgcagcaagcacatgccgtggtgttgtgtggcggttcggcgttcgggttggctgctgccgatggagtgatgacagccctagaaaaccgcggtattggtttccctgtccgtcccgaagggcctatcgtgccaatcgttccaggcgctgtgatttttgatttgttggtgggcgatcccaaaaacaggcccacggcagctgatggggaacaagcagttgaaaacgctttcgctggtacacacaacggttcgggcagcgtcggtgcaggaacgggtgctacagcaggtcggctgcgtggcggttttggccaaagctcgcgccgggtcggaaagtacaccatcgcggcaggggtcgtggcgaatcctgttggggaagtcgtggacctaacaactggagctttgtttggtaggcccgaagtgatgggggtgggcgtcgataagctaaaaagcgcggcagagacgctgaacacgaccatcggcgtcgtggcaactgacgcgccggtgacaaaagcccaagcgaagcgcttggcgctggtggcccatgatggtttggcgagggcagtgcggccgtcgcattcaccgatggacggtgacacatttttcgccatgtcatcgggtgatggtagtggcgttaccccggttgagctggcggaattgtcggctcatgctgcagattgcgtacaggacgctatcatcgacgccatacttaccgcgagtccgggactcgggctcaaaagcttcagggaacttttacca

SEQ ID NO: 2759 - DNA, 537 bp, Corynebacterium glutamicum
atgcagcagtggaagaagaaaaaagggctgatgcgccaggctcgttacgcggtggtttttgagccgatggagcgggaagtgttgggtgatttgtcagctgcggtcagtgaggcgttgattcagcgtgcacagtctgtgccgaaggatcctctggcagagatgaccggcatgacaagtggacacaaagaagcaccaaccgatccggcgcttgcgcgtttgctccctgattttcagcacgagggcgatgaggaatacgacggcgataattctttcctccgttcactccatgaaggcgacatcacccgagcaaaactggaaaatctgcgcgtgattaacgatgcgctgggacccgacggaaatgttgcggtcaccgcctctgaggaggaagcgcacgcttggttggctgcgctcaatgacatccgcctgtacgttgcctccggtgatgtacgcggcggggaagccgccgaggaagaccgcgaaaacctcgtgcagtggcttgcctacaatcaagagtccttgctggaagcgatgatgaat

SEQ ID NO: 2760 - DNA, 300 bp, Corynebacterium glutamicum
atgtcgtcaccttctgcaccgcttgccacgccagatgttgagcttgatgtgcacacgttgtcgagcgaaaacctgccttggttgtgcatcgtgtgggatgatccggtcaatttgatgagctatgtcacctacgtttttcagactgtgttgggcttcagtaagaagagggccactgagctgatgatgcaggtgcacaccgaaggtaaagccgtggtgagttctggcgagaaggacaaagtggagggtgatgtgaagaaactccacaccgcagggctgtgggcgacaatgcagcaggcaggg

SEQ ID NO: 2761 - DNA, 624 bp, Corynebacterium glutamicum
ttgtaccgagcatttgattttgttcccctatcaatgctggttttggtgacaaaaactcggcggaaggaccaccgaatggaaacccttgcagcacaagcgcgcaccctgctagaaaaatggggcgtcgcgccgacgcacgcatctttcgtcgaatccattgcaaaggccatcccgattctgtcgatcctgctgacgctgattgtcaccgtgaatggaatttcaagcggaaatccggtccagccaccagcactggaacaggtacggaccgatgtagtgaacaagatcaactacgaacgcaacctaaagggcctcgtctcgatcagcccggagcttgaattacacacggcagcccaaacaattgcgcagcgaaatgcagactcagattccgaagaaaaagtaccggatccagagggcaacctggtggttctgcaacagaatctgccctatgcaaatgccaacgccgataccatcgttgatcggttcttaaactctcctgatcatgtcaaactactgcttgcaaacgattatgaagccatcggagttggtgtggcctacaagggtgatcatgcgtggatagtggtggagttcactgtagctcccgctgattccgtagaatcaacagag

SEQ ID NO: 2762 - DNA, 1338 bp, Corynebacterium glutamicum
gtgaataccaatccgtctgaattctcctcaaaccgttcaacagctctccttactgataaatatgagctgaccatgcttcaagcagcgctcgctgatggttctgcagaacgcccctcaacgtttgaggtctttagccgccgcctccccaacgagcgccgatacggtgtcgtcgcaggaacagcacgagtgctgaaggcgattcgtgactttgtattcacagaggaacaactcgccgatcttgactttttagacgaccgtaccctggaatacctccgcaactaccgattcaccggccaagttgatggctaccgcgaaggcgaaatctacttcccgcagtcccctcttctgactgtgcgtggcacgtttgcagaatgcgtcatcctagaaactgtcattttgtccatcatgaatgcagattctgccgtcgcttccgccgctgcgcgcatggtcaccgcagctgatggtcgccccatcatcgaaatgggatccaggcgcacccacgaatactcggcagtcaccgcatcccgcgcagcatacctcgctggattctccaccacctccaacctcgaggcggcctaccgctacggaattccagcatccggaacctccgcccacgcatggactttgctgcacatcaacgatgacggcacccccaacgaagcagcagctttcaaagcacaggttgaatccctcggcgtggacaccaccttgctggtagatacttatgacatcacccaaggtgtggccaccgccattgaagttgcaggtccagaccttggtggcgtacgtatcgactccggcgacctaggtgtgcttgcccgaaaggtccgcaagcagctcgacgatctcaacgcccacaacaccaagattgtggtctcctccgacctggatgaattcgccatcgcgggtcttcgcggcgaaccagttgacgtctttggcgttggcacctccgttgtcacaggttctggcgcaccaaccgctggcctcgtgtacaagatcgtggaagttgccggtcaccctgtggccaagcgttcccgaaacaaggaaagctacggtggtggcaagaaggctgtgcgcacccaccgcaagtccggtaccgcaatcgaagaaatcgtctacccattcaatgccgaagcaccagatactggaaagctcgacactttgagcctgaccatcccattgatgcgcgacggtgaaatcgttccaggtttgcctactttggaagattcccgagcgtatttggccaagcaattggtctctttaccatgggaaggccttgcactgtctcgcgatgagcctgttttgcacactcgtttcgtgggtttcccgccggccgct

SEQ ID NO: 2763 - DNA, 306 bp, Corynebacterium glutamicum
gtggggcttcgtatcaacttgttcgggaggccaccgcaaaaaactcagatcacctggaagttgcccgcccagaatcgtccccaagcgcctttatcaaagcaatcgaaccagaccgtaaatcggtgtttcgcctggcttagtctttcgactccgatctggttagacttggcacaatgtctgcgcctgaatcacccacaaataccaccccagatccgctcaatgcttccacggaagagttgcttactgctgccgttgaagcgttgggcggtgcccgtcgtgctggacaggaagcaatggctaaggctg

SEQ ID NO: 2764 - DNA, 1740 bp, Corynebacterium glutamicum
gtgtctactgcgacgatcgcgttgcagcgccagttggtcaatagggatctcccccgcttggtggatgcgttggaacccttgatggaacgtcgcccgacttttgcgattatgaagggccgttccaattatttgtgcatgaataaggttgcccgccaggaagagctgaatcaggaagatgccctgattgagcaggaggatatctcgtggttaggtaagcacattgtgcgccttaatgagtgggccaatgagactgagactggcgatcgtgatgatttggatccgggtgttcctgatcttgcgtggaagcaggtaagtgttactgcccgtgagtgcattggcgcgtcaaggtgcccgcatggcgaggattgtttcgctgagattgcccgcgggaaggcaaaggaggctgatgtggtggtcaccaaccatgcgttacttgctattgatgcgttgtcggatgtttctgtgcttcctgaacatgatgtggtggtcatcgatgaggcccatgagctagatggtcgcatcactgctgtggcgtcggctgagatcacggtgaattcgctcaatttagctgctcgccgtgcgtccaagttggattccgataagcgggaagaacgcgtccaggaaatcgctggcgatttggaaaccttgttgcaaaccatgcagccgggccggtggaatgacatggatgagggttccaaaggcacactggtggcattgaaggacgcgttgtgggcattgcgtgctcagatcgcgggagcacctgagggtgaggctgcgaatgatccggagcgtttcgccgagcgacagaatttaagcaatcacttgatggaaatccatgatgccaacgtgcgcattttggaggtcttcgcggaggaggatccctccaagcagtacgacgtggtgtggcataaccacgatgatcgtcgcggggattccctcaatgtggcgccgctgtcggttgcagggctgttgcatgagaaactgttcgcggaaaacaccgtggttttggccagtgcgacgctgaccattggtggcaatttcaacgcaatggctgccagctggggtttgccgaaagggtcgtgggattccatggatgccggcacgccgtttgatccagcgaagtcgggtattttgtacaccgctcgacaccttccggaccctggccgcgatgggttgccggaggaaacgcttgatgaaatctacgagttgatcactgcggcgggtggccgaactttggggctcttttcgtcgaaacgcgctgcggaacaagccaccaaggcgatgcgtctgcgcctgccttttgatgtgctctgccagggagatgacaatactgccgcgctggtgaagaagttttccgacagcgaaaacacgtgcctttttggcactctcacgctgtggcagggcgtcgacgtccccggccgttcgctgtcgttggtgttgattgaccgcatcccgttcccccgccccgacgacccgctgctgcaggcccgcaaggaggccgccgatgccgaaggccgcaacggtttcatggaggtcgcagccacccacgcggcgttgttgatggcgcagggcgcgggccggttgttgcggcacgtcggcgaccgcggcgtggtagcagtgctagaccaccgcttatcgacgaaacgttacggcggtttcctgcgcttctccatgcccagattttgggaaaccaccaacccagagaccgtacgcgcggcactcaaacgattggtgactaag

SEQ ID NO: 2765 - DNA, 891 bp, Corynebacterium glutamicum
atgacaagcccttatggatcccaatacccaggcgacgacaacaataattggaactcccagttcggcaacccttccggcgagcagaactacggtcagccctacggtgcgccatatggacagccttacgggcagccatttgatcaaggattcaacgcctacagttctcccatcccacctgaggtcccacagccttccatgcaggaggctcagtggcgctcctttgaccttggaactgtttttggtcaggcatggaagggctttaccgcaacgtggcaggcatgggtgctgtctgcactgatctacttcgcggtgttgcttgtgctgatgtttgcgtggatcctcccgatggttagtgtgctcgcagcgacctcatctggttctgattccgcagctattgcagcgacgggtggcaccagcttcttcgggttcatgctgatgatcgtcctggcattcatcagttttgtgtactcccttaactgctaccgcaacgcggctcgagttgtgcgcggtgagcagatcaccattcagagtttcttcaagatgaagggtcttggtaaggcgctcggtatttacatcttgatcaatatcgtcatcttcatcggaatgatcttgctgctcattcctggaattatcgctgccgtggtgctgatctttgctgttcctgtggcattccagctgcgcgacgcctcgatcggtgatgcgttttccgcaagctggaaggcagtgtccaaaaacgttggtcaggtcattctcttagaactggctatcttcgcgttgagcttcttgggcagcgcagtgatcatcggtatgttggtgaccactccgcttacattcctgctgtatgcctacgcattccagaccgccagcggtggtcccatcatgcagcgtcag

SEQ ID NO: 2766 - DNA, 723 bp, Corynebacterium glutamicum
atgcctaaagattcgcttctcgacgcccacctcctcctcaaggcccgggctagcgacgggccacatagcgaggatccttcggatccttcgaccgttcaggcaatgcagatcgcgttgcacattccgaaacagaatccgccccggcggacagatgtgttggaagcggcggcgaggagtgtggtcaagctttgcctcgacgaacgagtatccaccgatcctgattttcgggcggccttggaacgttggtacggacacttgattcggaaggtgtcacgtcgcgctcgtaatgcggcgtgggatcgggtgcaagatttacccggcgtgactgtggaagatgatgctgcaaaggttcgggcatttttgcccagcgcagtggtggatgtgcctgcagatatcaaaaagctgcagatttccggtacggaattgcctctcgatgagccgaatccgatcaacgatgaataccccgttatctacattgatgaatcgttgaagatgacgctgggaaaggccgctgcgcaggtaggacacgcatccatgttgcttgccgcgcaccaaccgtttgagtgggtggagcagtgggaagcagcggattttgcgctgcacgtcagggagattccctcggaggagttcctgcgccttatcgagtctcctggtgctgttccagttcgcgatggcggctttactgaggttgcccccaacaccgtgacggttgttgcaattcca

SEQ ID NO: 2767 - DNA, 1017 bp, Corynebacterium glutamicum
gtgcatggacagtccgtggtggtggagctgcaggaaactgtgcagtcgtcccgtcctcgttcttcccatgttgttgtggtgttgggtgatccggttgatgcgttggatatttcccgcattggtcagaccctggcggattacgatgccaacattgacaccattcgtggtatttcggattaccctgtgaccggcctggagctgaaggtgactgtgccggatgtcagccctggtggtggtgaagcgatgcgtaaggcgcttgctgctcttacctctgagctgaatgtggatattgcgattgagcgttctggtttgctgcgtcgttctaagcgtctggtgtgcttcgattgtgattccacgttgatcactggtgaggtcattgagatgctggcggctcacgcgggcaaggaagctgaagttgcggcagttactgagcgtgcgatgcgcggtgagctcgatttcgaggagtctctgcgtgagcgtgtgaaggcgttggctggtttggatgcgtcggtgatcgatgaggtcgctgccgctattgagctgacccctggtgcgcgcaccacgatccgtacgctgaaccgcatgggttaccagaccgctgttgtttccggtggtttcatccaggtgttggaaggtttggctgaggagttggagttggattatgtccgcgccaacactttggaaatcgttgatggcaagctgaccggcaacgtcaccggaaagatcgttgaccgcgctgcgaaggctgagttcctccgtgagttcgctgcggattctggcctgaagatgtaccagactgtcgctgtcggtgatggcgctaatgacatcgatatgctctccgctgcgggtctgggtgttgctttcaacgcgaagcctgcgctgaaggagattgcggatacttccgtgaaccacccattcctcgacgaggttttgcacatcatgggcatttcccgcgacgagatcgatctggcggatcaggaagacggcactttccaccgcgttccattgaccaatgcc

SEQ ID NO: 2768 - DNA, 1596 bp, Corynebacterium glutamicum
atgtccagtgtgtgcctctgcgcgcatgcgttcaatcatgtgcgggtagtgcagctcgaacgcagggcgctcggagcggatacgaggcaaggatgcgaagttgtggcgaggaggagggcaggaggttgcccactccagggagttgccgtaaccccaaggatcatcaacggtaacgagctcaccgtagcgccaggacttgaagacgttccagatgaatggaatgacagacaggccaagcaggaaggagaacacggtggagatctggttgtagatggtgaaaccatcagaatccaggtagtcagcgtaacgacgtggcatacccatgttgcccacccagtgctggatgaggaaggttccgtggaaaccgacgaaggtcaaccagaagtggatcttgccaagacgctcgtccatcatgcggccagtcatcttcgggaaccagaagtaaacgcctgcacacgatgcgaacaccacggtaccgaagagggtgtagtggaagtgcgcgatcaggaagtaggagtcagccaagtggaagtccagtggtggggacgccagcataatgccggtcagaccaccgaagaggaaggtagccatgaagccaacagaccagatcattggggtttcccaagtgatgtgacccttccacatggttccaacccagttgaagaacttaacgccggtaggaaccgaaatcaggaacgtcatgaaggagaagaacggaagcaaaactgcgccagtaacgaacatgtggtgagcccacacagccatggacagtgcaccaatggacaaggttgcgaagatcaggccgacgtaaccgaacattggcttacgggagaacacaggaatgatctcagaaacaatgccgaagaacggcagcgccagaacgtaaacctcagggtgtccgaagaaccagaacaggtgctgccacaggagggagccgccgttagctggatcgtacaggtgtccaccaagcttgcggtcatacagaacacccagtgcagcagcgagcagcagtgggaagatcagcagagcaagaacggaaacaacgaagatattccaggtgaaaataggcatacggaacatggtcataccaggtgcgcggaggcagaggatggtggtgagcatgttaattgcggaagcaacggagccaataccagttgcaccgacaccgacaatccacatgtcagagccaaggcctggggagtgaattgcgtcagacagtggggagtacatggtccaaccgaagtcggcagcaccacccggggtcaggaagccggtcagcatcgcgacaccaccgacggtggtgatccagaagccgaaagcattcaaacgtgggaaagctacgtcaggcgcaccgatctgaagtggcaggacgtagttagcaaaaccccaaacaattggagttccgtacagcagcagcatgacagttccgtgcatggtgaacagctggttgaactgctcattagacaggaactgcagaccaggggtgaaaagctccgctcggataagcagggccatcaagccaccgaggaagaagaagctgaaggacataatgatgtacataatgcccagctgcttgtggtcggtggtggtcatcat

SEQ ID NO: 2769 - DNA, 1743 bp, Corynebacterium glutamicum
gtggcgcctagggtcgacgggcacgtcgcccctcagaggcccgagccgacaggccatgcacgcaagggcagcaaagcatggttaatgatgaccaccaccgaccacaagcagctgggcattatgtacatcattatgtccttcagcttcttcttcctcggtggcttgatggccctgcttatccgagcggagcttttcacccctggtctgcagttcctgtctaatgagcagttcaaccagctgttcaccatgcacggaactgtcatgctgctgctgtacggaactccaattgtttggggttttgctaactacgtcctgccacttcagatcggtgcgcctgacgtagctttcccacgtttgaatgctttcggcttctggatcaccaccgtcggtggtgtcgcgatgctgaccggcttcctgaccccgggtggtgctgccgacttcggttggaccatgtactccccactgtctgacgcaattcactccccaggccttggctctgacatgtggattgtcggtgtcggtgcaactggtattggctccgttgcttccgcaattaacatgctcaccaccatcctctgcctccgcgcacctggtatgaccatgttccgtatgcctattttcacctggaatatcttcgttgtttccgttcttgctctgctgatcttcccactgctgctcgctgctgcactgggtgttctgtatgaccgcaagcttggtggacacctgtacgatccagctaacggcggctccctcctgtggcagcacctgttctggttcttcggacaccctgaggtttacgttctggcgctgccgttcttcggcattgtttctgagatcattcctgtgttctcccgtaagccaatgttcggttacgtcggcctgatcttcgcaaccttgtccattggtgcactgtccatggctgtgtgggctcaccacatgttcgttactggcgcagttttgcttccgttcttctccttcatgacgttcctgatttcggttcctaccggcgttaagttcttcaactgggttggaaccatgtggaagggtcacatcacttgggaaaccccaatgatctggtctgttggcttcatggctaccttcctcttcggtggtctgaccggcattatgctggcgtccccaccactggacttccacttggctgactcctacttcctgatcgcgcacttccactacaccctcttcggtaccgtggtgttcgcatcgtgtgcaggcgtttacttctggttcccgaagatgactggccgcatgatggacgagcgtcttggcaagatccacttctggttgaccttcgtcggtttccacggaaccttcctcatccagcactgggtgggcaacatgggtatgccacgtcgttacgctgactacctggattctgatggtttcaccatctacaaccagatctccaccgtgttctccttcctgcttggcctgtctgtcattccattcatctggaacgtcttcaagtcctggcgctacggtgagctcgttaccgttgatgatccttggggttacggcaactccctggagtgggcaacctcctgccctcctcctcgccacaacttcgcatccttgcctcgtatccgctccgagcgccctgcgttcgagctgcactacccgcacatgattgaacgcatgcgcgcagaggcacacactggacatcacgatgatattaatgctccagaattgggtaccgccccagcccttgcatctgactccagccgc

SEQ ID NO: 2770 - DNA, 306 bp, Corynebacterium glutamicum
atgcccaaaaaaaatgtttttcaaacaattcatgaggtcgctgccaggttcagtcacttgtgggcagtgacttttaaccaaaggtgtgaaggggttcacaatttgacggacatttcgccaggaagccctacccccacggttaacccctgccacagatttcacaattccccccgccggggttcaatcgaatggttgagacgcccattccaggggcgttttcttctaaagcgtgatgtgccgccgaggggtccacggggcgcctggcgctcccctaccccgatatgcgcttcggaaaaacccgcacct

SEQ ID NO: 2771 - DNA, 1002 bp, Corynebacterium glutamicum
atggctgctgattctgatctcagtgttcacgatgcttacttaaaggagcatgttgcacctgtaaaggcgatcaactggaactccatcccagattccaaagatcttgaagtctgggatcgtctgaccggtaacttctggctcccagaaaaggtcccagtatccaacgacatcaagagctggggaaccctcaacgaggttgaaaaagccgcaaccatgcgcgtgttcaccggacttaccctgctggacaccattcagggcactgtcggcgcaatctccctgcttccagacgcagattcactgcacgaagaagcggtgctaaccaacattgcgttcatggaatccgtgcacgcaaagagttactccaacatcttcatgactctggcctccaccgcggaaatcaacgatgcgttccgttggtctgaggaaaatgaaaacctgcagcgcaaggcaaagatcatcctgtcttactatgagggcgatgatccactaaagcgcaagatcgcctccgtgatcctggagtccttcctgttctactccggcttctacctcccaatgtattggtccagccactccaagctgaccaacaccgccgacgtgatccgcctgatcatccgcgatgaggcagtgcacggctactacattggctacaagtatcaaaaggctgtcgcgaaggagactccagagcgtcaggaagagctgaaggagtacaccttcgatctgctctacgatctttacgataacgaaactcagtactccgaagatctctacgacgatcttggatggaccgaggatgttaagcgattccttcgctacaacgccaacaaggccctcaacaaccttggctacgaaggactcttcccagcggatgaaaccaaggtgtccccaaacatcttgtctgcgctgtcaccaaacgctgatgagaaccacgacttcttctccggctccggttcctcttacgttattggtaaggcagaaaacaccgaggatgatgactgggacttc

SEQ ID NO: 2772 - DNA, 486 bp, Corynebacterium glutamicum
atgacaatcaacgagaagatcgcatcagctttcaacaaccaagtgactgcagagcttgaagcttcaatggtgtaccttcagctctcctacgttctagacgatctgggcctcaccggcatgcgcgactggatgaaggcacagagcaaagaagagctcgaacacgcacagaagttcgctcagcaccttcttgaccgtgactacaccccacagatcggtgacattgcaccaccaaagcttgatgtcacctccgctatcgaggctttcgaggcttccctggcacacgagcagaagatctccggcctgatccgcgagctcgctgccatccaggacgctgagaaggactacgattcccgcgcactgatcgactggttcctcaacgagcagatcgaagaagaagcaaccgtcggcgagatcatcgaccgcctccgtatcgctggtgattccggttccggaatcctgcgcatcgacggcgaactcggctcccgc

SEQ ID NO: 2773 - DNA, 750 bp, Corynebacterium glutamicum
atgaccccagcaaacgaaagtcctatgactaatccattaggttctgcccccaccccagccaagccacttcttgacagtgttcttgatgagctcggtcaagatatcatcagtggcaaggttgctgtcggagataccttcaagctgatggacatcggcgagcgttttggcatttcccgcacagtggcacgcgaagcgatgcgcgctttggagcagctcggtcttgtcgcttcttcacgtcgcattggcattactgttttgccacaggaagagtgggctgtttttgataagtccatcattcgctggcgtctcaatgacgaaggtcagcgtgaaggccagcttcagtctcttaccgagcttcgtattgctattgaaccgattgccgcgcgcagcgttgctcttcacgcgtcaaccgccgagctcgagaaaatccgcgcgctcgcaacagagatgcgtcagttgggtgaatctggtcagggtgcgtcccagcgcttcctcgaagcggacgtcactttccacgagctcatcttgcgttattgccacaatgagatgttcgctgcactgattccgtcgattagcgcggttcttgtcggccgcaccgagctcggcctgcagcctgatctgccggcgcacgaggcgctagacaaccacgataagcttgccgacgccctccttaaccgcgacgccgacgccgcagaaactgcgtcccgaaacatcctcaatgaggtgcgcagcgcgctgggcacgctgaac

SEQ ID NO: 2774 - DNA, 660 bp, Corynebacterium glutamicum
ttgacgcagtggggtaattcgaatgttgtggaggactatctcacagcacttttccgtgcagaagaatgggatgaggaaccaacaacaggaaaactcgctgaagtaattggagttaccgcatcaacggtgtcggcgacgctcaaaaaactcaaccctgagggcttcgtcaattaccgtccctacggggacatcgagctgacgcccgcaggtcgagacatcgccatcaacgtgatcaggcggcgccggatcattgagacctatctgtctgagaagcttggattaggcgctcatgaactacacggcgaggcagatttattagagcacgcagtgtctccactggtgttggagaagatgtttcaggcagtgggctatccaacgttggatcctcacggggatcccatccccaccgaatctggggagatgaccatcaatgatggactcatgcttttgggactaaaagctggcgcatctgccacggttacacgtgttagggacggaaacccatcagtggttcggtacctcactggagtgggaattaccgtgggcacaacggtcacggtcgttgaagctcttagcgatattgccacactgcgcctgcagatcggggaaatgtttcaagacattccccttgcagtggcaaacgcagtgcgcgtatcacgt

SEQ ID NO: 2775 - DNA, 438 bp, Corynebacterium glutamicum
gtgtgctcgacaaccgtttcagaagcatattcaggaagcactgcaactaacgcaagcaaggccactgccaacgcaccagaaatatctttgcgcacagcttcagctgcccacgccaacacaaaagaggcagcaaccactgcggtaccaaaaatcagcatggtcgccacaggtgacgccgacagctcagaaaacctgagcacaacagcagggattgctgcgacagcacacattgccagcggaattcgcggaaacataggtggatcactctccttcgaggaactgctcgaaggtctcgctcacctagttttaggcacgtgggccgggtacacagatcttgcgtgccagtatgtcgacaaccgcgtttgtcgagctactccccttcagcaacagacatcgtgtcagctggcaatcgtgtgtgtctacggacaagaagatgtt

SEQ ID NO: 2776 - DNA, 276 bp, Corynebacterium glutamicum
atgtttccgcgaattccgctggcaatgtgtgctgtcgcagcaatccctgctgttgtgctcaggttttctgagctgtcggcgtcacctgtggcgaccatgctgatttttggtaccgcagtggttgctgcctcttttgtgttggcgtgggcagctgaagctgtgcgcaaagatatttctggtgcgttggcagtggccttgcttgcgttagttgcagtgcttcctgaatatgcttctgaaacggttgtcgagcacacttatcaaacatcggcggcgaat

SEQ ID NO: 2777 - DNA, 2121 bp, Corynebacterium glutamicum
gtgccacgcggagaccagatggacttccacgctcttaacgcgttgctcaacctttacgatgacaacggcaagatccagtttgagaaagaccgtgaagctgcaaaccagtacttcctgcagcacgtcaaccagaacaccgtcttcttccacaacctgcaggaaaagatcgactacctggttgaaaacaagtactatgacccaatcgttctggacaagtacgacttccagttcatcaaggacctcttcaagcgcgcatacggattcaagttccgcttccagtccttcctcggtgcatacaagtactacacttcctacaccctgaagaccttcgacggtcgccgctacctcgagcgtttcgaagaccgtgtctgcatggtcgccctcaccctcgctgacggcgaccgcgcattggccgagaacctggtcgatgagatcatgtctggccgtttccaaccagcaaccccaaccttcctgaactccggcaaggcacagcgcggcgagccagtatcctgcttcctcctgcgtatcgaagacaacatggagtccatcggacgttccatcaactctgctcttcagctgtccaagcgtggcggtggcgtagcgttgctgctgtccaaccttcgtgaagccggtgcaccgattaagaagattgaaaaccagtcttccggtgttatcccagtgatgaaacttctggaagatgctttctcctacgctaaccagctgggtgctcgtcagggtgcaggtgctgtgtacctcaacgctcaccacccagatatcctgtccttcctggataccaagcgtgagaacgccgatgagaagatccgcatcaagaccctgtccctgggtgttgtgattccggacatcaccttcgagctggctaagcgcaacgatgacatgtacctgttctccccatacgatgtggagcgcatttacggcaagcctttcgcagacgtctcaatcaccgagcactacgacgagatggtggatgatgaccgcatccgcaagaccaagatcaacgcgcgtcagttcttccagaccctggcagaaatccagttcgagtccggttacccatacatcatgtatgaagacaccgtgaatgcatccaacccaatcgaaggtcgcatcacccactcaaacctgtgctctgagatccttcaggtgtccaccccatctgaattcaacgatgacctgacttacgcagaggtcggcgaagacatttcttgtaacttgggttccctcaacgttgcaatggctatggattcaccaaactttgagaagaccatcgaaaccgcaatccgcggcttaactgcagtgtctgagcagaccagcatcgattccgtgccttccatccgtaagggcaacgaagcagctcacgccatcggccttggccagatgaaccttcacggctacttcggtcgcgagcacatgcactacggctccgaggaagccctggacttcaccaacgcatactttgctgccgtgctgtaccagtgcctgcgtgcatccaacaagatcgctactgagcgtggagagcgtttcaagaacttcgaaaactccaagtatgcaaccggtgagtacttcgatgatttcgatgcaaacgacttcgcaccaaagtccgacaaggtcaaggaactctttgccaagtcgaacatccacaccccaaccgttgaggactgggctgcgctgaaggccgacgtgatggagcacggtctgttcaaccgtaacctgcaagcggttccaccaaccggttcgatctcctacatcaacaactccacctcgtcgatccacccaatcgcatccaagattgagatccgcaaggaaggcaagatcggccgcgtttactacccagctccacacatggacaatgacaaccttgagtacttcgaggacgcctacgaaatcggctacgagaagatcattgacacctacgctgtggcaaccaagtacgttgaccagggcctgtcactgaccttgttcttcaaggacactgccaccacccgtgacatcaaccgtgcgcagatctacgcatggcgcaagggcatcaagaccttgtactacattcgcctgcgccaggttgctctggaaggcactgaagttgacggctgcgtcagctgcatgctg

SEQ ID NO: 2778 - DNA, 315 bp, Corynebacterium glutamicum
gtgggagccatctgcaacgacaactggtgcctgcaggtagccaagtgcgaggacgtactcacgtgcctcttcatcaaggctgatatcaacgaggtcatactcaagaccagcgcggtcgagggccttcttggtggcattgcactggacgcaagctggcttggtgtaaacggtgattgccattttttggaccttcccttatcggctttagcggttgacgctaatgcctcatctcacttttttagatctgtttttaaagtctttgcatcgctcaaggcgacacaacaaacactatactttgtggtgaataagcgcaac

SEQ ID NO: 2779 - DNA, 141 bp, Corynebacterium glutamicum
atgagagaaaggagcgcccgaatgaaggtacgcaattcccttcggtcgctgaagaacaagccgggcgcccaggtcgtgcgtcgccgtggcaaagtctacgtgatcaacaagaaagagccacgtttcaaggctcgccagggt

SEQ ID NO: 2780 - DNA, 831 bp, Corynebacterium glutamicum
atgacaaacactcaaaccgagatcattaatgaactaaaggtgagcccagcaatcgacgtggccaaggaagttgaattccgtgtgcagttcctcgtcgattacctgcgggcttcccatacaaaaggctttgttcttggtatttcaggtggccaggattccactcttgcgggacgactcacgcagctggcagtagagcgcattcgtgcggaagaaaacagcacggattatgtcttctacgcagttcgcctcccctacgcgatccaggcagatgaggacgatgcgcaagttgcattggaattcatcgcacctgacaagagcgtgaccgtcaacgttaaagacgcaacggacgccaccgaagcaactgttgcagctgctttggaacttcctgagctgaccgacttcaatcggggcaatattaaagctcgccaacgcatggttgcccagtacgcaatcgcaggccagttgggcttgctggttattggcactgatcacgcggctgaaaacgtcacggggttcttcaccaaattcggtgatggcgcagctgacctgcttcctttggcaggtttgagcaagcgtcaaggagctgccattctggagcacctgggtgcaccttcaagcacgtggaccaaggttcctaccgctgatttggaagaggatcgcccagcgttgccagatgaggaagcacttggtgtgtcgtatgcggacatcgataattacctggaaaacaagcccgatgtcagtgaaaaagcccagcagcgcattgagcacctgtggaaggtgggccagcacaagcgccacctccctgctaccccgcaggaaaattggtggcgt

SEQ ID NO: 2781 - DNA, 93 bp, Corynebacterium glutamicum
gtgtttgtcatgtacctaatcctaggcaaacatggcgcggtggtgtcttggggcgcgctaaactttggcggtgcgggccaagggtttggagtt

SEQ ID NO: 2782 - DNA, 498 bp, Corynebacterium glutamicum
gtggcaaagctagtagcgctcaggctcctcgccgagggtgaactcacggccagtgatttcattcggaacaatacggacatagttgtacttcagggttggaatccaaggcttcaactccaaagtgtcggcgtaggcgatctcatccagcttgcgcacaatctctgcggtcgcacgaaccaccacggaccaggcctttccgtccttgacctcatcggcttcaaagagcacatcgtggttgagattcatgctgaacaacttgttgccctcagctgtacgaatgtaaattgcgcccttatccacaatgaagttcaccgggaaaatgtccatctcatcgctgcgacgaaccaccacgcgaccaagagacaccgactgcaggcgctccaaagcttcctgctcattgaggatgttgactggattgtccatagttatctccactcccacaaactaaagaaaaaaagaatatccggtactaaccagtctagccctcaattacgcgct

SEQ ID NO: 2783 - DNA, 747 bp, Corynebacterium glutamicum
ttgccacatttcactaaacgccccgcacaaccccaagcagccttggcggaagccgcaggtctacgctggctcgccgaagcatcttcagctgtggcacaggttgttagcgccgacgcagagcagatcacgactgttggcgtcgaaacgcaattgcccacacccgatgcggccttcaaggccggcgaagagctcgcccgcatccaccttgccggcgccccagcgttcggctgtccaccagcgggctgggcggggttaaactacatcggcacccagggacaagcatgcttatcgacgcccacctggggtgttttttactcccagcaacgcgtactcccgtttgcgcgccgggcacgcaggcgaaatcacctcaccgagcacgcactctgggtcgtggaagccgcttgtgatttgattagcgaacttcccgatgacgttccccccgccagaatccacggcgacttgtggtttggcaacctactttttggcacagacgggcctgtgtttattgaccccgcagctcacggcggtcatcccgaaactgatctcgcgatgcttgatgtatttggcgcaccctatctcgatgaaatccgggaaggttatctgtctatcaacccgctgccagacgggtggcgtgaacgcacccccatgcaccaactccaccctttggccgtacatgcggcgtctcatgggccaagctacggcgtggaactactccacgccgccaaagcgacactcaaactgttggat

SEQ ID NO: 2784 - DNA, 288 bp, Corynebacterium glutamicum
gtggataagggcgcaatttacattcgtacagctgagggcaacaagttgttcagcatgaatctcaaccacgatgtgctctttgaagccgatgaggtcaaggacggaaaggcctggtccgtggtggttcgtgcgaccgcagagattgtgcgcaagctggatgagatcgcctacgccgacactttggagttgaagccttggattccaaccctgaagtacaactatgtccgtattgttccgaatgaaatcactggccgtgagttcaccctcggcgaggagcctgagcgctac

SEQ ID NO: 2785 - DNA, 1020 bp, Corynebacterium glutamicum
atgactccagctcacatattttctgaaggtccaatcaatagtgttgttctcagccaggatgaggatggaaatttcaccacctcctaccaggacacgttctctgatccatcatttttgggggaaggtgacgttctaattgaggttggttggtccagcttgaattacaaggacgcaatggctctgaagggtgataagggagtggtgcgtactgtgccactgattccaggtatcgatgtggtgggcactgtgatcgagagcgctgatcctcgctttggtcgtggtgatgaagtggtgctgaatggcgctggtttgggggagaaccggcatggaggtttcacgcagcggctgaaagtgccgtctgaaccgttgctgcatattccatttaacttctccgcgcagcaggtgggtgcgttgggtactgcaggtttcacggctgcgctatcggtgaatgctctggtcgatcaaggtatcaaaccggaggatggggagattctggtaactggttcgactggtggtgtgggttcgattgcacttcacctgctgaataagttgggatatacgacggtcgcggtgacggggcgtcgagaagcgcatgccgaatacctgaccagcctgggcgcaagcgacatcattgatcgcgcggagctttctgaaaagggccggccgctgcagaaggggcgttgggcgggtgtagtggattcagtgggatcccacacacttgtcaatgcgattgctcagacaaaatggggcggaattgtcacggcgtgtggcatggctcaggggccggatctgccgggaacggtgttgccgtttattcttcgtggcgtgcatttggttggcattaactctgtcgatgcaccccgtgagctgcgtcgacgtgcgtgggcgttgctgtccgagcatcttgataccgcggtgctagatgatatgaccactgtgattgatgtcaaggatgttgctcaagctggcgaagatttgatggctggcaagcttcacggacgtaccgcggtgcgtgttcat

SEQ ID NO: 2786 - DNA, 1371 bp, Corynebacterium glutamicum
atgaccgaatcgcaagatctcgccgcattcgtggaagctgccaaactcaatgatgcaagccccgaagccgtagagcaattgaaaatcagagtgctagacaccgtaggcgttgccattggcgcactggatgccgaaccgattgtcgccattcgaggactcctggaagacctcgggggaaccgaacagtcaacacttattggtggtggcaaaaccagtccggaacgtgcagcatttttcaacagcgcattaagccgctacctcgacttcatggacgcctacctagcaaagggcgaaaccaaccacccctcggataacttcggagcagtgctcgctgcagccgaaagcgttggcgcctctggaaaagacctgctcaccgcattcgccgtggcctaccaggtacacaccagactttcagatgtcgcaccagttcgcgccaaaggtttcgatcacaccacccaaggagcattcgcagcgggcgcatctgctgccaaggcactgggtttgccagctgatcaaatcgccaacgcactggccatcgcaggaacagccaatgttgcacttcgtgtcactcgcactggaaacttgagccactggaaaggccttgcctacccacacgtgtccaaagaaggaacctgggcagcactgctcgcaagccgaggtattaccggtccggaagaagtcttcgaaggcaacaagggattcaaagagtccgtctccggaccgttcgagatcgattggtccaaggaagacttggaaagcgttaagcgcaccatcatcaagaaacacaacgcggaaattcactcgcagtcagcgcttgatgcagcccaagaaatacgcgcacaagaaggcttcaatgtggacaacattgaaaagattcacctgactactttcgacgttgcctactccatcattggcggcggcgaagaaggcgacaaacagcttattcgcaccaaagaagaagccgatcactcactgccgtggatgctcgctgtagttctgctggatggtcagctcaatcccgaacagtacgaaccatcacgcatcgttgctgatgatgtacaaaccttgatgaagaaaatcgaaatcacaccgtcagatgaattctctgatcgcttccctgaccacatgccagctgatctagaagtcacactaaacgatggctcggtgttcaaagcttcacaagatagctacttaggcttccacgacaatcccctagattgggacaacgcgcgcaagaaattcgatgcccttgtcacaccattcaccggtgaagaactacgtgaagaaatcgccacgatcattcacgagctcgatagccgacaggtttctgaactcacagaagccctggccaaagtctccaccacccgcagc

SEQ ID NO: 2787 - DNA, 834 bp, Corynebacterium glutamicum
atgagcaacgcagtaccccacaacgtttccttcaactttgttccccgcgcttaccgtccagaaaagccccgcacattcggcatgacagaaattcgtgcaccgtactactccactttcggcacccgacacctccaggatgtcttcgatgttgcaggccagtgggtggacggcatcaaatgggcaggcggttccttctccctggtgccgaccgaacaggtgcgtgcttttagcgacatcgcccatgaaaacaatgcctatgtgtcttccggtggctggattgaaactgtgcttcgctacggcgacgacgcagttgatcattacttaaaggaagccaaggaagtcggcttcgatgttattgagatttccaccggattcatcatgctcaacacttcaggtcttcagcgcctggtagaaaaagtggtcaaggcaggcctcaaagcaaaacctgaactaggactacagattggttccggaggcgactctggtgaggctgaacttgcagccgaaggaaagaaagacattggcgatctggttgaccgcggtaaaaaagctctcgacgccggcgcatccatcatcatgatcgaatccgaaggcatcaccgaaaacgtcaccgaatgggatacaggcgctgccgcgtccatcatcaatggactgggattagaaaacgtcatgttcgaagccgccgacggccccgtctttgagtggtatgtcaaaaactacggcaacgaatgcaacctgttcgtcgaccacagtcaaattctgcaacttgaagggctgcgccaaaacatctggggcaacaagagcacctggggacgagtaatcaaccctgcgcct

SEQ ID NO: 2788 - DNA, 792 bp, Corynebacterium glutamicum
ttggatttttggaatgatcgccccctgcgagaattcaagaaaacaaaacagatcaaagtaaggcaacaagtgagcaacaaagttcagaatccgaaccaaggtggaagcaagaacttcctctgggcaatggtggcgatcgtcgtcgttgcaatcgtcgtcgtcggcttcatcgtcatccaaggccagggctcaaaagcagccaagcttggtgaccgcgactacgaagacacctctttggcaatggaagtaggctccgactccatcacgctgacctccgcaaacacctccgccgacgcaaagtccgtgcagctttttgaagacttctcctgctctcactgctccgagctctccctcgccaccgacgctgacatgaagactcagatcgaagacggcaacctggtcgtcgaaatcaagccactgaacttccttgaccgcgaaaacatcgacggccactccacccacgcattggcagcagcccttgcagtggcagactccaacgacgcaaccctctactggaacttccgcgcattcctcatggaagatcagtccgagatctacaaccagtggtccgatgatgacttcgcagacggcgttgaagcccttggcgcagactcctccgtagtagacgcaatccgaaacggcgacaacatccagcgcgcatacgacctggcaaccgcaaacggtgaagaactcactgaagaaaccggcagcctgtcctcaccacgcgtcctccaggacggcaaggatgttgaaggcaacatctccgactggatcaccactgttctagcttct

SEQ ID NO: 2789 - DNA, 1662 bp, Corynebacterium glutamicum
atggcacatgaacgcgccgggcaactcgcccaaccagaagatctcatcgatgttgcggaactggtcaccgcatatttcacccgcaagccggacgtgaacaaccctgatcagcaggtcgctttcggcacctccggacaccgtggctccgcgctggacagcgctttcaacgaggaccacatcctggcaaccacccaggcgatcgtcgactaccgcaaccagcagccaaaaaactgggtcggcccgctgtttatcggccgcgatacgcacgcgctgtccgaaccagcgatgatcagcgcgcttgaggtcctcattgccaacgacgtcgaagtgcttgtcgacgccgacggccgctacaccccgacgcccgcagtgtcccacgcgatcctacgacacaacgatggcatcatccttggcaccgcaggaccctcccgcccctacgccgacggcatcgtgatcaccccatcccacaaccctcctcgtgatggcggattcaaatacaacccagccaacggtggccctgcagataccgacgccaccgactggatcgccaaccgcgccaacgatattctgcgcggcgaccttgcagacgtgaagcgagttccagtttccggtgtcctcgacgagcgcaccactgcctacgacttcaagggcatttacatcgctgacctgccaaacgtggtcaacatcgatgccatccgcgaagctggtgttcgaatcggcgcagacccaatgggtggcgcatccgtggattactggggtgccatcgcagaaacccatggcctcaacctcaccgtggtcaacccacacgttgattccaccttccgcttcatgacattggacaccgacggcaagatccgcatggactgctccagcccacacgcaatggcatcgctgattgacaaccgagacaagttcgatgtggcaaccggcaacgacgccgacgccgaccgccacggcatcgtcaccccagacgctggcttgatgaaccccaaccactacctcgcagtagcaattgagtacctctttgctcaccgcccaggttggtccgcagataccgcagtgggcaaaaccctggtcagctcctccatgatcgaccgcgttgtggcgcagcttggccgcaccctcgttgaggttccagtcggattcaagtggtttgtcccaggtttgatctccggcgaaatcggattcggtggtgaagaatccgcaggtgcatccttcctccgcatggacggcaccacctggtccaccgacaaggacggcctcatccttgacctcctggcagctgagatcattgcagtaaccggcaagaccccatcacagcgctacgcagaactcgccgaagaattcggtgcacctgcctacgcccgcaccgatgcagaagccaaccgagaacaaaaggccatcctgaaggcactgtccccagaacaggtcaccgccaccgaactagccggcgaagcaatcaccgctaagctcaccgaagctcccggcaatggcgcagccatcggaggactaaaagtgaccaccgaaaacgcctggttcgcagcacgcccatccggcaccgaagacaagtacaagatctacgcagaatccttcaagggcgaagagcacctcgcccaggttcagaaggaagcccaagcgttggtcagcgaagtactcggacag

SEQ ID NO: 2790 - DNA, 288 bp, Corynebacterium glutamicum
atgcagaaactcatccaagggctaggtgtcggcgcgggtgccgcgttgggggtgtgcgtgcgccttgcgctgacgttgtggctcggcgattccgcctggccgatcctgaccatcaacgtgctgggagcgtttctgatgggctggttgcgccccaacgcgttctggggcacaggtttcctgggcggcttcaccaccttttcggccatgatgcttaacgacgtctccttctatttcttcaccgctgtgggctgcattctcgcctggttagctggggatcggttggcgcga

SEQ ID NO: 2791 - DNA, 324 bp, Corynebacterium glutamicum
atgatctttctttatgcagctctcggcggttttttcggaggctttctgcggtggagccttgcccaattattccccggaaaaagggccaccctggcggcgaataccctggcgtgtcttgctggtggattttttgtgtcgttggatcttccccatctctatacggttttgttgatcgctggtttctgcggcgccctttccacctggtccaccttggctaaagaacttggccagctattgaatgaaaagaagtggtggccgatgcttggctatctcagcctgacttttacacttggatattctgctgtttttctcgggatgcggctc

SEQ ID NO: 2792 - DNA, 792 bp, Corynebacterium glutamicum
atgaatcgttcaacaatttccccagttgaagcccgccagcaattccgcgcaggccttatccaacccacctccggctggtccgcgggttttgcccaagccaacctcatttccatgccccaggatctggcttatgatttcctgctttttgctcaacgcaaccccaagccctgccccatcttggaagtattaaatgctggcgaaaccttcggcggaattttcggctcaaacgccaccgaagcagacatccgcaccgacgcgccccaataccgcatttacgcacacggcgaacttatcgattcccccgccagcgccgtcgattattggcgcgacgacctcgtcagtttcatcatcggctgctcctttacttttgaacatcccatggtccaagcaggcgttcccgtccgccacctcgaggccggccgcaacgtccccatgtatgaaacctcacttgcctgccgaccagccggttccctatcaggaaacctcgtggtgtcactgcgcatgatccccgcatcccaagtcgcggatgccgtccgcattacctcccgctaccccgcggttcacggagcaccagtccacatcggcgatccttcactgatcggaatcgatgacatcaacaaccctgatttcggcgatgccccgctgtccgaaccaagcgacgtccccgtgttttgggcctgcggagttacccctcaagcaatggtcatgtcctccaagccaccgctggcgatcactcacgcacccggacacatgctgatcaccgacgccccagatctgggattccaggttcct

SEQ ID NO: 2793 - DNA, 1365 bp, Corynebacterium glutamicum
gtgcaattattacacacccccgcagccatatccatttccttcgacgaccccaacctcatctctaccgcagggctggtcccgaccatggccctggccgaggaccggttaacagtaccaaccgacaaaggtgctaacccaggtgccaaaatcacgaccctcattgcggggatggtcgccggtgccgactccatcgacgatatcgatgcactccgccacggcggtatgcaccgactctttgactggatctacgccccctccacgttggggtcgttcctccgggcctttaccttcgggcatgtccgccaactcgacgctgtggcctcccggttcctggtgggtctggcaacacaggccccggccctggtcccggttgatgcttctaccagtgattacgtcttcatcgatgttgatgacaccatcattaaggtccacggacatcagaaacaaggcgctggttttggttactccggtatccgtggactcaacgccctgctggccacagtgaccacaccagagtcagcaccagtggtcgtggcccaacgattacggaaaggatcgtgcggttccccgcggggtgcaggccggttgattgctgatgcggtggctaccacccggcgtttgccggggatggaggatgagaagatccttctacgcgcggattctgccttttatggccatcccagtatcagtgctgcgatcaaggcaggggcggatgtgtctgtcacggtgcggatgaccccgaatgtcaagaaagcgatcgcccaggtccctgatgatgcgtggcagacaattaagtacaccaacgcgatcttcgacgaggacaccgggcgctggatctcggtggccgaggtcgccgagataccgttcaccgcatttacctcccggaagaaaaccgaccacatccccggactgctggtggtacgccggataccggagctgaataacaaggatgtggatcagccggggttgtttgatctacaccgcttccatgcggtgttcaccaccgccgacccaggcatcctcgatactgttgctgcggataaaacccaccgtcaacacgcaatcatcgaacaagtcaacgcggacgtaaaggccagtgcgttggcgcatatgccatcaggtgtattcaccgccaacagcgcctggttggtgtgtgcggtcatggcgttcaacctcacccgcacagccggtgtgatcgctgcaggcgcgatggccagggccaccaccgcaacgatccggcggaaacttgtggccgttccggccaggattgcacgcagcgcccggagattgattcttcacttgccacggaactggcggtgggaaacccagtggtcaagattgtgtgatcacggccgtttaccaccg

SEQ ID NO: 2794 - DNA, 1620 bp, Corynebacterium glutamicum
atgaaactttttcatagggctgcaagcgtcgtagccgcagcgctattaggtacaggtgctattgcgcctgtggttcagagtcaacctgatcagacagtcacccttgatcatcaagaggcctacatccaagaatttcaccgcgggggcgatagaccacctatagtcgatggtgtcggtggttattcagatgaagaagtcgcacagatccatgaagcgatccgacaagcttacgtttctggtgaaccacacgatgagctagttcctggtgagatgtggtcagacaagattgacctgcctgcaacgatcgacaaggcagctgctgatgaagctgagataaagatcgcgcagcaacaatcagggtcgcaggccagggctcttgctgcacagtgccagtttttctggccgtctccttaccaagtgtgtggggccatcttggaacggtataaccaacaaggtgggccgttgagttggatgctattgccaattgagaatcaagcgcttaaccctgatggacagggatatcgtcagcgatttatgtccggatttatttattggcatcccactactggtgcgcatgcagttaataactacagtgcgcaaatatgggagcgtcatgggtgggagtctggctggatggggtaccccatcggtggtgaagtccctgtttcggggtcgaatctcattgacggtgagatcaatggttgggtgcaaacgttccaaggtgggcgggtctatcgtaccccgatgcttgaggggttccagattgccagtattaacggcatgattttaaatagatggttggctattggcgggccggatagcgctcttggttttcccattgccgatgaagctgttgcatccgatggtgtgggtcgatttagtgttttccagaatggtgtactttactggcaccctaatcacggagcatgggaaatgaccggatttattgaagaagtatggaaaatgcgaggtggcttggattctcaatggggttatcccacatccgccccggtgttagattcagatgccccagtggaaattgcccaaaacttttctggaggcgttttcgacctagcaaccgagatcgaggatgctggttttagtccgatcgaggataaggagatgagcaacttgatacttgaatattttggttatttaggattcgatttccctggaagctcttctcgagagttggtgcaagaccattctaaatcagacttgatgactcttagggctagtagatgtgcgctcaaggattcttctcaggcaagtttcggtggggtgacgattcctagccactatgactactggggatgtcttgacaagtccgaccgacccgaccctgatgcttatgggcgccatgactactgcactctttcgcctgattcgtatggtcccctagggaagaaggctgagtttagtggggcttgtgcaagacacgatctgtgtatggatgccgttgatgcgaatggcacggggtatgctccgtgccacccggctttttatacgtggatgagcacagtttgtactaccaactatgctgaggatgctaatttcaagaagggctgtgtgaataccgcgaaggcctactataaggcagtccaattaaagaacccgaat

SEQ ID NO: 2795 - DNA, 354 bp, Corynebacterium glutamicum
atgcgtgattatacgattttcgtaatcagactactattactatatttaatagtatttatcgctttttggatttggtctccgataacttctgaatcgtaccttgaagctgtggtgatggccttcgcggtgtctttgattaccgcgttggtgacaagtgcagttacgtacctagcttcgctaaaagtgatagcattcgtcggctttcttggtttcgtcagtttaatagttggtgtctatttctggattactgttccagacgggattttggacgtcttctttgtgctttttggcagcggtatctttctatccgaagtgttaattagcctgaagcgctactcgcgctcgtcaagtttt

SEQ ID NO: 2796 - DNA, 165 bp, Corynebacterium glutamicum
gtgcatgtgaaaccgtggatgcttgaccaaccaggtattgatggtcgggtgtttatgcgtggcgtagttgtcacaaataacatgaacatcaaggtcctggggaacagtcttgtcgatcttgaccaggaacttcttaaacctggatccaccgatgtgattcaggtg

SEQ ID NO: 2797 - DNA, 447 bp, Corynebacterium glutamicum
ttgattcttccagttcaggagggcatttcctattttcccacgccgttacacctgaatcacatcggtggatccaggtttaagaagttcctggtcaagatcgacaagactgttccccaggaccttgatgttcatgttatttgtgacaactacgccacgcataaacacccgaccatcaatacctggttggtcaagcatccacggtttcacatgcacttcaccccgacgtattcgtcctggatcaaccaggttgaacggttgttcgctgaggtgacccgggagttactccagcgttctgatcatcggagtgtccaggccctggagaaagatttacgcaactgggtgaaagcatggaacgaggatcctaagccgtttatctggaccaaaaccgcggaggagatcctttcctctatcgcccgatacttaaaacgaattaacggcgcaggacac

SEQ ID NO: 2798 - DNA, 1401 bp, Corynebacterium glutamicum; identical to SEQ ID NO: 1747

SEQ ID NO: 2799 - DNA, 768 bp, Corynebacterium glutamicum
gtgccttcacccaacctggggtggaggcactttctcattgctaaggtgtgcatcgtgaacgatttaccgaacctaccaaagctgcccttcaactggacatgggtgctggcaactgttgccacgacagtggtgttggcgggtattggtttgtatgtgtattacccgtcgttgccagatcctatgccggtgcattggaatggatccggggaggcggataattggacgcctaaatcggtgggttcgtttctttcactgattttgatagggccaggcattattttgctgaccctgtcgggtatgcaggcgttgctgaccatgcagtctggagtgatcacgcaacgcggtggggcgaaatcggcgaatgaagcgcaccggcagtgggaaacctacaaggcaacaagcatgcacatgggttggtacatgtttgtgctcaacgctttgattttggtgatgatcctcaatgagttccgcccaaaccctctgcctggtggatttatcatcgggcttattggaattattgctgccacgattgtcctgttggttctgattggaaaaacaaccacgagtttggcaaagaaataccccatgcctgaccaagatggaaagacgtgggggattttctacaacgatccggacgataatcggatcttagtggacaccgggatggggatgaattacacgtttaacattgcccatacgtggggcaagatcttcgcggttttgatcttcgcggtgccagtactcatcgttttattaaccgttctcctt

SEQ ID NO: 2800 - DNA, 1338 bp, Corynebacterium glutamicum
atgactggctttggtgcccaggttatcgccggcctcattcttggtcttattctcggccttgtcgcccgaggcatggacagcggcgctgcagacggtgaagcaagctggcttaccggtcttcttagcggcgtcggttctgcttatgtttctctacttaaagttatggttccaccactggtgttcgctgcagtggttaccagtgtggcaaagttgcgcgaggtagctaacgctgctcgcctggctgtttccaccttggtgtggttcgccattactgcattcttctctgtgctcgcgggtatcgccgtagcgctgattatgcagcctggtgttggatccactgtcgacgcatctaatgctgctgatccttctcgcgtgggcagctggctgggctttatccagtccgttattccatcaaacattctgggactttccggttcttacagtgagaactctggtgtgaacctgtccttcaacgtgctgcagatcctggttatctccattgcgattggtgttgcagctctgaaggctggcaagtccgccgagcctttcttgaagttcaccgagtccttcctcaagatcatccagatcgtgttgtggtggattattcgcctggctccaattggttccgctgcgctgatcggtaatgctgttgctacctacggttggtctgcacttggatccctgggcaagtttgttcttgcgatctacgttggtctggcaatcgtcatgttcgttatctacccagtcgtgctgaagctcaatggaattcctgttcttggattcttcaagcgcgtttggcctgtcacaagccttggctttgttacccgttcctccatgggcgttatgccagttacccagcgcgttactgagcagtccttgggtgttccatctgcgtacgcttcctttgctatcccactgggtgcgaccagcaagatggacggctgcgctgctgtctacccagctgttgccgctatcttcgtggcacagttctacggcattgacttgagcatcatggattacgtactgatcatgatcgtctctgtcctgggctctgctgcaactgcaggcaccactggcgcaaccgtcatgctgaccctgaccctatccaccttgggtctgccacttgctggtgttggtctgctgctggctatcgagccaatcatcgacatgggacgtaccgcaaccaacgtcaccggtcaggcactggttcctgcgatcgttgctaagcgcgagggcattctggatcaggatgtgtgggatgctgctgaaaagggtggcgctgctattgaaatggcaaccgtctctgagaaagaaactgagcctgcagaggttcgctcc

SEQ ID NO: 2801 - DNA, 693 bp, Corynebacterium glutamicum
atgtcggagactgcgtccttcatggttgcagaaagcatgccaattgcagtcactaaggcaatgcccaacgtcagtgcgaacgctgtagttgcggtacggcgagggtttcgcttggagttggtcgcagcaaggcttccaacgctgccaaacggtgcaccgataaccttgcccaggccacccaccacaggcatggagagcgctggtgagaagaggaacgtacccacgatgacaaacagtgcaccaatgcccaccaggatggaacgagtagcggtggaagaatcagtcatcatcgcaccggcaatcgcaaagatgatgccgagtgctagaacgatgccaccggtgatcgtgcgccccatcatggaacgcatagtggtggtttccatgttgcgcatcgcttcaacaggcttaacctcacctgcacgacgagccggagcccacgcgctcacaatggtgacaacggtgcccaatacgagcgcggtaaccactgcagaaggagtcaagccaacgctggatcccatcggcatgcccaggttattgaggacagctgaaatgatcgctacgaggcccataccacccagcacaccaagagcagagccgaagaggccaacgatggttgcttccagcaccacagagcgagtgatctgtcctggcgccgcacccagggctcgcaggagagcgaactcacgcatgcgc

SEQ ID NO: 2802 - DNA, 2541 bp, Corynebacterium glutamicum
atgcgcagaatcagtctgcgcaatattggcgcgcacaaggtcaggctgtttttgacagttctggcagtggtgctcggcacgtcttttgtttccggcgcgatgatgtttaccaacgcgctgtcctccacttttgatgaggctattgccagcagctttgacggcgtggatgtggtggtttcaccaaacggtgcatcagaggtgcagggtgttcctgttgagacggttgaatctttgcgtgaggattcccgcatcaaccatctcaacatcaacggttcccagactgtcgttctggcggatgctgattccaaggcaattcaaacgactgggggatcgtcgttaagcatttattacagcgcggacgacgcggttgcccaggcacctgaattggctgagggagaggcaccgactggcaccgaagaggtgcttgcctcgaaggcgggcgctgaggcgaatggcctgggagtaggggaccagatcttggtcgtggactccagtggccgctacaacgtcaccatcacaggcctgaccaccactgagacggattcggccaccgcgctgaacctgcagatgtcggaagctggctacctggagcgttacaccgacggggctaccgtccccagcgtcatgctgtcggctgcagatggcaccacgcctcaagagcttgtcgacgccctcgctgccgaacttggatcgaactttgatgtagaaaccggcgaagcgctagtcgagcaggctacaggaatgatcacgcaggccttgagcttcgtgcagtacttcctcgttgccttcggtctcattgcactgctggttggtaccttcatcatcgcgaataccttctccatgattgtggctcagcgcatgcgtgagttcgctctcctgcgagccctgggtgcggcgccaggacagatcactcgctctgtggtgctggaagcaaccatcgttggcctcttcggctctgctcttggtgtgctgggtggtatgggcctcgtagcgatcatttcagctgtcctcaataacctgggcatgccgatgggatccagcgttggcttgactccttctgcagtggttaccgcgctcgtattgggcaccgttgtcaccattgtgagcgcgtgggctccggctcgtcgtgcaggtgaggttaagcctgttgaagcgatgcgcaacatggaaaccaccactatgcgttccatgatggggcgcacgatcaccggtggcatcgttctagcactcggcatcatctttgcgattgccggtgcgatgatgactgattcttccaccgctactcgttccatcctggtgggcattggtgcactgtttgtcatcgtgggtacgttcctcttctcaccagcgctctccatgcctgtggtgggtggcctgggcaaggttatcggtgcaccgtttggcagcgttggaagccttgctgcgaccaactccaagcgaaaccctcgccgtaccgcaactacagcgttcgcactgacgttgggcattgccttagtgactgcaattggcatgctttctgcaaccatgaaggacgcagtctccgacatgatggcggagcagtacaccgcagattacatcctgcagggaccaaccaacggttccatcaccatgccgaaggaatctgtcaatgatgttcgcgatgctgagggcgttgccgatgtcgtgctcgtttccatgaactctgcctcggtgaacggtcaggcttcatacagccagctgggccagtctgtaacctttgtcgctgacggcgacctgagcaaggtcatcagcacagaaagcattgatggctccctcgacttgagcaacccaggtgttgtgactaaccagacgtttgctgatgaaaacggctgggcagtaggcgatactctgcagcttgaatcaatggggcagaccatcggcgatatcgagttgatcggtaccttcaccggaaacgacgccatcggaaatatgatcatctccgaaagttccttggctgatacaccagcggcagacactgctgttcctcagatgatgctggtggtaggcgaagaaggctttgataaggaacaactgcgcaccaacttggaagacgcagtcgctgattacattgtcatctctgtgaaatcagcaaccgagttcgctggtgaaacggttgcgatgatcgacaccatgatgaacattctgtacgcgctgcttgctctgtctgtcattgttgccatcatcggcatcatcaacaccctggcactgaatgtgatcgagcgtcgccaggagatcggtatgctccgcgcagttggcgtgaagcgcggacaggtccgcaccatgatcaccttagaatctgttcagatcgccatctacggtgctgtgattggtatcgcgattggtcttggtctgggctgggcctttgtgacagtgatgtcaggcgaaggactagacgctgcggttagtatcccgtggggtcaggtcggactgatgcttgttggttccgctgtagtcggtgttatcgccgcgctgtggccggcagtcaaggcatctaggacaccacctttggatgcgattaccgac

SEQ ID NO: 2803 - DNA, 891 bp, Corynebacterium glutamicum
ttgtggaaccggaattcattaggcaatatcctcaattccgttcatcgtggccaagatttcctcgatggtgggatcaaacaactggttcacgatacgaccgtccgccaagaaaatgacacgatctgcataggacgccgccttggcatcgtgggtaacgatcacaacggtctgatcatcctgatcaactgcggtgcgcaggatatccagcacttccctagaagagttcgaatccaagttaccggttggctcgtcgccgaaaatgatctccggacgagacaccaacgcacgagcacacgccacacgctgctgctgaccaccagagagctctgcaggacggtgcttaaggcgctcagtcagacccagacgagaggtaatctcatcgaaccacgactgatcaatcttgcggcccgcgatatcggtaggcagcgtaatgttctccgacgccgtcagagtaggaaccaagttgaacgactggaaaatgaatcccaaacgatcacgacgcaaagaggtcatctctttgtccttcaaccgcgacagatccgtatcaccaatgaatgccgaaccaccagtcgcagcatccagaccagccatgcagtgcatcaacgtggacttacccgagccagaaggacccatgatggcagtgaacttgttcttctcaaactccacgttgacgtgatccaacgcggtgacagtggtatcaccctggccatacgccttgtacaggttcactgcgcgcgcagcggcttcaccagtcgagttattgacaggctgggaagagtcaatgtcagtcttcggcgtaaaagaagagtcccaattctccttcgcaacatcgtccgaattgttggcaggtgtgctcgcggcagggttactcatgaactacgatgctttcct

SEQ ID NO: 2804 - DNA, 708 bp, Corynebacterium glutamicum
gtgaacctgtacaaggcgtatggccagggtgataccactgtcaccgcgttggatcacgtcaacgtggagtttgagaagaacaagttcactgccatcatgggtccttctggctcgggtaagtccacgttgatgcactgcatggctggtctggatgctgcgactggtggttcggcattcattggtgatacggatctgtcgcggttgaaggacaaagagatgacctctttgcgtcgtgatcgtttgggattcattttccagtcgttcaacttggttcctactctgacggcgtcggagaacattacgctgcctaccgatatcgcgggccgcaagattgatcagtcgtggttcgatgagattacctctcgtctgggtctgactgagcgccttaagcaccgtcctgcagagctctctggtggtcagcagcagcgtgtggcgtgtgctcgtgcgttggtgtctcgtccggagatcattttcggcgacgagccaaccggtaacttggattcgaactcttctagggaagtgctggatatcctgcgcaccgcagttgatcaggatgatcagaccgttgtgatcgttacccacgatgccaaggcggcgtcctatgcagatcgtgtcattttcttggcggacggtcgtatcgtgaaccagttgtttgatcccaccatcgaggaaatcttggccacgatgaacggaattgaggatattgcc

SEQ ID NO: 2805 - DNA, 273 bp, Corynebacterium glutamicum; identical to SEQ ID NO: 87

SEQ ID NO: 2806 - DNA, 141 bp, Corynebacterium glutamicum; identical to SEQ ID NO: 86

SEQ ID NO: 2807 - DNA, 678 bp, Corynebacterium glutamicum
ttggatgccgcaggaatttcactttcagccgttggatccgacttcggcaagatcaacatcaccgatccttttgaagatcacttggagcgcgcacgccacggtgttgaggtcgctaagctcttcggcgcgaaatacatccgcatgttctccttctttattgcagaaggcgacaaccctgaaagcttccgcaaagaagtactctcccgcacccacgcaatggtcgaactcgcagaagccggcggcatcaccctcctccacgaaaatgaaaagggaatctatggcgactccccgcagcgcgtgaaggatttaatcaccagcatcgactcccctaactaccgcgcaatctacgacgcagctaactacgtgcaaaccggattcaagccttttgatgaggcatggccgatcgttaaggactacgtcgactacgtccacatcaaggacgcgaccattccagatgcagagcaccccatcggaatcatcaagccagcaggacaaggcgacggccaatacccagagctccttgccgcgctaaacgccgacggttacaacggattcgtctccatcgagcctcacctgggtgacttcgatgaattcggcggactctgcggacctgacctgtggaccagcgcatgcgacgctctcgcaggaatcctgaacaacatcaacgccgagtacaac

SEQ ID NO: 2808 - DNA, 672 bp, Corynebacterium glutamicum
ttggcttccgatcttggtattaagttcgtcgcagtggtggataaagatctagagactgctgagaaatttgcgacgggacttggagctgctggcgattcttcagaaagcagcgtcaaggcccacggcagcctgccggctttgttctccaaaaagaagatcgatgttctacacatcaccaccccccacgaccaacacattggtttggctctcgaagcgctacaccacggtgtaaatgtcatcctggaaaagccgttggctaatgagttggaccaggcgcagcgtctcatcgactacttggatgaaaaccccgatggtccaaagattgcagtgtgctatcagaaccgttacaacgtttcctcccaggaactgcgtcgtctgctcgattcaggtgacctcggtgccatcaatggtgcatattcctctgtggtgtggacccgcaccccaggctactacacccagaaaccttggcgtggccagcaagcacactccggtggtggcctgctgatgaaccaagcaattcacaccctggatctgctgcagtggttccttggaaaggcaacagaagtcaagggcactgtctccaccgataagtatgccgatgtcatcgatgttgaagacaccgcacacgcatacatcggtcacgagtccggagtccacaccagtgaagtgagt

SEQ ID NO: 2809 - DNA, 525 bp, Corynebacterium glutamicum
atgcccatttggaatcacaacaccgcatatcggccatggctggtgtcaaagctcaaaggctcaagatcgcttctcgacgtcggctccggcgatcactccttcgccgacctggccggccgccaggtcgcgcatgtcgatgtcgtggatcctcttattaatacaacctttgaagaattccagccgacccaaagctacgatgccatcacgttcatcgcgtccctccatcacatgaacgcggaagaaggacttaacaaagcagtccgaatcctcaatcctggcggcaagctcctcatcgtaggcctcgccaaaaacaaaaccgcctccgactggatcatctccggactacaagcttttctctcccgaccaatcagcctcatcaatagggaacaacaaatctaccccttccctaccaaagaaccctcagagagtctccacgaaatacgacaactcaccaagcagctcctccctcaccgccgtattcgccgtggaatccacttccgatacctcctcgagtggacaaagcct

SEQ ID NO: 2810 - DNA, 273 bp, Corynebacterium glutamicum; identical to SEQ ID NO: 87

SEQ ID NO: 2811 - DNA, 141 bp, Corynebacterium glutamicum; identical to SEQ ID NO: 86

SEQ ID NO: 2812 - DNA, 195 bp, Corynebacterium glutamicum
gtgcgtatgttgtttgagaactcaatagtgtgccatttattatttttgtcactaccacagatcaccttgggtgatgtgtggtgggtcatgccgggtggtggatcgccaattttatccatcactgtaaacaataatcttattgttggcatgattttgtgggtctgcttgttccccgtcaagggactaggcccacgt

SEQ ID NO: 2813 - DNA, 1254 bp, Corynebacterium glutamicum
gtgaaagacaagtttttagtcactggtggagcacagctgcagggcgctgtaaaagtttacggcgcaaaaaacagcgttttgaagctcatggcagcagcacttctcgctgaaggcacaacaactctaaccaattgccccgaaatcctcgacgtccccctgatgcgcgacgtcctcgttggtcttggctgcgatgtcaccatcgacggctcaaccgtaaccattactacccctgcagaactcagctccaatgctgacttcccagcagtcacccaattccgtgcatccgtatgtgtgcttggtccattgacagcacgttgtggtcgcgcagttgtatcccttcccggcggtgacgccattggatcccgtccactcgacatgcatcaaagcggcctggaaaagcttggtgccaccacccgcatttcccacggtgcagtagttgcagaagctgaaaagctcgtcggtgccaacatcaccctggatttcccgtccgtcggcgccaccgaaaacatcctcactgcatccgtcatggcagaaggacgcacagtattagataacgcagcgcgcgaaccagaaattgttgatctctgccgtatgcttcgatccatgggcgccaacattgaaggtgaaggaagcccaaccatcaccatcgaaggcgtagagaaactcaccccaactcagcacgaagtaatcggcgaccgcatcgttgccggaacgtgggcatacgccgctgcgatgactcgtggcgatattacagttggcggaatcgcaccaaggtatctgcaccttccattggaaaagctcaagatcgccggcgccaaggtggaaacctacgaaaacggcttccgcgtccaaatggataagcagcctgaggcaaccgactaccaaaccctcccgttcccagggttccctacagatctgcaacccatggcaattggaatcaacgcagtatctaatggaacttcagtaattacagagaatgtctttgaatcacgattccgcttcgtcgatgaaatgcttcgcctgggcgctgacgcgaatgtcgatgggcaccacgtagtaatccgaggaattgaacagctttcctctacttccgtgtggtcttcagatatccgtgcaggagcaggactggttcttgccgccctttgcgcagacggagtgaccgaagttcacgatgttttccacatcgaccgcggataccccaacttcgtggaaaatctgcagaaactcggagcgaccatcgaaagggtttcttcc

SEQ ID NO: 2814 - DNA, 570 bp, Corynebacterium glutamicum
atggccgttcatttaaccaagatctatacgcgaaccggggacgatggaaccacggggctctcaaattttgagcgagttcccaaggacgatccccgccttattgcatacgccgactccgatgaagcaaactgtgcgattggccaagtgcttgcactcagcagccctacggaagatatggcaaccttattgcggactattcaaaatgaactttttgatgtgggcgcagacttagcaaccccgattgaggagaatccgaagtatcccccacttcgagttcttccggaatatatcgaacgacttgagaaggagtgcgataaatggaacgaggatgtgccggcgttggattccttcattttgccgggtggcacgccagcagcggcactcttgcacaccgcaagggtaattacgaggcgcgcggagagagcagcttggatagcggtgcgggaatttccgagcaccacctctaccttgccagcccaatacctgaatcgtcttagcgatctgctgtttattctttcccgtgttgccaacaatggcaatgatgtgaagtgggttccgggcggaaaaaga

SEQ ID NO: 2815 - DNA, 843 bp, Corynebacterium glutamicum
gtggatacccagcggattaaagatgacgaagatgctattcgttcggcgctgacatcgctgaaaaccgcaacaggcatcccagtcaccatgttcgccactgtgttgcaggacaatcgcctgcaaattactcagtgggttgggttgcgtaccccggctctgcagaatctggtcattgaaccaggtgtgggcgttggtggacgcgtcgtcgcaacccgtcgtccggttggtgtgagtgattacaccagggcaaatgtcatttcacatgagaaggattccgcgattcaggatgagggccttcattccattgtcgcagttcccgtgatcgtgcaccgcgaaattcgtggcgttttgtatgttggcgttcactctgcggtgcgtctcggcgacactgttattgaagaagtcaccatgactgcgcgcacgttggaacaaaacctggcgatcaactccgcgcttcgccgcaatggcgttcctgatggtcgcggttccctcaaagctaaccgcgtgatgaatggggcggagtgggagcaggttcgttccactcattccaagctgcgcatgctggcaaatcgtgtgaccgatgaggatctgcgccgcgatttggaagagctttgcgatcagatggtcaccccagtccgcatcaagcagaccaccaagctgtccgcgcgtgagttggacgtgctggcttgtgtcgcgctcggtcacaccaacgtcgaagctgctgaagagatgggcatcggcgcggaaaccgtcaagagctacctgcgctcggtcatgcgcaagctcggcgcccacacgcgctacgaggcagtcaacgcagcacgccggatcggcgcactgcct

SEQ ID NO: 2816 - DNA, 408 bp, Corynebacterium glutamicum
ttggggagcggcgtcgaaaagcatcttttaaagaagtccgttgtcggaaaaatctcaaaggtttggcagtttcgtccaataatttcactttttccacaaggaaaaaggtgttctatgacactaatttcagcaaacttgagtttagctaataccgcaaatgggggtagcgggtgtgttgaggggtggctgaccggacagggatttgagtttttctctaaaaccggcgtgaactgggggttaactacctcttcgggggtggttggggtggcgggggtggcccttgaggggtggggaacttatttaaatacccccgaaaaacaaggcaaatggacacccgtgccaacatattggcgatccgcctcgactatgttcacccccaaaggggaagtacactgtacccttgtcgaa

SEQ ID NO: 2817 - DNA, 924 bp, Corynebacterium glutamicum
gtgtacaacaacatcaccgaaaccatcggccacaccccactggtaaagctgaacaagctcaccgaaggcctcgacgcaactgtcctggtcaagcttgagtcattcaacccagcaaactccgtcaaggaccgtatcggtctggccatcgttgaagatgcagagaagtccggtgcactgaagccaggcggcaccatcgttgaagcaacctccggcaacaccggtatcgcactggcaatggtcggcgctgcacgcggatacaacgttgttctcaccatgccggagaccatgtccaacgagcgtcgcgttctcctccgcgcttacggtgcagagatcgttcttaccccaggtgcagcaggcatgcagggtgcaaaggacaaggcagacgaaatcgtcgctgaacgcgaaaacgcagtccttgctcgccagttcgagaacgaggcaaacccacgcgtccaccgcgacaccaccgcgaaggaaatcctcgaagacaccgacggcaacgttgatatcttcgttgcaagcttcggcaccggcggaaccgtcaccggcgttggccaggtcctgaaggaaaacaacgcagacgtacaggtctacaccgtcgagccagaagcgtccccacttctgaccgctggcaaggctggtccacacaagatccagggcatcggcgcaaacttcatccccgaggtcctggaccgcaaggttctcgacgacgtgctgaccgtctccaacgaagacgcaatcgcattctcccgcaagctcgctaccgaagagggcatcctcggcggtatctccaccggcgcaaacatcaaggcagctcttgaccttgcagcaaagccagagaacgctggcaaaaccatcgtcaccgttgtcaccgacttcggcgagcgctacgtctccaccgttctttacgaagacatccgcgac

SEQ ID NO: 2818 - DNA, 546 bp, Corynebacterium glutamicum
atgatccgtgaagatctcgcaaacgctcgtgaacacgatccagcagcccgaggcgatttagaaaacgcagtggtttactccggactccacgccatctgggcacatcgagttgccaacagctggtggaaatccggtttccgcggccccgcccgcgtattagcccaattcacccgattcctcaccggcattgaaattcaccccggtgccaccattggtcgtcgcttttttattgaccacggaatgggaatcgtcatcggcgaaaccgctgaaatcggcgaaggcgtcatgctctaccacggcgtcaccctcggcggacaggttctcacccaaaccaagcgccaccccacgctctgcgacaacgtgacagtcggcgcgggcgcaaaaatcttaggtcccatcaccatcggcgaaggctccgcaattggcgccaatgcagttgtcaccaaagacgtgccggcagaacacatcgcagtcggaattcctgcggtagcacgcccacgtggcaagacagagaagatcaagctcgtcgatccggactattacatt

SEQ ID NO: 2819 - DNA, 288 bp, Corynebacterium glutamicum
atgagcgagaacaaaaacattgagattgtccacaatgaaggacagaagcgctttgttatcagcgttgatggaacgccagctggatttgccagctatttagacggcccggatatccgcaacttcaaccacactgttattaagcctgaattccgtggacagggactgtctgcgccattgatcaagtttgctttggatgatgcacgtgagtccggtatccgtattcatgatgcttgctctgcagtcgctggcttcattcagaagaaccctgagtataaggatctaaagaac

SEQ ID NO: 2820 - DNA, 882 bp, Corynebacterium glutamicum
atgtctatttttctcaattcagattcccgcatcatcattcagggcattaccggttcggaaggttcagagcatgcgcgtcgaattttagcctctggtgcgaagctcgtgggtggcaccaacccccgcaaagctgggcaaaccattttgatcaatgacactgagttgcctgtatttggcactgttaaggaagcaatggaggaaacgggtgcggatgtcaccgtaattttcgttcctccagcctttgccaaagctgcgatcattgaagctatcgacgctcacatcccactgtgcgtgattattactgagggcatcccagtgcgtgacgcttctgaggcgtgggcttatgccaagaaggtgggacacacccgcatcattggccctaactgcccaggcattattactcccggcgaatctcttgcgggaattacgccggcaaacattgcaggttccggcccgatcgggttgatctcaaagtcgggaacactgacttatcagatgatgtacgaactttcagatattggcatttctacggcgattggtattggcggtgacccaatcatcggtacaacccatatcgacgctctggaggcctttgaagctgatcctgagaccaaggcaatcgtcatgatcggtgagatcggtggagatgcagaggaacgcgctgctgacttcatttctaagcacgtgacaaaaccagttgtgggttacgtggcaggctttaccgcccctgaaggaaagaccatggggcatgctggcgccatcgtgacaggttcagaaggcactgcgcgagcaaagaagcatgcattggaggccgtgggtgttcgcgtgggaacaactccgagtgaaaccgcgaagcttatgcgtgaggtagttgcagctttg

SEQ ID NO: 2821 - DNA, 225 bp, Corynebacterium glutamicum
atgccaccaaacacattcacaaacacactgcgtacctggctatccccaaggatcacatcgagaccagcagccatcgattcagctgatgctccgccaccaatgtctaggaagttcgcggggcgctgcccaccatggcgttcaccagctgcagccacgatatccaacgtggacatcaccaaacctgcaccattgccaatgatgcccacagagccatcaagtttcacg

SEQ ID NO: 2822 - DNA, 1194 bp, Corynebacterium glutamicum
gtggatctttttgaataccaagcacgggacctctttgaaacccatggtgtgccagtgttgaagggaattgtggcatcaacaccagaggcggcgaggaaagcggctgaggaaatcggcggactgaccgtcgtcaaggctcaggtcaaggtgggcggacgtggcaaggcgggtggcgtccgtgtggcaccgacgtcggctcaggcttttgatgctgcggatgcgattctcggcatggatatcaaaggacacactgttaatcaggtgatggtggcgcagggcgctgacattgctgaggaatactatttctccattttgttggatcgcgcgaatcgttcgtatctggctatgtgctctgttgaaggtggcatggagatcgagatcctggcgaaggaaaagcctgaagctttggcaaaggtggaagtggatcccctcactggtattgatgaggacaaagcgcgggagattgtcactgctgctggctttgaaactgaggtggcagagaaagtcattccggtgctgatcaagatctggcaggtgtattacgaagaggaagcaacactcgttgaggtgaacccgttggtgctcacggatgacggcgatgtgattgcgcttgatggcaagatcacgctggatgataacgctgatttccgccatgataaccgtggtgcgttggctgaatctgccggtggcttggacattttggaactgaaggccaagaagaatgatctgaactacgtgaaacttgatggctctgtgggcatcattggcaatggtgcaggtttggtgatgtccacgttggatatcgtggctgcagctggtgaacgccatggtgggcagcgccccgcgaacttcctagacattggtggcggagcatcagctgaatcgatggctgctggtctcgatgtgatccttggggatagccaggtacgcagtgtgtttgtgaatgtgtttggtggcatcaccgcgtgtgatgtggtggcaaagggaatcgttggagctttggatgtgctcggcgatcaagcaacgaagcctcttgtggtgcgccttgatggcaacaacgtggtggaaggcagacgaatcctcgcggaatataaccaccctttggtcaccgttgtggagggtatggatgcagcggctgatcacgctgcccatttggccaatcttgcccagcacggccagttcgcaaccgctaat

SEQ ID NO: 2823 - DNA, 360 bp, Corynebacterium glutamicum
gtggcgcagttggttagcgcgccgccctgtcacggcggaggtcgcgggttcaagtcccgtcagggtcgcagcaatgtgataacagaggttgtactttttcttcaagaaattgtacagcctctgttttttattttctggtgtgtttttggggtctcaggtttcgggtttcttaagagcgggggtttcttaagttcgacttcttgcttacgacttcacggtagcgacttcttatgctcaacttctcgtggtcgatttcagtcggattttcctggatttcctagtgaagtcgcctttgagaagtcggtgttaagaagtcgaactctaggggctgtcaggttaagcctcacggatgtcatgttt

SEQ ID NO: 2824 - DNA, 735 bp, Corynebacterium glutamicum
atgtctattgaattctccgcaccagcaaaaatgaaaatcgaagtgtggagcgacatcatgtgccccttctgctacatcggcaaaaagcgcctcgacgacgccctaagtacctttgaccaggccggacgcatcgaagtggaatacaagagcttcgaactcatgccaggcctagaaacccacccactgcgttccgacgttgaatacctcgccgacgccaagggcatgagcctcgagcaggcccgccaaatgaacggccaagtccaagcaatggcacaagccaccggacttgaaatgaatcctgacgaaaccatcgcggccaacaccatcaacgcgcaccgccttacccacttcgcgaaagcccacggcaagcaacaagaagtggcgcaggaactcttcaaggctcacttcgtagacggcaagaacgttgatgacctcgatgtgctggtctccattgctgcagaggttggtctcgatgccagtgcagcccgcgaagctctcgaatccgacgtgtacaccaacgaagtccaacaagacgtccacgaagcccgccaactcggcgtccaaggtgtgcccttctttgtattcgaccgcaaatacgccatcaacggcgcccaacaagaagaagtattcaccggcaccgtagaaaaagccttcgaagagtgggcagccgaaaacccagtcagcccatttgaggtcattgacggccaaagctgctccgtcgacggcacctgcaac

SEQ ID NO: 2825 - DNA, 819 bp, Corynebacterium glutamicum
atgaccaacccatacgaggccttcataccgctcaagcatcgtacggggattgaacccgagcacaccttttgggaatgggaaaacaaaagggttcacattgcaaggagacgtcgagaagcgcccgtccgcgttatcgtggtgcatgggctaggcacccatagtggcgccctctggcccctcgtcgcggccattgagggcgcggacctcgccgcgatcgacctgcctaaaactccgctttacgacgattggctgcgccttttagaatctttcatctcttccgaagacgacggtcggccactcatcctgatcggtgcaggcaccggaggcttgctttgcgcagaagctgcacaccgcacaggactggtcgcacacgtcattgccacctgcctgctcaacccctccgaccagccgacgcgccgggcactgttcaggttttcaccgctgactcggttgatccaaggccgcttgcgcaaccgcgaaattcccgtgaccagagtgttgaacttcagcaaaatcagccgcagcccagccctgagcaaattgtgcgcggccgatgaatttagcggagcatccaaaataacctggggtttcctcgcgtcatatgtgcaacacaaggccaaactgggtgcagttcccgtcactctgatgcaccctgaccacgaccttctgactcccgttgagctcagtctgcgtacgctttcgcgcctcaaagcgcccactgacgtggttatgctcaaggactgcgggcattttcccatcgaagaacccggcttcaccaccatgctcgaaaccgtcacatcagttatcgcgcggaatagt

SEQ ID NO: 2826 - DNA, 1539 bp, Corynebacterium glutamicum
ttgaaaaagtccgattacctgaggaggtattcaatgtctgatcgcattgcttcagaaaagctgcgctccaagctcatgtccgccgacgaggcggcacagtttgttaaccacggtgacaaggttggtttctccggcttcaccggcgctggctacccaaaggcactgcctacggcaatcgctaaccgggctaaagaagcacacggtgcaggcaacgactacgcaatcgacctgttcactggcgcatcgaccgcccctgactgcgatggcgtacttgcagaagctgacgctatccgctggcgcatgccatacgcatctgatccaatcatgcgtaacaagatcaactccggctccatgggatactccgatatccacctgtcccactccggccagcaggttgaagagggcttcttcggccagctcaacgtagctgtcattgaaatcacccgcatcactgaagagggctacatcatcccttcttcctccgtgggtaacaacgttgagtggctcaacgctgcagagaaggtcatcctcgaggttaactcttggcagtctgaagacctcgaaggtatgcacgacatctggtctgttcctgccctgccaaaccgcattgccgtgccaatcaacaagccaggcgaccgcatcggtaagacctacatcgagttcgacaccgacaaggttgttgctgttgttgagaccaacaccgcagaccgcaacgcaccattcaagcctgtcgacgacatctctaagaagatcgctggcaacttcctcgacttcctggaaagcgaagttgctgcaggtcgcctgtcctacgacggctacatcatgcagtccggcgtgggcaacgtgccaaacgcggtgatggcaggcctgctggaatccaagtttgagaacatccaggcctacaccgaagttatccaggacggcatggtggacctcatcgacgccggcaagatgaccgttgcatccgcaacttccttctccctgtctcctgagtacgcagagaagatgaacaacgaggctaagcgttaccgcgagtccattatcctgcgcccacagcagatctctaaccacccagaggtcatccgccgcgttggcctgatcgccaccaacggtctcatcgaggctgacatttacggcaacgtcaactccaccaacgtttctggctcccgcgtcatgaacggcatcggcggctccggcgacttcacccgtaacggctacatctccagcttcatcaccccttcagaggcaaagggcggcgcaatctctgcgatcgttcctttcgcatcccacatcgaccacaccgagcacgatgtcatggttgttatctctgagtacggttacgcagaccttcgtggtctggctccacgtgagcgcgttgccaagatgatcggcctggctcaccctgattaccgcccactgctcgaggagtactacgctcgcgcaacctccggtgacaacaagtacatgcagacccctcatgatcttgcaaccgcgtttgatttccacatcaacctggctaagaacggctccatgaaggca

SEQ ID NO: 2827 - DNA, 1143 bp, Corynebacterium glutamicum
gtgactttaaaaatcggcccctttgaccttgcctcccctgtggttctagcccccatggctggtgtaaccaacgttgctttccgcacgctgtgccgtgaacaggaaatgcaacgcacgggaacaatctcggggctgtacgtctgtgaaatggtgactgcgcgtgctcttgttgagcgcaatgagaaaaccatgcacatgaccaccttcgcgccggatgaaaatccccgaagcttgcagctgtacacggttgacccgaagtacacctacgaagcggcgaagatgatcgttgatgaaaacttggcggatcatattgatatgaactttggctgcccggttccaaaggtcacgcgccggggtggcggttctgcgattccttacaagcgccgtttgtttgaaaacatcgtttccgcggctgtgaaggctacggaaggcacggacattccggtgacggtgaagttccgcgttggtattgatgatgagcaccatactcacttggatgctggacgcattgctgtcgacgccggcgcgaagtccgtagcgcttcacgcccgcactgcggcgcagcgctattccggtgaggctgattggaacgagatcgcgcgcctgaaggagcatttggcagataccggcatcccagttttgggcaatggcgatattttcgcggcatccgatgcaacgcgcatgatggagcaaactggctgcgatggcgtcgtggttgggcgtggttgcctgggcaggccttggctctttgctgagctgtctgctgctgttcgtggagaagaaatcccagaggagcctaccttcggcgaagttacccaaatcatcctgcgccacgcagaactcctcatgcagcatgatggcgaaaccaaggggctgcgcgatctgcgtaagcacatgggttggtacctgcgcggtttccctgttggcggcgaattccgctccaatctggccaaggtttccacctatgtggagcttgaggatctcctagcaccatgggctgactccaccgccaaggcagaggacgcggaaggtgcacgaggtcgacagggcgctcctgcaaaggtggcacttccagatggctggttggacgatcctgaggatgccactgttcctaaaggcgcagaaatggaaaactccggaggg

SEQ ID NO: 2828 - DNA, 807 bp, Corynebacterium glutamicum
atgctgcatgaggagttctgcgtggcgcaggatgatttgggtaacttcgccgaaggtaggctcctctgggatttcttctccacgaacagcagcagacagctcagcaaagagccaaggcctgcccaggcaaccacgcccaaccacgacgccatcgcagccagtttgctccatcatgcgcgttgcatcggatgccgcgaaaatatcgccattgcccaaaactgggatgccggtatctgccaaatgctccttcaggcgcgcgatctcgttccaatcagcctcaccggaatagcgctgcgccgcagtgcgggcgtgaagcgctacggacttcgcgccggcgtcgacagcaatgcgtccagcatccaagtgagtatggtgctcatcatcaataccaacgcggaacttcaccgtcaccggaatgtccgtgccttccgtagccttcacagccgcggaaacgatgttttcaaacaaacggcgcttgtaaggaatcgcagaaccgccaccccggcgcgtgacctttggaaccgggcagccaaagttcatatcaatatgatccgccaagttttcatcaacgatcatcttcgccgcttcgtaggtgtacttcgggtcaaccgtgtacagctgcaagcttcggggattttcatccggcgcgaaggtggtcatgtgcatggttttctcattgcgctcaacaagagcacgcgcagtcaccatttcacagacgtacagccccgagattgttcccgtgcgttgcatttcctgttcacggcacagcgtgcggaaagcaacgttggttacaccagccatgggggc

SEQ ID NO: 2829 - DNA, 732 bp, Corynebacterium glutamicum
atgcgtactgcatatagacagcaattggatgaattcgcacacaatctaatcattttgtgtgatctaactaaggagtgcatggataaggcgactgatgccctcctgcgcacttctttggcatcggcagaaagcgctttaggcaatgcagaaaagcttgaagagcttcgtactggatgcgagtctcaagccgtcgaacttttggcgcttgaaactcctgtagcccgtgatcttcgccaggttgtctcctccatctacatcgtcgaggaaattacccgtatgggtgctctggcaatgcacgtggctaattccgtgcgccgccgttaccccgatccggtgatcccggaggacatgcgtggctatttcaaggagatggcccgcctcgcagctgacatgacagatcatattcgtcagatcctcattgatcctgaaccagatcttgccctagagatggctaaaagcgatgacgcggtggatgatctgcatcagcacatcatgcgtattctcacgctgcgtccttggcctcacgacaccaagagcgcggttgatttgacgctgctttcccgcttctacgagcgttacgccgatcacacggtaaacgtggccgcccgtatcatttacctgtccaccgggctgcacccggaggagtacatggaaaagcgcgagcaacaaagggccgatgccgacatggagaagcgctgggccgagctggagcggcagttccgcaccagcgag

SEQ ID NO: 2830 - DNA, 897 bp, Corynebacterium glutamicum
gtggggcgcagccctcaccctggtgctcatcatcgctgtcctgaacattggcgcacgaatcatctccgccaagttctctgtcaagcaataataatctcagaaaatacaacaggagtatctaaagcgatgtcgaagctcaagctcaatgatgtcaacatctactacggtgatttccacgcagtgcagaacgtgaacctcgaggttcctgcacgctctgtcaccgcattcatcggaccatccggctgtggcaagtccacagttctccgctccatcaatcgtatgcacgaggtcaccccaggtgcatacgtcaagggcgagatccttctcgacggtgagaacatctacggctccaagatcgacccagttgcagtccgtaacaccatcggcatggtcttccagaaggctaacccattcccaaccatgtccatcgaggacaacgtggttgcaggtctgaagctttccggcgagaagaacaagaagaagctcaaggaagttgctgagaagtctcttcgtggcgcaaacctgtgggaagaggttaaggatcgtctggacaagccaggcggcggcctctccggtggtcagcagcagcgtctgtgcatcgctcgcgcgatcgcggttgagccagaaatcctcctcatggacgagccttgctccgcgcttgacccaatctcaaccctggctgtggaggaccttatccacgagctgaaggaagagttcaccatcgtcatcgtgacccacaacatgcagcaggctgcacgtgtgtccgatcagaccgcgttctactccctggaggcgaccggtaggccaggtcgtctggttgaaatcggacctaccaagaagatcttcgaaaacccagatcagaaggaaaccgaagattacatctccggccgcttcgga

SEQ ID NO: 2831 - DNA, 921 bp, Corynebacterium glutamicum
atgactaacaatgttgttactccgcgcatggatgagcctttaaagaagagctcagccttcaccgacatctcctccagccgtaagaccaccaacaccgcagcaaccgtcatcatttatggtgcgatgctcatcgcagctgtgccactggtttgggtgctgtggaccgtgatctctcgaggcatcgctccgatcctcactgctgattggtggtccacctcccaggctggcgtcatgctgatgctgccaggcggcggtgcagctcacgccatgatcggtaccttcatgcaggcggtagtcacctcggtgatttccattccaatcggtatcttcaccgcaatctacttggtggaatactccaacggtaaccgtctcggacgcttgaccaccttcatggttgacatcctcaccggtgttccttccatcgttgcggcactgttcgtgtactccttgtggatcgtgctcttcggcttcgaccgctccggcttcgcagtgtccctgtcactggtgattttgatggttccagtgatcatccgaaacaccgaagaaatgctccgcgttgttcctcaggatctgcgtgaagcgtcctacgcactgggcgtgccaaagtggaagaccatcgcaaagatcgttctcccaaccgcactgtccggtatcgtcaccggcgtcatgctcgcagtcgctcgtgtcatgggtgagtccgcaccagttctggtcttggttggttcctcccaggccatcaactggaacccattcggcggtccgcaggcttcccttccactgatgatgcttgatatgtacaaggccggcaccgcaccagcaacgctggacaagctgtggggcgcagccctcaccctggtgctcatcatcgctgtcctgaacattggcgcacgaatcatctccgccaagttctctgtcaagcaa

SEQ ID NO: 2832 - DNA, 1014 bp, Corynebacterium glutamicum
gtgcaggcacatcctgtagcagttaatgcgaactcctctcagaccaagccttcaaagaagattgtcgccgaaggtggcggaagcgttaagcgtcccggcgatcgcatcttcgaagtcctatccaccgcttctgcagcaatcattactgcgataatcattgccattgcggcgttccttatctggcgtgctgttcccgccttgatgcgaaatgctgaaggtattggcggattcttcacttattcaggcgcttggaacaccaccgacattgatgcaatgtacttcggtattccaaacctgctagctgcaacacttctcatctctgtcatcgcactgatcatcgccatgccgattgctcttggtattgcgatcttcttgtccaactactcaccaaagcgcctggttaagccacttggctacatggtggacatgctggctgctgtgccttccatcgtctacggcctttggggctggcaggtgctcggaccagctctgtccggtttctacacctggattgaaagctggggcggaagcttcttcctcttcgctacttaccaaaactcaccttcttttgctaccggccgtaacatgctcaccggtggcatcgtgctcgcagtgatgatccttcctgttatcgcagcaaccgcacgtgaagttttcatacagactccaaagggccacattgaatctgctcttgcacttggcgcaacccgctgggaagtcgttcgtttgacggttctcccattcggaatgtccggctacgtttccggcgcgatgctcggcctcggccgcgcactgggtgagaccatggcgctatacatggttgtttctccatcctcggcgttccgcttctcgcttttcgatggcggtaccaccttcgcaacggccatcgccaatgccgctccagaattcaacgacaacacccgcgcaggcgcgtacatctccgccggcctcgtgctgttcgcccttaccttcatcgtcaacgctggcgctcgcgccatggttaaccgcggaaag

SEQ ID NO: 2833 - DNA, 1125 bp, Corynebacterium glutamicum
gtgaacctcactcttaagcgctccatcgcccttgtgggcgcagttactgcaggctccttcgctcttgtagcttgctccgactccaatgagtctgattccacctcctcatctgcagcttccaccggttcttccgatgctgcatccattgagggcctttccggtgttaccggtcagctcgttgctgaaggtgcatcttcccagcagtccgcaatggactactttggtatccgttactccgaggctgtcagcggtgcatctctggcttacaccccttcaggttccggttccggccgcaccaacttcgctgcaggccaggttgctttcggtggctccgactccgcaatgaaggacgaccaggctgcagaagcagaagcacgttgcaacggcaacgaagcatggcacctgccattcgttatcggcccagttgcagttgcttacaacctgcctggcgttgacaccctgaacctggacaccaacatcatcgctcagatcttcaagggcgagatcaccaagtggaacgacgaagcaatcgcttcccagaacgagggcaccgacctcccagaccaggacatctccgttctgtaccgttccgaagagtccggtacctccgacaacttccagaagttcctcggagcttccaccgacatctgggagaccgaaggccagcagttcccaaccgaggttggctccggtgcgcagggctccaacggtgtagcttctgaggcttccaacatcgagggtgcaatcacctacgttgaagctggtttcgctaaccagtccggcctgggcgttgcaaacatcgacttcggttccggcccagttgaactcaacgctgagtccgttggcgttgcacttggtgcactcgacttcctgactgagggccacaacatggttgttgacaccgacgctatgttcgcaatgaacgaagccggtgcttacccactgatcctcaccacctacgaaatcgtctgctccgcaggctacgacgagaccacccgcgaccaggtcaaggacttcctgaccgttgcactggactcccaggatgaccagctcgaggctctcggctacatcccagttaccggcgagcactacgatcgcctcgttgcagcagttgaagcaattcag

SEQ ID NO: 2834 - DNA, 876 bp, Corynebacterium glutamicum
atgaatacttccgatcgtattaaaagcactcaaatcgcgctggatcgtgacctccgtgagcaggcactattgcttttgaaggaggttcgcgcagttgatggcgtggatgctttatcagaacaatttgtccgtgggcttgcagaacccggacttggtcactcccatttaatagtcacgctcaatgacaaactggttggcctcgcggccacggatgaggaaaccacggaactggctgtccacccggcgcacaggcgtcagggaatcggtaaggcgcttatcgacgccacccccacctcatcaatctgggcgcatggaaatacagcaggtgcacaagcgttggcatccaccctgcgtatgaagaagactcgcgagcttctggtgatggagatttccgacagggcgctcgatgactctgcagcatacaaagatccagatggaattacacacagtagtttggcgaatgcccctgtggagaaatcagtagctgaggctaaatggcttcaatccaacaacgaagcattcgactggcatcccgagcagggcggatggacaactcatcggttggcgcaggctcagaaagccgattggtacaaggactctgacgtgttattcctctgggacggcgaagagatcgttggcttccactgggtaaagcagcacagtccagaattacaagagatttacgtagttggcctttcttcagcctaccgtggtcgcggcttgggagatccgcttgttcgcctcggactgcatcacatgagggctcatggtgctcgaaaagtgattctttatgtggaagctggcaacactccggcagtcgcggcatacgaaaaactgggattcactgtcgcggaaagccacgtagtttacgaaaag

SEQ ID NO: 2835 - DNA, 783 bp, Corynebacterium glutamicum
gtggaaaaatccagaaaacgacttgtgaccatcgcagcatcgacaattggggccgttgcggtggctggcggcgctttttggatcgttgatgcttccatcgctgcgcacgcggaacgcaacttgtctaaagcagttgcggaatccgcagatcttgaaaacgacccgcgagtattcctcggcagctccatttactccacggcgttttttaccggcaaactcgactccgtaagcatcgacatgctggacgtggaaatccccggcgtcggcatggtgaatgcacgcacagaggtagaaagcgtggaagtctcacgggatcaaatcctctccggtgacctcgacggcaccactgcggaaaccttcacgcgcacattacgcatggacggcgtcgcaatcggcgcgcagctcggaatcaccgacctcgacatctcccaccccatcgacatctccccctccggcggcatcacctcagaagcgctcctgacaggaaccccaccagacatggaagacccggtcagtgtgctggtcacccttcgcctagtcggctcagaattccagatgctgccgtacgagcttatcgacgcaccctccggactcaccctcgacgatgtcgcccccgacttcacgtggaaaatcgacaccctgcaactacccctcgcagatcgggcaatggcggtttacctatctggtggctccgtccatttccaatctgaagcccgcaacgtccagctcaccacccgcgaactatcaccactagctgcaccggaagaaaactccgatgaatcc

SEQ ID NO: 2836 - DNA, 1095 bp, Corynebacterium glutamicum
ttggcactactcttagataacgtgcatgttcttctgattgcgaatcctgagtcgaccacgcagacgcagaaacttttccgtcgtgtggtgcctgcgttgatggcgcttgatggtgtgtcgcttgaagcgaggtttacgcactatggaggccatgcggaggaaatggttgcgggtttgacggtggatgattttgatgtgattatccccgcgggtggggacggcaccgtcaacgaagtgataaatgggttacttgggtcggcggaaggtgattttagaaaccttgaggatttgccggcgattgcggtgttgccaacggggtctgccaatgtgtttgcccgtgcgcttggttaccccactgacccgtatgctgccgctgatgccctggtggagttgattcggaagaaccacaccagaactatcaccttgggtacgtggaagggtgatgatcaggggactcgttggttcgcggttaatgctgggtttggtattgatgcggatgttattgccagggtcgaacgggcgagatctttcggctttgcggcttcaccgttgttgtatctgcaggtgagtcttcgggcgtgggtgaaaactcagattaagccaccgaaaattaccgtggaggcggtggacagcaaagggcacaaattgcaaaaagaggaagtgccaatgctgcttgcctcgaataccaatccgtggacttttttgggtccgcttcctgtggtgacaaatccgcagaattcttttgacacaggtctggggctttttggcttgactagtgtgcgaggattcgggggagtggcagcgatgatgcacctgattggcgtggggcatggtcggaagttggagaagttgatcgctaagcgcaccattgcttttgatgatgcggagaaagtaacgctcacgtgcgacagcgatcagcgtttccaagttgatggtgagtatgaaggcaaaccaacaaaggtggtgttggaatcaatcactgatgcggtgcgagtgtatgcgccgaagacgcatccgacaccgccgatcatgaattgggctgtccatttgtttaagcacgtccgtgatttcctccgggtgcgcacgtttggcatc

SEQ ID NO: 2837 - DNA, 687 bp, Corynebacterium glutamicum
atgagcgaaaattccacccctaataatccagtcgtcccaggtgcaggcgcagacggcccatcactgtccgattctgcaagcatcagcggatccgacgcagtaaacctcgctgccgaacaatccaagagcaccgctcaccgcaacatcccaggcctaggtgaccttcctatccctgacgacaccgctaacctccgcgaaggccccaacctccacgacggactcctcgcgctcctccctctcgtcggcgtctggcgcggcgaaggccaagccgacaccgcagaagacggacaatacgcattcggccagcaaatcaccttcgcccacgacggtgaaaactacctctccttcgaatcccgcatgtggaaactcgacgaagaaggaaaccccaccggcgtcgaccagcgcgaatccggcttctggcgcatcaatctcaaagatgaaatcgaattcgtctgcacccacgccggcggagttgtagaaatctactacggccagccactcaatgagcgcgcctggcagcttgaatccgcatctaccatggtcaccgccaccggcccatccacccttggaccaggaaagcgtctctacggactgcttccaaccaacgaactcggctgggttgatgagcgtctcgttggcgacgccctcaagccacgcatgtccgcacagctcacccgcgtgatcggc

SEQ ID NO: 2838 - DNA, 942 bp, Corynebacterium glutamicum
atggcgcttgaaccacaaataaagtctgcaccgacgccggtgatcttaattgtcgaaccctacggcgggtccatccggcaacaaaaccccaacctaccaatggttttttgggacgatgcagccttaacccgaggcgatggcatctttgaaacactcctcatccgcgacggacatgcctgcaacgtgcgccgacacggagaacgcttcaaagcatcggcagcactattgggactgccagagccgatcctggaagactgggaaaaagccacccaaatgggcatcgaatcctggtactcccaccccaacgcaggcgaggcctcatgcacctggacgctcagccgaggtcgttcctccacggggctggcctcaggatggttaaccatcaccccagtctcctccgacaaactggcgcaacgtgaacacggtgtatcggtcatgaccagttcaagaggatattccatcgacaccggcctccccggaatcggaaaagccacccgaggcgagctatctaaagtggaacgaacccccgcaccatggctgacagtcggcgccaaaacactagcctacgcagcaaacatggcagccctgcgctacgccaaatcaaacggattcgacgatgtgatcttcaccgatggcgaccgcgttctagaaggcgccacctccaccgtagtgagtttcaaaggcgacaaaatccgcaccccttcacccggtggcgacattctccccggaaccacccaagcagcactctttgcacacgcaaccgaaaaaggatggcgatgtaaagaaaaagacttaagcattgacgatcttttcggagccgacagcgtgtggctagtgtcctccgtccgcggaccagttcgggtgaccaggctcgatggacacaaattacggaaaccagacaatgaaaaagaaatcaaggcgctgattaccaaagctctgggg

SEQ ID NO: 2839 - DNA, 1101 bp, Corynebacterium glutamicum
gtggctaacgaacaaatcgaggtcgcgaacaacactgatcagattcctgcaggatacaagtcccctcttctttctagaagtggtgcggcagaagcgcagggcgctgctgctcaagcaggtactgaaggtgtcgcgtggcattacggttcccctctcgtcgagcaacgcatcttcgaaactggcacgggcttagttgaccgttctaatcgcaaggtgatcaaagtcgaagggcctgatgcccccacgttcctcaataatattttgtcccaaaaggttgattccgttgaaaacggctttactgccggtgccctggatttggatgcgcagggtcgtattcaacacacaatgcaggtaactgtcgtcgatggggttttctacctcgacacgtccgcggcggagtttgataccctcatcggtttcttgaccaagatgattttctggtcggaagtcaccgtccaggaagccgatctggcgatcatcactctgctcggccaggaaattgcccttccggacgcggtctttgcccgtagggtcgattggaatgggccatcgcgtatcgacgtcgccatccggcgtgaaaacctggaggagggcgtcgacaagctcttagaagctggcgcaaagctcaccggtctcatggcttacacggccgagcgcgtgaaggcgttggagcccgctgcgggcgtggatttggatgataagaccattccccatgaaatcccccattggattggccgtggcgaacatttaggcgctgtgcatttgaccaagggttgctaccgcgggcaggaaactgtcgcgcgcgttgataatcttgggcgttccccgcgcgtgctggttctgcttcatcttgacggttccgcaccgctggatcctgtgactggcgctgaaatcaaggccggtgcgcgcaccgttggtcgtctgggcaccgttgtccatgacgccgattacgggccgatcgctctcgggctggttaagcgcagcgctttggataaagaacttcacatcgatgatgtctctgtaaacgtcgaccgcgatctgcttcctgcggaggaaagtgaacaacgcggacgcgcagcgatcaataagctcaagggtctt

SEQ ID NO: 2840 - DNA, 213 bp, Corynebacterium glutamicum
atgggtcgcggtcgcgcgaaggcaaaacagaccaaagttgctcgccagttgaagtacagctctccagacatggatctcgattcgctgcagcgggagctggctaaccagtctcctaggcgttcctactccgatacccctgatgatgaggaccagtacgcagagtatgcggactgggatgaggacgacaccgacaatcgtgcctacggcacaaac

SEQ ID NO: 2841 - DNA, 1074 bp, Corynebacterium glutamicum
atgagtgatcaccaggacaccaccgccgaaggcgtttcatacgcagcagcaggagtcgacatcgaagccggcgatcgtgccgtcgaactctttgcaccaatggccaagcgcgccacccgcccagaggttcttggcaacctcggaggcttcgcaggactctttgagctcggaaaatacaagaagccaatcctcgcagcaggatctgacggagtcggcaccaagcttgtcatcgcccagatgatggacaagcacgacaccatcggcatcgaccttgttgcaatgtgtgtggatgacctcgttgtcaccggcgcagagccactgttcctccaggactacatcgccatcggcaaggttgtcccagagcacgttgctgagatcgtctccggtatcgcagaaggctgtgtccaggcaggctgtgctctgctcggtggcgaaaccgcagaacacccaggtgttatggaaccagaccactacgatgtctccgcaactgcagtcggcgttgtcgaagcagatgaactgctaggaccagaccgcgtccgcgcaggcgacgtcctcatcggcatggcttcctccggtctgcactccaacggttactccctggctcgccacgtcctcctggaaaaggcaggcctggcgcttgacggacacatcgaagaactcggacgcaccctcggtgaagaacttctcgagccaacccgcatctacgccaaggactgcctggcactgatcgcagagtgcgaagttcacaccttctgccacgtcaccggcggcggcctcgcaggcaacctcgagcgggttgtcccagaagggctcgtcgcagaaatgtcccgagcaacttggaccccaggccaaatcttccgcaccatctcctctgtgggcaaggtttcccgcgaagaaatggaaaagaccttcaacatgggtgtcggcatggttgcagtcgttgctgaaaaggaccgcgaccgcgccctggcaatgctcaccgcacgtcacattgactgctgggaaatcggaaccgtacgcaacggtgaagagggagagcctcgcgtgatcctcaacggcgagcaccctggctac

SEQ ID NO: 2842 - DNA, 1482 bp, Corynebacterium glutamicum
atgacccaggtaaaccacccgtacgatgatctcaacgaacaggcaccgcaggaagaatgcggcgttttcggcgtttgggcgccaggtgaggaagtctcgaaacttacctactttggcctcttcgcacttcagcaccgtggtcaagaagccgcgggcatcgcagtaggcgatggcgaacagatcctggttttcaaagatttgggcctagtctcccaagttttcgacgaaccaattctggaatccctccgcggaaacatcgccatcggacacacccgatacaccaccgccggcggaaacacctgggaaaatgcccagcctatgttccgcatggcaccagatggcaccgatatcgcccttggacacaacggcaacctgattaattacatcgagttgttggacaaagccaccgaacttggcctcgtcgatcccgccaagaagccatcagataccgatgtgctcactggactgctcgcaagcggcgtccatgacggaaataatctctttgattccgccaaggaactcctccccagcgtcaagggagcctactgcctcaccttcaccgacggacacaccctgtacgcagcgcgtgatccattcggcatccgcccactgtccatcggccgcctcgagcgcggctgggtagtcgcatctgaaaccgcagcgctcgacatcgtaggtgcctcgcatgtgcgcgaggtcgaaccaggcgaactgattgctatcgacgaatccggcctcaagtccgcacgattcgccgagacaacccgcaaaggttgcgtcttcgaatacgtttacctggctcgtccagactccgtgatcaagggaagaaacgtcaacgaagcccgacttgaaatcggccgcaagctcgctgcagaagcaccagcagtcggcgatctagtcatcccaaccccagaatcaggcaccccagcagcagttggattcgcccaagcatctggcatcccattcggccaaggcatggtcaaaaacgcctacgttggccgaaccttcatccagccttccgacactctccgccaactgggaatccgcctcaagctgaacccattgcgcgaggttatcgccggaaagcgccttgtggttgtggatgattccatcgtccgcggtaacacccaacgcgccgtgatccgcatgttgcgcgaagccggtgcagctgaggttcacgtacgcatcgcctcaccacccgtgaaatggccatgcttctacggcatcgattttgccaccccaggcgaactcattgccaacgctgtcaccagtgacaacgaagcagaaatggtagaagcagtccgctccgcaatcggcgcagacaccctcggctacgtctccatcgactccatggttgcagcaaccgagcaaccagccaacgaactctgcatcgcctgcttcgacggcaaataccccatgggtctgccacagggaaacagcaacgcagacctagtccgcaagatgcaagcaaccgcctcaagt

SEQ ID NO: 2843 - DNA, 375 bp, Corynebacterium glutamicum
atgaggattgatccgctggaaacccggcaagccgtattggccgtcaaagactggattgaaggggagggagacgtcgaaaagcctggtcgtgcggcacttgccgccgcaactcgcctgagcgtccgactgctcgcgcaagacgcgccgggaaacagcgtggaggtgcgggtacccccatttgttgcggtgcaatgcatagaggggccaaaacatacacgcggcacaccacccaacgtggtggagaccgacgccaagacctggttacgcttagcaactgggcaaaccacatttgatgcagaatttgaaagcggaaaaattagcgcatcaggtacccgagccaaagagattgcggactggttaccagtggtcaaactt

SEQ ID NO: 2844 - DNA, 1017 bp, Corynebacterium glutamicum
atgtctgataatccgcatgagaatccccgtgagaatccacaccgctccccagaagtcgtccttcgtttcatggctgcccctactgacgttttgatggctggtagccatggcgttggcggtggccgagtcctggaatggatcgataaggctgcttatgcttgtgctacccagtggtctggaacctactgtgtcactgcttatgttggtcacattcacttcactcgccctattccctctggccacatggtcgaggtgcgttcccgcattgcgatgactggccgttcctccatgcacatcgtgaatgaggtgctttctgcggatcctcgcgatggcaactacacccgtgcgtgtgactgcttggttattttcgtggcgaaggacaccgcaactggtcgcgctaccccagttccttcatttacccctaagaatgaagaagagcagcgcgtgttggaagctgctaactcccgcatcgggctgcgcaaggctattgaagcggagatggaaaagcagacgtacaacggaccttctgaggcccctcgtttgattacccgcttcttggctaagccaacagatatcaactggggtggcaaggtccacggtggcactgccatggaatggatcgatgaggcgggtgctgcgtgcaccatggagtggtctggtaaccacaccgttgcggtttatgctggtggtatccgcttctaccagcccattcagatcggtgacctcattgaggtggacgcccgcatgatgcgtaccgataagcgttccatgcagatgtccatccacgtccgtgccggtgatgctcaccgtggccgtgctgagctagaaaccgctattcacgcaacggtgacctacttaggaattgatgtcgacggagagcctttgcctgcaccacagtttgtgcctcgtacccctgaggatatccagttggctgagcatgcaaacatcctgagggatctgcgtgctgattacaccccaatgccgctgttccagcgcagggttccactgcagatcgac

SEQ ID NO: 2845 - DNA, 741 bp, Corynebacterium glutamicum
atggacgcggacccgctgattgaggatgacgttagtggagcagaagtaaaagatagttcggatgaaccgcttctcgcactgacacgttacgtttttgatcgcggtgagcggccagttactcgtggactgttccaccaggttgcggccattttgagtattgtgtcaggttcggtgctctccacgtatgcatggatggaactggtgtggtggcaggcgctaggtgtcatggtgtacgccttggccatgctgggactgtttgctgtctctgcggcgtatcaccgaggaccgtggcgtcgattgcacaccgtggcgtggtggcgcaaagctgatcactccaccatcgcggtgtttatcgcagcaacctatacgccactgtgcttgatcgtcttagagcccggtaccgcagcatggatgttaggtattgcgtgggttggtgccattgccagcgtgatcatgaacatggtgtggatcaatcacccacgatggctcagcgtgctggtctacttggccttgggatggctcattgtgccacttgtccctcaattgtggtctggtgctggccccacagtggtgtggctcctgctggccggaggcatcgtctacagcgttggcgcgttggtgtacggctttaaatggccaggacgcaacgcacgagtgattggctaccacgagcacttccacatcgccacgatcgtcgcagcgattgtccatctggttgcagtgtggatggttgtcgttaac

SEQ ID NO: 2846 - DNA, 186 bp, Corynebacterium glutamicum
atgtcgcggacgatgccgccgacgccggtcgcagcgccctggtgtggctctacgaaggatgggtggttgtgggactccacgcggaaggtcacggcgttgccgtctccgatgtcgaccacaccagcgttctcgccgatgccggcaagaatcttggaagccatttcctcagtggtggtttcaccgaag

SEQ ID NO: 2847 - DNA, 2286 bp, Corynebacterium glutamicum
atgagcacttttgtcaatgacaccgtcgaagacgcaatcaagacccctgagctggatcagccatttgaggctcttggtctgaaagacgacgagtacgcgcgcatcaaggaaatccttggccgccgcccaaccgacgccgagctgaccgtttactccgtcatgtggtcggagcactgctcctacaagtcctccaaggttcacctgcgttacttcggtgaaaccaccactgaggaaatggcttccaagattcttgccggcatcggcgagaacgctggtgtggtcgacatcggagacggcaacgccgtgaccttccgcgtggagtcccacaaccacccatccttcgtagagccacaccagggcgctgcgaccggcgtcggcggcatcgtccgcgacattatggctatgggcgcacgcccaatcgctgtgatggatcagctgcgtttcggtgcactggacaacccagacacccagcgtgtgcttcctggcgttgttgacggcatttcccactacggcaactgcctcggcctgccaaacatcggtggcgaaaccgtcttcgacgattcctacgcaggtaacccactggtcaacgcactgtgcgtgggtaccctcaaggtggaagacctcaagcttgcattcgcatccggcaccggcaacaaggtgatcctgttcggttcccgcaccggccttgatggcatcggtggcgtgtccgtcctgggttccgcatccttcgaagaaggcgaagagcgcaagctcccagctgttcaggttggcgatcctttcgcagagaaggtactcatcgagtgctgcctcgagctgtacaaggctggcgtcgtggtcggtattcaggacctcggtggcggcggacttgcgtgtgcaacctctgagctggcagccgcaggcgacggcggcatgcgcgtcaacctagacaacgtcccactgcgcgcagagaacatgtctgcagctgaaatcctggcttccgagtcccaggagcgcatgtgtgctgttgtcacccctgaaaacgttgagcgtttcctcgagatctgtgcaaagtgggatgtcacctgcgcagaaatcggcgaagttaccgacgagaaggaccgctacgttgtggtccacaacggtgaagttgttatcgacgcacctccatcaaccatcgatgaaggccctgtctacaaccgcccagttgctcgccctgagaaccaggacgaactgcagctcgaaggcgagatcgctcgcccagtcgacgttgaagagatcaaggctgcttggctgaagcttgtcgcttcaccagcacttgcatcccgcgcgtttatcaccgagcagtacgaccgctacgtccgcggcaacaccgttcaggcaaagaacgccaatgctggcgtcttgcgtatcgacgaagagaccaaccgtggcgttgcgatctccgccgacgcatccggccgttacaccaagctcgagccaaacactggcgcgcagcttgcactggctgaggcttaccgcaacgtggtctccaccggtgcacgcccagtggctgtcaccaactgcctgaacttcggttccccagaaaacgctggtgttatgtggcagttcaaggaagcagtccacggtctggcagacggatccaagcttttgggcattccagtgtccggcggtaacgtctccttctacaaccagactggtgacgagcccatcctgccaaccccagtcgtgggtgttttgggagtcttggacaacgtcgagcagagcatcggcaacgtcctcccatccgaggacaacgatctctacctcctgggtgagaccttcgatgagttcggtggctccatctggcagcaggtttctggcgctggcctcaacggtctgccaccagtagttgacctgctcaacgagcagcgtcttgcagacctgttcgtcggttctgatctgtttgctgcatcccacgatctgtctgagggcggccttggccagaccctcgcagagcttgcgatccacgcagacaagggcatggatgttgatctctcccagatccacccatccctgttcacctcactgtttgctgagtccgcttcccgcatcgtggttgcaaccaaccgcggcgaagagttggaaaagcgcgcagcagagctgggtgttccagtgttcaagctgggctgcaccaacgattcagccgtcatcgctgtcaagggcgcagacgttgagttcactgtttccgtggaggaactccgcgaagcatggaccaacactttgcctgaggccttcggtcacgcagttggagctaacgcagtagttgca

SEQ ID NO: 2848 - DNA, 720 bp, Corynebacterium glutamicum
atgttccgggtgcggcatgagaccgacgatgcgaccagtttcattagtgataccggcgatatcgttgacggaaccgttgaagttatcggtgtaacggaacaccacgcggccttcaccctcaagctgggcgatggtctctgcgtctgcctggaagcgaccttcaccgtgctttgcaggaataaggatctgctgacccttttccaaagtgttggtccatgcagtggtgttgttctctacaacgaggtgtgcgtctacacagtgaaagtgcagacccttgttgcgggtcagcgcgcctggaagcaggcgtgcttcggtgaggatctggaagccgttgcaaatgcccaagactggcatacccttaccggcctgctcaatcacggactgcattactggcgccagtgcagagattgcaccggtgcgcaggtaatcgccgtaggagaatccaccgggaacgacaactgcgtcgacgcccttgagatcctcgtcagcgtgccacaggctgattacttctgcacctgcgatgcgagcagcgcgtgctgcatctacatcgtcaagggtgcctgggaaggtaatgacaccgattttggcgctcacttcgcgacctcaactcccaccacatcgaagtcttcgatgacggtgtttgcgaggagggtttcagcaattttctttaggtcagcttcggtgacggaatcatctacctcaagctcgaagcgctttccc

SEQ ID NO: 2849 - DNA, 669 bp, Corynebacterium glutamicum
gtgagcgccaaaatcggtgtcattaccttcccaggcacccttgacgatgtagatgcagcacgcgctgctcgcatcgcaggtgcagaagtaatcagcctgtggcacgctgacgaggatctcaagggcgtcgacgcagttgtcgttcccggtggattctcctacggcgattacctgcgcaccggtgcaatctctgcactggcgccagtaatgcagtccgtgattgagcaggccggtaagggtatgccagtcttgggcatttgcaacggcttccagatcctcaccgaagcacgcctgcttccaggcgcgctgacccgcaacaagggtctgcactttcactgtgtagacgcacacctcgttgtagagaacaacaccactgcatggaccaacactttggaaaagggtcagcagatccttattcctgcaaagcacggtgaaggtcgcttccaggcagacgcagagaccatcgcccagcttgagggtgaaggccgcgtggtgttccgttacaccgataacttcaacggttccgtcaacgatatcgccggtatcactaatgaaactggtcgcatcgtcggtctcatgccgcacccggaacatgccgtcgaaaagctaaccggcccatctattgatggcctggagctgttcctgtccgccgttggcaccatcgcggct

SEQ ID NO: 2850 - DNA, 243 bp, Corynebacterium glutamicum
gtggcccgtgtagttgtcaatgtcatgcctaaggctgagattctggatccccaggggcaggcggtacaccgcgccctcggacgtatcggagtttctggcgtttccgatgtccgtcagggaaagcgcttcgagcttgaggtagatgattccgtcaccgaagctgacctaaagaaaattgctgaaaccctcctcgcaaacaccgtcatcgaagacttcgatgtggtgggagttgaggtcgcgaag

SEQ ID NO: 2851 - DNA, 522 bp, Corynebacterium glutamicum
ttgccactggtcaaacctagccagcccttagatagggagattctcctcgattgcttccactacctcagctgcagatggttccgtccgaggagcaaagcgcttaatcgtattaccttctgcatctaccaggaatttctcaaaattccactcgatttcgctaccatcagttgcctctttgagcaccttgtacagggggtgggcaccctccccattcacctcggttttgctcaagagcgggaaggtgacgtcgtactgattttgcgcgaaagcacacacctcagcgtcggttccaggttcctggccgttgaattgattgcagggcacgccaatgacaaagaagcctcgatcttggtattcctcatacagtttttgaagcccttcatactgtggcgtgagtccgcacttggatgccacgttcacgatgagcaaaaggtggcccgcccaatccgccatggtggtttctgtgccgtcgttgagagttacgctgatgtcatgaatagaagtcataatcgcaaccctagt

SEQ ID NO: 2852 - DNA, 477 bp, Corynebacterium glutamicum
atgacttctattcatgacatcagcgtaactctcaacgacggcacagaaaccaccatggcggattgggcgggccaccttttgctcatcgtgaacgtggcatccaagtgcggactcacgccacagtatgaagggcttcaaaaactgtatgaggaataccaagatcgaggcttctttgtcattggcgtgccctgcaatcaattcaacggccaggaacctggaaccgacgctgaggtgtgtgctttcgcgcaaaatcagtacgacgtcaccttcccgctcttgagcaaaaccgaggtgaatggggagggtgcccaccccctgtacaaggtgctcaaagaggcaactgatggtagcgaaatcgagtggaattttgagaaattcctggtagatgcagaaggtaatacgattaagcgctttgctcctcggacggaaccatctgcagctgaggtagtggaagcaatcgaggagaatctccctatc

SEQ ID NO: 2853 - DNA, 2748 bp, Corynebacterium glutamicum
atgtctcgcatttctgcgcgcactctggcaatcgcacttgccggtgcaaccgcggccagcctggcagttgttccagcagcaacagctaatcctgccggaaccgctcctgtcatcaacgaaatctacggaggcggtggaaacagcggatcgttgttctccaacgacttcattgagctctacaacccaacctcaggggacatttccctcgacggttggagcgttacctactacgcagccaacggtaactccggcggaaccacaaacctgaccggaaacatccctgccaacggttactacctcatccagcaacgcgcaggcagcaacaacaccggcgctctgcctaccccagacgccaccggtaacttggcaatgggtgcctcccaaggatcagttgcactgaccgacaactctggcctaaccgctgaccttgtcggattcggtggcacgtccatgtttgaaggaacagctgctgcacctgagaccagcaacaaattgtctgttcaacgcaaagaagttggcgctgactctgataacaactccgtagacttcgagactggagctccaactccaacgtcctcgggaggatccgctcctgttgacccaggcgagccagaaactccagtaaaccctggggaaacagtctccatcgcacaaatccaaggaaccggtctcgctaccccactcgagggtcagaccgtcaccaccgaaggtattgtcactgccgtttacgcagaaggtggcttcaacggttactacatccagacacctggatctggtactgcaccaaaggttgctggcgacgcatccgacggcatcttcgtctacgtgggaagcaatggttcctacccagagctcggcgcatctgtcaccgtcactggcaaggccaccgaacactacgagatgactcagctaggcaactcctccttcaccgtttcggacaccgcattcgagccagtaaccccactcgaactggacaccgttcctactggcgatgacattcgcgaagcatacgaaggcatgctgctgaagccaaccggcgctcacaccgtgaccaacaactacgcaaccaacaccttcggtgaaattgccctcgccccaggtaacgagcctttgtaccaggccactcaaatggtggcaccgggagccgaagcgattgcgtacgaggcggaaaacgtcgcaaagcaaattacgctggatgacggacgctccggcaactacactcgcggcgactccagcacgcctatggcatggcttgtgcaggacggtggcgagaccatcaagtccatccgcaccggcgaccaggtggaattccaggcaccagtaatcttcgattaccgctacgacctgtggaaattccagccaaccacccctgtcaccggcaacaccgcaagctccgaccttcctatcacctgggatgacacccgcgcggctgagctagcttcaatcaatgacgttgctggcgaattccacatcgcaagcttcaacgtgctcaactacttcacctctctcggcgaagatgaaccaggctgcagcgcatacagggatatcaacaacaccccagtcaccgccaacaactgtaacgtccgtggcgcttacaccgaagaagcactcgaagatcagcagagcaagatcgtcgaagcaatcaaccgccttgacgtcgatgttcttggacttgaagaaatcgaaaacaccgcgaccgtcaccggcgacgtctcccgtcgcgatgacgcactcaataccctcgtcgcagcactcaacgaagcagttggatccgatcgctgggcggccgtcgaatctccagaacaattgggcaccgatgaagactacatccgcgtcgccttcatctacgaccaaaccaccgtcaagcccgtcggcgaatcccgaatcttcgacgacgcagccttcaccggcaccgcacgccagccactcgcacaggaattccagccactcaacgacagcgagaaatccttcgtcggcgtagtcaaccacttcaagtccaagggctctgtcactcgtggagacgccgacaccggcgacggccaaggcaacaacgccaacgttcgcgtcgcacaggcacaggcactcatcgaccacctggaaaaccaggacgactgggcatccaagccaatcttcatcctcggcgacaccaactcctacgccaaggaaaccgcgatgaccaccctttacggcgctggctacaccaacatcgccaccgaattcgacgctggctacagctaccagttctccggccgcattggcagcctcgaccacgcactcggcaacgaagcagccatgaagcacgtcatcgacgccgaggtctgggacatcaacgctgacgaagcaatcgcattcgaatactcccgtcgactcaacaacacctccgacgtattcgagaacaacgtcttccgctcctccgaccacgacccgatcaaggtcggattcaacctcagcgagaccactgagcccaccattccggtagagcccactgatcctgcagaacctaccgatccaactaccccagttaagccaactgatccggtagagaccacggatccatctgagccaaccgaccctgcagaacctactgatccagctgaaccaactgaccctgaggaaacgaagaagccagaggagccgaagaaccctggttcctccaacggaagctcccaatacgccaccattgcagcaatcatcgcagcaatcctaggtgccattgctttggccttccagttcttcccattcaagttc

SEQ ID NO: 2854 - DNA, 276 bp, Corynebacterium glutamicum
gtgttttcagaatgcctatcaccttggggagggtgccttgaggcgcttagaagcgaatctgagagggcactttttgcagaaccggggtttgaaatccggcatttcttgaagcgaccagacaggcgcgacaagattggcgaaaaagtcaaagttttggcacgtgtgtccggtttccagtggttcaaaccagacaggcgtgccaaaagctcgcaagatgtcagatttttgtcacgcctgtctggtctctcccaattgggtgccccgaacctccccaac

SEQ ID NO: 2855 - DNA, 687 bp, Corynebacterium glutamicum
atgtccggccgtcttcttgtttcagtttctagtattttcgaccagacccgatcggcggctgacaggctcatttcagacctgcgagccgacggcatcgaggtctcattacttgtcgcaccccgcatcgatggggactggcgtctcgccaaagacaaagggaccctcgcgtggatggaacaacaacgcgaacgcggccacgaactcatcctcaacggtttcgaccaagcagttcagggacgtcgctcagaattcgccaaccttgaacggcacgaagcacgtcttcgccttaccggtgccattaggcaaatgcagaaaattggcttcgaattccaaatctttgccccacctcgttggagaatgtcagaaggcaccttcgcggtactcccagaatttgatttcaacgtcgccgcctcgaccaggggattacataacctcgacaccggcgaattcttggcgtgtagaaacctctccgtgggtgaaggttttggtgctgcaaaatggtggcgcaagaatgtcatcaaggctgtcactcgtggagcggaaaaaggaaatacagtgcgcttgtccgcatcggcgcgaaatctcaccaaccctaaagtcgcagctgacttccgggaagctgcattagctgccttggatttgggtgctcaggtgcaaacctattctcaggcggccgcacaactggcc

SEQ ID NO: 2856 - DNA, 1338 bp, Corynebacterium glutamicum
atggattcaaacacagaatcttcaagtgttgaggtcaaaaacgaacacattaaagttcaaaagccgccgaagaaggaccgcactcactggctctacattgcggtcattatcgcattgattggcggtattaccctaggcctgatttcaccggagttgggcaaagaattcaagattttgggcaccatgtttgtgtccttgatcaagatgattatcgctccagttattttctgcaccatcgtcatcggaatcggttcagtcaaggcagcggcaacagtcggacgcgctggtggcatcgcccttgcgtacttcatcacgatgtccacattcgcactcgcagttggcctgctagtcggtaacttcatccagccaggtagcggactgaacatctcagttgatgaagaatcttcattcgcatccacagagagcagccctgaaggactcttgggattcatccactcgatcatccctgaaacgttcttctctgcatttactgatggttcggtgctgcaggtactgttcatcgccatcctcgtgggctttgcagctcagtcgatgggtgaaaagggacagcccatccttgatttcgtatcccatctgcagaagctcatcttcaagattttgaactggattctgtggctcgccccagtcggtgcattcggtgcaatggccggcgtcgttggcgaaacaggctttgatgccgttgttcagctcggtattttgatcctcgccttttacgtcacctgcgtgatcttcatctttggcgtgctgggcgccgtactgaaggtgttcaccggcgtgaatatcttcaagctggtcaagtaccttgccaaggaattcctgctgatctttgctacctcatcctctgaatctgccttgccaaacctcatgcgcaagatggaacacatcggtgtggctaaaccaaccgtcggaatcgtggtcccaaccggctattccttcaacttggacggcaccgcaatttacctcaccatggcatctatcttcattgccgacgcgatgaatatgccgatgagcctcggcgagcaggtcggtctgcttgtcttcatgatcatcgcatccaagggcgctgctggtgtctcgggtgccggtattgcaacgttggctgccggattgtcttcacaccgcccagaacttctgcacggcgttgacgtgattgtgggcatcgataaattcatgtctgaagcccgcgcactaaccaacttcgccggaaactccgtggcaacactgctggtcggcaagtggactggcaccgtggacatgaaccaagtccatgacgttttgaatggaaaatctccatttgtggagttagaagaagaccac

SEQ ID NO: 2857 - DNA, 2118 bp, Corynebacterium glutamicum
atgtctgaacgcctaaacgctccgcaagcaccaatccatcccatcacccgaacccaccacggtattgatttcgtagacaactatgaatggctgagggataaagaatcccaagaaaccttggactacctggaggcggagaatgcgttcaccaagcaggagactgaacagctagccacactgcgggacaacatctatgaagagattaagtcacgcgttaaagaaaccgacatgtccatcccagtgcgtgccggaaagcactggtattactctcgcactgaagaaggcaagagctacggctattcctgccgcattccagtgactgaagggtcggatgcatggacccctcctgttatccctgagggtgagccagcgcagggtgaaaccatcatcatggatgccaacgagttggcagaaggccacgaattcttctccatgggtgcatcatctgtcaccacctctggccgctaccttgcgtattccaccgatgtcacgggcgaagagcgctttacgttgcgcatcaaggatctagaaactggcgagctgcttcctgataccctgactggcattttctacggtgctacttgggtgggggaggagtacctcttttaccagcgcgttgatgatgcgtggcgtccagatactgtgtggcgccacaaggtgggtaccccggttgaagaagacgtgttggtgtaccacgagcctgatgaacgttattccacctgggtgggcaccactcgttcagaaaagttcatcctttttggttgcgcctccaagatcacctctgaagtccgcgtgcttcctttcgaccagccagagggcacccctgaggtgctgattccgcgcgcggagggtgtggaatacgacgtcgatcatgcagtcgtagacggctccgatatttggttggtcacacacaacgccgagggcccgaacttttcggtggggtgggctggcgtcgacaagctcaattctttggacgcgctggcgccactcgtcgcgcacaaggatgacgtgcgcattgagggtgtcgatacctaccgcgatttcatcatcctgggctacaggtccggcgcgatcggccaggtcgcgatcatgaagcttatcgacggaaccttcggcgatttccaacagctggaatttgacgaggaaatctacaccgtcgcatcgggcggaaacccagaatgggacgcccccgtcattcgcctttcttacggatcattcaccaccccggcgcagctgtttaactactggattgaatccggcgaacgcacgctgctgaagcagcaggaagtgctcggcggatacaagccgtcagactatgtggcctcccgattgtgggtcactgcgaaagatggcgcgcagattccagtgtccttggtgcaccgcaccgacctggatgtatccaagcccaaccccacgttgctctacggctatggttcctacgaatcatccattgatccaggcttctctatcgcgcgtttgtcactgatggatcgtggcatgatttttgcgattgcccacgttcgtggcggtggcgaaatgggtcgtggctggtacgacaacggcaaaaccaccacgaagaaaaacaccttcaccgacttcattgatgttgccgacgccctcatcgagcagaagatttctgcccctgaaatgctggttgcagaaggcggctcagctggtggcatgctcatgggcgccattgccaacatggccggtgaccgcttcaaggcgatcgaagccaacgtgccattcgtcgatccgctgacctctatgctcatgccggaactgccactgacggttatcgaatgggatgagtggggcgatccactccacgataaggacgtctatgaatacatggcgtcgtatgccccatatgaaaacatcgaggcaaagaactaccccaatatcttggccgtaacatcgctcaacgacacccgagtgttgtacgtcgaaccagccaaatgggtagcgcagcttcgggcgactgcaaccggtggagaattccttctgaaaactgaaatggttgccggacacggcggtgtgtcaggacgctacgaaaagtggcgtgagactgcatttgagtacggctggttgatcaaccaagcaaccggtgtgaccgaa

SEQ ID NO: 2858 - DNA, 624 bp, Corynebacterium glutamicum
atgatccacgtatcccagaagaagttttgggacgagcaatggtgtgcaagaagctcaacatgcttccttttgaatgcgtggttcgtggatacctcactggctctggacttgttgaatacaagcagaccagctccgtgtgtggagttgagctcccagaaggcctcgttgaatcttctcagctgcctgagccaatctttaccccagccaccaaggctgacatcggcgaccacgacatcaatgtctcctttgacgttgttgaagaacgtctcggcgaagctcgtgcgaaccagttgcgcgatgcctctattgctatttacaaggctgctgctgagatcgcccgtgaccgtggcgtcatccttgccgacaccaaatttgagttcggcatcgatgaagatggcaccctcgtgcttggtgatgaagtccttaccccagattcctcccgctactggcctttggaaggctatgaagcaggatctgtgcaaccaagctttgataagcaattcgtgcgcaactggctcaccggccctaaatctggctgggacaaggattccggcttggagccaccagctctgccaggttccgttgttgaggcaacccgcgagcgctacatcgaggcctacgagc

SEQ ID NO: 2859 - DNA, 891 bp, Corynebacterium glutamicum
atgcgtcctgaactctcccagtacaagcacctgtcggcaggcaaggtccgtgagatctacgagatcgacgacaagcacatcctcatggtggcttccgatcgtatctctgcatacgatttcatcctcgataccgaaattccagacaagggtcgagtgctcactgcgatgagccagttcttcttcgacaccatcgattttcctaatcaccttgcaggtcccgctgatgatccacgtatcccagaagaagttttgggacgagcaatggtgtgcaagaagctcaacatgcttccttttgaatgcgtggttcgtggatacctcactggctctggacttgttgaatacaagcagaccagctccgtgtgtggagttgagctcccagaaggcctcgttgaatcttctcagctgcctgagccaatctttaccccagccaccaaggctgacatcggcgaccacgacatcaatgtctcctttgacgttgttgaagaacgtctcggcgaagctcgtgcgaaccagttgcgcgatgcctctattgctatttacaaggctgctgctgagatcgcccgtgaccgtggcgtcatccttgccgacaccaaatttgagttcggcatcgatgaagatggcaccctcgtgcttggtgatgaagtccttaccccagattcctcccgctactggcctttggaaggctatgaagcaggatctgtgcaaccaagctttgataagcaattcgtgcgcaactggctcaccggccctaaatctggctgggacaaggattccggcttggagccaccagctctgccaggttccgttgttgaggcaacccgcgagcgctacatcgaggcctacgagctgatttctggtcagaagttctgccagtggattggttcttgcgtc

SEQ ID NO: 2860 - DNA, 1428 bp, Corynebacterium glutamicum
gtggctgataaaaagaagatcgcaaacgtcctgtcgaaccgttacgcctccgcggaactttctaacctgtggagtgccgaagagaagatcatcatggagcgccagctctggatcgccgtgatgaaagcccagaaagatttgggagttgagatccctgccgaggcaattgaatcctatgaagcagtgatcgaccaggttgatttggcaagcatcgccgatcgtgagcgcgtcacccgccacgatgtgaaggcccgcatcgaagaattcaatgcactggctggccatgagcacatccacaagggcatgacctcccgcgacctcaccgaaaatgttgaacagctgcagatccaccgctcccttgagctggtccgcaacaagggcattgcagttgttgcagctatcggatcccgcgcagcgcagtaccaaagcctggtcatggctggccgttcccacaacgtggcagcgcaggcaactaccttgggcaagcgtttcgcaaccgcagctgatgaaatgctcgtggcacttgagcgcgtcaccgaactgctcaaccgctacccacttcgcggaatcaagggcccaatgggaaccgcccaagacatgcttgacctcatggaaggcgacgaggctcgtctctccgatctggaaacccgcatcgcagcacacctcggctttgatcgcgtcttcgactccgtcggccaggtctacccacgttcccttgacttcgatgcagtatctgctctggttcagcttggctccggcccatcatcgctgtcccacaccattcgtctcatggccggcaccgaaactgttaccgaaggttttaaggaaggccaggtcggttcctctgcaatgcctcacaagatgaacgctcgctcctgtgagcgcgtgggcggcctgcaggttattcttcgcggatacctcaccatggttgctgatctttccggccagcagtggaacgaaggcgatgtcttctgctccgtgatccgccgcgttgcactgccagacgcattcttcgcgattgacggaatgtttgaaactttcctgacagtcctggatgaattcggtgcattccctgccatgatcgagcgcgaacttgagcgttacctgccattcctggcaactacccgtatcctcatggccgctgtccgcgcaggcgttggccgcgaaaccgcacacgaagtaatcaaggaaaacgctgtcgcggttgccctcaacatgcgcgaaaatggcggtgaccaggaccttatccagcgcctcgctgctgatgagcgcctcccaatgagcgaagctgaccttgaggcagcgctggctgaccgccacgccttcatcggtgccgctgagtcccaggtctcccgtgtgctcgaccgcattcaggtgcttgtcgacgcccaccccggcgccgcagactaccgaccaggtgagattctt

SEQ ID NO: 2861 - DNA, 1158 bp, Corynebacterium glutamicum
ttgtctcttatgaagccaagcactagaagcaatgttcagccgtttcgcgtcatgcagatgttggaccgagtccaccgtcgcaggcgcgaaggcaaagacaccttaatgttctgcgctggccagccgtcaactggtgcgccagaagcagtcatcgaagaagcagagatcgctcttcgctcgggtcctttgggatacaccgaggtgattggtgatcgtgagttccgtgaacgcatcgccgattggcactctgctacttatgacgtagacaccaaccctgacaatgttattgtcaccaccggttcttcaggtggattcgtggcatcgtttatcgccaccttggatcacggggattatgtggcaatgcctaccccggggtacccggcatatcgcaatattctggaatctttgggggcgaaggttctgaacctgcgctgtactgcagagactcgtttccagccaaccgctcaaatgttggaggaactgccacacaagccgaaggctgttattgtcaccagcccaggaaacccaacgggcaccatcattgatccggaagagctagagcgcatcgccaagtggtgcgatgacaatgatgctgttcttatctctgatgaggactaccacggcatgagctttggtcgtccgctggcaactgcgcatcagttttccaagaacgccatcgtggtgggtaccttgtccaagtacttctccatgacgggttggcgcgtgggttggatcatcgttccagatgagctggtcacaccgattgaaaacctgcaggcttctctttccttgtgtgctcctgccatcgggcaggctgcgggacgcgcagccttcactttggaggctggggccgaacttgatgcccacgttgaagcgtatcgcgaggcccgggaggtgttcgtcgataagctccctgaaatcgggcttggcactttcgccgacccggatggcggcctgtatttgtgggtcgatgtttctgcatacaccgatgattcagaggaatgggcattgcgtttgctcgatgaagcgggcgtggccgtcgcgccgggtgttgattttgatcctgaggaaggccacaagtggattcgtttgagcctgtgcgcgtcaaaggaagacaccattgaaggtgtgcgcaaaatcggagaattcatcaaaaaa

SEQ ID NO: 2862 - DNA, 1263 bp, Corynebacterium glutamicum
atgcgcattctggtaatcggctcgggcgcccgtgagcacgccctcctccgtggactgtcaactgaccctgcaaccactgaactccacgttgccccaggtaacgctggtcttggatcgatcgcaactgtccaccctggcatcaaggctgatgatccagaggctgtcactgcgttggctaaagaactgaactctgatctggttgttatcggcccagagatccctttggttgcgggtgttgctgatgcacttcgcgcggcgggtatcgctgtgtttggtcctaacaaggacgctgctcgtatcgagggctccaaggctttcgctaaggatgtcatggctgcgcagggtgttcgtactgctcatgctgaggctattactcctggtgcgtcttctgaagatattgatgctgccatcgatcgtttcggcccaacctgggttgtgaaggatgatggtttggctgcgggcaagggtgttgtggttacccccgatcgtgcagcagcacgtgctcacgtagatgcagtgcttgagggcggaaatccagttttgctggagtccttccttgatggccctgaggtttccctgttctgcctggttgatggcgagacggtagttcctctgctgccagcgcaggatcacaagcgtgcgtacgacaacgatgagggcccaaacactggtggcatgggtgcttatgcgccgcttccttggctgcctgaagatggcgtccagcgcattgtcgatgaggtctgcgttcctgttgctcgtgagatggtggcacgtggttgcgcgtactccggtctgctttacgcaggtatcgcatggggtgcagaaggccctgcagtagtggagttcaactgccgcttcggcgatccagaaacccaggctgtactggcactactgaagactcctctagcagtactgctcaacgcagttgctactggaaccttggcagagcagccagcactggagtgggaggatgcttacgccctgactgtggtgttggcttcttacaactacccagaggcacctcgtactggtgatgtcatccgcaacgctgatgcagataacgttcttcacgctggtaccgcactcaatgctgaaggcgagctggtctctgcgggcggtcgtgttcttaacgtgatcggtgtgggtgagaccctggaggctgcacgcgataacgcgtacaccaccatcaaggacattgaacttgagggaagccactaccgcagcgatatcgcattggctgcattagagggtcgtatctcgatc

SEQ ID NO: 2863 - DNA, 414 bp, Corynebacterium glutamicum
gtgcatatggcttctgtattcacgaaaattattaatggcgagctccccggccgatttgtgtatcgttccgagaatgtcgtggcttttctatccatcgaacccctcacctacggccacaccctagtcgtacccgttgcagaagttgaccgctggaccgaccttcctcagaacatctggagcgaagtaaacgaggcctcccagctcatcggaaatgcaatccgcacagcattcgacgcccctcgatgtggttacatcatcgcaggattcgatgttccccacactcacatccacctcttccccaccgacaaaatggccgattacgatttccgcaacgccatggccgcagacgccaccgaccctgcaaaaatggatgaagctgcagagaagatccgcgaagcgctggacggtctggtc

SEQ ID NO: 2864 - DNA, 435 bp, Corynebacterium glutamicum
gtgaccgaaaatgtcggtgcgggaagttttcggtcacctggtttggttttccgcaatcgacccacccagatcgcaaaaacccaccccaaagccaagcaaaggggtgggcttttcttaataaagcaattagaactacaagaactagaccagaccgtccagcgcttcgcggatcttctctgcagcttcatccatttttgcagggtcggtggcgtctgcggccatggcgttgcggaaatcgtaatcggccattttgtcggtggggaagaggtggatgtgagtgtggggaacatcgaatcctgcgatgatgtaaccacatcgaggggcgtcgaatgctgtgcggattgcatttccgatgagctgggaggcctcgtttacttcgctccagatgttctgaggaaggtcggtccagcggtcaacttctgcaacgggtacgac

SEQ ID NO: 2865 - DNA, 753 bp, Corynebacterium glutamicum
gtgacatcacctgaattacaaaacatccttaacaattattggagcggcagggcagaggcttaccacctcaaccaaacccaaagcgagcgtgcacaatttgaacgccccatctgggaaaaggtgtggtcgaaggctttgcctatcgtgtcggaagaagcggtaaaggttctcgatcttggctgtggcgctggttatgtcacccaccttctaagcgattgcggatacgaaacaatcggcgttgatggttctgaggaaatgatcaatcaagctacgcaggagaatggtcttcgcaggtcgacgggtcgggcgactgccatttttcaggtcggggatgcgcatgatcccgagttccgggaaggctcttttgatgcgataaccagccggtatgtgttgtggactctgctggatccccaggcagcgattaatcgttgggtgtctttgctaaaacctggtggggttattgcgtgcgtagatgcggcttggtatccgaagggcattgatgctggcacggaagtagattcagtggatggtccgagtgctttcgtagagacctataccccggaacttttgaggaatcttcccatgtcaacgacctccactggccacaatttcgcagagcttttccacaacgctggcctcaaagaagtcacattgacacccattgaggggctggctgaacttgaccagcgatttggcctctcaccagggcatgagtcgactccgcagttcctattcaggggaattaaatccagt

SEQ ID NO: 2866 - DNA, 1356 bp, Corynebacterium glutamicum
atgcaagcactcttggtgtactacctgtattttgatgttgcagccggtggattaggccttgatcaaacccaagcaacaggactggtcggcgtttatggcgcactgctctacctctgctgttgggcaggcggttgggtcagtgacagagtcctgggcgcagaaaaaaccctgctgggcggtgcgatctcagtaaccatcggacaccttgtgcttgctggcctcggcgggaaaattggtctagccattggccttggatgcatcgcgatcggttcaggatttgtgaaaacagcagccatcaccgtgctgggatccaggcatggtgaacaagaaggagacgcaaaggcagatcccgcattccaactcttctacctaggcatcaacgttggtgcactgctcggaccactcctgaccggttggctctccagcaggtattcctttgaaatgggattcggcgcagccgcagtccttatgatcggcggattgggaatctacgcagcgttgcggaaaccaatgctgcaatcgttcccgctcgaggtgaagaaagcgctgctccgcgcccaaaaccctgcagaaaaacatgtgattagcacggcatttgctgcagtggctgtgctttgcggagtgctgctttatcttctccttacagaaacagtcagcgcagaccaactagctggagctctgcttttagtaacaatcggtgcagcactatggctcattatccagcccttacgacacccacaagtcagctccgaagagaaacgaaaagtgctggcattcatcccgatcttcgtctgctcaaccgcattctgggcagtgcaagcacaaacctacggcgtactagctgtgtactcccaagaacgtgttgaccgcatggttggcgattttgagatcccagcagcctggtcacaatcactcaatccttttttcatcctggcgctgtccatcccgatttccctgtggtttatgcgcggatcacgcgccccaagagtgaaaattggaatcagcattggagtgatcattgcgggaagtgggcttctagttcttattccatttgttggaatgccgctcgcgccagtgtgggtgctgcctttaagtgttttcctcatctcactgggagaacttttcatcggacccggaggaatggctgcgactgcgcaccacgcaccacgaatatttgccacacgattctccgccctgtatttcctcacactcgccatcggcatgtctattgcaggtaatgtgtccaaattttacgaccccaccaaccacacctccgagctccgatacttcgcggtatttggcatttcgatcatcgtcatcggtgtcggttcactgatggtggccaagaaggttgga

SEQ ID NO: 2867 - DNA, 1269 bp, Corynebacterium glutamicum
atggaaaaccccagcttgcgcgagcttgatcaccgaaacatctggcacccgtatgccgcgccgggcgtgcgcaatagactcgtcaccaaaaccgatggagtgtttttgacgctggaagatggcagcaccgtgattgacgcgatgagctcctggtggtcggcaattcatggacacggacacccccgactgaaagctgccgcccaaaaacaaatcgacaccatgagtcacgtcatgtttggcggactaacccacgagcccgccattaagctcacccacaaactcctcaatctcactggaaattcctttgaccacgtcttttattccgattcgggctcggtctcagtggaggtcgccatcaaaatggcactgcaggcctccaaaggacaaggccacccggaacgaacaaaactcctcacctggcggtccggctaccacggagacacattcaccgcgatgagcgtgtgcgacccagaaaatggcatgcatagcctctggaaaggcacactccccgagcagattttcgcccccgccccaccagttcgggggtcatcgccgcaggcgatttccgagtacctgcgcagcatggaattgcttatcgacgagaccgtctccgcaatcatcatcgaaccgatcgtccaaggcgctggaggcatgcgctttcacgatgtcgcactcattgaaggagtcgccacactgtgcaagaagcacgatcgtttcttgatcgtcgatgaaattgccactggtttcggccgcaccggtgaactatttgccacgttaagcaatggcctacaaccagacatcatgtgtgtgggcaaggccctcaccggtggattcatgtccttcgccgctactttatgcacggacaaggtggctcaattaatcagcaccccaaatggcggaggtgcgctgatgcacggccccacttttatggctaatcctctggcctgtgcggtttcgcatgcttcattagaaatcattgagaccggcatgtggcagaaacaggtaaaaagaatcgaagccgaacttatcgcaggcctttccccacttcaacaccttccaggggttgccgatgtccgggttctcggcgcgattggtgtcatcgaaatggaacaaaatgtcaatgtcgaagaagctactcaggctgcattagatcacggtgtgtggatccgcccctttggacgcttgctctatgtcatgcctccatatatcaccacgtcagagcagtgcgcacagatctgcactgcgcttcatgctgcagttaaagggaaa

SEQ ID NO: 2868 - DNA, 672 bp, Corynebacterium glutamicum
atgccatttttatttgtcagcggtaccggaactggggttgggaaaaccttctccacagccgttttggttcgatacttagccgatcaaggacacgatgttctgcccgtaaagctagtccaaaccggtgaacttccaggcgagggagacatctttaacattgaacgcttgactggaattgctggagaggaatttgctcgtttcaaagaccctcttgcgccaaatctggcagcccgacgagagggggtcgagccaatacagtttgatcagattatctcgtggcttcgtggttttgacgacccagatcgcatcattgtggtggagggcgctggtggcctgctggtcagattaggggaagatttcaccctggcagatgttgcctccgctttgaatgcacccttagtgattgtgacaagcaccggattgggaagcctcaacgctgctgaattaagcgttgaggcagcaaaccgccgaggactcacagtgttgggagtcctcggcggttcgatccctcaaaatcctgatctagctacgatgcttaatctcgaagaatttgagagagtcaccggcgtgcccttttggggagctttgccggaagggttgtcacgggtggaggggttcgtcgaaaagcaatcttttccggcccttgatgcctttaagaaaccgccggcaagg

SEQ ID NO: 2869 - DNA, 1455 bp, Corynebacterium glutamicum
atggaaaatccttatgttgctgcgctcgatgacgaaaaccaagaagtcggcgtaaaaaaagaagcagaaaaagaacctgaaataggtcccatcagagctgccggacgagccataccgctgcgcacccgcatcattttgatcgtggtgggtatcgccgggcttggtttgctggtcaacgcgattgctgtctccagcctcatgcgtgaagtttcctatacccgcatggatcaagagctagagacctcgatggggacgtgggcgcataacgttgagctgtttaatttcgatggcgtccgccaagggccacccagcgattattatgtggccaaggtttttcctgatggatccagcatcatcttcaacgatgcacaatcggcacccgatctagctgaaaccaccatcggtactggtccacacactgtggatgctgctagcggttctgcctccaacactccgtggcgtgtgatggcggaaaagaacggtgacattatcaccgtggtgggtaaaagcatggggcgtgaaacaaacctgctgtaccgattggtgatggtgcagatgatcatcggcgcgctgattctggttgctattttgattacttcactcttcctagtcagacgctcgttgcggccgttgagagaagttgaagagaccgccaccaggattgcgggcggtgatttggatcgacgtgtcccgcagtggccaatgaccacagaagtcggacagctgtcgaatgccctcaatatcatgttggagcagctccaagcctcaattctgaccgcccagcaaaaagaagctcagatgcgccgattcgttggcgatgcctcccacgagctccgcacaccactgacctctgtgaagggcttcaccgagctgtattcatcaggtgcaacagatgatgccaactgggtcatgtccaagatcggtggcgaagcccaacgcatgagtgtgcttgtggaagacctcctgtcactgacgcgtgccgaaggccagcaaatggagaagcaccgcgttgacgtgctggaactcgccttggcagtacgcggatccatgcgagcagcctggccagatcgcacagtcaatgtatccaacaaagctgagtccattccggttgtcaaaggcgacccaactcgcctccaccaagtgcttaccaacctggttgccaacggactaaaccacggcggaccggacgcggaagtcagcattgagatcaacaccgatggacaaaacgtgaggattctcgtggcagacaacggtgtcggaatgtctgaagaagatgctcagcatatcttcgagcgtttctaccgcgccgattcctcccgctcacgcgcatccggcggatcgggcctcggccttgcgatcacgaaatccctggtcgaaggccacggcggcacagtcaccgtcgacagcgtgcaaggcgaaggcacggtgttcacgatcaccttgccggcggtttct

SEQ ID NO: 2870 - DNA, 705 bp, Corynebacterium glutamicum
atggacaaccagtctgacggacaaatccgcgtactcgtcgttgatgacgagccaaacatcgtcgagctgctcaccgtaagccttaaattccaaggcttcgcagtgatgaccgccaacgatggcaatgaagccctgaagattgctcgtgagttccgtccagacgcatacatcctcgatgtcatgatgccaggaatggacggcttcgagctgctgaccaagctgcgcggcgaaggccttgacagcccagttctgtacctcaccgcaaaggatgccgtggagcaccgcatccacggcctgaccatcggcgctgacgactacgtgaccaagcctttctccctggaagaagtaatcacccgcctgcgcgtgattcttcgtcgcggtggagcagttgaagaagacacctcaacttccctgcagtacgcagacctcaccctcaacgatgaaacccacgaggtcaccaaggctggcgaactgatcgatctttccccaactgaattcaacctcctgcgctacctcatgctcaacgctgaagtggtgctgtccaaggcaaagatcctggataacgtgtggcactacgattttggtggcgacggcaacgtcgtggaatcctacatctcctacctgcgccgcaaggtggacacccaggatccgcagctaattcagactgttcgtggcgttggatatgttctgcgcaccccacgtagc

SEQ ID NO: 2871 - DNA, 753 bp, Corynebacterium glutamicum
atgacagatcgaaccattggcgaggctgctgaactactcggtgtcaccacccgcacactgcggcattgggacagcatcgggttgcttcaaccgagctggcgaaccacaacggattatcgcctttacacagaagacgatgtcgagcgcgccctgcagattcttatttacagggccgccggaatcgggttgaaggatattgcggaggtgcttgatcagccggattcggccaatcagcacctgcgccgccagcgggaactcctagtggaacagatcggtcagctgcatcggatggtccgggcagtagatgaaatccttggaaaggatgcgattagcgtgaaggaaaagattgagatcttcggcgaggatctgcccaagtaccaagaggaggctttccagcgctggggcgacaccccggagtggaaagaatcccaaaagatccaggagaagatgaccaaggaggattttcagagggcgaaagatgaacatgaggggttcgtcgaaaagcttatcgacgcctccctgcgcggcatcgcgcccggctctgcagagggcaatgagctagcgcttgcgcaccgcgcaagcatcggtcagtggtacaccgtgagtgcaaacaagcaagtaattttggctcggatgtacgtggaagacgagcgttttaacgaaacttacaaaggacacgcctcatatcttttaacacttattgaagcattggcgcaggtagaaggcgtggacttggagaatgtggagtgggaa

SEQ ID NO: 2872 - DNA, 1140 bp, Corynebacterium glutamicum
gtgggaacaggtcatgggattcagcaaggcggccacccgaaccgtctttggtggaggagtaggagcgatgatcgatctggcccgttcgaacataaggaatattcctactccatgatgattgatacacctgctgttctcattgaccgcgagcgcttaactgccaacatttccaggatggcagctcacgccggtgcccatgagattgccctgcgtccgcatgtgaaaacgcacaaaatcattgaaattgcgcagatgcaggtcgacgccggtgcccgagggatcacctgcgcaaccattggcgaggcggaaatttttgccggcgcaggttttacggacatctttattgcatatccgctgtatctaaccgatcatgcagtgcaacgcctgaacgcgatccccggagaaatttccattggcgtggattcggtagagatggcacaggcgacggcgggtttgcgggaagatatcaaggctctgattgaagtggattcgggacatcgtagaagtggagtcacggcgactgcttcagaattgagtcagatccgcgaggcgctgggcagcaggtatgcaggagtgtttacttttcctgggcattcttatggcccgggaaatggtgagcaggcagcagctgatgagcttcaggctctaaacaacagcgtccagcgacttgctggcggcctgacttctggcggttcctcgccgtctgcgcagtttacagacgcaatcgatgagatgcgaccaggcgtgtatgtgtttaacgattcccagcagatcacctcgggagcatgcactgagaagcaggtggcaatgacggtgctgtctactgtggtcagccgaaatgtgtcagatcgtcggatcattttggatgcgggatccaaaatcctcagcactgataaaccagcatggattgatggcaatggttttgttctggggaatcctgaagcccgaatctctgctttgtcggagcatcacgcaaccattttctggccagataaagtgctacttccagtaatcggggagcagctcaacatcgtgcccaaccatgcctgcaacgtgattaatttggtggatgaggtctacgttcgggaagccgatggcactttccgtacctggaaggtagttgcccgcggcagaaacaat

SEQ ID NO: 2873 - DNA, 1737 bp, Corynebacterium glutamicum
atggcacacagctacgcagaacaattaattgacactttggaagctcaaggtgtgaagcgaatttatggtttggtgggtgacagccttaatccgatcgtggatgctgtccgccaatcagatattgagtgggtgcacgttcgaaatgaggaagcggcggcgtttgcagccggtgcggaatcgttgatcactggggagctggcagtatgtgctgcttcttgtggtcctggaaacacacacctgattcagggtctttatgattcgcatcgaaatggtgcgaaggtgttggccatcgctagccatattccgagtgcccagattggttcgacgttcttccaggaaacgcatccggagattttgtttaaggaatgctctggttactgcgagatggtgaatggtggtgagcagggtgaacgcattttgcatcacgcgattcagtccaccatggcgggtaaaggtgtgtcggtggtagtgattcctggtgatatcgctaaggaagacgcaggtgacggtacttattccaattccactatttcttctggcactcctgtggtgttcccggatcctactgaggctgcagcgctggtggaggcgattaacaacgctaagtctgtcactttgttctgcggtgcgggcgtgaagaatgctcgcgcgcaggtgttggagttggcggagaagattaaatcaccgatcgggcatgcgctgggtggtaagcagtacatccagcatgagaatccgtttgaggtcggcatgtctggcctgcttggttacggcgcctgcgtggatgcgtccaatgaggcggatctgctgattctattgggtacggatttcccttattctgatttccttcctaaagacaacgttgcccaggtggatatcaacggtgcgcacattggtcgacgtaccacggtgaagtatccggtgaccggtgatgttgctgcaacaatcgaaaatattttgcctcatgtgaaggaaaaaacagatcgttccttccttgatcggatgctcaaggcacacgagcgtaagttgagctcggtggtagagacgtacacacataacgtcgagaagcatgtgcctattcaccctgaatacgttgcctctattttgaacgagctggcggataaggatgcggtgtttactgtggataccggcatgtgcaatgtgtggcatgcgaggtacatcgagaatccggagggaacgcgcgactttgtgggttcattccgccacggcacgatggctaatgcgttgcctcatgcgattggtgcgcaaagtgttgatcgaaaccgccaggtgatcgcgatgtgtggcgatggtggtttgggcatgctgctgggtgagcttctgaccgttaagctgcaccaacttccgctgaaggctgtggtgtttaacaacagttctttgggcatggtgaagttggagatgctcgtggagggacagccagaatttggtactgaccatgaggaagtgaatttcgcagagattgcggcggctgcgggtatcaaatcggtacgcatcaccgatccgaagaaagttcgcgagcagctagctgaggcattggcatatcctggacctgtactgatcgatatcgtcacggatcctaatgcgctgtcgatcccaccaaccatcacgtgggaacaggtcatgggattcagcaaggcggccacccgaaccgtctttggtggaggagtaggagcgatgatcgatctggcccgttcgaacataaggaatattcctactcca

SEQ ID NO: 2874 - DNA, 1482 bp, Corynebacterium glutamicum
atgacttcagaaaccttacaggcgcaagcgcctacgaaaacccaacgttgggctttcctcgccgttatcagcggtggtctctttctgatcggtgtagacaactcgattctctacaccgcactccctctgctgcgtgaacagctcgcagccaccgaaacccaagcgttgtggatcatcaacgcatatcccctgctcatggcgggccttcttttgggtaccggcactttgggtgacaaaatcggccaccgccggatgttcctcatgggcttgagcattttcggaatcgcttcacttggtgctgcgtttgctccaactgcgtgggctcttgttgctgcgagagctttccttggcatcggtgcggcaacgatgatgcctgcaaccttggctctgatccgcattacgtttgaggatgagcgtgagcgcaacactgcaattggtatttggggttccgtggcaattcttggcgctgcggcaggcccgatcattggtggtgcgctgttggaattcttctggtggggttcggttttcctcattaacgttccggtggctgttatcgcgttgatcgctacgctttttgtggcgccggccaatatcgcgaatccgtctaagcattgggatttcttgtcgtcgttctatgcgctgctcacacttgctgggttgatcatcacgatcaaggaatctgtgaatactgcacgccatatgcctcttcttttgggtgcagtcatcatgttgatcattggtgcggtgttgtttagcagtcgtcagaagaagatcgaggagccacttctagatctgtcgttgttccgtaatcgccttttcttaggcggtgtggttgctgcgggcatggcgatgtttactgtgtccggtttggaaatgactacctcgcagcgtttccagttgtctgtgggtttcactccacttgaggctggtttgctcatgatcccagctgcattgggtagcttcccgatgtctattatcggtggtgcaaacctgcatcgttggggcttcaaaccgctgatcagtggtggttttgctgccactgccgttggcatcgccctgtgtatttggggcgcgactcatactgatggtttgccgtttttcatcgcgggtctattcttcatgggcgcgggtgctggttcggtaatgtctgtgtcttccactgcgattatcggttccgcgccggtgcgtaaggctggcatggcgtcgtcgatcgaagaggtctcttatgagttcggcacgctgttgtctgtcgcgattttgggtagcttgttcccattcttctactcgctgcatgccccggcagaggttgcggataacttctcggcgggtgttcaccacgcgattgatggcgatgcggcgcgtgcatctttggacaccgcatacattaacgtgttgatcattgccctagtatgcgcagtagcggctgctctgatcagcagttaccttttccgcggaaatccgaagggagccaataatgcgcac

SEQ ID NO: 2875 - DNA, 531 bp, Corynebacterium glutamicum
atgcgcactagtaaaaaagagatgattctgcgcacggccatcgattatatcggcgagtacagcctcgagacgctgagttacgattcgctcgccgaggcgaccggtctgtccaagtcgggcttgatttatcatttccccagccgccatgcgctgcttttaggcatgcacgagttgcttgccgacgactgggacaaggaattgcgcgacataacccgcgacccagaggatccacttgagcgattgcgcgccgtcgtggttacgcttgctgaaaacgtttcgcgccccgagctgcttttgcttatcgacgccccctcccacccggatttccttaacgcctggcgcactgtaaatcatcaatggatccccgacaccgatgatctggaaaacgatgcccacaaacgcgccgtctacctggtgcagctcgcagccgatggcctcttcgtgcacgattacattcatgatgatgtcctcagcaagtccaagcgccaagccatgctggaaacaattctcgagctgataccaagccagact

SEQ ID NO: 2876 - DNA, 1320 bp, Corynebacterium glutamicum
atgactgttcaggaattcgaccgcgcgaccaaacccacaccaaaacccccaattgtttcttgggcgttttgggattggggttccgcctctttcaacgcggtcctcgtgacctttattttctcggtctatctcactgattcagtcggcgccaccctccccgagggttccaacgccacatcactgtattcgatggcggtcgccatcgctggcgtcattgttgcggttgttgccccagtcatgggcaggcgatcagatatcaagggcactcgccgcaggtcactgcgcatgtggacacttgtcaccgtgttcttgatgttttgtctctttacagtaaagaacactgatcccacatttttctggtttggtgtagccatcatggcgatcgccaacatcacctttgagttcgctgaagttcagtactatgcgcagctctcccaaatctcgacccgcgaaaacgtgggccgagtttctggtttcggctggtccatgggttacttcggtggcatcgttctactgcttgtttgttacctaggttttgttgccggtgatggcgatacccgcggattcctaaacctgcccatcgaagacggcatgaatatccgcctcgtcgcagtgcttgcagccgtttggttcttggtctctgcgattccggcacttcttcgagtcccagaaattgaggcacaggtagctgccgaagaccaccccaaaggcctcatagctgcctacaaggatctctttgggcagatcgctgagctgtggaaacaagaccgcaactccgtgtatttcctcatcgcagcagctgttttccgtgacggactcgccggagtatttaccttcggtgccatccttgcggtctctgtgtacggactatctgccggtgatgtcctcctcttcggtgtcgcagccaacgtggtctctgcgttgggagcactcctcggaggattcctagacgatcgcgtcgggccaaaacccatcatcttgatttctcttgccatcatgatcgccgatgctgcaattctcttcttcgttgaaggccccactaatttctggatcttcggattaatcctctgtgcgtttgtgggacctgcacagtcagcgtcgagaagctatttaacacgtctttccccagatggccaggaaggccagctcttcggcctttatgccactaccggccgtgccgtgagttggatggtgccgtcgctgtttggtgtatttgtggggctcaccggcgatgaccgcactggtattttggccatcgcgctgattctgctattcggtattgtgctgctgagcatggtgaagccaccgcacaaggtgaag

SEQ ID NO: 2877 - DNA, 2142 bp, Corynebacterium glutamicum
ttgaaaaagcatgtgacctcagccgttaccgccgtggtgacggctttttcaacggctgcgcttggtttaagtattgccgtttctcctgctgttgcccaagtggctaatccagctccagatctttctgcgccgtatacatgggtggaagagtttgattccgaggatgctctcaaagggtggaacattttccgccagccagattatggcagcgacaaagttctctataccgaagatgctttaagtatcgaagatggcaagctcaccatcaccactcagcgccactgcgttgacgaagacttcgcgatcagtgatcctgtcaaccgcggaaagctcaatgacagcaccgcgcaagttgaaccttgtgctccaggtcagtttgaaaagttcaccagtgcgcgcatcgtcactccgaaaattgctcgtggagagttcgacctttctgtcactgcaactcttaacaccggtggcgtcgaaggtgtccgaagtgccatttggatgcaaaacggtgaacaggcgtgttcctcagcaaccaacaatggcctctacggagaactagacctggtagagcacttttcttacgatcttcgctcgccatggtctccatcaaacacccacttgggttgtgatcctgaaagtgtcaacggcaccaaccgtgcacctcgtgaacttaaactagatgagtcactcgatggcgtggagcacacctggactgtgagcaccacccgcgacggcgttgagtacttcattgatgatgaggcgattaaccgccagtcatggcgcaacgatgtcactttggggcatgccgaaattgatgatttcgggatctccgcgcagacgtttgatgagatcgtcgaccgcgaatggactctcactcttaatcaaaaggtagaaagcgccgactgggcaaaaccacgttcctctgaggaagatttcccagtccggtccatggtgattgaccgcatcgaggtcaccggatctcccgcagtatctgaagacacccccatgccagataccacccagcttttgacccaagacactctggaatacctcggtcgcatgccagtgctggaacgctacgagccagcaagtgctgattttgccgatggccgcaggccttcctggaactacttcaatttgaaggaatcgtggcagaatccagaactcgagcaacgcccagaagctgtcgaattcgttgatggacgcatggatatcgtgacccgtcgccactgtctggccaccactgatgacatcgccactccggaaaacgcacaggaggaaccgtgcgcgccgggtgaggtgacacgctacagctcagcgcgtgtccaccttccagagatccccgccggcaacttccggctcaccgtgcgcgcacgggcgcagtccgaagagcttgtcgacggcgtccgccccgctatctggatgcagaacaataccaacttctgtgctgacaacgatggacgcccttatggtgaactggatattactgagttctacagctctcgtgtgaacacccagtactcggcagtacaccttggatgtgctggcaaccgcccagagatgaagcttcgccaaatggaaatggaagagtccatgtttggggattggcatgactggggcgtcgaagtcttcgacggccagatcgtattcaccattgacggcaaggcagtaacttcctctggcaaagatgtctttggcaactctgttaccccagccgctgcacctcttcgccccgcgcacttcaagttgtcggaagaggaataccgtgaagtcatcgggcagccttggcaccttattttgaacaccatggtggagcagtctggcaaagacagctggattacagcggtcgacaataacgaggcgttcccagaacaccgcttccaaattgaccatgtggcagtagatatcgagtctgactctgtggacaatgtatggcctgacgctgcgaatgaaatcccagacaatgttggtattgaagactctgatgatggcagcgacctggaggttggttcgaccggaagctctacagctgagaccgtgagctggatctcgttgttcaccgcgttgagctcgctggtcttcacactggctctcaatcaagaagcattgcagaatttgattaatcagttcatgagacagttcaag

SEQ ID NO: 2878 - DNA, 960 bp, Corynebacterium glutamicum
gtgaacaagggcgtggtgctggcagcaggtggattctcccagaatccagaactgcgcaagaagtacatgccagaacccaccccacagttctcccgcaccaacgaaagcgccaccggcgacaccatggcccttgctgcgaaagtgggagcacgcctaggcgacgacaacggtgaaaacgcactgtggttcccatcgtccatcggcacccgcgccgacggatccaccgcggtgtacccacacatttgggaccgtggccgcctcggagtcatcgcagtcaacgcagcaggcgagcgtttcgtcgatgaatccgtctcctaccaccgcttcgtgcgcgccatgtacgaatccaacaaaaccaccccgactgtttcagcctggctcattgttgattcccacaccctggcaaaatacggcctcggcatgatcaccatgccacacctgcctaaactcgctctgcaaaaatacatcgactccggatacctgcacgcaggatcatccttggatgaattggcacgcagcattggtgtggacgctcgcggcctggaacaaaccgtcaaacgctacaataccttcgctaaaacgggtatcgacgaagacttccacaagggcgaactcctcttcggtcaagccgccggcgatccagacaacaagccaaaccccaacgtcggaccaatcaagaagggaccgttctacgcaatcgctgtagtcccaacccctctggccactgcctttggcatcagcatcaaccccaacggacaggttgttagtgaagatggggagcccatcattggactgtactccgcaggaaatgatgcccaatctgtcatggcttctgaatatcctggtgctggttcacaggttggttccggaatgacctttggttggatcgcagcacagcacgcggtggggaaagcgggaaaatccggaggagctaaggcaggatatgccgcgtcttctaag

SEQ ID NO: 2879 - DNA, 705 bp, Corynebacterium glutamicum
gtggagattcgttggttggaaggctttatcgcggtcgcggaagaattgcactttagtaatgctgcgattcgtttggggatgccgcaatcgccgttgagtcagttgatccggcggttggagtcggagttggggcagaagctttttgatcgcagtacccggtcggtggagttaactgccgcgggtcgggcgtttttgccacatgccagggggattgtggcgagcgctgcggtggcgagggaagctgtgaatgctgccgagggggagatcgttggtgttgttcgcattggtttttctggtgtgctgaactattccacgctgccgcttttgaccagtgaggtgcataaacggcttcctaatgtggagttggagctcgttggtcagaagttgacgagggaagcggtaagtttgctgcgcttgggggcgttggatattacgttgatgggtttgcccattgaggatccagagattgagactcggctgattagtttggaagagttttgcgtggtgttgccgaaggatcatcgtcttgcgggggaaggagtggtggatttggtggatctggctaaagatgggtttgtgacgacgccggagtttgcggggtctgtgtttaggaattccacctttcagttgtgtgctgaggctggttttgtgccgaggatcagccagcaagttaatgatccttacatggcgctgttgttggcgcgg

SEQ ID NO: 2880 - DNA, 813 bp, Corynebacterium glutamicum
atgatgattcagggacatctctttcatcaggaccgaaagcgaacgtttcgtattgttgagccttttggttccaccacggatgcgctgatctattttcatggctcccagcagtcaggatctgtggggcgcagcttcaccaacaggacttttgatccgttgccgttcatggtggtttatccggatggggtggatcagcattggaatgatgcgcggttgggtttggatgaaaatacccgccatttaggcattgatgatgtggggttctttgtaaaactcgccacgcacttgggcaacacgtatggcatcaagaggatctttattgttggctattccaacggtgggcagatggtgttgcggctcatgcatgaggttcccaagatgctcagtggcgctgcaaccattgcatccaacatgccagttgcagagaatacgctgccgcaggtgaaaaccttcaagacacatccggtgccttatttggcgatggctggaactgccgatactttttcaccgtatgagggtggcgatgccggtattggtcgcgaacaccgccgtggcgtgggcatgtccgcctttgattcagctgcctatattgccgcccgaaacggactgaccgaacaccgccacgacgtgattgatgatgtggtgtcgatcgatacctgggatggagaaaatcccgttgagttttggacactcaacgggatcggccacttggtaccaagtgggaaaacttatccagaatttctaggcccctcaaccacatcagtgatagcggctgaggagattgggaagttctttgatggggtcaggcgtcga

SEQ ID NO: 2881 - DNA, 813 bp, Corynebacterium glutamicum
atgggaaagttacttttcgtagacatcggtggcacactgctggattactcaaatgaagttccgcgttcggccgttgacgcgatccgtaaggcacgcgccaaaggacaccgcgtgtacttgagctctggtcgaagcagcgctgaggtgacttctcagttgtgggatatcggagtggatggcctcattggcgcaaatggtggatatgtggaaagcgcacaggagtctgtgttccaccgccgtttgtcgggtgaggagacccgccacattgtggagtggctctacaaccgtggtttggagttttatctcgagtccaacaacggtttgtatgcaagccgtggtttccgtgaggcttctaagccagtgctgtctcgcctttcggagaagaccgacgtgacagtcgatagcatgtacccggatatgttctggggcgcgagccttgatcgtgacgatgtgaacaagatcagttacatcttcaattctcaggaagatttggacgcagcgcgtgaggcgttccctaacctggagcacaccacgtggggtggtcagacgggtgcgttgttcggcacgatcggtgtgtctgtcaacaagaagatcggcgtggatcgcctgctgaagtacctgaacgcagatcgcgcaaacaccattgcgttcggcgacagcgatgaggatctctccctatttgaggcgagcgcttacggcgtcgcgatgggcgaggccaccgaatcgctcaaggctgctgctgacctggtcacggatgctgttgggcaggacggcttgcgcaatgcgtttttaaagcttgagcttatcgacgcc

SEQ ID NO: 2882 - DNA, 459 bp, Corynebacterium glutamicum
ttgaaactaatcgatgacagggagagccagatggcccagggtattagtgctgctgagctacaagcgttaaagctgcgtgctgctgaattgagagcggagggtgctggagggaccggcaccaaagagaaagaacgtgaggcggcagattgtgtctcgttgattgagtcgttggaggggcttgatcgacagatcgcggagttgttgcacagggttgttaaggatgaagcgccacaccttgatcctcaggtgcgagacggcgttccagcgtatgcgcgtgagggcacggttatcgtattttttcaaccagcttcccaacacgattcccgctatggaagcattggttttaatgacgaagcttttctggatgacggagatttctgggccacgagtttcgctgttttggctgttagtgacaagtttgaggcgaagctgagggggcttgtcggtaaggctgcaggg

SEQ ID NO: 2883 - DNA, 399 bp, Corynebacterium glutamicum
atgacaacaaatcaagaaaagtatccaatcagcgatctagttcgcaaccagcgccgaaccctcgacatgaatcaagagcatctagctaaagccatagacaaaacccgattctgggtaatcgacctcgaaaaaggaatatcccggagaaccggtgaaccattcaccgtcgatccaatgatgtgtatgaagcttgcagaggctctcgaccttgatccagtagaggttttaagtgcagcgaaagttcccgaatctgaatggccaaatttttcgaagatcatctcccaaagtgactatgtgaagcatgtagacataacaagactgaccgtccgccagcaagatctagtcatcaatctggtcaacgaatttaaggagcttaatttgaacacgccatatgaaaag

SEQ ID NO: 2884 - DNA, 1503 bp, Corynebacterium glutamicum
ttggactctttttccttgcaaaatgttttccagcggatgttgagttttgcgacccttcgtggccgcatttcaacagttgacgctgcaaaagccgcacctccgccatcgccactagccccgattgatctcactgaccatagtcaagtggccggtgtgatgaatttggctgcgagaattggcgatattttgctttcttcaggtacgtcaaatagtgacaccaaggtacaagttcgagcagtgacctctgcgtacggtttgtactacacgcacgtggatatcacgttgaatacgatcaccatcttcaccaacatcggtgtggagaggaagatgccggtcaacgtgtttcatgttgtaggcaagttggacaccaacttctccaaactgtctgaggttgaccgtttgatccgttccattcaggctggtgcgaccccgcctgaggttgccgagaaaatcctggacgagttggagcaatcccctgcgtcttatggtttccctgttgcgttgcttggctgggcaatgatgggtggtgctgttgctgtgctgttgggtggtggatggcaggtttccctaattgcttttattaccgcgttcacgatcattgccacgacgtcatttttgggaaagaagggtttgcctactttcttccaaaatgttgttggtggttttattgccacgctgcctgcatcgattgcttattctttggcgttgcaatttggtcttgagatcaaaccgagccagatcatcgcatctggaattgttgtgctgttggcaggtttgacactcgtgcaatctctgcaggacggcatcacgggcgctccggtgacagcaagtgcacgatttttcgaaacactcctgtttaccggcggcattgttgctggcgtgggtttgggcattcagctttctgaaatcttgcatgtcatgttgcctgccatggagtccgctgcagcacctaattattcgtctacattcgcccgcattatcgctggtggcgtcaccgcagcggccttcgcagtgggttgttacgcggagtggtcctcggtgattattgcggggcttactgcgctgatgggttctgcgttttattacctcttcgttgtttatttaggccccgtctctgccgctgcgattgctgcaacagcagttggtttcactggtggtttgcttgcccgtcgattcttgattccaccgttgattgtggcgattgccggcatcacaccaatgcttccaggtctagcaatttaccgcggaatgtacgccaccctgaatgatcaaacactcatgggtttcaccaacattgcggttgctttagccactgcttcatcacttgccgctggcgtggttttgggtgagtggattgcccgcaggctacgtcgtccaccacgcttcaacccataccgtgcatttaccaaggcgaatgagttctccttccaggaggaagctgagcagaatcagcgccggcagagaaaacgtccaaagactaatcagagattcggtaataaaagg

SEQ ID NO: 2885 - DNA, 327 bp, Corynebacterium glutamicum
ttgccggccaaaatcacggacactcgtcccaccccagaatcccttcacgctgttgaagaggaaaccgcagccggtgcccgcaggattgttgccacctattctaaggacttcttcgacggcgtcactttgatgtgcatgctcggcgttgaacctcagggcctgcgttacaccaaggtcgcttctgaacacgaggaagctcagccaaagaaggctacaaagcggactcgtaaggcaccagctaagaaggctgctgctaagaaaacgaccaagaagaccactaagaaaactactaaaaagaccaccgcaaagaagaccacaaagaagtct

SEQ ID NO: 2886 - DNA, 1455 bp, Corynebacterium glutamicum
atggatgattccaatagctttgtagttgttgctaaccgtctgccagtggatatgactgtccacccagatggtagctatagcatctcccccagccccggtggccttgtcacggggctttcccccgttctggaacaacatcgtggatgttgggtcggatggcctggaactgtagatgttgcacccgaaccatttcgaacagatacgggtgttttgctgcaccctgttgtcctcactgcaagtgactatgaaggcttctacgagggcttttcaaacgcaacgctgtggcctcttttccacgatctgattgttactccggtgtacaacaccgattggtggcatgcgtttcgggaggtaaacctcaagttcgctgaagccgtgagccaagtggcggcacacggtgccactgtgtgggtgcaggactatcagctgttgctggttcctggcattttgcgccagatgcgccctgatttgaagatcggtttcttcctccacattcccttcccttcccctgatctgttccgtcagctgccgtggcgtgaagagattgttcgaggcatgctgggcgcagatttggtgggattccatttggttcaaaacgcagaaaacttccttgcgttaacccagcaggttgccggcactgccgggtctcatgtgggtcagccggacaccttgcaggtcagtggtgaagcattggtgcgtgagattggcgctcatgttgaaaccgctgacggaaggcgagttagcgtcggggcgttcccgatctcgattgatgttgaaatgtttggggaggcgtcgaaaagcgccgttcttgatcttttaaaaacgctcgacgagccggaaaccgtattcctgggcgttgaccgactggactacaccaagggcattttgcagcgcctgcttgcgtttgaggaactgctggaatccggcgcgttggaggccgacaaagctgtgttgctgcaggtcgcgacgccttcgcgtgagcgcattgatcactatcgtgtgtcgcgttcgcaggtcgaggaagccgtcggccgtatcaatggtcgtttcggtcgcatggggcgtcccgtggtgcattatctacacaggtcattgagcaaaaatgatctccaggtgctgtataccgcagccgatgtcatgctggttacgccttttaaagacggtatgaacttggtggctaaagaattcgtggccaaccaccgcgacggcactggtgctttggtgctgtccgaatttgccggcgcggccactgagctgaccggtgcgtatttatgcaacccatttgatgtggaatccatcaaacggcaaatggtggcagctgtccatgatttgaagcacaatccggaatctgcggcaacgcgaatgaaaacgaacagcgagcaggtctatacccacgacgtcaacgtgtgggctaatagtttcctggattgtttggcacagtcgggagaaaactca

SEQ ID NO: 2887 - DNA, 513 bp, Corynebacterium glutamicum
ttgtttggcacagtcgggagaaaactcatgaaccgcgcacgaatcgcgaccataggcgttcttccgcttgctttactgctggcgtcctgtggttcagacaccgtggaaatgacagattccacctggttggtgaccaatatttacaccgatccagatgagtcgaattcgatcagtaatcttgtcatttcccagcccagcttagattttggcaattcttccctgtctggtttcactggctgtgtgccttttacggggcgtgcggaattcttccaaaatggtgagcaaagctctgttctggatgccgattatgtgaccttgtcttccctggatttcgataaacttcccgatgattgccaaggacaagaactcaaagttcataacgagctggttgatcttctgcctggttcttttgaaatctccaggacttctggttcagaaatcttgctgactagcgatgtcgatgaactcgatcggccagcaatccgcttggtgtcctggatcgcgccgacatct

SEQ ID NO: 2888 - DNA, 768 bp, Corynebacterium glutamicum
atgactttgactattgaggaaatcgccaagaccaaaaagcttttggttgtgtccgattttgatggaaccatcgcaggatttagcaaggacgcttacaacgttcctatcaaccagaaatccctcaaggcggtaaaagacctctcccaacaagcagacactgatgttgtcattttgtcgggacgtcacctggagggattgaagacggttcttgatcttggtcagtacgacatcaccatggtgggttcacacggttctgaggattcctcccgcccgcgtaccctcactcctgaagaggtagctcgcctcgccaagattgaagcagatctggaaaagatcgtcgacggcatcgaaggcgcattcgtggagatcaagcctttccaccgcgtgctgcacttcatccgtgtttccgacaaggacaaagtccaaggaatcctcgcccaagcagcacacgtagactcttccggcctgaaggttactaacggcaagagcatcatcgaatactccatcagctccaccaccaagggcacctggctgaaggaatacgttgaccgcaccgagcccactggtgtgattttcctcggcgatgacaccaccgatgagcacggtttcaaagctttagaaaacgatgatcgtgccctaaccgtcaaggttggcgaaggagacactgcagccaaaacccgcgtcgacgatgttgataatgtgggaattttcctagagaaactcgcctaccaccgcatgcagtatgcggaaagcgtgcgattggggatt

SEQ ID NO: 2889 - DNA, 1074 bp, Corynebacterium glutamicum
atgggtaggaaacaacaatacggaaccctcgcgtccatcgccgcgaaactaggtatctcaaggaccacagtgtccaacgcctacaaccggccggagcaactctccgcagaacttcgccaacgcatcctcgacaccgctgaagatatgggctatctcggccctgatccggtggcccgcagccttcgtacacgcagagcaggcgcaatcggagtgctgcttactgaggacctcacttatgccttcgaagatatggcctccgtggactttcttgccggggtggctcaagctgctggagacacccaactaacgctgattcctgcctcgcccgcgagcagcgttgaccatgtctcggctcaacaattagtcaacaacgctgcagttgacggagtggttatttactccgttgccaagggtgatccacacatcgatgccatccgtgcccgtggtttgcccgcagtcatcgccgaccagcctgcacgcgaagaaggcatgccgtttattgccccaaataaccgcaaagccatcgcccctgcagctcaagcgctaatcgacgccggccaccgcaaaatcggcatcctgtccatccgcctagaccgcgcaaacaacgacggcgaagtcacccgcgagcgcctcgaaaacgcccaataccaggtacaacgcgaccgagtcaggggtgccatggaagtctttatcgaagcgggaatcgatcccggcaccgtgccgatcatggaatgctggatcaacaaccgccaacacaacttcgaagtggccaaagaacttctagaaacacacccagacctcaccgcagtactctgtaccgtcgatgcactggcattcggcgttctggaataccttaaaagcgtaggtaaatcagcgcctgcagatctatccctcactggtttcgatggcacccacatggcactcgcacgggatctcaccaccgtcatccaacccaacaaactcaaagggttcaaagccggcgaaacactgttgaaaatgattgacaaagaatacgtggaaccagaagtggaattggaaacttccttccacccaggttccacggttgcgccaatc

SEQ ID NO: 2890 - DNA, 942 bp, Corynebacterium glutamicum
atgaaaaagcttctttggacactccccatcctcccactggtactagctggctgctcaactggatcagcagattccgcggattccaccaacgctgccggatccaattcccttaaagtggtcacctccacccaggtgtgggctgacgtcgccgaagctgtcgccccagatgtagacattgaagcaattattaccggtggcgacatcgaccctcattccttcgagccttccgctaccgatatggctaaagtttccgaagctgacatcattatcgtcggtggcggcggctatgattcctggctctacggcaccttggaagacgatgatcgcatcatccacgcattggatctctcagagcatgaccacagcgagcatgatgatcacgagcacgaagccgaagaagcccacgaacacgaccacgatgaagagggccacgatcatgacgtcgacaacgagcacgtctggtactccactgaatacgtctctgaggtagctgaagagttcgcagaaaaagtcaccgagcttgatcccgaggcacaggccgatgcaacggctgtgaccaccaagatggacgagctgcacaatcagattcacgatcttccagcagttcgcattgctcagaccgagccgatcgccgatcacattttgtcccactccgacatggtggaatccacccctgagggttaccgcgcaaccacgttgagcgagagcgagccaaccgcagcagatgttgcgtcgttccaggatgcaattaacaacggtgacctcgatgttttgatctacaacccacagtccgcgtcgactgtcgcgaccagcttgaaggatttggcagaagaaaaaggcatcccagttgttgagatctatgagacccctcaaaacaccgagaatttcctcgatgcattcaccaaggcagttgatgatctcaccgctgccactaaccaggtt

SEQ ID NO: 2891 - DNA, 690 bp, Corynebacterium glutamicum
atgctgttgactttcaatgatgctgcggtggatcccctctggaggggcctgaatttagagctccgacagggggaatttcttgcggttttaggccccaacggcgtgggaaaatccacgctcatcggtacgattttgggcacccgaaaactcacccacggttcggttaaaactgatgcccgggtgggttatattccgcaacaacgaattttcgatgtcccgttgcgtgcccgcgatatggtttcgctgtccgcggcgcatggcgtggtttccaaaaggggacccgcgaagggtgacgtcgataagcttcttgcccgcgtgggcgcttccggaatcgccgatcgacgcgtcggcgagctctccggcgggcagcagcagctcgtccgccaagcccaggcccttgccacgcgcccgcaattattgcttgccgacgaacccctcctcagccttgaccccggcgtcgcgcagcgcacggtgtccctatttggtgaattgaaggccgaaggcgtcggcgttgttgtggtcacccacgatgtcaatccactaatgggcctggtagatcgcattttgtacctcgcccccaacggccacaccatcggcacggttggcgatgtcatgcagtccgaaaaactcagcgaactctacaacgcacccgtcacggtggctcgcatcaacgacagaatcgtggtggtt

SEQ ID NO: 2892 - DNA, 555 bp, Corynebacterium glutamicum
gtgctgttcattcacctctaccccggccgaagctccaccgcgttctccctgctcacagggcaaatcgttggtgtttcctcatcatcgctgtggatccttgtggcagtcaccgtgatcgtggttagcgccgtggtgattttctggcgcccgctgcttttcgccagcgccgatccgatcatggcgcaggcctccggagtaaacgtccgattcatcgccgttgccttcgcagttctggttggcctcaccacgtcccagtccgtgcagattgtcggtgcgctgctggtcatggcattgctgatcactcccggcgcggccgctgtggcggtgaccgccaatccagtgaaagccgtggtgctggcagtcatcttcgcggaagtatcggctgtcggtggcctgctattgtcgctagcgcctggtttgccggtgagtgtttttgtcaccaccatctcttttgtgatttacctggtctgccgcctgatcggttggctccgcggccgtggagctcagcgtgacgaagatgcttatcgacgccgccagcacgatcaccaccctcac

SEQ ID NO: 2893 - DNA, 1500 bp, Corynebacterium glutamicum; identical to SEQ ID NO: 796

SEQ ID NO: 2894 - DNA, 201 bp, Corynebacterium glutamicum
gtgcacaaggatatgacattgggtgtgcacaacgtgctgacactttacaaggggaaaccagacaggcgtgacaaaaatctagatttccgccaggttttggcacgcctgtccggtttaggggattggaaaccggacacacgtgacagaacttcgagtttttcgccaatcttgtcacgcctgtctggtttgcctcgagaaggg

SEQ ID NO: 2895 - DNA, 1689 bp, Corynebacterium glutamicum
atgaaacaccaatatgatgtcatcgttgtcggttccggcgctggcggattatcagctgcagtcagtgcagcttacggcggtaagaaagtcgctgtaattgaaaaggcctcagtactcggtggagccaccacctggtccggcggttgggcttggactcctggaaccagccttgcgcgcaaagacggagtagtggaatccaaagaagaattccaaacctacctgcaagcggtagtgggggagtactaccaagaagacaacatctccgccttcttggacgcagcccctgaaatggtcgatttctttgaaaaaaacaccgacctgcagtggacccccggcgcgaaaatcaacgacatctacggcaacctccccggtgctggcactggacaccgctccgttgggccaaaaccattcaacggacgcaaagtacccaagagtgttcttccaaaactgcgccaccagctgtatgaaacctccttcctgggaatgggcatcatggctgggcctgacctgacgaaattcctctctgcttcacagttcgatccacgtggttgggtacatgccgccaggcgcgtcatcgtgcacatgtgggacatggtcgtgcacaaacgcaatatgcagatggtcaacggtgcagcactcaccgctcgactggctacctctgcagacaagctgggcgttgatctcctggtcaatcactccgcagtgtcgttgaattacaaaaacgaccgcgttaccggcgtgaaagtacaaaccccacagggcttggtagatttcgaagccactgccggcgtcgtgctcgccactggtggattccccaacaacgttgacctgcgcaaggaactcttcccacgcaccccatcaggtcaagaacactggaccctcgcgccagcagaaaccaccggcgacggactatccatggctcgggaaatcggtgcaggttttgtcaacgacctgaaatccccagcagcatggtgccctgtttcattggtcccatacttcaacggaaaagtcggcaccttcccccacatcatggaccgcgcaaaaccaggctccatcggtgttgtctccacaggtaagcgattcgtcaatgaagccaacggctactacgactacgttgacgccatgctgaaagcagcccccgaaggcgaaccagttgcatcctggcagatcgccgactccaccttcgtgcgcaaatacccactgggaatggccaagccactacccgtaccactcaccccatacctgcgttctggatacttggtaaagggcaaaaccatcgaggaactagcccaaaaatgtggcattgatcctgcaggtttgcgcgccaccgtcacggaattcaatgaaaacgcgcgccggggcgaagacccagaattcggtcgcggatccacttcattcaacaagtacggtggcgaccccaagatcggccccaacccatcactcgcaccaatcgaaaagggcccgttctacgctgtgaaagttgttccgggttcgtttggcaccttcgatggcatcaaagccgatggaaaatcacgagttctccgcgatgacgacacgatcatcgatggcctctacaccgcaggcaacgatcgtgcctccatcatgggtggtttctacccagcaggtggcatcaaccttggcccagcgctggcattcggatacatcgcgggcaaagaactggctaactcc

SEQ ID NO: 2896 - DNA, 747 bp, Corynebacterium glutamicum
gtgcgcctcgcagctgccactggtttctcctttgtcggtctgcgcgtcatcgcagtaacccccaacgaacgtgtatatgacctttccccaggatccccactgctggctgcaacccaacaagcgttgaaagaaaccgccctgtatgtgctcgacactgaattcctacaggtaaacgcagacaccacccgcgaggcctggcttcccgcactagaagccgccggagcactgggagctaaaaccttcaccatcgccgccggtgatgacaacattgcgcccctgaccgacacgatcggtgccatggttgacgatgcccgtgatttcggagtcaccccagccctagagccaatctcttaccgcagcgtgcattccattccgcaggcagcagcaatcgccagagactccggcggaaaagtcgtggcggacaccttgcacatggccaggttcggagccaccccagaagaactcaccgacgtcaccgatgttctaggagttctccagctttgcgatagccctctgcaacgcccggctgacctcgacggactggttacagaatcccgctccctgcgtctggctcccggcgaaggtgaacaaaacctcctgacctttgtcaacgccctggattctaacgtcccactcagcgtggagacccccaacgatggggaagtagcctctcgtggcgacgccggatggatcaaccacctctacaacaccacccaagctctgttagaaaaaattgaggaagcagtc

SEQ ID NO: 2897 - DNA, 618 bp, Corynebacterium glutamicum
atgggccaatgcacggtagcgctttaccgagagcattcctattacacagcaaccccatggcgaggaacctgggcagccgatggcggtggagtgctcatgactcaagccatccactacatcgatcttttgtactggctgttgggcgaacccgtggaagttttcggctacaccaactccttcaaacacggcgacaacatcgaagtcgaagacagcgccgttgccactgtgcgttttgaatcgggcgcgttggccacaatttcagccaccaccgccgcagagccagcactcggcgcacaagtgcaggtgatgggaacaaagggtgccaccatgacgatcctggaattccctgaaggtaccgacggcaggctcattgttcgcagtgaaaacgacaccgtcgaaaccaccccatcccaccccgcggatctttatcccaatgccgatctttccatcatcaacggtgctttgatcccgtatcacaccgcccagatcgcagactttatcgatgcgctcaacgaaggccgcccaccactgatcaccggccgcgatgccaccagagctctgaaagttctccttggtgtctacgaatcagcagccacccaccagccggtctctttgatc

SEQ ID NO: 2898 - DNA, 435 bp, Corynebacterium glutamicum
atgtctgacaagatctggaaagtcggcatcatcggttgcggtgcaatcagccgaaaccatatcgaagcagttcaggcaatccccggcgcagaagtcagcgcagtctgtgatgtggatggtgcgaaagcatcggaaaccgcagcgaaatatggaatttctcccagtttcacgtctgtcgatgagatcctcgcctccggggtggacattgtcgcagtctgcaccccacatccaacccacgaaacagtggtcctcgccgctgctgccgccggagtgcacgtgctttgtgagaagccaatcgccatcgaactcgattccgcacagcgcatgatcgatgcctgcgagtccgcaggggtccaacttggcgtgctcttccagcgccgcttctggcccgcggctcaaaaaatgaaaaaggagccgtcatgggccaatgcacgg

SEQ ID NO: 2899 - DNA, 855 bp, Corynebacterium glutamicum
atggaacattctcctgaaggcaagcgtggattcttcacctcatcggtgatggcgggttgctcagttggaaacgtcctggctggcttggtatttatcccgttcttgatgctgccggaagaacacctcatgtcatggggctggcgcgtacctttcctgctttccgcactggttttagttgtcgcatacttcgtgcgcacccgactggaggaagcatcaactgagaaggccgaagaggacgcaggcgctccggctttggctgtgctgcgcacccagggcattgatgtcgcacgagttttcctgatcaccttcttcgccgttgttcagaccactttcaacgtttacgcactggcatacgccgccaacgaaatcggcatcgatcgttccttcatggtgatggtgaacaccatcgcgctggggctttccatcggaacgattcctttggccgcgtgggtctctgaccgcattggccgcaagccagtcttgctgttcggggccatcacctgtgcaatcaccacctacttctacttccaggcaatctctgaagctgaccttgtgctgatcttcgcactgtgcttggtcaaccaaggtttgttctactcctgctggaacggcgtgtggaccattttcttcccagaaatgttcgcatcttccgtgcgctacaccggcatggctatgggcaaccagctcggtctgatcatcgttggtttcgcaccaaccatcgccaccgccctgtacgcatggaacggttgggaagctgttgcgggattcatcatcggcgcaatcgcactgtctgccgcagttattttgaccaccaaggaaaccgccttcaccaagcttgaagatctagggaagaaa

SEQ ID NO: 2900 - DNA, 426 bp, Corynebacterium glutamicum
atggaaaccgtgaggaccgcaaccgccgctcctgaaactgcatctttgaagctgcgtgaggcagaaagcccagcaaagtccccaaagaaagccgccttggcgtcacttttgggttcgactctggagtactacgactttgtcatttacggcaccgcctccgcgctgctgttcaatcacctcttcttcccacagggcgacccagtcgtcgcgacgatcggctctctcgcctcattcggtgttgcgtacattgcgcgccccatcggtggtctggtgatgggacatgttggcgataagatcagtcgcaaaaccgccctcatggtgacgttgatgatcatgggtatcgcctccatttccatcggacttctgcccacctacggacagatcggcatttgggcgaccgtgctgttgatgatcgcccgcatcgca

SEQ ID NO: 2901 - DNA, 654 bp, Corynebacterium glutamicum
ttgcctagctcgacggcgcaccgtttggtcgtggaattgacgtcggtgaagttgctggagcgcttttctgacggcaaatatggcatcggcacgcatgcgtgggagacgtttgtgagggcgaatcctttggagcgcatgaggctgcaagctcagaccatcttgagtgatgtgcgtgaagagctggggcaatacgtgtgtttggcggtgccggattttgtggatcgtacgattttgtatgtggagcgtttcgattcgacggatagtcagctgcgtcttttgggcaggcatgcggggcgtttggatttgcacaccacatcattggggttggtgatgttggcgtttgcttcgccgcaaaccattaaggcagtgacgagttcgccgtttaaggattccatttcgggggatattacggatggtgctgctgtagctgcgatgctcccggaaattcgcgcgacggggcattttgtatttgtgggtggtctgattccggagaatacggcggttgcggctccggtttttgatcgaaaaggggttgttcgggcatcagtgggggtagtggcgaggaacgatgaaattgatgtgaatcaggcggtttctgtggtgcttgatgcatgccaaaagctcagcgtaaggctacaaaaagactctctatat

SEQ ID NO: 2902 - DNA, 939 bp, Corynebacterium glutamicum
atggcaggaaatgacagtcgtcgaggcggcttacgcaagaccaataaaaaaggtgcaaccaagggcagtggcggacaggttcgtcgcggtctgaaaggtaaggggcctacccctaaagctgaggatcgcacctatcacgcagctcacaagcgcaaggtggagcgtgatcgtcgtgatcgtggacgccaccagcgtgaaatgccagagttggttgtgggccgtaacccagtgctggaatgtctgcatgcacgcgttccagcgactgctttgtatgttgcagagggtgcggcgaacgatgagcgtctgagcgaggcagtgcacactgcggctggccgaaatcttccagtgctggaggttaacaagctggagctggatcgtatgaccggcaacggcatgcaccagggcatcggcctggcgatccctccttacgagtacgcagatgttcatgatctgatcgccaatgctgcggcttctaagaagccaggcatgttcgtgattctggataacatcaccgacccacgtaacttgggtgctgtgattcgttccgtcggtgctttcggcggcaacggtgtcatcattccggagcgtcgttcagcatctgtgaccgctgttgcatggcgtacttctgctggtaccgcagcgcgtgtgccagtggcgaaggaaaccaacatgactcgtgtcgtgaaggaattccagcaaaacggttaccaggtcgtcggccttgacgctggcggcgaccacactttggacacctacgacggcaccgacaacgttgtcatcgtcgtcggttctgagggcaagggaatttcccgtctcgttcgcgaaaactgcgacaccatcatgtccatacccaccgagggctgggttgaatcgctgaacgcttcggttgctgccggcgtcgtgctgtcggagttctcgcgccagcgtcgcattaagggt

SEQ ID NO: 2903 - DNA, 1380 bp, Corynebacterium glutamicum
gtgactctacgcatctttgacaccggtacccgtacgcttcgagattttaaacctgttcaaccaggtcatgcctcggtgtacctgtgtggtgccaccccgcaatcttcaccccacattggacatgttcgttcagcagtagcgtttgatattttgcgccgctggctcatggctaagggacttgatgtggcatttgttcgcaatgtcactgatatcgatgacaagattctcaccaaggcatctgaaaatggtcgcccttggtgggaatgggtgtccacctatgaacgtgaattcacctggacgtacaacacgttgggtgtgcttcctccatcaacggagcctcgtgcaacaggccacgtcactcagatgattaagtacatgcagcgcttgattgataacggctttgcttacgccgttgatggctctgtgtactttgatgtcgcagcgtggtccaaggctgaaggatctgactatggttctttgtccggaaaccgtgttgaagatatggagcagggcgagcccgataactttggtaagcgggggccacaggactttgctctgtggaaggctgccaaaccgggtgagccgtcatggccaaccccttggggagacggccggccgggttggcatttggaatgctctgccatggccacctactatttgggtgagcaatttgatattcactgtggtggtttggatctgcaatttccacaccatgaaaatgaaattgcccaggcacatgcggctggcgataaatttgccaactactggatgcacaatcactgggtaacaatggccggcgagaaaatgtccaagtctttgggcaatgttttggctgtgccggaaatgctaaagcaggttcgtcctgtcgagcttcgttattaccttgggtctgcccattaccgttccgtccttgagtattccgagagcgctttgagtgaagctgcggtgggttaccgtcgcattgagtctttccttgagcgtgtgggggatgttgaggtaggcgagtggacgccaggttttgaagttgcgatggatgaggatattgcagttcctaaggctttggctgaaatccataacgctgtccgcgagggcaatgctgccttggataagggtgatcgtgaggcagcggagaagcttgcttcctcggttcgtgcgatgactggcgttttgggcttcgaccccgttgaatggggttcagatgcaggcgctgatggcaaggcagataaggcgcttgatgtgctgatttcttcggagcttgagcgtcgtgcaactgctcgtgctgagaagaattgggcggttgctgatgaggttcgagatcgtcttgccgatgctggtattgaggttgtggataccgcagatggcgctacatggaaattgcag

SEQ ID NO: 2904 - DNA, 1983 bp, Corynebacterium glutamicum
atggaccataaggacctcgcgcaacgcatcctgcgcgacattggcggcgaagacaacattgtcgccgccgcacactgtgcaacgcgtttacgcctcgtgctcaaagacaccaaggatgtggatcgccaaagtctggatgatgatccagatctgaaaggcacgtttgaaacgggtggtatgttccagatcatcgtcgggccaggcgatgtggatcatgttttcaaagaactcgatgacgcaacctccaaagacatcgctgtgtccacagagcagctcaaagatgttgtggctaacaacgccaactggttcagccgtgctgtgaaggtattggcggacattttcgtcccgctgattccaatcttggttggtggcggtctgctcatggctatcaacaatgtgttggttgcgcaggatctgttcggtccgcaatcactggtggagatgttccctcagatcagcggtgttgctgagatgatcaacctcatggcatctgcgccgttcgcgttcttgccagtgttggttggtttcaccgcaaccaagcgtttcggcggcaatgagttcctgggcgccggtattggtatggcgatggtgttcccgagcttggtgaacggctacgacgtggccgccaccatggctgcgggcgaaatgccaatgtggtccctgtttggtttagatgttgcccaagccggttaccagggcaccgtgcttcctgtgctggtggtttcttggattctggcaacgatcgagaagttcctgcacaagcgactcaagggcactgcagacttcctgatcactccagtgctgacgttgctgctcaccggattccttacattcatcgccattggcccagcaatgcgctgggtgggcgatgtgctggcacacggtctacagggactttatgatttcggtggtccagtcggcggtctgctcttcggtctggtctactcaccaatcgtcatcactggtctgcaccagtccttcccgccaattgagctggagctgtttaaccagggtggatccttcatcttcgcaacggcatctatggctaatatcgcccagggtgcggcatgtttggcagtgttcttcctggcgaagagtgaaaagctcaagggccttgcaggtgcttcaggtgtctccgctgttcttggtattacggagcctgcgatcttcggtgtgaaccttcgcctgcgctggccgttcttcatcggtatcggtaccgcagctatcggtggcgctttgattgcactctttaatatcaaggcagttgcgttgggcgctgcaggtttcttgggtgttgtttctattgatgctccagatatggtcatgttcttggtgtgtgcagttgttaccttcttcatcgcattcggcgcagcgattgcttatggcctttacttggttcgccgcaacggcagcattgatccagatgcaaccgctgctccagtgcctgcaggaacgaccaaagccgaagcagaagcacccgcagaattttcaaacgattccaccatcatccaggcacctttgaccggtgaagctattgcactgagcagcgtcagcgatgccatgtttgccagcggaaagcttggctcgggcgttgccatcgtcccaaccaaggggcagttagtttctccggtgagtggaaagattgtggtggcattcccatctggccatgctttcgcagttcgcaccaaggctgaggatggttccaatgtggatatcttgatgcacattggtttcgacacagtaaacctcaacggcacgcactttaacccgctgaagaagcagggcgatgaagtcaaagcaggggagctgctgtgtgaattcgatattgatgccattaaggctgcaggttatgaggtaaccacgccgattgttgtttcgaattacaagaaaaccggacctgtaaacacttacggtttgggcgaaattgaagcgggagccaacctgctcaacgtcgcaaagaaagaagcggtgccagcaacacca

SEQ ID NO: 2905 - DNA, 1299 bp, Corynebacterium glutamicum
gtgtgtggggctatgcacacagaactttccagtttgcgccctgcgtaccatgtgactcctccgcagggcaggctcaatgatcccaacggaatgtacgtcgatggcgataccctccacgtctactaccagcacgatccaggtttccccttcgcaccaaagcgcaccggctgggctcacaccaccacgccgttgaccggaccgcagcgattgcagtggacgcacctgcccgacgctctttacccggatgcatcctatgacctggatggatgctattccggtggagccgtatttactgacggcacacttaaacttttctacaccggcaacctaaaaattgacggcaagcgccgcgccacccaaaacctcgtcgaagtcgaggacccaactgggctgatgggcggcattcatcgccgttcgcctaaaaatccgcttatcgacggacccgccagcggtttcacaccccattaccgcgatcccatgatcagccctgatggtgatggttggaaaatggttcttggggcccaacgcgaaaacctcaccggtgcagcggttctataccgctcgacagatcttgaaaactgggaattctccggtgaaatcacctttgacctcagtgatgcacaacctggttctgctcctgatctcgttcccggtggctacatgtgggaatgccccaacctttttacgcttcgcgatgaagaaactggcgaagatctcgacgtgctgattttctgtccacaaggattggaccgaatccacgatgaggttactcactacgcaagctctgaccagtgcggatatgtcgtcggcaagcttgaaggaacgaccttccgcgtcttgcgaggattcagcgagctggatttcggccatgaattctacgcaccgcaggttgcagtaaacggttctgatgcctggctcgtgggctggatggggctgcccgcgcaggatgatcacccaacagttgcacgggaaggatgggtgcactgcctgactgtgccccgcaagcttcatttgcgcaaccacgcgatctatcaagagcttcttctcccagagggggagtcaggggtaatcagatctgtattaggttctgaacctgtccgagtagacatccgaggcaatatttccctcgagtgggatggtgtccgtttgtctgtggatcgtggtggtgatcgtcgcgtagctgaggtaaaacctggcgaattagtgatcgcggacgataatacagccattgagataactgcaggtgatggacaggtttcattcgctttccgggctttcaaaggtgacactattgagaga

SEQ ID NO: 2906 - DNA, 759 bp, Corynebacterium glutamicum
atggacatcatcatctgcaaagacgagcaagaagtcggcaaagcagcggcagccctgatcgcacccttcgcaactaagggcggaaccttggggcttgcaactggatcgtcacctttgagcacctaccaagagctcattcgcatgtatgaagctggggaagtgtcattcaagaactgcaaggcattcttgttggatgaatacgtgggattaacgcgcgacgatgaaaacagctacttcaaaaccattcgtaaagagttcactgaccacatcgacatcgttgatgaagaggtctacagcccagatggtgcaaaccctgatccatacgaagcagctgcagagtatgaggcaaagatcgctgcagaatccgttgatgttcaaatccttggcatcggcggaaacggccacatcgctttcaatgagccatcatcttctctgtcaggactgacaaaggtccaggcgctgcaccctaaaactgtggaggacaacgctcgattcttcaacaccatcgaagaggtcccaacccacgccctcacccagggtttgggcactttgtcccgcgcgcaaaacatcgtgttggtggcaactggtgaaggaaaagccgacgccatccgcggaactgtggaaggcccactgaccgccatgtgcccaggttccatcctgcagatgcacaacaatgccaccatcatcgttgatgaagcagcagcatccaagctggaaaacgctgatcactaccgtctcatggagcaattaaagctgcgc

SEQ ID NO: 2907 - DNA, 1152 bp, Corynebacterium glutamicum
gtgcattatcaagaaaatgcaggtcaagcagttaaaaaaattgaaggaagaattgttaccccccacggggtgattgatggctttctccaactcgaaaacggcatcatcacggaactctctggagaaccagcacctaaaaacgcaggattccaccccgaactccccacgattgttcccagttttattgatcttcataatcacggtggaaacggtggcgcgtttcctacgggaacgcaggaccaggcgaggaatgccgcgcagtatcaccgcgaacatggcacgaccgtgatgttggcaagcatggtttcggcgccggctgacgcactggcagcgcaggtggaaaaccttattcccttgtgtgaagagggcctgctgtgcggcattcacctcgagggtcctttcatcaacgcatgccgttgtggtgctcaaaacccggattttatttttcccggcaacccaacagatcttgcccaggtgatccatgcgggaaaaggttggatcaaatcgatcacagtagcgccggaaactgacaatcttactgagcttctcgatctctgcgcagcgcaccacatcattgcttccttcgggcacactgatgcagattttgataccactaccagcgcaattgccttggctaaagagaaaaatgtgacggtcacggctacgcatttgttcaatgcgatgcctccgctgcatcatagggatcccggcagcgtgggcgctttgcttgctgcggcacgtgccggggacgcatatgttgagttgatcgccgacggcgtgcatttggccgatggaacggtcgatctagctcgttccaacaacgcctttttcatcacggacgccatggaagccgccggaatgccagacggtgagtacattttgggcgttttgaacgtcaccgtcaccgatggcgtcgcccgtctgcgcgatggcggcgccatcgccgggggtaccagcacactagcgagtcagttcgtgcaccacgtgcgcaggggtatgacgcttatcgacgcgaccctccacacctcaaccgtcgccgccaaaattctcggacttagcgatcacgaaatcgttaaatccaaccctgtaaattttgtggtctttgactcaaacggccagttacaacaggtccatttagaccatcaagtaatt

SEQ ID NO: 2908 - DNA, 936 bp, Corynebacterium glutamicum
atggcttccgcaactttcaccggcgtgatcccacccgtaatgaccccactccacgccgacggcagtgtggatgtagaaagcctccgcaagctcgttgaccacctcatcaatggtggcgtcgacggacttttcgcactgggctcctcaggcgaagcggcattcctcacccgcgcccagcgcaaactcgcactgaccaccatcatcgagcacaccgcaggccgcgttcccgtaactgctggtgtcattgaaaccaccactgctcgcgtgattgagctcgtggaagatgccctggaggctggtgccgaaggcctcgttgccactgcacctttctacacccgcacccacgatgtggaaattgaagaacacttccgcaagatccacgccgccgctccagagcttccactgtttgcctacaacatcccagtgtcggtgcactccaacctcaacccagtcatgcttttgacgctggccaaggatggcgttcttgcaggcaccaaggattccagtggcaatgatggcgcaatccgctcactgatcgaagctcgtgatgatgctggactcactgagcagttcaagatcctcaccggcagcgaaaccaccgttgatttcgcctaccttgcgggtgccgatggagttgtcccaggcctgggcaatgttgatcctgcagcatacgcagctttagcaaaactctgcctcgatggaaagtgggcagaagctgctgctttgcagaagcgcatcaaccacctcttccacatcgtcttcgtgggagacacctcccatatgtccggatccagcgctggtttgggcggtttcaagacagcactcgcacaccttggcattattgaatccaatgcgatggcagttcctcaccagagcctcagcgacgaagaaactgctcgcattcacgccattgttgatgaattcctgtacaccgct

SEQ ID NO: 2909 - DNA, 909 bp, Corynebacterium glutamicum
atgactgatcccacttgcacccttgcccttgatattggtgccacaaagattgcctacgcactagtccccgataacaccccgacgacaacattgtccacgggacgcttgggaacaaaagaaggcgacagccctatcgagcagatccggctggttcttctggcaggcttaaaagctgccgaggaacacggtctcagtgtcgcccgcatcggcatgggcgctcctggtgtaattctgggaccagagggaaccatcgtgtacaacggtgaaaccctcacagagtgggcaggcactgacctgcgaggattatcccgagaagtcctcaacgttccattcgcggcacacaatgatgtccgcgtatgggcctacggtgagcaccacttaggcaccggcaaagacctcaccggcagggtactctacgtgtccctcggcactggagtcggcggagcaatcatcgaagacggaatcatgatgagtagccccactggaactgcgggagaattcgcagaagttgtgtgctctgaccatgcaggattagccgttcggtgcgaaaatgtagcaagtggcaccggcctaaccaggtactacaacgaggccgccgcaactcaacttgaccttcccgccatcatggagcgcttccaccaaggtgacggcctggcacagcaaatcattactggaaatctccgaggctttggccaagcgctaggcgcattagtcacagtgctggacctttccgcagtagtagttggaggcggagtcgcaggcatcggcgcacccgtcatggatcccatcaccgcagggattttcgatcgagtgttaacccccaacaaatccgtacaagttttaagcacgtcccttggtgcccaagcagccgtcatcgcagcagcaaaatatgcccgcgataacgccttt

SEQ ID NO: 2910 - DNA, 696 bp, Corynebacterium glutamicum
atggacttaaatactcaacgctcaaagctctacgcacagcttcaaggccagctcattgtttccgtgcaagctcccgacggccatgccatgcgagatacccatacgctcacccatgtggccgcagcctgtgtcgatggcggtgctcctgccattcgctgtggcggttacggcggtttggaagatatccgttcaatctccaaccgtgtcgacgttcccgttttcggactcaccaaagaaggctccgaaggagtttacatcaccccaaccagggattccgttcgagcagtggcagaatccggcgccactgtagtctgcgcggatgcaactttccgacctaggcctgacggctccacctttgcagagctggtcactgttgcccacgattccggaattctcatcatggcggactgcgcaactcccgaagaagttctcagtgcgcataaggctggcgcggattttgtgtccaccacgcttgctggatacaccgaacaccgcgagaaaacagtcggtccagatttcgattgcctccgcgaagcacgtgagttagttcccgatgcgttcctcattggcgaaggtcgcttctccaaccctgcggatgtggcgcacggtcgtctcattggtgccaacgcgatcatcgtgggcaccgcaatcactgaccctggtttcatcactggacagttcgcgtcactgttgcac

SEQ ID NO: 2911 - DNA, 177 bp, Corynebacterium glutamicum
gtgctgggtaggttttggggtcgttgggctcttagaagcgattctggcactgttgtttttggggctactgaggctggtgtgattcctgtgtggttactgggggttagcagggcaaggatccaccacatccctgaggaatcttggaatctgtggtggatcctagcgcttttaggcaga

SEQ ID NO: 2912 - DNA, 1215 bp, Corynebacterium glutamicum
atgcgcactagcctcattgcgcgcgggttgtaccgcattcccgcgctggtctgggatcagggtcttttaacgcttttcgacgcccgcctcagtgttgacgacctccccgcacccatcgacgtggtgtcagcgcgatcctcagacggcatcacctggaccaccccagaaccagcaatcgtcgaaactgaacaccgcggtgtgggcgatgtctgccttgtcacgggcgatctgtgcttccacggattgtccaacctcgcaggattttttgaggatcccaccgaccttgaaccccggctggcgcgccgggatgtgagtgggtggacgtcgataagcatggcccactattttgcggatgttgatgccgcgttcgcctcgtcggggacgggacttgtcctggcggatgggcggtggattcagagttttgtggtgcggcgcgggcgcgagatttcgcttcggattctgcgcagcgatggccacatcaccgatattgccggcggtaacgaatccgcgatgacgcagctgccgagcggtcggattgtgctgcattccaggggggtgggacaccgtctgagcagtgtgtccgatgatttcggggagacattcactccgctggagcctgtgcctgaactaatcgaccccggctgcaacggccacgtgttctactggaaagcggctggaatgctcgccgcaacgcacctggcggaccctgatctgcgacgccacttggtggttgatttatccagcgacgaaggagcgacctgggcgcatcgcatcaccatcgagcgcgaagaagccgcctattcaaccgctgcggaaatgcccaacggagatgttgccgtggtgtgggaagcagagggaacgcgcgcgataaaatgcacggtgatcagcgtaaatgatatttcgctgcggatcgatgagcccatttccgatgccatatccctccgccatgtggtgatcaacgatgaccatgacggcatcgaagtcgcactgcctgacgcatcgcaatggggtgaaggtgtattcaaaattgtgtccaatccagacgcgagcacccaaaaaatccgcactcgaggcaagcccgcgcgacagaccctggaaattggggatgaattggtttttgatatccgcaagggtggagaagtggcttacggcgtcacggttccttatgatggtcgctcgttgggggaagttaaacaggattttggagtggggctg

SEQ ID NO: 2913 - DNA, 729 bp, Corynebacterium glutamicum
gtgaacacaatggaaagctccaaaaagacttcgcgatcaaggtccactactcaagaagcagtgcgcgacattaaaaaatacattcgggacaaccggctgcgtacgggagaccttcttccttccgaagcgttcttatgtgaggaattgggttgttcccgttctgcgatcagggaggcgatccgcgcgctcgtgaccttggacatcgtcgaggttcgccacggctacggcactttcgtgtccaggatgtccctcgagcccctgatcaacgggatggtgttccgcacggtgttggacaatgacacctcggtggaaaaccttttctacgtggtggatacccgcgaaatccttgacctttcacttggcgaagagctgatcgaggtgttcaccgacgatgaccgcgagctactccttgatctggtggacaagatgcgcgagcacaacgatcagggcgaatcctttgtggtggaggatcaaaaattccaccgagcactcctagcgcgaacgaaaaacccgctgattagagagctcaacgatgcgttttggcagatccaaaccgaggcgcagcccatgctcaatctggctatgcccgcagacatcgacgaaaccatcaaagctcacagcgacatcgtcgaagcgctctccagcggcaacatcgacgattatcgcagcgccgtgctcgctcactacgcgccgtttcgccgcatgatttccaacatgctcgatgcgcac

SEQ ID NO: 2914 - DNA, 1608 bp, Corynebacterium glutamicum
atgagcaccacgattactcgccgcaatttcctccgagcaaccggaatcctcggtgtcgcagctggcatcggcgcaacacttgctgcatgtgcaccagacaacaccggcaccagcggatccacctccaccgcagctggcaccggaactgcaaatgaagaaggcaccatcaccgcagccatctcctacgaactgggaaccaacggctacgacccaatgaccaccacctcggctctcactgtggcagccaactggcacacccttgaaggcctcaccgaaatcgacccagccaccggcgaggtctacgcagcactcgccagcgcactgccttcagccgatgcgacctccctagacatcaagcttcgcgacggcgccaccttccacaacggcgacgcagtcaccgcagacgacgtagtcttctcttttgagcgagtcctcgatccagccaacaactccctttacgcatccttcatcccattcatcaagtcagtcaccaagaaggatgacaccaccgtcaccatcgacctcgactacgcaaccggcatcatcagcgaacgcctcgcagtagtaaagatcgtgccaaagtccgtcgtggaagcagacgcatccggattcgacgccaacccaatcggctccggcccatacaagatgaccgacaacggtgcatccaaggtggtcaagttcgagcgcaacgacgactacaacggcccacgcccagcacgtgccgccaagatggaatggcagatcatccccgacgcctccacccgcaccaactcccttcagtccggcagcaccatggccatcgactccgttccatacctgtcgatcccacagcttgaagccaccagcaccgtagaatccgtccaaggattcggcctcctgttcgccatgttcaactgctccgaaggcaaccccttcaacgacgtccgcaaccgccaggcattcctctacgcactggacatggacaagatcgttaagaccggcatgtccgaccaggcaaccccagccacctccttcgtgcagaaggaacaccccaactacaaccaggcatccacggtctactccctcgacgccgacaaagccaaggcgctgttcgctgaaaccggccttaccagcctcaacctcctgtgcaccgaccacgactgggtcaagaactgcaccccactgatccaggaatccctcgcagcccttggcatcaacgtttccttcaccgaacgtaaatccgccgacgtctacaacaccatcgacggcaagccagaagcatacgacgtcgtcatcgccccaggtgacccatccgtcttcggcaacgacccagacctcctcatgcgctggtggtacgccggcgacgtctggaccgactcccgcatgcactggaagggcagcgaatcctacgaccaggtacaaaacctcctggaagaaggcatccgcgctaccgacaaggcagaacagcaagacatctggaaccgcaccttcgatgtcatctccgacaatgttcccctctacccgctgttccaccgcaaggtcccaaccgcatggaactccaacgccctcgtcgacttcaagccaatctcactcaccggcttgaacttctcaggtgttgcaactactgaa

SEQ ID NO: 2915 - DNA, 951 bp, Corynebacterium glutamicum
ttgagacttgtcggccgacggctcatcgctttaccgatcatgattattggcgtcaccctgctggttttcatcgtcatgtcattctctcctgccgacccggcacgacttgccctaggcgaatcagcctcccccgaagcacttgaagcctaccgtgaagccaacggcctcaacgatccaatgatggttcgctatttcgacttcatcctcggcatgctcaaaggcgacttgggaacctctagcggtggcgtagctgttaccgacattgttgcccgcgctttccccatcaccctgcagctaacattctggggactcatcatcgctgttgtagtggcgttgatcctcggtgtcatcgccgctctataccgagaccgctggcctgaccagttgattcgcgtggtctccattgcggctcttgctactccttcattctggttggctatcttgctgatccagtggttgggtactatccctggagcctggggtttcttcccagcacttgtcacccggtgggtcccattcagcgaagatcccgccacctacttcaacaacatcgcacttccagcgattgcgttggcagtccccgttgcaggttctttggcccgcgttgttcgtacctccatggtggaagaactggacaaggactacgtccgcacagcaatcggtgcaggtatccccaaaactgaagttgttgcccgcaatgttctgcgcaatgcgctgatcaccccaatcaccgtgattggtcttcgcgttggttacctcatgggtggtgcggtgatcattgagatcatcttcaacatccaagcaatgggacagctcatcctagacggtgtgacccgaaatgacgtctacctcgtccaaggtgtcaccctcaccgttgccatcgccttcatcatcgtcaatatcgccgtggacctgctctacgtcctggtcaatccacgtattaggagcatc

SEQ ID NO: 2916 - DNA, 1068 bp, Corynebacterium glutamicum
gtgcttgggcacaccacacgtgaagaagccaacgcctcactgctcgcatcacttgctgcgctatccaccagcgaaaacaattccaataaccggcttatatttgatggcaaccccactcctctgttggaagttcgcgatctaaagatctccttccccaatgctcacggagatatcaatattgtcgacggcgtgaacttcaccgtcgccccaggccaaaccatgggtcttgtcggtgaatccggctgtggtaaatcgattaccgcaatgtcgatcatgggtctgctgcctccaacagcaaagatcgaaggcgagatccttttcgacggaaagaacctccttgatctgaaaccagacgagctcaatgcactgcgtggacatgaaatcgccatgatctaccaagatgcactctcctcactcaacccatccatgctgatcagcgcccaaatgaagcagctgacccgccgcggtggaaagcgcagtgccgaagaactcctggaacttgtaggccttgatccaaagcgcaccctgcagtcctacccgcatgagctttcaggtggccagcgccagcgagttctcatcgcaatggcactgaccagaaacccacgcctcctcatcgccgacgagccaaccaccgcgctagacgtcactgttcagcagcaggttgtcgatctgcttaatgaactgcgtgaaaagctcggattcgccatgatctttgtatcccacgacttggctcttgtcgcccgcctggtgcacaagctcaccgtcatgtacgcaggtcaggttgttgagcaaggaaccacccgcgaaatccttatcgatcctcgacacgaatacacccgcggtttgctcggatccgtgctctccatcgaagctggtgtggaccgcctctaccaggtcccaggcactgttccatcaccaaaggaattcgtggcaggcgaccgctttgcaccacgatcagaattcccagaacttggccttgaccaaaagccagtacttcgccccatcacgggcacagagcatgcatacgcagcaaccgatgaacttcttgccgcaaagggagaacaacga

SEQ ID NO: 2917 - DNA, 816 bp, Corynebacterium glutamicum
atgacctcgacaatcgacaccaggcaacccatcctggtactgcgaaacaccaacgtgatccacaagacccgtaccggaaagctgtttcgcccagaccaggtccacgccaacaaaaacatcaacttcaaggcctaccgcgatgaagtaatcggcatcgtgggtgaatctggttgcggaaaatctacccttgcccgcgttatggttggcctgcaaccggtcacctccggcgaagtgctgttcaaaggcaagcccatgaagcctcgtggtgcgcagcgcaaagaactcggcagctcagtatccgtcgtgttccaggatcctgccacctcgttaaacccacgaatgaccgtgcgcgaacagctcctcgatccacttcgagtacacaaagttggcgatgaagcatcccgcaaccagtgggtttcagagctgatctccatggttggcctcccgcaatccgcgttggaagtactcccccgacaggtttccggtggccaacgccaacgcgtggccattgctcgagcacttgcgctgaaacctgacatcatcgttgccgacgaaccaacctccgcgctggatgtatccgttcgtgcgcaggtcctcaaccttctgctggatctgaaaactgaactcggcctgggattggtattcatctcccacgacatcaacactgttcgctacgtttctgatcgcatcgcagtcatgctggctggagaaatcattgaggaaaacaccacctcagagatcttcaacaatgcgcagcaggactacacccgcactctgctcgaagcgacaccatcgctgctgaacaaaactcgtttg

SEQ ID NO: 2918 - DNA, 621 bp, Corynebacterium glutamicum
gtggacgcagcatcatgggtcgcattcgcactcgcattattggtggcattagcggtgcccggacctgaccttgttcttgttctacattctgcaacccgcgggatccgcacgggggtcatgactgcggcaggaatcatgacgggactgatgttacatgcgagtcttgcgatagccggagcaactgcattattgctatcagctccgggagtattgagcgctattcaacttcttggtgcgggagtgcttttgtggatgggcacgaacatgtttcgtgcttcccaaaataccggggaatctgaaactgctgctagtcaatcgagtgcaggttattttcgaggatttatcaccaatgccacgaacccgaaagcgctgttgttctttgcagcgattcttcctcagttcattgggaatggggaagatatgaaaatgaggaccttggcattgtgtgccaccatcgtgcttggctcaggagcgtggtggttgggaacaatcgcattggtcaggggtattggtctgcaaaagttaccgtctgcggatcgcattatcaccctggttggtggcatcgcactgtttctcattggtgccggattactggttaatactgcttatgggcttatcact

SEQ ID NO: 2919 - DNA, 483 bp, Corynebacterium glutamicum
atgaaacaagatcaatctccaaaattagattcggtagattggaaaatcctcgaacttttacaggtcgatgcaacaatgccgaacaaggacatcgcagccaaagtcggtatcgcaccgagcacctgtctagaacggatccggcgaatgcgacgaaatggaacaatcgtagccacccgtgcgcacgttcgcccaagtttgttgggtagaggtgaacaggcttttcttggcatccaaatccgaccccacgcccgtgatacagccaatgactttgtgcaaaaagtactcgcacttcccgaaaccctcgcgctctacaacgtcagtggcagcgaagactatcttgttcatgtcgccgtagcgaacagcaccgaattacaatctttgatcatcgataaactgctcgcactgccacaggtcgcgcactgtcgaacacaactaattttcggtgagccttgggtcgctccgcttcgacaaagcgacggacaa

SEQ ID NO: 2920 - DNA, 360 bp, Corynebacterium glutamicum
atgcccaagctgagttcacctaaagtctggaatctcgttgctatcatcgtgcttggcgggatggctaccgagcagattttgggatttcgggacaacaactccaccgcattagtgatgtggatttcgagtgcaatagccatcggagctgtggtgtggggactttcgaattacaaaaagccctgtgattggtttattccgcgcctctacgcatttgcggctgtacccaatttaatgctcctttttgatgcgcaatcctggactaagttttggggcggtttggcaggggcagttattttcacactaattctcagtggatttcttgccctgtataaagacttccacaaatcacctaagaggaag

SEQ ID NO: 2921 - DNA, 480 bp, Corynebacterium glutamicum
gtgactaacccaatcatcccccgcgtaggaatcgccacagacgcccaccaaatcgaagcgggaaaaccctgctggatcgcctgcctcctctttgaaggcgtcgacggctgcgaaggccactccgacggtgatgttgtagctcatgcaattgtggatgctctcctttctgcctctggtctgggggatttgggctctttcgttggtgtggggagacctgaatacgatggtgtttctggtacacagttgttgaaggaagttcgggagctgctttcggcacacgggtacgtcattggaaatgtcgccgcccaactggttggccaaacccccaaatttggaccccgccgcgaagaagcacaacaagtcatctccgaaatcatcggcgcaccatgctcactgtctgccaccaccactgatcacatgggattcactggtcgcagcgagggtcgtgcatcggtagcaacggcagtggtgtggaaggct

SEQ ID NO: 2922 - DNA, 768 bp, Corynebacterium glutamicum
atgtcgtctacacgaatccccgtcatcgcactcctcgcggcggcggggcgcggaacccgcctcggcggacccatccccaaagcattcgtcacgttgcgtgaacgcacacttttagagcgctcgctccaagccatgctcacctccgaaagcgtcgacgaaatcatcatcctcgtcagccccgacatggaaacctacgcccgcgatttgctgcgcaaacgcggtcttttgaacgaccccgaaggggtacgcgtacggctcgtgcacggcggcggggagcgcgcggactcggtctgggcaggccttcaggcaatttcgcttgacgacgccacccccgatgcaattgtcttaatccacgacagcgcccgagcgctcacaccacccggcatgattgcgcgcgtggtgcgcaaagtccacgaaggcgccaccgcagtcatcccagtactgccagtatcggacaccatcaaacgagtgtcccctgatggcggagtagttgtcgacacacccaaccgtgcagaacttcgcgccgtccaaaccccacaaggcttcctgctgtccgaacttgttgcagcgaatgagaaattcttcgccgaccccaacccaggcttcatcccaaccgatgacgccagcttgatggaatggtacggcgcagatgtagtctgcgtacaaggcgacccaatggcgtttaaagtaacaacccccattgatatgatgctggcacaacgcatcaccgacgaagccgaacccacaatatttgaggtaccaggtgac

SEQ ID NO: 2923 - DNA, 594 bp, Corynebacterium glutamicum
atggaattcaaggtcggagataccgtcgtttacccgcaccacggagctgcaattatttcagccctggagcagcgtgaaatgaatggtgagacggtggactacctggttctccagatcaatcattccgatctcgtcgttcgcgttccagcaaagaacgctgaactcgttggcgtgcgtgacgttgtcggcgaggagggcctgcagaaggttttctctgttcttcgtgaaattgacgtcgaagaagccggcaactggtcccgccgttacaaggctaaccaggagcgtttggcttccggtgacgtgaacaaggtcgctgaggttgtccgtgacctgtggcgtcgtgatcaggatcgtggcctttccgctggtgagaagcgcatgctctccaaggcgcgtcaggttcttgttggtgagctcgcgctcgccgaaaccgtggacgatgagaaggcggatgctttcctcagccaggtcgatgagaccattgctcgccaccgcgctgacctgctcggcgacgaggaagagaagaaggacgcattcgacgacttcgacgattccgacgtggatcttgacgatctgagcttcgacgacgaagat

SEQ ID NO: 2924 - DNA, 723 bp, Corynebacterium glutamicum
atgacgaacccctcccccgcgctaaatgaaaccctttccggcagggtgctgatcgttgaagatgagcgccctcttgctcgcatgatttcgctttatttaagcaaagcgggtttcgataccaccacgatccacgacggcgccgctgctccagataaggtcgctcacctgcgccccgacgtggtcattttggatcttgggctgcctggtcttgatggtttggaagtgtgcaaacgcatccgcgcgttcaccgattgctacatcctaatgctcaccgccaggggttcagagcgggatcggattacaggtttggaaattggggctgatgattacatcaccaagccgtttaatatccgcgaacttgtcattcgtatccagtcagtaatgcgtcgccctcgaaaaatcgatgaaaccatccaaaatggtttgaccttgacttatggccacattgagctggacaccttggcgcatgaagtcactgtcaaaggcgttggggtgacactgacccgcacagaatttgagctgcttcaagccctcatgcacaaaccgggagaggcagtgtctaggcgtgatttggtcagccaagtgtgggataccacctgggttggcgatgaacgcatcgttgacgtgcacattggaaatctgcgccgcaagctggaagcacctgcgccgggttcacacttcatcgacaccatccgaggtgttggctaccggatggccttcaaa

SEQ ID NO: 2925 - DNA, 1116 bp, Corynebacterium glutamicum
atgacagccctcatcccagctcgccacagcctgacttttcgtctgctcaccgcgcagcttgctgtggtgttgatcagtctgctggccgccctgattgtggctgccttggtagggcctgcaattttcaattctcacctggatctttccggcccgattgatccccgccagacggatttccacattcaggaggcctaccgggacgccaattacattgccctcgcagcggcacttcccaccgcagtgttgagctccattggtgtgagtttttggctttcccaccgcctgggccagccgttgtggcgactgtcccgggctgcaactgccatgagctccggcgactaccaggtgcgcgtacccatttccgatgtggataaagaggtcgctgctctatctctcgccttcaattccatggcggatcagctcgaacacacagaagaactccgccgaaacatgctctccgatctatcccatgaaatgaacactcccctttccgtcctccttgtttatgtcgacggtttgcaggacggcatggtggagtgggacgccgacacccacgcagttttcgccgagcaacttggccggctttcccgcctcacatcagatcttgatgatgtctctagagcccaagaacaccgcttcgacctggtctacagcaccgtcgccatcggtggtctcattcacaatgccgccggagccgccgcaggttcctaccaagaaaaaggcgtggccctggaagtaacaggcagcgattccaccgaactcatccgcgttgatagccaacgcttcgcccaagtcatggccaacctcttctccaacgccttgcggcacacccccgccggtgggaaagttcacgtccgcgtcctgcgtcaaggcgtgggaaccatcgtcatcgaagtcatagacaacggcgaaggaatcgcccctgaacacgtaaaatacgttttcgaacgctacttccgcgccaaacgatccgactccgacgaccaatccggctccggaatcggcctcaccatctcccgcgcactcatcgaagcgcaaggtggcacactaaccgcagaatccgctggcctgggcaaaggcgcgaaatttaccatccgactaccccttttaagcaaa

SEQ ID NO: 2926 - DNA, 582 bp, Corynebacterium glutamicum
atggaggacgaatccgtgaagtccctgaacttggctgcccgtcgtggcgcgctcgtgaccgtggctgctgcgtcagctcttgcgcttgcatcctgcagtgccggacagatcacccagacctcaagccaggttgcagcagttgatggcaaccaggcaggctccgcgaacgacccagttctggtgcgtgatgtaaccgtgcacctcaccaccgacggcgaagctggagtaaagttcaccgccatcaaccaggacacctctcacacttctcacacccttgagtccgtcaccgttgacggcgaagaggttgagcttgatgatgcagagccaatcgagcgcaactgctccctcgttgcagacatccagtccgaactggatctgatcgaggagccagaagttggctgcatccagcacgtagcaacttctcttgagaacccaggtttcgcatacggcggagtcgtgccagttgagttcgtcttcgacaccggtgcgatcaccatcgatgccaccgtttccgcacctgtcctcgagtcaggcgtagaaaaccgcgaggtcggcggagacactgcagaggcaagccaccac

SEQ ID NO: 2927 - DNA, 1392 bp, Corynebacterium glutamicum
atggcaaaaaaggttcgcagcgtacacgagtgttctgaatgtggttattccagcccaaagtggttggggcgctgccctgaatgtggttcttggggttccatggaagagcgcacagtcggtgagtccggtggtgcggctcgtgctgctgtgtcgggtgctgcgccggcaggcttgaccccaacttccccggcagtgcccatcggtaagatcgttgcttcccaggccacaagcatttccactggtattggagagttagatcgcgtactcggtaacggcatcgtgccaggatccgtcgtactcatggccggtgagcccggtgttggtaaatccactttgctgcttgaggtcgcaagccgttgggcttcaatgaaagagggcgacgggacccgcaccgcgctgtatgtcaccgcggaggaatcagcaggtcaggtgcgtcttcgcgctgagcgcaccgcagctgtcaaagacaccctttatcttgctgctgaatccaatctggatgtggttttcggccacgttaaccaagtgaaaccgagcctcctcatcgtggactccgtgcaaactatgcatgccgctggcgttgaaggcgttgcgggcggtgtcgcgcaatctcgcgctgtcacagccgcgctcaccacgcttgcgaaaacctccggaatcccaattctcttggtaggccacgtcacaaaagacggcaacgtcgcaggtccacgcgtccttgaacacctcgttgacgtcgttttaaacttcgaaggtgaccgccactcctccttaagaatgctccgtggcatcaaaaaccgcttcggtgccaccgatgaagtcggctgcttcgaacaacaatccgacggcatcaaagaagtccccgatccctccggactcttcctctcccaccgcggctctaccccagacggcaccgcggtcaccgtcgccatggatggcgtgcgcccgctattagcggaggttcaaagcttgcttgtcgacgccccctccaagaatccacgcagggtcgtcacgggcctcgacgccaatcgggtccccatggtccttgcggtgttatccgcacgcgccggacgccaaacccaaggaaaagacgcttacgtggcaaccgttggtggcatgaaagttggcgaaccagcaacagacctcgctgtcgcgctcgctactgcctcggctttagccaagaaaccactaccagataaaacagtggtactcggtgaagtcggcttggccggagaaatccgtcgcgtccccaacgttgatcgcagactagccgaggcggaacgtttaggttatgaaaaagcagtcatccccggaggctcaggcatcaaacaaacaagcctgagagtcatcgaagcttcaacacttgccgaagcacttgcagcagtaagctta

SEQ ID NO: 2928 - DNA, 1098 bp, Corynebacterium glutamicum
atgacaccaacaaccactcctgtatcaaacccagatgccctttccactggaactcaggatgtgcacaccctcaaaggaacgttgcagcgcctcgccccaggcacaccacttcgcgatggcttagaccgcatcgtccgaggacacaccggcgcgttaatcgtcattggtgatgatgaaaacgtctcctcgatctgcgacggcggctttgaattcgacgtttcgtttgctgcaacccgactccgcgagctgtgcaagatggatggcgctgtcatcttgtcttccgaccttgagcgtatcaaacgcgccaatgttcagctgctgccttcaccaacctggccaacccaggagtccggcacccgccaccgttctgcagaacgcaccgcgcttcacaccggtgtgccagtgattgcggtatccgaatcacaaaacaccatcactctctacgtcgagggcaaatcccacatgttggagcagccagctgccctgcttaaccgcgccaaccaagctttgggaacaatggagcgctaccgcgatcgtctcgatcaggtcaataaccgccttcacctggctgaactccacagctatgtcaccgtgattgatgttgtttctgtcattcagcgcgaggaaatgctgcgccgagtgggtgaaatcattgatggcgatgttcttgaactaggcaaagacgccaaggagattcagatccagctcagcgaattacgtggcgataatgaccgagaacgtgaatcaatcattgctgattaccttgtcaccgacggtattcctgcagatgaggaaatccacgcagccctcgaagcgatctcacatttagatgataaggctctgctgaatcctgcgaacatcgcgcgtgttcttggactgccaccgaccgaggaagcacttgatgagccagtcactcctcgcggctaccgcacgctcaacagaattcctcgagtgcaaaaattcctcatggataaactcatcgtggaattcggcaacttggatgcactgctcaatgcgtcagtagaggatctaagtgcagtcgatggtgtgggctcactgtgggcacgccacatcaccgacggacttggccgtttaagt

SEQ ID NO: 2929 - DNA, 687 bp, Corynebacterium glutamicum
gtgttctgtgtgggaacgccgagacataatgaagtcatttacaagcgccgccgcatggcagcgctcctagttctgctcgtcgtgattgccttgattatctgggcagtcgtcgcgcttcgaggtggatcatcggagcctgaggaagagcagccaaataatgctgtagtgacctcctcaatggaatcttccacgacgtctagttcttcttctaaagaatccacgactgaagccaccacagaagaagagacttccagtgctgaaccaaccgcaacatccaccgttgcagcagatgcaaaaaagacctgtgagcttagtgacttggtgatttccgcaagcactaatcagccgactttctcaggttctgcgcagccagaattatttatggctgtgcataatccgactgctgttgattgcgaaattgacctcgaggagaacaaactccgtttcgaggtatacaatctcgcgaccaacgcacgaatctggtctgatgtcgactgcaaccctgcagttgaagacggcacgagcgtgttccctgccggcgaggatcgctacttccaggcaacatggtctcgtaccacttcagcgccaaaccagtgcaacaaccgcactgatgtccccgccggtggctactacttgcacactgtggtcggtaataacccttcaccagcggtgacctttaacctaact

SEQ ID NO: 2930 - DNA, 1452 bp, Corynebacterium glutamicum
gtgactgcaacatttgctggaatcgacgccaccaaacacctcatcggaggtcagtgggtggagggaaactcggatcgaatttccaccaatatcaatccttacgacgattccgtaatcgccgaaagcaaacaagcttccattgctgatgttgatgccgcgtatgaagccgcgaagaaggcccaggctgagtgggcagctacgcccgctgcggaacgatctgccatcatctaccgtgcggctgaacttcttgaagagcaccgggaggaaatcgtggaatggctgatcaaggaatccggctcgacgcgttccaaggctaatttggaaatcactttggcaggaaacatcactaaagaatcggcttcattccctggtcgtgtgcatggtcgaatttctccttcgaatactccgggcaaagaaaaccgtgtgtaccgcgtagccaagggcgttgtcggagtgattagtccatggaatttcccactgaacctctcgatccgctcggttgctccggcactagccgtgggcaacgccgtagtgattaagcctgcgagtgataccccagttactggtggtgtaattcctgcacgaatctttgaggaggccggagttcctgcaggcgtgatcagcacggttgcgggcgcaggatctgaaatcggtgatcactttgtcacccacgccgtgccaaagctgatttctttcaccggttcaaccccagtcggtcgtcgtgtcggtgagctggcaattaatggtggaccaatgaaaactgttgcactagagctcggtggcaacgcgccgttcgttgtgcttgccgacgccgacatcgacgccgctgcccaggctgccgcagttggcgctttcctacaccagggacagatttgtatgtcaatcaaccgagtcattgttgatgctgcagttcatgatgaattcctagagaagttcgttgaagcagtgaagaacattccaaccggcgatccaagcgcagaaggaacccttgttggacctgtcattaatgacagtcagctcagtggtttgaaggaaaagatcgagttggccaaaaaggaaggcgcaaccgtccaggttgaagggccaattgaaggccgactggttcatccgcatgtgttctctgatgtcacctctgacatggaaatcgctcgtgaggaaatcttcggacctctcatcagcgtgctgaaggccgatgatgaggcacacgcagcagagctggccaatgcttccgactttggtttgagcgcggcagtgtggtcgaaggatattgatcgtgcagcccagtttgctctgcagattgattccggcatggttcacatcaatgacctcaccgtcaacgatgaaccacacgtgatgttcggtggttcaaagaactctggcctcggccgcttcaacggcgattgggcgatcgaggagttcaccacagatcgatggatcggcatcaagcgcagc

SEQ ID NO: 2931 - DNA, 147 bp, Corynebacterium glutamicum
ttggcgcaccagtttgatcgctgtggaaactatcacaattcccgtcctgaacagcgaaaaagtgacctcgcagaatcgattccaacggcggtgaacgccactcagccctatggcccttttggaaatccaggcccgcaaatcgacctc

SEQ ID NO: 2932 - DNA, 621 bp, Corynebacterium glutamicum
atgcctttgcgtaatgttgatagaactccgcccgcagtatgggaagcattgcttgccggaaacgaaagattcatcagtttcaacgaagatcgaccaaaccaggacgccccgcgcagaagagaacttcgcaatggacaaacgcctgcagctgttgttatttcctgttcagattctcgagtgccagttgagattatttttgacgtcggtctcggtgacctctttgttgtccgtactgccggagaaatcctcgaccaagcagtgcttgcgtccatcgaatacgccactgaatccatcggcgttccattggttatcgtcatgggccacgaatcctgtggtgcagttgcagcaactgcagcagcacttgaaggcggtgcacttcccggaggctaccaacgagttttggttgaaaaggttgcaccatccattctagaagccaaggcagagggcctgagctccatcaaggaattcgaggaacaccacgttgtggcaacggtaaaccaactgttgtcccgttctccagagattcatcagaaggtcgaaaccggtgagttgggaatcattggtttgcgctaccgactctctgacggtcgtactgaacctgtaattagcaagaacgtgggt

SEQ ID NO: 2933 - DNA, 879 bp, Corynebacterium glutamicum
atgtcatttacagcttttcaaacagccctgctcgtgtggtttagagcaaatgcccgcgatcttgcgtggcgtgatcccaatacttcagcatggggaattctcctttcagaggtgatgagccaacaaactcccgtcgcgcgagtcgagccgatttggcgtgagtggatggaaaaatggcccactccggaagatttcgcgaatgcgagcaccgatgagattttgcggtcgtggggcaagttgggctatccacgtagggcgctgaggttgaaggaatgtgcggaggtgatcgtcgaaaagcatgccggcgaggtgccggatacggtggaggcgctgctcgcgttgccggggatcggtgattacacggcgcgcgcggtcgcggcgtttcattttgggcagcgcgtgccggtggtcgatacgaacgtgcgtcgcgtgtaccagcgcgcggtagccggacgttaccttgcggggcctgcgaaaaagcaagagcttatcgacgtctcccttctccttcccaacactcacgccccagaattctctgccgcaataatggagttgggtgctcttatctgcacggccacttccccaaagtgtgacacctgcccactgcttgaccagtgtcaatggcaaaaacttggctgtccctccccgagtgaagaggagctggcttcagcgaaaaagcgtgtgcagaaatttgtgggaaccgaccgacaagtccgtggcctaatcatggacgtactgcgcaatgccaccgcacctgtgccactatccgcgattgatgtcgtgtggcctgacgatgcccaacgctcccgggcgctgttttcgctcattgaggacggactcgcggaacaaaatgaggcgggttatttccacctgccacgg

SEQ ID NO: 2934 - DNA, 1155 bp, Corynebacterium glutamicum
atgcttggtctctctcgtcgtaagtttgccatgctcgctgccttaactgcgggaatcgttggcgttgttgccactggttgtagtacgcccgcagaacctgaaacgatcgataatccggtgttcattggtatctccatcgatccaattaaaaacctaagtccgaatcacgctgcaaacctcttcgctttatctgcagatggctcgggaggaattttccaagaactcgctcccacatactttccgtcgatccatcgattaggaaacggattcatcgcacccgatagagattctttggtagttgtcgacgcttctctaaaggaagtttatcgacacgaagtggccaggcttggtgttggaatgcaaactcaatcagctaggtctccactgcataaatcagttgccttctccttcaatgaaggaacagctgaagccccatatagacaccgcatcgtctccgcaactgagaaaacatcagcttccgcaatgacagatcagcggcacttcgcgcttactgcatgcgatgacggatccacacggtgggtcgaatattcccctgaccgcggaatggaagatccaatgggccccggctcagcacgcatcgtgactctccaggccgacggagaactcagtgaaattgacgttgagtggaatttcccggatcggccctccgccccaattattctgtcttgcgaagatccaagcgcttatatagtttcagaagaagacatcatctatgtaaaagacgaggtaagccctgccgaatccataggaaaattacctgcatatgaaattccggaccgcgcccgattcgatacagtttccggcgaagactacttcgcttttacgtcaactgggatgctgacacgcatcaatattccccaagcaaaaatcgtctacgcacaatccattgacctctacggcaagcatccggtttccataactttcgattccgaccgtgcatacgtggttacttccggggattccggggaaagccttcttgaaatcgacttgaatgatccaacatgcacttcagatcagctctcgctcactggtttcaacaaattactcacagctcggaaacctaagccagaaccgtcgatcatcatcgaaaccatcttgccaattgacccaaactactcactgggttgtaagagt

SEQ ID NO: 2935 - DNA, 306 bp, Corynebacterium glutamicum
ttgcttcctcaaaataaattctcaagattcaaggccttatacagtttgtcgaaccttcaaaggccctcggtcgccacaatagaccagcaaaaatatttctgcacacaccatgtgatgaagattatgctggttcacatgggactgaattatcggaaaattattaagaccggaaaagacagttggctgaatgtttctaagtctggcgtttccggatcgaagcgaatcgggccggtgactattaattcgcgtggtggaatctcagtgaagttgcctggcggtttgaactatcgcggcaggtggaagaaa

SEQ ID NO: 2936 - DNA, 774 bp, Corynebacterium glutamicum
atgagcaaagttgcaatggttaccggtggtgcacaaggcatcggtcgtggaatttcagagaagctggcagcagatggtttcgatattgccgtagccgacctgccacaacaggaagaacaagctgcagagaccatcaagttgattgaagctgcaggtcaaaaggctgtattcgttggattagatgtcaccgataaggctaatttcgacagtgcaattgatgaggcagcagagaaacttggcggcttcgatgtgctagtaaacaacgccggcatcgcacaaattaagccacttctggaagtcaccgaagaagacctaaagcagatctactccgtgaacgtttttagcgtattttttggtattcaagcagcatcccgaaagttcgatgagcttggcgtaaaaggcaagatcatcaacgctgcatcaatcgctgctatccaaggtttcccaatcttgagcgcctactccaccaccaaattcgcggttcgtggcctcacccaggctgctgcgcaagaactcgcacccaagggtcacaccgtgaatgcctacgcacctggcatcgtgggcaccggaatgtgggagcaaatcgatgccgagctttccaagatcaacggcaagccaatcggtgagaacttcaaggagtactcctcctcaatcgcattgggccgaccatcagtacctgaggatgtagccggtctggtttcgttcctggcttctgaaaactccaactacatcaccggacaggtcatgcttgtcgacggcggcatgctctacaac

SEQ ID NO: 2937 - DNA, 324 bp, Corynebacterium glutamicum
ttgaagtcaaagaagttactgtcagtgcttacagcagtggccctttctggcggtgtggtaaccacaacagccatcgtttccccctccattgtttccgcagctgagacaatgacggaccaatatgatccgttttacgatgacactactgtccgggcggttccttgggtgctactgtacccacaaggcgaaaagcgtctgccatctgggacgactttttcactctttgattcaacttcatatagtcctgaagtcttctcggatggtgcagttatgattaaactaactcctagcagtggccaactacatgtctggcttaatagccta

SEQ ID NO: 2938 - DNA, 741 bp, Corynebacterium glutamicum
atggtcgcagagtaccctgacggatcctcggaaatattcccggtaacgttaaatttaattccggaagataccctcgtttatgacgccgtctacaaattcaaaagcatccgaactggttccgaagatcaaataaccccatttgtatcaaaccaacctgatgtgcctttccctgcaggaacatcgttcacattaactggatattatgaaattgatcagctgagaagtgcaggatggaaatttgagcttaatcctgtaacaggtgaactttcagtcacagttcctatctctgtaatttaccctgatgggtctcgtgataacacaatcgcgaccatggaatccgtaggccctgatgattctgagcttttcaaaccagactttgatttaatcccaataaaatcaggtgactatatagagataggtgtactcgcaccagggcttcctgctggtacggaattccatctcgattactacgcacttccggatcgattctttgacttaggcggttctacaagcctttcaggcaacggtaagttctctcttggagttccacttacctggaatgatgatctccagctcccgatctcgattacttttcctgacggaagccacacagttgagaatttgcatgttgacgtaacccccgcaaactttgctggcaaccccattgacgagcctaaggacgatgacaaggatcatccacaaccggctcctaaaccaagtggcagctcatttggttctagc

SEQ ID NO: 2939 - DNA, 312 bp, Corynebacterium glutamicum
gtgactatgccacgccaaggacttttagccttccaaaggaaccacatcgaaaccaagaacttccacgctcatgccacgttgttcatcatcagcatggttaccggcagggcgggcatccgaccatgcttgatagtcttcgcgggaatcccaacgagtaactacgaagtagcgatcctcaccaaattgtggacgcaacaactcaaattcttggaatcctttggccgtatctacagccttcttacgagccgcgaagcgttgttcgatttctttttcagcccctgcagggaacgtaagagccgtgatgttaacaaa

SEQ ID NO: 2940 - DNA, 291 bp, Corynebacterium glutamicum
atgtcatttgttaacatcacggctcttacgttccctgcaggggctgaaaaagaaatcgaacaacgcttcgcggctcgtaagaaggctgtagatacggccaaaggattccaagaatttgagttgttgcgtccacaatttggtgaggatcgctacttcgtagttactcgttgggattcccgcgaagactatcaagcatggtcggatgcccgccctgccggtaaccatgctgatgatgaacaacgtggcatgagcgtggaagttcttggtttcgatgtggttcctttggaaggc

SEQ ID NO: 2941 - DNA, 420 bp, Corynebacterium glutamicum
atgtcgatttggatgagggaatcatcgtcaccgaagaggaatcctgcgagagccttggacagctcggtcttaccaacgccggatggaccagcgaagatgaaggagccggaaggacgcttaggatccttcagacctgcacgggtacgacggatcgcacgggagacagccttgacagcttcatcctgtccgatgatgcgcttgtgcaactcttcttccatgttgagcaggcgtgaagattcagcttcggtgagcttgaagacaggaataccagtccagttggccagtacttctgcgatctgctcttcgccaacctcagcgatgtcctcgaggtcgccggagcgccactgcttttccttctctgaacgctcttcgccgagcttgcgctccttatcgcgaagacctgctgccttctcaaagtcc

SEQ ID NO: 2942 - DNA, 213 bp, Corynebacterium glutamicum
atgtgcttacggtactcatccagggtggttgcaccaatggtctgcagttcaccgcgggcaagctttggcttaagcagggaggcagcgtcgattgcgccttctgctgcacctgcacccacgagggtgtggatctcatcgataaacaggatgatgtcgccgcgctggttaatctccttgaggaccttcttcagtcgctcttcgaagtcaccgcgg

SEQ ID NO: 2943 - DNA, 321 bp, Corynebacterium glutamicum
atgtctagtgcaagaccttcaacaactgcggtcttaccaacacctggctcaccaataagaactgggttgttcttggtacgacgggagagcacctgcatgatgcgctcgatttccttatcgcgaccaacaactggatccagcttgccgtcctttgcagcctgggtgaggttgcggccgaactggtcaaggaccaaagaggtagaacgctcgcctgggctgcccgaagatggacgaccgccaggagcagctcctgcaccaacagcgtcaccgccagtaggggcgccctggccgccctctggggatccgccctggccaccttcg

SEQ ID NO: 2944 - DNA, 2775 bp, Corynebacterium glutamicum
atgttcgagaggtttaccgatcgtgcacgccgcgtgattgtgctcgcgcaggaagaggcgcgcatgctcaaccacaattacatcggcacggagcacattctcctcggcctcattcacgagggcgagggcgttgcagccaaggctttggaatccatgggaatttccctggacgccgtccgccaggaagtcgaagagattatcggccagggctcccagcccaccaccggccacattccttttactccacgtgccaagaaggtcctggagctcagcctccgcgaaggcctacaaatgggacacaagtacatcggtactgagttcctgcttctcggtttgatccgtgagggcgagggcgttgctgcccaggtcctggtcaagcttggtgctgatctgccacgcgtgcgtcagcaagttattcagcttctctccggctacgaaggtggccagggcggatccccagagggcggccagggcgcccctactggcggtgacgctgttggtgcaggagctgctcctggcggtcgtccatcttcgggcagcccaggcgagcgttctacctctttggtccttgaccagttcggccgcaacctcacccaggctgcaaaggacggcaagctggatccagttgttggtcgcgataaggaaatcgagcgcatcatgcaggtgctctcccgtcgtaccaagaacaacccagttcttattggtgagccaggtgttggtaagaccgcagttgttgaaggtcttgcactagacattgttaacggcaaggttccagagaccctcaaggacaagcaggtttactcccttgacttaggttccctggttgcaggttcccgttaccgcggtgacttcgaagagcgactgaagaaggtcctcaaggagattaaccagcgcggcgacatcatcctgtttatcgatgagatccacaccctcgtgggtgcaggtgcagcagaaggcgcaatcgacgctgcctccctgcttaagccaaagcttgcccgcggtgaactgcagaccattggtgcaaccaccctggatgagtaccgtaagcacattgaaaaggacgcagctcttgagcgtcgtttccagccagtgcaggttccagagccttcggttgatctcaccgttgagatcttgaagggtctgcgcgaccgctacgaagctcaccaccgcgtatccatcaccgatggtgctcttactgcagcagctcagcttgctgatcgctacatcaacgaccgcttcttgccagataaggccgttgacctcatcgatgaggctggcgcccgcatgcgcatcaagcgcatgaccgcaccttcctccctccgcgaggttgatgagcgtatcgctgatgttcgccgtgagaaggaagcagcgatcgatgctcaggactttgagaaggcagcaggtcttcgcgataaggagcgcaagctcggcgaagagcgttcagagaaggaaaagcagtggcgctccggcgacctcgaggacatcgctgaggttggcgaagagcagatcgcagaagtactggccaactggactggtattcctgtcttcaagctcaccgaagctgaatcttcacgcctgctcaacatggaagaagagttgcacaagcgcatcatcggacaggatgaagctgtcaaggctgtctcccgtgcgatccgtcgtacccgtgcaggtctgaaggatcctaagcgtccttccggctccttcatcttcgctggtccatccggcgttggtaagaccgagctgtccaaggctctcgcaggattcctcttcggtgacgatgattccctcatccaaatcgacatgggtgagttccacgaccgcttcaccgcgtcccgacttttcggtgcccctccgggatacgttggctacgaagaaggtggccagctgaccgagaaggttcgccgtaagccattctccgttgtgcttttcgacgaaatcgagaaggcccacaaggagatctacaacaccttgctgcaggtgttggaagatggtcgccttaccgatggtcagggacgcatcgtggacttcaagaacaccgtcctgatcttcacctccaacctgggcaccgctgacatctccaaggctgttggcctgggcttctccggatcctccgagactgacagcgatgctcagtacgaccgcatgaagaacaaggtccacgacgagctgaagaagcacttccgccctgagttcctgaaccgtattgatgagatcgtggtcttccaccagctcaccaaggatcagatcgttcagatggtcgaccttcttatcggtcgcgtttccaacgcactggctgagaaggacatgagcatcgaactgactgagaaggccaaggacctcctggctaaccgaggcttcgatccagttctgggtgcacgaccattgcgtcgcaccatccagcgcgaaattgaagaccagatgtccgagaagatcctcttcggtgaaatcggcgcaggcgagatcgtcaccgttgacgtcgaaggctgggacggcgagtccaaggacaccgaccgtgcgaagttcaccttcacaccacgtccaaagccaatgccagaaggtaagttctctgagatctctgtcgaggctgcggaagcaattcaagatgtagattctgcagctgacggcgatgtcccagaaaccgattcactttccgacattgaccttgaaacccttgaaaagtttgaggaagatgtagaaaacggcaccgacattgatcaggtgtccggtgactactacggcaccgatgatcagggaggcactgctccaagcaaggag

SEQ ID NO: 2945 - DNA, 1431 bp, Corynebacterium glutamicum
atgcgttttcttaacaattccaatccgccctatgagctgacatattccgatgtgtttatggtgccttcgcgttctgacgtaggctcccgcatgtccgtggatctgcgcaccaatgacggaactggaacaaccatcccgctcgttgtggcaaacatgactgctgttgctggccgacgcatggctgagaccattgcgcgccgcggtggcatggcgattcttccgcaggatgtgcccgccgatattgctgcagagactatcgcgaatgtgaagaaagcggacctggtttttgataccccaattaccgtaaaaccgcaccacaccgtgggttatgcacgcaacttgatccacaagcgtgcgcacggtgcagccattgttttggagggcgatcagccggtcggcatcgtcaccgacaaggacctcgaaggcgcagacaacttcactcaggtgggcaccctcatgtccacctccctattgacgctgcctgaggatatttcccccgaagacgccttcggaatcctccacgaacacagccgcaaactcgcccccgtcgtcgcggctgacggctcactccgcggcatcctcacccgcaccggcgccctgcgcgccaccatgtacaagccggctatcgacgccaacggccgcctgcgagtcggcgccgccatcggcatcaacggcgacatcgaaggacgcaccaaaacgcttctcgacgccggcgccgacgttctagtcgtcgacacagcacacggccaccaatccaccatgatcagcgccctcaaacgcatccgcgcactcgacgtcaacgtccccatcgttgctggcaacgtggtcaccgccgatggtgtccgcgacctagttgaagcaggcgcaaacatcatcaaggtaggcgttggaccaggcgcaatgtgcaccacccgcatgcaaaccggcgttggccgaccacagttctccgcagtgctggaatgcgcagccgaagcccgcaaactcggcgcacacgtatgggcagacggcggagtccgcgacccccgcgacgtcgccctggcactcgcagctggcgcctccaacgtgatggtcggatcctggttctccggaacctacgaatcccccggcgacctccgcttcgaatccgacggacgcatgtacaaagaatccttcggtatggcatcccggcgcgccgtggaaagccgaaaccaaaaggtcgaagctttcgaaaaagcacgccgcgcaatgttcgaagaaggcatctccactgcccgcatctacattgacaaacgccacggcggagtcgaggacctggtagatcaaatcatctccggtgtccgctcctcattcacctacgcaggcgccgattcgattgaaaccttcttcgaacgcgccaccgtcggagttcaatccaccgaaggctacgcagaaggaaagccacgcgcttcgcgt

SEQ ID NO: 2946 - DNA, 1011 bp, Corynebacterium glutamicum
atgactgctcaaccagcccacgagccgccaaggcatctccggttcagtacgagcgggatcctcccggacaatcgcgtccaaatgtgggagggccacaatgctcgcgcattgcttccgctcgacattagaaccattgacgatcgccccatgcaggcctccgaaaccaacctgcacctcccatcaatgcggatggcgagcgtattcgggacttcgcaatttgtcgagcgttcagagagtttcatctcagaaaaccccacgggtgtggttgcgatcttctttgcgactgaaggtgaagcagtcttcttccaccgtggtggacatgtagcgcttcggccaggtcaggccattgtttacgacgccgataggccattcctccgcggattcaacaatcgcttccgcgagctagttctcaccatcccgaagcagcgctaccttgaaattgttggctcaaaaggccctgagcttcccgctatttttgagttcggagcaacaggaaccgccaatgaacaagctttagcgcgactagttcaggaatctctacacaggattgaaagtggcgagccgaagcatatcgattccagtggacctttaggaaaaccgtggagcgatatcgagcacgaggcccacggacttatccgcaatgtacttggcgacgccacaagtagcgaagaaggcttaatttctgcagcccagagatttattgacatcaatatttccgaaagtgacttacaagcgtcgcggattgctgcagccgtgggaatcagcgaacgccaactaagtcgaatcttctcagactcaggacaaactatcggacgctacgtcctaaacacccgactggattttgcaaaggaagcgctgtcgacaccggagcgagacaaggtttcggtcagtgagatcggtaagcgctttgggttcgcttccccaagtcatttcagtcgcaccttccgcgagcggtttgaaatgacgccgcttcaatggaggaaggaatcgcagcgtcaatcctttcaagag

SEQ ID NO: 2947 - DNA, 1785 bp, Corynebacterium glutamicum
atggatgttctcatcgttggtgcaggtccggctggcaccatcgcagcggctcagctttcccgattccccaatgtgaccacccgcctcgtagagagaagcgaccgtcgcctcgaactagccaatgcagatggcgtgcactcccgaaccattgaaactttccaggcatttggtttcgcccacgagatcctcgccgaagctcatgaaatcaccgacatggcgttctggaagccggacccgcaaaaccctcgtgagatcattcgcgacaacagcacccgcgagctgccacagcacatcagtgaatttccgatggcgttgctcacccagacccgcatcatcgaccacttcaaccggttcatgaagaactccccaaccaggatgaagcctgactatggatacgagttcgtggactttgaagtagaagaagacgcagaatatccggtaattgtcaccctccgccgcaccagtggcgagcaaactggcgaattggtcaccgtccgcaccaagtacctggtcggtgccgatggtgcacgaagccaagtgcgcaaatcactgggataccgactccaaggtaagcaggctaaccacgcttggggtgtgatggatattcacgcgaacaccgagttccccgacgtgcgcaagaagtgcaccatcaaatctgattcgggtcgcaccatcttgctcatcccacgtgagggtggcttcctcttccgtctctacgttgacctgggcgaagtacctgatgatggcagcaaggctgttcgtgataccccactccaggatgtcatcgacaccgcgaaccagatcatggctccattcaccctcgacgtgaaaaacgttgtgtggaactccatctacgaggtaggccaccgcgtcgcagaccatttcgatgaccgtgtttcagaaaaaacctcgagcgaacacccacgcattttcattgctggcgacgcctgccacacccacagcgctaaggctggccagggcatgaacgtgtccatgcaggacggattcaaccttggctggaagcttggacatgtggccagcggaaatagcccacgcgaactacttcagacctacgctgaagagcgcgaagacattgcctacaagctcatcgagtacgacaagaactggtcaacactcatggcaaagccaagcagcgaaatgggcagtgcccaagaccttgaggatttctaccgcgcgaactctgagttcaatgccggctacatgacccactatcctccttcttccatcacaatggatggcagcaaccaagatctggcaaagggctacccaattggccgacgcttcaagtcagcgatggttggtcgagtctgcgacttcaccgaaacacacctcggtcaccaagcaacagccgacggacgcatgcgcgcatacgtcttcgcaggatccgatgcacttaacggcgagggttctgagctagaccgctgggcagaatgggcagaggcgaaccttgaccccacgcttgtcgacgccaaggtgatttaccaaagcccttataccgagctcgacacccgccaggttccatccgtgttcaaacctgcagtcgggatcttcgaactgaccaatgtggaaaactccttcggtatcaccacggactccgacatctttgatagtcgcgagatctcccgcgatggtgtcgtggtggtagtccgaccagaccaatacgtttccggaatcttcccactcactgatacccaagggcttggcgaattcctcaccggatacttccccaaaatgaaaggcgcacatcagctaatcaacgcgaac

SEQ ID NO: 2948 - DNA, 1716 bp, Corynebacterium glutamicum
atgcgctcacttcaatcggtccttgacctgctgacttctaagtccaaagtggctaccaaaattgtggtggaacgaattgaaaagcatcctgttcatggattgggatggatgatgtatccgccatttcatccatggactgatgcttcgaccttgacgattgagcgaaacggaaccagtcggcgcgcgagtcagaatggcgttgcggttcttcatcagcatgagcaagttcaaactatcggtctagccagctattttatcgactccaagatttgggtaaacgagctggctggccttgatcgtatcaacatttctgagagtgaagttgctggtcgtgacgtattagttctgccgttatctgatctgactttaagcatcgatgcgaaatacggcgtggttttggctgcggaagacagcgatgaatcagtgcgcgcggtatccgtggagttcctggaccagtgggtagatgaagaagaacccccagcggaagaagtgcctaaatatacggaaaccagggaggaacttcctccacttgagattcctccggctccttccggaaatcgtaatctccgagttctgtgcacgtggggagcgatggaaggaattattcctgagtggaaacccggcgatcaagtttcactgtttttgtctttcgacctcgacgatccgccgttcgaacagctcaaaaccactcgtcgcgggtacaccgaacctggcgagatttatggaaaccagcgcagctataaatttcacgctgatggttggaacgctgttatttccgccaaagtgccactgcgcaccgaagaaaacctcaccggctacttcacccacagctcctacgcggacacgagccgccgcacgtcagcggtcatcaccgcagtctaccgccacggtaaggacgcaattatcgacgtgaccctcgacggtgcgaaacctcctagatatcaagaatccttggattggagcagcaccagtacctgtgacggtgaaacaatctggctgtccgataagagcttgcccttcgtccgcggtttcaatgtctccacaggcaagctagtacacgagatctccatacccaccttcaatgagatcgccctcgaatccggcaatagagcccgcgcagcgaaaaaactttgggaacttccagatcttaaagaggcaaccgaccctgtcccagcgatccccgcgggctggaaactacacaaaagattcgggaaaaacttccatatcgtaagcgctgacaacggaacctggaaacaaaccatccttaggatcaaacccttcaaagcaattgagcttgatcttggatacgccaagatttcgacgatttaccaatacggtgaacgaatttatctgcgttccgatcttcaccagatcacgtttaatcaggatcttgaaatcctcagtgtagaggtccacggaaatcccgatgcaggttattggccactttccgatcttccaccaggggattctccaacgctgggatttcctatcggatcactcatgatgttccacgaacaacaagatatctacgctttccacgatcctaaaacaacaaagcaactaacaactgtgaacttgcccaaaaggcagtttgaagtggaatatgcttctcagaacagaattgttatttcgctgaaaaatccagaaagccgcctcattgacaaactgttggtgtgggaaccacaaaccaggtggcgggaacaaaacctggagagc

SEQ ID NO: 2949 - DNA, 1941 bp, Corynebacterium glutamicum
atggaatccgttgatgaactcctgagtctgatccgccgaggtgcagccaccaccgtgagtatgaaacttcaggtgacccgagctccgagctcccttcacttcgagggtgggatgagaccaacacagctcttgaagtacgtgaatctagatggtctaaacatcgatcgcagccacagtaccttccacgtgcagcaagatggggccgatgtattacgcggatcgggaaacatacggtggtgcttcgaagaagacgatatcccctacgaagtcgacgtggatgacttatttatcctcggtggcttagacaacttcataaatccccttggagtgattgagataatgaatctccactccttagagattcgccaaatttcatccggcacaatttcagaacgaaaaacttggatctttcccactgctgctcgctcattcaatcaaaatctagtacacccgcaaagcattgaaatcgatgcacaaaccggcgttattttggctatggaaaaccgactacaacgtaccgaagttgaatcagtagagtacccaacggatcttcctaatcctgcatggacaggtccagccatttcttggccactaaaagacccatcaatcgatttccctgacccgctcccccacagcatttccgaattaccacctcaatccgataatcctcggcatttgcgagtatccatcagcttagatgcagtggaaggtgcttttccgcgctaccggatcggagattcaatacgtattccgcttgtctttgcccgggacacgcccttcatgtccggcttagaaacaacacgtcgcgcctggattgaggcggccacggaaatggacatccataacacatggcccataatcctcaccggtgacggctggactgcactctctcattcagacaaaccaatacgccacgaagccgagttaaagggatggtttttccacagtttgttcggcagtgaaatgcccttgactgatctgaagattgaacgaatctacggaggcctgggtactttcgacagcggagccacccggtggcaagaactcacagacacagatgatgcctacacagaaaatggcagctggctgttggaagttatcgtcgatgccacccttgacggtgcaattccaccaccacttcagccacaacagtttgaagcatccatcactcacatcgtcgatgagcaactatgggtccttgggcagatgcttccagttctacgatgctgggatcttgaaaccggaaaatacctggggcaaacctatgtacctatttcggtttctcatagttctcggcttcagttttcggaagggttgattcacgattatgaaaatgcctggtcgctgaatcctggggtgcgcatgcttgcggagccacagccgtggatagagcctgtcatagaactcgacgttccagcgccatgggaattacaagaaagcttccccgatgggctttactccctaactgatggagagcaaacagcactgggtcgaagcactccagcaggacaattggaaatctgtgtaatcagcaatgacggatccaggatcttaaacgcaggccgagtagaagacctgtactttgtgcaattctggggcatgaccgtctttttgaattccaactttcaagtgcaaagtgccgaagaacatcagcttggtgcgaaacgtgaacgctggattacacaagaaggcgtagctgccaagttcaccgaagaagatgaaatcgtattcctcgatcagatatctggaagcgaaataaccaggtggaaaacaccagaaggatacttcactgaggtcagaattctgtcaccaaaccacttcaacatactggttactccgcctactggttctgactatctcaaaccagtaccttcctctgtctcagtgtttagagacggtcaatggagcaacattaaattcgaggacgtctctgtagaaatc

SEQ ID NO: 2950 - DNA, 1722 bp, Corynebacterium glutamicum
atgcgttcctttcaatcgatccttgacctggtaaattcagcatccgaggtggctaccaaaattgtgttgaagcgcttcgaaaaacggataaccagcgaaactgactgggtaccgtatcagcggtttagtctttggtcggttggttctccgctaacgatcgaacgcaaaggccccgatgtgcgtgtgagcaaggacaacactgccgttcttcagcgctatcaaagaccggaagcagaaggactgatcagctacttcatggatccaaagccatggataactgaattggcaggcctgaatctggacgatgtttccgaagatacagttgcaggtcggacagtattagtggttcccctatccaatgtcattctcagcatcgatgcggaatttgggatgattctaactgcggaaaacgacatagaaaagatccacgcaatatctgtcgaactcttagaaaaatggagatcatcccattaccctgagccgcattttcctgcagcggttctcccacctgcgtcgactggaaaccgcaacctccgagttctatgccctgagttttccattccaagtgtcaacgttggtgatcaggttttactatttttaacatttgatcaaaccctgccaccagtagatcagcttgaaactactcgccgcggatacactgatccaatccagcttgactacgaccaccgccaatacaggtttcacgccgacggttgggatgccatcatctccacggtggagccactacacgacgaagaagaactcacaggttacttcctgcaccgccttgacccagatagcgcgtacccaaccattgcagtcgttacagcagcgcactaccacggtacggacgcaattatcgacgtgaccctagatggtgtgcatccacccaaaaaccaagaaactcttgaaggcatcagcactagtaccagtgacggtgacatattttggctctccgatgaaagcttgcctttcgtccgtggattcagcgtgtcaacaggcgaactattacacgagatctccatccccacgttccaagagatcgtcctcgattccgctaatagagcccgcgtaaaacaaaagcaatggcctcacgatttcagtgattgcaagggaaaaacatgggagcttccggatcttaaagaagtattcgaagctgtcccttcgattccagcaggttggagattgttagacagcttcgggaaaaacttgcacaatgtcacacgcgaaaaccctcgtcttaatgacaacttttggcttcaaacaatccttaggcttaaaccatttaaagcagtagatcttgatatcggccgatcgataatcacagcaatttacccatacggtgatcgaatttacttacgcgctagtaaccaccacatcacgtttaaccaggacctcgagattctcaacgtagaagtctttggcgaccctgaggttcccgaatctggtctaatttatcttccacctggggattctccaacactcggttttcccaccggaacactcatgatgtttcatgagcaagaaggcacatatgctttccacgaccctgaaacaacagaacaaataacaactgtgaacttagacaggaatagtttttcagtggcatattcttcccgaaccaaaattgttatttcactgaaaaacccagaaagccgacctaccaacaagctgttggtgtgggaaccacaaaccgggtggcgagaacagaacctggagcgc

SEQ ID NO: 2951 - DNA, 162 bp, Corynebacterium glutamicum
ttgggaatccatgaatggagaaaaggcctttcacagcatgaagctcagtttctagagttctctaaagttgcgaaactgagctatgagaaaaaactactaaagagtgccacaagcaagtgcattgtgcaaatggtggttcttggagtgtttaggcggcttgct

SEQ ID NO: 2952 - DNA, 1443 bp, Corynebacterium glutamicum
atggattcccaaattaatactcagacctctccggcagctgcgaagctgcctagggaggtcgttgttgttctttcgatcctcgtggtttccgcgatgatcatgattcttaatgaaaccattctgtcggttgcgttgccttccatcatggaagatttctccgtgcctgaaactactgcacagtggttgaccactggctttatgttgacgatggcagtggtgattccaactactggttatctgcttgatcgtttttccactaagacgatctttgttactgcgttgttgttctttacggttggtacgttgactgcggcgttggctccaacgtttgcggtgctgcttggtgctcgtatcgttcaggcggttggtactgcgctggtgatgcctttgctgatgacggttacgttgacggtggttcctgcggagcgtcgtggttcgatgatgggcattatttccatcgtgatttctgttgcgccggcgcttggtcctacgttgtctggtgtcattcttaactctttgacctggcactggttgttttggatgatgcttccgatcgttgttatcgctttggtaattggtttcttcttgatcaaaaatatcggcgaaaccaagatcaccccactggatgttctgtctgtcatcctttcggtgtttgccttcggtggtttggtgtacggcttcagttccttcggagcaatcctggagggcgaaggcaccgtaggtatcttcgcgatcgtcgttggcgccatcgcactcctcatctttgctttgcgacagcaccaactcggcaagcaagacaaagcactgatggatctccgagccttcaaggtgaggaacttcagcttctccttgaccaccatccttttggcgttcggcgcgatgctcggaaccgtcatggttttgccaatctacctgcagacttccctcggagttactgctttggtgaccggtttggttgttatgcccggcggcctcctccagggtctgatcagcccattcatcggacgtttctacgacaaggtcggtccacgtccgctgctgattcccggagcaattgcgctggctatcgcggcatcctcgatgactttcctcaatgagaattcacccgtgtggatggtcgtggtcatgcacgttgtgttcagcatcggcatgtgtttgatgatgacccctctcatgaccaccgctctcggcgcccttccgaagcacctctatggtcacggctccgcaattttgaacacgttccaacagctcgcaggcgcagccggaacagcgatcatgattgcagcactttccttcggcacttccattgcagcgtcttcgggatctgcgcatgctgaagctgttgccgctggtaccaaggttgcgttcatcgcaggcgcaatcatcgcggtgatcgctttggttgtttccctcttcgtcactcgcgtcgaggaagaagctcac

SEQ ID NO: 2953 - DNA, 951 bp, Corynebacterium glutamicum
atgaaaaactggcaagaagaattccaactagtcaatctcacgaaacttctgcatagcgataccgagacttctgcggcaatcagtaatggtcaaatgattaaactcactcatgaagtcgcaatcaatgctgaaaagtaccgaagccttcctgcatgggataaagcagccgcccgagcttttgcagtgggtatgactgtggacaaagcagtggtagcggggcagtctgcggcgaggttatggggataccaaactttgactgttgagaaaaccgtgttgtgtctgttgccggaaaggctacgttcaaaatcctccaagcattggccgtccgggatgcgatataaagatcgttacctctcgtcgcgtgatattcgagaggttcatgggatccgagttacgggagcgttccgcacatttttggacatcgctttggatgatggggtggtggcggctgtggtcactattgattcagctcgaagacagaatccatcgcttacgcgtgagaagttaatgcacagtgcggaaagtttcccgaggcatcggggtgtgaaggcgtatcggcaggcgattgagttgtcgattcccaattcggatagtgctcaggagacgagggctcggttaatccttcgggaggccaagctcccggaaatccagtcagtgaaggtgcaggcccgtttcgatcaatcgcacaacaagtatttcctcgtcgatttcttgatcaatgagtggatcatcgtggagattgatggacgttcgaaatatgattccccggagctcaatgaggtgctcatggctgaacgcgatcgggagaaattcttcctcaatcagggctatgcggtcttaagaatcgatccgaaacagttagacctcaaccaagatggggagtgtgagttcatcggaatcctcaaaaacactttgcagaagaccccacctgagcacctcaagcaagccgcc

SEQ ID NO: 2954 - DNA, 1578 bp, Corynebacterium glutamicum
gtgactaattccaatcccacttccaagaacaattccgccgatttgcctgagcagctgcgaattcgtcgcgaaaagcgcgagcgcattctggacagtggattggacgcctacccagtcgaggttgatcgcaccatctcaatctctgacctgcgctcccaatttgttgtcattacagaagacctccaagagcgcgaagaaggcgtaacctacctcgaagtaggcgaagaaaccgacgttgaggtcgcaatcgctggccgcgtcatgttcgttcgcaacaccggcaagctctgcttcgcatccatccaagaaggaaacggcaccaccgtccaagcaatgctgtccctggcagcagtcggtgaagaatccctcaaggcctggaaagccgatgtggacatgggtgacatcgtttccgtccgcggcaaagtaatctcctccaagcgtggcgaactctccgtgatggctgactcctggcacatggcctccaagtccctgcgcccactgccagtcgcattcgcggacctcagcgaagacacccgcgtccgccaccgctacaccgacctcatcatgcgcgaacaagcccgcaccaacgcgctcacccgcatcaaggtcatgcgtgcactccgccactacctcgaagaccaagacttccttgaggtagaaacccccatgctgcaaaccctccacggtggcgcagcagcacgaccattcgaaacccactccaacgccctcgacattgacctctacctgcgcatcgcaccagagctttacctcaagcgctgcgttgtcggcggcatcgagcgcgtcttcgaagtcaaccgcaacttccgcaacgaaggcgtcgactcctcccactccccagaattcgccatgctcgaaacctacgaagcctggggaacctacgaaaccggcgcgaaactgatcaagggtctcgtccaatccgtcgcccaagaagtcttcggaaccaccctggtcaccctcgcagacggcaccgaatacgacctcggcggcgagtggaaagtcatcgagatgtacccttccctcaacgaagccctcgcacgcaaattcccaggacaaccagaagtaaccatcgactccaccgtcgaagaactccgcgaaatcgccaaggtaatcggcctctccgtccccgaaaacggcggctggggacacggcaaactcgtcgaagaaatctgggaactcctctgcgaagaccaactctacggaccaatctttgtcaaagacttcccagtagaaacctccccactcacacgccaacaccgcaccaagccaggcgtcaccgaaaagtgggacctctacgtccgcggatttgaactagcaaccggatactccgaactcatcgacccagtcatccaacgcgaacgcttcgaagaccaagcccgcctcgccgccgacggagacgacgaagccatggtcctcgacgaagacttcctcaccgcaatggaacaaggcatgccaccaacctccggcaacggcatgggaatcgaccgcctcctcatggccctcaccggcctcggaatccgcgaaaccgtactcttcccaatggtgaaaccagaacaaaag

SEQ ID NO: 2955 - DNA, 798 bp, Corynebacterium glutamicum
ttgagtttcacgcatggtcagggcagagtttttgataccgtcgagcagatccgcatgttcggcagcgccctgcgcaaaaccggcaaaccagtggtgctcgtacccttgggaaatggcctccacgcaggccatattgcgctcatccgcgcagcaaaacgcatccccggtgcggtggtcgtcgtcgcctatgccggcccggaatcggatcacgcacgtttaagggaagagcttatcgacgcgatcttcccgttcaatcccgaaacgctatggcctcacggcatccgggtggaagttacaggtggcccaacacttaccccacaaggtgcggaagtaaccaaggtgctggggctgttgggaatcaccggagcaactgatgtggtgctcggtgaaaaggactatgagctggtggttctagtccagcgcgcccttaatgatctgcatattccagtaaaactgcattctgttccaaccgtgcgcatgccagatggactagccatttccctgcgtaatatttcagtgcccgaagactcccgcgaaacggcattgagcctggcagcagccctcaccgccggtgcgcattcggcagaacacggcgaggcagtggttaaagaaacagtcacgcaagtgctcaaagccgcaggcgtgacccccgattatgtagaaatccgtggcctggatcttggaccagcccccgaaatcggagacgcccgactcttcgcagccatcacgcttggcgatgtccaactccacgacaacgtcggcctaccccttggaatcggcttcaaaaacatcgaaggc

SEQ ID NO: 2956 - DNA, 693 bp, Corynebacterium glutamicum
atgcaggctcctcgccttcgcgttggaatttttgatgatggatcatccaccgtcaacatggcggagaaattagattctgtcgggcactacgtgactgtgcttcacgcgcccgaagatattcgtgactttgagcttgtcgtgattgatgcccacggggtggaggggtacgtcgaaaagctttctgcttttgcgcgccgtggccagatgttcctgcatacctcgctcacgcacggcatcactgtgatggatccgctggagacgtccggcggcatcgtgatgtctgcgcacccgattggtcaggaccggtgggtggcgtccgcgttggatgagttgggggagaccatcgtggggcttttggtgggggagctcggtggctcgattgtcgagatcgccgatgacaagcgcgcacagttggctgcagcgctgacctatgccggatttttaagcaccttgcagcgcgatgcgtcgtatttcctggatgaatttcttggcgatcccgatgtgacctctgacatcgttatggattccgcacagcaattccaggcactgccttcgttggatgaggtcattgcccagtacgattcgattaacaaccccggcaggcaacgccttttccgggatttggcgcgcaggcaggcagagatttcccgcgcgcaagatattgagctgtgggcaattcagaaggaggaccgt

SEQ ID NO: 2957 - DNA, 798 bp, Corynebacterium glutamicum
gtgaggctccgcctccccaatctggcgaagcgatcagctagattggaattcatgaatcaagacctgtcacacgaggattccggcgacggcaattctgtcgaccgtggacagattctgctagcagtactcattggacttgccctgattgccagcgtcatcatgctgctggccaacagtgacggcgccatgaaaatagcacttcttgcagcgctgtgggcggcaatcatcggattcttccttgtttatcggtcccgcaaacaagtcgaagctgctgcgcgggagaaggaaaccctcgaatacgcacaccaatctgaactcaaccgactagaagctgaactcgtccaagaaaaaatggagatttctgaatcccgtcgtgcacgcgatcaggaaacccttgaggaaatcaaacttcaactggaggaaatgcgcacccagctgtctgagctttctggccgtgaatggggctatgagccaaccatgctgcgtgccgaagcccgacgaatccttgagttggaatcccagcagctttcccagcagttccaggcaccgcagccagaagtcccggagcctgttgcagttccagagccaatgccggaacctgcaccggtgccggaaccagtaccagaacctgagccagttgaagttgctgtcgaagctgaggaagaaccagcaccaggtcgcagaaggcgtaggcacgcagctcccgaagaaactggcggacgccgacgcaaagatgaacgccaaggcggtttgagcgtggctgatcttctggcagcagcaaggaaaaaggaaaacaac

SEQ ID NO: 2958 - DNA, 465 bp, Corynebacterium glutamicum
atgcagaaaacgtcagcgggttggttgatcgcaacgggaggtttcctcgccgctgtgtccgccattttgacgtggcgtttttatggatccatgacctctatttccatcacggtatccatcactttttggttgttggccgtggtgtgtggtttcgcaggtgtgaaggtccaaggtcgcctcgatgaggggctgatcggccaggacaaatcccaaatgaaccccgtgaccattgcctatctggccatgctgggtcgagcgtgtgcgtggggtggcgcaattttcggcggcgtttatgtgggaattggcagttatgtaatcccacgcgccggtgagttgtccgcagcatcgaatgatcttccgggagttattgcctgtgcgctgggcggaatcgcactctcagctgccggactttatttagagcgaagctgtgaggctccgcctccccaatctggcgaagcgatcagc

SEQ ID NO: 2959 - DNA, 477 bp, Corynebacterium glutamicum
atgcatgcagttttgtccatcggttccaacatggatgatcgctacgcgctgctcaacacagtgatcgaggaattcaaagatgagatcgtggcgcagtctgcgatctactcaaccccaccgtggggcattgaggatcaggatgaattcctcaacgcagtgctcgttgttgaggttgaagaaacccccatcgagttgctgcgccgtggccaaaaactcgaagaagccgccgagcgggtccgcgtccgcaaatgggggccacgcaccctcgatgtggatatcgtgcagatcattaaagatggggaagagatcctttctgaggatcccgaactgaccttgccacacccttgggcttggcagcgtgccttcgtgttgatcccttggttggaagcagaacctgatgccgtcctgcacggcacgaccattgcagaacatgtggataatcttgatcccacagacattgaaggtgtcaccaagatt

SEQ ID NO: 2960 - DNA, 390 bp, Corynebacterium glutamicum
atggctgatcgtattgaacttaaaggccttgaatgcttcggacaccacggtgtgttcgactttgaaaaagagcaaggccagcccttcattgtggatgtcacctgctggatggatttcgatgccgcaggtgccagcgatgacctttccgacaccgtagattacggcgcgttggcattgttggttgctgaaatcgtggaaggcccatccagggatttgatcgagacggtggccacggaatctgcggatgctgtgatggctaaatttgatgcgcttcatgcggtggaagtaaccatccataagcccaaagcaccgatcccacgtacttttgctgacgtcgcggtggttgcccgacgttccaggaaatccatggctgctggaaggagcaacgcc

SEQ ID NO: 2961 - DNA, 837 bp, Corynebacterium glutamicum
ttgaccatcccgggacgctgtttggtcatgggaattgtcaatgtcactgaggattccttttcggacggtggcaagtacattgacgttgatcaggcgatcgcgcatgccaaggaattggtggctgctggcgccgacatgattgatgtcggcggcgagtccacccggcctggggcagtgcgcgtcgacgcgtccgtggaacgggaccgggttgtgccggtcattaaggcgcttcacgacgccggcatccacacttccgtagacaccatgcgggcctccgtggcgcaggctgccgcgggcgctggcgtctccatgatcaacgacgtctctggcggtttggctgatcctgagatgttttctgtcatggcggaagcgcaaattcccgtgtgtttgatgcactggcgcaccctccaattcggtgatgccgcaggtcaggcagatcacggtggagacgttgtagccgatgtgcacgcagtgcttgatgatcttgtcgcccgcgccaccgctgctggtgtggccgaaaaccagatcgtgcttgatccaggtttgggttttgccaaatcacgtgaagacaactggcgtttgctgcaagcactgcccgagtttatttctggacctttccccatcctggtgggagcatcccggaagcgattcctggctggcgtgcgcaaagaccgtggcctagatgtcacccccattgatgccgacccagcaaccgcagcggtgaccgcagtgtctgcacatatgggagcatggggtgtgcgcgtgcacgatgtcccagtatcaagggacgctgttgatgttgccgcattgtggcgaagtggaggaactcaccatggc

SEQ ID NO: 2962 - DNA, 588 bp, Corynebacterium glutamicum
gtggataaccacgctgcagttcgcgagttcgatgaggagcgcgcaacagctgcgattcgtgagttgctcatcgctgtgggtgaggatccagatcgcgaaggcctgttggaaaccccagctcgagtggctagggcgtacaaggaaactttcgcgggtctgcatgaggatcccaccactgtgctggagaagacgttctctgagggccatgaagagttggttctggttcgtgagatcccgatttactccatgtgtgagcaccacttggtgccgttctttggcgtggcgcacattggttacattccgggtaagtccggcaaggtgactggcctgtccaagctggcgcgtttagcggatatgtttgctaagcgacctcaggttcaggagcgcttgacctcccaaattgcggatgctctcgtcgaaaagcttgatgcccaggccgtggccgtggtgattgaagctgagcacctgtgcatggccatgcgcggaatccgtaagcctggtgctgtgaccacgacgtctgcggtgcgcggcggttttaagaacaacgctgcctcccgcgctgaggtgttctccctgattcgggggcac

SEQ ID NO: 2963 - DNA, 915 bp, Corynebacterium glutamicum
atgcggttggagtcgcgtaagggttggggcggccgccacttgaatcaggggactgctcaggagcttgtgccggggtctgagccgggaagccctgctcagctggctgttcttctgcacgtgagcggtgctttccagcggaaccgggcacgctccaatcagctggaggtggggtgccataggatccggcagctgctccggccgcaggtgccacgccggcagaagacgcaggctgcaccggcaacttaccctgagcttccaattccttgcgacggcgttcgcgggttgcgcgggaggcctcaagaatggagaacttctttggtggttcttcgccacgttccagtgcgagctccactggggtttttactggttcgcggttttcttggcgagggaatcgtgtggactcgtcggggaagacttcggcgaccttgcgtgggacgatgtcgtcgaaaagcgcttcgaggtctgggcgtcgcagggtttccttttccaggagtttttccgcgaggcggtccaggtggtcgcggtattcagccaggatggagtaggacacttcatgggctttgtccaggaggaactggacttcggtgtcgatggttgctgcgacttcttgggagtggtccaagtttccaccgccaccgcgtccggagaatgggtcgccctgttcttggccgtatttcaccatgccgacagctggggacatgccatattcggtcaccatggatcgggcgatcttggtggccatttcaatatcggcggaggcgccggtggtgggttcgccgaagactagttcttccgcggagcgtccacccatggcaaagaccaggcgggcgaacaattcgttgcggttgtacatgcccttgtcatcttcttgggcagtcatggcgtgaccgccggtgcgaccgcgggccaagatgg

SEQ ID NO: 2964 - DNA, 2580 bp, Corynebacterium glutamicum
ttgagccggttgccactgcgtatgaaaaacaagaaatacctgcagttcggcggtatcgcagccgtaatcctcatcgttctgttcttggtgtccctgtttagcagtgacaccaggaacttccaggaggtcgatacctctgttgcgatggcacagcttgacgccggaaacgtcgccgaagctcaaatcgatgacagggaacagcgcgtccgactgaccttgcgtgaacccatcacggtggatgaacgcgaaggcgttgaagagatcctcgcgcagtacccagctcgtaccgcgccagcgatctttgagaaggtggaagcatccaacactgattcctataccaccaatgtgacgcaggagagcttcctgatgtccatgctgagcttcatcctgccgatggtgatcatcttcggtttgctgatgttcttcctcacccgcatgcagggtggtggcatgtttggcatcggtggatccaaggccaagcagctgaccaaggatatgcccaccaacaccttcgcggatgttgctggcgctgaagaagcagtggatgaactccatgagatcaaggacttcctggaagaccccacccgctacgaagccctcggagcgaaaatccctcgtggtgtgctgctttacggccctcccggtactggtaaaaccctgctggctcgtgccgtagctggtgaggctggcgtgccgttctactcaatttccggttctgactttgtggaaatgttcgtcggtgttggtgcctcgcgtgtgcgtgatctgtttaagcaggccaaggaaaacagtccctgcatcatcttcgtcgatgagatcgatgcggttggtcgcgcccgtggctcaggaatgggtggcggacacgatgagcgtgaacagaccctgaaccagttgctcgttgagatggatggctttggtgatcgtcaaggcgtcattctgatggctgctaccaaccgcccagatgttcttgacccagcgctgctgcgtcctggccgtttcgaccgccagatcccagtcaccaaccctgacctacgcggccgtgaacagatcctggaagttcacgccaagggtaagcctttcgcacccgatgcagatatcaaggcattggcaaagcgcaccgccggcatgtccggcgctgacctggcaaacgtgcttaacgaagccgcgctgctaaccgcccgcgtgggtggcaacgtgatcaccgccgacgctctggaagaagcaaccgaccgcgttgtcggtggaccacgtcgctccggcaaggtgatttccgagaaggaaaagaaggtcaccgcctaccacgaaggtggacacaccctgtccgcatgggcgttggaagacatcgagcgcgtctacaaggtcaccatcttggcccgcggtcgcaccggcggtcacgccatgactgcccaagaagatgacaagggcatgtacaaccgcaacgaattgttcgcccgcctggtctttgccatgggtggacgctccgcggaagaactagtcttcggcgaacccaccaccggcgcctccgccgatattgaaatggccaccaagatcgcccgatccatggtgaccgaatatggcatgtccccagctgtcggcatggtgaaatacggccaagaacagggcgacccattctccggacgcggtggcggtggaaacttggaccactcccaagaagtcgcagcaaccatcgacaccgaagtccagttcctcctggacaaagcccatgaagtgtcctactccatcctggctgaataccgcgaccacctggaccgcctcgcggaaaaactcctggaaaaggaaaccctgcgacgcccagacctcgaagcgcttttcgacgacatcgtcccacgcaaggtcgccgaagtcttccccgacgagtccacacgattccctcgccaagaaaaccgcgaaccagtaaaaaccccagtggagctcgcactggaacgtggcgaagaaccaccaaagaagttctccattcttgaggcctcccgcgcaacccgcgaacgccgtcgcaaggaattggaagctcagggtaagttgccggtgcagcctgcgtcttctgccggcgtggcacctgcggccggagcagctgccggatcctatggcaccccacctccagctgattggagcgtgcccggttccgctggaaagcaccgctcacgtgcagaagaacagccagctgagcagggcttcccggctcagaccccggcacaagctcctgagcagtcccctgattcaagtggcggccgccccaacccttacgcgactccaaccgcatccggtgagcaccctggtatgaaggcctatggcttcggcgattccgaactcatggaccaatcaacaggtgcggaacataccccaggtaacgtttcacaggaatccccaaccgaaatgatcgggttccgtttgccggatcatgaacgttcggactacccagaaaaggcgcaaaaagagtcggtgctggatgcttctgaaaccacagaaatgcctgtcgttccagatcagcccatcgatggtgattccgggaagtccgctgagggcacacaggagaatccggaaaatgaaggagacaaccgtgga

SEQ ID NO: 2965 - DNA, 582 bp, Corynebacterium glutamicum
atggccgaccacaaagatctcaatgttccagccaacccatacggcaccgacattgaatcagtattgatcagcgaagagaagctcaagcagcgcatcgccgaaatggccaagcgcgtctccgaagagttcaaagacgccgaagaagacctcatcctggtgtgcgtgctcaagggcgcgttctacttcctggcagatttctcccgcatgctcgacatccccacccagtccgagttcatggcggtgtcctcttacggaaactccacctcctcttcaggcgtggtgcgcatcctcaaggacctggacaaggaaattgaaggccgcgacgttttgatcgtggaagacatcatcgattccggactgaccctgtcctggctgatgcgcaacctgaaaaaccgcaaccctaagtccctcaacgtgatcaccttgctgcgtaagccagagcgcctgaccaccaacatcgacatgttcgacattggatttgatattccaaatgagtttgttgtgggctacggacttgatttcgcagaacgctaccgcgacctgccatatgtgggcaccctcgagcctcacgtgtactccgac

SEQ ID NO: 2966 - DNA, 891 bp, Corynebacterium glutamicum
ttggaattacgcaaggcggtgcgcccttacctgaaagagcatgtgcacattgggttgtcgggcgggccggattcattggcgctggtggctgctgtgctcgcggagaaatcccaggtaacggcgatttgtatcgatcataatctgcagaccggttctgctgaagtcacgcacaacgctgctgcgatggcgcgccacatgggcgcacaggcgatcgtgaagagcatcgaggtcgcgccgggggaggggatggaggccgccgccagggaggctcggtacgcggcttttgcgcagctcaccgatgagatttgggtggcgcacaccatggatgatcaagccgagacctatctccttggcggtttgcgggggaatcccgcgggcatgaaagatgcttctcgacgccccgagctatccattattcgaccccttctgggggctcggcgtgcgcacacgcacggggcgtgcgtggagttggggttgaaaccgtggcacgatccgcaaaattttgacgatgcctttcggcgggtagccatccgaaaccaggtgattcctcttcttgcgcaggtgcacgggggagaccctgtacctggtttggcacttgcggcgcgacgcgctgtggaggatgccgaagtggtggagggcgacgtcgagaagcggcgtttagagtggcaggacggttttcctgtgacgttggccggggaacctacgggccttaggcgacgcatgttggcggattttttgcgtggggaaggcatcgctgtgacctcgaggaaactcgacgccattgaccgattgctcaccgattggcgcggacagggtggcgtagccgtgggtaaaagcgataatggaaggttggaagtggtgcggcaaagtggcaagcttaagatcactgat

SEQ ID NO: 2967 - DNA, 1233 bp, Corynebacterium glutamicum
gtgggggctgtcatcggtggtggcgtgtgggtgaatcattctggttttggtttggatcacccggagcccatgtcggtggagatgcctgagcagctgttttcttctgcgattgatccggatgctttggaagccccagattttgccactttggagaaggatttgacctcgcaggctgcggattctcggttgggcacttttgtcggtgttgccagggatgtggaatctggtgaggtggtgtgggagcagaatcaggggactgcggtgaggccggcgtcggcgacgaagattttgacggcggcggtggcgttgtatgagcttggccgtgaggacaccatcacaacgaaggttgttgagggggagcagccgggaacggtggtgattaaggcgggtggtgatgtcacgttgagtgaggagatgctcgatgatttggccacccagcttgaggggcaagatattggcactgtgttgatcgatacgtctatttggcctgatgagggctttgctagtacgtgggatccagtggatgttgatgctggttatatcgctgatgtggagcccgcgatgattgaggctgcccgcattggtgggtcggagggggatctgccgaggtctcatactccggcgttagatgttgcgcaggcgttggcggatcgtgtcggcgcggacaccgtagatgagggcagcgctccggacaaaaccgtgctggcatccgtggagtctgacacgttggatcagcgtcttgctcggatgatgaaggattctgacaatgtgatggcagagggtatcgctaaggaagtggccgcgtcgaaggatttggctaccgattcggcgagtacctcgaagatgacgttggagattctcaaggacaagggcttcgatttgagtggcgtgtccattgtggataattcgggtttgagctttgacaacctcatcacgccccgcctgcttgatgatattttgacccgcgccgccacggaacctgagttgagttcactattgacatcgctgcctatcgcgcatggaaccggaaccttggaggatcgctacgacggactctcaggtgcgggttgggtgcgggcgaaaactggcactctgacggatacatcggcattggcaggggtggtgacctcggagtcggggcgtgtgtttacctttgcttttgtgtctaatggttccgcgattgtgccggcgcgtgaggctttggatgagatggcgtcgattctgagggacttt

SEQ ID NO: 2968 - DNA, 474 bp, Corynebacterium glutamicum
atgagcatcgaagtaaccgtcgaaatccctaagggatcacgcaacaagtacgaaatcgaccacgagaccggaaaggtctacctcgaccgctacctgttcactccaatggcatacccactggactacggctacatcgaccacaccctcggcgaagacggcgacccattggatgcactggtcatcctccccgagtccgtttttccagcagttgtggttaagtcccgaatcatcggtgttttcaagatgaccgacgaagccggcggcgacgacaagctgctctccgttctcgacgacccacgctacgaccacatccaggacatctccgacgtgtccgatttcctcaaggatgagatcgagcacttcttcgtccactacaaggacctggaaaagggcaagcacgttgacggttccggctggggcgacaaggctgaggctgaaaagatccacgctgaggcaatcgaccgctacaaggca

SEQ ID NO: 2969 - DNA, 219 bp, Corynebacterium glutamicum
atgctgaatcaggcggggctcgggccagaccagtgggacaaagaatctgaaaatccgacatctttgtcacatgtgccaggttttgcggagttgaagagccgcggacacccctcccagcccaagcgagcatgcaaaaagctgcgcaccccacctaaacaaaccggaaaaccggaatcgcagggatgcgcagctcttaatttacaaaagacttatgccttg

SEQ ID NO: 2970 - DNA, 1539 bp, Corynebacterium glutamicum
atgtctgatttaggacccatctggcgctggctgttattagtttccgtctccatttgtgcggcatcggggctggtctatgagctagccctggtatcgctttccaccagcttgaacggtggcggaattgtagaaacctccctcatcgtcgcaggttatgtagctgcccttggacttggtgcactgctggtcaagccgtttctcaactggcctgcgcaaaccttcctcggtgtggaaaccctccttggacttattggtggttgttccgcgctggtgctgtatttcaccttcgcgaccatcggccaatccctgtggattctggtgattgccaccgctgcaattggcatcctggtcggcgctgaacttccactgctgatgaccatgatccagcaaggccgcctcgccgacgccaaaaccacaggatctctggttgccaccttgaatgctgctgattaccttggcgcacttttaggtggcctggcctggccttttgtgttgctgccgtggcttggcatgatgcgcggtgccgcagcagccggaatgatcaacctcgttgcagcactattcgtgggctgtgtgctgctgcgacatttgcttccgcgcacccacttcttcgtatccgtggtggcgcttcttctcgcgatcgcagcgctagccaccgtgttggtgaaatccgacgggatcgttgccaccgcccgcgcacagctctaccgcgaccccgtgatctattcacaccaatctgactaccaagacatcgtagtgacagaacgaggcaaagaccgacgcctctacctcaatggcggtttgcagtattccactcgtgaccagcatagatatacagaatcactggtgtatccaagccttaatccagaggcagaatcggtgttaatcatcggcggtggcgatggcctcgcagcacgggaactcctccgattcccatcaatgcagatcacccaagttgaattagacccagaagtcatcgaagtagccaacacagtgctgcgctctgacaatgggggagcgatggaagatccccgcgtctccatcatcgttgacgacgctttcacctggctgcgctccggcggaaataatggcgaaacttacgattccatcatcatcgatcttcccgacccaaacaacgacaccatggccaggctgtattcagaagagttctacaccttggcccgagcacgactgaacgaacaaggccgcatggtggtgcaatcctccagcgcctacaccactccagatgtgttctggcgagttggagcaaccttgaaatcggcgggctgtgaacaagtcatcccatatcacgtgcatgttcccacatttggcgactggggcttccaactgtgtggccctgccgacatggaattagagcttcgggaagacaccccgccactgactttccttaatgatgaagttctggtggctgctggggtgtttgggttggataatcagcctcgtgaattggaaccttccacgctggatcatccccgcgtggtggaggatctgcgcaagggataccgcgaatcaggcgac

SEQ ID NO: 2971 - DNA, 399 bp, Corynebacterium glutamicum
gtgctcggcaccctttcatatttcgtgttggccgcagtgatcctcgtggtcggttttgtgattttggacttgatcaccccaggtaaactgcatgaactcgtgtttgtgcaccatctgcccaacgccgctgtgatcaccgtggcgcagcaggtttccatcggaatcatcgtggtcactgctgtgctgacctcctcagatattttgagtgaaggtttgctggagactgcagtgttcggtgcccttggtctggttatccaagtggtggtcatggcggtgttggaagctgtcattccgggacgtttccgtgatctcgtggaagatcccaaactccgttccggtgccgtcgtggccgccgtcatcttgatcgtggtgggaaccgtaaacgctgcatgtctgatt

SEQ ID NO: 2972 - DNA, 411 bp, Corynebacterium glutamicum
atgagctcccgaaactaccgaagcataggattcatcctgctgtttttagcagtgttgtgcctgttcgctgcggtttttgccaagcctgcggtgggaagccaagtctccgaccgctggcccggaaacaacggcacctactcatgcgctggcgaaagtggggtggtggatgaaatcgtgaacatgtccaccccaaccgaccgcgccaccgaccccgcaactggcgatacttacctgcgatacagcaaaaacctgatcatcatctcaggtgaaggcacgccggaatgcaccatcaccgtcgaaggccttgaccgcgtcaacagtggtgcgttcatctggctcggcggcggtttcggcccatcctcaccaagcagttccagcggcggatcctccggttccggcggtggcgtgaaa

SEQ ID NO: 2973 - DNA, 498 bp, Corynebacterium glutamicum
atgattcatcacatcgattgcatgcctacagatgtctccgccgaagcgctcggcgtgagctggaatggggaatcgccggaggtgctcgtcgataagcttatcgacgcatccccacaccccagcacctgccatttagcggtgattggcggctcgcatgtggttaccgttgaaacgcccgatgggcgtttccgggaagaaatttcctgccatgcacaagaagcggaagattcccgctggccgctgcccgacagcatcacgcgggaaaactacctgctgcaaaccaacgtcgccgtgctgtctgaggaagattttgcccgcgcagccgaagaaatctccaacggcgacgacgactggttgatcgccagtttccccggcgccggcgaacaccacctcaccgcgctgaccgcagaatttctggaagacgtatgggaatggtttagccaccacctctacccagaagagctcaccatcgtgagcacgaggagcatttacaaacca

SEQ ID NO: 2974 - DNA, 609 bp, Corynebacterium glutamicum
atgaatatcacgtggcttatcctggccggtgttttagccatcatcgctgtcgtgttcttttatctttcagcacagaagaaaaagagcgaaccgcagcctcctcgtcagcgtcaagatcctctgaaatttgccgacggatccgacacttttaatgcccgcattttgggtcctggagcaattatttcccgcggtggcgtggattatgtctgccgcggagccatccagttccgtcaaggccaatacatttggcacgagtatctactcgacggtggcaaaggcagtgagtacctgagcgtggaatacgatgagggccaactcaacctcggatggtggattacccgccctgacctggcacaacagcccgcacatgatgtcaccgtggagggcgttcgctaccgtaaaaccgaatctggcgtgggcaccttcacctccgaaggcaccaccggcgtggctgatcaaggtgaatttgaatactgggatctcgccgaagttggcggaaacaggttgctcagttttgaacgctacggcaaagacagtccatttgaagtatcgctcgggtggacggtgctgcccggcgaactcaccgtttacccagcaccagaggcctca

SEQ ID NO: 2975 - DNA, 249 bp, Corynebacterium glutamicum
atgttcttggcagtcattttggcgattactgcggctcgtaaattcggtgccaatgtctttacatcagtcgcactcgctggtgcattgctgcacacacagcttcaggcagtaaccgtgttggttgacggtgaactccagtcgatgactctggtggctttccaaaaggctggtaatgacgtcaccttcctgggcattccagtggtgctgcagttggcgttgcatgtagcgagtttgatgaagttgtcgcga

SEQ ID NO: 2976 - DNA, 264 bp, Corynebacterium glutamicum
gtggatatcgtgtcttccatctttgctccgattctgggacccatggctggtgttggtatcctcaaaggccttctagctgttgcagctgcagcgcactcggtggatacgacatccacgacctatcaaattctttatgctgcaggcgatgccttttcatgttcttggcagtcattttggcgattactgcggctcgtaaattcggtgccaatgtctttacatcagtcgcactcgctggtgcattgctgcacacacagcttcaggcag

SEQ ID NO: 2977 - DNA, 1233 bp, Corynebacterium glutamicum
atgagcacaccacaaagcatcgtcattatcggcggcggtttagccggagcgaaaaccgcagaggcactacgtgtaaacgggtatgaaggctccatcacgctcatcgcagcagaggattatctgccatatgagcgcccaccgctgtcaaaggagtacatggctggaaaagtgggctttgacaaggcgattgttcacccggcggagtggtacaaagaaaacaatgtcacgctgcgtcaaggtgtgcgtgcaacggcaattgatgcgggttcacgccaagtcaccgttgatgatggcggaaacactgagaccattaactacgacaaactagttcttgctactggatcagcagtgcgcaaacttccaattccgggagccgacgcctctaatgtgcactacctgcgcaccgtggaagactctgacgcgatcaaggcaaccttcggtgaaggtaaaaagctggtcctcatcggtggtggctggatcggactcgaagtcgcatcagcggcacgaggagctggcactgacgtcactgttttggaaggtggaaagctcccacttttgaaagtccttggtgaaacggtcgcgcaagtctttgccgatctgcatgtggcaaacggcgttgacctgcgcaccgaagtgaaaattacggacatcgtcaccgaagatggacgtgcagttggcgtgcgacttgatgacggcgaagtggttcccgcagacgcagtagtcattggcatcggtgtcaccccagtgattgacctagcggaaactgctggactggaaatcgacaatggtgttttggtggacgcagcactgcgtaccagcgacccggatatctacgcagttggagacattgcgaaccacgatcacccagttctaggacaccgcatccgcgtggagcactgggccaccgcgttgaatcaacctgcggctgcggtgaaatccctacttggcaaagacgccgagtttaccaaccttccgtacttctttacagatcaattcgatctgggttgtgaatacgtcggccacgccaccggttcgcaggagaaggtattcatccgtggaaaccttgaaacacgagaatttgtcgccttctgggttgatactgaaaaccgaattctcgccgcaatgaacgtgaatgtgtgggatgttcctgatcaaatcaagcctctcatcgcatcaggaaagagcgttgacaccgagaagctagtggatccagaagttccgtattcagagctc

SEQ ID NO: 2978 - DNA, 288 bp, Corynebacterium glutamicum
atgaaggaagtagcagtcaacgaagtcccagcaggcgcacagttgatcgatgtccgcgagaccgatgaatacgcagaggttcgagcacagggtgccgtcaacattcctatgagcgagttcgttggccgcatcgatgagatcgatctggaccgcgacatttatgtcatttgcaagctgggtggacgctcagctcaggttgccgaataccttgagcagcgcggaattgaagccatcaacgtaaacggtggcaccgacggctgggttgctgcaggattgccaaccgaggca

SEQ ID NO: 2979 - DNA, 444 bp, Corynebacterium glutamicum
atggctacgcatccagatattcccacagagttgcttgaatctccgagctatcaacttgaacgacttcgacgacgcactcgtgaccatgttgaggccgaattggccaagcatgagaccacgatgagggaattctggacgcttacatgtctggttcattccgacgctgcaagccagtcagttctgtgtgagctgctggccattgatgcatcggatatggtcagactcgttgactcacttgaggtacgcggctgggcgaaaagggaacgtgatcccaaagaccgtcgtcgccaaattgttgcgtcaacgaagaagggaaaaaacgcccaggcggatctgcacaaagttgtgcttgaggcagaggatgctgcgttggatgagtctacgtccaagcagttgaagcaccttcgtaaattggccgcagcaattatctccaccgaagaggac

SEQ ID NO: 2980 - DNA, 3885 bp, Corynebacterium glutamicum
gtggcattgagcagtgttccagcacagttcctgagatccgcccaggcgcccccgaagcgtactttgtgggacgtcttagaatccgtcgcctctacttatcctgaggcagcagctattgacgatggccaggtgttgacctacgcagagttgatggaagaagtcaccgcgttggctgattccattcatgcacagggcattcgccgtggtgatcgcatcggtattcgcatgccgtctggtacgcgtgacctttacatcgctattttggccactctcgctgctggtgctgcttacgtgccagttgatgcagatgatcctgaagagcgcgccgagatggtgtttggtgaagcaaatattaatgcgcttttcgacgccaccggcttccatatgcttcgcccgaccgcgggcggcgatacccgtagaccacgcttggatgatacggcgtggattatctttacttccggttccaccggcaagcctaagggtgtggctgtgtcccaccgttcagctgcggctttcgtggatgccgaagcacaaatgttccttgtcgatcacccttccggcccccttggcccagaagaccgagtccttgcgggattgtctgtagcctttgacgcatcttgtgaggaaatgtggttggcctggggccacggcgcctgcttggtgccagcaccacgctccctagtccgttccggtatggacttgggcccatggctgattcgccgcgacatcagtgtcgtctccaccgtcccaactctggctggtctgtggccagcagaagcattgtcacaggtccgcttgctcatcgtcggcggcgaggcttgctcgcaggagctcgttgaacgcttatcgacgcctgaccgcgaggtgtggaacacttacggccccaccgaagcaacggtggttgcctgtggcactcaactctatgctggtcagccagtgggcattggtttgccacttgctggttgggatcttgttgttgtcgacgatgccggcgaacctgtcggaatcggcgaggtcggcgaattggtcatcggtggtgtgggtcttgcacgctaccttgatccagaaaaagaccgcgagaagtatgcgccactgaagtctgttggttggacccgcgcttatcgttccggtgaccacgttcgtctggaagaagatggcctctactttgtgggccgcgttgatgatcaggtgaaaatcggcggtcgacgcatcgagctcggtgaagttgatgccaatgtggcagcgctttccaacgttcgttcctccgcagtggttgttcagaccactggtgcggatcaaaaagttctggttgcatacgtttctttggaagatgctgcagctggatttgatcacaacgtcgcgactgcccgactcaccgaaaccatgcctgctgctttggttccgcgcattcacgtgatggatgatctgcctgtcaccacctccggcaaggttgataagaagtctttgccgtggcctcttcctggcaccgtggtggaagctaatgacctcagcgcaacggaagcctggattgctcaggaatgggtcgatatcctcggcacttctgtgagcagcaaagacgccgacttcttctcccttggcggtacctctctcgcggctgcgactttggttggccgggtacgtgcaaaggttcccaccgctgcggtgcgtgatctttacgatcaccctcgcttggagaaattcgccgagcgtgtcgaggctatcgccgccgacactggcatttctttggaggcgccaaaccaggtggaggagcgcgtcgtcaagcctgtttcttttggcactcgtgtgatgcagaccctcatccagattccgatcatgacgctgcaagcagcacagtggattgcatggttgctgttgggcaacaacatcatggcagcgcttgatttcgattgggctgttcatgtctcctggtggcttgtcatcggcatgattttggtgttcgctaccccgattggtcgcttgccgatcggcggttggggcgcccgcatcatcacccgtggcataactcctggctcctaccctcgtggcggttccactcacctgcgcatttggtccgccgagcgccttgctgatgcctctggctctcgcaatatttctggcgcaacctgggtgaactacttcgcgcgttccctgggtgtgaagatgggcaagggcgtggatcttcactccctgccaccaatcactggccttttgaccttgggcaacaatgtttccatcgagcaagaagttgaccttcgtggctactggctcgacggcgatatcctgcgtgtaggcaccattgaggtccatgacaacgctcgtatcggcgctcgttccaccctgcttcccggcaccgtggtgggcaccggcgctcacctgctgcctggttcaacagtgactggtgataagaccatcaagcctggttctcgttgggctggctcccctgcacaaaaggtgggtcgtgcaaagcaccgcttcccaacctcccatcctccacgcaggtcccggtgggttccggtgttcggcgcgacctccatcgtgttgtcgctgctgccacttcaggctctcgctattggcgctgctatcaccttgtggctggccacgattagcccgcttccactgatctggggtgtgctggtttttgctaccgtcggcgcgttggctgcgttctttgcttacaccgtgaccatctgggtgcttgtccgtttgatccagatcggcatcaagggcggcaccgcaccagtgaggtcccgtcttggttggcaggtctgggcagttcaacgcctcatggacgatgcccgcacctatctcttcccgctctacgcatcccaactgaccccactgtggttccgcagcttgggcgcgaagatcggcaaggatgttgagatctccaccgcggtgatggttcctaaactggctgatatccgcgaaggcgcattcctggccgatgacaccctcatcggtggctatgagctgggtaatggttggctgctcagtggtgaaacccgcgtgggtaagcgttccttcattggtaactctggcatcgcaggacctgagcgcaagctcgctaagaactccctggttgcagtgctctcctccaccccgaagaaggctaaggccaactccaactggtggggttcccctccagagcgcatgcgtcgtgtcactgtcgaagttgatgagggcgaagcaaagacctacagccctggctttggtgtgaagtttgcacgtggcgcggtggaaaccgcacgtctgcttgctccaataacctctggtgtgttggctgcgctgtcactgctgctcatgcagtacctgctcactgagttcaacatgtggatcacctggttgcttggcggactgatcctcatgacggttggtgtgctcgccatgggcattacggttgtgatgaagtgggtttgcgtcggcaagcataagccgtctgagcaccctctcttcagccgctttgtgtggctgaatgagctgcaagatgcgttcgtggaatccgtggctggcccatggttcctcgtgcccaacctgggcaccggcgcgctgaacgccggcatgagcgcgcttggcgcacacatcggccgtggcgcatggatcgaatcctactggctgccggaaaccgacctctgctacatcggcaagggcgcaaccgtgggccctggcgtggtcgtgcagacccacctcttccaggaccgcgtgatgagcctagatacggtgaccgtcgctgacggcgccaccctagcggaccactccgttgcccttcctgcttcgcttatcgacgcctccgccaccatcggcccaggctcgctggtgatgcgcggcgacaaggtaccagcgcatacccgctggcaaggcaacccaattgagccgtggagcaactct

SEQ ID NO: 2981 - DNA, 1461 bp, Corynebacterium glutamicum
atggacctcaatggtgcctacacgcaggatatcgccgtcgagccagtagccacgaaggtcaacttcttgctcgatggaaacattgttgcccaaggtcaaaaggccagtgattggtggcagggagtgaagatccacgcccttgcccatcttcacacccagggaacgcgcgaagtagttcacccaggttgcgccagaaatattgcgagagccagaggcatcagcaaggcgctcggcggaccaaatgcgcaggtgagtggaaccgccacgagggtaggagccaggagttatgccacgggtgatgatgcgggcgccccaaccgccgatcggcaagcgaccaatcggggtagcgaacaccaaaatcatgccgatgacaagccaccaggagacatgaacagcccaatcgaaatcaagcgctgccatgatgttgttgcccaacagcaaccatgcaatccactgtgctgcttgcagcgtcatgatcggaatctggatgagggtctgcatcacacgagtgccaaaagaaacaggcttgacgacgcgctcctccacctggtttggcgcctccaaagaaatgccagtgtcggcggcgatagcctcgacacgctcggcgaatttctccaagcgagggtgatcgtaaagatcacgcaccgcagcggtgggaacctttgcacgtacccggccaaccaaagtcgcagccgcgagagaggtaccgccaagggagaagaagtcggcgtctttgctgctcacagaagtgccgaggatatcgacccattcctgagcaatccaggcttccgttgcgctgaggtcattagcttccaccacggtgccaggaagaggccacggcaaagacttcttatcaaccttgccggaggtggtgacaggcagatcatccatcacgtgaatgcgcggaaccaaagcagcaggcatggtttcggtgagtcgggcagtcgcgacgttgtgatcaaatccagctgcagcatcttccaaagaaacgtatgcaaccagaactttttgatccgcaccagtggtctgaacaaccactgcggaggaacgaacgttggaaagcgctgccacattggcatcaacttcaccgagctcgatgcgtcgaccgccgattttcacctgatcatcaacgcggcccacaaagtagaggccatcttcttccagacgaacgtggtcaccggaacgataagcgcgggtccaaccaacagacttcagtggcgcatacttctcgcggtctttttctggatcaaggtagcgtgcaagacccacaccaccgatgaccaattcgccgacctcgccgattccgacaggttcgccggcatcgtcgacaacaacaagatcccaaccagcaagtggcaaaccaatgcccactggctgaccagcatagagttgagtgccacaggcaaccaccgttgcttcggtggggccgtaagtgttccacacctcgcggtcaggcgtcga

SEQ ID NO: 2982 - DNA, 1563 bp, Corynebacterium glutamicum
atgatcaaacgtcttcctttaggtccgctgcctaaagaacttcatcagactctgcttgatctgaccgcaaatgcccaagatgcggcgaaagtggaggttatagcgccatttactggcgagaccctcggatttgtttttgatggtgatgagcaagacgtcgagcatgcttttgcactttcaagggcagcccagaaaaagtgggtgcacaccacggcagtggaacggaagaagatcttcctgaagtttcatgatctggtattgaaaaaccgtgagctgctcatggacatcgtgcagttggaaacaggcaaaaatcgagcatcggctgccgatgaggtgttggacgttgcgatcaccacccgcttctacgcaaacaatgcaggaaagtttttaaatgacaagaaacgccccggcgcgcttccgatcatcacgaaaaacacacaacagtatgtgcccaagggagtggtcgggcagatcacgccgtggaattaccctttaactttgggagtatctgatgctgttccggcgctgctggcaggaaacgcagtggtggctaaacctgacctcgcgacacctttctcctgcttgatcatggtgcacctgctcattgaagccggtctgccgcgtgatttgatgcaggttgtcaccggccctggcgatattgttggcggtgcgattgcagctcagtgtgatttcctcatgttcactggatccacggccacgggccggatcttgggtcggacaatgggtgagcgtttggtgggtttctctgcggaattaggcggaaagaaccctcttattgtggccaaggatgcagatctggacaaggtggaagctgagcttccgcaggcgtgtttttccaactcggggcaattgtgtgtctccactgaacgtatttatgtcgaggaagacgtgtacgaggaggtgattgcacggtttagcaaggcggcgaaagccatgtccattggtgccggatttgagtggaaatatgagatgggttcgttgatcaatcaggcgcagctggatcgggtgagcacctttgttgatcaggctaaagctgcgggcgccacggtgctgtgcggtggcaagtcacgccctgatattggtcccttcttctatgagcccacggtattggcggatgtcccagagggcaccccactgctcacggaggaagtcttcgggccggtggtgttcatcgaaaaggtagccacactggaagaagccgtcgataaggcaaatggcacgccctacggcctgaatgcgtccgtctttgggtcgtcggaaaccggcaatcttgttgcaggccagctggaagctggcggtatcggtattaatgatggctacgccgcgacgtgggcgagcgtgtccacgcctctgggtggcatgaagcagtcggggctggggcaccgccatggtgcggagggaattacaaaatatgcggagatccgaaacatcgcggagcagcgctggatgtctatgcgtgggccggccaaaatgccgcgaaaggtgtactcagacaccgtggccacagcgctaaagctgggcaaaatctttaaagttttgccg

SEQ ID NO: 2983 - DNA, 918 bp, Corynebacterium glutamicum
atggtgggtaaacttcccatcatggctgaaaccaacgaaaatgatcttccagttatcgaccttgcccaaatcgaaggctatgttgtagatgactcggatgaagatgatccagtacttctgcgtccagatggaacccccattgaaacctggcgcgaagacttcccttatgaagagcgcgtcacccgcgaagactatgagaaggtcaagcgctccctccagatcgagctgctgaagtggcagaactggaccaaggaaactggccagcgccacatcattttgttcgaagggcgtgacgccgctggtaagggtggcaccattaagcgcttcaacgaacacctgaaccctcgtggtgcccgtactgttgcgttggagaagccatcaccacgcgaatccacctcatggtacttccagcgctatattcagcacttcccagctgctggcgagatcgttttctttgaccgctcttggtacaaccgttccggcgtggagcgcgtcatgggtttctgcaccgaatcacagcatgcagagttcctgcgtgaggttccaatgctggaaaacatgatcctgggctctggtatcagcttgaccaagttctggttctcggtgacccgtaaagagcagcgcacccgttttgctatccgccaggttgatcctgtgcgtcagtggaagctttccccaatggacttggcttcacttgatcgctgggatgattacacccgcgctaaggaagagcagttccgttacaccgacactgatgagtccccgtggatcaccatcaagtcgaatgacaagaagcgtgcgcgtatcaacgcgatgcgttatgtattgtccaagtttgattacaccgacaaggattacgagctcgttggtgagcctgaccctaaggttgtgcttcgtgggcgcgaccagatcggtgac

SEQ ID NO: 2984 - DNA, 162 bp, Corynebacterium glutamicum
atgccacgcttgatgcccattgggttagagccagcagcaacgttgcgcaggccttcccgaaccagagcctgtgccaatacggtagcggtggtggtgccatcgcccgcgacgtcatcagtcttcttagcgacttccttgaccagctctgcgccgatcttctcg

SEQ ID NO: 2985 - DNA, 177 bp, Corynebacterium glutamicum
atggtgacaccatcgttggtaatggttggggcaccccaagccttttccaaaacgacgttacggccctttggtcccaaagtaaccttaacagcgtcagccagggtgttcagtcccttttctaggccacgacgtgcttcctcatcaaaggcgatgatctttgccatgtgtttgtgctcc

SEQ ID NO: 2986 - DNA, 1644 bp, Corynebacterium glutamicum
atggcaaagatcatcgcctttgatgaggaagcacgtcgtggcctagaaaagggactgaacaccctggctgacgctgttaaggttactttgggaccaaagggccgtaacgtcgttttggaaaaggcttggggtgccccaaccattaccaacgatggtgtcaccatcgcacgtgagatcgagcttgaggatccttacgagaagatcggcgcagagctggtcaaggaagtcgctaagaagactgatgacgtcgcgggcgatggcaccaccaccgctaccgtattggcacaggctctggttcgggaaggcctgcgcaacgttgctgctggctctaacccaatgggcatcaagcgtggcatcgagaaggctgttgctcaggtaactgagaagctgctcgaggctgcgaaggaagttgagaccgaggagcagatcgctgctaccgctggtatctccgcagctgacccagctatcggcgcacagattgctaaggcaatgtacgcagttggcggtggcaagctgaacaaggattccgtcatcactgttgaagagtccaacactttcggtgttgagctcgaggttactgagggtatgcgctttgataagggctacatctccggttacttcgcaactgacatggagcgcctcgaggctgttctggaagatccttacatcctgctggtttccggcaagatctccaacatcaaggacctgctcccactgctggagaaggtcatgcagtccggcaagcctttgctgatcatctctgaggacgtcgagggcgaggctctgtccaccctggttgtcaacaagatccgtggcaccttcaagtctgttgctgttaaggctccgggcttcggcgaccgtcgtaaggctcagctgcaggacattgctgttctgaccggtggccaggtcatttctgaagaggttggcctctcccttgagaccgctgatctgccacttctaggccaggcacgcaaggttgttgtcaccaaggatgacaccaccatcgttgacggcgcaggttctgaggctcagatcgaaggccgcgtcaaccagatccgcgttgagatcgagaactccgattccgactacgaccgtgagaagctcaacgagcgtctggctaagcttgccggcggcgttgcagtgcttaaggtgggcgcagctaccgaggttgagctcaaggagcgcaagcaccgcattgaggatgctgtccgtaacgctaaggcagctgttgaagagggcatcgttgccggcggtggcgttgcgctgctgcaggctgctcacgtcctggacaacgatcttgagctttccggcgacgaggcaaccggcgttcgcatcgtccgcgaggctctgactgctcctctgaagcagatcgctgctaacgctggcctcgagccaggcgttgttgctgacaaggtttcccagctcccacagggcgagggcctcaacgctgcaaacggcgagtacgtcgacctcatggctgcgggcatcaacgacccagttaaggtcacccgctccgcactccagaacgctgcatccattgcagctctgttcctgaccactgaggctgtcgttgctgacaagccacagcctgcaggcgcagctggcatgccaggtgcagacgagatgggcggcatgggcggcttc

SEQ ID NO: 2987 - DNA, 180 bp, Corynebacterium glutamicum
atgagttttcagcatgccgaaggcgtgaggcttgatgcggttcgcgcagaggaagaatatgaggcgcagcgacaggccaagcgaaaggcgcggaatcgttctgcgatgttgtggatcggcactggcattgcggcagccgtaattattgtgctcgtgatggtttttatctggtcacgtatc

SEQ ID NO: 2988 - DNA, 1209 bp, Corynebacterium glutamicum
atgaccgctcctgatgtttacccaccctccactggtctgctccccacacggtgtcctttcactttccaagtgctgccggatccagaagcgacctcatcaccttttgttgatgcgacggtccaggatgcgaccctgccagacgggtggcaaaattccggaactctgactttcgcaatggcaggtgacaggtcatcgggcaagagtatgtacattgcggtgatcgtgaagctgctgcgcaaactggtcgttgccaacggtggatcatttttatacgccgatgagcacacccgccggatttaccaggaaaaatacgagaagccactgtttgaacagatgggattgcttccgcctactccgccagcatcggctcctgatgcacatcagcagcgtccattgatctttgatatttcaacctcgaatcatccagagcagcgactctttttagtctttagggatgtggcaggcgaagatctgcaggaagagaatttttcggctcgtgaagacgaactagcgtttttccaaaacgcggaccgcattctttttctgtttgatcccatgtctgttccacgaatccgacagatgttggaaggttcagtccccactcatgaggtggacactgatgggccgatggttgtcttaagaaacgtgctccgagtgttgggaccggattatcgccccaagatttccctgtgcatgtctaagttcgacaccatgcagcagctagctgaagtgaaccaagatcacctgcactatgcaggagcaaacatggtgaattggcagcgcgtgatgagcaactttggtgcaactttccgcagggacagtgctccgcttgatggtgcatatgatcgcgttgctggcgagattttggatctggaaattcgaagcatgctgcagtgcttggatgcgacgcatttgctgaaccagttcaatcagcccctagctggtgaagaggcttatccgttccagtgcttcgcggtgtctcctctgggtgcaagtcctgaaggtgatcggattaatcgaagcggtatcgcaccgtttcgttgcctggatccgttgagagagttgttctcggaaattgggattctagaggggctggagacgtcgaaaagcaatatcccgcctgcccaacctgccccgaccagccagcctgaagcccaagaggccccggttgaagaacctaaaaaacgtggattcctgaggtggtttaaa

SEQ ID NO: 2989 - DNA, 963 bp, Corynebacterium glutamicum
atgaacgtgattcgactggattccaaccagacctatgacgtaccacgcgagggattttctgcacgtctggaatttgatctcagcgaggacttaggattccgggtagaggttccttccacagaaaccaaccgacgtggcaatacgtggtggattcgtaatcctcaaggaaataccgaggtcacggtgtttcctgatggcgatcggggagaattcccttcgggaaccaagctgtatgtaactgtggtgattcaggaggctgggcgccaagaaactacgctgcagcttccaacgtatcctatcggtggtttacgctccatcccgattcttaacgttttcccaagccagggcatcattcgcatgcaggctggcgatgtgagcaatgacagttctttggactctgaggcttcggcagttcgatcagcgttgggacgcaccattgataaggacggctcagctgatattgctcgagctaatgtcaccgtgttggtcgataagacggcgtcgatgaaagcaagcaccagccgcgagacctttgatctcatgtgttctttcgccactggtgttttatcagtagtgagccagggacgctccatccatgtgatgaccagtagcgctacggatccaaaagtgcgtgtcgctaatccggaggagatcagcaagctttcggaaaagtacgcgccggtgagggaagtggggtggaattcggatttgcaccagatttccccagacgatgcgctggtggtgatctctgatgacattcctgccgagatcttaaaactctccaacaacctgcatgttttgagttctcggaaacctttggtggaacatggaaccagcaccacctatttcgatccagtgctgattaacgctattaaaaatcatgatcagcgtcttctcgctggacctgtccaccaaatgtttaacgcgttgacttcggttgcacgacgagaggatccaacgaca

SEQ ID NO: 2990 - DNA, 1986 bp, Corynebacterium glutamicum
ttggtggaagcaggtgagttgcccgtggccttgagatggactcatgtcacctacgcgtcctttagaggaactgcaggtaggggtgggtggaaggtgggaacttggtctgctcaggccactaaagaagacctccaatttatcgcggaggttgcgcccactcatattgaaacggtgaccccttttgatgatttcatctcatcagaagatatcgatgcgttgccgaggaggtttgagtaccgtcctttggcaggccgatcgttgatcatgcagtctgttcctgcaggtaaagatgccactggacgtccagggaatgtgttcacccatgcagtatttgatggggatctagaaagcccactggagtctgtttatcccatttccctgtaccgttcacctgatttgctgaccccttttcgtgcagccgcggtcaacgctgccgagctccctttggatgcaggcgagccgagaattggccccatcactgatctgtccttgtcgtggatgatgatcgacagcatgtttggcgatcgcagacagcagttctaccagcttcaagatgctctccaagctggagataaagctactgttttggttctgaacagcactaacgaggcagcatattggcttcaagcgttgtcttctacattgactccgaatgaagcccggcgtctgttgcacttctcaacctttgagcgtgctgctaccttgccagctccagataaatcaatggaggctcgttctctgtttgtggtcccaggaattgatcgtgaattgttggcggagcattcagggattgtgattatcgatccggagattccacagagccaacctttcggcccgcagggatcctggtcccgaatgacagaagggctcttctccgacggttttgatgctgatgaacttgtcgcagggctgattcgtgccaacgagaacctggataatagccaaaaggaactcgctcaatttggagacggtttagcgcgatttatccggaatggccgtttttccggcacgcacccgcttcgcgtacttgctgatcagcatatgtttggaaaggtgccagacaagccagcacctaaggtggagcctgtcgctccggcaccaaaccccaatgcaatttgggcgcgtgcatctgaggtagttcacaatcctcggagagcatcagaatcacaagattggccaagtctgaggcgattgccggatagtcggcgcaggatcatcaatatgtcagagcaggcgatcaacagcattgagaagcttcatgattcgccggcacaggatcttgttgcctatttggatttccttttgaaaactgagcttgcgacaagcattaatgcttcggatcccttttttcggagtagtttttcagactttccagcgatggacaactggcgacacattaagttcaccgaggatgcgcaccctcgcttgagggaactactcgtggacgcagaacgcgatgctaggaacagagcacctgcggcaatcgtcttggaccatatcgttccgaacttcagcagagatcggtctttgccagacatcgaagactggacgagaagcgatgaagctcagcagatctttgcaggaatcattgcgggtgcgtctgttcaaactggtagaagccacttcatgtgggatcttttgcgggcgtattttggagtcgctttgatcggcgacgaagatacctacagggcttttactactctcacggtcgattctgttcttagtttcgtgcagttaactcttcaagagggcagaacggaagacattagacgattcgagaaatatggtgagcagattgcccgagaggatttgccgtcgattctcaccaatgctcgagcagtacagcaatatctcggctatatcgaccaagatatcatcaataagaaagtgtcccggtctagggatgttaaccagatttttactgagatggcgcgcgctatcatcagagcaattagccggaataatattggaaaggacatgcggtca

SEQ ID NO: 2991 - DNA, 2454 bp, Corynebacterium glutamicum
atggctagcgaataccaaattctcagtgcgtttaaaacctggcgcgacattgcccgcataaaattcaacgaagatcagctccccaccgacgaggaactactcgccaccgctaaggaccctgaccagctcaaacctggcggcgactacccagctcttctcgtgtgggcgacagcccttcgacgagtcctgggatacgtccaagtaggcacccttcacgtcattgagcagggcaccgacgcagcgatgttcacccctgaccttgattttgataagcactttgaacctgaagatgcttccgtggacgcgctcgaagacacacccgttgacgcagagttctacgacgatgagccagctgattatcactacgcggaagtgattgatgagcctgagtatgaaccggaactggaatcggagcctgtgcatgctgttccagggccagcacaggtgcctgagcaggtatttgagcaggtagtagcgccagaaccagtgctggatccagagcctgagctagtgcctgagcaggaatttactccggaatttacgccggaaccagagccggctcctgagcctgtggctgaacctgagcctatggctgaacctgcaccagagctggttcgcaagccagcgcaccaagctgaaccaagcgttgctgaaatccctgaaacccctgaacctgatccaacccctgcaccacgtcgacgacgccaaaacaccggatcacatcgttcggcaagtgctgaagctcaatcaattgatcgtgatatccgcaattggcaggactatgagttcgcacgacttgatggctttgcagaggtcaagcaggctcacggtggtttcctccggattacagcaaacctcacgggtgggttggatctggagtgggatgcgccggagtcttatatcaatgcatctcgggttttccgcattgttagtgatgagatggcgtttgagcaggatcctgatttagcggagcaccgagtgagcactgtgggcacccattgggtggatcaggagcctttgaccactgcttatcgcatgtatcaggtgtggatgtacgagggtgttacggagtcctcggcagtgaattcccaaccgcaattggtgggggaatcagtgtttatcaacccagtttccaacattgagttgtcggtggcaggttctgaggtgaaggggcagtgggctcctgctgaacacacccaccgagttgctgtctacgcagctccgagcaatgaacgcctggtcacggcgtctcgaaatgagatcgccgctgataaaaacaacttccagggattccgtttccatccgcagcaccgcggccgggagtacaagtttgtcgcgcgccgttttgcggaaatccacggaaagctggtcggctcggcgccgtcagaggagttcgtcatcgacgtcccagctgaggtcgtcgaggtgccaatttcgatcgaagagcgtttcgacggattcagcacgagttttgacgtgacgtgggatgctcctcactctggtgaagtctggatttaccgaactcaggaagcaccagaaagcgacctgcagttcaacgcgattgaaacagaccaactggaaagctttggcctggcgcgaagagattgggccaatgacctggaggacaccaagacctcctgcaatgtggtgtggcctgaagattggtattcgatcttcctcaccccagtcaatgttgtgggcaaccaagctcaagttggacaaacctattcacgagttcgggtgggagagattagccgtccgaagctgtacgagcgggtgaataaccaattgctcacttttggttggcctgaagaagcacacgaagtcactgctgtttttggcgagcccggttcaggtcattcagtaggaccaactgccgatgccccaggttctagtcttgtctccatccatagggaagcctacgaggaggaaggtggcatgcgggtgaaactgcctggtgccggcgatgttgcgctgtttgcctcccgagtttatgaaggacgccagatttggggacagcctgagatcctcaagtaccgaggtctagacaaattcagttacaaactgcatttgatgaataaccgtttgttcctttctatttacagcgagcgaccaaacaatcagttcaaccagttctctttgaggattcacccgtcccgtctcccgcttgaaccagaagatggtcaagaagtgatgactcgaaagatcatcaatgatgggggagggcagcagtatgctgatcttctagctggcattagttcctcatctttacgatctgagcaagaaccggaagttgaatactgggagatcgatcctaagattgctagccttccaccaactagctatcttcgcctattcatccaccaagaagagtccgatgacgttcatgtgaaagctctaatcgatcccgctccctccttgctgaatctgggaacgtggattggtggaagcagg

SEQ ID NO: 2992 - DNA, 2799 bp, Corynebacterium glutamicum
atgtccgccgcctattcgcaggacaccattttgacggtgtttctggggaggggtctgaccgctgaagggatccgacagaccctagaagacttcgcagaaaccggcctagtccgcaacctggtgtggattgatgccgatagtttccacgagtcttcatctgaagtcacccacttggcaaccaaccaagacggtcttccggagcttcagcgacgacctttcaatgagttggtgtcccggtcacgaaccaccaagcttcacatcggtgtcatcaacgtcattgatggcagcgaaggcatgcttcatgcagaagaactcaacccattggttgggatcatcgacagtgtctgttcacaccaccaaattcaccgatccaacgtgatgatcggtgcggtggctgccacacttgatgaggaacttccaattcttcgtggttatgtgaacctgatgctggcacctgaagatagccacagcccaggcaccgcaacagtgacctaccgtcatggtttcagcgatcaccgtttcaccctgcactgcgtggctaatatcgccagcttgtacggactgtgggaaggcagcacatccacaccaatcgaacagctcgtacctgcgaaaggttccagctttcgtttggtgaggtctttttacaggcgaattgacggccaagcagttcaggctcgtctcaaggagaagattctcagcaccgcggaaaacccgcttcctcgcttggacattccaggtaaggagcgcactgcgcagtacgcagaaaatccggataccttcgcccaaaaagcagctcaggaaattcttgatgagttcagaactccactgatcggtgaagaagctgcagctcatgttgagaaaacgaagacgatttctggaagtgcggtagttaagcagttcttcagcgtctggatcaagaagatggtgactacaccgaaccgcttctttgctgagttttctgctgaatcaaagaccttcgcagaagatgcacttcaagcaagtgtctacggcaattccggttcgggtactcgcgtgggtgatcgtgtcactgcgtctgctttgagtggaaacaaaaaccagagggcagtgcagtctgaggacctcaaaatcagatatgccgctgatcttcaagaactgtggcaagcatatgccaacaccgcaatgagccttcttgatgctcagcctcgcgcaattgcttacggtgaaaacgggatgagaaccccgtcggtcgttcacactggacaatcccaacgagtggttgttgcacgacgaagcgctgacgttatcccaggcccagaaactaactatggcgatgggctgcccgttgaggtcaaagtggctgtcgatgtcgaagaagtgcccccgtacgacctggaaggcgtcgctgagtttgagcgtcgattagcaaaagaaagcgaccgcgggcagcgcggaatgggccaggttattggcgaattcaagcgctggcaagaccaaaactcgaagagttttgcctacttcgtgggatctgggctgcaaaatctccaacgggagatggaatctcaggaaaagcggtggaatcaagaaattaatcgcctgtcccaacaaggaaaatccttcgatggaacaggtttaggatcccgagttttccgctggttgggttgggtatcgttctggtccgcggccatctttggcgtgtggtgggctgcagaatactacttggctgaaactccaatggacatcagtcgctgggctgtaagtttcgctgcgacagacaccgctttcaagtggaaattcttcggaatttggtttggtatctggctgatttgttggattgcgcaatgcatttttgagactcgcgatgaaattcgatttactcacctgcgtaaagacctagtcaccgagcttgatgctgcgaagaagaacctgaagatttcgcagcaggcacagctccgcattcaagtgggctaccaacagttcctgtctgtatccaagattatgggtgcactgctggaacgacctttcggcaacattgaacgagcccgcagggaatcaccgatccccattaactcgatgccagattcagtcattttcgccgaggctattcctgattcagatgccgtggagaaactgaccagacaattccgccgagacctataccagcagggatgggtgagcgaacgggtaatggctgcgctgaactccgcatcagatgccttggcagcggagtctggaaacagcgtcaatgaacgcaccctttttggcagcaccggcgaaggctcctacggtgatctagccagattgtcggatttcgtgaccggcgaaaaattccgccaaacagatcgcagcgtgcagatctgggatgacatcaccctgcaactctcgcaggaaagccatgaagttcgatccggtattttgaattcactccagatctatcgcggtggcgaaaaggtcgacgcaccataccaacaaccactaaaagacctggtaactgttggtttcttcaacggcgaaatcgccagcgaaaaaggtcgcgtgaaaggcatcctcagcctggatccttccctgtgcatgtaccagccacaagaaaacgaatcagatgccatcggaatcagcgaagtgctgctccaaatcagtgaacccgccgaagacgctgacatctcatttgtccgacctcaacaaacaacctttgatccaaccttgttcgacagaatgcccaccaatgaagacttccgctcagagaatcccgctgaatcgccgttccttgaccgcggaaaccaatctcacaagcggccagaactaccaggtacgggagagttt

SEQ ID NO: 2993 - DNA, 3591 bp, Corynebacterium glutamicum
atgaagaaagttctcgttgtcggctgtggtggttcaggtgccaaaacgctcgcttatatgatggaccagctcaagaccaccctggcggatagtcttcccgagcgttacccaaatccaaaggaagcaaaacttcctggtgcgtggcagttcgtgtcggtggatgttccgacctccccagaaagccccggcccgaaccttccgaatgttccagaagccggtggacgttatatttcctgtggttcctcggatcgctatgccaccgttgatactgcggtgtccaaccagctctcctccaggggcgcgttgggtggcgtttcttcatgggcgcttcgaaaccctgattctgaaaccaccccaattagtaaaggtgcgggccagtaccgctccattggccgtatgttgatcctgagccgacttcaggaaattcaggctgaattacgtaaatcatgggatgtgttgttcagcggtgagactgaacgtgagctcgctgaccttcgttctgcactgtatggcacgtctgtttccagtggtgaaacctctaaagagcagccaattatcttcgttgtctcctccatggctggtggcgccggtgcttcgatggctctagatatctgccgcctgctcaccggtcttgaaggcaacgcagtgggtctgagctcactgtttatggtgaccccggatatcttctcccagctttccccagaccaggttgccggaactaacccaaacgcgctggccatgtttgccgagctcgcagcagcacagatgggtgcagcttccgaagaagatgcccgactgtttaacgctttgggtgtttctgttggcgatgactccatcccagttggacgtatcttcccagtgggtattcgctccggtgaaaacggcgctctgcttggtgatggcaagccagataccgtctaccgcgcactcggccgtggccttgcagctctgatggctgatgaagtgtccatggacaacttcgagcaattcaccctcggcaaccgtggtggcggaagtgccgatcagagcaagtacgcatggggtgcacaggaagctaagaacattccgtggggcagctacggctactcacaactatccatgggtcgtgatcgctacgcagaatacgccgcccagcgactggcacgctctgccgtggatcgtctgctcaagggacactttgatccaagcaatgatgcggcctctgaccagcagcttcaaaagcgactcgagaacaaccgtccatcgctgatgggcaacctcagcgacgttttgcccgtcaacgcgccggcaggggactggattttccatagtttcaaccagatgattgaaaactggacccagcgtatgaaagcaatcatcaagagccaaattcctgcagctaatggccagcgcggaagtgaatggctcggggatgtccagcgtgctttccaatcatccagccagatgattgataatgactcccgccatgagctctacatgggtgtcgccgactgggccagtgctgatgtgttgcagcgccgagtagtcgagttgcttcgtgatgagatcgcaaaactgggcgttccttacggcgtcagcgtgatcgaatctctcagcgccacaatccaaaaccaactcatcggacagctttctgatctggcaaacaaccgtgcacctgaggctgttcaactagacgatgtcagccgcagtgaactggacaacagcaagggcaggatcgacgattctgacagctacatccaggaaatcgtgtcacgatccactggtcaactacacacccgcgcagtgcaatacattgcggaccacatggcttcggttctggacgatttcctcaaaaatttcatctacccacttcagcgcaccatccaacgtgagcaccactccctagaaaaggactaccagctcaccaacgatgtgaacctgggaatctcccagctgaaaaccaacgttccagcactgtggccagatgaatctcaaactaccgtcccgtcacgtttcagtcaggcagccaacgaagtcttcctgaccgatgtcgcctccttcccggagcagttccaagcacacgtccgctcgtccaccgatgacatcaacgaacaaaacgattactcgagcgccctgcaagaggcctcaactcgagtagtcagcggtgtgtgggaatccaagtccggctctgaaaaagcaccacgcgatctcatccgcctcatcgacgtatgggttgcccgtgacctgaccagggatccgtccggttcgggaagcctccgcgaccctaagcaagcacgctttgagctgaagattgataccggcgaagtactcgagcgctcccgccagtacatccgccgccctggtttctccttccagcagttcatcgccagctcactgcgtgaattcatcaccgcgccgggcttggcagaccacgagcgtcgcgcgcgccgtcagcaggtgctgagcaagttcagtgaggcaatgacctacgcgcttccattggctcagatcaaccctcaactggttcgtgcgctttacggcgatgaagtccgctacaacttcaacttctctcgcatcccatttgccggcgatgagcttggatccagcctggaacaggcagttcgtgattacccgaaccaccgaccagcagatatttccaagccactgggcaaggctttggtctcccaaggtgaagagcgttccattgatatcttcggctcttaccccaactacgcgccgatcgtgtttgactccctgctgcctccaatcgagaagcagtggcgtcagatcaccggcgatcgcacggaattctggcatggccgccgtactcgtcctttgactgctgcacttccaatgacagacctagagcgcaacgccatggtcaagggttggtacatcggtcgtctggtcggacgagtattcttccccgcaactctagacactgcggataccactccagtgcagatctacgatgagaagtctgattcgtggatcaacttctccaccccaatgctcaccccagtgtcccgtttccgtggaagcctcgattggctgccaaaccttctggaatcagcatcattggcatgggcacgggcaggcgagcgtcctgtctttgaatccgtcgagccttacatccagctccgccaactgtgggatgatgctgcgagcccatccttgccaggacgcaccacccgcggtgagaagctgctgcacgattggcttttcgacggcaaccgcatggctggaaacgtcctccagatcccaggaaccgaagctggtgtcaccccagctgcacgttttgaggctgcgaagaacttcctgcagcgccagaacgagatctcgcaaaattacgtcccaagcgacaagcttcgccaaggccgtctgttcaccaccgctgatcgtccatttggcgacgtcaaggatcgtgaactagcagcacagattccagtgtttgctgaccttgcagccgatgtttttgatggcacccaagaaatcatcgacatcctggaaaagtgcttggctgcaggtccaccatcagcacaggtctttgacatgaacgtagctcgccgcgacgtttcttcaggaccttctctacctggtgagggtgagttc

SEQ ID NO: 2994 - DNA, 2775 bp, Corynebacterium glutamicum
gtggaagaaagcgctctttactgcgacagccgtcctattggtgtttgctgttgtgtggtcggccttggatattgccctgtgggtaggaaagcagtcatggtgaacacgttgaactctaaaaccgtgaatgtaccccgttttgccagaggcgttgttgctgcagccacagcgctattttttggcgctttggtaagcctcgcgcctagtgcgttggcgcaggaaccacctgcagttgaggccggagcgtcaggttctttgagcaacctgggtgcctgcatcgctgataaaggcactcttgatgtcatcatcatgatcgatgagacagaatccttgatccatgaagctcgtgacggcgtggtcaacgccaatgaaccaggcgcggacgcacagcaccaccgtgttcctgcagcacagagctttgtggatgagcttctagccaagcaaagcgatggtgatctgaacacccgcatccgtgttgctggtttcggccagacgtacaaatctggtgccactgatccagacaattacggagcatggacgcaactagatgcctccaccgttggcggagtacaagatgaaatctcccgcttcgctgaccgcacccaggagcagtacaccaactacgcctccgcgattgagggcgcttaccaggacttcactaggtccggctctgaggacgcctgccgcatgctggtgaccttcaccgacggcgcactgaccgctcaagaaggcgccgatgttgcagaagcagcactgtgcgcgccgggtggcgtcaccgatcgactgcgcagtgctggcatcacccacatcggcatcggtttatcggcacctaccaacccatctgatttcagcctgctgcgcggaaccaccgcaggtggcggaacatgtggtgtcgaaccagctaacggtgcattcttcccagcagataacgtgggcggacttttcgcagcattccgtgaagcccttgcgattggtggtgaaacaattggtgaaacccgagctggtgatcctttcagcttcaccctggacaactcggtgaactctgtgcgtttcaccgcgatcgccaaggatgatctcggcccgaacgcccacttggtgctcaccgcacccaacggcgaaacggttgagctcaaagattctggaagcagcgtcgccaacagcactgacgtgagttgggaagccgaaagcagcccagtaaaaatggctgatggttccctcaacctgcagcaaggtggggattggaagggtgtctggcagattcagttccaaggaattgatcctgcagcggttgatggacgcgtattcaactcagtggagatccagcctgacctccagcttgtgttcagtggcggtgattcgacgtcaggtgcacttaaccttcgcgatgatcagcagctgaatatgcagctggtgggccgtgatggtcagccacgcatccttgaggggtccgcgctggtcgatcttggtttcacccgcgcagataccggcgagttcgcccctttggctcaaggaattgatatttctggcggcgaattaagcttcccgctggatacgatttcgcagctcccagccatcggcacggtggaagcgcgtaccacgatcaccaccgcaggcgtcgatgatctccccggcaccacgttgagcccaattctcaacaccacgcgcatcaccatcactcagcgcgatatgcctcagctgccagcgtcggttcgcttcacagcggatgaggacgttgttaccgtagacatccccatcaccggccccggcaaggtatggattgcaccgggaacccagctcagcggagtgcttccagacggcgtggacggcattgcagcatcaagtactttcgacagcccagataatgctttggtgctcggactggatgagcagggcacgattcctgttgaactaaccgtgagcgatcttcgtgacggactggtcaacggctcgattccactccagatctccaacgctgagggcgccaatgaaaccagcgtggatctgccgacagaaggcacgttgagcgttcccattaacgcctccactttcgcattggcattcattttggcccttgtgctttccctcctgattccgctgctcattttgtatattgtgcgtttcctctccgcaaaggttccgtcctctgcgatgagtggcgtgcgcattccagtggaattctccggtgaagctctgcgctatgcgggcagcactatgcctgatctcgcatcgcaaaccaccgccaccaagcaggtcgttgttcatggagacaccttcaatgtggaaggccacaaacttaaagtccagcgcttccagctgaacccgattgcgtctcctgcagtgatcgtgcagaccgacccgtcgatcagcttcgacggcaaacaaaagggcacacaagctaaactcccgctggcggtccaaggcagttggttcctcactgcaagcggcgctgacccttccaagatggaactcatcgccctgacaaacctgccgctcgagcagggccaaatcgaccgcatgatcgcaggtatcaccagcaaagcccctgatagggcacgcgaactacaaaaattgcttgacgacgccgcgacctcccagcccgcaaaggttccaccgcgcgccccagccgcgcagggccacgtcgaaaagcaagctcctagttttggcactggttccggtggtggtttcggctccagcaatggtggaggctttggctccggtagcggatccaacgacacaaatggtggatttggttccagcggcggcttcggcgcgcga

SEQ ID NO: 2995 - DNA, 612 bp, Corynebacterium glutamicum
atgtcacaaggatttacccaaccacccgggggaacgtttggttcttcctctggcggattttcaggcgggcaatcaggtttcggtggaggctcccaaaacagtggttttggtggctcttcaggcggtttctctgggggttcatcgaatggctcgttcggcggttcaactggcgggtttaccccggccggagcaacgtcaaacccatcgggcttttcgacgccaaaggttgcagaaagcccagcgccggggcgctcatcggggcgaaaaagagctggtgggcgccttcaatcggcacccactgaatggattcttccgggcctagttttagggctgatcagcctgggactcaatgcgtggattaccttcggtgcgccagtggccaccgataatctttttctcatcgttgctggaattgcgtgggtgttggcaggaattttgagcgtgctgtccatcggcaagtacatgtcagcagtaaatgagcgaaagtcgacaggcttttatacagaagtgccgtggaagaaagcgctctttactgcgacagccgtcctattggtgtttgctgttgtgtggtcggccttggatattgccctgtgggtaggaaagcagtcatgg

SEQ ID NO: 2996 - DNA, 1371 bp, Corynebacterium glutamicum
atgacccaattcgaaaacgcgcaagtacttaaagagaacatcgaaaaccaacgcgagcagatctttacccagttgaaagaaattgtgtctttcaactccgtgcacagcgatccaaacctactggaggactacgccggcgcgaaagaatgggtaaaagaaacactgaccaacgcaggtctcaccgtcagcgaattcgctgccgaagatggaaccaccaacttcatcggcacccgcaagggctccgaaggtgcaccaaaggtactgctgtacagccacttcgacgttgtcccatccggccctttggatctctgggacaccaatccttttgaactcaccgagcgcgacgctggccacggcacccgctggtacggccgcggcgccgctgactgcaagggcaacctggtcatgcacctcgcagcactgcgcgccgtcgaagccagcggcgacaccacactcaacctcacctacgtggtcgagggctccgaggaaatgggaggcggagcgctcagcgcgctcatcaaggacaagcctgagcttttcgacgcagatgtcatcttgattgcagacagcggaaacgcttccgtgggcaccccaaccttgaccactaccctgcgcggtggcggacaggtcaccgtcaccgtggacacccttgaaggcgctgttcactccggccagtacggtggcgctgccccagatgctgttgctgctctcgtgcgcgttctggatactttgcgcgatgaacacggacgcaccgtcatcgacggcgtcaacaccaccgcaaactggaagggcgagccttatgatccagagactttccgcagcgatgccggcatcctcgacggtgtagacatcatgggcgacggcgacaacccagcaagcatgctgtggtccaggcctgcaatctccatcaccggattcacttccaccccagtggcagaagcactcaacgcagtgcccgcaacggcatccgccaagctaaaccttcgcgtgccagcaggcctggaagcaaacgatgtggccgagaagctgaagcagcacctgatcaatcacacaccttggggcgcaaagatcacggtggagatcgatgacattaaccaaccgttctccaccgatattaccggccctgcaatgtccaccctggcgtcctgcctgagcgctgcgtacgagggcaaggatcttgtcaccgaaggcagcggcggatccattccactgtgtaccgaactgattgaggtcaacccagaagcagaattggcactctacggtgtggaagaacccctcaccgttatccactccgctaatgaatctgttgaccccaatgagattcgcgatatcgccaccgcagaagcattgttcctgctcaactacaccaag

SEQ ID NO: 2997 - DNA, 579 bp, Corynebacterium glutamicum
atgacgcaaaggaccgtgtcaatgtctctctacacccgtactcaaaatacccgtcactccaccatcatcgagttccgccgcgagcagactcgtaatcacacgatggagccaatccagtccgagccacggatctacgctgacgatcctttccgtgcacgcttcggacaccaactcccccgcggacttcgcgaagaagcacgcggcatggaatggcgcaccttcaccaacacctacgcaccaaccggcaacctgcgcatcagcaacctcgagtccgaggcacgccgcggaggaatgttccacttcaacgcaaccctgatcaacaactgccagggcgagcgcaccaccaccgacgctcacatcatggcaaccggcccagtttccgcatgcaccaacttgcttgccgacgccggccgtcgcgttgaaatcctcgaattccaccaattcgacatctttgaagcaaccgtcaccttcatctacacctgcaacaacgtttcccgcacctgggcaatgggcttcggcggtacccctgagcagtccgctgcttccgcaatgagctccgcagctcacttgctctacgga

SEQ ID NO: 2998 - DNA, 600 bp, Corynebacterium glutamicum
atgccctcaaggctcccggggaatgaatgttattgcaacctatccgtagagcaagtgagctgcggagctcattgcggaagcagcggactgctcaggggtaccgccgaagcccattgcccaggtgcgggaaacgttgttgcaggtgtagatgaaggtgacggttgcttcaaagatgtcgaattggtggaattcgaggatttcaacgcgacggccggcgtcggcaagcaagttggtgcatgcggaaactgggccggttgccatgatgtgagcgtcggtggtggtgcgctcgccctggcagttgttgatcagggttgcgttgaagtggaacattcctccgcggcgtgcctcggactcgaggttgctgatgcgcaggttgccggttggtgcgtaggtgttggtgaaggtgcgccattccatgccgcgtgcttcttcgcgaagtccgcgggggagttggtgtccgaagcgtgcacggaaaggatcgtcagcgtagatccgtggctcggactggattggctccatcgtgtgattacgagtctgctcgcggcggaactcgatgatggtggagtgacgggtattttgagtacgggtgtagagagacat

SEQ ID NO: 2999 - DNA, 3057 bp, Corynebacterium glutamicum
gtgctcattctttttctcgcgctcactgcagccgcagtagtcgcccccatcctgatccgaactctcggtcgaccagcttttggtctgctggcgcttgtacctggcattggttttttctgggtgctttcggagttcatcaaaggcactttcaaggatggaggtgaactcctcctccactatgcctggatgccttcggctcacctcaatatcgatttccgtatggattccctcgcggcgctgttctcactcatcgtcttaggcgtgggcgccctagtgctgctgtactgctggggatattttgattccaacgcgggtcgcctcagtgcctttggtgctgaactggtggccttcgccatggcgatgtttggtcttgtcatttcagacaacatcctgctgatgtacgtcttctgggaaatcacctccgttttatccttcctcctggttggttattacggcgaacgcgcatcttcacgtcgctctgcaggtcaagccttgatggtgaccaccctgggtggattggccatgctggtgggcatcattttgatgggtacccaaactggcgtgtggcgattctctgagatccctgcctactcaagctcctgggcagatgtgccgtatatttccgctgctgctgcccttatcttggctggcgcactatccaaatcggctatcgcaccaacccacttctggcttcccggcgcgatggccgcaccaacgccggtgtctgcttacctgcactccgcagcgatggtgaaggcgggtatttaccttgtggctcgcctctctccagacctcaacgtagttggttcgtggtacctgatcatcatcccgttgggcatgttgaccatgctcatgggtggttggatggcgctgcgccaaaaggatctcaagctgatcctggcgtacggcacggtatcccagttgggcttcattatttccgtggtgggcattggtacccgcgaagctttgctggcaggtcttgcactgaccgttgcgcactccttgtttaaggcaacattgttcatgacagttggtgccattgaccacaccaccggaactcgtgatattcgtaaactctccggtctgtggcgtaaacaaccgatcctgttcgccgttgctgctgtttcggcggcgtccatggctggtattccgccactgtttggttttatcgccaaggaaacagcgctggataccgtgttgaatgagcagatgttgcatggcatgccaggtcgattgatgctggctggcatcgttttgggttccatcttcaccatggcatattcctgctacttcctgtacgaagcctttgccacgaagcactccaaattcccagaggccaacggtgtctcacctgcagtggaggcaatgcatccggtgaagtttaagctgtggatcgcacctgtcatcctggctattttgaccgtagtgtttggtgttttccccaagccagtgtcggaagcaattgtcacgcatcttgataacgtcacgccatcgcttgatgatgtccacaccaaactggccttgtggcatggtctgaatctaccgctgctgctgtctgtggtgatcatcatttccggattcatcatcttctgggagcgagacaccgtcgaacgtttgcgccctaacaccgcagcgtttggcagtgccgataccgcctacgacgccattcttgatgcactgcgtgtgctctcccaccgcctgactgcatccacccagcgtggttctttgaccctgaacgtcggtgtgatcttcttcgtcctcacgattgttccgctgatcgctttgatcactggcgaacaaagcgatgtccgcatggagctgtgggatagccctattcagggcttcatcgcggccatcattatcgtcgttgcgattgtggcaaccaccatggataaccgtttgtctgcgctgattttggtgggtgtgacaggttatggcattgccgttatcttcgcgctacatggcgcaccggacttggcgctaacccaggtgctggtggagaccatcgtcatggtggtattcatgctggtgctgcgtaaaatgccgacagaagttgcgtggaaggcagaacctaaacagtctcgcgtgcgagcgtggcttgctggcgccaccggattgtccgttgttattgtcaccatttttgccatgaatgctcgcaccactgaaccgatctctgtatacatgcaggatctggcctatgagatcggacatggcgcaaacaccgtcaacgtactgctcgtagacctgcgtggttttgataccttcggtgaaatttccgtccttgtgatcgcggcaaccggtatcgcctccctggtctaccgaaaccgcagcttccgcaaggattctcgcagaccaaccctggctaccactggtcgccgttggttggctgctgctgttgataccgaaagggcgcagaaccgctcgctgatggttgatgtggcaacgcgcatcctcttccctgccatgatcatgttgtctgtgtacttcttcttcgccggacacaacgcgccgggcggcggattcgccggcggccttgttgcctccttggcgttcgccttgcgctaccttgccggtggacgtgaagaacttgaagaagcgttgcctatcgacgccggccgtatcttgggaactggactatttgtttctgcaactgcagtgctgtggcccatggttcttcttggtgaaccaccgctgacctcccatatttgggatctcacactgccacttatcggtgagattcacattgcatccgcgctgctctttgaccttggtgtctacctgatcgtcatcggtttgaccatgcacattctcaacagtttgggcggccagctcgaccgcgatgaggaaatgcgtaagcagcgtgcgcgcgaccgagctcgacgcttggcgcgcaaccagcgtcgagaagcagcaaccgtcggcgcacgcaggtcgaacgagaaatcgacacgccaaatgccgacgattcggcctccaggggcagacacagaatcggtggagcagaacggtgagaaccagacgtcgataagcacaaagcgtttaaagcaggaaggaaaa

SEQ ID NO: 3000 - DNA, 489 bp, Corynebacterium glutamicum
atggtagccaaccttttcctgctcctagctgctggaactctcatttctgcgggtgtgtatctgctgcttgatcgcgcgatgaccaaaatgatcatgggtctcatgctgatcggcaacggagccaacctgctgattttggtcgctggaggttccgctggatcgccaccgattctggggcgtgaaagcgaaatctacggcgacaaaaccgctgatccgctagcccaagccatgatcctgaccgccatcgtgatctcgatggcgctgaccgcgttcatgctgtcgcttgcctaccgtcaataccgttaccgcaccgaggacttcattgaagatgacaccgaggacgttgcaatcaccgtccgccccagttttgcgtctgctgcacctgaccacgatgcatctgacgacccagaaactggtcgcatgacctcagacggcgacgatttcggcccagaatccttcgaagcaccactgaagggagataaggatgac

SEQ ID NO: 3001 - DNA, 1668 bp, Corynebacterium glutamicum
ttgatcccttatatggtcccgctgcccatcattttgcctgcggttgcggcggcgctggcattgattttgtcgaaatatctgacagcgcagcgcaccattactttgtctgttttggcgttcctcattggtcttaacgccaccatgctgtacgtggtggatcgcgaaggcattcagactttgcagttgggtggctgggatgccccgatcggaatcaccctggtggccgaccgactgtctgtttccatgctgacggtgagttccatcgtgctgttttctgtcatgtggtacgcgatcagccagggtattcgcgacggcggcaaggacgaacctgttgcagtgttcctgcctacttacctgctgctctcgatgggcgtgaacctggcgttcctcgctggcgacctgtttaacctctacgttggtttcgaagtgctgctggtggcgtcatacgtgctgctcaccttgggtgcatcgccggcacgtgtacgttccggcgtgggttacgtgatggtgtccatggcgtcatcgatggtgttcctgtttggactcgcaatggtttacgcctcagtgggcacgttgaacatggctcacgttggcctacgcatggaagatgttccgtctggaactcgctccgcgatcttcgcagtgttgctcgtggcattcggtattaaagctgccgtgttccccctagattcctggctgccggactcctaccccaccgcgccatcgctggtcaccgcggtgttcgcaggtctgttgaccaaggtgggtgtgtattccatcattcgagcacgctcgattattttcaccgatggatcccttgacaccatgctgatgtgggtggcactcgccaccatgctcattggtattttgggcgcgatggcgcaaaacgatatcaaacgtttgttgtcatttactctggtcagccacatcggctacatgatcttcggcgtagcccttggatctgcacagggtttgtctggtgcgatcttctacgcaatccaccacattctggttcagacttccctgttcctggtggtcggtctggtggaacgccaagccggatcctcctcgctgcgacgccttggatccctggcatatatctccccacttcttgcgattttgtacttcatccccgccatcaacctgggtggtatcccaccgttctccggcttcctgggcaagatcatgctcatcgaagccggcgccgaagatggcagttggctggcatgggtccttatcgcaggcgccgttgtcacctcactgctcaccttgtacaccatggttctggtctggtccaaggccttctggcgcgaccgtaaagacgcccccgatggagcaaccgcactagcaagacccgcacctttggtagatatccaagacgaagtcgccgttaaagaccgcaacgatgtcggacggatgccttggggcatggtcttctccactgccctgttggtttccgcatcccttgctgtatccgtgctcgcaggaccactgtcatctattactggacgcgccgccgaatccgcacaagatgtcaacatctaccgcgccgcagtactcggccccaactacctcgacccatcacgcacactcgagatggagcgttacgacgccaaccgcgatgacatcaaccaccgcgtcgacaccaatggaacggaggaccaacca

SEQ ID NO: 3002 - DNA, 441 bp, Corynebacterium glutamicum
atgctcatggcagaattcacctgggcaaacttcgtcggcggtttcctcgtagctagcgcaatcgtgctgttcctcccacttccagccatgccgattgagaacatctccatccgctggggatcactcatcctgctgatcctcaactggttcaaagacctcgccgtggcatcagtcaaagttgcttggctcgcactacgcccagccgacccaccgcgcaccgccattgtgcaagtacccatgcgcgttcaaaacgacctagttttgtcattcgccacaatgctctacaacttgcagcccggcggaaccgtcacagacatcgacatcgccaacagaatgtggaccatccacgtactcgacgccgacgacgaagaagacctccgccgcgagatccaaaacgtcgcagacctagaagccaccctgatccacacctttgaaaggagc

SEQ ID NO: 3003 - DNA, 273 bp, Corynebacterium glutamicum
atggacaacaccctctacacagcaggcctcacaatcgcagctgcctttttcatgctgtcgttcatcttcaccatctaccgcatcatcgtcgggcccaactccatcgatcgcctactcggcctggacggaaccgtctccatgattcaatgctccatggccacctacatctgctggacactcgacaccaccgtcaccaacttcatgatggtcatcgcactcttaggattcatcagctctgtatccgtagcccgcttccgcaagagggatggtgcc

SEQ ID NO: 3004 - DNA, 378 bp, Corynebacterium glutamicum
atgaccctgcaactattcaccgacatcgtgtctctggtgttcattctcagcggcgcattcttgtcattctccgcatccatcggcctcatacgattcaaagacaccatgtccagagtccacgccatgaccaaaccccaaacaaccggccttatcctcaccgttgtaggcgcaatcatccgcatcttaggccacgaacacttcgatcaatcacaacgcagtgacctcggagtccttgttctcctcgtactgtttgcactgctcaccagcccagtgaccgcgcagcgtgtcggccgtgtgtccaggcgtgaaggactctacggtgcaaaggacgatatgtcggataaccaggctcctgcggagttgaagccgaagaagtct

SEQ ID NO: 3005 - DNA, 594 bp, Corynebacterium glutamicum
gtggaatcccaacacatcattttcatcccggaatcccaacaaacacccgacgagtttaccgaggtagtcaacgagattcccgccggaatcaaaccacggatcgtaccgtggagcggtagtgtttccgcaggtgtgcaggctgtggaatccatcctcgaccgtgaagaaatccggcgcgtcatcctggtcggcgctggaaccggagctggagtggcgttggaaattgccaagaaccaaccccgccgcgtggaacgcctcgtgctggattcaccgttggtgacctttgatgagaaacaactcaaaggcatgagcaccgcactgaaaatgatgccaggattcttcttccgaaagaagaacaagaaagacctcctgcagcaggtagaagaagcccgtactgcagttccgatgggattttccgagattaccatgccgacgttaatcatccgaggctccgctgcgaaggctggaattgattctgacttggaaaaacaaatcccgagcgctcgggctaccaccattattggtgccaattggctgacttacacaacgcatggacgccaaactggtgctgcgattgcggaattcctcgcccaa

SEQ ID NO: 3006 - DNA, 1128 bp, Corynebacterium glutamicum
atgggcattgagtttaagcgttcaccgcgacccaccctgggcgttgagtgggaaattgcacttgttgatccagaaacacgtgatctagccccgcgcgctgcagaaatactagagattgtggccaagaaccaccctgaggtgcacctcgagcgcgaattcctccaaaacaccgtggagcttgtcaccggagtgtgcgacaccgtccccgaagcggtggcagagctttcccacgatctagatgcgctgaaagaagcagcggattctctcgggcttcggttgtggacctctggatcccacccattttcggatttccgcgaaaacccagtatctgaaaaaggctcctacgacgagatcatcgcgcgcacccaatactggggaaaccagatgttgatttggggcattcacgtccacgtgggcatcagccatgaagatcgcgtgtggccgatcatcaatgcgctgctgacaaattacccacatctgttggcactttctgcaagctctccagcatgggacggacttgataccggttatgcctccaaccggacgatgctctaccaacagctgcctacagccggactgccataccaattccaaagctgggatgaatggtgcagctacatggcggatcaagataaatccggtgtcatcaaccacaccggatccatgcactttgatatccgccccgcatccaaatggggaaccatcgaagtccgcgtggccgattctacctccaacctgcgggaactgtctgccatcgtggcgttgacccactgtctcgtggtgcactacgaccgcatgatcgacgctggcgaagagcttccctccctgcaacaatggcacgtttcggaaaataaatggcgcgcggctaggtatggtctggatgccgaaatcatcatttccagagacaccgatgaagcgatggttcaagacgaactccgccgactagtagcgcaattgatgcctctagccaacgaactcggctgcgctcgtgagcttgaacttgtgttggaaatcctggaacgtggtggtggatacgaacgccaacgcagagtgtttaaagaaactggcagttggaaagctgcagttgatttagcctgcgacgaactcaacgacctcaaagcactggac

SEQ ID NO: 3007 - DNA, 663 bp, Corynebacterium glutamicum
atgacttcggacatgcagaattctccacagcactcggccacgccttcagaagaaaaacaaggcggactgcccatgcgcggtttggccatgattttgatcgccgtggccgtattgctcgcagcgtgggcactgtggtcaatgcagggcaaagacgacacctccaccaccagcgccggacaaacccagtccacggaaaccaacgcgggaactattgctgaatcttctggctcttcggattccgagcaggcatcagcagaacctggaacctccgaagaaacctctgctgagcagccagctgcagatggcgaagccgctaatgctgctggggccgctgctgctggtggcgctagttcggctaacggcaactccaccccagtgaacactctgtacgtgctcaacaactccaccgtcccacaacttgcagcacgagtggcagacagcctaagcggtgactaccaaaaggtagagtccggaaaccttccagacaccatcattccgcagaacactgtgtacttcaccgctggaaacaccgaagctgaaaaggctgcacgtgaactcgctgaccgcgtcagtggcgtagcaatggaacgcagcgatgcactgccaaccgaaacagaaggcaaagatgccctcgttttggtgctggtccaagacgtagcgctg

SEQ ID NO: 3008 - DNA, 579 bp, Corynebacterium glutamicum
atgactgtccgaccaatcgttattcatggagatcctgttctccacaaccctacccagcttgttactgaggatgtctctgaactgcaggaactaattgcagatatgtacgagacgatggatgtcgccaatggtgtgggtcttgcggccaaccagattggtgtgtccaagcgcatttttgtttatgactgtcctgatgatgagggcgtgatgcacaagggttgtttcatcaatcctgtgttggaaacctctgaaatcccagagaccatgcctgccgatgatggctccgacgaggaaggctgcctgtctgttcctggcgagggcttccccactggccgtgctcattgggcgaaggttactggactgaatgaaaagggcgaggaagtttctgttgaggctgagggtttcttggctcgttgcttccagcatgaggttggccaccttgatggtttcttgtacaccgatgtgttgattggtcggtggaagcgcatggctaagaaggctattaaggccaatgggtggactgagcctggtttgacctggatgccgggtgaagatgaggatcctttcgggcatgacgcc

SEQ ID NO: 3009 - DNA, 252 bp, Corynebacterium glutamicum
atgaataacgattggtcggacagtcatggcaacattctaagcatgctttccgcagatgatttaaccctcctcgagtttgaggctcacgcaccccacgcaatcggggctaaagaggaagccattcgcgccacttttggtatctcaccggtgcgttattaccaacgcctcaacgtgatcatcgatacccccgaagccatgaaagtgaatccaactttggtgtccaggttacgacgtcgcgccggaaagatagac

SEQ ID NO: 3010 - DNA, 1005 bp, Corynebacterium glutamicum
atgacgcctagtcttccccgtttccgcagccagaaacctgccgtcggcgatcgtgttgttgcacgtcgccggattcctggtgccaatgtgcattggacagatgtcattggccatgtgattggggtggatccgttggtggttcgcccgcagtcggttggtgggatgccgtctgatgcggaagaaattgtcattcctgatgatcagcttgaggtgattaagattttgtcgccgcgcaccattaggaattcggatattcgtgcggtggaggttgccacggcgaaggcctttccggggctggtcaatgagtggcatgatggttggctgctgcgtgccggtgatggcattgcggagcgttctaattctgcgtcgccactcggcccaagtgtcggttttgagccggtaccgatggaggatatttcgcggttttatgcacgtcacgatctccccgtgaagctgcacattccggagcggattggtcggcctgcgcagaaagtcattgacgccgatccccagaaatgggtgatgggcccggagattttggtgatgacgaaatctttggaccatgtggagtcgcacgaattgcccggtggcctagaatttagcgtcgataagcagcctgaccaggagtggctgggcatgtaccatttccgcggacaggcgttgcccgctcacgcccttgagcttttgcgcacgcaaatcgagggccgcatggggttcgggcgcctgaccacgccggcggggcaaaccgtcgcgatcacgcgcgccaccatcacggctgcggaggagcgcatatttttgggctattcagcggtcgaggtggatcctgcttttcgacgtcaggggctgggcaccgcgctcggctcgcgcatccaggagtggggcgccgagcaacacgcacaggaggcatatctccaggttgtcgcccataatgaagcaggtatcggcctgtatcaaaagctcgggttcagtgaacaccaccgacaccggtacgccgaacggaaattc

SEQ ID NO: 3011 - DNA, 669 bp, Corynebacterium glutamicum
atgacaatttcttccgcatcagacggcatcccaccaaccgactgcgggcgaaccaccaacggatccaccccaatcacatggccaatgacatctgtccaatgcacattggcaccaggaatccggcgacgtgcaacaacacgatcgccgacggcaggtttctggctgcggaaacggggaagactaggcgtcatgcccgaaaggatcctcatcttcacccggcatccaggtcaaaccaggctcagtccacccattggccttaatagccttcttagccatgcgcttccaccgaccaatcaacacatcggtgtacaagaaaccatcaaggtggccaacctcatgctggaagcaacgagccaagaaaccctcagcctcaacagaaacttcctcgcccttttcattcagtccagtaaccttcgcccaatgagcacggccagtggggaagccctcgccaggaacagacaggcagccttcctcgtcggagccatcatcggcaggcatggtctctgggatttcagaggtttccaacacaggattgatgaaacaacccttgtgcatcacgccctcatcatcaggacagtcataaacaaaaatgcgcttggacacaccaatctggttggccgcaagacccacaccattggcgacatccatcgtctcgtacatatctgcaat

SEQ ID NO: 3012 - DNA, 630 bp, Corynebacterium glutamicum
atggtccaaagatttcgtcatcaccaaaatctccgggcccatcacccatttctggggatcggcgtcaatgactttctgcgcaggccgaccaatccgctccggaatgtgcagcttcacggggagatcgtgacgtgcataaaaccgcgaaatatcctccatcggtaccggctcaaaaccgacacttgggccgagtggcgacgcagaattagaacgctccgcaatgccatcaccggcacgcagcagccaaccatcatgccactcattgaccagccccggaaaggccttcgccgtggcaacctccaccgcacgaatatccgaattcctaatggtgcgcggcgacaaaatcttaatcacctcaagctgatcatcaggaatgacaatttcttccgcatcagacggcatcccaccaaccgactgcgggcgaaccaccaacggatccaccccaatcacatggccaatgacatctgtccaatgcacattggcaccaggaatccggcgacgtgcaacaacacgatcgccgacggcaggtttctggctgcggaaacggggaagactaggcgtcatgcccgaaaggatcctcatcttcacccggcatccaggtcaaaccaggctcagtccacccattggcct

SEQ ID NO: 3013 - DNA, 789 bp, Corynebacterium glutamicum
atgcgcatcgttaattggaacgtcaactctgctcgcactcgtgtggaccggatggtcgattttttgcttcgccatgatgttgatgtattagcggtgcaggaaaccaagtgtaaagatgagcaatttcccaccgagcgtttcaccgaaatcggctatgaggtagcccatttcggccttaaccagtggaatggtgtcgccattatttcccgcgttggcattgaaaatgtggaaacccacttccctgcccaaccgggattcaacaaagacatcaccaaggaacaatccatcgaagcccgcgccatcggcgcccgctgcggtggtgtccaggtgtggagcctctatgttcccaacggccgcgaaatcgcagatcctcactacgactacaaactgcgctggctattctccctgcgcaactacgtgatcgacaccttggaataccgccccgaggaaaaactggtgttgctcggcgacttcaacatcgcgcccacagacatcgacgtctgggacatcgcagccttcgaaggaaaaacccacgtcaccgaaccagaacgtgcagctttcgacggcctcatcgaagccggactcaaagaaaccacccccggacctggtacctacacctactgggattacaaaggcgcacgcttcctcaaaggcgaaggcatgcgcatcgatttccagctcgcatccccggcccttgctgcaaccgcgggtgaaacctttgtggacgttgaagaacgcagcggaaccggcgcctctgaccacgcaccagtcatcgttgattacaaggtg

SEQ ID NO: 3014 - DNA, 1500 bp, Corynebacterium glutamicum
atgatctttcagatcaacctcgaatcttggcaaaccgttggtttgatcatcgactacaccatcaaaatcatcgccattggctacgtacccgaaggacgccgacccagctcctccaccgcgtggctcctggcaattttgctgctcccctacgtcggactcccactgttcctgcttatgggatcgccatacatcaaccggcgacgccaccgcatccaacaagaaatcaacgacctcatcgaagacgtccacgacgacgtccccgacatccccaccggaatggatgtctccgcggaagttgaatctgtcatcaaactcaaccgccgcctcacccgcatgccagcagtgaccggcggaaacaacggcttctactccgactaccgtgaatccctcaaacggatgaccgccgcaatcgacgaagccgaagaatacatctacgtcgagatctacatcatggcctgggattcctacacccaaccattcttcgcagcactcgaacgagcccacaaccgcggcgtcaaagtccgactccttttcgaccacgtcggcagctggaaataccccggctaccaccgcctcaaaaaagaactcaaccgcatgggcttcgcctggtacctcatgctccccctccaaccctggcgacgccgcttccgccgacccgacctgcgcaaccaccgcaaaatgctcatcatcgacggccacaccgcattcatgggctcccaaaatctcatcgccccgagttacctacaaaagaaaaacatcaaactcggccgcgaatggaaagacctcatggtcgaactcaccggccccatcgtctcctccatggaaatgatcttcgccggcgactggtacgtcgaatccaacgaagccctcgacatccgcgaccacgcagaagcccacggctacatcggcaacactcaaaaagactccgccaccaacctcgtgcagctcatcccctccggccctggttacaccacagaacccaacctgcgcatgttcaactccatcgttcaccacgccaaagaacgactcatcttgtgcagcccctacttcatccccgacgaatccctcctcgaagccgtcacctcagcctgctaccgcggagtaaccgtcgaactattcgtctctgaacaagccgaccaattcgccatcgaccacgcccaatcctcctactaccaggcactccttgaagccggcgtgaaaatctaccaattccccaaacccgacgtcctccacaccaagtacatgatcgccgaccccgacgacaccaccggcaacgaagccctcggagtcctcggatcctccaacctcgacatccgcagctttggcctcaactacgaaatctccctgatgatcgccaaaggcaacctcatccacgaactcaacgccctcaccgaccgttaccgcacagtaagtttcaagctcaccttggataagtggaaccagcgcagttggcggcgccgctacgtggacaatgtcatgcgtttgacctcggcgctgcag

SEQ ID NO: 3015 - DNA, 654 bp, Corynebacterium glutamicum
atgggaaacgataagaaacagcagcaacaggaacagcggtatccaattaataaacagcacttcaatcagcaaaagcgcacacagcacagtaaaactggccagcacagtttgcatgatgcggtgtggatgaatccgctgcagaagtcgcctattgaccattccgcccacaatcaaaccaaaagcattcactccgaaaataatggaatacagcagtaccggaatgcccatttgattctgcagcacgaacggcgacgccgaaatgtaggagaacatcgccccaaaagacagccccaatgtgaatacatatgccaaaaattgaggattcttcagcacaaagacatagttggacagcattccgccaagtcctgctgcggtacgctcttcaactggcttcgactccttaatctgcagcaaagcaacaagcagctgcgcaaaattcaccagtgcaagtgcccagaaaattccccgccagccaaaaggcccgaccagcacaccaccaatgagcggagctaccacgggagcaattccctgaataatcatcagcagtgcaaaggcgtgcgcagccttttgtccgcgttcaaggtctggcacgatcgcgcgcgcaatcaccacgcacgcaccgccgccaagcccctgcaccaggcgtgcgatcac

SEQ ID NO: 3016 - DNA, 1194 bp, Corynebacterium glutamicum
atgcagaaaaaacaacagctgagcaccgccctgattatgggattggcattattgtcagccagctccgcgctagcgactgatatgtatttgccggcaatgcctggtattgcggaagatttggggacaactgcaccgatggtgcagttaactctttcttcctttatggctggaatggcgattggccaattgatcattggtcctttgtcggatcaattgggaaggaaaggcctgctcgttgcaggtgcggtggctgcgctggtcgctagtgtggtgtgcgcgctggcgccgtcgataagcgtattagtgatcgcacgcctggtgcaggggcttggcggcggtgcgtgcgtggtgattgcgcgcgcgatcgtgccagaccttgaacgcggacaaaaggctgcgcacgcctttgcactgctgatgattattcagggaattgctcccgtggtagctccgctcattggtggtgtgctggtcgggccttttggctggcggggaattttctgggcacttgcactggtgaattttgcgcagctgcttgttgctttgctgcagattaaggagtcgaagccagttgaagagcgtaccgcagcaggacttggcggaatgctgtccaactatgtctttgtgctgaagaatcctcaatttttggcatatgtattcacattggggctgtcttttggggcgatgttctcctacatttcggcgtcgccgttcgtgctgcagaatcaaatgggcattccggtactgctgtattccattattttcggagtgaatgcttttggtttgattgtgggcggaatggtcaataggcgacttctgcagcggattcatccacaccgcatcatgcaaactgtgctggccagttttactgtgctgtgtgcgcttttgctgattgaagtgctgtttattaattggataccgctgttcctgttgctgctgtttcttatcgtttcccatattccgatggttatggctaacgcgacagctctgggaactgaagtggtgcgaagcagggcgggatcgggttctgcaattttgggtttcgtgcaattcacgatgggtgctttggtgagttcactggtcggattaggctctgataaggctttgactatgggaatcgcaatgactgcttgtgcactgctggcgtgtgggtgtgcgtacctggcaggtcgaaaaggtattccagaaatgaag

SEQ ID NO: 3017 - DNA, 1164 bp, Corynebacterium glutamicum
gtgcttctatctggttggggcaaatttgtgcgttggctcttggtattgttgtccattttggtcatcatcattggcatcaacctcatcttggacggtgtctacggatttggtactttttcaaccacccagatgtaccaagttgcgaaagatccactcattggtgtgctgatcggtatcttggctacggccttggtgcaatcatcaaccaccaccacaacgttgacggtgactgcagttggtacgggcattgtgtcggtgcctgtggcgattccgatcattcttggcgcaaatatcggtacgacgatcaccgcgatgctcgttgcgttttcttatgtgggtgaacgcagggagtttaagcgagcttttacggttgccgccatgcatgtgtggtttaacgtgctcgtcattcttgttctatttgttgtggaattgctctttcatccattccgcacaattagtggtgcgatcgcaacggagatcacactgacaactggtggctctttgcctaccagtggtgtgatgaccaagatttttgatcccccaacccaacttctgggtatgaatggtcttatcggttcgatcggcaatcctagtatttcggcgattgtatgtcttgtggtgggcaccattcttattctgatttcggtgcgtgccatgagttctcagatccgaaccattacggcagcgaccgtaacctcaattatggacaaggtgatcaatccagagaacagccccaaggcgacgattctttccaatttctggagcttcattcttggagttttgttcacgctcatggtcactgcctcgtcagtgaccgtggcttccatgcagccagtggctgcctctggtgtcgttaagcaaaagccattgctgggcgtcattttgggtgccaacgtgggcaccacggtgaccgcaatgtttgctactttcgcgattgtcagcgatcagggtgagttcgctattcaggctgcgttgatccacctcattgtgaacttcaccggcgcattactagtgctgtgtattccgcagcttgccaatgtgattattcacttggccgagaaaactgcgaacctcactgcccgcagttactccatcaccctggccacaattgtaacggcctatgtcttggttccttcagctgtgttgatgatttacttcttcatt

SEQ ID NO: 3018 - DNA, 840 bp, Corynebacterium glutamicum
atgccctctaaaatatcgcggccctattaccaagtagatgtattcagctccgagccgttcatgggaaacccgcttgctgtcatcgccgatgctgatgacttaagtgccgaacaaatggcccgaatcgctaggtggacaaacctctcagaaaccacatttcttttaaagccaacccaagaaggtgctgactaccgggtacgcattttcaccccaaccggtgagctccccttcgctggacacccaacactcggaaccgcccacgtgtttagggaactgcacggtgaacagggaacccagttggttcaggaatgtgtcgccggtttagttgctgtgcgcgctattgacgggccagcaagtggattggcttttcaggctccacccacactcaaagacgggccattggatgcttccgacctagacgcagcttgtgaggctttaggaatcagccccgacttcattcgagcccaccaatgggtagacaacggccccggctgggcagtagtggagctaccgagcgcccaacacgtattggatctggaacccgatttcagtgcacatccaacattgaaactcggagtgattggggcctatcccgaaggggctccccacgcttttgaagtacgggcattcgctcaaggaatcggtgaagacccagtaacaggaagcctcaatgcatccattgcgcagtggctacaccgagatggtcgcgccggcgaaggttacttggcatcccaaggaaccgccatcggtcgcgccggggaaatccacatcagtattgaatctcatgcgatttgggtgggcggctctgtgaccacgatctttcaaggaacagcagagttt

SEQ ID NO: 3019 - DNA, 633 bp, Corynebacterium glutamicum
atggaccaaacttgtcaccaccaaatccttctggtggacaaccgcactaattctggtcttcagcctgggatacgcagcgctcaccggatcactcgccaccggcgaaagctttgcatcactgttccttctcgcaggcagcacagtcaccggcctttacctccttggcttcgtggtgatcatgatccaatccatcatgatgttcaccaccgaatttcgattcggctaccaaacccaaaccttcctcgccacaccaaaacgctgggttgtcgccgtttccaaatggttgctgtacctcgtgttcgccgtagtgttgaccttcatcaccgtgattctgtgcttctatctagccaaagccctggcatcagacactgcaagctccaccctggtggtgtgggaagatacgcaagcacgacgaatcatgtggcaatacccactggcagcagcactattggtaactttctgttccggaattgcgctcctgctgcgtcaaactgcaggagcagtggcactggtgcttatgtggcacttcgctatcgaaaacctcctgtctttcttgccacgcatcggcgaatacgtcggcaagtatggtcccttcaccaacctctacgcattcatcaccgactatcaatcaat

SEQ ID NO: 3020 - DNA, 768 bp, Corynebacterium glutamicum
gtgtggacaacaatgattaataccatccgctccgaatggaccaaacttgtcaccaccaaatccttctggtggacaaccgcactaattctggtcttcagcctgggatacgcagcgctcaccggatcactcgccaccggcgaaagctttgcatcactgttccttctcgcaggcagcacagtcaccggcctttacctccttggcttcgtggtgatcatgatccaatccatcatgatgttcaccaccgaatttcgattcggctaccaaacccaaaccttcctcgccacaccaaaacgctgggttgtcgccgtttccaaatggttgctgtacctcgtgttcgccgtagtgttgaccttcatcaccgtgattctgtgcttctatctagccaaagccctggcatcagacactgcaagctccaccctggtggtgtgggaagatacgcaagcacgacgaatcatgtggcaatacccactggcagcagcactattggtaactttctgttccggaattgcgctcctgctgcgtcaaactgcaggagcagtggcactggtgcttatgtggcacttcgctatcgaaaacctcctgtctttcttgccacgcatcggcgaatacgtcggcaagtatggtcccttcaccaacctctacgcattcatcaccgactatcaatcaattgatccaggatggtccaccaccatgggagcggtgtacttcggagcgtgggcattcgtgctgttcgcactcggaatcgtcgtcctagaaaagaaagacgcc

SEQ ID NO: 3021 - DNA, 936 bp, Corynebacterium glutamicum
gtgcgcatgatcaacgttgaaggcctcaccaaacaatatggtcaggtccgcgcagtcgatgatctgagcttcgaagtaaaacccggaatagtcaccggatttctcggccccaacggcgccggaaaatccaccacgatgcggctgatccttggcttagataatccaactgcagggcatgccacgatcgaaggacaaccctaccgatcgctcaaaaatcccctgaccaaagtgggagcactgcttgatgccaaagcaacacacccaaatagaacagcagaaaaccacctcaagtggatcgcccgtgcaaatgggctgtccaccaaaagagtcgatgaagttctcaccctcgtgggactgactggtgttgcgtcaaagaagaccggtgggttttcactaggcatgggccaacgtctaggacttgctgcagcattgctcggcgatccggaatacttaattctcgacgaacccgtcaacggccttgacccagaaggcattcactgggtgcgcaccttgttgcaaaacatcgccaagcagggcagaaccgtgctcgtgagttcccacctgctgtccgagatggcgcaaactgcggaacatttgatcgtgattgggcgtggcaagctggtcgccgatatgcccatgcatgagtttgtgcgctcccattccgcttccacagttgtggtgcgcgcagcagtacccggcgctttggaaaacgcgttgaaagaagccggagtcgcattcaacacagcaccagatgaaagcggacgcatgacatatcgcatcgatggctccaccaccgatgacatcggccgtttggcattcgaacgaggaattgccttgttagaactgtccgaaacccgagcatccctggaagaagcattcctcgaaaccaccggcgaagcagtgcagtaccaggctggaagtgtggacaacaatgat

SEQ ID NO: 3022 - DNA, 501 bp, Corynebacterium glutamicum
gtggacaccatgaaaggcgacggcgatggatgggcagcagcacccaatggcggggcagtatggggcaaaaacggagcagcaggattgttgttggtagcagataaacaaatgctcatgcagcaccgagccgcatggaccaacaacggcgacacctgggcactccctggaggcgcacgagactcacatgaaaccgcagcggaatcagccctgcgtgaagcatttgaagaaactggaatcctgcccgacgacgtggaagttttagattcaatagtcaccgcaggcccttttcccgccgatccagaacgcccagaacttgccggcaactggacctacaccacggtcatcgcacgaactaaaaccggcgaaaccctagataccaccgctaatgaagaatccctcgaactacggtgggtagatatcgcagcggttgactctttggctttgatgccagcattcgccaaagcgtggccctctttaagaaagctactgaacacaacagag

SEQ ID NO: 3023 - DNA, 1386 bp, Corynebacterium glutamicum
ttggataccgatgactcgcctgatcattggcttgatccgttaacggagaaggatacttctaagcgcactctcgttaattcgattgttcaggaaactttcggccagcctatttttgttgcccgcaagatttgggctttcgtcaatacgtcgccgggccggatgacgttgatgacgattatcatttcgatcgccatttttgctgctggttacgccatgtcggtgtcttcggatactaggcagtccaatttggatgatttgatcactaatgcggagcctgtttcctataacgcgcatgtgctgtatacatcattgtcggttgctgataccactgctaccactggttttgttcaggctggtgtggagggcccggtgaatcgggtgaagtatcacactgctattgatcgtgctgcggttgctgctactcatactgcggcgtctgcggatagtagtaatgagcatttgatggagttggtgctggagattcagcgtcagttgccggtgtatacggggttggtggaaactgctcggactaataaccgtgcgggtaatcccgtgggtgtggcctatatgtctgaggccagcgcgatgatgcgtaatgaaattttgccgatggcgtctgagctttacaacctgacgagtcgtgcggtgtctgatcagcagcgttcggtgacgggtccgcagtggtttccgctgtctggattgcttgcggctcttgccatgttgattgttgcgcagtggtggttgatgcggattacgcgcaggcgcatcaacaaggggtttgccctggccacggtgatgatgatgacggcaacgttatgggtgtcagctgcaaactgggcgacgtggcaggctggcacgaagggttttgaggaagcgtcggggccgttgaattccatgactacggctcgtatttatgcgcagcagacccgcacgacggagacgttgtcgttggtgcgtaggcagtcgattcagggcagtggcactggttttaccgcaacgattaatcagattaagcgtgcgctggatgagtatgaaaccactgcgcagtcacagactccggagcatcagcagttgattacggcgattcgtaatgcgattgctgcatggactgccgatcacgatgagttcacggtgttgttggcgtctggtgattacaacggtgcggtcaatgcggtgctcaacaaagatgaggagggccagaccagctttgatgagctcgatactgcgctggctgagctgatcgcggattctcgcagctccatgcgttcctatatccagtcgggcctgcaggccacggagttggtgtccgtcatggtgatgattctgtctgtcgtttctgtgttggctttgtgggtcggcatccgcccccgtttgcaggagtactta

SEQ ID NO: 3024 - DNA, 1032 bp, Corynebacterium glutamicum
atgcacgcttttcgacgcccccctccactcaccacgcgagtcggcgctgcattgctggccgcaacgctgcttgcttcctgcactccaacacctgtggaaccggcagaaaccttgactgctttggatcccgatgccggtccaccactgccaccggattcttcgattgaagctcccggtgaaaaagagcccattgtggaagtaatagagaattggccaggttctttacgcccggatgatctgacccctgaggagcgggtacctggcatcgtcaaccggggtcgcatcattgtgggtgtggatcaatcgcaaaacttgctcagtttccgtgatccggtgactggtgagctgcgcggttttgaagtggaattagcgagggaaatttcccgcgacattttcggtgaccccaataaggtggatttccgattcgtcggctcgtccgaccgtctgcgttcccttgaccaaggtgatgtagatattgtgattcgttccgtcacgatcaccgacgaacgcgccaaattggtggaattttccacaccgtacctgcgcacccaaacccgcatgttgaccatggaatcttcaggaatcacgtccatcgcagatctacccggccacaccatttgtgtcaccgatggctccacttcattgcagcgagcccgcaccattgcgccggaggcctcaatcttaaaaactcgcaattggtccgattgtctcatggcgttgcagcagcatcaggctcaggtcattttgggcgatgatgtcattttgtccggcatcgcagcacaggatccctacaccgagattcttgatacctccctcgattcccattcctatggagtggcagcggcatcgaccactgctgaaacagactcttcggggttgattcggcaggtaaactacacaattgaacggatccgcacagaccgcatgtggtggacaatgttcgacgattggttcggaccttatctctggtcctacggtccaccacagctgcagtacatgccagaggaagaagggacagaaaacgatgaagga

SEQ ID NO: 3025 - DNA, 2253 bp, Corynebacterium glutamicum
atggtggtggaacaaccagcagttgaagacagcctcgggtcagcatctgcgcatacggagacaactgcggcctcactgcgtccccgcccagaggtggatccaagtgagaggagtcgtcgacaagcaatttcgctgttccgcgaacggcgccgcgtaaggcgccaatcccgcccagttgctgatggcatggtggaattgccgttcatcacccccaaaccggaagatgagctgctcatcgacccggaaaagaagcgcaaacctggtgtggcagcgccgcaacttgtcgcgggcgatatcgtcgcagagcaatatgaagtcctcggcgtcatcgcgcacggcggcatgggttggatttacctcgccaacgaccgcaatgtgtccggccgcatcgtggtgctcaaaggcatgatggcgcaatcttccgttcaagaccaaggcaccgctgaagccgaacgcgaattcctcgccgacatcacccaccccggcatcgtgaaggcctacaacttcatcgacgacccccgcgtccccggcggattcatcgtcatggaatacgtcaacggcccctccctgaaagaccgctgcaaagcccaacccgacggcgtgctccgcgtcgacctcgccatcggctacatcctcgaactcctccccgccatggactacctgcaccaacgcggcgtagtgtacaacgacctcaaacccgaaaacgtcatcgccaccgaagaccaagttaaactcatcgacctcggcgcggttaccggcatcggcgcattcggctacatttacggcaccaaaggattccaagcacccgaagtagccacccatggcccctcaatctcctccgatattttcaccatcggacgcaccctcgcagcactcaccatgcccctccccgttgaagacggtgtcctcgcaccgggcatcccctcgcccaaaaattcacctcttctgcgcaggcatttgtcgttctaccgcctcctgcaacgcgccaccgccgacgacccccaacaccgattccgcaacgtcagcgaactacgcacccaactctacggcgtactgcgtgaaattttggcagtccgcgacggcaaacaatacccgccacagcactcactattctccccacagcgaagcacctttggcaccaaacacctcgtgttccgcaccgaccgcatcatcgacggcatcgaacgacaagcacgcatcacagcaccagaaattgtctccgcgctgcctgtcccactcatcgaccgcaccgaccccggcgcccgtatgctctccggatcctcctatgcagaaccctccgaaaccctggaaactctgcgcaactccatggaagacgagcaataccgccaatcaatcgagatccccctcggtgtcgtccgagccctccttgacctaggctttaccaccgaagcacgccaatggctcgaaaccctagagggacgcatcggcgacgactggcgacacaaatggttctccggaatcacctacctcctcctcgacgactacgccaccgcccaagtattcttcaaccacgtcctgaccatcctgcccggcgaagccgctcctaaactagccctcgcagctgttgacgaactcatcctccaacaaatcggcgccgaatccaccgcctatctcaccccagacatcgtctctgcaaccgcgaccctcagcaaagatttcgaagacctcgacgcctccgccttcgaatcactcagcgacacctggtcccacatctccagcgacccacacgtagtccgcttccattcactgcgcctctacgcacttgtctgggcaaccaaccccaccaccgtgtcctccgcgttcgggctcgcccgccaactcatggccgaaaaccaaatcgaactcgcagtccaagccctagacaaactcccccaatcatccacccactaccgaatggccaccctcaccaccatcttgttgctggtcagctccaatttgagtgaatcccgcatccgacgggctgcccgccgactcaccgaaatccccacaaacgaaccccgcttcaaccaaatcaaaattgccatcatgtcggcaggcctcagctggcttcgagagcgaaaactcaaagcttccgcctccgcgaaccctttgtttgaatacccgttctcccaaaaaggcctgcgcaccggcatctccgaggcactccgcattcaggcacgttctgcaccgttcccgcaccaccgttacgcacttgtggatatggcgaatgccgtgcggccactgagttggttc

SEQ ID NO: 3026 - DNA, 747 bp, Corynebacterium glutamicum
atgggtggctacttcgggtgcttggaatcctttggtgccgtaaatgtagccgaatgcgccgatgccggtaaccgcgccgaggtcgatgagtttaacttggtcttcggtggcgatgacgttttcgggtttgaggtcgttgtacactacgccgcgttggtgcaggtagtccatggcggggaggagttcgaggatgtagccgatggcgaggtcgacgcggagcacgccgtcgggttgggctttgcagcggtctttcagggaggggccgttgacgtattccatgacgatgaatccgccggggacgcgggggtcgtcgatgaagttgtaggccttcacgatgccggggtgggtgatgtcggcgaggaattcgcgttcggcttcagcggtgccttggtcttgaacggaagattgcgccatcatgcctttgagcaccacgatgcggccggacacattgcggtcgttggcgaggtaaatccaacccatgccgccgtgcgcgatgacgccgaggacttcatattgctctgcgacgatatcgcccgcgacaagttgcggcgctgccacaccaggtttgcgcttcttttccgggtcgatgagcagctcatcttccggtttgggggtgatgaacggcaattccaccatgccatcagcaactgggcgggattggcgccttacgcggcgccgttcgcggaacagcgaaattgcttgtcgacgactcctctcacttggatccacctctgggcggggacgcag

SEQ ID NO: 3027 - DNA, 1365 bp, Corynebacterium glutamicum
atgtctcgccctttgcgtgttgccgttgtcggtgcaggtccagcaggaatctacgcgtctgatttgttgatgaaatccgacacggacgtgcagattgatctttttgaacgtatgccagcgcctttcggtttgatccgttatggtgttgcgcctgatcaccctcgcatcaagggcatcgtgaagtccctgcacaatgtgatggacaaggagcagctgcgtttcttgggcaacattgaggtcggcaaggacatcactgttgaggagttgcgtgagttttatgacgcgatcgtgttctccactggcgctactggcgaccaggatcttcgggttccaggttctgatctggaaggttcgtggggcgctggcgagttcgttggtttctatgatggcaacccgaactttgaacgcaactgggatctttctgctgagaaggtagcggttgttggtgtcggtaacgtggcgttggacgttgctcgtattttggcgaagactggcgatgagctgctagttactgaaatccctgacaatgtctatgagagcttggctaagaatcaggctaaggaagtgcacgtttttggtcgtcgtggacctgctcaggcgaagttcactccgttggagctgaaggaacttgaccattccgacaccatcgaggtgatcgtgaaccctgaggacattgattacgatgcagcttcggagcaggctcgtcgtgattccaagtctcaggacctcgtgtgccagactttggaaagctacgcgatgcgcgatcctaagggcgctcctcacaagctgttcattcacttctttgagtccccagtggagatcctcggtgaggacggcaaggttgttggcctcaagactgagcgtactcagctggacggcaacggtggcgtgactggcaccggcgagttcaagacctgggatatgcagtcagtttaccgcgcggtaggttaccgttctgatgcgatcgagggtgttccttttgacgatgagcgcgcggttgtccccaacgacggcggccacatcatcgatcctgaggtcggctcccccatcactggcctgtacgccactggctggatcaagcgtggcccaattggactgatcggcaacaccaagtccgacgccaaggaaaccactgagatgctgcttgctgatcacgctgctggttctttgcctgcgcctgcaaagcctgagttggagtccatcattgagttcctcgatgagcgcaaggttgcgttcaccacatgggatggctggcacctgctggatgctgcggagcgcgcgctgggtgagcctgagggccgcgagcgcaagaagatcgttgagtggaatgacatggtgcgccatgctcgtccagaatacgacatc

SEQ ID NO: 3028 - DNA, 546 bp, Corynebacterium glutamicum
atgacccgatactttgcagtttccaatcttcaggagcttggctccctcgaagtacacaaattgtacaaacttcgtgtagatattttcgtccacgagcagcagactccgtacgcggagatcgatgacaccgatgctgccccaaccaccaatcacatcctggtttgggagcgcgccgacgccaccccaaccaacctcatcggctgcgcacgcctcgcgcccatcaccgccgccgagcttaaggcgtacaccggcaagggcatttcgcttgacgacgccaccccgctctcacaactcggccgcgtagcggtggcacaggaagggcggggctcggggctctcaggtgagctcatgcgcaacgcgctgcgtcttgcatatgagcagtaccccgaccgcgatgttgtcctgaccgcgcagaagcctttggtagatttctacgcagaatacggctttgaggtcttgggtgaggaataccttgactcgggtgttcctcaccttccgatgttgctcaaggctgatgagcttgaaaggttctcagacctagacgcc

SEQ ID NO: 3029 - DNA, 1062 bp, Corynebacterium glutamicum
ttgggcaaacacacacgattttggagccggcacacactaattttaggagcactgatgaaaaccaagtggttagcgatcattccattcgtggcgcttgcggtggttgcatgctctgatacgcagccgccggttacagaaacagtgacagaaaccgccccgcaacctacttctgaaacggcagcgcagccaccacaacccacgacacctgcggaaacgaccacgcagcaggcagaaggtatcaacttgacgcctcgctacactcgccaaaatgtggggcacttttccagtggttatcagcctggacaggtgagtttttcctcagctgatggaaccattaaatgtgagtttcgccccatggaacaggacgcacctatcaaccgggagccctccaccgattggcggttgagtttcgtgcagggtgcgtgccaattcgacgatggttacgtagtggcggatacaaatgtggaaaacagaccaggttttgctgagtacaccacggcgatttctcatgtcatgccggaaaattacaccacgttgccgccgggaacctacatcgatttacacaccatggcttgtttcaccgagtctgccgatgaaatttcctgcattaagtacgcgaccaatgaaacattccgcatcagcgcgcagggttttgagatgctctcaaatgcccagcgcgacgcggaactaaccacacaaggtggcttgtaccaggcattttccaacatcgcggaattacggttcagtgacggcaacgccatgtcatgtttctttgacgcgccgggatcgcaagatttctggtgccaaacactcagcacccccggctgggacgacggcagcaacctcattcatttgacggtcaccggcggaaaactcagcctgatgggcacccaagtgggcaaccccggcctcgactatttccgcggccgccagctcattgaggcgccaaattcgcttctcgacgcctccctctccgtaacactcgacggcgatcgggtgcgtttccgcaccgcgaccggcgaggagatgtgggtgagttccagtgactacggattaggcgtc

SEQ ID NO: 3030 - DNA, 1029 bp, Corynebacterium glutamicum
atggctagaacgacaacagcgcacgcagttctcatggcgcttagttcagtcgggcttttgatgctccaggcctgctccgaacaggaacaaaccccagaacaaacgccagcgcccaccctgacttcgcaggctcccgagactcctcaagcctcaacaacctcctcagcaagctccacagcaactcccatagcaactcccatagcagccaccgagttggattatctccacatcgatccagcaacgtatgacatcggtgtccaagaccaagaaactgccgtatttaccactggcgatgggatcacagcgcagtgtttcttcgaggcaacaccgggggagaccagctatcagatcaaggagtttgatttcgacgaaactgcgggaacgtgcgcttttggtgatcaacacatcagcgtcaccacggatgaaaatgtccgggaacgctttgccgaattgagtgaaaccgaagaagaattaccagaagcgcaagcgactctcgatgttggtgagatggtgcatcttggtcacatgggttgttgggcgccgagtgtatcggagtttagttgtctcgatttcgcctccaaccaggcgttcaccatgaatgaacagggcttccatgagcttgatcctgcaaaagccactgagcagctaattaattcgagtggccaggttcaaacgttatcgaaaatgacgaatttccagttcaccgatggcaccagcatcacctgtgtcagtgagttgcaggcggaagagttcttgtgccacaacagtggtcctggaggctggtcaacttcagctggccctgccaacaccctgtggtggaatctgaaccaggccgactccgagtttgagggtgctcgccccacgaatccaacgcaaagcgtttataaatctcaacaaatattcggtccgggatcgtatctcctcgcgaacggtgtgagtgcagaatttgatggaaccaccctcacgctgaccacgcctcaggggaatcagtattgggcaaacacacacgattttggagccggcacacac

SEQ ID NO: 3031 - DNA, 399 bp, Corynebacterium glutamicum
atgctgggaaagcatcggggcagcatttcgtgggtttctacgatcctgcttgccatcggtgtcatcctgatcggatacgcggcggtagctgttggcccgcagcttgactccggcggggctgccggctggtgggctttaggtattggggtagtgtttgccgtggtatcgctttgtttgtacatcattgggatttctctcaggcacaccaccacctctgaggtggtggcttcaggggcaattgctgccctgtttttcatcagttacctcgtgtggactacaccagtgagtgacccggtgatcttccaccctgcgctcattaactttgggtgtgcagtgttgtggttggtgatcacgattttttgcgctttcaggagaggcagcagagtaggcataaaaatt

SEQ ID NO: 3032 - DNA, 1194 bp, Corynebacterium glutamicum
ttgacccccaatgccacgaaagtgatgctgctgggatcaggagaattaggcaaagaagtagccatcgctttccagcgtctcggcctggaagtccatgcagttgatcgctacgaacatgccccagcccaccaggtcgctcacttctcctatgtcatcgacatgacagatgcagcccaggtgcgggaattggtggagcgtgtgcgcccagattttgtcattcctgaaatcgaagcactggcaaccgatgaactggtgaagatcgaagaagaggggctagctaccatcgtgcccactgcacgtgcagccaagctgaccatgaaccgcgaaggcatccgcaagctggcggcagaggaactgggtcttccaacctccaactatgagttctgctccactttcgaggaattctccgcagctgctgaaaagcttggttaccccaacgtggtgaaaccagtgatgagttcttccggcaagggccaatctgttttgcgtagttcagacgatctgcaggcagcatgggattatgcgatgagcggtgcacgcgtggccaactcccgcgtcatcgtggaagctttcgtggaattcgattacgagatcaccctgttgacagtaaggtccatcgatcccaccacctctaagcctgcgacctggttctgtgagcccattgggcaccgccaagaagacggcgactacgtggaatcctggcagccaatggagatgactcctcgcgcgctggaaaacgcacgctcagtagccgcacgcatcaccaacgcattgggcggacgcggcgtatttggtgtggagctctttgtctccggcgatgacgtgtacttctctgaagtctccccacgcccacacgacaccggccttgtcacccttgccacccagcgtttctctgaatttgaactccacgccaaggcaattctgggattgcctgttgatgtcaccctgatttctccaggtgcctccgctgtcatctacggtggcatcgaatctgaaggcgtgagctacaccgggttggctgaagcgctggcagtggctgaaactgatcttcgtatctttgccaagccagaggccttcaccaagcgtcgcatgggtgttgcagtgtccaccgctgaggatgtggctgcagccagggaccgcgccactttggctgccgcggcgatcaaggttcatccaggaaattccgcagaggct

SEQ ID NO: 3033 - DNA, 888 bp, Corynebacterium glutamicum
atgtataccttttgcaccctcaagatttgggcacttttcgggaattttcgcttagaaaagttatttgttgtttttgttagctatattcaaattgttctccttcctaaactcgaaaggtttaacatgaaactaagcaaagccacaagatgtcttgtagctcttatgtttgcagctcctttgatgtcagctccacttgcaaacgctgtggataatacttggtttaatggtgttgtaacgccaggtactacaatgtatgaaggtgcaggatcgtggggctttttaagaacttccagtaatgcaagcagcggtcttaccgataaccctttggtagttatgacttgtagactggggatttattcttcagttggtggagacacttgtagtgttagcacttctcagctcaataatgaacgtgcttcttttacatatgaatatcgattgggtggccaagaagcgccagctcgagcatggattggaggaatcccaagtgggggaatgtctattgcggatagtcaggatgaaattttcagtattgcgtctgaaagtactagatggaccgatggatcctggtcccttcaggaagttcacagttctgcgggggatgttcagttaaaaattgtaagtcctgaagttcaagctgtaaccaatgtttccgcagaggcctttgagagcaggggtggaagcatttcattgaatgatggcacgaaagaactaagttttctggttttcccagaatcatcagagaagccgaatgaaatcatagagaactctaattctcataatattgaaatggtaagtgccggtgtctttcaacgcataacccaaggtaacgaaatcttagagatccaaaccggatcagggttagctttggaaacttcgctagtttat

SEQ ID NO: 3034 - DNA, 894 bp, Corynebacterium glutamicum
gtgagctgcttccggtttgttgacgacgtgcgaaaaacctatccggttaagcggttatgcgaagtgttgaaaatcaaccgctcctcgtactacaaatggaaaaagactgccccgaccaggagcaaccgcctgctcagcgacgcagtcttaggagcgaagatcaagtccatcttcacgaaagaacgcggctgctacggctcaaaacgcatcacggctgagctcaacgatgatcctggcagcactccggttaaccataaacgagtcgcccggatcatggcatcattaaagctgtttggtttcacgaagaaacgcagggtcatcacgaccgtgtctgataaaaagaagcctgtcttccctgacctggtcaaacgtcattttaacgcactagcagcaaatgaagtttacgtcggggatattacttacctaccgatcgcagatggcacgaacatgtatctggctacggtcattgattgctattcccgtaggctggtgggttttgcgattgcggatcatatgcgcacgtcattggtgcaggaggcattgctgatggcgaagagtcagcgaggcagcctgaagggtgcggtgtttcattcggatcacggcagtgtgtacacctcgcaggcgtttcaggacacttgtaaaaagttgggtgttcgtcagtcgatgggtgctgttggtaccagtgcggataattcgctggcggagtcgtttaatgccgccctcaagcgagaggtgctgcaggattccaagacgtttgccaatcagttggtgtgccgccgggaggtatttcgctggtgtaccaggtacagcacaaatcgcaggcattcttggtgtggctatgtggtgcctgcggtgttcgagagtagaaatttagctattctgaaatctgtttcc

SEQ ID NO: 3035 - DNA, 267 bp, Corynebacterium glutamicum
atgccaaccaagacctattccgaggagttcaaacgcgacgccgttgctttgtacgagaactccgacggggcctcactccaacagatcgccaacgatctcggcatcaaccgagtaaccctgaaaaactggatcatcaaatacggatccaaccacaacgtacaagggacaaccccatctgcggcagtctctgaagctgaacaaatccggcagctgaagaaggaaaacgcgctacaacgcgcaagaacgcgacatcctgcggaaagctgc

SEQ ID NO: 3036 - DNA, 1140 bp, Corynebacterium glutamicum
atgaagaaggagaaactcttctcgttacttcgatatatagataatgggagtctcgaatgtataacgagtttgttcctaataactttatcattaactatgcctgcaataggcttgggaaattttggcatccaggtaatcgcgctgtcaatgatcccacttattaatgtacgttttcccgttgccgccttacctctcgcattagtggcgactgtatggcttaatgcttgggcagaccatcttctcctaactggttttattgtttatcttgctgtggaatacgcaacaagccgtgggcgcttcgctctcgcattgattttgggagttgaatggatcttaattgcttatggggtagctttggaaaggcctcttgaggctaaagactctccatctctcattaccgaaattttgctcatacttgtagcagctggcacaggggcaggtcggtggaaaattttgagtgaacgcaagcaacgtgcaattactcagcaggaaatcatcaaaaaaatccgtactgatatagcgcactatttgcatgacagtatggcaagatcgttggcaataatgatagttcaatcaaagctgactgaactagagcctgatccaaaaaagattcaagaaaaactaaacagtattgccaaaattggacaagaggcagtggctgatttgcatcaattagttagacacctcgtggtcgaggagtctgctgaaaaagccacagcgtttggagcatgggctgcagtttctattcatgacacggttaattctgccattcagttattagtagatgcaggacatgtcgtttcctttgacagtagaaaaaagaactataagctggaccatattgctgaaacggcgtttgctttagccttcaatgaggcagtctgtaatgcaattaaacattctccgcccaaggcaaacgttactattcgcataacagaaaaagcacagtctcttcagattctagtaatgaatcctattggagattggcatgcaaatggggagtccgcaattccaggtgtgggcattggcgtagaaagcttaaccagaaggatacgtaatattaaaggacaggtctgtgtgacttcactgcaaggatactggaaagtagttatttcactacctttgaaatgtgaggattct

SEQ ID NO: 3037 - DNA, 618 bp, Corynebacterium glutamicum
atgcttggcccgattcaagttctaattgttgatgatgaaccctttttcattaatgcacttgaaacttatttttccactaatgagaacatcaatgtcgtcgcaacggcagagaacggcgtgcaagcgctagacattctatcaaagactatcgtggatgtggtgttatgtgatgttcgtatgccacttttgagcggtgtggagttgatgaaaatacttgctgaaaagaaacttacctgcagagtgctagcattaacttcttttctagatgattatgcgatgctctctatgcttcaatttggggcctttggatttttactcaaaagtgccgaccgagatgagataatagaagctgtccaatcagcagctatggggggaactaccatctcccctgaaatagcaacaaatttacgtaaatttttgtcgcagcctccttcctccataagtgatcttccgaccagagagcgagatgttctcacccttcttcatttggggaagagtaatgcagatatcgctgcagagctgaaattatcgacagtttcagtcaaaaaatccgttagtcgattgatgcaacgatttcaggtatcaagtcgtctggaactcgtagcatcgacccgactt

SEQ ID NO: 3038 - DNA, 225 bp, Corynebacterium glutamicum
atgcgcttgattacttctcagcctcgccccgcccggccaatcggtcaacctggtattttcggcaaccacgtccaccgaaacctaattaatctgtccatcgtggactttcccatcaaaccggagccattaatggacttgccaaaagaaaaactccccgactgttggaatctgatttctcaggccgacttccggggagtggagaaactcactgatgtttatcagtac

SEQ ID NO: 3039 - DNA, 1290 bp, Corynebacterium glutamicum
atggctgcaatcgttattgtcggcgctcaatggggcgatgaaggcaaaggtaaggccacggatattctcggcggactcgtcgattacgtggttaagcccaatggcggtaacaacgctggacacactgttgtggtcggcggcgagaagtacgagctaaagctccttcctgccggcgtcctctccgaaacggccaccccaattttgggcaacggcgttgtgatcaaccttgaggcactgttcgaagaaatcgacggccttgaggctcgcggtgcggatgcatcccgcctgcgcatctctgcaaacgctcacctggttgctccataccaccaggtgatggaccgtgttcaggaacgcttcctgggcaagcgcgcaatcggcaccaccggccgtggcatcggcccaacctacgcggacaaagtatcccgcgtgggaatccgtgttcaagacattttcgacgaatccatccttcgtcaaaaagtcgaatccgccctggattacaaaaaccaggtgctggtgaagatgtacaaccgcaaggccatcgtcgctgaggaaatcgtgcagtacttcctctcctacgctgatcgtctgcgccccatggtcatcgatgccaccttggtgctcaacgaggcacttgatcagggcaagcacgttcttatggaaggtggccaggcaaccatgctcgacgtggaccacggcacctacccattcgtcacctcctccaacccaaccgccggtggcgcaagtgttggttcaggtatcggcccaaccaagatcaccagctccttgggtatcatcaaggcctacaccactcgtgttggtgccggcccattcccaactgagctgtttgataagtggggcgagtacctgcagaccgtcggtggcgaggtcggcgtgaacaccggccgtaagcgtcgctgtggctggtacgactccgtgattgctcgttacgcatcccgcgtcaacggattcaccgactacttcctgaccaagctagacgtgctcaccggcatcggtgaaatcccaatctgcgtagcttacgacgttgatggtgttcgccacgatgaaatgccactgacccagtcagagttccaccacgcaaccccaatctttgaaaccatgcctgcatgggacgaagacatcaccgactgcaagaccttcgaggatcttccacaaaaggcccaggactacgtccgacgtctggaagaactctctggtgctcgcttctcctacatcggtgttggacctggtcgcgatcagaccatcgtcctgcatgacgtactagctgacaac

SEQ ID NO: 3040 - DNA, 759 bp, Corynebacterium glutamicum
gtgcccacccgaaaagacctcaaaattcttgatgatgtggcctttgatgtgctccctcaggatcccacgccttctctcgatgagatcgccaagcagcctgatgtcgagcatttgagcagccctaagtttgcgccacaacagcctgaaacccgtttgcgcatcgtggtgatcggttcggatgcagcgctgtctgcggtcctgactcgtctcatgcgcgccgataatttgtgggcggagattggattcgtgcccgttggtccttcaacggctgcgaagaactggggtctgcccgccgatgaggctgccgcgcttgagctcgcactgaccggattggtcaatcctgccccgctcatccgcgatgacgttgcggtcgccgtcgccggttcagccaccatcaccaactgggagccgggtgagatcaccggcgaagtcatcgtcgatgatcatgttctcatccgccacgaggctgcctcgaaggccccacgccgtggcgtctacggtgcccgcttggtgccgatgcttgacgccccaggcatcgctgcggtcatcatggacactcccctgcccggcgaggtgccctcccgcagcctgttccctcgcccctcgggctcggttattccagagagcttttcgacgggccgtgccatgcaagccggcggcccctcgctacaaatccgggttgacggaatttcccgcaaacgtaaagtggagcgcgttaccttctatcgacatttgcgcgatctccaaatcgtgcggccg

SEQ ID NO: 3041 - DNA, 264 bp, Corynebacterium glutamicum
atggcaccagcgacatctctcccgcttgaatcaggaaataatattctcttcccgccaatgtatgaccttgtttggtctgtgattcccttcgtcattctcttggttgtggccatcaccgtcgcaactgtggaatacacgagaaaacgggatgtagtggcttcattgggctggggagctctcgtgttgttcctccccatcatcggatttgtcatttgggcagtagcagcgcttattcgccgtgaaaaccgaaccgcgataaaaggc

SEQ ID NO: 3042 - DNA, 1167 bp, Corynebacterium glutamicum
atggcaaagaagaaactggggactgtcgccagactgtctgaactggataagtccctgcgcaatagattgctgcgggttcgttcccgactgctgtttattgttcattccgcaattggtgcgggtgtggcgtattggatcgccgtggaagtgatcaaacacggacaaccgtttttcgcaccgatgtccgcggtgattattttgggtctctccggaggagaccgcatcaaaagagccacggaactcaccctgggctgtgctttaggcgttggtttgggtgatttactgatcatgcaaatcggcacgggctattggcagatatttgtggtagttggattagcgctgctggtggcctcgtttgtttcaccggcaccgttggtgagtaatcagatggccattggtggcattttgattgccacgatgttcccgccaggtgatggtggaagcattgaccgtatgatcgacgccttcattggtggtggcgtgggaattttggtcatcgcacttcttccctcatctcctcttgacgcaggccggcatcaagtggccaacgttttggggatcgcagctagtgtgctggaagacgtggcagcttccctaaaagccaaggatgcagccaaactcaacaatgctttggaagcattgagaaggtcgcaggcgtcggtgaacaagctggaaactgcggcatcttcaggcaaggaagcaaccaccgtatcgccatttttatggggagatagggcccgcgtgagatcgctgtatcgcattctggcgccagtggacaacgtcatccgaaatgctcgagtccttgcgcgacgggcagtggtgctgaccgaagacaatgacaccgtcagtgatgaacaaatccacgtgattgaggaaatcgcagacattgcactgcgactgtcagacctttatgagcaccacaaagaaatcagtgaagcactggaaattcctgagttggttaaccgactgcgtcaactgggcagtgaagtgggcgaggacatcgccgaagatcgagtgctatccgcacaagtaattttggcgcaatcgcgatccatcattgtggacctgttgcagatctgcggcatgtccagggaatctgcggtggcagtgttggttccgacctcagagagtccggcttaccctccggagctgtgggatgacgaagac

SEQ ID NO: 3043 - DNA, 1032 bp, Corynebacterium glutamicum
atgcctatcgcaactcccgaggtctataacgagatgctcgatcgtgctaaggaaggcggattcgccttcccagccatcaactgcacctcctcggaaaccatcaacgcagctctcaagggcttcgcagaggctgaatctgacggaatcatccagttctccaccggtggtgcagagttcggttccggcctggcagtaaagaacaaggtcaagggcgcagttgcgcttgcagccttcgcccacgaggcagcaaagagctacggcatcaacgttgctctgcacactgaccactgccagaaggaagtcctggacgagtacgtccgcccactgctggctatctcccaggagcgcgtcgaccgcggcgagcttccactgttccagtcccacatgtgggatggttccgctgtcccaatcgacgagaacctcgaaatcgcacaggagctgctggctaaggccaaggcagcgaacatcatcttggaagttgagatcggtgttgtcggtggcgaagaagacggcgttgaggctaaggctggcgcaaacctctacacctccccagaagactttgagaagaccatcgatgcaatcggcaccggtgagaagggccgctacctgctagcagctaccttcggtaacgtccacggcgtttacaagccaggcaacgtcaagctgcgcccagaggtcctccttgagggccagcaggttgcacgcaagaagcttggacttgcagacgacgcacttccattcgacttcgtcttccacggtggctcaggctccgagaaggaaaagatcgaagaggcgctgacctacggcgtcatcaagatgaacgttgatactgacacccagtacgcattcacccgcccaatcgtctcccacatgtttgagaactacaacggcgttctcaagatcgacggcgaggtcggaaacaagaaggcttacgacccacgctcttacatgaagaaggctgagcagagcatgtctgagcgcattatcgagtcttgccaggacctcaagtctgttggaaagaccacctctaag

SEQ ID NO: 3044 - DNA, 951 bp, Corynebacterium glutamicum
gtgggcaagctgacctcgaatcgttattacgacgacaaagcttggctggcccttgctcttgggcgtgccggaaaagtgcgaaaggtgcgcacaccaaaatcattgccctcgttggaacaaaacatcgtcgatggcattgattcccttactggtgtgctgccgtggcgttccggcgaaaccttctacaacgttccctccaacggtcctgctgcgatcatgatggcccgcaccgaccgtttggacgaggctatgaaaatcaccgattggatttttgacaacctgatcgatggcgacggccttgtgatggacggattgcgcatgcgcatgcacggacctgagcttgtccgttccatccacccgtattgccaaggtgtcgccattggtgcgtgtttggaaattgctctcaaactgcgtgagcgcgcaggcttgaccactactgtggtggatcactggtcggatgccgataaggcagaagactccctcaaatactttgcacacatccacgctgtggttcaggctgtgtcgcggaagatgaccaacttccacggcgttattgattgggacaccggtgacggcgacggcggtttgttcaagggcattttggtccgctatttagctgatgtggccatccgcctgcctgacgattcaccaaccaaccgggaaaccaaaaagattgcagcacgcctggtactggaatcggcggaaagcgtatggaaccaccgattggaagttgatggccttccggtattcgccacagactggacaacggatgcacgcctgccacaaaactttggtttgagttcctctagtttgagcgatctggtgagtgttgtgcgcgtggatgaacgtgatctgtccgtgcaattgtccggttggatgctcatggaagcagcagcgaaagtggccgaagaactggaaaacaacggcaatagttacaccggtcgctcccga

SEQ ID NO: 3045 - DNA, 618 bp, Corynebacterium glutamicum
gtgggcaaaggtccatgggaagaggaaaaccccggcgtacctcggcctacaagcccgcttttcgacgtcaccctcctcaacgagggcgatcgccgcaacgttgttgacgcctatcgttattggacccgtgaggcgattgttgaagatatcgacacccgccgccacagcctccacgtagcgatcgaaaactttgaaaacgacgccaacatcggcaccgtcgtgcgcaccgccaacgcctttgccgtgaacacagtccacattgtgggcaggcgtcggtggaaccgcaggggagccatggtgactgaccgttaccagcacctcatgcaccacgaagacgttgattcgctgcttgcgtgggcaatcgcggagcggcttaccatcgtcgcgatcgataacaccccaggttccgtgcctttggaaaccgctgagttgccgaagaactgcctgttgctgtttggtcaggaaggcccaggtgtcaccgaagctgcgcgtgcaggtgcgttaatgacctgttcgattgcccaatttggttccactcgatccatcaacgcgggtgtagctgctggtattgcaatgcatgcatggattcgtcaacatgccgacttatcgcaagcctgg

SEQ ID NO: 3046 - DNA, 552 bp, Corynebacterium glutamicum
atgtcatctaattccattaacgcagaagcgcgcgctgagcttgctgaactgatcaaagagctagctgtcgtccacggtgaagtcaccttgtcttcgggcaagaaggctgattactacatcgatgtccgtcgtgccaccttgcacgcgcgcgcatctcgcctgatcggtcagctgctgcgcgaagccaccgctgactgggactatgacgcagttggcggcctgaccttgggcgctgacccggttgccaccgccatcatgcacgccgacggccgcgatatcaacgcgtttgtggtgcgcaaggaggccaagaagcacggcatgcagcgtcgcattgagggccctgacctgacgggcaagaaggtgctcgtggtggaagataccaccaccaccggaaattcccctctgacagctgttgccgcgttgcgtgaagctggcattgaggttgtgggcgttgccaccgtggtcgatcgcgcaaccggtgcagatgaggttatcgcagcggaaggccttccttaccgcagcttgctgggactttctgatcttggactcaac

SEQ ID NO: 3047 - DNA, 972 bp, Corynebacterium glutamicum
gtgcagtctgagcaacctcaagcccctgccacggcggaggtagctgcggacgaggagcaacggggcgtcgataagcattcgtttttgagctctttgcctggttcgcagcgccgggagcgccgaaactgggcggcgaagcaccacttcgatttcatcaaggaagatgcctttttgaccgatgaatggtcaaggggtgcggcatcgactggtgccgttgcacgtgatgtggtcagtggcatggctgaaggatatgaaacgcatctggtggatttggcgggcgtgcccgtgatggcgatgcgccgtggaattacctctgacgtggtcattgatgcgcgccgcggtgagcagcctgccgatccagagcgtgaagaatctgatgatttagtcgagattgataccgtctctggattccgcctgctcagtaacgtggcgggggttgcgcagcgttttgtcgacgagcgcattcacgtcggtttggattccatgccagaagctgtgactgctgtgtggatggaatctgattgggtgttggcggaaaccatcaagggttccacgccttccgattgggaagagattttgcggccgttggcgctgctcacggacgcgtctttcacgttgccacctcgttccacgcgtgcgcaaaccttggatttgaagcatttggaaccaagccgtctgaagccggagcagccagaaaagccagcgtttactcccaatgcttcggaagaagatttgtctcagccgttggtgatccgccccgaggagccgttgcagatgccggttcgcggtgtgcaggaaagccgcggagtggtcgagccacggtcattgggtgcggatgatgtggagtcgattgcggagggcgatccagagcgtccgagcgatctttatggcacgcgtgtgctgcgtgatctcaatggtcagtccagtattttccaagattccaccgacgcggatgagccaccaaaaaagtgg

SEQ ID NO: 3048 - DNA, 852 bp, Corynebacterium glutamicum
ttggtcacattaacgcctaggctcggggctatgaccgtgttgatttctccgtccacccttgctgaatcaatccacgctggtaagaaacaaactgttctcgctgctttctgggctccaattgaaggagcaggccgcacagttttctgctctgagcacatcccaacttccattttctgcgaccctgcccttgagctttccggagttccttcctctgaagatggccgcaacccactgccaccgctgaatgtgttggcacgttctttcaggacctggggtttgaataccgatcgtgaaatcgtgttttacgatcagggacgtggcctttttgctgcacgcgcctggtggatcctccgatgggcgggcatgcccaacgttcgcatccttgacggtggtttccagaagtgggaagaccatgagctgggacacgctggcgggcctggaaacttcccgcacttttgcaatgtgcgtcccaacccaggtcagctgtcggtagcgaccatcgaagatgtcaaggcacatcagggcattttgattgattctcgcgatgaacaacgatttgcgggtcgcagtgaaaagctcgatctgaaagccggacacattccaggcgctatcaacatcaacgctaaatctttgctggaagatgatttcaccttcaaatcaccagaagaaatccgccagatttttgcggacaagggggtaaccagcggagagaacgtcatcgtttattccggttccggtaaccactcgtcccagttgctggctggcatggagcacgcggggctaaccggtgcgagccattattttgctggttggtcacagtggagcgctaaccccgagaatcctatcgaggcc

SEQ ID NO: 3049 - DNA, 720 bp, Corynebacterium glutamicum
gtgaagatcgatgaattgattgctctcgccgcggagcaacccactcgcatctccaggcgttccggtgtctcgcgctcgaccctgaagcgggtcggcgatggcaccagcgagcccaccctgtcgacgctgcgtgaggtcgcgttggcgctcgggcttgatattaaggtcgccgcgcaccacgcctgcgatccctttgcggccgctgcagcgcgcacgcttatcgacgcctccgtccccgaaaatccccacaaccaggaaattctcgcttggttgcaccgttttgagcggtggaatatcaacgatccgctcacccttgtctctgaagccggaacgcttcagggcatcacacatcgccaggatgcgcagtttgtgaaactcaatccacgcggcatcgctgagctaccggagcttttccaacagcacaaaaccaaatgggcgctgtcgggcgctgcggctgccacggtgatcatgggacaaattgtgctggggaattcgattgtgtggcacgaacctgcccacgatctcgatgtctcagcgctgggcaccattgttgatgtggcagaagacgccgatctaattctcctgcccgcaacggtcacggaactggtgggaagttacacccaggacaggctaaattttgtggcacctgtgcaattagttattgatctacacagcctccacatgttcgaggaagccgattacctcacgagcggttggcgc

SEQ ID NO: 3050 - DNA, 279 bp, Corynebacterium glutamicum
ttgttcatttactcgctaactctgaatcaagttcttttagccatagctttcatcggcctccttgttgccttgtcatgggggattaataaattctccacagttcgattttggaaaaagcgggccccggtttggcaagttggcgcaatgattatcttgtgttttgttgccaatgggttccctgcggaaccaatttatgctgcttctttgggtgtagcttcaggactgtttgtttttctttccctcgttcaacaggcaagaaaagccaatcaaacaacggtc

SEQ ID NO: 3051 - DNA, 399 bp, Corynebacterium glutamicum
gtgggcaagcaggaaaagctgcgcattcctctcgatgttccgggagtggaatcagaagaggtaggtgtagaactgcttgccgaaggctactacctggtagccactttgccggctgtcgcccaggactgtgccctgggtgacgtcgtgcgggcacatcatgttgatgaggtcttggaatttcaagaagtggcagttgctggcggaaacaaaaccctccgggtgctcgttgatgccatcgctgctgaccacgtgcgagcccaactagaaacacttgggctacacgtggaagctcccatgtcagaaatgctaactgtcaatattgcccccgattcaccgtcgcacggtttggagatcctgctcgatgatctgcatgctcagggggtaattttcagggcgtta

SEQ ID NO: 3052 - DNA, 177 bp, Corynebacterium glutamicum
atgcggatcatggcgcgatcatcatcgaagaggaactccgcgacagccttggccagctcagtcttaccgacgccggtaggtccaaggaacaggaaggaaccagttggacggtttggatcggcaacacccgcgcgtgaacgacgcaccgcgtcagacactgcagttaccgcttctagc

SEQ ID NO: 3053 - DNA, 762 bp, Corynebacterium glutamicum
atggacctcgtagcgttccttcaatccacgaagaataccgatggcatcttctaccgttggctcaccgacataaacctgctggaacctacgctccagggcagcgtccttttcgatgtacttgcggtactcattcagcgtggtggcaccaaccaagcgcagctcaccgcgggcaagcagtggcttaatcatgtttccggcatccatggcggattcacccgaagcaccagcgccgacgatggtgtgcagctcatcgatgaaggtaacgacttcgccgttagctcccttgatctcatccagaacagccttcagtcgctcctcgaattcaccgcgatacttagcgccggcaaccatggaaccaagatcaagactgatcagagttttgcccttgagggattctggaacgtcaccagcaacgatgcggcgtgcaaggccttccacgatggcggttttaccgacacctggctcaccgatcagaacagggttgttcttggtacgacggctaagcacctgaacgacgcgacgaatttcctggtcacggccaataacaggatcaatcttgccttcacgagcaagcttggtcaggtcagtggagtacttttccaaagcctggaactgtccctctggatcctgagtggtgacacgctgagatccacgaaccgaagggaaagcctctttgatggcgtcataggttgcacccttgttggtcaacagatccgcagcatcagactttccgcgagcgataccggcaagaagtacttcggt

SEQ ID NO: 3054 - DNA, 396 bp, Corynebacterium glutamicum
atgtacttgcggtactcattcagcgtggtggcaccaaccaagcgcagctcaccgcgggcaagcagtggcttaatcatgtttccggcatccatggcggattcacccgaagcaccagcgccgacgatggtgtgcagctcatcgatgaaggtaacgacttcgccgttagctcccttgatctcatccagaacagccttcagtcgctcctcgaattcaccgcgatacttagcgccggcaaccatggaaccaagatcaagactgatcagagttttgcccttgagggattctggaacgtcaccagcaacgatgcggcgtgcaaggccttccacgatggcggttttaccgacacctggctcaccgatcagaacagggttgttcttggtacgacggctaagcacc

SEQ ID NO: 3055 - DNA, 1347 bp, Corynebacterium glutamicum
atggagtacacaccgtttagtctgattctcgatgtggggtggatctcggggttgatgatcatcggcaatatcatgcgccggaagattccgtttttccagactttgctcattccttcctctattactgctggcatcatcggcatgattttggggcctaaggtgttgggtctgattggttggtcggatcatctttccacttacactacggtgctcattgcgattgtgtttgcttcgatgccgtattcgatgaagtttgaccgtggcgtgcgtactggcatgaagacgatgtgggcgtattcgactgcgatgtttgtggggcagtggggtctgttcattttgctgggtctgtttttgttccagccggtgtggggtaccgatgagtggttcggcatgatgttgccggttggttttgttggtggttttggtactgctgctgcggtgggtactgcgttggagtcttcgggtgcggaggctgcgatgtctttgggctttacctctgcgacggtgggtacttttgctgcgattgttggtggaattattttcacaacgtggggtattaagaagggcaagactgcggcgatgcctgcgcagttgccgtgggatttgcgttcgggttatatcgataagctgagtgatcgtccgtcgattggtaaggcgagtacgaatccgtctgcgattgagcctttggcgctgcatactggcattattttgttgactgttgcggttgcgtattccattaatcagtggttgggtagcatgttcccaaccgtgcagattccgttgtttgcgatgtcatttgtggtcggcattgtgggcatgggaattatgcgtttgttgaagaagcctgagtatttggatcgcgacaccgtgaattccgtgtcgggcgcggcgacggattacctcattgcgtttggtattgcctcgattgctcctgctgcgattgctgattactgggttcctcttgtggtgctgtttgttttgggcaccatctactgttgtttcttctttttctgggttgcgcctcgtttctttggcgagaagtggctggagcgcgcgatcttcggttggggttgggctactgccgcggttgctaccggtatcgcgttgctgaagatcgtggatccgaagttgaagtcgggagcgcttaatgagtacggcgtggcttatatcggttttgctccatttgaaatcggcatgaccatcatcgcgccgatcgcggtgctcgcaggctttaccatggggttgggttgggcgtcgttgattgttgcgatcgtgatttttggcctcgcgtggggtctgaagtggttgccggagcgcggacatgtccgcggcgagggtaagccgcaa

SEQ ID NO: 3056 - DNA, 387 bp, Corynebacterium glutamicum
ttgtgcaatgatctgcgtatgaatgcagataagaaaatgtgcggaatgaacccggatagccaatacgtcgaacttgccgtcgaagttttcggactcctcgcggacgccactcgagttcgcatcatcttggcacttcgaaacagtggtgaactttccgtaaaccacctcgcggacatcgtcgataaatcccccgcagcagtttcccaacacctcgcccggctgcgcatggcccgaatcgtgtccacccgtcaagaaggtcaacgagttttctacaaactcaccaatgaacacgcatcacagctagtctccgacgctatttttcaggcggaacacaccattgcggacggccagactcccccacaccaccaccgagaacgagaacaatca

SEQ ID NO: 3057 - DNA, 858 bp, Corynebacterium glutamicum
atggaggcgaactcagagggtattcgagcgctgaagtttagccttgtattgatgctgctcacgacggttttgcaggctatcattgtgtctttttctggatctgttgcactgttggcggatacggttcacaacctttccgacgcattgactgcgattcctctttggattgctttcatactttcccggcgcgcagcgactcaaaaatatacgtatggattcaatcgtgcagaggatttagcggggttgtttattgtcgcgatgattgctctttcggcgattgttgctgcatggcaggcgatcgaccggatgattaatcctcgcccgatggagaatattgaatgggtgattgcggcaggtgttattggtttcttaggaaatgaggctgtggcaatgtatcgcattcgggttggtaagaggattggctcggctgctttggttgcagatggcgttcatgctcgcacggatggttttacttcacttgcagttgtcgcaggtggtgttggagtttttctgggattccccctggctgacccaattatcggattgatcatttctgcgatgattgccacccttcttgttggtacgatccgttcggttggcagacgcctcatggatggaattgagccggagttggtagagaaggctacgcacgcgatctggcatgtgaaggaaattgagtcgattgatcgactgaggttgaggtgggttggacaccgtcttcacggcgatgccacggtcagcacttctacatcatcgctatcggaagccaccgcaatcgcccttgaggctgagctttccgtcaaacaacatcttcccaatgtggatgaaatgactgtgaccatcaccccttccaaacct

SEQ ID NO: 3058 - DNA, 1170 bp, Corynebacterium glutamicum
atgtcaacaaattatgaagcaatcatcattggagcaggtcaggctggactcgcggcggcgcatgaactttcccgccgcggtttcactcccggaaaagattttctcgtcctcgattccaacgacgggcccggtggcgcctggcggcataggtgggattcactcacattaggtaaagcccacggaatcgccgatctcccagggcttcccatgaatcgccccgatccgaaaactccggcttccacattggttgctggttattacggcgcttacgagaacgagttctccttcgcagttgtgcgcccagtcaaagtctcacgagttgagcccacttccgaggatccttcgagcccattgcgcgtgagcagcgacgatggtcgagagtggattacccgcatggttcttaatgcaacaggtacgtggacaaacccttatgttccgtacattcctggcatcgataaattccagggcaagcagctccacaccgttaattaccgcaaggccgaggatttcaaaggtaagaaagtcctggtcgtcggcggtggtttgagtgctgtgcaatttctgctggagttggaaggcttggcggaaaccacctgggcgacgcgtcgtccgccgaacttcacgcagcgcgagttcgacgccggctggggcattgcggttgagcgcgccgtccgcgaacgcacgttcaacggtaaagctcctgctagcgtcgtgcgcaccacgggaattccgcagattcctgattatctcgctggcgtggatcgtggactcattgtcagccgcggcatgttcgaggaaatcacgcccaccggtgtggttttcggtgagcctcccgccgagagatctgaaggtttaggcccttcggcaggcacgacgctggcggttccggaaagctggaagccatatcctgcaggcacgcacctggatgtggacgtcattttctggaataccggcttccgcgccgcactgcgtcacctcgcaccaatgaaactccgcgggcaaggtcgcggtatcgagctgatcgacgaggtcagccccgcctccgacgcgcgcgtcctgctcgttggctacggctccaccgcatccacggtcggcgccacccgcgcgggcagggtcgccggccgggttgctgctaaaagattgcttgtcgacgtctcccctcacgtaaat

SEQ ID NO: 3059 - DNA, 1041 bp, Corynebacterium glutamicum
atgaaagcattcggttttttaagcttcgggcactatcaaatcggccacgaacgttccatgctgaaacaagcactggaattagcaaaagaagcagatgccattggagtaaatggcgcatacttccgcgttcaccacttcgctccccaaggtacatccccgatgccacttcttggagccatcatcggtgccaccaaacacattgaagtgggcactggagtagtggatatgcgttatgaaaatcccttgtatatggccgaggaagcagctgctctcaatctgcttgccgacggccgactagccctcggagtttccaggggatcacccgaaccagccgagaagggttgggaagctttcggctacgacggcggtgatgatcctaaagctgcaggcatggcacgggagaaattccttcgcttcctcgatgccatcgatggtcgccccatgtccatcgcttccgagaatcaatacccacgcctctaccatccgggcactcccctgccgatcttcccgcatgatcctgacctgcgtaaatccatttggtggggcgccggttcccacaacaccgccgaacaagcagcacgcgatggcgttaacttgatgagctccaccctcgtcgccgaagccaccggccaatccttcggggatctgcaagccgatcaaatcgcgttctaccgccaagcttggaaagaagccggacacgattggaccccacgtgtgtctgtctccaggtccatcttcccgatcgtcaccgaccgcgaccgtgagcttttcggacttcagggacaaggcggtgaccaagtaggaatcctggatgatacccgatccacgttcggtcgcagctacgccggaagtcccgatgaactcatcgaccagctcaaggaagacaaagctgtgatggaagccgacaccttgatgctcaccgcccccaaccaaatgggtgttgagatcaacgcgtcgatcctgaagaacttcgctgatcatgtcgccccagcactggagtggcaaccaaacactgaaggtctggttactggctacgagttc

SEQ ID NO: 3060 - DNA, 762 bp, Corynebacterium glutamicum
atgggaagacctcaacgcctcaatcgacaaagttctgggttagaactcgtagccagtaaccagaccttcagtgtttggttgccactccagtgctggggcgacatgatcagcgaagttcttcaggatcgacgcgttgatctcaacacccatttggttgggggcggtgagcatcaaggtgtcggcttccatcacagctttgtcttccttgagctggtcgatgagttcatcgggacttccggcgtagctgcgaccgaacgtggatcgggtatcatccaggattcctacttggtcaccgccttgtccctgaagtccgaaaagctcacggtcgcggtcggtgacgatcgggaagatggacctggagacagacacacgtggggtccaatcgtgtccggcttctttccaagcttggcggtagaacgcgatttgatcggcttgcagatccccgaaggattggccggtggcttcggcgacgagggtggagctcatcaagttaacgccatcgcgtgctgcttgttcggcggtgttgtgggaaccggcgccccaccaaatggatttacgcaggtcaggatcatgcgggaagatcggcaggggagtgcccggatggtagaggcgtgggtattgattctcggaagcgatggacatggggcgaccatcgatggcatcgaggaagcgaaggaatttctcccgtgccatgcctgcagctttaggatcatcaccgccgtcgtagccgaaagcttcccaacccttctcggctggttcggg

SEQ ID NO: 3061 - DNA, 1146 bp, Corynebacterium glutamicum
atgaatttttacccaccatctgtacctattaaccctgcgtggcgtccacccacagtaactgtgcaagcgggacggccagccagaactcctggtgcgccgatgaacccacctatcacgttgtccagcacttatgttcatgattcagaaaaagcttatgggcgcgatggcaatgatggatggggtgcatttgaggctgccatgggaactctagatggtgggttcgcggtatcttattcttcaggtttggcagcggcaacgtcgattgctgatttggttcctactggtggcacagttgttttacctaaagctgcctattatggcgtgaccaatattttcgccaggatggaagcccgcggaaggctgaaggttcgaactgttgatgcagacaataccgaagaagtgattgctgctgctcaaggtgcagatgtggtgtgggtggaatcgatcgctaatccgacgatggtggtagctgatatccctgcaatagtcgacggtgtgcgtgggcttggagttttgactgtcgttgacgcgactttcgcaacgccacttcgtcaacgtccattggaacttggtgctgatattgtgctttactcggcaaccaaacttatcggtggacactctgatcttcttcttggagtcgcagtgtgcaagtctgagcaccatgcgcagtttcttgccactcaccgtcatgatcatggttcagtgccgggaggtcttgaagcgtttcttgctctccgtggattgtattccttggcggtgcgtcttgatcgagcagaatccaacgcagcagaactttcgcggcgacttaacgcgcatccttcggttacccgcgtcaattatccaggacttcctgatgatccccaacatgaaaaagccgtgcgagtcctaccctctggatgtggaaacatgttgtcatttgagcttgatgcaacacctgaacgaactgatgagattctcgaaagcctgtcacttttaacccacgcgaccagttggggaggtgtggaaacagccattgaacgtcgcaccaggcgggatgctgaagtggtggcaggagtaccgatgactctttgccgcgtttccgtaggaattgaagacgttgaagatctatgggaagacctcaacgcctcaatcgacaaagttctgggt

SEQ ID NO: 3062 - DNA, 567 bp, Corynebacterium glutamicum
atggaagacgatctcagtgctgctctcgtcaaagcgcttttcgacgcgcgaacccaacgcaggctctctatctcggcgttagctgaatcctccggtgtgtcgcgagcaatgatttcccgcgtggaaaacgcagaggcgcaaccaagcgctgcattacttggacgcctttccggtgcattgggtatgacgctttcggagctcattgcacaggctgaaggtggctatgaccggggcgctcggcggtcaaagcagtctgtatggacagatccagctaccggttacacacggcgtgcagtgtcacagccgtcagaatccccactagaactagtggaagtaatgctgcctcctggggcggaagttggctacccagctgatgcttatcgtttcatggatcaggtggtctgggtactcgaaggggccgttcgtattactgaaggtgaagaggtccacgaactttcaacgggggattgtctacggtttgggcctccgcgagataccgactttgctaatcccaccaccgtagccactaggtatttagttgccttggacaagcgtgtacctcgtgct

SEQ ID NO: 3063 - DNA, 240 bp, Corynebacterium glutamicum
atgaataatcagctagatcagggcccccttttccacggaacaatagcgcggcttcaacctggtgacctccttaaacctggtcataagtctaattaccgtcctgacataatcatgaaccatgtttatttcaccgctctgattaatggcgctgggcttgctgccgaaatcgctgctgaattagacgctggcctatcggacgatgtttttcagttccccggaaaactccgcgagtttatgaag

SEQ ID NO: 3064 - DNA, 183 bp, Corynebacterium glutamicum
gtgaaaccactggggagttttgacaacgatcccaacgtgaccgacaagaagtttccaggcaatccaacgaggtcttatcgcagtgacgaactgctgcagattattcgagagatcaccgattggactcggttaactcctgaggcactagcgaagtggagggaaaggttacgcaattacccccaa

SEQ ID NO: 3065 - DNA, 1125 bp, Corynebacterium glutamicum
atgccaatagtaacttttgaggactggaatgaatcgttccttcagacgggacttccctttgaactccttggacaggttcaaggcaagactttagaagacgaacccttcgccgatatgggcgaagccaagttaaggattaaaaattttgaatcggtgaatgcgtcaaaaatagtgcatgcgctatatttccccaacttgaaatatctccgatttacactgccacagtctgtggacaagttctttatcttatccccaagtattccccctcgagttgctgaacttttgcgcgaacaagggtttatgttcgccgaccaacgaggcaatggtttcgcatcatggcctggggtccatatcgatgtccgcggtaaaacaagcaccgattcatcaaagaaaatcaaaagacgaacaccagatcgtcgaactgcatcacttttcactcctcgcagagctcaagtatccggagcattgcttgcacaaccagccatattaaggtcaccaatccgcgagattgcagactcagcgtccgtctctgttggcaccgcgatccaaactcttgaattactcaccgaagctggctacttgcgcaaaatagaaagcggataccgactcatgaaaggcgatgcactgcttgattcatgggcgcatgcctatccgactgggctcggtgtaagccaacaaactttcagaggcaatggagaccttaatcgctttaaaaacattgaacctcttgggtggatcagtggcgaacaagctgtcccaaaacttatcagtggcggaaatactgcacatatttatgtcaacgatgacagcgacgacaaggccactaacaaaatcattcaacaaggacgacttcggagagatgataccgagggccaggtattagttcgacgagcattttggcggcaatcaaaaaagcataatgaaagctaccataaaagaaatctatcgctagcttttccaaccccatttaacatgtggccgatcgctccattaccagtaatctatgcagatttactgtccgttggggatccgcgcctatcggaagttgcctacattataaaaactcagattcaggaatacacagaccatgatgaattcaccgaacgcggacattattttagtagt

SEQ ID NO: 3066 - DNA, 732 bp, Corynebacterium glutamicum
atgctcgttggagcacgatgtagagacattcaccagcaaaaatatcgcgatcaaacagcgggtagaagaactaaggatgttgacttcgctttagctttagaaagctgggacgacttcaatctattaaagcaacaattctcaccgactggtaacgcatggcaaggaatcaccattggaaatattccagtagatctcgtgccattcggaaatattgaaaacccacccggtgaagtcttgtccagaaaaggtcatctacttaatgtcgctgggttcaaggaagtattcgagcaagctgagctatatcccctaaatgatgcgatagacattaagttgtctacagttcccggacttactgcgctaaagctacatgcatggctcgaccgtaaagaaaataacatcaaagatgcaagcgatctagcattaatcttgtcgtggtacgaagaggatgtagaaactttatggaatcgctattttgccctggaaaatcaaggatacataggtgaaccagaggcaatggcagctgaattactaggacttgacactggaagaatactcggccacaaggaaactcaagccctccttgatcgatttaatgaacagtctcctcctgagctaaaccaatttgctgaatcacttgaagcccctcctgaacacagtcacccattagaacggcgtcgtatccaggtcgaggcactgttaggtggacttagagattccctcggttacgatgaa

SEQ ID NO: 3067 - DNA, 1179 bp, Corynebacterium glutamicum
ttgattaggtgcacaatagggagtgtgacacctcgccctgtttcttctgttgcgcgactcgttgaggataacgcgcaagattttcttcgcgccgttcaggcgaaacttttaacgctcgcgccacaggctcgtgggcattttcccactgcggatgatgcgactcatatcagcatcgccgaaatggtgagtgcgctgttggaaggcactggtgaggaagggaaagtagacgacaaaacactggagttctttaaagaagcggcgttagatgcgcgtcgatttggcctgaccccagaaatgcacagcgctttgggtgaggccgtgcgcagcgaactattgtcattatgcgaggatcttccctttgaaaatgtgctgtttgccgagcgtgcgattgctgcaaccacggctgtttccgtcgaggcggttcgtgaagctgatgaggcacacattcctgcctcatatcaggcagaaattgtagaagttgaaaagcgcagccgtaggttcaccgtcgtgcgcatgcaagctgaaacgcaactgccctacctaccgggacaatatcttgcagcaactgcggattttctgcccaacacatggcgctacctgtgcccttcgatccccactaacgaatgggggcaggtggagtttcacatccaatcagacgcagatgatatcgctggacttttagccaccacacgccttggcgataaatggcgacttggccccggtcgtggagatttcggacaaagcaaaattagttccggcaatgatttgttatttattgcacatggaacgggcctagctcctcttcgcgcttacatgtttgagctgatgaaccaagcagcacctccacgtttgcactttttcgtcggtgccgactaccccggtgagctgtatgaactcaccggcatgtggaattttgctgcagccagcccatggctttctgtcgtaccggtgtcaacgcatgacaaggatgcgtggtgggttcaagccaccgaagcatcgcagccaccgaggggtttgcatttgcatcaaacgggttcgatggcgaagatcgtcaccgaagcaggtgcttgggccgaccgcgacgtgttaattgctggccctgaatcgtgggctcgggatgttcggcgcgcgatgattaggcgtggaactccggcccagcagattgagattttagggttc

SEQ ID NO: 3068 - DNA, 798 bp, Corynebacterium glutamicum
atgcgtattgccttgcttcagatctcgacgaattccgataagatggacaacttcgccctgctgcgtgatgctgctgaaaaagctgcggaacagggggctcgggtgttggtgtttccggaggcgacttcgcaaagctttggtacgggaaggcttgatactcaggcggaggagctcgatggcgaattctccaccgcggtacgaaaattagccgatgagctggacgttgtcatcgttgcgggcatgttcacccctgctgacaccgtgcagcgcggtgaaaaaacgatctcgcgcgtcaacaacaccgtgctgattagtggcgctggattgcatcagggatacaacaaaattcacacatatgacgcgttcggttatagggaatccgacactgtgaaaccgggcgatgagctggttgtattcgaggtcgacgatattaaatttggtgtggcgacatgctacgatattcgattcccagaacagttcaaagacctcgcccgcaacggtgcacagataattgtggttcccacgtcgtggcaagacggtcctggaaaattagaacaatgggaagtcctccctcgcgcgcgtgcactggattccacctgctggatcgtagcgtgtgggcaagcgcgacttccagaagaattacgcgatgaacgaaaaggccctacggggattggtcattccatggtgacaaacccacacggtgaagtaattgctagcgcgggttatgagccagaaatgttgatcgcggatattgatgtcagcggtttggccaaaattcgggaggcattgcctgttctt

SEQ ID NO: 3069 - DNA, 243 bp, Corynebacterium glutamicum
atgtacctacaaaccgacctccccaatcacctcatccaccgcgacatcacctatcccagccccacacttaactgcacgcccagccacacggccaccgcgctgagcagcgcgaatcaacactggcgtctattgcttttcgacgccaacctccatctcaacaatcatctttccgatatgcgcactgtcagcgagcagatgctcaacatagacgtcgatcttggccacacactgaataagttgcac

SEQ ID NO: 3070 - DNA, 1134 bp, Corynebacterium glutamicum
atgctcgccctcaaaagttcagaattagaaggcatagccacatcactcaccgccgtggcgggtgcgctccacgaatcaaacactgaccggttgcagtcctggcagcagctcgaaacgatgacctctgccagctcccttatccagggctttatcaagcttgtcgattacaaccgacccacagtgaatatcgtggaacaaatgcacaaaaccgcatccacgcttttcaacaccgctgatttcctacgcactttggaaggctatgttgatgtactggaaaaacaagccgataaatctataacgctcaccgtcatgcttcgatatattgccagcttgagtagccttttagacctcatgtgtgcacgcgagatcaacgcgttgtgcacagcgattactccagaaccattgaagcatctgggcgattttggcactctacccgcctcagcaatccacgagtttcatttggtgaatgccccaccagaaatccgtgccttagccgaagcccatcccgatatgcagatcctagaagccggcgatggttcattggtagcatcgtttggggatattgatagggctacgaccgtgaccaccatcgtggcaggtgtgggttcctccaacccagaagggtggaatacatatgttgaccgtgcccgcacagtatctgcttccaccggttccgcaacggtgttgtggctgggatatcaagcacccgcttcgattcctgctgcggtatccggcgcggcagcgaatcgcgctgccgcggatctccagaggtttcaagcggcactacagtcccgcaatccccaccaaagaaaagtagtgatgggctacagctacggttccacagtggtgggaaaagctgcgtcttccggcgagctcagtgccgatgcgttggtattggttggcagtcccggcgcgggtgtctcgcactcttcccagcttggcgcacctgtgtatgcggtaacagggtctgctgatcccatcggttttgccggcacccaatatgacggcatccacggcactgatcccaccgctgccctattcggtgcaacagtgtgggattcgccctcaacgcattccggttattggaatgaccaggagttcctgggcaatgtggcggaggtggttcgcggcaaa

SEQ ID NO: 3071 - DNA, 330 bp, Corynebacterium glutamicum
atggatggggacttaccgccgagctccagggtgacaggaatgatcttgtcggatgcagcgcggttgatcagcttgccgacctcggtggaaccggtgaaagcaatcttgccaatccgattagagccggacagtgcagcgcctgcttcaccgccgagtccgttgacgatgttgaggacgccctctgggatgagatcgccgatgatgttaatcagatacaaaatggatgctggggtctgctcagctggcttcatgacgatcgcgttacctgcagcaagtgccggtgcgagcttccaggtagccatgaggattgggaagttccaaggaatgatc

SEQ ID NO: 3072 - DNA, 1518 bp, Corynebacterium glutamicum
atgactgtctacgcaaatccaggaaccgaaggctcgatcgttaactatgaaaagcgctacgagaactacattggtggcaagtgggttccaccggtagagggccagtaccttgagaacatttcacctgtcactggtgaagttttctgtgaggtcgcacgtggcaccgcagcggacgtggagcttgcactggatgctgcacatgcagccgctgatgcgtggggcaagacttctgtcgctgaacgtgctctgatcctgcaccgcattgcggaccgcatggaagagcacctggaagaaatcgcagttgcagaaacctgggagaacggcaaggcagtccgtgagactcttgctgcagatatcccactggcaatcgaccacttccgctactttgctggcgcgatccgtgctcaggaagatcgttcctcacagatcgaccacaacactgttgcttaccacttcaacgagccaatcggtgttgttggtcagatcattccttggaacttcccaatcctcatggctacctggaagctcgcaccggcacttgctgcaggtaacgcgatcgtcatgaagccagctgagcagaccccagcatccattttgtatctgattaacatcatcggcgatctcatcccagagggcgtcctcaacatcgtcaacggactcggcggtgaagcaggcgctgcactgtccggctctaatcggattggcaagattgctttcaccggttccaccgaggtcggcaagctgatcaaccgcgctgcatccgacaagatcattcctgtcaccctggagctcggcggtaagtccccatccatcttcttctccgatgttctgtcacaggatgacgccttcgcagagaaggcagttgaaggcttcgcgatgttcgccctcaatcagggtgaagtttgtacctgtccttcccgtgcacttgttcatgagtccatcgctgatgaattcctcgagcttggcgtgaagcgagttcagaacatcaagctgggtaacccacttgatactgaaaccatgatgggtgctcaggcgtcccaggagcagatggacaagatctcctcctacctgaagatcggcccagaagaaggcgctcaaaccctcactggtggcaaggtcaacaaggttgatggcatggagaacggttactacattgagccaaccgttttccgcggcaccaacgacatgaggatcttccgcgaggaaatcttcggaccagtcctttctgttgctaccttcagcgacttcgatgaggccatccgtattgcaaacgacaccaactacggcctcggcgctggtgtctggagccgtgaccaaaacaccatttatcgtgcaggtcgcgcaatccaggctggtcgagtttgggtcaaccagtaccacaactacccagcgcactccgctttcggtggatacaaggagtccggcatcggccgtgagaaccacctcatgatgctgaaccactaccagcagaccaagaacctgttggtctcctacgatccaaacccaaccggactgttc

SEQ ID NO: 3073 - DNA, 438 bp, Corynebacterium glutamicum
atggcatccacaccgaaaaaatccaacgatgaaggtcagtttgaccgtgtcgattttcaaggggaagtcttcgttatctctgtcgcagccgagcttgccggcatgcatgcccaaactttgcgaacctacgatcgcatgggtttggtcaccccgatacgcactcgcggaggcggtcgccgttactcccgcgctgacgtggaattactccgagaaattcagcacctcagccaggaggaaggcgtaaacctcgccggaatcaaggcgatcatcgagctcggcgaagaaaaccgaaacctcaaagaatccctgcgtaaggtcacagctgagaatgagcagctcaaagatcaattacgcagcgggcgtccgcgtggcgagctggtgcacgtgccccgctccaccgcggtggtcatgtgggaacgccgcaaggggcgttccaag

SEQ ID NO: 3074 - DNA, 1185 bp, Corynebacterium glutamicum
gtgaacaacagcgaatgggcaaataagaactattacgcagacctgggggtctcctcgtccgcttcagaagatgagatcaaaaaggcttaccgcaagctcgccagggaaaatcacccagataaaaatccaggtgacaaggccgctgaagatcgattcaaaaaagcggccgaggcatatgacgtacttggtgatgacaagaaacgaaaagaatacgacgagctcaaagcacttctagcttctggtggaatccgcggaggattcggaagcggaggtgcgggattccccggcgggtttcgcacgtcgacgggaggattcgacacctcagacctcttcggaggaggacaaggtggagggttttctacggacggcggtttgggcgatatcttcggtggccttttcaaccgcggcgctggttctcaccagtcagctaggccgacgcggggggcggatgtacaaaccgaaataactctctcgtttgttgaggcagcgaaaggcacgaccatcccagtggaactcaccggcgatgcgccctgcaacacctgccacggatcgggctccaaatcaggccaccccgcaaaatgtggaacctgtgatggaaccggattcacctctgagaacaagggtgctttcggattctccgctccatgtgcaacctgtggtggcactggtgaaataatcactgatccttgcgataactgccacggccgaggcaccgtccggaagtctcgttccatcaccgtgcgtatcccaactggtgtggaagatggacagaaagttcgtcttgcaggccaaggcgaagcaggaccaaatggcaaaccagcgggcgatctctttgtgaaagtccacgtgaaaaaggacgatgtgttcacacgcgacggcagcaacattttgatcaccattcccgtgagcttcagcgagctggctttgggtggcgctatttctgtgccaacgctcaacaagcctgtaaaactcaagctacctgcgggaacgccagatggtcgtactttgcgtgtacgcggtcgcggtatcgaagcacgtgattccactggtgatctgctggttacagtccaggtttctgtcccgaagaatctggatgacaacgctgcggaagctctccgcgcatatgctgaagcagaaactaattcaggttttgatccccgcgctaactgggcgggccagaaccgc

SEQ ID NO: 3075 - DNA, 636 bp, Corynebacterium glutamicum
atgcccgacaatcctggggatcctgaaaataccgatccagaggcaacctctgctgatcgtgctgagcaggcagctgaagaagcagctgcccgccaagcggaggaatctccatttggacaggcctcagaggaagaaatttctccagagctcgaagcagagatcaatgatcttctatcagatgttgatccagatttggatggcgatggtgaagtgtccgctgtagaaacacagcttgccgaacgcactgaggatctgcagcgagtcaccgctgagtacgccaactaccgtcgacgtaccgagcgtgaacgccagggcatcatcgacaccgcacgcgcaggtgttgttacccaacttctgccgttgctcgacgatcttgacctggctgaacagcacggtgaccttaacgaaggtccgctgaagtcactgtctgacaagctgatcaacatcctgggtggattgaaggtggaatccttcggcgagatcggcgaagcattcgatccagagatccacgaagcagtacaggatctctcacagggtgatgtcaaggttctgggaacggtactccgcaagggataccgcctcggcgaccgcgtcatccgcaccgcaatggtcctcattggggatccagaggagagc

SEQ ID NO: 3076 - DNA, 1854 bp, Corynebacterium glutamicum
atgggacgtgcagtaggaattgaccttggaaccaccaactctgtggtttccgtacttgaaggcggcgagccagtagttatcgcaaacgcagaaggctcacgcaccaccccttccgtcgttgcattcgcaaagaacggtgaagttctagtcggccagtccgctaagaaccaggcggtcaccaacgttgaccgcaccattcgctccgtcaagcgccacatcggcaccgactggtccgttgctatcgatgacaagaactacacctcacaggaaatctcggctcgtaccctgatgaagctgaagcgcgacgctgaagcatacctgggcgaggacgtcactgatgctgttattaccgttcctgcatacttcgaggactcacagcgccaggcaaccaaggaagctggtcagatcgcaggccttaacgttctgcgtattgttaacgagccaaccgcggctgcacttgcatacggccttgagaagggcgagcaggagcagaccattctggtattcgacctcggtggcggcaccttcgacgtctccctcctagagatcggcgacggtgttgttgaggttcgcgcaacctccggcgataacgagctcggtggcgacgactgggatcagcgtatcgttgactggctggtagagaagttccagtcctccaacggcattgacctgaccaaggacaagatggccctgcagcgtctgcgtgaggcagctgagaaggcaaagatcgagctgtcctcttcccagagtgcaaacatcaaccttccttacatcaccgttgatgcagacaagaacccactgttcttggatgagaccctttcccgtgccgagttccagcgcatcacccaggacctcctggcccgcaccaagactcctttcaaccaggttgttaaggacgctggcgtgtccgtctcggagatcgaccacgttgttctcgtcggtggttccacccgtatgcctgctgttaccgaactggtcaaggaactgaccggtggacgtgagccaaacaagggtgttaacccagatgaggttgttgcagttggtgcagcacttcaggccggtgttctccgcggcgaggtcaaggatgttcttcttcttgacgtcaccccactgtccctcggcattgagaccaagggtggcgtgatgaccaagctcatcgagcgcaacaccaccatccctaccaagcgttccgagaccttcaccaccgcagaggacaaccagccttctgttcagatccaggtcttccagggcgagcgtgaaatcgcaaccgccaacaagctgctcggatccttcgagctcggcggcatcgcacctgcaccacgtggcgtcccacagatcgaggtcactttcgacatcgacgccaacggcatcgtccacgtcaccgcaaaggacaagggtactggcaaggaaaacaccatcaccattcaggacggctccggtctctcccaggatgaaattgatcgcatgatcaaggatgctgaagctcacgctgatgaggacaagaagcgccgcgaggagcaggaagtccgcaacaacgctgagtccctggtttaccagacccgcaagttcgttgaagagaactccgagaaggtctccgaagacctcaaggcaaaggtcgaagaggcagccaagggcgttgaagaagcactcaagggcgaggacctcgaggcaatcaaggctgcagttgagaagctgaacaccgagtcccaggaaatgggtaaggctatctacgaggctgacgctgctgctggtgcaacccaggctgacgcaggtgcagaaggcgctgcagatgacaatgttgttgacgctgaagttgtcgaagacgacgcagctgacaatggtgaggacaagaag

SEQ ID NO: 3077 - DNA, 1332 bp, Corynebacterium glutamicum
ttgcctgacaccgtcttagacgcgattgaaggcaattttgagccaccgctaaatacccagaagtcggcggttccccctaatgccgaagcaactgtcgaggctgattctgaaggaactaccgaccgctctgtcattttgggcagggacggccgctggctgtccggatgggcattgcgcttcatcgtgctggttatcgccggcgtcattgcacttcgtatgctgggcttcatctgggttggcatcctcccagtcgtcctcgcacttctagtctgcaccgtgctatggccaccagtgaaatggctgcgcgagcataagattcccgcggcgctcgccgttgtcatcacaattttgggtttcttcgccctcatcggcggagtttttgcagccatcgcgccaagcgtgtcttcccagacaaagcaagtggtagaccaagcaactgttggtatcgaagatctaatggattgggttcagggcccaccttttaacttagatatctcacagtttgaaggcgcgctcaatgacctaacatccatgctgcaatcacagtcttccaccattgcttctggtgtgttctctggactgtcaacggcatcatccatcgttgtcacactagcagtgatgctggtgttgaccttcttcttcctcaaagacggtcctcgtttcctgccatggatgcgcggcttcactggtgaaaacgcaggttggcacctcacagaagtcctgacccgtacctggaataccttggccggattcatccgtgctcaggcattggtgtccatggttgacgcaatattcattggtatcggattgctgcttcttggcgtcccaatggccctcgcgctcgcggtcatcacattcttcgcgggcttcatccccatcgtcggtgcggtgtctgcaggcgccctggctgtcatcatcgcgctagttaccaacggcgtgaccaatgcgcttttggtacttgtattgatcctggcggttcagcagatcgagggcaatatcttgtccccattcctgcagtccaaggctatgaacctgcacgcagcggttgttttgctatccgtcaccgtcggctccaccatgttcggcatcatcggcgcattcttggctgttccagtagccgcgacgttggctgtctgggtgcgctaccactctgaaatggttgctttgcgcgccggtgagatcaccagtgatgacattgagatcgccacgacgaaaggttccccaaccagcctcaatggccaagaaacccttgctgccattcgaagcagattcgccatccttggccgcaagaagccgacatctgccactgcagaaaaagcagactcagaaagc

SEQ ID NO: 3078 - DNA, 633 bp, Corynebacterium glutamicum
gtgaagttgtttcagagttgttttttattaaacaactcagcctgtaacctcttggtcgttctatgcttggtcaccatgactgagactctttttgtatccgccacaactgaggaagcggtgtatcttccagatggaatcgacttgctggtgactggcatcggaacgaccgcagcaacgatgattttgactaaggagttggctactcgggaggtgcttcctgcccgaattgtcaatattggtacggcgggagctttggtggatggattggctggcgtatacgagatcgaatacgttctgcagcatgatttcagtagcgagttaatcgctgaaatgacaggaaagccatgctcaaatggttcaactttggccacgagtgggcacttcccagtagcgagtttggcaacaggaaactcatttattgcagattcagaaacccgcaaccacctggccacccgggcctccctctgcgatatggagggcgcggcgctggtgggcgtcgcaaagcattttggtgttccgattacgctgctgaagcaggttagtgacagcgcggatgaggaggcttcggggtcgtggtttgatgcggtcgatgcgggcgcacgacagttggcggaggctgtgaaggagtttaaa

SEQ ID NO: 3079 - DNA, 1200 bp, Corynebacterium glutamicum
atgtcggctccaccatcgtggtcagctacaccgaaaaaccaaacgcccagggcgcaattcagggcaattccagtttctctaggatcgagaaataacatgccattgtttatcgacgacgccctccaccgcagcaaaaaatacttccacgcgcacttaagcgagctgctcctcggcgaatttgcaggcctcagcctgcccctgcacccaccgacggcagctaaagccgccgccgatattgatgccacgagggaatttatccgccaatgggaggggcgtgatgatgtggaatatgccattcgaaactggtctcctgtgggcttaggtaaaactgaagtacccgttaggctgacgttgaacacgactgaggaattagttgtgtttgcgcaggtagaggatgaatggtcttcacttcacgagaggttttcacagctgtctggttttacagcggaggtggtggcgaaacatgtgtcgctgtggcgttcgctgtctaacgatgatctctctaaggcagtgttagttgtggattggtttttgaaacaccctaactctggcctgctgaaacgcgccgtcgcagttgaaggcgtgcataccaaatggctcgaaaaccaccgcgtactcattgaaacgttagtggccgacaaacgtggtgaacctggtcgtgccgatcttggacttggtgacgccgaagctcgcgtccggctccgcttccattccgtagatgctcccgctgggctcacagacattgaagtaccgctttccaacctgtgtgaattacaagaaccgcaagtaattctgatggtggaaaacctcgattcatttctcgctttacccacttggccgggcgtaacaattgcttggggtgcgggctaccgtgcagtagacattgttcgaggaccctacttttctaatggtcggttgctgtactggggtgaccttgacctggacggtttcaaaattctcgacggcgtccgcagccatgttcctcacaccgaatccgtgctgatgaactctgaaaccgtctcccgctggcgctaccttggcgttgccgaccgagaattcaaggcagagagctttgacaaccttcatgattttgaatctgacgcacttgacctactcattacagacggtgagctccgcattgaacaagaacgcatccgcctcgatgttgctgttgaagaaatcgagaaagtaattcgtggg

SEQ ID NO: 3080 - DNA, 885 bp, Corynebacterium glutamicum
atgtttggcatttacccaatcccgaacccgtggcaacaacccatgaggaaccaacatttccgcagcaaaaccacccaaaatgcgctgcacaacgggttcccattccgcattattcggatcaatcagctcaccggcaaagggcatatcccgcgggctcacgcccaaatcctgacacaaattttcccgcacctgcagcaaacggtactcaatattactgctgcctttactcaaagaagacagctcttgatccgccgctttgaactcatcaaccgcacgggttcggtcctctacattcctctgacctgcagattcaagcgcttccctcgccgccggatactcatccacggtcagccgcgcagcgttgttgagctccaaaagctcctccgccgattccggcgccgcaccgcccagccccttaaccaatgcgtccagaccagcgcgcgcagtgctaattgttcttcgcttatcgacggccccctccctcttcgcactcaaaattccatgctgcgctcccacaatttgtttgacgttgtcgtgcgcgagggtttccatttcgcgggcacgatctgtctcaattttggcggactccaccttcgacttcgcctgcgtttgctcgacagtaaattgtcgaaccagcgtttcttgctcttccttcttaatgcgattcccgacagtcggcagcgccttcttcagtgcattggcatgatctttggactgttgcgctttctctcgccgattcttcagctgcaccaaaggatccagggtgtggatctgccgtttaatatcttcgacctgctcataagcaccttcaaggtcttggaattgttccacggcagttttggcaatgctgaacgtatccggttccaccagcatgtaatcccgaaa

SEQ ID NO: 3081 - DNA, 3333 bp, Corynebacterium glutamicum
gtgaccagcgaacaagctttagatcctatccacccaggtcagttccgtctttctcggattcagttgatcaactggggaaccttccacggaacggtggacattcctgtgaccagggaaggaatcttagttaccggtggttcgggatcaggaaaatccacgctgattgatgcgatcacggcggtattgcttccgcaaggaaagctgaggtttaactctgccgcacaggctaatactccgcggaataagggacgcagtttggttacctatatccgtggcgcttggcgtgcgcaggaggatccgctgcaggatcagattgtctccacgtacctacgtccccgcgcaacctattcgctggttggattgacttattccaacggtgaaggcgtcgagcacaccttggtggctattttctatctgaaatcgggacacaatttaacctccgatatttcttcatattatggtgtgtttcccgttgatcaagacatcaatgcgctgctggatttcctgaaagagggcatcgataaacgccagatcagagctgctttcaaggaagccatctttagcgagcagcattctgtattctccggcaggtttagaagccgtttggggatctccagtgaggaagctttgctgttgttgcaccgcgcgcagtcggcgaaagatcttcaaagcttggatgatctatttcgggattacatgctggtggaaccggatacgttcagcattgccaaaactgccgtggaacaattccaagaccttgaaggtgcttatgagcaggtcgaagatattaaacggcagatccacaccctggatcctttggtgcagctgaagaatcggcgagagaaagcgcaacagtccaaagatcatgccaatgcactgaagaaggcgctgccgactgtcgggaatcgcattaagaaggaagagcaagaaacgctggttcgacaatttactgtcgagcaaacgcaggcgaagtcgaaggtggagtccgccaaaattgagacagatcgtgcccgcgaaatggaaaccctcgcgcacgacaacgtcaaacaaattgtgggagcgcagcatggaattttgagtgcgaagagggagggggccgtcgataagcgaagaacaattagcactgcgcgcgctggtctggacgcattggttaaggggctgggcggtgcggcgccggaatcggcggaggagcttttggagctcaacaacgctgcgcggctgaccgtggatgagtatccggcggcgagggaagcgcttgaatctgcaggtcagaggaatgtagaggaccgaacccgtgcggttgatgagttcaaagcggcggatcaagagctgtcttctttgagtaaaggcagcagtaatattgagtaccgtttgctgcaggtgcgggaaaatttgtgtcaggatttgggcgtgagcccgcgggatatgccctttgccggtgagctgattgatccgaataatgcggaatgggaacccgttgtgcagcgcattttgggtggttttgctgcggaaatgttggttcctcatgggttgttgccacgggttcgggattgggtaaatgccaaacatttggcagcgctgctgaaattcaacggcgtggtgacaacgggggagtacaaaacctcgcgttttccggcggattccctgatccgaaaagttgatgttgtggagtcgccgtttcgcgattgggtaaatcaagaattaggcaagcgttttaatattcggtgcgtgcgcactcctgaggaattgtcggcgctggggccacgcgatcagggcgtgaccattttgggtgtgcgaaaatttgcgcagcagacaggcgatccgacgacgcgttgggaaaaagatgatcgccgaaagctgggggatcgttccacataccgtttgggttccaccaatgatgccaaggtggaaacgcttcgggaaaccgtgaaagctggcaaagcagttgtgcaggcagctgataatcgcattgctgcaaaccgcgctgagctgcgggaacttgaacggcagtatcaagcttcgcaagaaattttgaaagtgtcgtgggctcagattgatgtggaatcagccgacgcggcgattgctgagctggaccgattgctggaagagctgaacaacactccagaggccaccgagctttccgcgcggcatgaggcggcgaagcagacgctcgcgagggtttctgacttgcttgtcgcagctcagagtgaggaaaccgtggcgtcgatgaacctgaaacgcgccgaaactgaattgaaacggctcgaaagcctgccggttgcggaggtttctgaagaaatcgcgcgggaagtggagaaactatttcttgccaacacccgccgggttcacgccgccaacgtggatgagcagaccattgcgctgcgcgaggatctggacaaacaaatcgatgccaatgaggcagaacttcgacgttgtgaaaaccaaattgttggcattttgcgcagctatattgaaacgtggcctgcgaaccgcgctgacttacaagccgaacctgagtttgttggtgaggccatcaaccgcctcggcgagcttcgcagcgatcgtttggcagaattcacggccaaattcctagggctcatgaacgagatgtccacccgaaacctcggccaaatctcgcggcgtctacgtgatgcgcgccgggaaatcgaggagcgcatcgagccgatcaacgcctccttggcgcagtcggaattcaacgaaggtcgcttcctgcacatcgacatccgtgatcaaagtggtccgattgtgagggaattccagcagaaacttgatgccgctaccagcggtgacctgggaaccagtaccgagaaacaagccttcgcccgttatgcgctgatcgctgaaatcatttccaaactcgcctcccacgactccgccgacgcccgctggcgcaacaccgttctagacacccgccgccacgttcgcttcatcggcctcgagcgcgattccgacggcgcaaccgtcaacacctacgtcgactccgcatcactttcaggcggacaagcccagaagctggtgtttttctgcctcgccgctgccttgcgctaccagctagccgaacccggcgcccattatcccacctacgccaccgtcattctggacgaagccttcgaccgcgccgaccccgccttcacccgccaaaccatgaacgtcttccacagcttcggcttccacatggtgctcgcgaccccgctgaaacttatccaaaccctcggcgattatgtcggctccaccatcgtggtcagctacaccgaaaaaccaaacgcccagggcgcaattcagggcaattccagtttctctaggatcgagaaa

SEQ ID NO: 3082 - DNA, 636 bp, Corynebacterium glutamicum
atgaatgatcagctgtgggaaggcgacactggaacgctgacttttgggtccaggaaagctctggtgcaattactcaaaggtcccatggtgaatgctttgcagcatgttgaagtgtggcgggctatcaccacagatcaagatgcgctcaatgctgtgcttaacaatttgttcctcgagttggttcttgatgaggatgcgggtgttgcatttactcggcctgccaatggtagacaagaagtattggttggaaataacaaaactgaagcgatgcccaaagtgctgcgcacggagacgctgtcgcattttgatacgttgatcattttgattctgcgccaagaactcaccatggcgccaccgggggaacgagtcattgtggatcgtgaagaaatccgcgaacaagtgttgctctaccgcgttgatgaagagcgagatgaagccaaactagctaagcgattcgacgctgcatttaggcgcatcgtggattattcattagctaaaaagacagagacacctgaacgttttgaggtctcaccagcactgcgccagatttttgatgccgacactgtggcaggtgtgcgcgctgagtacgaaaaatttaacaaagcagcccatgatggaaatgaagaggaacagaag

SEQ ID NO: 3083 - DNA, 1485 bp, Corynebacterium glutamicum
atgaccgttgtatcgcacgcgcttgggtttaagcgatttaggcaggaatccctggagctgtctttgttgcgcagtgacaactttccggtggtgctcgccgtggtagcgcagtattttccgcagggggctatcgctaagccggcctcagagctgtatcagctgctcagcgatgattttcgggtgctgcgtgaagaaggatttgagctgccgaaaagcccgtcggattatgtgagtgattgggtgaagtcccggtggtttgtgcgtcgtccgggtagttcgcagactggtgagaccgtggaaccgagtgaagagctgttggcggtgctggattcggtgcagcggtgggataacccgcatcgaagcatttcggcgtctcgaattgaatcgttgacgcaggcgttgcagactttggcgttggaatcggaccccagcacagcgaaacgtttagctgagttagagcgtgaacgcgacaggattgaacgccagattgaagcggtccacgctggtgaatttgaagtcctcaccaccgtgcagattggtgatcgggtagcagatattttggatctagcagcatctattcctgcagatttcgccagggtaaggcatgagctgagcgatctgaaccggaagctgcgcaggcagttgcttgatcctgaagattcccgtggtgatgttttggaagagatcttcaggggagttgatctgattggggattccgatgcggggcgcagcttcaatagtttctttgatgttttgctcgatcgggaacgctcaagtctgattgatcgatggatcagagaagttctgggacgcgatgaggctattgatctggattcaaaattaaggacagggctgtaccgaattttccgggatatggaggatgccagcttcgaggtcaacggggaaatgacagggctggctcgaagtttgcgtcactatgtcactaccgaggagttcgcagagagccgacgcatgattcagttgcttcgcgatacccgcagtgccgctgctaaggccgccgaggctggtgaagtgacctcactcaatcacatggacacaccactcgtgcgcattggtatggatgttcgctcgattgcggggttgaaactgaagaacccaggtgaagaacgcgtcgaagatttgcctgagccagttgaagaacaagaactagacactgaagtcttgatggaacaaattcgggcaagcgagattgattttgaggaattggaagaggctgtttctttagttcttgccgagcaatcgcacgccacgatcaccgaggtactagaacatttcccggcaacgcaaggtctcgccagcattgttggattgttatacctggcgatgcgtgatggtgttcccacaggtcgcgcgcaaatagtggagtgggaaagtgatgatgccacacaccgccggcggattacaggatggcagttcatcaggggtttaaacagtgaagatttggcagaaagcgagatggataaa

SEQ ID NO: 3084 - DNA, 1035 bp, Corynebacterium glutamicum
atgaccactgctgcaccccaagaatttaccgctgctgttgttgaaaaattcggtcatgacgtgaccgtgaaggatattgaccttccaaagccagggccacaccaggcattggtgaaggtactcacctccggcatctgccacaccgacctccacgccttggagggcgattggccagtaaagccggaaccaccattcgtaccaggacacgaaggtgtaggtgaagttgttgagctcggaccaggtgaacacgatgtgaaggtcggcgatattgtcggcaatgcgtggctctggtcagcgtgtggcacctgcgaatactgcatcaccggcagggaaactcagtgcaacgaagctgagtatggtggctacacccaaaatggatccttcggccagtacatgctggtggatacccgttacgccgctcgcatcccagacggcgtggactacctcgaagcagcaccaattctgtgtgcaggcgtgactgtctacaaggcactcaaagtctctgaaacccgcccgggccaattcatggtgatctccggtgtcggcggacttggccacatcgcagtccaatacgcagcggcgatgggcatgcgtgtcattgcggtagatattgccgatgacaagctggaacttgcccgtaagcacggtgcggaatttaccgtgaatgcgcgtaatgaagattcaggcgaagctgtacagaagtacaccaacggtggcgcacacggcgtgcttgtgactgcagttcacgaggcagcattcggccaggcactggatatggctcgacgtgcaggaacaattgtgttcaacggtctgccaccgggagagttcccagcatccgtgttcaacatcgtattcaagggcctgaccatccgtggatccctcgtgggaacccgccaagacttggccgaagcgctcgatttctttgcacgcggactaatcaagccaaccgtgagtgagtgctccctcgatgaggtcaatggtgtgcttgaccgcatgcgaaacggcaagatcgatggtcgtgtggcgattcgtttc

SEQ ID NO: 3085 - DNA, 216 bp, Corynebacterium glutamicum
atgcccccagccacccattccccaccaccccagcgggcaattaaggcacgcgcgccgtacctactagatagactcgacaaacatgcagtacacaacaacattccaaggatcgttttagtgtcgattttcaaatggaatgaatatatgctgccggtgcttaaggcactgccccaagatcagattatggtccgtcgggatttgattgagctcgtcgcc

SEQ ID NO: 3086 - DNA, 207 bp, Corynebacterium glutamicum
ttgctcggtcggcgtcagctcggcttcttgcttgtcgacggaccgttcttcattattcagctttctttgagcaacaccgcttggatactttattccatgatcttgggcgaacttggcaaggtcactttgcgaaatttcatccgggtgctgagcttggagttttttgcccagattattgatcgcgtagtgagcacgttgcggacggtt

SEQ ID NO: 3087 - DNA, 189 bp, Corynebacterium glutamicum
atggaaaccggccttgtgcggctgtgctctaggatttcagccgatttgttggagcgattgcacaacaacgctccggtgttatttgagctggggttgcccgcaagtggtggacacataattaagctacttgttagtttcctacaggtgaaacagggcgatcatgatcctgctcaaactgaacaggagaga

SEQ ID NO: 3088 - DNA, 261 bp, Corynebacterium glutamicum
gtggatctttcatgggaaaggggaaagtggggctggctgagtccatgtgtggtgcgtgatggttgttcacggcgtgtgttgggatgggcatggatgatactcaaacgacacggcttgttgggcgtgcgttgcggatggcgcatacgttgcggtgtggtgtgcctgatggtgtggtttttcgcagttcacatcggatcagttgtatcgggcgtgtcaggaattggggatcgctcagtcgatgggccggactggggtgtgttt

SEQ ID NO: 3089 - DNA, 927 bp, Corynebacterium glutamicum
atgcagacattaatctttatcgccattgcaggcgtcgcagcacagcttgttgatggcggcctcggcatggggttcggcgtcacctcaaccaccatcctcatcatgctcgcaggtttaggccctgcgcaggcatccgccgtcgtgcacaccgcagaggttggaaccaccttagtttctggtttaagccactggaaatttggcaacgtggattggaaagtagttgtccggctcggtatccccggcgctatcggcgcatttgctggcgctaccttcttgtccaatatttccaccgaagcagcagcaccgatcacctccctgattcttgccctgatcggcatgaacctagtctggcgattcagcaagggacgcatccgccgcgactattccgatcgcccgcacagcaggggattcctcggcggactcggtattgtcggtggtttcgttgacgcatccggtggcggcggatggggtccagtgaccacctctacgctgctgtctttgggacgcaccgaaccccgcaaagtagtcggcaccgtcaacaccgcagaattcttagtctccctagccgcaacattgggcttcgtcgtgggactgtgggatgacctagtagctaacctctctgcagttctcgcgttgctcatcggcggcgcaatcgcagcaccaatcggcgcctggatgatctctcgcgttaatgcaaccgtcctcggtggcttcgtgggcaccctgattgtcacactgaacctgccaaaggtgctcaacgtggttggccttgatttcatccccaccggcctcatccaggtcaccgtcctcctcatcggcctgccgctgacgtacctcggcttccgccgctaccgcaaaaatctcctcaacgagaccatctccagcgaagttgtctccgaaccaaagggccaaaagattaaaagcact

SEQ ID NO: 3090 - DNA, 723 bp, Corynebacterium glutamicum
atgattcccctgattacgctttcccacggttcccgcaaaaagtccgcagctgcaggcattactgcgctgactcatgaggccggacgaatgctggaaacaccagccgtggaagcgcatttagagcttgctgaaccttcccttgatcaggttgtggcaacgctcagtgcggaaggtgtaaccagggcagcgttggttcctttgctgtttagcaatgcgtatcacgcaaagattgacgttcctgaggcagtaaaagatgcttcagaaaagtatggtgtggaacttctcgtgggtccgcatttgggcactggctccgatgtagccagcgtgcttgcgcagcggttgagtgcggacgcccccacagatgcccatgtgattttgtattccgttggcagctcacacgtgtccgccaatgaatcagtcatcgatcttgcccacaccattgctctcctcactggcttttcggttgaggtggtgcccgctaccggtgggccaggtgccggcggcgccggagtaatagaggtggcctcgaaacacaaggccgtccacatcctgccgctgtttgttacggaaggtttgctgctggatcgggctattgatcaatccgccaacatcgcagctgccaccggcacaaacttcacctattccgaacccctaactactgacctcgcaccacttgttgcagcccgttaccacgctgcattgagcgcactgctggcacatatc

SEQ ID NO: 3091 - DNA, 915 bp, Corynebacterium glutamicum
atgctttattcaaggttggagcagtcatcagaagtagccttccttcttgcggtcttccattgcggattcgctgaggcggtcatcggcgcgggttgcgccacgttcggtaagggtggaggtggcgatctcttcgatcacatcgtcaatggtgcgggcttcggagagcacagcaccggtgcaggacatatcgccgacggtgcggtagcggacagtcttggtgacgatctcctcgcccttctttggtccaccccactcgcctgcggtcagccacatgccgtcgcgctcgaaaacttcgcggtcgtgggagaagtagatcggtggaagttcgatgccacgggcgccgatgtactcccaaatgtcagcttcagtccagttggagattgggaaaacacggatgttttcgcctggcaggtggccaccgttgtagagggtccacagctctgggcgctgacggcgtggatcccaaccaccgaaggagtcacgcacagagaacacacgctccttggcgcgggcacgctcctcatcgcggcgagcgccaccaagcactgcgtcgtagccctgctcagcgatggtctccaccaaagggacagtctgcagtgggttgcgggtgccgtctgggcgttcctgcaggtcaccgcgatcgatccagtcctggactttagctacgcgcaggcgggcgccggtgcgctccaccaggttgtcgcggaattccaaaacctctgggaagttgtggccggtgtccacgtgcagcaattcaaaaggcacgttagctggagcgaaagcgcggcgcgcaagctcgtacaccacgacggaatccttaccgccggaaaacagcaggccgaccttatcaaactggccagctacctcgcggaggatgtggatggattcattttcaagatctttaaggtgtgggga

SEQ ID NO: 3092 - DNA, 1299 bp, Corynebacterium glutamicum
atgactgctccaaccttgaataaagcatccgaaaagattgcatcacgcgagacccttcgtctgtgcaccgcaggttccgtagatgatggcaagtccaccttcgtcggccgcctcctgcacgacaccaagtctgttcttgctgatcagctggcttccgtagagcgcacctccgccgaccgtggcttcgaaggcctcgacctgtcactcctcgtcgacggcctgcgcgccgagcgtgagcagggcatcaccatcgacgttgcctaccgctacttcgccaccgacaagcgcaccttcatcctggctgataccccaggtcacgtgcagtacacccgcaacaccgtcaccggcgtctccacctcccaggttgtagttttgcttgtcgacgcccgccacggcgtcgtcgagcagacccgccgccacctgtccgtatcggctctgctgggcgtacgcacggtgatcctcgcagtcaacaaaattgaccttgttgattacagcgaagaagtcttccgcaacattgaaaaggaattcgttggcctggcatctgcacttgatgtcacagacacccacgttgttccaatctctgcgctcaagggcgacaacgttgcagaaccttccacccacatggattggtacaccggaccaaccgtgctggaaatcctggaaaacgtagaagtttcccacggccgtgcacacgacctgggcttccgcttcccaatccagtacgtcatccgcgagcacgccaccgactaccgtggctacgccggcaccatcaacgctggttccgtctccgtgggcgataccgtgtacctacctgaaggccgcaccacccaggtcacccacatcgattccgctgacggatccctccagaccgcatcagttggagaagccgttgtcctgcgcctagcccaggaaatcgacctcatccgcggcgaactcatcgctggcgaagaccgcccagaatccgttcgctccttcaacgccactgttgttggcttggccgatcgcaccatcaaaccaggtgcagcagtcaaggttcgctacggcaccgagctggtccgcggacgcgtcgcagccatcgaacgagtcctcgacatcgacggcgtcaacgacaacgaagcaccagaaacctacggcctcaacgacatcgcacacgtgcgcatcgacgttgcaggcgaactcgaagttgaagattacgctgcccgcggcgccatcggatccttcctcctcatcgaccaatcctccggcgataccctcgcagctggcttggttggccaccgcctacgcaataactggtcgatc

SEQ ID NO: 3093 - DNA, 912 bp, Corynebacterium glutamicum
atgaccacaaccgttgcatcagtactatccccacaccttaaagatcttgaaaatgaatccatccacatcctccgcgaggtagctggccagtttgataaggtcggcctgctgttttccggcggtaaggattccgtcgtggtgtacgagcttgcgcgccgcgctttcgctccagctaacgtgccttttgaattgctgcacgtggacaccggccacaacttcccagaggttttggaattccgcgacaacctggtggagcgcaccggcgcccgcctgcgcgtagctaaagtccaggactggatcgatcgcggtgacctgcaggaacgcccagacggcacccgcaacccactgcagactgtccctttggtggagaccatcgctgagcagggctacgacgcagtgcttggtggcgctcgccgcgatgaggagcgtgcccgcgccaaggagcgtgtgttctctgtgcgtgactccttcggtggttgggatccacgccgtcagcgcccagagctgtggaccctctacaacggtggccacctgccaggcgaaaacatccgtgttttcccaatctccaactggactgaagctgacatttgggagtacatcggcgcccgtggcatcgaacttccaccgatctacttctcccacgaccgcgaagttttcgagcgcgacggcatgtggctgaccgcaggcgagtggggtggaccaaagaagggcgaggagatcgtcaccaagactgtccgctaccgcaccgtcggcgatatgtcctgcaccggtgctgtgctctccgaagcccgcaccattgacgatgtgatcgaagagatcgccacctccacccttaccgaacgtggcgcaacccgcgccgatgaccgcctcagcgaatccgcaatggaagaccgcaagaaggaaggctacttc

SEQ ID NO: 3094 - DNA, 693 bp, Corynebacterium glutamicum
ttgtcaccagaggtagcaaaacataacgaggaactcgtcgaaaagcatgctgctgcgttgtatgacgccagcgcgcaagagatcctggaatggacagccgagcacgcgccgggcgctattgcagtgaccttgagcatggaaaacaccgtgctggcggagctggctgcgcggcacctgccggaagctgatttcctctttttggacaccggttaccacttcaaggagacccttgaagttgcccgtcaggtagatgagcgctattcccagaagcttgtcaccgcgctgccgatcctcaagcgcacggagcaggattccatttatggtctcaacctgtaccgcagcaacccagcggcgtgctgccgaatgcgcaaagttgaaccgctggcggcgtcgttaagcccatacgctggctggatcaccggcctgcgccgcgctgatggcccaacccgtgctcaagcccctgcgctgagcttggatgccaccggcaggctcaagatttctccaattatcacctggtcattggaggaaaccaacgagttcattgcggacaacaacctcatcgatcacccacttacccatcagggttatccatcaattggatgcgaaacctgcacccttcctgttgctgaaggacaagaccctagggccggccgttgggctggaaacgccaagacagaatgcggacttcactca

SEQ ID NO: 3095 - DNA, 1683 bp, Corynebacterium glutamicum
atgacaacaaccaccggaagtgcccggccagcacgtgccgccaggaagcctaagcccgaaggccaatggaaaatcgacggcaccgagccgcttaaccatgccgaggaaattaagcaagaagaacccgcttttgctgtcaagcagcgggtcattgatatttactccaagcagggtttttcttccattgcaccggatgacattgccccacgctttaagtggttgggcatttacacccagcgtaagcaggatctgggcggtgaactgaccggtcagcttcctgatgatgagctgcaggatgagtacttcatgatgcgtgtgcgttttgatggcggactggcttcccctgagcgcctgcgtgccgtgggtgaaatttctagggattatgctcgttccaccgcggacttcaccgaccgccagaacattcagctgcactggattcgtattgaagatgtgcctgcgatctgggagaagctagaaaccgtcggactgtccaccatgcttggttgcggtgacgttccacgtgttatcttgggctccccagtttctggcgtagctgctgaagagctgatcgatgccaccccggctatcgatgcgattcgtgagcgctacctagacaaggaagagttccacaaccttcctcgtaagtttaagactgctatcactggcaaccagcgccaggatgttacccacgaaatccaggacgtttccttcgttccttcgattcacccagaattcggcccaggatttgagtgctttgtgggcggtggcctgtccaccaacccaatgcttgctcagccacttggttcttggattccacttgatgaggttccagaagtgtgggctggcgtcgccggaattttccgcgactacggcttccgacgcctgcgtaaccgtgctcgcctcaagttcttggtggcacagtggggtattgagaagttccgtgaagttcttgagaccgaatacctcgagcgcaagctgatcgatggcccagttgttaccaccaaccctggctaccgtgaccacattggcattcacccacaaaaggacggcaagttctacctcggtgtgaagccaaccgttggacacaccaccggtgagcagctcattgccattgctgatgttgcagaaaagcacggcatcaccaggattcgtaccacggcggaaaaggaactgctcttcctcgatattgagagaaagaaccttactaccgttgcacgcgacctggatgaaatcggactgtactcttcaccttccgagttccgccgcggcatcatttcctgcaccggcttggagttctgcaagcttgcgcacgcaaccaccaagtcacgagcaattgagcttgtcgacgaactggaagagcgcctcggcgatttggatgttcccatcaagattgcactgaacggttgccctaactcttgtgcacgcacccaggtttccgacatcggattcaagggacagaccgtcactgatgctgacggcaaccgcgttgaaggtttccaggttcacctgggcggttccatgaacttggatccaaacttcggacgcaagctcaagggccacaaggttattgccgatgaagtgggagagtacgtcactcgcgttgttacccacttcaaggaacagcgccacgaggacgagcacttccgcgattgggtccagcgggccgctgaggaagatttggtg

SEQ ID NO: 3096 - DNA, 1371 bp, Corynebacterium glutamicum
atgacaactcccctgcgcgtagccgtcatcggagctggccctgctggcatttacgcatccgacctcctcatccgcaatgaagagcgcgaagtgttcgttgaccttttcgagcaaatgcctgcaccgttcggactcatccgttacggcgttgctccagaccacccacgcatcaagggcatcgttaagtccctgcacaacgtgttggacaagccacgcctgcgcctgctcggtaacattgaaatcggcaaagacatcaccgtcgaagaactccgcgactactacgatgcagtcgtgttctccaccggcgcagttgcagaccgcgacctcaacatccccggaattgaagcagaaggctccttcggtgccggcgagttcgttggcttctacgacggcaacccacgcttcgagcgctcctgggatctgtctgcacagtccgtcgctgttatcggcgttggtaacgtcggcctcgacgtagcccgcatcctggctaagacaggcgacgagctcaaagtcaccgaaatttccgacaacgtctacgactccctcaaagaaaacaaggccactgaagtgcacgttttcggacgtcgtggcccagcacaggtcaagttcaccccacaggaactcaaagaactcgaccactcccccaccatcaacgtggttgttgatccagaagacatcgactacgacggcgcctctgaagaagcccgccgcgcatccaagtcccaggacctggtctgccagatcctggaacagtacgcaatccgcgagccaaaggacgctccgcacaccctgcagatccacctctttgaaaacccagttgaggttcttcaaaaggacggcaaggttgttggcctgcgcaccgaacgcacctcacttgatggcaacggcggcgtaaacggaaccggcgaattcaaggactggccagtccaggctgtctaccgcgcagtcggctacaagtccgaccccatcgacggcgtcccattcgatgagaacaagcacgtcatccctaatgacggcggacatgtcctcaccgctccaggcgcagaaccagtaccaggcctctatgcaaccggctggatcaagcgtggaccaatcggtctaatcggcaacaccaagtccgacgccaaggaaaccaccgacatcctcatcaaggatgccgtcgccggtgtacttgaagctccaaagcaccagggcgaagaagccatcatcgagcttctcgattcccgcaacatcccattcaccacctgggaaggctggtacaaactcgacgcagcagagcgcgcactcggtgaagccgaaggccgcgagcgcaagaagattgttgattgggaagaaatggtccgccaggcccgcgaagctccagcaattgtc

SEQ ID NO: 3097 - DNA, 1083 bp, Corynebacterium glutamicum
atgaaaggcaaacatgttaagcctgcgtttgacgatactctagaaggctttgagtatgttctcgatgcagtaactggtagaactccaatctctcagcaatggattagaaatttgcacgccgtcattctgcggagccaagaaagccacgaggtttttacagccgttggagtccaaaatcaggcgcttcagaaaggcgagtataaaactcagccaaatagtccacagcgctcagatggatctgtacatgcatacgccccagttgaagatactcctgctgaaatggctagatttatttcagaacttgaatctaaggaattcttagcagccgagaaggttattcaagctgcctatgcccactatgctttcgtatgtattcatccttttgcagatgggaatggacgagttgcacgagccttggctagtgtttttctatacaaagatcctggtgtccctctcgtaatctaccaagatcaacgcagagattacatccatgctctagaagcagcggacaagaataacccgctcctgctgattagattctttgctgaacgagtgaccgatactattaactctattatcgttgatctcactaccccgatcgcgggtaaatctggttcggctaagctttcggatgcgctacgccccactcgcgtattaccagaattacatgatgctgcacataggctccaagaaagtttatttacagaaatccgatctcgattggatgaagaaggaaaaaggaatgggttggagtttctacttcaacggatttttatcggttccccattcaatctgccagagggctataacgctttccctgatagctattgtctgaccttagctttcaatagcaactctccaaaacaaatcttccacccgctatccatagtaatagcagctcgagatgggaaaagagcgagcagcgacctcgtggcagctacttctattggatacaactttcacgcttacggacgtgaagtcgagcctgttgttactgaaagctttcgagaacgtgtgaaaatttacgccgacgggattgtagatcacttcttaaccgaactggctaaaaagtttcaacagaat

SEQ ID NO: 3098 - DNA, 237 bp, Corynebacterium glutamicum
ttgattttgagcattgaggaaaaggtggttgccatgaaagaagatcttcaacgaagggccgttgttaaggcgttcattatcttcttgcttggagttctcaccggaatgtacatcagcatcatgtatgccaatgcgctggttgcgcttggttttatgatcgccggattggtagtggcagtgctggtttatatggtgaatcggccgcgcaaggtggaaagcgaaagtccccgcctcgaa

SEQ ID NO: 3099 - DNA, 534 bp, Corynebacterium glutamicum
gtgagttccaaagcgatcctccagcgcaccataaaccgcaccccaaggaacagcttccaaaggcatggtcacggtgccgccctcagacaacttctcccagtagccacgaatttcctcttccagctcagcgccaccagtcagcgacaacggagtgtcctcgcccttcattcgttgcatcacgcgcggaatatcactggcaaaaagcaacttctgaccatcaacgaccagctcagcgtgcatgattttctcgccgtcaccaccaacttcctcctcagaatgcatggcggaaaacggcatcatctgaagctcgccaccaaaaactgtttggtagaactccattgcttctttggcatttccattgaactgacggtacggggtgagatcggctttcatcggattcctgccttccaagcgagagcattttctgtgacccacattacgctagaaagcatgcgtcaatctgcttccagacatgtcaccctcctcagcaccgccacccgaccaaaaaatttacgagatagcgcgcgatcttcc

SEQ ID NO: 3100 - DNA, 414 bp, Corynebacterium glutamicum
atgaaagccgatctcaccccgtaccgtcagttcaatggaaatgccaaagaagcaatggagttctaccaaacagtttttggtggcgagcttcagatgatgccgttttccgccatgcattctgaggaggaagttggtggtgacggcgagaaaatcatgcacgctgagctggtcgttgatggtcagaagttgctttttgccagtgatattccgcgcgtgatgcaacgaatgaagggcgaggacactccgttgtcgctgactggtggcgctgagctggaagaggaaattcgtggctactgggagaagttgtctgagggcggcaccgtgaccatgcctttggaagctgttccttggggtgcggtttatggtgcgctggaggatcgctttggaactcactggatgttcaacatcggtggc

SEQ ID NO: 3101 - DNA, 366 bp, Corynebacterium glutamicum
atgtcaccctcctcagcaccgccacccgaccaaaaaatttacgagatagcgcgcgatcttcctaggctgcccgcttgggcttcaggtttagcaagcgggacgctttcgcttatcgacgccaactccctccatttggaatcccccatgggcctagttcacaccgaattcaccccaataaacacctacggaatcctcgaccacgtagtcaccctccccgacggaactaaagtgctcaaccctttccgagtcatcccccacgacaccggctccgaactcattttcaccgtccgccccaacgaaaacttcgaagaagattgccaagcagtcgcagcagacctcgaaaggctggtcgcactggccgaaaaa

SEQ ID NO: 3102 - DNA, 522 bp, Corynebacterium glutamicum
atgttggcagcgttccgccagtacggaatccagcccggaccactactcttcgatcgcaaccctgaacttgtctgggcacttcttgccagcttcttcatcgcgatgatcgtcctgctgttcatcaacctgccgttcgcacagctgtgggcaaagctcctgctcattccaaaccactacctctactccggcatcgcattgttctgtggcctgggcatttacgccacctccggcgcagtgttcgacctgctcatgctgctcggcatcggtgtcgtggctttgatcatgcgtcgctacggttacccgctggcaccgctgatgatcggtatggttcttggacctttggctgaaacctccctccgcgacgcactactgtcctcggttggcgatttctccatcctcgtctccagccccatcacctggtccctctacgcagtgctcgccatcttcatcgcggtcagtgtcatcactgcaatccgcggtcgtcgcaagcacctgacttctcagctcgaaaccatcgacgct

SEQ ID NO: 3103 - DNA, 321 bp, Corynebacterium glutamicum
gtgaagcgctcgatgccggtgaccgaatcgatgccgatggtcgcaatgccgaggccgaaaatgagggacgcaagtcccttaaacacggagtcggacaccacggaggaggtggcgacgaacgcgaagagtgccagtgcgaagtactcggcggggccgaatgcggtggacagttccgccagggttggtgcgaggaagaccacgatgaaggaggagacgataccgccgatgaaggcaccgatcgctgcggtagccagagcctgtggcgcacggccgttaagagccatgcggtggccctcgaatgttgaggcgattgccgatgcc

SEQ ID NO: 3104 - DNA, 486 bp, Corynebacterium glutamicum
gtgcgccacaggctctggctaccgcagcgatcggtgccttcatcggcggtatcgtctcctccttcatcgtggtcttcctcgcaccaaccctggcggaactgtccaccgcattcggccccgccgagtacttcgcactggcactcttcgcgttcgtcgccacctcctccgtggtgtccgactccgtgtttaagggacttgcgtccctcattttcggcctcggcattgcgaccatcggcatcgattcggtcaccggcatcgagcgcttcacgctcggggcaccgcagcttttcgacggaatttccctcgttactgttaccgtcgcgattttggcactgggagaagtgttttacattgcagcccgcgcacgccgtgacaaagcaaatctggagacgcgctctgcaggccgtccgtggcttaccggaacggaattcaaagaagccgctccagcctgggcacgcggaaccatcattggtctgcctttcggtg

SEQ ID NO: 3105 - DNA, 285 bp, Corynebacterium glutamicum
gtgttcatcaaaattgccatcgtggagtcaccgaagagaccaccgaaatatacgccagagaacataatgaacgcggcagttggatcaagcgcgaaggtcattggcagcagcagcgccacagccatggaggatccaagaccaggcatgacgccaaccgcggtgccgagcaaacagccgacaatcacccagaggaggttcatcggcgttagcgcgccggcgaaaccttccatcaagagggacaaaatatccattaaaagccaccacccaaaagtccggaaggaagat

SEQ ID NO: 3106 - DNA, 564 bp, Corynebacterium glutamicum
gtgaacgtcactgaacaatccggcgagtcccatatcgacatcccggaatcacaccagctgcccggacctcgtccagttggcgagggcactttctgggaaggccgctccgggctcatcatgcccgcaattcttacggcatttagtttgtatttgctcatcggtgttttaaacatggatgtgggcaatgcagcattcccaggacctcgattcttcccaacaatcctcggcatcgcgggtttgttggtggcagtggcattgaccattcaaaccatcaagtaccccatgcatccagaaaatgaatctggccgaagctggaaattccactctgattacgtctcactcgcgtgggcgatcggtggcttcttcgcctttgcagtcttgcttccatatcttggctgggtccttgctggctccttgttgttctggacaatgaccagggctttcggttccaaacgcccaggtttcgatgttcttgtttccctcatgatgagctccgtggtctacctcgcattcgatgtgggcttgggacttaatcttccttccggacttttgggtggtggcttt

SEQ ID NO: 3107 - DNA, 1002 bp, Corynebacterium glutamicum
atggccgaagtaggagcagaacccgcagggtctgcacaatccaaaactaaacaatttgttgtaggtaccgcagcggtggtcatcactgcaatcgctgcgtttttctccatccagtctgcatccggtggcgaggatattcgttccaacatgacgctgattgctcctgcagctgcaggtggaggttgggatactttccaacgtgagcagcagcagtctatgcgcgtgaataagatcgtgaacaatattcaggtggtcaacatccctggagctggtggaaccattgcacttggcaaactgtctaccatgactgcaccgaacaccttgatggtgggtggaacggggcatatcgcagcacaaattcaattcgatacccctgcgaaaatccaggatgtcaccccaattgctcgtgtggtggaagagttcgacatcatcaccgtgccagcggattctccatacaacacccttgaagagctcattgaaggttggaaggcagatccagcaggagtgtcctggaccggtggtggttcctttgaccagcttgttatgacagaaattgcactgtctgcaggtatagatcctaagcaaaccacctttattccttctgatggtggtggcgaagcgattcaggcgctactgaacggaaccgcaaaggcatcaactggtggttttgctgatatgtatccgcaggtagaagccggtcgattgaaggttttgggaattgctgcagaagaacgccttccaggttctgacattccaacgctagtggaacaaggctatgacgtgaccttgaccaactggcgtgccatgttcgctcctcctggtttgagcgatgatcaaattgcggaacttcgagcaatcgttgcggagtctgtggagactgctgaatggcagtccgcggtggaacgaaactactggatgaacgcctcacttgaaggcgaagaactcgaccagtttgttgaagatgaaattgaccgaattgatcagctattcaaggagatgggc

SEQ ID NO: 3108 - DNA, 693 bp, Corynebacterium glutamicum
gtgggtgtggctgctgcttggacagagaaggttcctgcttttcgggtgttgagagaaaagcgcatgctggactttcgtgcgccgatcaccgtcataaccggggaaaacggtgtgggtaagtcgacattgctggaggctatcgcgatcaatgcgggcttcgacacagcaggtggtgaacacaccggaaagttcaaaccttccgacaaccctttgcaaactgtggcaaaagcacacaagggaaaagagccgatgcgggggtatttcctgcgggcggaaactcatttcaacgtcgcgtctggatatcgcgatgaggctcccggctgggtgaaccttcatcacatgtcgcacggggagtcggtgatgcatattgtgcagaatgcttttgtgggcaaggggctgtatctgatggatgagcctgaagcggggctatcgttcattcgacagatggcgattctggcggagcttaattttctggcggaaagtggtgcgcaaattatcatcgtgacgcattcgccggtgttgatggctattccgggtgcagaaatttgggagtttagtgcatcgggggaactgcatcgagggtttgattttgaggtgacaacggcgtttcgagcgctacgtgacttctttgaggatccggaagaaattgctgagtacatgatggacgtcatgatggacaacaagggggagtcc

SEQ ID NO: 3109 - DNA, 714 bp, Corynebacterium glutamicum
ttgacaaaggtttcgctgcttgatcatccggagtcattgccggggtatttatcgagcctggcgatcgtggaatatctgcatgaacagccgttggagtttcgtgcaccgattactgtgattactggtgaaaatggggtgggtaaatccacgttggttgaggctttggcggtggggatgcgccttaatccgtctggtggctctaggcatgcaaactttggcagggaaggcgatattgtgtcgtcgcttcatcagtcgttgaagttggtgcggagagaaaaccctcgggatgcgttcttttttcggggtgagacgatgtataacgtggcttcctattatgaggagttaatgggggaaaagaacatgcatgatcttcacaagatgagccatggcgaatcggtatttgcggtgattgatcggcgttttaacaatcaaggattttttgttttggacgagcctgaggcaggcctttccatgctgaggcagttggagttgttgggaaagttgggcaaccttgctcgaggtggtgcgcagatcatcatggctacgcactctccaatattgttggctattccgggggcagagatccttgaaattacatcttcgggtgttgcaaaggtgaattttgaggatgcggaggctgttcgtgcggctcgggaatttgtggcagatccgcgaggtacggcggcgtttctgactgcggaggaggatcaccaa

SEQ ID NO: 3110 - DNA, 1209 bp, Corynebacterium glutamicum
atgcacgcctcgtcgccccaacctcaccctcagcgcacccgtgttctcagcggcctgattttcgcccaaatcatggttggtgcatccaatggcgtgacgctatcgatgggaagtttgctggcagcacacttggcgggagcttcgtggggaggatcagccgccacattgaccacgatcggcgcagctatcttttcgattccccttgcccgcatggtctccacatacgatcgccgaacttcactcagcacgggcatgttgcttggttgcgtgggcgcactactggcgatcctcggcgcacaattcggcttgtttccagtagtacttttggcatttttgttcctcggatccatgtcggcggttaacctccaagcacgtttcgccgcaaccgacgtggccagtgaagaaacccgcggccgcgacctctcgatcgttgtgtggtccaccaccatcggcgcaatcgccggaccaaatttatttgaaccaagcgcccgattcagcgaaaccctgggcctcgaacaacatgccggcgcatacctgctgtgtttatttggccagctcatcgccatcgcagtctggcgattcaccctccccaaaggcctcaaacccgaagccaccccaaatgcaccaacagaaaagaagcgcctcaccccgaaagccctccaagccatcacatcggttgcaaccgcacacttctccatggtcggtctcatgtccatggccgccatccacatgcaaggccacggcgccagcctcaccatcatcggcttcaccatcagtttgcacgtcgccggaatgtacgcactctcaccagtgttcggcctgctcacagacaaactcggccgcaatgtcaccatctattccggcttcgccatgctcgccacatccgcagcatttcttatcatttggcccgaaccacagtgggccatgatcacatccatgatcctgcttgggctcggctggaactctgccctcgtcggttcttcaacattgcttgtcgacgccacccccatccaccaccgcacctacgcccaggggcgcagcgacctaacgatgaatcttgcgggagcttcaggcgggttgatcgccggaccgttaattgccatgggcggaatgcccttgttggcaggcgtcgttcttgcagttgtggcgcttcaaacggtgcttagtttcagaacccgttcaattgaaaagactcctgcttcatgtttt

SEQ ID NO: 3111 - DNA, 822 bp, Corynebacterium glutamicum
atggtgacattgcggccgagtttgtctgtgagcaggccgaacactggtgagagtgcgtacattccggcgacgtgcaaactgatggtgaagccgatgatggtgaggctggcgccgtggccttgcatgtggatggcggccatggacatgagaccgaccatggagaagtgtgcggttgcaaccgatgtgatggcttggagggctttcggggtgaggcgcttcttttctgttggtgcatttggggtggcttcgggtttgaggcctttggggagggtgaatcgccagactgcgatggcgatgagctggccaaataaacacagcaggtatgcgccggcatgttgttcgaggcccagggtttcgctgaatcgggcgcttggttcaaataaatttggtccggcgattgcgccgatggtggtggaccacacaacgatcgagaggtcgcggccgcgggtttcttcactggccacgtcggttgcggcgaaacgtgcttggaggttaaccgccgacatggatccgaggaacaaaaatgccaaaagtactactggaaacaagccgaattgtgcgccgaggatcgccagtagtgcgcccacgcaaccaagcaacatgcccgtgctgagtgaagttcggcgatcgtatgtggagaccatgcgggcaaggggaatcgaaaagatagctgcgccgatcgtggtcaatgtggcggctgatcctccccacgaagctcccgccaagtgtgctgccagcaaacttcccatcgatagcgtcacgccattggatgcaccaaccatgatttgggcgaaaatcaggccgctgagaacacgggtgcgc

SEQ ID NO: 3112 - DNA, 687 bp, Corynebacterium glutamicum
atgcgatggcaatacattgatggcttgacctgcacgaaccacagtttgggcgatcgtgagatgagacaccgcgtgggcgaagcgggagagtccgccgaactctgcgtaggcctcaggggaggtcccgctaagaagcgcctgctccgtttctgggtcgaaacggtgcgcttggacgaagccttgccagatatcgtccttggctaccttcagatcggcggcagcgattcggcgggcgacttcaccgatcttgacaatagcgctgtcacggtcgaaaggaatggaaccatgaccagcatcgccattgacgtgaatacgacgttgagctgcacctttttctccaacgttaattactactgcgtcgctgccgtcgtggactggaaggtgcgatccaccggattcggagaggcagtttttccagctgaagaggttttggtgttcttcggaaagccacttcgctccgagtccgccgcgggcttcctcatcagcaacgccaacgaatgtcagcgtgccacgcaggccgccttcacgggctacttgacgggtgacggccgcttgggttgcggtaataaagagcatatcgacggaccctctaccccaaatctgtccatccgaaatctccgcaccgaatggatctttagtccatttaggcagatcaacaggcacaacatcagtatgtccaagcagtgt

SEQ ID NO: 3113 - DNA, 1323 bp, Corynebacterium glutamicum
atgacgctttacgacgaaaccctcaccctccttcaggaacttatccgcaacgcctgcgtgaatgatctaaccccagattcaggtcaggaaattagaaacgcggaaagcctagaacgtttctttgaaggaacccccaacgttaaaatcaccaagctggaaccgcatccgggccggacctcaattatcgtgactgttccaggcagcgatccagatgctgagcctttaacactgcttggacatactgatgttgtgcctgttgatctgcctaaatggactaaagatccattcggtgcggagatttcggatggacagatttggggtagagggtccgtcgatatgctctttattaccgcaacccaagcggccgtcacccgtcaagtagcccgtgaaggcggcctgcgtggcacgctgacattcgttggcgttgctgatgaggaagcccgcggcggactcggagcgaagtggctttccgaagaacaccaaaacctcttcagctggaaaaactgcctctccgaatccggtggatcgcaccttccagtccacgacggcagcgacgcagtagtaattaacgttggagaaaaaggtgcagctcaacgtcgtattcacgtcaatggcgatgctggtcatggttccattcctttcgaccgtgacagcgctattgtcaagatcggtgaagtcgcccgccgaatcgctgccgccgatctgaaggtagccaaggacgatatctggcaaggcttcgtccaagcgcaccgtttcgacccagaaacggagcaggcgcttcttagcgggacctcccctgaggcctacgcagagttcggcggactctcccgcttcgcccacgcggtgtctcatctcacgatcgcccaaactgtggttcgtgcaggtcaagccatcaatgtattgccatcgcatgcgtacttggaactggatatccgtacccttccaggccaaaccaatgactatgttgatgacaccctgcgtgctgctctgggcgatcttgccgatgaagtagaaatcgaacacctcatctctgaagaagcaacggtgagcccaactgattccaggttgtataacaccttggaaaaagttcttggtgatttcttccccgatgcgcctgtggtcccaattatttcctctggtggctctgacctgcgctttggtcgtcgactaggcggtgttggttatggttttgcagttcatgcacgtgaacgaactttggcggaagcaatggggcaacttcactcccatgacgaggcgctgtacctggaagatcttgaactgactgttcggggttatgactccgtcgtgcgtgaattcctaggc

SEQ ID NO: 3114 - DNA, 1905 bp, Corynebacterium glutamicum
atgactttccagcgtgcccgattcgaaagcatcacccacccaacacaacgtcacagtatgaaacaaaccagctcacgatatggaatttcaccaaatgcgaactaccctaaataccaaagacagacagtgacagccccttcgagaatgcagcaagagacgacacctcctatggacggcacctcgccacagaacaaaatttccaccactcccccagcgccaggaaatgctattcctgcacctggaggcgccattcctacaccagcgaaaactgagcaggacgcagtacctccaactgtggcggcgaaactacccgtacctggaagttctattccagcacccggtagagcattgccaactccagtggctccgggaggttccgtcccagctccgagagcgtccgcacctgcggttcctaacgttcctgcagctcccggcgctgctgttccagctccgggaatctcgatcccggcagcacctagtgccccaggcagtgcaattccaacaccaggcacagcaatccctgtgcctggaagtgcaactcctgtcccagcacctggggttagtgcacctggcgcaagcgttccaagcattccagtaccaggatctgtcaccccacctgcaccaggaatttccgcacctggcggtgcacttccgactcctggcagtgcgcccccaacacctggcggtgcccttccgactccaggtgaggcacttcccgttcccggagcacctggtgcacccggagcatccggaatcccaagtcctggccttccaaccccaggtgtcccaactcccggagcttccttaccagtcccaggagcaccagacgcacctggaaccccaagcattcccgcagctcccggcattcaagcaccaggaattccagcagcaccaggagcccctgcccaagctgctgctcacgcaaagccagtattccaagatgcagagaaacgacctcgcacagatgaagctggaaatgcgaagaaggaactgccgctgagagttcggttggcgcagccaattacacgtaagcagtgggcaatgactcttggtgtcctggttctcggagcaattgtcgtggctgcaatcgcggtggtccttgccaaatgggcgtttaccacggagtggttgcaggacttcgtcgagaagtatccgggtaaatatgacaaccccgaaggtgcgccagtaggaattccaacgtggctgagttggcagcacttcttcaacatgttcttcatggtgttgattatcaagacgggcattgagatcaatagaacccgcaggccaaagggttattggacgccgaaaaagggtggcaagaagatctccttgacgttgtggatccacctggttttggatttgttgtggatcatcaacggtgcggtgttcatcattttgttgttcgcgacgggtcagtggatgcgcattgttccaaccagttgggatgtgttcccgaacgcgctgagtgctggtttgcagtatgtgtcgttggattggccgactgagaatggttgggcgaattacaacagtttgcaggagctgacgtacttcttcactgtctttattgcggcaccgttgtcgattgtgtctggtttccggatgtcgagttactggcctaagaacaatgcgacgatgaataagttgatccccatcgggtttgctcgtgcgctgcacatgccagtgatggtgtattacatcgtgttcatttgtatccacgtgttcttggtgttggcgaccggcgcgttgcgcaatttcaaccatatgtatgcaggtcaagacgttgtgaactgggttggttttggttggttcgtggcgtcgttggtggtgatcattggagcatttgtggcattgcgtccaacgattatcgctccggtggccaagctgtttggtcaggtcactgcccgt

SEQ ID NO: 3115 - DNA, 774 bp, Corynebacterium glutamicum
atgctattcctgcacctggaggcgccattcctacaccagcgaaaactgagcaggacgcagtacctccaactgtggcggcgaaactacccgtacctggaagttctattccagcacccggtagagcattgccaactccagtggctccgggaggttccgtcccagctccgagagcgtccgcacctgcggttcctaacgttcctgcagctcccggcgctgctgttccagctccgggaatctcgatcccggcagcacctagtgccccaggcagtgcaattccaacaccaggcacagcaatccctgtgcctggaagtgcaactcctgtcccagcacctggggttagtgcacctggcgcaagcgttccaagcattccagtaccaggatctgtcaccccacctgcaccaggaatttccgcacctggcggtgcacttccgactcctggcagtgcgcccccaacacctggcggtgcccttccgactccaggtgaggcacttcccgttcccggagcacctggtgcacccggagcatccggaatcccaagtcctggccttccaaccccaggtgtcccaactcccggagcttccttaccagtcccaggagcaccagacgcacctggaaccccaagcattcccgcagctcccggcattcaagcaccaggaattccagcagcaccaggagcccctgcccaagctgctgctcacgcaaagccagtattccaagatgcagagaaacgacctcgcacagatgaagctggaaatgcgaagaaggaactgccgc

SEQ ID NO: 3116 - DNA, 762 bp, Corynebacterium glutamicum
atgccgggagctgcgggaatgcttggggttccaggtgcgtctggtgctcctgggactggtaaggaagctccgggagttgggacacctggggttggaaggccaggacttgggattccggatgctccgggtgcaccaggtgctccgggaacgggaagtgcctcacctggagtcggaagggcaccgccaggtgttgggggcgcactgccaggagtcggaagtgcaccgccaggtgcggaaattcctggtgcaggtggggtgacagatcctggtactggaatgcttggaacgcttgcgccaggtgcactaaccccaggtgctgggacaggagttgcacttccaggcacagggattgctgtgcctggtgttggaattgcactgcctggggcactaggtgctgccgggatcgagattcccggagctggaacagcagcgccgggagctgcaggaacgttaggaaccgcaggtgcggacgctctcggagctgggacggaacctcccggagccactggagttggcaatgctctaccgggtgctggaatagaacttccaggtacgggtagtttcgccgccacagttggaggtactgcgtcctgctcagttttcgctggtgtaggaatggcgcctccaggtgcaggaatagcatttcctggcgctgggggagtggtggaaattttgttctgtggcgaggtgccgtccataggaggtgtcgtctcttgctgcattctcgaaggggctgtcactgtctgtctttggtatttaggg

SEQ ID NO: 3117 - DNA, 954 bp, Corynebacterium glutamicum
atggttgaaattgcgcaacgcgccggtcgccaacaccaagaacacgtggatacaaatgaacacgatgtaatacaccatcactggcatgtgcagcgcacgagcaaacccgatggggatcaacttattcatcgtcgcattgttcttaggccagtaactcgacatccggaaaccagacacaatcgacaacggtgccgcaataaagacagtgaagaagtacgtcagctcctgcaaactgttgtaattcgcccaaccattctcagtcggccaatccaacgacacatactgcaaaccagcactcagcgcgttcgggaacacatcccaactggttggaacaatgcgcatccactgacccgtcgcgaacaacaaaatgatgaacaccgcaccgttgatgatccacaacaaatccaaaaccaggtggatccacaacgtcaaggagatcttcttgccaccctttttcggcgtccaataaccctttggcctgcgggttctattgatctcaatgcccgtcttgataatcaacaccatgaagaacatgttgaagaagtgctgccaactcagccacgttggaattcctactggcgcaccttcggggttgtcatatttacccggatacttctcgacgaagtcctgcaaccactccgtggtaaacgcccatttggcaaggaccaccgcgattgcagccacgacaattgctccgagaaccaggacaccaagagtcattgcccactgcttacgtgtaattggctgcgccaaccgaactctcagcggcagttccttcttcgcatttccagcttcatctgtgcgaggtcgtttctctgcatcttggaatactggctttgcgtgagcagcagcttgggcaggggctcctggtgctgctggaattcctggtgcttgaatgccgggagctgcgggaatgcttggggttccaggtgcgtctggtgctcctgggactgg

SEQ ID NO: 3118 - DNA, 1068 bp, Corynebacterium glutamicum
ttgtcgctggttgttgccgcttttggcagtcgggatggcgtggtggctctaactcaaatcgtcggaccgtccggctccgggctcacgcgggaattggaaaaacgctaccgggaaacgcccggagcggtgatgctgaccgccgacccgcgcgcgcatatcacctacctgcgcgcgacagtcgccgaggagctggcctttgggctggaacaacgcggcatcgtacccgcgcagatgtgggagcgcgtccgaaacatcgggctcggcctcgagaatctgctagaccgcgcacccgcgcaactttccggcgggcaaacacggcggctggcgatcggcaccgtcgccatcttagaggcgccaacgatgcttctcgacgaccccctctccggtcttgatacctcctcgcgagcccaactcatcacaatgttggaatcatatgagggcgatgtcatcgtcgctgcgcacaagcggtggctcgacgcgccgactgtgtacttaggggatttggaggagctgtccctgcctgcgcgggtggaattttccggtccatcgcgaacgttttcagcgattacaggaacccgcggacaacaacgccgacgctggtggcaattcaacgaatcccaaccacagtttcagatcggccccctggatattactgtttctgcaggtcaagtgctgtggttgcagggtcccaatggttcagggaagtccacactcctgcgtggtcttgccaatgaacccggcactgaattgatgctgcaaaaccctagcgatcaagtcattgactccactgttgctaattgggtgccaggcagtaacagtgaagaacatccgctggatttatcgcaacgcgaactccgccttgcccaatgcgacgcagccctgggtaataacccggaagttttgcttgctgatgaacccgacgtcggccttgatgtcggcggtcgaaacgccatccaccagcgctttgcggatttcttagggaatgggggagcgctgatcctgacctgccatgatgaaaccttcgtggcagaggtagctgaatacgcgatagtgaaggaaatggggctc

SEQ ID NO: 3119 - DNA, 642 bp, Corynebacterium glutamicum
atgaatcctttgacatggatcattggcgcattcagcatgtggatcgtggtgctgggcgttaataagcttggtttaagcatcgcagtgatcatcatcgcgcaggtcgtggcgatgattcgggtgcgcaatgtatctgtgttggcttcaacagcattgttatcggttcctgcattggcctcgatggcgctgattcacatgccgtattcttccgacggctggttgattgctcttaccttgacggctcgttttagtgcgttgatgtctattttcctccttgcagcaacagcgattactattcctgagctggtgaaatccctatatcgttggcccaagctggcgtatatcgtgggttctgcattgcagatgattccgcagggtaaacagaccttggcgttggttcgtgatgccaatgctttgcgcgggcgcagcgttaaaggtcccgtgcgcgcggtgaaatatgtgggtttgcccctgattacacatttacttagtgcaggtgccgcgcgagcgattcccttggaggtcgcaggcctggacaggccggggccgcgtacggtgttggttgaggtggtggaggggcgcgtcgaaaagcattgtcgctggttgttgccgcttttggcagtcgggatggcgtggtggctc

SEQ ID NO: 3120 - DNA, 618 bp, Corynebacterium glutamicum
gtgggctatgttgccggcacgatcgcgttgttggttggtgtgctgcctacgcttccagccaggaccattgcgatcattcctgtggctttggtgctcaatattttgttaggccaagtcactggttcttttgtcattccgctgtatttagatgcggtgggcacagtgctggtcgcagctcttgctggtcctagtgctggtttggcaacaggtgctttaagttctgtggtgtgggcgttgttcaatccgctggctttgccgtttgctgcaggttccgcgctgactggttggttgaccggtgtggtgattaaaaagggtgcgtttaagaatatcttcgccaccatcatctctggtgcggtcattggtttgatcacgggtgctgtcgctgccccggttgcggcgtttgtttatggcggaaccgccggtgtgggaactggtgcggtggttagcctcttccgcgaaatgggtaactctttgctcgcatcggtaacctggcagtcgtttatttccgatcctttggataaggccattgttatgctcattgtgtttgtggtggtcaagtcgctacccaagcgcaccactagggcattggttccgcagcgggttccggaggacgtcgct

SEQ ID NO: 3121 - DNA, 816 bp, Corynebacterium glutamicum
atgccgtcaccaggagaacttttagccgcccgctacggacaacctgcaacctggacgccaccgcagtggaatgagacgcttgatgtcattcaccagcatcgatcagttcgcaggtggttggataaaccggttgatgatgacaccatccgcaccattatttccgccgcacaatcggctggaacctcttccaataagcaggtcatttctgtcatcgtggttaaagatcctgagctgaggaaaggcctcgcggggatcactcgccagatgtttccgcaccttgagcaggttcccgcggtgctgatttggttgattgattattcccgaatcagtgcggtggcagccagagaagatctcccaacaggggctcttgattatctcgatgaggccgcgttggggttcctcgacgccggaatcgcagctcaaaacgctgcaattgctgcggagtcacttggattgggaacgctctatttgggttcggtgcgcaacgatgcggaagccgtgcagaaattgcttggccttccacctgagatcgtgcctgtcgtgggcttggaaattgggcatgcggatccgtctgaacctgccggaattaaacctcgcctgccacaagaagccattgttcactgggatacctacaccgagaaaaacctcgaacttatcgattcctacgaccgcgccctcgacacttactattctcgctacggccagcaccagctctggtcgaagcagacggcgcatagggcggcgtcgaaaagcattacaaaaaccaacaggcagttccttaggcgcgtgtttgagcgcgccgggtttgggctgaga

SEQ ID NO: 3122 - DNA, 903 bp, Corynebacterium glutamicum
atgattcctgttctcatcgactgcgacaccggcatcgacgacgccctcgccctgatctacctggttgctttgcataaacgtggtgaaatccaactttttggagcaacgaccaccgcaggaaatgttgatgtgaaacaaaccgccatcaataccaggtgggtgttggatcagtgtggattagcggacatcccggtcctcgcaggacaacctgaaccaaagcacgtgccgctagtgactactccagaaacacacggcgaccatggccttggttatataaacccaggtcacgtcgaaattccagaaggtgactggaagcagctgtggaaagaacacctcagtaacccagaaactaagctgattgtcaccgggcccgccaccaaccttgcggaattcgggccagtggaaaacgtcacgctgatgggtggcacctacctttatccaggcaacaccactccaacggcagaatggaatacctgggttgatccacacggagctaaagaagcattcgcggcagcccaaaagcccattacggtgtgttccttgggcgtgaccgagcagtttacgctgaacccggacatcctttctacacttatcaacacgcttggcagccaacccatcgcagagcatttacctgagatgctgcgcttttactttgaatttcacgaagtgcagggcgaaggttaccttgctcaaattcatgacctgctgacctgcatgattgccttggataaaatcccattttcaggccgtgaagtaaccgtggacgtggaggctgattcgcccttgatgcgtggcaccactgttgcagatattcgcggacattggggcaagccagctaacgcatttcttgtggaaaccgcagacattgaggccgcccacgcggaacttctaagagcagtggaa

SEQ ID NO: 3123 - DNA, 975 bp, Corynebacterium glutamicum
atgagcaccatagaagagcgcactcctggagctgtcgccacagaaccagtgggacacgaaggcgcacgcgtcagcattaatgagaagaacgtgtggtctttgggcgcaggtccagcagctttcgcactgctcgcaatgattgtgctcatgattgccagtggagttttcttcgctcaatccatcaacactttagaaaacgatggcggtggaacacttgcggttacgggactgattgccagcatcgtcgttttcactgttgcattggtggtcaccataacttcggtgaaggtggtcagccctggacatactctgactgtgcagttctttggacgatacatcggaaccctgcgtcgaactgggttgtctttcgttcccccactgtctgtgacgaagaaagtgtccgtgagggtccgaaactttgaaaccaacgaagccaaagttaatgactacaacggcaaccccatcaacattgcagcgatcatcgtgtggcaggtagccgatactgcacaggctagcttctctgtggaggatttcgaagagttcctgcaccagcaggccgagtccgcactgcgtcacgtggcaacccagcacccctatgattccccagttgatggtcgtgtttccttgcgtggcgctaccgatgaggtcagtgaagaactcgcagatgaggtggcacaacgagcagctgttgcaggtcttgaaatcgtcgaagcccgcatctcttccttgagctacgcaccggaaattgcccaggcgatgctgcagcgccagcaggcttccgcgattgttgatgcccgcgaaaagatcgtcgagggcgctgtcaccatggtggaaaccgcacttgaccagcttgagcaacgtgaaattgtggatttggatccagagcgacgcgccgcgatggtttccaacctgttggttgtgttgtgttccgacaccaatgctcagccaatcgtcaacgccggtagcctctaccaa

SEQ ID NO: 3124 - DNA, 588 bp, Corynebacterium glutamicum
atgagttcattaatcgttggcacggacggcctcagtcgcccgagttgggctgcgcaagatcccctgatgcgcgattattacgacaccgagtggggaatgccgattcgcgatgaacagggattattcgaaagagttagtctggaagcttttcaatccgggctgtcctgggcgacgattttgcgcaagcgcgatagtttccgcgcagctttctctcagtttgatccggaattagtcgcaaaattcaccgatgctgacatcgaacgcctcatggaggacgccggcatcgtgcgcaacaaacgtaaaattttggccaccattaacaacgccaaagccacccttcaattgcgtgagaagggtggcttggtggaatttgtatggggtttcaaaccgattgataccccacagccggagaccctggaggagattccgacgcagtcgccggagtcagttgcactgtctaaggcgctgaagaaggaaggtttttccttcgttggtcccacgacgatgtttgcccttatggaagccataggaatcgtcgacacccatttggtgggcagccatcgccgcggaagttctggggtgtgggct

SEQ ID NO: 3125 - DNA, 1158 bp, Corynebacterium glutamicum
ttgatcgtttccacccagcccattactgatcgcagcgcactctcggcagaacacgcagaggtgatcaaagcaacgcttcctctcgtgggcggcaagattaatgagatcacgccggttttctacaacaagatgtttgcggctcacccagaattgatcgctaacaccttcaaccgtggcaatcagaagcaaggcgatcagcagaaggcgctggcggcttcgattgcaacgtttgccaccatgctcgttactcctgatgctcctgacccagttcagctgctgtcccgcattggccacaagcacgtgtccctcggcattactgctgatcagtacgacattgttcacgagcacctgttcgccgcaatcgttgaggttttgggagcggaaactgtcaccgcacctgtcgctgaagcctgggatgctgtctactggatcatggcaaatgtgctgatcggttttgagaacaacctttatgcttccaacgatctggagcctggcgacgtcttccgcgaagtcaccgtgaccgcgaagaagcagctcagcgcaaccgtctgggaatacaccctggcaggtgagctggttgccccagagccaggtcagtacacctccatcggagtagtgcttgacgacggcgcccgccagctgcgccagtacagcttgctcggcggctccgacaccgagtaccgcattgcggttgaggataacggcgaggtttctggattcctgcgtgatcgcgtatccgttggtgacaagattgaagccaccatcgcggccggcgacctggttcttaacaaggacaccaatccagttgtgctgatttcccagggcatcggctccaccccaatggtgggcatgctcgcaggtatgaaccctgaacgtgacgttgtggttttgcatgctgaccaggccgagtccacctacgcgcaggtggaggaagtgcaggggctcgtcgaaaagctccctaaggctgcgtttgaaatcttctaccgcgacaacgaccagtggctcgaggtcgctggccgcattccatcaggtgcgtccgtgtacctgtgcggtggcgtggaattcttgaagaacgtgcgtgagcagatcgaggcgctcgatgagcagcctcgcgacgtaaacttcgagctcttcgcaccaaacgactggctgatttcc

SEQ ID NO: 3126 - DNA, 603 bp, Corynebacterium glutamicum
atgggcgaacaatttccaggcgataaaaacatccgagtcagcgacaccgaaagatcagcagcactagcagcactcggccagttctacgcagaaggtcgcctctccctagaagaaaccgacgaccgctgcgaagccgtcgccgacgccaaaacccgcggcgacctcaacgccatcttctacgatctgcccaaccaacaaatcgcagtcgtcgaccgctccgaacaaacctacacagccaccgaagttgccgaactccaccgcaaaggcgcacgcccacgcgccggaatcctcggactcaccacagttttagccatcaccggtaccgctgctttcgccagcaccacagcttttgcaacagtacttttagccctgattccgatcgtgttcatcatgctgtacgtgatgaaaattggtcctgaatcctggcacgcaccaacacctcgccaacttcagcgaaagcgcatgatcgaactgcgtgaaaaggaaaaactccgcgacatggagctcaaagcccagcgcaaggaacgcacccacgcattaaccaaccgcgcgttggatgctgctgaaactgctttcaacaccaagccctggaagaagaacaaa

SEQ ID NO: 3127 - DNA, 624 bp, Corynebacterium glutamicum
atgtcacacactaagccatccattgccatcctcggtgctggccgagtgggttcttcacttgccaggtcagcggtcgccgcaggctatgaggtaaaggttgctggttcaggtgctgtggacaaaatcgctcttaccgctgagatccttatgcccggcgcggttccaagcactgctgaccaggctgtaaaggatgcagatattgtgttcttggctgttcccctgcataaattccgcagtgtcaatccagccactttagagggcaagatcgttattgacacgatgaaccactgggttccggtcaatggtgagttggaggaaattgatcaggatccgcgcagcacttcggagattattgcggagtttttcgcgggatcaaccatggtgaagtcttttaaccacattggttatcacgagattgagcaggatgcgggtaccgggcgtgcgattgcgtatgccacggatgatgtggatgcaggtgcccaggttgcacagctaattaagagttttgggtttgttcctttaaatattggcgcattggaaaacggccgtattctggaacctggccaagaagctttcggcgcgcaccttaataaagattcgcgcctagaacttgttaatcagcgg

SEQ ID NO: 3128 - DNA, 156 bp, Corynebacterium glutamicum
ttgttaatcagcggtagtacctcgatcttcagccaacctcgcgacatggagcgcgaggtaggtttgctcgtcggaggaaagttcggcacccaatcgaaggctgaggatttggctgagtctttccgcacatgccaccgaatccgggtgggaaatttc

SEQ ID NO: 3129 - DNA, 591 bp, Corynebacterium glutamicum
gtggtggcgttggcggatcaccttcaaatggcggtgaaacgtaatgagttggaacccgagctgacgtccaaccccaacccattaagcgcagaagtgcatcatttgtatcctgaggaaactcgtcttgcaacggagatcctggaacgcaccaacaattggcttgctgaaaaagggatccctccgctgccaccagcggaagttgtagccatctcattacacctggttaatgctggtttccgcacggaagacctcgcagaaacctacgtgatgactggcgttttcgagcagctctttgaggtaatcgattcctcgtttggcatcacccttgaccgacaatccgtcaacgccgcacggtttatcacccacatgcgctacttctttgttcgcgttcaccacgacggacaactcaacgacggcatgtccgtgctgcgcaacagcctagaaatttcccacccggattcggtggcatgtgcggaaagactcagccaaatcctcagccttcgattgggtgccgaactttcctccgacgagcaaacctacctcgcgctccatgtcgcgaggttggctgaagatcgaggtactaccgctgat

SEQ ID NO: 3130 - DNA, 279 bp, Corynebacterium glutamicum
atgatcagcgtcgcggttattttctggcacaaacacctgcgccactttggactaatcaatatcttcacctggttttttctggaaacccacacctcatccggtcagtaccacctcggcaccgtctttcatggcaagcacaacattattgttgagcactctcaaccctttcaccgaagtgacacctacctttatttcttaggattccaggctttcgccattggtggcgatgatgtcgcggcaccaatcaaaggacttcttcttgtagcgcttcaagattcc

SEQ ID NO: 3131 - DNA, 360 bp, Corynebacterium glutamicum
atgtccgtatgtgaagcccacaaccccgaaaactactcaaccggtggcggtaacatcatcggcggagtggtcagccccactctcgcggcttccgaatggggttggcaagttgatcccctcggtttgcgcatcgtcctgaacaactactgggagcgctggcagaagccactgttcatcgtcgaaaacggactaggagcaaaggacgtgcttatcgacggaccctccggcccaacagtaaacgatgactaccgcatcaaatacctcgacgacggcggctcaggaatcttgaagcgctacaagaagaagtcctttgattggtgccgcgacatcatcgccaccaatggcgaaagcctggaatcc

SEQ ID NO: 3132 - DNA, 381 bp, Corynebacterium glutamicum
gtgcagcaagtagcctgggtattcgccacggacgtgaatattgccgaaggcatagtcctcgtgggacttttgctgggcggtaagttgatcgcgtgggtccggggtaatgccataacgaggaacggcaataatcatgcaaccgatctggttttgtgggtcgatctcatgagcaatcttagttgccaaagcacttgctactcaatcatggtaaacagcctggtcgcagtccttcacgattcaaactttgccttccgctacgccttccacctgatcatcatagaagacggtgaagtaacagcagccggagatcccacagagatcgtcactgcgggactgatcgaagaagtctacaacgtcaaagcctgtgcatcccagaccccg

SEQ ID NO: 3133 - DNA, 240 bp, Corynebacterium glutamicum
ttggcaactaagattgctcatgagatcgacccacaaaaccagatcggttgcatgattattgccgttcctcgttatggcattaccccggacccacgcgatcaacttaccgcccagcaaaagtcccacgaggactatgccttcggcaatattcacgtccgtggcgaatacccaggctacttgctgcacaaattccgcgaaagggtatcaccatcgacatcacagatgaagaccgtgagatct

SEQ ID NO: 3134 - DNA, 1257 bp, Corynebacterium glutamicum
gtgggcgcggatcaggcagcgcgtcccactcggcgaacaactcgccgcatcttcgatcagtcggagaagatgaaggacgtgctgtacgagatccgtggcccggtggccgcggaggcggaacgcatggagcttgatgggcataacatcttaaagctcaacacgggaaatccagccgtgttcggattcgatgcccccgacgtgattatgcgtgacatgatcgccaaccttccaacttcccaagggtattccacctccaaaggcattattccggcccggcgagcagtggtcacccgctacgaagttgtgcccggattcccccacttcgatgttgatgatgtgttcttaggcaacggtgtctcagaactaatcaccatgaccacccaagcactcctcaacgacggcgatgaagttcttatccccgcaccggactacccactgtggactgccgcaacctccctggctggtggtaagcctgtgcactacctctgtgatgaggaagatgactggaacccatccatcgaagacatcaagtccaaaatctcagagaaaaccaaagctattgtggtgatcaaccccaacaaccccacgggagctgtctacccgcgccgggtgttggaacaaatcgtcgagattgcacgcgagcatgacctgctgattttggccgatgaaatctacgaccgcattctctacgatgatgccgagcacatcagcctggcaacccttgcaccagatctcctttgcatcacatacaacggtctatccaaggcataccgcgtcgcaggataccgagctggctggatggtattgactggaccaaagcaatacgcacgtggatttattgagggcctcgaactcctcgcaggcactcgactctgcccaaatgtcccagctcagcacgctattcaggtagctctcggtggacgccagtccatctacgacctcactggcgaacacggccgactcctggaacagcgcaacatggcatggacgaaactcaacgaaatcccaggtgtcagctgtgtgaaaccaatgggagctctatacgcgttccccaagctcgaccccaacgtgtacgaaatccacgacgacacccaactcatgctggatcttctccgtgccgagaaaatcctcatggttcagggcactggcttcaactggccacatcacgatcacttccgagtggtcaccctgccatgggcatcccagttggaaaacgcaattgagcgcctgggtaacttcctgtccacttacaagcag

SEQ ID NO: 3135 - DNA, 300 bp, Corynebacterium glutamicum; identical to SEQ ID NO: 204

SEQ ID NO: 3136 - DNA, 1203 bp, Corynebacterium glutamicum; identical to SEQ ID NO: 205

SEQ ID NO: 3137 - DNA, 1257 bp, Corynebacterium glutamicum
gtgggaaaacatgcagctgaaacatcggaaccgaagaaaaattcaccgtggcgcattggtttgttgacgtttttgatttcttcagttgtcgtgacgctggtgggcatggtgatgctgtggccggattctgatgatgtggtgttggcggataacttttcgcagacgtttgcgggaaatcatgagcaggtggatggaacgatcacgctcgttgataattctgcgtgtaattcgccagacaccggccgagtttttgcggaaagccccacgatttctgcggagccggcaacgttggagtgcgtgcgtgcactcgtagacatcacatcgggtgccaatgaggggcagaaaactcagctgatcacttacgcgcaacctggtgatccggagttttccgagggcgacaagatccgcatggtggaaacaccggatacaaatggcgagatcatctacacctttgctgattaccagcgcggaccggcgttgatcatttggggtgtggttctcattgtggcgatgggagctttcgcggcgtggcgaggtgtgcgtgcgctggttggtttggtcgtcaccttgggaattgttggtattttcttgctgccaggattggccagcgggcacgatgcgatgtggttggcgctggtgtgtggcgcggcgatcttgttgattgtggtgccgatggttcacggaatcaactggaaatcggcagctgcgttggcgggcacgctggtggcattgttgttgtcggcggtgttgtcgtgggcgtcgatcgtcaccacgaatttgcgcggactgggcgatgagaatcatctgaagatcatcaactatttgccggaggtgtcgatctctgggttgctgttggcatcgttcatcattggtaccttgggtgtgctcaacgatgtgacgatctcacaggcgtcgaccatcaatgagctcgcggaaatcgatgaagatgccacaccgtggaggctgtttaccggcgcgatgtcggttggtcgcgaccacatttcctcaatgatttacaccctggtgttgggctacaccggcgcagctttgccactgttgctgctgctttccttggcagagcgtccgctgattcagactctgagcagcgatgttatggccggcgagctgctgcgttcaggtgtcggtgcgctgacgttgacactggcggtgccgatcacgacgctgatcgccgcatggacggtacccggcgatgagcctgccccagatgatggcaagccccgcctgatccaccgccac

SEQ ID NO: 3138 - DNA, 183 bp, Corynebacterium glutamicum
atgcccaccagcgtcacgacaactgaagaaatcaaaaacgtcaacaaaccaatgcgccacggtgaatttttcttcggttccgatgtttcagctgcatgttttcccacggtgtctccttgctgttgccatgctcaagtttcaggcataggcaggcacttttacccagtgaagcctaacccagaa

SEQ ID NO: 3139 - DNA, 1317 bp, Corynebacterium glutamicum
atgcggatgacagtgattggtacgggttaccttggcgctacgcacgcggcctgcatggctgagcttagccatgaggttcttggtgttgatgtcgatgaggcaaagattgcgtcgttgaaggacagcaaggtcccattttttgagccgggtttgcctgaggttttggagcgcaatctggaaaatggtcgcctgaacttcactactgattatgcggaggctgcggctttcgcgcaggtgcatttcttgggcgtgggtactcctcagcagaagggtacttatgcggcggatctgacgtatgttcgtcaggttgttgaggatttggtgccgctgcttgagggcgagcacattattttcggcaagtctacggttccggttggtactgctgagcagttgcaggagcttgctgattctctggtcaagcctggttcgcacgtggagatcgcgtggaatccggagttcttgcgtgagggctacgcggtcaaagacaccatcactccggaccgcatcgtggtgggtgtgcgtgagggggcgacagcagaggcgatcgctcgcgaggtttacgccaccgcgattgctgccgataccccatttttggtgactgatcttgctaccgctgagctggtgaaagtttccgcgaatgcgttcttggccaccaagatttccttcatcaatgcggtcgctgagatttgtgagcagaccggcgccgatgtggttgcgcttgcggatgccatcggtcacgacgatcgtatcggccgaaagttcttaggcgcgggcctgggattcggtggcggttgtttgcctaaagacatccgcgctttcatggcacgcgcgggcgaattgggtgctgaccaggcattaacgttcttgcgtgaggtcgattccatcaatatgcgtcgtcgcgaccgtgtggtgcagctggccaaagagatgtgtggcggttcgctgctgggcaagcgggttacagtgctcggcgccgcattcaaacccaactcggacgatgtccgcgattctccggcgctgtcggtcgcgggttcgctgtcgctccagggtgcggcggtctcggtctacgacccggaagctatggacaacgctcgacgcgtcttcccgacgctcagctatgcgtccagcactaaagaggcgcttatcgacgcccacctcgtcgttcttgccactgaatggcaagaattccgcgaccttgaccccgaagtggcgggaggggtcgtcgagaagcgcgctattattgatggccgaaacgtcctcgatgttgccaaatggaaggccgccggttgggaaatggaagcgctcggccgcaacctt

SEQ ID NO: 3140 - DNA, 567 bp, Corynebacterium glutamicum
gtgcttctttcagatcgtgacattcgtaaatcaattgacgcaggcgacttgggaattgaacctttcgacgctgagctgattcagccgtcgagtgtcgatgtccgcatggaccgctacttccgggttttcaataactctaagtacacccacattgaccctaagttgaatcaggatgagctgaccagccttgttgaggttgaggacggcgagggctttgtgctgcatccgggtgagtttgtgctggcgtccacgctggaaaagttcactttgcctgcgcatctggctggtcgtttggagggtaagtcgtctcttggtcgtcttggcttgttgacgcactctactgctggtttcattgatcctggttttagtggttacatcacgttggagttgtccaatgtggctaatctgccgatcacgttgtggccgggtatgaaggtggggcagttggctttgttccagatgagttcccctgcggagactccgtatggttccggcaagcttggttcgaagtatcaggggcagcgtggtcctactccttcgaaggcgtacctgaatttccccaacaag

SEQ ID NO: 3141 - DNA, 237 bp, Corynebacterium glutamicum
atggaaactacaaaaagcacccacttaaatacacgctttaaatcccctcacggtgcgatcatcagcccttttacatttttagaaaaagctttgcagttttccatcgcagccgaaaaccgctccagtgcgaaattgcgcactacatcacaccgaacactcgacgacatctttaattttcaacatatccccacccccagaaattattcaccacttacacttcacatactcaccaatgca

SEQ ID NO: 3142 - DNA, 771 bp, Corynebacterium glutamicum
atgtctcacaagttttcccgccgtgctttcgcagtactgaccgctgccgcaatttccacttccgctttcgcaaccactgctccgtctgcgattgcagagccagtttctaatgtcgccactgcagacgattccagcgtcgcaacttcagaaaactccctcgactggggcttcaaggcttcctggcgcacctatgtcaccggaccttggactggtggaaccgttgacgcaactggcggtgcaactgtcaacgaagatggaacctacaacttcaccctcggaactggctccaattacgacgtcgacaccgagaagggccagctgaactacgaaggaactgttgccttcgccagtgacgctcacggcttcaacatcaccttgtccaacccgcagatcaccgtcgagggcgacactgcaactttgagcgccgagctgtctgacaatgccgctcccgaagagacctccactactcgcgttgatgttgctgagttcgaactgaccgctcctgaggtttcagaaaccgatgcggacattacctacacctggaccgatgcttccggcactttcttggagaccctgcagcctgaagaattgagccgttacgcaggccaggaagcggatgcgctgagcttctccatcaccgtggacaaggcttcagagaacccttccgatgatgttgctaccggatcttcctccagcttcctctccaccatcttgaacttccttcagcagctggcgagcccactgctcaagctcttcggttcgctttcttcc

SEQ ID NO: 3143 - DNA, 1689 bp, Corynebacterium glutamicum
gtgaagaactctgggaaaaattcggcaaagaatcggaccaaagggatcctaatcggggttctcgttggtctgattgccatttttgcaggcatctatgcggtcgatgttttcctcaacaaggacaacatccctcgtggaacaaccgtcggtggcgtcagtatttccaacctcagtgcacaagaagcccgcacaaagttggaaaccgaactggccaatgatgtggtgcagcccgtcaccgtgacggcaggggagcagagcaccacttttgatccagttgcctccggcgtcggcatcgattgggacgcaaccatcgaaggcaccggcgagcagtcttggaaccccattacccgcttcgtggcgctgttcaaagaatccgaatctcccatcgtgagcaccgtcgatcccgcagccttcggcccgacccttgatcgcatggtcggcgaactctatcgagatcccatttccggaaacctgcatatcgacgccggcaccctcgtggtcaacgacaccatcgacggacaagccgtagaccgcaccattttggaacaagcagtcacagaaaactggctcaacccagagggcgtaaaagccgagccatacgttgttcccgctgcgatcagccaagacaccatcgataaacttgcagaaggcgccggagctaaagcagtatctagccctttcgtcgtccgaggcgatgacggaattgaaggcaccatccccgtcgagcgcatgggtgaagtggtgagtttcccagaagaaaacggcaccatccgcgtcgacatcaatgcagaagcagcaacagcaatgctggccgaaggtctcaaagaaacagagatcgagcccaccaacgctcaaatcagtttctcctcaggctcccgcgtagtcaccccagaagtcaccggacacggaatcaactgggaagaaaccctggccgatctgcccaacaacctcaccggcgatggcccccgcaccatcgacgcaatctacgaggacaccccagcaacattcaccgccaccgacgcccaaaacgctaccttcaatgaggtcatgggcgagttcaccaccggcggcttctctgctgcctccggaacaaacatccgcctcaccgcgcaaatggtcgacggcgcagtcgtttcacctggcgatacattctccctcaacaactacaccggcccacgtggcgcagcccaaggctttgttgattccggcatcattttgaatggtcgttccgacaccgcagtcggcggtggcatcagtcagttcgccaccaccttgtacaacgcgtactacttcgcaggtctggaagacatcacgcacaccccgcacagctactacatttcccgctacccagccggacgtgaagctacgattttcgatggcgccatcgacctccaattccgcaacaactccccataccccgtcatgatcagcacctctgccgacgcctcaaacgtgaccgtgcgcatcatgggtgtggacaccacctccgtggaatccatcaacaacggacgttggtccaccacccagcccaacacagttcgagtatcgggttcagattgtgtgccatcaaccggtgcaccaggatttaccacctcagacacccgaatcatcagcgatctttctggcaacgaaatcaccagagaaaccgtcaccacggtttacgatccttcaccaaacgtggtctgctcc

SEQ ID NO: 3144 - DNA, 1185 bp, Corynebacterium glutamicum
ttgctgccgtcttttcctatagttagagccgtgtggaagcgattgaaacccctcgcagcagccgtcgcggtagccggtgtgctccttgcgggctgcgcagaagagccggaacagcaaaaagcaataagccgcttatcgacgtccccctccacccctcccgcaccgaccgcggaggatttggcgcgcgcgcaaatccctgaacagcaacgcgaccaagtcgcgtcgctgatgatggttggagttgcgaattatgatcaggcattggatgcgctcaatcagggggtgggtggcatctttattggttcctggacagatgaaaatctgctcacggaacctggccgtaatattgaggcgctccgcgaagccgtcggcagggatttctccgtcagcatcgacttcgaaggcggccgcgtccagcgtgccaccaatattcttggtgatttcccctcaccgcgcgtgatggcgcaaaccatgacgccggaacaagtagaagatctcgcagaaatcctaggcactggtttagctgcacatggtgtgacagttaactttgcacctgttgtagatgtagatgcttggggtctccccgtcgttggcgatcgttccttttccaacgacccagccgtagcagctacttatgccacagcttttgcaaagggcttaagcaaagtaggaattaccccagtattcaaacatttcccaggtcacggtcgtgcaagtggcgattcgcacacccaagatgtggtgacccccgcacttgatgagcttaaaacttacgacctcatcccttatggtcaagcactttctgaaactgacggagccgtcatggtgggccacatgattgttccaggtcttggcaccgacggagttccatcctctatcgaccccgccacctatcaactgctccgcagtggcgattacccaggtggcgtgcctttcgatggcgtgatctacaccgacgatctctctggaatgagtgccatttccgccacccattcacccgcagaagcagtgcttgcctccctcaaagcaggcgcagaccaagcactatggatcgactatgggtcgttgggctccgcgattgatcgcgttgatgctgccgttagcagcggtgaataccctcaagaacaaatgctggcatctgcgttaagagtccaattgctctacatcacacgtctcgaacaaaag

SEQ ID NO: 3145 - DNA, 444 bp, Corynebacterium glutamicum
atgacgaacaaaaccatgctggttgcttttgatggctcaccggaatcccggcgcgctttggaatatgcggcgaaattgttgcagccgcgcaccgtggaaattttaactgcgtgggagccattgcatcggcaagctgcgcgctcggtttcgttgatcaccttgggggtggaacccgaagaccccgcccattccgctgcactaaaaacctgccaggaaggcgtagagctagcccaatctctaggtctggaagcgcgagcccacatggtggaatccgcaacggccgtgtggagcgccatcgttgatgctgctgacgagctccgccccgacgtgattgtcaccggcacccgcgggatctccggatggaaatccctgtggcaatcctccacctcagacagcgtgctccaccacgccgacgtaccagtttttgtcgttccacccctggac

SEQ ID NO: 3146 - DNA, 201 bp, Corynebacterium glutamicum
atggcatacgaaactgattccctcaaccgacgcaccctcgggcccgcgattgcaagcgcagtcgtgggaatcgccgtcggcgcagtcgcagtagttggggtttcaatgatctcagggcaggacactgttcccactggtaacgccgtaactgcagacgatgccctgctcggtggccctgagtatggttcacgcgaagcagac

SEQ ID NO: 3147 - DNA, 3129 bp, Corynebacterium glutamicum
atgccctgctcggtggccctgagtatggttcacgcgaagcagactaagaagccacttccccgttttcttcactcggcgcatttctatgtctggattgtgctgggttttgtggtgtttgcgcaaccttatggtcaggttgctgccgatactaaactagatttgctgctcaaccccgcaggatttttaaccggtgcgcttcatgcgtggactgacacgttcaccttgggtcagttgcaaaaccaagcttatggctatctgtttccccaagggtttttcttcctcataactgatttcctccctgactggattgcgcagcgactgtggtggtggcttgttcttggcctgggattttctggattctacgcactggtagcccggctggggattggcaatcctgcattcagggtgatcgccgcgctgctgtttgctctgtccccgcgcacgctcaccaccctcactgcaatctcctccgaaacttggcctatcatgctcgcgccatgggtatgtctgcctctgctttcgcgaaatgtggatgcacgggccatcgcgttgtccttacttcccgcggcatgcatgggtgcagttaatgccaccgccacgatggcagcactcatcccggcagcgctgatcttgctgtatagagggctcttcttaaggctgcttctgtggggaatgggcgttctcgctgttaattcatggtggatcggacctttgttggtgcttggcaaatacgccccgcccttcaccgaattcatcgaaagttcctccgtcaccacttcctggctcaacccagtagaaatactccgcggaaccaccagttggacacccttcgtagacactgaacgacaagccggatatctcctggtcaacgatgctctctttgtcaccctcagcgttctcgtcgcagccctcggcttgatcggcctcaccttgatgaaacaccgtggactgtgggcattcatgctggccatcggactcctcatcctcggcagcgcccacctaacggctgttcaagaattcctcgacggcccaggcgcagcacttcgaaacatccacaaatttgatctattagtccgcatgccgttgatggtgggcgttgccgcattggggtcgcatatcagtctgcccttgcttgggacgactgcattgaccagcggacaaggcaaacaccacaccatcccgctgcctctccaaaaacgccaagccgcaggactcctcgtggtgatcatcgctgtcggtgctcttgctcccgcatggtcggcacggctgctacctcagggaacgtgggatgaagtgcctgactactggtacgaagccacagaattcctcaaccaaaacgccacaggcacccgcacgttgatttggcctagctcgccgtttgcccgccaggactggggatggactcgggatgaaccagctcaaccacttcttgatgttccgtgggctgtccgcgatgccattcctttggttcccccggaggcgattcgcggattagatggtctcgacgacctaggcactctaggcaccggtctaaacgacgaggctttaaaacgtctaggcatcggcgcagtactggtgaggcatgatctggaagccgacccagatattgaggtggatctgcctggggaaaagcacacttttggctcccaaggccaagtagacgtctacctcaccgaccccgaccgcaatatgtggatcacttccggcacatccaagcagctgcccaccgtcgctggcggcggcgaaatcctctcgctcctagacaccatcaacggctattccccgaggactttggtgagtgagaatgcccagatcgtcaccgatacccctcagctagtcggcacaaattacggcgatggcaccagttccgcagcattggccagccttgatgagactgaggtgaaaaaccgcatcgtggattatccttccgcggggccaatgacgcaggtggtgcaggaaggttccatcacggcgtcttcgtctggttccgatgccacttctttcggcggcgcggatcctgatcgttcccttaattcacttcttgatcatcgttacaacaccgcctggtacccgacacctggcgatacgtctccgtggctcgaagtctccggtaccggcaccacattatcgatctccccccgcagcaccgtcaccgccaccatcacctccggcgattccgtgatggtccgcgagttcgaaaaaggccgcaccaccacagttacgttggcggagcctgaagctcgcattgaattcgatggtttcgtaggaatttccgagctgtccctagagggtctcagccgcaccatcactgtgccggagacctctcctgacgtgcagcaattcgttttccaacgcctcacagtgcccacctcgttcctcgaccgcactttcacagtcccccgccacatgtccgtcaccgtggaggcccaatcctgcgtcacattggaactcgacggcgatcgcatcgactgtggccccctcgaactcacccccggaacccacacgctgcgcacccaatcggaatgggtcaccctcaccgaatccgctccgctcgccgctgttcagccagcaacaaacatcgaggcagcacccaccgaccgcgtgctcgtcaccacgcgcgctttcaattcaggtaccagcgcgcttatcgacgccacccccctttccccaatccaactcgacgcctcctcccaaggtttcatcatccccgcgaacgcctccggcgagttgagcttcgctttcgacggcgaaaaaccctacaaactgtcccttttcggtggcgcaaccatcgcattaatcgtggtgttgggttgtgttgttgtggggaggcgtcgagaagcaataaaccccgtgtggcaggacacccgcaacgcgcaatgggcggtggtggcattgatcccgatgttggggtggtggttcgtgccggcggtggcgtcgtggctagttctgcgattcaccctcatcccgaaatgggtgctggcagggctcccgttggctatctgcggattgtggctcgcccaagctccctggccggctgccgcatacccaggagattcccccgcattggccctgctagcgggcatttccgtggctgcgctatttgctggcgatttaaggcctccaaagcgc

SEQ ID NO: 3148 - DNA, 621 bp, Corynebacterium glutamicum
atgaggagtccgatggccagcatgaatgcccacagtccacggtgtttcatcaaggtgaggccgatcaagccgagggctgcgacgagaacgctgagggtgacaaagagagcatcgttgaccaggagatatccggcttgtcgttcagtgtctacgaagggtgtccaactggtggttccgcggagtatttctactgggttgagccaggaagtggtgacggaggaactttcgatgaattcggtgaagggcggggcgtatttgccaagcaccaacaaaggtccgatccaccatgaattaacagcgagaacgcccattccccacagaagcagccttaagaagagccctctatacagcaagatcagcgctgccgggatgagtgctgccatcgtggcggtggcattaactgcacccatgcatgccgcgggaagtaaggacaacgcgatggcccgtgcatccacatttcgcgaaagcagaggcagacatacccatggcgcgagcatgataggccaagtttcggaggagattgcagtgagggtggtgagcgtgcgcggggacagagcaaacagcagcgcggcgatcaccctgaatgcaggattgccaatccccagccgggctaccagtgcg

SEQ ID NO: 3149 - DNA, 195 bp, Corynebacterium glutamicum
gtgtcagttcattctgacgattctaggcccttggaggcgattgtagagagggtagaatttgtgaccattggggctcctgtgattcctgtcagcttgttgatcaaggatccaccacaatcctgtggccagaccttcaaatcgaacggatttttgcataaaaccgccggcgagttgcaaaaatccaccacaaacggc

SEQ ID NO: 3150 - DNA, 903 bp, Corynebacterium glutamicum
atgaatccgcgatggcggatgggtgcatatgattgggtagacattatttcaacatgcgagtttagcggaaaggtgtgggctgtttttatgaagcgatctgcaacggtcctcattattgcgggcgtgctgttcctcatttttgccttcacggtaccgccgtatgtgactggtcaggcgcggacgattccgaaggatttggatctgacgttggtgagcgaaagtccgcaggggtttgtgcgcactgaacatattgtgactgctccgacggaaaaggtcgatgagatcgcgacgcatgtggatcagacagttacggatgtgcaggggaaaactgttgcggaaatttcggatgatgtggtgttgattggacactctcgttatccggtgattaagccgactgccaccatttcgggttcgccggcggatagtagcaatgtggtgcgggaggggttgcattacttcttcccggctaatacgttgcggaattcttatccctattatgacatcgtattgggtgaggattccccggtggattatgtctcgcgcgagggcaatacttataccttctaccagcatcttcgttatgttccattggatgattctcacacctattcggtggagcggaccctgaaagtggatcgtttttccggcatcattgtggctaaagatgaggcgatgacgtttcatggcccagacggcgatgacacagtagaattcacttatactgcggatacgttgaagcttctgcaggatcatgcgcatgatattgatcagcggttgtcgtgggctaaggggtttgatttcttttctaaattcttaggcctgtcgttgcttgcgattggtgtgttcctcacgggaattttcaagcgcggccagctgatgagcactgtgaataaactcaggagt

SEQ ID NO: 3151 - DNA, 1068 bp, Corynebacterium glutamicum
atgtctacccaatcatatgcacccatccgccatcgcggattcatcagctcactcgagggactacgcgcaatcgcctccctgggagtcttggcgacccacgttgcattccaaacctccgtcgaccccgccagcaacatcggtgcagtactcgcgcgtttcgactttttcgtcgccgtcttcttcgccctctccgccttcgttctttggcgacgccgcgccgggcaaccagtgggactgtactacctcaaacgcctagcccgcatcatgcccgcatactgggcaacggtcattgcagtcctgctgtttattcccaccggcccctggttagccaacctgacgatgacccaaatctactggccagacggcctcatgacaggcctcacccacctttggtccctgtgcgtggaagtggcgttttacctggtgatgccgcttctcgcgtgggtgttggataggtttggtcggccggtgcgcatcctgttgattgttggtggggcagtgttgagtctggcgtggccgtggattccccttgtggagcatgcgttggacgaggggtgggcgaacatgcagatctggccacccgcttacgcttgctggtttgcagtcggcatgatcgccgcagaaattgaaggagttcgattcccacgggttccgagctttgtgtgggtgggtttagctttagtggtcgcttggatcgcgggccaagaatggttcggaccactaggtttagtgcaccccagcccctgggaattcaacttaagagtcctcgcgggcacacttttcgctgtatttctggtggttccctacgcgctgggtacgccctctcggcttcttgattccagttggatgaaaacgctcggcacctggtcgtattccatcttcctctggcaccttcccgtgctgacgattgtgttcccactgctcgggttgcctttatttagtggaaatttcctgttggtgttcatcgtgacggtcttgttgacgatcccagttgccgccatcagctacaccttcatcgaagagcccatcatgcggtggacccggcgcgccattcaggctgggggtcgt

SEQ ID NO: 3152 - DNA, 708 bp, Corynebacterium glutamicum
atgcgcatgatcctgcagaagcttcaacgtatccgcagtataagtgaattctactgtgtcatcgccgtctgggccatgaaacgtcatcgcctcatctttagccacaatgatgccggaaaaacgatccactttcagggtccgctccaccgaataggtgtgagaatcatccaatggaacataacgaagatgctggtagaaggtataagtattgccctcgcgcgagacataatccaccggggaatcctcacccaatacgatgtcataatagggataagaattccgcaacgtattagccgggaagaagtaatgcaacccctcccgcaccacattgctactatccgccggcgaacccgaaatggtggcagtcggcttaatcaccggataacgagagtgtccaatcaacaccacatcatccgaaatttccgcaacagttttcccctgcacatccgtaactgtctgatccacatgcgtcgcgatctcatcgaccttttccgtcggagcagtcacaatatgttcagtgcgcacaaacccctgcggactttcgctcaccaacgtcagatccaaatccttcggaatcgtccgcgcctgaccagtcacatacggcggtaccgtgaaggcaaaaatgaggaacagcacgcccgcaataatgaggaccgttgcagatcgcttcataaaaacagcccacacctttccgctaaactcgcatgt

SEQ ID NO: 3153 - DNA, 1422 bp, Corynebacterium glutamicum
atgaccccgacccgccgtatcctgctgtgggcatggacgactgtgcttttgggttctttgctgtggccgttggctgcgcctggcgagttgttgttgcgggatatgtcggtggtggaccatcctgcgttgtcgttgaatgcgttgggttttggtgatttgccgtcgcggaacgccccgcaggatggtgtgctggcgttgcttggctttttgccggtgagttggatcgttcgaaccatgctgcttgtggcgggtttcgcgggcgcgtggggtgcgatgcgccttgggccttccaagtttttggccgttaccgtggcgatttacaatcccttcgtggtggagcgtctgctgcagggccattggtcgttggtgatggcggtgtggctgttgccgctggttgtggcgctgcgcaggcatccgcgttggcaggttgtggcgatctgggcggcgtcgttgacgcccacgggtgcggtggttgcggcggtcacgggcgtggcgagttctaaaagaaaacgctttacgacgctatgttccttcctttcgtggcttccttggctaatacctgcgcttcttgccacccccacttcgggaggtgcgctgaccttcgccattcgttctgaaacatatgcaggaacgttgggaactgcgctgggcctgggtggaatttggaacgcgggggccgtgccggcctcacgcgaactgggtttcgcggttgctggaattttgttatttgcgattctgctggcgggtttcaaaaactgtccgtgggttctcgcactgctggcggtcgtaggttttatgggggcgatcggtccgtggctgatgccgaatctgttcacgtggaccatcgcatatgttccaggcgccgcgctgtttagggattctcaaaaactcctcatgctggctatccctgcctatgtgtgtttggccgccggggtgaaaagcccactgtcgtgggtggctaccggtttggcgttgctccagattcctgatgcaccacgtgaggtttccgtgatacgcccaagttcagcgcatgtggaatcagtggaagcactggcagaaatcgctgatggccgcgacatcttaatcatcggccaaggccccttggtgacccgcgaggatgggatcccggttgtcgatcccaaaaccaaagccctctccgtggtggaatccggcgaactgcgtgtggacggaatcatcaccgacgcgccctcacagcggtggaccgaagcaacgcaggcatgggcggccggggatatcgagcgccttgaagaacttggcgttggtgtcgtggtggatggagatacgatcacagaaactggcgcaccaccgcagcatggctggaaatactacctcggtgtgggcctgaccgtgctgtggatggcgttgccgctgggactactttttcgacgcaagaccaagaag

SEQ ID NO: 3154 - DNA, 669 bp, Corynebacterium glutamicum
gtggtatcacgccagcacaacaaaaggatcttcatagggttattcagtctagctgcttttaaacaagccataatggaagccatggccacaacgatcaccgttttctctcccacccactcccccgcacaaatccgcgaaaccatcctcagcgccgcgaaagaagacgacgtggacttcctcggagtcccctttacccaccccagaaacgtcaccatcgaagtcgacgacgaactgatcaacgactgcttaggctggctcgacgacgtggcactcgcctccggcctgggcatccaatacaacgacgaagtgctccgctacggcgacgaagacatttcctttaccgtccaaaccaaaaatgacgatgacgcccgcatcggcgcctcccgccttggactcgagcaccagttgaacgtcattgccgggggctctggagattccggggattccggggattatttgaagattgcacacttcgacctagacaaccccgccgacgagtcctcctacatctccgcgcgcagcctcgcagaagtagacggctggaccctagaattcggcgtcgcaggagtaaaaaacaccaccattgtttcctccatcgacgatgccatcaccaccattttgcgatggatgaacggcgaagacatccgcgacctcaactggacccgcgca

SEQ ID NO: 3155 - DNA, 1137 bp, Corynebacterium glutamicum
atggcttgtttaaaagcagctagactgaataaccctatgaagatccttttgttgtgctggcgtgataccactcatcctcaaggtggcggaagtgaacgctatctggagcgggtgggtgagtttttggcggatcagggccatgaggtggtgtttcgtactgctgggcacacggatgcgccacggcgttctttccgcgatggtgtgaggtattccaggagcggtgggaagtttagtgtgtatcccaaggcgtgggtggccatgatgttgggtcgtgtggggattggcacgttttccaaggttgatgtggtggtggatacgcagaatggcattccgttttttggaaagtttttctccggtaagccgactgtgttgctcacgcatcattgccataaggagcagtggccggtggtgggtcgggtgctggcgaaggttggttggctgattgagagccagatcgcgccgcgcgcttacaaaactgcgccgtatgtgactgtttcagagccgagcgctgaggagctcattgcgttgggtgtggatcagcagcggattcatatcgtgcgcaatggcgtggatcccgtgccgctgcacacgccgaagctggatcgcgatggccagcatgcggtgacgttgtcgcgcctggttccgcacaagcagattgagcatgcgatggatgtcgtcgcggcgctcgacggcgtggtgctggatgtagtcggaagcggttggtggcaggaggaactggtcgattatgcccgcacgctgggtgtgagcgatcgcgtggttttccacggccaggtcgccgaggatcacaagcacgccctgctggagcgcgccacgattcatctcatgccttcgcgcaaggaaggctggggcctggcggtcacggaggcggcgcagcacggcgttccgacgatcggttaccgaagctcaggcggcctgcgcgattccgtcgtcgacggcgaaaccggcctgcttgtcgactccaaggccgagcttatttcagccaccaaaaccctgcttatcgacgcctccctccgctccaagctcggcgccagcgcgaagcagcgcgccgaaaactacaagtgggacaccgcgggagcgcagttcgaggaactacttcttggtcttgcgtcgaaaaag

SEQ ID NO: 3156 - DNA, 771 bp, Corynebacterium glutamicum
atggcctcatttccggagcttccggctcttcgtcgcttggctaccttgggcaggtcgtggggtttactgtctgatttcaaatacgaacaaacccgacctgacatcttttacggaaacctggccctcgatacctcgagtctggtggcggctttgtctgaagatatttctggcgccggattaaatgacctgaaagttctcgacgtcggcggcggacccggatacttcgccgaagcctttgagacactgggcgccacctacttctccgtcgaacccgacgttggcgaaatgtccgcagctggcatcgacgtccacggatcagtccgcggatccggcctcgacctgccgtttcttcccgattcctttgacgtggtgtactcctccaacgttgcagaacatgtctccgcaccgtgggaattgggagaagaaatgctccgcgtcacccgcagcggcggcctggcaatcctgagctacaccatttggttagggcccttcggcggccatgaaaccggactgtgggaacactacgttggcggagaatttgcccgcgatcgctacacgaagaaacacgggcacccgcctaagaacgttttcggggagtcactgtttaatgtgtcctgccgggaggggctggaatggggagcctccgtgggcaatgcggaattggttgccgcttttccccgctaccacccgtattgggtctggtggatggttaaagtcccagtgctccgagaattcgcggtaagtaacttggtgttggtgtttaaaaagcac

SEQ ID NO: 3157 - DNA, 1830 bp, Corynebacterium glutamicum
atgactactgctgcaatcaggggccttcagggcgaggcgccgaccaagaataaggaactgctgaactggatcgcagacgccgtcgagctcttccagcctgaggctgttgtgttcgttgatggatcccaggctgagtgggatcgcatggcggaggatcttgttgaagccggtaccctcatcaagctcaacgaggaaaagcgtccgaacagctacctagctcgttccaacccatctgacgttgcgcgcgttgagtcccgcaccttcatctgctccgagaaggaagaagatgctggcccaaccaacaactgggctccaccacaggcaatgaaggacgaaatgtccaagcattacgctggttccatgaaggggcgcaccatgtacgtcgtgcctttctgcatgggtccaatcagcgatccggaccctaagcttggtgtgcagctcactgactccgagtacgttgtcatgtccatgcgcatcatgacccgcatgggtattgaagcgctggacaagatcggcgcgaacggcagcttcgtcaggtgcctccactccgttggtgctcctttggagccaggccaggaagacgttgcatggccttgcaacgacaccaagtacatcacccagttcccagagaccaaggaaatttggtcctacggttccggctacggcggaaacgcaatcctggcaaagaagtgctacgcactgcgtatcgcatctgtcatggctcgcgaagaaggatggatggctgagcacatgctcatcctgaagctgatcaacccagagggcaaggcgtaccacatcgcagcagcattcccatctgcttgtggcaagaccaacctcgccatgatcactccaaccatcccaggctggaccgctcaggttgttggcgacgacatcgcttggctgaagctgcgcgaggacggcctctacgcagttaacccagaaaatggtttcttcggtgttgctccaggcaccaactacgcatccaacccaatcgcgatgaagaccatggaaccaggcaacaccctgttcaccaacgtggcactcaccgacgacggcgacatctggtgggaaggcatggacggcgacgccccagctcacctcattgactggatgggcaacgactggaccccagagtccgacgaaaacgctgctcaccctaactcccgttactgcgtagcaatcgaccagtccccagcagcagcacctgagttcaacgactgggaaggcgtcaagatcgacgcaatcctcttcggtggacgtcgcgcagacaccgtcccactggttacccagacctacgactgggagcacggcaccatggttggtgcactgctcgcatccggtcagaccgcagcttccgcagaagcaaaggtcggcacactccgccacgacccaatggcaatgctcccattcattggctacaacgctggtgaatacctgcagaactggattgacatgggtaacaagggtggcgacaagatgccatccatcttcctggtcaactggttccgccgtggcgaagatggacgcttcctgtggcctggcttcggcgacaactctcgcgttctgaagtgggtcatcgaccgcatcgaaggccacgttggcgcagacgagaccgttgttggacacaccgctaaggccgaagacctcgacctcgacggcctcgacaccccaattgaggatgtcaaggaagcactgaccgctcctgcagagcagtgggcaaacgacgttgaagacaacgccgagtacctcactttcctcggaccacgtgttcctgcagaggttcacagccagttcgatgctctgaaggcccgcatttcagcagctcacgct

SEQ ID NO: 3158 - DNA, 1011 bp, Corynebacterium glutamicum
atgcccactccttcttcgaccaaaagctacgctgcggtcttacctccacctggcccctcgtgggctggttccctcatgggcatctcattgttgtcatcactgttgaaaatccatggttttccagtcgtcgcagatttcttcttcgcgttagctgttgtggtggcaattgtcattattggcggttggctaatctaccgctctccttcattcaaaactgaagtcatgccggcatgggcaatgctgtccatgggtttgatcgcattgggaactgcaagccccgtagttttgggtgatgatctgtggggatttatgtttgtgtgctggtctattggcacagccgtgggacttgttgcctattccttatatataacggccattttgcgatctaaggcgggcacaccaacttttgcgtggggtcttcctcttgtcacgccgatggttgcttccacctcggcagcacaactccatgagcactttgaacttccggcgatgctgtgggtttctttcgggctcttccttttaactttggcgtctgcaccagcagtttttacccgagtgtatttctactatttcggccccaaggcgcagggcatcccactgatggcaacaccaacatcatggattcctttgggtatggtgggccaatccactgcagcagctcagctcatcggtgcgtcctttggatccaagacagcaatcacaatgggcattatttacggcatcatcatgggaatttttacgattcctctgggagccatcgctcactttgtgttctacagagctgttttcaaaggggcgacatacagccccacatggtgggccagtaccttcccagttggcactttgagtttgggtgcgcattttttatcacagagcaccggagtggagtggtttaactacttcagcctgtacttgattgctttaatgctctttcatgtcatcgtgtccaccatcgccggtacgattgcagtaatgagaagaatcgtcggaaagcttaaatctcaactggcc

SEQ ID NO: 3159 - DNA, 765 bp, Corynebacterium glutamicum
atgtctatttctgataattcccgcgatcaattaggagaactgccagctggtcggcctctccaatccgattttgataatgacctcgactacccacgtctaggcagtgtcacgtttaggcgtggcaccctcactgaaaaccagcaaaccatgtgggatgaaaagtggcctgaactgggtcgcgtcctcgaagatgagctgattgatgttgatgcgtggttcgggcgcgaaggcgcaaaaaccatcgtagagatcggctctggcactggaacttcgactgctgccatggctccacttgaggctgataccaacattgtcgccgtcgaactatacaagccgggcttggccaagttgatgggctctgttgtccgtggagagatcgacaacgtgcgcatggtccgcggagacggcatcgaggtgctcaaccgcatgtttgccgatgggtccctggacggcatccgcgtatacttcccggacccttggccaaaggcgcgccacaacaagcgccgcatcatccagtctggtccgctgaacctgtttgcaaagaagctcaagccaggtggagttctgcacgttgctaccgaccacgctgattacgcagagtggatcaatgagctagttgaggtcgaaccactgcttgagtacaaaggctggccatgggaggaatgccctcagctgactgaccgtcaggtcatcaccaagtttgaaggcaaaggcttggaaaaagatcacgtgatcaatgagtacttgtggcagaaggtgcaaaac

SEQ ID NO: 3160 - DNA, 705 bp, Corynebacterium glutamicum
gtggcagaaggtgcaaaactaatgtctgatgtgcatgaggtcattcatagctacaatcccactgacaaagaaggccctgaaagtgtccttctagtgtgggacgctcccaacctagatatgggtttgggcgctattttgggtggtcgcccaaccgctgcgtaccgacctcgctttgatgccatcggtcggtggttgcttgctcgcgcaggtcgcagggcacatgagttgggccgccacattgagcctgaggcaacggtgtttgccaacatcaccccaggtggctctgatgttgttcgaccttgggtggaagcgctgcgtaacgttggtttcgcggtcttcgctaagcctaagatcggcgaggattccgatgtcgatccggacatgattgatcacattcgcaggcgctatgaagaaggcgtgctgcggggtgtcatcgtggccagtgcagatggtcagaacttccgtgagactctcgaggagctcgttgcagagggcattcctgccacggtcattggtttccacgagcacgcgtcatgggctgtagctcatgacaccatcgagtttgttgatctggaggaaatccccggcgtcttccgtgagccgcttcctcgcgtcagcctggataacctgccagacggtggcgcatggctgcagccgttccgccctctgactgccttgttatccaaccgccacaattcccaggag

SEQ ID NO: 3161 - DNA, 2316 bp, Corynebacterium glutamicum
gtgttttctaaatggggccactttgcttacagatttaggcgcattgttccgttagtcgtcatcgccgcgattttggctttgtttgtcattttcggcaccaagctgggcgaccgcatgagccaggaaggatgggatgatcctggttcttcctcgaccgctgcggcgcgcatcgagttggagacctttgggcgtgacaatgacggcgatgtcgtgttgctgtttactgcgcctgaaggcacttctttcgatgatgcagaggtgttctccagcatctctggctacttagatgggctaatcgagaacaaccctgatgaagtcagccacatcaacagctactttgacactcgtaatcaaaatctcctcagcaaagacggcacccaaacctttgcagctctcgggctcaaaggtgacggcgagcaaacgctgaaggacttccgggagattgaagatcagctccatccggacaaccttgccggtggcgtcaccactgaggtcgcgggtgccaccgctgtagccgacgcactcgatgagggcatggctggcgatatttcacgcgccgaagtttttgcgctgcctttcgtggctatcttgctgctcatcgtgtttggctcagttgttgccgcggcgatgccattgatcgtgggcattttgtccatcttgggttcgctgggcatcttggcaattttggctggattcttccaggtcaacgtatttgcacaatctgttgtgacccttctgggcttgggtcttgccattgactatggcttattcatggtctctcgtttccgtgaggaaatggataagggcaccccggttgaacaggctgttgccaccactacggcgaccgcgggtaagactgtggtgttctctgcagcgatggtggctgtggcgctgtccgggttgtttgttttcccacaggctttcttgaagtcggtggcattcggtgcgatttccgcggttggccttgctgctttgatgtcggtgacggtgttgccgtcgctgttcagcatgttgggtaagaatatcgataagtggagtttgcgtcgcactgctcgaacagcgcgccgtttggaagacaccatttggtaccgcgtgccggcatgggcaatgcgccatgccaaggcagtgaccgtgggcgtcgtattgctcttgcttgctcttacagtgccgttgacgggcgtgaaattcggcggcatcaatgaaacgtatctgccaccagctaacgacacccgcgtcgcccaagagcgtttcgacgaggcgtttcccgccttccgcaccgagccggtcaagcttgtggtcaccggggcggacaacaaccagctgatcgatatctatgttcaggccaacgaagttgagggactgacagatcgtttcaccgcaggtgcgactaccgatgatggcaccacggtgttgtctactggtattcaggatcgttccctcaatgagcaggtagtggagcagcttcgcgctatttccgtccctgagggcgttgaggtgcagatcggtggcactccagccatggagatcgaatccattgaggcgctctttgaaaagctcctctggatggctctctacattgtgctggccactttcatcctcatggcattggtatttggttcggtgattttgccggcgaaggccatcatcatgaccattctgggtatgggtgccaccttgggtattctcaccttgatgttcgtcgatggcgtgggtgccagcgcattgaacttctcccctggcccactgatgagtccagtgctggtgctgatcatggctattatttacggactttccaccgactatgaggtgttcctggtatctcgcatggtggaggcccgcgataaaggcgaatccaccgacgacgccatcagatacggcactgcacacaccggatctatcatcaccgcggccgcactgatcatgattgtggtctgtggagcgtttggtttctctgagatcgtcatgatgaagtacatcgcgttcggcatgatcgcagcgctgattctggatgccaccatcatccgcatgctgcttgtccccgccgtgatgcacctgcttcgcgacgacaactggtgggcacccggcttcgttaaaaaggcctacaccgtcatgggtcacggctctgaggtggaggaagcacctcgcccaaccacccgtcgcctcaacgacgatgaggaagtcaccgtgcatgaagcagttgtcgctggcgataccgtggcatctcgcggtggtttgagcacgcaggaaaaccgtgatctggtgtccttcgtggaacttaaggctcgtttggaaaagcgcaggcttgaggatctagat

SEQ ID NO: 3162 - DNA, 1422 bp, Corynebacterium glutamicum
atgcacggtgacttcctcatcgtcgttgaggcgacgggtggttgggcgaggtgcttcctccacctcagagccgtgacccatgacggtgtaggcctttttaacgaagccgggtgcccaccagttgtcgtcgcgaagcaggtgcatcacggcggggacaagcagcatgcggatgatggtggcatccagaatcagcgctgcgatcatgccgaacgcgatgtacttcatcatgacgatctcagagaaaccaaacgctccacagaccacaatcatgatcagtgcggccgcggtgatgatagatccggtgtgtgcagtgccgtatctgatggcgtcgtcggtggattcgcctttatcgcgggcctccaccatgcgagataccaggaacacctcatagtcggtggaaagtccgtaaataatagccatgatcagcaccagcactggactcatcagtgggccaggggagaagttcaatgcgctggcacccacgccatcgacgaacatcaaggtgagaatacccaaggtggcacccatacccagaatggtcatgatgatggccttcgccggcaaaatcaccgaaccaaataccaatgccatgaggatgaaagtggccagcacaatgtagagagccatccagaggagcttttcaaagagcgcctcaatggattcgatctccatggctggagtgccaccgatctgcacctcaacgccctcagggacggaaatagcgcgaagctgctccactacctgctcattgagggaacgatcctgaataccagtagacaacaccgtggtgccatcatcggtagtcgcacctgcggtgaaacgatctgtcagtccctcaacttcgttggcctgaacatagatatcgatcagctggttgttgtccgccccggtgaccacaagcttgaccggctcggtgcggaaggcgggaaacgcctcgtcgaaacgctcttgggcgacgcgggtgtcgttagctggtggcagatacgtttcattgatgccgccgaatttcacgcccgtcaacggcactgtaagagcaagcaagagcaatacgacgcccacggtcactgccttggcatggcgcattgcccatgccggcacgcggtaccaaatggtgtcttccaaacggcgcgctgttcgagcagtgcgacgcaaactccacttatcgatattcttacccaacatgctgaacagcgacggcaacaccgtcaccgacatcaaagcagcaaggccaaccgcggaaatcgcaccgaatgccaccgacttcaagaaagcctgtgggaaaacaaacaacccggacagcgccacagccaccatcgctgcagagaacaccacagtcttacccgcggtcgccgtagtggtggcaacagcctgttcaaccggggtgcccttatccatttcctcacggaaacgagagaccatgaa

SEQ ID NO: 3163 - DNA, 1083 bp, Corynebacterium glutamicum
atgcgaggatttttcagcaacccctggattcgttgggctttgtccctggcgtttctaggggtgatcctatttttcctgagggatcagctggatttcctcaaaatgggcatccaacaaatccgccacgtcagccccgtaggcgttgccctcaccatggtggcgttggtgttgtcattcgttgcgatggccagagtcatgcagatcatgttgaaagccggaggtagtcctgcgactctcaaagccaccacggctttaacttttgcggctaactcctggtccgcgacccttcctggcggcccggcgttttccgcgattctcacctataaagtgcagcgcagctggggtgccagcgccgtgctgtgttcgtggtttttcctgctctccagtgccctatcgaccgtctggttggttgctctcggtgtcatcgccgtgttttatatgggcgcatcgctgaacttatggtcactgatcgccacattcatcgccatggtcgggctgtctggcgccgtttattgggcagccaacaaccccgactccttggctcggtgggtgcgaaaattgacgaaaaacagggagtggggcttcgtcgaaaagcttcttggaagcattgagcagctgcgctcggtctcgctcaccgggccgcaattcgcggccagcaccgcgtggtctttaggcaataggcttttcgacgccatctccctctggatttgcatctgggcggtcaccggcactgccccgatgtttgaaccagaacccaacaacaccaccatcgcaggcgtactgttggcgtacaccaccgcaaaaatcgcaggctcaatccaagccaccccaggcggaatcggccccatcgaagccgcctacatcgcagccctcgtagccaccggtatgaccgcagtggaagccgccggagctgtcataatctaccgtttatgctcatttatcatcatggcgattgtcggatgggtcatctattttatctatttcaccccccagggactcaaggccaatgaatccctggatgtggaacaggatacgattaactcagactctaaccgacagtccgcaattgaaaggccagatacg

SEQ ID NO: 3164 - DNA, 363 bp, Corynebacterium glutamicum
gtgaaccgctggatgtccttgctgtgtgattccatcgccatcggtctcttcgcactcttcgcccgcgtcgcccaccaaagcgccgacatgccactaaatgtgcagggctggtttttcacatggctgccattcctcgcaggtgtgttcatcgcctacctggtggcaatcctccctgcgaagcttcccagcgaacgcatccgccccgctggcctgaccgtgtggatactcgcggtaattgtgggacttgtgatttggggcttcaacaatggtggggttccacactggtccttcatgattgtcgcaacgaccgcctccgccattttggttctcggctggcgagcgttgtttaaggtgacaatgcgc

SEQ ID NO: 3165 - DNA, 1548 bp, Corynebacterium glutamicum
ttgagtaacaccactactgcagagaagctagcggatctgcgcgcacgcctggagattgccaaagacccaggtagtgaacgcgcacgtaaaaagcgcgacgaggaaggccgaaccacccctcgtcagcgtattgatgctctgcttgatgccggatcctttgtggagatcggcgcactaggccgtaccccggatgaacccgatgcgccttactctgacggtgtggtgactggttatggtcgcatcgatggtcgcccagtggccatctacgcccatgacaagaccgtttacggtggttccgtgggcatgactttcggacgtaaagtcagcgaagtcatggacatggctatccgcattggttgcccagttatcggtattcaggattccggcggagcccgcattcaggatgcggtgacctccttggcgatgtactcagagatcgcgcgtcgtcagcttccgctgtctggccgcagccctcagatttccatcatgctgggtaaatcggcaggtggcgcagtgtatgcacctgtgaccactgactttgttatcggcgttgatggtgaaacagaaatgtatgtcaccggcccagccgtgatcaaggaagtcaccggcgagcagatcacttccgcagacctcggtggcggtgcgcagcagatgcaaaacggcaacatttcctatttggcgtcctctgaagaagaggccctgaatatggtcaaggatttgctcgacttcctgcctttgacctgcaatgatccagcccctgtgtttgcagcaccaacggatgaagagatcgcctacgacgaagctctgaactcgttcatgcctgacgacactaaccagggctacgacatgcatgacctgctggacaagcttttcgacgacgccaacctgctggaaatccaagaggagtacgcccccaacctgatcactaccttcgcccgcgttgatggcaaggcagtcggtgtggtggccaaccaaccaatggataaggcaggctgcatcgacgctgacgccgccgacaagggcgcccgcttcatccgtatctgcgacgcctacaacatcccgatcatcttcgtcgtggacacccctggctacctgcctggcgtggaccaagagaaggtcggtttgattcaccgtggcgcaaagctagccttcgcagtggtggaatcgaccgtccctaagatttccttgatcgtgcgcaaggcctacggcggagcatatgccgtgatgggttccaagaacctcaccggtgacctcaacttcgcatggccaaccgcacagatcgccgtgatgggcgcagccgcagctgtcgtgatgatccagggcaagcagctcgaagccgccccacctgagcagcgtgaatacatgaagaaactgttcatggacttctacgatgagaacatgaccagcccatatgtggccgccgagcgtggttacatcgacgccatgatcgaacctgcagagacccgtttggtgcttcgccgagcagtccgccagctggaaaccaaggctgtgcgagacctcgacaagaagcacacgatcatgccgatg

SEQ ID NO: 3166 - DNA, 4830 bp, Corynebacterium glutamicum
atggaacagagccaatcgtcggatcagaagatgaccgttgaacaggttcgcacctggctccgtgattgggttgtccgcaccacgggtattccggtggaggaagttacggatgacaaggcaatggagacctttggcctttcctctcgcgatgttgttgtgttgtctggtgagctggaaaacctgctggacacctccttggatgccaccatcgcttatgagtacccaacgatccgtagtttggcgcagcgccttgttgagggcgagcctcgtcgtgcacatacccagcgtgaattgaatttctccgcggtgagcgattccccaggttcccacgatattgcggttgtcggtatggctgcgcgttacccaggcgctgagagcctggaggatatgtggaagctactcgtcgagggccgtgacggtatctcggatctaccgattggccgttggtctgagtatgcaggcgatgaggttatgtctcggaagatggaagagttttctaccatcggtggctacctgtcagatatctctagctttgatgcggagttctttggtctgtctccgctcgaggccgccaacatggatcctcagcagcgtattttgctggagctaacgtgggaggctttggagtacgctcgcatcgcaccaaacactttgcgtggcgaagccgtgggcgtgttcataggttcctccaacaacgattacggcatgatgatcgctgccgatccagcagaagcacatccttatgcgctgactggtacttctagtgcgattgtcgctaaccgcattaactacgctttcgatttccgcggtccttccgtcaacgtggataccgcatgttcttcttctctggtagcggttcaccaggctgtccgtgcgctgcgtaatggcgaagcggatcacgctatcgctggtggagtgaacattttggcatctccatttgtcacaactgcattcgctgagctcggtgtgatcagcccaaccggcaagatccacgcattctctgatgatgccgatggtttcgtgcgttccgacggcgccggagtcgttgtgctgaagcgcgtggatgacgcaatccgcgacggcgacaagatcatcggtgtgatcaagggttctgcagtgaactccgatggtcactccaacggactgaccgctccaaaccctgacgcacaggttgatgtgctgcagcgtgcatatgttgacgctcaggttgatcccaccaccgtggattacgttgaggctcacggcaccggcaccatcctgggtgaccccattgaagcaactgccctgggtgctgttttgggctatggccgtgacgcatccaccccaactcttctgggctctgcaaagtccaacttcggccacactgagtcagctgcgggtattgcaggtgtcatcaaggtgctgcttgctttgcagaacaagactctgccaccaaccgtgaactttgcaggtccaaaccgctacatcgatttcgatgctgagcgtttggaagttgtggaagatccacgtgaatggccggaatacaacggtcacgcagtagctggtgtgtctgcgttcgggttcggtggaaccaacgcgcacgtggtgatctctgagtacaacgcagaagactacgaaacccgtgccccgaaggaggcgttgcttcctgaccagcaggttgccctgccggtgtctggtcacctgccatccaggcgtcgacaagcagctgctgacttggcggacttcttggagggccgcaaagattgcgacctaaccccagtagcccgcgcgctggcaggccgcaatcatggccgctcccgcgcagtcgtgcttgcaagcactatcgaggaagccgtaaagcgcctgcgccaggtcgcagaaggcaaggtcagcgtcggtatctccgcagctgattccccagcggccaacggtcctgtgtttgtgtactccggtttcggatcccagcaccgcctcatgatcaaggaattgtgctcaatttcgccacagttccgcgagcgcatcgaagagctcgatgaaatggttaagttcgagtccggctggtccatcatgaaacttgttttggatgatgagcaaacttacgacaccgagaccgcgcaggttgtgatcaccgcaatccagatcgcactgactgacctgttggcaagcttcggtgtaaagccagctgccgtcatgggcatgtcgatgggtgagatcgctgccgcttacgctgccggtggactcagcgaccgcgataccatgctcattgccagccaccgttcccgcctaatgggcgagggcgagaagtccctggctgaggatcagctgggtgccatggctgtggtggaattcgccgctgcggacctggataagttcatcgaagaaaaccctgagtacaagggcattgagcctgctgtttatgcaggcccaggcatgactaccgtgggtggacctcgcgacgccgtggttcagttcgtagagaagctggaatctgaagacaagtttgcccgcctgctcaacgtcaagggcgctggccacacctctgctgtggaaccacttcttggtgagctcgctggcgaaatcgctggcatcgagccacttccgctgcagatcccgttgttcagctctgtcgatcagggtgttacctacccagttggagcagtggtccacgacgccgattacatgctccgctgtacccgccagtccgtgtacttccaggactccaccgaagctgcattcgctgcaggccacaacaccttggtggaaatttccccgaacccagttgcactcatgggcatgatgaacaccgcgttcaccgtgggcaagcctgatgcacagctgctgttcagcctgaagcgaaaagtcccagaggcagaatccctccgcgaccttctggcgaagctgtacgtcaacggcgcaaacgttgatttctccgcgctgtacggcgaaggtgaaaccatcgatccgccacacatcacctggaagcaccagcgcttctggacttccgcacgcccatcctctggcgcatccctggatctgccgggcttccgcgtgaatctgccaaacaacactgtggcgttttccaccgcagccgaactggcaccatccgcagtggcaatcatggaagcagccgccatggctgtcaccccaggttcctccgtcgacgcagtggacgagcgcgacatgctgccaccaagcggcgaaatcaccaccatcgtgactcgctccttgggcggtttgagcctgtccgtatacaagattgagggaaccaccagcactcttgtcgccgaaggtttcgcagccaacccaggattcgccgcagcatcttccttcgacggtccaggctacgacggattcaacaccgattacagcgaccagccagaccctcgctccgacctgcctttggacatcgaagcagtccgctgggacccagcgaccgaaaccgtcgaagagcgcatgcgcgccatcgtctccgaagcaatgggctacgacgtggatgacctcccacgcgaactcccactgattgacctcggcctcgactccctcatgggcatgcgcatcaaaaaccgcatcgaaaatgacttccagatcccaccactccaggtccaagcgctccgcgatgcatccgtcgctgacgtggtaatcatggtggaaaacatggtcgctggccgctcctctgagacgcttgtcgacgccaccccgcaggtgccagctgaggcagcaggggaggctcaagctgctgagtcttctgcttcgggcgaggacgtgcagggcgttggcgttgcaccgcgagatgcgtcggaacgcatggtctttggtacttgggcaggcctgactggcgctgcggcagctggcgtgaccagcaagttgccacagatcgatgtcgatactgcaaccgcaattgccgagcgcctcaccgagcgttccggaattgaaatcagcactgaacaggtgttggctgcagaaaccctcgaaccactgtctgacctggtgcgtgaaggcctcgaaactgaagttcagggcaacattcgtgtgctgcgtggacgtgcagaaggctccaccaagcctgcagtgttcatgttccacccagctggcggttcttccgtggtctaccaaccactaatgcgtcgtctgcctgaagatgtccctgtctatggcgttgagcgtctggaaggcgatctcgctgaccgcgcggcagcatatgttgatgacatcaagaagtactccgatggcttcccagtagttttgggtggctggagcttcggcggtgccgttgccttcgaggttgcccaccaactggttggctccgatgttgaggtagctaccgtggcgttgctggatactgtgcagccttcaaacccagcaccagataccgctgaggaaactcgtgcacgctggactcgctacgcggacttcgccaagaagacctacggccttgatttcgaggtaccttttgaaatcttggacaccatcggtgaagacggaatgctgtccatgatgaccgacttcctggccaacaccgacgcctccgagcacggattgtccgcaggtgtgcttgaacaccagcgcgcttcttttgtggacaaccgcatcctggctaaacttaattttgcagactgggccaacgttgaagcccctgtcatcctgttccgcgcggaacgcatgcatgatggagctatcgaacttgaaccaaactatgccaagattgatcaagatggaggatggtccggaattgtcaacgatttggaaattgttcagctgaatggtgaccacctggcagttgtcgatgaaccagaaatcggcacagtcggagctcatttgagtcgccgcattgatgagatttctcggaagaat

SEQ ID NO: 3167 - DNA, 1788 bp, Corynebacterium glutamicum
ttggcagccatgggtgagttcatgtaccaggctgacatcgctgaaggcggcggggataaaccacgcatgcatttctgggacttctccgaagaccgcgatggcaagctgattcagtacacccgaaacgagatcgatactcgtatcaaggctgtagcaggccgtttgcagcaggtcgccaccctgggtgatcgtgcagcgatcctggctaacaacagccctgagtacattttcagcttcctcggcgcgatctacgctggcatggtccctgtgccgctttatgatccaaacgagccaggacacgcagaccacctcaacgctgttttcgcagacagcgagccagttgtcgttctgaccaactccaagtccgcaggtgccgtgcgcaagcacttctccagccttccagctgcagaacgcccacgcatcctctctgtagattccttgcctgattctctcgcggattcttacgagaacccaatgctgaccgaagccggccgccgcctggctgctctgcgccagtccgcgcccattgatctgaccgcattcctgcagtacacctccggctccacccgaaccccagctggcgttgttctgaccaaccgctccatcctgaccaacgtcttgcagatcttcagcgccgcacagctgaaaaccccactgcgcctggtttcatggctgccactgcaccacgacatgggcattatcctcgcggcgtttgtcactatgcttggcctggacaacgagttcatgaacccacgcgatttcgtgcagcagccttcccgctggattaagcagctcaaccgtcgcgaaagcgacgtggacgttaacgtctacaccgtggttcctaacttcgccctcgagcttgcagcacgctacgcaaagccagcagagggagagaccctggatctttccgcattggatgccatcattatcggttccgagccagtcacagaaaacgctctgaccaccttccgtgaagctttcgagccttacggcctgcctgttcagaccctgcgtccttcctacggtcttgcagaagcatccctgctggtcaccaccccacagaccgaaaaccgcccactgatctcctacttcgaccgcgaggccttggccgaaaaccgcgttgagcttgtagaaaagggcaataacaaggctgttgctttcgtctccaacggccaggttgcagccccacagcagctggtcatcgttgattccgaaaccggaaccgagctggcagacggccagatcggcgaaatctggacccacggcgaaaacactgctgcaggttacctcgaccgcgaggaagacaccgcagaaaccttccgcaaccgtctgaccacccgcctggaagaaaactcccgcgcagaaggtgctgccgacgacaactactggatggccaccggtgacctcggcgtcatcgtagacaacgagctctacatcaccggtcgtctgaaggacctcatcgttgtcgcaggccgaaaccactacccacaggacatcgagtacaccgtccaggctgcttccgcacacatccgtgcagattccgtcgcagcattcgcagtcccaggcgatgacattgaaaagctcatcatcctggcagaacgcgacaccactgcaaacgaagccgacgatgcagctgctgaagaagcaatccgctccgccgttggcactgcacacggtgttgttccagaagagatccgtatcctcgcacctgacgagatcgcgcgttcctcctccggaaagatcgcacgccgcgtcaaccagcgcaactacattcaggaacaagctaac

SEQ ID NO: 3168 - DNA, 927 bp, Corynebacterium glutamicum
atgaggaaaaccatcaccgttattgctgtattgatcgtcctcgccttaatcggcgtgggcatcgtgcagtatgtgaacacatccgatgactcagatttcattggccagcctggcgagccaaccggtaccgaaaccacggaaccaccggttcaacctgattggtgccctgcggtagaagtcattgccgcgccgggtacgtgggagtcggctgctaatgatgatccgatcaacccgaccgctaatccgctgtcattcatgttgagcatcactcagccactgcaggagcgttattctgcggatgacgtcaaggtgtggacgctgccgtacactgcgcagttccgcaacatcaactcgcaaaatgagatgtcctatgatgattcgcgcaatgaaggcaccgcgaagatgaatgaggaactgatcaacactcacaatgagtgccctgccacggagttcatcatcgttggtttctcccagggtgcggtcattgcgggcgatgtggctgctcagatcggttcagagcaaggtgttattccagctgacagcgtcaggggtgtcgccctgatcgctgacggtcgccgggagcctggtgtgggccagttcccaggcacgtttgtggatggcatcggcgcggaggttactctgcagcctttgaacttgctggtgcagccgattgttccgggcgcaaccatgcgtggcgggcgcgcgggcggtttcggtgtgctcaacgaccgggtgcaggatatttgtgctccaaatgatgcgatctgtgatgctccggtgaatgtcggcaacgcccttgatcgtgcgttggccatggtctccgccaacggtgtgcacgcgctctacgccaccaatccggatgttttcccaggcacaaccaccaatgcgtgggttgtggattgggcgaccaacctcatcgacaacgga

SEQ ID NO: 3169 - DNA, 498 bp, Corynebacterium glutamicum
gtgaagcgcatctacgcaactctcgcttccggacttttgtgcctgagccttgctgcttgtgggggagtcactgttgaaggagatgattctccctcgacaacggcagccccaacagaaagcagcgctgggtcaagcagcaccgcaaggtcgaccgaacgcagcagtcaggcgtcgcaaagcaatggaagcggcggaagcacagcccgggacggggcagccgaggaaatcgacggcctgcccgaggtgaccgtggaacgcagcgctgaggcgcaagcgttcctggatgcgctgaaagatgaaaaaatcgacatctccggcgtggaggaccagttgattgcgactgcgcgaaattactgcagttcggaaaacaaggaccaaaacgtcactgtcgatgcggttgcaggccagctcatcgtgcagggacgcaccagcgtgaaggaagatcaagcagcggaaatttctacgctgctgaaggaatctgcggatcggacgtattgt

SEQ ID NO: 3170 - DNA, 1971 bp, Corynebacterium glutamicum
atgcgcgacaccgcatttcgttccatcaaggctaaagctcaggctaagcgccgttccctctggattgcagcaggcgctgtcccaaccgcaattgcgttgactatgtccctggcacctatggcttcggctcagtccagcaacctttcctctgatgccgttattggcagcatcgcgcagggcgtcaccgatggcctgactgactacctgaagcctcgcgtcgaagagcttcctgctggtgaagtcacctacccagagatcgccgggctgcctgatggtgtgcgcgtgatcagcgctgagtgggcaacctccaagcatgtcattttgactattcagtctgcagcaatgccagagcgcccaatcaaggtgcagctgctgcttccgcgtgactggtactcttccccgaaccgtgagttccctgaaatctgggcacttgacggtctgcgcgcgattgaagagcagagtggttggaccattgagaccaacattgagcagtactacgccgataagaacgccattgttgtgctccctgtcggtggcgagagctccttctactctgactgggaagggccaaacaacggcaagaactaccagtgggagaccttcctgactcaggagctcgcaccgatcctggacaagggtttccgttctaacaccgatcgcgccatcaccggtatctccatgggcggtaccgctgcggttaacatcgcaacccaccacccagacatgtttaagttcgtcggttccttctccggctatctggacaccacctccgctggcatgccaatcgctatttccgcagccctggcagacgccggcggatacgatgccaacgcaatgtggggaccagtcggttctgagcgctggcaggaaaacgatccaaagagcaacgtagacaagctcaagggcaagaccatctacgtttcctctggtaacggtgcagatgacttcggtaaggaaggctctgtagctattggacctgcaaacgcagcaggtgtcggtctggaagttatctcccgtatgacttcccagaccttcgtcgatcgtgcaagccaggctggcgtggaagttgttgctagcttccgtccatccggcgtgcactcatgggaatactggcagttcgagatgactcaggcgttccctcacatcgctaacgctcttggcatgtccactgaggaccgtggcgttgagtgtgcacctgtcggcgcaatcgctgacgctgttgcggatggcgcgatgggcacctgcctgaccaacgaatacgatgttaccggcggtaaggcccaggacttcgctaacggtcgcgcatactggtctgcaaacactggcgctttcggcctggttggacgcatcaacgctcgttactctgagctgggtggacctgcctcctggttgggctacccaacctcttctgagttgaagacaccagacggacgtggccgcttcgtcaccttcgagcacggctccatctactggaccgccaccactggtccttgggaaatcccaggcgatatgctcgccgcatggggcacccaggactatgagaagggcagcctcggctacccaaccggcgctgcagttgaatacaacggtggcctgcgccagcagttcgaaggtggctacgtattccgtacctccaataaccagtcttactgggttcgcggagaaatctccaagaagtacgccgaagacggaatcttcgctcagcttggtttcccaaccggcaatgagaagttgatcaacggtggcgctttccaggaattcgaaaagggcaacatctactggtccgcatccactggcgcgcacgtgattctgcacggcgacatcttcgacgcatggggtgctaagggctgggagcagggcgaatacggcttcccaacctctgaccagaccgcaatcaccgcgggtggacagaccattgatttccagaacggcaccatccgtcaggtcaatggccgaattgaggagtctcgc

SEQ ID NO: 3171 - DNA, 1401 bp, Corynebacterium glutamicum
gtggaaaacagaaaaggaggggaaaacaaaatgcaagaaatccacaccatcatgaaacacatggacgcgctcatcgccgacccgtccgccgccgcattcaaagcaacactccccttcgccgaactcctcgaaaagctccacaacaaaaaagcgcttttcgacgccgccctcgccaaatccgccgagcgcgccgatgccggacgcatcatcggaaaaacctcccacatcgatgccctcgcgtaccttctcgacatctccaaatccgaagcattccgacgcacaaaacgcgccgaagaacactacggcaacccaagcccggaacccagttcagaagaactcgcgaaagaaacccccgaagagaagctagccagagaagaaaaagagaaacaagacctagccgaacaagcagaagccaaccgcatcgcccgcgaacacggcatctccgccgaaaaacaagacaccatccgctacgaactagaaaaactcaacgacaacacatccctatcccgagcctcactccgcaaactagcaatgcaggaagccaccagccgaacccccgaagacctacgcaactggacccgcaacaaagttatccgcataaaccccaccgccaaagacccactcgccgcagtaaagaaacgctccttaagcatcggacgccaagaccacgacggcggagccaaagcatccctctatttagatgccaaaggtctagccctgctcaaatcactgatgtctaaagccaagccggggcatttgcttgaagactctttggcggaggataaacgtacgaaaccgcaacgccaatacgatgccttcgccgacatcctccaccgcgcacacagcgatctcctccccgcacgatccggagtgggcaccatcctcgtctccctctccgccaaagacgtaacaaacctcaaagcatcgggccccgaccaccgctaccccaccagcaccggcataaaactcacaccgcttgagatcctgcgactcggtgcagccaaatatgacttcgtgaccgtcctcgactccgaatccggccgtccgctgcacctggcacgcactcaacgcaccgccagcctgtatcaacgcctagccctcttcgcctccgaactcgtctgcacccgcgaaggctgcgactcccccttcgaagacaacgaaatacaccacatcagatcctggctagacggcggccccacagacatagaaaacatcaccaacatctgcccccacgaccacggaaacaacaacgaccaacgcgacggcaaagacaacatggggcacatgaacatagatcccacaaccgggcgcgtcggatatcaacccgccgaccgccgaaaacccatgcggtttaacaacaccgcagccgcagcagaatcaggaggagcacaggccaggacc

SEQ ID NO: 3172 - DNA, 219 bp, Corynebacterium glutamicum
ttgttttcccctccttttctgttttccacacaaccgaagcttcaaggggaaaacaagggccttaaaagttatccacagatccgaagtgatccgcgccctggggtgaaaagttatccacaggaagcggaggggcggattgaaaaattcagcgaaatgcgaaaaggtggaggggaaatgctgcgagtcttgcggattcccggcgtggcattgaaaaaagtc

SEQ ID NO: 3173 - DNA, 1023 bp, Corynebacterium glutamicum
atgtccgtatttacacgagctggcgaggcaagccgtaagctcgtcgcccttgtagtggctcttgccaccgcggcagccctcatggttgttggacaaggcaccgcacaagctgcaaaccgtgactggttgcgcgcagataactctggttactgtgactgggatgctgtgggcttctgggttcagcgctgtgatgtttggtcgcctgcaatgggccgcaacattcctgtccagatccagcctgcagggcgtggcggaaacgctggcctgtacctgctcgatggtatgcgcgctactgagtactcaaacgcatggctcgtggataccaacgctgcgcgcctctacgcaccaaacaacatcaccctcgtgatgccagttggtggcgcaggttccttctatgctgactggaactcccaggcatctctttcctcctccgatcctgtcatctacatgtgggagactttccttacccaggaattgcctgcataccttgagcagaacttcggcgttgcgcgaaacaacaactccattggtggcctgtccatgggcggaactgccgcgctgaacctcgcagcaaagcacccagatcagttccgccaggctatgtcttggtccggctacttgaacaccactgcaccaggcatgcaaaccctgctgcgtctggccatgctggacaccggtggattcaacgtcaacgcaatgtatggctcaatcattaacccacgtcgttttgaaaacgacccattctggaacatgggcggcttggctaacaccgacgtctacatctctgcagcttccggcctgtggagccctcaggatgatggagttcgcgtagaccaccgcctcactggttctgtgcttgaattcgtggcaatgacatccaccaggatttgggaagcaaaggcaaggcttcagggtctgaacccaactgcggattacccaatgtatggcattcacggctgggctcagttcaactcccagctggagagaactcagggtcgtgttctagacgtcatgaacgcctgg

SEQ ID NO: 3174 - DNA, 2058 bp, Corynebacterium glutamicum
atgacgtttagcccccagcgtccggagtttgagaccggtaagcagccagatccagaaactgaacacgcaggtgacttctttgaagaaacctcaagcagtgctcctcgcgccgcatctaacggttcttctggtccgaactacaccctcattacaacgtttctagcggcccttactgctggcatctttgctttctgggcaggctggacccgcaaatggatcagcgacgacggactgatcgtcctacgcaccgtccgaaacctcctggctggaaacgggccagtattcaacgctggcgaacgcgtcgaagccaacacatctactctgtggcaatactgcatctatctggttgccttagtaactgactatcgcctcgaagatattgctctgtggcttgcgctgctgttcaccaccgcagcgtccatcatcggtgtcctgggtaccgcgcatctccaccgcaaacgcattgccgtattgcttcctgcaggcgtgatcggctacttcagcctttccccggcgcgagactttgccacttccggattggagtggggcctatctttgatgtggatttccatccaatggctgctgctggtgttgtgggcgacttcgggcaagacctcgggcaagaaggcttcgggcgcaaaaacttcaaatcctatcgttaatgccggtgcaataacctatgctttggccttttggtcaggcttgagctggctggttcgcccagaactggcgatgtatggcggtttgactggagtgttgctgctgcttactgcgccacgatggcgggtagttttggggatcctggtggcggctttgcctcttccagctgcgtaccaaatcttccgcatgggttattacgggctgatggtgccgcacacggctgtagcgaaatcagcctcagatgcggtgtgggggactggttgggaatatgttgaggatttcacggggccttacaacctgtggctcggtttggccttgctgttggccgcaggcgcgttgacagtgtggaaaactgacaagcacttagcgataccgaaggggcggctggggctgcgcactccgggtatggctatagcgttgctggttatctgtgcgctcgtccacttcctttacgttatccgtgttggtggcgacttcatgcatggacgcatgctgctccttccactttttgccattctgctgcctgtttctgtcattccggtcaatgttgttgatcgaggttggcaggatttggttgcgctggttctcgttttctctacgtgggtgtggtccactgtggtttttgtgcaggggcaccaatgggaaaataccggccagcatgtggttgatgagcgtgatttttggattgatttcaccaaccgagatgaagatcatcctccgctttatgcagaggatttcctcactgttgattccatgaatgattacgcagaggttatgcgcgatcagacgttggttaatccaacaggccagcaactcaatattctggccagcagtgacccgaccacttattcgtggatcaccacacctcgcgtggagggggttgaagccggtgatttggctaacctctcgccaactgttttccatgtgaacctcggcatgacctccatgaacgcaccgctcaacgtgcgtgtgacagacctgattggtttggcaacgccactggcagcccgccagccacgcattgaaggtggtcgaatcggccacgataaattgatggacttggaatggcaggtcgcggaatccgccactccgctggcgtacacaccgggttggttggatactcaaaagacttatgaggcccgccaggcgctacgccacccagaattggttcaccttttccagacttaccgtgagccaatgtcctaccaccggtttgtggacaatattaaatacgcactcactaccggaagaacactggaaatttcagataatcctgaagatcttttgaaagaatttaacccgacccctgcagagattcaggacgggttagaaactattgcttggcctggggaaattaaacttgatgaacctcgcggagaacctttatatagctctcag

SEQ ID NO: 3175 - DNA, 996 bp, Corynebacterium glutamicum
gtgagcgaacacgccgctgaacatcaccgcgatacccaaaatttcttaacctccgaaccgcacaccacggcaatcgaagacaacaagaagcgccaaccgccgaaaaaccttgctgacggcatgatcaaggcgctgcgccccaagcagtgggtcaagaacgttcttgtgctagcagcaccacttgctgctggtgcagatgcgatcttcaaccagcgcacgatcatcgacgttgctatcgcattcgtagtgttctgcttcggtgcatcagccatttacttggttaatgatgcccgtgacgtggaagctgaccgcgagcacccaaccaagcgtttccgccccatcgctgcaggagtcctgccagtaggaatggcatacggcatggccgtggcgctcattgcactatccatcggactgtctttcctcgccaccgacggcgtggcacttgcctgcgtgattggcgtgtacattgcgctgcagctgggatactgcttcggttggaagcacatgccagtgatcgatattgcgcttgtctcctccggattcatgctccgcgcaatggcaggtggtgtcgcagcaggcatcgagctatcccagtggttcctgctagtcgctgcgtttggttccctgttcatggcatctggaaagcgctacgcagaaatccttctgcacgagcgcaccggcgctaagatccgcaagtccctggaaagctacacccccacctacctgcgcttcgtttggaccatggcagcaacagcagtggtcatgtcctacgcactgtggggcttcgacctttcccaacactccaccgacgcaggtccgtggtaccaaatctccatggttccattcaccatcgccatcctgcgctacgcagccggcgtagacaccggcgacggcggtgcccctgacgaagtggcactcagcgacaaagttctgcaggtactagccctagcatgggttttctgcatcgtgatggctgtgtacatcatgccgatgttt

SEQ ID NO: 3176 - DNA, 504 bp, Corynebacterium glutamicum
atgagcaataaggaagtacagattctggtagcaatccaggatcaactcatggatgccccaggagtactgcccaccgcacgaggactcagcctgctcggcgaacatgctgcaggctggctggcactcggcgctggcggtgctgttgtggacaaaaaacgtcgccgctcctgggctggactcttcatcgctgcactgggaagccacgcagcatcagtgatcatcaaacgagttgtccgccgcgctcggccacatgacccagccatcaggattggtgtgggcaccccctcaaagctaagctttccttcttcacatgcgacctcgacaaccgcaactatggtttatcttgcgcgcatcaccaagtcaccagtgccactgctaggaatccccatcatggtgctatcacgcatggtgcttggcgtgcattacccaaccgatgtgctagccggcgcgttgttgggagcagcgaccgcagaggccgtccataagatcgaaagggctacgaag

SEQ ID NO: 3177 - DNA, 1968 bp, Corynebacterium glutamicum
atgagcgcaacaaacctggcggttgagcagctacagcgagtgctcctgccgaggcgcggcgagccagcagatgtcaggtcgttgtacctgttggaagcagaaagtaataaggaacgcctggaatgggaagatcgttttagcgtttccgtccccgctggcgccgaggtgtcttttcagacctacttcaatgcatttcctgcaagctactggcgtcgctggtcacagctagattctgtcgtactgaaactgaaagtttccggcgaagcgcgcgtcgacctctaccgatccaagatcgatggagcacgcatcggaattaccggttccgtagtcaaagatgacttcatcgaatttgaagtttcattagccccattcgaagacggcggctggatctggttcgacctcaccgctgaaaccgacgcaaccgtcgaagaagcaggctggtacgctccacacgcgccaaaagcccagatcatgccagatggatctgaagtcggcccatttgaagcccgtgcaaccgtcggaatcccgaccttcaaccgcccagctgatgcagttgcagcactggaagcacttgcctccgacccagcagttgacgccgtcattgataccgtcatcatgcctgatcaaggcaacaagcaccctgccgacgagccaggttacaaggcagctgttgagcacttcggcgaccgcttcttcgaattccgccagggcaacctcggcggatccggcggttactcccgcatcatgttcgaagcccttggcggagtcgacggcaagggcgaagcaggcgctgccaagagcccatacatcctgtacatggatgacgacattgctattgagccagactcagtgctgcgtgcgcttcaggtagcccgctacgcaaaatcccccatcctcgttggcggacaaatgctcaacctgcaagagcgcagccaccttcacaccatgggcgaagtagttggcggacacgacttcatgtggaccgccgcaccacacgtgcactacgaccacgacttctctgcacacccactacatgatcgcggtaaattcgacgacaagccagacgcaccaaactcccgcgacctgcaccgccgcatcgacgttgacttcaacggctggtggatgtgcatgatcccacgcgttgtcgccgaacagatcggccaaccactcccactctttatcaagtgggacgacgccgaatacggtctacgcgcacgcaaagctggattccccacagcaacctggccaggaatcgcaatctggcacatggcctggtccgacaaagacgacgccatcgactggcaggcctacttccacctccgcaaccgcctcgtggttgccgcgatgtaccaccaaggcagcgtcgacggcattgtccgatcgatgcaaaaagccaccttcaagcacctgctgtgcctggaatactccaccgtggcaatccaaaacgaagcaatgaaggacttccttgcaggaccagatcagctcttctcgatcctggacacctcactacctcgaattgcagcgattcgcaaaacctatccagacgccgttgtgctgccaagcgccaccgaactgccacgagcaaccggcgcgccgggtgtcccaaccaaggacatcggtggacgcctggccccaatcaagaaggcaatgtggctggctaagggcctgaagcactccctgtctaaggaagatgcctcccaccacgaggtgccacaggccaacttcgcaccaatcgaagcacgttggttcagcctgtcccgagtcgatggcgcaacagttaccaccgcggatggccgcggcgtggtctaccgcaagcgcgaccgcgacaaagctaaagaacttggcaaagaagcacgcgcactgcaaaagcaagtagcagagcgtttcgacgaactcagtcgcgcctaccgcaacgctcatcctgagcttgtgagccgtgaagcctggggaaaggtcttcgatgagcaa

SEQ ID NO: 3178 - DNA, 1494 bp, Corynebacterium glutamicum
ttgcttttcgacgcaccgttcggccgttatctagatctggtcacaatgtcggtttttcatggattcatgtcctttatcggacgtactgtggggagtatgcaaccttttccactgtccttaaccaacagctccgtcgctggtattgcagcgggagcgttgctgtttctctccgtccctttcgcatcgcctgttcacgcgcaaaccatactgcaagacacccttgaagtgactgtgttggataatgccgacgagctcgctccagaggatgaggatttcctcagcacggaaacacccaagattgatttccctgactcagttaccgcagtccggtacatcacgctcacggacaacactgacaaaatcaatgatgacgttgaaaattacctgcgcgccgaacaccccgagtggatccaaacaaactctttcgcccctggtgaagtgatcatcgcagtcggtttcgaccccaacaccatgggtgcctacgcgggtaacgatgtggccgcagagactgggatcgcagaacaagaccgcatcgacggcaccaccgatgcgatgcgcccattactccaagacggtcgcattgccctaggcatgttggagggtgcaaaatcggttgctgatacctctgtcgttcgggaaagctcagctccaagtggtggagtaatcgccgctattttgggtggcatcgctgctctcgtggcaattattgtcgcgtgggctacgagttacgcgaataagaagaaggcagaaaaggctcgtgagcagtttgattatgcatcacgccattatggtgaggtcgcccagcaactcgacggtatcaacgtgcgagcgcactcgctaacttccccactggctgatgatgagctccgcaggcaatgggacgatgtaaattctcgttttcttgaagtcaatgatatttttggcaggctcgaaggtttgacctcgacctcagaaaacaaggcatttcgaaaagccttgccagatattgaaaaagctcatactgccgtgactcaaatggagatcgcacagaaaaacattgacacgctctacgatatggagcacggccatgaagacacccgtcgcagggaattaactaggctgcgtgccgatatgcaggaagcccgtcaagatatcaacgataaagatgcagttgttgacgatattctccgcacgctgatccagcgcacggaaactatcgcaccgtccgcacctgatttcatggaccaatacgcccgcttgatccgtgattatgccgtggcgcttcaaggtgtggaaaagaacctcgagcaggttaaacagaccaccgagcgcaatgctccagccatctacgacgacaattggcgcgtgggcactggctacaactcgtgggtcccgtactacatgatcagttcttggcacgcagctgatgtcagtgctgcatcgtcagcttcttccagttcagcaaataccactttcagcagtggtttcagcggcgctggaggaggttccagctgg

SEQ ID NO: 3179 - DNA, 477 bp, Corynebacterium glutamicum
atggatcagctaatcctcgacgcatttatcggcttgagagtgacttggctgagtccggtgattattttgttcacccagctcaccgggccaacactgatgtttgtgtatgcgcttgtgtggggcttgttgcgcaagagcgccactgccccgatcgcggtggggctggctaatctgatcagtcattttctcaagagggcgtttgaacggcctcgaccaaatacagcagagcacttggttgtagaaactaacttttcattcccttctggtcatgctgtgggcgctgcagcatgtgccgtggcagtggggtactccgtgaaccggtggtggaaactcacgctgtgggtaatcgcgctgcttgtggggctgtctcggttgtatgtcggtgtgcattggcccagcgatgtgcttgccggctgggccatcggtgcgttgacttcagtggtggtgtttaccagctggaacctcctccagcgccgc

SEQ ID NO: 3180 - DNA, 777 bp, Corynebacterium glutamicum
ttgagggtgcccccgtttgtaattcttgcaaagtgggtattgtgcactttttgcgaggatctatcgaatgaattggcaaaacataactttgggaaagtaccccctatgacggaaaactggatggatcctgtggttgaaccacagtcaacgggagaggggaaatcggacactatatggttggagatcgtgacaactgaccaaaacaaaagaagtctcagtgagcttgcggccagaatcgttagtgaaatctgtgcaccgtgggtactcaacatcggatttttcctcatcctgggcggcgtaacaggcgcctggacgctaggaattgtggcggcaatcggaaccggaatcgttccgatgatcttaattttgggcttgatgaagctcggcagggtaggaaaccaccatgtgacgacccgaaatcagcgcggccttgtgtttgtgggcatcattgtttgtgtcatcattttgatttttatcctcagagcccttgaagcacctcagctgatttgggatggcatgttctcagcactgattttcttagttctgtttgcacaagtgacgttgaaaattaaagcctcagttcatgttgggctgtgggtgtgtttagtgatgttcctcggtctgacggtttcttcgtggtggttactcgggttgctgtttaccccagtcaccgcgtgggcacgtatgcggatcaagcatcatacgatgtcggagattgtggcgggcgttgttacaggagcagttgcaaccggcatttgttatgcactcctacttgcg

SEQ ID NO: 3181 - DNA, 510 bp, Corynebacterium glutamicum
ttgcggtcagtccaatttcgggtgtcctcattttgtccatggacgacgcccatctcacggttgcgccccttgggctctgggtgctccaggagctcacgagctgaggtgagtagcgtccacgccttgccattacgaaggcggacaatgcccgtgcacttgaagtctgcggattcgcaggagaaatgtacgcgagtgacaccatctccttcatcagctggttcgccctttagctcaacgtttcggaagatgcttgatggccacgtattgcgaatcatctcggcgatttcatctgcaccttcagcggtggtgaggttccacgtgaatgcaagaaggtctcgccagtatccttcatcctcaaaaagttgcacgactgcagtggcagcttcatcagggctggaactagcagtggccttttcaaaagcttggagccaatcattggccaaggtggttaagtcttgttcgggcaaagcatcctcctttaaaaagtgtcgtgactcactttctactcta

SEQ ID NO: 3182 - DNA, 1302 bp, Corynebacterium glutamicum
ttgggtgtcaccgagcagccatacaccctcatcatcggtggtggacagggtggcattgccttgggcgcacgactcaagcgacttggtgtacccgctctaatcattgataaagcatctcgcccgggcgaccagtggcgtagccgttaccattctctctgcctgcacgatccagtttggtacgaccacctgccttacattccattcccagatcattggccagtatttactccaaaggacaagatgggtgactggctcgagcactatgtcggcatcatggatttggactattggaccaacaccgagtgcctgcgcgcctcatacaatgaggacaccaagcagtgggatgtgacggtcaatcgtgatggcgcggagtccacgctccaccccacccaactagtcatggctactggaatgtcgggcagcccgaacaaaccaactttgcctggccaggataagttccagggtgaaattcggcactcttcagagcaccccggcggcgatgtcgatcgcgataagaacgttgtagttctgggcgctaacaactcagcccacgacatctgcgcggatctttattccaatggtgcaaagcccgtgatgattcagcgctcgtctacacacatcgtgcgttctgattcgctgatgcgcgaagtcttcgggcctctctattctgaggatgccgttgaagccggaattgataccgatactgccgatctcctgtttgcgtcgtggccatataaggtgctgccaggtgtgcagaagcaggctttcgacaagatccgtgaggacgacaaggagttctacgacaagcttgaaaatgctggattcttgcttgatttcggcgatgacgattcggggcttttcttaaagtaccttcgccgtggctctggctactacatcgatgtcggcgcctctgaactggtggctgatggaaagattccggtgcgctccaatgtcagcattgaagacgtcaaggaaaactctgtggtgctcacagatggtactgagctcccagctgacgtgattgttctagcgaccggctatggaaacatgaacaactgggttgctcagctggttgatcaggaaaccgctgacaaggtcggcccatgctggggtctgggctctgaaaccaccaaggatccaggcccatgggaaggcgagttgcgcaatatgtggaagcccacaaacgtggattcgctgtggttccatggtggcaaccttcaccagtcacgccattactcacggtatttgtccatgcagttgaaggcgcgctacgaaggtatgaacactccggtgtacagcaag

SEQ ID NO: 3183 - DNA, 612 bp, Corynebacterium glutamicum
atgctctgccatcttttccaaccatgccgcgtagccgtctgtgggaaggccttcgtaggtgtcgttgaaatagcggttgttgaagttgtagcgaactggcaggcgggtgatgttgccggctgggaggttctttggatcagtctgccactgctttgcggtgtagtcgcggatgaatgcctcgtaaagtgggcgaccaatgagggaaatggccttttcttcgaggttggtggcgtcggaggaatcgatttctgcagactgttccttgatgagctcacgggcttcatctgggctgtagtacttgccgaagaactggttaatcaggcccagtcccatggggaattggtaggcggtgccgttgtgcattgcgaagacgcggtgctggtagccggtgaaactggtgaactggttgacgtattcccacacgcgtgtgttggaggtgtggaagaggtgcgcgccgtatttgtggatttcaatgccggtctctggttctgcttcagagtaagcattgccaccgaggtgcgagcggcgttcaacgatgaggactttcttacccagctggctagctgcacgctcagccacggtgagcccgaagaggccggagcctacaacgat

SEQ ID NO: 3184 - DNA, 1203 bp, Corynebacterium glutamicum
atgacggaatcgaaaaattacgacttaatcgttgtaggctccggcctcttcgggctcaccgtggctgagcgtgcagctagccagctgggtaagaaagtcctcatcgttgaacgccgctcgcacctcggtggcaatgcttactctgaagcagaaccagagaccggcattgaaatccacaaatacggcgcgcacctcttccacacctccaacacacgcgtgtgggaatacgtcaaccagttcaccagtttcaccggctaccagcaccgcgtcttcgcaatgcacaacggcaccgcctaccaattccccatgggactgggcctgattaaccagttcttcggcaagtactacagcccagatgaagcccgtgagctcatcaaggaacagtctgcagaaatcgattcctccgacgccaccaacctcgaagaaaaggccatttccctcattggtcgcccactttacgaggcattcatccgcgactacaccgcaaagcagtggcagactgatccaaagaacctcccagccggcaacatcacccgcctgccagttcgctacaacttcaacaaccgctatttcaacgacacctacgaaggccttcccacagacggctacgcggcatggttggaaaagatggcagagcatgagcttatcgacgtccgcctcgacaccgactggttcgacgttcgcgatgacctccgcgcaagcaaccccgacgcacctgtggtctacaccggcccactcgacctctacttcaactacgcagagggcaagctgggatggcgcaccctcgactttgaaaccgaagtagtagaaaccggtgacttccaaggaaccccagtgatgaactacaacgatgcggacgtacctttcacccgcatccacgagttccgtcacttccacccagagcgtgatgacagttaccccaaggataagaccgtcatcatgcgcgagttctcccgtttcgcagataacgaggatgagccttattacccaatcaacactccagacgaccgagacatgctgaagcagtaccgccttctggctgctgaagaggctgctaataataaggtgctgttcggcggtcgactgggcacgtaccagtacctcgacatgcacatggctatcggttctgcgctgagcatgtttgacaacaagctggtgccgttctttgaagaaggcacaccgctagagcaggaacgcggacac

SEQ ID NO: 3185 - DNA, 2049 bp, Corynebacterium glutamicum
ttgggcgcatctggccttgcagccgctggcactcagtacctcaatactcagggcgaaggcatcggtccggtcgccgtccaaaacgacagtgaatcgtttaattccggcaccaacgtggttgttgaagacgcagcagtcaccgcccagggtgaaggcggaggcgctcgcaccgtcaaggaattccagcgtgaccagcaattctctagttttgctcttacctggaccggtaaaaaagacatcactgcttttgttcgcgcagaacaggaagacggcacctggtcacagtggtacgacttggagccaatggtcaatgaagatcaaggcaccaacggaactgagctgatctggcacggccctaccaacaagatccaggtttccaccctcaacgtggatctctttggagcagatgctgcagccgctgatgaaaacggtcaagacattccagcagtagatgcagccgaggcagcgccagcagcagaacctgcaccagctgaagcaccagtcgaggaagctcctgcacctgtcgcagaaccagcaccagctgctgaacctatcgctgagccagtcgctgattactcagcaaatgacggcctcgctcccctgccatccaactatggcgacatccagcctgttgccgatgttgatgacggcctaaacgcagtatttatcgatggcaacgctgatgcaggcgtgggtatcgctaacgttgctgacaccgatggcatgccaaaggtgatttctcgtgctggttggggtgcggacgaaagtctgcgctgctcaaacccaactattgatgatggcgtttctgcgatcaccattcaccacactgcgggttccaacaactacaccgaggcgcaggctgcagcccaggttcgtagtgcttacagctaccacgccaagaacctcggctggtgcgatatcggataccagtcattggttgataagtacggcaacatctacgaaggccgtgccggcggcatgaccaatgctgttcagggtgctcacgctggcggcttcaaccagaatacttgggcaatctccatgattggcgactattcctacaacgctccccctcaggaaaccatcaatgctgtcggtgagcttgctggttggcgcgcaaaggttgccggtttcgatccaactggtactgatactcactactccgagggtacttcttacgcgaagtactcctatggcacccgagtgtcacttcctaatatcttcgctcaccgcgatgtcggcctgaccgcatgtcctggcgatgctggctatgcgcaaatggagaatatccgccagatcgctaaggcgaagtacaccagcttgcagaatggcaacacaggtggcacgactaccaccccggcgacaacgccgaaggagacgtcgacaagcaatgctccttcgacgaccactgcccagcctgtaactcccgctgaacctcagcagtacagcgaatccgatgccctggcagctctgctgacaggtggctcttccggcggcaccgacctgctcaatggcgcaaactctgagcagctcctgactggcctgggttccattgcggctgtgctgattgctgcgtctttggctgatggtggcctgaatggtctgatcagcaatgttggtagcaacaacggcgtcccagtgcttggcgatatcaagatcactgacgtcatcccaatcgttgataccgcgatcaacctaaccggagacaataagtactctcgcggttggaacgacctgaacaacacgcttggaccagtgcttggcgctgccactggtggcgaaaccaccgtgaagtacaccagcgaccagaactctgaggttactttcgtgccgtttgaaaatggcatcatggtgtcttcccctgaggctggaactcacggcctgtggggcgcaatcggtgacgcgtgggctcagcagggcgctgaccttggccctctgggacttccaaccagtaatgaatacaccgttggcgaacagcttcgtgttgatttccagaatggttacatcacttacgattctgcgactggccaggcaagcattcagctgaac

SEQ ID NO: 3186 - DNA, 1527 bp, Corynebacterium glutamicum
atgagaatctcaaaggccaatgcgtatgttgcagcgattgaccaaggcaccacttccactcggtgcatcttcattgatgcccaaggaaaagtggtgtcttctgcttccaaggagcaccgccaaatcttcccacaacagggctgggtagagcacgatcctgaagaaatttgggacaacatccgatctgtcgtcagccaggcgatggtctccattgacatcaccccacacgaggttgcatcgctgggagtcaccaaccagcgcgaaaccaccgtggtgtgggacaagcacaccggcgaacctgtctacaacgcaatcgtgtggcaagacacccgcacctctgacatttgcctagagatcgcgggcgaagaaggccaggaaaagtggcttgaccgcaccggcctgctgatcaactcctacccatcggggcccaaaatcaagtggattctcgacaacgttgagggagctcgcgaacgcgccgaaaagggcgaccttttgtttggcaccatggatacctgggtgctgtggaacctgaccggcggtgtccgcggcgacgacggtgatgatgccatccacgtcaccgatgtcaccaacgcatcccgcacactattgatggatctccgcacgcaacagtgggatccagaactatgcgaagccctagacattccgatgtccatgctccctgagattcgtccctccgtcggagaattccgctccgtgcgccaccgcggaaccctagccgacgtcccgattactggcgtgctcggcgaccagcaagcggccctttttggtcagggcggattccacgaaggtgctgctaaaaatacctacggcaccggcctcttcctgctgatgaacaccggcacctcgttgaagatttccgagcacggcctgctgtccaccatcgcctatcaacgggaaggatccgctccggtctacgcgctggaaggttccgtatccatgggcggttccttggtgcagtggctgcgcgacaacctacagctaatccccaacgcaccagcgattgaaaacctcgcccgagaagtcgaagacaacggtggcgttcatgttgtcccagcattcaccggactgttcgcaccacgttggcgccccgatgctcgtggcgtcattacaggcctcacccgttttgccaaccgcaaacacatcgcccgcgcagtccttgaagccaacgccttccaaacccgcgaagttgtggacgccatggccaaagacgcaggcaaagccctcgaatccctccgcgtcgacggtgcgatggtggaaaatgacctcctcatgcaaatgcaagccgacttcctcggcatcgacgtccaacgtctcgaggacgtagaaaccaccgccgtcggcgtcgcattcgctgcaggtctcggctctggattcttcaaaacaactgacgagatcgaaaaacttattgcagtgaagaaagtctggaaccctgacatgagcgaagaagagcgcgaacgtcgctatgccgaatggaatagggcagtggagcattcttatgaccaggcc

SEQ ID NO: 3187 - DNA, 834 bp, Corynebacterium glutamicum
atgattgcactgggttcagcgcccaagctggttgcctccgatgttgatggcaccctcatcaatagttctgagcgcgtgccgcaacgcctgcgcgatgtgatcacgcggatgaccaatcagggcgtgaccctggcgctgtccacgggccgcccgccgcgctggattcattatgtgctggatcagctgagcgtgaagccgatttgcgtctgcgcgaatggcgcggtgctgtacgattccgctgccgatgagattcttgcagctcagacgcttagtccggaggttatggcgagtgccgtcatggctgcgcgtgccgctttggaagagcatggcggggtcagtattgctgtcgagcgcgctggaaaatccgcttacgatccagccgatgagctgtttttggtcaccccggaatacagccacgcgtggccctcaaatgatcacggcaccttcgaggaagccgaagtgctttccgaaccagccaccaaattgttgatgcgcagcgattacctcgattccaagcagctttttgatatcgtccgcgcctccgttcccgaggatcaagtccacgtcaccttctccatgtccggcggactcattgagatcgcagcgcccggcgtgaccaaggcactgggcgtatcgatgctggcagagcgcctaaagattgcgcaaaaggacgttataacgttcggcgacatgcccaacgatattgaaatgctccagtgggccggccggggagtggcgatgggcaacgcccgaccagaggtcaaagccgtgtcagaccacatcacccgcaccaacgacgacgccggtgtagcagatgtattggagtggtggttc

SEQ ID NO: 3188 - DNA, 876 bp, Corynebacterium glutamicum
atggtcaaaaggtttggctttttcgtagaggattccctgcctaaggttccgctgcatcccgaagagtcacgggagacgttttatgggcgcatcatcattagtgctgtgcggacggtgatgaaagcccaggatgtgcagatttccatcttcggtgcggagaacattccgaccaccggcggcgcacttttcgccatcaaccacactggttattatgacttcattctgggtggtatccccgcattcgtgcggggtaagcgcctggttcgattcatggcgaagaaggaaattttcgacaccccagttgtcggcaccctcatgcgctggatgaagcacgtctctgtggaccgctccgcaggtgccggttccatggaagatgcgcggaagcgtctcgacgccggcagcctcgtcggtatcttccctgaggcgacggtgtcacggtcctttgaaatcaaggaactaaaaactggcgccgtccgcatcgccgacagcgctaacgttccgctgctgccacttattatttggggcggccagcgcatcatcaccaaagacatcgagcgcgacttcggccgctcccacatccccgtattcatcagcgtgggtgaacccgtcgacgccagcggcgatcccgacgaagcaacggaacgcctctacgaggctatgaaaaagcttctcgacgaaacccgcaccgcctacgaacaaaagtatggcccattcgaaggtggagaattgtggcgcccgaaatccctcggcggcggcgccccaacgttggagcaggcgaaaatgttggaaatcgccgaacgggaacgtcgacaagcaaaacgcgcggcaaaggtcgccaagaaacgcaccacctttataaggaaaatctttaaaaaa

SEQ ID NO: 3189 - DNA, 1266 bp, Corynebacterium glutamicum
atgatcgatctgaaattcctccgtgataacccggacgttgttcgtgcctcccagatcactcgcggcgaagaccccgcgcttgtggacgaactgattagtgctgatgaatctcgtcgcgaagcaatcaaggctgccgacgatttgcgcgctgagcagaaggcttttggaaagaagatcggacaggcctctccggaggaccgccctgcacttctggagggttccaacgaactcaaagccaaggtgaaggatgctgaggctgcacaggaagctgctgaggcgaaagtcaatgagctgcagatgaagctctccaacgtggtttccggcgcgcctgctggtggcgaagatgatttcgtcgtcctggagaccatcggcgagcctcgcacttttgatttcgagccaaaggatcacctggagctcggtgaatccctcggacttatcgatatgaagcgcggcaccaaggtttccggtgcacgtttctactacctcaccggtgacggcgcaatgctgcagttgggcatgctcatgttggctgctcagaaggcgcgcgaagctggatttagcatgatgatccctccagttttggtgcgccctgaaatcatggcgggcactggattcttgggtgatcactccgaggagatctactacctcgaacgcgatgacatgtacttggtgggtacctctgaggtggctcttgcgggttaccacaaggacgaaatcattgatctcaacgaaggcccagtgaagtacgccggttggagctcctgcttccgccgtgaggctggttcctacggcaaggacacccgaggcattttgcgtgtgcaccagttcgacaaggttgagatgtttgtctactgcaagcctgaagatgctgaagatgtacaccagcagctgctcggcatggaaaaggaaatgctcgcagccatcgaggttccttaccgcgtcatcgacgttgccggtggagacttgggtgcatctgctgcccgcaagttcgacaccgaggcatgggtgccaacccaggacacctaccgtgaactcacctcgacctctaactgcaccactttccaggctcgtcgcctgcagactcgttaccgcgatgaaaacggcaagccacagatcgccgcaaccctgaacggtacgttggctaccactcgttggcttgtcgcgatcctggagaacaaccagcaggccgatggctctgttgttgttcctgaggcgcttcgtccattcgtgggcaaagacgtgctcaagccagtgaaacaagccggt

SEQ ID NO: 3190 - DNA, 714 bp, Corynebacterium glutamicum
gtggacggccttaaaccaaagcatcagcagcttcgtgaaattttggaggaaatctgcaccacccagcttcagcctggggacatgctgcctggtgagcgcatcctggaagaaaagtatggcgtcagccgaattacggttcgtcgggcgattggtgatctggtcgcgtccggcaggttgaagcgagctcgcggcaaaggtaccttcgtggcccactcgccgttgatttcccgcctgcatttggcctcgttttccgcagagatggccgcccagaagctatcggctaccagcaggattttgagttcttcccgcggtcccgccccagatgatattgctgatttctttggtaccgatcgcgcggcccagcacatcacgttgcgccgcctgcgccttggaaatggtcgaccctatgccattgacaacggctggtacaactccgaattcgcacctgacctgctggaaaatgatgtgtacaactccgtgtactccatcctggaccgcgtctatggcgtccccgtcacccaggccgagcaaacggtcaccgccgtagcagccgacgaagacaccgcacggcttctcgacgtcacccccggcgccccactccttcgtatccttcgacagtcactttctggcgataagcccgtggaatggtgcgtttccttgtaccgaaccgaccgatattctttaaaaacattggttacacgctccgaagatctc

SEQ ID NO: 3191 - DNA, 1113 bp, Corynebacterium glutamicum
atgatggtgtcaattatgagtacaaactttgacacttcgacgtctccagagggtgaaaccaagaagaactcttctttccgcactgcggcctctgtgcagaccatgcttgttgcagctttggcagcaacggctgctgttggcgtgtactcctacaacacggacaattcagcaaacggcggcgaatcccccacaggacctgagcaaagtacagtgtccaccaccgcaactattgcctcatttaccactgctgacgtgggccaatgtgcaacctgggatgttaacaatgaaggtctagtgtctggttttgaacaaaccagctgcgatcaagagcaccgctttgaaatttctgctcgggaaaacttggcaacttacccaagttcggaattcggtccggacgcagctccaccaaacctcacccgtcaggcgcagctgcgtgaagagctctgccaatctcctaccttggcgtatttgaataaccgtttcgatccatcggggcgctacaccatcgccccgatcctgccacctgcggaagcgtgggctgcgggagatcgcaccatgctctgtggacttcaggcaaccgacgcttcaggcactccacaactcaccgtcggaccgatagcagccaatgaccaggcacgcgtttttgaaaccggcgcctgcgtgaaggtggaatcctccgcagagttccgccaagttgattgcacggaagatcaccacctcgaatcaattttgacagtcaaccttggtgtccccttcccacagggcgcgcccagcacggatgagcagaacaatttcctcggaaacacctgcacccaagcatccattgattacctaggctccgaagaaaacgtctaccaatccaccctgcagaccttctggccaacgattacctccaactcctggttgggcggttcacacagcgtgaactgcttcctcatgtcaccatccaccgagggtgctgcaacatttaacaccctcaacggttcagcgactggcacattcaccatcaacggtgaagttcccccacctcagccagagcgcgatccgctccgtgacactgcaggaacgacagcatccgcggaggtcggagtacctgtagaggagaacgctcca

SEQ ID NO: 3192 - DNA, 342 bp, Corynebacterium glutamicum
atgattgaagtcagcgacgaacgcttcgaggaactggtcgaactagccttcgaccaagttccccagcaattcctggatcatatgcgcaacgtggttttactcattgaggatttcaacccagattcgccttatatcttgggtttataccacggcgttgctctcacagagcgcacattcaaccacggtggcctgccggattccatcaccatttataaaggtgcgttgcaaaattactgcaattcagaggaacaactagtggagcaggtgcgggtgaccgtgctgcatgagattgggcattattttggcctcggcgaagaggacctgcacaggctcggatacgcc

SEQ ID NO: 3193 - DNA, 99 bp, Corynebacterium glutamicum
ttggtgggtctttggtccgaaacgacgttttttaggcttgggaaactgctgtttcagaccaaggacgcccactttttaggggttcttggtctgtgcacc

SEQ ID NO: 3194 - DNA, 669 bp, Corynebacterium glutamicum
atggccggccggattattttgctacgacacgggcagactcacaacaacgtcaaacacctcctggacacccgcccaccaggagctgaactcaccgacctgggccgtaaacaagcccttgaagttggccacgaactagccacctactccggtgagcgcctcgcccatgtgtacagctccatcgtgttgcgcgcccaacaaaccgccgtgcttgccacctctacctttgaaaaagctcgcgacatgcagtccggtgcgattccactcgacgttgtggaaggcattcaggaaatcaacgtcggcgactttgaaatgcgcggcgatgaagaagcccacatgaattactcccgcgcactcaacggctggcttcacggggatcctgccgctggtcttcccggcggtgagacctacaaagacgtgctgaaccgctaccagccgactcttgatcgaatcatggacagccacgaccttgacgacgaccgcgacgttgccgttgtcagccacggcgccgtcatccgcatcgtggcaacacacgcaactggtgtggatcccaactttgcgttcaacacctacctgggcaactgccgcttcgtggtgctggagccaaacggtaagaaattcagccaatgggatgttgtgcgctggactgacagcccactgccatggcaggag

SEQ ID NO: 3195 - DNA, 630 bp, Corynebacterium glutamicum
atgcgggtgaggtcaacgccgcggatggcgaattcgttgagggcgcgcacgaggctgcctggcacattcggtagggagaaaatgacggaggtgcggtcgtggccggtcggttcggaaacggctgcttgggcttggacagcaacgaagcgggtgcgggcgccacggacgtcggcgacatcatcaacaaggcgttccagtccgaagagttcggctgcgcgggagggcgctgcggctgcgtcggcggttccttcggcaaccatttgtgcgccggcgccgttggagcttgctgaaagatacatggcgtccggaatggtggttgccatccagtttttcacttgttggtacccaaccgggtgggtggcgagggttttgacgtcggcaagcgaagtccctggccggaccatgatggaaaaggcgatgtcgagttcttcttcggcgatgatttgcacgttggagccctggtcaagggcgtcgaaggtgggggtgacggggccgtcgacgaagttttcgatggcgaccaccgcgaactgggcggtgccgtggcggacggcgtcgacagcttcttgtggcgatttggctggtagctgctcgatctcaccgtcgccgaatacgccggcgtcggcaaatttg

SEQ ID NO: 3196 - DNA, 1143 bp, Corynebacterium glutamicum
gtgtccatgtctgttgctcaattagcgaaccgcttggcccaactctcccccgccgagcatggttttgcatggttcgaccctgaaatcaccgctggccatggcgttggcccgttgcatggcatggtgattccagccaaggacctcaacgatgtcgcaggcatgcccaccgcgttcggaaatgcatctcggcgaaaggtagcaacagataccgatccgttcatccaaaatctcatcgaccgcggcgcgatcatcgctggcaaaacccaaaccagcgagctcggcatgacggcgtattgcgaacccatcgacatggacgcacccagcaacccggttttgcctggtcacacgcccggcggttcgtcgggtggtgcggcggttgccgttgccaggtcgcttgtcgacgccgcccacgcctcagacggaggcggctcgatccgggttccagccgccgcgtgcgggctggtcgggtttaaacccgcccacgattccagcggcggaaacccctccacgcaggggtttatcacccgcgatgtggccacccaagtgcgcttgcacgcacttcaaccacgcaccaggcgcctgcgcatcggcgttctcgctgagcccatccatgctaattcgcttgtcgacgcccccttcctgagcatcctcgaatccaccgcccacctcctggagaaagctggccacgaaatagtgtccgtacccctcccttatggcgcttgggcttttgacgcttatacagaagttttcatgatgaaatccgctggactaaccaacctgggtagccccattacaagatggttgagtgaacaaggccgtagtctttctccttctgatagacaatcaagtgtcaaggcttttgattccgtggctgagactgtacacggagcatgggacatcgatgttttattaacccctaccttggcttatgcacctcccaagattgggtacttttcatccatgccacctgaagaagacttccttgcacaaaccaaatggacgccgtgggcaacgctgttcaacatgaccggtggtgcagccatcagcgtgcctgttgaaggtgtcggcattcatcttggtgggatacgcgtacgagatgaagacctcttaggattagcagcatttgtggaaagagctgtggca

SEQ ID NO: 3197 - DNA, 729 bp, Corynebacterium glutamicum
atgagtagttcagtaatgtcaccgcgtcgaataaaggcggaaatacttatcgttttagccatcacctttggcatgagcggcctgcgatcaatcctgcgcctcatcgacgatctcctcgcaccggttgcgctcaacgaccagcaagttgcactgaatgcctcaatggcaaactccgcatggctggatctcaccttgcaattgtgttccgccggagtgctgttttcctggggagcactagcgatctacctgctaggtgaacgttttcagtggattaaacccaaagactgggcatggggtgcaggccttgcagcactcattggtattccagggttaatcttctacgccagtgctgttcatttggggctgtccaaacaggttgtgcccaccacgttggaaacctggtgggaaatcccagtacttcttatctggtcagctgccaacgcctttggtgaagagatcgtggtagtcatgtggtttttcaccaggctgcgccagctgaagtggagtgtgcctgcagttatcgtgacatcttcagtactacgcggttcctatcacctctaccagggaatctctgcaggcttgggcaacatcatcatgggagtagcgttcgcgtacttctatcaccgcacgggcaaaatctggccactggtaatcgctcacttcttgattgatgcggtggcttttgtgggctactccgcaattggcgggaatttaagttggttagggctt

SEQ ID NO: 3198 - DNA, 1035 bp, Corynebacterium glutamicum
atgcctcctaggcaaaccccaccgaggcaggttcccccacaacagcagtaccagcagcctggtcagatcgggcaggttcgtccacagccgccggtgattgcaggggatggggggaggcgtcgaaaagcaatatcttttaagccccgtggctgcctgggcacgatcgcgggcgtgcttgctgtgggcttggtgcttgtgtttgtggtgacgctgtgggcggattcgaagctgaatcgcgtggatgccacgcctgcgacgcaggtggcgaacactgccggaacgaactggctgctggtaggttcggattcgcggcagggtttaagtgatgaggatattgagcggctaggtaccggcggcgatatcggtgtgggccgtacggacacgatcatggtgttgcatatgccgcgtactggcgagccgacgctgttgtcgattccgcgtgattcttatgtcaatgtccctggctggggcatggataaggcaaacgccgcatttaccgtgggtggcccggaactgctgacgcaaaccgtggaggaggcaactggcctgcgaattgatcactatgcagaaatcggcatgggtggtttggcgaacatggttgatgccgtgggcggcgtggaaatgtgtcctgctgagccgatgtatgatccgctcgcgaacctggatattcaggctggttgccaggaatttgatggggcagccgcgctgggttatgtgcgcactcgtgccacagccctgggtgatctggaccgggtggtgcgtcagcgggaattcttctccgctctgctgagtacagctacgtccccgggcacgttgctgaatccgttccgcaccttcccgatgatctccaacgcggtgggaacattcaccgtcggcgagggcgatcacgtgtggcacctggcccgattggcgctggcgatgcgcggaggaatcgtgacggagaccgtgccgattgcctcattcgcagattacgatgtgggaaatgttgcgatttgggacgaagctggagccgaagcactatttagctccatgcgc

SEQ ID NO: 3199 - DNA, 120 bp, Corynebacterium glutamicum
ttgcttttcgacgcctccccccatcccctgcaatcaccggcggctgtggacgaacctgcccgatctgaccaggctgctggtactgctgttgtgggggaacctgcctcggtggggtttgcc

SEQ ID NO: 3200 - DNA, 552 bp, Corynebacterium glutamicum
gtgccacacgtgatcgccctcgccgacggtgaatgttcccaccgcgttggagatcatcgggaaggtgcggaacggattcagcaacgtgcccggggacgtagctgtactcagcagagcggagaagaattcccgctgacgcaccacccggtccagatcacccagggctgtggcacgagtgcgcacataacccagcgcggctgccccatcaaattcctggcaaccagcctgaatatccaggttcgcgagcggatcatacatcggctcagcaggacacatttccacgccgcccacggcatcaaccatgttcgccaaaccacccatgccgatttctgcatagtgatcaattcgcaggccagttgcctcctccacggtttgcgtcagcagttccgggccacccacggtaaatgcggcgtttgccttatccatgccccagccagggacattgacataagaatcacgcggaatcgacaacagcgtcggctcgccagtacgcggcatatgcaacaccatgatcgtgtccgtacggcccacaccgatatcgccgccggtacc

SEQ ID NO: 3201 - DNA, 870 bp, Corynebacterium glutamicum
atgaaaaagatccacatgattccagcggccctcctcatcggttcccttgcgcttgttagctgcgcgccttcacaacctacccagaacgcgcagacggtttcttctgtcatgacggaaactcctacttatacctcttcatctaggtcggtggaatctaccgcggggacgatcgctgcctcggaggaagccacgatgacgctactggagaatagttcgggggatccgggatctgattctgggggtgcacgctatagcctcaattcgctcaaagtttctgagcaggccgcggctaacgccgtcttaaaggccgtgcttaacgacgtctcctaccaagagttcgcagactcctcctacttagaaatcacaggaacgccctccgccgacggaacatggggcatctcatttggcggaccttccgaatcggcctccgtggaattctccgacggcagcatcagcttctcccctgttgacatgacagtgcccgcaacacgattgcctcagatgggcgcattttatgaaaccctgaccgaagaacaattaggcatgctggagactggcctcgcggtttccaccgtggattcgagccaacaggaaatgcttctggacttggtctccaactcgatcggcctggcagatactgaaaccactgcgactgcaattagtaaaatccgagcaacgctttccgagacctacctgttcggaacccccgacggattaaccttggcgcttagtggcccacacgttgatttcgaagtctcccaccagggcagcaccgcgaaaattacttaccgcgatccaagcaccgacaccttaaccgccgaagatcgggtagataccgcaagtgtggctgctgctccgccggaggttgtt

SEQ ID NO: 3202 - DNA, 327 bp, Corynebacterium glutamicum
atgtcttaccacgatcacagcgacatcgaatacctcaagaagatcggcgccaactcccctgacgccttcaaagcttttgtccattttgatgaggcagctctccgcggcccgaacaagaaaatcccacgcaactacaccgaaatgatcgcacttgcggtcgcattcacaacccaatgcgcctactgcatcgacatccacactgccgctgcgaagaaggaaggtgtcaccaccgaggagctcgctgaggttgcgctcatcgccgcagcacttcgggcaggcggcgccatgacgcacggcgcacttgccatgaagctttacgacgaaaac

SEQ ID NO: 3203 - DNA, 1314 bp, Corynebacterium glutamicum
ttgagaagttttacttttatattagttctcatgcgcctcaacaaacgactcccagcggcactctccggactgctgctctctgctgcccttcttgccggatgctccacttctggaaccgccgagaccacgacaacaaccgtttcatctgctgcggcatcaacaaccacttccacctcctctgcttcgtcttcctcttcctcctcctcttcctcctcttcctccgactcaagcaccaccgccgaaaccatctccaacaccgcggaagctgcccaagctttcttgtccaccctgtccaccgaagaacaagacgccgtactctacgactacgacgccgaagaaaagtccaccggctggtctaacttcccagtcaccttcgtgcagcgttccggcgtgaacctcaccgacctcactgaggaacagcaagcagctgccctcaacgtgctgaagaacctgctcaacgacgacgcctaccaaatgatcgaagacatcatggctagcgatcagtacctcaacgacgaaagcaacaccaccgaggattccctcggccagtactacatcgcattcttcggcgatccaagcagcgactccgactggtccatccaattcggcggacaccacatcggcatcaacaccaccttctccgacggtgccatcaccttcgccccaacccaccttggcacccagccttccgagtggaccaacgaggacggcgaaaccgttgcagcactaagcaacatgtacgaaaccgccttcgccttctacgacagcctcgccgaagagcagcaagcacagctctaccagggtgaagagttggattccatggtgtgcgcaccgggcagcacgtgcgactacccaaccggcaccggcttgaaaggctctgacctcaccgatgagcaaaaagaattgctcatcgatgtcatcgcaaactgggttggcctcgccgatgaggaaaccaccgaaactgaactcgatgccatccgcgaaaccctggatgacacctacatcaactggtccggcgccaccgagtacgacacctccaccggcgacggcatctacttccagatcagtggcccaaaggtctacattgagttcgctaaccagcaaggttctgcaggtgccgacatcgacggtgtcatcaccgctggatggggccacattcacaccatctaccgcgacccaaccaatgactacgctaactccgtaactcaggaagcagccagcggaatgatgggcggcggccctggtggtaatggtggcgagatgcctagcggtgacatgcctactggtgagatgccttctggcgctccatcaaac

SEQ ID NO: 3204 - DNA, 918 bp, Corynebacterium glutamicum
atgcgcatggcaaagaagactaagaagaatgaacagctgccggagggcatgagccgtcgtcaggcaaaacttgcagcccgcgcggctgaacgtgcagcacttgagcgtgaacctcgcccattcgagggcctggcaatggagtcacagctcgttgcactgcaggaattcattccatctgcaaccgcacccatcaccgttgcaggcaccgatcgcaagatcaccctctgtaccgtgcttccaggcgcagctgcggcacttgtccgcgaagaagcattcggcggcgaagcgtttgttgcaatgcagcaggccatccgctccaacaacccaagcaaggacctcgcgttcgcgctgaactgggtcatcaacgcaaaagccggcgagtcactggccaccgccacagcggacggcacccagccagagctaaagagcttgcttaacgacgccgacaccctcgaaatcaccactcaccaggacttcaactggtggctggcggaaaacgacaacctctccccagaagttgcgcagcacatgcaggcagccaatgactccatcctgccttcacacgaagtcgaagcagacgtcccaggcgctgtttggtgggtcaacccaggcggaaaagcgcacatccgttgggtccgcaccgaaaacgaaaccgcactgttcaacgctttggcacgcatcgcagcacgtggcgagctgaatctcggcgaagaaactaagttcgctggtgctttccgcacccacggcatcgtcgtcccagtgtgggatctcgatcctgagcgtccatccaccgattacgccgatgttttggttgcactcaacgagaagatcgtcgctgaactggataacgatgcacagctcaacgccgacgagcgccgtcagctggagaacatcaagtcccgccaggtgaccatccgc

SEQ ID NO: 3205 - DNA, 819 bp, Corynebacterium glutamicum
gtggtttggagggatactagagtcgatagcaggtatataaaggccaggagagatgggttcatgaaagtcatcgcgcaccgaggtttatcgtctcgctttcccgaattaacagagtctgcgtttcgggcggctctagagctaccgattcatggaattgaaactgatgtccggctgactaaatgtggcgaagtggttaacgtccatgaccccattgtggatcgcgtgtcgaatggtcgcggtcgggtgtcgcgtttggacttggaatccttgctgagcttgaactttggaaccaaagaaaccccagaaaaagtgcttactttaaacaatctattagatatttttgaggattatccagataagcacctttatatagaaaccaagcacccaatgcgctacgcggtcatgctggaagaagaaatcacaaaaatcttaaaatatcgtgggctgacggaagacccacgcatccacatcatttcttttgcacttcccgcgatgtatcgcatggctcgccttgctccacagcttgatcgcattcatctgcgcaggtcgtgggagcgttggggtaatccgcgcgatgtgcgctgcggtgtacccaccggtttggggttgtcgctggagcgggcgaagatggatccaaggatgattggggcgaaagggttacccacctatcttttcaccgtcgataagcaaaaagacatgctgtgggcgcgcgaacagggcgtcgacatgctcgccaccaattatccggaccgtgcggcggagcttttgaacgcacatcccaagcccgccatgtacgctaatgcgcatggcaaagaagac

SEQ ID NO: 3206 - DNA, 1389 bp, Corynebacterium glutamicum
atggacacctgggaacaaacccttggaacagggccactgctaggcattgcagccggcgccattgccctcatcttggttctcgtcatcgtttttaaactccatgcttttctcaccctaatactggtttcaattgttaccgcacttgctgccggcattcccgtcaccgcagtagtggacactctccttgacggttttggtaaaacactcgcctcggtcgccctattggtaggcctgggtgccatgcttggtcgattggttgaaacatccggtggcgcaaaatctctagccgacactatggtgcgaatcttcggtgaaaaacgagcagctttcgcactcggtgtcgcatcgctgatcatgggattccctatcttcttcgatgctggcctcgtggtcatgctcccagtgatcttcgcagtagctcgacgcctcaacggctccgtccttacttttggtatccctgcagctggcgccttctctgtcatgcacgtgttcgtcccacctcacccaggcccaattgcagcctctgaattcttcggcgcacaagttggatacgtactaatcgctggcatcatcgttgcactacccacctggtatttaaccggttacctgctaggtaagttcttaggccgaaagttcccccttcccgtacccgatctactcagtggtggagcacaggaagatgatcagcctcagaacccagctaacgcagtgtcgatcattgtcattttgctcattcctatgctccttatttttggcaataccggaacatcaatggcagtttccgccggcctcctagatgcagaatccaccatggtgaaaattctaggattcctcggcgaaacaccagtggcactgctcattaccttgatcattgccctgttcttcctaggcaaccgacgtggcattaatggttctgctctagagaaaaccatcgaaggcgcactcggcccaatctgttcagtcgtattaatcactggcgccggtggcatgttcggtggagtgctacgcacgtctggaattggaggagcgcttgcagactccatggcagatctaggacttccagttatcgcaggttgtttcatcgtggcagccgtccttcgtgtcgcgcagggttctgccaccgttgcgctaaccaccgccgcagcactcatggcacctgctgttgccgctgctgactttaacgaattccagcttgctgccatcgttatttccactgccgctggttctgttattgccagccacgtcaacgactccggattctggctcgttggtcgactcatgaacgccgacgtacccaccacgctaaaaacttggaccgtaaaccaaacctgcattgcgattgtgggatttgtgatggcctatgcaatgttcggattggcatcgcttgca

SEQ ID NO: 3207 - DNA, 642 bp, Corynebacterium glutamicum
atgcaggtttggtttacggtccaagtttttagcgtggtgggtacgtcggcgttcatgagtcgaccaacgagccagaatccggagtcgttgacgtggctggcaataacagaaccagcggcagtggaaataacgatggcagcaagctggaattcgttaaagtcagcagcggcaacagcaggtgccatgagtgctgcggcggtggttagcgcaacggtggcagaaccctgcgcgacacgaaggacggctgccacgatgaaacaacctgcgataactggaagtcctagatctgccatggagtctgcaagcgctcctccaattccagacgtgcgtagcactccaccgaacatgccaccggcgccagtgattaatacgactgaacagattgggccgagtgcgccttcgatggttttctctagagcagaaccattaatgccacgtcggttgcctaggaagaacagggcaatgatcaaggtaatgagcagtgccactggtgtttcgccgaggaatcctagaattttcaccatggtggattctgcatctaggaggccggcggaaactgccattgatgttccggtattgccaaaaataaggagcataggaatgagcaaaatgacaatgatcgacactgcgttagctgggttc

SEQ ID NO: 3208 - DNA, 159 bp, Corynebacterium glutamicum
gtgacaaaaatactgaaaaccctgcaattttggtacctatgtttggtttatctcgccctcaaccagccctcaaccagacagggaggacaagaatctgggaaaacccaaatccttgtcacccatgtttggtgcgagccgaaccagggtgcccgcaatcct

SEQ ID NO: 3209 - DNA, 1617 bp, Corynebacterium glutamicum
gtgcaggcccgcctcaaggccgcccgcaatgttatcggagctttcgcaggtgaaggcccactttatccaccctcagatgtcgtcgatgccttcgaagatgccgatgagattctcgacgagcacgccgaaattctccttggcgaacccctaccggatactccatcctgcatcatggtcaccctgcccaccgaagccgccaccgacattgaacttgtccgtggcttcgccaaaagcggcatgaatctagctcgcatcaactgtgcacacgacgatgaaaccgtctggaagcagatgatcgacaacgtccacaccgttgcagaagaagttggccgggaaatccgcgtcagcatggacctcgccggaccaaaagtacgcaccggcgaaatcgccccaggcgcagaagtaggtcgcgcacgagtaacccgcgacgaaaccggaaaagtactgacgcccgcaaaactgtggatcaccgcccacggctccgaaccagtcccagcccccgaaagcctgcccggtcgccccgctctgccgattgaagtcaccccagaatggttcgacaaactagaaatcggcagcgtcatcaacgtcccagacacccgcggatcccgccgagcattcaccgtgaccagggtttttgatggcgcggtcctcgccgaaggcccacaaaaagcctacatctccaacggcaccctcctggaacacaactacgaccgctcccgggtctacggcatccccgccgtagttcagcgcatcaacctcaaagtcggcgaccgcctcatccttaccgacgaagaactcacctacgatccatccctcggatccggccgcacaccacgcatcagctgcacccttccacaagcagtcgatgcaattaaagtcgggcaccgcgtgcttttcgacgacggagccatcgccgcagtctgcatcgacaagacctccactgccgacggccacaacgacgtagaattggaagtcacccacgcccgcccacaaggcgtaaacctggccgcatacaagggaatcaacctcccagactccgaacttccactcccaagcctcactgaagaagacctccaacacctgcgctttgtcgtcaaatacgccgacatcgcagccatctccttcatccgaaacgtcgccgacgtggaatacctcctccaagcactcgccgacatcggagatccagtagccgtcgaacgccttggcctcgtccttaaaatcgagaccatcccaggctacgaaggcctcgcccaaatcctcctgaccggcatgcgccacgaaaacttcggcatcatgatcgcccgcggagacctcgccgtcgaactcggcttcgaccgcatggcagaagtcccccaactgatcatggcccttgccgaagccgcccacgtcccaaccatcttggccacccaagtcctggaaaacatggccaaaaacggactcccatctcgcgcagaaatcaccgacgcagcaatggcacttcgcgctgaatgcgtcatgctgaacaagggaccacacatcaacgacgccatcaaggtcctcaccgaaatgagccgcaaacttggtgcatcccaacgaaagagtaggctgctgctgcgcaaggtgaagagctgggaagag

SEQ ID NO: 3210 - DNA, 942 bp, Corynebacterium glutamicum
atgaaagaaaccgtcggtaacaagattgtcctcattggcgcaggagatgttggagttgcatacgcatacgcactgatcaaccagggcatggcagatcaccttgcgatcatcgacatcgatgaaaagaaactcgaaggcaacgtcatggacttaaaccatggtgttgtgtgggccgattcccgcacccgcgtcaccaagggcacctacgctgactgcgaagacgcagccatggttgtcatttgtgccggcgcagcccaaaagccaggcgagacccgcctccagctggtggacaaaaacgtcaagattatgaaatccatcgtcggcgatgtcatggacagcggattcgacggcatcttcctcgtggcgtccaacccagtggatatcctgacctacgcagtgtggaaattctccggcttggaatggaaccgcgtgatcggctccggaactgtcctggactccgctcgattccgctacatgctgggcgaactctacgaagtggcaccaagctccgtccacgcctacatcatcggcgaacacggcgacactgaacttccagtcctgtcctccgcgaccatcgcaggcgtatcgcttagccgaatgctggacaaagacccagagcttgagggccgtctagagaaaattttcgaagacacccgcgacgctgcctatcacattatcgacgccaagggctccacttcctacggcatcggcatgggtcttgctcgcatcacccgcgcaatcctgcagaaccaagacgttgcagtcccagtctctgcactgctccacggtgaatacggtgaggaagacatctacatcggcaccccagctgtggtgaaccgccgaggcatccgccgcgttgtcgaactagaaatcaccgaccacgagatggaacgcttcaagcattccgcaaataccctgcgcgaaattcagaagcagttcttc

SEQ ID NO: 3211 - DNA, 1776 bp, Corynebacterium glutamicum
atggtttcgctccccagactagcgtctctgctcaccactcgcctggcaacgcttaaacccgcactaaaacctgccacccacctcgcctccctcggcgcgcaggtcattgcagagctagttccggggatccgaatgtcgccaaaccgcaggcgaatcctccctgcaaatatgggcgctggctttatcggagcggaaatcgcaatgtggtgggctctctcgccgtcattgttgccgaaaccgtggtgggttacggctgctaacctggctgttttacaagcggtggggcatgcggcagcgacgggaatccactcgatcctccccagaaccaaccggcgggtatccaggaaaatttacaacgccacccacatcgcaactggtgccatcacgttgaccaccacggttgtgggattgatcaggcatcgcacccaaatccggctgattgggcagaagaattttggaccgaaggagacgatcgcgggcattagtgtcggcaccttggggtacggcgcgctgctgatcaccggcgaattaacccagcacagtattaatgaggtcaagctcctaattgagaggtttttaccgccgtggataagtttcatcgcagcggtttcggtcattacattgaccactttgaccttggccgatcgcgttttgttgcggcgcatcttgcataattctgcaattcaagcagcgcaccttaatcgcatggtgttcccaggaactgagcagccgtgggagccggagcgttcgggtagcccgtggtcgtatgaaaaatggggtgcggtgggttcgcagggccgtgcagtgttgtcgggaggcccacgcaaagatgacatcatcacggtaaccaggctttctgacacggaaacacatgaaccgattcgtatttttatcggtatggttccgggacgatccttaagcgatcaggtggatcttgtcattcatgaaatgcgccgcacgggagccctgcgccgcgaccacatcgtgatcaacaattccacgggcaccggctggatcaccgattggtccgcccacacctttgagttcctcaccggcggaaactgcgtgacaatttccatgcaatattcttatcttcccagtgcactgagctggtacaaggacaacgacggccccattaatgcggcgagaatgcttatcgacgccgtcctccacgagctagaccagcttcccaccgggagtcgcccaaagctgttcctcgcgggagagtcactgggggcgtatgggttggctgaggtgtggggagacgtcgaaaagcttcttggaaccgctgacggcgtgctgctcagtggggcgccgcgtttttcggacgccatgaatgcgttgcgcacccggcgcgatgcgagcagctccgagcggctgcccgtgattgatagcgggcggcacatccgttttgcgggcgagcctgagcaccttgatatgccggctacctggcagtttccgcgcatgatcgtggcgcagcacgcctctgatccaattgtgtggtggaacgcggagctgtttattcggcggccggaatggttgaaaactcccaagcaagaccaccaagatgtctttccccgcttgcgatggatgccgtttgtaaccggctggcaggtggctttggatttgttcacttcaacctccgttcccggcgggcacgggcacaattatcacgaggagtttattgattattgggcagctcttttggaccgcgaagtcacccccgagctgcgccacagcattgcttattggatccgcgcgaaccacatcaaacgc

SEQ ID NO: 3212 - DNA, 636 bp, Corynebacterium glutamicum
atgacgcatgcgatcctctttgacctcgacggcaccctcgttgatcacgcttccgccgcccgcgccgccctgcacgcctggtcgccgaccgtgggcgtcgacacggatgttgagcgctggattgagctggataagtggggttttgcccgttttgagcgcggcgaaaccacgcatttaggtcagcggcgcgaccgcatcagggcgtacctcaacagagagcttgacgacgccacctgcgatgatatttactccggctaccttaaagcatatgagcaaaactggactgcctaccccgatgccaagggcgttctcgatcgcgcggtagccaccggtgcccctgtgggaatcctgaccaatggcgcagcccccatgcagcaagacaagcttgatcgcaccggccttggcctgccagaactcgtcatgttggcggcgtccactctggattctgcgaagcctcgccccgaaatgtatgcccgagcgctcacccatttgggtgcccgaaccgcaacaattatcggcgatgattggaccaacgatgtcgcagctccccgcgaacttggctggaatgctctctatttagatcgttccggaaccgatccacgcgccgatatccactccctggatgaactctttcac

SEQ ID NO: 3213 - DNA, 543 bp, Corynebacterium glutamicum
atgaaaattggtgtcatcctgggcagtatccgcgaaggccgcttcggccaaggcgttgccgattgggtcatggaacaaatcggggcttatgacgcacccgatgtggaatttgaactcatcgacctcaaagctttcaacgtgcccctgttggaatccgcgacagttccaggttccgcggataaacagtacgacgacccgcgcgtaactgcctggtcacaggccattgatgcctgcgatgccttccttttcatcaccccggaatacaaccacggtgtgcccggcgcgttcaaaaatgcgtatgacatcctgggcaatgaatggctgaacaaaaccgtcggtttcatttcctacggtgcagtcgaagggatccgtgttgtcgaacagtggcgtcagatcgtcgccaccttcaacatgtacgatatccgcagccagctatccttttccaccttcaccgagaacaacaacggcacttttgcgcccaatgatcgacgccccggtgaactaatccgcctccttgatagcctcctaacggctgtccgcgat

SEQ ID NO: 3214 - DNA, 693 bp, Corynebacterium glutamicum
atgagtgtgaaagcacatgaatctgtcatggattgggtcaccgaggagctccgcagcggtcgcctaaaaatcggtgaccacctccccagcgaacgggcgctctccgaaaccctcggagtttcccgaagctccctgcgcgaggcgcttcgtgtgctcgaagccctcggcaccatttccaccgccaccggatccggcccgcggtctggcaccatcatcactgctgcccctggccaggcgctttccctctccgtgacgctgcagttggtcaccaaccaggtcggccaccacgatatttatgaaacccgccaactccttgaaggctgggctgccctgcattccagcgccgaacgtggcgactgggacgtggcagaagcgttgctggaaaagatggacgacccctcgctaccgctcgaggattttttgcgtttcgacgccgaattccacgttgttatctccaaaggcgcggaaaaccctctgatcagtacgctcatggaagccctccgtttgtccgtggcagatcacaccgttgccagggcccgggcgctccccgattggcgagccacctcggcgcgtctgcagaaagaacaccgcgcaatcctcgcagcacttcgcgcaggcgaatccacagtggccgcaaccttgatcaaagaacacatcgaaggctactacgaagaaaccgctgccgccgaggcc

SEQ ID NO: 3215 - DNA, 786 bp, Corynebacterium glutamicum
atgtcccgcactctgtgggcggtttcagatctacacgtcaccttcgcccaaaaccaaaacaccgttgatgccctcatgccgcaggaccccggcgactggctgatcgtcgctggcgatgtagcagagaaaatccccgatgtggtacgtaccttatccgcgctggtcaaacgctttgacaccgtgatttgggtgccgggcaaccacgaactcttcaaccggaaaacagaccgcgtcaacggcaaagcccgctaccgagcattagtcggacaactccgagccatcggcgtgatcacccccgaagatccctatccgatctttggtggcgtcaccatctgcccacttttcacactttacgattactctttccgtcccctcggcctcaccgcgaaacaagccctcgcccaagcaaaaataaagctagacgacgaactagccatcgccccctacgtagacatccccgcctggtgcgccgaacgagtcacctacacagaagaccgcctaaaagccaccaaaggcccaaaagtcctggtcaatcactggccgctggtcattgagcccacccaccggctcttccaaaaagacatcgcgctgtggtgtggaaccaccgccaccagggattgggccgtacgattcaacgctctcatggccattcacggtcacctacatattcctgccgaaacccgcgttgatggggtaagccacgtggaggtttctttgggttacccctttgaaaaacacccacctcacatgaagcgtccgtggccgtttccggtcatgcagattaac

SEQ ID NO: 3216 - DNA, 1299 bp, Corynebacterium glutamicum
atgacaaccgcagtagatcaaaactcaccgcccaagcagcaactcaacaagcgcgtcctgctgggcagcttgagtggcagcgttatcgaatggttcgacttcctggtttacggaaccgtcgccgcgctggtcttcaacaagatgtacttccccagcggcaacgagttcctctccacaatcctggcgtacgcatccttctccctgaccttcttcttccgccccattggtggcgtcatcttcgcccacatcggcgaccgcattgggcgtaagaagaccctgttcatcaccttgatgctcatgggtggcggcaccgtcgccattggtttgctgcccgactacaacgccatcggcatttgggcaccaatccttctgatgttcctccgcattttgcagggcatcggaattggcggcgaatggggtggcgcactgctcctggcatacgaatacgctccaaagaagcagcgtgggctctacggcgcagttcctcaaatgggcatttccctgggcatgctgcttgcagctggcgtgatctctctgctcaccctcatgccggaagatcagttcctcacctggggctggcgcatcccattcgtcggatccatcctcctagtgttcatcggcctgttcatccgaaacggccttgatgaaacccccgagttcaagcgtatccgcgattccggccagcaggtaaagatgcctctgaaggaagttctgaccaagtactggccagccgttctggtctccatcggcgcaaaagctgccgagaccggccccttctacatcttcggcacctacatcgttgcttacgcaaccaacttcctgaacatccgcgacaacattgtccttctggcagttgcttgcgccgccctcgttgccaccatctggatgccactgttcggatccttctccgaccgcgtcaaccgtgcagtgctctacaggatctgtgcatccgcaaccatcgtgctgattgtcccttactacttggtcctcaacaccggcgaaatttgggcactgtttatcactaccgtgattggcttcggcatcctctggggtagcgtcaacgcaatcctcggaaccgtcatcgcagaaaacttcgcacctgaggtccgctacaccggcgctaccctgggttaccaagtcggagcagcactcttcggcggtaccgcacccattatcgcagcatggctgttcgaaatctccggcggacaatggtggccaatcgccgtctacgtcgctgcatgttgccttctctctgtgatcgcctcgttcttcatccaacgcgtcgcgcaccaagagaac

SEQ ID NO: 3217 - DNA, 1215 bp, Corynebacterium glutamicum
atgaagttcaaaaagccagagctcaacggcaagaaacgacgcctagactccgcgctcaccatctacgacctgcgtaaaattgctaaacgacgcaccccagctgccgcgttcgactacaccgacggcgcagccgaggccgaactctcaatcacacgcgcacgtgaagcattcgaaaacatcgaattccacccagacatcctcaagcctgcagaacacgtagacaccaccacccaaatcctgggcggaacctcctccatgccattcggcatcgcaccaaccggcttcacccgcctcatgcagaccgaaggtgaaatcgcaggtgccggagctgcaggcgctgcaggaattcctttcaccctgtccaccctgggcactacctccatcgaagacgtcaaggccaccaaccccaacggccgaaactggttccagctctacgtcatgcgcgaccgcgaaatctcctacggcctcgtcgaacgcgcagccaaagcaggattcgacaccctgatgttcaccgtggatacccccatcgccggctaccgcatccgcgattcccgcaacggattctccatcccgccacagctgaccccatccaccgtgctcaatgcaatcccacgcccatggtggtggatcgacttcctgaccaccccaacccttgagttcgcatccctttcctcgaccggcggaaccgtgggcgacctcctcaactccgcgatggatcccaccatttcttacgaagacctcaaggtcatccgtgaaatgtggccaggcaagctcgtagtcaagggtgtccagaacgttgaagactccgtcaaactcctcgaccaaggcgtcgacggcctcatcctctccaaccacggtggccgtcaactcgaccgcgcaccagtcccattccacctcctgccacaggtacgcaaggaagtcggatctgaaccaaccatcatgatcgacaccggcatcatgaacggcgccgacatcgtcgcagccgtagccatgggcgctgacttcaccctcatcggtcgtgcctacctctacggactcatggccggaggccgcgaaggcgtcgaccgcaccatcgccattctccgcagcgagatcacccgcaccatggctctcctcggtgtttcctccctcgaagaactcgagccacgccacgtcacccagctggccaagatggttccagtttctgacgcaactcgttctgcagcggcggagatt

SEQ ID NO: 3218 - DNA, 405 bp, Corynebacterium glutamicum
gtgcccatccgtttggatgggcaccttctcgtttcttgcaatcggcatattcagtcaaaaaatgttgaaatcagcactttcaatttgggacatctactcttaggagaaaagccacaaacctttcccaccccacaaccgtgtgttctgcagtcgacccagtttagaggaaacatgagtgacttcacggaaaatacttggactgtccactacgacgaagatggtgatttcccaaaattcttcaactctctaaaggaacacgagcgcgctgcagttatcttgaccatcgaaaatattctaactcctctaggcattaacatttgccagactgaatggggaaaagcgctgggccagggcctttacgaaattaggattagacataccgtaaaaaaatctcaagaacctcac

SEQ ID NO: 3219 - DNA, 312 bp, Corynebacterium glutamicum
atgtcattaaagagttttagttctctagcacaatcagagaagtcaacatggagtaaagaagctaagcaagattacgaggacgcttccgcgctaatcactcaagaactcgcctcacgaaaagctcttggccaaaaactagtcaaggctcggaaacaacgaggagtcacccaagttcaacttgctgaagcttctggagtccaacaggcagaaataagcaagattgaacgtggcctcgccaatcccactttttccacacttgaaagcctcgcatcccacctaggacttcaattcacttttacagaatcagccgca

SEQ ID NO: 3220 - DNA, 138 bp, Corynebacterium glutamicum
gtggcacttgtcccagaagcagagcgttccaccatgttgggtgaaccgatgtcaaaaaaactagggattcaagaggagatccgagagaaggtccaagggccttctgaaaaatcagagttagcgtctgatcgaactgaa

SEQ ID NO: 3221 - DNA, 711 bp, Corynebacterium glutamicum
atggtggtaggtcaggacgatccagtccttgtcgtcaccgtgtgctgcgacggtgtcgcgaaggaatgcgatgtcgtcgtcgatgtccaagtagtcgttggagtccagggacaggaagagtgcattgttgtactcgaagaagtagttctcatcgacctggttagggcgtgggtacatcgcgttgtaggcgtcgtagttgtactggtcgtggtttccattgttcacggccagacggtagttgcgcagggtttctggggagatgtatgcggagtgctcgtcccagctggagtggtttgcctgatcacccgcggagaggatgaaggaggttcctgggttttcgatggtggcgcgttccaggttgtttgcccagttctggacttcttctgcacggttggagtgggtgttgtacagctgggtgtcgccgaagaagaggaagttccagttgtcaccgtaggtgccggtgttgaaggtttgcacttcggaccagccgtcagcttcggagccgacgcggtaggagtaggtggtgttttctgcgaggctatctacggttgcgcggttgactgcgccatcgcggtattcaacgtattcaccttcagctcggtcgcgggaatcgccttcggtgttcacgatgctgacgttttcagaaactgcatcaacggtgattggggatgcgaaggtatcgtccagggagatctgtgcaacctggccggt

SEQ ID NO: 3222 - DNA, 1617 bp, Corynebacterium glutamicum
atggcttcacgccgtttccgtatgatgctcaccgcaagcatcaccgcagcttcccttggtttttccctcaccccagcaatcgccgatgaagctgtaaccgttgctacggcaccctccgtcggattcgattccggcgtcgaacgcgatgcaccattcaccgcagttccacacgacgtagttctcggcgttggagcgacccagtccgagctcattttcaactggatcaccgcgcagggcctaaccggccaggttgcacagatctccctggacgataccttcgcatccccaatcaccgttgatgcagtttctgaaaacgtcagcatcgtgaacaccgaaggcgattcccgcgaccgagctgaaggtgaatacgttgaataccgcgatggcgcagtcaaccgcgcaaccgtagatagcctcgcagaaaacaccacctactcctaccgcgtcggctccgaagctgacggctggtccgaagtgcaaaccttcaacaccggcacctacggtgacaactggaacttcctcttcttcggcgacacccagctgtacaacacccactccaaccgtgcagaagaagtccagaactgggcaaacaacctggaacgcgccaccatcgaaaacccaggaacctccttcatcctctccgcgggtgatcaggcaaaccactccagctgggacgagcactccgcatacatctccccagaaaccctgcgcaactaccgtctggccgtgaacaatggaaaccacgaccagtacaactacgacgcctacaacgcgatgtacccacgccctaaccaggtcgatgagaactacttcttcgagtacaacaatgcactcttcctgtccctggactccaacgactacttggacatcgacgacgacatcgcattccttcgcgacaccgtcgcagcacacggtgacgacaaggactggatcgtcctgacctaccaccattccactttctcccaggcctaccacatggatgacgctcgcattaagtaccagcgcgaacgcctcaccccagtgatctctgaactgaacgttgacttggttctcggtggacacgaccacatctacacccgctcccacctgatgaacggcttcaccccagtcgatgcaggccgcgaagcagttgtcggtgaaactctgaaccctaaggccggcgaagttgtttaccttgcaaccaactcttcctcaggctccaagttctacgacttctacgacttccagctcggccagcgttacgacaccggactggatttccaggaaaccgtcgatcagaagaagatccgcacctacaccgcagtctggaaccaggaccaggttcaggactacaccaacgttgaactgaccccagaaggcctgactgtgaccactaaggacgcagtctccggcgagctggttgaccagttcaccctgagcaagcaggaccgcgacgaagaatctgaagtcccagttgaagatgacaaggacggagacaacgcgaccggctcctccaaccttggtctagctgctatcttggctccagttctggccatcttcggtttcgtcggtggactctttgttggcggcggctccctcgctgagttctttgccaacctcggcgtgaagatgcctttc

SEQ ID NO: 3223 - DNA, 546 bp, Corynebacterium glutamicum
atgaatccttttctttcggacacgttgattgtccagcagacctcttccttcctgtctaacaactttgagatctacaatccagacggcgaagttgttatcagaatcaaaactgaagggtcgttgggctctcggctggtcaagggcgaccgcagattcacactggaagacgccttcggcaccccattgatgcaggtgcgcgatcccatgaactttgttcgcgacacctatgaaattgatgatccaaatggcaatcccattgctcatgtgcggaagcgtttcaccttcttcaacaagcggatggacatcgaactaccaggtgaccgcgttattgaaatgcacggtaacttccttggatttgaatttgagttccgcatgggcgatcggattcctgcgaaagtaacccgaaaatggtccggcgctggcaacggatacctaggccgaagcacctacgcccttattttcgatgaagaagcccctgatgaaatcagaaaagtcatcattggaggcatggtcgcgctagatctgatccgggagaaggaacgtaat

SEQ ID NO: 3224 - DNA, 402 bp, Corynebacterium glutamicum
gtgatcagcaatggggaaggtccggttgttgcgcttcgtggcgacattgatgcgttgcccatggcggagcgatccggcaaagaatacgcagcaaccggagtgacacaggtggataacaccaccggtcaagaaactccggtggcgcatacctgtggccacgatgtgcatatttcatcactgttgggtgcggtgcaggcgttcaattctcatcgggaattgtggaacggaacgttgatggccgttttccagccagcggaagagacggcagctggtgcgaggatgatggcggatcaggacaacgcgccgggaaatcactctccagcgttcgcgccagatatgcagccaactcttgatcgtggtgtggaagcgctggttgtagctgcttctgcgtggctagtaaaa

SEQ ID NO: 3225 - DNA, 150 bp, Corynebacterium glutamicum
ttgcaaagacaactgcgggtgctgatggaagaactagtacagttcttcgcggtagctacgcgtgttgtccaggtcggaaagaagcgcgacgatagtcatgcctcaggcgtaatccgaggtggagggatgcgtcgaaaagcaaaaatcttt

SEQ ID NO: 3226 - DNA, 651 bp, Corynebacterium glutamicum
atggcatggtttttcgcacccgaacccgtgatggttaccgctgatgaggcgcttaaaggtggcaggcatcctgttttagaaaatcctgcgccgcacactgtgttgggaactcctgtgactggtccgtggaaagaaggccagcagcgaatttggattggccttggttgtttctggggtgtggagcaaatgtattggcagatggatggcgttgagggaacttcggttggttacgccggcggtttcacccctaatcccacttatcgcgaggtgtgttctgggcgcaccggccacactgaaatcgtggaggttgtttacgatccttcgaagatttccctcgagcagcttgttgcccgcggcctggaagcacacgatccgactcagggtttccgccagggtaacgatgtgggaacgcagtaccgctctgcttattacaccgagaacgaagaggacgctgcgcgcgtaaaagccgtggtcgatgcctatggtgagacgctgaagcagcacggttttggtgaaatcaccacggaaatcggtgtcattagcccgtctgactacttcctcgccgaggattaccaccagcaatacctggacaagaatcccgatggctactgccctcatcactccacgggcatcccgtgcggggtagaagct

SEQ ID NO: 3227 - DNA, 600 bp, Corynebacterium glutamicum
atggctgtatacgaactcccagaactcgactacgcatacgacgctctcgagccacacatcgccgctgaaatcatggagcttcaccactccaagcaccacgcaacctacgttgcaggcgcaaatgcagcactcgaggcactagagaaggcacgcgaagagggcaccaaccctgaccagatccgcgcactgtccaagaaccttgcattcaacctcggtggacacaccaaccactccgttttctggaagaacctctcccctaacggtggtggcgagcctaccggcgaactggctgaggctatcaaccgcgacttcggttctttcgctaagttccaggatcacttcaactccgcagcactcggcctgcagggctccggctgggcagttctcggctacgaccacatctccggtcgcctggttatcgagcagctcaccgaccagcagggcaacatctccgtcgacatcaccccagttctgatgctcgatatgtgggagcacgctttctacctgcagtacaagaacgttaaggcagattacgtcaaggctgtttggaacgtcttcaactgggacgacgcagcagcacgcttcgcagcagcttccaag

SEQ ID NO: 3228 - DNA, 924 bp, Corynebacterium glutamicum
atgggcaacgacggcggagacctgcgaatcgacgacctacgcagcttcatttcagtcgctcaatcaggccacctcaccgaaactgccgaaagattaggcatcccgcagcccacactttccagacgaatcagccgagtggaaaaacacgcaggcaccccacttttcgaccgcgccggccgcaaactcgtcctcaaccaacgaggccacgccttcctcaaccacgccagcgccatcgtcgcagaattcaactccgccgcaactgaaatcaaacgcctcatggacccagaaaaaggcacaatccgactggacttcatgcattccttgggcacttggatggtccccgaacttatccgaacattccgcgccgaacaccccaacgtagaattccaactccaccaagcggcagcaatgctcctggtagatcgtgttttggctgatgaaactgacctcgcattagttggccccaaacctgccgaggttggtacctctttagggtgggcgccactgcttcgtcaacgacttgccctagctgttcccgcagatcaccggcttgcctccttttctggccaaggagaattgccgttgattactgcggcggaagaacctttcgtggcgatgcgagcaggtttcggcacccgactcctcatggatgcattagccgaagaagccggttttgttcccaatgtggttttcgaatccatggaactcaccaccgtcgcagggcttgtcagcgcaggtctcggcgttggtgtggttccgatggatgatccgtaccttcccacagtgggaatcgtgcaacgcccacttagtccacccgcttatagggaactaggtttggtgtggcgactcaacgcggggccggcacctgcggtggataacttccggaagttcgtggcgggatcgaggtatgcattagaagagggc

SEQ ID NO: 3229 - DNA, 1134 bp, Corynebacterium glutamicum
atgctggccgccggtcttgctgctttcaatggtctttattgcacgcaggcattgcttcccaccatgacggaagagttgggaattacgcccactgagtccgcgctgacggtgtcggctacgactggaatgttggcgctgtgtattgttccggcgtcgatactttcggagaaatttggtcgcggtcgggtgctgacaatttcactcacgttggccatcatcgtgggattaattttgccgcttgtccccaatattactgctctcatcctgctcagaggtctccaaggtgcgctgcttgctggcactccagcggtggcgatgacctggttgtctgaggaaattcaccccaaggatattgggcatgcgatgggaatttacatcgcgggaaatactgtcggcgggctcactggacgtatgattccggcgggactacttgaagtaactcattggcaaaacgcactgctgggaagttctatcgctgcgctgatcttcggcgtaatcatggtggtgttgcttcccaagcagcggaaattccagccgaagaatatcaatctgcgccatgagatttcggcgatggctgctcattggcggaatcctcgtttggcgttgctttttggtactgcgtttttgggcatgggtacttttgtgtcgctgtacaactatttgggtttccgcatgattgatcagtttgggctgagtgaagtgctggttggtgcggtgttcatcatgtatctggccgggacctggagttccacccaggcgggtgcgttgagggagaagatcggcaatgggtcaacggttattttcttgagtctgacgatgatcgcgtcgatggcactgatggggattaataatttgtgggtcacgttggttgccctgtttgtgtttaccgcggcatttttcgcactgcattccagtgcttcgggatggatcggaatcatcgcaacgaaggatcgcgcggaagcctccagcatgtatttgttctgttattacgtgggatcctcggtgattggttgggtttctggattcgcgtttacgcatttgccgtggttggcgttcattggctggttgattctgcttctttgcggagtgctggcgatttgtgtgacgctggcaaggcttgcccgcaacgccaat

SEQ ID NO: 3230 - DNA, 1611 bp, Corynebacterium glutamicum
atgagaagcgattccacatggagcagtcggacttggcacagaaaagctagtagaccagtatcgatttggttgatggttctggtaatcgccggaataatccacccgctcctgccggaataccgttgggttctcattcaccttttcacccttggtgccatcaccaattcgattgtggtgtggtcgcagcatttcacggaaaagtttctgcatttaaagcttgaggaatcgaaacgccctgcgcagctactgaaaattcgggtgctgaatgtgggaattatcgtcacgattattgggcagatgatcggtcagtggatcgtcaccagtgtcggcgcgacgattgtgggcggtgctttggcgtggcacgcaggcagtttggcatcacagttccggagcgcaaaacgcggtcagcctttcgcgtcggcagtgatcgcgtatgttgccagcgcgtgctgcctgccgtttggcgcatttgccggagcgttgttgtccaaggagctgtcgggacatctccaggaacgagtccttctcacccacacggtgattaattttctaggtttcgtgggatttgctgcgctcggttcgctgtcggtgctgttcgccgcgatttggcgcaccaaaattcgccacaatttcaccccgtggtctgtggggatcatggcggtgagcctgccgatcatcgtcacgggcatcctgctcaacaacggctatgtcgccgccacaggcctggccgcgtacgtggcagcatggttgctggccatggtggggtgggggaaggcgtcgataagcaatttaagcttttcgacgtccacctccaccaccgcacccctttggctcgtgggcacgcttgtgtggctggcggtgcaggcggtgatgcatgacggcgagctttaccatgtggaagttcccacgattgcgctggtcatcggctttggcgcgcagcttctgatcggtgtgatgagttatctactgccgtcgacgatgggtggcggcgcgagcgcggtgcggactggaacgcacattttaaacactgcggggctgtttaggtggacgctgatcaacggtggcctggcgatttggctgctcaccgacaattcgtggctgcgcgtcgtggtgtctctgctgagtatcggagcgttggcagtttttgtcattctgctgcccaaggctgtgcgggcgcagcgcggagtgatcaccaaaaagcgcgaaccaattactccgccggaggagcctcgactcaatcaaattaccgcgggaatctctgtgcttgccctgattttggcagcattcggtgggctcaaccccggtgttgcgccggtggcaagctcaaatgaagacgtctatgctgtgaccattaccgcaggtgacatggtgtttatccctgatgtgattgaagtgcctgctggtaaatcactcgaagtcacgatgctcaacgaagacgacatggtgcacgatctgaaatttgccaacggtgtgcaaaccggacgtgtggcgccaggtgatgaaattacggtgaccgtcggcgatatttccgaagacatggacggctggtgcaccatcgctgggcaccgcgcgcaaggaatggatctggaagtaaaggttgcggctccgaat

SEQ ID NO: 3231 - DNA, 111 bp, Corynebacterium glutamicum
ttgttgcaggtaaaggagagatttctgggaaatttatgcgctggacctgacggtacctacatcccaccagatcacttggcgttaaccgttccgattgcattcttcccacaa

SEQ ID NO: 3232 - DNA, 1521 bp, Corynebacterium glutamicum
gtgggaagaatgcaatcggaacggttaacgccaagtgatctggtgggatgtaggtaccgtcaggtccagcgcataaatttcccagaaatctctcctttacctgcaacaatgcagcgcagggcccgccgtgaggttgggttgacggaagttttggatcgtctcccagagcagcccaaaaagcggggccgaattcctttcaccagggcagatctagacaatgatgctgaattggcggagtttgaaaccctcgaagcaattgcagccggcgacaccttgattaccggcgcagtgttcacgggcaccctcgaaggggtggcatgggaagtgcaagtggatgtcttggtgcgcaaccctgatggaagctacatgcccgtgatggtgagcaatcaccgtgtcgcccgtccggatccgcacaaaactatgcagggcattgccgtcacccgcctcggtttgggtcagccgctagagctcaaggcaacgctgcgccaccacacgatcgatggctatcgcctcaccctcgcgttgatgggtttggaggaagctggagcagcacccgagtcttcgatcggcgccgtcgtgggacaggaccgcgattgggcatacctagtggatgtcacccgctacgcccctgcagctcaccgcgcgttgctgaccccggcgccgacagcacctcgacgggtaaaagagtgcgcaacctgcagattctggcccaaatgcgaaccagaactcaaagccgccgatgacatcagcctcttcctcaccggcgaccgcgcagacacctaccgcgaaaaaggcatcaacaccacaacagcgcttatcgacgccaacctcggcgaaatctcccacgtcgctgccgcctggcgcgccgaaatccccgtccttcgacgcgaggcgcacaccagcgccccacgtttcgatgtggaaatcgacgtcgatgtggaagcctacctagatttaggtgcctatttgtggggagcttgggacggcaaaacgtacataccttttgtcatttggtccgatctcggtgaggctgccgaaggtgagaactttgctcgcttctggtcctggctgaaatcgcgccgggacaaagctcgccagcagggacaaaccttcggtgtgttctgctatgccagcaacggcgaaaaccactggatgctctccactgctcgcagattcttcggcaaagtcaaaggtgtgcccgacgagcaagaaatccgcagcttcattagctctgaccaatggaatgacatgtttgctgtcgcgcgctcccaacttgttggccccggtggtttaggtctgaaacaactcgcgccggcagctggattccattgggaggaagaagacttcgcaggtgaagatagcctccacgcatatctcattgcttccacggctgccgaaccagaagctgaggccgctcgtgctcaattgctcagctacaacggcgatgattgcagggccaccgcagcggttcgccattggcttcgacaaggtgcgcgcacggcacctgtgctggggaatatt

SEQ ID NO: 3233 - DNA, 633 bp, Corynebacterium glutamicum
atgggcatcttcgaagccatccgagccgcacgcgcgaagaccaaagctgagatcaaagcagccgaggcaaaagtaaaaactgaggcgaaaaacaaagcaaagctagatctcaagcgcgagaagcttcttgtccagcaggaaaagaatctgctcaaggttgaagaaaagggcctgaagaagcgcaacaagcatgagctgaagatggccaaaaatatccttgagcaaaagcgccaaggacgcctaaacaaagacaaggtgaagcgctgggctggcaccgcacgtgtgctcactccactactgctgcctattatttatcgactctccaccgaagcacgcgatcaggttgttaagggacgtgcccgtcgtgcaggtgtcaccgcggagcagcttagccaattcgcaggtcacgcagcagcgctgaaggctcgtattcaaggtgttcgcgaaaccgcaaagaactccagcctccctgctggctttgtacgcgatgttgaagagcgtctcaatgagctcgaggctgctgcgaataactctgagttcatgtctccacagcagaggaaccgtgcgcaccagtcgatcagtcgtgatctgaaccaggtgtcagatcagattcaggatcgactactggacaag

SEQ ID NO: 3234 - DNA, 1491 bp, Corynebacterium glutamicum
ttgcacaaaatgtgtaccatacacataatgtcatcgagtcctcccgaatcagccacaccacagatcaaatacggcctgctggtggtcactctcgcctcagctggtatcactgtttccctagcgcagaccctggttattccgatcattggtcggttgcccgagatcttcaacaccacggctgctaatgcctcttggatcattactgtgacgctgttggtgggcgcagtggcgactcctgtgatgggcaggcttgcagatatgtacggcaagaaaaagatgatgctcatctcacttgtcccgttcattcttggatcagtgatctgcgctgtgtcggtggatttgattccgatgatcatcggccgtggttttcaggggcttggctctggcctgattcctcttggcatttctctcatgcatgatttgttgccccgggagaaagcagggtctgccattgctttgatgagttcttccatgggcattggcggtgcactcggtctaccgctggctgctgctattgcccagtttgcgtcctggcgggtgctgttctggttcaccgctctggtagcgcttacagttggcgcggtcatttggaaggcgattcctgctagacccaggatcgtgaggagtggcggctttgattatttcggtgctctcggccttgcaatgggacttatcgcattgttgctcgcggtgtccaagggatcagaatggggctggagaagtgccctgaccattgggttattcgtggcagcgctggtgattttggtgggttggggctggttcgaaacccgccagaaatcccctttgattgatctgcgcaccactattcgggcgaccgtgttgatgacaaatattgcgtccatcctcatcggtttcaccatgtatggaatgaatctgatcctgcctcaggtcatgcagctgcctgtaattctgggctacggtctaggccagagcatgcttcagatgggcatctggctgatcccgatgggtctaggcatgatgttgatttcgaatgcaggtgcagccattagcgctgctcatggtcctcgtgtgacgctgacaattgcgggtgttgtgatcgcagtcggttatgcacttactgccacagtgttgttcactatcggcaaccgcacaccgggaggagatgcagacaacgcacttattttgaccaccctggtgctgttctcagtgtgtagtctcgtggtcggtatcggcattggcctggcatttggttccatgcctgccttgatcatgggtgccgtaccagccacggagaaagccgcagcgaatggtttcaactctcttatgcgttcactgggcaccaccggctcatcagctgtcatcggtgcagtgttggccggaatgatgagtggcggagtacccaccttagggggattcatgaccactctgatcatcggatgctgcgccgcgcttgtggctgcggtcatctcctatttcatccccaccacaaccactgtggtggaagcaaaa

SEQ ID NO: 3235 - DNA, 456 bp, Corynebacterium glutamicum
atgagcaccgaccccatcgcggccttggaatacgaatccaccatcttcgcccgtcaccggaatcaatacaccggccaagcaggtacgaatgctggcgtcctcgattccagcggctacaacctactcacgctgctccagttacgtggcccctccaccatcggcgaactcagcgccatcaccggcctagacgcatctacccttaaccgtcagacaaaagccctactaaccaaaggatttgtcgaacgcatcccagatcccgacggtggaatcgctcggaaattccaccccaccgacctcggcaatgaactgctcaacgaggaacgcacatccagccaagaaaaatatgccgagttactttcagactggcccgaagaggatctacgcaccttcgtcaaacttcttgaaaaactaaataaagccgtggagacacgcgtcggaaagcattggccgcgcccc

SEQ ID NO: 3236 - DNA, 636 bp, Corynebacterium glutamicum
atgattcgcgtgctgcttgctgatgaccacgaaatcgtgaggctcggactccgagctgtgctggaaagcgccgaggacattgaagtggtgggcgaagtctccaccgccgaaggtgcggtgcaggcagcccaagaaggcggaatcgacgtcatcttgatggacctccgattcggccccggcgtccaaggaacccaggtttccacaggcgcagacgccaccgcagccatcaagcgaaacatcgataacccgccaaaagtcctggtcgtgaccaactacgacaccgacacagacatcctcggcgcaatcgaagccggcgcactgggctacctgctcaaagacgccccaccgagcgaactcctggcagcagtacgatccgcagcagaaggtgactccacactgtcacccatggttgcgaaccgcctgatgactcgcgtgcgcacccccaaaacctcactcaccccacgtgaactggaagttctcaagctggttgccggtggatcctccaaccgcgacattggccgtatcctcttcctctcagaagccacggtgaaatcccacctcgtgcacatctacgacaagctcggcgtgcggtcacgtacctccgctgtcgcagccgcacgtgagcaggggctgctg

SEQ ID NO: 3237 - DNA, 639 bp, Corynebacterium glutamicum
atgtttcgccacatttccgatcgcaccttgagcaattcgcagaagggtggcttcagttttcatgggcagttggcgaacatcaccgtcgacagaaatcacaaaattaatacccaacaacggttctgtgacgcggtgaagtgctgcttccaaggaggttttagacagcgctgccggttgcaacgccgcaatcatcgcgcgagcctcactgagattgtcggaggctgtttgtcgggcaaggcgcatcttcttcacgatcgcctcctttggcttctcttccatctcagcaacgagaatctcctgttcagagacatgcagcagcatttgaatggaggagagtccctgggcgaccgtgtcatgaatttcatgcgcaatacgttgacgttccgcagcaatacccgcatttcgttccgtcaccgccagctgggagcgagtttcaatcaactgatcaatcaattcctgcttttcattattcacccgccacaacgtgcggaacgcgtaatcaatagccacggtcacgatcgcagagaccaccggacccatcacaccaccaaaggtcaaccccacggaatactggctggcaatcgcaatcgctgtcgcacccaaaatcgcaataatgcctctcacgtcaggcatcacctg

SEQ ID NO: 3238 - DNA, 588 bp, Corynebacterium glutamicum
ttgcgtccggtttccgacacacgatctaggcttgactgcatgcgtcgtacattacctactatcctcgctgcttccatcatgctcaccgcttgtaccccggcggaacctgaagcaaccccagagaccaccaccgaggcagccccggaagtaattactgacggccttcccatcgacgcgatgcccgcggtcgaacgcaccgcacaaaccgcatgcccctacctgggcaccgactgggtcgccgataccaacggccagcgcgtcacgggttacggcacagacgaacgcttttcgacgccctcctgcgttttttactcctaccccgaagaaccacaactcacggtgattgtccgcgatatggccaccacggatgacgctatcgcggtagtggattgggcagcccccatcgattccactgagcccgctgaggaacccgcagggtggtccggtggccgccgaggtggaaacgatacttcaggcgcactctacgcggttcaaaacggccccaccgcggtcatcgtgttcaccaatcaggatcaatccctcaaagcgcagttaatcgctgaggaagtaatccagaatcttggtctc

SEQ ID NO: 3239 - DNA, 1311 bp, Corynebacterium glutamicum
gtgtcggaaaccggacgcaatgagctcgatgttgaaacccttgtgaagaaggggaatcaaccgggcgcgatgagctatcgcaacagtatccacattttgacagcctcgctgctggtcgtggggttgggagcttccgcccgcctgacgctgccgatgtttgcgctgtcgtgcgtgctgttgtttgtgtggggttttctgtacttctatggatcaaccaaacgcgtagatttgagccacggcatgcagctgggctggctgtttgtgctgacgctggtgtggatttttatggtgccgatcgtgcccgtgtccatttatctgctgttcccgctgtttttcctctatctacaggtgatgcctgacgtgagaggcattattgcgattttgggtgcgacagcgattgcgattgccagccagtattccgtggggttgacctttggtggtgtgatgggtccggtggtctctgcgatcgtgaccgtggctattgattacgcgttccgcacgttgtggcgggtgaataatgaaaagcaggaattgattgatcagttgattgaaactcgctcccagctggcggtgacggaacgaaatgcgggtattgctgcggaacgtcaacgtattgcgcatgaaattcatgacacggtcgcccagggactctcctccattcaaatgctgctgcatgtctctgaacaggagattctcgttgctgagatggaagagaagccaaaggaggcgatcgtgaagaagatgcgccttgcccgacaaacagcctccgacaatctcagtgaggctcgcgcgatgattgcggcgttgcaaccggcagcgctgtctaaaacctccttggaagcagcacttcaccgcgtcacagaaccgttgttgggtattaattttgtgatttctgtcgacggtgatgttcgccaactgcccatgaaaactgaagccacccttctgcgaattgctcaaggtgcgatcggaaatgtggcgaaacattcagaggcgaaaaactgccacgtgacactaacctacgaagacacagaagtacgccttgatgtggttgatgacggtgtgggttttgagccttcggaagtgtccagtacccccgctggccttggccatatcggcttaaccgcattgcagcagcgtgcgatggaattgcacggcgaagttatagtggaatctgcatatgggcagggtactgcggtatctgcagcattgccggtggagccaccagaggggtttgtcggggcgccggttttggcagattcggactcaagtgctacaggcgaggttgaactaagttctccaactgacgatgag

SEQ ID NO: 3240 - DNA, 150 bp, Corynebacterium glutamicum
atgtattcacttctgtggcactatcttccaggaccttggtttgtaaaacttctcatcgtattggcgctcattgtgttggtgttcttcctcctcatggatgttgtgttcccatgggtgtccacactgatgccatataacgatgtggccttc

SEQ ID NO: 3241 - DNA, 822 bp, Corynebacterium glutamicum
atgacagccacgttaagcgcggaatcttctcgcaatggtaaaaagccgcggcctcgagtgagtgtttcccaggttgttggtgaaatcttgctcaccgtaggcattttggccttgttattcgcatactatgaggcctattggaccaacgtggaatctgggaaattacaagaatcggctggtcaaaagcttgatgaagactggaatgaagctcgggtgaatcctcgacaaaagctcaccccggaacttggtgaggcatttgcccggatgtatgttccagctttcggctctgacttcaacttcgcagtgattgaaggaaccgatgaggaagaccttcttgccggtcctggccgttatgtggattcccaaatgcctggtgaagccggaaactttgcagtggcaggccaccgagtgggcaagggtgcgccattcaatgatctaggaaacctggaagtctgcgatgcgatcgtggtggagacttacaattcctgggatgtgtaccgcgtgatgccgatgtccaccaacggtgcagatcgtgcagcagaagctgcggattgcttcaacgaaaaccaggtcagccgcatggctgaaggtgactatgtgaatgtgtccggacgaagcatcaccactccggatcgcatcgatgccacctaccccacaccgggcgtcttcgacactgcagtgcgtgaaggatcagaagctctgcttaccttgaccacgtgtcacccgcagttctccaacgctgagcgcatgattgtgcacgcaatgttggtggaagaaatcgataaatcaagtggcgaacgccctgcagctttggaggaaaac

SEQ ID NO: 3242 - DNA, 1302 bp, Corynebacterium glutamicum
gtgaagtgccacctgtttggaaaggcgaacacgatagtgctcgatattttgatttacccggtgtctggagtgatgaagctgtggcacctgcttcttcacaacgttgcgggtttggacgattcactggcgtggttcttttcccttttcggccttgtcatcacgatccgtgcaattatcgcgcctttcacctggcagatgtataagtcgggccgcactgccgcacatattcgtcctcaccgcgctgcgctccgggaagaatacaagggaaagtacgatgaagcgtccattcgggagttgcagaagcgccagaatgatttgaataaggaatacggcattaacccgctggcaggttgtgtgcctgggctgatccagataccgattgtccttggtctttactgggcacttctccgcatggctcgccctgaaggtggtttggaaaatcccgtcttccagtcgatcggcttcctaactcctgaggaagtggaatctttcctcgctggtcgcgtgagcaatgtgcctctgcccgcttatgtttcgatgcccactgagcagctaaaatatttgagcaccacgcaggcggaagttcttagtttcgttttgccactgttcatcacagccgcaatcctcaccgcaatcaacatggcgatgtccatgtaccgcagcttccaaaccaacgattacgcatccggattctctaacggcatgctgaagttcatgatcgtgatgtcgatcctcgcgccgatcttcccactgtcccttggcctcacaggaccattccccacagcaatcgcactctattgggtcagcaacaacctgtggacgctcctccaaacaatcatcatgatggtcattttggaacgcaaatacccacttaccgacgatttcaaagtgcaccacctagagcagcgcgacatctaccgcgcaaaacaaaaagaaaagcgcatcttcctgtggacacgacgcaaaaaccgcgccctgatgattctcaccccatggaacgcctcaacgcttcacgcaacaaacgtggaactcaccaaaacccgtactgccgaaatcaacgaagcaaaacaggcccgcaaagaaatcgcgaacaagaggcgcgaaacgcaacgtgaaatgaaccgcgccgccatgcagcgcttaaagcagcgtcgcgctgaggttaaagctaaaaagaaggggcttatcgacgcctcccccaacgaagataccccttcggaaaatgaagaaactaaattgagtagtccgcaggtggagccgacaacaactgccgagccaaatcgcgagccgtctcaagaggac

SEQ ID NO: 3243 - DNA, 639 bp, Corynebacterium glutamicum
gtggctgctagcgcttcaggcaagagtaaaacaagtgccggggcaaaccgtcgtcgcaatcgaccaagcccccgacagcgtctcctcgatagcgcaaccaaccttttcaccacagaaggtattcgcgtcatcggtattgatcgtatcctccgtgaagctgacgtggcgaaggcgagcctctattcccttttcggatcgaaggacgccttggttattgcatacctggagaacctcgatcagctgtggcgtgaagcgtggcgtgagcgcaccgtcggtatgaaggatccggaagataaaatcatcgcgttctttgatcagtgcattgaggaagaaccagaaaaagatttccgcggctcgcactttcagaatgcggctagtgagtaccctcgccccgaaactgatagcgaaaagggcattgttgcagcagtgttagagcaccgcgagtggtgtcataagactctgactgatttgctcactgagaagaacggctacccaggcaccacccaggcgaatcagctgttggtgttccttgatggtggacttgctggatctcgattggtccacaacatcagtcctcttgagacggctcgcgatttggctcggcagttgttgtcggctccacctgcggactactcaatt

SEQ ID NO: 3244 - DNA, 261 bp, Corynebacterium glutamicum
atgcttgccctaggttggattacatggatcattattggtggtctagctggttggattgcctccaagattaaaggcactgatgctcagcaaggaattttgctgaacatagtcgtcggtattatcggtggtttgttaggcggctggctgcttggaatcttcggagtggatgttgccggtggcggcttgatcttcagcttcatcacatgtctgattggtgctgtcattttgctgacgatcgtgcagttcttcactcggaagaag

SEQ ID NO: 3245 - DNA, 903 bp, Corynebacterium glutamicum
atgagcactgaagacattgtcgtcgtagcagtagatggctcggacgcctcaaaacaagctgttcggtgggctgcaaataccgccaacaaacgtggcattccacttcgcttggcttccagctacaccatgcctcagttcctctacgcagagggaatggttccaccacaagagcttttcgatgacctccaggccgaagccctggaaaagattaacgaagcccgtgacatcgcccatgaggtagcgccagaaatcaagatcgggcacaccatcgctgaaggcagtcccatcgacatgctgttggaaatgtctcccgatgccacaatgatcgtcatgggttcccgcggactcggcggactctccggaatggtcatgggctccgtctccggtgcagtggtcagccacgcaaagtgtccagtcgttgttgtccgtgaagacagcgcagtcaacgaagacagcaagtacggcccagtcgtcgtcggtgtggatggctccgaagtctcccaacaggcaaccgaatacgcatttgcggaagctgaagctcgtggcgccgaactcgttgcagttcacacctggatggacatgcaggtacaggcatcacttgcaggtcttgcagctgctcaacagcagtgggatgaagtggaacgtcagcaaaccgacatgctgatcgaacgcctcgcaccactggtggaaaagtacccaagtgtaaccgtcaagaagatcatcacccgtgaccgcccagttcgcgcacttgcagaagcatctgaaaacgcgcagctcctagtcgttggttcccatggtcgtggcggatttaagggcatgctccttggctccacctcccgcgcactgctgcaatccgcaccgtgcccaatgatggtggttcgcccacctgagaagattaagaag

SEQ ID NO: 3246 - DNA, 987 bp, Corynebacterium glutamicum
atgtctagtgtagtcggggaaggcccaaaaccacgattgagcgtgcttgatctcgtcgcgctgagtgaagggatgacggccggcgaggccattgcacacagtgttcgcgctgcgcagatcgccgaagagcacaattatgcgcgtttctgggtggcggagcaccacaactcggaaggcttggcatcttccgcgacgacgctgctcatgggtcatattgcaggccacacttcacgcattcgcgttggctccggtggcatcatgatgcccaaccactccgcgctgcacgtcgccgaagaactcggcacccttgaggccatttaccccggccgcatcgaggccggcctagggcgcgcaccaggaaccgaccccatgacggcgcgggaattgggtcgggcaagttcgcttgtcgacgacgtcctctccacaatcgtctccctccagaattatttggacacccccgaagaacgcccgaacatcatcgcgcatccaggaataaattcccgtgtgccgctattcatgctgggatcttccctcaacggcgctgcgatggccgctaaattagaccttccattcgccttcgccagccacttcgcacccttccaaatggggcccgccatcgcctcctatcgcgaactagcagccaatccttatgtcatggccgcagcgaatgtcctggtgtgcgacaccgaggaagaagccgaattccagatctccacactgcaccaaatgttcgccggaatcgtgacgaactcccgcggcaaacttgccccaccagtgcggaatctgaaagacaaactcgacccgatgatctggaaacacatcgaagattcattggaaatgactttcatcggaacagccgaatcagtggtattacaactgcaggaattcgctgatcgctacaagttagatgagatcattacagtcacctactcctacgaccccgaagtcaggttccgctccatagctgcacttggcacggcatggaat

SEQ ID NO: 3247 - DNA, 966 bp, Corynebacterium glutamicum
atgaaagcgccgctacccatccgcgacggcctcaacccttcccgtgtgcgcttgccgctcgacgcggcgccgatccgcgccatcgattttgttgaatacctcatttccacgcagcgccaccgcaatccggccgacaacgccgaagcgcttcaagcgcgtttcgacgccgaccttgttgtcaaccactacggcgagccctacgcccccgacaccatggttcagcccgacgacgacatttggttctaccgcatgcccgccgccgaacggccgatcccttacaaaattcatgtcattcacgaagacgatgacatcctcgtcattgacaagccaccctacctagcaaccatgcctcgtggccgccacatcaccgaaaccgctctggtgaaaatgcgtgtgctgactggaaacaacgatctcaccccagctcaccgcctcgatcgcctgacttccggtgtgttagtcatggtgaaaaaaccagaactccgtggcgcttaccaaaccttgtttgcccgacgtgaggcgtccaaaacctatgaggcaatcgcagaattcgttccagggctacttgatgatggtcccgcgatttgggaatcccgcatcgaaaaagaacgcggcatcgtgcaagccttcgtcgtggaaggccccgtcaacgcacgcactgaactggtgtcagtcaccccagtcgaagacgccgaacagagcatcctcgaagaaatgcacggcccactcccccgccaagcgcgctacgttctagccccctcaacaggcaaaacccaccagctgcgcatccacatgcgcgacttcgcagcccccatcctcggcgaccccctctaccccgtcctccacgcagtcgacgatgaggactacaccaccccaatgcacctcatcgcccgcacgctaaccttcgtggatcctcaaaccaacgaggaacgtacctttgtgagtaatcgacctacgggaagtttg

SEQ ID NO: 3248 - DNA, 273 bp, Corynebacterium glutamicum; identical to SEQ ID NO: 87

SEQ ID NO: 3249 - DNA, 141 bp, Corynebacterium glutamicum; identical to SEQ ID NO: 86

SEQ ID NO: 3250 - DNA, 207 bp, Corynebacterium glutamicum
gtgcgtatgttgtttgagaactcaatagtgtgccatttattatttttgtcactaccacagatcaccttgggtgatgtgtggtgggtcatgccgggtggtggatcgccaattttatccatcactgtaaacaataatcttattgttggcatgattttgtgggtctgcttgttccccgtcaagggattcaggcccacgttgaaggcacga

SEQ ID NO: 3251 - DNA, 363 bp, Corynebacterium glutamicum
gtgaccgtgcctctgtataaacagatcgcttctttgattgaggactccatcgttgacggaaccttgagcattgatcaacgcgtgccttctactaatgaactagccgcgttccatcgcattaatcccgccaccgcacgcaacggcctgaccctccttgtcgaagccggcatcctctataagaagcgtggcattggcatgttcgtcagcgcccaggccccagcactcatccgagagcggcgagatgccgccttcgcggctacttatgtagcaccgcttatcgacgaatccatccaccttggtttcactcgtgcgcgcattcacgcccttttagaccaggtcgctgaaagtaggggcctgtacaag

SEQ ID NO: 3252 - DNA, 1416 bp, Corynebacterium glutamicum
atgcttgaacgcacacaggtattcgtggatacgtcctacctgctcgcaagcttttacaactcttgggagacaggggcacgtgcccaattagaaatcgacctccccgaagtagtcggggtattaggaaggatgattgaacaacaacttaaacagccagtacaacgccaaatgtggtacgacggaatccccgattccggcccccaccgctatcaacgagcactacgcacctgcgatggtgtgcaacttcgtgctggccaattaattgaatggggcgaacgccgcacacaaaaggcagtagatacccgccttgttgcagacctcgttctcgcaggtgttcgcggacaatgctccgatatcgtgctcgtcagtggcgacgccgacatgatccccggtgttcaagaagctgccaatgcaggccttcgcgttcacctctacggcttcggctgggattccatgtcctcccaactgcgccactgctgtgacaccaccaccattttggatcctcgagaagattttgctgaatgcatgcagctgcaggttctcgaaggtccactaccccctgtcgttcgggtaaagcccatcaacgatgcagaacccatcgaggatttggatttcactccagttccaggcgtcgcctcaccatttgaagaggtcagcgcgaaagatgagaaattctctccacgcccaagtgaacctgccgaagctttgtcggaacaggtctgtgaagcgcagtatgagatctccaaacacgaaggtcaaaccgctgattcaggagaaatcaccgagtctttcgaggccgctgaaatcaaggtaactgagttttttggagaaccagctgctccagtagcggaatcaggcgtagaagctcccactccggaagctcccacggttcctgaagcagctaagcccactccggcgaaacctaagactccaaaggcagagccccaaaagcaagaatcccccaagccgggaactccaaaaccaaaagctccaagccctgcggatattccaccgaaagccccagctgacactgaggaacattcggaagtcgaagctgaaatcgaggactcacgtccaaagatccccagcccttcgatgatggctccccgccgcaagcttcgttcccgctacgttccgcttcccaacgaagtgtgggcaacagcaggattccaaactccttacgatgtcgggcaacagtacgcatcgtggtggtttgaaaacgcagctaccagcactcaaagagatcaggctcatctattgtctggtggcggacttccaccagagatcgatcgcccgcttctgcagtttgcttgtgaaactctccacgaatacaccctgactgaagcgcagcgcgtagctttacgcgatggctttcactccggaatccgtggtgtattgctcaaccagcgagatagc

SEQ ID NO: 3253 - DNA, 873 bp, Corynebacterium glutamicum
atggctaatccgctcagcaagggctggaagtatctcatggcatcgttcgacaacaagatcgatgagaatgcagatccaaagatccaaattcagcaagctacagaagctgcccagaagcagcaccagcagattatgcagcacgcttctcagattatcggtcagcagaagcagcttgagatgaaattgaaccgcttggttactgaccgcgataagttgcaggaacaggctcgtcaggcaattcagttggcagataagtccgcaaacgaaggcgacagtgttaaggctcaggagttcaacaacactgctgaggtttttgcttcccagttggtagctgtggaacagcagttggagcagactactgcgcttcatcagcaggctgaggttgcggcgaaggatgctgttgcgaagtctaaagagtctgagatgcgcctgaaagagcagatgtctcagattgatgctctacgtgcgcaggctgatcaggcgaagatgcaggaaagtgtcactaagtctatggattctttgaatcagtttggcactcaggattcttctgttcctacccttgatgcggtgcgtgagaagatcgagcgtcgatacgcagatgctttgggcgcgcaggaacttacccagaacactgttagtgatcgcatggctgagattgcgcagtccggcaccgatatgcgggcgtcagctcgtttggctgaacttcgcgcggaggcgctgggcacgtccgcaacgcctaagggccagctagaggcaggtgtcgaggatgcggaagaacttatcgacgaaacctccaccccttcagctaccccagaaaccgcaagcccagaagctgatgctccagaagcatccgcagacgagtccgagaagaaa

SEQ ID NO: 3254 - DNA, 153 bp, Corynebacterium glutamicum
ttgaaaaatcatttctgcgcccgcaagcaaatcactgaatccgattcgctgctcagaacccgagtctacgcaaaactgcactctgctgaacgctcatttgaaaaaatgggggatggttcggggtcttcatcaggggtgaaggtggtgcgccct

SEQ ID NO: 3255 - DNA, 1452 bp, Corynebacterium glutamicum
ttgagatcatacctaaacccctgcccccagaaacccgatgcaagatcatcgatttcgatctgttcgcaccgaacagtccctcgatcgaagagttctgcagtcggcttaaaatatcgcggcgcagcttctacaacatccgcaaccgataccaacaagatgccagtgcagcgctgcatccacgctccagcgcccagatcacctcccggcgaacatacgatgaatccatcaccagtatcttgttggccatccgcgcaccgcctgaaagcccaaggatgggaatacggtccgatctctatccgattcgaaggcatcgccaccggggaactgactgcaccgattccatccgtctcaactatcgcttgcttgttacgcgctgcaggagcagtcgaaagtaaccctaagaagcgaccaaagtcgtcggtggtgaggtttcaacgaggtcaagctatggaaatgtggcaaatagatggtttcatttacacgctgcacgatagtgatctgactcgggtaacgatctatcaaatccttgatgatgccactcggtttgatgtcggaacctgtgtctttcccgcgaatgaaaactcagtcgatgcccgaacagtgctagaacaagcgattgctcattttggtgccccgcatgaattactcagtgataacggctcagcgtttaaccggatgcggcaaggatacgtcggaagtttggaaagctatctcgcgacggtggggtgtttaagcattaccggcaagcctgggcatcctcaaacccaaggtaaaaacgaacgcggccaccgcacactatttcgtttccttcaagctcatcaaccacacacacttgaggaatgtgcgcactatattgaacagttccgtgatcattgcaacaatcgtcgtccacatcaggggttgccgaataatctcactccggctgcggcctgggagattgtggggtgtgtggagcaacaacccccgattgatcccgtcgtgcttcaacagcaagctgatcactatgcccgtcgtcgaattgagaagcaatcagatgtctcgcttgttcggcaggaggaatctgttccggtgtctaagatgcagcagaccgagcaacgtcgacgggtacgtcgttttggtaaaaagccggtggatcctgatgtgtttacgtttgctgggaataatcagaaggtggtgttccaggggatgcgtatttctgttcctcgtacgatgagggacagggagttttatcggacggtgacggcaactgagcttggtttctgggatgcgataaccggggagcttgagttgttgatttcgttgccggttgtggcgattgcccggggtaagtcgtatatcagttcttacaacattcgtggggtgtggatgcaacacccgacgctgttgtggcaacgcaaacgtgatgaggctgagaagcgatttaagtcgatagatccgggggatctactgcgc

SEQ ID NO: 3256 - DNA, 1068 bp, Corynebacterium glutamicum
gtggtacgtcaaactcttcggcggccaccagggtgcacgttccctgcacttcatcgccatggtgttgatgacgggctttgtcatcatgcacgtcggcctggttttttggtccatggcgactacaacatggtccacatggtcttcggcgatatgaacactgaccgtgcggcgcaggcctacatcatcgtgatcaccaccatcgtcatggtggtgttgttctggatcgtgctcagctattggtcgctggctgaccgggcccgcgcccagcggttcaccgccagcatcacggagatcggacgcaaaatcttcctcaaccggctgcgtccccggatgagcaggcagaacacctacacggacaaggacatctcgcagttccactggaccaatggcctgccgccgaccgatgatgaatcccccgagtggatcgccgcccgcgacaacgagtgggagggatacaccatcaccctcggcgacgatcccaacggcaccgagaaaaccatcaccctcgacgatctgcgggagctgccgcagacctcgtatgtcgccgtccacacgtgcatgcagggctggtcagctaccgcccggtggacaggggtgcggttacgtgatgttttgtgtcatgaccttgtgcacaccctagaccttcaccacaggcatagtcctcggctgctcacaattgagatcatacctaaacccctgcccccagaaacccgatgcaagatcatcgatttcgatctgttcgcaccgaacagtccctcgatcgaagagttctgcagtcggcttaaaatatcgcggcgcagcttctacaacatccgcaaccgataccaacaagatgccagtgcagcgctgcatccacgctccagcgcccagatcacctcccggcgaacatacgatgaatccatcaccagtatcttgttggccatccgcgcaccgcctgaaagcccaaggatgggaatacggtccgatctctatccgattcgaaggcatcgccaccggggaactgactgcaccgattccatccgtctcaactatcgcttgcttgttacgcgctgcaggagcagtcgaaag

SEQ ID NO: 3257 - DNA, 249 bp, Corynebacterium glutamicum
ttgcaaatgctgggctacaccttcgtcatctttatcctggcgccgtttctcatcctcaccggaatagcgatggccccggccatccggtcccgcttcccgtggtacgtcaaactcttcggcggccaccagggtgcacgttccctgcacttcatcgccatggtgttgatgacgggctttgtcatcatgcacgtcggcctggttttttggtccatggcgactacaacatggtccacatggtcttcggcgata

SEQ ID NO: 3258 - DNA, 309 bp, Corynebacterium glutamicum
atggctccgggtcaccaaatgcaaactgcccaaggaggaagggtctacacctcactgatggacgagaagtccctttccccgttgatcggtctgccgggtcgggagaacatcggcctgggccgacactggcacggtctgtcgacgatgttgcgggtgctcaacggcatcgtctacgtcgttctgctgttcgccaccgggctgtggcaaggcattatccccacctcctgggacgtcttccccgaggcgtgggagacattgaaggtttacctgggctttcgtgccccaggcatcgagcacttcaccccccta

SEQ ID NO: 3259 - DNA, 711 bp, Corynebacterium glutamicum
gtgtcgtcctacaggccgttagaatccagactcgcgggcactagccgcgcgactgccgacaaccgcacgccgtgtaccggaaggcttggaacgcctagggtgttcctcatggcaacagatgacgttagcaaggcctacagctcaccgacctttgatgcggaggcactgctcggaacggtaatctcggccgaggaccccgaccgcgtgctcatcgagccctgggcgaccggcgtcgacggggtgatcctcgatgtgggctctggtaccgggcggtggaccggtcacctcgcgagcctcggacaccagatcgagggactggaaccagcgacacggctcgtagagctcgctcgtcagacacatccctcagtgacctttcaccacggcactattaccgacctctcagactcgccgaagcgctgggcaggcctgttggcctggtactccctgatccacatgggcccgggcgagctgcccgacgccctggtcgcactgcggatggcggtggaggatggtggtggcctgctgatgtcctttttctccgggccttctctggaaccgatgtatcatcccgtggccaccgcctaccggtggccactgcccgagcttgcccaggcactggagaccgcgggtttccaggtcaccagtagtcactgggatcctcggttcccccatgcctatctcaccgccgaggccagcaagcagaatctcgcc

SEQ ID NO: 3260 - DNA, 720 bp, Corynebacterium glutamicum
atgatcatctccactaacaccgctcaccccctgcacgaaccgcacgtacccagccaccacaatcgtatgaatactctgcgtgccggtgtgctgggtgctaatgacggtatcgtctccattgctgcgctactgctcggtgtgatcgccaccggcgccagtgacaccgtcgtgttcggcgctggtttggcctcaacgatcgcgggggcggtatctatggctctcggtgagtacgtctctgtctcctcacagcgtgataccgaacgggtgctcatcgcaaaagaagcgaaggagctggccgaagacccgacggccgagcacgtcgagctgtcggagatcctacactcctacggcatctcccctgagactgcgaaccaggcggccaccgagatcgggcagggcgacgccttgggcgcccaccttcagctcgagctcggtattgataatgagcaactgaccagccccttggccgccgccttctcctcggccgtggctttcctgctcggagcactgctgccgatggtgtcggtattcatcgcccctgcaggctgggacgccggcgtggtcttcgtagtcacgctgctggtcctggcggtgaccgggttcatctcagcccagatctcgggtacctccccaatgcgcgcgtgcgggcgcctggtgatcggtggtgccctcggcctggccctgacctacggtgtcggtgttttgttcggggccgcagtc

SEQ ID NO: 3261 - DNA, 204 bp, Corynebacterium glutamicum
gtgaattactcctggagatcacgtggagaaggtgaaccggatctccttcggcatgatgtggacagccttaaactctgggtctgccacgatctcgtgccagatatcagcgggaatgacgaggctgtctcccgcgctcacaccacggtcttcggcagagaactgaacgatgcatcgcccctcggtgacgacgagcaccgattcggt

SEQ ID NO: 3262 - DNA, 378 bp, Corynebacterium glutamicum
ttgggcgatcgacaccttggactcaccagcttctacccgtttccgggctttctcgacgtcgtccggggtgagggcgcgtttgcggcccttgtacttgccggcctttttcgccaggcgatcccctcggcttggcgctcccggatgatggagcgttcgaactcagcgaaggagccgagaatgctcagcatgagctgggcccgcaaagcattggattccgccgagaagatcaggttttccttgatgaagtgcacgctcgcacccttggtggtgatttggtcaatgatcttctgcaggtcgaccttcgaccatcacaatgacaggccaggaacaactattggtacgagggacatgaaacatcgcagtcaggttctccttgtt

SEQ ID NO: 3263 - DNA, 186 bp, Corynebacterium glutamicum
ttggcgctcccggatgatggagcgttcgaactcagcgaaggagccgagaatgctcagcatgagctgggcccgcaaagcattggattccgccgagaagatcaggttttccttgatgaagtgcacgctcgcacccttggtggtgatttggtcaatgatcttctgcaggtcgaccttcgaccatcacaa

SEQ ID NO: 3264 - DNA, 216 bp, Corynebacterium glutamicum
gtgcacttcatcaaggaaaacctgatcttctcggcggaatccaatgctttgcgggcccagctcatgctgagcattctcggctccttcgctgagttcgaacgctccatcatccgggagcgccaagccgaggggatcgcctggcgaaaaaggccggcaagtacaagggccgcaaacgcgccctcaccccggacgacgtcgagaaagcccggaaacggg

SEQ ID NO: 3265 - DNA, 483 bp, Corynebacterium glutamicum
gtggggaacatcatcttcgtagaagatggcttcaaccgggcagacgggctcgcaggcaccgcagtcgacgcactcatcggggtggatgtagagcatccgtttgccctcgtagatgcagtccacgggacattcctcgacgcaggctcgatccaggacatcaacgcagggctgggcgattgtgtaggtcatcggatctccaatactacggataaagacgtggaaaataggttcactgtcatcctattagctccccgacccttcaccaaggggcacatattttcgattatccccgccaccagtagcggtaaggatagtggaaccggtcagctggtcaccgtcgcatgctggtacaaacatcaggggcaggaggccggtgatcgaacggtgccggtccatggtctcgccgcggaagacggaccctcggcgggctcaaacaccccaggggaagtccctatctttcttattgcgtcagtttggcaatgg

SEQ ID NO: 3266 - DNA, 321 bp, Corynebacterium glutamicum
atgacctacacaatcgcccagccctgcgttgatgtcctggatcgagcctgcgtcgaggaatgtcccgtggactgcatctacgagggcaaacggatgctctacatccaccccgatgagtgcgtcgactgcggtgcctgcgagcccgtctgcccggttgaagccatcttctacgaagatgatgttccccacgaatggtgggactacaccggcgctaacgccgcctttttcgacgacctcggttcgccaggcggtgccgccagcctgggtccgcaggacttcgacgcccagctcgtcgcggtgctgccgccacagaaccagaac

SEQ ID NO: 3267 - DNA, 333 bp, Corynebacterium glutamicum
atgcacaaaatatcgatcgaggccctcgcccgcaagcaacttaaagaggccgtcgccgcccctagtgctcgtgccgccgataccgtcttcggcgggcacgaaaaaattctgcggcagaccgtcgtcgggatacgtcagggtgctgagctcggagagcgcgacaatcacgatgaatccacgatttatgtcctacaagggcgtgtccaactcaggacgggcgatgagacctggataggtcgcagcggtgatctgttgatcgtgccgcgatctcggcacagcctcgaagcaatcgaggactccgctgttttgatcaccattgccaaactgacgcaa

SEQ ID NO: 3268 - DNA, 111 bp, Corynebacterium glutamicum
atgacttcagcggggcgtgccggtcgatcacaccacgattctcaccgctgggtccagacatacgcccctgagctggacaagcaaacacggtggtaccggcaggtacctgac

SEQ ID NO: 3269 - DNA, 162 bp, Corynebacterium glutamicum
gtgccggtcgatcacaccacgattctcaccgctgggtccagacatacgcccctgagctggacaagcaaacacggtggtaccggcaggtacctgactagcaggccagttcctggcgggtggataagacctacatccgggtacggtgtcatcggtaatcggtgg

SEQ ID NO: 3270 - DNA, 1038 bp, Corynebacterium glutamicum
gtgtcatcggtaatcggtggtgacgtcgctgaccccgaggagttccatgtcctcctgggctctcaccgcgtcggctacacgtttaccgatgacaccgtacccgtttactgcaaccttgattttattcggcatgctgattgtccttcccggaaatcctggtttggcccgatggtcgtatggtcgtgtttctcatctggggtggtcggggaatgtccttgttcagagctcgttgagcatctgctccatctcggcgatctcggcctcctgatcttcaatgacctgctcagccagagcgatggcctgcgggttctggccatcagtgacctcatcgcgggccatatcgaccgcgccctcatggtgggcggtcatctgctcaaggtagagccgggcagcctcggtgccctgggcgtcctcgagggctgtcatgtcctcctcgctcatcattccactcatcccgccatggtccatctcacccatatcaccggtgaccggatcttcttcccaggtctcgagcatggtattcatccggtcgatctccgggccctgggcatcgataacaccctgggtgaactcgatgacctcggccgggatatcgtccttggccaggaggatttcactcatctccacggcctgttggtgatgcgggatcatcatctgcgcgaacatgatgtccgcatcattgtgctcggcggagacctctccggccgcccccgtctctgtctcaggatccgtggtggccccggtcgtttcggtggtgtcgggggcggacgtagtggcgatggtcgtggtgtcggtgttttctccctcagtgttatctgcgcaggcggacaaaaccagggtggaggtcaaggcgagagcggcgatggtgatagtgcgcttcatgggggttccctttcggaggttgtgtatgggggagtcgatgaaggattgaaagtcagcggacgggggctgcagagctcacagcagccttctcctccttcccgtcggtcggagctaggtgagccgggtccaggtcgatccggcgtagcagctgggcgt

SEQ ID NO: 3271 - DNA, 126 bp, Corynebacterium glutamicum
atgccgaataaaatcaaggttgcagtaaacgggtacggtgtcatcggtaaacgtgtagccgacgcggtgagagcccaggaggacatggaactcctcggggtcagcgacgtcaccaccgattaccga

SEQ ID NO: 3272 - DNA, 660 bp, Corynebacterium glutamicum
atgaagcgcactatcaccatcgccgctctcgccttgacctccaccctggttttgtccgcctgcgcagataacactgagggagaaaacaccgacaccacgaccatcgccactacgtccgcccccgacaccaccgaaacgaccggggccaccacggatcctgagacagagacgggggcggccggagaggtctccgccgagcacaatgatgcggacatcatgttcgcgcagatgatgatcccgcatcaccaacaggccgtggagatgagtgaaatcctcctggccaaggacgatatcccggccgaggtcatcgagttcacccagggtgttatcgatgcccagggcccggagatcgaccggatgaataccatgctcgagacctgggaagaagatccggtcaccggtgatatgggtgagatggaccatggcgggatgagtggaatgatgagcgaggaggacatgacagccctcgaggacgcccagggcaccgaggctgcccggctctaccttgagcagatgaccgcccaccatgagggcgcggtcgatatggcccgcgatgaggtcactgatggccagaacccgcaggccatcgctctggctgagcaggtcattgaagatcaggaggccgagatcgccgagatggagcagatgctcaacgagctc

SEQ ID NO: 3273 - DNA, 2217 bp, Corynebacterium glutamicum
atgagcactccccaccaccacggtgatcaccccgctccggaaacagaccacacccaccacccgaatcatgccggtcacgagcaccatgcggatgccgccacccacggccaggccatgccgcacgatcatccgcattccactgtcgatgaagaacatcaggtccacagtcacggtgaacacgccggccacagcgccgcgatgttccgggaccgcttctggtggtcgctgatcctgtcggttccggtggtgttcttcagcccgatgttcgccgacctgctgggatataatattccggagattccgggagcctactggattcctccggtcctgggcacgatcatcttcctctacggcggcacccccttcctcaagggcgcaatgaccgagctgaaatcccgccaaccgggcatgatgctcctgatcgccatggcgatcaccgtggcgtttatcgcctcctgggtcaccaccctggggctgggcgggttccacctagatttctggtgggaactggccctgctggtgaccatcatgctgttgggccactggctggagatgcgcgctcttggtgcagcctcctccgcgcttgacgcgctggcagcgctcctgcccgatgaggccgagaaggtcgtcgacgggaccacccgcaccgtagcgatctcagagctggccgtcgacgatgtcgtgctggtccgagcaggtgcccgcgtcccggccgacgggaccatcatcgacggagcggccgaattcgatgaggccatgatcaccggcgaatcccgacccgtctaccgggataccggtgagaccgtggtggccggcaccgtggccaccgacaacaccgtccgtatccgggtggaggccaccggtggggacaccgccctggcaggcatccagcgcatggtcgccgacgcccaggcctcctcctcccgggcccaggccctggccgatcgagccgcagccttcctgttctggttcgccctgatcacggccctgatcaccgccgtggtctggaccatcatcggcagccccgacgatgccgtggtccgcgcggtgaccgtgctgatcatcgcctgcccgcacgccctgggcctggccatcccgctggtcatcgcgatctcctccgagcgcgccgcgaaatccggggtgctcatcaaggaccgcatggcactcgagcacatgcgcaccatcgacgtcgtcttgttcgataagaccggcaccctgaccgaaggcgcacacgccgtcaccggcgtggctccggccacgggtatcgccgagggtgagctgctggccctggccgccgccgctgaggccgatagtgagcaccccgtggcccgcgcgatcgtgactgccgcggccgcacacccggaggcctcgcagcgtcagctgcgcgcaaccggtttcaccgccgcctccggccgcgggatccgggccaccgtcgacggtgccgaaatcctcgtgggcgggccgaacatgctacgcgagttcaatctgaccaccccgggtgagctcgccgacatcaccggttcctgggcacagcgaggtgccggagtgctccatgtcgtccgcgacggtgagatcatcggtgcggtggcagtggaggacaaaatccgccccgaatcccgcgcggcggtacgcgccctgcaggcccgcggggtgaaggtggcgatgatcaccggtgacgccacccaggtcgcccaggcagtgggcaaggatctggggatcgatgaggtcttcgccgaggttctgccgcaggacaaggacaccaaggtcacccagctgcaggagcgcggtctgagcgtggccatggtcggcgacggtgtcaatgacgccccggccctggcccgggccgaggtcggtattgcgattggcgcgggtacagatgtggcgatggagtccgccggggtggtcctggccagtgatgatccccgggccgtgctgtcgatgatcgagctctcccatgccagctaccgcaagatggtccagaacctggtctgggcgaccgggtacaacatcgtggccgttccgctggccgccggtgtgctcgcccctatcggtgtgctgcttcccccggcggcggccgccatcttgatgtccctgtccacgatcatcgtcgccctcaacgcccagctgctacgccggatcgacctggacccggctcacctagctccgaccgacgggaaggaggagaaggctgctgtgagctctgcagcccccgtccgc

SEQ ID NO: 3274 - DNA, 171 bp, Corynebacterium glutamicum
atgggaggggaaaccccgcctgatcccccgatcccacaggagcgatccgatgaccaccccgacttcccccttgctgccgctggcctccgacggttgtggatgctgcgcgccctctacaccgtccgcgaccgtctccgcctcggccgtggccgcggcaaccgacgcaacacc

SEQ ID NO: 3275 - DNA, 192 bp, Corynebacterium glutamicum
atggagcagatccccgagcccttcctccgccaggtccaaatcgatccggtgttcctgggcccgggagacatcgtcgatgtcttccatcaaccgggtcaggcgggtgagttggtcagccatgatcgtgtgggtggcattattccagtccacgaccccgtcctggagaccatcgaggtagaccgtgagcaccga

SEQ ID NO: 3276 - DNA, 1197 bp, Corynebacterium glutamicum
atgaatcacagacccggcctgaccttccgcttcctggccgcccaggtgttggtcgtggtgattagcctgctggtggccgcggccgtggccacgatggtgggcccgaccctgttccatgatcatatgttgatgaccggccgggaggacccctcgctggagctgttccatgccgagcaggcctaccgggacgccaacctgatcaccctggccgtcgccctgcccaccgccttgatcagcgccctgctggccagcctgtggttatcgcgtcgcctgcgcacccccctgcaggatctcacccgcgccgctaccagcctgacggccggcaactaccgtatccgcgtgcccgccggagaagcaggccccgaggtcaccaccctggcgcatgccttcaacaccatggccgaccggctggaacacaccgaacaggtccgccgccagatgctctctgatctggcccacgaaatgggcacccccttatcggtgctcacggtctacctcgatggtctccaggacggggtcgtggactggaataatgccacccacacgatcatggctgaccaactcacccgcctgacccggttgatggaagacatcgacgatgtctcccgggcccaggaacaccggatcgatttggacctggcggaggaagggctcggggatctgctccataccgccgctgctgccgcgggggaagcttatgctgacaaaggcgtcgatttacaggtcgagaccattatggacaccgtccgggtgctcgtggaccggcaacgcttcggccaggtgatgagcaatctcctgtcgaacgcgctacggtacaccccggccggcgggcaggtccggatcagcgtccaccgacagggggcgtccaccgcgctcatccacgtcgccgatgacggcgagggcatcccacctggccagctcggacacatcttcgaacgcttctaccggggggatgccgcccgcagccgggacaacggcggggccggtatcggtctgaccatctccaaggcattgatcgaggcccacggcggcactctcaccgccacctctcctggccccggtgccggatcggtcttcaccatccgtcttcccctgcaccaggaaaacgtgtccctgatgctcagtgaccccactcccggggacaataattctgatgacctcggcagcgatccgtatcaaccccttgacaatacccca

SEQ ID NO: 3277 - DNA, 828 bp, Corynebacterium glutamicum
gtggacatcgacgatgcgttcatcgccgacccaggtggtgtcccagacctcggtgatcaggtcgtggcgggtcagcacctggccggggcgcagggccagggcaaccagcagctcgaactccgtgcgggtgagctccacggtcgtctcccccacccacacctgatgggcgacggggtcaaggatgaggtcaccaacgatcaagggggtggtcacctgcggtggggtggtgctggtgcgcgggcggcgcagcaccgcatgcacccgggtcaccagttcccggatgctaaaaggtttggtgatgtagtcatccgcccccagggtcaaaccgctgatcttgtcgtcctcgctgccacgcgcggtgagcatgaggatgtagcagtccgagaaggtgcggatccgtcggcacacctccaggccgtcgagttcgggcagccccagatccagcaccacaacatcgggggaaaagcgacgggcctcgtccacggcctgggtgccggtgtgcgcctggcgggtgtcgaagccggcccggatgaggtaggaggccaccatctgagccaggggttgttcatcatcgacgaccagcacccgccccgggggcgtggcggtggtcggtgtgcggtcagccatagaccccagtatcgcttcggccggggggaataccaccctcgttcagtgcccggcggggaaatcttcatcaaatcttcaaacatcacccttcgaccgccgtcacccctgtgccccaccccgggccggcggcatcgcctcccctggtcggttcagcaggcgtcaccagggatttcactgcctgcaccgcatacccggggcggg

SEQ ID NO: 3278 - DNA, 756 bp, Corynebacterium glutamicum
gtggtattccccccggccgaagcgatactggggtctatggctgaccgcacaccgaccaccgccacgcccccggggcgggtgctggtcgtcgatgatgaacaacccctggctcagatggtggcctcctacctcatccgggccggcttcgacacccgccaggcgcacaccggcacccaggccgtggacgaggcccgtcgcttttcccccgatgttgtggtgctggatctggggctgcccgaactcgacggcctggaggtgtgccgacggatccgcaccttctcggactgctacatcctcatgctcaccgcgcgtggcagcgaggacgacaagatcagcggtttgaccctgggggcggatgactacatcaccaaaccttttagcatccgggaactggtgacccgggtgcatgcggtgctgcgccgcccgcgcaccagcaccaccccaccgcaggtgaccacccccttgatcgttggtgacctcatccttgaccccgtcgcccatcaggtgtgggtgggggagacgaccgtggagctcacccgcacggagttcgagctgctggttgccctggccctgcgccccggccaggtgctgacccgccacgacctgatcaccgaggtctgggacaccacctgggtcggcgatgaacgcatcgtcgatgtccacatcggcaacttgcgtcgcaagctcggcaccgacacccggggccgggggtttatcgacaccgtgcgtggcgtgggctaccgggtggggcagcca

SEQ ID NO: 3279 - DNA, 672 bp, Corynebacterium glutamicum
ttgatttctgggccgtcaggcacccgtgctagaaaaggtatggcatcgaccttgaggcggtgtcttctcacggtcttaccacgatccaaggagattgacgtgaaacgagcagcgatcgcagccgccgcccttaccctcgccctcacggggtgttcggccgccgacccggaacccaccgccgacgggacggtgtcccaggatacattcctgactacccatggcctggccgccatggacgcggtggagatcattgatcacctcgaccggcagaaggtcactgagcgtcccacggatctgatcgcctcagtgcgtgccgatgaactgctgctctcgagcgatgaccaggaagtcgtggtcgatcttcccgacaatcagacgtatgtctcgatcgcaccctacctcacctccacccacgactgcttctaccacagcctcacgacctgcctgggggaactcgacaatgaggatatccaggtcacgatcaccgatgaagcgaccggcgaggtcctgatcgatgagcaaaccaccaccttcgacaacgggtttgtcggcttctggcttcccgatgatgccaccggcaccatcgagatcacccatcaggggcgcaccggtgtcaccgagttctccaccaccgaggacggggccacctgtgtcacggacctgcgcctgacc

SEQ ID NO: 3280 - DNA, 1479 bp, Corynebacterium glutamicum
atgacaagtagtttttcccggcgacagtttctgctcggcgggctcgtactcgccggcaccggggccgtggccgcctgcaccagcgaccctggacccgctgcctcggcaccaggtccctcccttcgccccactcccacccccactgcgctcggtgagccgacggtgcgccggacactgaccgcccggcccctctccctggatatcggcggcatcgaagccaagacgtggggatacgtctctgacaccggggatgcggccattgaggccaccgccggcgacgtcctccaggtcgatatcaccaatgaactgcctgagagcacctccatccactggcatggcatcgcactccacaacgcagccgacggtgtgcccggcatgacccaggaccccattgaacctggcgagtctttctcctatgtttttgaagtcccccacggtggcacctacttctaccattcccacaccggcctgcagcttgatcgcggcctccacgccccactgatcatccgtgacccgcaagacgctgaggaccaggacgtcgagtggaccatcgtgctcgacgactgggtcgatggcattcagggcactcccgacgatgagctcgacaagctcaccggaatgggttcgggcgaccataacgggaggatgggaatgggaggtcacggccagatgatgcacggcaccccggaccgggtactgggcggggatgtcggcgatgtgatgtatccgcactacctcatcaacggacgtatcccccgtgctcaccggaccttcgaggctcgcccgggcgacaaggcccgcctgcggtttatcaactccggcggtgacaccatcttcaaggtggccctcggtggtcaccgcatgactgtcacccacaccgacggcttccctgtccagccctgggagaccgaatcgatctacctgtcgatgggcgagcgtgtcgacgtcgaggtcatcctcggcgacggcatcttcccgctcacggctttggcggtgggtaaggacgaccgcgccttcgccgtcatccgcaccgccggcggccaggccccccgccccgatgtcgacttccccgagttgtcgtccaccggactgcttctgtcctccctgaagccagcagaccgtgcactcctgcccgagggcacaccagaccgagaagtcagcatcgacctgggcgggcagatgatgccgtatgaatggagcattctcaccgacggccaatcctcctccgcgaccgtgcaggagggccagcgcctgcggatggtcatgcgcaacaggaccatgatgccccatcccatgcacatccacggccacacgtgggcgctgcccggcagcggcgggctacgcaaggacaccgtccttctccgccacggtgaaaccatgatcgccgacctgatcgctgacaaccccggtgagtgggcatttcactgccataacgcctatcacatggaaaccgggatggtcagctcgcttcgctacgag

SEQ ID NO: 3281 - DNA, 363 bp, Corynebacterium glutamicum
atggaggagggtgaggagatcagcctgtctgattttgaaggcgaggtcgtcgtcctcaacgcttggggccagtggtgtgcaccgtgtcgggcggaagtcgatgacctgcagcttgtccaggagactctcgaccccctcggtggcacggtgctgggcatcaacgtccgtgactacaaccagaccatcgcccaggacttcaaactcgacaacgcggtgacctatccctcgatctacgacccgccgtttcgtatcgctgcggccctgggtggggtgccgacctcggtcatcccgaccaccattgtcctggaccgaagccaccgcccggccgcggtgttcctgagggaggtcaccgcgttgtctggt

SEQ ID NO: 3282 - DNA, 918 bp, Corynebacterium glutamicum
atgtcgaaggtatacgtgtccaacgagtacggcggcccggaaaaccaggaactgatcacccgcaacaccccccagccaggcccgggagaactcggggtcaaggtccacgcggccggggtcaacccgcttgattggaaggtccgttccggggttgccggaaccccgcgagagcttccggcacccctgggcgaggaggcctccgggatcgtcaccgccgttggagacggtgtggagggcttcgcggtcggcgatccggtgctcggcctggtggcccccggcgtcggcggatatgccgaggacaccctgctggtggcagagagtaccgtgctaaagccggaggagatctcgttcaccgacgccgccgcgatcccggtcgctggggcgagcgcctacgccggcactcaccaggtcgagcttgaaccaggccagtcgttgctgatcaatggggccggtggtggggtcgggctgatggccgcgcagatcggacgggtccacaagttccaggtcgtcggcgttgaccacgaggacaagcgcgagctcatcgaatccaccggtgctatcttcgtcgccaccggcgacgccgtcgcggagcaggtgcgtgcgctgctccctgacggtgtggacgtagtcttcgacctagtcggcggggaggcgttgcgggtggttgctcccttagcgaagaatccggcgcacgtgatctcggcggctgatgctgccaccgtgggagaactcggtggacaggtgctgcgccgcaccccggaaatggtcggacagatcaccggggtggtccagtacgggctggtcgacccgaaggtcgatacgacctacccgctggaacaggccggtaaggccctggcccacgttgagcagggccacgcccgcggcaagatcgtcctcgagctcatcacctcccaggac

SEQ ID NO: 3283 - DNA, 471 bp, Corynebacterium glutamicum
atgaacccgttgtcgaaggtggttgcctgctccgagacgagcaccgcacccgtgccgtcctcaatgatctccaactcctgggcgattgagaccacctgcgcgctctacctgcccgtcgaggccctggccgaggtcgtggacgcctacccgcaactggcgttggcgatcatgcggatgcagcaggaccaattggtccggtcccgggaacgcgagaccgcacagaccacctcgactgtcgagcagcgcgtggccgccgccctccaacacctggacgccaagctcgggcaaatccgacaagacggatccagcctgctgcaggtccgcctgcgccgcgacgacgtggccggcaccaccgtcgagtccgcctcccgggcaatggcgcggatgaagaaaaccggtgtcatcgactccggccgcgaatggatcgccattaccaaccaccaggccctggccgacctggtcgccggcctc

SEQ ID NO: 3284 - DNA, 234 bp, Corynebacterium glutamicum
atgaccgcccccgccacgctgaagaacaccaccttgcgctctgatgagttcacctgtccgagctgtgtcgccaagatcgaaaacaagctgaatggtttggacggcgtggagaatgcggaggtgaagttctcctccggacgcatcctgatcacccacgacccacagaaggtctccgtacgtgacctggtcaccgcggtagccgaggtcggttacaccgccaagccgtcggcgatc

SEQ ID NO: 3285 - DNA, 315 bp, Corynebacterium glutamicum
atggccgaagtaacctttgccagtctccacgagaaaatgaacttcctgctcaaggaccacggggtcgagaacttcgacgagtcggatctggacctcgaatccgtctcctcactgcacgccaaggcgaacgcgttatgcgccgcccacggcggtgacccctcccgcatggcgaacgataccctcgcccagctgcacccgaagctggacttcctgatgaaggggcacggcgtggacaccgacactgcccgcctggacttgagcacactggaggctgtggatgccaaggtcaacgccgttgtcaacgcccacgatcat

SEQ ID NO: 3286 - DNA, 207 bp, Corynebacterium glutamicum
gtgacactcattaagttaggacaattccggagaaacttccttgacctggatcaatcacccacacacctccgacctgacgaggtggagcagaagagcatgccacgtggcctgtcaacgccaggaacccaccagcaccgcacggtgctggtgggttcctggcgtggagatgacgtggcgtcgatcatgctcctttcccgggtactcgga

SEQ ID NO: 3287 - DNA, 1875 bp, Corynebacterium glutamicum
atgaagacctggaaaacctggggcatcgtcgccgtctcaggcctgttgattatcctgtcctggctcacccccgctgggtggctgtcagacggattcatgatcgccgccgcggtggtcgccggctggcagatcgccctctccgccgtccaggccctgcgcattaggatgatctcgattgacctgctggtcatcgtcgccgccatcggcgcgctgttcatcaacaactactgggaatccgccgccgtcaccttcctcttcgccctcggcaaggcactggagaaggccacgatgaaccgcacccgcaaggcactgtctgacctggtggacgctgcccccgagaccgccaccgtgctgcgcgacggtgagcccgaaaccgttgagatctgggaactggcccccggtgacgtcgtgctcgtgaaaaacggcgagcagatccccgtcgatggacgcgtgctctccggacacggtggggtcgatgaggccaccatcaccggagaatccgtcccggccgagaaggccgcggactccgaggtcttcgccggcacctggctgcgctccggtgtgctgcgcattgaggcgatcggcatcggctcggattccaccctggccaagatcatccaccgtgtcgaagacgcccaggatgacaaggcaaaaacccagacgttcctggagaaattctcgaagtactacacccccggcgtcatgatcgccgccctggccgtcggcctgatcaccctgaacgttgaactggccctgaccctgctggtcatcgcctgcccgggtgccctggtcatctcgatcccggtctcgatcgtcgccggtatcggccgctccgccaaggacggcgtcctgatcaagggcggggaatacctggagacctccgcgaaggtcgacaccgtagtcgtcgacaagaccggcaccctgaccaacggccgccccgagctgaccaacgtcgacgtccttgaccccgcctactcggacgatgaggtgctcaccctggccgcccgcgcggaaaccgcctccgagcaccccctggccgaggccatcatccgcggcgcggagaacaggggcttgaccgtggcgatggtagaaaaggccgaaccggtcgccggccgcggcatccgcgctgacgtggacggtgccaccgtggccgtgggctcagccgacctgctcgatcacaccccggataacacccgcattctcgagctcaacgaacagggcaggaccgccatgtacgtcggcatcaacggcaaggccgtgggcatcgtcgctgtggccgacaccatccgagatgatgccccggccgcgatcaggtccctgcacaataagggaatccgcgtggtcatggccaccggtgatgccgaacgcgtcgcccgcaacgtcgccgccgagctcggtgtcgatgaggtgagggcagaactgatgcctgaggacaagctcgagatcgtcaaggagctgcaggcgcagggccgggtcgtggccatggttggcgacggtgtcaatgacaccccggcactggccaccgcggacatcggtgtggcgatgggtgcggccggttcgcctgccgccatcgagaccgccgatatcgccctgatggccgacaagctgccgcggctgccctacgccctgggtctggcccagcgcacggtgcgcaccatgcgggtcaacatcggcatcgccctgctcactgtcacgatcctgctggccggtgtcctgctcggtggagtgaccatgtcgattggcatgctcgtccacgaggcctccgtcctgctggtcatcgcgattgcgatgctcctgctgcgccccaccctgaaggaagacaaggacaaggcagacgtcagtactgctgacgccgcgaaggagacgctgagcgcc

SEQ ID NO: 3288 - DNA, 390 bp, Corynebacterium glutamicum
atgatcttggccagggtggaatccgagccgatgccgatcgcctcaatgcgcagcacaccggagcgcagccaggtgccggcgaagacctcggagtccgcggccttctcggccgggacggattctccggtgatggtggcctcatcgaccccaccgtgtccggagagcacgcgtccatcgacggggatctgctcgccgtttttcacgagcacgacgtcaccgggggccagttcccagatctcaacggtttcgggctcaccgtcgcgcagcacggtggcggtctcgggggcagcgtccaccaggtcagacagtgccttgcgggtgcggttcatcgtggccttctccagtgccttgccgagggcgaagaggaaggtgacggcggcggattcccag

SEQ ID NO: 3289 - DNA, 309 bp, Corynebacterium glutamicum
atgagtgcatcgcctccatccctttcaacgtccgatatgcagatgtctaagttcttaaacgcgcctttcggcccgaggatccgtttcagccgaccatggtcgccttccaggatgttgttgaggtatttcacctaccggtgttccactgttggcgggcagattccctctgacttcaactcggtgattgccctggctagggagggtgctttatcggtgttgatcactctgggatacccggctgacgcattggatctgagggccttggccaggaaacgcttcgctgcggccacgttccgcttcggagagagg

SEQ ID NO: 3290 - DNA, 216 bp, Corynebacterium glutamicum
gtgaaatacctcaacaacatcctggaaggcgaccatggtcggctgaaacggatcctcgggccgaaaggcgcgtttaagaacttagacatctgcatatcggacgttgaaagggatggaggcgatgcactcattgcggaaagggcaaggcatgatgtttgccctcacgggcaaccgaacccggacgcggtgatcgtcaaccgggtcttcgagacggcc

SEQ ID NO: 3291 - DNA, 258 bp, Corynebacterium glutamicum
atgagacctatatccgggtcggcggcaggtggtgctacctctgatctggcgatcaccgccggtggccagaccctggacttttacctctctccgaagcggaacgtggccgcagcgaagcgtttcctggccaaggccctcagatccaatgcgtcagccgggtatcccagagtgatcaacaccgataaagcaccctccctagccagggcaatcaccgagttgaagtcagagggaatctgcccgccaacagtggaacaccgg

SEQ ID NO: 3292 - DNA, 159 bp, Corynebacterium glutamicum
gtgccggtcgatcacaccatgatctaccgctgggtccagaaatacgcccctgagctggacaagcaaacacggtggtaccggcaggtgcctgactggcaggccagttcctggcgggtggatgagacctatatccgggtcggcggcaggtggtgctacctc

SEQ ID NO: 3293 - DNA, 447 bp, Corynebacterium glutamicum
ttggccgggaataactacagtccgctgaaagttggtctatatatagaccttacaaatcttgaacggagattcttaatggcaaccatcgatgtaaccgaagaaacatttgagagcacagttaccggcgacggaattgtcctcgtagacgcatgggcatcctggtgcggaccttgccgccagttcgccccaacctacgagaaggtttccgaaacccacaccgacgcaaccttcgccaagcttgataccgaagcaaaccagggcctggctgcagcactgcagatccagtccatcccaactctgatggttttccgcgacggcatcatggtctaccgcgaagccggcaccatgccagctcctgcactggatgatctggtcaaccaggttaaggcactcgacatggatgacgttcgtcgccaggtcgcagagcagcagggttctgcagaggca

SEQ ID NO: 3294 - DNA, 264 bp, Corynebacterium glutamicum
ttggacggtggacacgtttcagagtccgctggatttcatcacatcggaaggaagagaattttgagtaccaaaaattaccacgtcgagggtttgacctgcgcaaacggtgtagcttccgtagaggatgaaatcggcattgttgcgggcacccagggtgtggatattgatattgagaccggccgcgtcacggtgactggtgaaggtttcactgacgaggaaatcattgaggctgtcgcgaacgcgggctacaaagtttctgggcgg

SEQ ID NO: 3295 - DNA, 1344 bp, Corynebacterium glutamicum
gtgtcacagcgagtaatcttttcgggcatgaacctaacccggaatgacaggctcgatcgactgcccgtaacttccaaacataaaaagattcttggcggctcaggtatcggctgggcattggatgccatggatgtcggactgatctctttcgtcatggctgcgttggccactcattggggcctatcccctactgaaacttccctgctcggatccatcggtttcgttggcatggccatcggcgcttcgctgggcggtttgctggcggacaagttggggcgtcgacaagtttttgcgttgtctttgctagtttatggcgttgccactggcgcgtcggcgctttcagtgtcgctggcaatgttgatggcgctgcgcttcgtcgttggacttggcctgggcgctgaactccccgttgcatccactctgatttccgagttttctccacgaaaagttcgtggccgcatggtcgttatcctggaggcgttttgggcgctgggctggatcatggctgcaatcgtcggaacctttgtcgtggcaggatccgataatggttggcgttgggcgttagctcttggctgtgtccctgcaatttacgcggtgtatgtccgtctcggacttccagaatcagtacgtttcctggagaagaaaggccggcacgacgaagcagaagccatcgttgtttccttcgaagaagctgccgctgccgaaggtaaagctgccgatgccaccaccgctgtggttcatgacaacgctgccgagggttccgtatccatctggtcagctgctttgcgcaagcgcaccgtcgcgctgtggatcgtgtggttctgcatcaacttgtcctactacggagccttcatttggattccatcgctgctggttgccgacggtttcaccctcgtgaagtctttccaattcactctgatcatcaccttggctcagcttccaggctatgcggttgcagcgtggttgattgaaaagtggggccgtcgcagcacattggccacgttcctggttggttctgctatctctgcagcgctctacggcttggcaaatgtggagtggcagatcctggtcgcaggttgtttactatccttcttcaacctgggcgcatggggcgcactgtatgccattgggccggagctttatcccactaatgtccgtggaactggaacgggtgctgccgcgggattcgggcgcattgcttccatcatcgctccgctcattgttccgccagtgattgcttttggtggaccaattgctttgttcgctctctttgccaccgcgtttgcgatcgcagcgattgcggcgtttacgctgcctgagcagaagggtaagtctctcgctgat

SEQ ID NO: 3296 - DNA, 159 bp, Corynebacterium glutamicum
atgaatcttgtggatcacgcggatccggagaattcaggggaaggccgggcaggcgtcatgctcaacggcacgctgaagggcacggacatggacatcatcacggcaggcgacccggacgtggtcgcggtggacgtgctggcagaggcgatctgcgcaatg

SEQ ID NO: 3297 - DNA, 576 bp, Corynebacterium glutamicum
atgcattttgaagaactaaacaatgaatcttgtggatcacgcggatccggagaattcaggggaaggccgggcaggcgtcatgctcaacggcacgctgaagggcacggacatggacatcatcacggcaggcgacccggacgtggtcgcggtggacgtgctggcagaggcgatctgcgcaatgtgattttggtgctgctggaagctgagtcaatgcacggctaccagatcatcaccaccatcagtgagcaaacagaaggtaactggactccaagcccaggaaccatctatccaaccttgtccatgcttgaagatgaaggcctgatttccatctcccatgaaatgggcagaaaaatggcgcgccttacagaagaaggcgcgcaggaagtggcaaagaacaaggatgcgtggggatcaattctggaggcttatcgcaatccagaatcccgagaggtgcgggtgtttaacattcgctctgagtttcacaaggtcagggaagcagcgaaagctgctcccgacgataaagcagagcaaataatcgagattttaaggagagcagcagatgacatcaagagacta

SEQ ID NO: 3298 - DNA, 1530 bp, Corynebacterium glutamicum
atggctacagatacacacgccgcaagttttgatgatgactacgtacctccacaggagccaagcgattccttcgcggatgacgcacacgtagatgtccctgctccggcgtttgaagatttctccccggcccaggcctttggtcagggaactaggggaggagactctcagggcttcaagaagaggggtcgcaaggacgagtcccgtgaataccgagacttccgccaacctccctatgacaatgacgctgagatgggcgtgctgggcgcgatgctgctcagtccgaccacggtcatcgacattctggatatcctcaccccagaagacttctacaggccgtcccaccagctgattttccaggcgatcattgacctgttcagtgacaaccgtgatattgaccccgtgattgtctccggtcgcctcgatcgaaccaacgatctggaccgcgtcggcggtggcgcgtacctccacgacctcatccagtccgttcccaccgcagccaacgcgcgctactatgcggaaatcgtttcggaaaaggcagtgcttcgcaggcttgtcgacgccggcacccgcgtcgtccagctcggctacgagggcgatgaaggcgccgaaattgacgcggtgattgaccgcgcgcagcaagaagtcttcgccgtttcccaaaagaatcagagcgaagactatgcagtcctagccgatattctggatgaaaccatggctgagctggaaatgctcaacgacggcggcatcgccaccggtattccaaccggcttcaaagatctcgatgacctcaccaacggtctgcgcggtggccagatgatcatcgttgcagctcgtcctggtgtgggtaaatccaccatcgccttggacttcatgcgttcggcatccatcaagaacaacatggcgtctgtcattttctccttggaaatgtccaagtcagagatcgtgatgcgtttgctctctgcagaaacagaaatccgcctggctgatatgcgtggtggaaagatggatgaaaccgcatgggaaaagatggtgcagaagttagacaaggtagcccaggcacctttgttcatcgatgactccgcgaacctcaccatgatggaaatccgctccaaggccagaaagctgaagcagaagcatgatctgaaaatgatcgtggtggactacctccagctgatgagctccggtaaacgcgtggaatcccgtcagcaggaagtctccgagttctcccgtcagctcaagctgctggccaaagaactcgatgtgccgttgatcgcgatttcccagctgaaccgtggacctgaatcccgtaccgataagcgaccacagcttgctgaccttcgtgaatccggctcgctggagcaggacgccgatatcgttatgctgctataccgcccagactcccaggataaggacgacgagcgcgcgggcgaggccgacatcattttggctaagcaccgtggtggcccgatcgataccgtccaggtggcgcaccagctgcactattcacgttttgtggacatggcgcgcggt

SEQ ID NO: 3299 - DNA, 516 bp, Corynebacterium glutamicum
ttgtcgttacgctgcgacgacctcaaacttcacgcgggaaacaattccgtcggtgagctttgcttctacctggtacttaccggtggtcttaaccaggttcttcgggagaacaatggcacgcttgtccaggttcgggccgccggctgccttgactgcgtcgacgatgtcgtcagtcttaacggagccgaacagttttccgctctcggaggtgcggactgcaatggtaacaccttcaagtgcttccagtgctaccttaacttcgcgagcgtggtcgaggtcgcgaatctcgcgagcctcctgggcacgcttgatgccctcgatctgcttctcagcacccggggtggctacgattgccaggccacgggggagcagcaggttacgtccgtagccgttcttaacctctacgatgtcgccagcgacaccaaggttttcaacggcggcggtgaggatcagcttcatgatccctgcctttcgtggtttttgagtgtttgtgaatgttttagaaaagaaaagctt

SEQ ID NO: 3300 - DNA, 450 bp, Corynebacterium glutamicum
atgaagctgatcctcaccgccgccgttgaaaaccttggtgtcgctggcgacatcgtagaggttaagaacggctacggacgtaacctgctgctcccccgtggcctggcaatcgtagccaccccgggtgctgagaagcagatcgagggcatcaagcgtgcccaggaggctcgcgagattcgcgacctcgaccacgctcgcgaagttaaggtagcactggaagcacttgaaggtgttaccattgcagtccgcacctccgagagcggaaaactgttcggctccgttaagactgacgacatcgtcgacgcagtcaaggcagccggcggcccgaacctggacaagcgtgccattgttctcccgaagaacctggttaagaccaccggtaagtaccaggtagaagcaaagctcaccgacggaattgtttcccgcgtgaagtttgaggtcgtcgcagcg

SEQ ID NO: 3301 - DNA, 675 bp, Corynebacterium glutamicum
atggcaatcggagatactaacatcaccgtcgttggcaacattgttgctgacccggaactccgcttcaccccatcgggtgcagcagtggctaacttccgcattgcatcaactccccgctcgttcaaccgccaaaccaaccagtgggaagacggcgaagccctctttctcaccgttaacgtttggcgtcaggcagctgaaaacgttgcagagtccctgtccaagggtatgcgcgttatcgtcaccggtcgcctcaagcagcgctcctatgaaacccgtgagggcgaaaagcgcagcgtttttgaggtcgaagcggatgaagtcggaccatcactaacatttgccaaggcagatgtccagcgcacaccgcgcggtggaaactctggcggaaactacggtggcggcaaccaaggtggtggcctcggtggaaaccaaggcaaccagcaaggtggattcagcaaccagaactctggcggcttcggtggaaaccaaggcaaccagcagcaaagcaaccagggcggatttggtggaaaccaaaaccagtcccagggtaacaacttcaaccaaggtggatttggcggaggcagcccacaggcagcaccggacaatgacccttggaattctgcaccaccagctggctccggcgggttcggcggcgcagacgatgagccaccgttc

SEQ ID NO: 3302 - DNA, 285 bp, Corynebacterium glutamicum
gtgcgtcaatacgaacttatgatcattctcgatccttctcaggatgagcgcactgttgccccgtccctggataaattcctcgaggttgtccgcaaggacaagggtgacgttgtgaaggttgatgtttggggcaagcgccgtcttgcatacccaatcgacaagaaggaagagggcgtttacgccgtcgtcgatctcaagtgtgagtctgcgaccgtactcgagctcgatcgtgttctgaacctgaatgatggtgtcctgcgcaccaaggttctgcgactcgacaag

SEQ ID NO: 3303 - DNA, 189 bp, Corynebacterium glutamicum
ttgagcacaacagttttgctggtcaccatggtcagcgtttttgtgggttttctctgtttcggcggcgcgtttgccagcttcatgtataagaaatcgaataagcagatttggacgctgttcagcatcgcgattgtgctgatcacggtgattccggtgacgattgcggttttctgggccaccacgcccgcc

SEQ ID NO: 3304 - DNA, 1458 bp, Corynebacterium glutamicum
atggaccagaaattggaccagcagaaggtagaccgcgtatcgcccggtgatagtgaaccggtggcacgggattttatcaatgcaatcggcggtcggtttggtcgttttgcgcaggtgggcactcagcggttctggactcccctgcgtgttttgatcaccacttccctggtgtttttggccatggggtttttaacaaaagccaattgcatccagggttctagaggtactgatggtgtggtttctttgaactggtcgggaagtcgccagtacacctcagcctgttacaacgacatcgttccgctctatggggggcgcggaattgatgcgccaggtttcccttatgccttttcgtggcaggaaggtgatctcaccaggtacatggagtacccggtgttgggcggaattttccagtggatttgtggcattatcacgcggtttttgtacccggttgttgatgtcattccgtttcatacgctgcctgaatctggtctttatttcatcgtcaccgcgcttgcgttggcgttcttttgggtgttggtcatccgcatgatggtggagctcactggcaatcgagtgtgggataccgtccttgttgcggcgtctcccctggttgctgtgcatgcgtttaccaactgggatactccagccattgcggcggtgattggtgcgatgcttgcggtgaaacgcggaaaccccttggttgcgggtgtgctgatcggcgcgggtacggcgttcaaattgtggccgctttatcttcttggtgcgtatttggtgctggcggtcaagaataagaatctcaagccgtttatcaccatggctgcagcggctgcggtgacatggctcgtggtgaatgtgccagtgatgatcgcgtaccccaaggcgtggaatgaattcttgcgcctgaaccgggagcgtggtgcggagtggaccacgatttaccaggtcatcgaccgtaatttgccgatcaatttgaatgatccagtgctgcttaatgtgctgagcttcggcttgtttggtgcatcgtgtgtggccattttgatccttgggctcaaggtgcagcgcactccccgagtcgctgagctggcctttttgattgtcgcggcgtttttgctgtttaacaaggtgtggagtcctcagtattcactgtggctggtcccgttggctgttctggcatttcctcagtggaaagtgctgttcccgtggatggttacagacgccatggtgtggccaattttgatgtggcacatgctcggcacggacaacaagggactcccccatgaaatgttggatctcatcgtgatttcccgagatgccttcattgtggtcatgatagtaggtgtaatccggcagatgctcggacgacgtgcagatccggtgatggatgcgcacgccgggcgcgatttgttggccgggcccttcggcgcaggcgagcgtcgaaaagcattgaaggaagtaagt

SEQ ID NO: 3305 - DNA, 882 bp, Corynebacterium glutamicum
atgcaacaacgcctgctcgatggaacaggaaccacaaccgctgccaccgacgtttccgatttgagcatcacccacagtcaccggcgcagagctgtatggctgagacagtggaataccttgctgaagtgctgctgccagaccaaagatcttgaatgtagaaccggtctgaagcggagcgtttgcaaagtcccaaccagtcgcatcctcgccgccgtaataagcacgaaccgcaccattagaaggatcaatggagactaccgctgcacggttgttctcagacagaagatccaactggttttgtaccgcttcaacggcaccttcctgagtctttggatcaatggtggtggtgacctgcaaaccacgggtttgcacatcatcctcagtgataccaagctcagacaactccgccatcacttggttcttaatcaaaccattagtgccggtggcttcggtgtacgcactgttggacgcagggtcagtggtttcagggtaggtagcaactgcgcgctcctctgccgagatagcgccaatttccaccaggccgtccatgacatagttccaacgcgtttccgcctcaactggatttgtccaaggatccaactggcttggcagctgaatactggccgccagcactgcgccctcagcagccgtgagctcttctactggcttatcaaagaatgcatgagctgcagcctgcacaccataggcatttcgaccgaagtacacagtgttgagataagcctcaaggacctcgtccttagaccactcattggccatcttcgcggaatagaccaattccttagccttacggatcagcgaacgctcatcaccaaccacagccttcttcacatactgctgagtaatggtggaaccaccacccgc

SEQ ID NO: 3306 - DNA, 2160 bp, Corynebacterium glutamicum
ttgacgaatagtaaaaatcctcctgccaaaaagagcagcggcaaaaggcgcttaaagagcgactctaagggctacgctgtaagaaacaccatcattggtgccattgttgctgtcattttgattccagtaatggtcttcatgggtgcttacatcatggttgatgttccagaaccggaagagttggtttcaccccaggtttcgcagatttacgcatctgacggtgagactgaattggcacgcatcgttcctccagaaggcaaccgccagatggtgacgatcgatcaggtgcctgacactgtgaaaaatgcggtggtggctgcggaagaccgagagttttacacaaaccccggtttttccattactggctatgcccgagcagcacttggcgtaatcactggtgattcttcagcgggtggtggttccaccattactcagcagtatgtgaagaaggctgtggttggtgatgagcgttcgctgatccgtaaggctaaggaattggtctattccgcgaagatggccaatgagtggtctaaggacgaggtccttgaggcttatctcaacactgtgtacttcggtcgaaatgcctatggtgtgcaggctgcagctcatgcattctttgataagccagtagaagagctcacggctgctgagggcgcagtgctggcggccagtattcagctgccaagccagttggatccttggacaaatccagttgaggcggaaacgcgttggaactatgtcatggacggcctggtggaaattggcgctatctcggcagaggagcgcgcagttgctacctaccctgaaaccactgaccctgcgtccaacagtgcgtacaccgaagccaccggcactaatggtttgattaagaaccaagtgatggcggagttgtctgagcttggtatcactgaggatgatgtgcaaacccgtggtttgcaggtcaccaccaccattgatccaaagactcaggaaggtgccgttgaagcggtacaaaaccagttggatcttctgtctgagaacaaccgtgcagcggtagtctccattgatccttctaatggtgcggttcgtgcttattacggcggcgaggatgcgactggttgggactttgcaaacgctccgcttcagaccggttctacattcaagatctttggtctggcagcagcacttcagcaaggtattccactgtctcagccatacagctctgcgccggtgactgtgggtgatgctcaaatcggaaacgtcggtggcagcggttgtggttcctgttccatcgagcaggcgttgttgcattcttacaacaccagcttcattcgtttgcagcaggatctggaaaatggttcacaggatactgcggacatggcgcatgctttgggtatcgcgaagtctttgccaactatccctgagacactgactgaaaacggagagaccccttatgagggcatcatcttgggtcagtatgagtcccgcccacttgatatggcttctgcgatggcaactatcgctaatgaaggtgtctggcaccgcccgcacttcgtgtccaaggtggagactgtcagcggtgaggttctctacgagttcgaggatggcgacggcgagcgtcgtgtttctgaaaaggttgcactgaatctgctcaaggccatggggccaatcgctgcatactccaacggaaacgctctggctgatggccaggtttctgcatccaagactggtaccactcagcttggtgataccggtgcaaacaaggatgcgtggatgttgggtgcggcacctcagctagctactgcggtgtgggtcggaactgctgataacactgcattgtataacacctggggtggcagtatgtatggttctaactcccctgccacgatctggaagcagaccatggataacgccctcgagaactcccctctcgaaacttgggatatcgctccagcattggggtacggtaacccaccagttccggaatatgtgtggactccaagtccaaacatcgcgactaatgatccagaaggagcaaccgaggaagctccagtggaggatccaaatgcagtaatcgatacccctgctgtagatcccactgcacctgcagaggagaccggtaacggtcaggtagaaatcctgccggggctgactatcccgggagatctcttagggatcggc

SEQ ID NO: 3307 - DNA, 357 bp, Corynebacterium glutamicum
gtgcaatatcaaaatgagatcagtcaccaactagctcgtaggcagactctccgtcagtttcgggcggggttggtgcaaaaagacacaatttgtgacgccgagttcatcttggtgactgcgagcaaatatcacggacacctcgcagattatccttgcccgatttgtggcagcgaggatctacgtgtggttttgtgggtttatggcgatgaaatcggtcgggcggcaggttctgctcgaagtgaagaagaaatcgaacagttggtaaagaatggacggcaggcaacggtgcatactgttgaagtatgtcccacctgcaagtggaatcacctgcttaaggcggaaaccgcgacggccagc

SEQ ID NO: 3308 - DNA, 471 bp, Corynebacterium glutamicum
atgctggcaggcatgcctaatttaaacgctgaggagctagcagtccgcgtgcgacccgcgctgacaaaactctacgttctctatttccgccgctctgtgaattctgacctctcgggtccacagctcactattttgagtcgcctggaagaaaacggcccatcccgaattagtcgcatcgcggaacttgaagatattcgtatgccaaccgcttcgaatgctctgcatcagctggagcaactcaacctggttgagcgtatccgcgacaccaaagaccgccgaggcgtgcaggttcagctcactgatcatggacgcgaagagcttgagcgcgtgaacaatgaacgaaacgcagagatggctcgactccttgaaatgctcaccccagagcagctggaacgtaccgaagacctggtggatatcattactgagcttgcagaggtgtacggtagctggaaagagaccgacagcggttct

SEQ ID NO: 3309 - DNA, 942 bp, Corynebacterium glutamicum
ttgatgaaacaaccccttcgcgtacttatttcttgtcgacccgaagaaaattcgggtggcaaacgtagtgaacaaaatgatgctgtttttgagttcgccgcatggctagctcgtacttcagacatcaatgttcgtggaatcacaactttcatacgcccttggccgtcttcctccatcagtaagctcggaggaaaatatcataagtggtataagaatttagattcttactaccgcagtcgcacgatcaagggactcaaagaggccggagttgagaagtcccaatgggacgatgatgtttcagtttttgtagatggtccttctgaatccacgctgctcacccatgctgctgaagaattcgaagcggacctcattctgcttggctctgatgcgaccgcaccaaaaggccgctttctggccagctccaccgcagatgccctccttcactcctcgcccgtcccactaggacttgtgccgcgaggggtgaagctttccaaaaagggtgtcacccgcgtcaactacgctttcaccaatgaaagcgatgactttgagcaaggtttacgctcttccgcggagctcgccaccaattggaacgttcctcttcggatccttgctttttcacccacaggcattacttccgcaccaacgtcgcggagcttggatatttccactgagctttcctccgagtggcgtgaactaacgctcgccatgcttgatcgagcccgtgatggcgtcctcacagaccacccaaacttgagcgtgagcagtgaaaccggttctggctggggttggagcggtgcaattgatgctttgcgatggaagaaaggtgacctgctgtgcatgggaagccatcgcacagacaccctttcacgtgtctttgtcggttcggaaacaatggaaattatccgaaactctcctgtaccgaccatcatttatcccggtctt

SEQ ID NO: 3310 - DNA, 495 bp, Corynebacterium glutamicum
atgcctgcaaaggaggacaacttcatgaacacccaaccagagcatccagaaaatgatctagtcgacgaagccgatttttctaaccggcccaggatctactcggacgatcctgattccttggctgatgcgccagacccagcgctggagcatgagaagaacaagaaatcttcacgccaagcactcatttatctgtttgcagttccactagttacattcgtttctgcatacgtattggcctgggtgtcacgactccagggcggtcccatctgtgacgccggtgaggccgtgtggatttgttcccgtgctgcagaactgtggtggccaattaccactagcgtcatcgcatttggtggcatgcttggatctgcatggatcctctatgacaaataccgaaattacctacgctggcgtccttggatgggcgtgttgtggattttgattccattcagcatgctgtggggaacctcggtgctcaccttgtccatcttggggcac

SEQ ID NO: 3311 - DNA, 321 bp, Corynebacterium glutamicum
atgagcatcgttaagatcaacgcaatttccgtacccgaaggcgctggtgaagagcttgagaagcgcttcgcagcccgccaaaatgccgtggattccgctccgggatttgagggctttcaactgttacgccctgtttccggtgaagaccgctactttgtagtcacccagtgggctgatgaagacagctataacgcgtggcgtgatgccgaaaaggccaagggcggtcatggccagggagcccacggctcagataagaagcctgtcgcttccggcgcttccctgctggagttcgaagtagtcctaggatctaccggcgctaag

SEQ ID NO: 3312 - DNA, 936 bp, Corynebacterium glutamicum
gtggctacctcaaaaattcttctttattacgcattcaccccgctctctgaccctaaagcggttcagctgtggcagcgtgagctctgcgagtcactgaatcttcgtggccgcatcctgatctccactcacggcatcaatggaaccgtgggcggagatattgatgattgcaaggcgtacattaaaaagacccgcgagtacccaggtttcaaccgcatgcagtttaagtggtccgagggtggcgctgaggatttcccaaagctcagtgtcaaagtccgcgatgagatcgttgccttcggcgctccagatgagctcaaagtggatgaaaacggcgtcgtcggtggcggcgttcacctgaaaccacagcaggtcaatgagcttgtggaagcccgtggcgatgaagttgtgttctttgacggccgcaacgcaatggaagcccagatcggcaagttcaaggacgctgttgtccctgacgtagaaaccactcatgatttcatcgcagaaattgagtctggaaaatacgacgatctcaaagacaagcctgtggtcacctactgcaccggcggaattcgttgtgagatcctgagttcactcatgatcaaccgtggtttcaaagaggtctaccaaatcgatggcggcatcgttcgctacggcgagcagtttggcaacaagggcctgtgggaaggctccctctacgttttcgataagcgcatgcatatggaattcggcgaggattacaaagaggtcggacactgcatccattgcgatactcccaccaacaaatttgagcactgcctcaacgaagatgattgccgcgagctcgtgttgatgtgccctgattgcttcgccaatgttgagacccgtcattgcaagcgcgaacgctgtgcagcaattgctgcggatttcgctgagcaaggaattgatccgctcgttacttct

SEQ ID NO: 3313 - DNA, 1263 bp, Corynebacterium glutamicum
atgagccttgcagaatcaattcttttggcgctcaccagcctgagaagcaacaagatgcgtgcattgttgacgctgttaggagtcatcattggtatcgcatcagtcatcggaattttgaccattggtaaagccctgcaggatcaaactttgaatagtttggaaagcttgggcgcgaatgatctgtcggcgcaggtggaggaacgccccgacgaagattcccccgaacccgatatgttcgctttttctggggctgcaaactctagtggcaatctgattccggaagaaacagttgatacgctgcgcgatcgtttcgcaggcagcatcacgggaatcagcgttggcggaatgggtacgcaaggcactctcatcggcgacaccgcagatcttaaatccgatctcctcggcgtcaacgaggattatatgtggatgaatggcgtcgaaatgaactacggccgcgccatcacgcaagacgatgttgccgctcagcgccccgttgcggtcatcgccccagacacctttaatacgcttttcgacgcaaaccccaacctcgctctggggtccgaagtagcttttgaactcaacggtcaagagacatttttgcgggttatcggtgtgtataaagaagccgcagcaggtggacttgtgggaagcaatccaaccgtccacacctacaccccatatacggtggccaatgacatcacccacacggaagatggattgaacacgttaagtatccgtgcagctcagggcgtagaccaggattcacttaagggttcactgcaaacctacttcgacgcgctgtacgccaacaatgactcgcaccacgttgccatgttggacttccgtaaacagatcgaagagttcaacaccattctcggcgcaatgagtttgggtatctcagccatcggcggaatttccttgcttgtcggtggcatcggagtgatgaacattatgttggtgtctgtcaccgagcgaacccgcgaaatcggtgtccgaaaagccctcggcgctcgtcgacgtgacattcgcctgcaattcgtcgttgaagccatgatcatttgtttcatcggtggcatcctcggcgtgcttttgggcggcattttgggattgatcatgtccagcgctattggctacatttccttgccaccactgagtggaatcgtgatcgccttggtattttccatggctatcggcctgtttttcggctactaccccgccaacaaggcagcaaagctcgatccaattgacgccttgcgttatgag

SEQ ID NO: 3314 - DNA, 690 bp, Corynebacterium glutamicum
atgagcctcatcgaaatgcgaaatattgtcaagacctacaacattggatctgaaggtgaactcaccgtgttgcacggtgtggatttccatgtggaccgtggcgaattcgtgtcggttgtgggtacgtccggctcaggtaaatcaacgatgatgaacatcattgggttgttggataagccaactgatggcacgtacaccttggatggcgtggatgtgttggatatcagcgatgatgctttggcgagccaccgcgctaaatcgattggttttgtgtttcagaacttcaatctgattggccggatcgatgcgttgaagaatgtggaaatgcccatgatgtatgcgggcattccggctaagcagcggagaagtcgtgcggttgaattattggaaatggtcgggatgggtgagcgtctcaaccatgagcccaatgagctttcgggtggtcagaagcagcgcgtggccattgctcgcgcgttggcgaacgatcctgagatcattcttgctgatgaaccaactggtgcgttggattctgcaacgggccggatggtgatggatattttccaccagctcaacaaggagcagggcaaaaccatcgtgtttattactcacaaccctgagcttgctgatgaatctgatcgggtggtcaccatggttgacgggcgcatcattgggtctgaggtgaaacactca

SEQ ID NO: 3315 - DNA, 1977 bp, Corynebacterium glutamicum
atgtccgtaccctggcattttggatacagacttgttgtaagaacttatgaaaggagtgccccggggttacctgatcctcggggccatctcactgtggcactaccaccttcgctttccttggccccgaagaaattaatcattgtggccgtggtcctgattttgatcattgcggctgcctcgttttattttctgcgttcatcatcgaatgaccaggtgattgccacttctgatgttcgggagatttcctccgagggaatcgtggcgcgtgtgtctgtcaacggaaatattgaagctgcgcgaaccaccaccatttacaccagtctgactgtgccggtcgcgaacttgccggttgcggttggtgaccgtgtggcagctgatcaggtgttggctgagttggatgcctctgccctgcaacgacagttggatgaaactgatgccaacaatgcgcgtgcagccatggcgaaccgcaattccatcgcgcagtcgcagcaagcatatgagcagtccagggaacttcttgatagtggtttgagcccggagatcaactcggcgcggtcctcgttgcgggcgtcctcacaggcatatcaggatgcgatccgcagttttgaagcgaagcagcgagatgtggatggcggattggattccaccatggtcgctcaatcggatgctctcaaggcagctcgtgagcaagcagatgctgctgaaattgaacgactgcgcgcggacttcggactgctcaacaacgatcgcagcaacctcaacgatgtcattggtctgctcgatgagagagaatctttggcttctgcggaatccgaactagctcaagcccgcgctgcaggtgacctagaggcagtcgctgcagctgaagcaaaggttgcaggcctggaacaatcaattgcttccaaaacctccacgtggcctagccaagatcagacttacttgcagtcctacaccgctttggaggaagctgagcgacgcgtcgcatccaccactgaagctctagaaatagccgagcggatctacattgattcactcggaaaagttgactcagaactagccgccgcacagcgcgccgttgccgaagcccactcagcacaacaagacgcagcacttggcctcgagaccgcgcagctttccacccaacaccaattggaagcccaatcaagcgccatcgatgcagctttaggtttggcatcagtagataatgaagccgccaccagatccacgtcccagctgcggatggatatcaacaacaccaccgttcgctccccatactcaggcattgtttcatccgtgcaggcagcccaaggtcaaccagcagccggcgcactgttgagtgttgctgatgattccgaactgaagatcaccgcgaatgtaaaagaagcggagatcagcaacgtcaccatcggatcccgcgtcaccttcactaccccatcgaccggaaccaaagaattcgccggccgagtatccaaagtctcccccattgcagctgccgccagtgccccagctacaggtgaaggagctgccgcaggcgccacaaccaccaacactgacgtcaccttccccatcgaaatttccgtcaccggcgaccgcgaaggcctcaacctcggcggatccgctcgagtacgcatcgtccatgaaatcgcaccacacgtactgaccgttcctttggaagctgtgtacaaaaatgatgacggcaaagacgctgttttgatcatcagcgacgacaacaaagtagaagaagtagaagtaaaaacagctgaatccgatgactttgatatcgcagtcagcggtgctggaatttcagaagacgctcgagtgctcacccagcctggaaactaccggggcctcatcggagaaactgtgaaacttcacgcagatacggtggagcaggcggcggctccttttagtcctgcggccccttttgaccctgcagcccctgccgtttctgccaagcaaaccgtgggccaggtgatt

SEQ ID NO: 3316 - DNA, 1089 bp, Corynebacterium glutamicum
atgagcacgtccaccatcagggttgccattgccggagtcggaaactgcgcgacctccctcattcagggtgtggaatattaccgaaatgcggatccttccgaaactgtcccgggtttgatgcacgtcaaattcggtgattaccacgttggcgacattgaattcgtggccgcgttcgacgtcgacgccgaaaaagtaggcatcgatcttgccgacgccaccgaggcttcacaaaactgcactatcaaaatcgccgatgtcccacagaccggcatcaacgtgctgcgtggcccgactctcgacggcctgggcgatcattaccgcgcgaccatcgacgagtccaccgccgagccagtcgacgttgtccaggcgcttatcgacgcaaaagccgatgttttggtgtcctacctcccagtgggctccgaagaagccgacaaattctacgcacaagccgccatcgatgcaggctgcgcctttgtcaacgctctcccagtattcatcgcctccgaccctgagtgggctaagaagttcactgacgctggcatcccaattgttggcgatgacatcaaatcccagatcggtgcaaccatcacccaccgtgtcctcgcacgcctttttgaagaacgtggcgttcgcgtagatcgcaccatgcagctcaacgtcggcggcaacatggacttcaaaaacatgcttgaccgcaatcgcttggaatccaagaaggtctccaaaacccaagcagtgacctccaacattccagatggtccactgtctggaaaggtggaagaccgcaacgtccacatcggaccatccgaccacgtccaatggctcgatgaccgcaagtgggcttatgtccgcctcgaaggcaccgcattcggtggagttcccctcaaccttgagtacaaactcgaggtgtgggattcacccaactctgccggcatcatcatcgacgctgttcgcgccgccaagatcgccctcgatcgcggtatcggcggaccgatcatgccagcaagctcctacctgatgaagtccccacctgagcagcttccagacgatgttgctcgtgaacgcctagaggcattcatcatcgaggcg

SEQ ID NO: 3317 - DNA, 606 bp, Corynebacterium glutamicum
ttgtcgagcagtttcaggctgtttagcgggcgagttcttatagagatgtataaggtgaagctcatgaagttgaagtggattgcaccaattcttccggttttggcccttgcaggctgcggaaactacgtcaacgtagagtcgcaagggaaatctggaatttcccatgatgaggacggaaatataagcgttcacatgtacatctgtggtgataatgcggtggatgaactgatacttagcggtggtttttacgatggcccacctgggacaaacaacccagcccttgggatgttgaaaacttccaaccctgagtcgggttatgttgtagtcaacatcgctgatccagcaccgtgggaagttgttgagccaatcaatttgcccacggaacagggaaagtacattattgccaatccgaggttggtagataaaggttggccgattcctttcgcaaaagaaaagtatatgccgagtgtttccacatcagtaggaatgcttgaaggaatagatccaggtctagtcatgcgggatatgtataccgagtcgactcatgtgttcggtactgccgaagactttgttgaagccggtcaacagtggtgcgaggattatttc

SEQ ID NO: 3318 - DNA, 1485 bp, Corynebacterium glutamicum
atgagcatcggattcgaccgcgacctttatattaagatgcagtcgcagcacatcaatgagcgccgcgagcagatcggcggcaagctgtatctggaaatgggcggcaagcttttcgacgacatgcacgcttcccgtgtgctgccaggtttcacgcctgacaacaagatcgctatgctcactgagcttaaagatgagctggaaatcctcgtcgcaatcaatgcgaaggatctggagcgcaagaaaacccgcgccgacctcgacatttcttatgaggaagatgttttacgcctcattgatgtgttccgtgagctgggctttttggcggagcatgtggtgctcacacagttggaggatgacaactatcaggcactcgcgttcaagcagcgcctagagcgccttggcctgaaggttgctgttcaccgcgtgattccaggttacccaactgatgctcgccgcattgttagcgaggaaggtttcggcatcaacgagtatgtggaaaccacccgcaatttggttgttgtgaccgcaccgggcccaggttctggaaagctcgctacctgcttgagccagatttatggcgatcaccagcgcggaatcaagtccggctacgcaaagtttgaaactttccccatttggaacctgcctcttgagcacccagttaacttggcttatgaggctgccacggcagatctcgatgacatcaacatcatcgatcctttccacctcgccgcctatgacaccaaagccaccagctacaaccgcgacgtggaagtcttcccgctgctgaaaaccatgctggaaatgctgtcgggctcatcgccgtacaaatcccccaccgacatgggtgtcaacatggtcggaagcgcaattatcgacgacgccgcgtgccaggaagccgcccgccaagaaattgttcggcgttacttcaaggcgcttgtcgacgagcgtcgcgaggagcaggacgataccatttcagcgcgcatcgccattgtcatgagcaaggccggttgcaccgttgaagaccgccgcgtggttgcccgagcacttgatgttgaagaatccaccggcgcgccgggttgtgccattgaacttaacgatggtcgactcgtcaccggcaagacttcagaacttctcggatgctccgcagcgatggtgcttaatgcactgaaggaactcgctggcattgatcgcagcgtggatctcctctcccctgaatccatcgagccaatccaatcgctgaagacccagcacctgggatcccgcaaccctcgcctgcacactgatgaagtgcttattgctttgtcagtgtctgctgcgaactccgaaactgcccgccgggctctggacgagctgaaaaatctccgcggctgcgatgtccacaccaccacgatcctcggatcagttgatgagggcattttccgcaacctcggagttttggttacttcagagccgaagtaccagcgcaaagctttgtaccggaagcgt

SEQ ID NO: 3319 - DNA, 495 bp, Corynebacterium glutamicum
atggcaaactacacagtccctggaatcaacgagaatgacgcaaagcagcttattgatggactgcaggagcgtctcaccgactacaacgatcttcacctcatcttgaagcacgtgcactggaacgtcactggccccaacttcattgctgttcacgaaatgctcgacccacaggttgaccttgttcgtggctatgctgacgaagttgcagagcgcatttccaccctcggaggcgcaccagttggaaccccagaaggccacgttgctgaccgcaccccactgcaatatgagcgcaatgccggaaatgtccaagcacacctcactgacctcaatcgcgtgtacacccaagtgctgaccggagttcgcgagtccatggcatcagccggcccagtggatccagtaactgaagacatctacatcagccaggccgcggagctggagaaattccagtggttcatccgcgcacacattgttgatgtagacggaaacatccaagag

SEQ ID NO: 3320 - DNA, 813 bp, Corynebacterium glutamicum
gtgattatgcctgaaggacacgtgattcatcgactagctggggaactcaccaagaattttggcgataccattttggacgccacttcacctcaaggacgctttacttctgaagcggcgatcatcaacggtcaccgcatcgcggttgcggaggcttacggcaagcacctgttcgtcgagttcgatgcggatcaccctgagcacattttgtatatccatttggggctgattggcacgttgcagtttgaacctgcggaagaaacccgcgggcagattcgcctgcacctttccgacggggagatcgcagctaatttgcgcggaccccaatggtgcaggttgatcaccgatgcagagcgcacccaggccattggaaaattgggcgctgatccgattcgcgatgatgccgatccggaaccaattcggattaaggtgcagcgctcagggcgaagcattggttcgttgttgatggatcagaagcttttcgcaggtgtgggaaatatctaccgtgcggagacacttttccgcctggggatttcaccgttcaccattggaaaagacatcaccacggcacagttccgatccatttgggcggatcttgttgggttgatgaaagacggtgttgtgactggtcggattgatactgtgcgcccggaacacacaccggaggcgatgggtaggccaccgcggaaagatgatcacggcggtgaggtttacacctatcggcgaaccggtcaagagtgctttctgtgcgcaactcccatcaaggagcaggtcatggagggtcgcaacttattttggtgtcccggctgccaacgc

SEQ ID NO: 3321 - DNA, 1149 bp, Corynebacterium glutamicum
atgaatcatgttgttaattttgcttcacatttggaagacgcagccctgaagcaagccgaagctactgccaccatgccgtttatttacccgcatgtggcgttgatgcctgatgctcactttgggctgggttcgtcggtgggaacggtgttcggcaccaagggtgcgatcattccggcggctgtgggtgtggatataggttgcggaatgataggagtgtgtaccaattacacggcctctgacctggagggacgtgatttggtgacgcttcgggattacatcgagcgggtgattccgttgtctcctggaaattacaattccaccaccttgaaggaaaccgcgaaggtgaaggtcgcggagttggaggaactcgcggagcgcgatggtgtagatttgtcgcactctccgacgtggaagcgccagttgggttcgcttggtggaggtaatcacttcattgagttgtgtcttgatgagttggatcgggtgtggatgtttttgcactctggttcccgcggtgtgggtaacaagattgcccagaagcacatcaagatcgcgcaggccgagtgtaagaatgaggagcttcccgataaggatcttgcgtacttgaccgaggggactgaggagtttgagtcttacatcaaggaactgaattgggcgcagcgttttgcgttcctcaacagggaagaaatgatggacagattcgcacgggagctgggttttttcgtcgacaagcagcttgaagaggtcgagcgcatcaactgccaccataactacacggtccaggaggagcactacggcgagaccatttggctcacccgtaagggtgccgtgttggcggacgaaggcacgccggcgttgattccggggtcgatgggcaccgcgtcgtacgtggtcagtggcaagggcaacgccgaggcactgcggtcggcgccgcatggggcgggccggaggatgtcgcgcaaccaggctaaaaagcgcttctcgacggccgacctggattctcggatggcgggcatcgtctaccggcccggcaaggagtggatcgatgaaattcccgacgcttacaaagacatcgatcaggtgatggccgatgctgccgatttggtgacaattcgccataaattgcgccagatcgtcaacgtgaaaggcacc

SEQ ID NO: 3322 - DNA, 1089 bp, Corynebacterium glutamicum
atggcgaattgtcaccaaatcggcagcatcggccatcacctgatcgatgtctttgtaagcgtcgggaatttcatcgatccactccttgccgggccggtagacgatgcccgccatccgagaatccaggtcggccgtcgagaagcgctttttagcctggttgcgcgacatcctccggcccgccccatgcggcgccgaccgcagtgcctcggcgttgcccttgccactgaccacgtacgacgcggtgcccatcgaccccggaatcaacgccggcgtgccttcgtccgccaacacggcacccttacgggtgagccaaatggtctcgccgtagtgctcctcctggaccgtgtagttatggtggcagttgatgcgctcgacctcttcaagctgcttgtcgacgaaaaaacccagctcccgtgcgaatctgtccatcatttcttccctgttgaggaacgcaaaacgctgcgcccaattcagttccttgatgtaagactcaaactcctcagtcccctcggtcaagtacgcaagatccttatcgggaagctcctcattcttacactcggcctgcgcgatcttgatgtgcttctgggcaatcttgttacccacaccgcgggaaccagagtgcaaaaacatccacacccgatccaactcatcaagacacaactcaatgaagtgattacctccaccaagcgaacccaactggcgcttccacgtcggagagtgcgacaaatctacaccatcgcgctccgcgagttcctccaactccgcgaccttcaccttcgcggtttccttcaaggtggtggaattgtaatttccaggagacaacggaatcacccgctcgatgtaatcccgaagcgtcaccaaatcacgtccctccaggtcagaggccgtgtaattggtacacactcctatcattccgcaacctatatccacacccacagccgccggaatgatcgcacccttggtgccgaacaccgttcccaccgacgaacccagcccaaagtgagcatcaggcatcaacgccacatgcgggtaaataaacggcatggtggcagtagcttcggcttgcttcagggctgcgtcttccaaatg

SEQ ID NO: 3323 - DNA, 573 bp, Corynebacterium glutamicum
atgtggatagtgctgaaaatccgacggctgcttctacgccgtgtccttccgctactcatcaccttggcgctcctgtgcggactggtgcttgcgtggtttatctatcctgcgaaggctgagcccaaaaaagttgatgtagttctggtgctggccggttccagcgatggtcgacacgaatatggtgccgagcttgttgaagaaggctacgccagcaattacgtcgtctccaacccgagtggctccaaagacaaagtgggatatgcccactgcgcaggaaagtcacggccaaaaaatgcggaaagtttctgcatggatccttaccccgtgatcacctccggcgaagcccgcacgtttaacgagcttgccaaaaaggaaggctgggaaagcgtattggtagtgaccagccgcacgcacacccaacgcgttcgcaccatgtttgaccagtgctataccggtgattccacagtgctcaacgtcaacagcctaggacgtaccgggcttcacaatgcagtactccacgagattggcggcttcattaaattttggattaccgctccgtgcgcggacacaaac

SEQ ID NO: 3324 - DNA, 474 bp, Corynebacterium glutamicum
atgcaccatctacgctatgaatcaccaatcggagagcttcttcttgttgcaagtgaccaagggctaacctatgtggcattctccgatgaaaactacgcagcttgtactgtcgggtcgaccccgggaaccaatgcggtgctggaacaggcagttgctgagcttgaagaatacttcgcagggaaacgtaaagagttcagcactcccctggattggccaagccaaaatctgctgagcttccgcggtaaagtgcaggaatttttgctgtccattccttatggggagagtaaaacttacaaacagatcgccgctgagcttaataatgtgggcgcggttcgtgcagtgggaagcgcctgcgccaccaaccccttgccaatctttgctccttgtcaccgagtactgcgcactgatggggcgttaggtggctacagaggaggcttggaagcaaaacagtggctgttggagctggaacgtcct

SEQ ID NO: 3325 - DNA, 1011 bp, Corynebacterium glutamicum
atgagcgcgcaaatggatacccctgatcccactatgtctgctgttgcaatgttagattccatcccttctgatcaaccagatttcctgatcgatgtagaagtagatcgaccaactcccggaccacatgatctgctagtccacattgaggcggtctcaattaaccctgttgataccaaggtacgcatgcgggccgggaagcaaaagcatcctaaaattttaggttttgatgctgcaggtgaggtggtggctgttggatcgcaggtcacgctcttcaatgttggtgacaaagtgttctacgcaggatccaatcagcgtccaggaagtaacgcagagtaccaggtggtggatgaacggctggtgggtcacgcaccacaaagcttgggggcacacgacgccgctgctctcccacttgtcgcgctcactgcatgggagtcactttttgaccgattgggagtaactcagtcaactactggaacactgttggtcttgggcggttcaggaggtgtgccttcagctcttattcaacttgctcgagctctcactggtctgaaagtagtggcaacagcttctcgccctgaatcacaagaatgggtgacaaagctcggtgctcatgaggtgattgatcactccaaggatttgagtgagcaaatctccgacgtggattttgttttcagctcgtggactactgggcgtgaagtagagctcgccacgttgatgaaaccccagtcccacctagtgctcatcgatgatccagtggatcccaatttgggcgcttttaagcaaaaagcgatcgctttgcactgggagttcatgtttacccgcgctatgttcaacactcctgatatgggtgaacaagggaaaattctgaataagatcgccgacatggttgatcggggtcagtttgagtccgtgacagcaacggtgctggatgggctcaacgctgcaaacatcatggaggggcaccggctcgttgagcagggtaaaacctcaggaaaaattgttgtgagggta

SEQ ID NO: 3326 - DNA, 111 bp, Corynebacterium glutamicum
ttgcccgaaatattgctcaaagcatctctcaaagcactgcctaaagcactgcccagagccttgcccggagctttgctcaaagcatctcaagcatcaggcaagacctcccca

SEQ ID NO: 3327 - DNA, 1176 bp, Corynebacterium glutamicum
atgagcaccaccaccgcgcccgaagcacggtttcctgtcgtccctttgaccgccatgagtttcgcggcatttgtttatgtcacgttcgagatgtttgcagttggcctcatcaagccgatggccagcgatcttggagtgtcagaatccagcatcggcctgttgatgactgtgtatgcgactgtcgttgccgtggtgacgatccctgccatgttgtgggtttctcgatttaacaagcgcacagttttcctgattactctggcatttttggccacgggcattgttgttcaggcactgaccgttaattatggaatgctagccatcggccgcactatcgcagcattgactcacggggtgttttgggcacttgttgggccaatggcagcgcgtatgtccccaggtcacactggtcgtgcagtaggcgttgtgtcgattggatcaaccatggcgctggtcgttggttctccgctggcaacatggatcggtgaactcatcggatggcgtcctgccacctggattcttggtgcgctgaccattgcggccgtggctgtactcattccaaccgttccatcactgccaccacttccagacacggaatcagagtccaaagaaaagaaatcccttccatggggtctcatttccctggtcattttccttctccttgccgtcaccggtgtttttgctgcctacacctaccttggcctcatcatcgctgaaacagcaggggacagcttcgtgtccattggcttgttcgccttcggtgcactcggactcattggcgtgacagtggcaacccgaactgtggatcaacgcatgctgcgtggaagtgttcacaccaccactttgtttgtcattgctgcaattctcggacagatcgcattcggattagagggcacactagccgtagtagctatcttccttgcagtcaccgtgtttggtggagcatacggcgctctcccaaccctgggaaccaccatcttcctccatgcgggtcgcgaccacccagatactgcatcctccatttatgtggtcacttaccaagtgggtatcgcgtctggcgcggcacttggcgcgatggctgtggatgccgattgggttgctggcactttgtggatcatggctggactgtcattggcttccacgttggccttggcgctgtggtcccgcccgctactgaag

SEQ ID NO: 3328 - DNA, 1176 bp, Corynebacterium glutamicum
atgaccatcgacctgcagcgttccacccaaaacctcacccatgaggaaatcttcgaggcacacgagggcggaaagctctccattagttccactcgtccgctccgcgacatgcgcgatctttcccttgcttacacccctggtgttgctcaggtttgtgaagcaatcaaggaagatccagaggttgcgcgcacccacacgggcattggaaacaccgtcgcggttatttccgacggcaccgctgttcttggccttggcgatatcggacctcaggcctcccttcccgtcatggagggcaaggctcagctgtttagctctttcgctggcctgaaggctatccctatcgttttggacgttcacgatgttgacgctttggttgagaccatcgcagccatcgcgccttctttcggtgctatcaacttggaggacatctccgctcctcgttgcttcgaggtggagcgccgcctcatcgagcgtctcgatattccagttatgcacgatgaccagcacggcaccgctgtggttatcctcgctgcgctgcgcaactccctgaagctgctggatcgcaagatcgaagacctcaagattgttatttccggcgcaggcgcagcgggcgttgcagctgtagatatgctgaccaacgctggagcaaccgacatcgtggttcttgattcccgaggcatcatccacgacagccgtgaggatctttccccagttaaggctgctcttgcagagaagaccaaccctcgtggcatcagcggtggcatcaatgaggctttcaccggcgcggacctgttcattggcgtgtccggcggcaacatcggcgaggacgctctcaaactcatggccccggagccaatcctgttcaccctggcgaacccaaccccagagatcgatcctgagctgtctcagaagtacggcgccatcgtcgcgaccggccgctctgacctgcctaaccagatcaacaacgtgctcgcgttcccaggaattttcgccggcgctctcgcagccaaggctaagaagatcacccccgagatgaagctcgccgctgcagaggcaatcgccgacatcgcagctgaggacctcgaggtcggccgcatcgtgcctaccgccctggatccccgcgtcgccccagcagtcaaggcagctgtccaggccgtcgccgaagcgcaaaacgct

SEQ ID NO: 3329 - DNA, 1482 bp, Corynebacterium glutamicum
atgggatcaattccaacaatgtccatcccttttgatgactcacgtggaccttatgtccttgctatggatattggttccactgcatcacgaggtggactttatgatgcttccggctgcccaatcaaaggcaccaagcagcgcgaatcccatgaattcaccaccggtgagggcgtttccaccattgatgctgaccaggtggtttcggagatcacctcagttattaatggcattttgaacgcggctgatcatcacaacatcaaagatcagatcgccgctgtcgcgctagattcttttgcatcctcattaatcttggtcgatggtgaaggcaatgcgctcaccccgtgcattacctacgcggattctcgttctgcacagtatgtggagcagctgcgcgcggaaatcgatgaggaggcctaccacggccgcaccggcgtctgcctgcacacctcctaccacccatcgcgcctgctgtggctgaaaactgagttcgaggaagagttcaacaaagccaagtatgtgatgaccatcggtgagtacgtctacttcaaacttgcaggcatcaccggaatggctacttcgattgccgcgtggagtggcattttggacgcccataccggcgaacttgatctgactatcttggagcacatcggtgttgatccggctctgttcggtgagatcagaaaccctgatgaaccagccaccgatgccaaagttgtcgacaaaaagtggaagcacctggaagaaatcccttggttccatgccattccagacggctggccttccaacattggcccaggcgccgtggattctaaaaccgtcgcagtcgccgccgctacatccggcgccatgcgcgtgatccttccgagcgttcccgaacagatcccctctggcctgtggtgttaccgcgtttcccgcgaccagtgcatcgttggtggcgcactcaacgacgtcggacgcgccgtcacctggctggaacgcaccattatcaagcctgaaaacctcgacgaagtgctgatccgcgaacccctcgaaggcaccccagctgtcctgccgttcttctccggggaacgctccatcggctgggcagcctcagcgcaggccacgatcaccaacattcaggaacaaaccggccctgaacacttgtggcgcggcgttttcgaagccctcgcactctcctaccagcgcgtttgggaacacatggggaaagccggcgcagcccctgaacgggtcatcgcatcaggacgagtctccaccgaccacccagaattcctcgcgatgctttccgacgccctcgacaccccagtcatccctctggaaatgaagcgcgccaccctccgcggcaccgcacttatcgtccttgagcagctcgaaccaggcggcacgcgcgcgacgccaccattcggcacgacgcatcagccgcgctttgcgcaccattactccaaggcaagagagcttttcgacgccctctacctcaagttggtc

SEQ ID NO: 3330 - DNA, 591 bp, Corynebacterium glutamicum
atgagagccccttccacttcgatgattgccctcgcgctgattgcttacagcgctgtcatggtttcgttgaccatgttgaaatcattcttcgtcattggattgttgtgggtaccggaagcccataggaatcgttcgatttctttagtgccattcaatgacttcatcgaatccagttcatggttttctccgctatttggttacggaggaaacttcgctttctttgtccccttcggagtgctgttctacgtcctgttaaaaacatctgggtcgtggcataagaattcagtcattcacacgatgcgggtgggcgcgctatttagcctggctattgagatatctcagtatgttttcatgctgggctacagcgacatcgatgaccttattttcaatactcttggtgccggtgcgggagcattaattgccaagatctttggggagagattttttaaggtgtgggtttggctcgcactgattctggcagtagtttttgcagtcttggtggcactggggccaaggcttggcgatcccgacaaggtggttgatctgggagaagcacagcaattgagcaatactcccatgcatgttttcgcg

SEQ ID NO: 3331 - DNA, 525 bp, Corynebacterium glutamicum
gtgaagaagagcttcaatgcctcttctttactgttcgcgttttccttcggcgtgtacctggtgctgcttgtgatgatgacacttcttaaaagtcgcctttctttaggcggactgtggaacacagaagcacaccaatacagatccatcgacttagagcttttcaacggctttgctgatccaccaatttggtgggggccttggaccaacacttttggcaacatcgcactgttcatgccatttgggtttttcctgtacaaaatgctccgtagattcaaccatcgattccccttcgtagaaaccatcctgtttgccagcgtcaccagcctcagtatcgaagttctgcaatgggtgtttgctattggatattcagatgtcgatgacctgttgtttaatacgatcggcggactcattggagcatccgtagcagcgcttgtctcgcttaaatcctccaaggtagtcagcggaatcatcatgggcggttcactatctgtgatggcgatgatgatgtattcaagttttatcgcc

SEQ ID NO: 3332 - DNA, 1344 bp, Corynebacterium glutamicum
ttgcccgagagtatcttgggtcgcatggacacaaaattaggcgctgaattgggtactgaatttgatctcattgttgttggtttcggcaaagcaggcaagactatcgcgatgaaacgctcggcagcgggggataaggtcgcactgatcgagcagagtccacagatgtatggcggtacctgcatcaatgtaggttgcatccccacgaagaagttgttgtttgagactgcaacgggcaaggatttcccggatgcggttgtggcgcgtgatcagttgattggcaagctgaatgccaagaatcttgcgatggccacagacaagggtgtcaccgtcattgatggaaaagctacgtttacagctagccacgaaatcacagtaacttcaggtagtgacactcttgtgctgtatgcgccaacgattgtgatcaacacgggctccacgccggtcatccccaatgtcccaggcaccgacaatccgcatgtttttgattccactggcattcagcacatttcgcccctgccgaagcacctcgcgatcatcggcggtggccccatcggtttggaatttgccacgcttttcagtggacaaggctccaaagtcaccatcatcgaccgtggtgaattgccgctgaaaaatttcgacagggaagtagcggagctggccaaaaccgacctggaggcccgcggaatcaccttcctcaacaacgctgaactcaccggattcagcggtgacctcaccatcgcgctcaaagaccacgacctcctcgccgacgccgcacttcttgccatcggccgacgcccggccaccgacgggctcggccttgaacaggcgggcatcaaaacaggcacgcgtggggaggtgcttgtcgacgcccacctccggaccaacatcgacggcatcttcgctgtaggtgatgtcaatggcggcccgcagtttacctacgtgtcctacgatgaccaccgcattgtgctggatcaactagccggaacaggtaagaaatccactgcacaccgactgatccccaccaccacgttcatcgaaccgccgttatccaccatcggtgacaacactgaaggggaaaatgtggtggtgaaaaaggccttgattgcagatatgccgatcgttccccgaccagagattattaaccaacctcacggtatggtgaagtttttcgtcgacaagcaatctgatgcgctgctcggcgcgaccttgtactgcgccgactcccaggagctcatcaacaccgtggcgcttgccatgcggcatggcgtcaccgcctccgagcttggcgacggcatctacacccaccccgccacctcggagatcttcaaccaattattgggcagt

SEQ ID NO: 3333 - DNA, 1230 bp, Corynebacterium glutamicum
atgagttcgtctggaaaagtcattgttgttggagccggcatagtgggtcttgccaccgcctggcatttacaggagcacgggttcgaggtgagcgtccttgatcgggatggtgtcgctgcaggttcttcgtggggtaatgctggttggttagcgccggcgaaaactattccgttgtcggagccggggctgtggacgtatggtccgaaagagctgttcaatccggtgtcgccgatgcatatgccacttcgtgtggatcccaaactgtggcttttcttggcgcaatttatggcgcaggcttttcaacgcaagtgggattccacgatggcggacctcacggagatcgataaggtcgcgctcgaagcttttgatgaactgtcgatcggtggcgtggaaggcctcacccatgaaggtccatttgttattggttttgaggaagagcgccaatcggcgggtttccgtaaggaaattgatggcgtgagcaggcacggccagaaagtggagatgtctcgactggagaatccacaagagttggcgccgatgctgaatgagcaaattcaggtggcttaccgtttggaaggccagcgtttcatcgagccgggtccatacgtgcagtcattggcggatgctgtggtgaagcgtggtggcgtgatccgcgccggggcagaagttgtgcatgtggcgaagggtgatcgtcccgcggtcattttggcggatggtagccgtgaagaagcggacaaggtggttgtggcaacgggtgcctggctgccgggtctaacgcgtgaatacggtgtgaaaactcttgttcaggctggtcgtggctattccttctctgtggcaacggatattcctgccaagcattctgtgtaccttccccaccaccgcatggcctgcacgccgtatgagggccgtttccgcattgcgggcaccatggagttccgcggtccggatgagccgttccagcagggccgggtggatgcgattgtttcgcaggcgaagaaggttatgagaggtattgatttcaacgatcgtcaggatgagtgggtgggttcccgcccggtcactccggatgggcgtccgttgattgggcagaccaaggcggagaacatttacgttgccggtggtcacggcatgtggggtgtggtgctgggccctgccaccggtaagtatttggcggagctgatggctacgggcaacaccaacccgatcatcaagccgttcgatccgctgcgt

SEQ ID NO: 3334 - DNA, 1503 bp, Corynebacterium glutamicum
ttgcctgaaggccaatctggcaccatcgtattggtctctgatggcattgcaacgtgtacgccccctccagtgtgtgaggttgctgcagaactagccgaccagggtgttgatctggtgattaacactgttggattcaacgtcgatgagtctgctcgcgcggaactggagtgcattgcgcaggctggaaacggtacttatgcagatgcgagcgatgcggattcgcttgtggcagaactgaagcgagctgccacccgcacggcagtgggctatgaatcagacctggaacaaatcgatggcaacagcagccaaacaagcctgaccccaattccagatgatgtggaattgttcaaagccgatcttccagcactagataataaagacggcgaagtaactcagtactggtccattcccgttgaagattatgaacgtgtgcaggtaaccacctcgtatgttgcgccagtgacttttggactcgggaacgactacctgagcattaggaatgaactgcttttcggagatgaacaagatcaaacctgtcatcgttcgatcagcaatgatcaaattcttgataattacggtgcgcggcctttggttgccagtgtggagtcagatgtgattggagataagtgcgataccgatgaactggttctcgcaatcaccagaagccagcctttcaattgggaagaagaattacctgttgagatcgtggtaaagcgccttaatcacgcggatacgtcagggcttccactcggtgatcaacagcgtgaaatcccagatctcgacgtggccgcagtacaaacatgggcacccaccactggcggatcttggtttaccaacgctacggagctaactccaggtgaaggtgttgaagcagagatcgtacctggtgaaaatcacgtttatcgcctgcctatggcaactggtcagcagctgcatggctttgtggaagttgtagaaaacacggcaccagatgatcctggcgtgacggacaaattgggtgttgcagtgtattcgccaacacgacaggacgccggagttgatatgtggacggatatcgctccacgtgagggcaccagtgagtattttgcagcgccagttgcactgacttatctgaatatgttccctgctgaaggcggatttggcactacttctaaggccaccagcacgtttacgtttgaaggcgattactacctcgttgtgcactatgacgatctcagtggcagtacaatcagagatgccagcaaccagcagtcttttccccttcgttatcgcttagcagcggatgcttttggtgatgcagagccaggcccagtgtttgaaaaggtttctgcaaccacctcagaatcctctagcccaagcactcaaccagatgagccagctcaaaataccgcaactgaggaaagcagcactggaatctccccgctcattgttggcgctatcgtcgcactcattttggcgttcgctgcgtttgccagctggctagttttgaaaggccgcaagaaa

SEQ ID NO: 3335 - DNA, 330 bp, Corynebacterium glutamicum
gtgttcattgtgcacctagctggacaatccaccagacaacggcaaacgatattccttgccgtaataacaagtattcttctcatagttttaagcgtgccctccaccgcgaatgcgcaaacagaatctacatcccgcggagttcccacgatgctggtgttagatagctcgggatcgatggtgactccagatgctggtgggcaaagcaggtcagatgccgccaaagaggctacgaatcagtttattgatgagctcgctggaaccctcgacttaggtttggtgacctacggcggaaacactggtgaaacaccagaagattatgaagccggttgc

SEQ ID NO: 3336 - DNA, 321 bp, Corynebacterium glutamicum
atgcgtaaacttcgtactgcttccgttgcactgctgaccgcaggtgcacttgcactgaccgctactcctgcaatggctcagtccaccaccggttcttctgcatcttctcaggttggcgacgcactcggtgctagcgactacgagcgcgacatctggggttcctctaaggacttcgacgatgtaaccccattcggttccgcttggtacggctacaccctggccgcaaccgcagttgctatctccggtcttgtgtacgcaaaccttcctgcaatcgagcaggctgctgcacaggccggcatcaagctggagatcccacgctac

SEQ ID NO: 3337 - DNA, 609 bp, Corynebacterium glutamicum
atgactacagttactcaagaccttctagcacttgacgaagacgcacagaacctccttttccgtgaggctcgcaccgcaaatgctttcactgatgaaccaatctctgacgagcagatcgaagcaatcttcgacctagttaagtgggcaccaaccgcaatgaactcccagcctctgcgcgtggtaattgttcgttccgaagaagccaaagctcgcctcgtgccattgatggcagaaggcaaccaggccaaggttgctgcagctcctgcggtcgcacttcttgcagccgacatcgacttccacgaagaaatgcccaagctcttcccacctttcccaggcgcacgcgacatgttcgaagccgatgaagcttcacgtgcttcctccgcagaactcaatgctggccttcagatcggatacgccatcatcggtatccgcgcagcaggtctcgccgctggcccaatgaccggcatggatgcagacgctatctccaaggagttcttcccagacggccgccaccgcgttctggttgccatcaacatgggtaagccagctgacaatgcttggtacgaccgcctgccacgccttgagcaggacgaagttgtcgaaaccctc

SEQ ID NO: 3338 - DNA, 924 bp, Corynebacterium glutamicum
atgaaccgcacactccgaacacttggctggcttgctgccgtaattcaagaagatccggagccctggttcaccactgatcccgacaccgattatgtcccttatgtaaatagtttctcatttgaatccctttccctcgttccagatgctctgatgctgctcaaacgttctcttcaccttgcgatggagcaacaggacctcccagtgaaggatctacaagaagcactgaggcacgtactagttttcaaattccacttcagggaagaatgggagctggaattagcatgggactccgagcggaccaagtctgcggtgagaattattgagagcacaaaagaatctcttgccgatcaatacagagattacaaatacgcattcttgcctgagctaattttccaggaatcacgcgggatctttgactttgagctggagggatacaccctcaaagtaggacaaagcacgctttccattccttgggacatgatcgccaatggttatgtccctgcaagtcttcggaattttggagaattaatggaccgtgacaccggagatcttgatgcagatcccattctgagacctcgagaactcaaatttgagatccataattgtccagatcttaatccttggataatgcgggaaacttttgatttcatgatggaaatcgcaactgaaacaggatggttccatgctctcaaccccgcatataattccgtctacacctacgatcttatttctcgcatgccagatttccttgttgaagggagctttcgtccgcattcagtgaaacgatcttgggaaaaaattcaaaagatagctaaagctgttgagtcttatgcatctcacgattactgcatgtcaacgctgacacatgactacagggcaatcgagttatccctgacgcctacaaaaactgaggaaccaagcaca

SEQ ID NO: 3339 - DNA, 1452 bp, Corynebacterium glutamicum
atgtgcttggccgttttcgtcgtagacgattgggaaaggctcgccccagtaacgctggcgagcgaacagccagtcgcgcagcttgtactggatggtgccgcggccaagttccttttcttccaaccattcgatggtcttggcaatagcctcatccttggcaaggccgttgatatccaggccgttgtcgttcgcagagttgactgcttcgccagattcggtgaaagcagcctcttcgatgttgccacctgcgacaacttccttgataggcagacccaaaacggtggcgaattcgtagtcgcgctcgtcgtgagcaggaaccgccatgatggcgccggtgccgtagccggtcagaacgtagtcagcgatgaacactgtgatctgatcgccgttgactgggttggtcgcgtaaacgcccaggaagacgccggtcttttccttgttttcctgacgctccaggtcggacttcgcggcgatggaggcgcggtatgcagcgacagcttccgcagggctcgcctggccattggtccaacgggcatcaacgccctcgtaggaaccagccttctccagcagcacgtcgaccagctcatgctcaggtgcaagaaccatgtaggtcgcgccgaacagagtatctgggcgggtggtaaacacggtgacggtttcgccctctgcactgaaatcaacttcagcgccgcgggaacggccaatccagttacgctgcatggacttgaccttctcagtccaatcgagcagctccagatcatcgatcagacgatccgagtacgcggtaatgcgcatcatccactgggacaaattcttacggaaaacagggaaattgccacgctcggaacggccgtccgcggtcacttcctcgtttgccaacacggtgcccaagcctgggcaccagttcacggtggagttcgagcgataaacaaggcggtagtcatccaccgctttttgcttttcgacgtctcccagcgcgttgtaatccgccccgtccttagtcttcagctcgccggactccagcaacggaatcagctcactgatgggacgtgccttctgctgctctgcatcgaaccacgaattgaaaatctgcaggaagatccactgagtccacttgtagaactcaggatccgtggtggccaccgcacgacgggaatcatggccaagacccagcgcaccgagctggcgcttcatgttctcaatgttggccatggtggtggtgcgtgggtgtgtaccggtttggatcgcgtactgctctgctggcagtccgaaggcgtcatagcccaaggtgtgcagaacgttcttgcccagcatgcggttgtagcgggcgaaaacatccgttgcgatgtaaccgagtgggtggcctacgtgcaggccagctccggatgggtacgggaacatatcctggacaaagagcttgtcctcaggaagtgctttaccgtccgcaggcgc

SEQ ID NO: 3340 - DNA, 2856 bp, Corynebacterium glutamicum
atgactaacccgagcgaaggcaccactcccctggcgttccgttataccccggaactcgccaacaagatcgaaggtgagtggcagaattactggactgacaacggcacattcaacgcacccaacccagtgggtgatttagcgcctgcggacggtaaagcacttcctgaggacaagctctttgtccaggatatgttcccgtacccatccggagctggcctgcacgtaggccacccactcggttacatcgcaacggatgttttcgcccgctacaaccgcatgctgggcaagaacgttctgcacaccttgggctatgacgccttcggactgccagcagagcagtacgcgatccaaaccggtacacacccacgcaccaccaccatggccaacattgagaacatgaagcgccagctcggtgcgctgggtcttggccatgattcccgtcgtgcggtggccaccacggatcctgagttctacaagtggactcagtggatcttcctgcagattttcaattcgtggttcgatgcagagcagcagaaggcacgtcccatcagtgagctgattccgttgctggagtccggcgagctgaagactaaggacggggcggattacaacgcgctgggagacgtcgaaaagcaaaaagcggtggatgactaccgccttgtttatcgctcgaactccaccgtgaactggtgcccaggcttgggcaccgtgttggcaaacgaggaagtgaccgcggacggccgttccgagcgtggcaatttccctgttttccgtaagaatttgtcccagtggatgatgcgcattaccgcgtactcggatcgtctgatcgatgatctggagctgctcgattggactgagaaggtcaagtccatgcagcgtaactggattggccgttcccgcggcgctgaagttgatttcagtgcagagggcgaaaccgtcaccgtgtttaccacccgcccagatactctgttcggcgcgacctacatggttcttgcacctgagcatgagctggtcgacgtgctgctggagaaggctggttcctacgagggcgttgatgcccgttggaccaatggccaggcgagccctgcggaagctgtcgctgcataccgcgcctccatcgccgcgaagtccgacctggagcgtcaggaaaacaaggaaaagaccggcgtcttcctgggcgtttacgcgaccaacccagtcaacggcgatcagatcacagtgttcatcgctgactacgttctgaccggctacggcaccggcgccatcatggcggttcctgctcacgacgagcgcgactacgaattcgccaccgttttgggtctgcctatcaaggaagttgtcgcaggtggcaacatcgaagaggctgctttcaccgaatctggcgaagcagtcaactctgcgaacgacaacggcctggatatcaacggccttgccaaggatgaggctattgccaagaccatcgaatggttggaagaaaaggaacttggccgcggcaccatccagtacaagctgcgcgactggctgttcgctcgccagcgttactggggcgagcctttcccaatcgtctacgacgaaaacggccaagcacatgctctgccagactccatgcttccagtcgagctgccagaggtagaggactacaagcctgtctccttcgaccctgaagacgcagactccgagccttccccaccactggctaaggcccgcgaatgggttgaggtggaactcgatctcggcgatggcaagaagaagtacacccgcgacaccaacgtcatgccacagtgggcaggttcctcctggtaccagctgcgctacgtcgatccaagcaacgatgagcagttctgcaacatcgaaaatgaacgctactggaccggcccacgcccagaaacccacggaccaaacgatccaggcggcgtagacctctacgtcggtggcgtcgagcacgcagttctccacctgctctacgcacgtttctggcacaaggtcctcttcgacctgggccacgtctcctccaaggagccataccgtcgcctgtacaaccagggctacatccaggccttcgcctacaccgattcccgtggcgtctacgtgcctgccgatgatgtcgaagagaaggacggaaagttcttctaccagggcgaagaagtcaaccaggaatacggaaagatgggcaagtccctgaagaacgccgttgccccagacgatatctgcaacaacttcggtgctgacaccctgcgcgtttacgagatggccatgggacctttggacacctcccgtccatgggcaaccaaggacgtcgtcggtgcgcagcgcttcctccagcgtctgtggcgtctcgtcgtcgatgaaaacaccggcgaagtgctcactcgcgatgaagtcctcaccgacgatgacaacaagcaactgcaccgcaccatcgcaggcgtccgcgacgactacaccaacttgcgcgttaacaccgtggttgccaagctcatcgaatacgtcaactacctgaccaaaacatacccagacaccatcccagctggcgcagtcctgccactgatcgtcatggtctcccctatcgcaccacacatcgcggaggaactctggaagaagctcggccacgacgacaccgtcacctacgaaccattccccacctttgaggaaaaatggctcaccgacgatgaaatcgaactgccagtccaggtcaacggcaaggtccgcggtcgcatcaccgttgcagccgacgccagccaggagcaggtcatcgaggcagcgcttgccgacgagaaggtgcaggagcaaatctccggcaagaacctgatcaagcagatcgttgttccaggacgcatggttaaccttgtggtgaag

SEQ ID NO: 3341 - DNA, 429 bp, Corynebacterium glutamicum
atgtggaaaccactgcttatcgccgtcggactgctcagtcttgtctgcggagcaatcggcgttgtattgccagttatccccacgactccgtttttattgctgagtgctttctgtttcacgcgcagctcagagcggttgcataattacctggtctcgcaccgaatctttggcgagtacatctccaattactacaaccacgcgatgaccccgcagcataaattccgcacacttttgacactgtggtgcggaattatcctttcctgcttcctcatcggggcaaccattccgtggatcatcttgccgctgattgccaccggcgtgagcatccacatcattcgtttgaagccccgaccagaggcgactcctactgcgagctctcctgaagcggattcagggtccgagccacattttgctgacgatcataaggct

SEQ ID NO: 3342 - DNA, 357 bp, Corynebacterium glutamicum
gtgcaggacgcaggcgaacgcaacaacaatgaccggccagtgatgccgggagagatcctccgtgaggaattcatggagcctttggggctgtcccaaaacggcttggcgcgggcaataggagtgccaccacgcaggattaatgagatcgtgcacggcaaacgcgcaatcacggcagacactgcgctgcgtttagctgcttatttaggtcccgatccacagttttggctcaacttgcagacccactacgacctgtcggtgacgtatttagatgcgcgcacactgttggaagcgatcaagccttatgatcgtcagcaaaatgtggctcggaccctgaatccgcttcaggagagctcgcag

SEQ ID NO: 3343 - DNA, 774 bp, Corynebacterium glutamicum
atgctcgccgaactcagcgttgtccacgagggagagctgacgggagtagtgggatgtgcccaacctggccagtgtcagccgctcctccagcggaagatcgtggaaagttgtcatttattcaaacaccgtcttgttttcaatgaagccgaggcccgcaatctcaacctttacggtttcgccgtcaccgatgtagcgctgtgggttacgtgcgtggccaacgccgcctggggtaccggtgacaatgacgtcgccagcatccaatgggtagatgtgggtgatgtattcgatgagcttttctgggctaaagaccaggtcattggtaggggtggactgtaccttctcgccctcgaggtaggttgccagctcgccgccgaactcaaaagaatctggggtagtcatccaaggcccgaagccagcggacttttccaaagacttgccctggtgccactgtggagtctttgcaggtgctgcgtactggaaatcgcgggtggtgtaatcgttcatcactgcgtagccagcgatgtactcagcagcatcggcctgcttgacacggcgtgcgcgcttgccaatgataactgccatctcgccttcccagtcgagagccttgttagcccactctggaacgacaacatcatcgaaaggtccgatgagcgcgtcagggaacttaacaaaaagggttggggtatcagggaggtcgcggcccatttctttaatgtggttggcgtagttaaggccgacgcacacaatcttcttaggtgctggaactactgcatc

SEQ ID NO: 3344 - DNA, 723 bp, Corynebacterium glutamicum
atgacaactttccacgatcttccgctggaggagcggctgacactggccaggttgggcacatcccactactcccgtcagctctccctcgtggacaacgctgagttcggcgagcattccctgctagaagggtggactcgttcccacctcattgcccacgtggcatacaacgccatcgcactgtgcaacctcatgcactgggcaaatactggtgaggaaaccccaatgtacgtgtcgccagaagcgcgcaacgaggaaattgcctacggttccacgctcaatcccgatgcgttgcgtaacctgcatgaacactccgtcgcacgcctggacgtggcttggcgtgaaacgtctgaagatgcttggtcacacgaggttctgacagctcagggacgcactgtcccagctagtgaaacattgtggatgcgttcccgcgaagtctggatccacgcagttgacctcggtgcagtggcaacctttggcgacatcccagaggtcatcctgcgcaccttagctgcagaaatcacacaaaagtggacaagccaaggagccggcgagggacttgtgcttctcgacgagccctccagcactcgctaccccgccgccccagggcaggacgaggtagtagtgtccggtagccttgcaggcattgttcgctacgccgctggccgcggttccgatggagtcacttcttccactggagaggttccagagccaccgcgctggctg

SEQ ID NO: 3345 - DNA, 837 bp, Corynebacterium glutamicum
atgcgtcttgcaacaatccgcaccaacggcaccaccattgctgctcgtgttgaatctgaaaacaccgctaccaccatcgagggctttgccaacgtcggtgaattactccaggaatccaactggcgcgagctggcagaaaacgctgctggtgaggctgtgacctttgaaaacaaggagctagatgcagtagttccagcacctaagaagattgtgtgcgtcggccttaactacgccaaccacattaaagaaatgggccgcgacctccctgataccccaaccctttttgttaagttccctgacgcgctcatcggacctttcgatgatgttgtcgttccagagtgggctaacaaggctctcgactgggaaggcgagatggcagttatcattggcaagcgcgcacgccgtgtcaagcaggccgatgctgctgagtacatcgctggctacgcagtgatgaacgattacaccacccgcgatttccagtacgcagcacctgcaaagactccacagtggcaccagggcaagtctttggaaaagtccgctggcttcgggccttggatgactaccccagattcttttgagttcggcggcgagctggcaacctacctcgagggcgagaaggtacagtccacccctaccaatgacctggtctttagcccagaaaagctcatcgaatacatcacccacatctacccattggatgctggcgacgtcattgtcaccggtaccccaggcggcgttggccacgcacgtaacccacagcgctacatcggtgacggcgaaaccgtaaaggttgagattgcgggcctcggcttcattgaaaacaagacggtgtttgaa

SEQ ID NO: 3346 - DNA, 1125 bp, Corynebacterium glutamicum
atgggcgccccaggtaaaaacgattacgcaactgaacacgtcaagcaagaagtcccacccgcaactccagaagagcaggcagagctggacaccatgtataaacgcatggatgacctgcatctaaagcccctgtggactcaaatcggtgggttgatgccaaaccacccggaaccacgagctgtggcacacaagtgggattgggcggaactcctgaagctcgcgcagcgctccggtgaactcgttccagttgggcgcggtggcgaacgccgtgccattggcctggcaaacccaggtttagacggcaatacctacatctcccctaccctgtgggcagcaattcagtacctcgctccgggtgagaacgctccagagcaccgccactcacaaaacgcattccgctttgttatcgaaggcgaaggcgtgtggactgtcgttaacggcgatccagtaccaatgcgacgcggcgacttcctgctcaccccaggctggaactaccacggccaccacaacatcgcgaccgagccaatggcctggctagacgggctcgatatcccatttgcctaccaaatggacaccggattctttgagtacggcaccgaaaaactcactgacgaatccaccccagacctctcccgttcagaacgcctgtgggcccacccaggacttcgcccagtctccttcccaggaaaaacttcctactcaccaattgggcgctacgcctgggagcacaccgacgcagcactcaacgatcagctggcattggaagaagcaggacacccaggaacagtcgcgccgggacatgctgcgattcgcttctccaacccaactaccggtggcgatgtcatgaccaccatccgcgcggagttccaccgcctgcgcccaggtgcatccactgcccccattcatgaggtaggaaaccgttgcttccaggtatttgagggttccgcaacaatcaatgttggagataaaacctttgaagctaaccacggcgatgtgatcaatgtaccgtcgtggcagaagtggaatatcgtcgctggctctgacggcgtcgacttgttctgcttctctgatacaccaattttcgaggcccttaacctcgcacgtacttttactccggaaggaatc

SEQ ID NO: 3347 - DNA, 780 bp, Corynebacterium glutamicum
gtgattatggataacgtcgcccccacccaggggttacccccgaaagaatttctaagctctgtcgacattgcattgcagctcattttgctgctccgtgactctggaagtttgaccatttccggtgccgccgaaacccttggggtgggcgcgtctacgatccatcgatccatgtcaatgctggtctaccggggttttgcagtcagaagcgagtcccgcacctaccttccaggctctgcattggcgacctccgcgctgcagccaggccttggcgctgacttgacgaaaaaatgcagccactacatggaatcaatcggcaaggaaactggcgaaacaacccacttggtgattctgcagggagatagcgttcactttattcacagtgttgaaggttccctgccggtgcgcgtgggcaatcgccgaggtcaagtcatgcccgccatccaaaattcaggtggattagtgatgcttgcagagatgtcagcccgggagcttcgggcactgtattccagcctgggcgatgaggaatttgagaatttaagaaagcgtcttcgcaggacccgggatcgaggccatggcgcaaactttggcttctttgagcaggacgttagtgcagttgcggagcctttactcaacgatgtgggtgatgttttaggtgcaattacagtggctgtgccgtcgaatcggttccgggaggtctatccgaaggcggtgcaggttttggaacgacatatgcgggatctgaacaaggctttagctgattaccgagtgcccgaaaaaggg

SEQ ID NO: 3348 - DNA, 1356 bp, Corynebacterium glutamicum
ttggctcacctcgattatgtgtttatgacatcacacgcaccagaatcgggaggacttgtgacagagtcaactctcggagcatcgaatagctcccaaacaattgaaaataaaggcctcaccatcttgggcatcagcggccgacgcttggctgcggtgctcattggctggttttttgtcattttcgacggctacgacctcattgtgtacggcaccgtccaatcggccctggctaaggagtggaacttaagctctgcaacgctgggcaccatcggctccaccgcgttctttggcatggcgatcggcgctgtgttcattggtcgactgtcagaccgcgtgggccgaaaagcagcggtgattggatccgtgctgattctctctgtcttcaccatgctgtgtgcatttgctccaaacccatgggtgttcggcgctttccgtttcatcgcaggccttggtctgggcggcttggtgccttcagttaatgcgatgacctctgatttggttccacgtaagaccatgtcagcgtgggcaacggtgatgatgtcgggcgttcccatcggtggttctatcgcggctgtgctggcacttgtggttgttccttcctcggaggagtggggctggcgcttcatgttcctcatcgcgttgatcccactggttgtcggcttgccgatcgccatgaaggtcattccttccgataaggccatcaaggcggatcacgacattagagaaggccacgatgagccagcaggtttcaaggatctgcttgtcgatcgctaccgctggatctccatttggttcgcgctcgccacatttgtcaccctgctcgcgtggtacggactgggcacatggttgcctcgcctcatggaaactgcaggttatgagttcggccatgcattgatgttcaccctggctctgaacctcggtgcagtgatcggatccgtggttactgcgtgggccggcgatcgcttcgggccaatccgttccggtgtcatcgctgcaggtatcgccggtattgcactgctcctgctgctcacttacccgcctgtcaccgcggtttatgtcattctcattttggctggcgtgggcacccacggcactcagatcctcatcattgcagctgtcgccaacttctacccaagcaacctgcgtggcacagcactgggctgggcgctaggtgtaggtcgtattggtgctgttgtggccccgcagctcgctggcctgctgctggcatggaacttgggcgtgaactccaacttcatcatgttcggcaccgctgcgctgctctctgcgctggctctcagcgtgttgctgcgcctgcagaaaacctacagcgtcacccacaaagtcgaaatccaaggc

SEQ ID NO: 3349 - DNA, 1326 bp, Corynebacterium glutamicum
atgtctcttccacattctgatgaactccgcggccaaaagatcattatttccggtggcggaattggtggcgcagcaggtgcacttgcgcttgctttgcgcggtgccgatgtcactttgtacgaacgcgcagctgagttcaaggaggtcggcgctggcctccagatcggtccgcacggctggcgaatgctggaatcctggggtctgctcgaccaaattgtcgtggccggctacctcccagaagacatgcagttccgcgacgctgtcaaccgcgaaaccatcctgaccatgcgtttcgatgaagaattccagcagcactacggcggtcgctacctggtgattcaccgctctgacctgctcaacatcctggtcaccaacgccgaagcagcgggcgcgaagctccacaatggcgtcctggtcaccgattcccgcaccgtcgacggcggtatcgaggtggacatcgaatcctccatcaacaagggcgaagataacaagactttgcttgtcgacgccttcctcgccttcgacggcatccactcggtcatgcgcaaaaagcttgtcgacgacgcccccgtcgcctcctcctacgtcgcctaccgcggcacctccaagctggcagaagacgccgaaatgaaggacctgaaatccgtcatcggctacatcggaccacacgtgcacttcatccaatacccactgcgcggcggagaactcctcaatcaggtcgccgtctttgaatcccagcgttacctcgatggacgcaccgccggcgacatcccagaagactggggcaaccccgaagaattagaccgcgcctacaaccactgcgaccccttcatccaggaccgtctggacaccctgtggcgcaacaactggtggcaaatgtccgaccgcgagcctctagagaactggcgtatcggccgcatgttgctgcttggcgacgccgcccacgcacccctccagtacctcgcctcaggcgcggtcatggccatggaagacgccgaggctgtcgccctcttcgctgccgacgctgcgcgtgctggcaacctcgattgggaagaggtactcgcagaggtggaagctgaacgccgaccacgctgcagccgcatccaaaccgtaggccgtttctggggagagctctggcatgtggaaggcaccgcacgtctcatccgcaacgaagttttccgccaagcagaccgcaatggctggttcatctatgcagactggctgtggggttacgatgcatccaagcgtgcccacatcgccaaccctgagctcggagaaatgccacaagcactgaaggaatggcgctacgccctcctcgaacagaaa

SEQ ID NO: 3350 - DNA, 1251 bp, Corynebacterium glutamicum
atggacataaagagcatgagctcgtcgctgctgttccgagtgatcgttgccatcatcctcggaatcatctgcagcctcttcttcccggtgtggctcgctgagatcttcaccaccttcaacggcctattcagcaactttctgggcttcttcatcccagtgctgatcttctccctcatcgcccccgccattgcagggctcggccgaggcgctggcaaatggctcggcattgttgcagcaatcgcctacgcgtccaccgtcttctccggtctgatcgcctacggagcatcccaagcgctctacccatggctgctgaaagaccaccaaagcgtcaccgaaatcgaccttgatgcaggtgccctccagccctacttcaacatcgagatgccaccaccatttgaagtgatgaccgcactgctgctggcattctgcctcggcctgggcatggctgtaattaaatcagacaccctgttcaaggtaacccgcgaactcgagcgcgtagtcatgaagaccatcaccgcctttgtcatcccactgctgccactcttcatcttcggcatcttcctcggcatgggcatgaacggtggcctcctggagatcatgtccgcctttggcaaggtactgattctcgccgtcgtgggaaccctgctcttcctagccatccagttcattatcgctggtgcagtatccaagaagaacccatggaaactgttcaaaaacatgctccctgcatacttcactgcactgggcacctcctcttcagcggcaaccatcccagtgacctaccagcagaccctgaaaaacgatgttgatgtcaacgtcgcaggctttgttgtcccactgtgcgccaccatccacctagctggatcgatgatgaagatcggcctcttcaccttcgctgttgtcttcatgtacgacatggaagtaggcgtcggcctctccatcggattcctcctcatgctgggcatcaccatgatcgccgcaccaggcgttcccggcggagccatcatggcagcaaccggcatgctggcctccatgctcggattcaacaccgaacaagtcgccctcatgatcgccgcttacatcgcgattgactccttcggcaccgcagcaaacgtcaccggcgacggcgcaatcgcagtcatcgtgaacaaattcgccaagggccagctgcacaccacttccccagatgaaatcgaagaagacgaccgcgttgccttcgacatcactccatcggatgtggaacatcacaag

SEQ ID NO: 3351 - DNA, 510 bp, Corynebacterium glutamicum
atgacggtgatcggaattattcttggcagcctttttggcgttcttgcagtccttctcatcgtggttggtgctttggggtgggcggctaagctccctggcaacccggttgtgggcattcgtgtccctgaggtgcgtaaatcccaagaattgtgggatatggcgcaccgtgtcgctggcccgttgtgggtgctgtcgggagtttcctttgttattgcatcgctagttgcgtttgttgcttctggttggatgtggcttgttgtggcgttgggtgttgtggctgccatcgtgttcattggtatgggtgcgggtatggctgcgcatactgttgcgatggttgacgcgaagcgcagtcgcgaaaccccgcaggcgcctgtttccgctgaaattgaagaggccggtggtgtgactattacctcgccgattatcaacaagactccgctgaatgcccccaagattgacttggatgcagtgcgtagagctgcggaaactacgcaagaacccaaaaatgat

SEQ ID NO: 3352 - DNA, 1554 bp, Corynebacterium glutamicum
atgagcacgaatccccatgttttctccctagatgtccgctatcacgaggatgcttctgcattgtttgcccacttgggtggcacaaccgcagatgatgcagccctgttggaaagcgctgatatcaccaccaagaatggtatttcttccctcgcggtgttgaagagttcggtgcgcattacgtgcacgggcaacacggtggtaacgcagccgctgacggactcgggtagggcagtggttgcgcgcctaacgcagcagcttggccagtacaacaccgcagagaacacctttagcttccccgcctcagatgcggttgatgagcgcgagcgcctcaccgcaccaagcaccatcgaagtgctgcgcaagttgcagttcgagtccggctacagcgacgcgtccctgccactgctcatgggcggtttcgcgtttgatttcttagaaacctttgaaacgctccccgctgtcgaggagagcgtcaacacttaccccgattaccagttcgtcctcgcggaaatcgtcctggacatcaatcaccaggaccagaccgccaaactcgccggcgtctccaacgccccaggcgagctcgaggccgagctcaacaagctttcattgcttatcgacgccgccctccccgcaaccgaacacgcctaccaaaccacccctcacgacggcgacactcttcgcgttgtggctgatattcccgatgctcagttccgcacccagatcaatgagctgaaagaaaacatttacaacggtgacatctaccaagttgtcccggcgcgcactttcaccgcaccatgtcctgatgcattcgctgcttatctgcagctgcgtgccaccaacccgtcgccgtacatgttctatatccgtggcctcaacgaaggccgctcctatgaactttttggcgcatcccctgagtccaacctcaagttcaccgctgctaaccgtgagctgcagctgtacccaatcgcaggtacccgcccccgtggactcaacccagatggctccatcaacgatgagctagatatccgcaatgagttggatatgcgcactgatgccaaagagatcgcggagcacaccatgcttgtcgatctcgcccgcaacgacctggcccgcgtctcggtcccagcgtcgcgccgggttgcggatcttttgcaggtggatcgctattcccgcgtgatgcacttggtgtcccgtgtgacggcgacgttggacccagagcttgatgctttggacgcctatcgggcgtgcatgaatatgggcacgttgaccggcgctccgaagttgcgcgctatggagctgttgcgcggcgtcgaaaagcgcaggcgtggttcttatggtggggcagtggggtacctgcgcggcaatggcgatatggataattgcattgttattcgttcggcgtttgtccaggatggtgtggctgctgtgcaggctggtgctggtgtggtccgcgattctaatcctcaatctgaagccgatgagacgttgcacaaggcgtatgccgtgttgaatgccattgcgcttgctgctggttccactttggaggtcatccga

SEQ ID NO: 3353 - DNA, 171 bp, Corynebacterium glutamicum
atggggattcgtgctcatggggcacctaccgaggaaatcattgtggggctgaagcctttctgggaaacatcaaataattactcgctgcgagcttcattcgatccagggcttgccggttgtgggctaaaaaccacaaaaggcccgcttcttcgtcgaacgaagtacgagcct

SEQ ID NO: 3354 - DNA, 624 bp, Corynebacterium glutamicum
atgacacacgttgttctcattgataatcacgattcttttgtctacaacctggtggatgcgttcgccgtggccggttataagtgcacggtgttccgcaatacggtgccagtggaaaccattttggcagccaacccggacctgatctgcctttcacctggacctggttaccctgccgatgcgggcaacatgatggcgctgatcgagcgcacactcggccagattcctttactgggtatttgcctcggctaccaggcactcatcgaataccacggcggcaaggttgagccttgtggccctgtgcacggcaccaccgacaacatgatccttactgatgcaggtgtgcagagccctgtttttgcaggtcttgccactgatgttgagcctgatcatccagaaatcccaggccgcaaggttccaattggccgttatcactcactgggctgcgtggttgccccagacggtattgaatcactaggtacctgttcctcggagattggtgatgtcatcatggcggcacgcaccaccgatggaaaggccattggcctgcagtttcaccctgagtcagtgctaagcccaacgggtcctgtcattttgtcccgctgtgtcgaacagcttctcgcgaac

SEQ ID NO: 3355 - DNA, 1044 bp, Corynebacterium glutamicum
atgacttctccagcaacactgaaagttctcaacgcctacttggataaccccactccaaccctggaggaggcaattgaggtgttcaccccgctgaccgtgggtgaatacgatgacgtgcacatcgcagcgctgcttgccaccatccgtactcgcggtgagcagttcgctgatattgccggcgctgccaaggcgttcctcgcggcggctcgtccgttcccgattactggcgcaggtttgctagattccgctggtactggtggcgacggtgccaacaccatcaacatcaccaccggcgcatccctgatcgcagcatccggtggagtgaagctggttaagcacggcaaccgttcggtgagctccaagtccggctccgccgatgtgctggaagcgctgaatattcctttgggccttgatgtggatcgtgctgtgaagtggttcgaagcgtccaacttcaccttcctgttcgcacctgcgtacaaccctgcgattgcgcatgtgcagccggttcgccaggcgctgaaattccccaccatcttcaacacgcttggaccattgctgtccccggcgcgcccggagcgtcagatcatgggcgtggccaatgccaatcatggacagctcatcgccgaggtcttccgcgagttgggccgtacacgcgcgcttgttgtgcatggcgcaggcaccgatgagatcgcagtccacggcaccaccttggtgtgggagcttaaagaagacggcaccatcgagcattacaccatcgagcctgaggaccttggccttggccgctacacccttgaggatctcgtaggtggcctcggcactgagaacgccgaagctatgcgcgctactttcgcgggcaccggccctgatgcacaccgtgatgcgttggctgcgtccgcaggtgcgatgttctacctcaacggcgatgtcgactccttgaaagatggtgcacaaaaggcgctttccttgcttgccgacggcaccacccaggcatggttggccaagcacgaagagatcgattactcagaaaaggagtcttccaatgac

SEQ ID NO: 3356 - DNA, 1422 bp, Corynebacterium glutamicum
atgactagtaataatctgcccacagtgttggaaagcatcgtcgagggtcgtcgcggacacctggaggaaattcgcgctcgcatcgctcacgtggatgtggatgcgcttccaaaatccacccgttctctgtttgattccctcaaccagggtaggggaggggcgcgtttcatcatggagtgcaagtccgcatcgccttctttgggaatgattcgtgagcactaccagccgggtgaaatcgctcgcgtgtactctcgctacgccagcggcatttccgtgctgtgcgagccggatcgttttggtggcgattacgatcacctcgctaccgttgccgctacctctcatcttccggtgctgtgcaaagacttcatcattgatcctgtccaggtacacgcggcgcgttactttggtgctgatgccatcctgctcatgctctctgtgcttgatgatgaagagtacgcagcactcgctgccgaggctgcgcgttttgatctggatatcctcaccgaggttattgatgaggaggaagtcgcccgcgccatcaagctgggtgcgaagatctttggcgtcaaccaccgcaacctgcatgatctgtccattgatttggatcgttcacgtcgcctgtccaagctcattccagcagatgccgtgctcgtgtctgagtctggcgtgcgcgataccgaaaccgtccgccagctaggtgggcactccaatgcattcctcgttggctcccagctgaccagccaggaaaacgtcgatctggcagcccgcgaattagtctacggccccaacaaagtctgcggactcacctcaccaagtgcagcacaaaccgctcgcgcagcgggtgcggtctacggcgggctcatcttcgaagaggcatcgccacgcaatgtttcacgtgaaacattgcaaaaaatcatcgccgcagagcccaacctgcgctacgtcgcggtcagccgtcgcacctccgggtacaaggatttgcttgtcgacggcatcttcgccgtacaaatccacgccccactgcaggacagcgtcgaagcagaaaaggcattgatcgccgccgttcgtgaagaggttggaccgcaggtccaggtctggcgcgcgatctcgatgtccagccccttgggggctgaagtggcagctgcggtggagggtgacgtcgataagctaattcttgatgcccatgaaggtggcagcggggaagtattcgactgggctacggtgccggccgctgtgaaggcaaagtctttgctcgcgggaggcatctctccggacaacgctgcgcaggcactcgctgtgggctgcgcaggtttggacatcaactctggcgtggaataccccgccggtgcaggcacgtgggctggggcgaaagacgccggcgcgctgctgaaaattttcgcgaccatctccacattccattac

SEQ ID NO: 3357 - DNA, 696 bp, Corynebacterium glutamicum
gtggttgacgccaaagatcttcgcacccagcttgatggcgcgggcgacttcctcctcatcaataacctcggtgaggatatccagatcaaaacgcgcagcctcggcagcgagtgctgcgtactcttcatcatcaagcacagagagcatgagcaggatggcatcagcaccaaagtaacgcgccgcgtgtacctggacaggatcaatgatgaagtctttgcacagcaccggaagatgagaggtagcggcaacggtagcgaggtgatcgtaatcgccaccaaaacgatccggctcgcacagcacggaaatgccgctggcgtagcgagagtacacgcgagcgatttcacccggctggtagtgctcacgaatcattcccaaagaaggcgatgcggacttgcactccatgatgaaacgcgcccctcccctaccctggttgagggaatcaaacagagaacgggtggattttggaagcgcatccacatccacgtgagcgatgcgagcgcgaatttcctccaggtgtccgcgacgaccctcgacgatgctttccaacactgtgggcagattattactagtcattggaagactccttttctgagtaatcgatctcttcgtgcttggccaaccatgcctgggtggtgccgtcggcaagcaaggaaagcgccttttgtgcaccatctttcaaggagtcgacatcgccgt

SEQ ID NO: 3358 - DNA, 1251 bp, Corynebacterium glutamicum
atgactgaaaaagaaaacttgggcggctccacgctgctgcctgcatacttcggtgaattcggcggccagttcgtcgcggaatccctcctgcctgctctcgaccagctggagaaggccttcgttgacgcgaccaacagcccagagttccgcgaagaactcggcggctacctccgcgattacctcggccgcccaaccccgctgaccgaatgctccaacctgccactcgcaggcgaaggcaaaggctttgcgcggatcttcctcaagcgcgaagacctcgtccacggcggtgcacacaaaactaaccaggtgatcggccaggtgctgcttgccaagcgcatgggcaaaacccgcatcatcgcagagaccggcgcaggccagcacggcaccgccaccgctctcgcatgtgcgctcatgggcctcgagtgcgttgtctacatgggcgccaaggacgttgcccgccagcagcccaacgtctaccgcatgcagctgcacggcgcgaaggtcatccccgtggaatctggttccggcaccctgaaggacgccgtgaatgaagcgctgcgcgattggaccgcaaccttccacgagtcccactaccttctcggcaccgccgccggcccgcacccattcccaaccatcgtgcgtgaattccacaaggtgatctctgaggaagccaaggcacagatgctagagcgcaccggcaagcttcccgacgttgtggtcgcctgtgtcggtggtggctccaacgccatcggcatgttcgcagacttcattgacgatgaaggtgtagagctcgtcggcgctgagccagccggtgaaggcctcgactccggcaagcacggcgcaaccatcaccaacggtcagatcggcatcctgcacggcacccgttcctacctgatgcgcaactccgacggccaagtggaagagtcctactccatctccgccggacttgattacccaggcgtcggcccacagcacgcacacctgcacgccaccggccgcgccacctacgttggtatcaccgacgccgaagccctccaagcattccagtacctcgcccgctacgaaggcatcatccccgcactggaatcctcacacgcgttcgcctacgcactcaagcgcgccaagaccgccgaagaggaaggccagaacttaaccatcctcgtctccctatccggccgtggcgacaaggacgttgaccacgtgcgccgcaccctcgaagaaaatccagaactgatcctgaaggacaaccga

SEQ ID NO: 3359 - DNA, 840 bp, Corynebacterium glutamicum
atgagccgttacgacgatctttttgcacgcctcgacacggcaggggagggcgcctttgttcccttcatcatgctgagcgacccttcaccagaggaggctttccagatcatctccacagcaatcgaagctggcgcagatgcactggaacttggcgtacctttctccgacccagttgccgatggccccaccgtcgcggaatcccacctccgcgcactcgacggcggcgccaccgtagacagcgcactcgagcagatcaagcgcgtgcgcgcagcctacccagaggttcccatcggaatgctcatctacggcaacgttcctttcacccgtggcttggatcgcttctaccaagagttcgctgaagctggcgcagactccatcctcctgccagacgtcccagtccgcgaaggcgcaccgttttctgcagcagctgcagcagccggaattgatcccatttacatcgctccggccaacgccagcgagaaaaccctcgagggtgtctccgccgcatcaaagggctacatctacgccatctcccgcgacggcgtcaccggcaccgaacgtgaatcatccaccgacggcctgtccgcagtggtggacaacatcaagaaatttgatggcgcacccatcctcttgggcttcggcatctcatcccctcagcacgtggcagacgcgattgcagcgggtgcttccggtgcgatcacgggttccgcgatcaccaagatcattgcttcccactgcgaaggtgagcacccgaacccgtccaccattcgagatatggacggtttgaagaaggatctcactgagttcatctctgcgatgaaggcagcgaccaagaaggtt

SEQ ID NO: 3360 - DNA, 1539 bp, Corynebacterium glutamicum
atggactggttaaccattcctcttttcctcgttaatgaaatccttgcggttccggctttcctcatcggtatcatcaccgccgtgggattgggtgccatggggcgttccgtcggtcaggttatcggtggagcaatcaaagcaacgttgggctttttgctcattggtgcgggtgccacgttggtcactgcctccctggagccactgggtgcgatgatcatgggtgccacaggcatgcgtggtgttgtcccaacgaatgaagccatcgccggaatcgcacaggctgaatacggcgcgcaggtggcgtggctgatgattctgggcttcgccatctctttggtgttggctcgtttcaccaacctgcgttatgtcttcctcaccggacaccacgtgctgttcatgtccaccatgctcaccatcatcttggccaccgccggatttgatgcgtggattgtggtgggtgtgggtgctctcttgctcggtattctcatggtgtcgttgcctgcgttcgcgcatccgtggactcgccgaatcactggcgatgattccattgccattggacacttcggcaccgcaggttatgtagctgccggtgcagtcggccgactggtcggtggcaagggcaagaaggccagcccttccactgaggatatgaaggttccggaaggcttgcgcttcctccgcgactccatggtttctacagctctgtccatggcgatcatgtacatcattttggctattttgttcctggtgcgcgcaggagaagaagaagccttcactgcattccccaatggcgccaccaacgtaggcaactacatcatgcagtccttcactcaaggtctgcagttcggcgttgcagttgccgtgattctctttggtgtccgcaccattcttggtgaactggtccccgcattccaaggtattgctgcgaaggttgttcccggagctatccccgcattggatgcaccgatcgtgttcccctacgcgcagaacgccgttctcattggtttcttgtcttccttcgtcggtggcttggttggcctgactgttcttgcatcgtggctgaacccagcttttggtgtcgcgttgattctgcctggtttggtcccccacttcttcactggtggcgcggcgggcgtttacggtaatgccacgggtggtcgtcgaggagcagtatttggcgcctttgccaacggtcttctgattaccttcctccctgctttcctgcttggtgtgcttggttccttcgggtcagagaacaccactttcggtgatgcggactttggttggttcggaatcgttgttggttctgcagccaaggtggaaggtgctggcgggctcatcttgttgctcatcatcgcagcggttcttctgggtggcgcgatggtcttccagaagcgcgtcgtgaatgggcactgggatccagctcccaaccgtgagcgcgtggagaaggcggaagctgatgccactccaacggctggggctcggacctaccctaagattgctcctccggcgggcgctcctaccccaccggctcgaagc

SEQ ID NO: 3361 - DNA, 810 bp, Corynebacterium glutamicum
atgtttgtactcaaagatctgctaaaggcagaacgcatagaactcgaccgcacggtcaccgattggcgtgaaggcatccgcgccgcaggtgtactcctagaaaagacaaacagcattgattccgcctacaccgatgccatgatcgccagcgtggaagaaaaaggcccctacattgtggtcgctccaggtttcgctttcgcgcacgcccgccccagcagagcagtccgcgagaccgctatgtcgtgggtgcgcctggcctcccctgtttccttcggtcacagtaagaatgatcccgtcaatctcatcgttgctctcgctgccaaagatgccaccgcacatacccaagcgatggcggcattggctaaagctttaggaaaataccgaaaggatctcgacgaggcacaaagtcccgaggagatccaagcaatcttagagaaggcagcagcgccggcgaagcagaaggctcctgctgtggctcctgctgtaacacccactgacgctcctgcagcctcagtccaatccaaaacccacgacaagatcctcaccgtctgtggcaacggcttgggtacctccctcttcctcaaaaacacccttgagcaagttttcgacacctggggttggggtccatacatgacggtggaggcaaccgacactatctccgccaagggcaaagccaaggaagctgatctcatcatgacctctggtgaaatcgcccgcacgttgggtgatgttggaatcccggttcacgtgatcaatgacttcacgagcaccgatgaaatcgatgctgcgcttcgtgaacgctacgacatc

SEQ ID NO: 3362 - DNA, 906 bp, Corynebacterium glutamicum
atgaacactccggcagttcaggttcaaaatctaagtttgagttttgggtcgttcacagctgtcaacggcctcagcctcacggtggagcaggggagcattcacggcttcctcggccccaacggtgcaggaaagtcaacaaccatcagggcactcattggagtgctaaaaccccaaacaggttcagtcgctattctcggccaagatcctgttgctcaccccgatgtccttcgaagagttggctacgttccaggagatgccacactgtgggacaacctcactggggcggaagttttcagggcgctcgaatcactccgcaagactccatccaaccgagctctagaaaacgagctcattgacgccttccaattggatccctcgaagaagatccgcgaatactcgacaggtaacagaaggaaagtcagtctcatcgcggcgctcagtcatgagcccgagctcctcatcgttgacgagcccaccgcaggcttggatcccatcatggagcaagtctttgtcacctatgtccgcaaggcacgaaccaacggcgcgtccgtgttactcagcagccacattctcagtgaggtggagcagctgtgtgattacgtcacggtccttaaagaggggcgagcagttgcatctaatgaggtgagctatctgaggaagatctccgctcaccgcattactgccacgattccggcggtacctcaacaccttgctggcaggggagaagtggatttcgatgctggccatctcagcatcacctgcgatgcctccgaggttcccgatattttgcgcatcatcatcgacgctggcggccaggacatcatcagcaccgcggcgtcgctggaggagatcttcttgcgtcactatggagaaaccgtgagtggttcagaaagcaaggcatcacaa

SEQ ID NO: 3363 - DNA, 1584 bp, Corynebacterium glutamicum
atgatccgtcttaatctacgtcttcgtcggatgctcattctgtggtggctgcttggcatctgggtatttctcatcatcaccccgccgtcatatgttgccacctatccggaccttgcgagccgtgggccggttgtctcaagtgtgcaaaataatgtgggcactcaagcaatgtatggctatcttccatcgcctggcaccattgggcaattaaccgcctgggaaactggagcatggttatgcgtgttgtcgtcggtgatgatggttttgctgtttagctcgcttcatcgcaaacctgaaagctcgggtctcgtcgagtatgtgtatgccgcggggcgcagcggttcttcccgtttcggcgcggcgatcgccacaggcacgattgtgtctgtcctcaacggtgcggtgtgcgccttcatcctgctcgcttttcgatatctaagcattgatgaaatcacggtcgctggcagcatagcgttcggcgtaaccatcactctcaccatgctcgccaccatggccatcacgagcattctgcagagcttgtgggggaggggaaccaacttcaaccgccttggcctcctcagcgtgggtgccgcatttttgatcagaatgttcgctgacacatcgtcgtcaagctgggcaactcacctcaactgggtgtcaccgcagggctggcgcacagtgatcgcacccttcacggaagacagttggctgaaggctttggtcttggccatcgtgtgcgcggcgctcatcggcgttgcatttaccctcgattcccggcgccccttcgatgaaagcctgcttcaccttcgaggttcgaagcgctaccgcgagcgaaaaatccgaagcctgtacagcctgaacatggtgcttcacagaggaaatctgatcacttggtcgatcgtcatcggcttggttctgctgattttccttcccctcatcgactcactcctgccgtcgctgcaaggcgatgccgcgacgatgcaagccgtcgaagccttcttgccagcgggcgaattgcagatcaccttcatcgtctacgtcttccaaatcgcgtctattctgctcagcatcgcagtggtcttgcccgtcatcgggttcatcggccaagagcgcgaaggcctcatcgacgcggtccgcagcacgggcgtgcgccgctggtcgcccctatggggctgcgttcaagcatgcttatcgacgctaacctcctgcaccattttcgccattctatgtgctctcctgggtttgtatctccaaccgtcaacagtggaagacgggacctccctcatggtgctttccggcctctcaattgccgtccatgcactgttcttcctaggaatcgcaatcgcagtagcgggacttgcaccgcgcgtcatccaccttgcctggctccccattattgcggcgtcggtagtgactctcctcggcccattgttctcactcaccgagcagcaaatggaattctcgccactgacacattcatgggcaaactccgatgaagcagtgtggccgttgctcacattcgcgattattggtgtcgcccttgggggagtaggcctacttggggcgcagcgaaggaacctactt

SEQ ID NO: 3364 - DNA, 450 bp, Corynebacterium glutamicum
ttggggcgcagcgaaggaacctactttagcaactggctaaataagattctctggacgatactaggcattatgactcaaccagcccccatgtgtagccgccgcatgtttcttcttggaacagcaacaaccttcgcaggtgcttttcttgcagcctgtggtactgaaccagatcaggaggtagcggctactgaagtccccgtcggaagctctgtcatcttgggttccgtaatcattgcgcagccaaccgaaggcaacttcgtggcttactcttctgcatgcccacaccagggatcacgcatcaccaaggtagagggagacactgttatttgcacgaaccataagtcagtcttcaacatttccgatggttcagttgtgtccggcccagcccagaacggactcaccagcgccaatctcaagcaggacggcgacactctgagcgcgtccgtgcag

SEQ ID NO: 3365 - DNA, 1110 bp, Corynebacterium glutamicum
gtggatttttggactattctcgacaccatgacttccctccttactcccattgcaatccgtggattagaaattcccaataggatgtggctcgcgcccatgtgccagtaccaagccaataacctcgatggggttccacttgattggcacctcgtgcattacggagcccgagctgttggcggcttcggactcctcatcgcggaatccaccggcattagtccagagggaagaatctcatcgcgttgcactggcctatggaatgaggcccaagttgaggcatgggagagaattacaaattttgtccacgctcaaggtggactgatcggtgtgcaacttaaccatgcaggccgcaaagcgagcacatatccggcccttcctaacttccctactggtactcaatcagttgacgagggtggatgggaaacctttgggcctagtgctgtcgctcagccggggcttgcagatccgaccgaattgacccgcgaaggtattgaaaaggttattcaggatttcgctgctgctgcagagcgcgcggtgcgtgcagggtttgatgctgtggaggtccatggtgcccacggttacctgttgcatcagttcctcactcccgtcgcaaataaacgtactgatatttatggaggttcgtttgagaatcgcacacgactatttagggaagtagcccaggcgatccgtgcagtgattccgggctcgatgccactgattgcccggatctctgccacggactggattgatgatgaaccttcgtgggatgacgatcaaaccgtctcgcttgtgtcagatctgaaaaagctgggtgtggatgcagtcgatatttccaccggaggtgcagtacccgcgacaatccctgtggagccgagctatcaagtgaaatttgctcgtcgtgtgaagcaagaggtgggtatccctacctccgcggttggattaattactcatgtgggtcaggcgcaggggcatcttgatcgtggagatgcggacattatttcgctgggtcgagctgccctccgctacccttcctggccactatttgctgcgcatgaactggggaaaactcgcgatgagatcccctacccaccgtcctatgtgcgaggtgcgtgg

SEQ ID NO: 3366 - DNA, 972 bp, Corynebacterium glutamicum
atgcttgaacgcctcaaacgcctagatccgctcattgtcctcattgtgctggctgtcattgtggcgatcatcattccagttcgcggggttgctgcggattggtttgatgtcgccgtcaagattgccattgcgctgctgttttttctttatggtgcccgcctatccacccaagaggcgctgaatggtctgaagcactggaggcttcacctgactattttggcgatcactttcggaatattcccacttatcggcattgggctcgagccgatgactgcatttgtgtcggaagatatttatcggggaattttgttcctcacgctcgttccgtccaccgtgcagtcatcggtggcgtttacctcgatcgctaaaggcaacgtagctggtgcgattgtgtcggcatcgctctccaaccttgcgggtgttttcctcactccgctgctggtcatgctcatcatgtctgcgggcgggggagttcacgtggattcccaggtcttcctcgacattgcgattcagcttctgctgccgttcatcctcggccaggtatgtaggcgttgggtgaagaattttgcggccaacaaagcaacaaaaatcgtggaccgcggctcgatcgcgatggtcgtgtactccgcgttttctgccggcatggtggctggcatttggtccactgtgagcgttctagagattatctacctcattgttttcgctattctgctggtgatggccatgctgtggttcacgctgttcatggctacacgccttggatttaaccgggcagattccatcgctattcagttctgcggaaccaagaaatccctggccacaggcctcccaatggcggcagtcatcttcggtggcgccaatatcggcctgctcatcttgccgttgatgatcttccaccaagtccagctgatgatttgtgcatggcttgcagctcgttatggtcgtgatgcgcaggaacagaaagccaacgcc

SEQ ID NO: 3367 - DNA, 774 bp, Corynebacterium glutamicum
atgactcacactctgcaggcaactaatccccttgatcaaaccgcttggcacgcttggcatttctcccgaaacaaagaggccatcagccgcaccggcgccaccagcctgagtgccacagagtggattagcgccaccacactcaaggacgcgcacacttttccttcacttcccgggcgatggtataaacgaggcggcggggtagtgggagcacatttaccaccagctttcgcaacaactggaacggtgcaactgcgccccggtgagctcttgatagcggaagatttcaccctcaccgtcattgaacggcttggacagtttgcacttcaggtttttgatgcacgcaatccgaagcgttttgaattccactccatcgcagctttcccaccgtccgaggaatggcggattgaggctcgcttcttcccggaacctgacactgttaacaccgctgcagctgatggagttatcgttgccacgcctactgcgggttgggtgcactttttgaagggccgtctggattaccgtcttcgtgtaaccgttcagaaaaataatctacgggcactatttagcgacaattcctcgacgttgggcgtttatcagcatcgttttgtcgacatcccacgccctgatgccgagggaaacaccatcattgatttcaaccgcgcttatcttcccccaaaggcattgaaccgaaagttcctgtgcccatcgcccagcctgaacaaccacctcaatctcaccgtggaggcaggggagaagtgggtggttgctggagga

SEQ ID NO: 3368 - DNA, 348 bp, Corynebacterium glutamicum
ttggagggtgtcatggcccgcaaattggaacatccatctttggccgagatgaatttaaatgccatcatgtttgcgctgtcggatcctattaggcgacaaatcctgtcgcagctgtcgtgcggacataatgatcaggcatgtgttgccttcgagcttccagtatctaaatccacctcaacgcaccacttccgcgtactccgtgaggcgggtctgattactcagcgctatgaaggaactgccattctaagtgcgctgcgcagcgaagatatggaagcgcgttttccgggactgctgacttctgtcatgcgagcggaagtggaagagcgcaacgcagctgacttgcccgtt

SEQ ID NO: 3369 - DNA, 1092 bp, Corynebacterium glutamicum
atggagcctttggtgtccaagctgtttaccccaattcaaatccgcgacatcaccatccccaaccgcgtgtggatgtcaccgatgtgcacctactctgcagccaccggttcaggtcttcccaccgattttcaccaggctcattacgcagctcgcgcagcaggtggtgtcggattagtcatggttgaagcaactggagtgaaccccgtagctcccatctccccagtcgaccttggactttggagccatgaccaaattgaaccattctcccgagtgacagcagctattcgcgccggtggggcagtaccggccgttcaattagcccatgctggccgcaaggcatccaccgatgctccgtggaatggtggcggatatgttggaccagaaaccaatggatgggagactgtcggccccagccctctggcattcccaggtttgcctgctccgcgcgagctgacggtttcagaaatccaagaggttgtgcagcagttcgctggcgccgccgttcgtgccgatcaggctggttttgatgtcgtggaaattcacgcagcacacggctaccttttgcataacttcctttctccgatctccaacaagcgcaccgattcatacggcggatctttagaaaaccgcgctcgcatcgtgctcgaagtcattgatgcaatccgcgcagtgtggccagaggaaaagcctgtattcatgcgcatttccaccaccgactgggtggaggaaaacccacaggatgatcgcgagtcctggacgctgagccaaagcaggcagctggctttgtgggcatccgagcacggagttgatttgatcgatgcctcttctggtggcctcgacatcgtccccattccgcatgaccgcgattaccaaaccgcgaaggccgcagatcttcacgcaagtaccggagtgacagtcgctgctgtggggcgcattgatgacgcccaaactgcgcacaatttggttgattctggcgatgtcaatgcagttttcctcggccgtccactgctcaaggatccttcctgggcaaaccaagcagccctcgcactaggtgcggaacccaggtatgttcaccaatacgactacgtactt

SEQ ID NO: 3370 - DNA, 648 bp, Corynebacterium glutamicum
atgaaggttttcatcatcggcgctgcgggtggcatcggcaatcgactttccagcctgcttcacgccaggggagatgcagttagcggcatgcaccgcaatcttgagcaggcctcaaaaatcacagacactggggcaactgccgtactcggggatctcatccacaacagcacggaggagcttgcggagcttttccgcggtcacgatgccatcgtattttctgcaggcgcccacggaacagggcaagaaaataccacgcttatcgacggcgccggcctccgtaaagccgccgacgctgccagcgcggccaacgtttcacgcttcatcttggtctctgcgtttccggaatcctcccgcggggagaacaccaccgagaactttgagcactatatgaaggtgaagaagtccgccgatgtctacctcagtcacactgacctagactgggttattgtccgaccaggcgtgcttcaagatgaggcaggggatggtttagtcactgctggcttagcgattaattacggcaatgttgctcgcgataatgtcgcagcgttcattgatgaagctctgcatcaaccgcagttgtcaaagatcattgttgaactcaccgacggttcaactccggtggcggaagccgtagaacgcctcatcaag

SEQ ID NO: 3371 - DNA, 153 bp, Corynebacterium glutamicum
atgtttgatcagatccagcacttcaccgacatcgcacagaacttcaagccagcacagtggggcgctcagatccaagagcagttccagcacttccagggatgggcgcgacctgaagcagtcgagtcacagcactacacttcttcactctcttcc

SEQ ID NO: 3372 - DNA, 192 bp, Corynebacterium glutamicum
ttgcttctttacaacaatcactttaaggagatcactatgtttgatcagttccagcagttcaccgacattgcacagaacttccagggcgcacagtggggtgtccagattcaggagcagttccagcagcacttccagaattggtttaacaccgaaactgtagagccagccaagagcactttctccctcagctcc

SEQ ID NO: 3373 - DNA, 168 bp, Corynebacterium glutamicum
atgttcgatcagattcagcacttcaccgacattgcacaaaacttccagcctgcacagtggggcgctcaaattcaggagcagttccagcagcacttccctcagcagattcagcagtgggttcgccctgaggctgctcccctgccggagcgtacctcttccctctcttcc

SEQ ID NO: 3374 - DNA, 321 bp, Corynebacterium glutamicum
ttgttggttagccatgatgatatgccatttccgcagctagatcatgatgatgggggaattcccataaacttcagtatttttgcatttgtgcaggtcacggagttgaaaattggtctgaccgctgtttgtgggaaaaattttttcggtgttaacttcaagtcacagcaacggaacacaccgtcgctggcacaccttgcaagtacacgagaaagtgagttcttttcatgggatacatcgtcaacatcttcaacactgtcctgggaagcgtttccgacatcttctctgcagtcgttctttcttcctaaatctcactcaaccact

SEQ ID NO: 3375 - DNA, 753 bp, Corynebacterium glutamicum
atgaaatcaatcttcatttccggtgcggcgaacggaattggcaaagctgtggcgttgaaatttcttcacgaaggttggctcgttggagcctacgacctcgcggaaatcacctactcacaccccaatcttcgctggggctacctcaatgttcgacagtccgagtcgtgggacaaagccctagaagactttgcgacgcacaccggaggcaccatcgatgtggtggacaataatgccggcgtaattattgagggaccgctgcaggacgcagaggaggggagcgtcgacaagcttcttgcaatcaacgtcaatggcgtgactcttggtgcccgcgccgctcatccttatttggcgcgcacgccgggcgcccagttgttaaacatgtcctcggcgtcggcggtgtacgggcagccccagatcgcggtgtattcggcttcgaagttttacgtcgcaggtcttactgaggcgctgaatttggagtggcggaaagacgatattcgcgtggtcgatgtttggcctttgtgggcgaaaaccgatttggtgaacggcgtgaaggctaagtcactgaagcgtttgggtgtccggatcactccggaacaggtggcacaggcggtatgggatgcggtgcatccgaaatctcggtgggcgaagggaaaggtgcatcacggggtgtcaaagttggataaggcgctgtatctcatgaaatctctgtcgcctgatcgggtagcgatgtgttttgcgcgactaatcgccgga

SEQ ID NO: 3376 - DNA, 180 bp, Corynebacterium glutamicum
atgacgcctgcaggtccagcacaattactcattgttgctcttgtagtaattgtcctctttggttccaataagttgcctgatgttgctcggtccgttggccgttcgatgcgcattttcaaatctgagatcaaagagatgaacaaggatcagatcgaaagctccgatcagaccttgaagaac

SEQ ID NO: 3377 - DNA, 1359 bp, Corynebacterium glutamicum
atgcagtccatccttgctttctatctgtactactccgtcaccgatggcggacttggtatgaatcagacagctgcactgtccattgtgggcgcctacggcggcttcgtctacatgacctccctcgtggcttcgttcattgcagaccgagtattgggctctgaacgtacactcttctactccgcgatcatcgtcatgctgggccacattgccctggccttgattccgggatatacgggactgtccatcggcttggtcctcatcggccttggctcaggtggcgtgaagacggcagcgcaggttgtgctgggccagctgtactcacgcacggacacgcgtcgagacgcaggcttctccatcttctacatgggcgtcaacctcggtggcctctttggcccgctgatcaccaacgctctgtggggatggggaggattccactggggcttcggtatcgccgcagtcggcatggctttgggtctcatccaatacgtggcgatgcgtaaaaccaccatcggtgcggcaggccatactgttcctaacccactgcctaagaatgaatatgcgcgctggattatcggtgcagtcgtggttgtcgcagcagttgtcgctctcatcgcaacgggcatcatcaagctggaatggctgtccaacatcaccgcagcgatcgcactgattgcggctattgctctgcttgctcagatgtacgtttccccactgaccaccgcagcggaaaagtcccgcttgttgggattcatcccgatgttcatcggtggcgtgcttttcttcgcgatcttccaaacccagttcacggtcctcgcggtttactccgacacccgcctggaccgtaacttcttcggcattgatcttcctccaggattgatcaactccttcaacccaatcttcatcatcatcttctccggaatctttgccaccttgtggacaaaactcggagcaaagcagtggtctactgcagtgaagttcggtgtcgccaacattgtcattggttgcgcgctgttcttcttcctgccgttcgccggcggtgcagagaactctaccccaatggcactgatcatttgggtctacttcctcttcaccatcgctgagcttctgctctcccctgtcggcaactcacttgcaaccaaggtcgcacccgaggcattccagtcccgcatgttcgccgtgtggctgatggctgtctccatgggtacgtccctgtccggcaccctgggtggttactacgatccaaccgatgcaggatctgaaaaggtcttcttcattaccgttggcgttgcagccatcgttcttggtgcaatcgtcatagcagccaagggctgggtgctgaagaagttcatcgacgtccga

SEQ ID NO: 3378 - DNA, 171 bp, Corynebacterium glutamicum
ttgaaaagcactttcggacaccatgtgctcaataaggaacaaaatgggggtaaagaagtgtgcgcgaaggatattaagcgttccacaatctccagcgcgaccacccaaacaggctgcacgccatcagtggacttccacacaaatggcccccaatttgaaataattcacaaa

SEQ ID NO: 3379 - DNA, 555 bp, Corynebacterium glutamicum
atgaatctgaaagatctcaaggccgcagagacccgtcaaaggtttatcgatgtagcccacgaactcttcttggagcacggttatggttccacctccatgaatcagattgctcaggcagcgggtggtagccgggcaaacctttaccttcatttccgtaacaagcccgatctcatgatggctaaaatgcgggaacttgaacccgcggtccgcacccctgtcctaaaagtttttgatctccctgaacacactttggagtccattcttagatggctggactccatgacggaggtgtggaaagcgaatgccaaagtgttcggggcgatggaacaagcgatggtcgaagatgctgcggtggccgatgagtggctttcaatgatgcagaggttgagccaatcggtgcccgaattggttgagaatgaagagcgtcgagttcagttcctggctagcttgatgggcatggatagaaacttttacttcctctatgtccgagggcaagatgttgatgaggaattgctaaagttggctgtggctcgccaatggttggcagttttccaa

SEQ ID NO: 3380 - DNA, 903 bp, Corynebacterium glutamicum
atgacaaccaccaccgcagaccacaacatcagcgcgcagcaaaaggctgttgaagaaaatctggtgaaccgtgtcctccaatcttttgatgcgtgtgaaaacccgcgcctcaagcagctgatggaatcgctggttgtgcatctgcacgatttcatccgggatgtgcgcctcaccgaggatgagtggaattacgccattgatttcctcacagcggttggccacattactgatgacaagcgccaagagtttgtgttgctttccgataccttgggcgcctcgatgcagaccatcgcggtgaacaacgaagcgtatgaaaactcaacggaagctacagtctttggtccattcttcctcgatgacgctcctgaggttgagctgggtggagatatcgccggcggcgcccaggggcaggcagcgtggattgaaggaaccgtcaccgacactgaaggcaatcccgttccgaatgctcgtatcgaggtgtgggagtgcgatgaagatggactctacgatgtccaatatgccgatgagcgcatggcgggtcgcgcgtatatgcacaccgacgccaatggcgattaccgcttctggggtctgactccggttccttatccaatcccccacgatggccccgtgggcaacatgctcaaggcggttggtcgttcgccggtgcgctgcgcccaccttcacttcatggtgaccgctcctgaattgcgcaccttggtcactcacattttcgttgagggtgatccgcagctagaaatcggcgattccgtcttcggggtcaaggactcgttgatcaagaagtttgaggagcaggcgccaggcactcctaccccagatggtcgggatctcggcgatcagacgtgggcgcgcacgcgcttcgacatcgtgctcgcgccgggcgcg

SEQ ID NO: 3381 - DNA, 1089 bp, Corynebacterium glutamicum
gtgaacaactcactcgcattcaaccacgacaccctcccacagaaagtcatgtttggatatggcaagtccagtgcattcttaaagcaggaagttgaacgccgcggctcagccaaggtcatggtcattgcgggtgaacgagaaatgtcgatcgcccataaggtggcctcagaaattgaggtggcgatctggcacgacgaagttgtcatgcacgtgcccatcgaagtagccgaacgtgcgcgtgcagtggcaaccgacaatgagattgatctgctggtgtgtgttggcggcggatccaccataggtttggccaaagcaattgccatgaccactgccctgcccatcgtcgcgatccccaccacctacgcaggatcggaagcaaccaacgtgtggggtctgacggaagcagcgcgcaaaacaaccggtgttgatctgaaggtgctccccgaaacagtcatttacgattccgaactcaccatgtcgcttccagtggagatgtccgtggcatccggactcaacggcctggcgcactgcattgattctttgtggggacccaacgccgatcccatcaacgcagtgcttgcagccgaaggaatccgcgcactcaaccagggactgccgaaaattgttgcgaacccgcacagcatcgaaggacgcgacgaagccctctacggcgcctacctcgcagcagtatccttcgcctccgcaggctccggactacaccacaaaatctgccacaccttgggaggcaccttcaacctcccccacgcccaaacccacgcaaccgtgctgccgtatgttttggcattcaacgcaggcgacgcaccagaagctgaacgccgcgcagccgcagcctttggaactgacaccgcactagaaggcctgcaacgcctccgcttgtcagtcaacgcaccgaaacgactttccgactacggcttcgaggcttcaggaattgctgaggcagtggacgtcacgttggagaaagttcccgccaacaatcctcgcccagtgacccgggaaaacctcagcagattgctcgaagcagcactcaacggtgaggatccggcagttcttagcgcagtactcagtaac

SEQ ID NO: 3382 - DNA, 1524 bp, Corynebacterium glutamicum
atgacggacatcaaggccacatcaagtacatcggccactacagcaccaacagcaggccgaccagcgcgtcgacttggacaaatttccctcgtcgcctgtctcggcggacttctcttcggctatgacaccggtgtcgccaacggcgccgaaggccacatggcacaagaactcggactcaacgtgctgcagctcggcgttgtcatcagttcactggttttcgctgcagcctttggcgcgctgttcgctgggcgtatctcggacgaaatcgggcgtcgaaaagcaattatcactttgtccgtgctgttcttcctcggatcaatcctcgtcgtattctcccccgccggtgagctggggcagttctacggaccaggatttgccaccttggtcaccgggcgcatcatgttgggtctcgcggttggcggcgcctccacagtagttccggtgtacctcgctgaactcgcaccactagaaatccgcggctccctgaccggccgaaacgagcttgctatcgtcaccggccagctgcttgccttcgtgatcaacgcgcttatcgccgtcaccctacacggagttattgatggaatctggcgcatcatgttcgccgtctgtgccctccctgccgtcgccctcttcctcggcatgctgcggatgccggaatcaccacgctggctggtcaaccaggggcgttacgacgacgcccgccgcgtcatggagaccgtccgtacccctgagcgtgcgaaagccgaaatggatgaaatcatcgcggtgcactctgaaaacaatgcggcacttcctggtgttaagcagtcttcgggccaggcttcaggccaggtttctagcaagcacacccacatgtccatcggcgaagtcctcagcaacaaatggctggttcgtctgctcatcgccggcatcggtgttgcagttgcccagcagctcaccggcatcaacgccatcatgtactacggaacccgcgtcctcgaggaatccggcatgagcgcagaaatggctgtggttgccaacattgctttcggtgccgttgccgtcatcggtggactgatcgcactgcgcaacatggaccgcctggatcgccgcaccaccttcatcatcggcctgtcactgaccaccaccttccaccttttgatcgcagctgccggcactctccttccagaaggtaactccattcgaccattcgccatcatgatccttgttgttgggttcgtgctctccatgcagactttcctcaacgttgcagtgtgggtgtggctggcggaaatcttcccagtccgaatgaagggtatcggcaccggtatttcggtattctgcggttggggcatcaatggcgtcctagcgttgttcttcccagcactggtctccggcgtgggtatcaccttctccttccttatcttcgcagtcgtcggagtcattgccctggcgttcgtcaccaagtttgttcctgaaacccgtggccgctcacttgaagaactcgatcacgcagcattcaccggccagatcttcaagaaggct

SEQ ID NO: 3383 - DNA, 861 bp, Corynebacterium glutamicum
atgccgccagccaaaacgcaggaattcgatccatcacgaatcaaggaacccaattcaccttcggtaatcaccaaagcggcaacgctcatggatgtgctccgcactgaaggtcccaccaactccgctcgcctagctgaggtgctgggggagccgatcagttcggtgtacagaatgctccacaccttaaccgcgatcgggtgggttgagcaggacggaaagcgcggctcctatcgcgttggcctagccatgctcacacttgccgaattgcaattgcgccatatggatctccgcaagatcgccgcactaacaatgcggaaaattcatgcactcactggtgaaaccacatttttatgtgttcgtcacggcattcgcgcggtatgcatcgagagggtcgatggcgatcgtgtgaatagtcgagttctccagctgggaacctcgctgccgctccatgtcggtgccgcacctcgtgcgcttctcgcttttgagggacgcagggcctgggaaacatatgccacaaacttaggattcgagggccataactggtctaaaggaccgtccagaggcgagctattccaacacttggacgaagaccgcgataagggtttttgcctggtagacaatgaaattactcccgggatcgccgctgtaggagcaccgatttacaaccatcgtggtgaagtcgtggcaagcctgtccatgagtggactgcgggacggcatcctcagcgataccaccgactactcggccgtggaactgatcctgcaggggtctgcggagatttcccaagcgctgggagcgaccattgagcacaacgggggcaaccaaaaactaccccaggtaacccctctgagcattgtggtt

SEQ ID NO: 3384 - DNA, 1077 bp, Corynebacterium glutamicum
atgagtgatcaaaaaattgttgttggcctgctaggcatcacccacccgcatgcgtcggcgcgggtgcgtgccctccgtgaaattgatggggtagaggtcgtcgccgccgcggatactgattcccgcctccagtacttcaccgacaaatatgatgttgaaccccgcgagatcgatgacgtcttgaacgacgatcgcatcaacgccatcatggttcactccaagagcaaggacatggtccctcacgccaagcgcgcgctcgcggccggaaaatccgtcgtcgtggagaagcccggcgggggaacagtggcggatcttgaggagctcctggccctcaaagaagctgccgatcctcagcgaatcgtgcaggtcgggtacaacgtccgcctgtctgaatcggttcagagattaaaagagcttctcgacgccggcctcatcggcgaagtcgtcagcgtgcaagcacgcggcgccgcaaaagtaggtgagcatatcaccgagcacctcaaccaacccgcagacatgggcggtgtgttgtggattcttggctgccacatgctcgatgcattggtggaagtcttcggagctccagaatccgtgaacgcccgagtgcataagaccgcaaaactctctgacgacaccagccgcgaagactcagcctccgcactgctgtactacccagatttctccgtcagcttcagcttcgacggccacgatgatctggaatggttcgaaagctcccgactcacggtctatggaaccaagggcatgatcgaagccggaatcctccctcagacactgcgcgtatacctcaatgagtcacgccagggctggccacagggttggaccgagtggacccagagctacttcaccccaccgtttgctcgcacagaatccaacaaattctcagagcttccagagctagaaaacatcagcaacttccgcacagaaatgcaggggtgggtgaattccattcgcactggatcccgcaatgtggcgccagttgaggatgctctcacagtcgctcgcattgtcagtgcatgctacgaatccgacaacaaccagggcatttccgtaaacatc

SEQ ID NO: 3385 - DNA, 879 bp, Corynebacterium glutamicum
atgaaaccacaacttattgcatcttgctggaccagcgcgggagacgccgcacccgatcgtgacgatctcagcagcccagtagcaatcgatgagcgcatcgctctagtcgctgaaaccggttgggcaggcattgggcttgttcacgccgatctcatcaaagcacgcgacaccattggctacgaggaattgcgccgacgcatccacgctgcaggaattgaaatcattgaggtggagttcctcaatggttggtgggcgactggtgcggaacgccaagagtccgatgccgttcgtgcggatctgtttgctgcggcgcaagctcttggttccccacacattaaggtcggagcaggagagggcaccaatggtgtggttcccattgctcacatggccagtgcgtttactgatctcgctgcggaagctgaagctcatggcgtcaagctcgcgttggaagcaactccgttttctcacctgaagaccatctacgacgcgctggaagttgtcagccattccgatagcccatcggctggactcatggttgatatctggcacaccgcgaaaatcggaatccccaacgatgaactgtggcgcaacattccactgtccaaggtcaacgcagtggaggttgatgatggtttcattgacaccccaattgatcttttcgatgactccaccaaccgtcgcgcgtactgcggtgaaggcgaatttgatcccgcaagcttcatccgtggcgccatcgacgccggttggacgggcgcatatggtgtggaaattatttccgcagagcaccgaagcctcccggtgaaagaagggctgcaacgtgctttcgacaccaccatcgcagcgtttgaacaagctgctcgtctcgccccctccactaac

SEQ ID NO: 3386 - DNA, 1005 bp, Corynebacterium glutamicum
atgactcttcgtatcgcccttttcggcgctggccgcatcggtcacgtccacgctgccaacattgctgcaaaccctgatcttgaactcgttgttatcgccgatcctttcattgaaggcgcacagcgtttggcagaagccaatggggcagaagcggttgcatcaccagatgaggtgttcgcccgcgatgatatcgatggcatcgtgatcggttcaccaaccagcacccacgttgatctgatcacccgcgccgtggaacgtggcattcctgcactgtgcgaaaaacccattgatttagacattgaaatggtgcgtgcctgcaaagagaagatcggcgacggcgcttccaaggtgatgctggggtttaaccgacgcttcgatccttctttcgctgccatcaatgcgcgagtggcaaaccaggagatcggcaacctggagcagttggtgatcatcagccgcgatccagcgcccgcaccgaaggactacatcgcaggttccggtggaatcttccgcgatatgaccatccacgatctggatatggcgcgtttctttgtgcccaatatcgtggaagtgactgcaaccggcgccaatgttttcagccaggaaatcgcggagttcaatgactacgaccaggttatcgtcacgcttcgtggctcaaagggcgagttgatcaacatcgtgaactcccgccactgctcctacggctacgaccagcgacttgaggctttcggctctaagggcatgctcgccgccgacaacatcaggcccaccacggtgcgcaagcacaatgcggaaagcaccgagcaggcagatccgattttcaacttcttcctcgagcgctacgacgccgcttacaaggcagagctcgcaacttttgctcaaggaatccgcgacggccaaggcttctcaccaaacttcgaggacggcgtcatcgcccttgaactagcgaatgcatgccttgaatcagctcaaaccggccgcaccgtcaccctcaaccctgccaacgtt

SEQ ID NO: 3387 - DNA, 1083 bp, Corynebacterium glutamicum
atgaaaaacatcaccatcggaatggtcggcgtcggccgcattggccgcatgcacgtcgccaacatgcttgccgttgctgaaactttgaaggaacgcgacctcaacattgagatcgtgctcgcagacgcaatgcccggttttgcggagcaggtgggcgcggacatgggcgtgaaggcggcggcaagcgtcgataagcttattgaggacggggtggatgcccttttcattgccaccagcaccgctggccacgtcgatgttttgcgcaagggcatcgcggcaaagctgccgatgttctgcgagaagccgatcgcgtcggatgtgcctgagtcgctgaacatcatccgcgaaattgatgcggctggcgcgacggttcaggtcggccaccagcgccgttttgacctcggttaccaggaagctaaacgacgcctagatgcaggcgacctcggctggcttcattcgctcaaggccgtatcgagcgatgcgtttccgccaccggtgtcctactgcgctacctctggtggacttttccgcgatgtgtcgctgcacgatttcgacatcattcgctggctgaccggccaggatattgtcgaggtgtacgccaagggcagcaacaacggcgacccagaaatcggcgcagtcggtgacatcgataccggagcggccctactcacgcttgccgacggcaccctcgccaccgccatcgccactcgttacaacggtgcaggccacgacgttcgcctcgatgttatgggctctaaagattccacgatcgttggcctggatgaaaagtctgcgttcgcttctgcggaggagggcatcgatttcccaaccggcgaatcgcacccaacgtttgccgagcgcttcgccgacgcatacaagaatgagtgcattgcgttcgtggagttgatcctgggagagcgggaaaacccttgtacccctgcagacgctgtggctgcggcgattgttgccgatgcagctcagctgtcgctggtcactggcgagccagtgaagattcctactgtacgggaaattcttgaaggttctgcgcagccagttgaggtgcgtgcgctggttccatctgct

SEQ ID NO: 3388 - DNA, 4032 bp, Corynebacterium glutamicum
gtggtgtggattgagtactccagttcaactgttgataccgctgcgtttagtgagcaagacttccgtgatttctacggcatggattcctcagcccgcatcttccgagcaactggccaggcgggtctcgctaacggtggtgatcgtggcatccgagttctgtacaatggtgaagtttctggttggtcccactacccatcagatagcgcagcggttcaaaagggaattgacttcgcgctgccaaaagtaggggagcaggccagcattgcagtgcgcaccaaaactgatccaactccaggatcaattacttctgatcagttgattcctggcggattggacactccagaagagcctgaagcccctgaagactctctttttgaagggcgcactccccctagggatgcagcaccgctgatcctcactgaactaatggtcaactccaccaacatgggcagttctgatggttttgagtatgtggaaatcaccaacactactgccgaacccatcgatttttccgattacaccttgaactacctgtacccgcaggatgagttcaccaacaccaacgaagccgtctgggctgcggaacctggtgatgtcattattcagcctggaaaatctctcgtgttttggatcaaaaatggccccaatgatgaggcaaccgcagcagatttcaatgcagaatatggcaccaacctggaggctggaaaagaccttgttgaaatctcctcaggtgggatggccaatggtactgccagaggaatgcagattcagaccaacactggccacatagtcaaccgtggtttctacaacatggctggcgcttctgatgtgaaagccaacgagggtcttcatttcgcagtggatgagtctgatcttctgaagcaaacgcttgtcggcagcggtgcgccaaccccgggcactgtgtacacttcgcagattcctaatccactgtctgccgttatcgctgattcttctgtaccactcatcacagataataccgcaaccagtatcaaccctgcggagccgtttaccttcgccttcaatatcaccgatgatgtccaggtgcgcacggcaacactgcatgttacttccagtgctggcgaagccgcgacaaccatcaacctcaccgaggatgacggctctttcaattgggctctgcctgcagcggatctcaccggaaaatcctggttcgaatacaccgtaaccgccaccgacggattcaacagcgttaccaccgagccggtacgcgtcaccgtcgacggcgccaacaccgacccgctgcgcctcaacctggaagaaaaccaatgggtcagtggcaccaccgatgttatcggtgcttcagatgtcttcggcgacaagcttgaattgcttatcgacgacgcgcctgcagtcaccaactccagcctgtctgcggccccgacgtttgcgatggaagtaacccaaactgatgtgttcttccgcaacggcatccttgccggtggggaagaactccgcattttcgatcaaggaacttacgccaacaccgaaaccatctccacaccagtcccgctgtatcacatcaatgaggacggtaccctcacagtcagtgtgtatgcgggaactaaagcagcaccagaaattgacctcaacgagaacaatgacgatttccagatcagaaaccttcgactaattctgcctgatggccggaccctcacccctgccggaatttccgattctaatgcgtggctcaacatgggagacagcgctggaaaactcgatttcttcgatgccaccttcgccctccctgaggatgctttcaccggtgtggcacacgcatgggataccacccaaagcacagatggagaacaccacatcaccatttcccgcgaagacggcggggaaatcagccgcaccatccgggttgataatactgccccagaactcaccgtttctggagttgaagaaggacaagaactgcgcggcaccgtagaaattgatgcccaggcaaccgatgcgggtgcgggcgtgaagagcgtcgagacgcttctcgacggcgaacgcgtgcaacttccactaaccaccggttccatcgctttggataaaggtgaacacaccttggttatccgtgcagaagatgaagtaggaaaccgcaccgagaaaaccatcacgtttagcactccggatgaaaaccccatcagtggtgactacgctccaagcaatggggccaccgtgggcgtcggtgacgttaagttatctgcacgagcaagtgatccaagtggcgatactgtcaagatgacgttcctggaagccgattcaccaaaattagatagtggtcgcgtccgaatgtcatcaggaacggtagaagatgccggaagtgtctcgcgcgccgaggcgaaaatgttggagaggggagacgtcgagaagctatccagcctggatgggctgggcatggaagttacctccgacgccgcactgccgtaccagctttttgaagtcgatgcggcggatgcactcgcggccgacactgaagtgcgcctgaattgggcgggatccgccgatggtcgcgcgcaggtgatcatgtatgttttcgatggcgaggcgtgggttgaggtggatcgtcacttgaccggcgatgagctggaagagtttacgctgcagggcgtcgtcaatgcggaaaaatttgcaatcggcggcactgtcaccgtattgattcagcactccgaaggcttcgccggtgcggatcattcaactagaaattccgacgtgaccgcagcgcacccggatgatgtggctcgctctgagtacgatttcaccctcgcgtgggaatctgacacccagtactacaacgaggaattccacgagcaccaaaccaacatccatgactacgtgctcgccgaacgggagaacaagaatattcagttcatgttccacactggcgatgttgtcgacgactgggatcagcccgcgcagtgggccacagccaaccccgaataccagcgcctcgacgacgccggcctgccatattctgtccttgccggaaaccacgatgttggccacaccagcaatgactacaccgaattcagccgacacttcggcgaacagcgctacgtagacaacccgtggtacggcgaatcctaccaagacaaccgagggcactacgatctattttctgccggcggaattgacttcattaacgtagcgatgggctggggtccagacgacgaagaaatcgcgtggatgaacgaggtcctggccaagcatcccgagcgtgtggcgatcctcaacctccacgaattcatgctcaccaccggcggacttggcccgatcccgcagcgcattctcgacgaggtcgcagccaccaacccaaatgtcagcatgatcatgtccggccactaccacgacgcattccaacgcaccgactcctttgacgacgatggtgatggagtagatgaccgcaccgtcacctctatgcttttcgattaccaaggcctaccggagggcggacaggggtacctccgacttctccactttgataaccaaggccaaaagatgatggtgcgcacctattcaccatccctgaaggattacaactctgatgaaccctcactgttggggcctgcagaagaccccaacatgtatcaagaattcgaagtgtcctacgagcagctcggcatcaaaccagagggccgcaccctgatcggcgattccttcagcgccgatttcttgacctccaatgaaattggaatagttgatgaggttccttctggaacgatcgcttccacgaactggaaggacgtaaccgaaggtcgccacagttggtatgttcgctccgaggatcctttcggcggcgtcgagatttcacccgtgcagtccttcattgccggggaagaggctggcgggaacgcgcccggcactggaagctccaatggcggttcatcccacggattatggggtgcgcttgcgggattctttgccggagcggcagccctggctggagctgcgatcgcatttgtccccggaatttgggactatgtgaccaacgcattcaagcga

SEQ ID NO: 3389 - DNA, 645 bp, Corynebacterium glutamicum
atgcggagttcttccccaccggcaaggatgccgttgcggaagaacacatcagtttgggttacttccatcgcaaacgtcggggccgcagacaggctggagttggtgactgcaggcgcgtcgtcgataagcaattcaagcttgtcgccgaagacatctgaagcaccgataacatcggtggtgccactgacccattggttttcttccaggttgaggcgcagcgggtcggtgttggcgccgtcgacggtgacgcgtaccggctcggtggtaacgctgttgaatccgtcggtggcggttacggtgtattcgaaccaggattttccggtgagatccgctgcaggcagagcccaattgaaagagccgtcatcctcggtgaggttgatggttgtcgcggcttcgccagcactggaagtaacatgcagtgttgccgtgcgcacctggacatcatcggtgatattgaaggcgaaggtaaacggctccgcagggttgatactggttgcggtattatctgtgatgagtggtacagaagaatcagcgataacggcagacagtggattaggaatctgcgaagtgtacacagtgcccggggttggcgcaccgctgccgacaagcgtttgcttcagaagatcagactcatccactgcgaaa

SEQ ID NO: 3390 - DNA, 618 bp, Corynebacterium glutamicum
atggggttttcatccggagtgctaaacgtgatggttttctcggtgcggtttcctacttcatcttctgcacggataaccaaggtgtgttcacctttatccaaagcgatggaaccggtggttagtggaagttgcacgcgttcgccgtcgagaagcgtctcgacgctcttcacgcccgcacccgcatcggttgcctgggcatcaatttctacggtgccgcgcagttcttgtccttcttcaactccagaaacggtgagttctggggcagtattatcaacccggatggtgcggctgatttccccgccgtcttcgcgggaaatggtgatgtggtgttctccatctgtgctttgggtggtatcccatgcgtgtgccacaccggtgaaagcatcctcagggagggcgaaggtggcatcgaagaaatcgagttttccagcgctgtctcccatgttgagccacgcattagaatcggaaattccggcaggggtgagggtccggccatcaggcagaattagtcgaaggtttctgatctggaaatcgtcattgttctcgttgaggtcaatttctggtgctgctttagttcccgcatacacactgactgtgagggtaccgtcctcattgatg

SEQ ID NO: 3391 - DNA, 1086 bp, Corynebacterium glutamicum
atgagccctgcccgcacccagccccgagcggctttcctaaggaagctccgacccatcacatgtagcctttccttggttctcgtagggtgcagcaacacggcagagtccacgaccaccgatacggcaggctccactgaaacttcatcacagatttcacccaccactccagtcagcaccaccgaagcagcgccgcctgaagatccaagcgcaaacgctttggaagagtatgctcagatccttgccaatccaagcatctaccccttaaccgaaatttcacaattcgtccccacaggcacatatgcctacacacttgttgaagcaacttccgattccatcccagaactactactccgcgccgatagtcacgaattcgcgccaattttggttttcacctatgacgaaaacacacaatccgcaacccaagctggaggagtcctaattgacggtgtcgccagcgccggcggttcacgagtcaaggtcagagcttcaaattcaggagcaggaatctaccaattgaattggtactcgatacaaccagttggcgaaagctctttgtacggaatccaaggaaactccctgacacaaatcgcagaccccgaggatttcatggtccgtgaactattacctgaccaccacgaaattacctgggttgattccaacgacccctccggcctatcaaccgttcagactggtggagccaacattcaacaagcagccccaactcccgttcaacagcctgcgtcaaacctgcactacttctctggtgtagtaacgatgcagaccgccggcgaactcatgcgaggtgaacgaactcccaatggtgagcctgccactgatctctatctcgtactggtccttgattccccaattgaaatcacagcacgaaacgcagctacagaccctcagactcgtaccatttccgaagtcagcctcggccgatacatccccgctgatggtgacaatgattggataggctacctcgacacccacgtggaaatcactgcaacaacggatcaggtctggttcccaaccgacaccggtctacctcttggaatgcttcgtctagcggactacaaaagcatctca

SEQ ID NO: 3392 - DNA, 744 bp, Corynebacterium glutamicum
atgggtattttcaggtcgcggtcgcaggattttgggtggagcatgcaccaggctggccagctcatcaatgatcccagtcagggtctgtggcgcacttctgccctgcgctcgccggttgctcgggttggacatgccgtgttgcgccagcgtgccggtgagatctcgcgcatgcaaggtcgtgagttttctcgccctggggatcagttccgacaggtagatttgcgcaggcgactgattcaggtccatccccaatcaattcctacagcggatgcgatggccgtaaccatcaccatggcgctcaccgctgccacgattgatccggtgaagttcgtcgcggattcacagaacccggatgaagagatttatttggcagctcagatcgcattgcgggaaatggttatcgctatgcctttggaggatttcatcggggtgcgcattgatctagagcctgttttggtggctgctcaagctgctgcgaagaatgtgggcgtggaagtctcgtcaatcttgctgaaggatctgaatcttccccaggagtactcgggagcgttgcaggaatcgatcgttgcgaaaattcaagccgaaactgatctggaacgtgcacgaaatgaagtgaaaactacccgtgctcgacttgccagcgcgaaagtgttggagcaaaatccgattcttgccaaaattcggatgattgaagcgctcccaccgggatccacaattgaggttcgggagggtgactcaaaggca

SEQ ID NO: 3393 - DNA, 969 bp, Corynebacterium glutamicum
atggaaaagcagtttttcacagggaaaagattcgatgtccgggatttggaatcgatcgcttttgtacttcgtgatgagccacattttagagggctctatcggctgagctttgctacaggtgaagcctatgttgggcagtcggtgaatgtggtgaaccgctttacgggacatcgtcgacgatgggatgacattatttccctggaattctttccctttgccaatgaagacttgaatcctttggaaaagaccttgatttccatgactgaggaatctacctcagttcgaaatatcagggatgcgggcaaacctcgtggggaggaagactttgtttttgatagtgaaaatggagtctcttccccattgtcctgggatcgtgagaaaagaattccaccaggtagctatgtagttagtacagagtccgccaaatttgttcagcttgcacaacagccaaattatcgcccacttcgagatgttgttgggtggtacctctatcaaacttatccagatccctttaatacccaacgtcatttatgggtttgttcagcaatgcccactactaataagtctaagaaccatcaacgcttattagcgcttagcgctgggatgctggaaacgtttgttgcatttgatgatcgggataagcaggcaccgaatgttgaaattttcatcaatactgcccgctcttcaatatcggcagatgagctatcccacccggatggattttggcaagtggaacaccataatcgatataaagcttctgaagtgaccgcatggtatttcaccttggaaggtttagaggccatcatttttggggacttggaatttccacatctggacctcatgctggatctagcctatgagctaaacgtcaagctcatgcggcatggtggaacaattttccggaggtttcacaataatctgctggctgcggatctattggcggcttcacttcaatggagagctcgcact

SEQ ID NO: 3394 - DNA, 4929 bp, Corynebacterium glutamicum
atgtccacgattactgatgctgtatccgccctgcgcacactgccttcccagtctgcgcagggtttggcttttgaaaaactcatggtcaacttcattaagtctgaccccactctctccactgagtttgatgaagtccatcgttgggtcgattggccatataacggtggcaccatggatactggcatcgacttagtggcttataacaaggacgatgatgcttatacggcgatccagtgcaagttttatcttcccactacttccctggcaaaaggacagctagattccttctttgaagcctcgggacgcacttttgaaacccctgaaggaacacgctcctttagcaatagactcgttatttccactactgataagtggagttcaaatgcggaaaagatgttggagaaccaaaccattccaactaaccgcattggtctatctgcaattgcggaatccccgattgactgggatattgcctatccaggttctgaattaactattaacctgcagcttaaagagccgtatagccctcgtcctcaccagcaaactgctattgaaaaagcaattgaaggcttccaaactcatgaccgtggcaagctcatcatggcttgcggtaccggaaaaacctttactgccctgcgtctttctgaagaggttgcgcgactcaatggcaataaagctcgcattctttttctagtcccttccatcagcttgctttcgcaaacactcaaagagtggactgcacaaaagacaatggatcttcgtcctgtcgccgtatgttctgactccaaggtctccaaggctgcagaagatattgctgcttatgatcttgaagttccggtaagtactgatggtgcattgattgcggaaaaactggagcatcgtaagcgagcagcaggattgaccgtggtgttctctacttaccagtcccttcctgctgttcacgcggctcaagaagctggggctgagccctttgatcttgtcatctgcgatgaagcccaccgcaccacaggcatcaccttggctggagaagacccttcaaacttcacccgcattcatgacgcttcttatatcaaggcagcaaagcggctgtacatgacggcaaccccaaggcttttcgacgactccgtgaagggcaaggctgcagatcattcagctgaagtttcttccatggatgatgaagcaatctacggacccgaatttcaccggctgggttttggggaagcagtagaaaaaggcctgcttactgactacaaagttgtagtgatgacagttgatgagcaagttgcagccagtgccttaactgttttgggttcaacacctggtgaagaactcactctggacatgacttccgcaattattggcgcgtggaatggcttggcaaagcgttcgggtaaagagcaagacaccaagactggtttctcaagctctgacgcagcaatggaacgagctgttgcatttgcgcgagacattaagacttctcagcaaatcgcggagtcttttccacgagttgtcaatgcttatacgactgagcttgaggttaaaaacgatgacgtagatgagcacaacctcaatttgagcgtggcatgccagcatgtcgatggatcaatgaatgcgctggaacgaaactctcgtttaacttggcttaaagctcctacccagtcaatggaaaccaagattcttactaacgcgcgctgcctttctgagggtgtcgatgtaccggctttggattccgtaatcttctttaatccccgtaattccatggtggatgtggttcagtcggttggccgagttatgcgtaaatctccaggtaagaattacggatatatcatcttgccagttgctgttcccccaggtgttgcaccatcagctgcgttaaatgattcacgccgcttcaaggttgtatggcaggttcttaacgcccttcgtgctcacgatgaccgttttaacgcaatggtgaactccattgcgctcaatgagggaaatattaaggatctacctgttgagactgagcatactggccctacaagtaaagatagagataacgcaccctatgacagtgctgaatccgctacacaatacgtactgttctctttagaacagtggcaagaagcgatctacaccaagcttgtagataaagttggtacccgaacctactgggaagattgggcagatgatgttgctgacatcgcccaagcacaaataacccgtattaaagcgctcttagacaatgcttcaccaacgatcaaagaagagttcgagcgatttgttgaaggtctacgtggcaacctcaatgagtccatctctgacgacgaggcaatcagcatgttgtcacagcatctgatcaccgcaccagtgtttgacgctctatttgctgaatcaagcttcgctaagcaaaaccctgtttcccaggttatgcaacgcatggcagatgctcttaatagtgctgaacttaactctgaaacggaaaaacttgagaagttctatgactctgttcgtatccgtgctgctgaagtaagctccgcagctggtaaacaagcagtaattaaagacctctacgaacgattctttaaaaaggcctttaaaaagcaatctgaagctctaggtattgtctatacccctgttgagatcgtggactttattctgcgagctgccgatgatgtgtccaagaagcattttggtcgtggcttaagcgataaagatgtccatgttcttgatcctttcaccggtacgggtacttttatggtgcgtttattgcagtcaggtctaattaagcctgaagatttggcccgtaaatatgccaatgagctgcacgctactgagatcatgttgcttgcctattatgttgcggccgttaacattgagaccacttattttggtctcgagggagagcgtgctctgcgtaatggtgaagatgcgccggtctatgagccgtttgatggcattgtgttgggtgataccttccagatgtatgaagacgatgacaaactcgatctagatgtttttactgctaacaatgaccgtatggagcgtcagagacttactcctgtacaggttattgtgggtaacccgccttactctgtggggcaatcgagtgcgaatgacaataacgcaaacctcaagtaccccactcttgatcgacgtattgaagattcttatgcgaagtattcgaccgcaacaaataagaactctctgtacgactcctatttacgtgctttccggtgggcaacagatcgtattcacacacaaggggttgttgcttttgtttctaacaacggttgggttgacggcaataccgctgatggtgtgcgcctaagtttggcacaggacttctccgagatttatgttttcaaccttcgtggcaattcccgaacaggtggtgatttggctaagcgcgagggcggcaacgtctttaatgtccgtgtgggtactcaaatcattgttgccgtgaaaaacccacaattgtctggttgcaggattctttataaagatattggtgacaatctcagcgcggatgcgaagttgaacgagattgccgttgccacaattgagggcgctgagtggcagactatttcgcctaatgaatatggagattggatcagccagcgctctgtagattttgatacctggcctgtactcggtgataagaaaaacaaatctgcattaaaggtttttcaaaccttttctgctggtctaaagactggccgcgatgcctggtgctatgggccaacatctgcgcaggtaaaaactaatatcacccggttattagaaacctatgaacaagctcagcaacggtttaattcgtgggttgtggataacggagtgacatctcctaaggaagctgacgttaatcaattccttaagcagaaccctgatttagcggatagcaagaaaatatcctgggattccaatctaaaaatgtccttgtcacgcggtgatactttttcttttgatccaagcagcatccaaatgtccttgtatcgtccatttttccctcaacagacatacttccatgtttcattgaaccagcgtcgataccagttaccgtcaatgttcccgaccccggaacatgacaaccagggcttttatatcgtcaacccaggtagtgccaagccattctctacccttgcaacaaatctacttccagatcttgctatgtggggttctaacgccggacagttctttacccgatggacttgggaacccatcgaaactcgagaaggcgaattagacttcggtaatggacttttctccacaaccccaaaaaagggagttgaaggcgagatccttgacggttaccggcgcgtcgataacatcaccgacgagatcttaaagctctaccaatcaagcttgggtgaggatgtcaccaaggatgacatcttctactttgtttatgcacagttgcatgatcctgcctatcgtgaggcctatgcggctgatctaaagaagatgctgccacatattgaaacccctactgatcgcgcacgctttgatcactttgtgacagccggcaaggaattgatggatcttcatatcaactatgaagatgttgaaccatgggatgtggaggtaaaggtcaaagaaaaagctgatcccacggatcgtgagacctggcgtgttaccaagatgaagtgggctaaggttcgtgatccagagaccaagaaattggtggaggaccataccaccttgatttacaacagctcaatcaccatcagcggcatccccgaagaagctgaaaactatcaactaggttcacgttctgccatcgcatggcttattgaccgttaccaggtgaagaaagataaggcgtccggcattgttaatgatcccaatgattgggctgatgaagtgggtaaccctcgctacattgtggagctgattgctaaggtcacccgcgttgccgttgagaccatgagaattgtagaggagctt

SEQ ID NO: 3395 - DNA, 507 bp, Corynebacterium glutamicum
atggccgtttttgatttccctaaccccgttaacgaatatgcagctcgctgcactgcgggtttggttgttttgctgagcgccgccacgctttttgcctctggtgaccttcgtattattttggcaagcatcttgaccttcggcttcgcattgcgcgtcgccggcggaccccgttactccccctttggacgtctttcagtacacgtacttgtaccactgctgaagaaagcaccgatcctgacccctggcccaccaaagcgcttcgcgcagaccatcggcctgggctttagcggtacttcccttatccttatggcctttggatttaacgttgcagcttccgtagtcctagtcatgctcatcgcagcagccaccttagaatccgtctttggtatctgcctcggttgctggggattcggcaagctcatgcgctacggcgtcatcccagaagacgtttgcgagcagtgcttccagaaggaatcctcccgcaccggctggctcgttagcctgaag

SEQ ID NO: 3396 - DNA, 360 bp, Corynebacterium glutamicum
ttgcttgaggcagaagttctaccccttgatctttccccgttgtggaataaagttcacaccatcgtatcttcaatccctgcaggtcattgggcgagttacggagatgttgcagtggcagccggaacaaatgctcagtccattggtaaccatcttgctgaacacccagtactaaacgctcatcgagttctaagaacagatgggtcaatctcagatggtttcagatggttaaacgctgaggaaacccgctcaccaaaagaagtattggaaagtgaaggtgtggaatttacttcttccaatagggcaaaccctcaacagcgattgactccagaggaattgctcgccttctttgcagctgagaat

SEQ ID NO: 3397 - DNA, 600 bp, Corynebacterium glutamicum
ttgacccatctgttcttagaactcgatgagcgtttagtactgggtgttcagcaagatggttaccaatggactgagcatttgttccggctgccactgcaacatctccgtaactcgcccaatgacctgcagggattgaagatacgatggtgtgaactttattccacaacggggaaagatcaaggggtagaacttctgcctcaagcaaccgtcgttaccccaaataacttcgaggcttccaccctctccggccttgagaagcttgagaccgtcgaggacctcaaggaggctgcccgcctcatttatgagcaaggcccccagtacgtagtcgtcaagggtggcatggacttccccggcgagaacgccgtggatgtgcttttcgacggatcctcctaccacgtcttctctgagccaaagattggtgaagagcgcgtttccggcgcaggctgcaccttcgcagctgttatcaccgcagagctcgcaaagggtgctgaggttgtagacgcagtggcaaccgcaaagcgtgtggttacccgtgcggttcaagatgctgttgcatccaacgcaccttttacctccgtatggcttgctgaggacaacaag

SEQ ID NO: 3398 - DNA, 243 bp, Corynebacterium glutamicum
ttgagggagagagtacttcacctgaaaggggccagtgacatggcattaaagaactacaccgttgagggcatgacctgcgcacactgcgtggcatcggtaactgaagaggtaagcgaagttaatggcgttagcgctgttgacgtcactctagaatcaggaaacgtcgctgtcagtggcgaaggtttcagcgatgcagagatccaggctgctgtagaggaagccggctacaagatcgttgcctcc

SEQ ID NO: 3399 - DNA, 837 bp, Corynebacterium glutamicum
atgcttcggcgaggggttctatttattgtgtgtgctagccttttcgcaatcgttcagcccgccccgacgtcaatgttgggagtgggctggcgcattccattcctgatggccgtgccactagggcttatcggctggtggatccgcaccggtgcccaggaaaatgtacgccccgcatccgaacgccccgaagctcctattaagcaggcattgcgtactgagtggaagatgatgttgcgggtaggtggctttatctcttgcaccggtctgagcttctacattttcaccacgtacatgaccactttcctgcgcagcaccgtcggactggagggcacgttagtgctggctggaaacatcatcgctctcagcatggcagcaattgtggccccatttgttggccgcgcaattgataaattcccccgccggaacatcatggctttcgctaccttaagcacagtaattatggcgatcccggcctacatcattgcaggtcaaggtactttgactgcttctttgattgcgcaggtaatgcttggaatcggcgcggttaccgctaactgcgttacctcagtaatgatggccgaggtcttccaagaggtcacccgcggtacttccgccggcattacctacaacgtcacttacgcaatcttcggcggctcggctccatttatctccaccgcattggtctcctggaccggcagcccgctggcccctgcggtatacatgatcatcattgcgctcttcgccttcaccgcgtcccgcttcattcctgaaacctccccagtttttgtcaccgcaaccccggccattaaggcaccaaaggtgctggtcaacccgggt

SEQ ID NO: 3400 - DNA, 957 bp, Corynebacterium glutamicum
ttgggtatcgcaggatgttccacggccagtgatgaagccacaagcaccagcgacgatgtagctgtcggcggccgcctattttctacagcggattccgccaccgccgctctgggaagcgacgccgaaccaggccaattcccccgcaccgttgtgcattcacgcggcgaaactacccttgagcagcagccacaacgagtcgtggttctcgacagcggtgaaatcgaccaggttttgagcctcggcgtgactcccgtcggcatcgccagcccgaaagacgcctccagccagcccgcttacctcgaaaatcagctggcagatgtacaaactgtgggcaccacgagtgagctcaatttcgaagccatcgccgccctcaagcctgacctgattctgggcagcaagctgcgcgtcgacgaatcctacgatcagctctcccaaatcgcaccaaccgtgctgagtattcgccccggattcccctggaaggaaaacttcctcctcaccgccgacgcgctcggtctcgagggcaaagccgtcgaggttctcaacgagtaccaaacccatgtcgatgcagtccgcgagaccatcgacggcagcccagaaatctcactcgtccgcttcatgcctggtcgcacccgcctgtacggaaacctctctttcatcggtgcaatccttaaggacctggggctttctcgcccagagatccaaaatatcgacgatcttgccgtggagatctcccccgaaaacatcaccgatgccaacggcgactggattttctactccacctacggcaagcccgaggccaccgagcaggacaacattttgtccaacgagctgtggcacaacctccccgccgtccaagaaggtcatgccctggaggtcaatgacgagagctggttcatggggttgggtcctctcggcgccaatgaagtgctcgacgacatcgaaaacatcctcggatcc

SEQ ID NO: 3401 - DNA, 1122 bp, Corynebacterium glutamicum
ttgccagtctttggccataactttctacggttaaaaagttgcattgacctgcaagtttactgctcggccgtcacgggggaatggaaaaagtacgcttggtgttcatatagcgaacccattttctattgcgatgagaggaacaccaccatgcgcgcaatcactcacaacactttcggcgaccccgccgacgtcctacagattaccgagaaggaaattcccactcccggcccaggtcaggttcgtattcaagtgacgctggcaaccatccacaaccatgatttgtggaccgtgaagggctcttacggcttcgtcccagatctgccggccgccgcaggcaccgaggcagtcggcatcgtcgacgccctgggcgagggcgtcgaaggtttgcaggtcggtcagcgtgttgcgtccggcaccagctttggcatctgggcggagtacgcgcttgtcgacgcctccggcctcattcccgtaccagaacagctctccgacgaaagcgcagctcagctcgtcgcaatgcctttcagcgccatcagccttcttgatttcctggatatgaaaccaggggagtggctgatccaaaactccgcaaacggtgccgtcggccgcatgctcgcacagctggcagaatcccgcggcatccatgtcgttggtctcgtccgccgtgacgccggtgtccaagaactcgctgctcaaaacatcagcggcgtcgtttccactgagaccccaggctgggaaaagcaggtcgaagacatcaccggtggcgcaagcatcgccgtcgcacttgattccgtcggtggatcctccgcagctgacctggtgaaactgcttggcgaaggcggcaccctcgtctccttcggcgccatgggcaacccaatcatggaaatcccatccggccccgtcatcttcaagcacatcaccgtcaagggcttctggggaagcaaagtcagccgcgaaatgccagcagagaagaaaacccagttgttcggcgagctcattgcgcgcatacttgatggaacattgacccttccagttgattccacctttgatgccgctgacatcgtctcggccgtgcgcgcctccagcgagcctggccgtgccggaaaagtgctcattcgtttc

SEQ ID NO: 3402 - DNA, 384 bp, Corynebacterium glutamicum
atgatcattatcggagcagttttcgccatcctcgcagttctactgcatgttttcatcttctacatggaatcattcgcatggactagtgagaaagcacgtggagttttcggcaccaccgaaatcgacgccgagaacaccaaggagatggcctacaaccaaggcttctacaacttcttcctggcagtcatcgccggcgtgggtgttgcgttcctcttcgctggttcaactggcatcggcgcagccctcgcactcgctggcaccggttccatgctggcagccgctgcagtgttggctttgagctcacccgacaagcgtggtgcagccttcaagcaaggcacgttcccgctgctcgcagtggtgttccttgtgattggattgctggtt

SEQ ID NO: 3403 - DNA, 219 bp, Corynebacterium glutamicum
ttgttacaattagttatgtctgaaaattcaacaccgattttcaaagtttgtacaacagcggaactccgggctgaacgacaagaactacttgaacggatgcgtccctttaacctggaacagatgcatcgcctctacgatgcagatttattgagcgtggaagaatcagaaatgcttgataactacaggtcattggcttggctcattgacggagaaattttg

SEQ ID NO: 3404 - DNA, 798 bp, Corynebacterium glutamicum
gtggttaattacgcattcgttattgcaggttcagaagctaccggcggcgccggcatccaggttgatttgaagaccttccagcatttagatgtttatggcattggtgccatcacatgcttggtggcctttgatcctaaagacaactggaatcaccgttttgtcccggttgatgcgcaggttatcgctaatcagattgaggccgccaccgcagcgcacgatcttgatgtggtgaagatcggtatgttgggtactcctgcaacgatcgatactgtggcaaccgctttggaggaaaacagcttcaagcacgttgtcctagacccggtactgatctgcaagggccaggagcccggcgcggcacttgatactgacactgcccttcgcgcgaaggtgctgccacaggcaaccgtggttactccaaacaacttcgaggccaccaccctgtctggcctagacaagctggagaccatcgacgacctgaaggaagcagcccgcctcattcatgagcaaggacctcagtacgtcgttgttaagggtggcatcgacttcccaggcgacaacgctgtggacgtacttttcgacggcaccgactaccacgtgttctctgaaccaaagatcggcgacgagcgcgtctccggcgctggctgtaccttcgcagctgtcatcaccgcagagctggccaagggcaactctgccgttgatgcagtgaccaccgctaagcgcgtagtcacccgcgcagtgaaggacgctgtcgcatccaacgcaccgtttacctctgtgtggttggcggaagacaacaag

SEQ ID NO: 3405 - DNA, 345 bp, Corynebacterium glutamicum
atgtcgaaaacgatcatcgtgcgcaccgaaattgaaatccctggacacccaaccgccatccatatcgcagagatgcaggagcttcccccatctgaggctcaaggcggcgtgcagatgtgcaaaatgcagcgcattattgaactagcaggaactgccgaaggggatgtcgttactggtgcaggtgttattggcggatctaatttccagctgaataacgagccaaatgaagtggttccccatccagatacctatgcggatttccccgatatcaaggcggttgttatctccgcggagacttttgaaggcctgtggctggaagcgggagcgaagttccctgggttaaat

SEQ ID NO: 3406 - DNA, 201 bp, Corynebacterium glutamicum
atggctatcaagaactacaccgtcgaaggcatgacttgtggacactgcgtctcctccgtaaaggaagaggtcggagaggttgctggcgtcaccgctgtggacgtcaccctagaaaccggtgccgtgcaggttaccggcgaagacttcaccgacgaggctgtcaaggctgctgtcgttgaggctggctacaaggttgttgca

SEQ ID NO: 3407 - DNA, 345 bp, Corynebacterium glutamicum
atgagtgagtttggcctgccagaaggcgtcacgctgctcaacgtcgccgccgtgttgatccccatcgcgatcatcaccttgctgctgcgcatcttccccttcgccgcgatgaaacgcgtcaacagcaaccaactcatgggagttttggggcgcacaatgccagtcggagtgatggtcgtattggtcatttacacgctctttggccaggtcagtgcgccaggtggtgtgggtgcttcactgatcgcggtggcattcaccgcgctgctgcactggttgaaaggctccgccgggctgtccatcgtcggtggcaccttggcctacatgtttctggtcaacgtcgttttt

SEQ ID NO: 3408 - DNA, 711 bp, Corynebacterium glutamicum
atgagttccgaaaatttaaaagaaattcgcggcggaatcggtgagactttaacggtcggtttggggctgattccgctgggtttggcctttgggctgttgatggtccagacaggtttcgcctggtggtggacgccgattttctccttcgtgatctatgccggttcgatggaatttctggcaatcggcatggtcaccgcaggtatcggcccgttttcggcggcggtcgctggtttcatggtgaatttccgccacattttctacggtctcaccttcccacgccaccgcatcaagtccggcgccggccgcgcctattccacctacgcgcttaccgacgagtcctacgccatcgtgtcagcccgcccacctggcgatatcagtggcacgcgggtgcttaccgttcaaattttgtgccaagctctgtgggttatcccaggaattattggcgccttggttggtcaagtgctgcccgatgatctaaaaggcatggattttgccctgaccgcgctgtttgtggtgctggcgtgggaggcattcaaaaataacaaggattattcgctgccattattcgcggtggtattggctctggtttccggttttgtggcgcccgagcagatgctggttatcgctttgaccacgtactttttgatccttcttctccgcgtccgcttccccaacctggacaagaaactggagatcaggacttcccatgag

SEQ ID NO: 3409 - DNA, 567 bp, Corynebacterium glutamicum
atggagcgcaatgaggtagctccaggcatgttgttggtggctgcgcccgatatggcgtcggaggattttgagcgcagcatcgtgttgatcatcgagcattctcctgccaccacttttggtgtgaacatttcttcacgttccgatgttgctgtggccaatgtgttgcccgagtgggtggacctcacctcgaagccacaggcactgtacatcggtgggccgttgagccagcaggctgtggttggtttgggcgtgaccaagccgggcgtggatattgaaaattccaccagcttcaacaagctcgccaaccgcctggtgcacgtggatctgcgttctgcacctgaagatgtggctgatgatcttgagggcatgcgcttttttgcgggctacgcggagtgggctccgggccagctcaacgaggaaattgagcagggtgattggttcgtcacacctgcgttgccgtcggacattatcgcgccgggccgcgtcgatatttggggcgacgtgatgcgtcgacaagcaatgcctttgccgttgtattccacgtttccgtcggacccttcagataat

SEQ ID NO: 3410 - DNA, 1320 bp, Corynebacterium glutamicum
ttggtgggcggttccgtgagggatgctttcttaggtgagttggggcatgaccttgatttcaccacgtcggcacgccctgaggagacaaaggcgatcctggatgattacgccgatgtggtgtgggataccggaattgcgtttggcaccctttctgcagaaaagcatggtcagcagatcgaaatcacgacattccgttctgatctctatgacggaaactcccgcaaccctgaagtgaccttcggtgacaccttggaaggcgatctgattaggcgcgatttcaaggtcaacgccatggctgtggagatccaagccgatggtgaattaactttccacgatccagtgggtggcttggaagatctacttacccacactttggataccccagctactccggaacaatcattcaatgatgatcctctgcgaatgctgcgcgctgcccgctttgtttcccaactgaatttcacccttgcaccacgagttattaccgccatgactgaaatggcgcagcagattactcggatcactgtggaacgcatgcaggttgagttggacaaaatgatccttggcaaaaaccctgaggctggcattgacctcatggtggagtccggtatcgcgcagattatttatccggagatccctgcgatgcagatgactcaagatgaacacatgcagcacaaggatgtgtacgcgcactcgttgcaggtgatgcgccaagcgattgatcaggaagaagatggccctgacctggtgcttcgttgggctgctctgcttcatgattgcggtaagccagatactcgtgacttcaatgaggaaggccgcgtgagcttccatcagcatgaggtagttggcgccaagctggtgaggcgacggatgcgcaagctgaagtactcaaagcaaatggtcggcgatgtcgggcagttggtgttcctgcacatgcgtttccatggtttcagcgaaggccagtggacggattctgcagtgcgtaggtatgccgcagatgcgggtgaattgctgccacgtttgcacaagttagtgcgtgctgattgcaccacaagaaataaaaggaaggcagcacgactgcaagccacctacgatcatttggaagagcgcatcgcggagatcgccgcaaaggaagatcttgccagggtgcgcccagatttggatggcaatgagatcatggagattctgaacatccaagccggacctgaagtgggtaaggcgtgggcgtttttgaaggagcttcgtttggagcgcggtcctttggatcgtgaagttgccatcgcagagctgaagagctggtgggaaggagaaaacaatgag

SEQ ID NO: 3411 - DNA, 966 bp, Corynebacterium glutamicum
atgagtgacttgaaacccgaggggactactagcggagcgcctaaacgcaggcgccgccgccgttctcgccgtccttcaggtcagaaccaaaacccaaaccaaaacaggcagggacaacaggggcagcaaacccaaaatcagccccaagcccagccacaaagccaacaggcccaaccccaaaagcagaaccagcagggccaaaatcagggccaagcttctgagaaaacctctcagaggccaaagcgccgtcggtcccgcaggaacccgaagagcaacaacacccaacaacacagccaaaacagtcaaaacaaccagaacagccaaaactcccagcaaaacacccaaacccaaacctctcagtcgaataagcagaagtctcaggacaaccgcaggggtaagggtcgtaggtctccaaccaggaggcgttccaacacgagggtgaatcaggcgtggcagcagtcccgtttggttacttctgatgagacttccgcaggtggtctcgtggtgtcaggtttggctgaggcggtcaacgctaacaatgaggttgatctgtcgaagatttatgttgcgttgattggtcgccttgatcgtcgtggtcgtttgttgtggtcgatgccgaagggccatgttgagcctggtgaggataaggctgcgactgctgagcgtgaggtgtgggaggagaccggcatccacggtgaggtgttcactgagttgggtgtgattgattattggttcgtttcggaagggaagcggatccataagacggtgcatcatcatttgttgcgttatgttgatggcgatttgaatgatgaggatccagaagtcactgaggtggcgtggattccggcgaatcagttgattgagcatttggcttttgcggatgagcggaagttggctaggcaggcgcatgatttgttgcctgagtttgctttgaaggaaaaggcggagggaaggtccaccccaagg

SEQ ID NO: 3412 - DNA, 273 bp, Corynebacterium glutamicum
ttgggtttgggtgttttgctgggagttttggctgttctggttgttttgactgttttggctgtgttgttgggtgttgttgctcttcgggttcctgcgggaccgacggcgctttggcctctgagaggttttctcagaagcttggccctgattttggccctgctggttctgcttttggggttgggcctgttggctttgtggctgggcttggggctgattttgggtttgctgcccctgttgtccctgcctgttttggtttgggttttggttctgacc

SEQ ID NO: 3413 - DNA, 2511 bp, Corynebacterium glutamicum
gtgattccgaaccccaacccgaaccccaaagccaaaactcttcgcctcgtttcagcgctgaccgccatcactgtggtgggttttagcgcttcacctgttcatgcgttgccgattccgttggatccttctgatccggcggtgtcggagttgtgggtgaatccgaatgcgcgggctgatgatgagctttctggtgtggatgtagagatctcggattttgtcatgccgaatagcaatctaactgtgcaggtgggggagtcttttaaggcgcaggttcgggtgactaatcgttcgtcggagacgttgagcaatattacgttgcaggcgcgtcgtgcggaggcgtcgtttgatatggcgagtgctcgggtggcggcgacggataataattatggctacttcggcgcgatggtgactcttgatgatgagttggagccgggggagagtgttgagactgaggtggagatttctaccgatagtttgtcgatttctcagccgggttcttatccgacgatgttggcgttgtcggggcagcttgatggggtggcgcagcatttggattcgcagcgtttccttctgccagtcctcagcgatacaactgatacagaagacaccgccacccccacgacgatgatttacccgatatcagcccagacgaatgtgttgggtggtgagaccggcgaggcgccggaagagccgcctttgctggtcagttccgacgcgcttgcgggcgagttggatgagggcggtcgtttgcaaaagcttatcgacgcctacctccagtcttcacccgccgtgcagcaagccacgtgccttgctattgatccgcagcttcttgatgtggtggatcgcatgaccggcggttacaccgtgaccgatactcgtcccagtacggtgcggcagaatcagcggcttcgtgagttgtggactgccgataatcaacccaccaatggtgtcgcgggcacgggtgcggaaaacgctgccattttcttggagaaactccgacaggccacagccacctcgtgcaccgtggcgttgccgtgggcgaatgctgatctaaatgcagtgagccaaaccggtaatcagtggttgatgcgcgaggcgctacagcgaggtgtcaccacctttgaagaagtgttgggtgttattccggaatccaatgtggtgattcctggaaatggttttgtggagccctccaccgtgggtgatctcggatgggcggaagtaacgcttaatccggatcaggcgtgggaggtgcagtcagaggagttggttgctgcccctgatgccacagagcaaagcgcattggataaccctaagccaacgccaggcacggtgacgccgccaacccctatgtcaacggtgtccgtgttggtttctgataacacggtgtggcgcacaacgagcgcggatcggttccactctttggctccgggaataactggggtgtcgtatcagggatcgttatcggcaaccttggctaccttgggacaaaaccctgagactgtgggctattccaatccggattcgcgttatgactacgccatggattctgagagcgcccgcaatctcaccggccaggcggcgctgcgcttgacggtggacaacggcgatgaagactctcccgtgttgatcatgccgagcgcggtgctgggcgccgaagacggcgcgatgttgcttgagaccaccggggctttgcttgccgacggctccgcccgacctttttccctgcagcaatatgtcactgccaatgcggaacaaagaaatactttggccacagcaacaactccaccggatgacactgcttttggtgcaccctacgacgatcctgcgtcattgacggaaaccgaaattctgcgaaccactcagcaggcggagtacatcgatgatctcactggcatcatgtccaatgatcccagcattgcactgacccgttatgggtttacagcaccgctgcggcaagatctgctgcgcgcgttgagtatcagtgagcgtcgttcgttagctcgccacacccaggcaacctctgctgccgataaattacttaatcgcaaccgcgatactctgcagaagctgcgtagctctgtggcgttgttgccgccgggaaatgtgtatacccgaacctcggaatcgtctccgttgttgattgtggcgcaaaacggtttgccattgcccgcggagactcagattttgtattccggaaatcaggatgcgcacatcaatactccgggtgtggttcgtattccggcgcagggttccatcaccttgcagatgactgcggatttgcccgatgacaatctgcgcactgatctcacgttgtggttggcatccccagatggggccaccattagtgaacctgtggaaattactgtccagcctcgcccgaatttgggcaccacgctgtttttcgtggcagcgggcattctggcagtaggagggttgttgtttatacggaagaaacgaaacgtcgaaaagcgctcgcccggtacgggatcgcccaaaccgccaccaacccac

SEQ ID NO: 3414 - DNA, 3249 bp, Corynebacterium glutamicum
gtgcccgaggcgcgcaagaaggctgtcgcacgcacggatggtgatcgctcgagtttgaaaaactcgcctacggcatccgccacccaggcagcccagacgcgcccggcagaaccggaaccagaaaagcacacctccgattctgatgtggtgcgctcgactggctccatggcaatagccacgctgctgagtcgtatcaccggtttcctgcgcaccgtgatgattggtgcggcgctgtcgccggccatcgcttcggcgttcaacactgccaacacgctgcccaacctgatcactgaaatcgtgttgggtgcggtgctgacatcgctggttattccggtccttacccgcgcggaaaaagaagacgccgacggcggttccgggttcttcaggcggctgctcaccctgtcggtgacgctgctgggtggtgtcaccatcctgtcgattatcggcgcgccgctgctgacacggatgatgctgtcctctgagggacaagtcaacgtggtcatgtccacggcctttgcgtattggctgctgccacagattttcttctacggcctgtttgccctgttcatggctgtgttgaacacccgtgaagtgttcaaacccggcgcgtgggcacctgttgtcaacaatgtgatcaccttgaccgtgctgggcgtgtacatggtgctgcctgcgcgtttgcacccgcatgagcaggtgggcatttttgatccgcagatcattttcctcggcgtgggcaccacccttggtgtggttgcacagtgtctaatcatgattccgtacctgcgtcgcgcgggcattgatatgcgccctctgtggggtatcgatgcgcgtttgaagcaattcggtggcatggcgatggcgatcatcgtgtacgtggcaatctcccagttcggttacatcatcaccactcgcattgcgtcgattgcagacgatgctgcgccgtttatttatcagcagcactggatgttgctgcaagttccttatggcatcatcggcgtcaccttgctcaccgcgattatgccgcgactgtcccgcaacgcggcagacggcgatgatagggcagtagtctctgaccttcagttgggttccaagctaaccttcatcgcactgatccccatcgtggtgttcttcaccgccttcggtgtccctattgccaatggcctttttgcctacggccaattcgatgccaacgccgccaacatccttggttggactctgagcttctctgctttcacgctgattccttacgctttggtgctgctacatctgcgtgtgttttatgcgcgtgaagaggtctggaccccaaccttcatcatcgccggcatcaccgccaccaaggtcgtgctttccctgttggcaccgctgctgtcgagctccccggagcgtgtggtggtgcttcttggtgcggccaacggtttcagtttcatcaccggcgcggtcatcggcgcgtatctgttgcgcaacaaactcggcctgttgggtatgcgctctttggctaaaacctccctgtgggcgttgggctctgcggcggttggtgcagcagcagcatgggcgttggggtggctgattcaagccgtcgtgggcgatttcttgctgggcactctaagctccgtaggctacttgttgtacctggctgtgttgggtgtcttcttcatcttcgtcaccggcatcgtgttgtcacgttctggtttgccggaggtccaaaacttgggccaggcactgacccgcatcccaggtttgagccggtttattcgcccgaataccaagatctctttggatgtcggcgaagtctccgagcaggatttctccacccagctggtcgcgccaagcgagttcgcagcaacccctgtgccgccaccgatgtccgccggtattgtccgcggacctcgcctggttcccggcgccccagtcggcgacggtcgtttccgtctgctcgccgatcacggcggcgtccaaggcgcgcgtttctggcaggcccgcgagatcgccaccggcaaggaagtcgcgctgatctttgtggatacttccggcaacgccccatttgcgccactgtcttcggcagccgcagcgggcatcgcctacgaggtgcagcgccgcaccaagaagctggccagcttgggcagcttggcggtagcccccaacatccactccgaggcgtaccgcaacggttgcctcattgtggccgattgggtgcctggctccagcttgagcgccgtcgcggaatccggtgccgatccccgcgccgccgcgttcgcgctcgcggaactaactgaaaccatcggcgaggcccacgagatgggtatcccggccggcttggacaacaagtgccgcatccgcatcaacaccgacggccatgccgtcctcgccttcccggcgattttgcccgatgcctcagagctccgcgacgccaagtccctggcctcggccgccgagatgcttatcgacgcgaccctcgctcccagcgacgtcaaggcaatggtcactgaagcccaggggctagctacagaagacaatcccgattacgcatcacttgccatggcgatgcgcacctgcggactgttcaccgaggaaccaacccaccttgtggtgaagaaggaaaagacaccaaagcctgcgacacgtgatggtttcggtgcctccgactacaccgtcaagggcatggcagccatcgccgctgtggtgatcatcttggtttccctggtggccgccggtaccgcgttcctcaccagcttcttcggcagcagcaccaacgaacaatccccgttggcctctgttgaagccaccacctctgcaacaccagaacctgtggggccaccggtctacctggatctggatcaagcccgcacgtgggatgacggtgcaggaacagatgtcaccgacgtcaccgacggcaacacctccaccgcatggacctccaccggcggcgacggcctcctagttgacctgtccacgcctgcccgcctcgaccgcgtcatcttgaccaccggcaccggctccgacagcaacgtgacctcgaccgtgaagatctacgcattcaacgacgcctcaccacactccctgtcggaaggcatcgagatcggcaccgtggattattccggccgcagtctcagccacagcatccgcgattcctccaagcttccgggtcaggtggaatccgtggtgattctggtcgatgaggttcgttcctcacaaacctcagacaccaatccacagatgcagatcgctgaagtacaacttgttggttgg

SEQ ID NO: 3415 - DNA, 723 bp, Corynebacterium glutamicum
atgggcgttggggtggctgattcaagccgtcgtgggcgatttcttgctgggcactctaagctccgtaggctacttgttgtacctggctgtgttgggtgtcttcttcatcttcgtcaccggcatcgtgttgtcacgttctggtttgccggaggtccaaaacttgggccaggcactgacccgcatcccaggtttgagccggtttattcgcccgaataccaagatctctttggatgtcggcgaagtctccgagcaggatttctccacccagctggtcgcgccaagcgagttcgcagcaacccctgtgccgccaccgatgtccgccggtattgtccgcggacctcgcctggttcccggcgccccagtcggcgacggtcgtttccgtctgctcgccgatcacggcggcgtccaaggcgcgcgtttctggcaggcccgcgagatcgccaccggcaaggaagtcgcgctgatctttgtggatacttccggcaacgccccatttgcgccactgtcttcggcagccgcagcgggcatcgcctacgaggtgcagcgccgcaccaagaagctggccagcttgggcagcttggcggtagcccccaacatccactccgaggcgtaccgcaacggttgcctcattgtggccgattgggtgcctggctccagcttgagcgccgtcgcggaatccggtgccgatccccgcgccgccgcgttcgcgctcgcggaactaac

SEQ ID NO: 3416 - DNA, 603 bp, Corynebacterium glutamicum
atgacagtactgcctaaaaaccatgacctaagcgatacccaactcgtcaaacagtttatatctggcgactccagggcattttccaccatcattcaccgccacgaacgacatatgatgcaggcagccagaaaatacgggcggaaaccagaagacgcccaagacattctccaagaagctctctttcgcgccagccgaaacatgcacctttatagagcagaagcagctctcggcacgtggctccacaaacttgtcctgaatagcggcttcgattgggctacccaccgctcccaagtagaattccccatccttaacgaaccaacaatcgatttagaaaaagatcctcgcctagccaccgaccccttgggctacctcgatgtcgccatgacaattcgatccgccatcgaccaattacaccccgatcaacgcatcgccttaatacttgtcgacctcggcggctacaccgtagaagatgtggccgaaatcgaaggaatcaaagtaggtaccgttaaatcacgccgagggcgcgcacgcaaagcgttgcgcgcccttttacatgcagatttcttcgggcccgaagatggctccatacagtgcgaaagcaac

SEQ ID NO: 3417 - DNA, 951 bp, Corynebacterium glutamicum
atgtctgaagaacaatctgccgtagcaccaaagattcatgatgtcgccatcatcggctccggtccagctggctataccgcagcagtatatgcagcccgcgctgacctcaaccccatcatgttcgagggctatgaatacggtggatctttgatgaccactactgacgtggaaaacttcccaggctttgaaaagggaatcctgggcccagagctcatggaaaacatgcgcgctcaggccgagcgtttcggcaccgacatgcacatggagcttgtcgaccgcgttgatctcaccggcgacatcaagaagctgtgggtcggcgacgatgagtaccacgcgcgtgctgtcatcttgtccatgggttctgcacctcgctacttgggtgtgaagggcgagcaggaactgctcggccgcggcgtttctgcatgtgcaacctgcgatggtttcttcttccgcgatcaggacatcgccgtgatcggtggtggcgactccgcgatggaggaagcaaccttcctcaccaagttcgctcgcagtgtcaccatcgtgcaccgccgcgaagagttccgcgccagcgccatcatgctggagcgtgctcagaagaacgagaagattcgcttcgtcaccaacaagactgtcgaagaggtcatcgaggcagacggcaaggtcagcggtctgaagctcaacgacaccgtcactggtgaagattccgtcttggatgtcaccgccatgttcgttgccatcggccatgatccacgctctgaaatcctcgcaggtcaggtcgaggttgatccttccaactacgttttggttcaggagccttccacccgcaccaaccttgatggtgttttcgctgctggcgacctggtggacagccactaccagcaggccatcaccgcagctggttccggttgccgcgcagcgatcgatgcagagcattacctagcttctctggcc

SEQ ID NO: 3418 - DNA, 1185 bp, Corynebacterium glutamicum
atgctctgcatcgatcgctgcgcggcaaccggaaccagctgcggtgatggcctgctggtagtggctgtccaccaggtcgccagcagcgaaaacaccatcaaggttggtgcgggtggaaggctcctgaaccaaaacgtagttggaaggatcaacctcgacctgacctgcgaggatttcagagcgtggatcatggccgatggcaacgaacatggcggtgacatccaagacggaatcttcaccagtgacggtgtcgttgagcttcagaccgctgaccttgccgtctgcctcgatgacctcttcgacagtcttgttggtgacgaagcgaatcttctcgttcttctgagcacgctccagcatgatggcgctggcgcggaactcttcgcggcggtgcacgatggtgacactgcgagcgaacttggtgaggaaggttgcttcctccatcgcggagtcgccaccaccgatcacggcgatgtcctgatcgcggaagaagaaaccatcgcaggttgcacatgcagaaacgccgcggccgagcagttcctgctcgcccttcacacccaagtagcgaggtgcagaacccatggacaagatgacagcacgcgcgtggtactcatcgtcgccgacccacagcttcttgatgtcgccggtgagatcaacgcggtcgacaagctccatgtgcatgtcggtgccgaaacgctcggcctgagcgcgcatgttttccatgagctctgggcccaggattcccttttcaaagcctgggaagttttccacgtcagtagtggtcatcaaagatccaccgtattcatagccctcgaacatgatggggttgaggtcagcgcgggctgcatatactgctgcggtatagccagctggaccggagccgatgatggcgacatcatgaatctttggtgctacggcagattgttcttcagacattgtttccctcaaagtagtaaacgtaaaagtgcagcatcacgtgcaccattcaccctagttgtgaactcaccgttttcaacgtcagacactttgaaaaacttccatcagttgctttcgcactgtatggagccatcttcgggcccgaagaaatctgcatgtaaaagggcgcgcaacgctttgcgtgcgcgccctcggcgtgatttaacggtacctactttgattccttcgatttcggccacatcttctacggtg

SEQ ID NO: 3419 - DNA, 372 bp, Corynebacterium glutamicum
atgaatgtcggattccccaggagtcccgtcattgttaatttaggagaaaccatgagcaatgttgttgcagtaaccgagcagaccttcaagtccaccgtcatcgattccgacaagccagtcatcgttgacttctgggcagaatggtgtggcccctgcaagaagctcagccccatcattgaggaaatcgcaggcgagtacggcgacaaggcagtcgttgccagcgtcgacgtcgatgcagagcgtaccttgggtgccatgttccagattatgtcgattccttctgttctcattttcaaaaatggtgcaaaagtcgaggaatttgtcggtctgcgccccaagaacgaaattgtggaaaaactagagaagcacctc

SEQ ID NO: 3420 - DNA, 1242 bp, Corynebacterium glutamicum
gtggatgaactatatccattgataattttgaacatgaatgatggaaggagcagggtgtctaaagtcctgagagttggcgatcgcagcccgcgcgtggcagaagtgcgcactacgctcgctcgcctcggtgtgattgaaggctattccagggagatgtctgcaaagacagaatcccagaagttccacgaagaagagacgcttttcgacgaagaactcagcctcagcatcaagtcattccagcaagctcgaggagtcgttccctccgggcttattgacgaccccaccctgcgcgcaatccgcgaagcctcctacaccctgggaacccgcgtgctggcctaccagcccggcaaccagcttgttggtgacgacgttgtagaaatccaatcccatctccaagagctcggcttctacgccgaccgtgtggatggacattttggcgagctcacacacaaagctgtgatgaactaccaactcaactacggcatgcaggtagacggcatctgtggccctgacaccatccgtgcgctgtcccgacttggtctgcgcatcaagggtggctctgctcaagctatccgtgaacgcgaacgcatgcgcaatgcaggcccacgtcttgctggcaagcgtgtggtcattgatcctgcgcttgggggctccaacaagggtcagatcgtgaaaggcccctacggtgagatctctgaggaagaaatcctctgggatttggccacccgcctggaaggtcgcatgatcgcaacaggcatggaaaccattctgtcgcgcccgcacatggatgatcccagcagccgtgatcgcgcgtcgatcgcgaatgctttcggcgctgacctcatgctgagcctgcactgcgattcctacccgaatgaaaaagctaacggcgtggccagcttctacttcggttcggaaaacggcaccaactccttgaccggtgaaacgctctccgcgtacatccaaaaagagatcgttgcccgcaccccactgaacaactgtggcagccatgcccgtacctgggatctgctgcgcctcacgcgcatgcccatggtggaagttgtcaccggttacctcaccaaccccgatgacctggcagttctgactgatccacaaatgcgtgatcacattgccgaagccatcgttgtcgccgtcaagcgcctgtacctccttgatgaggaagcacagcccaagaccggaaccttcaagttctctgagctgttgcaatcagagcaggctggc

SEQ ID NO: 3421 - DNA, 777 bp, Corynebacterium glutamicum
atggctgccacagttgttcagtggggtgcgggcaacgatctctttttggatgtacgcggagagcgtttcaccggtcaaggagttggtgccgttttccgaaccgaagtagaagctggccacgccgttagctttttcattcgggtaggaatcgcagtgcaggctcagcatgaggtcagcgccgaaagcattcgcgatcgacgcgcgatcacggctgctgggatcatccatgtgcgggcgcgacagaatggtttccatgcctgttgcgatcatgcgaccttccaggcgggtggccaaatcccagaggatttcttcctcagagatctcaccgtaggggcctttcacgatctgacccttgttggagcccccaagcgcaggatcaatgaccacacgcttgccagcaagacgtgggcctgcattgcgcatgcgttcgcgttcacggatagcttgagcagagccacccttgatgcgcagaccaagtcgggacagcgcacggatggtgtcagggccacagatgccgtctacctgcatgccgtagttgagttggtagttcatcacagctttgtgtgtgagctcgccaaaatgtccatccacacggtcggcgtagaagccgagctcttggagatgggattggatttctacaacgtcgtcaccaacaagctggttgccgggctggtaggccagcacgcgggttcccagggtgtaggaggcttcgcggattgcgcgcagggtggggtcgtcaataagcccggagggaacgactcctcgagcttgctggaa

SEQ ID NO: 3422 - DNA, 1041 bp, Corynebacterium glutamicum
atgttgaaaccgcaggattcatattccagcagcgtggtggacagccaggcttccttctcaaacaccggatcagctttagctgcaacctcaggtgcgagctcccaaaacaccgacttgcgggcctgggggtgcaggaaatctatgtgttcctgcacgatcgggaaaagggaagcctggagcatggcgccaaacttaaaattattggccctggatcaaggacatgatgcgctcgaaatcatccttgtcgccgaattccaccacgagcttgcccttcttcttacccatcatcaccgagaccttggtatccaaattatccgccaaggactcagccgcacgggtaaagacctcaggagttgcagccttttcgcgtggcttcttctcctcatcctgatcaccacggttgtgcagcagcaccaattcctcagtagcacgcacagacaggccctcagcgatgattcgggtcgccagggtgtcctgagcatcctcgccggccttgagccccagcaatgcgcgtgcatggcctgcagacagcacaccggctgccaccttggtctgcacgttgactggaaggcccagcagacgaatcatattggtgattaccggacgggaacggcccagcttatcggccagctctgcctgggtgacaccgaactcctccagcaactgctggtaggcggctgcctcttccaaaggattcagctgcaccctgtggatattttccaaaagggcgtcgcgcagcatcgcgctgtcttcagtttcacggacaatcgccgggataacctcaaggccagctcgcttggatgcacgccaacgacgctcacccatgatgagctcatagccatcctcggacctgcgcaccacgatcggctgcatgaggccgaactcgctgatcgaatgcaccaactcgtcaagtgcctgcggatcaaactcatggcgaggctgctgcgggttggggcggatctgctcgatcgggatctcaaggtaggatgcgccgaactcagactgctgtgctggctgtgcctgcggcgcttcctgctgtgc

SEQ ID NO: 3423 - DNA, 618 bp, Corynebacterium glutamicum
atgctccaggcttcccttttcccgatcgtgcaggaacacatagatttcctgcacccccaggcccgcaagtcggtgttttgggagctcgcacctgaggttgcagctaaagctgatccggtgtttgagaaggaagcctggctgtccaccacgctgctggaatatgaatcctgcggtttcaacattggttaccgcaatggaactccggcgttggcgtcggtcattttctgcgagcgcgatgccgccccgggcgcgaaggcgctgcctacggcaccggtgtctagcgacgctgcgatcatcagcagcctgttcatcgacgaggttttccggggcacgggcatggaatcggcgcttctcgacgcttccctcatggaactcattcggcgcgactacccagccgttgaggcgtttggataccgctcggaaaacacagaagcggatgcgatcgcagctaggcgtttagaaatcggcctgattgatgtggaggcgttagaatcagccggtttcgaagtggttgctgaccatcccgtgttaccccgtctgcggatggaattaccacccgcaacggtgctgctcacagctaaggatgcccagcgactccttcaagagatgggcgcgatt

SEQ ID NO: 3424 - DNA, 1152 bp, Corynebacterium glutamicum
gtgcgtctaagagcgatggctcagaacaagggttccgacaagtcccagacggaaaagcgtaagggcggtctggggcgcggtctggccgcacttattccctcaggaccaagtaattccccaggtcttggtggcggtgcggctgacatcattttgggcggtaccgtgggtgcgcgtactgctgcagctcccaagcgtgagtccacaccagcagctcctgcacctgaggctcctgcgcaggccgctccacaacacactgaggccacaaagccagaggtagttccagagccagcagctcctgctccaacgcagtcagcacagcaggaagcgccgcaggcacagccagcacagcagtctgagttcggcgcatcctaccttgagatcccgatcgagcagatccgccccaacccgcagcagcctcgccatgagtttgatccgcaggcacttgacgagttggtgcattcgatcagcgagttcggcctcatgcagccgatcgtggtgcgcaggtccgaggatggctatgagctcatcatgggtgagcgtcgttggcgtgcatccaagcgagctggccttgaggttatcccggcgattgtccgtgaaactgaagacagcgcgatgctgcgcgacgcccttttggaaaatatccacagggtgcagctgaatcctttggaagaggcagccgcctaccagcagttgctggaggagttcggtgtcacccaggcagagctggccgataagctgggccgttcccgtccggtaatcaccaatatgattcgtctgctgggccttccagtcaacgtgcagaccaaggtggcagccggtgtgctgtctgcaggccatgcacgcgcattgctggggctcaaggccggcgaggatgctcaggacaccctggcgacccgaatcatcgctgagggcctgtctgtgcgtgctactgaggaattggtgctgctgcacaaccgtggtgatcaggatgaggagaagaagccacgcgaaaaggctgcaactcctgaggtctttacccgtgcggctgagtccttggcggataatttggataccaaggtctcggtgatgatgggtaagaagaagggcaagctcgtggtggaattcggcgacaaggatgatttcgagcgcatcatgtccttgatccagggccaa

SEQ ID NO: 3425 - DNA, 837 bp, Corynebacterium glutamicum
ttgccgaaacctaaagaaccacgcctaattaccatcgccaaccaaaaaggcggcgttggtaaaaccacctccacggtgaatttggctgcgtctttagcaattcatgggcttaaagttctcgtcgtggatttggatccgcagggaaatgcgtcgacagcgttgggtgtcgagcaccgctctggcaccttgtcatcttatgaactactgatcggtgaatgcactgctgatgaagcaatgcagccatccacagctaacgaaaacctcttctgcattccagcaaccctggatcttgctggcgcagaaattgaattggtcagcttggtccgccgcgaataccgtttggcggatgcgttgggccgtgagttcattgacaagcacgattttgattacatgatcattgactgcccaccgtctttgggtctgctcaccattaacgccatgaccgcggtgaatgaagtgctcattccgatccagtgtgagtactacgctctggagggcgtgggccagctactgaacaacatcactatgttgcgtcagcacctgaaccgccagctgcatatttccgcgatcttgctgaccatgtatgacgcccgcaccaacctcgcagaacaggtggccacagaggttaatgatcacttcggtgacgtggtgttgggtaacaagattccacgttcagtgaaggtgtctgaagctcctggctatgggcagactgtcattgaatatgatccaggttccaggggcgccatggcgtatttggatgctgctaaagaattggccactcgtggcgattacttgcctagcgatgaatccggtccgatcggcctaaaacctgcgaaa

SEQ ID NO: 3426 - DNA, 669 bp, Corynebacterium glutamicum
gtgttgtaccgctcgatatcttgcccgaaggggacttttttcatgaccacgcctccagcagccgctgaaattttcggggacaacctcgaaaaagccattgcatatcatgaatctttggcaacagatggatccgtccgcggattcatcggcccccgtgaagttccccgcctgtgggatcgccacattctaaactgtggtgtcatcggcgaagctatggatgagggcatctctgttgcagatattggttctggtgcgggactgccaggaattcctcttgctatcgcacgcccagatctcaacatcactctcattgagccattgctcaagcgttcggtgtacctcaacgaggtaaaagaagccctgaacttggacaatgtcaccgtcgttcgtggtcgtgctgaggaaaaagtggtgcgcaagcaggtcggattggtcgatattgtcacctcccgagctgttgctccactgggcaagctagcgacctggtcgttgccgctggtgaaaatcggtggacgcatggtggccatgaaaggctccagcgttgaggaagaaattgagcgtgacgccaaggaaatccgcaaggctggcggcactgacattaaggtttataccgtgggtgaggcgctgttgagcgagcccacaacacttatttcaatccgcagggaaaag

SEQ ID NO: 3427 - DNA, 951 bp, Corynebacterium glutamicum
gtgctcaatttcatttattggccaatttcggccattctgtggttctggcataaagcgttcagctttgtgctgagcccagattccggaattacctgggccttgtcgatcatgttcttgaccttcaccgtgcgtatggttctggtcaagccgatggtcaacaccatgcgttcacagcgcaagatgcaagacatggctccaaagatgcaggccatccgcgagaagtacaaaaatgaccagcagaagatgatggaggagacccgcaaacttcaaaaagaagtgggcgttaaccccatcgcaggctgtttgccaatgttggtgcagatcccagtgttcctgggtctgttccacgtgctgcgctccttcaaccgcaccggttctggcgttggccagctggaaatgaccgttgagcaaaacgcgaacaccccgaactacatcttcggtgtcgacgaggttcagtccttcctgcgtgcagacctgttcggtgcgccactgtcgtcctacatcaccatgcctgctgacgcgttcgacgcgttccttggcctggatgtctcccgcctcaacatcgcgctggttgcagctccaatgattttgatcattgtcgtggcaactcacatgaacgcgcgtctgtccgtcaaccgccaggaagctcgcaaggcagccggcaagcagcaggccgcttccagcgatcagatggccatgcagatgcaaatgatgaacaagatgatgctctggttcatgccagccaccattttgttcaccggcttcatctggaccatcggtcttcttgtctacatgatgtccaacaacgtgtggaccttcttccagcagcgctacatcttcgccaagatggacgctgaggaagcagctgaggaggaggaaaagcgcgcagcaaagcgcactaccgctccaaagcctggcgtgaagccagaaaaccccaagaagcgtaagaag

SEQ ID NO: 3428 - DNA, 399 bp, Corynebacterium glutamicum
gtgcttccagcgcaacataagctgaactcttccatgcaatttcgcacggtgatgaggaaagggcgtcgcgctggcagtaaaactgtcgttgtgcacctgtgggatagtgccgaatcgttggatggcaccgaaaaacagggcgaagtcgcctcattcggtggtccgcggttcggccttgtcgtttctaaggccgtcggaaatgcggtggttcgtcaccgcacctcccgacggcttcgtcatatctgtgcaagcattgcagaaaaatcaccagagctactctcccccactcatcacgtggtgatccgcgcgttggcgggggctgggaatgcaacctcggcggaacttgaacgagacatccgctacgggttggggaaagctagccgtgtgcgcaccaacaag

SEQ ID NO: 3429 - DNA, 336 bp, Corynebacterium glutamicum
atgtgcttgagagcaacactttccataaagcgttgctgcggtttcattcacgaatctgcaatctcaaaaaaaatcatccaacgttgggtgatccgttcccccggtatagggctagcgcggaaatcttcgcgcactttgtccactagaaccggtgtgtccggtgatccgtcaacaaaatatttaggagtgtttcacatggcaaagggcaagcggacgttccagccgaacaaccgtcgtcgtgcacgtgttcacggtttccgtcttcgtatgcgtacccgtgcaggtcgtgcaattgttgcggctcgtcgtcgcaagggtcgcgcaaagctgaccgcg

SEQ ID NO: 3430 - DNA, 294 bp, Corynebacterium glutamicum
ttgcacacagcatcaacagcctgtgaaaacttcaacctgtggataacaggtaatgttcaccttgagatcaagggaaacattcaaataactgcaggtgagagcgaatttgaggttgatgcacattttccacaggtagtgcgctatcctgtggataaacgtttttgggaaaagttatccacagctgtggacaacattgtggaaacaatggttatgggcgtttttcgatgtgaatggagctgtagaaacatcgagaacgcccacgtggataacaaagcggaattttgccctgctttt

SEQ ID NO: 3431 - DNA, 222 bp, Corynebacterium glutamicum
ttgatgctgtgtgcaattttcattgttacccgcagttcaatccacatgtccaacccctgtgaattctttgccgagtggagtttgccggagggtggcgtcgaaaagcgtttggacgggcgatatgccctctcaccagtgtttaatgccagctttgtaattacgggtgcccccgccgaattgccaaaggacagatttgttttcgcaggtcgttttcccgtaagc

SEQ ID NO: 3432 - DNA, 408 bp, Corynebacterium glutamicum
atgctgcgcaccatcctcggaagtaagattcaccgagccactgtcactcaagctgatctagattatgttggctctgtaaccatcgacgccgacctggttcacgccgccggattgatcgaaggcgaaaaagttgccatcgtagacatcaccaacggcgctcgtctggaaacttatgtcattgtgggcgacgccggaacgggcaatatttgcatcaatggtgccgctgcacaccttattaatcctggcgatcttgtgatcatcatgagctaccttcaggcaactgatgcggaagccaaggcgtatgagccaaagattgtgcacgtggacgccgacaaccgcatcgttgcgctcggcaacgatcttgcggaagcactacctggatccgggcttttgacgtcgagaagcatt

SEQ ID NO: 3433 - DNA, 1848 bp, Corynebacterium glutamicum
atgtctcctaacgatgcattcatctccgcacctgccaagatcgaaaccccagttgggcctcgcaacgaaggccagccagcatggaataagcagcgtggctcctcaatgccagttaaccgctacatgcctttcgaggttgaggtagaagatatttctctgccggaccgcacttggccagataaaaaaatcaccgttgcacctcagtggtgtgctgttgacctgcgtgacggcaaccaggctctgattgatccgatgtctcctgagcgtaagcgccgcatgtttgagctgctggttcagatgggcttcaaagaaatcgaggtcggtttcccttcagcttcccagactgattttgatttcgttcgtgagatcatcgaaaagggcatgatccctgacgatgtcaccattcaggttctggttcaggctcgtgagcacctgattcgccgtacttttgaagcttgcgaaggcgcaaaaaacgttatcgtgcacttctacaactccacctccatcctgcagcgcaacgtggtgttccgcatggacaaggtgcaggtgaagaagctggctaccgatgccgctgaactaatcaagaccatcgctcaggattacccagacaccaactggcgctggcagtactcccctgagtccttcaccggcactgaggttgagtacgccaaggaagttgtggacgcagttgttgaggtcatggatccaactcctgagaacccaatgatcatcaacctgccttccaccgttgagatgatcacccctaacgtttacgcagactccattgaatggatgcaccgcaatctaaaccgtcgtgattccattatcctgtccctgcacccgcacaatgaccgtggcaccggcgttggcgcagctgagctgggctacatggctggcgctgaccgcatcgaaggctgcctgttcggcaacggcgagcgcaccggcaacgtctgcctggtcaccctggcactgaacatgctgacccagggcgttgaccctcagctggacttcaccgatatacgccagatccgcagcaccgttgaatactgcaaccagctgcgcgttcctgagcgccacccatacggcggtgacctggtcttcaccgctttctccggttcccaccaggacgctgtgaacaagggtctggacgccatggctgccaaggttcagccaggtgctagctccactgaagtttcttgggagcagctgcgcgacaccgaatgggaggttccttacctgcctatcgatccaaaggatgtcggtcgcgactacgaggctgttatccgcgtgaactcccagtccggcaagggcggcgttgcttacatcatgaagaccgatcacggtctgcagatccctcgctccatgcaggttgagttctccaccgttgtccagaacgtcaccgacgctgagggcggcgaggtcaactccaaggcaatgtgggatatcttcgccaccgagtacctggagcgcaccgcaccagttgagcagatcgcgctgcgcgtcgagaacgctcagaccgaaaacgaggatgcatccatcaccgccgagctcatccacaacggcaaggacgtcaccgtcgatggccgcggcaacggcccactggccgcttacgccaacgcgctggagaagctgggcatcgacgttgagatccaggaatacaaccagcacgcccgcacctcgggcgacgatgcagaagcagccgcctacgtgctggctgaggtcaacggccgcaaggtctggggcgtcggcatcgctggctccatcacctacgcttcgctgaaggcagtgacctccgccgtaaaccgcgcgctggacgtcaaccacgaggcagtcctggctggcggcgtt

SEQ ID NO: 3434 - DNA, 255 bp, Corynebacterium glutamicum
atggggcaccgtggtcagacaccggatcgcgctccgcaccccaaaagatggctccctaaggagctcacctttactcaatgctctgatgacaccgatgtggtgggcaggcatgagtaccgcgatgctggcatatttcttacaaacagtagcacttggtttcggcaccctcttggtagtgcaaccagtgcttgtcctgtcgctgatgttcacgctgccgctctcagcacgattcaatggctaccgactacgccgaac

SEQ ID NO: 3435 - DNA, 1032 bp, Corynebacterium glutamicum
atgaccaccatcgcagttgttggtgcaaccggccaggtcggccaggttatgcgcacccttttggaagagcgcaatttcccagctgacactgttcgtttctttgcttccccacgttccgcaggccgtaagattgaattccgtggcacggaaatcgaggtagaagacattactcaggcaaccgaggagtccctcaaggacatcgacgttgcgttgttctccgctggaggcaccgcttccaagcagtacgctccactgttcgctgctgcaggcgcgactgttgtggataactcttctgcttggcgcaaggacgacgaggttccactaatcgtctctgaggtgaacccttccgacaaggattccctggtcaagggcattattgcgaaccctaactgcaccaccatggctgcgatgccagtgctgaagccacttcacgatgccgctggtcttgtaaagcttcacgtttcctcttaccaggctgtttccggttctggtcttgcaggtgtggaaaccttggcaaagcaggttgctgcagttggagaccacaacgttgagttcgtccatgatggacaggctgctgacgcaggcgatgtcggaccttatgtttcaccaatcgcttacaacgtgctgccattcgccggaaacctcgtcgatgacggcaccttcgaaaccgatgaagagcagaagctgcgcaacgaatcccgcaagattctcggtctcccagacctcaaggtctcaggcacctgcgtccgcgtgccggttttcaccggccacacgctgaccattcacgccgaattcgacaaggcaatcaccgtggaccaggcgcaggagatcttgggtgccgcttcaggcgtcaagcttgtcgacgtcccaaccccacttgcagctgccggcattgacgaatccctcgttggacgcatccgtcaggactccactgtcgacgataaccgcggtctggttctcgtcgtatctggcgacaacctccgcaagggtgctgcgctaaacaccatccagatcgctgagctgctggttaag

SEQ ID NO: 3436 - DNA, 447 bp, Corynebacterium glutamicum
atggaacctaaaatgcctggaaaaattctcctcctcaacggcccaaacctgaacatgctgggcaaacgcgagcctgacatttacggacacgacaccttggaagacgtcgtcgcgctggcaaccgctgaggctgcgaagcacggccttgaggttgaggcgctgcagagcaatcacgaaggtgagctaatcgatgcgctgcacaacgctcgcggcacccacatcggttgcgtgattaaccccggcggcctgactcacacttcggtggcgcttttggatgctgtgaaggcgtctgagcttcctaccgttgaggtgcacatttccaatccgcatgcccgtgaagagttccgccaccattcttacatttccctcgccgcggtctccgttatcgctggcgctggcatccagggttaccgtttcgcggtcgatatcctggcaaatctcaaaaag

SEQ ID NO: 3437 - DNA, 1188 bp, Corynebacterium glutamicum
gtggcaaaggcgaagttcgagcgtaccaagccccacgtaaacatcggcaccatcggtcacgttgaccacggtaagaccaccaccaccgcggctatcaccaaggttctggctgacacttaccctgagctcaacgaggctttcgccttcgactccatcgataaggctcctgaggagaaggagcgtggcatcacgatcaacatctcccacgttgagtaccagactgaaaagcgccactacgcacacgttgacgctccaggccacgccgactacatcaagaacatgattaccggcgctgctcagatggacggcgcaatcctcgttgttgctgctaccgacggcccaatgcctcagacccgtgagcacgttcttcttgctcgccaggttggcgttccttacatcctcgttgctcttaacaagtgcgacatggttgaggatgaggaaatcatcgagctcgtcgagatggaagttcgtgaacttcttgctgagcaggactacgacgaagaggctccaattgttcacatctccgctctgaaggctcttgagggcgacgagaagtggggcaagcagatccttgagctcatgcaggcttgcgatgacaacatccctgacccagttcgtgagaccgacaagccattcctcatgcctatcgaggacatcttcaccatcaccggtcgtggcaccgttgttaccggtcgtgttgagcgcggtaccctgaacgtgaacgatgatgttgacatcatcggcatcaaggagaagtccacctccaccaccgttaccggtatcgagatgttccgtaagcttcttgactccgctgaggctggcgacaactgtggtctgcttctccgtggtatcaagcgcgaagatgttgagcgtggccaggttatcgttaagccaggcgcttacacccctcacaccgagttcgagggctctgtctacgttctgtccaaggatgaaggtggccgccacaccccattcttcgacaactaccgtcctcagttctacttccgcaccaccgacgttaccggtgttgtgaagcttccagagggcaccgagatggtcatgcctggcgacaacgtcgacatgtccgtcaccctgatccagcctgtcgctatggacgagggcctgcgtttcgctatccgcgaaggctcccgcaccgttggcgctggtcgtgtcaccaagatcatcaag

SEQ ID NO: 3438 - DNA, 1320 bp, Corynebacterium glutamicum
gtgtccgccattattcaggcattcaaggacgccgatctgcgtaagaagattttcttcactatcgcaatgatcgttctataccgcatcggtgcgcagatcccttccccgggagttgactacgcaacgattagtggtcgtctgcgtgacttgactcaggatcagtcaagcgtttattcgctgattaacctgttttccggtggagcgctgttgcagctgtccatttttgctattggtatcatgccgtacatcacggcgtctattatcgtgcagctgctgactgtggttattccacactttgaggagttgaagaaggaaggccagtctggccaggccaagatgatgcagtacaccaggtacttaacggttgctttggcgttgctgcagtcttcaggcattgtcgcgttggcggaccgtgagcagctgcttggcgcaggtattcgtgtgctgtcggctgatcgcaacttcttcgatctcattgttttggtcatcaccatgactgcaggtgcggtgcttgtgatgtggatgggtgagctcatcacggaaaagggcgtgggcaatggtatgtcgttgctgattttcgctggtatcgcaactcgcctcccaactgatggcatgaacattctgggtaactccggcggcgtggttttcgctgttgttctggcttccgttctgatcctggtcattggtgttgtattcgttgagcagggccagcgtcgtattccagtgcagtacgcaaagcgcatggtgggacgtcgccagtacggtggttcttccacttacctgccattgaaggtcaaccaagctggtgttatcccagtgatcttcgcgtcttcgctgatttacatgccagtgctgattactcagatcgtgaactctggttcgctggaagtgtctgataactggtggcagcgcaacatcattgcgcacctgcagacgccttcttcctggcagtacattgttttgtactttgcactgaccatcttcttctcttacttctatgtttccgttcagtatgatccagctgagcaggctgaaaacatgaagaagtacggtggatttatccctggtattcgtccgggccgcccgactgctgagtacttgggattcgtcatgaaccgcctgctgtttgttggttccctgtacctggctgtcattgctgtgctgccaaacattatgctggatctaggtgttgacgccggttcggccggagcaactccattcggcggaaccgcaatcttgattcttgtatctgttgcactgaccacagtgaagcagattgagagccagctcctgcaaagcaactacgaaggacttctaaaa

SEQ ID NO: 3439 - DNA, 2214 bp, Corynebacterium glutamicum
atggctaagatcatctggacccgcaccgacgaagcaccgctgctcgcgacctactcgctgaagccggtcgtcgaggcatttgctgctaccgcgggcattgaggtcgagacccgggacatttcactcgctggacgcatcctcgcccagttcccagagcgcctcaccgaagatcagaaggtaggcaacgcactcgcagaactcggcgagcttgctaagactcctgaagcaaacatcattaagcttccaaacatctccgcttctgttccacagctcaaggctgctattaaggaactgcaggaccagggctacgacatcccagaactgcctgataacgccaccaccgacgaggaaaaagacatcctcgcacgctacaacgctgttaagggttccgctgtgaacccagtgctgcgtgaaggcaactctgaccgccgcgcaccaatcgctgtcaagaactttgttaagaagttcccacaccgcatgggcgagtggtctgcagattccaagaccaacgttgcaaccatggatgcaaacgacttccgccacaacgagaagtccatcatcctcgacgctgctgatgaagttcagatcaagcacatcgcagctgacggcaccgagaccatcctcaaggacagcctcaagcttcttgaaggcgaagttctagacggaaccgttctgtccgcaaaggcactggacgcattccttctcgagcaggtcgctcgcgcaaaggcagaaggtatcctcttctccgcacacctgaaggccaccatgatgaaggtctccgacccaatcatcttcggccacgttgtgcgcgcttacttcgcagacgttttcgcacagtacggtgagcagctgctcgcagctggcctcaacggcgaaaacggcctcgctgcaatcctctccggcttggagtccctggacaacggcgaagaaatcaaggctgcattcgagaagggcttggaagacggcccagacctggccatggttaactccgctcgcggcatcaccaacctgcatgtcccttccgatgtcatcgtggacgcttccatgccagcaatgattcgtacctccggccacatgtggaacaaagacgaccaggagcaggacaccctggcaatcatcccagactcctcctacgctggcgtctaccagaccgttatcgaagactgccgcaagaacggcgcattcgatccaaccaccatgggtaccgtccctaacgttggtctgatggctcagaaggctgaagagtacggctcccatgacaagaccttccgcatcgaagcagacggtgtggttcaggttgtttcctccaacggcgacgttctcatcgagcacgacgttgaggcaaatgacatctggcgtgcatgccaggtcaaggatgccccaatccaggattgggtaaagcttgctgtcacccgctcccgtctctccggaatgcctgcagtgttctggttggatccagagcgcgcacacgaccgcaacctggcttccctcgttgagaagtacctggctgaccacgacaccgagggcctggacatccagatcctctcccctgttgaggcaacccagctctccatcgaccgcatccgccgtggcgaggacaccatctctgtcaccggtaacgttctgcgtgactacaacaccgacctcttcccaatcctggagctgggcacctctgcaaagatgctgtctgtcgttcctttgatggctggcggcggactgttcgagaccggtgctggtggatctgctcctaagcacgtccagcaggttcaggaagaaaaccacctgcgttgggattccctcggtgagttcctcgcactggctgagtccttccgccacgagctcaacaacaacggcaacaccaaggccggcgttctggctgacgctctggacaaggcaactgagaagctgctgaacgaagagaagtccccatcccgcaaggttggcgagatcgacaaccgtggctcccacttctggctgaccaagttctgggctgacgagctcgctgctcagaccgaggacgcagatctggctgctaccttcgcaccagtcgcagaagcactgaacacaggcgctgcagacatcgatgctgcactgctcgcagttcagggtggagcaactgaccttggtggctactactcccctaacgaggagaagctcaccaacatcatgcgcccagtcgcacagttcaacgagatcgttgacgcactgaagaag

SEQ ID NO: 3440 - DNA, 1773 bp, Corynebacterium glutamicum
gtgtcagtcgagactaggaagatcaccaaggttcttgtcgctaaccgtggtgagattgcaatccgcgtgttccgtgcagctcgagatgaaggcatcggatctgtcgccgtctacgcagagccagatgcagatgcaccattcgtgtcatatgcagacgaggcttttgccctcggtggccaaacatccgctgagtcctaccttgtcattgacaagatcatcgatgcggcccgcaagtccggcgccgacgccatccaccccggctacggcttcctcgcagaaaacgctgacttcgcagaagcagtcatcaacgaaggcctgatctggattggaccttcacctgagtccatccgctccctcggcgacaaggtcaccgctcgccacatcgcagataccgccaaggctccaatggctcctggcaccaaggaaccagtaaaagacgcagcagaagttgtggctttcgctgaagaattcggtctcccaatcgccatcaaggcagctttcggtggcggcggacgtggcatgaaggttgcctacaagatggaagaagtcgctgacctcttcgagtccgcaacccgtgaagcaaccgcagcgttcggccgcggcgagtgcttcgtggagcgctacctggacaaggcacgccacgttgaggctcaggtcatcgccgataagcacggcaacgttgttgtcgccggaacccgtgactgctccctgcagcgccgtttccagaagctcgtcgaagaagcaccagcaccattcctcaccgatgaccagcgcgagcgtctccactcctccgcgaaggctatctgtaaggaagctggctactacggtgcaggcaccgttgagtacctcgttggctccgacggcctgatctccttcctcgaggtcaacacccgcctccaggtggaacacccagtcaccgaagagaccaccggcatcgacctggtccgcgaaatgttccgcatcgcagaaggccacgagctctccatcaaggaagatccagctccacgcggccacgcattcgagttccgcatcaacggcgaagacgctggctccaacttcatgcctgcaccaggcaagatcaccagctaccgcgagccacagggcccaggcgtccgcatggactccggtgtcgttgaaggttccgaaatctccggacagttcgactccatgctggcaaagctgatcgtttggggcgacacccgcgagcaggctctccagcgctcccgccgtgcacttgcagagtacgttgtcgagggcatgccaaccgttatcccattccaccagcacatcgtggaaaacccagcattcgtgggcaacgacgaaggcttcgagatctacaccaagtggatcgaagaggtttgggataacccaatcgcaccttacgttgacgcttccgagctcgacgaagatgaggacaagaccccagcacagaaggttgttgtggagatcaacggccgtcgcgttgaggttgcactcccaggcgatctggcactcggtggcaccgctggtcctaagaagaaggccaagaagcgtcgcgcaggtggtgcaaaggctggcgtatccggcgatgcagtggcagctccaatgcagggcactgtcatcaaggtcaacgtcgaagaaggcgctgaagtcaacgaaggcgacaccgttgttgtcctcgaggctatgaagatggaaaaccctgtgaaggctcataagtccggaaccgtaaccggccttactgtcgctgcaggcgagggtgtcaacaagggcgttgttctcctcgagatcaag

SEQ ID NO: 3441 - DNA, 1311 bp, Corynebacterium glutamicum
atgtttgaaagggatatcgtggctactgataacaacaaggctgtcctgcactaccccggtggcgagttcgaaatggacatcatcgaggcttctgagggtaacaacggtgttgtcctgggcaagatgctgtctgagactggactgatcacttttgacccaggttatgtgagcactggctccaccgagtcgaagatcacctacatcgatggcgatgcgggaatcctgcgttaccgcggctatgacatcgctgatctggctgagaatgccaccttcaacgaggtttcttacctacttatcaacggtgagctaccaaccccagatgagcttcacaagtttaacgacgagattcgccaccacacccttctggacgaggacttcaagtcccagttcaacgtgttcccacgcgacgctcacccaatggcaaccttggcttcctcggttaacattttgtctacctactaccaggaccagctgaacccactcgatgaggcacagcttgataaggcaaccgttcgcctcatggcaaaggttccaatgctggctgcgtacgcacaccgcgcacgcaagggtgctccttacatgtacccagacaactccctcaatgcgcgtgagaacttcctgcgcatgatgttcggttacccaaccgagccatacgagatcgacccaatcatggtcaaggctctggacaagctgctcatcctgcacgctgaccacgagcagaactgctccacctccaccgttcgtatgatcggttccgcacaggccaacatgtttgtctccatcgctggtggcatcaacgctctgtccggcccactgcacggtggcgcaaaccaggctgttctggagatgctcgaagacatcaagagcaaccacggtggcgacgcaaccgagttcatgaacaaggtcaagaacaaggaagacggcgtccgcctcatgggcttcggacaccgcgtttacaagaactacgatccacgtgcagcaatcgtcaaggagaccgcacacgagatcctcgagcacctcggtggcgacgatcttctggatctggcaatcaagctggaagaaattgcactggctgatgattacttcatctcccgcaagctctacccgaacgtagacttctacaccggcctgatctaccgcgcaatgggcttcccaactgacttcttcaccgtattgttcgcaatcggtcgtctgccaggatggatcgctcactaccgcgagcagctcggtgcagcaggcaacaagatcaaccgcccacgccaggtctacaccggcaacgaatcccgcaagttggttcctcgcgaggagcgc

SEQ ID NO: 3442 - DNA, 354 bp, Corynebacterium glutamicum
atggaaaagccacagattgagctaccggtcggtccagcaccggaagatctcgtaatctctgacatcatcgttggcgaaggagcagaagcccgcccaggtggagaagttgaggtccactatgtgggcgttgactttgaaaccggcgaggagtttgactcttcctgggatcgtggacagaccagccagttcccactcaacggcctcattgcaggttggcaagagggaattccaggcatgaaggtcggcggacgtcgtcagctgaccattccgccagaggctgcttacggccctgagggttccggccacccactgtctggccgtaccctggtgttcatcatcgatttgatcagcgca

SEQ ID NO: 3443 - DNA, 1785 bp, Corynebacterium glutamicum
atgactacatctgacccaaatccgaaaccgatagtggaggatgctcagccagagcaaattaccgcaaccgaagaactggcgggcttgcttgagaatccaactaacctggaagggaaactggccgacgccgaagaggaaattatcctcgaaggcgaagacacccaggcctcacttaactggtcagtcatcgttccagccctagtcattgtcctagcgacagtggtgtggggtatcggattcaaagatagctttaccaactttgctagttctgcgttgtcagcagtagttgacaatctcggctgggccttcattttgtttggcacagtctttgtattttttatcgttgttatcgccgctagtaaattcggcacgattcgcttaggccgcattgatgaagcaccagagtttcgcacggtgtcatggatttccatgatgtttgctgcaggtatgggtattggtttgatgttctacggaaccacagaacctttaaccttctaccgcaatggtgtacctggacatgatgaacacaatgttggcgttgctatgtccacgacaatgttccactggaccttgcatccatgggctatctacgcaattgtgggcctagccattgcctattcgaccttccgagtgggccgtaaacagcttctaagctctgcattcgtgccactcattggtgaaaaaggtgcagaaggatggttgggcaagctcatcgacatcctggcgattatcgccaccgtattcggcacggcatgttcccttggccttggtgccctgcagattggtgcaggcctgtccgcagcaaacatcattgaagatccaagcgattggaccatcgttggcattgtttctgttttgaccctggcatttatcttctccgctatttctggtgtgggcaagggaatccagtacctctccaacgccaacatggttctggcagctctgctcgcgattttcgtgttcgttgtcggaccaaccgtgtcgattttgaacctgctgccaggttctattggcaactacctgtccaacttcttccaaatggcaggccgcactgccatgagtgccgacggcacagcaggtgagtggctaggtagctggaccatcttctactgggcatggtggatctcttggtcaccattcgtaggaatgttcttggcacgtatttcccgtggccgctccatccgtgagttcatcctgggcgtgttgctcgtcccagcaggtgtgtccaccgtatggttctccatttttggtggcactgcgattgtcttcgaacaaaatggggaatccatttggggtgatggtgcagcagaagagcagctttttggattgcttcatgcacttccaggtgggcaaatcatgggcatcatcgccatgattttgctgggtactttcttcattacctctgctgactctgcttccaccgtcatgggcaccatgagtcagcacggccagctggaagccaacaagtgggtgacagctgcctggggtgttgctaccgcagctattggactaacgctattgctttctggtggtgacaatgccttgagcaacttgcaaaacgtcaccatcgtggctgcaacaccattcttgtttgtggttattggattgatgtttgcgttagtcaaggacttaagcaatgatgtgatctacctcgagtaccgtgagcagcaacgcttcaacgcgcgccttgcccgtgaacgtcgtgttcacaatgaacaccgcaagcgtgaactggctgcaaagcgacgcagggagcgtaaggcgagtggcgcggggaagcgtcga

SEQ ID NO: 3444 - DNA, 1278 bp, Corynebacterium glutamicum
gtgaatgaatggcgaacagtctcgcttgtagattccacggcgctgaccgtgatcatcagtgtggccgtgtttacttctgctgtggctctgctcggagttgtgaaaaagcgctctcggtggcgggttctcggagctctcatctcctcagcagttctcaccagtggcgcatgggtggttattgaaaagctgtggaagcctttccccgaccccaatccgtggaccatctatctttccgctggtttggcggtttttcctctgttgagcatcttgttccgcactggtcgtacaagaatactgatggctacactcaccgtgattgcactggttaatacggccgcagtcatcaatgtcatctaccagccatacccgacgttgggttctttcaatcccgtgccaacggctgtgtccatgtcgtatgcagattttgaatctcagaccactgccccgacgatggatgaccgtgaagtcggtgcccttgtgcaggtgccgctagctggaacaacagatgattccacctccggctttgatgcgcgcgatgcctacgcctatattccgcctgcgtattgggataatccttccctacaactgccagttttggttctcatgcccggaaaccccggccagccagatcagtggtttagcagtggaaatgccgatcaaacagcagataatttccaagcaacccacgatggcatcagccccattgtcatcagcgtggatggcacaggatcattcagcggaaaccctgcttgcgtggattctgatgcccaaagcgtgatgacatatctatcccacgatgtccccatgttgatcaaacagaaattccgagtcaatcaggatcagcgcacctggacaattggtggtttaagttacggcggcacctgtgctttgcagatcatgaccaatcaccccgaagcgtatggttctttccttgacttctcgggccaggaagaaccaacacttggcacacgccagcaaactgttgatcagcttttcggcggcgatgaagacgcattcaaagccgttaatccggaagatctgctcaatcaagcaatcagctcaggagcgcatacctacagcgggatttcgggcaggtttattgctggtagcaacgataaaagtgcagtgagcgcgctgtctcatcttgataatttgagcaatcaggcgggcatgtccaccacctttgataccgtggccggtggacattccttccaggtgtggcgcgtggctttagcgaatacttttgattgggttgccaagcgcggcggattgcaggtt

SEQ ID NO: 3445 - DNA, 1503 bp, Corynebacterium glutamicum
gtgaatactcaatcagattctgcggggtctcaaggtgcagcggccacaagtcgtactgtatctattagaaccctcatcgcgctgatcatcggatcgaccgtcggcgcgggaattttctccatccctcaaaacatcggctcagtcgcaggtcccggcgcgatgctcatcggctggctgatcgccggtgtgggcatgttgtccgtagcgttcgtgttccatgttcttgcccgccgtaaacctcacctcgattctggcgtctacgcatatgcgcgtgttggattgggcgattatgtaggtttctcctccgcttggggttattggctgggttcagtcatcgcccaagttggctacgcaacgttatttttctccacgttgggccactacgtaccgctgttttcccaagatcatccatttgtgtcagcgttggcagttagcgctttgacctggctggtgtttggagttgtttcccgaggaattagccaagctgctttcttgacaacggtcaccaccgtggccaaaattctgcctctgttgtgcttcatcatccttgttgcattcttgggctttagctgggagaagttcactgttgatttatgggcgcgtgatggtggcgtgggcagcatttttgatcaggtgcgcggcatcatggtgtacaccgtgtgggtgttcatcggtatcgaaggtgcatcggtatattcccgccaggcacgctcacgcagtgatgtcagccgagctaccgtgattggttttgtggctgttctccttttgctggtgtcgatttcttcgctgagcttcggtgtactgacccaacaagagctcgctgcgttaccagataattccatggcgtcggtgctcgaagctgttgttggtccatggggtgccgcattgatttcgttgggtctgtgtctttcggttcttggggcctatgtgtcctggcagatgctctgcgcagaaccactggcgttgatggcaatggatggcctcattccaagcaaaatcggggccatcaacagccgcggtgctgcctggatggctcagctgatctccaccatcgtgattcagattttcatcatcattttcttcctcaacgagaccacctacgtctccatggtgcaattggctaccaacctatacttggtgccttacctgttctctgccttttatctggtcatgctggcaacacgtggaaaaggaatcacccacccacatgccggcacacgttttgatgattccggtccagagatatcccgccgagaaaaccgcaaacacctcatcgtcggtttagtagcaacggtgtattcagtgtggctgttttacgctgcagaaccgcagtttgtcctcttcggagccatggcgatgcttcccggcttaatcccctatgtgtggacaaggatttatcgtggcgaacaggtgtttaaccgctttgaaatcggcgtggttgttgtcctggtcgttgctgccagcgcgggcgttattggtttggtcaacggatcactatcgctt

SEQ ID NO: 3446 - DNA, 1389 bp, Corynebacterium glutamicum
atggctaaatctaatgaagggctgggaaccggacttcggacccgccacctcacaatgatgggactcggctccgcaattggtgccggactgttcctcggcaccggcgttggtatccgcgcagccggccccgcagtgctcctggcgtacatcatcgccggagccatcgttgtgcttgttatgcaaatgctcggcgagatggctgctgcccgtcccgcctccggatcgttttcacgttacggcgaggatgctttcggccactgggctggtttctccctcggttggttgtactggttcatgctgattatggtgatgggcgccgaaatgactggcgctgctgccatcatgggtgcatggttcggcgtcgaaccgtggattccttcgcttgtctgcgtggtcttcttcgctgtggtgaacctcgtcgcggttcgcggtttcggtgaattcgagtactggttcgcattcattaaggtcgcggtgatcatcgctttcctcatcattggtattgctcttattttcggatggcttcccggatccacctttgttggaacctcaaacttcatcggtgatcacggattcatgcccaatggtatttctggtgttgctgctggtttgctcgcggtggcttttgcctttggtggcattgaaattgtcaccattgcagctgcagagtccgataagccacgtgaagctatttccctggcggtgcgtgccgtgatttggcgtatttcagtcttttacttgggctctgttttggtcatcactttcctcatgccttatgagtcgatcaatggtgccgacaccgctgcggaatcccccttcacccaaatcctggcgatggcaaacatccctggcacggttggtttcatggaagcgatcatcgttctagcactgctttccgctttcaacgcccaaatctatgccacttctcgtttggtattttccatggcgaatcgacaagacgctccgcgagttttcagtaagctcagcaccagccacgtccccaccaatgcggtgctgttgtccatgttcttcgccttcgtttcagttggtttgcagtactggaatccagccggtctgcttgatttcctcctcaacgctgttggcggttgtttgattgtggtgtgggcaatgatcactttgtcacagttgaaactccgcaaagaactgcaagcaaacgatgaaatctccacggttcgcatgtgggcgcacccatggttaggcatcctcaccttggttttgttggcaggactcgttgctctcatgctcggcgacgcagcctcccgcagccaggtttactcagtggcaattgtgtacggattcttggttcttttgtccttcgtcacagttaacagcccattgcgcggaggtcgcaccccttccgacttgaac

SEQ ID NO: 3447 - DNA, 948 bp, Corynebacterium glutamicum
atgagtgaaaacattcgcggagcccaagcagttggaatcgcaaatatcgccatggacgggaccatcctggacacgtggtacccagaaccccaaattttcaacccggatcagtgggctgaacgctacccattggaagtgggcaccacacgcctcggagcaaacgaactcaccccacggatgctgcagttggtaaaactggaccaagatcgcctcgtcgaacaggtagcagtccgcaccgttatccccgatctgtctcaacctccagtagacgcgcacgatgtttacctgcgcctccacctgctttcccaccgcctggtccgcccccacgaaatgcacatgcaaaacaccttggagctgctgtccgacgtggtgtggacaaacaagggcccttgccttcctgaaaactttgagtgggtgcgtggtgctctgcggtcccgcggactcatccacgtctactgtgtggaccgtcttccccgcatggtcgactatgtggttccccctggagtccgcatctccgaagcagaacgcgtgcgcctaggtgcataccttgctccgggtacctctgtgctgcgtgaaggtttcgtgtctttcaactccggcaccttgggtgccgcaaaggtggaaggccgcctgagttccggtgtggtcatcggtgaaggttccgagattggactgtcttctactattcagtccccgagagatgaacagcgccgccgtttgccgttgagcatcggccaaaactgcaactttggtgtcagctccggaatcatcggagtcagtctgggagacaattgcgacatcggaaataacattgtcttggatggagatacccccatttggttcgcagccgatgaggagttacgcactatcgactccatcgaaggccaagcaaattggtcaatcaagcgtgaatccggcttccatgagccagttgcccgcctcaaagct

SEQ ID NO: 3448 - DNA, 1107 bp, Corynebacterium glutamicum
gtgaactctgaactcaaaccaggattagatctcctcggcgacccaattgtccttactcaacgtttggtagatataccgagtccgtcgggtcaggaaaagcagattgctgatgaaattgaagatgcccttcggaaccttaatctacctggtgtagaggtcttccgcttcaacaacaacgttcttgctcgcacgaacaggggattggcctcgagggtcatgcttgctggtcatatcgatacagtgccgatcgcggacaatctgccaagccgtgtggaagacggcatcatgtatggctgtggcaccgtcgatatgaaatctgggttggcggtgtatttgcatacttttgccaccttggccacgtcgactgagcttaaacatgatctgacgctgattgcgtatgagtgcgaggaagttgctgatcacctcaatggtttgggccacattcgcgatgagcatccggagtggttggcggctgatttggcgttgttgggtgagcctactggcggctggattgaggcgggctgccagggcaatctgcgcatcaaggtgacggcgcatggtgtgcgtgcccattcggcgagaagctggttgggtgataatgcgatgcataagttgtcgccgatcatttcgaaggttgctgcgtataaggccgcagaagtcaacattgatggcttgacctaccgtgaaggcctcaacatcgttttctgcgaatcgggcgtggcaaacaacgtcattccagacctcgcgtggatgaacctcaacttccgtttcgcgccgaatcgcgatctcaacgaggcgatcgagcatgtcgtcgaaacgcttgagcttgacggtcaagacggcatcgaatgggccgtagaagacggggcaggcggtgcccttccaggcttggggcagcaggtgacaagcgggcttatcgacgccgtcggccgcgaaaaaatccgcgcaaaattcggctggaccgatgtctcacgtttttcagccatgggaattccagccctaaactttggcgctggtgatccaagtttcgcgcataaacgcgacgagcagtgcccagtggagcaaatcacggatgtggcagcaattttgaagcagtacctgagcgag

SEQ ID NO: 3449 - DNA, 1572 bp, Corynebacterium glutamicum
atgagcgataacacctggttcatcatagccatcgttatctatatgttggtgatggtgctcatcggctattggagttaccgcaagacagaaaaatacgacgactacatgctcgccggccgcgggctcaacccttttgttgccgcaatgtccgcaggtgcctcagatatgtcaggttggctgctcatgggtctgcccggcgcgctgtttgtcaccggcatgtccgagttgtggatcgcagtcggactcaccattggtgcatgggcgaactggatgtgggtggcacctcgtcttcgttcttattccgaaatctcggccaactcaatcaccctgccttcattctttgagaaccgacttcgcgataaatctcgcgcgcttcgcatcattgcagcactaattatcattgtgttcttcaccttctacatttcttcaggcatggttgctggtggagtgtattgggagtccacgtttggtggagattatctactcggtatggccattgtcgcaggtgtgacagtgctgtataccttcattggaggattccttgctgtgtcttatacagacgcagttcaggggactatcatgttcttctcgttgatcatcgtgccagtcatggcatatttcgcactggcgaaccccatggatatttggagctttgcaaactctaatgattacggcccgcacaccgatggaattggcaatcccacctacttctccatgatcagtggcatttctgcagcagcaatcattggtaacttaggttggggtcttggatacttcggccagccacacattgtggttcgtttcatggcacttcgcacaccagctgaagcaaagcaaggtcgtcgcatcggtatttcctggatgataatctgcctgattggtgcaacctttaccgcaattatctccacagttttctttgcacaaaaccccgacgccaacatcactgacacaagggcttatgagtccatcttcctagatcttgcccggatgctgttccacccattgatcgctggacttattctgactgctgttctcgcggccatcatgtctaccatgtcgtcacagctgctggtcaccgcatcttccctgattgaggacctgctgaaggtagttaaaaaggactcgctgagcgaacgcaccctgatcatgctgtctcgtgccacagtcatcattctggcgatcattgcagcagccatggctattaacccgtctgattccatcctcggattggtgggatttgcgtgggcaggattcggctctgcatttggtccgatcatacttgctagcctttattggaagcgtctcaacgccgccggcgctatctccggcatgattactggtgctattgtctccatcgcgtggggtatgtccccactaagcgatacgttgtatgaaatcatcccaggtttcgccttggcaaccatcgtgatggtcgttgtttccctcctgacaaaggaaccctccgaagaaatcctcaacgagtttgaaaccgccaaggatcttgctgccgctgtggaatcaaacgaggatgttgatttcgctgacgcagctcagaagctttcgaaagaaagt

SEQ ID NO: 3450 - DNA, 1650 bp, Corynebacterium glutamicum
atgacaccagctgatctcgcaacattgattaaagagaccgcggtagaggttttgacctcccgcgagctcgatacttctgttcttccggagcaggtagttgtggagcgtccgcgtaacccagagcacggcgattacgccaccaacattgcattgcaggtggctaaaaaggtcggtcagaaccctcgggatttggctacctggctggcagaggcattggctgcagatgacgccattgattctgctgaaattgctggcccaggctttttgaacattcgccttgctgcagcagcacagggtgaaattgtggccaagattctggcacagggcgagactttcggaaactccgatcacctttcccacttggacgtgaacctcgagttcgtttctgcaaacccaaccggacctattcaccttggcggaacccgctgggctgccgtgggtgactctttgggtcgtgtgctggaggcttccggcgcgaaagtgacccgcgaatactacttcaacgatcacggtcgccagatcgatcgtttcgctttgtcccttcttgcagcggcgaagggcgagccaacgccagaagacggttatggcggcgaatacattaaggaaattgcggaggcaatcgtcgaaaagcatcctgaagcgttggctttggagcctgccgcaacccaggagcttttccgcgctgaaggcgtggagatgatgttcgagcacatcaaatcttccctgcatgagttcggcaccgatttcgatgtctactaccacgagaactccctgttcgagtccggtgcggtggacaaggccgtgcaggtgctgaaggacaacggcaacctgtacgaaaacgagggcgcttggtggctgcgttccaccgaattcggcgatgacaaagaccgcgtggtgatcaagtctgacggcgacgcagcctacatcgctggcgatatcgcgtacgtggctgataagttctcccgcggacacaacctaaacatctacatgttgggtgctgaccaccatggttacatcgcgcgcctgaaggcagcggcggcggcacttggctacaagccagaaggcgttgaagtcctgattggccagatggtgaacctgcttcgcgacggcaaggcagtgcgtatgtccaagcgtgcaggcaccgtggtcaccctagatgacctcgttgaagcaatcggcatcgatgcggcgcgttactccctgatccgttcctccgtggattcttccctggatatcgatctcggcctgtgggaatcccagtcctccgacaaccctgtgtactacgtgcagtacggacacgctcgtctgtgctccatcgcgcgcaaggcagagaccttgggtgtcaccgaggaaggcgcagacctatctctactgacccacgaccgcgaaggcgatctcatccgcacactcggagagttcccagcagtggtgaaggctgccgctgacctacgtgaaccacaccgcattgcccgctatgctgaggaattagctggaactttccaccgcttctacgattcctgccacatccttccaaaggttgatgaggatacggcaccaatccacacagcacgtctggcacttgcagcagcaacccgccagaccctcgctaacgccctgcacctggttggcgtttccgcaccggagaagatg

SEQ ID NO: 3451 - DNA, 1335 bp, Corynebacterium glutamicum
atggctacagttgaaaatttcaatgaacttcccgcacacgtatggccacgcaatgccgtgcgccaagaagacggcgttgtcaccgtcgctggtgtgcctctgcctgacctcgctgaagaatacggaaccccactgttcgtagtcgacgaggacgatttccgttcccgctgtcgcgacatggctaccgcattcggtggaccaggcaatgtgcactacgcatctaaagcgttcctgaccaagaccattgcacgttgggttgatgaagaggggctggcactggacattgcatccatcaacgaactgggcattgccctggccgctggtttccccgccagccgtatcaccgcgcacggcaacaacaaaggcgtagagttcctgcgcgcgttggttcaaaacggtgtgggacacgtggtgctggactccgcacaggaactagaactgttggattacgttgccgctggtgaaggcaagattcaggacgtgttgatccgcgtaaagccaggcatcgaagcacacacccacgagttcatcgccactagccacgaagaccagaagttcggattctccctggcatccggttccgcattcgaagcagcaaaagccgccaacaacgcagaaaacctgaacctggttggcctgcactgccacgttggttcccaggtgttcgacgccgaaggcttcaagctggcagcagaacgcgtgttgggcctgtactcacagatccacagcgaactgggcgttgcccttcctgaactggatctcggtggcggatacggcattgcctataccgcagctgaagaaccactcaacgtcgcagaagttgcctccgacctgctcaccgcagtcggaaaaatggcagcggaactaggcatcgacgcaccaaccgtgcttgttgagcccggccgcgctatcgcaggcccctccaccgtgaccatctacgaagtcggcaccaccaaagacgtccacgtagacgacgacaaaacccgccgttacatcgccgtggacggaggcatgtccgacaacatccgcccagcactctacggctccgaatacgacgcccgcgtagtatcccgcttcgccgaaggagacccagtaagcacccgcatcgtgggctcccactgcgaatccggcgatatcctgatcaacgatgaaatctacccatctgacatcaccagcggcgacttccttgcactcgcagccaccggcgcatactgctacgccatgagctcccgctacaacgccttcacacggcccgccgtcgtgtccgtccgcgctggcagctcccgcctcatgctgcgccgcgaaacgctcgacgacatcctctcactagaggca

SEQ ID NO: 3452 - DNA, 1335 bp, Corynebacterium glutamicum
atgacctcagcatctgccccaagctttaaccccggcaagggtcccggctcagcagtcggaattgcccttttaggattcggaacagtcggcactgaggtgatgcgtctgatgaccgagtacggtgatgaacttgcgcaccgcattggtggcccactggaggttcgtggcattgctgtttctgatatctcaaagccacgtgaaggcgttgcacctgagctgctcactgaggacgcttttgcactcatcgagcgcgaggatgttgacatcgtcgttgaggttatcggcggcattgagtacccacgtgaggtagttctcgcagctctgaaggccggcaagtctgttgttaccgccaataaggctcttgttgcagctcactctgctgagcttgctgatgcagcggaagccgcaaacgttgacctgtacttcgaggctgctgttgcaggcgcaattccagtggttggcccactgcgtcgctccctggctggcgatcagatccagtctgtgatgggcatcgttaacggcaccaccaacttcatcttggacgccatggattccaccggcgctgactatgcagattctttggctgaggcaactcgtttgggttacgccgaagctgatccaactgcagacgtcgaaggccatgacgccgcatccaaggctgcaattttggcatccatcgctttccacacccgtgttaccgcggatgatgtgtactgcgaaggtatcagcaacatcagcgctgccgacattgaggcagcacagcaggcaggccacaccatcaagttgttggccatctgtgagaagttcaccaacaaggaaggaaagtcggctatttctgctcgcgtgcacccgactctattacctgtgtcccacccactggcgtcggtaaacaagtcctttaatgcaatctttgttgaagcagaagcagctggtcgcctgatgttctacggaaacggtgcaggtggcgcgccaaccgcgtctgctgtgcttggcgacgtcgttggtgccgcacgaaacaaggtgcacggtggccgtgctccaggtgagtccacctacgctaacctgccgatcgctgatttcggtgagaccaccactcgttaccacctcgacatggatgtggaagatcgcgtgggggttttggctgaattggctagcctgttctctgagcaaggaatctccctgcgtacaatccgacaggaagagcgcgatgatgatgcacgtctgatcgtggtcacccactctgcgctggaatctgatctttcccgcaccgttgaactgctgaaggctaagcctgttgttaaggcaatcaacagtgtgatccgcctcgaaagggac

SEQ ID NO: 3453 - DNA, 927 bp, Corynebacterium glutamicum
atggcaattgaactgaacgtcggtcgtaaggttaccgtcacggtacctggatcttctgcaaacctcggacctggctttgacactttaggtttggcactgtcggtatacgacactgtcgaagtggaaattattccatctggcttggaagtggaagtttttggcgaaggccaaggcgaagtccctcttgatggctcccacctggtggttaaagctattcgtgctggcctgaaggcagctgacgctgaagttcctggattgcgagtggtgtgccacaacaacattccgcagtctcgtggtcttggctcctctgctgcagcggcggttgctggtgttgctgcagctaatggtttggcggatttcccgctgactcaagagcagattgttcagttgtcctctgcctttgaaggccacccagataatgctgcggcttctgtgctgggtggagcagtggtgtcgtggacaaatctgtctatcgacggcaagagccagccacagtatgctgctgtaccacttgaggtgcaggacaatattcgtgcgactgcgctggttcctaatttccacgcatccaccgaagctgtgcgccgagtccttcccactgaagtcactcacatcgatgcgcgatttaacgtgtcccgcgttgcagtgatgatcgttgcgttgcagcagcgtcctgatttgctgtgggagggtactcgtgaccgtctgcaccagccttatcgtgcagaagtgttgcctattacctctgagtgggtaaaccgcctgcgcaaccgtggctacgcggcatacctttccggtgccggcccaaccgccatggtgctgtccactgagccaattccagacaaggttttggaagatgctcgtgagtctggcattaaggtgcttgagcttgaggttgcgggaccagtcaaggttgaagttaaccaacct

SEQ ID NO: 3454 - DNA, 627 bp, Corynebacterium glutamicum
atgtacgcattgcgtgacattgttgcgtctggaaaggctctttacgtgggtatttcttcctacggtccagagctcacagcggaggcggctgagttcatggcggaggagggctgcccgcttctgattcatcagccaagctattccatcattaatcgttgggtggaggaaccgggcgatgacggtgagaacttgttgcagtcagctgccaacaatggtcttggcgtcattgctttctcaccacttgcgcagggcctgctcacggacaaatatctcgatggaattccagagggttcccgcgccagccagggtaagtccctgtctgagggcatgttgaacgtgaacaatattgatatggtccgcaagctcaatgacatcgcccaggaacgcgggcagtcacttgcgcagatggcgcttgcatgggtgctgcgcgagcaaggagagtacggcgcggataccgtgaccagtgcattgattggtgcttcgtcagttgagcagctggacaacagccttgattcactcaacaacttggagttttctgacgccgagttggaggcgatcgatgagatttcccacgacgccggcatcaacatttgggcgaaggccaccgattccaaaacccgcgaaaac

SEQ ID NO: 3455 - DNA, 708 bp, Corynebacterium glutamicum
atggtgatcatggaaatcttcattacaggtctgcttttgggggccagtcttttactgtccatcggaccgcagaatgtactggtgattaaacaaggaattaagcgcgaaggactcattgcggttcttctcgtgtgtttaatttctgacgtctttttgttcatcgccggcaccttgggcgttgatcttttgtccaatgccgcgccgatcgtgctcgatattatgcgctggggtggcatcgcttacctgttatggtttgccgtcatggcagcgaaagacgccatgacaaacaaggtggaagcgccacagatcattgaagaaacagaaccaaccgtgcccgatgacacgcctttgggcggttcggcggtggccactgacacgcgcaaccgggtgcgggtggaggtgagcgtcgataagcagcgggtttgggtaaagcccatgttgatggcaatcgtgctgacctggttgaacccgaatgcgtatttggacgcgtttgtgtttatcggcggcgtcggcgcgcaatacggcgacaccggacggtggattttcgccgctggcgcgttcgcggcaagcctgatctggttcccgctggtgggtttcggcgcagcagcattgtcacgcccgctgtccagccccaaggtgtggcgctggatcaacgtcgtcgtggcagttgtgatgaccgcattggccatcaaactgatgttgatgggt

SEQ ID NO: 3456 - DNA, 870 bp, Corynebacterium glutamicum
atgaaccccattcaactggacactttgctctcaatcattgatgaaggcagcttcgaaggcgcctccttagccctttccatttccccctcggcggtgagtcagcgcgttaaagctctcgagcatcacgtgggtcgagtgttggtatcgcgcacccaaccggccaaagcaaccgaagcgggtgaagtccttgtgcaagcagcgcggaaaatggtgttgctgcaagcagaaactaaagcgcaactatctggacgccttgctgaaatcccgttaaccatcgccatcaacgcagattcgctatccacatggtttcctcccgtgttcaacgaggtagcttcttggggtggagcaacgctcacgctgcgcttggaagatgaagcgcacacattatccttgctgcggcgtggagatgttttaggagcggtaacccgtgaagctaatcccgtggcgggatgtgaagtagtagaacttggaaccatgcgccacttggccattgcaaccccctcattgcgggatgcctacatggttgatgggaaactagattgggctgcgatgcccgtcttacgcttcggtcccaaagatgtgcttcaagaccgtgacctggacgggcgcgtcgatggtcctgtggggcgcaggcgcgtatccattgtcccgtcggcggaaggttttggtgaggcaattcgccgaggccttggttggggacttcttcccgaaacccaagctgctcccatgctaaaagcaggagaagtgatcctcctcgatgagatacccattgacacaccgatgtattggcaacgatggcgcctggaatctagatctctagctagactcacagacgccgtcgttgatgcagcaatcgagggattgcggcct

SEQ ID NO: 3457 - DNA, 1878 bp, Corynebacterium glutamicum
gtgaatgtggcagcttctcaacagcccactcccgccacggttgcaagccgtggtcgatccgccgcccctgagcggatgacaggtgcaaaggcaattgttcgatcgctcgaggagcttaacgccgacatcgtgttcggtattcctggtggtgcggtgctaccggtgtatgacccgctctattcctccacaaaggtgcgccacgtcttggtgcgccacgagcagggcgcaggccacgcagcaaccggctacgcgcaggttactggacgcgttggcgtctgcattgcaacctctggcccaggagcaaccaacttggttaccccaatcgctgatgcaaacttggactccgttcccatggttgccatcaccggccaggtcggaagtggcctgctgggtaccgacgctttccaggaagccgatatccgcggcatcaccatgccagtgaccaagcacaacttcatggtcaccaaccctaacgacattccacaggcattggctgaggcattccacctcgcgattactggtcgccctggccctgttctggtggatattcctaaggatgtccagaacgctgaattggatttcgtctggccaccaaagatcgacctgccaggctaccgcccagtttcaacaccacatgctcgccagatcgagcaggcagtcaagctgatcggtgaggccaagaagcccgtcctttacgttggtggtggcgtaatcaaggctgacgcacacgaagagcttcgtgcgttcgctgagtacaccggcatcccagttgtcaccaccttgatggctttgggtactttcccagagtctcacgagctgcacatgggtatgccaggcatgcatggcactgtgtccgctgttggtgcactgcagcgcagcgacctgctgattgctatcggctcccgctttgatgaccgcgtcaccggtgacgttgacaccttcgcgcctgacgccaagatcattcacgccgacattgatcctgccgaaatcggcaagatcaagcaggttgaggttccaatcgtgggcgatgcccgcgaagttcttgctcgtctgctggaaaccaccaaggcaagcaaggcagagaccgaggacatctccgagtgggttgactacctcaagggcctcaaggcacgtttcccgcgtggctacgacgagcagccaggcgatctgctggcaccacagtttgtcattgaaaccctgtccaaggaagttggccccgacgcaatttactgcgccggcgttggccagcaccaaatgtgggcagctcagttcgttgactttgaaaagccacgcacctggctcaactccggtggactgggcaccatgggctacgcagttcctgcggcccttggagcaaaggctggcgcacctgacaaggaagtctgggctatcgacggcgacggctgtttccagatgaccaaccaggaactcaccaccgccgcagttgaaggtttccccattaagatcgcactaatcaacaacggaaacctgggcatggttcgccaatggcagaccctattctatgaaggacggtactcaaatactaaacttcgtaaccagggcgagtacatgcccgactttgttaccctttctgagggacttggctgtgttgccatccgcgtcaccaaagcggaggaagtactgccagccatccaaaaggctcgagagatcaacgaccgcccagtagtcatcgacttcatcgtcggtgaagacgcacaggtatggccaatggtgtctgctggatcatccaactccgatatccagtacgcactcggattgcgcccattctttgatggtgatgaatctgcagcagaagatcctgccgacattcacgaagccgtcagcgacattgatgccgccgttgaatcgaccgaggca

SEQ ID NO: 3458 - DNA, 516 bp, Corynebacterium glutamicum
atggctaattctgacgtcacccgccacatcctgtccgtactcgttcaggacgtagacggaatcatttcccgcgtatcaggtatgttcacccgacgcgcattcaacctcgtgtccctcgtgtctgcaaagaccgaaacacacggcatcaaccgcatcacggttgttgtcgacgccgacgagctcaacattgagcagatcaccaagcagctcaacaagctgatccccgtgctcaaagtcgtgcgacttgatgaagagaccactatcgcccgcgcaatcatgctggttaaggtctctgcggacagcaccaaccgtccgcagatcgtcgacgccgcgaacatcttccgcgcccgagtcgtcgacgtggctccagactctgtggttattgaatccacaggcaccccaggcaagctccgcgcactgcttgacgtgatggaaccattcggaatccgcgaactgatccaatccggacagattgcactcaaccgcggtccgaagaccatggctccggccaagatc

SEQ ID NO: 3459 - DNA, 1014 bp, Corynebacterium glutamicum
atggctattgaactgctttatgatgctgacgctgacctctccttgatccagggccgtaaggttgccatcgttggctacggctcccagggccacgcacactcccagaacctccgcgattctggcgttgaggttgtcattggtctgcgcgagggctccaagtccgcagagaaggcaaaggaagcaggcttcgaggtcaagaccaccgctgaggctgcagcttgggctgacgtcatcatgctcctggctccagacacctcccaggcagaaatcttcaccaacgacatcgagccaaacctgaacgcaggcgacgcactgctgttcggccacggcctgaacattcacttcgacctgatcaagccagctgacgacatcatcgttggcatggttgcgccaaagggcccaggccacttggttcgccgtcagttcgttgatggcaagggtgttccttgcctcatcgcagtcgaccaggacccaaccggaaccgcacaggctctgaccctgtcctacgcagcagcaatcggtggcgcacgcgcaggcgttatcccaaccaccttcgaagctgagaccgtcaccgacctcttcggcgagcaggctgttctctgcggtggcaccgaggaactggtcaaggttggcttcgaggttctcaccgaagctggctacgagccagagatggcatacttcgaggttcttcacgagctcaagctcatcgttgacctcatgttcgaaggtggcatcagcaacatgaactactctgtttctgacaccgctgagttcggtggctacctctccggcccacgcgtcatcgatgcagacaccaagtcccgcatgaaggacatcctgaccgatatccaggacggcaccttcaccaagcgcctcatcgcaaacgttgagaacggcaacaccgagcttgagggccttcgtgcttcctacaacaaccacccaatcgaggagaccggcgctaagctccgcgacctcatgagctgggtcaaggttgacgctcgcgcagaaaccgct

SEQ ID NO: 3460 - DNA, 1020 bp, Corynebacterium glutamicum
atgaaacttgctgttattggtggagatggtatcggcccagaggttactgcagaagccctcaaggttctaaacgctgtccgcgacgacatcgagaccaccgattatgaccttggcgcacgccgttacctcaaaaatggcgagctgctcaccgacgaggatctggcatccctgcgcgagcatgacgcgatccttcttggcgctatcggtgcaccaggttccgtccctccaggaattctcgagcgtggtttgctgctgaagatgcgattcgcactggatcaccacgtgaacctgcgcccatccaagctgtacgacggcgtggagtccccactgcgtaacccaggcaagattgatttcgttgtggtccgcgaaggtaccgaaggcgcctacactggcaacggtggagcaatccgcgtgggaacccctcacgagattgccaatgaaacctccgtgaacactcgctacggcgctgagcgcgttattcgctacgcattcgagctggcacagagccgccgcaagaagctcaccctcgtgcacaagaccaacgtcctggttcacggtggtggcctgtggcagcgcaccgtagatgaggttgcaaaggaatacccagaggtagccgtcgattacaaccacatcgatgcagcaaccatctatctggtcactgatccttcccgcttcgatgtgattgttaccgataacctcttcggcgacatcctcaccgatgaggcaggcgcagtctctggcggaattggcctcgcagcatccggcaacatcgatgccacgggcaccaacccttccatgttcgagccagtccacggctctgcaccagatatcgcaggccagggaatcgcagacccaacggcagcaatcctatccgctgcgatgctgctgcgtcacttaggtgatgaagacaacgcagtacgtattgaaacagccatcgcagctgatgtggctggccgagataactctcagccgatttctaccactgaggtgggagaccgcatcgtcaaggcgctgcaaagc

SEQ ID NO: 3461 - DNA, 2049 bp, Corynebacterium glutamicum
atggcgtccaaactgacgacgacatcgcaacatattctggaaaaccttggtggaccagacaatattacttcgatgactcactgtgcgactcgccttcgcttccaagtgaaggatcaatccattgttgatcaacaagaaattgactccgacccatcagttcttggcgtagtaccccaaggatccaccggtatgcaggtggtgatgggtggatctgttgcaaactattaccaagaaatcctcaaacttgatggaatgaagcacttcgccgacggtgaagctacagagagttcatccaagaaggaatacggcggagtccgtggcaagtactcgtggattgactacgccttcgagttcttgtctgatactttccgaccaatcctgtgggccctgcttggtgcctcactgattattaccttgttggttcttgcggatactttcggtttgcaagacttccgcgctccaatggatgagcagcctgatacttatgtattcctgcactccatgtggcgctcggtcttctacttcctgccaattatggttggtgccaccgcagctcgaaagctcggcgcaaacgagtggattggtgcagctattccagccgcacttcttactccagaattcttggcactgggttctgccggcgataccgtcacagtctttggcctgccaatggttctgaatgactactccggacaggtattcccaccgctgattgcagcaattggtctgtactgggtggaaaagggactgaagaagatcatccctgaagcagtccaaatggtgttcgtcccattcttctccctgctgattatgatcccagcgaccgcattcctgcttggacctttcggcatcggtgttggtaacggaatttccaacctgcttgaagcgattaacaacttcagcccatttattctttccatcgttatcccattgctctacccattcttggttccacttggattgcactggccactaaacgccatcatgatccagaacatcaacaccctgggttacgacttcattcagggaccaatgggtgcctggaacttcgcctgcttcggcctggtcaccggcgtgttcttgctctccattaaggaacgaaacaaggccatgcgtcaggtttccctgggtggcatgttggctggtttgctcggcggcatttccgagccttccctctacggtgttctgctccgattcaagaagacctacttccgcctcctgccgggttgtttggcaggcggtatcgtgatgggcatcttcgacatcaaggcgtacgctttcgtgttcacctccttgcttaccatcccagcaatggacccatggttgggctacaccattggtatcgcagttgcattcttcgtttccatgttccttgttctcgcactggactaccgttccaacgaagagcgcgatgaggcacgtgcaaaggttgctgctgacaagcaggcagaagaagatctgaaggcagaagctaatgcaactcctgcagctccagtagctgctgcaggtgcgggagccggtgcaggtgcaggagccgctgctggcgctgcaaccgccgtggcagctaagccgaagctggccgctggggaagtagtggacattgtttccccactcgaaggcaaggcaattccactttctgaagtacctgacccaatctttgcagcaggcaagcttggaccaggcattgcaatccaaccaactggaaacaccgttgttgctccagcagacgctactgtcatccttgtccagaaatctggacacgcagtggcattgcgcttagatagcggagttgaaatccttgtccacgttggattggacaccgtgcaattgggcggcgaaggcttcaccgttcacgttgagcgcaggcagcaagtcaaggcgggggatccactgatcacttttgacgctgacttcattcgatccaaggatctacctttgatcaccccagttgtggtgtctaacgccgcgaaattcggtgaaattgaaggtattcctgcagatcaggcaaattcttccacgactgtgatcaaggtcaacggcaagaacgag

SEQ ID NO: 3462 - DNA, 882 bp, Corynebacterium glutamicum
ttgcagcacttccgcgacaagattgttgtcgtgaaatatggcggaaacgccatggtggatgatgatctcaaggctgcttttgctgccgacatggtcttcttgcgcaccgtgggcgcaaaaccagtggtggtgcacggtggtggacctcagatttctgagatgctaaaccgtgtgggtctccagggcgagttcaagggtggtttccgtgtgaccactcctgaggtcatggacattgtgcgcatggtgctctttggtcaggtcggtcgcgatttagttggtttgatcaactctcatggcccttacgctgtgggaacctccggtgaggatgccggcctgtttaccgcgcagaagcgcatggtcaacatcgatggcgtacccactgatattggtttggtcggagacatcattaatgtcgatgcctcttccttgatggatatcatcgaggccggtcgcattcctgtggtctctacgattgctccaggcgaagacggccagatttacaacattaacgccgataccgcagcaggtgctttggctgcagcgattggtgcagaacgcctgctggttctcaccaatgtggaaggtctgtacaccgattggcctgataagagctcactggtgtccaagatcaaggccaccgagctggaggccattcttccgggacttgattccggcatgattccaaagatggagtcttgcttgaacgcggtgcgtgggggagtaagcgctgctcatgtcattgacggccgcatcgcgcactcggtgttgctggagcttttgaccatgggtggaattggcacgatggtgctgccggatgtttttgatcgggagaattatcctgaaggcaccgtttttagaaaagacgacaaggatggggaactg

SEQ ID NO: 3463 - DNA, 957 bp, Corynebacterium glutamicum
atgacttcacaaccacaggttcgccattttctggctgatgatgatctcacccctgcagagcaggcagaggttttgaccctagccgcaaagctcaaggcagcgccgttttcggagcgtccactcgagggaccaaagtccgttgcagttctttttgataagacttcaactcgtactcgcttctccttcgacgcgggcatcgctcatttgggtggacacgccatcgtcgtggattccggtagctcacagatgggtaagggcgagtccctgcaggacaccgcagctgtattgtcccgctacgtggaagcaattgtgtggcgcacctacgcacacagcaatttccacgccatggcggagacgtccactgtgccgctggtgaactccttgtccgatgatctgcacccatgccagattctggctgatctgcagactatcgtggaaaacctcagccctgaagaaggcccagcaggccttaagggtaagaaggctgtgtacctgggcgatggcgacaacaacatggccaactcctacatgattggctttgccaccgcgggcatggatatttccatcatcgctcctgaagggttccagcctcgtgcggaattcgtggagcgcgcggaaaagcgtggccaggaaaccggcgcgaaggttgttgtcaccgacagcctcgacgaggttgccggcgccgatgttgtcatcaccgatacctgggtatccatgggtatggaaaacgacggcatcgatcgcaccacacctttcgttccttaccaggtcaacgatgaggtcatggcgaaagctaacgacggcgccatcttcctgcactgccttcctgcctaccgtggcaaagaagtggcagcctccgtgattgatggaccagcgtccaaagttttcgatgaagcagaaaaccgcctccacgctcagaaagcactgctggtgtggctgctggccaaccagccgagg

SEQ ID NO: 3464 - DNA, 513 bp, Corynebacterium glutamicum
atgtcccttggctcaaccccgtcaacaccggaaaacttaaatcccgtgactcgcactgcacgccaagctctcattttgcagattttggacaaacaaaaagtcaccagccaggtacaactgtctgaattgctgctggatgaaggcatcgatatcacccaggccaccttgtcccgagatctcgatgaactcggtgcacgcaaggttcgccccgatgggggacgcgcctactacgcggtcggcccagtagatagcatcgcccgcgaagatctccggggtccgtcggagaagctgcgccgcatgcttgatgaactgctggtttctacagatcattccggcaacatcgcgatgctgcgcaccccgccgggagctgcccagtacctggcaagtttcatcgatagggtggggctgaaagaagtcgttggcaccatcgctggtgatgacaccgttttcgttctcgcccgtgatccgctcacaggtaaagaactaggtgaattactcagcgggcgcaccact

SEQ ID NO: 3465 - DNA, 1401 bp, Corynebacterium glutamicum
atgtcagttaacccaacccgccccgaaggcggccgtcaccacgtcgtcgtcatcggttctggttttggtggcctttttgctgccaagaacctggccaaggcagacgtcgatgtcactctgattgaccgcaccaaccaccacctcttccagccactgctgtaccaagtggcaaccggtatcctctcctccggtgaaatcgcaccttccactcgacagatcctgggctcccaggaaaacgtcaacgtcatcaagggcgaagtcaccgacatcaacgtcgagtcccagactgtgaccgcctccctgggcgagttcacccgcgtttttgagtacgattccttggtcgttggtgctggcgcaggtcagtcctacttcggcaatgatcacttcgctgagttcgcacctggcatgaagtccatcgacgatgcactggagattcgtgcacgcatcatcggtgctttcgagcgcgctgagatctgcgaggatccagctgagcgcgaacgcctgctcaccttcgtcgttgttggcgctggcccaaccggtgttgagcttgctggccagttggctgagatggctcaccgcacccttgctggtgagtacaagaacttcaacaccaactccgcaaagatcatcctgcttgatggtgctccacaggttcttcctccattcggtaagcgcctaggccgcaacgcacagcgcaccctggaaaagatgggtgtcaacgttcgcctgaacgctatggtcaccaacgttgacgctacctcggtcacctacaagaccaaggacggcgaagagcacaccatcgaatctttctgcaagatttggtccgctggtgttgcggcatccccactgggcaagctcgtcgcagagcagaccggtgttgagaccgaccgcgcaggccgcgtcatggttaacgatgacctgtctgttggcgatcagaagaacgtcttcgttgttggcgacatgatgaactacaacaacctccctggtgttgctcaggtagcaatccagagtggtgagtacgttgctgagcagatcgaagctgaggttgaaggccgctccaacaccgagcgcgaagctttcgattacttcgacaagggctccatggctaccatttcccgcttctccgcagtggtgaagatgggcaaggttgaggtcaccggcttcatcggttgggttctgtggttggctgttcacatcatgttcctggttggcttccgcaaccgtttcgtctccgcaatcagctggggcctgaacgcactgtcccgcaagcgttggaacctggcaaccacccgccagcagctccactcacgcaccacgctgtccaagttcgctcacgagcttgaggaagcatcttctgatcttccaatcgagctgcgcgacaaccagcgtttcagcggaaag

SEQ ID NO: 3466 - DNA, 261 bp, Corynebacterium glutamicum
gtgaagacatttgactcgctgtacgaagaacttcttaaccgtgctcagacccgccctgaagggtctggaaccgtggccgccttggataaaggcatccatcatctaggtaagaaggtcatcgaagaagccggagaggtctggattgcagccgagtatgagaccgatgaagagctagccggagaaatctcccagctcatttattggacccaggtcatcatggttgctcgcggcctgaagccagaagatatctacaagaacctg

SEQ ID NO: 3467 - DNA, 1086 bp, Corynebacterium glutamicum
atgatcgcggccggagtcaaagacgtcgcgcaatgcgtcgatgtcatggaggaaacgctcgtgctcttggcgcagggcgactacaaaatggccggtttgaactccaactcgcatggcgcgatgatcaccttcccggaaaacccagaatttgaaggcatgcccaaggacggccccgaccgccgattcatggcgatgcccgcatacctcggcgggcgattcaaaaacaccggcgtgaagtggtacggatccaacgcggaaaacaaggcctcaggcttgcctcgctcgatccacaccttcgtcctcaacgacacggtcaccggtgcaccgaaggccatcatgtccgcgaacctgctgtccgcctaccgcaccggcgcggttcccggcgtgggcgtgaagcacttagcggtcgccgacgcgacaaccttggctgtcgtcggacctggtgtcatggcgaaaaccatcaccgaagcgtgcatcgcagagcgcccaggaatcaccaccatcaagatcaagggacgcagcgaacgcggcatcaacgcctttgcaacatgggcgttggaaaaattccccgagatcgaagtggtcgccgtcggatctgaagaagacgtggtcaaagacgccgacatcgtcatcgccgccaccaccacggacgccgccggctcctccgccttcccatacttcaaaaaagaatggctcaagccgggcgcattgctgctgcttccagccgccggtcgcttcgacgacgcttatttgcttgacgacgcccgcctcgttgttgactacatggggctctacgaagcctgggcagaagaatacggcccacaggcctaccaactactcggcattccaggaacccactggtacgacctggcgctgcaaggaaaactcgaccttgcaaagatttcccagattggcgatatctgctccggcaagctacccggacgcaccaacgatgaggaaatcatcctctattccgtcggcggcatgccagtagaagacgtcgcctgggcaacccaagtgtatgaaaacgccctggaaaaaggcgtcggcaccacattgaacctgtgggaatcacccgcactggct

SEQ ID NO: 3468 - DNA, 1356 bp, Corynebacterium glutamicum
atggacccctcagatctagcctggattctcgcagcttttgcgttggtaagcctgatgttccccggattgtccctgctctacggcggcatgctgggtgggcaacacgttcttaacacgttcatgatggttatgagctcacttggaatcatcagccttgtgtacatcatttatggacacggacttgtcttaggaaactccatcggtgggtggggaattatcggaaatccccttgaatacttcggcttccgcaacattatggaagatgacggcaccggagacctcatgtgggccggcttctacattctgttcgctgcaatctcactcgcacttgtttcatctggtgcagcggggcgcatgcgctttggagcgtggctggtcttcggtgtcctgtggttcacctttgtgtacgcgccactggcacactgggttttcgctatcgatgatcctgagtccggctacgtgggtggctggatgaaaaatgtgcttgagttccacgactttgctggtggaacggcagtgcacatgaatgcgggtgcgtctggactcgcgctggcaatagtgctgggacgccgccactccatggctgtgcgtccacacaaccttccactgattttgattggtgcaggactgatcgttgcgggctggttcggattcaatggtggtaccgcaggtggtgccaacttcctcgcaagctacgtggtcgttacctctctcattgctgcagctggcggaatgatgggcttcatgctcgttgaacgtgtgttcagcggaaaacccactttctttggctcggcaaccggcacaatcgcaggccttgtggctatcaccccggccgcggatgcagtgagcccgctcggagcattcgccgtcggagcgctcggcgcagttgtctccttctgggcaattagctggaagaagggacaccgagtcgatgattccttcgatgtgttcgcagtccacggaatggccggcattgcaggtgcactgtttgtcatgctctttggcgatccactagcaccagcgggagtttccggagtcttcttcggtggcgaactctccctgctgtggagggaaccactggccatcatcgtgacccttacatacgcattcggcgtgacctggttgattgccacgatcttgaacaagttcatgactctgcgcatcacctccgaagccgaatatgaaggcattgaccgcgcagaacacgcagaatctgcctaccacctcaattccaacggaattgggatggcaacccgcaccaatttcggacctgaaatccccgaggaaaccgtgcccgacgccgtgcaggtgggcgtcgataagcaaaaaatcgctgatactcgaaaggcctcaaaa

SEQ ID NO: 3469 - DNA, 231 bp, Corynebacterium glutamicum
atggcattgacgcttcaaatcatcctcgtcgtcgccagcctgctcatgacggttttcgtcttgctgcacaagggcaaaggcggcggactctccagcctcttcggtggcggtgtgcagtccaatctttcgggctccactgttgttgaaaagaacctggatcgcgtcaccattttggttgccgttatctggattgtgtgcattgtcgcactcaacctcatccagacttattca

SEQ ID NO: 3470 - DNA, 2757 bp, Corynebacterium glutamicum
atgactgattttttacgcgatgacatcaggttcctcggtcaaatcctcggtgaggtaattgcggaacaagaaggccaggaggtttatgaactggtcgaacaagcgcgcctgacttcttttgatatcgccaagggcaacgccgaaatggatagcctggttcaggttttcgacggcattactccagccaaggcaacaccgattgctcgcgcattttcccacttcgctctgctggctaacctggcggaagacctctacgatgaagagcttcgtgaacaggctctcgatgcaggcgacacccctccggacagcactcttgatgccacctggctgaaactcaatgagggcaatgttggcgcagaagctgtggccgatgtgctgcgcaatgctgaggtggcgccggttctgactgcgcacccaactgagactcgccgccgcactgtttttgatgcgcaaaagtggatcaccacccacatgcgtgaacgccacgctttgcagtctgcggagcctaccgctcgtacgcaaagcaagttggatgagatcgagaagaacatccgccgtcgcatcaccattttgtggcagaccgcgttgattcgtgtggcccgcccacgtatcgaggacgagatcgaagtagggctgcgctactacaagctgagccttttggaagagattccacgtatcaaccgtgatgtggctgttgagcttcgtgagcgtttcggcgagggtgttcctttgaagcccgtggtcaagccaggttcctggattggtggagaccacgacggtaacccttatgtcaccgcggaaacagttgagtattccactcaccgcgctgcggaaaccgtgctcaagtactatgcacgccagctgcattccctcgagcatgagctcagcctgtcggaccgcatgaataaggtcaccccgcagctgcttgcgctggcagatgcagggcacaacgacgtgccaagccgcgtggatgagccttatcgacgcgccgtccatggcgttcgcggacgtatcctcgcgacgacggccgagctgatcggcgaggacgccgttgagggcgtgtggttcaaggtctttactccatacgcatctccggaagaattcttaaacgatgcgttgaccattgatcattctctgcgtgaatccaaggacgttctcattgccgatgatcgtttgtctgtgctgatttctgccatcgagagctttggattcaacctttacgcactggatctgcgccaaaactccgaaagctacgaggacgtcctcaccgagcttttcgaacgcgcccaagtcaccgcaaactaccgcgagctgtctgaagcagagaagcttgaggtgctgctgaaggaactgcgcagccctcgtccgctgatcccgcacggttcagatgaatacagcgaggtcaccgaccgcgagctcggcatcttccgcaccgcgtcggaggctgttaagaaattcgggccacggatggtgcctcactgcatcatctccatggcatcatcggtcaccgatgtgctcgagccgatggtgttgctcaaggaattcggactcatcgcagccaacggcgacaacccacgcggcaccgtcgatgtcatcccactgttcgaaaccatcgaagatctccaggccggcgccggaatcctcgacgaactgtggaaaattgatctctaccgcaactacctcctgcagcgcgacaacgtccaggaagtcatgctcggttactccgattccaacaaggatggcggatatttctccgcaaactgggcgctttacgacgcggaactgcagctcgtcgaactatgccgatcagccggggtcaagcttcgcctgttccacggccgtggtggcaccgtcggccgcggtggcggaccttcctacgacgcgattcttgcccagcccaggggggctgtccaaggttccgtgcgcatcaccgagcagggcgagatcatctccgctaagtacggcaaccccgaaaccgcgcgccgaaacctcgaagccctggtctcagccacgcttgaggcatcgcttctcgacgtctccgaactcaccgatcaccaacgcgcgtacgacatcatgagtgagatctctgagctcagcttgaagaagtacgcctccttggtgcacgaggatcaaggcttcatcgattacttcacccagtccacgccgctgcaggagattggatccctcaacatcggatccaggccttcctcacgcaagcagacctcctcggtggaagatttgcgagccatcccatgggtgctcagctggtcacagtctcgtgtcatgctgccaggctggtttggtgtcggaaccgcattagagcagtggattggcgaaggggagcaggccacccaacgcattgccgagctgcaaacactcaatgagtcctggccatttttcacctcagtgttggataacatggctcaggtgatgtccaaggcagagctgcgtttggcaaagctctacgcagacctgatcccagatacggaagtagccgagcgagtctattccgtcatccgcgaggagtacttcctgaccaagaagatgttctgcgtaatcaccggctctgatgatctgcttgatgacaacccacttctcgcacgctctgtccagcgccgatacccctacctgcttccactcaacgtgatccaggtagagatgatgcgacgctaccgaaaaggcgaccaaagcgagcaagtgtcccgcaacattcagctgaccatgaacggtctttccactgcgctgcgcaactccggc

SEQ ID NO: 3471 - DNA, 1230 bp, Corynebacterium glutamicum
atgctaggcatgcttcgatggactacagcaggtgaatcccacggccaggcgcttatcgccacggttgaacacatgccagcaggcgtgcccgtgactaaagatgaggtctcgtatcaattggcgcgccgacgccttggatatggtcgcggcgctcgcatgaagtttgagcaagacgcgttgaccttcctcaccggcatccgccacggcctcactttgggtagccccatctcaatcatgatcggcaacactgagtgggataagtggaccaccatcatgtcctctgacgctttggacatggaagacccagataacgttgcggcgatgtcttcgggtcggggcgcaaaactgactcgtccgcgtccaggccacgctgattacgcaggcatgctcaagtacggattcgatgatgcccgcaacgtgctggagcgttcttcagcccgtgagacggcagcacgcgtggcagcagcaaccgttgcgcgttccttcctgcgtgaaaccttgggcgtggaagtgctttcccacgtaatttccattggtgcgtccgagccttacactggcgcggagccaacctttgcagatattcaagcaatcgatgattccccagttcgtgcattcggtaaagacgctgaagaatccatgatcgcggaaatcgaggccgcaaagaaagccggcgataccctcggtggcatcgtggaagtgattgttgaaggcctgcccatcggtttgggctcacacatttctggcgaagatcgcctcgatgcgcagatcgcagctgcactcatgggcattcaggccatcaagggcgtggaaatcggtgacggtttcgaagaagctcgtcgacgtggctccgaagcccacgatgaagtgttcctggatgacaacggcgtataccgcaacaccaaccgtgcaggtggcctcgaaggcggcatgaccaacggtgaaaccctgcgcgttcgtgctggcatgaagccaatttctactgtgcctcgcgccctgaaaaccattgatatggaaaacggcaaggcagcaaccggaatccaccagcgttccgacgtgtgcgctgttccagccgccggtgtcgttgcagaagcaatggtcaccctggttctcgcccgcgcagtcctgcagaaattcggcggtgactccctgagcgaaaccaagagcaacattgacacctacctcaaaaacattgaggaacgaatgaaattcgaaggtttagaggatggagcg

SEQ ID NO: 3472 - DNA, 1896 bp, Corynebacterium glutamicum
ttgtcacaccacactcacctcaataactacatcacgagcttgagtgataacgctgatctccgtgaaaaagtcaccgcaaccgtagacgctttccgccataccgtcatggatgacttcgactacatcagtgatcaacaagtcctgctttatggcgatgtccaaagcggtaaaacctcacacatgctgggaattatcgcagattgcctcgacagtacgtttcacaccattgttattctgacctcgcctaacacacggctcgtgcaacaaacatacgaccgtgttgcccaagcatttccagatactttggtgtgcgaccgtgacggatacaatgatttccgtgcgaatcaaaagagcctcaccccgcgaaaatctatcgtagtcgtcggaaaaatacctgcagttcttggtaattggttacgcgtctttaacgacagtggcgcactttctggacaccctgtactcattattgatgacgaagcagatgcgacaagtctcaacaccaaagtaaatcagtctgatgtttcgaccattaaccaccagctcactagcataagagaccttgccacaggatgcatctaccttcaggtcacaggtacacctcaagcggtgcttcttcaaagcgacgatagcaactgggcagcggaacatgtgcttcacttcgcacctggtgagagctacatcggtggtcaacttttcttttctgagctcaacaacccttatctacgacttttcgctaatacccaatttgacgaggattctcgcttcagcgacgccatttacacctatctcttaaccgcagcactgttcaaacttcgcggtgaaagcttgtgtaccatgctcattcaccccagccacactgcatccagtcatagagacttcgcgcaagaagcccgcctccaactcactttcgccttcgagcgattctatgaaccaatgattcagcacaatttccaacgtgcttatgaacagctcgcacaaactgacagcaacctgccacccttgagaaaaattcttaacattcttggtggcatggaagatgacttctccatccacatcgtcaatagcgacaacccgactgttgaggaagattgggctgatggttataacattattgtcggtggcaactcgcttgggcgcggtttaacattcaacaacttgcaaaccgttttctacgtgcgcgaatccaagcgaccacaagcagacaccctgtggcagcacgcccgcatgtttggctacaaacgccacaaagacaccatgcgtgtgttcatgccggccactattgctcaaaccttccaagaggtctatctcggcaacgaagctattaaaaatcagctcgatcatggcacgcatatcaacgacattcgggtcattttaggtgatggcgtcgcacctactcgtgccaatgttctcgacaaacgcaaagttggaaacctcagcggtggcgtcaactactttgccgctgatcctagaatcaagaatgtcgaagcactcgacaaaaaactcttggcctacttagacaagcacggtgaggactccaccatcggtatgcgcgcgataatcaccattctcaacgcctttactgtagaccccaacgatctcgacctcgcgaccttcaaggctgcgctccttgactttgaacgcaaccaacctcatctcacagcacgtatggtgctgcgaacaaaccgcaaagtcaatcagggtacaggcgccctgctctcccctactgatcaagctctcagccgtgcagaagtcgcacacccattattgatcctataccgcattgaaggtgttaacgatgctgctgcgcaacgaggtgaacctacgtggtcaagcgaccctatctgggtgcctaatattaaactccctggtcaacgtcaattctggtgcgtagacggc

SEQ ID NO: 3473 - DNA, 993 bp, Corynebacterium glutamicum
atgacagcaccgtccacgcaggatctcgcaacgactgaacgtgaggtagatcccggcagcagaaggggccaaaccaacgacaatccctcgcaggaccttgttcgcgtttacctcaacggcatcggcaaaactgccttgcttaccgcggaggatgaagttgagctcgcacagaccattgaggttggcctttatgcagagcaccttctgaaaaactctgaagagccactcacccgcgccatgaagcgcgatctaaaggttcttgccaaggacggcaagaaggctcgttcccacctcctcgaggcaaacctgcgcctggtggtgtcccttgctaagcgctacaccggccgcggcatgccactgctggatcttatccaggagggcaacctcggactgatccgcgcgatggaaaagtttgattactccaagggctttaagttctccacctacgcaacctggtggatccgccaggcaatcacccgcggcatggcagatcagtcccgcaccatccgcctcccagtccaccttgtggagcaggtgaacaagctttcccgcatcaagcgcgagttgtaccagcacttgggccgtgaagccaccaatgaggaactcgcagaagagtccggcattgaagagtccaagattgaaatgctgcttcgtcagtctcgcgatccagtgagcttggacatgccagtcggcgccgatgaagaagctcctttgggtgacttcattgaggattctgaggccaccgatgcagaatccgcagtggttgcttccatgcgccactccgatatccgcgcggtccttaacactctcgagccacgcgagcaggatgtcatccgtttgcgctacggcctcgatgacggtgtgccacgcacccttgatcagattggtcgccgcttcggactgtcccgtgagcgcgtccgccagatagagcgtgaagtcatgagtaagctccgcgatggagagcgcgcatcacgtcttcgtgagtacgcccag

SEQ ID NO: 3474 - DNA, 885 bp, Corynebacterium glutamicum
atgtctgcaaagcgtacttttacccgtatcggtgcgattcttggagcaactgcacttgccggagttaccctcaccgcctgtggtgattcaagcggtggcgacggattcctcgcagccattgaaaatggttctgtcaatgtcggcaccaaatacgatcagcctggtcttggcctccgcaacccagacaactccatgagcggtctcgacgtggatgttgctgaatacgtagtcaactccatcgctgatgacaagggctgggatcaccccaccatcgaatggcgtgaatccccttctgcgcagcgtgaaaccctcattcaaaacggtgaggtagacatgatcgcagcaacctactccatcaacgctggccgttcagagtccgtcaacttcggtggcccatacctgcttacccaccaggctctgcttgttcgccaagatgacgatcgcattgaaaccctcgaggacttggataacggtttgatcctgtgctccgtttccggatccactccagctcagaaggtcaaggatgtcctcccaggcgttcagctccaagaatacgacacctactcttcctgtgttgaggcactgtcccagggcaacgttgacgccctgaccactgacgccaccatcctcttcggctactcccagcagtacgaaggcgacttccgcgttgtggaaatggaaaaggacggcgagccattcaccgacgagtactacggcattggcctgaagaaggatgaccaggaaggcaccgacgctatcaacgccgcacttgagcgcatgtacgctgacggcaccttccagcgactgctcaccgagaacctcggtgaagactccgtggttgttgaagaaggcaccccaggtgacctctccttcctcgacgcaagc

SEQ ID NO: 3475 - DNA, 1128 bp, Corynebacterium glutamicum
atggctcccaagaagacagcaacaaaggcaactgccgccaaggggaatgatcgtcagaaggcacttgatgccgcactagccctgattgagaaggatttcggtaaaggcgctgtcatgcgtctgggtgatgagaatcgtccgccaatccagaccatctcatctggtaacaccgcgattgatattgccttgggtatcggtggattcccacgtggtcgaatcgttgaggtgtatggcccagaatcatcaggtaaaaccaccgttgcactgcacgcaattgcgcaggcacaaaaggccggcggcatcgctgcattcattgacgccgagcacgcgttggatccagattatgctcgcaagcttggtgtagatactgatgcgcttctggtttcgcagccagacactggtgagcaagcactagaaatcgccgacatgctggttcgttccggcgcaatcgacatcatcgtgattgactcggtggctgcgctgacaccaaaggctgaaattgaaggcgaaatgggcgatagccacgttggtcttcaggcccgcctcatgagccaggcgcttcgtaagatgacaggtgcgctgtacaactcgggtaccaccgcgatcttcattaaccagctgcgtgaaaagatcggtgtgatgttcggttccccagaaaccaccaccggtggtaaggccctgaagttctacgcatctgttcgttgtgacattcgacgaatccagactctgaaggacggacaggatgccattggtaaccgcacccgcttgaaggtcgttaagaacaaggtctccccaccgttcaagatcgctgaattcgacatcatgtacggcgaaggcatctcccgtgaatcctccgtcattgacttggcagtggacaacggcattgtgaagaagtcaggttcctggttcacctacgagggcgaacagcttggtcaaggtaaggaaaaggtgcgtctttccctcaaggagaaccctgaactcaccgatgagctggaagataagatcttcaagaagctgggagtaggcaagtacgctgcagcctcagatgaactcaccgacgatccagtagagctcgtgcctaacgttgacttcgatgatgaagccgacaccgaagcagacgctgaagac

SEQ ID NO: 3476 - DNA, 903 bp, Corynebacterium glutamicum
atgagcacaggtttaacagctaagaccggagtagagcacttcggcaccgttggagtagcaatggttactccattcacggaatccggagacatcgatatcgctgctggccgcgaagtcgcggcttatttggttgataagggcttggattctttggttctcgcgggcaccactggtgaatccccaacgacaaccgccgctgaaaaactagaactgctcaaggccgttcgtgaggaagttggggatcgggcgaagctcatcgccggtgtcggaaccaacaacacgcggacatctgtggaacttgcggaagctgctgcttctgctggcgcagacggccttttagttgtaactccttattactccaagccgagccaagagggattgctggcgcacttcggtgcaattgctgcagcaacagaggttccaatttgtctctatgacattcctggtcggtcaggtattccaattgagtctgataccatgagacgcctgagtgaattacctacgattttggcggtcaaggacgccaagggtgacctcgttgcagccacgtcattgatcaaagaaacgggacttgcctggtattcaggcgatgacccactaaaccttgtttggcttgctttgggcggatcaggtttcatttccgtaattggacatgcagcccccacagcattacgtgagttgtacacaagcttcgaggaaggcgacctcgtccgtgcgcgggaaatcaacgccaaactatcaccgctggtagctgcccaaggtcgcttgggtggagtcagcttggcaaaagctgctctgcgtctgcagggcatcaacgtaggagatcctcgacttccaattatggctccaaatgagcaggaacttgaggctctccgagaagacatgaaaaaagctggagttcta

SEQ ID NO: 3477 - DNA, 744 bp, Corynebacterium glutamicum
atgggaatcaaggttggcgttctcggagccaaaggccgtgttggtcaaactattgtggcagcagtcaatgagtccgacgatctggagcttgttgcagagatcggcgtcgacgatgatttgagccttctggtagacaacggcgctgaagttgtcgttgacttcaccactcctaacgctgtgatgggcaacctggagttctgcatcaacaacggcatttctgcggttgttggaaccacgggcttcgatgatgctcgtttggagcaggttcgcgactggcttgaaggaaaagacaatgtcggtgttctgatcgcacctaactttgctatctctgcggtgttgaccatggtcttttccaagcaggctgcccgcttcttcgaatcagctgaagttattgagctgcaccaccccaacaagctggatgcaccttcaggcaccgcgatccacactgctcagggcattgctgcggcacgcaaagaagcaggcatggacgcacagccagatgcgaccgagcaggcacttgagggttcccgtggcgcaagcgtagatggaatcccggttcatgcagtccgcatgtccggcatggttgctcacgagcaagttatctttggcacccagggtcagaccttgaccatcaagcaggactcctatgatcgcaactcatttgcaccaggtgtcttggtgggtgtgcgcaacattgcacagcacccaggcctagtcgtaggacttgagcattacctaggcctg

SEQ ID NO: 3478 - DNA, 1500 bp, Corynebacterium glutamicum
atgtcagattccccgaagaacgcaccgaggattaccgatgaggcagatgtagttctcattggtgccggtatcatgagctccacgctgggtgcaatgctgcgtcagctggagccaagctggactcagatcgtcttcgagcgtttggatggaccggcacaagagtcgtcctccccgtggaacaatgcaggaaccggccactctgctctatgcgagctgaactacaccccagaggttaagggcaaggttgaaattgccaaggctgtaggaatcaacgagaagttccaggtttcccgtcagttctggtctcacctcgttgaagagggagtgctgtctgatcctaaggaattcatcaaccctgttcctcacgtatctttcggccagggcgcagatcaggttgcatacatcaaggctcgctacgaagctttgaaggatcacccactcttccagggcatgacctacgctgacgatgaagctaccttcaccgagaagctgcctttgatggcaaagggccgtgacttctctgatccagtagcaatctcttggatcgatgaaggcaccgacatcaactacggtgctcagaccaagcagtacctggatgcagctgaagttgaaggcactgaaatccgctatggccacgaagtcaagagcatcaaggctgatggcgcaaagtggatcgtgaccgtcaagaacgtacacactggcgacaccaagaccatcaaggcaaacttcgtgttcgtcggcgcaggcggatacgcactggatctgcttcgcagcgcaggcatcccacaggtcaagggcttcgctggattcccagtatccggcctgtggcttcgttgcaccaacgaggaactgatcgagcagcacgcagccaaggtatatggcaaggcatctgttggcgctcctccaatgtctgttcctcaccttgacacccgcgttatcgagggtgaaaagggtctgctctttggaccttacggtggctggacccctaagttcttgaaggaaggctcctacctggacctgttcaagtccatccgcccagacaacattccttcctaccttggcgttgctgctcaggaatttgatctgaccaagtaccttgtcactgaagttctcaaggaccaggacaagcgtatggatgctcttcgcgagtacatgccagaggcacaaaacggcgattgggagaccatcgttgccggacagcgtgttcaggttattaagcctgcaggattccctaagttcggttccctggaattcggcaccaccttgatcaacaactccgaaggcaccatcgccggattgctcggtgcttcccctggagcatccatcgcaccttccgcaatgatcgagctgcttgagcgttgcttcggtgaccgcatgatcgagtggggcgacaagctgaaggacatgatcccttcctacggcaagaagcttgcttccgagccagcactgtttgagcagcagtgggcacgcacccagaagaccctgaagcttgaggaagcc

SEQ ID NO: 3479 - DNA, 2076 bp, Corynebacterium glutamicum
atgaataatccagcccagctgcgccaagatactgaaaaggaagtcctggcgttgctgggctctttggttttacccgccggcaccgcgcttgccgccaccggatctttggccaggtccgaactcacgccgtattccgatttggacctcattttgatccatccaccaggagccaccccggatggcgtggaggatttgtggtacccgatttgggacgcaaaaaagcgtctcgactactccgtgcgcaccccagatgagtgtgtggctatgatttctgcggattccactgcagcccttgccatgcttgacctgcggtttgtcgctggcgatgaggatctgtgtgccaaaacgcgccggcgcatcgtggagaagtggcgccaggaactcaacaaaaacttcgatgccgttgtggacaccgcgattgcccgttggcgccgctccggacccgtcgtggcaatgacgcggccagatcttaaacacggcaggggagggctgcgcgatttcgaactgatcaaggccctcgcgctcggccacctatgcaaccttccacagcttgatgcgcaacaccagctgcttctcgacgcccgcaccttgctgcacgtccacgcgcgacgctcccgcgacgtccttgaccccgaatttgcggtggatgtggccatggatttgggctttgttgaccgctatcacctgggccgggagatcgccgatgcagcccgcgccattgatgatggcctgaccaccgcgctggccaccgcccgtggcattttgccacgtcgcacaggttttgcattcaggaatgcttctcgacgcccacttgatcttgatgtcgtcgacgccaacggcaccatcgaattgtccaaaaaaccagatcttaatgatcccgcacttccacttcgagtggccgcagccgcagcaaccaccggacttccggtggcagaatcaacctgggttcgacttaatgaatgcccgccacttcctgagccatggcctgccaatgcagcaggggacttctttcggattctctccagtccgaaaaactcacgccgagtggtgaaaaatatggatcgccacggattgtggtcgcgttttgttccagaatgggaccgcatcaaagggcttatgccccgtgaacccagccatatttccaccatcgatgaacatagtctgaacactgttgcaggatgtgcgctagaaactgtgaccgtcgcgcgccccgatcttttagttttgggagccttgtaccacgacattggcaagggcttcccgcgtccacacgaacaagtaggtgcagagatggtggcgagggctgcaagccgcatgggattgaaccttcgcgatcgtgccagcgtgcaaacgctggtcgccgagcacaccgcggtggccaaaatcgccgcgcgccttgatccctcctcggagggcgccgtcgataagctgcttgatgctgttaggtatgacctggtgacattgaatctgcttgaggtgctaacagaagctgatgcgaaagccacggggcctggcgtgtggacggcgcgtttggagcatgcgctgcggattgtgtgcaagcgtgcgcgtgatcgcctcaccgatattcgcccggttgcgccgatgattgcgccacgtagtgaaattggtttggtggaacgcgatggcgtgttcacagtgcaatggcacggcgaagacttacatcggattcttggcgtaatttatgccaaaggatggacaatcaccgcggcgcgcatgctggccaatggtcaatggagtgcggaatttgatgtccgcgcaaacggcccccaagattttgatccgcagcatttcctgcaggcatatcaatccggtgtgttttccgaggttcccattccagcacttgggataacagccacattttggcacgggaacactttagaagtgcgcactgagcttcgcacaggagctatttttgccctgctcagaacattgcccgatgccctctggatcaacgctgtgacccgcggtgcgaccctgattatccaggcagcactgaagcccggcttcgatcgagcaacggtggaacgctccgtagtcaggtcgttggcaggtagc

SEQ ID NO: 3480 - DNA, 336 bp, Corynebacterium glutamicum
atgaaactcatcaccgcaattgtcaagccgtttaccctcaccgacattaaagatgctctcgagcaggcaggtgtgcagggcatgactgtcaccgaaacccaaggctttggccagcagaaaggccacaccgaggtgtaccgtggtgctgaatacgctgtcgattttgtgcctaaggtcaagattgaagttattatctccgatgctcaggctgaggaagtcatcaacattatcgtcgagaccgcacgcaccggcaaagtcggcgacggcaaagtgtggatgactaacatcgaagagctggttcgtgttcgtaccggtgagcgcggcgaagcagccctt

SEQ ID NO: 3481 - DNA, 1314 bp, Corynebacterium glutamicum
atgggtgcagatcaaattgcagcagtctccggcaattcagcttggatgctgatgtccgcgtcgctcgtgctgctaatgacaccagcactggcacttttctatggcggcatgtctcgtcaaaagtccgtgctcaacatgatgatgatgtcctttggagcattgggcgtcgttactgttatttacctcttgtggggatggtcgatgtcttatggaacccaatcaatcgcgggaatctttgctaacccttttgagttcttcggtcttaaagattccatcgttgatgcagacggcaactacattgagggcgcagctggctacccaaacattattgatatcggattccagcttaccttcgccgttatctccactgcactgatctccggtgcgttggcagagcgtgtgaagttttccacctggcttattttcagcggcgcgtgggtgactttggtgtacttcccactggcacacatggtgtggggtggcggattgttgggccataatgtcactggttttgcttcgtggttgtttggttctaccgatggtgaagccaatatcgctccgatcgactttgctggtggtaccgttgttcacatttcggcgggcacagcggcccttgtgctggcttttatcgtcggcaagcgaaagacgtttggcaaggcaattgccaggccgcacaacctgcccatggtcatgctcggcgctgcgctgttgtggtttggttggttcgggttcaacggtggctcggcgttcgcagccgacggccttgcgggcctggcctgggtgaacaccacggcggcaaccgcagctgcgatgcttggctggttggctactgaaaaattccgcgatggacacgcaacctccttgggtgctgcttctggtgtcgtcgccggtctggtcgcaattactccagcagctggcgcactgaccccagtgacctccctgatcctcggtgcaatcggcggcatcttggcgtgcttgggcgtggggctgaagtaccgcttcggtttcgatgactccctcgacgtagttggtgtgcacctggtcgctggcctgtggggcaccgtgggtgtaggacttcttgccactgacatcggatggtttagtggtggtggcatggatggacttaaactctttattgtccagatcgtcatcgcgctagtcgctgtagttttcgcaggtgtgattactgcgctcatcgcattcgccctgaaggccacagtaggatggcgcgttgatgatgatgtggagcagcaaggcattgatactcacgaacacgcagaatccgcttatgacaccacgggtccggaaattcgt

SEQ ID NO: 3482 - DNA, 1341 bp, Corynebacterium glutamicum
atgacagttgatgagcaggtctctaactattacgacatgcttctgaagcgcaatgctggcgagcctgaatttcaccaggcagtggcagaggttttggaatctttgaagatcgtcctggaaaaggaccctcattacgctgattacggtctcatccagcgcctgtgcgagcctgagcgtcagctcatcttccgtgtgccttgggttgatgaccagggccaggtccacgtcaaccgtggtttccgcgtgcagttcaactctgcacttggaccatacaagggcggcctgcgcttccacccatctgtaaacctgggcattgtgaagttcctgggctttgagcagatctttaaaaactccctaaccggcctgccaatcggtggtggcaagggtggatccgacttcgaccctaagggcaagtccgatctggaaatcatgcgtttctgccagtccttcatgaccgagctacaccgccacatcggtgagtaccgcgacgttcctgcaggtgacatcggagttggtggccgcgagatcggttacctgtttggccactaccgtcgcatggctaaccagcacgagtccggcgttttgaccggtaagggcctgacctggggtggatccctggtccgcaccgaggcaactggctacggctgcgtttacttcgtgagtgaaatgatcaaggctaagggcgagagcatcagcggccagaagatcatcgtttccggttccggcaacgtagcaacctacgcgattgaaaaggctcaggaactcggcgcaaccgttattggtttctccgattccagcggttgggttcatacccctaacggcgttgacgtggctaagctccgcgaaatcaaggaagttcgtcgcgcacgcgtatccgtgtacgccgacgaagttgaaggcgcaacctaccacaccgacggttccatctgggatctcaagtgcgatatcgctcttccttgtgcaactcagaacgagctcaacggcgagaacgctaagactcttgcagacaacggctgccgtttcgttgctgaaggcgcgaacatgccttccacccctgaggctgttgaggtcttccgtgagcgcgacatccgcttcggaccaggcaaggcagctaacgctggtggcgttgcaacctccgctctggagatgcagcagaacgcttcgcgcgattcctggagcttcgagtacaccgacgagcgcctccaggtgatcatgaagaacatcttcaagacctgtgcagagaccgcagcagagtatggacacgagaacgattacgttgtcggcgctaacattgctggcttcaagaaggtagctgacgcgatgctggcacagggcgtcatc

SEQ ID NO: 3483 - DNA, 1425 bp, Corynebacterium glutamicum
gtggatagacgaactaagattgtatgtaccctaggcccagcggtggctagtgcagatggaattctgcgtttggtagaagacggcatggatgttgctcgcctcaacttctcccatggtgaccacccagatcatgagcaaaactacaagtgggtccgcgaggcggcggagaagactggccgtgcagtcggtattctcgcagacctccaaggaccgaagatccgtcttggccgtttcactgacggcgcaaccgtgtgggaaaacggcgagaccattcggatcaccgttgacgatgtagagggaacgcacgatcgtgtgtccaccacctacaagaatctggcaaaagacgcgaagccaggcgaccgcctgctcgttgatgacggcaaggttggcctcgtctgcgtttccgtcgaaggtaacgacgtcatctgtgaggttgttgagggcggaccagtctccaacaacaagggtgtttccctgccaggtatggatatttccgtacctgcactgtccgaaaaggatatccgtgacctgcgcttcgccctgaagctcggcgtggactttattgcactgtccttcgtacgttccccagcagatgctgaactcgttcacaagatcatggacgaagaaggtcgtcgtgttcctgtgatcgccaagctggaaaagccagaggctgtcacctccctcgagccaatcgtgttggcattcgacgccgtcatggttgctcgtggtgacctcggcgttgaggttcctctggaggaggttccactggttcagaagcgcgcaatccagattgcccgtgagaacgcaaagccagttatcgtggcaacccagatgctggattccatgattgagaactcccgcccaacccgtgcggaagcttctgacgtggcaaacgctgtgctcgatggcgcagatgctgtcatgctttctggtgaaacttcagtgggcaaagatccgcacaacgttgtgcgcaccatgtctcgcattgttcgcttcgctgaaaccgacggtcgcgtcccagacctgacccacatccctcgcactaagcgtggcgttatttcctactctgcacgtgatatcgccgagcgcctcaacgctcgtgcattggttgcgttcaccacctctggtgataccgcaaagcgtgtggctcgtctgcacagccacctgccactgctcgtgttcactccaaatgaggcagttcgctctgagctggcgctgacctggggtgcaaccaccttcctgtgtccacctgtcagcgataccgatgacatgatgcgcgaagtcgaccgtgctcttttagcaatgcctgagtacaacaagggtgacatgatggttgttgttgcaggttcccctcctggtgttaccggtaacaccaacatgattcacgtccaccttcttggtgacgacacaaggattgcaaagctc

SEQ ID NO: 3484 - DNA, 969 bp, Corynebacterium glutamicum
atgccacaaaaaccggccagtttcgcggtgggctttgacatcggcggcaccaacatgcgagccgggcttgtcgacgaatccgggcgcatcgtgaccagtttgtcggcgccgtcgccgcgcacgacgcaggcaatggaacaggggatttttgatctagtcgaacagctcaaggccgaatacccggttggtgctgtgggacttgccgtcgcgggatttttggatcctgagtgcgaggttgttcgatttgccccgcaccttccttggcgcgatgagccagtgcgtgaaaagttggaaaaccttttgggcctgcctgttcgtttggaacatgatgccaactcagcagcgtggggtgagcatcgttttggtgcagctcaaggcgctgacaactgggttttgttggcactcggcactggaattggtgcagcgctgattgaaaaaggcgaaatttaccgtggtgcatatggcacggcaccagaatttggtcatttgcgtgttgttcgtggcggacgcgcatgtgcgtgtggcaaagaaggctgcctggagcgttactgttccggtactgccttggtttacactgcgcgtgaattggcttcgcatggctcattccgcaacagcgggctgtttgacaagatcaaagccgatccgaattccatcaatggaaaaacgatcactgcggcagcgcgccaagaagacccacttgctctcgccgttctggaagatttcagcgagtggctgggcgaaactttggcgatcattgctgatgtccttgacccaggcatgatcatcattggtggcggactgtccaatgctgccgacctttatttggatcgctcggtcaaccactattccacccgcatcgtcggcgcaggatatcgccctttggcacgcgttgccacagctcagttgggtgcggatgctggcatgatcggtgtcgctgatctagctcgacgctctgtagtggaagccaac

SEQ ID NO: 3485 - DNA, 1431 bp, Corynebacterium glutamicum
gtggcgtttgaaaccccggaagaaattgtcaagttcatcaaggatgaaaacgtcgagttcgttgacgttcgattcaccgaccttcccggcaccgagcagcacttcagcatcccagctgccagcttcgatgcagatacaatcgaagaaggtctcgcattcgacggatcctcgatccgtggcttcaccacgatcgacgaatctgacatgaatctcctgccagacctcggaacggccacccttgatccattccgcaaggcaaagaccctgaacgttaagttcttcgttcacgatcctttcacccgcgaggcattctcccgcgacccacgcaacgtggcacgcaaggcagagcagtacctggcatccaccggcattgcagacacctgcaacttcggcgccgaggctgagttctacctcttcgactccgttcgctactccaccgagatgaactccggcttctacgaagtagataccgaagaaggctggtggaaccgtggcaaggaaaccaacctcgacggcaccccaaacctgggcgcaaagaaccgcgtcaagggtggctacttcccagtagcaccatacgaccaaaccgttgacgtgcgcgatgacatggttcgcaacctcgcagcttccggcttcgctcttgagcgtttccaccacgaagtcggtggcggacagcaggaaatcaactaccgcttcaacaccatgctccacgcggcagatgatatccagaccttcaagtacatcatcaagaacaccgctcgcctccacggcaaggctgcaaccttcatgcctaagccactggctggcgacaacggttccggcatgcacgctcaccagtccctctggaaggacggcaagccactcttccacgatgagtccggctacgcaggcctgtccgacatcgcccgctactacatcggcggcatcctgcaccacgcaggcgctgttctggcgttcaccaacgcaaccctgaactcctaccaccgtctggttccaggcttcgaggctccaatcaacctggtgtactcacagcgcaaccgttccgctgctgtccgtatcccaatcaccggatccaacccgaaggcaaagcgcatcgaattccgcgctccagacccatcaggcaacccatacctgggctttgcagcgatgatgatggccggcctcgacggcatcaagaaccgcatcgagccacacgctccagtggacaaggacctctacgaactaccaccagaggaagctgcatccattccacaggcaccaacctccctggaagcatccctgaaggcactgcaggaagacaccgacttcctcaccgagtctgacgtcttcaccgaggatctcatcgaggcgtacatccagtacaagtacgacaacgagatctccccagttcgcctgcgcccaaccccgcaggaattcgaattgtacttcgactgc

SEQ ID NO: 3486 - DNA, 1443 bp, Corynebacterium glutamicum
gtggactacatttcgacgcgtgatgccagccgtacccctgcccgcttcagtgatattttgctgggcggtctagcaccagacggcggcctgtacctgcctgcaacctaccctcaactagatgatgcccagctgagtaaatggcgtgaggtattagccaacgaaggatacgcagctttggctgctgaagttatctccctgtttgttgatgacatcccagtagaagacatcaaggcgatcaccgcacgcgcctacacctacccgaagttcaacagcgaagacatcgttcctgtcaccgaactcgaggacaacatttacctgggccacctttccgaaggcccaaccgctgcattcaaagacatggccatgcagctgctcggcgaacttttcgaatacgagcttcgccgccgcaacgaaaccatcaacatcctgggcgctacctctggcgataccggctcctctgcggaatacgccatgcgcggccgcgagggaatccgcgtattcatgctgaccccagctggccgcatgaccccattccagcaagcacagatgtttggccttgacgatccaaacatcttcaacatcgccctcgacggcgttttcgacgattgccaagacgtagtcaaggctgtctccgccgacgcagaattcaaaaaagacaaccgcatcggtgccgtgaactccatcaactgggcacgccttatggcacaggttgtgtactacgtttcctcatggatccgcaccacaaccagcaatgaccaaaaggtcagcttctccgtaccaaccggcaacttcggtgacatttgcgcaggccacatcgcccgccaaatgggacttcccatcgatcgcctcatcgtggccaccaacgaaaacgatgtgctcgacgagttcttccgtaccggcgactaccgagtccgcagctccgcagacacccacgagacctcctcaccttcgatggatatctcccgcgcctccaacttcgagcgtttcatcttcgacctgctcggccgcgacgccacccgcgtcaacgatctatttggtacccaggttcgccaaggcggattctcactggctgatgacgccaactttgagaaggctgcagcagaatacggtttcgcctccggacgatccacccatgctgaccgtgtggcaaccatcgctgacgtgcattcccgcctcgacgtactaatcgatccccacaccgccgacggcgttcacgtggcacgccagtggagggacgaggtcaacaccccaatcatcgtcctagaaactgcactcccagtgaaatttgccgacaccatcgtcgaagcaattggtgaagcacctcaaactccagagcgtttcgccgcgatcatggatgctccattcaaggtttccgacctaccaaacgacaccgatgcagttaagcagtacatagtcgatgcgattgcaaacacttccgtgaag

SEQ ID NO: 3487 - DNA, 1845 bp, Corynebacterium glutamicum
atgagctcaaatatagctatcacgaccgagcctgaagggaaaaataaaaagggtctcaaatcagacccgttcattttttccatttctgtcggttttatcgtggtgtttgtcatcgccacaattgcgctaggcgagaaagctcgaacaaccttttccgcgattgccggctggctcttagaaaatttagggtggatgtatatcgggggtgtctccttggttttcattttcctcatgggtatctttgcgtcccggtatggccgggtaaaacttggtgatgacgatgatgaccccgagcacaccctaatcgtgtggttctgtatgctttttgctggcggtgtcggtgcagtcttaatgttttggggtgttgccgaaccgattaaccacgcgttcaacgtgccaatggctaatgaagaatccatgagtgaagccgcaattgtgcaggcttttgcttatactttctatcacttcggtattcacatgtgggtaatcatggcactcccaggattatcattgggatactttatttacaaacgtaagctacctccccgtctatcctctgtgttttctccgatcttgggtaagcacatttattccacacccggcaagctcatcgatgtactggccatcgtaggcaccacgtttggtattgctgtgtcagtaggtcttggtgtgctgcaaatcaatgcaggtatgaacaaactatggagcaccccgcaagtatcgtgggttcagcttttgatcatcttgatcatcaccgcggttgcatgtatttccgttgcttccggtttggataagggcattaagttactgtccaacattaatattgcaatggccgttgcgttgatgttcttcatcttgttcactggtccaaccctcacattgctgcgctttctcgtagaatccttcggaatctatgcatcctggatgcctaatctgatgttttggactgactctttccaagataacccaggctggcagggcaaatggacggtgttctattgggcatggactatttgttggtcgccatatgtcggcatgttcgtggcgcgtatttcgcgtggacgtaccgtccgtgaatttatcggtggggttctagctctgccagcgatctttggcgtagtttggttctctatctttggtcgtgcaggcatcgaagtggaactgagtaacccaggtttcttgacccagccaactgttgttgaaggtgacgtgccagcagcgctttttaatgtgctgcaagagtatccgctgactggaattgtctccgcgtttgcacttgtaattattgtgattttctttatcacctccatcgattccgcagcgctagttaacgatatgttcgctaccggtgcagaaaatcaaacaccgactagttaccgcgtgatgtgggcctgcaccattggggcggtcgcaggttccttgctgatcatttccccatcctctggtattgccacgctgcaagaagtggttatcatcgtggctttcccattcttcctcgtgcaatttgtcatgatgttttctttgcttaaaggcatgagtgaagatgctgctgcggttcgtcgtgtgcagactcgtcagtgggaaaagactgatacaccagaaaaacttgaagagcattcgtcccaaccagccccgggctatgatgacgagggcaaccccttgccaatgcctgccctcgaacatgatgaggacggtaacattgttatcccaggcaacgtagtcattgaaggtgatcttggggtagttggtgatgtggtcgacgatcctgaggaagcccaagagatggggtctcgttttaagatcgtcgagcaaactcggccccagtccagggacgaatacgatatt

SEQ ID NO: 3488 - DNA, 2217 bp, Corynebacterium glutamicum
atgactgaacaggaactgttgtctgctcagactgccgacaacgctggaactgacagcaccgaacgcgttgacgcgggcggaatgcaggttgcaaaagttctctacgactttgtaaccgaagcggtactccctcgcgtgggtgtggatgcggaaaagttctggtccggattcgccgccatcgcccgggacctcaccccacgcaaccgcgagctgcttgctcgccgcgatgaactgcagatgcttatcgacgactaccaccgcaacaactccggcaccatcgaccaagaggcgtacgaggatttcctcaaagaaatcggatacttggttgaggagccagaagctgcagaaatccgtacccaaaacgtcgatacggaaatctccagcaccgcaggacctcagctggttgttccaattctgaacgcacgcttcgcgctgaacgctgccaatgctcgctggggttccctctacgatgcgttgtacggcaccaacgccatcccagaaactgatggcgctgaaaagggcaaggagtacaacccggtccgcggccagaaggtcatcgagtggggtcgtgaattcctcgacagcgttgtcccactggacggtgcttcgcatgccgatgttgagaagtacaacatcaccgatggaaagcttgcagcccacattggagatagcgtctaccgactgaaaaaccgtgaatcctaccgtggcttcaccggcaacttccttgatccagaagcaatcctgctggaaaccaacggcctgcacatcgagctgcagatcgatcctgtccacccaatcggcaaggcagacaagactggtctcaaagacatcgttttggaatctgcgatcaccacgatcatggacttcgaagactccgttgcagctgttgatgctgaagacaagaccttaggttactctaactggttcggactcaacaccggcgaactgaaagaagagatgtccaagaacggacgcatcttcacccgtgagctcaacaaggaccgcgtctacattggccgcaatggtaccgagctggttctgcacggtcgttccctgctgttcgtccgcaacgttggtcacctcatgcaaaacccatccatcttgattgatggcgaggagatcttcgaaggcatcatggatgctgtcttgaccactgtttgtgccatcccaggaattgctccgcagaacaagatgcgcaattcccgcaagggctccatctacatcgtgaagcctaagcagcacggccctgaagaagtcgcgttcaccaacgagctcttcggccgcgttgaggatctgcttgatctgccacgccacaccttgaaggttggtgttatggatgaggagcgtcgcacgtccgtgaacctggatgccagcatcatggaagttgctgaccgcttggcattcatcaacactggcttcctggaccgcaccggcgatgaaatccacacctccatggaagcaggcgccatggtgcgcaaggctgatatgcagaccgcaccgtggaagcaggcctacgagaacaacaacgttgatgcaggtattcagcgtggtcttcctggcaaggctcagatcggtaagggcatgtgggcgatgactgaactcatggcagaaatgctggagaagaagatcggccagccacgcgaaggcgccaacactgcatgggttccttcaccaactggtgcgacgctgcacgcaacgcactaccacttggttgatgtgttcaaggttcaagacgaactgcgtgctgccggccgccgcgacagcctgcgcaacattctcaccattccaaccgcaccaaacaccaattggtctgaggaagagaagaaggaagagatggacaacaactgccagtccatcctcggatacgttgtgcgctgggttgagcacggtgttggttgctccaaggttccagacatccatgacatcgacctcatggaagaccgcgcaacgctgcgtatttcctcgcagatgctggccaactggatccgccatgatgttgtctcgaaggagcaggtcttggagtcactggaacgaatggcagtggtcgtcgacaagcaaaatgcgggcgacgaggcctaccgcgatatggcgccgaactacgacgcctccctcgccttccaggcggctaaggacttgattttcgaaggcaccaagtccccatcgggctacaccgagcccatcttgcacgcacgccgccgcgagttcaaagcaaaaaac

SEQ ID NO: 3489 - DNA, 1296 bp, Corynebacterium glutamicum
atgtcaaacgttggaaagccacgtaccgcacaggaaatccagcaggattgggacaccaaccctcgttggaacggcatcacccgcgactacaccgcagaccaggtagctgatctgcagggttccgtcatcgaggagcacactcttgctcgccgcggctcagagatcctctgggacgcagtcacccaggaaggtgacggatacatcaacgcgcttggcgcactcaccggtaaccaggctgttcagcaggttcgtgcaggcctgaaggctgtctacctgtccggttggcaggtcgcaggtgacgccaacctctccggccacacctaccctgaccagtccctctacccagcgaactccgttccaagcgtcgttcgtcgcatcaacaacgcactgctgcgttccgatgaaatcgcacgcaccgaaggcgacacctccgttgacaactgggttgtcccaatcgtcgcggacggcgaagctggcttcggtggagcactcaacgtctacgaactccagaaggcaatgatcgcagctggcgctgcaggcacccactgggaagaccagctcgcttctgaaaagaagtgtggccacctcggcggcaaggttctgatcccaacccagcagcacatccgcaccctgaactctgcccgccttgcagcagacgttgcaaacaccccaactgttgttatcgcacgtaccgacgctgaggcagcaaccctgatcacctctgacgttgatgagcgcgaccaaccattcatcaccggtgagcgcaccgcagaaggctactaccacgtcaagaatggtctcgagccatgtatcgcacgtgcaaagtcctacgcaccatacgcagatatgatctggatggagaccggcacccctgacctggagctcgctaagaagttcgctgaaggcgttcgctctgagttcccagaccagctgctgtcctacaactgctccccatccttcaactggtctgcacacctcgaggcagatgagatcgctaagttccagaaggaactcggcgcaatgggcttcaagttccagttcatcaccctcgcaggcttccactccctcaactacggcatgttcgacctggcttacggatacgctcgcgaaggcatgacctccttcgttgacctgcagaaccgtgagttcaaggcagctgaagagcgtggcttcaccgctgttaagcaccagcgtgaggttggcgcaggctacttcgaccagatcgcaaccaccgttgacccgaactcttctaccaccgctttgaagggttccactgaagaaggccagttccacaac

SEQ ID NO: 3490 - DNA, 1107 bp, Corynebacterium glutamicum
atgcgtgagcgcatctccaacgctaagcgagtggtggtgaaaattggttcgtcctcattgactaacgatgaggacggacacaccgtcgatcccaaccgcatcaacactattgtcaatgccttgcaagcacgcatggaagctggctcggacctcatcgttgtgtcctctggcgcagtggccgcgggaatggccccgcttggattgagcacccggcccacggaattggcagtcaagcaggctgcagcagcagtggggcaagttcacctcatgcaccagtggggacgttcttttgcccggtatggtcgccccatcggccaggtgcttcttaccgcagctgatgcaggaaagcgtgatcgtgcgaggaatgcgcagcgtaccatcgacaagctgcgcattttgggcgcggttcctatcgtcaatgaaaatgacaccgtggcaaccaccggtgtgaattttggtgacaacgaccgacttgctgcaattgtggcgcacctggtgtcggctgatgctttggtgctgctcagtgacgtggatggactttttgataaaaaccctactgatcccaccgcgaagtttatttccgaggttcgtgacggcaatgatttgaaaggtgtcattgccggcgacggcggaaaagtgggcaccggtggcatggcatcaaaggtgtctgctgcacgtttggcttcccgaagtggcgtgcctgtgctgttgacctctgcggcaaacattggcccagcactggaagacgcccaggtgggcactgtattccaccccaaggacaaccgcctctccgcgtggaagttctgggctttgtatgccgcagatactgcaggaaagatccgactcgatgacggcgcggtggaagcagtgacctccggtggtaaatctttgctggctgtgggcattactgaaatcattggtgatttccagcagggtgagatcgtggagatcttgggacctgccggccaaatcatcgggcgaggcgaggtgtcctacgattctgataccttgcaatcaatggttggtatgcaaacgcaggaccttccagatggcatgcagcgcccggtagtgcatgcagattatctgtccaactacgccagccgcgcg

SEQ ID NO: 3491 - DNA, 1158 bp, Corynebacterium glutamicum
ttgtcttttgacccaaacacccagggtttctccactgcatcgattcacgctgggtatgagccagacgactactacggttcgattaacaccccaatctatgcctccaccaccttcgcgcagaacgctccaaacgaactgcgcaaaggctacgagtacacccgtgtgggcaaccccaccatcgtggcattagagcagaccgtcgcagcactcgaaggcgcaaagtatggccgcgcattctcctccggcatggctgcaaccgacatcctgttccgcatcatcctcaagccgggcgatcacatcgtcctcggcaacgatgcttacggcggaacctaccgcctgatcgacaccgtattcaccgcatggggcgtcgaatacaccgttgttgatacctccgtcgtggaagaggtcaaggcagcgatcaaggacaacaccaagctgatctgggtggaaaccccaaccaacccagcacttggcatcaccgacatcgaagcagtagcaaagctcaccgaaggcaccaacgccaagctggttgttgacaacaccttcgcatccccatacctgcagcagccactaaaactcggcgcacacgcagtcctgcactccaccaccaagtacatcggaggacactccgacgttgttggcggccttgtggttaccaacgaccaggaaatggacgaagaactgctgttcatgcagggcggcatcggaccgatcccatcagttttcgatgcatacctgaccgcccgtggcctcaagacccttgcagtgcgcatggatcgccactgcgacaacgcagaaaagatcgcggaattcctggactcccgcccagaggtctccaccgtgctctacccaggtctgaagaaccacccaggccacgaagtcgcagcgaagcagatgaagcgcttcggcggcatgatctccgtccgtttcgcaggcggcgaagaagcagctaagaagttctgtacctccaccaaactgatctgtctggccgagtccctcggtggcgtggaatccctcctggagcacccagcaaccatgacccaccagtcagctgccggctctcagctcgaggttccccgcgacctcgtgcgcatctccattggtattgaagacattgaagacctgctcgcagatgtcgagcaggccctcaataacctt

SEQ ID NO: 3492 - DNA, 444 bp, Corynebacterium glutamicum
atgctaatcgtgtatttttcctcggccaccgacaacacgcatcgttttgtacaaaagctcgatttacccaacgtgcgcatccccctcactagggtggaagaaccgctgaaaatcaacgagccctacgtgctaatcaccccgacctatggtggtggagtctccatgactggagaaaactcccgcccggtcccaccacaagtcatcaggtttttaaatgatgaacacaaccgcagcttcatcagggcagttgttgcaggtggaaactcaaacttcggctccgattttgggttggcaggcgagatcatttccaagaaatgtaaagtgccctatgtctaccgtttcgagctcatgggcaatgaggaagatgtaagtatccttcgtggaggtcttactcaaaacgcccaagctttggggctggaaccacaagaaccagttacctcgcga

SEQ ID NO: 3493 - DNA, 231 bp, Corynebacterium glutamicum
atggcaatcaccgtttacaccaagccagcttgcgtccagtgcaatgccaccaagaaggccctcgaccgcgctggtcttgagtatgacctcgttgatatcagccttgatgaagaggcacgtgagtacgtcctcgcacttggctacctgcaggcaccagttgtcgttgcagatggctcccactggtccggtttccgcccagagcgcatccgtgaaatggcaaccgcagctgcc

SEQ ID NO: 3494 - DNA, 960 bp, Corynebacterium glutamicum
atgaccaacatccgcgtagctatcgtgggctacggaaacctgggacgcagcgtcgaaaagcttattgccaagcagcccgacatggaccttgtaggaatcttctcgcgccgggccaccctcgacacaaagacgccagtctttgatgtcgccgacgtggacaagcacgccgacgacgtggacgtgctgttcctgtgcatgggctccgccaccgacatccctgagcaggcaccaaagttcgcgcagttcgcctgcaccgtagacacctacgacaaccaccgcgacatcccacgccaccgccaggtcatgaacgaagccgccaccgcagccggcaacgttgcactggtctctaccggctgggatccaggaatgttctccatcaaccgcgtctacgcagcggcagtcttagccgagcaccagcagcacaccttctggggcccaggtttgtcacagggccactccgatgctttgcgacgcatccctggcgttcaaaaggcagtccagtacaccctcccatccgaagacgccctggaaaaggcccgccgcggcgaagccggcgaccttaccggaaagcaaacccacaagcgccaatgcttcgtggttgccgacgcggccgatcacgagcgcatcgaaaacgacatccgcaccatgcctgattacttcgttggctacgaagtcgaagtcaacttcatcgacgaagcaaccttcgactccgagcacaccggcatgccacacggtggccacgtgattaccaccggcgacaccggtggcttcaaccacaccgtggaatacatcctcaagctggaccgaaacccagatttcaccgcttcctcacagatcgctttcggtcgcgcagctcaccgcatgaagcagcagggccaaagcggagctttcaccgtcctcgaagttgctccatacctgctctccccagagaacttggacgatctgatcgcacgcgacgtc

SEQ ID NO: 3495 - DNA, 135 bp, Corynebacterium glutamicum
atggaaaacgtttacgagttccttggaaaccttgatgtcctttccggctccggcctcatcggctacgtcttcgacttcctcggcgcttccagcaagtgggctggcgcagttgctgacctcatcggtctgcttggc

SEQ ID NO: 3496 - DNA, 1191 bp, Corynebacterium glutamicum
atggcattggcacttgttttgaactccggttcatcttccatcaaattccagctggtcaaccccgaaaactctgccatcgacgagccatatgtttctggtcttgtggagcagattggtgagccaaacggccgcatcgtactcaaaatagagggtgaaaaatataccctagagacacccatcgcagatcactccgaaggcctaaacctggcgttcgatctcatggaccagcacaactgtggtccttcccaactggaaatcaccgcagttggacaccgcgtggtccacggcggaatcttgttctccgcaccggaacttatcactgatgaaatcgtggaaatgatccgcgatctcattccactcgcaccactgcacaaccctgcaaacgttgacggcattgatgttgctcgaaaaattctccccgatgtcccacacgtagctgtctttgacaccggtttcttccactcacttccaccagcagctgcgctgtatgccatcaacaaggatgtcgcagctgaacacggaatcaggcgctatggtttccacggcacctcccatgaatttgtgtccaagcgcgtggtggaaattctggaaaagcccaccgaagacatcaacaccatcaccttccacctgggcaacggcgcatccatggctgctgttcaaggtggccgtgcggtagatacttccatgggtatgacacctctcgcgggccttgtcatgggtacccgaagcggtgacattgatccaggtatcgtcttccacctttcccgcaccgctggcatgagcatcgatgagatcgataatctgctgaacaaaaagtcgggtgtaaagggactttccggtgttaatgatttccgtgaactgcgggaaatgatcgacaacaatgatcaagatgcctggtccgcgtacaacatttacatacaccaactccgccgctacctcggttcctacatggtggcactgggacgggtagacaccatcgtgttcaccgccggtgtcggtgaaaatgcccagtttgtccgtgaggatgccttggcaggtttggaaatgtacggaattgagatcgatccagagcgtaacgcattgccaaacgatggtcctcgattgatttccaccgatgcctccaaggtgaaggtgtttgttattccaactaatgaagagttagctatcgctaggtacgcggtgaagttcgct

SEQ ID NO: 3497 - DNA, 987 bp, Corynebacterium glutamicum
atgagcgccgaactctttgaaaactggctgctcaagcgcgcacgcgcagagcactcccacattgtgctgccagaaggtgacgacgaccgcatcttgatggctgcccaccagctgcttgatcaagacatctgtgacatcacgatcctgggcgatccagtaaagatcaaggagcgcgctaccgaacttggcctgcaccttaacactgcatacctggtcaatccgctgacagatcctcgcctggaggaattcgccgaacaattcgcggagctgcgcaagtcaaagagcgtcactatcgatgaagcccgcgaaatcatgaaggatatttcctacttcggcaccatgatggtccacaacggcgacgccgacggaatggtatccggtgcagcaaacaccaccgcacacaccattaagccaagcttccagatcatcaaaactgttccagaagcatccgtcgtttcttccatcttcctcatggtgctgcgcgggcgactgtgggcattcggcgactgtgctgttaacccgaacccaactgctgaacagcttggtgaaatcgccgttgtgtcagcaaaaactgcagcacaatttggcattgatcctcgcgtagccatcttgtcctactccactggcaactccggcggaggctcagatgtggatcgcgccatcgacgctcttgcagaagcacgccgacttaacccagaactatgcgtcgatggaccacttcagttcgacgccgccgtcgacccgggtgtggcgcgcaagaagatgccagactctgacgtcgctggccaggcaaatgtgtttatcttccctgacctggaagccggaaacatcggctacaaaactgcacaacgcaccggtcacgccctggcagttggtccgattctgcagggcctaaacaaaccagtcaacgacctttcccgtggcgcaacagtccctgacatcgtcaacacagtagccatcacagcaattcaggcaggaggacgcagc

SEQ ID NO: 3498 - DNA, 1377 bp, Corynebacterium glutamicum
gtgtccacgtttcataaagttctgatcaacaccatgatctccaacgtcaccactggatttctgttctttgccgtggtgttttggatgtatctttccactggcaacgtcgcactgaccggcatcgtcagtggaatttacatgggtttgatcgccgtttgttccatctttttcggaaccgttgttgatcacaatcgcaagaagtccgtcatgctgttttccagcgtcaccacactcgtgttttattgtctcagtgccctggtgtgggtgttttggctggaggaagacggcctgagcatcggaaataccgccctgtgggtgttcgtttctttcatcctcatcggatcaatcgtggaacacatgcgcaacatcgcactgtccaccgtggtcacgctgttggttcctgaagctgaacgcgacaaagcaaacggcctggtaggagccgtgcaaggtgttggatttttagtcaccagcgtcattgctggttccgccatcgggttcttgggcatggaaatcaccctgtggatctgccttgggctctcacttgtcgcgctgctgcacctgctgccgattcgcgtcgacgaaccggaaatcatcacccaagaagacgcacagcctactgtttctgacgattcagttcccacacctacctccgatttggcgatcgtgtccaaaggcatcgacctaaaaggatcaatgaaaatcatcctgagtgttccgggactgctcgcgcttgtgttgtttgcgtccttcaacaacctcatcggcggcgtgtactccgcactcatggacccttacggcctggaacttttcagcccacagctgtgggggctactgcttggactcaccagcctcggcttcatcgttggtggtgctgtgatctccaaaactggcttgggcaaaaaccctgtgcgcaccttgctgctggttaatgttggtgtggcttttgttggcatgttatttgccattcgcgaatggtggtggctctacatcctgggcattttcatcttcatggctatcaccccagctgccgaagccgcagaacaaaccatccttcaacgagtcgtcccattccgccaacaaggccgcgtatttggactagccatggcagtggaaatggcagccaacccgctctccacagtgatcgtggcgattttggccgaagcctacctcattccatggatggctggccccggcgcggacaccatctggggcgtgatcctcggcgagggtaaagctcgcggcatggcactgatgttcctcgcatcaggtgccatcatgttggttgtcgtgctgttggcattcatgtcgaggtcctaccggaaactcagccagtactacgccaccaccagccaagacattgcgggagctgctgagaag

SEQ ID NO: 3499 - DNA, 2556 bp, Corynebacterium glutamicum
atgagttcattcaatccaactaccaaaaccaatgaagccatgcaggctgctcttcagcaggcatcctcggctggcaaccctgatattcgtccagctcacctgttggctgccatcttggagcaaactgatggcgtagcagcgccagtcctcatggctactggtgtggatcctaaggagatcctcgcagaggccaagaagttggttgcttcttaccccaaggcttctggcgccaatatggctaatccaaacttcaaccgggatgccctcaatgcgttcactgcagctcaggagcttgccggtgagttgggcgatgagtacgtctcaaccgaagtacttcttgccggtatcgctcgcggaaagtctgatgctgcggatctgttgaccaacaagggtgcaacctatgacgccatcaaagaggctttcccttcggttcgtggatctcagcgtgtcaccactcaggatccagagggacagttccaggctttggaaaagtactccactgacctgaccaagcttgctcgtgaaggcaagattgatcctgttattggccgtgaccaggaaattcgtcgcgtcgttcaggtgcttagccgtcgtaccaagaacaaccctgttctgatcggtgagccaggtgtcggtaaaaccgccatcgtggaaggccttgcacgccgcatcgttgctggtgacgttccagaatccctcaagggcaaaactctgatcagtcttgatcttggttccatggttgccggcgctaagtatcgcggtgaattcgaggagcgactgaaggctgttctggatgagatcaagggagctaacggcgaagtcgttaccttcatcgatgagctgcacaccatcgtcggcgctggtgcttcgggtgaatccgccatggatgccggaaacatgattaagccactgcttgcccgcggtgagctgcgcttggttggtgccaccacgctgaatgagtaccgcaagtacatcgaaaaggacgctgccctggagcgtaggttccagcaggtttatgtcggtgagccaacggtagaagatgccatcggtattcttcgtggattgaaggaacgctacgaggtccatcacggtgtccgcatccaggactccgcactggtcgccgcagctgaactctcaaaccgctatatcaccagccgtttccttcctgataaggctattgacttagttgatgaggcagcatcacgcctgcgcatggagattgattcttcacctcaggaaatcgatgagctggagcgtatcgtccgccgcctcgagatcgaagagatggcgctgtccaaggaatccgatgcagcttccaaggaacgtctagaaaagctgcgctcggaacttgctgatgaacgcgaaaagctctctgagttgaaggctcgttggcagaatgagaaaactgctattgacgatgtccgtgagatgaaggaagagctggaagcgctgcgttctgagtcggatattgcagaacgtgacggcaattatggtcgtgtcgcagagctgcgctacggccgaatccctgagctggaaaagcagatcgaggatgcagaatccaaggtcgaggtcaatgaaaatgccatgctcactgaggaggtcacgccagacacgatcgccgatgtggtttccgcatggacgggcattcctgcaggcaagatgatgcagggtgagaccgagaagctgctcaacatggagcgcgtcttgggcaaccgtgtggtcggtcagctagaagcggtaactgcagtgtctgacgcggtgcgtcgttcacgcgcgggtgttgccgatccaaaccgtccaactggttccttcctgttccttggacctaccggcgtcggtaagactgagctggccaaggctgtcgcggagttcctcttcgatgatgatcgcgccatgatccgcatcgatatgtccgaatacggtgagaagcactcggttgctcgtctggtcggtgcccctccgggatacgtcggctatgaccagggcggtcaactcactgaggcagtgcgccgtcgtccgtacaccgtcgtgcttttcgacgaggtggagaaggctcaccctgatgtcttcgatatcctcctgcaggttctcgacgagggtcgcctcaccgacggccaaggccggaccgtggatttccgcaacaccatcttgatcctcacctctaacctgggcgcaggcggtactcgcgaacaaatgatggatgctgtgaagatggcattcaagcctgagttcgtgaaccgtctcgatgatgttgtgatcttcgatcgtttgtcccctgagcagctgaccagcatcgttgatatccagatcaagcagctgactgaccgtttggctggccgcaggcttaaccttcgagtcagcgacagcgcgaaggcttggctggcggagcgtggctacgaccctgcttatggtgctcgtccgttgcgcaggctgatccagcaggccatcggtgatactttggctaaggaactgctggcaggcaacgtccgtgatggcgatggtgtgcttgtcgacgtcgccgacggcggccagaagctcgacgtttccagggcggtc

SEQ ID NO: 3500 - DNA, 945 bp, Corynebacterium glutamicum
atgagcgacgcaccaactgttgtggcctatttggggcctgccggaaccttcaccgaagaagccctctacaaatttgccgacgccggcgtattcggcgacggtgagatcgagcagctaccagccaaatcgccacaagaagctgtcgacgccgtccgccacggcaccgcccagttcgcggtggtcgccatcgaaaacttcgtcgacggccccgtcacccccaccttcgacgcccttgaccagggctccaacgtgcaaatcatcgccgaagaagaactcgacatcgccttttccatcatggtccggccagggacttcgcttgccgacgtcaaaaccctcgccacccacccggttgggtaccaacaagtgaaaaactggatggcaaccaccattccggacgccatgtatctttcagcaagctccaacggcgccggcgcacaaatggttgccgaaggaaccgccgacgcagccgcagcgccctcccgcgcagccgaactcttcggactggaacgccttgttgatgatgtcgccgacgtccgtggcgcccgcacccgcttcgttgctgtccaagcccaagcagccgtttccgaaccgaccggccacgaccgcacctccgtcattttctccctaccgaatgtgccaggcagcctcgtgcgcgccctcaacgaattcgccatccgcggcgttgacctcacccgcatcgaatcccgccccacccgcaaagtcttcggaacctaccgcttccacctggacatatccggacatatccgcgatatccccgtcgccgaagccctccgcgcactccacctccaagccgaagaactcgtcttcgtcggctcctggccctccaaccgtgcggaagacagcacgccccaaaccgaccaactagctaagctacacaaggcggacgaatgggttcgcgcagcaagcgaaggaaggaaacttaac

SEQ ID NO: 3501 - DNA, 1512 bp, Corynebacterium glutamicum
gtgagcccgattcgctcaaaaaagaaaatcaagaacgaaccaagactaacagtcgatgacgtcaacgttgttcccccaaagaagatccgtccggccattaaaggcactgtggtgggtaacttcatggagtggtacgacttcggaatttatggttatttgacggtcacgatgaccgcagtatttacccaaggcctgccgcaagaatggcagttgttggccgtgatgtttggtttcgcggtgtcttatttagttcgcccgcttggtggcctggttctgggtccgcttggcgataaggttggccgccagaaggttttgtacgtaaccatggccatgatggccgtgtctacggcgctgattggcttgctgccgacggcggcgtcgataggcgcttgggctttggtgcttttgtacctgttgaagatggtgcagggattttcgactggtggtgaatatgctggtgcgaccacctatgttgctgagtttgcgccggatcgtcgacgaggtttcttcggagctttcctagatatgggttcctacctgggctttgccgcgggtgcttcggtcgtggcgattactacctgggtgaccactcacttctatggcgcaactgccatggaggatttcggttggcgtattcctttcctgactgcgatcccgctgggcatcattgcggtgtacctgcgtactcgtatccctgagacccctgcgtttgagaacaaccaagacgagccaaatgcagttgttgaaaaggacactgaagatccttatgcacgcctgggcctggctggtgttatccgccaccactggcgtccactgctgattggtattgcgattgtggcagcgaccaacaccgccggttacgcgctaaccagttacatgcctgtgtatctagaggagcagatcggtctgcactccgcatccgctgccgctgtgaccgtgccgattctggttgttatgtccctgctgctgccatttgttggtatgtggagtgaccgcgtgggccgcaagcctgtctacgcgactgctgttgcggcaacgctgatcttgatggttcctgccttcttgatcatgaacaccggaaccatcggcgccgtactgattgcactgtccatggttgctattccaaccggtttgtatgtggcactgtccgcatctgccctgccagcgctgttcccaaccgcgtcacgattctctggaatgggtatttcctacaacatttccgtgtcgttgttcggtggtacaaccccgctgatcacccagttcctgctgcagaagactggcctggatatcgttccagcgctctacatcatgttcttctctgcaatcgcaggtgtggcgctgctgttcatgaccgagtcttcacagaagccactgcttggctcattcccaaccgtggaaaccaagtctgaggccgtggagatcgtgaagaaccaggacgaggatccaaatattgatctttcccatatgccgtttcctgatgaggaaaacgtaggtgctgaaaagcaaaacgca

SEQ ID NO: 3502 - protein, 524 aa, Corynebacterium glutamicum
MSQNSSSLLETWRQVVADLTTLSQQADSGFDPLTPTQRAYLNLTKPIAIVDGYAVLSTPNAMAKNVIENDLGDALTRVLSLRMGRSFSLAVSVEPEQEIPETPAQQEFKYQPDAPVISSNKAPKQYEVGGRGEASTSDGWERTHSAPAPEPHPAPIADPEPELATPQRIPRETPAHNPNREVSLNPKYTFESFVIGPFNRFANAAAVAVAESPAKAFNPLFISGGSGLGKTHLLHAVGNYAQELQPGLRIKYVSSEEFTNDYINSVRDDRQETFKRRYRNLDILMVDDIQFLAGKEGTQEEFFHTFNALHQADKQIILSSDRPPKQLTTLEDRLRTRFEGGLITDIQPPDLETRIAILMKKAQTDGTHVDREVLELIASRFESSIRELEGALIRVSAYSSLINQPIDKEMAIVALRDILPEPEDMEITAPVIMEVTAEYFEISVDTLRGAGKTRAVAHARQLAMYLCRELTDMSLPKIGDVFGGKDHTTVMYADRKIRQEMTEKRDTYDEIQQLTQLIKSRGRN

SEQ ID NO: 3503 - protein, 108 aa, Corynebacterium glutamicum
MIVDNFVYLWIDFKVRILSPVCADVSPAYPQFLGSCAQGGKFRGITFPVTKLTELQVCNYTAVNKVVDNFVSWAFIGSYPQNPCTTPKLQKDPSEDGSSRAAELNFVI

SEQ ID NO: 3504 - protein, 394 aa, Corynebacterium glutamicum
MESQNVSFRVAREDLVTAVAWVARNLPTKPTQPVLRAMLITADDEGLELAGYDYDVSTRVRLSAEVSQPGRIAVAGKLLSEITGSLPNKPVDFRIDGSKAFVTCGSSRFELPLIPLDDYPMLPKLPAGTGSINAKLFTEAVSQVASAAGKDDSLPMLTGVSMEIVGNQINLAATDRFRLALRTFEWEANDPELNVKLLIPARTLLDNARSLDSGLNDSIDIAVGTGDQVGREGLFGVHTDNRETTTRLLDADFPNIAPLLPKEHTAIASVEIAPLVDAIRRVSLVAERNAQIVLHFSEGQVILTAGATEAGHAEETLPCAFTGKELTIAFNPGYLKDGLSVVPTSRAVFGFTEPSRPAIMIPEPEEMPSANENGIFQTPDTYFTYLLMPVRLPG

SEQ ID NO: 3505 - protein, 394 aa, Corynebacterium glutamicum
MHIRSLELRDYRSWPELKVDLEPGITVFIGRNGFGKTNIVEAIGYLAHLSSHRVSSDAPLVRAHAENARVSAVAVNQGRELAAHLLIKPHAANQASLNRTKVRTPRELLGVVKTVLFAPEDLALVKGEPAERRRYLDDIIATRQPRMAGVKADYDKVLKQRNALLKTATIALRRGYGTEEGAAALSTLDTWDGQLARLGAEVMAARFALLNELGPKIYEAYTTIAPESRPAAVNYKTTIDQGLSQFSEFDAGIIEATLLTELAAKRQREIERGSSLVGPHRDDVDLMLGDQPAKGFASHGETWSFALSLRIAEFNLLKSDGTDPILILDDVFSELDAGRREKLVGIAQEVEQVLITAAVHDDLPENLKKVLTAQHTVTVQDTGTGRISLLDVQP

SEQ ID NO: 3506 - protein, 178 aa, Corynebacterium glutamicum
MTDPIEQAFERIRAEAMRRNGSVPDLNKNDAFRRPPAPKGGVEKRKKGRASGLDGRQKRYVRGAESLGSVLNKEIQRRGWGKDIAGGWVTSNWEELVGAKIAQHTRVEMIKDKKLFITCDSTAWATNLRMMQRQILQVIAEKVGPNIITELRIFGPQAPSWRKGPLHVKGRGPRDTYG

SEQ ID NO: 3507 - protein, 711 aa, Corynebacterium glutamicum
MRGTTWGPKRVRWKRLYRISSEECSLKVANTEHNYDASSITILEGLEAVRKRPGMYIGSTGPRGLHHLIWEVVDNSVDEAMAGHATKVEVTLLEDGGVQVVDDGRGIPVDMHPSGAPTVQVVMTQLHAGGKFDSDSYAVSGGLHGVGISVVNALSTRVEADIKLHGKHWYQNFEKSVPDELIEGGNARGTGTTIRFWPDAEIFETTEFDFETISRRLQEMAFLNKGLTITLTDNRATDEELELEALAEQGETATELSLDEIDNETELVEETTDAPKKPKKREKKKIFHYPNGLEDYVHYLNRSKTNIHPSIVSFEAKGDDHEVEVAMQWNSSYKESVHTFANTINTREGGTHEEGFRSALTSLMNRYAREHKLLKEKEANLTGDDCREGLSAVISVRVGDPQFEGQTKTKLGNTEIKSFVQRMANEHIGHWLEANPAEAKVIINKAVGSAQARLAARKARDLVRRKSATDLGGLPGKLADCRSKDPEKSELYIVEGDSAGGSAKSGRDSMFQAILPLRGKILNVEKARLDKVLKNAEVQAIITALGTGIHDEFDINKLRYHKIVLMADADVDGQHIATLLLTLLFRFMPDLVAEGHVYLAQPPLYKLKWQRGEPGFAYSDEERDEQLNEGLAAGRKINKDDGIQRYKGLGEMNASELWETTMDPTVRILRRVDITDAQRADELFSILMGDDVVARRSFITRNAKDVRFLDI

SEQ ID NO: 3508 - protein, 322 aa, Corynebacterium glutamicum
MIQTYILKIQSLKWAQREMLKTTLITDTLGHVTSTEPTTTAHVPLPDGSSTPVQIWASDNKDSQLVMLWPGFGMGGYYYRPLAAALNKAGFHVAIGELRGQGQSSAKASRKSQWGYHDLASVDFPLQIAAAKKALDLEEGHPMRFLSHSMGGQISCLFAARPEAEKYNLRAIFGVGAGSPFRPTFSPKMGKRLGLGAVLLGGIGGHIVGFWPGKVLGKDLVGYGRQSGTHMREWRRFHKHNSLDDLTAQDINYVEVMKKVSIPITFSRCPDDEDCPQASIDGLASFVPAAQIKMIEIPEALGHNRWAREPESTVKLFLEQAL

SEQ ID NO: 3509 - protein, 223 aa, Corynebacterium glutamicum
MSNPNKKPLDPAQRFSLPTRWAMFFVGIFIMSFAIGITVHAGLGTTTISSLPVVWTAASGLSLGWTTIYFNGFMILCQIIVLRSQFKPQMLVQILWAFLFGFLCDLSLQLTTWAQTDNYFVAWIWVIVSTILMSIGVFIQVLPNITFIAGEGIVSALVKKFPNVEFGTMKQIVDWTFVSVAAILSWITMGGLIGVREGTVFAAFFIGFFVRQWRKLYLRSIGH

SEQ ID NO: 3510 - protein, 170 aa, Corynebacterium glutamicum
MPSPGTLMLSAFLSATLRIASSAVELLASRWAPKSAAVPPFWYSCQSPSRESAISGRRRLEPLATMSESILVAAPIAPLSAMPLMPDCLPTVSSINADISAIAASALVETSKSLSEVMFYILSEMRKDRRSTLRLSGRTVILLKKRCNPSSTETENHISHCNHNSHKAYI

SEQ ID NO: 3511 - protein, 147 aa, Corynebacterium glutamicum
MTSLRDLLVSTNADAAIADMSAFIEETVGKQSGISGIALKGAMGAATKIDSDIVAKGSRRLLPEIADSLDGLWQEYQNGGTAADFGAHLEANSSTALDAILSVADKNAESINVPGLGKVYKGVRGKAAKVIEQELPAIGQLIEKNAQ

SEQ ID NO: 3512 - protein, 357 aa, Corynebacterium glutamicum
MFMLAQRTLPIHITAPHLPVARVFHQIRATDADRTSLQRDLELSQAGITRHVSALIDAGLVEETRVDSGARSGRPRTKLGIDGRHLTAWGVHIGLRSTDFAVCDLAGRVIRYERVDHEVSHSTPSETLNFVAHRLQTLSAGLPEPRNVGVALSAHLSANGTVTSEDYGWSEVEIGAHLPFPATIGSGVAAMAGSEIINAPLTQSTQSTLYFYAREMVSHAWIFNGAVHRPNSGRTPTAFGNTNTLKDAFRRGLTPTTFSDLVQLSHTNPLARQILNERAHKLADAVTTAVDVVDPEAVVFAGEAFTLDPETLRIVVTQLRANTGSQLRIQRADAYILRTAAIQVALHPIRQDPLAFV

SEQ ID NO: 3513 - protein, 87 aa, Corynebacterium glutamicum
MKGLSAENVLAIADEVCAEHGVVVRDFAALAAAAAVSTANFHGVRVFGSAEAMAGKVSEMIRALKPLSGRNETFAAVTQRVLLEINK

SEQ ID NO: 3514 - protein, 82 aa, Corynebacterium glutamicum
MPQNWYQSDTILGMAMTLRLNDAQDRALTLLARTQGCSKQEAATRAIIAAASRAVDDAEIAGLARTMLHEYAGVEKRIRQAR

SEQ ID NO: 3515 - protein, 856 aa, Corynebacterium glutamicum
MSDDNTGQFDRVNPIDINEEMQSSYIDYAMSVIVGRALPEVRDGLKPVHRRVLYAMFDNGYRPDRSYVKSAKPVADTMGNFHPHGDTAIYDTLVRMAQPWSMRYPLVDGQGNFGSRGNDGPAAMRYTECRMTPLAMEMVRDIRENTVNFSPNYDGKTLEPDVLPSRVPNLLMNGSGGIAVGMATNIPPHNLNELADAIFWLLENPDAEESEALEACMKFVKGPDFPTAGLIIGDKGIHDAYTTGRGSIRMRGVTSIEEEGNRTVIVITELPYQVNPDNLISNIAEQVRDGKLVGISKIEDESSDRVGMRIVVTLKRDAVARVVLNNLFKHSQLQANFGANMLSIVDGVPRTLRLDQMLRYYVAHQIEVIVRRTQYRLDKAEERAHLLRGLVKALDMLDEVIALIRRSPTPDEARTGLMSLLDVDEAQADAILAMQLRRLAALERQKIIDELAEIELEIADLKAILASPERQRTIVRDELTEIVEKYGDERRSQIIAATGDVSEEDLIARENVVITITSTGYAKRTKVDAYKSQKRGGKGVRGAELKQDDIVRHFFVSSTHDWILFFTNYGRVYRLKAFELPEASRTARGQHVANLLEFQPGEQIAQVIQLESYNDFPYLVLATAHGRVKKSRLLDYESARSGGLIAINLNEDDRLIGAALCGEEDDLLLVSEFGQSIRFTADDEQLRPMGRATAGVKGMRFRDNDQLLSMSVVRDGEFLLVATSGGYGKRTPLEDYSTQGRGGLGVVTFKYTPKRGRLVSAIAVEEDDEIFAITSAGGVVRTEVKQIRPSSRATMGVRLVNLEEGVELLAIDKNVEDQGEASAEAVAKGAVEGPASKTAAEETDSVDNGSDENGEE

SEQ ID NO: 3516 - protein, 114 aa, Corynebacterium glutamicum
MASREVSITRISPLATFRVALAMSIIGLVAWIICVTVLYFGLNVAGVWQNFNDVIGGVGAEQTITFGLVLSISALLGAIGAITVAVLAPLCAIIYNSIVDLFGGLQIQLQEEVD

SEQ ID NO: 3517 - protein, 345 aa, Corynebacterium glutamicum
MSTNLLESTPPFTQLRTGVLQKYTPGLLLCSIAVLIAMIVNHFFSGVSPLIVAIILGIILTNLIQLPASTSPGITLASKKLLRLGIVFLGLQLVFSDILSLGFPMLAVIVCIVAGGIFGTILMGHLLRMKPTQVLLIACGFSICGAAAVAGVEGVTDSEEEEVVTAVALVVIFGTLMIPFIPFATKVLGLSPEIGGMWAGGSIHEIAQVVAAGGVIGGGALGVAVVVKLARVLLLAPIAAILSFRQRRQGYTSPDGKRPPVVPLFILGFLAMVVLRSTVALPDEVIAAGGFLQTALLSAAMFGLGCGVKIQNLIHVGVKPFILAFGSTTLVTSIALAGTLLTHLG

SEQ ID NO: 3518 - protein, 298 aa, Corynebacterium glutamicum
MDNGWPNLQTLALFVAIVEEGSLGAGARKVGMAQPNASRAIAELEADMKAELLVRHPRGSHPTAAGLALVEHSRDLLQSVQEFTEWVTEGRTEQPLKLHVGASMTIAEALLPAWVADMRTRFPACRVDVSVMNSSQVIEAVQKGHLQLGFIETPHVPVRLHARVVQEDKLIVVISPNHEWANRTGRISLRELSETPLIVREVGSGTREALQELLADYDMAEPIQVLNSNAAVRVVVEAGAGPAVLGELALRDHLALGRLLSVPFEGSGVTRPLTAVWSGPRRLPILAGELVSIASNHI

SEQ ID NO: 3519 - protein, 140 aa, Corynebacterium glutamicum
MTIMNEIPEWLTLVSVEAGKRLGLPGPLVFPPELVTLAVEGIELIELEPSWTSDFPLPEFGFLAADMVDFYDDYEFSEWIPGAWPLALDGGGGFFCLDLRAANADGEIPVVWVHASNLGWGDDEAVRVAASLADLLSPSK

SEQ ID NO: 3520 - protein, 290 aa, Corynebacterium glutamicum
MDVGLVTAFLGGTLALLSPCAALLLPAFFASSVGAGPRMILHGVVFYAGLLVLLVPLGLGAGILGELFITQRQTIIVVSSIVLIILGFVQIFGGGFDFGKALPGLDRLQSKATVTSGLGKSFLLGMTSSIAGFCSGPILGAVLTLAATSGNSITSALILSAYGAGMVLPLMAIAALWAKLGQRGQQMLRGREFTFLGRQWHIVSVISGALIIAVGILFWSTNGLVSMPELVPMDTQIWLQEATFSLGSPLFDIALIIVAAGLFLYFWNKRQKRKEEAQRPKESGWVINPR

SEQ ID NO: 3521 - protein, 254 aa, Corynebacterium glutamicum
MVKENSVNQQSKKWLVPTLVVIIAVLLIAVVLLMYRGNASDTAEGVSAAATSDSAAASTAASGSASGAADSDLTSVEARDPSDPVAVGDVDAPVGLVVFSDYQCPFCAKWSDETLPQMMKHVEDGNLRIEWREVNIFGEPSERGARAAYAAGLQDAYLEYHNALFANGEKPSEDLLSEEGLIKLAGDLGLDESKFTADFQSPETAVAIAQHQQLGIDLGAYSTPAFLLGGQPIMGAQPASVFEAAFEQALAAKE

SEQ ID NO: 3522 - protein, 123 aa, Corynebacterium glutamicum
MSIEPGIPTLGPLEEQVMHILWDHGKLTVREVIEFLPGDPAYTTIATVLRHLGRKGMVTTVKDGRTARHSALMNREQYTAGIMDQVLSTSRDRSASILHFVDTITATDRELLLEYLQQQEGRK

SEQ ID NO: 3523 - protein, 331 aa, Corynebacterium glutamicum
MTAASALTVALIIGISLAVIGIFGPALLRHAAPALAKTPHLAVALLIGGILVWPTTLLALSLALAWVLVGPALLPQKAALVCEQCLTAANPFSVESIQTTLPTVLLLVIPTVIAAMCTVGIAAQFMARVRCSRSTAARVQHEAYRRPLLGYNVSVVHDHRPWALTFSPRLGGITLSSGAIDQLADDELEAVLAHEQAHMDQRHHIVTALVDSIAAQLRWVPFIREAAEVLPDYLEIAADQQACRKVNTTALVRALLVLGEKKIPTGTIGSAAGTLFAAGPGRIPHLVGSSTGRKGYVPALAAGSQILLLGFVSVIVLLSYAIALLTGCSLP

SEQ ID NO: 3524 - protein, 60 aa, Corynebacterium glutamicum
MLVSMSSQKALKRLRENIDVFDFTLTDEEMAGIAALDKQQPLAGFTHRDPRMLERLQSLD

SEQ ID NO: 3525 - protein, 176 aa, Corynebacterium glutamicum
MLKCAVDEAAGGRAQAFVSSGDNIGGSPFQSSILGDEPTLEALNQMGLDYSAVGNHEFDKGYADLSSRVADLADFDYLGANVEGENPDLAPYGISHLDGVKVAFVGTVSQETPMLVNSEGIEGITFTDPLEATNRVADELVGSGAADVVVALYHEGITGTEAWSENIDVVFAGHTH

SEQ ID NO: 3526 - protein, 412 aa, Corynebacterium glutamicum
MQSGNYGHALADVDFSFNHDTGELTVDDARMLGVDDINACENPDDTIADIVAQAELDAGEAGKEVVATIDGDFLRASDEGAESGSNYGAESQLVNMIASAVRWSMSTNTATTADIGLMNAGGLHTDLFSGDVTYAEAFEIQPFSGEDSFVTLKGSDFKDALEQQWEEGSARPVAALGVSDNVSYTYDINRPIGDRVTSVTIDDTPLDPERDYVVAASLYLQSGNEGMTALTRGTAPAQTGIVDVQSTIGYLSNNNVTPRTGQAQISITPSGEFNAGETITLDMAGLRYTQGDTATEVTVSLREEIVSAPIDPQLGEAGFGEAGTATVSLDIPATLSGTQNLVVTTDTGTRISMPVEIVGAEQPAPQPAGSSVLGTGVLSGLLGIVVGILGMVGLVNWIDPSFIQQIQQQIFA

SEQ ID NO: 3527 - protein, 55 aa, Corynebacterium glutamicum
MPSNPVAIARQQNWGQDGLANVPDLIQQEQPHDHYGRPVTYDTGIDATTTRRKSK

SEQ ID NO: 3528 - protein, 145 aa, Corynebacterium glutamicum
MAIESIAYTSEALSTGSGRLGHVRSTDGALEFEMTPPKALGGSGEGTNPEQLFAVGYAACFHSAMHSVARSRKITLEDTAVGARVSIGPNGAGGFEIAVELEVSIPQLPQAEAQELADAAHQVCPYSNATRGNISVTVSVIDEEA

SEQ ID NO: 3529 - protein, 471 aa, Corynebacterium glutamicum
MEPVPHHEIHEMTVDGAEVVLVSVSPLSVNGPCYYLPVGITNGSFKRVGDEDRKLSHLEIYELQNRFVQTKTDRNPVPDSSIDDLNNQLAASFKQRLIESNSRSLGTDDNWLLRKNITTSKGELTIAGLLALGSYPQQFFPRVIIDVAVHPGLHKSPIGTSIRFEDRKICEGNLLEMVQEAMSAIKRNLRVRRVVEGLSGKDVLEIPEEVLREALANAVLHRDYSELAQNEAIHVDIYKDRVEITSPGGLPNGKRPESILDGYSEPRNRVLSRILMDIPWTHEVQGVLAESNGTGVPRMFNLMREAGLPVPNFKIDISSVTVELSRHGLLDAQTSEWLVEKLGSDFSNTQGIALVLAKELGAVTSRDLRNQTGHDSEDMRSLLDALVDRGVLNQNLQNQYQLATSSVNVTQSEQEVLDAINKTTPVTIREIATKTGKTASSLRPLLRGLVEAGLVVATAPPSSRNRAYLKA

SEQ ID NO: 3530 - protein, 146 aa, Corynebacterium glutamicum
MNWILACESNPSTGVKSGSLSPNRMYPPLVFANALNDSQKLFDPLLKGNRPQDFTSTVSSSFPFFLRRSRSFSNSNGSTVASAPQSIKRIRYPCQSTSLRPSVSTLRASLYTLRPSVSTLRASLYTLRPSVSTLRVLVFLVRSALR

SEQ ID NO: 3531 - protein, 426 aa, Corynebacterium glutamicum
MKNSKLLLIAAVSTASILLASCGTDSSADTATASSSATASSEAHDHDGHEAEGSSTAVEVSSPQARIVTTYDGGIITLDANTLEILEDTELAGFNRLNSAGDGRHVFVSTGGGFQLFDTGAWTEPHGDHTHSYTATPELTDITYSTDKPGHVVNHAGKTVLFGDGDGKIQIFDTASLLKGDEVEPEIKNALKAHHGVAVVLENGDLLHTLGDEDSRNGAVVFNAAGEEIARNEQCPGVHGESAALGDAIAVGCEDGVLIYKDGEFTKVQAPDSYGRIGNQSGSDVSPVVLGDYKVDKDADLERPERVSLTNTETGELTLVDLGTSYSFRSLGRGPAGEAVVLGTDGALHIIDANTGAITNTYPVIDAWTEPEVWQEARPTLFINKDRAYVSDPSNNELHVVDLANGNILASATLPGTPNELTGVSG

SEQ ID NO: 3532 - protein, 318 aa, Corynebacterium glutamicum
MILKDIFNNGELFGASSAKNFRKLLAVPAVAASLAFGITACSAVDDTPDIVVTTNILGDVVSHIVGDSADVQVLMKPNADPHSFGVSAQDAAAMEHADLIVANGLGLEEGLQSNVDNAKSQGVPVLEVGEHIDVIDYSPGVPDPHFWTDPARMIAATEVIEAELIKELDPSLTESITQSAQHYREELVALDEEVTELLSGVAPENRKLVTNHNVFGYLASRFNYTVIDTIIPGGSTLAAPSASDLNDISTAIEDNNVPAIFTDTSSPQRLAEVLASNAGIDVQVVSIFTESLTDADGEAPTYISMQKINAERIASTLS

SEQ ID NO: 3533 - protein, 283 aa, Corynebacterium glutamicum
MKFFTDALIVPFDVSFISRALVAGCLAAILCSLIGTWVILRRLTFFGDAMSHGLLPGVATASLLGGNLMFGAAISALIMSAGVVWTSRKSSLSQDVSIGLQFITMLSLGVVIVSHSDSHAVDLTSFLFGDILGVRPSDIFIIAIATVLGGLTIFLFHRQFTALAFDERKAHTLGLNPRFAHLLMLALIALATVVSFQVVGTLLVFGLLIGPPATAALLVQDKASISLIMIVASLLGCAEIYLGLLISWHASTAAGATITLLSAAIFFATLLTKSAISRLNFTA

SEQ ID NO: 3534 - protein, 219 aa, Corynebacterium glutamicum
MAELSVRNLTCTYGNHIALNNITARFPTGKITALIGSNGSGKSTLLETLAGMLAPRSGSINNLVPEIAFVPQRSHVSHNLPITIRQTVSMGRWSAKKNWQRLTAADCNIVDSCLDRLEISGLADRPLGEVSGGQRQRALIAQGLAQQAPLLLLDEPLAAVDSHAASLIEDVINQQRNQGTTIILATHDLDQAHQADQIIALEKGIIKPQRKATESIKKR

SEQ ID NO: 3535 - protein, 327 aa, Corynebacterium glutamicum
MKLPRLAAALIGAALLITGCSATGGAPRATDGASGGGTVDTPRLVVAMVSHGAPGDTFWDLVRKGAEDAAQKDNVELRYSSNPEIPEQSNLVQNAIDSRVDGIAMTMPNAQSLGPVAQKAVDAGIPVVGLNAGMNEYQDYGMTGFFGQDESVAGASAGARLAEENAQKVLCVIHEQGNSSQEARCGGVSEGLGKQVETLYVNGMDLTSVNSTLQAKLAQDRSIDWVVGLQAGVSMAISDAADAANSEVKIATFDTNAQLMTAIRDGKIQFAIDQQPYLQGYMAVDSLWLAHRNGTTVGGGRPVYTGPAIVDATNVDVIAEAVGEGLR

SEQ ID NO: 3536 - protein, 341 aa, Corynebacterium glutamicum
MTKIKSGEASTSIVERALKRPELTSLLGAVLVFTLFMVVAPAFRSWDSMATVLYASSTIGIMAVAVGLLMIADEFDLSTGVAVTTAALAASMFSYNLWLNTWVGALIALVISLAIGFFNGFLVVKTKIASFLITLATFLMLQGINLAVTKLISGTVATPTIADMEGFPSARAVFASSIPIFGVNIRITVFWWLLFVIVGTFVLFKTRIGNWIFAVGGDEEAARAVGVPVRGVKIGLFMFVGFAAWFVGMHNLFLFDSIQAGQGVGNEFLYIIAAVIGGISMTGGRGTVVGTMIGALIFGMTNQGIVYAGWNPDWFMFFLGGTLLLAVLLNHRFERFNKERS

SEQ ID NO: 3537 - protein, 253 aa, Corynebacterium glutamicum
MTDLIQLREVSKKYGAFQALNDINLNVRAGEVTCVLGDNGAGKSTLIKILSGLHPATSGEVIVAGDVVNFGSPRDALDAGIATVYQDLAVVGQMSVWRNFFLGQELTGRFGVLKQEEMRRITDEQLREMGIELRDVDVPVASLSGGQRQVVAIARAIYFGARVLILDEPTAALGVKQSGMVLRFIAAARDRGIGVIFITHNPHHAYLVGDHFILLNLGKQVMDKSRAEVELEELTLAMSGGGELDSLSHELKR

SEQ ID NO: 3538 - protein, 272 aa, Corynebacterium glutamicum
MNMSTIGNLKLVVDGARKAYGTYADYRDRKVSETYDALSQAAGEYAPKAEQAVETARESAKEFYTESRDKAGNVTKAARARLEKALAEADKQGTSALKDARESGKKLNRKARRKADKAAKAARKATEKKESHWVRNLSLAALATSGIVAVAYAFLNKTKKETPGTQPPRVEVQLKKAVEQDEPEVVAEAAVEEPELVYSTESPETTEAPAEATETPAETTEEEAKTEAELEAELEAEADAEQEAAEEAEAEAIQAEFDKKNAPQRTQSEKKK

SEQ ID NO: 3539 - protein, 187 aa, Corynebacterium glutamicum
MVGISLDVVMMGVMTSKTATAILHTNRGDITIDLFGNHAPETVANFVGLAQGTKDYQSANAQGDSEGPFYNGSVFHRVIDGFMIQGGDPTGTGRGGPGYTFADEFHPELRFDRAYLLAMANAGPGTNGSQFFITVTPTPHLNNAHTIFGEVTDAESQKVVDAIATTATDRYDRPADAVVIESVEITA

SEQ ID NO: 3540 - protein, 229 aa, Corynebacterium glutamicum
MKDQLKIVGFMNVERIYRQAPASTLISLAIIAVYAVTAIQSRSVTDNLGSTSIGDAWILYAPLMDDGGFGPLRAIGGMFLHIGPGHMLLNLVLLWLLGREIERDFGSALFTAMYFVGGIGASAAVIWMDPYSPTAGASGAIYAMMAILVGLFVLRSADIRAPLILIAINIAYTLMSTNVSLWGHLGGLITGALITWPMVKAKTQRTRWIIVLIGFAVVVAAVILGIDRV

SEQ ID NO: 3541 - protein, 326 aa, Corynebacterium glutamicum
MQFRPRTLMVVLIAVTLVVILIHLSLTVGSITASQAWSAVVGVGDASDIRSVQSRRLPRVLTAVGVGAALGLSGACFSPCHVTVLGSPDIIGFTTGAATAAAISIIFFDAGVVLTGVAAILGGLATAVFVYLMARQNSNTGGLRLVLVGIGTGAFLGAARDFFMVRADITGASTVQLWSAGSLSGRDWNHALLVLISCAVIVPALCIIVRRLRLMEMGDDAAGALGISVERTRLIAILLAVLLVGIATAAAGPIAFIALAAPQIARALAREDGVLVAASISIGSGLLVAADCLEQHVDTELHTPVGLVTSLLGGVYLMWLLSRKEA

SEQ ID NO: 3542 - protein, 332 aa, Corynebacterium glutamicum
MSGDGTAQKALQPESSGFFSQRRFLDETGLNISTWRTRTRLSLAVAYLSDGDSAEWAAHHVGFSGASNLSKAFRTHMGISPNQILTLPEPQHLDPPLPQLASLEIPANETWSRINGSHIMVWAFQGTSTVRVADRELTVHQGEGLILPAGMRLDLHTPAGGLMLPLGYQVPDSHSISAQHVDIIQFDCSIQQLLQCTISAYTPFHPHKAAPDQCFSLPFPKCSTKNTPTKNHNDELISLAVDLAVSRETNVSAIRGGIAEEFAHMTGIAVQRWGLLRRMTLARIQLSKGLSPGVVARNLGYSHLPAFNRAFTATHGCTPMQYQADCARIPTP

SEQ ID NO: 3543 - protein, 259 aa, Corynebacterium glutamicum
MLQAHDLTLSYGGRNIVEGLSLDLPERGLSIIIGPNGCGKSTVLKALGRLLKPQLGKITLGGRDISSMGTKHVAKHIGVLPQPPYAPDGVSVTELVSRGRYPHQHLLSQWSKDDEAIVARSLAEVGMHTHAEHLVSELSGGQRQRAWIAMALAQETDILLLDEPTTFLDVAHQISVLDLCSDLHQRGRTLAIVLHDLNMAARYATHIIAMRDGTIIDQGKPEEILTKALLKEVFDLDALILKDPNNGRPLIVPTDRRNS

SEQ ID NO: 3544 - protein, 274 aa, Corynebacterium glutamicum
MKETDNLLRENSHDRDISEIVATITALDHPSPSLLRFTAFVPGSANNPVWAEANVAIRLYLSEEFDDATRVYTVRSFDAATESIVVDVVQHHHESPMMRWSDTVKINDTLVLTGPRPHFVIPEGEQAALFLDDTAIPALAAILDQWPTDLRGKGWVVTDDPAAFDELPSIDGLELNLLAPGSDPTVQPLAQQAYDLENPETYVVWAAGERDEIKSIRRHFRKQVGLEKDAVAVFGYWKYNTTNTQIDAVRKENYMKMLSEGLQLENFDDLSLEI

SEQ ID NO: 3545 - protein, 90 aa, Corynebacterium glutamicum
MPKARVTKNETAPVSSNPSANRTPVKINSAGTPMWYKVIMFAFMIVGLAWLIINYLVGPQIPFMADLGAWNYGIGFGLMIIGLLMTMGWR

SEQ ID NO: 3546 - protein, 646 aa, Corynebacterium glutamicum
MTFVIADRYELDAVIGSGGMSEVFAATDTLIGREVAVKMLRIDLAKDPNFRERFRREAQNSGRLSHSSIVAVFDTGEVDKDGTSVPYIVMERVQGRNLREVVTEDGVFTPVEAANILIPVCEALQASHDAGIIHRDVKPANIMITNTGGVKVMDFGIARAVNDSTSAMTQTSAVIGTAQYLSPEQARGKPADARSDIYATGCVMYELVTGKPPFEGESPFAVAYQHVQEDPTPPSDFIADLTPTSAVNVDAVVLTAMAKHPADRYQTASEMAADLGRLSRNAVSHAARAHVETEETPEEPETRFSTRTSTQVAPAAGVAAASTGSGSSSRKRGSRGLTALAIVLSLGVVGVAGAFTYDYFANSSSTATSAIPNVEGLPQQEALTELQAAGFVVNIVEEASADVAEGLVIRANPSVGSEIRQGATVTITVSTGREMINIPDVSGMTLEDAARALEDVGLILNQNVREETSDDVESGLVIDQNPEAGQEVVVGSSVSLTMSSGTESIRVPNLTGMNWSQAEQNLISMGFNPTASYLDSSEPEGEVLSVSSQGTELPKGSSITVEVSNGMLIQAPDLARMSTEQAISALRAAGWTAPDQSLIVGDPIHTAALVDQNKIGFQSPTPATLFRKDAQVQVRLFEFDLAALVQ

SEQ ID NO: 3547 - protein, 469 aa, Corynebacterium glutamicum
MSQEDITGKDRLQELIGADYRLQWIIGHGGMSTVWLADDVVNDREVAIKVLRPEFSDNQEFLNRFRNEAQAAENIDSEHVVATYDYREVPDPAGHTFCFIVMEFVRGESLADLLEREGRLPEDLALDVMEQAAHGLSVIHRMDMVHRDIKPGNMLITANGIVKITDFGIAKAAAAVPLTRTGMVVGTAQYVSPEQAQGKEVTAASDIYSLGVVGYEMMAGRRPFTGDSSVSVAIAHINQAPPQMPTSISAQTRELIGIALRKDPGRRFPDGNEMALAVSAVRLGKRPPQPRTSAMMAQAEAPSPSESTAMLGRVARPATITQEAAPKRGSGIGIGLFIAALLAVIIGAVIYAGTTGILFNDTPEETTTPETITETYTPTVEETTSQWVPPTPPTRSTFTEPETTSHRPTTSEESTSEEPTTEAPTSSRTVPQIPTSTPRTSASVPVETNAPADDLIDAVNGLLDVGGAQ

SEQ ID NO: 3548 - protein, 474 aa, Corynebacterium glutamicum
MNRSIRITSLFSLLLILVLVANLTWIQAFRDDDLAQNPLNARGFLEAKSTPRGQISTGGQVLAESSQDDQGFYQRSYITNPTAYAPVVGYLSDVYGAAGLELGYNSILNGSDSSLFTSQWLDVISGSPTHGANIELTLDPNAQQTAYEQLSQSGYEGAVVALRPSTGEVLAMASSPSYDPNQIVDPATAEDAWAEYTSTEGAPLLNHATQESLPPGSIFKIITTAAALENGYSADSTVTAEAAVTLPGTNTTLTNYGGQTCAGGGTTTLLTAFQLSCNTAFVETGIDVGADALRASAEDFGVGQTYSLGLDNVPGGLGEIPDDAALGQSSIGQRDVQMNVLQAAVMAGTVSNGGVRMEPYLVSRVTGQDLSELSTHKPKSVGGVEPEIAEQLKTLMEASERNTSGYTGIQIASKTGTAEHGDENTPPHTWYVAFNNDIAVAVLVKDGGGFGTSATGGQVAAPIGRAVLQAAGGF

SEQ ID NO: 3549 - protein, 381 aa, Corynebacterium glutamicum
MAWVAPFADQIMLPVVAVLNGIGLVMIYRLDEATGYSTVNSQLMWTVVGVTLMVAVLLLLRDYKSLSRYSYLLGVVGIVLLALPLVWPQPGGVEARIWIWLGPFSIQPGEFSKILLLLFFAQLLATKRALFTVAGYRFLGMDFPRLRDLAPILVVWALAILIMAGANDFGPALLLFTTVLAMVYLATGRGSWLLIGAVLVAVGAFAVYQVSSKIQERVQNFVDPVAHYDTTGYQLSQSLFGMSWGGITGTGIGQGYPNMIPVVHSDFILAAIGEELGLIGLAAIIVLFGVFVTRGMRTATLARDSYGKLVASGLSMTIMIQIFVVVAGISSLMPMTGLTTPFMSQGGSSLMANYILMAIILRISDSARRPVMSKQASEVAA

SEQ ID NO: 3550 - protein, 451 aa, Corynebacterium glutamicum
MLKLKYAVASDRGLVRGNNEDSAYAGPHLLALADGMGGHAAGEIASQTMINHLRALDVDPGDNDMLALVGMVAGEANAAIAEGIAEDPARDGMGTTLTAFMFNGRDLAMCHVGDSRGYVLRDDKLVQVTVDDTFVQSLVAEGKLDPEDVSTHPQRSLILKAYTGHPVEPTLEQFPALPGDRLLLCSDGLSDPVTHSTIEETVRVGTPQDASTKLVELALRSGGPDNVTVIVADVVEVTEAEAAAEASVPVTAGALNGEQPEDPRPDTAAGRAAAITRRAQVIDPAPKISDAGTEDIPTIEEPPEKSSSKLAVLIVALVILIGVVAAGWWGYSRIDSTFYVAVNDEEAITVEHGVDYRIFGKDLHSQFQVACLNEAGTLSLKESCENGTSFKLDDLPASVRGSVAGLPSGSYDEVQAQMQRLAAQALPVCVNLEVTTGGDRNEPGVNCREVS

SEQ ID NO: 3551 - protein, 154 aa, Corynebacterium glutamicum
MDSLVLLGLRIALLVVLWFFVLMALRAMRADLKVTGQASTSSSSVAAPQGLARAFNRSSPPRLLTVVEGPLAGSSIEVSEDMTMGRSPECTFVVGDDYASGMHARVFKRGSEWFVEDLDSRNGTFVGGTRIDQPEQIAVGTDIRIGRTTVRLVP

SEQ ID NO: 3552 - protein, 288 aa, Corynebacterium glutamicum
MNSLAKLDSSMQRGLDNALAFVFRGRVVPAELEELLKQEAEDNVVHTEFGYVEAPNVFKVSVSPNDFSNLVDRFPDQPARFGDQMMRFCRNSGWTLVGPVIVLIEEDSSLHTGQLKSVSEKDPDPELSSGYLPLEGDGILPVAESESKNVSDSSPYTGTEFLPAQSADRPLVQGVPQSQVDANRQAAMKPAGPTVTLLLQDGSSRTYLVREGSNIIGRSNDADLRLPDTGVSRQHVEITWDGRDAILVDLKSTNGTTVNDTPVDNWLLADGDVITVGHSNIEVRIVSP

SEQ ID NO: 3553 - protein, 49 aa, Corynebacterium glutamicum
MHPGGLAYNSGAVHLYNDAIVRFGLDRVKVFLNGISVTGRDKAMPLGVF

SEQ ID NO: 3554 - protein, 240 aa, Corynebacterium glutamicum
MIHEQDVQKLLNYITSHFGVDPERWFHPEGYQSIALAILDSIYSTGNRYTGVLNLVNRYCGLRANEGSHPEADTATDLIETFYRWGGVDEFVLKTNNRWRTSSKIHAPYKAYAALEAAKVLAGHSIESISDVVGRFDSRESREHSDIAREWLMITGQSSALTWSYFLMLVGVPGVKADRMIVRFVTHVLERPKEISRHEASRLIEEVADIMCVNYIYLDHTIWRFQSGRPYLQEDSSPFE

SEQ ID NO: 3555 - protein, 73 aa, Corynebacterium glutamicum
MDVASFKFEYPLRLPTRGYHFSKKDYFSPYFIWVFGFEEQVCLSAALATLRSESDQSVNEAISAKQDTQLSQK

SEQ ID NO: 3556 - protein, 157 aa, Corynebacterium glutamicum
MTYKADYDLDFEKVVFRMSQLFEDLIPSENAYDPYKKSTWPTLTMAATWVQDDCLIVVFRADPRRVAPMDGATFVGYFCKIYPQYIPDNIEFGAVELMYADWMAGDGFIWKIDLKAPQKIHWRNAFDGLKAPADLEELLDYAAEIPMWLNPEIEKWM

SEQ ID NO: 3557 - protein, 318 aa, Corynebacterium glutamicum
MGTLASSSETLIVMMRYFPSLFVSSSVELLDIGTDSDKVGAGVEVVLCLVQIKGIDTHRFTSITESLDGFLLRPQRLAGSSATCFLVVRHDEHYPAAANLIAFDKGWSTLIAPQLEDPEAEEFTAGFLTEYQDNLITAGMEHQALASGFPVGRRFKSDIALRRCDAVTTHIGHEHSADGHWRIYVFAGQATPQDSESALNKWAQWMEESEDSPLNRFTPEAGDRNAVFDIKATYQQHYHSFDLFDAPEVFFPRVGPYKLQNLENVWTALDSQDIFESRGISRDGAIVVVRPDQYVAAVLPLEDTAALAEFFNGNLLEP

SEQ ID NO: 3558 - protein, 490 aa, Corynebacterium glutamicum
MTINVSELLAKVPTGLLIGDSWVEASDGGTFDVENPATGETIATLASATSEDALAALDAACAVQAEWARMPARERSNILRRGFELVAERAEEFATLMTLEMGKPLAEARGEVTYGNEFLRWFSEEAVRLYGRYGTTPEGNLRMLTALKPVGPCLLITPWNFPLAMATRKVAPAIAAGCVMVLKPARLTPLTSQYFAQTMLDAGLPAGVLNVVSGASASAISNPIMEDDRLRKVSFTGSTPVGQQLLKKAADKVLRTSMELGGNAPFIVFEDADLDLAIEGAMGAKMRNIGEACTAANRFLVHESVADEFGRRFAARLEEQVLGNGLDEGVTVGPLVEEKARDSVASLVDAAVAEGATVLTGGKAGTGAGYFYEPTVLTGVSTDAAILNEEIFGPVAPIVTFQTEEEALRLANSTEYGLASYVFTQDTSRIFRVSDGLEFGLVGVNSGVISNAAAPFGGVKQSGMGREGGLEGIEEYTSVQYIGIRDPYAG

SEQ ID NO: 3559 - protein, 489 aa, Corynebacterium glutamicum
MSEPALELYPLGYYCRFSIPRGVSSFYVEKESSVLIERIYDEDLAQASYFIGCQAHNTAVVVDPRRDIAVYLDMAKKNGMEIVGVTETHIHADYLSGTRELAAATNATMYVSGEGGADWQYEFDAERICDGSEIRLGNLVLTAVHTPGHTPEHLSFLLKDGAFADEPGFMLTGDFVFAGDLGRPDLLDEAAGGVDTRFEGARQMFKSLKEKFLTLPDHIQIFPGHGSGSACGKALGSVPSTTLGYERQFAWWGKYLEADDEQGFIDELLEGQPDAPAYFGRMKRQNRQGPAIMGARELLPQLEASDLHDVIVVDTRSADEVHQGTVAGAVNIPAGNSMAKFGSWTVDPEKDSRALVLLAASQIGAMEMWDHMVRVGIDNVAGFITNFDGVDLVAPQTVSPDQLDELEYDLLLDVRNRSEVEEGYIPGALHINGASVLWNLEKLPRDGKIVSYCKSGTRSSIAASTLRNAGFDVVELQGSYDNWVRHNAQ

SEQ ID NO: 3560 - protein, 263 aa, Corynebacterium glutamicum
MRGTKTICRLSRKSPMTAVLLLTLFLSLFIGISLGLLGGGGSILTVPILTYVAGLEPREAIAASLFIVGTTSLVSAISHARNGRVRWKTGLLFGAAGMVGAFGGGVLGGYIPGTILMIAFALMMIATSTAMLRGRKQKKGASKSSLWRVLVDGLVVGAVTGLVGAGGGFLVVPALALLGGLSMPVAVGTSLVVITMKSFAGLAGYLTSVQLDWGLVLMVTAAAIVGSLAGSRLAGRVPETLLRKGFGVFVLVMGVFVLGLELL

SEQ ID NO: 3561 - protein, 97 aa, Corynebacterium glutamicum
MSITITETNKRRNLDQILDVRENFEIAEGIIPEAVHIPMGELNFRFKELDQNRPVIVVCRSGNRSTQVANALKQAGYTAYSMTGGMSAWYQNNLPIK

SEQ ID NO: 3562 - protein, 197 aa, Corynebacterium glutamicum
MTSAQPITSVDAQTLKSWIDKHEGLTVIDVRTAHEFSNLHIKGSYNVPLTTLAEHSEEISSRVGEHVVLVCQSGIRAGQAQQKLAPLGISTVAVLEGGINSFAKADGDVVRGTQVWDIERQVRFAAGSLVLAGLAGGKFLSPKVRTLSGIIGAGLTFSGVSNTCAMGKALSALPWNKTKPVPTETETLSKLPSPKEN

SEQ ID NO: 3563 - protein, 58 aa, Corynebacterium glutamicum
MLDEGEDCKAVVTQLAAVTKALDRAGFAIIATGLEQCLTNPDGDMDKKELEKLFLSLA

SEQ ID NO: 3564 - protein, 285 aa, Corynebacterium glutamicum
MRTVFQLVQDFHKEARGEGLPIKWGPSRGEFGMLEFPADVIPENIKHIAQTKFQTEATSVEDIRRAINLLSDQAERAGASFNPGFILAQVGSTIVEVYGGAPVAWLDAVELLISPDVEWVGVHGSRKLDINVSGELSGVISAGDKLGELLGDDWTINIVHGEYKIQIEDARPSTAFLADATELINQANSEIVPFHVRMLSNSKIVMSGFSDYSLAGDAITSAGKLAELARPFAHWKENVIPTIEIAMDYEPSPVADLWQGDSSETPEPFDDFERLLREEMLIPEI

SEQ ID NO: 3565 - protein, 280 aa, Corynebacterium glutamicum
MLIGMSNQTVNQAVSSGVKASPHRFNRFEIKYLITEQDVPALREQLATRMSTDPLSPPGGYRVESLYFDSADLRCYTEKIEGLKFRRKLRIRTYGDGVLTPESTVSVEIKQRVNKVTQKRRLDLPFIYALALGDSTGAAVGEQVDVEKLLEISPENQHALIHEMASFAKNYRLRPIATTKYHREAFVGADAEESSRVTIDHGVSGRDRDFLLGQDLEDRPTVAQGLAVVEIKCDERVPFWLTDMTAQLEMSVIRMSKYCETIEAFHNRPASAFGAVDPIF

SEQ ID NO: 3566 - protein, 237 aa, Corynebacterium glutamicum
MLSDLSSIFDFQDLSGTFSVVDVLITLVLSFVLTSIVGVVYQKTHRHISYSQSFVQTLVLVGMVIAIIMLVVGSNIARAFALVGALSVIRFRNAVKETRDVGFLFLAMAIGMTCGTRFYVLAIAATIVVCGVLFIMYRFDWFKADIQRQVIKVQVPADGQADSGRSYAEEVELILAQYCTSFEMMSAESVRGGALTEFSYTAQMRKNVKPHELVAKMRDVNYGQKATVLTGHDQTDV

SEQ ID NO: 3567 - protein, 551 aa, Corynebacterium glutamicum
MPSFKSARWRMNRRLFLGTSAAIIAVGGVLGGVQVVPYISSGEIQTSASSTATIDVGAGNVDIFDTSVSHEISLQVSQESLDEMLADYQEDGSKTWVKATITIDGVTIENVGIRLKGNSTLSGLGRTSEEGGPQAPEGVEEFTDLSEEEIAQFEEQFAAQQETTDASETGETAENEETRGPGGGMGGGGMGGMTSVDADDVSTWPLLISFDKYEDGRVYQGMTQLALRPGTTVVNEAMALALTAETGQVSQQSSFTTFSLNDEPSTTRLLLKHPDENYADALGNGVLFKADSNSSFTYQGEDQTEYDGQFKQINGDGNGDIQPIINLLKWLDTASDEEFAEHLSDYVDVESFARYVATQNLLVNSDDMAGPGSNYYLWYDYDTGLISVISWDLNLAMSGSTDAGPDDEISMGGGGGGGMRPGGTTDTEIEGTATEDMPDMGNMQQRERPEGMPDMGEMPDMGDREGGGSMGGNQLKERFLASDAFTEIYEQVYWELYEEMYGSGTAIELLDEIAASIPETDAVTADEIATEVASMREWITARTEALAALQE

SEQ ID NO: 3568 - protein, 373 aa, Corynebacterium glutamicum
MPKNYDINGAIRRRDMLRRRYLPDSANSTPVPEEVSPLTRYVTDGIPKRPPLGATVADGLKFAEGASNRMVMSLYPAPSKPAIEELAEAWDLHPTIVEDLLLGQQRPKLDRYEDIIFIAIRSARYIDSREEVDFSEFHILMKPQAIAILCQDNQWIDGTSAASFSNPEEIDKRIKTLLADAELLSSGPRAVAYRLVDAIVDGFSPVLRGIAIDQEQIERQVFSGDAAVAERIYNLSQEIIDMQHTTSSVTEVVQRLNKDFIRSGMSEELRAYLDDVADHLTRDNTRVSEYRESLSQILNVNATLVAQRQNEDMKKISGWAAIIFAPTLVSSIYGMNFDIMPELHWAFGYPLALLAMLGFTLLLYWIFKRSKWM

SEQ ID NO: 3569 - protein, 149 aa, Corynebacterium glutamicum
MPTYTCWSQRIRISREAKQRIAEAITDAHHELAHAPKYLVQVIFNEVEPDSYFIAAQSASENHIWVQATIRSGRTEKQKEELLLRLTQEIALILGIPNEEVWVYITEIPGSNMTEYGRLLMEPGEEEKWFNSLPEGLRERLTELEGSSE

SEQ ID NO: 3570 - protein, 423 aa, Corynebacterium glutamicum
MSTIPLNRLAVIAAIIGVGTGLFVAALNWSAIGVERLVYGADHLHNYNPVANVSPLRLSITVIVLSVVASWAWFFVHRTGPKEVSIVGAIRGEKMPILETIASAFLQVTTVAAGAPVGAENAPRIAGALVGERFSRWLQLDIDAKRILVASAAGAGLGASFHLPLAGVLFALEVLLVEASTRTVVIAIITTTAAVATTGFFVQTPDVFSTVPLTESPWMLLAAMVTGVVAGMCGHWFSAAAHKMAQASPKGVKILWQMPLGFVVIAAVIYFFPETLANPRWLADSMLGDGLILSTILLVLVLRTAMFLLAFRVGMVGGNLIPAFALGSMVGGVVGAVLEPITNVPIAAFALLGAAAFLSTTMAAPLFGLIAAVEFTDMEAQGYLPIFLAVASAVLAVRVWSVIAKHELRAIPITYASWTGELK

SEQ ID NO: 3571 - protein, 230 aa, Corynebacterium glutamicum
MNPITELLDATLWIGGVPILWREIIGNVFGLFSAWAGMRRIVWAWPIGIIGNALLFTVFMGGLFHTPQNLDLYGQAGRQIMFIIVSGYGWYQWSAAKRRALTPENAVAVVPRWASTKERAGIVIAAVVGTLSFAWIFQALGSWGPWADAWIFVGSILATYGMARGWTEFWLIWIAVDIVGVPLLLTAGYYPSAVLYLVYGAFVSWGFVVWLRVQKADKARALEAQESVTV

SEQ ID NO: 3572 - protein, 374 aa, Corynebacterium glutamicum
MLDELREIHGDLSKPLPIGDEGGHIHVELNHQNTGSLPVGFRLGDNDTRILAVAKNLQEEGHNVVLVSKDLPMRIKASASGIAAQEYRAALARDRGYTGMTHANITDDQLSELYDTGEVRIEELEKLPVNHGFTLKSNSGSALGRMNSDKIIELVPGDQQVFGISGRSAEQRVAIDLLNDDAVGIVSIGGPAGTGKSALALCAGLEAVMERRIQRKIIVFRPLFAVGGQELGYLPGDQEEKMGPWAQAVFDTLSSMVSQNIIDEALSRGLIEVLPLTHIRGRSLHDAFVIVDEAQSLERNVLLTMLSRIGQNSRVVLTHDVAQRDNLRVGRYDGIVSVVEALKDHELFGHITLQRSERSRIAELVTQVLDAPSL

SEQ ID NO: 3573 - protein, 44 aa, Corynebacterium glutamicum
MQDWPLNLQKSTTFWLIRAICGESSPLLLSKVGKVEERQDYRAH

SEQ ID NO: 3574 - protein, 128 aa, Corynebacterium glutamicum
MSNREYGLGFRSFIVGIIFAAVWLVFTGANEFSQMQVIGACTNFVLICAALTFWGYRQRLTAKRVITRVSAGLTLAIGAAFAAISAPFDETGLWGVGLIFIAIGSYAGAALVSSIVLALLNLSHLRQQ

SEQ ID NO: 3575 - protein, 255 aa, Corynebacterium glutamicum
MTVVIQVAIASTMPVPLRTPTRTPAARTMETTPTMLEECASISVAWSLTLGKFTASASPAPAMKTKASGKISATRRTMTTRVRTALNQNSFGRSVARCGSSRVSVMFSVRVESSRLMCCSVSTSRSSTSTPPVGPGFGASFALPSPPRPGKPFLLELEPEPVPVSGASSPGPPKREESILPRRLRSERPRNHANSRQMTTPAMREGTIGTKTSAGSRPSAAAARTVGPPQGRIFMVPLIRPAVQVRTTGLMPRRR

SEQ ID NO: 3576 - protein, 489 aa, Corynebacterium glutamicum
MILTFMTLIMLGRLTPMVAMLLVPTIFGLIAGAGLGLGDMALDAIKDMAPTAALLMFAIMFFGIMIDVGLFDPLIRVITRVLHDDPAKVVIGTAVLAGVVSLDGDGSTTFIITTSAMLPIYLRLGMSPVVLTCTAGLINGTMNILPWGGPTVRAAAALGLEPADVFVPMVPSLIAGVVICLLFAWFLGLSERKRLGKIDSSRFGGPGLDAPETGTGSGSSSNKKGFPGLGGLGKAKDAPKPGPTGGVLVEDREVETEQHINLDDSTLTENMTDTLLDPHRATLRPKLFWFNAVLTLVVMVLLVADIFPLAFVFMAGAGLALAVNFPKVKDQATEMLAHSSSIVGVVSMVLAAGVLVGVLSGTGMVDAMATWITTVIPNAMGPHLAVITGLLSIPMTFFMSNDAFYFGILPVLAESASHFGIEPVEMARASITGQPVHMQSPLVPAILLLVSLANVNLGDHHKKVLWRACIVSIAMLAVALFIGVVPLSA

SEQ ID NO: 3577 - protein, 551 aa, Corynebacterium glutamicum
MSVGGSDWKNFKEVDIIRFATRILVIQVATVALVVAICTGIFAVLMMDQMKTEAEHTALSIGRSVASNPQIREEVALDTQTGANPSAEELADGDIQAVAQAANERTGALFVVITDGLGIRLSHPDEERLGEQVSTSFEAAMRGEETMAWETGTLGASARAKVPIFAPDSSVPVGEVSVGFERDSVYSRLPMFLAALALISVLGILIGVGVAMGMRRRWERVTLGLQPEELVTLVQNQTAVIDGIDEGVLALSPNGTIGVHNEQAQSMIGAGPMSGRTLKELGLDLGLDGVVLHGQHPETVAHNGRILYLDFHPVRRGDQDLGYVVTIRDRTDIIELSERLDSVRTMTHALRAQRHEFANRIHTATGLIDAGRVHDAAEFLGDISRNGGQSHPLIGSAHLNEAFLSSFLSTASISASEKGVSLRINSDTLILGTVKDPEDVATILGNLINNAIDAAVAGEAPRWIELTLMDDADTLVISVADSGPGIPEGVDVFATATQIGDSEDNERTHGHGIGLKLCRALARSHGGDVWVIDRGTEDGAVFGVKLPGVME

SEQ ID NO: 3578 - protein, 190 aa, Corynebacterium glutamicum
MPCPWVRSLSSESPIWVAVANTSTPSGIPGPESATEMTSVSASSINVSSIHRGASPATAASMALLIKLPKMVATSSGSLTVPRMSVSELMRRLTPFSDAEIEAVLKNELKNASLRCADPINGCDCPPLRDISPRNSAASWTRPASISPVAVWMRLANSWRWARSAWVMVRTESRRSLSSMMSVRSRMVTT

SEQ ID NO: 3579 - protein, 218 aa, Corynebacterium glutamicum
MDQTLKVLVIDDDFRVAGIHASIVDASPGFSVVGTARTLAEAKTLIATFSPDLLLVDVYLPDGDGIDLVGTSNIDAFVLSAADDIKTVRRAMRAGALGYLLKPFPQKRLVERLDRYVRYRHVLSGTQGLSQDKIDQATAILNGTQAPVTVSRSATEQLLLDALEGQELSATEASEAAGVSRATAQRRLAAMASQGVIQVRLRYGQSGRPEHLYSKPLL

SEQ ID NO: 3580 - protein, 304 aa, Corynebacterium glutamicum
MKIFVGFGDYPLTTKALKEAGAEIVDSLEKAEGFVFTQTPGTEFPLLPDGVRWVQFPNAGLNAYFTAGQIDDKRRWSNASGVYGQQVAEAAMALLLGLIHMHPTMVRADSWAPSTQIDQQTRWLDGATVAIVGAGGIGKHLAAMLKPFGAKSLAVSRTGTPTQDFDATEPISNLHQVLADADHVVLCVPLTADTYHLIGKAELKAMQSTAILINVARGEVVDTEALVDALDAQEISGAGLDVTDPEPLPDDHPLWGRSNVIITPHVANTLTSMDRMLAPVVAENYRRFLAGEKMLTEVDIHKGY

SEQ ID NO: 3581 - protein, 143 aa, Corynebacterium glutamicum
MSISNAILRGVSGAYILQSGYGKLGLPNEAAAGIQGLAATGIPAVADMDSDTFGKFVAYSELGIGGALLAPFIPSRLAGLGLGAFSTGLLAIYFRNPAMTQDDGIRPSQDGTGLSKDLFLAAIAGALVFAPAKKRKKAKNKSK

SEQ ID NO: 3582 - protein, 334 aa, Corynebacterium glutamicum
MTIPGTILDTARTQVLEQGIGLNQQQLMEVLTLPEEQIPDLMELAHQVRLKWCGEEIEVEGIISLKTGGCPEDCHFCSQSGLFESPVRSVWLDIPNLVEAAKQTAKTGATEFCIVAAVKGPDERLMTQLEEAVLAIHSEVEIEVAASIGTLNKEQVDRLAAAGVHRYNHNLETARSYFPEVVTTHTWEERRETLRLVAEAGMEVCSGGILGMGETLEQRAEFAVQLAELDPHEVPMNFLDPRPGTPFADRELMDSRDALRSIGAFRLAMPHTMLRFAGGRELTLGDKGSEQALLGGINAMIVGNYLTTLGRPMEDDLDMMDRLQLPIKVLNKVI

SEQ ID NO: 3583 - protein, 79 aa, Corynebacterium glutamicum
MNDDLQMAMILADTPIFHPNTGKPFDGEHKLSPSARAGLEAPRYCQLCGRRMKVQVRPDGWDALCSRHGFVDSSYLGRR

SEQ ID NO: 3584 - protein, 113 aa, Corynebacterium glutamicum
MLPPRFRRLLLSRAPIMRGHLIDGDGRCIHYHGPFDVVGNKCATCNEWWACHRCHEEIANHPFGKMLIDAPSSLQCGHCGELMAYGVQKCPRCGHNFNPGCSLHTPLYYEMPS

SEQ ID NO: 3585 - protein, 39 aa, Corynebacterium glutamicum
MVGHAGWWIAKLSITVNNNLIVGMILWVCLFPVKGLGPR

SEQ ID NO: 3586 - protein, 47 aa, Corynebacterium glutamicum
MRQQGSRYAIRAGRNLPDKEFRYLRMVIVTTAVYWGLNSQLRKNKFS

SEQ ID NO: 3587 - protein, 91 aa, Corynebacterium glutamicum
MRRADIEVPNHPVDMDSWGRSACYPRGTFYPLSDTTTTSRCRITSPDFRPCSTCQCHSQAPLCTYTHHLITNQAEETFGRLRYILGGNRPS

SEQ ID NO: 3588 - protein, 483 aa, Corynebacterium glutamicum
MSYTSFKGDDKALIGIVLSVLTFWLFAQSTLNIGPDMATDLGMSDGTMNIAVVAAALFCGTFIVAAGGIADVFGRVRIMMIGNILNILGSLLIATATTSLATQMVITGRVLQGLAAAAIMSASLALVKTYWLGTDRQRAVSIWSIGSWGGTGFCALFAGLVVASPFGWRGIFALCAIVSIVAIALTRHIPESRPAQSIGMHLDWSGIIVLALSVLSLELFITQGESLGWTHWMTWTLLAVSLTFLAVFVFIERIASWPVLDFNLFKDHAFSGATITNFIMSATGGVVAVVMWVQQMGWGVSPTISGLTSIGFAAFVILFIRVGEKAMQKVGARAVIITAGILVATATALLMITAVSESTYIVISLAGFSLYGLGLGLFATPVTDTALGTLPKDRTGAGAGVFKMSSSLGAALGIAISTSVFLALRDGTSINSDVALAGTVSLGINVVFAATATITAAVLIPKAAGKVSQTSITLPEPAIAVKI

SEQ ID NO: 3589 - protein, 415 aa, Corynebacterium glutamicum
MRITNAQVKNYAELVDITIEGEKISSITPSSIRSEEDHRADDYDAAGRLVAPQFAEAHIHLDYANTAGIPRENSSGTLFEAIEIWADRKTQGFHIKEDIKAKALQAARRAAEHGVGFIRTHVDVTDPTFAGFEAIAELRDEVREWCDIQIVAFPQNGIYAYEGGQKLISDAMSAGADVVGGIPHLEPTRDDGVESVKWLFDLAEKHSAPIDIHTDEIDDPHSRFVEVLAAEAAKRDMGAQTVVSHSVAMAYYSPGYMARLLPKLAASKVRFAVCPNENLHLQGLGFQGPVPRGVAPVKQLTEWGIPVSFCQDSLNDPFYPMGDGDLLRILDSGLHVSHMLTASHLKNALSFITTNPAGNLGLDNYDIAENSPANLLVLDASSEKEAVQRKASVLLSIHRGKKVLSREPEQVDWNI

SEQ ID NO: 3590 - protein, 102 aa, Corynebacterium glutamicum
MIVEIRPLLLWHKWIQQQKAADSKEQLGMRQPFLEQMSPAEMKLSLTDSNWLVKAKPPESSVEVSGAGDTPDASITDTAAVLGPVTSTTSTPMKTIEVLGQG

SEQ ID NO: 3591 - protein, 205 aa, Corynebacterium glutamicum
MNSHPQHWCISVTSVWLLVMSFLNSAKTKTVALTATFVGAATLATPAIASADIVDNALAALPSGEISCSQAEKYWTTEADYNSKVAQANALAMFDSRGPQIQAALARVDEAANRCGLKGGTVAAQAEATEAAPAAPAPAPQDNTGTSQTAPAPAAPAAPAATPVVNLAPAGSPTFTIEVPGVGGVQLPDLYQIVQQFLAQFGIKI

SEQ ID NO: 3592 - protein, 308 aa, Corynebacterium glutamicum
MFDELTARAHNSALRSIARVVAETVEPMGEDVARVGVVKQLKAGNVLAVTGAGVSTDSGIPDYRGPKGSLSRHRPMTYQEFRHDPAASHRYWARSFVGWRVMDQARPNRTHYAMVELEQHGFLSGVVTQNVDGLHAEAGTKNLVALHGDLAHVMCLNCGFGEDRHLFDERLEAANPGYVASIRLEPGAVNPDGDVFLDEEQVRRFTMIGCLRCGSLMLKPDVVYFGEPVPAARKKDLKKLLDASSSLLIAGSSLAVMSGYRIVIEAQRQGKQVSVINGGPGRADSRVDILWRTRVAPAFDDILDALDL

SEQ ID NO: 3593 - protein, 324 aa, Corynebacterium glutamicum
MVDALNDLRRELTNALRSVWKNLPTDNAPQADALPDDVVEEIAINFYRDPKNRGKLNEDKTDSLPMLARIRSRGLFEDDWRARPTEDRPWPVVLVHGTGSTKGDWQDLGADLRRDGWAVFAPEFGQRATGSVAESSAQIGAYIDTVLLATGASKVIVVGHSQGGVLLRYWMRVLGGASKVKHMVSLAVPNHGTTMGGIVSPLIRNNRGESVVNSVVQSWFGEAGFEMIRGHDTINAINEGGDLDPDVTYLCIATHFDTVIQPPETCFLEARNPEELKRVQNIWVENLDPNSVVLHEAMPYDPRVRALVRADLSKLVEISETAEN

SEQ ID NO: 3594 - protein, 300 aa, Corynebacterium glutamicum
MSQENSGLFKRAITRGVAKVRRNPREDFAEEFTQELYDHATNITLPLTARLKPKGFFQDDWRARPSGARPWPIVLIHGSGASKGSWEEMGAELRSKGWAVFAPDFGTRATEPIAASAAQIGAYIDAVLLVTGAAQIVLVGHSQGGVVARYWMRTYGGYMKVRHMISISTPNHGTLMGGILNPMTKVKSGEGTIEKLMHRLFGPTGFEQLRGHDIIEFLADGGDLDPGVTYTCIGTHFDPFIQPPEVAFLEVNEDDDPNRVHNIWVEDEHPRAMIAHNDMVRDPRVIEIVRAELDRVARLG

SEQ ID NO: 3595 - protein, 296 aa, Corynebacterium glutamicum
MYRKIVQKWGLSFVERIVIMNNVQQFHRFFDDSAVYYPCFVPLDRAIGEHFDRQNKPMSRFIGTLILPLAKLEEAAQYTGDEVLRVSAVISTDGLADLRRDFYELPNIDIASVEIKLVGAALTNTAWLGDVEKLIQQHRNTFVWVEIPTALVTADIVRKLRHMGAGLKYRTGGDREELFPSPQDLVTVLRTAIDAALPFKLTAGLHRALRYRDEKTGRLHFGFLNIAAAVATLRAGKGEAEALKILEGDDAAPLIHALQSGENWRDSFRSFSTCNVVEPLNTLIDLDVLAEGDVHP

SEQ ID NO: 3596 - protein, 171 aa, Corynebacterium glutamicum
MTQDEHPRQADSHFNMLLPDGNENAHQLSVALNQVAHLLAYDADSSIHRPDGLSLASYRILFSLWTDGPMSPLQVTDKTGMKKSAISNLLKPLLAESLIVQVTAENDRRSKVLSLSEKGTTYIQKTATRQNALESEWFGTLTDIEQDLLESLLRKLLDSNRASKVRKNRSN

SEQ ID NO: 3597 - protein, 100 aa, Corynebacterium glutamicum
MHITPREQEKLMIVVAADLARRRKDRGLKLNHPEAVALITYELIEGARDGRTVADLMSWGSTILTRDDVLEGIPEMIPDIQVEATFDDGTKLVTVHNPIR

SEQ ID NO: 3598 - protein, 162 aa, Corynebacterium glutamicum
MIPGEYILSSESLTGNVGREAKTIEIINTGDRPVQIGSHFHFAEVNPSISFDRSEGYGFRLDIPSGTAVRLEPGDARTVNLVAIGGDRIVAGFRDLVDGPLEDLKVNVWEGREDGWRRSSAAGDAPQELPQVEAAERGRKLDDATDVDTNVGTEEGFEEGRN

SEQ ID NO: 3599 - protein, 570 aa, Corynebacterium glutamicum
MSFEISRKQYTDLYGPTVGDSVRLADTELFLCVEKDYAAIGEEVAFGGGKVIRDGMGQNGTLVRDVDIPDTVITNVIVLDYTGVYKADVALRDGKIFRIGKAGNPNVMENVDIVIGVATDIIAGEGKILTAGGIDTHVHFLGTDQVNTALASGITTMIGGGTGPSQASMATTVTPGQWNTYNMLSAFEGMPMNFGILGKGHGSSKSPLAEQVRAGAIGLKIHEDWGATPSSINTALEVADDMDIQVALHSDTLNEAGFVEDTIEAIAGRVIHTFHTEGAGGGHAPDLIRVAALPNVLPASTNPTLPYTRNTVEEHLDMVMVAHHLNPDIPEDVAFADSRIRAETIAAEDVLHDMGIFSITSSDSQAMGRVGETITRTWQVADHMKRTRGSLTGDAPYNDNNRLRRFIAKYTINPAIAHGVDYVVGSVEEGKFADLVLWDPKFFGVKPDLVIKGGLMVNSLMGDSNGSIPTPQPRTLRNTWGAFGQAVSRSSITFLSQDAIDANVPDLLNLRKQIRGVRGVRNLTKRDMKLNAEMPDIRVDPETYQVFVNGELITSKPAETVPMARRYFLF

SEQ ID NO: 3600 - protein, 157 aa, Corynebacterium glutamicum
MIITAIDTNIYDQPEFVEGRDVIGVRFEDLVLDKRIQRVALPGGEELGLRLNHGHPILREGDVLKADDKTVFVVEIIPTDVLVITPSDIHQMGFVAHSLGNRHLPAQFSKPGELTEKAAMIVQYDHTVVSFLDEHGIEYQRTELVPPIPFRHSGHTH

SEQ ID NO: 3601 - protein, 226 aa, Corynebacterium glutamicum
MDLDADFLLLHLSDSALPTGAFAHSFGFETYMDAERITNAEEFQDWLKVLLKVQLTSSDALAMRMFYATPTVSELKRLDERLFAGTPAREIREANARMGTRMAEIVAETYSVPLIVEYLELIQHRELSGHPALALALATHSAGIDVDRAIHAHLTATVSSLIQNAVRGIPLGQMAGQRVMFAMREHIGAAVKRSANLDEIDFCSGDPGLDISQMVHETQRARLFMS

SEQ ID NO: 3602 - protein, 205 aa, Corynebacterium glutamicum
MGPIRIGVGGPVGAGKTQLVERITRALIDEVSMAAITNDIYTIEDAKILAANGVLPEERIVGIETGGCPHTAIREDTSMNDAAIKDLVERFPDLELIFVESGGDNLSATFSPELVDFSIYIIDVAQGEKIPRKAGQGMIKSDLFIINKTDLAPYVGANLDVMVEDAKAFRKNKPFCLTNLRTDDGLDKVLEWIRHEVMMQDLQEA

SEQ ID NO: 3603 - protein, 283 aa, Corynebacterium glutamicum
MTQTQPVGTLRLTIDDQGPQGQSRAVEQFHQGALRVIRPHYLDDSGQVCYTIIAIGGGYLGGDVYEQQFTIKDNAKALITTQSATKIYRTPQGPATQHTEINVGENAVLEYLADQTIAYREATYHQFTKVALHPSATFVMSEQITPGWHPDGKHFAYDEMRLHTEITDSTTGRLVLLDNLLLRPDSREGSFGWTEQYTHSGQMIVMGEGVDKQLVAELNEQLAAHPDVYGAVNFLSAPGTLLRGFIARTLSNRTEELINLHEHIASLLRGRWRGQEPVNLRKY

SEQ ID NO: 3604 - protein, 259 aa, Corynebacterium glutamicum
MFLTLSGADMSALIKGSGPHHVVVLNGWFGHAAGWGAFADYLDLGNYTWHFWDYRGYGNRKDDAGEFTLEEISADIVAYIDSIEAEKVSILGHSMGGVFMQKVLADSATPIASLVGISAVAAAGTPFDEDSRKLFTSAGHNPDSRRAIIDFTSGSRQPAAWLDDLTDSTVQNSTPEAVEKYFFAWADCNFAADLGTQDLPVYILTGDLDPAVTKTAVESAFGPIYQNLTVEELHDVGHYAIFEHPLGLAARVLRFLDAV

SEQ ID NO: 3605 - protein, 223 aa, Corynebacterium glutamicum
MLRRPSRRQRPYAVPNRIEAITKSHTGMESPPKAASAKPARAHSAPTIPEPRPHANFLPKNCAIRPALKAIAAPIPGRRMALPKVESMRADITIREVVMQLNTQIAIGKDTARAFFMLRSCLIPLDAPSALGVLRASPSANPTTTAISERATLMAKGVIMLVDAIPNPLVTIGPIMKPAVRIMPANVTPLAPRNLPAHAVPALTTNPTPRPTMNRPTRREGPS

SEQ ID NO: 3606 - protein, 384 aa, Corynebacterium glutamicum
MRSGNANRVFIGVTILLFTAGWAANHFASVLVLIREQLDVSSVLVNGAFGIYALGLLPSLLAGGVLADRFGARMVVLTGGVLSALGNLSLLAFHDGPSLLVGRFIVGLGVGLVVSAGTAWAGRLRGASGVTLAGIILTAGFMMGPIVTSGLGMASTSIITPFAISVALSLIAVVVGFALGDARSTPSALGASSGIKHERSMKKALAVSLPMAIWVFSCITTSLIVMSARIDSTFGNAILLPGIGAAIAFSAGLIAQFLGRKFAWGRGSGIVGALCALAGFALAAFGGDSIPVWLFVIASILFGTAYGLCLREGLLSIETYTPLNRRGTGIGIYYVFTYLGFGLPVLLDALLPHLGASIPLYALAALALGSAVIRGVQIKRGYVV

SEQ ID NO: 3607 - protein, 225 aa, Corynebacterium glutamicum
MLAENAVQGEFLNKVSLCTKLLVAGYVEVLRALSKQDGELGELGLEVFESQLRMGSGFLDDLAGDCKWLVVFLAVWNKIDVVQCHLIDDCPRPQVIANQFRFGEVSLDIGVIQLVNSLGFQEIDSAVALAAKLRKEKFASFCFFSRLIKQGDGISQTLIIRKLRELVGVEQESLRIGKCPLTIGDAETVQFVLSIRRLRWGRGLRLEQQIGAAQSHWNIQGGISN

SEQ ID NO: 3608 - protein, 925 aa, Corynebacterium glutamicum
MDYAFEQSATALLDRAIDMPMNDEQMEAFQLALSVAQETEDQDTEFKARLFLATLGNINEDHTSMLTHFSAAVGMHDRDPARFPGQGDGSYPDLFWLYKNALNLVISSVLFTREQMDNMLDQMDEHFTRAGIPRIAINIERRDDALMNGSLERALELQELIDASQHDDPFDDCPTCQIAGKAALAMAADDYDETQNLVSQIISYGSIGCVMEPETTLAAFMLRVLKSGDADYARYLQDVSAKANPEFQSLDSVGRHLEFLGITGNHSRGLGFLTRYQHRLITDPLATLGHFQFYLGAYTLLSSTERAGFGDLVVSGTGEVFGHDEDLNVEKLKERCLELARNLAREYDARNGNDNFMKRFEASIANSTLDIPVGLGGSNLLLKAQTATPSEPANAQDKLYRFCIANGKRAFSDAQRFLLNADELAELSDYERLAYAITLLDQPGKEAEGRELFLSELRRQGYRAVDFLESQTVDQLNNPDVQTYLTEAELIRDDLRSWAVINQMALDNIDLVPYGEENDEPLAIARKIIEETASHPELRFENLEAQFSEFTILLAQSPENLDVARYQELRTQGNFVQELALDSIFGQHAVVQDTGNGEAILDETIGYMIGAGMRETTARTASQFAQLYSFVGRQERSIEMARLAFEELQAAGLPHREEELRLGMQLAQVEPIEAREILEKLLLPKFEQNLTLDELETEALLPLGATVAIHDPQAAAAILRHARENAAGFGNFELAVQAMTMITDVLYTQNMHEQLLEELNHSLPYAQMLDDQHQAELKLLDSIAIVQADLGSTEALETLGTAMGLAETTAQKLYVQESLNRAYFTFARPEDCISGAADASALAMQNDDPSNAAAQLEQCAQYLFQLGHETDGASLLESAFRVEGIPTEQALYYANALSSIYEDFGDSAKSQYWEQQAQEKQQLLE

SEQ ID NO: 3609 - protein, 608 aa, Corynebacterium glutamicum
MQESSRDNFQVDLGGVVDLLSRHIYSGPRVYVRELLQNAVDACTARSEQGEEGYEPSIRIRPVTKDRATFSLVDNGTGLTAQEARELLATVGRTSKRDEFGLQREGRLGQFGIGLLSCFMVADEITMVSHAEGASAIRWTGHADGTFNLEILGDDATDVIPVGTTVHLTPRPDERTLLTENSVVTIASNYGRYLPIPIVVQGEKNTTITTSPVFAKDTDQQHRLYAGRERLGKTPFDVIDLTGPGIEGVAYVLPEAQAPHMSRRHSIYVNRMLVSDGPSTVLPNWAFFVECEINSTDLEPTASREALMDDTAFAATREHIGECIKSWLINLAMTKPHRVREFTAIHDLALRELCQSDADLAETMLGLLTLETSRGRISIGEITTLSITEDVSLQLATTLDDFRQLNTIARPDTLIINGGYIHDSDLARLIPVHYPPLTVSTADLRESMDLMELPPLQDIEKAKALDAQVTESLKDFQIKGATRVFEPADVPAVVIIDSKAQASRDRNETQSATTDRWADILATVDNTLSRQTANIPQDQGLSALCLNWNNSLVRKLASTDDTAVVSRTVRLLYVQALLSSKRPLRVKERALLNDSLADLVSLSLSSDI

SEQ ID NO: 3610 - protein, 472 aa, Corynebacterium glutamicum
MVRMEATTIDDAIAKLIDIYDTSTKLAKETLNNEDYAAYADVVYPKLTVDVLEWKPIDRTEPFGYVDRAGRYSATLSKPRVIERYLREQLERLTSNYPCKIYVSESDIRIPPEYIRGAPSATEARRAGDVADIIPRPTLDEVHDAIIDGDWHAFNGPELPLFHFGPQRFDIACARIEHYTGINVEHVQKYILFTNYAMHTTEFVHFAMSELTSEDSRYVGLSLPNGQVIDRETATSLGTETLDLTSRFQMPRYDLITEAGDGITIINIGVGPSNAKTITDCLAVLRPEAWVMIGHCAGMDARMRIGDLILGNAYQREDHILNTRIPLGNPIPAIPEIQKALEASVDEIYGSDNSLMRTGTVLSTDDRNWEWHTPENLWNWLKGSTAAAVDMESSTLATNGYRYRIPYGTLLSVSDLPLHAVPKLPAQAQAFYSNSKEAHVMCAVRAMEYLAVDPERLRTRKLRRTLGEVPFR

SEQ ID NO: 3611 - protein, 193 aa, Corynebacterium glutamicum
MAADVATSAPARGFFHPSGNSRDLVVCGGFAATGAASEIRRANVALVLGAGLNQFTMAFGEAFGELAEVLQVDLETQTTNPRINHFISADNTTVVAAVLLKLRTQNFHAPRRLYLDDNPLTCPGGDALAADGRLDPHSLMRQLNGILPANKFVASDGGHFIGGANTYFDLESRDSIVLLGTAFNPSASASPPP

SEQ ID NO: 3612 - protein, 184 aa, Corynebacterium glutamicum
MYSISETIARTLMPRTDHVFDLMGNGNAWFVDALERLGRGIITVRPTVETVAAADTYHRVTRRPAVATTTYGAGFTNTMTTLADVALSRIPLLLVVGTAPSAGPRCFDIDRQGLARAVGVETFTVHADDVAAVTLQAWNNTPENTHVILEIPYDLAAATATDPTVTTYLLRPGFQKLPMSPTLS

SEQ ID NO: 3613 - protein, 220 aa, Corynebacterium glutamicum
MLKAQRTRFPLSLLIPPFCHLKQPLIFISYSLHRVEYMKNAKLFLALISAPLILAGCSSTDTGTAESTISSETASAVDATTSTSSSTATSAVIDDDPVFDIIDIVLAQYPDRIITDIDREDSSDQYEVDVVVGQEVLELDVTTSGQIHTDDRDNDDDDDIREAHAATVTAAQAIGLALDQYPDGIIDSVELDEDDGQLKWKIDLDDTSGNDLADVEIAAV

SEQ ID NO: 3614 - protein, 1152 aa, Corynebacterium glutamicum
MTSMNLPIELATLSDQAVDKVRSWLEYSKKESVPNADAKRLAAVLQDPNGLEFTVGFVDRVVRTEDREAAAHALYELGKIAPSTMSFLDRAQIQAGSLVGRALPQVVVPAARARIRQMVGHMIVDARDKQFAKAVAEIQSDGHRLNINLLGEAVLGRKEAAKHLDDTVRLLRRPDVEYVSIKVSSVASQISMWGFEDTVNYVVEQLTPLYIEAARAPKGTKFINLDMEEYRDLRLTMEVFKRLLSNPELHELEAGIVLQAYLPDALGAIQDLAQFGRERVNTGGAGVKVRLVKGANLPMEHVHAQITGWPVATEPSKQATDANYKRVLYWTMRKENMEGLRLGVAGHNLFDIAFAHLLSVERGVADRVEFEMLQGMASDQARAVSVDVGELLLYVPAVRPQEFDVAISYLVRRLEENAASENFMSAIFDLDADNPSFKREESRFRASISDLATLIDVPAPGPNHTQDRSKETLLDAPLVPFINEPDTNPALIQNQQWATKAVATAAEPGWLEKQTKPEVLEEGDVDKLINDVRDAAEAWAARPARERAEILYKTAEILRVRRGHLISVTAAEVGKAVEQTDPEISEAIDFARYYAHLALELDDVDNAEFTPDRVVVVTPPWNFPIAIPAGSTFAALAAGAGVIHKPSKPSQHCSAAVVEALWEAGVPREVLHCIYPANRDVGCALISHEHVDRVILTGSSETAAMFSSWRPELTINGETSGKNAIVVTPSADRDLAVADLVKSAFGHAGQKCSAASLGILVGSVYESERFRKQLVDAASSLIVDWPTNPSATVGPLTELPSDKLHHALTTLEEGESWLLKPRQLDDTGRLWSPGIKEGVKPGTFFHLTEVFGPVLGLMKATDLNEAIEFQNGNDFGLTGGLQSLDADEVRTWLDHVDVGNAYVNRGITGAIVQRQSFGGWKKSSVGLGSKAGGPNYVMLMGTWADAPSHHAPRETNPLISKLDLPGEELEWLEKANASDETAWNTEFGSPRDPSGLDVEANIFRYRPAEVVLRLDDSATPRETARALLAARRAGVTPRVLQTPGVSEQVREVLSAAGVSAETVDDSVFISNVLRGEYDENSSVRVRYLGKVSDTVRERLSVRPEVVLLDDAVTASGRVELRYWLKEQAISMTLHRFGNPVAAFHELAEELKR

SEQ ID NO: 3615 - protein, 38 aa, Corynebacterium glutamicum
MVDPNQSGSGVGEFIIGGLFKGHMSILGRKIDTFSRCV

SEQ ID NO: 3616 - protein, 315 aa, Corynebacterium glutamicum
MEHGVTVIKGTEFDVFPLNLGGNTFGWTSNREQTFAVLDAFVAAGGNFVDTADSYSAWVEGNEGGESERELGAWIKERGADKLIIATKSGALEPVAGRSREATFKAVEGSLERLGVESIDIFYYHYDDEAVSIDEQVAIANDLIAQGKIKHLALSNYSAERLAEFFEKSVGTPAQPVALQPHYNLVSRKDYEENVQPLAEKHGVAVFPYFALAAGLLTGKYTSKEDISGKARAGQLDRYASDEAFAVVTELRAVADELGVAPTTVALAWLVAHGVTAPIASVSKVEQLKDLMAVKDVELSAEQLARLDKVSEPFA

SEQ ID NO: 3617 - protein, 538 aa, Corynebacterium glutamicum
MSSTTSKTSERQQPDAPTSKLSKWSDKFLNGVETLGNKLPTPFTLFLILFLITALASSIMAWMNVSVIVPGSDEELFVKGLFTGEGLTWLTTNLGANYIGFPPLLTVLPILLAVGVAERSGMLAALIRKLFGSAKKIVLPYAVGVIGVTASIMADAAFVVVPPLAAMVFKAAGRHPVAGLLGSFAAVGAGYSTAIVPTSLDALFAGITNAVMETLPGIATTEVNPVSNYYFNIASSIVLGLLCGFLIDKVLEPRMWRQKIATEYAESIEPTSAADDEEISATLTAQENRALTISMWTTLATAIIVLVVVLIPGSPWRNEDGGFLPTSPLLSSVVFIVFLFFMVMGLAYGMVVGTIKNMDDVVNMMGEAIKDMIGFLVLAFILGQFVALFNWTGIGTWTAVQGAAGLEAIGLTGFPAIIAFIILASCLNLLIISGSAMWTLMAAVFVPMFALLGYEPSFIQAAFRVGDSATQVITPLNPYMIVILGLLRRYEPDAGLGTLMSRLIPFVIPFWLAWATLLAIWFYADLPLGPGSAIFLEG

SEQ ID NO: 3618 - protein, 444 aa, Corynebacterium glutamicum
MEQGIAARKAEAESNASTKGESPDYPGQQVIWRLIQEAGESLRDELRTLAFTLHDHPEEAFEEVFATEEITKLLQNHGFEVQSGVYGVKTALETSFETPGYDPAQHPSIAILAEYDALPEIGHACGHNIIAAAGVGAFLAVTNMIKTAEVKGVDHLDFEGRIVLLGTPAEEGHSGKEYMIRNGAFDGIDASIMMHPFGFDLAEHVWVGRRTMTATFHGVSAHASSQPFMGKNALDAASLAYQGFGVLRQQMPPSDRLHAIITEGGNRPSIIPDTATMSLYVRSLLPEALKDISKRVDDVLDGAALMAGVGVEKQWDVHPASLPVRNNHVLARRWAKTQNLRGRTALSEGILPDTLAASTDFGNVSHLVPGIHPMVKISPENVALHTKEFAAYARTEEAIDAAVDAAIGLAQVAVDALADPQMLIDATLEFTNSGDVLKVGDYLA

SEQ ID NO: 3619 - protein, 233 aa, Corynebacterium glutamicum
MNARNQVRDIAKISRCCQSVGQNTLRKRRSTTQILRFCPTPRQHMIVAHGQASWVHIPLLFDANPRHQGRPIEHIIHAFRYVFECFRQQRTHVQRHRCSVWNDAWPVSAFRNNGVKAVARWHLLTQNSEALVRQTCSVEGIFTHERLRRRVCRDTVERRRHGTSAHPNMLRQIEAKGVHHNRRINAIECAISDHVFLAGMPLLSRCSQQHDPAFKVEVIHAFHFGSFDHVGDS

SEQ ID NO: 3620 - protein, 122 aa, Corynebacterium glutamicum
MDERSRFARSVFPDGEEPDPRFTLANERTFLAWTRTSLAFLAGGIAFEAFQISGLSDTVRTTIAVFIIAVGMIIAAGAAVRWMNVERAMRKQKPLPVPAIIPFLSIAALVASAAVLVLIIVQ

SEQ ID NO: 3621 - protein, 105 aa, Corynebacterium glutamicum
MRIHEDPGLQPERTVLAWNRTTVSLAVCSAILLRWTNFYGIFALLPVVILSGMAIFILFTQRVRYERQAIGLADNKLPPNIVGVVSLTVTLLAFGAAGIVFVFID

SEQ ID NO: 3622 - protein, 684 aa, Corynebacterium glutamicum
MLKVLARKLSILCSMAPTITDIHVLLRRGERQSVIMTLTASSLEAGKMSFSGGYIVGETMIFLVDPDEVEIRRSPNSLHVLRNGSDILRRNEHHCWVFENFNKPIDPPVRLGPRDIICPSALAWVLQQHSISRSLSHHLHADKITAGEIAGRPTWILREEPTSGGQDPSRLVSLEIDQEHGVILAVETGQERLEATEISFPDTLPNPSWDGAWEPFHYPDSTPHTAPDVAEIPGYIQSLPPQSEDPRRLRVFVNEIALEGDFPDYRQGQSVRLTLGISSSPVPLEGMTTRRRGRVRNLGEEASPGDDGMPQWPILLTGDGWTALAYTPIPKRGDAEIQGWFYYSAYGIVDVPTDLRVERIFAGIGTSGTNERLWQEIDNTSSAYHSEDWWIRDVVLDVTLDGAVPPPLRRDVFTAVDPIVAGDKLWLCDVHFPVARCWETTTGRYLGQTLVPAPLRDRSYVLELHSDQQLGAVAASGKSGWILTPGQAVATKAPDWTPPTRATDLPQVPSPWEIVAVRGQGLFELQVETSRRTALGRVNATGGVDIGELPPNGYTISSVVQIGDEYIVGRWVEEYRLNSKLEVISTKELDISASGWKSKGTVAYLSEDTHICFFDQVSGAELPSLGIAEGHQGEVMSATSSESIVLIYRRNPNNSMSIVPTSVATYDNGTWTTMPLQEAPAELS

SEQ ID NO: 3623 - protein, 260 aa, Corynebacterium glutamicum
MEREQRHKVIMRTIDRPGITRIDALTELTGVSAVTIHRDLVELEQAGFLARTHGGAKRVPKRGTPQPFAVRQAEDREAKRILAQATAQLIADDEAVIFDNGTTCQAVAQELAGRPITALCLSLHSAVALGSRAGTNVFIPGGPVENDSLALSGPAVITALRDFSADVVILGSCSTSLEHGLATTTYDDAENKRAAIHAATRRILVVSARKLNHVSTFRFADVADLHQLVTTSDAPREILAEIRDLGVQVITVPAPDEQRS

SEQ ID NO: 3624 - protein, 130 aa, Corynebacterium glutamicum
MRIEITSVFVDDQAKALDFYTTKLGFELKHDVTAGDYRWLTVVDPENPDGVQLLLEPNQHPDAATYQAGIKRDGIPATQFYVDDVQEEYDSLKDKGVDFIMEPTDVGPSVIAILDDTVGNLIQIVQLKQN

SEQ ID NO: 3625 - protein, 170 aa, Corynebacterium glutamicum
MSPTHRLVILRHAKSSWSTGVLDHKRPLNQRGLRDGVAAGQWLAGNIGEIDHVLCSDATRTQLTWERVQLGGATAKGSSFHNDIYENQVSEFKHLITGLPDVVGTALLIGHWPGVEELAHYFGIRDEHPGWDQMEEKFPTSAIAVLEFNTPWSKLERNSARLTDFVIPRG

SEQ ID NO: 3626 - protein, 503 aa, Corynebacterium glutamicum
MNTPLQLNTENLQEIASTSGVQIPAFNRADVAPGIVHFGVGGFHRAHQAMYLNELMNEGKALDWGIIGMGVMPSDVRMRDALASQDHLYTLTTKAPDGTLDQKIIGSIIDYVFAPEDPARAVATLAQDSIRIVSLTVTEGGYNIDPATEDFDHTNPRIVADREALQAGDTSTLQTFFGLITAALISRKESGSTPFTIMSCDNIQGNGDLAKRFFLAFAHSVSSELGEWVENNVAFPNSMVDRITPETTDGDRDDIKEIGYIDAWPVVSEDFTQWVLEDAFTQGRPAYEEVGVQVVSDVEPYELMKLRLLNASHQGLCYFGHLAGHHMVHDVMADTRFQDFLLAYMEREATPTLKELPGVDLDAYRRQLIARFGNAAVKDTVPRLCAESSDRIPKWLLPVVRENLAAGRDVTLSAAIVASWARYAEGTDEQGNPIKIVDRLSERVQENASGNRTDILSFIRDRGIFGDLVDAEPFTKAYSETLSSLHDRGAEATIDALLTQVTV

SEQ ID NO: 3627 - protein, 445 aa, Corynebacterium glutamicum
MSVQQSGLLERLGIPRPLIFGFIGLTIFMIGDGVETNILEPFLSSEHGFSVSLAGTLVTVYGVAVAIAAFFAAALSDLWGPRKVMILGASIWIVFELIFLTVALTTDHTWLIFLAYGLRGFGYPFFAYGFLVWITATASPKQLGTGVGWFYVAFSAGLPTLGALVATISMQYVNLTFYETLWVSLVLVVIGSLIALLGVKERRGRHPLVANPDDVKQTLGQGFKLLRNDRRARFVTYIRTINSIPTYAMAVFFPSFFTDDLKWQLSWFLILTTVIYAVNLPFNPFFGSFGDRHGWARTVFWGGSIGGAVTLALVYFIPMFGVQAGMSNGVVFGITIAAGALFGVSLAGFVPLSAIAVSLDPKHPGAAMATYNLGVGGAVAVGPLLVAVFHPLIGPTGLILVMIALYLLSGWMTLQLRGTQPGFDGVPALAEDAHIEDLADVNANA

SEQ ID NO: 3628 - protein, 63 aa, Corynebacterium glutamicum
MFTFVLNVESSAKASEAKSQKLKTLRNRHVKSVLDSTKSGLASALNSQFRLVRGANHVKLTTI

SEQ ID NO: 3629 - protein, 279 aa, Corynebacterium glutamicum
MIPASSQEKRRERIVSYVTRHGFARVEALAELFEVSAMTIHRDLEALAADNLVERIRGGARSVSPSMSELAVEQRRHLHRTVKEALCTAAARLIPEGAVVAIDDSTTLESLVEKLPQRSPSALITHSLKTMADHRVRAGMSDIRLIACAGLYFAETDSFLGKATSAQLNELSADISFVSTTAVRATGEVPALFHPDMEAADTKRALIGIGSVRVLVVDSSKFGSAGVFKVASIEEFDHIIIDQQCTREQRDLLRNSRAQIHVIDHNGDEILDTPTEEDF

SEQ ID NO: 3630 - protein, 473 aa, Corynebacterium glutamicum
MKFWIPQRKRIFKMALVLGIDSSTQSCKALLVDAATGQVIDEGRASHPSGSEVDPRAWIAALDQATEGLLERADAVSIAGQQHGMVALDENDEIVRPALLWNDTRSAQAALDLNEEIGGDQAAVDATGSVYVASLTATKMRWMRDHEPENAARTASVMLPHDFLTWHLMGRGRKVTDHGDASGTGYYSTRDRAWRTDLAALALGHEVELPELLAPNAIAGTTPGGVKVAAGTGDNAAAALGLDLQPGDVSVSIGTSGVAGMTVQHSVHDPSGLVTGFADATGAYFPLACTLNGAPVLEFGRRILGVEWEEFDALALAAQPGSGGVTLQPYLEGERTPNRPAARGVLAGLNCATTREDFARATVEGLLLALDDAVTALVEATGVPVQRIQLIGGGARSQAVREIAPEIFGHEIVVPEPAEYVALGAARQAAWALSGEATPPQWPTPGSDPHRAPKNTELSTRYAKLRAATQGWY

SEQ ID NO: 3631 - protein, 274 aa, Corynebacterium glutamicum
MWLLPALKGLRFAWEGTRVDIGDVGLRGVVQGIAQGGVLADEAWLLAAVEAEGILPHQNLPICAIAGTDSDSGDGKILGNLARCLCWNHLQHNRKRTRLLQRAGIGDELSRTRATTLNHVAAQGMLGLRGVPDVADNRNSSINNASNRLRDLHATLDLHRSRTRFTHDPDRGLHRLIWAHLIGTKRQINHHKRTLRSDRHRLGQHNHLIQGDRQGGIATQHNVGSGITNKEHIDASLIKNARRKRIIAGENRNFLAVYFSFAEMTGADFLCINA

SEQ ID NO: 3632 - protein, 279 aa, Corynebacterium glutamicum
MQVATTKQALIDALLHHKSVGLVPTMGALHSGHASLVKAARAENDTVVASIFVNPLQFEALGDCDDYRNYPRQLDADLALLEEAGVDIVFAPDVEEMYPGGLPLVWARTGSIGTKLEGASRPGHFDGVATVVAKLFNLVRPDRAYFGQKDAQQVAVIRRLVADLDIPVEIRPVPIIRGADGLAESSRNQRLSADQRAQALVLPQVLSGLQRRKAAGEALDIQGARDTLASADGVRLDHLEIVDPATLEPLEIDGLLTQPALVVGAIFVGPVRLIDNIEL

SEQ ID NO: 3633 - protein, 271 aa, Corynebacterium glutamicum
MPMSGIDAKKIRTRHFREAKVNGQKVSVLTSYDALSARIFDEAGVDMLLVGDSAANVVLGRDTTLSITLDEMIVLAKAVTIATKRALVVVDLPFGTYEVSPNQAVESAIRVMRETGAAAVKIEGGVEIAQTIRRIVDAGIPVVGHIGYTPQSEHSLGGHVVQGRGASSGKLIADARALEQAGAFAVVLEMVPAEAAREVTEDLSITTIGIGAGNGTDGQVLVWQDAFGLNRGKKPRFVREYATLGDSLHDAAQAYIADIHAGTFPGEAESF

SEQ ID NO: 3634 - protein, 317 aa, Corynebacterium glutamicum
MISTNEIENIHSTRRDIEIALDESSTSEPKRFSEISHLYLALAEGKISFPESPSELRELYDHLMHGELGKENELDGEIFRQGPVEIRDSRQKVIHSGFSPESQIIEGINAIIKLAHSEEESNLVGIMMSHFMFESIHPFYDGNGRTGRYLLGIQLSKILSPATALTMSSAINQFRNKYYKAFHAVEHRLNRGDGTPFVISMLELLIAAQEGLIENIKQRIDFLASLEDAIKTLRGTNSFKNHQINLLYILGQIQLFGKDETLSLESAAKFLKVSKATATRYFRTLREMELVHEVSKRPLRFALTDKGREIVGLEVKI

SEQ ID NO: 3635 - protein, 210 aa, Corynebacterium glutamicum
MYALVTFAWWDFRSVRPRIGAMPIDFLQPADIVAPQLLGCTLTHGGVGIRITEVEAYLDSTDEAAHTYRGKTPRNAAMFGPGGHMYVYISYGIHRAGNIVCGPEGTGQGVLLRAGEVVSGESIAQSRRGEGIPHARLAQGPGNFGQALGLEISDNHASVFGPSFLISDRVETPEIVRGPRIGISKNTEALLRFWIPNDPTVSGRRGYPKE

SEQ ID NO: 3636 - protein, 218 aa, Corynebacterium glutamicum
MSTSFESIPGVTISARKALSTAGFKDLESLAGTNYEEVAGLSGIGARTLERLQAALVEKRMSFGGKVPEAEQRTATWTTLDSAAPEATETSESPEYFIQNLDIPRRITHGRLLLEIFNRATGQKPYVAGSSIVGYGRVHYRYATGREGITIRVGFSPRKAKISLYGLTSAPASRELLKKLGKHSVGVSCLYINKPEDVDLEVLEEMIRISWEAEPGEC

SEQ ID NO: 3637 - protein, 308 aa, Corynebacterium glutamicum
MPKASRIVVMLLHPDAQFYIDTLPTLSAEEQVSFGKDAPVSEADATHVATDQDIAGVPVRVYTPLSGAGDLPCLVYFHGGGWSGGTLNMIDATVHSLVVGLPIIAISVDYRLAPAHPFPAAIDDAFAVVSAVLDGVSGLSIDTSRVAIGGDSAGGNIAAVTAQQLRERAVGSTPVLAHQVLIFPVTDVSTTSTPSYLTFGKDCYLTKDAMERYIEQYADGHDRTDPRLSPLLASDLSDLPPTTIVYGECDVLAHEVRAYGQALLEAGNSVTMTEFKGQIHAFINLGGISSDARAARRLIRAELEAALC

SEQ ID NO: 3638 - protein, 209 aa, Corynebacterium glutamicum
MQVRKEPSMSKTRTFLFDLYGVLIKEHGAAQFERVARAVGEPSKNDKLHEVYESLRLDLDAGRVSEVNYWNQIKLLVGLEFLDIQEVIAADYRGLYERDQDMVDYVLSLKAKGHRIGILSNIPEGLAKLLKEHNSEWLDQLDAVTLSCDIGAAKPEPKSFHVALEALGEKAEDVTFIDDRVRNIEAAREEGLSTIHFTGLDSLKESIQE

SEQ ID NO: 3639 - protein, 186 aa, Corynebacterium glutamicum
MTPQPLILPFGDKVPRIHESAWIAPNATIIGDVEIGPDASIFYGVVLRGDVNKITIGARTNVQDNCVLHVDGDAPCTLGDDVTVGHMALVHGATVGNGTLVGMKSALLSGSHVGAGALIAAGAVVLEGHEIPAKALAAGVPAKVRRLLDDAQSQSFIPHAGRYVETSKAQASIAEALSLDEVRVRE

SEQ ID NO: 3640 - protein, 381 aa, Corynebacterium glutamicum
MPNQAHFSASFARPSTPAAKCMHHIRLGQQLIRNELVEATGLSQPTVTRAVTALMQAGLVRERPDLTLSSGPGRPNIPLELAPSPWIHAGVAIGTKSSYVALFDTKGRTLRDAMLEISAADLDPDTFIEHLIAGVNRLTTGLDLPLVGIGVATSGKVTNAGVVTASNLGWDGVDIAGRLNYQFSVPATVASAIPAIAASELQASPLPHPEQPTPITLTFYADDSVGAAYSNDLGVHVIGPLATTRGSGLDTLGMAAEDALSTQGFLSRVSDQGIFANSLGELVTIAKDNETAREFLNDRATLLAHTAAEAAETVKPSTLVLSGSAFSEDPQGRSVFASQLKKEYDADIELRLIPTHRENVRAAARAVALDRLLNEPLTLVP

SEQ ID NO: 3641 - protein, 424 aa, Corynebacterium glutamicum
MSFRDIFADTRPLKEPAFKRLWLGNVATVIGAQLTVVAVPVQIYQMTGSSGYVGLTGLFGLIPLVIFGLYGGSIADAFDKRIVLICTTIGMCVTTAGFWVLTILGNENIWLLLINFSLQQAFFAVNQPTRTAILRSILPIDQLASATSLNMLLMQTGAIVGPLIAGALIPLIGFGWLYFLDVVSIIPTLWAVWSLPSIKPSGKVMKAGFASVVDGLKYLAGQPVLLMVMVLDLIAMIFGMPRALYPEIAEVNFGGGDAGATMLAFMYSSMAVGAVLGGVLSGWVARISRQGVAVYWCIIAWGAAVALGGVAIVVSPGAVTAWAWMFIIMMVIGGMADMFSSAVRNAILQQSAAEHVQGRIQGVWIIVVVGGPRLADVLHGWAAEPLGAGWTVLWGGVAVVVLTAICMVAVPKFWKYEKPKITGI

SEQ ID NO: 3642 - protein, 268 aa, Corynebacterium glutamicum
MSSRALKASSTHSTTSIFAPPSNGTSWDFPNPPTRCPFCSVTCATPLTPPLLCHLNPRHAPLTDPHIDASRRHRGPFHATPSYAGFHPSFTDDTARMLGNLAKIGAVATWEKTLVDAASWAELPHPPVIVGDTPPSTVTPDNAWYQFRVGKHLGRDAFAEIVMCLGHVFCHHVPQVWSTTCASQDADSTTMLIEAETAGALAIARVGGPTRRGGSFFGDALLKEGTPLPAGFRLDVVLHAASEIEDLLRGDTTAVVSGAWSVEDRRGY

SEQ ID NO: 3643 - protein, 148 aa, Corynebacterium glutamicum
MVRLTLFPMNVNQQLGARTAMNHPETATVLRSISDMVSTETNPRRKSRLEQLIYATASAWPHYPIAHAAQAAVQLARPMRVFELQSFEGVKHALHHIDLRPALEWDIMGFPESPDTLPILLSDLRDPPYATTAVPPQSTPRSAHRSTH

SEQ ID NO: 3644 - protein, 647 aa, Corynebacterium glutamicum
MKIKSVFLSTALSASLLLGITPPVLGATINPSLPLSALSSSDDIAVPNFAKELPLAFDVPAGTVPQSLSGTLQIPAEFSGGVVEFYDGDRLFHTLRLEVNDSRAHIEVPLQSVPVEDGRATFWLRAMLDPVNNQWCYEEQEVRFLDGNVTFEGATINPAVVADYFPSVLRALTIYVPENPSEAVQEATLEVATSLDSVYRRSGLDVNVETLPTGTDAPPTRPQDFERQIVLVDEATESNTQKTELVNPGQDNAFLRLNGNADELYDQARLLTDATLPLAVDTEVTASGFGDVPNLSTDVATLQELGITQLTSESVARTSVTLGIERSRLRTYSQSMDLHITGTYTPLPPQNAGQITFSIGDTVLDSLTTDDTGIIDREFNVPGDLVNRYTAIVVEFTSTGDVNCGVTQPVGLNIDSDSLVTSQHSDVPVLNGFRSLPQSFQPRVDVAFADPSVQELSRAVSVVLGIQSMSSQRIRPHLVNWDEAVASERPTIFIDAAGAKTDQVPSYLAQQGQTLEITSKNDQNADGEQLTRSLQTNAALVVGSIQAVWDADKKRTVIVASSQDNPADLDALISWMGEDRERWSDLNGDLIVKVRDREPVQLTTVEAPDQPGRSATAFIAIGVSLVVIALIVAAVVSVSRRSQKGYK

SEQ ID NO: 3645 - protein, 513 aa, Corynebacterium glutamicum
MSNPSLEPLEPIELSDGTEIEVSDVDPEPQAGNAQMEVPSLRTYVFRGIIAIACLIIGFYESFVLMWQNLRIGVANYSLLVVLMAIVLFIGLDRKRARALNIHDREVDYIIGGIVVLIAITIKSQLLPRFVDWETLLRLDMFALLFFAFGISGLVFGMRSTFSFAPGWILLFGYNAVAHLIISVIFGGGFWGPVMANIIGLSLAVLVSSNRDLVQATYLALMTVLFGVIIAIIVWALTDGSKFLTLVPAVLATITVVLVSSRWRLGQWKIRRRQPTVEKAGPALIAVVVATALLAWIPTPYVERVNNLPGLQMLAKPAPGVIAPIGWHIDDVQYYNWASRYFGPGSSLLRQTMTADHYNEAWDPDGLDRTVVVDTLQSAERFQQRAFGDETLYSTLRGRKSDTVQVDLGYGVDGRAYTVLDETDFLTYTKLVFEWQTTNNTVEKISVIAVDDHRAEAKFPELAPSVTRMFIQVATILFRGNDVTIDTNTQLKDLDLVSQVGRQIVAEQQVGRS

SEQ ID NO: 3646 - protein, 212 aa, Corynebacterium glutamicum
MICRHRLPKQRGTGAEVARSPVVILHIVDVPTNRCDNTWGRLCQHLKPGEVVDALHIRSRNPRQECCRNHDRDKRGSGFFHRGLSTTNFPLTKPPTRRHQHHSDGCQHCWDQGEELTAIGQRPHDDGNNDAKQHRHQCQIGGLNQVPVGGHQHRKRQSNDVCHHRAPKATTENHRDDQVCHRVVAKQQNPAGCKRKGRAHAKHQAGNTKRKE

SEQ ID NO: 3647 - protein, 487 aa, Corynebacterium glutamicum
MMEQDLSYREILPLNASEEKKKAALIDAIEGLRVRDPLLSASIAFTRGQKVAFIAVVVGFILMLIFARQAALIGLSATCTFMYLITLLDRFIMFSRGIRAESIIQVSDEDALAFPEDKLKTYTVLVPAYGEPEVIAQLLASMHAFDYPKHLLQVLLMLEEDDLPTIAAAEAAGVDQVATIIKVPPAQPRTKPKACNYGLHFATGEIVTIFDAEDMPDPLQLRRVVVAFERSASNTVCVQSRLSYRNARQNLLTAWFTIEYDVWFNFLLPGVMRMNAPVPLGGTSNHLLTGVLKDLGAWDPFNVTEDADLGVRIAAKGYSTAVLDSVTWEEANSDTINWLRQRSRWYKGYLQTWLVYMRRPKWLVQELGIIPAVRFTFLMAGTPIIAVLNLLFWYLSLTWILGQPGTIEQMFPPAVYYPALVCLVVGNAATIFMNLIGCREGRDPLLLIAVLTFPLYWLLMSIAALKGTWQLITRPSYWEKTAHGLEA

SEQ ID NO: 3648 - protein, 577 aa, Corynebacterium glutamicum
MPIVKPMPALPRRAPVLASSQIEGFEHRRGWRRQANFWFAASLALYWCAALWIALDVGYFWGDALSRTQGALSALYSRNPTLSAIGYVFTPLTTVLQIPLVALSPWVPEFTRAGLAGALVSSVFMAASVRQLWLIASERNIRYWLAVVGLLLYALNPMIILYGATGMSEAPFIYATLWAVRRLIRWTSTDDVHDLITCGFALALAFLARYDALIMAFVAMWTVGFMTWRARYRRGFRDRIGFALVDMLLLVWPIGFAFVAWTGASWLTTGELFAQFTSTDGNAAIIAASGGGAIGPQALFDASVRTFLISPALLLVAVVAVFFAYRRRDPEPIIPLALIGSVVFFQIITYSLGSTFGLLRFFLTALPLTIILLFQIIPPRHRFPSLRPGACYRDRVTGKYVPKTITGVLVLAIFGGTGITLYGMSSANWAPQEYAIQELVFNMGSPSQDAVHTLNTFSTEMDVADFVDSLNLGDGEVLLSTTYGFAVLTASNNQKQFIIPSDEDFITTLNEPAEHGVKYILALPREGRGATDPINLRYPDMYETGSHIATMEIEFINQGQGQPNWRLYRVLTTPEQS

SEQ ID NO: 3649 - protein, 207 aa, Corynebacterium glutamicum
MDCRIYDMARTIPPWLPRPHRIRTCRHAAPRLADRLRLRRLDWRQLAHYRRTLCPIHLHRRQRCDHRSIRRRRHRAPSAFRRLRPHLPHLPSSPTRRSSCSLFCLSTPRPRTHHPLSSHRLCGVLPNHYLLTWIYLRPAALFPHRPAAHHYLAVPNYPAPPPIPLTATRCVLPRSRHRQVRAQNNHRCFSSRDLRRHRHHPVRHEQC

SEQ ID NO: 3650 - protein, 355 aa, Corynebacterium glutamicum
MARKLKDKLPRSFDKIVESGDFDAFKEVFTERALDAKNRHGNTALHMRGVPEEFKIWMLDQGLDVDIRNEDGDTPLHVHSHDWNLSPDFLLKRGADVCAVNNEGESVAYSAAFFPENLKKLIDAGADPYSRANDGTTPLMRVIRSADTGQIIELAEITKLLSGTEFTDAEFRETQERIIAMGERFEDVREVYNEESVDQASADMIWLYDRFDIPEELRANTPILHDGVSPIELPGDTWQEQFIEGYDLLVPAMGKAKSLQGEAIRIAGRVSNEFHGNGGVNWDKDFKRMAKSLNHICEQGVPLGEPELEELAAAVKSVRKGEPTEEEIDTLPRLATKWVAQNPQPLPLGEVDYKR

SEQ ID NO: 3651 - protein, 252 aa, Corynebacterium glutamicum
MIVLTIAIVLLASVLIGALLQRMTGLGVGLVTGPVLTSLLGPLAGVTMVNGLSIINAVNNAWSVRKRTDWAKFRILAGALVLGSVPAVAVVYFLNGPWLLIFVGAMVLLALGVSLFPTEKFALKQEAKLPMVIFGMIGGFMSTVAGIAGPSLTVYARLSRWDYRDFVATLHPVLLVANTVSFLLKVILIGGLDFGGAPAWLWIGAVAMIFVGAWLGEIVNAKVSTPMAKRIATLLAAAGAAVVLFRGIMELV

SEQ ID NO: 3652 - protein, 293 aa, Corynebacterium glutamicum
MATNRTSSAGVITSVLASALFGAIFFISGAIEAKAETLVAWRVLLTAACYLLALLHPAGRKVFKEFWDTLRSQPRQILYFIFLVVLITLQLWLFSWSPKSHALDASLGYLLLPIFLVIVGRFFFADYITRLQWIAVGIALIAVTLKFVISAQLSWVTFAIAAGYALYFALRKYSGLNNAFAYGAEVLALSPLAFFMLATVEDPLSNAMLSMVILAGLAGALAMALYLAASTLLSMPMFGLLSYGEPILLFVAALLLGETLNLSDAIVYSLLACALALLGFDGIRRSRKNLETD

SEQ ID NO: 3653 - protein, 239 aa, Corynebacterium glutamicum
MDLALAQVDSTVSGLYDALDLIGVLLNGIIGGTIARQRGYDIIGFLFLALFSALGGGMIRDMLIQQGTVAAIDNQIYLALAFSGALIAMAVNFKGRVWELFKVHGDAIVLGVWAVTGSVKAMNAGVAPLPSIFMGVLTAVGGGMVRDVATGQTPTIFGGGTLYAVPATLSATSMVIFHSFDQVILGMIISPFLGIALAVTAYWCGWVIPVNTDFAPVNLTVSQLRAMLSKAERKDKDQK

SEQ ID NO: 3654 - protein, 111 aa, Corynebacterium glutamicum
MKTYAVLIAVAGLALAGCSSSAPGIWRATEPADAYLEIADDGTLSGTDGCNRLFGGWEKDGSTITFGAIGMTEMYCEGVNDWLSQMHTATVTDATMTIFNEAGSNIGELKR

SEQ ID NO: 3655 - protein, 553 aa, Corynebacterium glutamicum
MTLQSSDKRSPSLLDASSEVFVHDLAALSPTDATAWGISGFEGDLQDFSPDYWNAIAERNRDMVADVDAFDDGTDDNDDEEDFDDVDRVTADVLRDRVCLDLALHHQGETLANLNNIDSPVQTIRDTFLIMPRETDDDVENLRERLSRVPDALHGYCESLAEAASQGHVAAVRQVEEVVSQCEDLADEDSVLQHLGLDENDPVVVEAQEAFARVAGWLAEQLAPHAPHVDAVGRDRYEMFSHLHVGEFVDLDEAYQWSLEQLRDIDAQQLQVAQQLYGPGTTIREAMKKLNADERYLIRGTDALQEWMQKTADQAIADLDGVSFNIPEQARQVECLIDPAGTGGIFYTPPSDDFSRPGRMWWSVPKTQEVFHTWQELTTVFHEGVPGHHLQISQTLVEKDLNLWRRVACWNSGHGEGWALYAESLMKELGYHEDPGNLMGYLDAQRLRAARVAIDIGIHLNKRNPECTGLWDASYARSFLRENTSMNEDALYFELNRYLGWPGQAASYAIGQRLWLNLRDEAISQGQTLAQFHSKALSYGSIPMGILRDQVLN

SEQ ID NO: 3656 - protein, 379 aa, Corynebacterium glutamicum
MSDKEPDPHEQIPEKPSRKVIALRWCIVAPLSLAVGWLFTMWGVPAAWILGAILVAGVCALTTGQDLPMAKGVHVFGRSIVAMLAALPLISSSGSELVRFLIPGLVISFFTIAVGIVGGLLLARSRPEILPETGVLSMLAGGASVMPILARELGADFRYVALTQYLRLLVVSMTLPLVTHFFVPGGADLGSPPEKWLDVLSLGEFGTSISVLSLLVLFGIVLAGEPLGRLLRLPAPAVMGPLILTVLVSFVIPDDLSLQPPTVFKIIAFMAIGWMCGGALNMTALKVFSKQLPATFLFIFALLAVCAGAAGLLTWWLDISFFEAYLATSPGALETVLALSSEGSAGPVVVTIQIIRLLAILTIAGLIPTLLRRILRRDR

SEQ ID NO: 3657 - protein, 266 aa, Corynebacterium glutamicum
MIGAHHMGLELAASGWGILIAGAAVAGWIDAVIGGGGLVLIPLILAVMPQLAPVTALASNKLAAVTGTASAAFTLVRRVKPDKKLLALYVLVAAVCSGAGALAASLIDKQIMRPLIIVLMLVVGLIVVFKPNFGTGESKALPTGWKRWAAIVAVGLIAAYDGIFGPGTGMFLIMAFTALLSQNFLSSAAMAKVVNTATNLGALIVFIIGGHMWWTLGLVLAVANVAGAQLGARTVLGGGTRLIRYALLTLVVVMSVYLTWQQIQGM

SEQ ID NO: 3658 - protein, 208 aa, Corynebacterium glutamicum
MVRSYHIPVSVLHHLCCLKYMAVEVPFSRISMGITSISGRLRMIHMRNQTIAAVAALVLLTAATPAIAATPATAGNGLYSIDMGDEQKLTCVLFDEPSTEAHVVASCAATFPVTWKLLDGAHEQAAKLEITQAQDGELSVTASKQPLITTMIAPTSITKPITVNRLVVVPGENEVRFYATDPDVLPVLITPDSYEVLTDSAAKVKATL

SEQ ID NO: 3659 - protein, 135 aa, Corynebacterium glutamicum
MAGNIPRMGGMAKTKLESISERNSDDPLSYPDLTLAPISTTVTVVVAEDTPNDNFSELLLGAAESTRLLGLDELHIIAPSVHLPALAVAAADIAHHLPEKFQFCEAETCTHLHPDDDTYLTAESVAQLGTKLKSA

SEQ ID NO: 3660 - protein, 796 aa, Corynebacterium glutamicum
MSSRIGNFLINRISTGLPVENIIPHLQEAFSAGPKNLVIQAPPGTGKTTLLPPLVANILCNEGAGNATPTKVLVTAPRRVAVRAAARRLAQLDDSQLGTKVGFSVRGEHISGSHVQFMTPGVLIRQLLNNPELPGIGAVIIDEVHERQLDSDLLLGMLAELSQLRDDFSLIAMSATLDSDKFANLLDAQVLSVEAPIFPLDISYAPARAPRLNAKGVDWDFLDHMAQKTHDAVTHSEHSALIFVPGVREIDRVMSTLKSLGHNNVFPLHGQLSPTEQDRALAPSQQQRIIVSTPVAESSLTVPGVRIVVDSGLSRSPKRDSARGMTGLITSSCAQASAGQRAGRAGREGPGQIIRCYSEEDFSHFPRFVTPEISSADLTQAALWLAQWGTSPADLPLLDQPPHAAWTAAQQILRLIGALEGDAITSLGHRLSTLPLCPQLSASLLRFGEQSAKILAVVSENPQGDVEKQQPDKREVERLRRLAPASVGKASAGQIVGAAFPQLIGRKIDNGEYLLASGTRARLMDSDLKDAEWISVAAINRSQNSAIIRAAARISEDDAIDIIGVVEETRAIFVNGKVQARKVKAAGAIELSSTPTKPTPAEASETIATALAKGGIDLFHFSDKAASLRDRLKFIHEHRGEPWPDIETADPHLWLSPEIEALSHGTRLNNIDMYPALQRLLPWPEATNFEEFAPSHLSVPSGNQHRLDYSSGRPVIRVKLQECFGLEESPQLCGIPVQFHLLSPAGRPLAVTDDLRSFWSGPYSQVRAEMRGRYPKHPWPEDPWTAPATARTKNRM

SEQ ID NO: 3661 - protein, 105 aa, Corynebacterium glutamicum
MESRKVIVGCAEKQDFTKLLSKQKTRWTPTALISLGCIVVAILALVVFHGSSRSCIFHQVICPLILGISGAIAGIVAKKPLLTGINLGFAFFLVPAYLIFFGNIF

SEQ ID NO: 3662 - protein, 225 aa, Corynebacterium glutamicum
MDNDFESIEKMSSGDWYVATGAEREEVAQKTALLFHEYNQIGPTDPARTAEILRTVLNPASGTCTIKAPAIIEYGFNTTIGEHVFINFGLTILDIAPVRIGARSMLGPNCQLFTAGHPVDDWEMRSGGWENGAPISIGEDTWLGGNVTVVGGVSIGDRCVIGAGAVVTKDIPDDSIAVGNPARVVRKRDDSRLERSQLPEGASVDALGILPTKSPRLSENIAEKY

SEQ ID NO: 3663 - protein, 230 aa, Corynebacterium glutamicum
MPTLFDDPLHQLPRPPRRVAAGVVHLPNFLGLAEQKALVAQARDLAREVVGTPLAMVRPKLKSGQMSVHMLHLGKYWASNPYRYVDVVDGFPVPPLPDSFVDLAHRALLSAGSLSNSLQSWSEAYRAEAALVNYYSPDASMGMHQDANEESEAPVISLSIGDTGIFRLGGTLNRNKPWTDIPLMSGDLIVFGGANRQAFHGIPSIEANTAPAGCGLKEGRINITIRQLAL

SEQ ID NO: 3664 - protein, 175 aa, Corynebacterium glutamicum
MTTNKANPNELVICADEKSRPRWASRSELCWEYFDNEWGRPPVDLNALFEILTLVVFQVGVTWHAVLSKREGFRQAFAQFDVAKVAAFNEDDVERLLDDLQIFRNRRKINAAITNAKALLELNDETGTFDSIIADHSTDATAMVKHLKALGFTHIGLTSLSILQQAIGVTELKAA

SEQ ID NO: 3665 - protein, 226 aa, Corynebacterium glutamicum
MTTAQFLALFLVWIAAIASPGPDLFQIIRLSAKNRRDGVLTAVGIMVGNSIWIIASLLGLSALISTYPAILNLLQLVGGGYLTWMGIGAVRSWWTKRSTQQAAADSQAVENTLVTATAASVGVWPAIRSGIATNLSNPKAVLFFGSVFAQFVRPDMGIGWSIFIGVFLTLTGLLWFVGFAVLVRKLAAGLTRNGAIIDLLTGVIFIGLGMFMIFEGVVGIGGRVVG

SEQ ID NO: 3666 - protein, 97 aa, Corynebacterium glutamicum
MQPEEVHIKDETIKLGQFIKLANLVESGGAAKDAIANGDVTVNGEVDTRRGKTLRDGDVVCIGEVCAQVSTGDAADDDYFDEATANDDFDPEKWRNM

SEQ ID NO: 3667 - protein, 284 aa, Corynebacterium glutamicum
MPAFEAMPGMPYWIDLSTSDIAKSAHFYENVLGWEIEEVNDGYRMARLQGLPVAGLIDQRGESSIPDTWITYFLSYDLDATAKKIAELGGRILAEPTDVHLGRMILAVDTAGALFGVIEPGSEESFVAAGEPGTSVWHELTTVSKYSEAIDFYGELFTWTTSEMASAEDDSFRYTTALADGSAFAGIFDAKGHFPPQVPSFWQSYLGVLNADDAAAKAKEFGGDVIRKPWDSEFGRMVLISDSTGATITLCEVEEYVEEAAEGDDLFDIDLSAFEEQFRKQEGQ

SEQ ID NO: 3668 - protein, 114 aa, Corynebacterium glutamicum
MEELEFDELTSMVLDCADLIPQGKVATYGDIAKIVGTGPRQVGRIMATAGQFTSWWRVVRSDGGSQVAGTARSKWAEENIAFSELSAPKVRMQQHRLSEEELETIAGKLQQIAD

SEQ ID NO: 3669 - protein, 310 aa, Corynebacterium glutamicum
MQVFYNRAVTFTGMKTPRLLKILSAMVAVTGLLIPTVVPMAAADAAELSDNVPDRTQIAIINPDGSVQESDNAEESRPALSLAKLYLGYYVLAQGAEEDIELVPDMIRYSDDFTADYLESEYPEAIPEVIDAFDLEDTEWAGFWGNATTSAVDIATFVAALIDDPTAQPLLDAMSDTAEYAADGYAQNFGTFTLSDVTGTKFGWSDSLDVHSSVSFGPGFVIAANTYGDAETLTEDVQDSVSSLYPEEVTTAIEEQVDQLCECAAETTHLGMHTGAELKAQLEGTIYGKTLSFLPNSAPAPAFIYNLLAH

SEQ ID NO: 3670 - protein, 219 aa, Corynebacterium glutamicum
MVAGVTDRLAHNLIHIVEVMAWGQRIVQVKDGCAGQFRSCRDLWTPLELQRITGTAPPTTAVERYSPAARRIRRVENRASDLRDVIDAHTTDKCDTRHGMIKARTQHDHRSMRGAIGKMCNIAVCWIRIAGATCPRGREIWNRVVRINIRSELLQLFFFRKLTILTANLELLTEACFLILFSFLWGVVFSHGHNLSACAHVAGWKVKISTVFWVGVRLE

SEQ ID NO: 3671 - protein, 311 aa, Corynebacterium glutamicum
MSARTKVVPMAENNTPQETEQDQEARFREEFEVGGKDRQLSEEEQLEQLGSYIDAHYPVPDFTPPWAGGAGDPDPADRYIAHLPDRTTHTAMIMLGSGLDHSMPGVAFIGGVSVDDVPEVGGAIFHPSNPTGRWAVSFHSGGWWRGSGDALEFQWRPEVAAAAELSGTTILDLDYPLAPGHNLHDMNEVVGKAVGYARHHNPVSITGWGYSSGAALAAINASLFDALVLTFPDLGSVEKLPAEIRGDAVVPAAAAWPTTFVQIAAQDEIAERPGELGDATVKEYVSRHRISTPKVAREKITDVAEFLKTVC

SEQ ID NO: 3672 - protein, 135 aa, Corynebacterium glutamicum
MSAVMPAQLPPGPAERTVYSYGVRAGDQLHISGMVAFDSDANIVGEGDIEAQAEQVFKNLQAVVEEAGGTINNIVSTTTYLADVTDAPVVNAARSRYFTGEVLPTHTVIGVAALARPQFLVEISAVAYLGDLSKD

SEQ ID NO: 3673 - protein, 213 aa, Corynebacterium glutamicum
MRRRFSMSGTAIMYDTTVVPSKKEIAQAWTGYVDLQGSYRLVDTVDGEVGVEVLISKDREGRLLQIPFSYRSAEINPEQTLSTLEHGVLGKRWVTNALGDPVAVREFIRTILTGDDGAARSDGVKGYLDIKGSGDAESVDLQDVKLTEVTRQRAIGSVTINGERKQFSLRLPQLLKNFRETAAGHTATTLRIVATHPEKDDVELLVAEFNWME

SEQ ID NO: 3674 - protein, 247 aa, Corynebacterium glutamicum
MSVIEGKYQLKPQGRGGLWWSIVGVAVVLLLLPTLINLVVPDKANDYKQLEIDLLGVDWSVPITTEESAAVLCEETSDEITQKYWDCNGDTTVVTMIVEGVKDPSNTLRRMVGSSLITSVDDSLEAVSSEDGRAHALYVPGQQEGSLWTLPIVALSVQGSGDYEDLTAIAIINGTSLDYYSTHIWSSMAADRGLPYQQDFPLMLEEEPWQDTPGGDRPFELPNDFFDQYPDLFGPGSVIPNLEGESL

SEQ ID NO: 3675 - protein, 689 aa, Corynebacterium glutamicum
MRFQLVLALDYAHTDRLPSGVDMIPNAQPTCGTNHKPCGGKSPRVGHMKDLYRFVNGLWLDTHIIPDDRAVDGTFHKLRDDAEEDVHEIVKEDTGRAGTLYASFMDTDAINAAGVAPLDADLNRLSVANSSFFAAALGELDREGVGAPVGFWVEKDSSSNESVAYVIQSGLGLPDEAYYREEAHAETLAAYKEHVERMLGYLDNSRLFGLSAASAAARIVALETEIAAGHWDVVKTRDAVATYNPTELGALPPKVRTLLSSAGLPDQRLVSMMPSYLDHLNGLLVDDRLPDWQLWATWHILRSRAGLLTEEISQANFDFYGTKLSGATEQKDRWKRAVGLAERMVGEEIGQRFVERHFPASSKEHMLELVDYLVAAYRDRISNLEWMTPATRERALEKLGKFNAKIGYPDKWRSYEGLEFGSDLVDNSRKGSAFLHDYELGKIGKPADRDEWVTTPQTVNAFYNPVVNDITFPAAILRAPFFDPEAEAAENFGAIGAVIGHEIGHGFDDQGSQYDGDGNLNSWWTDEDRSAFEQLTSRLVTQFSGLVPAVLTSEGIDTDGVNGEFTLGENIGDLGGLGIAVVAYEKYLADRGQTFETSPVQKFEAEGAEEGLAEQEFNGLQRLFLSWARVWRTKIRPQMAVQYLAIDPHSPAEFRCNVIAGNVAEFYEAFDVPEDAPVYIKPEERLAIW

SEQ ID NO: 3676 - protein, 321 aa, Corynebacterium glutamicum
MSRMFSITLWVAILLSTPALFLSLATFIFVDGISVLVNIVFAVLYLVVIVFLLSRTPLWPRFKGSGSKKGGGFAWAASSLLWGAFVGFGIVMLFAGPVMDLTDKLGWDFVAMSFTGAYPEEIAKALGVAIILLSFRQLNRPWHGFITGALVGLGFEVNENLLYGATGAIMDPNADLDGVLMMWQYRTMLGPLIHTLLTGFAGYGIALAFFRARKTVAWRWGVAIGWTLIAFALHFSWNLMWENVIGSYVTIIVVSVVMYGLAIYILWSNWAEARNDSSYAFVPGIITNTKDLSLLDAPIPVGAEVPESRIPQQIEEPKAEN

SEQ ID NO: 3677 - protein, 253 aa, Corynebacterium glutamicum
MTTEAPIWPAELFEDLDRNGPIPLYFQVAQRLEDGIRSGVLPPGARLENEISVAKHLNVSRPTVRRAIQEVVDKGLLVRRRGVGTQVVQSHVTRPVELTSFFNDLKNANLDPKTRVLEHRLLAASSAIAEKLGVSAGDEVLLIRRLRSTGDIPVAILENYLPPAFNDVSLDELEKGGLYDALRSRGVVLKIANQKIGARRAVGEESTLLDIEDGGPLLTVERVALDNSGQVIELGSHCYRPDMYNFETTLVAR

SEQ ID NO: 3678 - protein, 339 aa, Corynebacterium glutamicum
MTCDREGRHIPSKMSEGLHRHMTNLTSTHEVLAIGRLGVDIYPLQSGVGLADVQSFGKYLGGSAANVSVAAARHGHNSALLSRVGNDPFGEYLLAELERLGVDNQYVATDQTFKTPVTFCEIFPPDDFPLYFYREPKAPDLNIESADVSLDDVREADILWFTLTGFSEEPSRGTHREILTTRANRRHTIFDLDYRPMFWESPEEATKQAEWALQHSTVAVGNKEECEIAVGETEPERAGRALLERGVELAIVKQGPKGVMAMTKDETVEVPPFFVDVINGLGAGDAFGGALCHGLLSEWPLEKVLRFANTAGALVASRLECSTAMPTTDEVEASLNQKV

SEQ ID NO: 3679 - protein, 307 aa, Corynebacterium glutamicum
MTPPIISPESFEALRRMRAAEPTMVAERFKQRRKRELLGEDGKLFIVAADHPARGALAVGDNETAMANRYELLERMAIALSRPGVDGVLGTPDIIDDLAALGLLDDKIVVGSMNRGGLRGASFEMDDRYTGYNVSSMVDRGVDFAKTLVRINLSDAGTAPTLEATAHAVNEAAAAQLPIMLEPFMSNWVNGKVVNDLSTDAVIQSVAIAAGLGNDSSYTWMKLPVVEEMERVMESTTMPTLLLGGEGGNDPDATFASWEHALTLPGVRGLTVGRTLLYPQDGDVAAAVDTAARLVHTDIQQFTSQSI

SEQ ID NO: 3680 - protein, 504 aa, Corynebacterium glutamicum
MSEPQTISHWIDGAISPSTSGKTAPVYNPATGQVTANVALASQEEIDATIASATKAAKTWGNLSIAKRQAVLFNFRELLNARKGELAEIITAEHGKVLSDAMGEILRGQEVVELATGFPHLLKGAFNENVSTGIDVYSLKQPLGVVGIISPFNFPAMVPMWFFPIAIAAGNAVILKPSEKDPSAALWMAQIWKEAGLPDGVFNVLQGDKLAVDGLLNSPDVSAISFVGSTPIAKYIYETSAKNGKRVQALGGAKNHMLVLPDADLDLVADQAINAGYGAAGERCMAVSVVLAIESVADELIEKIKERIDTLRIGNGAGDEQGEPHLGPLITDVHRDKVASYVDIAEADGAKIIVDGRNCAVDGHEEGFFFGPTLIDDIPLTSRAYTEEIFGPVLSVVRVASFDEAIELINSGEFGNGTAIFTNDGGAARRFQHEIEVGMIGINVPIPVPVAYHSFGGWKNSLFGDAKAYGTQGFDFFTREKAITSRWLDPATHGGINLGFPQND

SEQ ID NO: 3681 - protein, 296 aa, Corynebacterium glutamicum
MRWFHKKGELARDGWQSVVDATTPGWEYTGIRIAELGSGESLELNDTGVERIFIPLQGSFDVAHHGQVTHLHGRKSVFDGPTDVLYLPTGQTATLSGQGRVAVAEAPTQEPKEWKYIAPAETPVELRGAGRSSRQVHNFGTPEALDAARLIVCEVITPGENWSSYPPHKHDEHIPGHESKLEEIYYFESAPSRVGGRAEAAEGAFGMFSTYSSPAGEIDINAMVYSGDIALVPFGYHGPAVAAPGYDLYYLNVMAGPDPERIWLINDDPAHAWVRDTWTGQAFDDRLPYENANKEG

SEQ ID NO: 3682 - protein, 576 aa, Corynebacterium glutamicum
MPYYQARNEQAMVHQSVGYARMHRRRGTYASAASVGPGATNLLTGAALATTNRLPALLLPSDTFATRVADPVLQQLEQPWDIGLTVNDAFRPVSKFFDRVQRPEQLFSIALAAMRVLTDPAETGAVTIALPEDVQAEMLDVPVEFLQDREWHIRRPRPERAALARAIEVIKNAKNPMIIAGGGVLYSDAETQLQALVEQTGIPVGTSQAGGGVLAWDHAQNLGGVGATGTLAANRIAGDADVIIGIGTRYSDFTTASRTAFQNPDVTFININVASFDAYKHGTQLPVIADAREAIVELAEALQGFTVAEDYAQRIAKEKAAWDAEVDKSFAPSGLALPGQPEIIGAVQASTSEKDVIVQAAGSLPGDLHKLWRVRDALGYHVEYAFSCMGYEIAGGIGAKRGLDAAGDDRDVVIMVGDGSYLMLNTELVTAVAEGIKVIVVLIQNHGYASIGHLSETVGSQRFGTWYREYDAEAKNFQGEQILPVDLAMNARSYGMDVIEVEPSANAIEDLKAAMATAKASEKSTFIHINSDPLIYAPDGAGWWDVPVSETSTLDSTNAAREDYLKNQALQRPLLG

SEQ ID NO: 3683 - protein, 318 aa, Corynebacterium glutamicum
MTTSVPASTKASSVAGENPGLRIGTAPDSWGVWFPEDPKQIPWERFLDEVVKAGYTWIELGPYGYLPTDANQLEDELGKRGLKLSAGTVFTGFHKGEEQWKRAWDQALDVAGLASKLGAEHLVVIPDLWRSDATSEVLEARTLDDEKWAKLAAGHDRLGKALLEEFGMKQQFHSHADSHIGTTREVLRFLEETDARYTNLCLDTGHFAYYGGDNVKLIEQHPERIGYLHLKQVDPTLLFDVLKNDTPFAEAVAQGIMIEPPHGIPDLAPIIEAVSKIDSEIFAIVEQDMYGCDIDYPFPIAERTRKHIFGCTHFARVN

SEQ ID NO: 3684 - protein, 337 aa, Corynebacterium glutamicum
MSKSLRVGVVGAGAMGADHIDRINNRTSGAHISAIIEPDAARAAAAAEDAPGAQAFTRIEDAIAADAVDAVLIAVPGQFHEPVLVPALEAGLPILCEKPLTPDSESSLRIVELEQKLDKPHIQVGFMRRFDPEYNNLRKLVESGEAGELLMLRGLHRNPSVGESYTQSMLITDSVVHEFDVIPWLAGSRVVSVEVKYPKTSSLAHSGLKEPILVIMELENGVLVDVEMNVNIQFGYQVATEAVFEKGLARIGQPSGMQRWRDGEFLINEHTDFTTRFATAYDRQIQSWVDAVHEGTLVAGPNAWDGYLVALSCEAGVKALDGGVIPVDAAPRPDFYA

SEQ ID NO: 3685 - protein, 290 aa, Corynebacterium glutamicum
MVRIALDPTPFHHDYDLLDFPDVTARLGYEYMQLTPHVDFGPFFRHPKADDDLVAALKKRAKDAGVTIPALLPVQRISWPEETQRVAAVRNIKRIIQLAVDLEVDTLNTEFSGRPERSEDSEDAFYRSMEELLPILEKEGIKFNIDPHPDDFVENGIEAWRVIRGLNSKQVGFVYVAPHSFHMGDQAEAILPAVGDRLGAVYLSDTFDHHKSHGLRYITNPPGNAVRVHQHLKIGDGDVNFEEIFSLLRSTGYLDREDALLVSNVFAEDEAADEVSRYQLEKIRSLIENA

SEQ ID NO: 3686 - protein, 458 aa, Corynebacterium glutamicum
MDIDAMRNDRSFSVPIALLAAGALFLEILDGTILTTAVPAIARDFGIDAVDVSIALVAYLAAAAAGIPAAGWLADRFGVRKVLLLALAVFTAASLVCAVAPGLTVLTGARVIQGLGGALLVPVGRLAVIRGTDPKDLLDAIAFLTWPALVAPVIAPLLGGLLADTIGWRWIFLLNVPLGIIAIIAGLFILPKNTAVNVKRFDLPGFLGAMLVMVALTVAAELISRGSSAELTIAACLVLSAAVVCGFVVRWLRVPGRLFDLSIMRIPGFRVGNSSGSIYRLVITAAPFMFTLLFQVAFGWSATLAGAMVVALFAGNVAIKPFTTPIIKRWNFKPVLVFSNAAGALVLATFLFVRADTPLVLIVLLLFVSGALRSLGFSAYNTLQFVDISPEQTSNANVLSATLHQLGMSLGIAVAVIAMSLAPTANWAFPLAAALFLIPLIGALSLPRDGGARAFSSS

SEQ ID NO: 3687 - protein, 207 aa, Corynebacterium glutamicum
MRMMLRSKSRPGTRSQRTTKPHTTAALKTRHAAIVSSAELPLEINSAATVSATITSIAPRKPGRSNRFTFTAVFLGRMNSPAMIAMIPKGTLRRKIHRQPMVSARRPPRSGAITGATRAGQVKNAMASRRSLGSVPRITANRPTGTSSAPPRPWITRAPVSTVSPGATAQTKEAAVNTAKASNRTLRTPNRSASHPAAGMPAAAAAK

SEQ ID NO: 3688 - protein, 341 aa, Corynebacterium glutamicum
MTIRIGLVGYGVGGRLFHTPYIQASTHCELVGVVARSEGTKAAVAEDLPDVAIVGSLTELLELGVDAVVISTPPATRRELALEAINAGVAVVADKPFAPSAADAMELVEAAEKAGVLLNVFHNRRNDTHIVTALGIQEELGAMRGLDLRLDLIEPDSLEAGPEGGLLRDLGSHVVDQTLVLMGPATSVTAQLGSIDLPEGPTNARFRIVLEHESGAVSHISASKIDRLESWEIRLVGERGSYVSNYTDVQTVAIKQGLRPTNDREHWGYESEERWGTLVTDEGSKVIPSAQGDYTRFYDAFALAVENGGAGPVPAREGVAVLKVLDAVAQSAAEKRTIELS

SEQ ID NO: 3689 - protein, 152 aa, Corynebacterium glutamicum
MSKIVDLRYGTRRSSELSKRSAEVFAEAEEHPITVTRRDGEALVLMSQREADGRARLLELAAQLITVATDHQGTLAERMAKVFPWMLALSVADREACAREILDAARASFATEQPHLALTELTSWKETAAAVAAGLSNTDLQWYDDPHLVERP

SEQ ID NO: 3690 - protein, 128 aa, Corynebacterium glutamicum
MVRRSASGGASLSVAGKKSELVPRPRKKNEFESRFATTHAAKGWRDLVASIRNPMAETWDFLTVTPLLTTPTNYRLKGELGIVHHNGKAHDRWQHKSTAKGSARIWFYVEKNTVFLEQVHTHHPNETK

SEQ ID NO: 3691 - protein, 331 aa, Corynebacterium glutamicum
MSTSRPTIYDVAKAAGVSKSLVSLVLRGSPNVSKESEAAVKTAIKKLNYQPNRAASDLAAKRTQLIAVLIDDYSNPWFIDLIQSLSDVLTPKGYRLSVIDSLTSQAGTDPITSALSMRPDGIIIAQDIPDFTVPDSLPPFVIAGTRITQASTHDSVANDDFRGAEIATKHLIDLGHTHIAHLRVGSGAGLRRFESFEATMRAHGLEPLSNDYLGPAVEHAGYTETLALLKEHPEVTAIFSSNDITAIGALGAARELGLRVPEDLSIIGYDNTPLAQTRLINLTTIDDNSIGVGYNAALLLLSMLDPEAPHPEIMHTLQPSLIERGTCAPRG

SEQ ID NO: 3692 - protein, 411 aa, Corynebacterium glutamicum
MTQQELRVAVIGAGMAGKAHAAGYRTASSIYSTTLPNIRLVSIADANVQLAEETAARFGFERFDTSWQAIVEADDIDVVSVVVANFLHREIVEALLASGKHVLCEKPLSDTIEDAEAMIEAAGRAATNGTIARIGLTYRRSPGVAHIRDLVQSGELGKVLHVTGHYWTDYGSNAQAPISWRYKGPNGSGALADVGSHLTYLAEFVAGSDFAAVRGGQLSTVITERPKPLGAIVGHEGGAVSDEYEAVENDDIASFSGSFIGGGTATLQVSRISQGHPNTLGFEVFCEKGSVLFDFRNSGEFKIFTPATSGDISQEAGYRTITIGPKHPYWRGGLAMDAPGVGIGQNEGFVFQARAFLEEIAGISEAESLPRCATLEEGLHNMQLIDAVSQSAAAGGETVAVPAAALIPANN

SEQ ID NO: 3693 - protein, 337 aa, Corynebacterium glutamicum
MKLGLYNAIFHDRTLPEALAAIKAAGLTGIELNTGGFLPATHIPTIDDILVSDDARDEFLGIFEGTGVDIYGLNCNGNPLHPNKAIGDKHAEDIRRSIRLAERLGQNRVVTMSGLPGGEPGAKYTNWVVNAWNSAALDVLDYQWDIAAEFWRETDRFAADHGVKVALELHPQNIVFNSADVHKLIDLTGATHVGVELDASHLFWQQMDPIAVIDHLGELIFHAAAKDVRVNKEWAQLNGVLDNSFRRLDPSENRTNLGGDEWANEWPKNSAWDFVALGRGHDVAYWTEFLRALHRVDPNMLVNIEHEDVSLGREEGVNEAAKVLIEANKALEESLVS

SEQ ID NO: 3694 - protein, 143 aa, Corynebacterium glutamicum
MYSNNLFLLSVSEDSEEYECCVGLLDGSDGLAYIEKLLKGRRLKNHHLVWDQIDKATIAREPIHKGQLVHLIFLTALTTPGEFSFVYPGQNLIEATLEKDYAALVLDEERKQFVPELIQMWSLPVGWVAPGLEDFLYRNSEWY

SEQ ID NO: 3695 - protein, 67 aa, Corynebacterium glutamicum
MAQGTVKWFNGEKGFGFIAPNDGSADLFVHYSEIQGSGFRNLEENQPVEFEVGEGAKGPQAQQVRAL

SEQ ID NO: 3696 - protein, 178 aa, Corynebacterium glutamicum
MGGLCPSRSLNRLYFQFIKSLTIRKIASRTNAITGRMKSFTHTAHLAQSGNPRNISQAEGWLLVVQSMGIAVLLAVSFQSHLWEWGGIIRMLAQIVFIILIILVSRGLAKTRRVHPRGFKWRLTCAGILPVVVAVIGGWFWTAPTFHDTSWIITTAVAVGASLPGALVGLELVVRGNK

SEQ ID NO: 3697 - protein, 102 aa, Corynebacterium glutamicum
MNLEEARIALNDTIHSPVRLALMAALNSVDSADYQSLREELGVSYSLLSKHAAILEQAGYLKISKAFDGRTPITHLNLTRDGRQAFQSYLSALDRLVRGLTT

SEQ ID NO: 3698 - protein, 138 aa, Corynebacterium glutamicum
MTPDLAAFLDKLYAEGQEFDAEQPDRLDRRRNLESESAALLRSLIYGISPKSVLELGTSNGYSTIWMADVVNLTTVDNDPERSLDAAANLRAAGVEEKVQRIVADGATVLADSADEQWDFIFLDAEQSLYVNWWPDLQ

SEQ ID NO: 3699 - protein, 142 aa, Corynebacterium glutamicum
MKIEIFSPEAMQSAEFAHLLWLASGYSAAQLDHTITHEISQMTTIGIFEDASPIAFASYFNEPTRAVIEYIAVLESHQGMGLGSQLLNVVATSFPEVYLETDDDAVDFYRKLGFVISPKERDPRWPDRERYACVWKRAEERV

SEQ ID NO: 3700 - protein, 330 aa, Corynebacterium glutamicum
MNVKLTDAAREAGVGYGTASRAISGRGSVDAATRDKVLAAAEKLGYRTNAMARALRENKTRTVGLIVPGIINKFYTESATVLQDELDKSGYQLVVSTTGNDAEKERRAIESMLNRQVDAVVHAPVNPQAKFPKGFKVVELNRRSDLNRPTVTSDDATGLKELALHILDQGYRDIGIIVGPAELSTARDRKAGFINALETEATQRGIREELRFRVVHSRYSPTGGYEAFAEFRNDLPQIVVPLSTQLTLGVLKATQENGIKISDDLALACYGVAEWLAVWGPGITVFAPDLPAMGAAAATQVLTLLDAAPLPENHLSIPGQLIVRGTTPKV

SEQ ID NO: 3701 - protein, 134 aa, Corynebacterium glutamicum
MTRKFRRLHDLGYFIIPFVEFLSIAAGYFLIKTAADEFGKLNFIGTILVVGGVVSLFTGWPLLFARVNDFRWDAVYLVGGAVFLAFLFLGPKEMTVLGLVAMFAGPGMLIAGFSYLSRRIIAYFVELRRLQPSD

SEQ ID NO: 3702 - protein, 80 aa, Corynebacterium glutamicum
MEGQRCFSLKFGFQITEFGSEAHSYPIGSSTAFNATRATLLFKFNRHCEHISQDYPRIAVISFFTWATSSFTNVFLADTV

SEQ ID NO: 3703 - protein, 491 aa, Corynebacterium glutamicum
MASTFIQADSPEKSKKLPPLTEGPYRKRLFYVALVATFGGLLFGYDTGVINGALNPMTRELGLTAFTEGVVTSSLLFGAAAGAMFFGRISDNWGRRKTIISLAVAFFVGTMICVFAPSFAVMVVGRVLLGLAVGGASTVVPVYLAELAPFEIRGSLAGRNELMIVVGQLAAFVINAIIGNVFGHHDGVWRYMLAIAAIPAIALFFGMLRVPESPRWLVERGRIDEARAVLETIRPLERAHAEVADVEHLAREEHAVSEKSMGLREILSSKWLVRILLVGIGLGVAQQLTGINSIMYYGQVVLIEAGFSENAALIANVAPGVIAVVGAFIALWMMDRINRRTTLITGYSLTTISHVLIGIASVAFPVGDPLRPYVILTLVVVFVGSMQTFLNVATWVMLSELFPLAMRGFAIGISVFFLWIANAFLGLFFPTIMEAVGLTGTFFMFAGIGVVALIFIYTQVPETRGRTLEEIDEDVTSGVIFNKDIRKGKVH

SEQ ID NO: 3704 - protein, 100 aa, Corynebacterium glutamicum
MNSAARLPVRKVAARWRSLSGPCLRHRDILARVMPTYSPISRGRHPFSSMLAAISSFSAVSKALPPRGPRVSFTPAAFAHFRPVNSLTPTAVDAARPDIP

SEQ ID NO: 3705 - protein, 401 aa, Corynebacterium glutamicum
MGPYYGPRTLHQVLREDYTTLFDELSALGLPAQVCGALLHLAPPPSLRFSYMSCVVPLFADEIKVVGQGTRLSLEEKMMIQRFHDTGVSAAEIGRRLGRCRQTISRELRRGQDDDGRYRARDSYEGAIRKLARPKTPKLDANRRLRAVVVEALNNKLSPEQISGLLATEHANDSSMQISHETIYQALYVQGKGALRDELKVEKFLRTGRKGRKPQSKLPSRGKPWVEGALISQRPAEVADRAVPGHWEGDLVIGGENQATALVTLVERTSRLTLIKRLGVNHEASTVTDALVEMMGDLPQALRRSLTWDQGVEMAEHARFSVVTKCPVFFCDPHSPWQRGSNENTNGLVRDFFPKGTNFAKVSDEEVQRAQDLLNYRPRKMHGFKSATQVYEKIVVGASTD

SEQ ID NO: 3706 - protein, 145 aa, Corynebacterium glutamicum
MVDFDTIAARLVTETEEAIIYATRDGIIRLWNGGSEKLFGYTAGEALGKSLDIIIPEKHRKAHWDGWDRVMESGETRYGSEPLNVPGIRADGSKMSLEFSITILKDDSGKIEGVAAFLRDVTANWDEKKALRIRIKELERQIEGH

SEQ ID NO: 3707 - protein, 1510 aa, Corynebacterium glutamicum
MKPQGLYNPAHEHDACGVAFIADIHGRPSRSIVDRALEALRNIDHRGAAGAEKNTGDGAGILMQIPDGFYREVSGIELPEAGEYATGIAFLPRGRMAMMDAQKEIERIAKQEGADVLGWRMVPFDSRDLGSMAEEAMPSFAQIFLTVPGKSGEDLDRVMFFIRKRCERELGTTNGRDTVYFPSLSSRTIIYKGMLTTLQLEGFFEDLGDARLESAIAIVHSRFSTNTFPSWPLAHPYRFVAHNGEINTVRGNENWMRAREALIKNDKLGNLSSVLPICTPEGSDTARFDEALELLHLGGYSLPHAVAMMIPQAWEHNKTLSPELRDFYEYHSCLMEPWDGPAALAFTDGRFVGAVLDRNGLRPGRITITDSGLVVMASESGVLDLREESVVKRTRVQPGRMFLVDTAEGRIVEDEEIKQKLSEAQPYGEWIRDNFVHLDRLPQTRYNYMAHSRAVLRQRVFGITEEDVDLLLLPMARQGAEAIGSMGSDTPIAALSQRPRMLYDFFAQRFAQVTNPPLDSIREKPVTSMFTLLGAQSDVLNPGPDAARRIRLESPIIDNHELATLINANAHGEWDSFGAAVISGLYPVAHHGAGMKAAIARVRREVSEAIRNGKTLIVLSDRESDERMAPIPALLLTSAVHQYLVQQRTRTQCSLVVESGDAREVHHLAMLIGFGADAINPYMAFETIDELRMKGQLGDLSLDEASRNYIKAATTGVLKVMSKMGIATVSSYRGAQLADVTGLHQDLLDNYFGGIASPISGIGLDEVAADVEARHRSAFLPRPEEHAHRELDLGGEYKWRREGEYHLFNPETIFKLQHATRSGSYEIFKDYTRKVDDQSTRLGTIRGLFEFSTDRKPISVSEVEPVSEIVKRFSTGAMSYGSISAEAHEVLAIAMNRLGGMSNSGEGGEDARRFDVEPNGDWKRSAIKQVASGRFGVTSHYLNNCTDIQIKMAQGAKPGEGGQLPPNKVYPWVAEVRITTPGVGLISPPPHHDIYSIEDLAQLIHDLKNANPRARIHVKLVAEQGVGTVAAGVSKAHADVVLISGHDGGTGASPLTSLKHAGGPWELGLAETQQTLLLNGLRDRIRVQCDGQLKTGRDVVIAALLGAEEFGFATAPLVVEGCIMMRVCHLDTCPVGIATQNPDLRSKFTGKAEHVVNFFTFIAQEVREYLAQLGFRSIDEAVGQAQVLRKRSGIPADSRAAHLDLSPIFHRPETPHFPTQDVRCTKTQEHSLEKALDNAFIDKASDTITRAAAGVETSIVIDSSISNVNRSVGTMLGSAVSRVAGAQGLPDGTITLNLQGCAGNSFGAFIPRGITINLTGDANDFVGKGLSGGKIVIKPSAQAPKQLKNNPNIIAGNVLGYGATSGELFIRGQVGERFCVRNSGATAVVEGIGNHGCEYMTGGRVLVLGPVGENFGAGMSGGIAYLANSPDLNQKINGELVDVVPLSADDLTWADELIARHRELTGSETKLRAQDLVKIMPRDFQKVLNIIETAHAEGQDPAIKIMEAVS

SEQ ID NO: 3708 - protein, 506 aa, Corynebacterium glutamicum
MADPQGFIKYSRREPAHRPVPLRLMDHSEVYEKAPAGQIEEQAARCMDCGVPFCHEGCPLGNIIPEWNDLVRQGRWKEAYDRLHATNNFPEFTGRLCPAPCEGACVLGINDDSVTIKNVELEIVEKAFREGWVQPVIPSMSTGLSVAVVGSGPAGLAAAQQLTRAGHSVTVFERDDRLGGLMRYGVPEYKMENRWIDRRIEQMEAEGTTFQVGTSPRAAELALFDAILLATGTPVARELSVPGHDLNGIHAAMDYLTAQNRINEGDGEVSPINAKGKKVVIIGGGDTGTDCFGTALRQGAESVTQFDIRPRAPFQRADSTPWPMYPNLFRTATAHEEGEYIITGDESADEIAALGLAERAAGSTLGERKFAVNTVEFHGNNGHVTGLTGNQIRVVNGKREPIEGTEFPFEADLVLVALGFTGAEQGGLAHELGVGFDDRGRILRDSEYRSPTNSRVYIAGDNGRGQSLIVWAIAEGRACAAAIDADLMGETALPVAVAPQDVPLAV

SEQ ID NO: 3709 - protein, 80 aa, Corynebacterium glutamicum
MLTRFFRSSEETRARRPLWLITTSPVVGFAVVILFGAAAIQLVVWSSSVLFALASAAVYLVFALLGLASAVYAMMHPVKR

SEQ ID NO: 3710 - protein, 495 aa, Corynebacterium glutamicum
MGESVSTDRYTPQQRTRYRQLLMEDLEIFDRHLQHSDFEDQGSIGLELELNLVDKHMQPALAGHAVLSHLDDEYQSEIGNFNVEMNHPPLSVKGDALRRLEQGITSRLGRVRAAATSENVNVAMIGTLPTITPEFLEDPAWMTQENRYRALSNAVMESRGELVHINIADREQIIHDFTDLAPESTCTSIQLHLQLAPNKFAAAWNASQAIAGVQAALSANSPLFLGRRVWHESRIPVFQQAIDTRTPELVNQGVRPRVWFGERWITSVFDLFEENVRYFSPLIAESRALSGTPMMKGKSPALHYLNLHNGTVWRWNRPIYAPGEERSHLRLENRLLPAGPTPIDITADAAFYYGLVKYLAEENRPVWSRLLFPDAEKNFQSGARSGLFARMTWPTLGQVNVANLVQEHLIPQARIGLERLEVNKDLIDQYLGIITERAKSRQNGATWQLRSLNKLEAHGSMPGSDARKAGLAAMLQQYLQNQESGQPVHTWAIGS

SEQ ID NO: 3711 - protein, 123 aa, Corynebacterium glutamicum
MRINADKLTSNAATAIRPVGPDAREMVAIMTPMAAGNNLEVAIARSKETHASRAPIAMIGSGRVPLLYGSQNARNTMAADQCATRRPLTNEPNRGMTSLVITNHMISPASNAGRRSQIDEVEM

SEQ ID NO: 3712 - protein, 106 aa, Corynebacterium glutamicum
MVMMKPSSEVLAPRKCQNTKIATTTPSSGFSLYQLAGRKRCAFRPSKISMRCSVHRETNTDARPMKMAAYFRRLGDEVKRELISISTFKPAEARADAVEGSSTSSV

SEQ ID NO: 3713 - protein, 1157 aa, Corynebacterium glutamicum
MSNSSPNDPSPMRQVGGNGGHQLDSINVSDVVESKKLKGSAQEPPQVAPGWLKKLAISSGLLGLLMFVLLPFLPVNQVQSSLSWPQNGELSSVNAPLISYAPQSMDASIPVSALDSLNDNQSLVMGTLPLDSTDATNRGLFVRTIDGNLDVIVRGEVLLDLSPTEVNRLPDDAILEISSTEETTSAEITGTAFSGETEGDERPQVTGVYTELVDDPSTASALASAGLNVDIEINSRFTSSPSLLKYAAIFIGLASVLVSLWTLHRMDILDGRKAHRFLPANWYKLKPLDGVVVAILVFWHFLGANTSDDGFIMTMARVSQNADYMANYYRWFGVPESPFGAPYYDLLALMAYISTSSIWLRLPALLAGLIMWFVITREVMPRFGSLVNGRRVAHWSAAMVFLAFWLPYNNGTRPEPIIAMGALLAWVSFERAIATSRLLPAAIGVIIATISLASGPTGLMAVAALLVSLSALIRILYRRLPLIGASRGASKSKVFGASMAMLAPFLASGTAILIAVFGDQTLSTVMESISVRSAKGPALTWYHEYVRYQTVMEQTVDGSFTRRFAVLMLMACLAIVVIAILRYGRIPGAAKGPSLRLMMVIFGTMFFMMFTPTKWTHHFGVYAGLAGALAGLAAVGLSYVAVKSPRMRTISIGAFLFLLALALAGVNGFWYTSSYAVPWWDKTIQIKGIEASTVVLVIAVIVLIIGVIQSFVHDVKTAQAETNHSMGELVAEDEAKRERASRFTGLAASPIAGVSALVVLITCASMGKGFVDQYPAYSVGLGNLRSLTGNTCGLASDAMLETNSNDSFLTPVNSTLGESLESEDIRGFSAAGIPPSISQDQADLSAVGAIANTDDSTETGGSDESSGQSTGNTGGVRGSEGINGSNARLPFNLDYTQVPVVGSWSAGTQNPANITTDWYEIPEATEEAPIIVVSAAGRIEHYDINGVRQSGQSVMLEYGRLRDNGDVEDLGEAMMYDIGPEPSWRNLRYPLDQLPEEADVVRIVATDVNLDEDQWVALTPPRVPNLDSLNNVIGSETPGLLDWAVGLQFPCQRTFDHYAGVTEIPEYRISPDHGGKSTLSPFQDWAGGGSMGTAEAVNNAYEIPSYLRNDWGRDWGSIERYSLRTNSNGDAPKVADINLETIQRSGLWNPGHMKVDE

SEQ ID NO: 3714 - protein, 661 aa, Corynebacterium glutamicum
MNPYGPSRVPEGEVYRPDRLNRKATLVAIVGAAILAFAFALVLWMGLKQTNLPAFGPSNVTRAVASATIAAVLIVTGFLTWLWLRDEHQSNPRWELEDVKPRPKWRTALTYLASYLSPAALVVAVLAIPLSATRLYLDGISVDQGFRTQFLTRMADDIGLSDMNYIDMPTFYPAGWFWLGGRLANLLGLPGWEAFQPWAIVSMAVAASVLVPVWQRITGSLPVATGIALVTTCIILAMNSEEPYAAIVAMGIPAMLVLASRIAKGDKFALAGGIIYLGVSATFYTLFTGAIALSAVAVCIVVAAIVQRSIKPLLWLAVLGGGSIVIALISWGPYLLASINGAERSGDSATHYLPLEGTQFPVPFLASSVVGLLCLVGLIYLVVRFHNNEVRAMWVGIAVFYAWMGMSMAITLLGNTLLGFRLDTVLVLIFATAGVLGIADFRLASVYQLYPTQITERTATHLTNLIVVLVLLGGLYYAQDLPQKNARAIDLAYTDTDGYGERADLYPAGAARYYKDINDHLLDQGFEPSETVVLTDELDFMSYYPYRGYQAFTSHYANPLGEFGNRNAFIEDLAIRSWDELADPQQFSDALNTSPWTIPEVFIFRGSIDDPDAGWKYDVAEDLYPNNPNVRFRGVYFNPESFDQMWQTKQVGPFVVVTHNE

SEQ ID NO: 3715 - protein, 253 aa, Corynebacterium glutamicum
MLNAVGKAQNILLLGGTSEIGISIVSRFLKQGPSHVTLAARKDSPRVDAAVAEIKAAGAASVAVVDFDALDTESHPAAIDAAFENGDVDVAIVAFGILGDNEAQWRDQALAVEATTVNYTAGVSVGVLLGQKFEQQGHGTIVALSSVAGQRVRRSNFVYGSAKAGFDGFYTQLGEALRGSGANVLVVRPGQVRTKMSADGGEAPLTVNREDVADAVYDAVVNKKDIIFVHPLFQYVSFAFQFIPRAIFRKLPF

SEQ ID NO: 3716 - protein, 488 aa, Corynebacterium glutamicum
MNSSHGTSSSGASAGAHGALPLEAQKLNGWGRTAPTTAEVLTTPDLDIIVDAVRQVAEQNDSKPDYLKRGVIARGMGRSYGDPAQNAGGLVIDMQPLNKIHSIDPDSAIVDVDGGVTLDQLMKAALPYGLWVPVLPGTRQVTIGGAIGPDIHGKNHHSAGSFGDHVVSMELLVADGRILHLEPEGTAEDPQGDLFWATVGGMGLTGIIVRARIRMTKTETAYFIADTDRTNNLEETVAFHSDGSEHNYTYSSAWFDVISPEPKLGRSTISRGSLATLAQLEELAPKLAKDPLKFNAPQLMKVPDIFPSWTLNKLTLSAVGVAYYAMGAPAKNQVKNLTQFYQPLDLIGEWNRGYGSKGFLQYQFVVPTEAVEPFKDIIRDMQKSGHYSALNVFKLFGPGNRAPLSYPMPGWNVCVDFPIRPGLGAFLDDLDKRVMEFGGRLYLAKESRTSAENFHAMYPGMEGWLKTRNEIDPTGVFASDMSRRLELS

SEQ ID NO: 3717 - protein, 78 aa, Corynebacterium glutamicum
MVGMFERFKKAKAPEVHIAAERTNLPLNDFMTRLFAQELPLLDSTSRSEVYRLLREYDGPTISSQEEIPAEIRELMDL

SEQ ID NO: 3718 - protein, 169 aa, Corynebacterium glutamicum
MSSLGNMDTRMRLQVAAGSALIGAGVAVNDYVQSPVRRAISYGALALSGATVIAMGQDPTGERSIIAKDSATMVDQIRQEIGDLGVTPGPESDVDAITERGPLVTWLLLAVFVVAFFTLAYFSMRMDVAVMRRIAKFFEKRGASRPFTCTGMVYAAFIYAICELEARTK

SEQ ID NO: 3719 - protein, 151 aa, Corynebacterium glutamicum
MTYPVLSVLDNSGDHNIIWHVQTYPAALPTGAWIADEQQLTDLLKDTVVFLTPGSTAPENAPVATIEGVRVDVDKQVAEYNKHGIRLPSLGARTVEAQYRGEPEAEAAWRTAMELVEIAGGWLEIEAKRRARKALAEAFGAEVQPLPLDTE

SEQ ID NO: 3720 - protein, 334 aa, Corynebacterium glutamicum
MKPSAGRGRRWLRPSARRSSHCRLTPNRTNGSILGRMPTNYARDNVISLASAREQRSGKPEPKPELTLIVRATNVQADGEVHRQIGLNSAMSLDELHNVLNIVFGVGGEQSPWRFEDQFHQPSAPDTNLGELLPEPGDFLFYFWGLWQFNLQCVEMYPRDNGTPRALCIGGSGGLGDDFDQATINAELTGTDTIRDVLSGVRPEVIDLVDRTGVFDFIPLLQALDLKREPLIDATRYHTCRTLPVENSAEASDAFWSCVLALSCLGNDELFIEVIESTMSTLGWVADDGSPLRAPEITSACEASLKILAELGGYGPERLAPVDRLDIYRELLCF

SEQ ID NO: 3721 - protein, 132 aa, Corynebacterium glutamicum
MSLKTQAFRFILTGGLSAIVDLGLLSLLQLVFGLPVPVARTISFIAGTTTAYMINRRWTFQAESSTSRFLAVVALYGVTFLINIGLQTLCSALFENWGWNEAVAMVVAFVIAQGTGTVINFIVQRTIIFRVK

SEQ ID NO: 3722 - protein, 134 aa, Corynebacterium glutamicum
MKTFNPTMIAGLIGVLYFVLLTLIFSIQDMELAAEIAFGIVTIVGLIAVWDNFRDRNNSTWKTWTGLVGGLLIAVPGICLLVGNLVLLAVDGNPSTMVNTLLSVAGIGAIFLLPIGIIMCLIAGFNRYYAALKV

SEQ ID NO: 3723 - protein, 211 aa, Corynebacterium glutamicum
MPGLVLSTNVAHIQQDPGGDDRISGINKLPVATGIDVFIPGPNYGDGSGVVGDAIGDSLHHGGAHKAIYAYSREELDFFDPTYRNGYFGENLTTSGIVLEDLLINQQVRIGTTLLEVSIPRRPCRTFAHWLDIKGWLKTFTQRGLPGSYFRVIEEGHINPGDPIEVLQAPDHDITMSMAFRAKMGNKDLARRVVAANCLPARYHEELLKLI

SEQ ID NO: 3724 - protein, 313 aa, Corynebacterium glutamicum
MYAMAQTTTRLQPGINVAAVIVTHNRVELLRHSLEVVANQTYPVKHIVVVDNGADPDVEKLVLEVAGDRAVYTPSRTNLGGGGGFAFGFLTALALGADAVWCADDDGRPEGPGVLKTLIDAASRHNLEEVSPVVCNADDPERLAFPLRRGLEWRRMRSELIDPANPEDDLLPGIASLFNGALISAYAMERIGVPDYRLFIRGDEVEYHRRLVRSGLPFGTCLTTAYLHPDGSDEFKPILGGRMHTQYPDNDFKRFFTYRNRGYLMSQPGMRKLLPQEYARFAWFFLVQKRDVKGFREWLRLHKLGRDEKFNRP

SEQ ID NO: 3725 - protein, 114 aa, Corynebacterium glutamicum
MTLEGCGDPNQSIANGTGAKSTPGSGKINRHVSVVPSGVCLLINCDCVPRLAARASKSSGRTHHAATLGSVDCVVAIAKLSCVTASASGSGPINSRYDPFGSFSGTSAFAVPVS

SEQ ID NO: 3726 - protein, 199 aa, Corynebacterium glutamicum
MGTQIDHIVIAAPNLKDLVSRFEKLTGVKAVAGGRHDTGTANALVPLKEPKGSYLELIGPDPEADAVTQDNFAIATTQSTEPRVAAWCVRPDDLEALAAKRGTQSQLMSRHTPEGTTLTWRLILPEPGVDFAPVPFAIDWLGSPHPSKVTEPQVSVHSFTVYGHSEPDELPEPAIFQEGKPLLELVLESPKGRVNLSDL

SEQ ID NO: 3727 - protein, 263 aa, Corynebacterium glutamicum
MVSIDTYNACVDFPIFDAKSRSMKKAFLGAAGGAIGRNQDNVVVVEALKNVNLHLREGDRVGLVGHNGAGKSTLLRLLSGIYEPTRGSADIRGRVAPVFDLGVGMDPEISGYENIIIRGLFLGQTRKQMKAKMEEIADFTELGEYLSMPLRTYSTGMRIRLALGVVTSIEPEILLLDEGIGAVDAAFMAKARDRLQALVERSGILVFASHSNDFLAQLCNTALWVDHGQIREAGLVPDVVEAYEGKGAGDHVRRLLTRMEEEK

SEQ ID NO: 3728 - protein, 268 aa, Corynebacterium glutamicum
MTFGAAWNDIVRGFKQHELWLQLGWQDIKQRYRRSVLGPLWITIATGVMALALGLLYSVLFKIPIAEFLPHVTVGLIIWNFISGCIKEGSDIFIDNEGLIKQLPSALSVHVYRLVWKQALFLAHNLVIWVILMMIFPRPLGWDVLLIIPAMFLLVINGVWVVMFFGIIATRYRDVSPLLEAGTQLLFYVTPIVWMTSTLQSQSAEIGNRARLAELNPLYHYLEIVRAPMVGADLPAYHWWIVLAFTFVGLGLALLAMKQWRFRVSYWV

SEQ ID NO: 3729 - protein, 391 aa, Corynebacterium glutamicum
MGFDVARVRGLYTSLGDGWTYLNSHQIPQVPERVASGVAAAFRTHAQISEVTSQPIAVDQLEAAREAVASLAGVDPDCVVLGPTRQFLAHTLARGLGGFVRRKAGVVLSRADADWLTAPFRSLDGVFSWAEPDLGTGMLPDWQYEKLVDGSTRLVVLSAAHPLLGTVAPVGKIVDKVRARSRAWVLVDATTYAAYRPLRLDEWEADIVMLDLGELGGPQISALIFRDTSMFPRLDRTVPLELPASSLPHGLLGGVPNLVRHLGNLDENAPSVVEAMGEMAKFHKGLFEHLVESLEGLHAVHIVGISGDAAGQDAAFLDRVPRLTFTMEGVPADMVYRRLVDNRLITTVSPADPLLEAMGVTEAGGSITIGLSPFSTYYEVDQLTRVLASLA

SEQ ID NO: 3730 - protein, 318 aa, Corynebacterium glutamicum
MQAIVQTEEKVTASLELQEVPVPTLKPGEVLVEVKAAGVNRADLLQTQGNYPVPAGASEILGLECAGVIVDAGDTGQTVGQEVACLLTGGGYAQYVAVPEGQLMPIPEGYSFVEAASIVEVACTVWSNIGMLAGLQKEDTFLIHGGAGGIGTFAIQMGKALGVTVAVTAGSTEKLKTCKNLGADILINYKEEDFAEVLKNKADVILDIIGAKYLSQNVKAMAKDAHMVVIGMQGGVKGELNLGHLLAKRGTISATALRGRDEADKARIVSSTVENIWPLLQSKEITPHIDHTLPLAEAAAALQKIQDGTITGKLVLAV

SEQ ID NO: 3731 - protein, 194 aa, Corynebacterium glutamicum
MKSYPIVSNILNHLIRGNYMDVLKIAIIAAAMIGVPVLVVFLIVFAVHKLAKEVPRSGRRPGIGLGLLLGFVAGLIVWFVWLSWGGYYENEFGQMQGPYRPWQVVACGVTMVAVTVILGLWTRWTASGPFYSALGGASGFSFAWAMDAIPQDETGLSAFGLVMVIVGVGAGLNVVATLTSIGATIWNNRLPSNA

SEQ ID NO: 3732 - protein, 99 aa, Corynebacterium glutamicum
MPKLGHMALHTHKIDGETYAFSWSPTQTLLDALLQADLPARYSCMEGHCGTCQCTLTGGPSHMLNNEVLSNYEIVSENQVLACQTIRDADGPYHCSFDD

SEQ ID NO: 3733 - protein, 492 aa, Corynebacterium glutamicum
METFITDVINDNLWMILPFLLVAAGLYFGGRTLLVQIRMIPEMFKAVVEKPAKDGEFADKQDISAFKAFTISAASRVGTANVAGVALAITLGGPGAVFWMWIIALVGGATSFIESTLGQLWKVKDGDSYRGGPAYYMTLGLNARWLAVVFGVAITLTFGFVYNALQSNAVVEAITVSLGTPSTTAKAFVGLGMAGLSALVIFGGVQRIANVTQWMVPFMAGAYIIVGVVVIVINIQQVPTMINDIIAGAFGFRPVATASVWGAFWLAFMNGMRRGLFSNEAGEGSVPNAAATATVSHPVKQGLVQTLGVYFDTLLVCSITAFVILLSGVEYATGDIQSSSLTQSALASVVGGWGTHFITVVMFFLAFSSVLGNYYLAQANIQYFTDSKTVMTVFRLLVLLSVFSGAVASVPLIWALGDTFAGIMVLINLAAIIPLGGVAVKLLKNYTIQKKAGLDPVFHRDMMPEVRNIACWNGKDAATSNYHEAMEVIKKS

SEQ ID NO: 3734 - protein, 303 aa, Corynebacterium glutamicum
MGEKRRMWTAKELIGMGYSRRRINSLVKEGKLHRVLRGVYALDPPSGEVVWSAIRLVRPGALLDGKSAVEVYQGVSLSLPVRVRVSTSNVLRGSRNVVARRSQRMDGIAHRGFRVVSLVDTVATCLDERSVNPSDLRRLVEERYKSGSGVKQMAHDLKLLRTRRKAQLREFLEECIYGLDSGLEKVMVQELRDAGFRTRQNVVVEGYRWDIQVVGVALIDVDSRKYHQANRRNFIIDRWKSNEAVVQGHVPLRFTDDCVNYATGEIIKLVKQVAEFKRKHPRRRVKTQGVGPVFRWHNALVLP

SEQ ID NO: 3735 - protein, 361 aa, Corynebacterium glutamicum
MGRPVKNLDIARYRRQIMLGEIGQQKQQSLFDAKVSVIGAGGLGSPALLYLAGAGVGHIHIIDDDLVDLSNLHRQVIHTTAGVGTPKAESAREAMLALNPSVKVTVSVRRLDWSNALSELADSDVILDGSDNFDTRHLASWAAAKLGIPHVWASILGFDAQLSVFHAGHGPIYEDLFPTPPPPGSVPSCSQAGVLGPVVGVMGSAMAMEALKIITGVGTPLIGKLGYYSSLDGTWEYIPVVGSPEVLERVLGSAGVSGISGGFGEVLDVPRVSALVDGVSLIDVREPSEFSAYSIPGAHNTPLSAIREGAIPPSVSAGKEVIVYCAAGVRSAQAIAILESAGYTGMSSLDGGIEGWLDSLG

SEQ ID NO: 3736 - protein, 152 aa, Corynebacterium glutamicum
MNTDPAYVAEQTGKLIDAFLTTDPLEPLLDAAKNGVCTEAMGALVTFEGIVRDHDGGARVTSLTYTAHPTAPQVLSAVADSIVEKHPRTRLWTAHRTGALKIGDAAFLVVAASAHRADAFAACSDLADAVKAQVPIWKEQTRLDGSTDWVGL

SEQ ID NO: 3737 - protein, 157 aa, Corynebacterium glutamicum
MVCSVTALVIVASTRAAAGVYEDRSGPILVSWLRAKGFDTPAPVIVADANLPAFLDELEFPQVVLISGGTGLTPDDITVDTLIPRLDKEIPGIAHAFWNYSMDAVPTAVLSRTVAGTIGGSFIMALPGSTGAARDATAVLDPLIDHITGTLQGHHEH

SEQ ID NO: 3738 - protein, 156 aa, Corynebacterium glutamicum
MSELTHVRADGSAHMVDVTGKNETSRTAVAEGFVKMRGDVVKQLFSAGLPKGDALPVARIAGIMGAKKTPDIIPLCHPLPLGKITVDFFELTDGVRIEASVKTRGVTGVEMEALTAVSTAALTVYDMIKAVDKMAVIDGIRVLSKTGGKSGDWSVQ

SEQ ID NO: 3739 - protein, 395 aa, Corynebacterium glutamicum
MMSRSPEQHLAEISALLPPQKSTFVNLREALGRRTFSAVTAQWDSPRFDNSQMDGFALGPSHLNGGTFAVGPTIPAGHDPDQWYPRGIEKDIAPIMTGARLPKNTAAIIPVEKTTPGNFDAPQVEIPATPQGQFIRLQGSDITAGDEIIPAGTELNSVHIGVLASQSIKSIEVAAKPRVLIITGGSEISEQHGPATIPDANGPLLRSLCARNNIEVIAGLHTNDDPERLRFELENAIDQYQPDVIITSGGISHGKFEVFRQILEGTPNSWFGHVDQQPGGPQGISTFAETPVISLPGNPISTLVSFTLFVAPALNRQPLRHLDARITAPVQGLQDNREQFLRGTISYRNGHVLATPLLGTSSHLLVQAATADCLIRIPARTTVEENDIVKIYPFN

SEQ ID NO: 3740 - protein, 241 aa, Corynebacterium glutamicum
MLLQIPWDRSWELLTAPESLGTARLSIGTALFSTALCAIVGFPLALALHLYERSHPRVTSVLTVLVYAPLVLSPVVSGLALTFLWGRRGFLGSWLDQVGLPIAFTTTAVVFAQVFVALPFFISTVTTALRGIPKQFEEIAATEGATRWEIMHKMIIPLAMPGIFTGMILGFARALGEYGATLTFAGNIAGVTRTIPLHIELGLSSNDMDKALGAVIMLLAVYVLIIGAIGALRLFSKVRKV

SEQ ID NO: 3741 - protein, 268 aa, Corynebacterium glutamicum
MNKSIRRALYSFITISAGISLVACSSSDTASTTTQNASATEAAGVSGTASVFAAASLTNVAEDLAAAFNEDNPDAKLEFNFAGSSALVRQISEGAPSDLFISADIANMDDALALPEFAGATSKVIATNKLVLVTADGNPGEISELADVKDSLVAICAPEVPCGTITHEALDYADIELNTSSEEANVADVATKISTGAVDAGFVYQTDAQSLAKTQDNTVIELEGIDANEYPMALTTTGEDNEVAKAFAEFLSSDRAKEILASYGFGTN

SEQ ID NO: 3742 - protein, 107 aa, Corynebacterium glutamicum
MFKYCAFPTISSVLNPEGSFNNMDIHYFAAARAARGVAQETVAPSELTLSDLLKQLGEQHTETTAAGMTLAQVFDRCTFLIDGRSADSSASLSGASRVDVLPPFAGG

SEQ ID NO: 3743 - protein, 304 aa, Corynebacterium glutamicum
MADLSIEHVSRFFGDAIALNDVSLTVPSGSITAIIGPSGSGKTTLLRLLAGLDSPDEGTVSIGNKIAKLGDTALCFQDSPLYPHLNVWENVAFPLKLKATNTADEVVKKRVSDVLEMLEIAPLARRKITELSGGQKQRVGIARALVRDVEVYLFDEPMAHLDQALARDIVADLRKIQQSLGLTFVYVTHSKSEAFALADQIVVLVDGQVAQVGEAEELVEKPKTLEIAEFLSPTELNVRRRGDAVEAWRPEDTQLARGGTATVEAVTYLGREWLVQTTEGHAVSEEKFDVGESVTLTQKKVFSF

SEQ ID NO: 3744 - protein, 140 aa, Corynebacterium glutamicum
MLGSLWRFAVRTAAGAVALWVVIKLIDGISLSFPTTPLYQDGQHDNLLTFLAVAAIIVVLNATVKPVLKLLGLPLTIITLGLFSLVINAVIMLLAEYVSDLIGFGLRIETFGAAFWGAIVLALVNWVLGPITGLLGAKKD

SEQ ID NO: 3745 - protein, 341 aa, Corynebacterium glutamicum
MIRADLATIPTYVPGRRLVDATKLSSNEVSFSPLPAAVDAVTEATWGANRYPDMGAVELREALAEHLEVEFDQVTVGCGSSALCQQLVQATCAQGDEVIFPWRSFEAYPIFAQVAGATPVAIPLTADQNHDLDAMAAAITDKTRLIFICNPNNPSGTTITQAQFDNFMEKVPNDVVVGLDEAYFEFNRADDTPVATEEIHRHDNVIGLRTFSKAYGLAGLRVGYAFGNAEIIAAMNKVAIPFAVNSAAQAAALASLNSADELMERVEETVEKRDAVVSALGAAPTQANFVWLPGEGAAELAAKLAEHGIVIRAFPEGARISVTNAEETDKLLRAWEAINAG

SEQ ID NO: 3746 - protein, 302 aa, Corynebacterium glutamicum
MLLGYIDEVGETGAFVSRQDPRYKTSPAFGYAGFLIPAENARAFGSEFTKQKRIRFSTEIVNAPNPARWEVKGADLFRPDTPIVRPENLRIFGSLVERLQKLGGHLFYYVDEKPIGTPRQTKLDQVGREREAMRETLNRLATQANREDRNLMVLVDSINEKSRKERIAEMYSHIFSRSGEHPEMRSIVEPPMHVDSALSSNIQFADWIAAYVSRAIDRQLIEDSRYQWIADDISTFKVYGSFTLESKLHLLRNRPCEDFNTSDILKRNRPMFSFDAATAIGSRVGVARAMQIKAASDRANSR

SEQ ID NO: 3747 - protein, 98 aa, Corynebacterium glutamicum
MSHTMAAFLEITLKINDEGRPSAAGVYQEYKQPFLSSIAGATSKELLIREEDVQVLHGCDTVANAEDYLVSELFTADVVGGLAPLLQADPEIRIYQVA

SEQ ID NO: 3748 - protein, 40 aa, Corynebacterium glutamicum
MILMNVTISNSYDQLSVSVSRRASFSISSDKFVPGDHTAS

SEQ ID NO: 3749 - protein, 254 aa, Corynebacterium glutamicum
MTKRLSLEGLRYAQAVAETHSFSAAAREYGVTQPALSNGIAKLEDRLGEQLFDRSTQGVTPTSFGLHILPLIQRALTEIDAITAEAHRLINSEARSIRVGISPLINPQLVARTYTAVRELPTAHDLVLREANMKELHEGLLAGELNVILIPAVKPLPHFEHRIIDSEPVVIVESTQDSTDPIELRETQHEPFILVPDTCGLTTFTNQLFETNDLALNAYSGEAASYQVLEQWATLGLGSAMLPLSKLSSPTAPH

SEQ ID NO: 3750 - protein, 339 aa, Corynebacterium glutamicum
MPKYIAMQVSESGAPLAANLVQPAPLKSREVRVEIAASGVCHADIGTAAASGKHTVFPVTPGHEIAGTIAEIGENVSRWTVGDRVAIGWFGGNCGDCAFCRAGDPVHCRERKIPGVSYAGGWAQNIVVPAEALAAIPDGMDFYEAAPMGCAGVTTFNALRNLKLDPGAAVAVFGIGGLVRLAIQFAAKMGYRTITIARGLEREELARQLGANHYIDSNDLHPGQALFELGGADLILSTASTTEPLSELSTGLSIGGQLTIIGVDGGDITVSAAQLMMNRQIITGHLTGSANDTEQTMKFAHLHGVKPLIERMPLDQANEAIARISAGKPRFRIVLEPNS

SEQ ID NO: 3751 - protein, 267 aa, Corynebacterium glutamicum
MPTASPIYDVVVVGAGISGLIATQLLDRAGLNIKCFEACSRVGGRAVSVQQSDLFLDLGATWFWLNEPLVQQLVNNLGLGTFPQAIEGDALFETLVDAPSRLRGNPIDAASGRFQAGASSLALGLAAQLKPGVLELGDPVHSLSEEDGEIVVKSSKQIVRAKHVIIAVPPALAAELIGFTLDLPADVRKAAHPQHIAVMNWAKEKYTLPTQAASAGGFGHELFQQPLGHGRIHWASTEVATEFGGHLEGAVRAGIQAALQTGFNLKS

SEQ ID NO: 3752 - protein, 450 aa, Corynebacterium glutamicum
MRLKSGLLRGEVCDMKELELGEARDVAATLEAMPIQEVIDQVERTSITKGAVLLRLLSKDRSLLVFDALGPRLQADLIGAFQDAEVLDYFADLDPDDRVSLLDELPASIADELLRSLDPQEKQVTELVLGYAKGSVGRWMSPQVLLLFDDMSVAEVLDFVRNHAAEAETIYALPIVNRARQVMGVVSLRKLFIADPTLKVSEIMVRPVSVLASADIEETARWFLQLDLVAMPVVDESNMLLGVLTFDDAQDIVEQADSEDSARSGGSEPLQQPYLSTPIRKLVKSRIVWLLVLAVSAILTVQVLDIFEATLVEAVVLALFIPLLTGTGGNTGNQAATTVTRALALGDVRKSDVFRVLGREIRVGLMLGALLGAVGFVIASLVYGMPVGTVIGLTLLAVCTMAASVGGVMPIIAKAIGADPAVFSNPFISTFCDATGLIIYFAIAKLVLGI

SEQ ID NO: 3753 - protein, 58 aa, Corynebacterium glutamicum
MTGEGLNVIFLPIRTANVNIPSLAYMVIDDRAEYVRKSIPSLSKGVNYRKGLFSNEHT

SEQ ID NO: 3754 - protein, 510 aa, Corynebacterium glutamicum
MVVGDRREWRRQATGIIAGLVLAALVYLLFPSNSVETVMQSSGVDPETEYTNNAMRLTAAVTILMAVWWMTEAIPLAATALIPLVAFPAFQVVDFGKAAAPYANPTIFLFLGGFLMALGLQKWNLHRRMALAVVLAVGTKPKQLVLGFMVATGFLSMWVSNTATAVVMLPIGMSVLALTAETVGGMKNQKKFATGLMLSIAYSASIGSLGTLIGTPPNALLAAYMSESHDIHIGFGQWMILGVPIAVVFTIIAWLVLTTVFKPEMKEIPGGRELIKREIAEMGPWTAPQVTVGVIFAAAALAWVFIPLTLDWTGSQLSINDSLIGIAAGLLMFIVPANFKTGERILDWRTAGELPWDVLLLFGGGLSLSAMFTSTGLSLWIGELAKGLDALPIFILIFAIAVLVLFLTEFTSNTATAATFLPIMGGVAVGIGLTAGGEQNVLLLTIPVALSATCAFMLPVATPPNAIAFGSGYIKIGEMVKGGLWLNIIAVILITIFTYFVAIPLFGIML

SEQ ID NO: 3755 - protein, 340 aa, Corynebacterium glutamicum
MTTKDISRPVCILGLGLIGGSLLRDLHAANHSVFGYNRSRSGAKSAVDEGFDVSADLEATLQRAAAEDALIVLAVPMTAIDSLLDAVHTHAPNNGFTDVVSVKTAVYDAVKARNMQHRYVGSHPMAGTANSGWSASMDGLFKRAVWVVTFDQLFDGTDINSTWISIWKDVVQMALAVGAEVVPSRVGPHDAAAARVSHLTHILAETLAIVGDNGGALSLSLAAGSYRDSTRVAGTDPGLVRAMCESNAGPLVKALDEALAILHEAREGLTAEQPNIEQLADNGYRSRIRYEARSGQRRAKESVSPTITSSRPVLRLHPGTPNWEKQLIHAETLGARIEVF

SEQ ID NO: 3756 - protein, 174 aa, Corynebacterium glutamicum
MWHIPTTVISMNTEEDGLSFAVTATLVEGKWQVREFEDHFSKLSTSINAVRSLRSEGPAFALLCVDDEYFVMVRPTPSRVFLFLSDAPMAVDDDFAAAVMDELDADLPDINPDDLDDIDPWPEGDFDILADLGLSEEVLSVICDDMDLDPSEQLLRIAEELGFDNDLARVVGFD

SEQ ID NO: 3757 - protein, 139 aa, Corynebacterium glutamicum
MDIARQTPEGDVPVGAVIYAPTGEILATATNRREADRDPTAHAEIIALRRAARRFSDGWRLSDCTAVVTLEPCSMCAGALVGARIGRIVFGAFEPRTGACGSVFDVVRDPAVLHKVEVSGGILEPECAALMTEFFELHR

SEQ ID NO: 3758 - protein, 67 aa, Corynebacterium glutamicum
MSDFSNKAEDLTGKAKEGFGEATDNESLADEGRADQAKADIKDAVENAGEKVKDAANKVLGAFKKDD

SEQ ID NO: 3759 - protein, 117 aa, Corynebacterium glutamicum
MLYSVVMNLALFFAIAVTALVGVSLLRKQASEERVFPWFWVFFPLTLMSISGILMKPESRTSFDFGWSMYEPSIYSNEFQPDFFDLFNSSTISLVTYVVTLLVGVIGSVIAWKKRRI

SEQ ID NO: 3760 - protein, 801 aa, Corynebacterium glutamicum
MAKLLFRLGRWSYNRKWIVISAWLLILAIVGGLALTMQKGFSNSFTIEDTPSIDATVSLVENFPDQTNPVTAAGVNVVFQSPEGTTLDDPQMMTAMDAVVDYIEDNLPDFGGGERFGNPVEVSPALEEMVIEQMTSMGLPEETAAKDAANLAVLSEDKTIGYTSFNIDVEAAEYVEQKHRDVINEAMQIGEDLGVRVEAGGPAFGDPIQIETTSEIIGIGIAFIVLIFTFGSLIAAGLPLITAVIGVGIGALAIVLATAFTDLNNVTPVLAVMIGLAVGIDYALFILSRYRAEYKRMPRADAAGMAVGTAGSAVVFAGATVIIALVALIIADIGFLTAMGISAAFTVFVAVLIALTFIPALLGVFGGHAFKGKIPGIGGNPTPKQTWEQALNRRSKGRSWVKLVQKAPGLVVAVVVLGLGALTIPAMNLQLSLPSDSTSNIDTTQRQSADLMAEGFGAGVNAPFLVIVDTHEVNADSTALQPLIEAQEPEEGEFDREQAARFATYMYVTQTYNSNIDVKNAQIISVNDDFTAAQILVTPYTGPADKETPELMHVLRAQEAQIEDVTGTELGTTGFTAVQLDITEQLEDAMPVYLAVVVGLAIFLLILVFRSLLVPLVAGLGFLLSVGAAFGATVLVWQEGFGGFVNTPGPLISFMPIFLIGVTFGLAMDYQVFLVTRMREHYTHHNGKGQPGSKYTPVEQSVIEGFTQGSRVVTAAALIMIAVFVAFIDQPLPFIKIFGFALGAGVFFDAFFIRMGLVPASMFLMGKATWWMPKWLDRILPSLDIEGTALEKEWEEKQAAR

SEQ ID NO: 3761 - protein, 421 aa, Corynebacterium glutamicum
MAPMSDLSFTLNNKLADDAPGKHGRTGVIHTPHGDIATPAFIPVATKATVKTLTPEQIRETGAQAILSNAYHLYLQPGPDIVDEAGGVSAFENWHGPTYTDSGGFQVMSLGSGFKKVLAMDTTNLTRNDIKAAKKERMALVDEDGVDFKSVIDGSKHRFTPEVSMQIQHQLGADIIFAFDELTTLVDTYDYQVESVERTRRWAQRCLLEHERLTQERVDKPLQSLWGVVQGAQFEDLRRQAVKGLLDLDRQAADEGRRGFGGFGIGGALEKENLGTIVGWVCDELPEDKPRHLLGISEPDDLFVAVEAGADTFDCVAPTRLGRRGGVYTLDGRMNLTGARFKRDFKGIDEEVGGYASENYSRAYIHHLLKAKEFLAGTLCTMHNLHFMITLVDKIRASIDDGTYYEFKEEFLGRYYASKVS

SEQ ID NO: 3762 - protein, 246 aa, Corynebacterium glutamicum
MQNQSHTPETQPQPGQGAAKKTPVASGNSTFIHIQPSLYPILLALFVAVFLISNITATKGVEIGPLVTDGAFFLFPISYVLGDVLAECYGFKSTRRAILTGFGITMLAALSFYISIWLPGASFWEGQEAFEATLGLVPQIIVASLAGYIVGQLLNAKVLVAIKKRTGEKSLWARLIGSTVVGEFVDTLLFCAIAAPVIGIATAPDFINYVVVGFVWKTLLEVILMPITYAVIRWVKRREGYETFDA

SEQ ID NO: 3763 - protein, 360 aa, Corynebacterium glutamicum
MTIALEHPVLHSTAIALPARFQASYTTRLVAVGVDKRPSDFWLETAGTPQAGDVVIARVTAINNHKRVETPESRKAILFEGVLVMLAYGHRYAADQFLAHVPEDLGPCHLVAAGGIAGTVTALHDRVDEPTEIEPLGLLTNARGTVNVRDFAAFDNPLKVEAPNKRAQVIAVLGTSMNSGKSTTLACLVNGLAAAGQKVAAGKITGTGAGNDRMIYHDAGAHSVIDFTDFGYPTTFKLNFAEIRALSVNMINVLADSGADTVIVEIADGIYQGETSRLLRDQVFQEAVDHVVFSAVDALGAKAGVQELQAAGLHVAAASGVMTASPLATAEAAAVLEVPVVPTFDLTNPEIVTAVLTDHA

SEQ ID NO: 3764 - protein, 216 aa, Corynebacterium glutamicum
MKPRRLQFLHTGLRAQGINSGEHHMIHGFLEHLIAQQPRGFALINSVRDFHDHGIRTRISQHINHVDAQRTNLREIQLERSWVAKVGEINNAVSTSIVINHAVISSTSARDLSSRHLLPRRSQTIDQAGKRGGFSRVHRRSQHRDHLRTLVGSLHFQRIIKSRKVPYIHSSARIGEQSQRFNLCGFIHPIVQRRHRSRDATSRHQMAWPQILRYMR

SEQ ID NO: 3765 - protein, 479 aa, Corynebacterium glutamicum
MPSLWRARRRLLLIALGVLGVLQALLAIMVSLSVAAILEGNRALVGLLLATTLGLGVAQWIQKVVAEDLGQHYVHEVRRELVGAALVPGNTASLGVTVTRASNDLTAVRNWVALGIVPMVTGLPLIAIVLVALFIQDLRTGVAVTVPLLMCVAVLPVVARWTLKRARELRKKRGRMAARIADSVMAGELLHATGAIDRELNAVTRDSDRVVIAAVRRSWATGFSRALMAMAASLGTVSIVISGHLEVSEVAGIMMLLGVLATPVAELGRVVEYRQNYKAATRILIPLLQRGSEFKHSQQKLPGLQATEGIPGVYVKGISALPGERIYLHGSADATRKWVTSLSAMEEGTDVIVNGQRLSQLPLKQRRALIGIASAHHHLSRGSVSRLVGLRVPDATVEEIEQALEQVGLNNTGKQRLKNGGHPWSTSQINKLKIASATLRTPPLLVLEGITPENLLNYPGVIISTVQENPSETWRQVNI

SEQ ID NO: 3766 - protein, 293 aa, Corynebacterium glutamicum
MAGRYAPSPSGDLHFGNLRTALLAWLFARSEGKKFLMRVEDIDEQRSSKESAESQLADLSALGLDWDGDVLYQSTRYDAYRAALEKLDTYECYCSRRDIQEASRAPHVAPGVYPGTCRGLKEEERVEKRATLAAQNRHPAIRLRAQVTSFDFHDRLRGPQTGPVDDFILLRGGQEPGWAYNLAVVVDDAYQGVDQVVRGDDLLDSAARQAYLGSLLGTPAPEYIHVPLVLNAHGQRLAKRDGAVTLKEMLIDAPLHTIFSRLASSLGYEGVNSAPQLLEIFDPTTLSREPFIY

SEQ ID NO: 3767 - protein, 330 aa, Corynebacterium glutamicum
MAEQLRQFEGRVLPNQSEDLEDQGLGFDLGTVFSRRKVLGFIGVGGAGVALAACSPSGSSAASSTSSASSSAAATTSAAAETLTEMKSETAGPYPGDGSNGPDVLEVSGVERQDITKSIDSDTVAEGVPLTLTMTILDMNNNNQPMEGAAVYVWHCDAPGRYSMYDSELEDETYLRGVQITDKYGQVTFDTIFPGCYAGRWVHIHFEVFPDRDSITDSTNNILTSQIALDEASAASVYALDVYGDSLTNLNNITLESDNVFSDGWDQQMANLTGDATSGFIASIDVPIDPTTEQNQSMNMPSGGQGGPGGQGGPGGMTPPDGMTPPSEPQ

SEQ ID NO: 3768 - protein, 370 aa, Corynebacterium glutamicum
MITDLTTCARLSHNKALRLIKLSKSTAYYRNKPRPRPAPKPVLQAVPAPTAPGVEPTPEPWQGKEPAVSSVRQALAEHERQFIVDAITAYPQLSVSGVFNMLFNKGIYRASLRTWWRVAKQHKLLHKDRVSALSPGKRSPTPRVKPRLEATQPGQVVCWDVTFLPSLVRGKTYALHLAIDLFSRKIVGAKVAPTENTSTAVELLTQVLADNPGVVTVHSDNGSAMTSTRVRRLLADHGVALSLIRPRVSDDNAFVESVFHTLKYRPFYPKVFASMDQARVWVEEFVVYYNTVHPHSGVAGHTPQSVFDGSWRAAHRLRVQALDAHYRQFPQRYVEQPVVQEVAGVVRLNGARDDGSVQERVGGVASLLSA

SEQ ID NO: 3769 - protein, 101 aa, Corynebacterium glutamicum
MAWCAAMTDGDLDADISPRQIGLMTTRTVVEIVRLRHMIAQQLERATIMENEYLKEIAALKKELAHYKQKDHQNQMVIDILGKAIGTRPNPGEGLDEEDAT

SEQ ID NO: 3770 - protein, 46 aa, Corynebacterium glutamicum
MKFGVHWSPGLGLQGIAGTHQRKAHILSLNHQRESPIHEKTSSPPK

SEQ ID NO: 3771 - protein, 432 aa, Corynebacterium glutamicum
MRRYAVMSSVSLQDFDAERIGLFHEDIKRKFDELKSKNLKLDLTRGKPSSEQLDFADELLALPGKGDFKAADGTDVRNYGGLDGIVDIRQIWADLLGVPVEQVLAGDASSLNIMFDVISWSYIFGNNDSVQPWSKEETVKWICPVPGYDRHFSITERFGFEMISVPMNEDGPDMDAVEELVKNPQVKGMWVVPVFSNPTGFTVTEDVAKRLSAMETAAPDFRVVWDNAYAVHTLTDEFPEVIDIVGLGEAAGNPNRFWAFTSTSKITLAGAGVSFFLTSAENRKWYTGHAGIRGIGPNKVNQLAHARYFGDAEGVRAVMRKHAASLAPKFNKVLEILDSRLAEYGVAQWTVPAGGYFISLDVVPGTASRVAELAKEAGIALTGAGSSYPLRQDPENKNLRLAPSLPPVEELEVAMDGVATCVLLAAAEHYAN

SEQ ID NO: 3772 - protein, 210 aa, Corynebacterium glutamicum
MNTAETAHWINRLLPGTPEFHQVGAFKVAGYTLEDESIACSVNFGRVNTGLVTEGGAETVDVRSEILSLARADVSVPGRAVGAAATMLLDASLSFKSATDSSVTPMHAQPGQILPCVGIMANLPQEGFSVVHGILADPRIWGPEIPYVREEAGQVNVEAPDEAGDLARLTLPLQLILLTEEEFAIALNEGSDVMFERMAEQEVDLLDLKR

SEQ ID NO: 3773 - protein, 775 aa, Corynebacterium glutamicum
MALYSKYRPASFGELVGQSQVTDPLSAALDSGRINHAYLFSGPRGCGKTSSARILARSLNCVEGPTSTPCGVCNSCVALAPGGPGTLDVTELDAASNNGVDDMRELRERANYAPAESRYRVFIIDEAHMISTQGFNALLKIVEEPPAHLIFIFATTEPDKMIGTIRSRTHNYPFRLLTPGDMRKVLKNAVDGEGVHVDDSVYPLVIRAGGGSPRDSLSILDQLIAGSGPEGLTYERALPLLGVTSFTLIDDSIHALASKDNASMFTTIDNVIEEGLEPRRFTIDLLDRLRDLMVLQAVPEALNLGLVDAPTDRADALIEQSTLFKGNELANLASMVNSGLDDMRGATSPRLLLEILCARLLLASNTVAGPAVSSSTDAAPAATPGGLTGIAAARAKAREYGQKKAAPAPAPTPAPEPVREQSLAPTPEPTPAAEPTSQPAPEPEPAREPVVEVREASVEKQPASSDPLETIRSRWSELRNIVEKQSVRTSIMLTEARVLGLRGDTLVLGHSTGALAARLNAADHNGILVKVLAEETGLQLKVECIVGTNPAEAGFTAQPAVQKSTWNPNYDSKPATPSAPAQPQTPKQESVPTEPEEPESSAETSGWGQPVKIGGPAPEAQTPTPPPAPVVPATPAAPAAGAAKPAWKERVEQAAANAAQQRQHRQGSSEPFERGVPLPPEPDLPPDPYGYPADEGFPERNQGFQQQPAPPVEQPAPEPATEPVPAVAPEPEVSQLSEEEQLIREADEEPGEMDRRDAKTIAMELLAQELGAKPL

SEQ ID NO: 3774 - protein, 239 aa, Corynebacterium glutamicum
MDRIVDKREACDTEQRQGALICQALRARAGDELVEDGEAVAGAAAAGADDQWVNGIVDVDAFAIDRIFQHFAHIPWGEQAEWVIVRAGTDRTDHFVRLGGGEDENQVRWWLFNDFQQGVEALGTDHVGFVNDEHAVARFRRGVVRAFAQFTHVIDTIVTRGVELCYIKGSRATRGQRYARITHPTRRGSWAFHAVEGPGKDACRRRLATTTRTRKKVRMVDAPAIQSCGQRVSHLRLPN

SEQ ID NO: 3775 - protein, 103 aa, Corynebacterium glutamicum
MTQPDMSQILAQAQQMQAQLQAAQQEILATTVVGNAGNGLVTVTMAGNGEVSAVTVDPKVVDPEDVETLQDLLLGAFKDAHNKVANVAEEKMGPLSQGMGGLF

SEQ ID NO: 3776 - protein, 218 aa, Corynebacterium glutamicum
MFEGPLQDLIDELSRLPGVGPKSAQRIAFHLLNVDPSDITRLQEALGGVRDGVQFCRICCNISREEVCRICSDSGRDGGTICVVEEPKDIQVIERTGEFSGRYHVLGGALDPLANIGPRELNISTLLQRIGGVLPDRELADSTPENKLFDATPTVREVILATDPNTEGEATASYLGRLLKDFPDLVISRLASGMPLGGDLEFVDELTLSRALSGRLQI

SEQ ID NO: 3777 - protein, 250 aa, Corynebacterium glutamicum
MTTLNIGLILPDVLGTYGDDGNALVLRQRARMRGINAEIQRVTLDDAVPSTLDLYCLGGGEDTAQILATEHLTKDGGLQTAAAAGRPIFAVCAGLQVLGDSFRAAGRVIDGLGLIDATTVSLQKRAIGEVETTPTRAGFTAELTERLTGFENHMGATLLGPDAEPLGRVVRGEGNTDVWAASENTDDQRQQFAEGAVQGSIIATYMHGPALARNPQLADLMLAKAMGVALKDLEPLDIDVIDRLRAERLA

SEQ ID NO: 3778 - protein, 423 aa, Corynebacterium glutamicum
MKLSLPAPLRRLRSAAAIISAKVATSASKATGRGSGGMIGGLVASKVDPDIMSNLINNRPTVLVTGTNGKSTTTRMLAAAMRSTYTVATNEGGDNMDAGIISALLAGRNASHVVLEVDELHVPAAIERLKPDALVLLNLSRDQLDRVGEINKIERVLRDAVRSRPEMTVIANCDDVLVTSVAFDAENVIWVGAGTGWQGESATCPRTESRILHDGRHWSAEKTLLDGRTFARPTPSWEVDGDTIHSPSGDLTLDLNLPGQANRGNAAQAIAASTVFNVPVSSALPAVNSVNNVAGRYSTITVGEHKVHLLLAKNPAGWQEALSMVDRTADGLVIVVNGQVADGEDLSWLWDVRFEDFENLSVKASGERGTDLAVRLTYAEIDHELISNPVDAIAACPPGRIEVLANYTAFRDLKKALEKGTEQ

SEQ ID NO: 3779 - protein, 360 aa, Corynebacterium glutamicum
MSTTSESQDHAARIEAERQEAIEAAPFVSVSIQSSGIHPSTSRMVTIDLVTLSPNLEPVETFHAVLDSKTDPGPFHLHGVTEEEFASAKRFGQILKSLDRLIDGRTLLIHNAARSWGFIVSEAKRAMNDAARANRNSNRGNRRGGRGRRRQRVGHIPKPLVIVDTLASARRQAIALDDVRIRGVAHTLGLDAPAAEASVERAQVSHRQLCREETLLVARLYGALKQSGPLAEIDPQSLRADKFGLQRSIIRVQAQEASPTLVNPGTYEPGKTLIAGMEVVVAPEIEMDPDIIIQACVDADLSYSEKLTRQTSVVVCNQTRDIDGKAMHAQRKGIPLLSDVAFLAAVKRVKEGKKVDVEKR

SEQ ID NO: 3780 - protein, 289 aa, Corynebacterium glutamicum
MQSNLLAVLFALASALTIAWGTVVRHRIALRTPKDGSLRSSPLLNALMTPMWWAGMSTAMLAYFLQTVALGFGTLLVVQPVLVLSLMFTLPLSARFNGYRLRRTEIFWATLLTVAVGIMIVLGRPLPGNPHPPLDRWIPVLLVGVAVMGGMWLLAEYVLKKDKALILGLVTGALFGYVAVMSKAAVDLFVHQGITGLILNWEGYGLILTALLGTIVQQYSFNAGELQKSLPAMTIAEPIVAFSLGYLVLGEKFQVVDWEWIAMGIALLVMIVSTIALSRTSTMPAGSKR

SEQ ID NO: 3781 - protein, 421 aa, Corynebacterium glutamicum
MALVVQKYGGSSLESAERIRNVAERIVATKKAGNDVVVVCSAMGDTTDELLELAAAVNPVPPAREMDMLLTAGERISNALVAMAIESLGAEAQSFTGSQAGVLTTERHGNARIVDVTPGRVREALDEGKICIVAGFQGVNKETRDVTTLGRGGSDTTAVALAAALNADVCEIYSDVDGVYTADPRIVPNAQKLEKLSFEEMLELAAVGSKILVLRSVEYARAFNVPLRVRSSYSNDPGTLIAGSMEDIPVEEAVLTGVATDKSEAKVTVLGISDKPGEAAKVFRALADAEINIDMVLQNVSSVEDGTTDITFTCPRSDGRRAMEILKKLQVQGNWTNVLYDDQVGKVSLVGAGMKSHPGVTAEFMEALRDVNVNIELISTSEIRISVLIREDDLDAAARALHEQFQLGGEDEAVVYAGTGR

SEQ ID NO: 3782 - protein, 351 aa, Corynebacterium glutamicum
MQCTCSSIQIIFTDQHGNTNLRGGNQFDVHVDIAQSFHELCGNTWVRLHASTHEGDFADLVVVKHIGPVALNLKLLQDLHRAAAVGTRAGEGDVGGAVFYRRDVLQNHVNVDFCISQRTENLRSLAWLIGNTQNGYFGFGLVGCDTGKDCFFHRNILHRAGNQSAGIITIRRAYAKWHIECTSVFNTAQHQNLGANSSKFQHFFEAELFQLLCIRNDARVSGIHTVNVRVNLTHISVQSSCQRNCSGVRTTTTQRGDIAGFFINTLETSNNADLALIECFTHTTWSDINNACVSVALGGEHTSLRARERLGFCAKGLNSHGDESVRNTLTSSQEHIHFTSWRNGIHCRCKF

SEQ ID NO: 3783 - protein, 478 aa, Corynebacterium glutamicum
MGVELVKWNFPQVLSFFSRGNTADSTSDKEHENATELAAEALADVIFQWKNWVYRRVDSVHPSEGARGRLRHSMDCEPPPDPRLAYNEVERRYNDINDVKGQLMVPLAFIEKGPMRHLDVWRNDGTSIPVLGSEETGELMVAVLMLFLKKNGIERTSELEDAMRALVISREKGNLAKATNLIESGVWEGKTLWDSNDPAVRFDVGTKDLLLNLSTDFLLIGLLPAETSGIRQVLKFSYHWVVELPDRGLLRSLWGSVCVAFRAAPMEIELPTHMPTDAKSYHLEFHTPPELDTQELSLPVDSKNKGHRVGYPTDSSRTPIAHVHSHFSEIMTTNAKVKLEVPKRGIWVTALLSNALTAGIFILALLLPNATDALRSVGGNAAALMLAAPAVFVSFLIFPKEHIFVSSMLNPLRIVVGICALLLFMMAGSLVGGLERPFLILLWSFGAGFSLLVVSALVLGPLLGKFFERLHLRPSTKN

SEQ ID NO: 3784 - protein, 193 aa, Corynebacterium glutamicum
MKSKERNDAHVTELALAAGRGDRAALTDFIRETQDDVWRLLAHLGGHEIADDLTQETYLRVMSALPRFAARSSARTWLLSLARRVWVDNIRHDMARPRKSIVEYEDTGATDASNAGIWSEWIDVRTLIDALPPERREALILTQVLGYTYEEAAKIADVRVGTIRSRVARARADLIAATATGDSSAEDGKSAQG

SEQ ID NO: 3785 - protein, 502 aa, Corynebacterium glutamicum
MRPKLSGNTTRHNGAPVPSENISATAGPQGPNVLNDIHLIEKLAHFNRENVPERIPHAKGHGAFGELHITEDVSEYTKADLFQPGKVTPLAVRFSTVAGEQGSPDTWRDVHGFALRFYTEEGNYDIVGNNTPTFFLRDGMKFPDFIHSQKRLNKNGLRDADMQWDFWTRAPESAHQVTYLMGDRGTPKTSRHQDGFGSHTFQWINAEGKPVWVKYHFKTRQGWDCFTDAEAAKVAGENADYQREDLYNAIENGDFPIWDVKVQIMPFEDAENYRWNPFDLTKTWSQKDYPLIPVGYFILNRNPRNFFAQIEQLALDPGNIVPGVGLSPDRMLQARIFAYADQQRYRIGANYRDLPVNRPINEVNTYSREGSMQYIFDAEGEPSYSPNRYDKGAGYLDNGTDSSSNHTSYGQADDIYVNPDPHGTDLVRAAYVKHQDDDDFIQPGILYREVLDEGEKERLADNISNAMQGISEATEPRVYDYWNNVDENLGARVKELYLQKKA

SEQ ID NO: 3786 - protein, 114 aa, Corynebacterium glutamicum
MRAYPPMVDRPSFDFEAIERKLARQQIRNSQGHCSGTNGGRAESNGKETSGALNCSFNLRSLSSRQEAQQIGGFLWKLDPRAEVGGTSSRASFLCASDSSATSQGGGSDCNCCD

SEQ ID NO: 3787 - protein, 97 aa, Corynebacterium glutamicum
MRMKSIAAIAIATAALAGGTGVASAQEAGSTAGSSNLSSGIQLPQEATDLLSFLPAAQAAQVEGAIQSTAGFFAVGLGSTAIGSTAVTLGIADLLSS

SEQ ID NO: 3788 - protein, 154 aa, Corynebacterium glutamicum
MQYMKLDSIDRAIIAELSANARISNLALADKVHLTPGPCLRRVQRLEAEGIILGYSADIHPAVMNRGFEVTVDVTLSNFDRSTVDNFESSVAQHDEVLELHRLFGSPDYFVRIGVADLEAYEQFLSSHIQTVPGIAKISSRFAMKVVKPARPQV

SEQ ID NO: 3789 - protein, 251 aa, Corynebacterium glutamicum
MQKTQEIHSSLEVSPSKAALEPDDKGYRRYEIAQGLKTSLAAGLGMYPIGIAFGLLVIQYGYEWWAAPLFSGLIFAGSTEMLVIALVVGAAPLGAIALTTLLVNFRHVFYAFSFPLHVVKNPIARFYSVFALIDEAYAVTAARPAGWSAWRLISMQIAFHSYWVFGGLTGVAIAELIPFEIKGLEFALCSLFVTLTLDSCRTKKQIPSLLLAGLSFTIALVVIPGQALFAALLIFLGLLTIRYFFLGKAAK

SEQ ID NO: 3790 - protein, 108 aa, Corynebacterium glutamicum
MTTDFSCILLVVAVCAVITFALRAVPFLILKPLRESQFVGKMAMWMPAGILAILTASTFRSNAIDLKTLTFGLIAVAITVVAHLLGGRRTLLSVGAGTIVFVGLVNLF

SEQ ID NO: 3791 - protein, 105 aa, Corynebacterium glutamicum
MQYFLGVPMRFKSVAAIALSTAMIRGGTASVANAQQVSPSSTIEIPQEFVHTVQNFVPGMTYGDAGSAIQSTAGSVALNSTAGIILPIVLPFLGLGAVGSAALSA

SEQ ID NO: 3792 - protein, 115 aa, Corynebacterium glutamicum
MTAPIHLPLINSAECCSLAAEPLSVDDAERYAEIFKVLGEPVRLRILSHLAAEGCTPTTVNELTEIMGLSQPTISHHLKKMTDAGLLVRIPEGRTVFHQVQPETFTNLRTILQIG

SEQ ID NO: 3793 - protein, 360 aa, Corynebacterium glutamicum
MTLTKEHSTPRAAGSMSFLDRWLAAWIFLAMAAGLLIGKVFPGIGALLSAVEIGGISIPIAIGLIVMMYPPLAKVRYDKTKEISTDRALMVVSIMLNWIVGPALMFSLAWLFLPDQPELRTGLIIVGLARCIAMVLVWSDLACGDREATAVLVAINSVFQILMFGVLGWFYLQILPSWLGLDTTSVTFSVVSIVTSVLVFLGIPLVAGVLSRVIGEKTKGRRWYEDTFLPKISPLALIGLLYTIVLLFSLQGDEITAQPWTVARLALPLLMYFVGMFFISLVVSKLSGLTYERAASVSFTAAGNNFELAIAVSIGTFGATSPQALAGTIGPLIEVPVLVGLVYVMLWLGPKIFKKENAGS

SEQ ID NO: 3794 - protein, 129 aa, Corynebacterium glutamicum
MKSVLFVCVGNGGKSQMAAALAQKYASDSVEIHSAGTKPAQGLNQLSVESIAEVGADMSQGIPKAIDPELLRTVDRVVILGDDAQVDMPESAQGALERWSIEEPDAQGMERMRIVRDQIDNRVQALLAG

SEQ ID NO: 3795 - protein, 106 aa, Corynebacterium glutamicum
MTIPEIIVSILVILAGLFSLGTAIALWRAPDPLTRANLLGTTVGVSIPLLIIALLIHTWSVDGFNPNNFIRAIIAIIGVWVIGSVGSYYMGRAIYGVTVVDNRRSK

SEQ ID NO: 3796 - protein, 90 aa, Corynebacterium glutamicum
MTAFGIVTTVGICMFAFSLLSALVLILRTKDFLTRVVLSDMVFYSMIAIYLIWVLNNPTSIAFEIALLAAVLGGVLPTLSMARIISKGRR

SEQ ID NO: 3797 - protein, 151 aa, Corynebacterium glutamicum
MLNALKFIPWLIGQIFLSGFSVITAAVKKDTGFNPVVIRYPLRVTTDFQIAALSTCITATPSTLSLGLREPRKPGDPTILLIQAVFGSDPVEVFESIADMEQRLVPSVASIDHGVPGQGPYKEIRPSDAEWPSREIADTAQNTVSQDKREF

SEQ ID NO: 3798 - protein, 510 aa, Corynebacterium glutamicum
MAMDVLLPIFVAVPLAASAIAVLLPWRLIRDILHIIVPFAGIFAGIWLFAHTAEHGPIAHNVGLYVGGVAIPFAADTFSAIMLITTSIVAVAANWFATIVGETRARFYPALTLMLITGVNGALLTADLFNFFVFIEVMLLPSYGLIAMTGTWARLASGRIFVLVNLSASTLLVAGVGIVYGVIGSVNIAALQDVVEGNPLVASAMGIVVIAIAVKAGVFPVHTWLPRTYPGTSAAVMGLFSGLHTKVAVYMLYRIWVHIFDMDPTWNWLIVAFMVISMLVGGFAGLAENSIRRVLAYQMVNGMPFILIMMAFTSDDPQRALAAGLLYTLHHMITIAALVLTSGAIEETYGTGMLSKLSGLARREPVVAAVFAAGAFSVVGFPPFSGMWGKALILLEIARVGNIAAWIAIAAIIIASLGALLSMIRVWREVFWGGAMHQRGVSPQLRISPAKIAPALSLIILSVGMFIFAGPLIDATLTATDGLLNTDAYQQAVLGENAIGVPSPSYQGGN

SEQ ID NO: 3799 - protein, 127 aa, Corynebacterium glutamicum
MILALTVAILFGGGVYLIQQRGMVRIVFGMSLIGHAANLTILYAGVPTWRGEAFPDRTPLTDAADPLPQAFVLTAIVIAMATTTIMLALAALGRSDDTRSIEPDDDQSPLTTSARSVTNPTDQEDKA

SEQ ID NO: 3800 - protein, 962 aa, Corynebacterium glutamicum
MLFVVALAVISVFLAPISVKVIDRKAGWPLAVIFAVAAYFLVREAGPILDGQALTWDITWVRDILGSGVDVKFALRADALSLFFALLALVIGAVVFVYSAEYLPRKKGNTSFYTIMTAFTAAILLLVLADDVFVLFVGWELVSLASFMLIARSGSSGESGSIRTLILTFFGGLTLLTAVAIAATQAGTTSLDGILHSDFWAEKPVLTGVIAVLIAMSAFTKSAQFPFHFWLPEAMAAATPVSAFLHAAAVVKAGIYLLLRFSIVFHDVAVWNWLLIIVGMGTAIMSAYFAVQKTDLKKLTAYSTVSHLGWIVATIGVGTPFALGAAIVHTLSHALFKSSLFMLIGVIDHQTGTRDIRRLGFLVKKMPFTFVSVLIGALSMASVPPLLGFVSKEGMITAFMDAPIGNSYVVLLLVGAAIGAVLTFTYSAKLVLGAFVDGPRDMSHVKEAPVSLWLPAALPGLMSLPLVLVLSLFDAPVSAAATSAAGEAAHMHLALWHGINTPLLISLGVLVAGILGVLFRKELWKIAETSPFPIATGNDILSMLVYRANLLGKFFGRMADSMSPRRHLVSLIVLLWALAAFATIHPSVQLAPKQPGIDRWIDLIPLAIIALSVFGLLTTRNRLSAAVLVGTVGVGVSFQMLLLGAPDVALTQFLVEGLVVVIIMMVVRHQPANFKRIKPSRRRSTVLVAVLAAFAAFMAVWGLLGRHERSELAMWYLNQGPEITSGANVVNTILVEFRALDTLGELSVLGMAAVVIGAMVASMPRHPFAKGTHPRPFGQSQLNSIPLRMLLKVLVPALCFLSFMVFMRGHNDPGGGFIAALIAGGALMLLYLSKAKDGRIFRPNVPFILTGAGILMAVFSGVLGLTHGSFLYAIHFNFVGQHWTTSMIFDLGVYLAVLGMVSMAINGLGGYLRPGTDIADLDYARRSGPLPATPTVEPEPEGDEDWPEPINPAGDNKEEANR

SEQ ID NO: 3801 - protein, 495 aa, Corynebacterium glutamicum
MHTMSAAASRSRNILTALLLLVPLIAGTIYASAMGLDVSRAWSSADEVTGAPAASVATNNQELIEARRAAGEAGAQAGFLTSGTEELTSGTQELIDGAAPLEEGVSAAADGAAQLHDGLIQLQAGTGQMGTGATEIADGVQNAVEQLGGLVVVQQQLLGALNEADKQLASSKIPEAEDLRKQITEVRGHLENFGISVEMTDQLDQLRSGTRDLANQLAVPGYGFHDGIYSATNGAAELSAGLQELEAGVGTAVEGFTALDEGANRLDSMATLNEEKTSAVQRALPVPQVPAGTIEGTADEERTSALAPMYAFLISALVMLAGAALGWATLKNKWLMAFAVIGVTAIGGIILFTVALGISIGALFGALGILLLATVVAGILSRILLDVLGTTGAIVVSVLGWVAQAAVIGHVWSVTAVSDIALVWRVVAGMMPLHYPTFAVTSIGNGGSAAAIWMSVAVLLAMGAIGAVALRKPKAVAVEVEEAVDADADQAASES

SEQ ID NO: 3802 - protein, 201 aa, Corynebacterium glutamicum
MPATTRQTSAISDTAVTLHTWPITAAWATHPRTETTIAPVVPNTSSKIRERIPATTVARSKIPKAPNKAPMDMPKATVNKIMPPIAVTPMTAKAISHLFFSVAHPSAAPASMTNAEIKKAYMGASALVRSSSAVPSIVPAGTWGTGRARWTAEVFSSLRVAMESNRFAPSSSAVKPSTAVPTPASSSCKPADNSAAPLVAL

SEQ ID NO: 3803 - protein, 288 aa, Corynebacterium glutamicum
MEPKKPVTYKELAHEYSRRTFNKLFTKITGFVYLKNDLINDPNLVTQALLKRCPEGVLRGYAALKQRGYQLLDDQWMPIISVSGDLNRRDCSRGEILRRIEPENTLLSGNIRFVNDVQAIQDVFDLHSLNDFEDQVALIDHLIRQRPELFQELIQEPKLKKHTQYANPFAESPQESRLRVRLHSLGYHGFIPQIHVEYDGQSYFLDLADPLWQVALEYNGGWHYTSEQREKDSHRKNALKSAGWDVLEVTSKTLQNPNSWNNLIQQINSSLRRKQAQRRRRLPMQTVG

SEQ ID NO: 3804 - protein, 222 aa, Corynebacterium glutamicum
MSKILLAEDDAGIADFIVRGLIREGFECEVTESGAEAFARAHSGDFDLMVLDLGLPHMDGTDVLEQLRNLQVTLPIIVLTARTNIEDRLRTLEGGADDYMPKPFQFAELLARIKLRLAKHTPQETPTDARVLRNGDLELDLRTQRVLIDGSWHDLSRREVDLLETLMRHPGQILSRVQLLRLVWDMDWDPGSNVVDVYIRALRKKIGAHRVETIRGSGYRLR

SEQ ID NO: 3805 - protein, 489 aa, Corynebacterium glutamicum
MAKSTPLIASLRWRIVLWMTAVVFLTLASVVIITRSVLLSEVTNTANSAVEQEIEEFRRFAAEGIDPTTAQPFESGHRLMEVYLSRQIPDENEAIVGIFPGELIQVDYSQLSGAHPLPLEHSDPLISEIRQTTLNSGVFSDLERGTTHWGKVNFQTASGEADGEFVVAFFADNLKDQVNGQIQILILIGTGGLIASILIAWLIAGQIIAPIRKLSSVSAKISNSDLTWRVPVEGRDEIAQLARTFNAMLDRIEIAYNDQRQFVDDAGHELRTPITVVRGQLELLATTPPEEQARSIELATTELDRMSRMVNDLLTLAVADSGTFIHAHPTDVTDLTIDIEDKARTISDRILLVDAAEGLVSLDEQRVTEAVLELFGNALRYSDDVVELGSDFRGSGPDRIFRIWVRDKGNGVDMDEQEALFDRFSRGSQKNSRRPGGAGLGLSIVKAIGEAHGGRAFVNSTPGLGSIFGLEIPAPEQSKEYTHEQDPAR

SEQ ID NO: 3806 - protein, 201 aa, Corynebacterium glutamicum
MSWVETLMTASVFYPVLSVVVLIDCILPLIPSETVLALAGAWSGARGTPNLWLVISVATLAAIIGDNLCYFFGTRLINMVNRIPGESRRGKALEWARKNLNERDVSTIIIARFIPWARWFVTIILGSVGYSWSRFIVWDSIGALIWATQATLLGYVGGWLFQEQPLIGLVAGAALGIFFGFFLQWLNKMWERRRLAKVAAE

SEQ ID NO: 3807 - protein, 187 aa, Corynebacterium glutamicum
MFPPNSPTDHSMGIPLIKKSLNEPILMINPGNFLMIPPQTATSRTWSENSHLHFILVPNNGIQIELIKGEPPMKSLPRFAPLITILALLVLVAIGGSALANNRATPNVESEPATVNQRSTPTTSAYEPPATESPEEPTTQIQESPVQPPVPAPAQIPQAPQVPLNYQYYDDDWDDDDDDFDDDWDDD

SEQ ID NO: 3808 - protein, 305 aa, Corynebacterium glutamicum
MNKVSTIAKTLTFSSAALLGAGIATAAWGYSELKKFELKTVELPILKPGTLRGKKEFRLLHISDLHMIPGQETKKAWVSALDSLSPDLVINTGDNLSDEKAVPDVLRALGPLMNRPGAFVFGTNDYWAPRPVNPFGYLFGKKREVSHIDLPWRAMRAAFIEHGWQDANQKRLEFQVGSVRLAISGVDDPHHDLDDYTEIAGAPNVDADLSIALLHAPEPRVLAQFEADGYQLSLSGHTHGGQLCLPGSKPIVTNCGIDRKRATGLNKFGDMWMHVSNGLGTSKFVPFRIFCRPSATLIKITEQAL

SEQ ID NO: 3809 - protein, 151 aa, Corynebacterium glutamicum
MSELKDKIRADLTTAMKARDKDTTGTLRMLLSALTQEETSGTKHELNDEEVLKVIAREIKKRRESAEVYTENGRQELADVELKEAAILEGYQPEQLDDDQLNALIDEAIAEVGGEADMKKMGQIMKAATAKAAGRADGKRLSTAVKSRLSN

SEQ ID NO: 3810 - protein, 795 aa, Corynebacterium glutamicum
MSTTNSLTKLVASTVAAGVLGALALVPFASLSGVAVARTNDTMQTNLSDLTDGRGPGVTTITDSTDQPIAYIYAQRRFEVGGDQISTSMKDAIVSIEDRRFYEHDGVDLQGFGRAILTNLAAGGVEQGASTINQQYVKNFLLLVEADDEAEQAAAVETSIPRKLREMKMASDLEKTLSKDEILTRYLNIVPFGNGAYGVEAAARTYFGTSAAELTIPQSAMLAGIVQSSSYLNPYTNHDAVFERRNTVLGAMADAGAISPDEASAFQQEPLGVLETPQGLSNGCIGAGDRGFFCDYALQYLSEQGITQDMLAKDSYTIKLTLDPDVQDAAHNAVSSHVDPTTPGVAEVVNVIEPGENSRDILAITSSRNYGLDLDAGETMLPQATSRVGNGAGSIFKIFTAAAAIQQGAGLDTMLDVPSRYEVKGMGSGGAANCPANTYCVENAGSYAPRMTLQDALAQSPNTAFVEMIEQVGVDTVVDLSVKLGLRSYTDEGSFDGESSIADYMKDNNLGSYTLGPTAVNPLELSNVAATIASGGMWCEPNPIASVHDREGNEVYIDRPACERAIDAETASALAVGMSKDTVSGTAASAASMYGWSLPTAAKTGTTESNQSSAFMGFNSNFAAAPYIYNDGTSTTPLCSGPVRQCSSGNLFGGNEPAQTWFNMASNVPAASQGTLPSSSDSFRLGTSGELLNQVVGQSEASARRTLEAKGYKVTTRSVSGAGSARGTVVSATPQGAVLIDGGTVILDISDGTSPAPAATNNDDSDDGDTPAPSTNNRGTTIEDAINDAINQFFR

SEQ ID NO: 3811 - protein, 113 aa, Corynebacterium glutamicum
MIPEQRNNPFYRDSATIASSDHTERGEWVTQAKCRNGDPDALFVRGAAQRRAAAICRHCPVAMQCCADALDNKVEFGVWGGLTERQRRALLRKKPHITNWAEYLAQGGEIAGV

SEQ ID NO: 3812 - protein, 64 aa, Corynebacterium glutamicum
MVGFFDSGRTPGAPQAHPSAPQAHPSAPQAHQPSTRANASVRHASKGASKKHAPEALEMRSPVG

SEQ ID NO: 3813 - protein, 51 aa, Corynebacterium glutamicum
MTKWEYATVPLITHATKQILDTWGEDGWELVSVMPGMNPENLVAYMKREVA

SEQ ID NO: 3814 - protein, 153 aa, Corynebacterium glutamicum
MASNSERLAELGISLPSVAAPVAAYVPAIQTGNQVWTSGQLPFVDGQLPATGKVGAEVSAEDAEKLARAAALNALAAIDALVGIDKVTRVLKIVGFVASADDFSGQPAVVNGASNLMGEVFGEAGAHARSAVGVAELPLNSPVEVEVIVEIAQ

SEQ ID NO: 3815 - protein, 451 aa, Corynebacterium glutamicum
MTTSSTASPIAELQNLSPKQRKSESRRAIISSYLGSTIEFYDFLLYAAASATVFPAVFFTNLDPLAGTIAAYGTFAAGYLARPLGGAIFGHFGDRLGRKKMLVLSMLIMGVASTCIGLVPSAEMIGSMGAVILIMLRICQGIAVGGEWGGAALMALEHSDSKKRGFAASFTNAGAPTGAALGTFALGTASAVLTQEQFLSWGWRIPFLLSFVLLIVGLVIRAKVSESPLFAAAAAAEKAKPTERKVPLLQVLRRPKALILTMLGGASGFGLQVLLSTFSISYATQSGIERSSVLYAFAVASVFSVFFVILFGRVSDLFGRRPVMIIALVLFVAYLPAFFRMLTSDNWFILLSAFTIALALHAMLYGPLAAFISEQFGTSARYTGASLGYQLATLIGAGFTPTILASLYAGPGGGTSVTPVIVFLATMSLVSIIAIAITRESKDHDLSTYEH

SEQ ID NO: 3816 - protein, 203 aa, Corynebacterium glutamicum
MAISPEWYQPFCSALAVSSGRFQYPVITCGPRMRTSPASPVGTSSPVFGSTSLMSVKKWARPAVPRCVLVSVASRIQAPGAVSVMPKPWTIFTSRPCQIRSARSLRGEPPTMMARREERSRSANDGWLDNMSIIAGTMKDSDTLERSISSRTCSARNSRWMITFPPFIITGMVVMLRPAMWNNGAVDKSTAPCSISWLSRALK

SEQ ID NO: 3817 - protein, 512 aa, Corynebacterium glutamicum
MKVNLGIGSYPRRRATVRPESTAIEFEGTSITYGEFSKRVNRLGHALLDLGVAHQDRVAYVGFNHPALLEVFFSTNLIGATPVLVNPRLSANEIDYIIQDSGASIVFYGIDLIEHATYLQELHPEIIMVAVEGDEGPGLRRKALIEAASDADIDLEVSDDDIALLMYTSGTTGRPKGAMLSHRNLFFNYFNALLSQEIEQGAVLLSTAPLFHIAGLNMTTIPVMMKGGKVIIHREFRAEHVLDEIERSKVSESFMVPAMIDMLSNHPSFAERDLSSLRAIMVGGSPLSERALRIWQGRDVKIVQGFGMTETAPGACILEATDTSTHLGTAGRAHFFTDIKLVDPKTGEEVPTGEAGEVLIRGPHVMTGYWNRPEDTASALQNGWYHSGDIAIKDEDGYYTIKDRIKDMYISGGENIYPAEVEQALQELEAVLDAAVIGVPDERWGETGIAFVSIRESYLTNPPTGPELRELLGSVLARYKLPREIHIIEELPRNATGKIQKNILRDFTIPVS

SEQ ID NO: 3818 - protein, 175 aa, Corynebacterium glutamicum
MHVQMIEDRNYFSASSHGATMTTSNPTAEIIGGPERFLEAELSQQIQFLTARARAKGSAKGNEALVDLGLKVRQYSTLSLAASGLKPTQRELGAFLDLDPSQIVALVDFLEKRGLVAREVDPRDRRSKIIIATEKGLEIHDEATKRLLIAEGESLKNLTSDEQEQLRELLLKIAF

SEQ ID NO: 3819 - protein, 311 aa, Corynebacterium glutamicum
MSLNGKVAIVTGSGAGLGRSFAQELARQGASVIVNDVNQAAADETVAAITEAGGKAAAVIAPVGPSESAALLVREAVDKFGSLDILVTNAGILRDRSLLKMTDDDFDAVINVHLKGTFTCVREAFGYFKENGIAGRIVTIGSPTGQRGNFGQSNYAAAKAGIVGMVRTWALEMKRAGVTINAIIPEAATDMTKTVPYFQKAVEADERGEAMPAFFRETLGFGTPQDVAGLVAFLSSDEAANISGQAIGAGGDRMQVWKHPEPAVTEFNPGGWTYEALQERGKNIIEGNLQSVGVVFPELPAELQPQIPVKA

SEQ ID NO: 3820 - protein, 314 aa, Corynebacterium glutamicum
MSNNVVKYECAVDADNIVAVDMHVHLEVDSCGHKSMPADIMAASSKYFKTAERTPSADAIADIYREHKMAAVVFTIDARTQMGHLPNSIDDLVASCARNNDVLIPFGSVDPRTGEDALVEARRQVEELGVRGFKFHPSVQGFDPSAPEFYPLWELLESFGLPCVFHTGQNGMGAGLPGGRGIKLRFSNPMLLDDVAADFPNLTIIMAHPSVPWQDEANSIATHKANVFIDLSGWSPKYFPESLVRQSNNVLSKKVLFGTDFPLITPEKWLAAFANLPLKDEVRPGILKDNAVKVLGLAASTERGSQAEKVVQHA

SEQ ID NO: 3821 - protein, 398 aa, Corynebacterium glutamicum
MRDPIQGAVIPSDLFGFAEVLTEAERAVLLETRRVLEEEVKPYINEAWDKAVFPDEIVQPLQDLQLLDPPALREAGESVRDIFTGFRNFELARCDINVGTYYNASAGLFRTACMVGGSPEQAQRLDAQIKSGEVKGVFALTEPDHGSDIAGGLATTATKDADTGEWIINGEKRWIGGASTADLIATFARDTADNQVKCFLVAPQAEGVSMEIIDRKASLRIMQNAHITYNNVRVSGDARLHNINSFKDVSECLRRMRSDVAWMAVGAQAGAYEAAVKYVRSREQFGRPIAGFQLIQEKLALMLGNLTASLGMMVKLTDQQQAGIFKEENSALAKMFTSLKLRETASWAREICGGNGIILDNDVARFHADAEAVYSYEGTHEINALIVGRAITGVSAFI

SEQ ID NO: 3822 - protein, 157 aa, Corynebacterium glutamicum
MTTSTTPNTIVSFEDAPTLTGQDLGFSQWRTVTQEMVNTFADATDDQQWIHTDPERAKDGPFGGAIAHGFLTLSMIIPFWGELLDVTGVTTKVNYGLDKVRFTSPVKVGSRIRMGAVVREISEVKGNGLHLVADGTIEIEGQERPAVVATFLTRFYA

SEQ ID NO: 3823 - protein, 281 aa, Corynebacterium glutamicum
MTKLERMEHPAYSQLRPVTPSASVVLCPNPGYSSLEGTNSWVIRAPEDPRSIVIDPGPEDEGHLNVLHSKAEEVGLILLTHRHYDHADGAQRFRQLTNAPVRAMDPSYCAGAEEIHDGEIITIDGVTPQIEVVATPGHTRDSVSYFIWSGVPHESTLEGIVSGDTIAGRHTTMISETDGDLGEYLNSLAILEERGKDIPLLPGHGPDGQDVSSFARKYIERRELRLNQIREVWETRGRDVSMKDLIDAIYDDVDPVLRGAAEQSTHVAIRYLQAQEASASN

SEQ ID NO: 3824 - protein, 391 aa, Corynebacterium glutamicum
MTTRNGVARNDALQSGLMRDSTPDEIRHRITGMTRCGHHLNLWGDTVDRDDLTIMNLLRTSTVRRVHRTHRCIGQLTETLCAVSMIIVTVGQKNQTHLLSLGMQDVKVALIFRTWIDDNAPGVFWCPDNPRISAFQRAVTGIRAQNNRCGRGNRPQLAVSRMLHALKLSHNKSFRRTGEKNSSAPLTLKGCAGWVFASRSKLLSVEAGEEGSYDGRALLPFDLNSAIGDQVQAIALHLRDLTDHSAHADAGTDLDGRGETHLIQAIVHLGGHAGDIEKLAPERNDHGQGEETVGNCATKRTVLGALRISVNPLLIISCVREGVHHLLGDSAPLRKAQVLAGEGWCVFERNDGVWGGGSSHDVLLKSVLDKSADARDGATNDECIDFVGAFI

SEQ ID NO: 3825 - protein, 235 aa, Corynebacterium glutamicum
MLGVHNEDGLALEANPATVCERCKSLIHSFTGSTDELCDFFLSEVVVHAQRASFLGAEAVSQLQKGLSNAAWDVGEDEVSQGSVGATQTTSQNAQELLSDSWVVSYPVAQHVRVHGCCMNFGDTHCRGGAWAWVEDGELTEHVGRTHDGQQVFAAVRCVARKLHFAGGDDVKAVTWLALVEDGCSAWEANGLHILDEVIDCRWVNALKNSGARQDLLYTFHCFSPSSAHILFESG

SEQ ID NO: 3826 - protein, 227 aa, Corynebacterium glutamicum
MEGVQEILSRAGIFQGVDPTAVNNLIQDMETVRFPRGATIFDEGEPGDRLYIITSGKVKLARHAPDGRENLLTIMGPSDMFGELSIFDPGPRTSSAVCVTEVHAATMNSDMLRNWVADHPAIAEQLLRVLARRLRRTNASLADLIFTDVPGRVAKTLLQLANRFGTQEAGALRVNHDLTQEEIAQLVGASRETVNKALATFAHRGWIRLEGKSVLIVDTEHLARRAR

SEQ ID NO: 3827 - protein, 64 aa, Corynebacterium glutamicum
MTPMTGLLVVIIPLLLMLFAFAMERIESSFLHSNAPQNTEVKLAKDAIGAENLNDGDVQEASAA

SEQ ID NO: 3828 - protein, 260 aa, Corynebacterium glutamicum
MGSITPQKRPRVGSHIANKGQETDIGRKRRARRINRTLTVAYPDAHCELDFTNPLELTVATILSAQCTDVRVNQVTPALFKRYPTATDYANADRTELEEFIRPTGFYRNKATSLIGLGEALISLHDGQVPGTLEQLVELPGVGRKTANVVLGNAFGVPGITVDTHFGRLVRRLKLTDEEDPVKVEKVMNELIEKPEWTMFSHRLIFHGRRICHSRRAACGACMLAADCPSFGLEGPSDPFEAQKLIKSDDREHLLKMAGM

SEQ ID NO: 3829 - protein, 186 aa, Corynebacterium glutamicum
MTSSAKWSIVGVVAILAVIVALIPQLVGGESAEEAQGETSTSKITTRPDCVASGAAGVDLPCLGGANGVGNELATVVNLWAWWCEPCRAELPIFDEFATTHPELNVIGVHADQNAANGAALLEDLGVNLASYQDDSNLFAGTLGLPGVVPITIVVSPDGNVVDTFPQPFETIDDLETAVAGALQNA

SEQ ID NO: 3830 - protein, 223 aa, Corynebacterium glutamicum
MWMHRLLDRIHTGRMANPLDGAETLGDTDSEKRAAVLMLFSGSETSFDLPNDASVLLTHRTPTMRSHAGQIAFPGGRIDPTDTNAVDCAFREAWEETGLDRRTATPLAQLNEVHIRATGYPVYPILGHWHTPSPVAVASPHETDEVFDAPLYDLIDPKNRLMVGWREWHGPAFRINDYIIWGFTGGLLSAILDTAGWATEWDTDRIFDLENTLSTSRNNERMR

SEQ ID NO: 3831 - protein, 397 aa, Corynebacterium glutamicum
MSPSLVVDAVIVLVMAFALWGGWRQGAFTSLLSTVGVVSGLVVGAAAAPFVMGLTDSTALRFLLAIGTVVLLVGLGNLIGAHLGAAIRDNIKFRSSRTLDSGLGAIFQVLATLIVVWLVAIPLATGLPGTVASGIRDSRILGFVDKYTPQGLDTLPSKIAAMLSESGLPPLISPFTGGSSVEVDAPEINVTNVDLVEAMRPSVIHVMGDAQECSRRLMGSGFVASPDYVVTNAHVVAGTSTVSLDTMIGTRSAEVVFYDPNLDIAVLYSPDLGLDPLPWASTPLDTGDEAIVMGFPQSGPFNASPARVRERIMITGSNIYANGQHEREAYSVRGSIQSGNSGGPMTNEMGEVVGVVFGAAIDGSDTGYVLTAEEVQERIGDITALTQPVDTMQCAVS

SEQ ID NO: 3832 - protein, 331 aa, Corynebacterium glutamicum
MAFFSFSTSPLTRLIPGSRSKATGAKRRLSSTIASIERSPGIIALDGPFTHDHVSVRGIRLHLAEAGSPTKPLVLLIHGAFGGWYDYREVIGPLADAGFHVAAIDLRGYGMSDKPPTGYDLRHAAGELSSVIAALGHDDALLVGSDTGASIAWAIASMYPERVRGLISLGAIHPLDMRRAIRRKPHLHVSDLSRLAPFRLPSFLHNLFHFGITSEARREIVNNTSSSYQRSNAFTETVLLRKKALSIDHTITPIIRTNRYLVGSIPSKTVSAPVWLLRTNTRRWEHLANTARTRTTGPFTTIAIPGGYELPYLENPSEFAATIAEFARTTF

SEQ ID NO: 3833 - protein, 183 aa, Corynebacterium glutamicum
MSNKDGLFTDGNSTFAPKVDSIPLSDVDTSVSGEASIGTLISNATSQMSSLFRAEVELAKTELAGEAKKAAIGGGAFSVAGVIALYSSFFFFFFVAALLSEWIKPWAAFLIVFLFMLVIAAALALFGWRKVKKMGAPKNTIQSVNQLKNLVPGQASEKLEKANKRGLYTSASFHSPGAITGDH

SEQ ID NO: 3834 - protein, 322 aa, Corynebacterium glutamicum
MTLPARLLHSQCATPARHFNLIGNFSFFLSLGKLPKSAKLCGVKHPDPAQKVEGTTATTPTKVAAFFDLDKTIIAMSSTYAYGREFMNSGLISPVEALQLSLAQATYMFAGHTSEQMDNTRDQLTAMIRGWEVQQVRSIAEETMHSVVTPTIYAEARELIEHHQELGHDVIIISASVKELVEPIARELGVHKTVTTVLEAHDGMYTGEVLFYCKGDAKAQSILDLAEANNYDLSLSFAYSDSFTDLPMLEAVGNPAAVNPDRALKKIALEQGWKILSFKNPEPLFQMPSTRDVGIGTGVVAGIAAVTAGSIWWMKRARRGSA

SEQ ID NO: 3835 - protein, 341 aa, Corynebacterium glutamicum
MEDPVLHPEAMHVAAATGRPVIETTNLMDISRHFHRTSAVLIDASMASQLSPGKRRDRVFLLDSDPGPSDWKTAMKIHAEQAMLLPAQAGELLSALGRDDKQLPVASGHVIGVAGVVGGTGASTFAAALAKRRAESVTTVLIDADPSSGGIDLLLGIEDVPGARWPDVGLRRGTVQAADVLKALPSTPDEVVVLSTARSNILDPFALSESDVSAAIDCFLSADRSVDVVVDLPHARVHPDIAERLSHLVLVIPAEVRAVAAARARCLELQQLHVSITCVLRHRGWSGLDVAEVEEILGADITAEVGSIQRLAKSVEMHGLTGSLPRVLSSACDAVLGEVAA

SEQ ID NO: 3836 - protein, 341 aa, Corynebacterium glutamicum
MISNEDIVMVLRRLRSDSVGVGPLESLLALPGVTDVLVNAHDSVWIDRGQGVEKVDMDLGSEEAVRRLATRLALTCGRRLDDAQPFADGRITRDDGSVLRIHAVLAPLAESGTCISVRVLRQARLSLDDLIQSGTVPEDIAPALRNIINQRRSFLVVGGTGTGKTTLLSAMLTEVPADQRIICIEDTAELHPGHPSTINLVSRQANVEGAGAVSMADLLKQSLRMRPDRIVVGEIRGAEVVDLLAAMNTGHDGGAGTIHANSISEVPARMEALAATGGLDRMALHSQLAAAVDIVLVMKHTPFGRRLAQLGVLRGNPVTTQVVWDLDHGMHEGSEEAWFMP

SEQ ID NO: 3837 - protein, 205 aa, Corynebacterium glutamicum
MQCHAVQSAGRRKSFHARGNFRDGVRVNGASTAVVSGIHRSQKIHDFRTANLSDDNPVRPHAQRLFQQIRHAHGAGALDVCLARHQVDGAWMAGMKLCGVLDADDSLISGNFGEHRGQQCGFPCAGATDNKERAPLIDDVPERRRDVLRHRAALDKIIKAQPCLTQYSHTDARAGFRQGCQHRVNAQHAAVVPGDSAISERLRII

SEQ ID NO: 3838 - protein, 272 aa, Corynebacterium glutamicum
MGFGPRHARRERRGMVYALGLLSVAVLISGSRGPGARTRPPTPGNGVHLFALIALFCLATVLFIVVDAYTMIAGIIIATTLFWYLRQTHAAAQRTKQSLQLASFLSLCAGNLRAGVTMVDAMDYALDNTTPDKFLSPTLQTAARQARSGGSGPRVLIDASLPDLQRLGHLWETSERHGIPLVALIDQMRSRISSKQRHGESTRAALQGPQATAVILTVLPLAGMLMGTAMGANPLGLLTGGGIGGFLLVIGVGLDAAGFVLTHKILQSASPS

SEQ ID NO: 3839 - protein, 182 aa, Corynebacterium glutamicum
MAMFLGSPNPGVRGGLISPKSGKSLRIRAGPKKLGNADPVDVSADIELFSACLDAGLNTRDAAQVVAHVAAITHRELWTHVVALLSIGVSAPQAFALMAGVDGLDELANLATVSHRSGSALSDGCRNISTSLLASAGDKRTAAAERAGVFIALPLALCFLPAFMIVGLAPVVLSLGTQLINF

SEQ ID NO: 3840 - protein, 66 aa, Corynebacterium glutamicum
MSNNLELLRLRTRAILAQDDGLTTVEYALGTLAAAALAAVLYMVVNSDAVSSAFESIISDALSARP

SEQ ID NO: 3841 - protein, 106 aa, Corynebacterium glutamicum
MRTKQQREPPELCSDDGSVSIEAALALSSLVIVCGLIIAAMATLAAYLAAVDAAGAAARAHAIGESFEPARGHVDMHEAGGMLTATATIPAPIGQVSASAVFPVEN

SEQ ID NO: 3842 - protein, 138 aa, Corynebacterium glutamicum
MAVAVSIPPASCISTCPRAGSKLSPMACALAAAPAASTAARYAAKVAIAAMINPHTITSDDNARAASILTEPSSLHSSGGSRCCFVLIGYGRALKASLIIDSNAEDTASLLTTMYKTAAKAAAAKVPKAYSTVVRPSS

SEQ ID NO: 3843 - protein, 115 aa, Corynebacterium glutamicum
MRCSRWKTSCANDEGYMTIASAGVASILISLLVVLAWQAGNLVAREQAQVAADVSAVAGAYAFARGELPDAACATAKHTAEANNAQLENCATEGEDLTLTVTVRGQEAHAKAGPL

SEQ ID NO: 3844 - protein, 785 aa, Corynebacterium glutamicum
MRPSFGEELAAIVSKRYSESTLTHMVTLPASKAKYVDWPSWVPASLRDALVNRGINKLFSHQEQTAHLAWNGQHVVVATGTSSGKSLGYQLPILSALGTDPTACALYLTPTKALGSDQLTSTSTLLRDIPDFHPINPAPYDGDTPSEARSGIRDLSRFVFTNPDMVHASMLANHPRWARLLRHLKFIVIDECHAYRGVFGANVSMVLRRLLRIAAFYGSHPTVILASATSSDPEIHASRLLGAPVKAVTEDGAPTGERTVLLWEPGFIEGAEGENGAPVRRAASTEAANIMATLISEGARTLTFVRSRRQAEIVALRAQEELSTLGRPDFARRVASYRAGYLAEDRRRLERLLDDGTLLGVASTNALELGIDVGGLDAVVTAGFPGTVASFWQQAGRAGRRGQGSLVVLVARDEPMDTYLVHHPAALLEKPVEAAVFDPTNPHVIRGHVYCAAVEKPLTEAEVAAFGAQKVVEKLEIEGLLRKRPRGWFAVEKPMSEDPDELSPDSAHQQVSLRGGSGSEFMIVDITDGRLLGTIDSAKAMSQTHPGAVYLHQGESFVIDELDLEENLALARPELPDYTTYARSDTDIRITSAPLEDEVFDAGGGLWVANVEVQVTDRVTGYVTRLSDGTTLDATPLYLPPQILQTRAVAYTIDPLALEAMGIPAADIPGALHAAEHAAIGMLPLLATCDRWDIGGVSTALHADTGYPTVFVYDGMDGGAGFADTGFRRFAQWIEATFEVVRSCSCESGCPSCVQSPKCGNGNNPLDKAGAIKLLGAMVTLLGTS

SEQ ID NO: 3845 - protein, 67 aa, Corynebacterium glutamicum
MAQGTVKWFNPEKGFGFIAPSDGSADVFVHYSEIEGNGFRTLEENQLVEFEIGEGAKGLQAQAVRAI

SEQ ID NO: 3846 - protein, 75 aa, Corynebacterium glutamicum
MQLDCTNSLSLKALSALADFELDELVLLEGTEAVALDLGVVDENVSGSVGRSDEAEALLWVEPLNSALCHLSYLY

SEQ ID NO: 3847 - protein, 996 aa, Corynebacterium glutamicum
MADTAGTTGSKKKYLVIVESATKAKKIQPYLGNDYIVEASVGHIRDLPRGAADIPAKYKKEPWARLGVDTDRGFAPLYVVSPDKKKKVADLKAKLKLVDELLLATDPDREGEAIAWHLLEVLKPTVPVRRMVFNEITKPAILAAAENTRELDENLVDAQETRRILDRLYGYEVSPVLWKKVMPRLSAGRVQSVATRVIVERERERMAFVSADYWDLSAEFNARENGKADSDNPSSFTARLSTIDGNRVAQGRDFNDRGELTSEAVVVDKQRAEALAEALEGQEMAVVGVEEKPYTRRPYAPFMTSTLQQESGRKLHYTSERTMRIAQRLYENGHITYMRTDSTSLSEQGMKAARDQALELYGAEYVSPSPRTYDRKVKNSQEAHEAIRPAGETFATPGQLHGQLDAEEFKLYELIWQRTVASQMADAKGTSMKVTIGGTAKTGEKTEFNATGRTLTFPGFLRAYVETTRTADGRDVADNAEKRLPLLSEGDLLKVLSIEADGHSTNPPARYTEASLVKKMEDLGIGRPSTYASIIKTIQDRGYVYSRGNALVPSWVAFAVVGLLEANFTSLVDYDFTSSMEDELDNIAAGREGRTEWLNGFYFGDAEADQSMAESVARQGGLKALVDANLEHIDARSVNSLKLFDDAEGRAVNVRVGRYGPYIERIVGTTAEGEPEFQRANLPEETTPDELTLEVAEKLFATPQGGRELGINPANGRMVVAKEGRFGPYVIEQVTDSERAGAEAQAEEVVAAERKAEDEQRATDGMRPKNWETKTAANQKEKRINQLVEENLKPATASLFSGMEPATVTLEEALKLLSLPREVGVDPSDNEVITAQNGRYGPYLKKGSDSRSLNSEEQIFTVTLDEARRIYAEPKRRGRAAAQPPLKQLGDNDVSGKPMTVKDGRFGPYVTDGTTNASLRKGDVPESLTDARANELLSERRAKEAADGGAPAKKTSTKKTAAKKTTAKKTTAKKTVRKAPPKTTKNVVKAGAKKKS

SEQ ID NO: 3848 - protein, 237 aa, Corynebacterium glutamicum
MLNGFVTKTRQGASALVKAVSKSGSEPERAAFVAAAGAHVCASLMGVSKVKTLSKPTLMPLLAGRVLRSSCGSLEKGLGLVGLASGWVGDLVLMKPDSLPKGAAGFAFNHAAYIALLLRRGARPSAVRAGIRAVPLLGAAGFAAIREPKMLPIVLGYGGLLATTSMLADDSKLHDSSNLASFGMGHGGNLFLISDAVLFARELFLEDGTVAAQFADGAVMGTYTIAQLLLVDGLFSD

SEQ ID NO: 3849 - protein, 347 aa, Corynebacterium glutamicum
MRPVAASALARRFEDSTLEPPVSQRLRMTWLLTLGIPVMGILLLIWGYSQGIFGSDASGIMPAIAALAFASLVTGYLGNRLVVSSVVDPIRELQEAINRVRRGENDVQVDIYDGSEIGVLQAGFNEMMRGLRERQRVRDLFGRYVGAEVAKRALEERPTLGGEDRKVAVLFVDVIGSTTFAVNHTPEEVVEALNEFFEHVVEVVHRNKGVINKFQGDAALAIFGAPLPLSDATGHALAAARELRAELKDLQLKAGIGVAAGHVVAGHIGGHARFEYTVIGDAVNQAARLTEIAKTTPGRTVTNASTLREANEAEQARWTLMKSVELRGRSQMTQIARPIRPTLADRS

SEQ ID NO: 3850 - protein, 419 aa, Corynebacterium glutamicum
MTNSSVFDSLAGSKTVSKTLFDAASSARALVRARTTERARARAEHQNPAMIHDSGFAQSWLFTGPPGSGRSVAAKVFAATLVCSNPDVVGCGQCEDCRAAMGGSHPDIEHIVPQQLSIGVDAAREVIKAAAVSPVAGNWRVVIFENADRLTMQAANALLKTVEEPTESTVMILCAPTTDPRDIAITLRSRCRHLYIPTPSIAEVARILVAEGNVSQADAELAAAASGAHIGRARYLAHNNAAQRRRASILNLAELIFHGDVAFRSVNTLVKMVETEAKDSNKEKEEAELEAVRISLGMGAKGKGVHKAVRGGAGDFKALEDQQKLRRTRFLRDSLDLALVDLAGIYRDAIIISSQAQVGLTHPDMEGLSQELATKVSQEGLLACLDAISKCRESFGFNVRPIVAMDALVGRLRKAYKVS

SEQ ID NO: 3851 - protein, 54 aa, Corynebacterium glutamicum
MGGRRPRNFRVLLPGFHLRWNIFEEYLVESSASSSENLPKLTKFKKIRYPMNQL

SEQ ID NO: 3852 - protein, 148 aa, Corynebacterium glutamicum
MKIRSAREIAEWFVAWGDELDAEVSPLKLQKLLYYSQGEHIAATGRKLFSDKILAWQHGPVTPGVYSDTKSYGRNPIDPDEFVSDEFNWDDYSDVSDELVTVWRKYGIYSAWALREKTHSESPWLDAWAQGQNIEITDAALKDFFLVH

SEQ ID NO: 3853 - protein, 187 aa, Corynebacterium glutamicum
MKTASDPIDWNPQRIAVSGVSGVGKTTLCKQIAALSGFPRVELDSLYHGENWVPRETFVAEVQDFIKGPQWVMELQYRQVRPLIVERADTVLWLDYSTPRQMFRLIKRTIPRSLFKTKLFNDNIEPPLWTIFKDPDHIVRWGWQTRNSLKKVTPTFEGRFAPLTVVRLSSPKETKRWLRAYGESVKL

SEQ ID NO: 3854 - protein, 294 aa, Corynebacterium glutamicum
MAESFIEVSAGHADRRIDKFLRAQLKGVPASLIFRQMRKGDIRVNGRKVDPNYRLQEGDRIRMWQMDLLADLPPPVVDKHIFKAVADSVLFEDAELLVINKPAGIPVHGGTGHGGGVIEALRQKFPQERDLELVHRLDRDTSGLLLVSKTTSVLRELQEILRDREEEIFRGYLLKVEGAWPGDLRQIDVPLKRTETTVVPHSDGLRARTYFEVVKRLPGATLVKAQLATGRKHQIRVHAQYAGHPIVGDPRYGSRGGRAATMHLHAAELVAPRGAGKRQKFTAPLPKEWGMGRV

SEQ ID NO: 3855 - protein, 548 aa, Corynebacterium glutamicum
MSQERPQIGSRLSRVIEQDGLQFRDLDGDGVLAPYEDWRLTPAERAADLVKRMNVEEKAGLMIIGSHYPGYSPLAPESEGKDAEKCEPLLNPVDMWREDNPITGVPFTEPVLATSSTENAINLRNQRYLIVRDNLPARGLATWTNAVQEVAERSRLGIPVAFASNPRNHVALVAQFGVNESAGVFSEWPGELGLAALRDAELMETFGTEAAKEWRAGGVHKLYGYMADLASEPRWSRFNGTFGEDPELISDYIAAVVRGLQGPELSKNSVSTTIKHFPGGGVRLDGHDPHFHWGQTNEYPTEDALGKYHLPPFQAAIDAGCASIMPYYARPMNNSANQLDQQLWQNPTTQFEEVAFAYNRTFIQDLLRDAMGHRGYVNSDSGVIDAMMWGVEELSEPERFAAAVRAGTDIFSDMANPRRLLEAVAEGHLDESELNQPVQRLLEEIFQLGLFENPYVSEDEAEKIIGAPEVSALGNKAQLDSVTLLRNNPIRAATGSCSKPEDLPIGYWPYQDRRGSTTAGSSHSRRTPRGNLGVFRVRSRSCNRVGSP

SEQ ID NO: 3856 - protein, 650 aa, Corynebacterium glutamicum
MNKTAYNSAISTATAYLHLMKIGVPQQSVPLTWNVMWKKKRASSVRTTPDTRLWRRRVKAKTRKSASLCTLSICGVRITRSRVFLSPSLCWQLLPLKMPLTCAISVTLFVTTCQLVGLLLGPMLFRKSRSDPVWVFLLRLRRILVTTSRSLRSSVTSPRVCSLSGLASWVLLRFAMLNWRLSVPRLLKNGVPVVCTSCTVTWLTSLLSLVGPASTVLLVRIRSSLITSLLLCVVCRALSCPRIPCRPPLSTSQVAACASTATILTSTGVRPMSTQPKMRWASTICLLSRQLSTLAAPRSCLTTHGQTTPPTSSISSCGKTRPRSSKRLRLPTTAPSFRICFATPWATVGTSTPTPASSTPCGAWRNSASQNASPQQCVQAPTFSPTWLTHVDCSKQLLRDTLMSQSISQSSDSWRKSSSLVCLRTHMSLKMKQKRSLVRQRFLHWATKHSLIPSPCCVTTPSVLPLDPAASLKIYPLVTGRTKIDEVQLQLEAAIRAELPGVTLVSSESEADLAIVWARPEIALFEDDLEGVSLSVDPRANGVDVERVQAVEAAVPTILAVNFTNPWVLSEIEPGAAAVVGTFEIKPEFLLKALTGQEGGPKGKLPLTVPASMQAIADSPRDIPGKFLDESYTYVDSAGMAYKYGHGLNF

SEQ ID NO: 3857 - protein, 368 aa, Corynebacterium glutamicum
MSTVVPGIVALSKGAPVEKVNVVVPDPGANDVIVKIQACGVCHTDLAYRDGDISDEFPYLLGHEAAGIVEEVGESVTHVEVGDFVILNWRAVCGECRACKKGEPKYCFNTHNASKKMTLEDGTELSPALGIGAFLEKTLVHEGQCTKVNPEEDPAAAGLLGCGIMAGLGAAVNTGDIKRGESVAVFGLGGVGMAAIAGAKIAGASKIIAVDIDEKKLEWAKEFGATHTINSSGLGGEGDASEVVAKVRELTDGFGTDVSIDAVGIMPTWQQAFYSRDHAGRMVMVGVPNLTSRVDVPAIDFYGRGGSVRPAWYGDCLPERDFPTYVDLHLQGRFPLDKFVSERIGLDDVEEAFNTMKAGDVLRSVVEI

SEQ ID NO: 3858 - protein, 207 aa, Corynebacterium glutamicum
MMPTASMETSVPKPSVSSRTFATTSEASPSPPRPEELMVWVAPNSFAHSSFFSSISTAMILEAPAILAPAIAAMPTPPRPKTATDSPRLISPVFTAAPRPAMMPQPRRPAAAGSSSGLTLVHWPSWTRVFSKNAPIPSAGDSSVPSSRVIFLEALWVLKQYFGSPFLHARHSPHTARQFKMTKSPTSTWVTDSPTSSTMPAASWPRR

SEQ ID NO: 3859 - protein, 179 aa, Corynebacterium glutamicum
MGNDDEVFIIDAAHTAAPIIEAVGGRAVKGILCTHAHNDHITVAPELSKEFDAPIFVHPGDQMLWEETHGNLTHEDLADQQKFQIAGTELIVLNTPGHSPGSSCFYLPEANELFSGDTLFQGGPGATGRKYSSFDTIIESLKTSILDLPAETTVRTGHGDHTSVGAEAPHLEEWIKRGH

SEQ ID NO: 3860 - protein, 223 aa, Corynebacterium glutamicum
MDLKLGGQVILVVGGAGTIGSEVVKLLTEEGATAVAASRSTPLSIDASDEASVRAGIDQVIAEHGRLDGLVVSSAPAAQTLSAETADDPDTVLAAIEGKAITFMKAATVALEKMREAGHGRIVALSGMNSYKTLSTTASARNAALNVVVKNLADRHAGTGITVNAISPGFVVAEPDAEVNRANGDTTVEEVAEAIAFLLSPRTASISGEIISVGHKAKGIILP

SEQ ID NO: 3861 - protein, 410 aa, Corynebacterium glutamicum
MGVSALNMSDMVANKRAQRKVWLAVALSVFTVAWGGNEFTPLLVFYRGEGFFSNLFIDLLLVFYAIGVAVGLLAAGPLSDRYGRRAVMLPAPLIAILGSALIASGEETAILIAIGRVLSGISVGMVMTAGGSWIKELSSSRFEPGVKTSAGAKRASMSLTGGFALGPALAGVMAQWLPLPGQLAYVLHIILTLILFPLLITAPETRQSAHLKTKGSFWSDVLVPSALDKRFLFVVAPIGPWVFGAAFTAYAVLPSQLRDMVSAPVAYSALIALVTLGSGFGIQQFGPQIMGTSKTRGPILAMFVTVIGMIGAVIVVMNPHPWWALVVCMALGLSYGLCMFMGLAETQNIAPPIDMAGLTGIFYCLTYVGMVFPALMTWLNQWLSYPFMLGFGAVMATICLIIVSFSARRF

SEQ ID NO: 3862 - protein, 311 aa, Corynebacterium glutamicum
MRTVVTGGAGFIGSHLVDLLIKEGHEVVVIDNLSRGRLENLSDAEATGKLTFVEADLLDVDFNEFLGTHKPEVIFHLAAQIDVRHSVVDPLHDAETNILSTIRIADAARQHGVRKVVFTSSGGSIYGEPSEFPVDETVPVDPHSPYAASKVSGEIYLNTFRHLYGLDCSHIAPANVYGPRQDPHGEAGVVAIFALRLLGGLDTKVFGDGGNTRDYVYVGDVVRAFYLASGEIGGGERFNIGTSVETSDRQLHTLVATAAGSKDDPEYAPARLGDVPRSALSFGKAKEVLGWEPEVNIEQGVAKTVEYFRTH

SEQ ID NO: 3863 - protein, 125 aa, Corynebacterium glutamicum
MTQTTTQIIIQILLLLATAALALYFLRNRRKARAKAWVKIGFVVFIFAAVWAVLRPDDLTQLANFVGVDRGTDLMLYALVVAFMFTTLSSYVRFREQELRYSKLARAVALQNVVLPEDSQGSDPA

SEQ ID NO: 3864 - protein, 253 aa, Corynebacterium glutamicum
MAPNRKISHHALGSIPIMDASKNSDFKDTWLVVPCYNEATVIREVLENALKTFPNIVAVNDGSPDNSAEEIHAAGAHLVNHPVNLGQGAAIQTGIEYARKQPGAKYFVTFDADGQHQVKDVIRMVERLRAEDVDIIVGTRFGRPRQADDQVPLIKRLVLRTVVLLSPKTRRLGLTDAHNGLRVFNQKVAQEMNIRMNGMSHASEIVDQIDERGWRISEEPVDILYTEYSMSKGQSLLNGVNILADGFLARRLP

SEQ ID NO: 3865 - protein, 343 aa, Corynebacterium glutamicum
MIVMKSIDLEQLAGTQSRTYQSRKITDEMVARPVHVAIALWEVPWESAKSGKIEGWVIAVDSPRGRFVRSGQTKNGDAVNRTVSMLKSALKGVRGKAWIVTGRRQAALRAALVRENYLVTGSFAEQNRAGVKASAISRRAEQSALYKAKKIGEFAERAPRVKERQEAHWWPRLSRTQGTAGVLRLATDASTDGVFRGAMCFVASNGDYLLETQDTTASSDELELESITHALIYLKTIGATQAIIESDSKAALEAIDFILNNRPRRGRWRGITACARNRFRDAWEALIDDCVVELSRVLGHAGDPLNQAADQIAYMGMRAVIFEQKSAHPTLLKGIDKALRKAE

SEQ ID NO: 3866 - protein, 345 aa, Corynebacterium glutamicum
MSNKRIGVVIVSYGHEQDVANLVDTFADQLKTGDRVVVVDNRKPWVLKDAVGERLEKHGAEIINHDNGGFAAGCNVGAAHIVDDVDLLFFLNPDTVIDDPTLFNSLRRVDEQWAAFMPYLLLPDSTINSAGNALHISGLSWVTGLDEKPVEGSSEVTDISIASGACLAVRVDWWKRLGGMEELYFMYHEDTDFSARLLLAGGRIGLLHSAYVTHHYDYAKGDYKWIYIERNRHVLLLSVLPLPLLFVLIPQILGVNLGLWAIAAKEKRVGLKVKSLRLLIRDLPAIFKLRRSTQELAELTPSQYLAKMEWRLDNPNLGNIGSNKIVATGYKTYYKLCMSILKLLA

SEQ ID NO: 3867 - protein, 694 aa, Corynebacterium glutamicum
MKRLSRAALAVVATTAVSFSALAVPAFADEASNVELNILGVTDFHGHIEQKAVKDDKGVITGYSEMGASGVACYVDAERADNPNTRFITVGDNIGGSPFVSSILKDEPTLQALSAIGVDASALGNHEFDQGYSDLVNRVSLDGSGSAKFPYLGANVEGGTPAPAKSEIIEMDGVKIAYVGAVTEETATLVSPAGIEGITFTGDIDAINAEADRVIEAGEADVVIALIHAEAAPTDLFSNNVDVVFSGHTHFDYVAEGEARGDKQPLVVIQGHEYGKVISDVEISYDREAGKITNIEAKNVSATDVVENCETPNTAVDAIVAAAVEAAEEAGNEVVATIDNGFYRGADEEGTTGSNRGVESSLSNLIAEAGLWAVNDATILNADIGIMNAGGVRADLEAGEVTFADAYATQNFSNTYGVREVSGAQFKEALEQQWKETGDRPRLALGLSSNVQYSYDETREYGDRITHITFNGEPMDMKETYRVTGSSFLLAGGDSFTAFAEGGPIAETGMVDIDLFNNYIAAHPDAPIRANQSSVGIALSGPAVAEDGTLVPGEELTVDLSSLSYTGPEAKPTTVEVTVGTEKKTADVDNTIVPQFDSTGKATVTLTVPEGATSVKIATDNGTTFELPVTVNGEGNNDDDDDKEQQSSGSSDAGSLVAVLGVLGALGGLVAFFLNSAQGAPFLAQLQAMFAQFM

SEQ ID NO: 3868 - protein, 54 aa, Corynebacterium glutamicum
MDAQGARSKLENRVVRVNRETGMYTSYEDAAWVMLESATTDKYDRQLVSVATNV

SEQ ID NO: 3869 - protein, 117 aa, Corynebacterium glutamicum
METPIDPHIYSLMQDRKVVRKKIALILGIYIIAVALLAYAISFIFDDGTRAVLGLILVVAAFIAGGIKFKEFMKIVDKSNRLTADIKTAQNSTAWKALQKQQEEQQRLIAEIFPEQQ

SEQ ID NO: 3870 - protein, 353 aa, Corynebacterium glutamicum
MSISVKALQKSGPEAPFEVKIIERRDPRADDVVIDIKAAGICHSDIHTIRNEWGEAHFPLTVGHEIAGVVSAVGSDVTKWKVGDRVGVGCLVNSCGECEQCVAGFENNCLRGNVGTYNSNDVDGTITQGGYAEKVVVNERFLCSIPEELNFDVAAPLLCAGITTYSPIARWNVKEGDKVAVMGLGGLGHMGVQIAAAKGAEVTVLSRSLRKAELAKELGAARTLATSDEDFFTEHAGEFDFILNTISASIPVDKYLSLLKPHGVMAVVGLPPEKQPLSFGALIGGGKVLTGSNIGGIPETQEMLDFCAKHGLGAMIETVGVNDVDAAYDRVVAGDVQFRVVIDTASFAEVEAV

SEQ ID NO: 3871 - protein, 285 aa, Corynebacterium glutamicum
MKGIILAGGSGTRLYPITKGISKQLMPIYDKPMVYYPLTTLIQAGIKDILIITTPEDSASFERLLGDGSSWGINLTYAVQPSPDGLAQAFIIGEEFIGDDDVALVLGDNIFDGAQLGHALKQCSNPDGGIVFAYEVSDPERYGVVEFDAANKAVSIEEKPTAPKSNFAVVGLYFYDNRVVDIAKSIKPSSRGELEITSVNDAYLQQGALTVQRLDRGDVWLDTGTIDSMSEASSYVEVLQKRTGNIIGSPEVAAYREGFITAEELTVLGEELKKSGYGNYLLRAL

SEQ ID NO: 3872 - protein, 453 aa, Corynebacterium glutamicum
MEYGKQLTSHTTDIEGLLVFDFPVHGDNRGWFKENWQRTKMTNLGLPDFGPVQNNMSFNATAGTTRGMHAEPWDKFVSVAVGSVFGAWVDLRAGSSTYGNVVTQKITPDVGVYVPRGVANGFQALEDGTLYTYLVNDHWSPDAHYANVNLNMIDWPLPITEISEKDKKHPALIDATPLPARKVLVVGAGGQLGTALRAQFPDAEFVTRQELDITSDLTEARAWKQYSTIINAAAYTAVDQAEHDRAAAWDINAAAVANLATIARDNNLTLVHVSSDYVFDGAAESYDENAPFSPLGVYGQSKAAGDIAATTAPRHYIVRTSWVIGDGNNFVRTMKSLDERGIAPSVVDDQIGRLSFTEDIAAGIAHLLEVGAAYGTYNLTNTGEPASWADVARAVFSDPTKVTGVSTAEYFANKDAAPRPLNSVLDLGKIEATGFSAPTWQTRLNDYLKELSK

SEQ ID NO: 3873 - protein, 377 aa, Corynebacterium glutamicum
MLPDSLMNSRSTLVVCRIGASTTATNSASSPGRTKVDGMTSLLVTGGAGFIGANFVRQTVEQHPEYTHITVLDKLTYAGNADNLKGLPDSKVTLIEGDICDAELVDSLVKDHDITVHFAAESHNDNSLNDPSPFVHTNLIGTFVLLEAVRKHNKRFHHISTDEVFGDLELDDPNRFTETTAYKPSSPYSATKAGSDHLVHAWIRSFGIQATMSNCSNNYGPYQHIEKFIPRQITNILAGLTPKLYGTGEQVRDWIHVDDHNDAVHLILSKGKIGETYIIGADNDHVNNKQVIELICELMGLDKNAYEHVADRPGHDMRYAMDSTKLRTELGWAPKYTDVDSGMRKGLEQTIDWYRENEAWWRPAKNNVEATYAKQGQ

SEQ ID NO: 3874 - protein, 193 aa, Corynebacterium glutamicum
MSLSVVEAITNRRATRKYTDEAPTPELIDKIVDLALEAPSAFNAQQREIVVITDPAQKQKLYEASHQKQFLTAPVTFIAVARVENEPEDLEEILGTERAERVAGFINGRSIQQAREATLRDASLAAAFLILAAQAEGLSTSPTTGWDEEKVKEAIGLGGREDRAIALVIATGFPNEQPEHPGRLQNRRIDNSY

SEQ ID NO: 3875 - protein, 315 aa, Corynebacterium glutamicum
MHFCLLPLAKPAKVVAPLLGVALLLSSCSSTSSDESIQPEVASTGYSVEHAMGTTEIPETPTRVVVIDSPHLDALLALGITPVGATESGSENGFPAYLADELKDTESVGLTSEPNLEKIAALDPDLIIGAKVRHEAIYDQLSDIAPTVMSEGSGTNWNEQAEITAAAVNKSDEMDKLISDLDTRATELGEEIGADGQTASMVRFRTDNFRLYGPETFSGSVLEQVGFDLGERDWNEYSMMELSSENFGQIDGDLIFYTIPGSPEATTYPKISELWVDSPAVRQGRTYEFEDETWMVGIGVLGANEILDDLEETLS

SEQ ID NO: 3876 - protein, 213 aa, Corynebacterium glutamicum
MLPNRLFLRLFALIALIGVVTGGILLLINSQNGEQTSSSTRTTVNDSMVIRALQREEEIVLLSAGALGIHEKTVERTIRGKRIPGTQKTVHVQYSYTGKLGIDASDVEIKSAGDNKLSITIPEFIFIGYDDLKFKTIAEDDGWISFSTDDIDTAEVVSEIMSQENFVEQVTTNREMLEDQAVDFYNDLLHEFTEKLDTDRYEDTKIELEFEFE

SEQ ID NO: 3877 - protein, 436 aa, Corynebacterium glutamicum
MAVLASRSGVAGVSFWWFGLVRYLTLATIIAGLSGFVVIIIAAWALGDSSQLSEEFTAYWGLFFAGTGVLTGLTQETTRAVTAGSRGGSRGGRAGSVVGFRPFLFSFVVAAIVLVVLGASAPLWIGQLLSNLQGVGVGLLAVGLASYAIQATISGILSGCQLWKEYASLISLDTGVRMVLAVAAWLLGYQLLAFLIITVVGSISWLVIVLCFGSVRSVLGSVADVSRGVFIRQALLAMAASGATAVLITGFPTLLKFTNPSAVAGGVSMAAVSYAVILTRAPLLVPLQQFQSAIIVRFVKGTSGPLKTLAGPLAIVWAVGLVGAGLAWLVGPWILDVVLQKELFAVPGWLLAMLTLGATTTASLMVSGCAAIAFERHGIYLTGWVVATVVAVGFLLGPFDLGVAAGLALIVGPLCGLLVHMGAFVGGDRNRVLTAG

SEQ ID NO: 3878 - protein, 460 aa, Corynebacterium glutamicum
MIMRRLRSTPVPGTRDSYTGIDFNLGFHIRRYELDLTYRVAPNLLMGTATLHMDNYRALDALTLDLGGSLRVEKVTAKGTAGTHIQVARFRHAGRKLRITFRNQIPVDQEFSLTIRYRGNPRPLRSEWGMIGWEELDNGALVAAQPNGAPSWFPCDDTPDEKALFDVHFHTDNGYAAIITGDLISKHVSGSMTTWHYQSREPMATYLAAVHVGEYDTVSLGVSESGVVVEAYVPVGDAALRARILEDFAKQVDMLDAYEKLFGPYPFRSYRVVITEDELEIPLEAQGLSSFGANHATGEGTWERLIAHELSHQWFGNSLGLAQWNDIWLNEGFACYAEWLWFEAAGVKSAAESALEFYRGLEALPKDILLANPGAKDMFDDRVYKRGALTVHALRELLGDDAFFKAVRSYVAEGRHGLVEPRDLKRHLYAVSTDHAALDAVWQSWLRDLELPEFPSGGLD

SEQ ID NO: 3879 - protein, 706 aa, Corynebacterium glutamicum
MKTAGTTRFTFTSADPIGGALGSRLKKPAGQKITNLNFMTDYTFLEDIDTPEALAWAEKWSGESVEKLKSPAKDALEARLLAALDTDDRIAYVSRRGEKLYNFWRDAQHPRGVWRTTTLESYESDQPEWDVLIDVDALAEDEGENWVWKGAVVRSPEFDRALVKFSRGGADATVIREFDLATAAFVDDSPFELEEAKSDVTWVDLDTLLVGTDTGEGSLTDSGYPARVLTWKRGTPLEQAELFFEGSRQDVATHAWRDSTPGFERTFVSRSLDFYNSETSLETEGGLVKLDVPTDCDVIVKKQWIFVSPRTDFAGIPAGGLGVLLLKEFLEGGRDFQPVFTPTESTSLQGLATTKNFLVLTLLNNVSTEIVTVPLNDPTTEHEHIDLPEHVTAHVVATSPLDGDEIWVQAASFTEAPTLLRAELPGALEAVKKAPLQFENAGQETRQHWATSADGTKIPYFITGAFEEEPQNTLVHAYGGFEVSLTPSHSPTRGIAWLEKGYYFVEANLRGGGEFGPEWHSQATKLNRMKVWEDHRAVLADLVERGYATPEQIAIRGGSNGGLLTSGALTQYPEAFGAAVVQVPLADMLRYHTWSAGASWMAEYGNPDDPEERAVIEQYSPVQAVVGVEKRIYPPALVTTSTRDDRVHPAHARLFAQALLDAGQAVDYYENTEGGHAGAADNKQTAFVESLIYTWIEKTLDQQGSI

SEQ ID NO: 3880 - protein, 191 aa, Corynebacterium glutamicum
MTARAKMIGMRKTLITMLATTAIAFSAISPVQAQTVDTDTDASVSSELSSGTSSGSSEDSEDSDISNRDIIFGIAAIAAVGGLIASGVHWAVQQRMIPNPLPGIIPNPPALAPQAPAPAPAPAPAPQAVAPQVVAPQVVAPAPAPVQTNRTYKNCTEVWNVLGRSIRQSDPGYGTHLDRDRDGIGCESRPR

SEQ ID NO: 3881 - protein, 364 aa, Corynebacterium glutamicum
MAEITTPLMEKIRSPAVQSDALQVFKSALAATVTWWISVNLLNSQLPFLAPWVALMTMQFTVYHTFISGIQTAIASVIGVGLSFVIGTYLDVSVWTFGLAMVIGLIGARVPKLRAEGIGIATTSIFLLASGFDDQQPLLYDRILEILLGVAVAIAINLIIFPPLRDQEANMVVGNLDRRMGEVLQKMADELAEKWNIDNADEWLEEINSINNDLEKAWHSVRFARESRRVNPRKIRIQEGRPQPTETSYESNLTSIDEGIAHLRHLARTLRDTPIIDSDWDPVFQQQWVSLMHDAGALLADPNQEIDPIRDRLSKLSSEMSEDQQLTSKKWPIYGSLLTSLFHLSALADDALTTRKTEDKEHNS

SEQ ID NO: 3882 - protein, 365 aa, Corynebacterium glutamicum
MKLLRRIAAPAIALGIAMSTIVTPSTAGAAEVTPADVAGDTALSTISDSAPADEASAPRWRAHVNAADERVKEMWAYSPSMDRNVPLVVITADESAGPRPVIYLLNGGDGGEGAANWVMQTDVLDFYLEKNVNVVIPMEGKFSYYTDWVEENASLGGKQMWETFLVKELPGPLEEKLNTDGQRAIAGMSMSATTSLLFPQHFPGFYDAAASFSGCAATSSLLPWEYLKLTLDRGNATPEQMWGPRGGEYNIYNDALINSDKLRGTELYVSNASGLAGEWESVDSPRFEGLNQQVQSIAMAETVVTGGIIEAATNKCTHDLKAKLDSAGIPADWNLRPTGTHSWGWWQDDLRGSWTTFARAFELEA

SEQ ID NO: 3883 - protein, 478 aa, Corynebacterium glutamicum
MELREYATILMKNWVLIVIASILGIAAGAGFSLLATPEYQSRTQLYVSVRSGAGTTSDMVQGANFSRQIVNSYVDVIKTGVVLEPVVDELGLELTANQLSSHISAASPADTALINITASSPSPQQAAEIANAVGESFKNVIQTELEPDSGDGMSPINLTTTQVALEPSSPVSPNVMMNILLGLLVGLAIGVGIAVLRAALDTRIHSLRDIEEVTDKPLLGGIIADSEVEKHPLIIKHKPHSPIAESFRALRTNLQFLNVGGSSSVFVISSANPGEGKSTTSVNLALALAEAGSRVALIEADLRLPRVSKYLGVEGNAGLTDILIGKAEVNDVLQRWGRTQLYYLPAGRIPPNPSELLGSAEMEKVIAELEESFDYVIIDAPPALAVTDAAVIGHGKAGILIAVSAGSTKKPELEATLSTLENADANVVGVVATMLPPKSVAGYGYGNYGYGDTSKINAPKPDNTELTTTDASKANNEQ

SEQ ID NO: 3884 - protein, 201 aa, Corynebacterium glutamicum
MSNSFTILTVCTGNICRSPLAKQLLELELPGADIIRVDSAGVQAMVDSPMPEQSLEIARKQGIENPEEHRAKQITEELVNQSDLILAMDRGHRKSIVQLSPRATRKVFTVVDLARLIEATTDADLQEELNLAGDSVIDRLHATVEAARLSRSELNPLDNLADEDIVDPYGKSQSVYEASASQLIPAIRLIASYLNKALESA

SEQ ID NO: 3885 - protein, 328 aa, Corynebacterium glutamicum
MARKYRVGQRQRGWSIWLSILVIVVLLVGAGALSVFALKSVKENDKNEGFSTTKAASVEQISSETSEESPEEAPAEISESEEISAEQASLPLVAPQRQIAQFENLAVRSQVGTCTDPGTLEISTDGGQAWSTSASFTATTATQVLRLIPVSTSNIFVVALNADCEPRIYGTTDQGATWQQPVSAVGTWYLDPSNPTQLTAPGGAKAISCEAISIAPRTDSNVDVLCADGSLTSTSDGGASWSEPVAGAGVFNVAHSNGDWLLIAQDPDQCTGIQLSDTLPVAEGATCVHAELGESDAGQIAATQFGDSVLAWVGETQFISKDGGQTWQ

SEQ ID NO: 3886 - protein, 604 aa, Corynebacterium glutamicum
MAISIGKAGQNLKGSVPIGKVLFLIDALAWISALFIGVVLRYEFNLSSINWSAFAWFGLAAVILQFVLGLSLHLYRKGLRHLFGSFEDTLNVSISVIVVGVVLWIASLFVGQRWEISRGVMLLVIPLALVFVLAVRYLARMRVERLRRPAADSTPALILGGGYIGTNLIQWMMSDPKSPFRPVGVIDDNPELAWQRVRGVPVLGKFDDIAQVASDTGAELLIVAIGDADSALLRRVQDTANKNGLSVKVMPAIDRVVSKGVRGNDLRDLSIEDLLGRQPVETNVSEITGYLTGKRVLVTGAGGSIGSQLCTEIAKYGPAELMMLDRDETGLQQVLINVAGNGLLDTDAVVLADIREADAMKEIFLKRKPEVVFHAAALKHLPMLEQYPDEGWKTNVLGTLNVLAAAEAVGVETFVNISTDKAANPTSVLGHSKRVAEKLTAWYGQNSTSKYLSVRFGNVIGSRGSMLPTFTRLIMEDKPLTVTHPDVTRFFMTIPEACQLVLQAGGIGRSGEVLILDMGEPVSILEIAQRMIAMSGKDIDIVFTGLREGEKMHEELVGDGETEDRPFHSKISHAHAESLAPNNLDRDRFMQRAGKLASTDSEII

SEQ ID NO: 3887 - protein, 314 aa, Corynebacterium glutamicum
MISESVEASFPARCINRSLSRLLGARLSACACEIFEWNGRSSVSPSPTSSSCIFSPSRRPVNTMSISLPDIAIMRCAISRMLTGSPMSRMRTSPERPIPPACRTNWQASGIVMKNLVTSGCVTVSGLSSMISLVKVGSIDPRLPMTFPNRTDRYLLVEFCPYQAVSFSATRFECPKTLVGLAALSVEILTKVSTPTASAAARTLRVPRTFVFQPSSGYCSSIGKCFNAAAWKTTSGLRLRKISFIASASRISARTTASVSNKPLPATLIRTCCKPVSSRSSIISSAGPYLAISVHSWEPIDPPAPVTRTRLPVR

SEQ ID NO: 3888 - protein, 385 aa, Corynebacterium glutamicum
MTNERIFLSSPDVTQLEEDALVRAIRSGWIAPLGPEVDAFEQELAEYCGRKYVVALSSGTAALHLGLLALGVGEGDLVLTSSMTFAATTNAIVYTGAEPIFVDCDESGNMDPDLLEKAFAELKSEGKEVKAVVPVDLLGKVVQHEKIKKIADEYGAVVLSDAAESLGAIRNGKSAAAYGVAAAVSFNGNKIMTTSGGGALLTDDKDIADNVRYLATQARQPVVHYEHTDVGYNYRLSNILAALGRAQLSRLDKMIERRRQHRAFYRELFAGVSGVEIFGEPSGVDGGDTIDNFWLTSILIDKEVAGFSSEDLRSVLNQANIESRPLWKPMHLQPVFKKYRSFTNEEGQRLFDSGLSLPSGSVLDNASMNRVETTIGQFLESQHAI

SEQ ID NO: 3889 - protein, 204 aa, Corynebacterium glutamicum
MRSKYKNYGVVKRAIDIGVSGVGLIISAPIQLAIAAVVLRAHGRPILFRQPRPGKDGVVFEMIKFRTMLEPDEKHVTDEQRLTKVGKLLRETSLDELPTLWNVFKGDMSLVGPRPLLVSYLEHYSSEQARRHEVRPGITGLAQVNGRNQTTWDERLKLDVEYVDRCSLKLDFKILIATVKTVLSKKGISNEGHVTMPSFIEERK

SEQ ID NO: 3890 - protein, 387 aa, Corynebacterium glutamicum
MILRNRSRCRSSRENVILFGATTDMSNIFYEGILQNLIQDGWDVHLVSNPGPVGKKLLNGKAHTIEMSREISIGTDVKSLFNWVLLLRKIRPRVLIVGTPKASLLGVVAARIARVPRIVYVAHGLRSETVLGLKKKILVFLEYLTQLFAHQTLAVSHSLKKAIEDAHPRFKGRVQVLGYGSMNGVELDRFRVPSLEEKLSARNALNLPSKSVIVGFVGRINKDKGGDLLAALTKHEAFTRLRLHLLIIGELEDDDLREAFIKLVNEGQVTITGWIDFPEEPLAAVDVLLHPTQREGLGMSLLEAQAMGVPVLTNAVTGTVDAVTSGEGGFFADDDSVESWVSKIDLLVSDPKLRDRMGRAGRQFVSARFNRDDVAARFSHFVEQFKK

SEQ ID NO: 3891 - protein, 497 aa, Corynebacterium glutamicum
MANTRDEATEVPEDGSLRKGAARGSAITLVGQITRILIQLLSVILLARLIPPADFGLYAMVLAVSGVAQIFLDLGFSMAALRSRDLTKQQHSNLFWINTSAGFLLFIIIFSLAIPLATFYGDDRLIRVTQWISIVYLLGGITAQFRVHLNRHLRFGALSLADVLAPLVALVVAVIMAMKGYGVQALVVQTILNYLVMLVLVVVMARWVPSFPRKTPGMKPLLTFGMGLGATRFLSYLTQNIDSIIIGRVMGPVQLGFYDRAFRLAVAPVVQISFPFTRVAIPFLVRVMDDGKKYVAALREAQMVGIYGTASFLLVFGGMATPIVTLIFGPDWVEAGLLMTILCIGAIFRTLQQVATWVFMSKGLSGALLKLNLVMQPVIVLLIIGGARWGTVGVAWAGTLGYFLFWLVSIAWASYATNLNLWSLVTNPLEIIGKFSLPAGLITFAISSNSSLSLLTQFLASIGGALIWFVFIYCISKKIKKDIRRLVGIGMLVLKRR

SEQ ID NO: 3892 - protein, 438 aa, Corynebacterium glutamicum
MYAEINGGFIPEGTVRVSGAKNSATRLLAAALLTDEVVHLGNFPTKLVDVEHKIRFIEELGGKVHVDHDEQILVVDAKDLAAREMTTDELNIPIRTTYLLAAAQIGRGEIARVPFPGGCAIGGGPAGGRGYDLHLMVWEQLGCKILEKDDHIEVTAPQGFIGGVIDFPISTVGGTENALLCASIASGDTKIANAYITPEITDLIELLRRMGAEITVYGTSRIHVKGRAGLLQGAYMDVMPDRIEALTWIVYGIISGGRITVEGVPFSSMEVPFIHLEKAGVDLFRNSSSVYITPECLPSGSVQPFELACGTHPGVISDMQALFVLLGLKGAGTSRVYDYRYPERIAFVEELTNLVSGDKLSAEAGKITIQGDATFRPGYANSTDLRGSMAVVLAALCADGKSTINNVHMALRGYNELDKKLRLLGADLTIREGEVPSP

SEQ ID NO: 3893 - protein, 335 aa, Corynebacterium glutamicum
MNDFKKVSESLETALRNEFDFRFATEVSLKEISRWRIGGPAAVFAEPSSINEICALLAFMKNRPEPVVVVGGTSNILFDSDGFGGLVIKLGENFSNFIIEGSRIRAQAGASVPQLVRAVATEGLEGIVHAGGIPGTVGGLVVMNGGTQRRGIGEHVTKVLVTDAEGSIRELNANELQFTYRNSVLKNSETTVLEVELLLKPGNAGELLAELETILDQRSQKFPEDLPNCGSTFLSDPAMYSIVGPPGKAIEDAGLKGLRRGSAEISMQHANFIVNHGDASDDDILWLISAVRKEVYSRTGFVMDCEVLYLSYSGDFRPAHEVADEQWPDIDLVRN

SEQ ID NO: 3894 - protein, 345 aa, Corynebacterium glutamicum
MPKVSVVTGFYNRCEHLERTIESILNQTYSDFELIVFDDASTDGTASRLLELKEKYDDPRFRFIIHEENKGFVKGLSEAISGAKGQYIAVQGSGDVSLPRRLELQVEFLDANPSVGAVGGAIYNIQEDTGTRNPQRFEKPIATFDDLLTSNPFTHGEVMYRLDLYKSIGGYRSGFTFAQDRDLWLRMAKKADLGIIPDFLYHRYTLLDGVSFVPDKTIRQRCFSEAAVRLALMPEEEGALAYSRLEAEGPTAVVPIADRAVQKFVPKAAIRLCLYGAPETGLHMARDYIQNPLRRTIVVVLISIYSSRLIKPLQDILYKSIFKGVSISKPIKSSLVKFTRRIQGK

SEQ ID NO: 3895 - protein, 50 aa, Corynebacterium glutamicum
MSVSATAKALKIGWELVNQVALDACRQLIYNDPRHLEVDEHVWKYTRKPG

SEQ ID NO: 3896 - protein, 45 aa, Corynebacterium glutamicum
MTWKNYFTQWQKRGLVMLWATDDDYVALDLTWLFYQDMIAAYGNP

SEQ ID NO: 3897 - protein, 109 aa, Corynebacterium glutamicum
MVVLSRHDCGVWESVEIRGKEADEKGINSLRKGLPARMDELAQLGHTLWRRRKNVLASFNIGASNGPVEAINGRLEHLRGITLGFRNLNHYILRCLIQAGQLQRKINVL

SEQ ID NO: 3898 - protein, 92 aa, Corynebacterium glutamicum
MTSTTSSTMIFANSSDLEYIDLPLQLSGLDQAPQDVVVEVPEPQGDPAQVLKSAVDGLDRSVGCTDIEGRQHVLTPTPQGVPQLGKLVHSRW

SEQ ID NO: 3899 - protein, 390 aa, Corynebacterium glutamicum
MIVVGIYYFNGEMHFWQGLLIIGFSFIPAWLSYHFIENPMRNWSAIKADARKAVAFGVILMTVSATAGILLFLSPNRSQAAPPQFSLTPYDPTAVNKESEKEAAKNLFGAEALTVDPDAGEVVDRVDNFYPTTAKAKRDYPSNYAAGCHQEVNETSPESCVYGDKNSDFSVALVGDSHAGHWLPALEPIAEAQGWRLEVYTKSQCPLISTAIKLGETFYAECYEWNEKLLAKLTGPSAPNHVIVSSQRYASANPLIDSVATGTVSEGYEMAWNSLKDAGVSISVLLDTPRPQIDIPECVASNRDNLSECSVHRSVALGTEAHPQQKTAAQNIDVPVLDLSNWICPEEYCSAVIGNVLVYRDSHHLTATYARSLSSALWNELVASNGEPFK

SEQ ID NO: 3900 - protein, 331 aa, Corynebacterium glutamicum
MTTSTATAKQQASKSHFRPDIQGLRAVAVLLVLIFHAGDGSVLSGGFTGVDIFFVISGYLITGHLIRSCLEKGKISLINFYAGRIRRILPAATAVLVFTALITILVLPDTRWMLIGAEIIASSVYLVNWLFASNTNYLNAEAAASPVQHYWTLSVEEQFYILWPALLIGLLYFSRHRFTLDSEETSGTKLNKVRWLQRYIALAAVLITLVSLCFSIYFSYTNPAPAYFITSTRLWELGIGAILASFSFQLERISAPIGYALGVMGLASIVAAGVTFDSQTVFPGYAALVPTLGAAAVIIGGMGGRAEKGVGVLLKVKPMRWIGDLSYSLYL

SEQ ID NO: 3901 - protein, 77 aa, Corynebacterium glutamicum
MLWVSVRIIRWLQSFNAAFKREVPRRIPRRLRTSWCAVGRYLKWCTRYNTSLRQSWCGHLTPAMYEIRGSAILKSAS

SEQ ID NO: 3902 - protein, 387 aa, Corynebacterium glutamicum
MKIAVAGLGYVGLSNAALLSKNHKVVAVDIDEERVKLVQEFRSPIVDSDLEEYLSTKPQNLTATTDAEAAYKGADFIVIATPTNYDPESNFFDTSSVESVIEIVLKVSPGSTIVIKSTIPVGFTSELRIKHPEASIIFSPEFLREGRAFYDNLYPSRVVVGDRSPLGEEFATLLAEGAKEKPPILLTDSTEAEAIKLFSNTYLALRVAFFNELDTYASVRSLDTKQIIEGVGLDPRIGSHYNNPSFGYGGYCLPKDTKQLLANYKDVPQNLISAVVQANKTRKDFIAEDILSKSPTVVGIYRLVMKSGSDNFRSSSIQGVMKRIKAKGIEIVVFEPNLGEETFYNSKILNDIEEFKDYCDIIIANRPTDELSDVPEKVYTRDIFQRD

SEQ ID NO: 3903 - protein, 91 aa, Corynebacterium glutamicum
MVTIVKHLSGHHEAVPTPASISKKRFNARWLSTAYAVFGYVVPVFCAAGVLYRDVVHKVVIEHTTYAESQYRLLRIVGFKESADQFRSSAF

SEQ ID NO: 3904 - protein, 403 aa, Corynebacterium glutamicum
MLREPLAVGSLIFLATILILSLPSFVAGLIVGVWHSLPGIAPSLAGFALTIGVLVLCLLILIFRKKKFPDASIFTKYSGFLSLIPAIFIIEWINNESASETRTLLGAIVTGFLFLVTSSFRDNIPHIIWGFSTGVSIYGVGELLRIAGGGALHLKAGAFGANPIFASQFLGLAIFGVWLLHITKRSTPKFTLFVSSILLVCLLSALSWGPIIALAVAFLYANTTKSSTHRLQDYRVRNRIIVWGPLLVGPVIILSRDAIKSFYYSEDSVARLHIWQEFIDLALTSPLTGVGMEKVHSFYSISSSDKFLSPHNLFLEMWVAYGALPIFILFATLIYLFRKINYLGRASLIFLVICSSVSGSLAVSFNFWIGLTLVVIIGSSSLASTNQNAHSSKSRKVNKQPAK

SEQ ID NO: 3905 - protein, 274 aa, Corynebacterium glutamicum
MTSSAPLISVVIPTIAYDEYCSQSIKSVCEQNYENWQIVLVLDGAPIKDVPQWVKEHERIKIVEQKIRQGTPTSLNNGIKASDGQLIARLDSDDLAAPSRLSKQEEFLRNHPYIICVATKTKHINEHGKIFGQSADLPTSQDIRQILLVKNPIIHSSVMYRKQVVEQIGGYSLEMTRSQDYELFLRLSKIGAIGYLDESLSSYRIHGGQHSRKTSPFKKYTWIILKRRMELASFLKRSPVRQIFLNFIWYGAQVTRYLGLRKAGFMTGYTPDRI

SEQ ID NO: 3906 - protein, 215 aa, Corynebacterium glutamicum
MVAQNSVVVIGASGFGRESLDVLEAMKEAGHSLEIIGVVDDNPAAINLQRLAERKIEYLGTLKEWIEGSPKSCKYVLAIGNPTIRHKLSALLDKSGFDAFTAVHPSAVIGSQVVFGSGAVVCSGAVISTNVRLGVHVHINPNVTIGHDSILEDYVSINPAATISGEVLIMEETLIGAAATVLQGLTIGNRSLVGASSCVTKDISAGKVVKGIPAR

SEQ ID NO: 3907 - protein, 65 aa, Corynebacterium glutamicum
MHPGAVGFPYLILEWKKMKNTHIRAQMGTEMQVFYVRSKHRAVLEQADAVGKITECGGSSMQAVT

SEQ ID NO: 3908 - protein, 469 aa, Corynebacterium glutamicum
MTEHYDVVVLGAGPGGYVSAIRAAQLGKKVAVIEKQYWGGVCLNVGCIPSKSLIKNAEVAHTFTHEKKTFGINGEVTFNYEDAHKRSRGVSDKIVGGVHYLMKKNKIIEIHGLGNFKDAKTLEVTDGKDAGKTITFDDCIIATGSVVNTLRGVDFSENVVSFEEQILNPVAPKKMVIVGAGAIGMEFAYVLGNYGVDVTVIEFMDRVLPNEDAEVSKVIAKAYKKMGVKLLPGHATTAVRDNGDFVEVDYQKKGSDKTETLTVDRVMVSVGFRPRVEGFGLENTGVKLTERGAIEIDDYMRTNVDGIYAIGDVTAKLQLAHVAEAQGIVAAETIAGAETQTLGDYMMMPRATFCNPQVSSFGYTEEQAKEKWPDREIKVASFPFSANGKAVGLAETDGFAKIVADAEFGELLGAHLVGANASELINELVLAQNWDLTTEEISRSVHIHPTLSEAVKEAAHGISGHMINF

SEQ ID NO: 3909 - protein, 307 aa, Corynebacterium glutamicum
MSLPIAQHQNAVKTVVVPAAGMGTRFLPATKTIPKELLPVVDTPGIELVAKEAADLGATRLAIITAPNKDGILKHFEEFPELEATLEARGKTDQLNKVRAARELIATVPVVQEKPLGLGHAVGLAESVLDDDEDVVAVMLPDDLVLPFGVTERMAEVRAKFGGSVLAAIEVAEDEVSNYGVFKLGELDAESESEGIRRVVGMVEKPAPEDAPSRFAATGRYLLDRAIFDALRRIEPGAGGELQLTDAIALLIEEGHPVHIVVHEGKRHDLGNPAGYIPAVVYFGLRHAEYGSKIHRAVKEILAEFES

SEQ ID NO: 3910 - protein, 166 aa, Corynebacterium glutamicum
MAKKVDTSNATPALALLTERQIPFELDVHDVDPKSSKGFALDASEVMGVEPEVVFKTLMADIDGEHVVAIVPASRTLNLKQLAKAGKGKHANMMDRSRAQVVTGYVPGGISPIGQKNKHRVFLDESAILQERIYVSAGRRGWSLIIAPDDVLLATDGVYADIADHS

SEQ ID NO: 3911 - protein, 474 aa, Corynebacterium glutamicum
MGKTYVGSRLRQLRRERDLSQASLAATLGLSASYVNQIEHDVRPLTVPVLLRITEAFGVDATFFSRDDDSRLLAEVQDVMLDREINPANVELQELSEMVYNHPQLARAMVEMHQRYRNVRDKFSIAVDNRTNTPEERRPIAEAVSMPHEEVRDFIYARQNYFDALDRRAEAIAAQLGWQPYDSRAMEDSIARRLQMDHDVTITSSKEESGTLHHFDPETRLLTIHARLNPGQRAFRMATELGYLEANDLIEGIVDDGIWSTPEARTLAIRGVASYFAAAVMLPYKIFHSEAEKSGYDIEYLGQLFGVGYETTAHRLSTLQRPNLRGIPFTFVRVDRAGNMSKRQSATGFHFTHYGGTCPLWNVFETFTNPGQVLRQFAQMPDGRNYLWISRTVRHHEARFGEVDKMFAIGLGCEARHADRTVYSRGFNLQDLSTATPIGSGCRVCTRENCAQRAFPSVHGRINIDAHESTIAPY

SEQ ID NO: 3912 - protein, 257 aa, Corynebacterium glutamicum
MTVRNPDREAIRHGKITTEALRERPAYPTWAMKLTMAITGLMFGGFVLVHMIGNLKIFMPDYAADSAHPGEAQVDVYGEFLREIGSPILPHGSVLWILRIILLVALVLHIYCAFALTGRSHQSRGKFRRTNLVGGFNSFATRSMLVTGIVLLAFIIFHILDLTMGVAPAAPTSFEHGEVYANMVASFSRWPVAIWYIIANLVLFVHLSHGIWLAVSDLGITGRRWRAILLAVAYIVPALVLIGNITIPFAIAVGWIA

SEQ ID NO: 3913 - protein, 625 aa, Corynebacterium glutamicum
MNLVSPLNRRKFRVLVVGTGLSGGAAAAALGELGYDVKAFTYHDAPRRAHSIAAQGGVNSARGKKVDNDGAYRHVKDTVKGGDYRGRESDCWRLAVESVRVIDHMNAIGAPFAREYGGALATRSFGGVQVSRTYYTRGQTGQQLQLSTASALQRQIHLGSVEIFTHNEMVDVIVTERNGEKRCEGLIMRNLITGELTAHTGHAVILATGGYGNVYHMSTLAKNSNASAIMRAYEAGAYFASPSFIQFHPTGLPVNSTWQSKTILMSESLRNDGRIWSPKEPNDNRDPNTIPEDERDYFLERRYPAFGNLVPRDVASRAISQQINAGLGVGPLNNAAYLDFRDATERLGQDTIRERYSNLFTMYEEAIGEDPYSSPMRIAPTCHFTMGGLWTDFNEMTSLPGLFCAGEASWTYHGANRLGANSLLSASVDGWFTLPFTIPNYLGPLLGSERLSEDAPEAQAAIARAQARIDRLMGNRPEWVGDNVHGPEYYHRQLGDILYFSCGVSRNVEDLQDGINKIRALRDDFWKNMRITGSTDEMNQVLEYAARVADYIDLGELMCVDALDRDESCGAHFRDDHLSEDGEAERDDENWCFVSAWEPGENGTFVRHAEPLFFESVPLQTRNYK

SEQ ID NO: 3914 - protein, 279 aa, Corynebacterium glutamicum
MGTRRERNLRPPRRTTVLRIRPTADKELQVMKLTLEIWRQAGPTAEGKFETVQVDDAVAQMSILELLDHVNNKFIEEGKEPFAFASDCREGICGTCGLLVNGRPHGADQNKPACAQRLVSYKEGDTLKIEPLRSAAYPVIKDMVVDRSALDRVMEQGGYVTINAGTAPDADTLHVNHETAELALDHAACIGCGACVAACPNGAAHLFTGAKLVHLSLLPLGKEERGLRARKMVDEMETNFGHCSLYGECADVCPAGIPLTAVAAVTKERARAAFRGKDD

SEQ ID NO: 3915 - protein, 112 aa, Corynebacterium glutamicum
MNTMSSAKKKPAPERMHYIKGYVPVAYSSPHSSLERSATWLGMGFLLTALAGVGAVLFAVGANSVGQQQEHWVLYSIIGVVFAVVCTVLGTVLIIKGRAPYNRYVKETGRTQ

SEQ ID NO: 3916 - protein, 87 aa, Corynebacterium glutamicum
MTSTSNNTLSSIYVGERVLFCFCLEFPGAFIDSPQALENAESNPLWSQLPAVKNGQLCTTENLTPWILTGPAAAEIVTSDLEACFAA

SEQ ID NO: 3917 - protein, 210 aa, Corynebacterium glutamicum
MTSLHELLRREFELAYPISPSILLHDPISTNLPCLLSSETCLEVRGHNLSCCWSGEDPWGEVFRGTELTVFDCGELAPQWVAFGVFEGLGAVDEGSRELQAKTKQHPLPHINGRKGVVGGASQRTCIQKLLRTAGFLDVTVVRCSALDDQDGAQNCADNGEYNTDDAVEDPVFLLLANAVCADCEEDCANACQSSEEESHAQPGCAALEG

SEQ ID NO: 3918 - protein, 32 aa, Corynebacterium glutamicum
MLASVLAGVNVYGSENFVGLGSGYGGFFGGGC

SEQ ID NO: 3919 - protein, 113 aa, Corynebacterium glutamicum
MAEAARMRGEHSSVIQRTSSAASIWWVPRCVQLRMSSDFLNAVAASAFSERVSSATSAEPRCWAWLASMCFATSTALRSDLKFNAADGASSCEMRRRARTRSRESAGITPKIP

SEQ ID NO: 3920 - protein, 325 aa, Corynebacterium glutamicum
MPALSLERVRALRLISQLLAPSAALNFKSERNAVDVAKHMLASQAQQRGSALVALDTRSENADAATALRKSLLIRSWTQRGTHQILAAEDVRWMTLLCSPRILAASAKRRSSLSLDSAAVQRARDALTTAAEKSPVSRTQAYEIFRSVDVDPGEHRGQHLLRHFGGEGDIVQGPPIGTEDSFVLLDSICPLSLALNGDEALTEMTRRYFHSRGAATVKDLVWWTGLTVRDVKKGIAAVSSDGLIHSVEGPNGEEMWIPTWADDVTDAEVSDALALELTLPAFDEYLLSYTDRSHVMDPEHLFSIGPGKNGVFKPFKVVQGEALPV

SEQ ID NO: 3921 - protein, 417 aa, Corynebacterium glutamicum
MEAQRRKELRKHKAIATGLLIFAAAVYFLCRFVETRPGETAAWVGFVRAAAEAGMIGGLADWFAVTALFRHPLWLPIPHTAIIPRKKDQLGEALSGFVGDNFLNAQLITEKVSQARIPERAGEWLAQPENGEKVSREVGKLTANIVRAIDPSDAEAVIKSAVIDKLAEPTWGPPAGRLLEQLLAEGKAEPVVQELAQWLHKKALGSEPLIDRLLNERRPIWAPKFTAQLVSGKVYDEVIKFTEAVAADPNHEARKSLRRFLNKLAQDLQHDPGMIIKVEEIKRDIMGSGAIAQAAPTIWASASESLIESAEDESSILRRKIAEAATSWGQRLLVDDSLRHSLDTRITGAAAFLADNYAPEVTGIISETIERWDAEEASEKIELMVGKDLQYIRLNGTIVGALAGLAIYAISHILFGA

SEQ ID NO: 3922 - protein, 140 aa, Corynebacterium glutamicum
MSDAKDDSILSKWSNAASELSGAVSGVAKKLREELSEKETFSKLKTEASEAVDQAKSGSYLDAGKEFARDAGSIIKDAAKTVKGAVSDSDKNDVKSAFGNAVEASRDKFDDTLEKRKAKKDSPEPGDDDIIDGEVIPPQN

SEQ ID NO: 3923 - protein, 101 aa, Corynebacterium glutamicum
MDISMLNVITSYTIWAIFAIIGICGFVGAFLAATTREDAFEVADRQKKMVWVAILIASGFVLTALGPSIPILPWVAIIMIGLYWFDVRPQIKSILEGAGGW

SEQ ID NO: 3924 - protein, 226 aa, Corynebacterium glutamicum
MQVYTRFTSVDIEEQPSLREIKRQMTLEAIEDNATRLILERGFDNVTIEDICAEAGISKRTFFNYVESKESVAIGHTAKLPTDEEREAFLATRHENIIDTVFDLVINLFGNHDNSKSGVAGDIMRRRKEIRVKHPELAVQHFARFHQAREGLEHLIVEYFEKWPGSQHLDEPADREAIAIVGLLISVMLQGSREWHDMPQGTQADFQACCRKAIKNTFLLRGGFSE

SEQ ID NO: 3925 - protein, 68 aa, Corynebacterium glutamicum
MNGTTCHKARKLISKPAVAKQLKILFFLEVDFQNDITGQAGRRTSGNNNFKKWCTFGPHLSTIWCSSN

SEQ ID NO: 3926 - protein, 549 aa, Corynebacterium glutamicum
MTSQVKPDDERPVTTISKSGAPSAHTSAPYGAAATEEAVEEKTKGRVGFIIAALMLAMLLSSLGQTIFGSALPTIVGELGGVNHMTWVITAFLLGQTISLPIFGKLGDQFGRKYLFMFAIALFVVGSIIGALAQNMTTLIVARALQGIAGGGLMILSQAITADVTTARERAKYMGIMGSVFGLSSILGPLLGGWFTDGPGWRWGLWLNVPIGIIALVAIAVLLKLPARERGKVSVDWLGSIFMAIATTAFVLAVTWGGNEYEWASPMIIGLFITTLVAAIVFVFVEKRAVDPLVPMGLFSNRNFVLTAVAGIGVGLFMMGTIAYMPTYLQMVHGLNPTQAGLMLIPMMIGLIGTSTVVGNIVSKTGKYKWYPFIGMLIMVLALVLLSTLTPSASLALIGLYFFVFGFGLGCAMQILVLIVQNSFPITMVGTATGSNNFFRQIGGAVGSALIGGLFISNLSDRFTENVPAAVASMGEEGAQYASAMSDFSGASNLTPHLVESLPQALREAIQLSYNDALTPIFLALTPIAVVAAILLFFIREDHLKETHE

SEQ ID NO: 3927 - protein, 544 aa, Corynebacterium glutamicum
MTHETSVPGPADAQVAGDTKLRKGRAKKEKTPSSMTPEQQKKVWWVLSALMVAMMMASLDQMIFGTALPTIVGELGGVDHMMWVITAYLLAETIMLPIYGKLGDLVGRKGLFIGALGIFLIGSVIGGLAGNMTWLIVGRAVQGIGGGGLMILSQAIIADVVPARERGRYMGVMGGVFGLSAVLGPLLGGWFTEGPGWRWAFWMNIPLGIIAIGVAIYFLDIPKKSVKFRWDYLGTFFMIVAATSLILFTTWGGSQYEWSDPIIIGLIITTIVAAALLVVVELRAKDPLVPMSFFQNRNFTLTTIAGLILGIAMFGIIGYLPTYLQMVHGINATEAGYMLIPMMVGMMGTSIWTGIRISNTGKYKLFPPIGMVVTFVALIFFARMEVSTTLWQIGIYLFVLGVGLGLAMQVLVLIVQNTLPTAVVGSATAVNNFFRQIGSSLGSALVGGMFVGNLGTLMEERMPAAMAQLSPEEQAAMAAQGGLDSNELTPAIVNQLPTALHDAFAGSYNDALIPVFYVMMPLIGIALLLLLFIKQEKLRETTTD

SEQ ID NO: 3928 - protein, 304 aa, Corynebacterium glutamicum
MTPSSPEVRNRPSAAPEERQFVLTFGCPDSTGIVAKLSSFLAERGGWITEAGYFTDPDSNWFFTRQAIRAESIDTTIEQLREEFAPLAEEFGPRAKWSFTDTAQVKKAVLLVSKEGHCLHDLLGRVAENDYPMEVVAVVGNHENLRYIAENHNVPFFHVPFPKDAVGKRKAFDQVAEIVNGYDPDAIVLARFMQILPPDLCEMWAGRVLNIHHSFLPSFMGARPYHQAYSRGVKLIGATCHYATGDLDDGPIIEQDVIRVTHKDTPTEMQRLGRDAEKQVLARGLRFHLEDRVLVYGNRTVVFD

SEQ ID NO: 3929 - protein, 222 aa, Corynebacterium glutamicum
MTISRSTMAQILDYTLLGPEVTNSELAAFIDSAIELGVGTICVPNSMVNLTAKAQEAGIRVATVAGFPHGKTPALVKAAEARLAVQSGASEVDVVLDIAVVKEGDANRLLQEIVAIREAVPSPVVLKFILETAVVSDEAIVTAVNALIAAGADFAKTSTGFHPAGGATVEAVRVMASASRGRVGIKAAGGVKTWEDAVAFVEAGATRIGTSNAGAILEGAPE

SEQ ID NO: 3930 - protein, 50 aa, Corynebacterium glutamicum
MHPKASKAGKSTTDLNIPAGCGGFLHCPEARPPNRTSNPLNRPQLPISPD

SEQ ID NO: 3931 - protein, 299 aa, Corynebacterium glutamicum
MQGYFSAPFTPPQESVSSLINYSPQRAASQQNRSDFCIPRPLKRENPPQISTFLQVVVDFCIAPKPDPRIELRTLLTALNYPSVPIRTPNYSGAPSKMAPALEVPMRVAPASTNATASSQVFTPPAALIPTLPREAEAITRTASTVAPPAGWNPVEVLAKSAPAAINAFTAVTIASSLTTAVSRMNFSTTGDGTASLIATISCSNLLASPSFTTAISKTTSTSEAPDCTARRASAAFTNAGVLPCGNPATVATRIPASWAFAVRLTMLLGTQIVPTPSSIAESINAASSELVTSGPRRV

SEQ ID NO: 3932 - protein, 289 aa, Corynebacterium glutamicum
MKPIRFEDVQHEMNRRQFSAKYTRVVGTFWIKKEYAENPVVVADALLRRFPNGVIRGFTALIVRGYSLLDEPRTAEISVPRGASHVTVLLGKVVRHKMPEVHVVKGRRCVSVAQALLDEFPAMVLEQQVALVDHLVRQNEDLYKQLQQVKALKEVMRLVNPMAESRPESMLRVRLRREGIWGFEPQIPVECDGVTRFVDLGNPKLRIALEYQGAVHFEDAEKRSQDSRRVNELRAAGWVVIEVTWPDLADQARWGRLLTELRKQIGRAEEERKMRRTPIPMPPDPFRPY

SEQ ID NO: 3933 - protein, 100 aa, Corynebacterium glutamicum
MSNSECHTHGYIEEKQRYLARLKRIEGQTRGIHRMIDEEQYCIDILTQISAVNSALKNVAFGLLDDHLAHCVKEAADLGGDELDAKLKEVSDAIARFSKA

SEQ ID NO: 3934 - protein, 200 aa, Corynebacterium glutamicum
MAVTSVTDMVPVVTVPVLSRTMVSTFLVDSRISGPLINRPSCAPRPVPTRSAVGVARPRAQGQAIMRTATAAVNAGARPASVKTRCAISVAIAITMTTGTKTCEIWSTRRWTGAFLDCASVTSLAICDRVVSAPMRVTFTMRRPEVFSVAPVTLEPLVTSTGMDSPVSMDSSTAEEPSTTSPSVAIFSPGRVMKTSPSLS

SEQ ID NO: 3935 - protein, 755 aa, Corynebacterium glutamicum
MAQTPAKIPAALNFIDVDLGVTGMTCTSCSARVERKLNKLDGVEATVNYATESAQVSYDPSKVSPEQLIKTVEDTGYGAFTMASAAAESEEDNAPADSGQSRIDAARDHEAADLKHRVIVSALLSVPVVLVSMIPALQFNNWQWAVLTLVTPIFFWGGSPFHKATWANLKHGSFTMDTLVSLGTSAAYLWSLWALFIGNAGHPGMKMEMHLLPSASTMDEIYLETVAVVITFLLLGRWFETKAKGQSSEALRKLLDMGAKDAVVLRDGAEVRVPVNQLKLGDVFITRPGEKIATDGEVVEGSSAVDESMLTGESIPVEVTKGSKVTGATLNTSGRLMVKVTRIGADTTLSQMAKLVTDAQSKKAPVQRLVDQISQVFVPVVIVIAIATLIAHLVFTDAGLAPAFTAAVAVLIIACPCALGLATPTALLVGTGRGAQLGLLIKGPEILESTKKVDTIVLDKTGTVTTGTMSVTDVTAINYSETEILEFAAAVESASEHPIAQAIAKAAEHEQVTDFQNTAGQGVTGVVRGHEVRVGRPSSTLIDALLHPFQHAQKIGGTPVVVTIDGVDSGIITVRDTVKDTSAEAIRGLKELGLTPILLTGDNEGAAKSVAAEVGIDQVIANVLPHEKVQNVEALQAQGKNVAMVGDGVNDAAALAQADLGLAMGAGTDVAIEASDITLMNNDLRSAVDAIRLSRKTLGTIKGNLFWAFAYNVALIPVAAIGLLNPMLAGIAMAFSSVFVVSNSLRLRGFKARSN

SEQ ID NO: 3936 - protein, 150 aa, Corynebacterium glutamicum
MTFQNAAFPNLYPDVDPLTPIPITFGERLAACVAAGTIAFGAASGDLLITGVGLVLVLFATFVPASKTARRIRREARARFPQEGWIDEEITRNNRTSIFVPLIWFLIAAISFAIYRFVDATWGSIIAAVIAMTLTWFTPGMFPRRVDPYP

SEQ ID NO: 3937 - protein, 621 aa, Corynebacterium glutamicum
MRKRTLLFMKLAPRMRMRSPKTFAALASLALVIGLGQVPIAQAQTEYRTASDGSLNWGFRQSFRNYIQTGVAKGSITLGDGASDNGGNFAFTPRTNGTTVTSDSQGTVEFNGSVHFLGHQAEDKWILDTTMSDIKMVFNGSSAQLVVDLVAREFKGTTYDDIGEYIISDDIVLADVSLNSAADFSQDSIDLSGTTDLTAAGAQAFGGFYETGEALDPTGGSLTISSTTTAPSTSTTSTSASTSGGTADCSSGALGVVTTGTNDGMLGTIQEVNNTFAIWNNLIVNTERMFCNIDTLKARFDTDDSSDSATSATSGTTASTGTTAATTAGTTGTTGTASTASGTSGTSGTSGTAATVAGTTPTDNGVCTASGSLGVTQASAQWGVKASFQNYIRGSIANGSWTLNGVGFDNQQFQFSGNSGAVDAENKTGSINFPGSIHFTGHGGILDMQIANIEISFNGNSGELIADVVSSDMDGNSTNYGRTVVGTLNFSALNVSATEASGSASVSLSQSGSQAFADFYTPGTQLDPISFSATLGGDASCATGSTSTTGAAATANTDNTEGVAGEESTTPANQNSQFQIRQAAADSTGLDTTTTMLLILAAFVVAGGSMTRFTVGNPTGK

SEQ ID NO: 3938 - protein, 359 aa, Corynebacterium glutamicum
MNNAFRRTLTSVVLAASLALTACASWDSPTASSNGDLIEEIQASSTSTDPRTFTGLSIVEDIGDVVPVTDNASPALPVSLTDADGNDVVVEDVSRILPLDLYGTYSKTIAGLGLVDNIVGRTVSSTEPALADTEVVTTGGHTLNAEAILNLHPTLVIIDHSIGPREVIDQIRAAGVATVIMSPQRSIASIGDDIRDIASVVGLPEEGEKLAERSVAEVEEASTVVDELTPEDPLKMVFLYARGTGGVFFILGDAYGGRDLIEGLGGVDMAAEKGIMDLAPANAEALAELNPDVFVMMSEGLVSTGGIDGLMERPGIAQTTAGQNQRVLALPDGQSLAFGAQTGELLLRASRELYVQGGE

SEQ ID NO: 3939 - protein, 356 aa, Corynebacterium glutamicum
MKEVDVEKQKAGRVPGAIAKRRTVRIVLFVALGAIVIAASLWSILVGQYTIPIRDLPAILASGPTGAQTMAEQVVWQIRMPRIVLGLLVGAALGVAGALLQAVFSNPLAEPSIIGVTSGAGVGAAAVIVFNLTFLGTSTVAVGAFITAVITTILVYQLARSRGRVQVINLILTGIAINAVSGALTSFFIYIAPTSSREEIIFWQMGSLNGSQWAHVNVVFVIVTIGLVAAFGLGKQLDVLALGESAAGHVGLNVKKLRIIAIAVSTLLTAGAVAYAGLISFVGLIIPHLLRTVTGPANKILVPASALGGAALISVSDILARTLIPYADLPIGIFTALVGGPTFFIMLRRMMKKGVH

SEQ ID NO: 3940 - protein, 271 aa, Corynebacterium glutamicum
MAIVSLDNVTVSIEGKKLLDAVSLKAYPGEVLGLIGPNGAGKSTLLSVLSGDRLPDSGEVNVGGLDPATAAASDMARVRAVMLQDVSVAFSFLVWDVVEMGRRPWQKASTPEEDHEIIEAALAATSVSHLAEREITTLSGGERARVALSRVLAQQTPIVLLDEPTAAMDISHQEQTLGTARALAAAGAAVIVVLHDLNAAAAYCDSIVCLSDGRVIASGSVDQVYSTETLSRVYGWPIRVDHSGKYVRVEPDRSEANLPSVLQVKNTVSPA

SEQ ID NO: 3941 - protein, 319 aa, Corynebacterium glutamicum
MNKLATRALVALTGSAIAMTGLTVVSANAAEKTGKCRVVTTTGTADWSVRESFNNYLEGPIANGAAYKYHGGIEVRDGVETTGTKSAREFTWPVLGSEEGAVKLGGGVHWTGHNHYSGDDESQAPDNFILDLDFSNPTVKFDGNEGTLLVDFKSREFVDTKTVADFLTGTQAELATITFDEPIDLTQENVTVTGQTKLTATGVDVMGTFYPEGEALAPITLNLTNEVVCDEPETPVEPEVPVEPETPVDPETSVDPETPVDPETSVDPEKPGDDNKDDGSNSSSNGDILGILGILAALGGVGALVYNFLVASGFLAAFK

SEQ ID NO: 3942 - protein, 279 aa, Corynebacterium glutamicum
MNRFPSALLAASVAGAALAIPATSAHAAESICTFTGDVGWNVRDSFNSYLLGNIANGSAYKYKGGLDVRDGVQTDGNGKTPALTWPVDSVTSSKISTSGGAHWTGHNLYPGDDLAEVPNNFTLDLDFSNITVELSGSTGRLLVDYTSREYINTHTLGEFQTGEQAELATITFAKAPDLTSNSVNVTGDVALTADGVEVFGGFYTAGEELAPITLNLTADEGCGSTPEPEDPETPSASSSDVSSSSFGDTITQVLSIGSMVGMAGLLFTIVNYFIQSFAP

SEQ ID NO: 3943 - protein, 270 aa, Corynebacterium glutamicum
MGVAKSKKSALPKVLLTIVVILLLLVLVAEFGLRFMIGKQLKDEFQAQASSQGISATEEPSISFGASPLLLGIARGSINEVTIDTPDSVSITNQDGVPSISGTPESTIQLQGLDIGDRDNPVADHLTLTTLATDDFILATIQQQMAEATGGNSTSQGFAEQLIQELIKVTDITSDAANQTIEVEFTDGAARASLHPIVTNGQLGFEIVDSQLFGFGLPDEISQMLTDALQSSINEVAGGLQIQSLEVVDAGINVTLTGDNINIQTLEAAQ

SEQ ID NO: 3944 - protein, 271 aa, Corynebacterium glutamicum
MADHAHNLRASFRKGANGKQKPIGVITRGTTGVNRLRRFDRWCFHHPKIRSLLDATSLALDVGYGASHTTTVEWGRWLHRLQPDMDVIGLEINPERVLEPQNGVSFELGGFELAGYTPQLVRAFNVLRQYDVDQVEAAWETVTSRLAPGGLFFEGTCDEIGKRCTWITLNSDGPQELTLAWDPWGISTPSDVAERLPKMLIHRNIPGEKIHALLAAADLAWDYCAGWEPHGPRVRWEKAREMLIDQGWPIAVSRRRVGDSLLTVPWETVAP

SEQ ID NO: 3945 - protein, 167 aa, Corynebacterium glutamicum
MATRTENTITINQPVGKVHQALTTEAYWAYIAENLSPEAGEVNEFTAADGGATATLFEVLPLEVLPEAVRAMISQALKVKRVLTVPALTNNATTVEYNADVKGTPVDFKGTIAINGDDAATTFDYSNEVSVNIPFMGPAIEPKVADALGELFANEGALTEKWISENL

SEQ ID NO: 3946 - protein, 367 aa, Corynebacterium glutamicum
MDSSLAQEIAAIDGVELDSEVTFADLTTLRIGGKPRSAVRCQTTEALVSAIKLLDDASLPLLIVGGGSNLVVADGDLDVIAVIIETDDVSINLTDGLLTADAGAVWDDVVHLSVDAGLGGIECLSGIPGSAGATPVQNVGAYGTEVSDVLTRVQLLDRTTHQVSWVDASELDLSYRYSNLKFTNRAVVLAIELQLLTDGLSAPLRFGELGRRLAISEAEPHPRRPVRMVRDAVLELRRAKGMVVEHTDHDTWSAGSFFTNPIVDPALADAVFEKVGEPTMPRFPAGDGKEKLSAAWLIERAGFKKGHPGAGAKASLSTKHTLALTNRGDARASDLVALAKEIRDGVLETFGVTLVPEPVWIGISIDD

SEQ ID NO: 3947 - protein, 217 aa, Corynebacterium glutamicum
MESASMTEFSDVPGTAAPLHRALENAGYSTLESLDGVPYKTLIALHGVGKTGLGRIQAALLERGLSLGEETKGATITPGHTGKVASDIKTHITSVDPVAYVDGLEGRRVAHGHQLLSIFGRVTGAEPKMWGPSMIGYGSVHYVSHTGREGDWFQCGFSPAKSKICLYGLKDSPRGEELLQKLGKYTEGRGCVYINKPEDIDLDVLEAMISESWAGQG

SEQ ID NO: 3948 - protein, 245 aa, Corynebacterium glutamicum
MLPGSCRGQFFRHHAGQSTSCREHRRGILKWSIRHFPTPCAVGRRCQGRRKIQSSMLIPIQTGSGTRVTPKVSRTPSRISLANATRSEARASPRLVSARVCLVLREAFAPAPGCPFLKPARSMSQAAESFSLPSPAGKRGMVGSPTFSKTASARAGSTIGLVKKDPADQVSWSVCSTTMPLARRSSRTASRTMRTGRRGWGSASEIANRRPNSPKRSGADNPSVRSWSSIAKTTARLVNLRLEYR

SEQ ID NO: 3949 - protein, 58 aa, Corynebacterium glutamicum
MDLWWIFASSLSETARIHHRFEFSFETWLILALESFRNHISPTGYKVETPQNRFWGVN

SEQ ID NO: 3950 - protein, 568 aa, Corynebacterium glutamicum
MSAYETKEWLQHYPEWTPHSLEYGDTTLLDVYDNNLAINADKPATYFFGRSQTYGELDKEVRKTAAGLRALGVRPGDHVAIILPNCPQHIAAFYAVLKLGAVVIEHNPLYTAHELLEPFKDHGARVAIVWDKASPTVEQLRGQTQLETIVSVNMINAMPPLQRLALRLPIPALRKSRESLSGAAPNTVPFETLTSAAMGGDGDDVVSEPTVTKESVALILYTSGTTGRPKGAQLTHGNLFSNLLQGKHWVPGLGDKPERMLAALPMFHAYGLTMVGTLSVFIGGEMVLLPTPRIDLIMNVMKKHTPTWLPGVPTLYEKIVDASEKEGIPIKGVRNAFSGASTLSQRTVERWEKHTGGRLVEGYGLTETSPIIVGNPMSDHRRQGYVGIPFPDTIVRIANPENLDETMPDGSEGEVLVKGPQVFKGYLNQEEATKNSFHGEWYRTGDVGVMEEDGFIRLVARIKEVIITGGFNVYPAEVEEVLAEHPDIEDSAVVGIPREDGSENVVAAITLVEGAALDPDGLKEFARKNLTRYKVPRTFYHFEEMPRDQMGKIRRREVQAELLKKLGK

SEQ ID NO: 3951 - protein, 418 aa, Corynebacterium glutamicum
MRVAMISMHTSPLQQPGTGDSGGMNVYILSTATELAKQGIEVDIYTRATRPSQGEIVRVAENLRVINIAAGPYEGLSKEELPTQLAAFTGGMLSFTRREKVTYDLIHSHYWLSGQVGWLLRDLWRIPLIHTAHTLAAVKNSYRDDSDTPESEARRICEQQLVDNADVLAVNTQEEMQDLMHHYDADPDRISVVSPGADVELYSPGNDRATERSRRELGIPLHTKVVAFVGRLQPFKGPQVLIKAVAALFDRDPDRNLRVIICGGPSGPNATPDTYRHMAEELGVEKRIRFLDPRPPSELVAVYRAADIVAVPSFNESFGLVAMEAQASGTPVIAARVGGLPIAVAEGETGLLVDGHSPHAWADALATLLDDDETRIRMGEDAVEHARTFSWAATAAQLSSLYNDAIANENVDGETHHG

SEQ ID NO: 3952 - protein, 248 aa, Corynebacterium glutamicum
MTNGKLILLRHGQSEWNASNQFTGWVDVNLTEQGEAEAKRGGELLVEAGVLPGVVYTSLLRRAIRTANIALNAADRHWIPVIRDWRLNERHYGALQGLDKAATKEKYGDDQFMEWRRSYDTPPPELADDAEYSQANDPRYADLDVVPRTECLKDVVVRFVPYFEEEILPRAKKGETVLIAAHGNSLRALVKHLDGISDADIAELNIPTGIPLVYEIAEDGSVVNPGGTYLDPEAAAAGAAAVANQGNK

SEQ ID NO: 3953 - protein, 413 aa, Corynebacterium glutamicum
MSTLLAFVLGVVLMGLALPAYTKIKDRMRRHKSAVTLSENQVTTVGQVLHLAIQGSPTGITVVDRTGDVILSNGRAHELGIVHERSVDGNVWRVAQEAFQDQETHSLDVHPDRNPRRPGSRITAVQAVVKPLTLIDDRFVIIYASDESENVRMESARRDFVANVSHELKTPVGGMALLAEALMESSDDPEQVEYFGSRLHREAHRMADMINELISLSKLQGAERLPDMEPVQADDIISEAIERTQLAADNANIEIIRGDRTGVWVEADRSLLVTALANLISNAINYSPKSVPVSVSQSIRNDVVMIRVTDRGIGIAPEDQGRVFERFFRVDKARSRQTGGTGLGLAIVKHVMANHGGSISLWSRPGTGSTFTLELPVYHPESKEPAGSKQGPSLDSPIRTTASKASGRRKEKS

SEQ ID NO: 3954 - protein, 232 aa, Corynebacterium glutamicum
MTRILIVEDEESLADPLAFLLRKEGFDTIIAGDGPTALVEFSRNEIDIVLLDLMLPGMSGTDVCKELRSVSTVPVIMVTARDSEIDKVVGLELGADDYVTKPYSSRELIARIRAVLRRRGVTETEAEELPLDDQILEGGRVRMDVDSHTVTVGGEPVSMPLKEFDLLEYLLRNAGRVLTRGQLIDRIWGADYVGDTKTLDVHVKRLRSKIEEEPSRPRYLVTVRGLGYKFEL

SEQ ID NO: 3955 - protein, 293 aa, Corynebacterium glutamicum
MDNNNSYLWPVTYDEVSHELTKWKFYKHFTKISGSVYLKNDLIDDPVLVTQALIKRCPQGVLRGYAALNRRGYQLFDDPWMPIISISGEPRTRKTTNVGKIIRRETPENLRRSGEFTLVSDSQALLDVFSLHGLDSFEHQVALIDHLIRQCPDLKDEIKKVPELRKHAEFTDEFAESPPESRLRVRLHMQGYRNFMPQVRVELEGRRFYLDLADPVWGVALEYNGGWHYTAEQRSKDAFRKNALKNAGWDVFEVTSKTLQSQQAWDYFFQQVRVAIQRKYADRKRRLPMQTVS

SEQ ID NO: 3956 - protein, 862 aa, Corynebacterium glutamicum
MANKLRMALTVLSVVLGTAFLCGSLLLTHSLERTFSSIVDAGVEGVDVGVIAQQNNPDGVPFSVIAEIEQYPEVRAVNIIGDGPGMPSGTTMTGQSALILTDSDGNPLQAGSSGTHPLAIYPQGEWVSPEPTLIDGHFPTKPDEVVVNASAAKRGGLSLGDHLTIVTPTERIDATLSGTFESNTDVAGWVGVGFTPQRYVELFTNGTDASQITIAVNDGADPMAVRNRIGKNHRDLLPLLPEQIIDQTTGDTARQLEFMTYVLLAFAAIALIVGSFIIANTFAMIVAQRTGEFALLRSIGVSTFQIGFSVIMEAVFVGLIGGFIGIAVGFGVVNALVQVLNQFGDTLSSIDITYNAGSFIFPVLFAVTATVLSSISPAHRAGNLPPVQAFESSDARSDALGRIRFLVAAVMLTLGISLTIAGAVVSAINGDEFKTETRLAFIGAGLLLVFFSLSLSGPALMVATSQTLGVAIMSPFRAVGKLAQRNTLRNPRRSATTALAVTLSVGLVACVGVIGATTRASVFGSMESTIKSPYVLDSIGGTMIPGQPAGGSRSLSMSAAVAQEIAQTRGVGKVGTLMTGSVQVNGWDNENTTIFDGDLSQFLDLAVRSGDAFDDETPGVMISTTYADQSDLEVGDTVTVNPYGSDDGIRVPITGIYAETNLVGHLMVNAAATNRVLTSADTYHRSQIFVNGDGSTTNEELRDILVDAVAPFLIVQVKSKDEFRGSLGTQINQLLGIIYGLLALAVIIAVLGIVNTLFLSISERTREIGILRATGVQRGQIRRMITLESVILSIHGAIHGLLLGTFIGWAIVSCLRTRGMAPVEFPWTQIGLMLISAIIIGGIAALIPANRASRISPLEAIN

SEQ ID NO: 3957 - protein, 301 aa, Corynebacterium glutamicum
MNRSNSSSVFLGFPESSPAAASIRAGEELPLDFPREWYEFTDPTDIEHVFSIDLTWLESNWNCTFGTPDCLGIDSENADVGCCGHGAFLADETDRDQLYDAVAQMPAKYWQLRPASTDSFLASDDGTDIEPWLTWDELDDEDGNPEPALKTTVVNGACIFANRAGWETGAGCALHQWGVNANEDLTVVKPEVCWQLPLRRLEAWEERPDGQEILRTTITEYNRRGWGNGGEDFDWYCTTSPRCHTNAEPMWKTQETELRALMGPNSYEVLRKYLEARSAIPAHLRAQHPASASNNNETPRG

SEQ ID NO: 3958 - protein, 309 aa, Corynebacterium glutamicum
MRLGVLDVGSNTVHLVAVDARPGGHPTPMSNWRTPLRLVELLDDSGAISEKGINKLTSAVGEAADLAKTLGCAELMPFATSAVRSATNSEAVLDHVEKETGVRLSILSGEDEARQTFLAVRRWYGWSAGRITNLDIGGGSLELSSGTDESPDLAFSLDLGAGRLTHNWFDTDPPARKKINLLRDYIDAELAEPARQMRTLGPARLAVGTSKTFRTLARLTGAAPSSAGPHVTRTLTAPGLRQLIAFISRMTAADRAELEGISSDRSHQIVAGALVAEAAMRALDIDKVEICPWALREGVILTRIDKGLE

SEQ ID NO: 3959 - protein, 271 aa, Corynebacterium glutamicum
MAKMSEEKLTVAELMARAAKEGRSTDAPRRRRRRSIEDGGVSVAELTGSIPAVKEKPAESKHSSVPIDAPAEPEVVEAPKPEPAEEVEVASVEGDVDKQETPERPAPSNEETMVLRIVDEKDPISLTTGAFPVVPAVAAKPAPVVRAEKDADVETAVKADFAEVEVDNTDTTQMAVVEEVDEEPEQENKMSVFAIIMMAIVGVVLGVVVFLGFEMLWERLNKWIVAVLAVGVTLGMVGIIHALRTSRDGFSMVLAGIVGLVMTFGPLAIVM

SEQ ID NO: 3960 - protein, 270 aa, Corynebacterium glutamicum
MTTIAVIGGGQIGEALVSGLIAANMNPQNIRVTNRSEERGQELRDRYGILNMTDNSQAADEADVVFLCVKPKFIVEVLSEITGTLDNNSAQSVVVSMAAGISIAAMEESASAGLPVVRVMPNTPMLVGKGMSTVTKGRYVDAEQLEQVKDLLSTVGDVLEVAESDIDAVTAMSGSSPAYLFLVTEALIEAGVNLGLPRATAKKLAVASFEGAATMMKETGKEPSELRAGVSSPAGTTVAAIRELEESGIRGAFYRAAQACADRSEELGKR

SEQ ID NO: 3961 - protein, 374 aa, Corynebacterium glutamicum
MVTRIFCGFMLAAIKPETKASPICPPPITAIVVMVPTLPLTTPVLQQRGPKTTNYMTIASGPNVMTRPTIPARTMLKPSREVRKAWMMPTIPKVTPTARTATIHLFRRSHSISKPRNTTTPRTTPTIAIMMIANTDILFSCSGSSSTSSTTAICVVSVLSTSTSAKSAFTAVSTSASFSARTTGAGLAATAGTTGNAPVVKLIGSFSSTMRSTMVSSLLGAGRSGVSCLSTSPSTEATSTSSAGSGLGASTTSGSAGASMGTLECLDSAGFSLTAGMEPVSSATDTPPSSMLRRLRRRGASVERPSFAARAISSATVSFSSLIFANSFPGKCYSSPLSILVRITPSRSAHGQISTLSISNARIAASATSAPATI

SEQ ID NO: 3962 - protein, 66 aa, Corynebacterium glutamicum
MIYMAREDNGTFLTVAEVAEIMRVSKMTVYRLVHSGELPAVRVGRSFRVHEKAVNEYLDSSFYEAG

SEQ ID NO: 3963 - protein, 73 aa, Corynebacterium glutamicum
MRWHDFSILPLRLLSTKNTSKTPQQNPKIIMPGEQTEKPLYVTFGGVIRELRGEVFAVVESSQPRRRRSPGTR

SEQ ID NO: 3964 - protein, 33 aa, Corynebacterium glutamicum
MGSVIKKRRKRMSKKKHRKMLRRTRVQRRKLGK

SEQ ID NO: 3965 - protein, 64 aa, Corynebacterium glutamicum
MSFKLAPPFGAVLFCVLGGVRWGFFMGSLWVRGSQTPRESDSGAGVLENVRIEPRSTSLDELLV

SEQ ID NO: 3966 - protein, 206 aa, Corynebacterium glutamicum
MDASAATACLLPGPWRMSPTSRPVNTPSFASATVPIAPVKPRRCARIWASWTGVAETSQTWWPAAMCMSASCLVPGHILSAMRWSTISSQRSTSSWTGRPLMNSRACSRPRETSSAFSEPVSLNFTCFHTTGRISLMVKNFFRKSPWAKTMREEPWMRVLSTSKNAAAPTSWGTSGSGMLTWMAPADSMAPATASTPALNSLSSMP

SEQ ID NO: 3967 - protein, 355 aa, Corynebacterium glutamicum
MSSEGRNHNWDYAAIGTPEDFLASWSASRGNLRRFFEDHAAAPINDAAQRQAGEAAATQAVAAIYGMELNEFNAGVDAVAGAIESAGAIHVSIPDPDVPQDVGAAAFFDVDNTLIQGSSLIVFAQGLFRKKFFTIKEILPVVWKQVKFKLTGSENAEDVSRGREQALEFIKGRPVQELVDLCEEIVDQRMADKMWPGTKQLADMHIAAGHQVWLVSATPVQLAQILAQRLGFTGAIGTVAEAKDGVFTGRLVGDILHGPGKRHAVAALASIEQLDLTRCTAYSDSINDLPMLSMVGTAVAVNPDSKLRKEAETRGWDVRDFRSIRKATREYGIPALVTAAFSVAGWRLRRRWRKQ

SEQ ID NO: 3968 - protein, 82 aa, Corynebacterium glutamicum
MGATMGHSVEIIVRDNCGSCVRVKAQILPIVEAAGIKLTERNVDQDASLKLEFGDRVPVILVDDEEFACWEVDNDELANALL

SEQ ID NO: 3969 - protein, 86 aa, Corynebacterium glutamicum
MSLIPAASTIGKIWAFTRTHEPQLSRTMISTEWPMVAPTPSHFTTLRERIRPESFTMDTILNGDIHYRFGVCALMNQEGFCLSHEL

SEQ ID NO: 3970 - protein, 463 aa, Corynebacterium glutamicum
MSVLIVGMSHRSAPVSLLERLSMDDSVRGETTQALLGRASLSEALIVSTCNRLEVYTVTSSFHTGVNDVVEVLHEASGVDIETLRGYLYVRYADAAAEHMLVVTSGLDSMVLGEQQIIGQVRTAYQAANEYGSVGPALHSLTQTALHTGKRVHSETAIDDAGASMVSFAVDRALVQMGLDSEAEAPLSGKTALVLGAGAMSSLAATHLGRAGISNLIMANRTLERAERLAEHSLEAGVPAEVVEYDQRASAYNRVDLVVSATGADDFTVKPEDIPEGASLMLVDLSMPRDIDDACADLPGVDLVNIERLHKASREGGSGMAPSEEEALAIVREELDSFTSEQRIRDIVPAVSALRRQAASVGSDELDRLRQRAPGISEVEWGEVEKTVRRVVDKLLHEPTVRVKELAARSGSISYDSALQELFGLESLASTAAPATTSVNASELPDAGIVAFVNAPSATQTRE

SEQ ID NO: 3971 - protein, 302 aa, Corynebacterium glutamicum
MTLKIGTRGSKLATTQAGTIRDQLKHYGRDAELHIVTTPGDVNMSPVERIGVGVFTQALRDVLHSGECDVAVHSMKDLPTATDPRFHLVVPTRADSREALIARDGLTLAELPEGAKVGTSAPRRISQLKAIRPDLEILPLRGNIDTRMGKVTSGELDAVMLAYAGLTRVGMQDRATEVFDADIIMPAPAQGALAIECRADDTETVRALNMLMHADTFVSAVAERTVLNRLEAGCTAPVAAHATLDGYSGDTMTLTAGVYALDGSDQLVFSAEGDGARPEELGELVAQQLIDAGAANLLGDRS

SEQ ID NO: 3972 - protein, 124 aa, Corynebacterium glutamicum
MIVVAELRINNRIVTVHLSWWEKLSARRSHLRIPRKAIRNIQVVDNVISSVDRPIKRTGRLRIPGVFVAGTHAYVNETLSENEFSMCRKNEPGLVIELENISIDRIVISTPDAHRYADELMAAV

SEQ ID NO: 3973 - protein, 294 aa, Corynebacterium glutamicum
MHLNQLEFFIAVAQHGQINRAAEELLISQPALSRQISALEKSVGAPLFERHSRGVSLTKAGEILHEEALRTLSRMQSVVDEIQSGEHLITSINIGVPPGIPIDWLRCQLIDLGPETRISLIESPTDDQLKLLKQRELDIALCRRQSEAFATTLVHEQELGIVVRKNSELHQKVAGKDNATLFDLEGLRVLAHSRGEVRIQEEILKNAMLAAGVNATWIFRKFGQYSSLIADLVQADVALTTEESARTNFPSWQWVPIEGEDASGNDLVVRTWITWNPQPTPAVKALIQKFIDGN

SEQ ID NO: 3974 - protein, 467 aa, Corynebacterium glutamicum
MSEQLQGVTHSESTPGKTPKRAALSSWIGSALEYYDFAVYGTAAALVLNHLFFPADTSPGIAILAAMGTVGVAYVVRPLGALIMGPLGDRYGRKFVLMLCLFLIGASTFAVGCLPTFDQVGYLAPALLVLCRVIQGLSASGEQSSAISVSLEHADERHRAFTASWTLHGTQFGTLLATGVFIPFTLFLSEDALMSWGWRVPFWLSAAVVLVAFLIRRGLEEPPAFRENKEAVAGAASPLAMTLRYHKAAVARVAIAAMINSVNIVFTVWALSFATNIVGLDRSTVLLVPVVANLVALIAIPLSGMLADRIGRRPVFIMGAIGGGLAMNGYLGAIYSGNWTMIFFMGVLMSGLLYSMGNAVWPAFYAEMFPTSVRVTGLALGTQIGFAVSGGFVPVIASALAGDQGDQWMKVSIFVGVVCVISALVAMTAKETKALTLDEIDALHTAGGEAADLAAASKASEAQLAAQ

SEQ ID NO: 3975 - protein, 618 aa, Corynebacterium glutamicum
MRTSIATVCLSGTLAEKLRAAADAGFDGVEIFEQDLVVSPHSAEQIRQRAQDLGLTLDLFQPFRDFEGVEEEQFLKNLHRLEEKFKLMNRLGIEMILLCSNVGTATINDDDLFVEQLHRAADLAEKYNVKIAYEALAWGKFVNDFEHAHALVEKVNHKALGTCLDTFHILSRGWETDEVENIPAEKIFFVQLADAPKLSMDILSWSRHHRVFPGEGDFDLVKFMVHLAKTGYDGPISLEIFNDSFRKAEVGRTAIDGLRSLRWLEDQTWHALNAEDRPSALELRALPEVAEPEGVDFIEIATGRLGETIRVLHQLGFRLGGHHCSKQDYQVWTQGDVRIVVCDRGVTGAPTTISAMGFDTPDPEAAHARAELLRAQTIDRPHIEGEVDLKGVYAPDGVELFFAGPSPDGMPEWLPEFGVEKQEAGLIEAIDHVNFAQPWQHFDEAVLFYTALMALETVREDEFPSPIGLVRNQVMRSPNDAVRLLLSVAPEDGEQGDFLNAAYPEHIALATADIVAVAERARKRGLDFLPVPENYYDDVQARFDLPQEFLDTLKENHLLYDRDENGEFLHFYTRTLGTLFFEVVERRGGFAGWGETNAPVRLAAQYREVRDLERGIPN

SEQ ID NO: 3976 - protein, 283 aa, Corynebacterium glutamicum
MNDSILLGLIGQGLDLSRTPAMHEAEGLAQGRATVYRRIDTLGSRASGQDLKTLLDAALYLGFNGLNITHPYKQAVLPLLDEVSEQATQLGAVNTVVIDATGHTTGHNTDVSGFGRGMEEGLPNAKLDSVVQVGAGGVGNAVAYALVTHGVQKLQVADLDTSRAQALADVINNAVGREAVVGVDARGIEDVIAAADGVVNATPMGMPAHPGTAFDVSCLTKDHWVGDVVYMPIETELLKAARALGCETLDGTRMAIHQAVDAFRLFTGLEPDVSRMRETFLSL

SEQ ID NO: 3977 - protein, 91 aa, Corynebacterium glutamicum
MFGRKDVNLSALEARVAALERRLAEQDRIIAQLGGDSSIPLSLQRPQSGLHPDVVALLQQGKKIAAIKRHRELTGAGLKEAKETVEASRFY

SEQ ID NO: 3978 - protein, 350 aa, Corynebacterium glutamicum
MSSIKLRDLSVSFRDGTFGLQDINLKIEPEEFVVLIGPSGSGKTTMLRTIAGFVEPSSGSVLIGGEDMTHVPPERRRMGMVFQQHAVWPHMSVAKNVGYPLARSGQKGASISKRVERTLALVGLEGFGSRRPASLSGGQRQRVALARAIIADPTVLLLDEALSALDEPLRDALRRELVSLTRREGLTTVHVTHDRAEAISIADRIVVLGNGRIQQVATPTELLSAPATADVARFIVDATVLNGIVRNGRVMCPDLDTSWDLDAVQAIDDIFDGDLVDIAIPPHSVDIGPAHHPDYIFAEITSVLFQVTSYSVTAKTQSGHSFRMSITCSLPEIGETIGLSIDNPMVYRAD

SEQ ID NO: 3979 - protein, 205 aa, Corynebacterium glutamicum
MADRSAHHPNPAFRQRTVDTHCAASHRTAGHDHRRRLAHFGQIHRNLQHTLGDFGCICVCFYRAGCPSCTRTTQSSTRSNRRSRTNQRRRQITIHHGHHRSDGNSRSFRRRSAGCGNCGSRVNRVHFAHRAGHHHPGCAGVQFAAGGKLQSGIGVVVDVCDYRYRGARVDGAQPEGVLGVIDQIARFKRELPRRNLRAARYQFEN

SEQ ID NO: 3980 - protein, 548 aa, Corynebacterium glutamicum
MQLSPSNTSTQRFHISALTSLSFMRLGVWLIVAGLFITPLALVVGLALGGNQFPALWDSGLGKALWNSAYTTVLSAVGATIIGTIMALTLDRTDVFGRTALRLFLLSPLLIPPFIGAIAWLQLFGKNQGINRFFGTEVWDIYGADGVTFLLIVHSYPTVYIIVSAALRQLPSDLEQAARIAGADTFTVLRTITLPLLKPALLSAFTLTTVANLADFGIPALLGSPARFETLATMIYRFMESGTVSNPLQVVSTIGIVLLFLGIAAVTADYLVSLYAASKLQDAGTPHRFTLNKSRIPVSVITWIIALIITAAPLLGLAYRALLPAPGVPFNLDNITLNNFEAALSNPRVIEGFSNSLMLSLGAALICGVLGWLIGVLITRTQHFANVPLTLTVLLPTALPGMIIGVGWLILGRYTGIYNTPWVILGAYVCAFTALVVQAVRGPLSQAPEAIEEAARISGAGRLRSIMDTTGAMAIPAAFAGAVLVAVTAVRELTVSILLIAPGTTTLGVQVFNLQQAGNYNQASALSLMFAIIGIVALALTVRSQKEF

SEQ ID NO: 3981 - protein, 371 aa, Corynebacterium glutamicum
MEELNSSRLISGYNLQVRGHELDVSQLGGALWSSDIFTHWQVCLLNCDFLAFNRQQEVDVALGCFLLFRISEHTCRLSDVRRTLRCVDGVDWRSSSSQVAHQVVHHDAHWVATASDLLGGWAVGLSDHWLVFTQGGDPGFAKRRVVLPHRSIEGCSTRHSWIRHDQLACILRISQISPRRRKLSLINNFSVVCNHGWDDAGAYIKVLSIQSLFNDVGSLNIFQLCKVALCCISFKGCSIRSPQHISLDRTGCLFSFNASSQIASTSAVHLNLNIWVGFHERLVDLIDLFLRLRGVDGDGYFFTGCIGCVSGRACSGGLCGGNVLRRFRASHEESSGSAECKNSNGSALQRVLRRHENKALLEILRSVWGRK

SEQ ID NO: 3982 - protein, 353 aa, Corynebacterium glutamicum
MKRTAVTVFALGASAALLVACSEPSEDVSTAETTTASSSANASDAAGEKVTITVYTSEPEEKVDEINKAFMEANPDIEVEVYRAGTGDLTARIEAEKASGSIEADVLWAADAATFETYAAQGDLAELEDVETSDIIEEALDAENFYVGTRIIPTVIAYNTEVVDQAELPTSWADLTDPKYAGQLVMPDPAVSGAAAFNASVWKNDPALGEAWITALGENQPMIAQSNGPTSQEIAGGGHPVGIVVDYLVRDLAAAGSPIDTIYASEGSPYITEPAGVFADSEKKEAAERYINFLLSVEGQEIAVEQAYLPVREDVGTPEGTPELADIELMTPDLEVVTADKAAAVEFFQNAMN

SEQ ID NO: 3983 - protein, 590 aa, Corynebacterium glutamicum
MAETTGIETNQVSETIGVESLTHGNLRPVSSFEGQHEGQTEELLPGKVIFVGAGPGNPDLLTVRAREVLGNAVRAITDEQVLSGVRAFVATEIPVPEDKLQAAEDEYERICIEAKENGARRKPPRPAPPTAAEITEVSEATPAQIVELVQDALSYGGDVIRLVTGNPLSSDATLAEISAVSEAGLEFQVVPGMSLPATVPAFAGIALGSTYTETDVNGQNLDWDQLASAPQPLVLQARVDDLSRIAQELKARNMSLETPVSVTANGTTRLQRTYDTTLGLLHKLDAELSGPLVVTLGKGVDDRSKYSWWENRALYGWRVLVPRAREQAASMSARLSSHGAIPQEVPTISVEPPRNPAQMERAIKGIVEGRYQWVVLTSVNAVKAVWEKITEFGLDSRSFAGVRIAAVGEKTAAEIRALGITPELLPARTRQNAQGLVDVFPEYFEELDPVGRVLLPRADIATDVLVDGLTHLGWEVEDVVAYRTVRAAPPSADIRDMIKTGGFDAVAFTSSSTVKNLVGIAGKPHPRTIVACIGPMTAATAEELGLRVDVMPEIAEVPELIDALAEHVADLRAKGELPPPRKKRRRRKAS

SEQ ID NO: 3984 - protein, 142 aa, Corynebacterium glutamicum
MLSMDIQQLDAETTAWKDSLLRAAQEAGFHFEPPKLFEDFETMVEQYKQAAASDPDIDVTDIQQMWGIVVGEYLREKMGMEWVVITDDYGTDLAILATAPNGDHVYSCPIIVVGKRFSPDYEPGQLEFFCNQFMVTSLAQLQ

SEQ ID NO: 3985 - protein, 339 aa, Corynebacterium glutamicum
MSTSSDYSHALIRRPRRLRANPAMRELVAETALRPADLILPMFFADGITEAREISSMPGVYQHTEDSLLRAAHEALDAGVRCVDLFGVPVDADKDFNGSQAWSETGVLNRALSSLRKEFGDDLLIMADTCLDEFTDHGHCGVVTEDRHGNAIVDNDATLPLYQQMAVAQARAGAHIVSPSGMMDGQIAAIRAALDEEGYQDVAIMAYSAKYASAFFGPFREAVGSSLQGDRRTYQQDPANLRESLLEAELDIAEGADFIMVKPALPYLDVLTRIADTSPVPVAAYQVSGEYAMIQAAGRNGWVDLDAVMMESLTSIKRAGANQILTYFAVDAARALRNA

SEQ ID NO: 3986 - protein, 194 aa, Corynebacterium glutamicum
MSMLPNLTPKKSAPPSSSASAKNAGEKKEDTVKLLIQMWAVMIGLELLHQILNVVMSFTDPTALRTVAKEQAAAQGLSDGIVNATVIAAILVMGFFNLIVIAILSWMVVMVKNRSKRLPTAFLLLTIFSFFFILRVLMLFFASPGGTDVPMALFAIDGCVQILVGVSAGVAYALSRTEQPVKMLTDYAPEDAKR

SEQ ID NO: 3987 - protein, 170 aa, Corynebacterium glutamicum
MPSMFPSPATGGDDINRRPLNEPNADATTIPTALKVVFWMLFATAAFMIFTGLVMYTAGYTGPDDVDESYKAVVVNNQEFIGGINAFAGVVIAALTSQLPKGGKNPRRLLLAIMLLVLLTDLLSFATRAGGFALAIIAVLLALEALLMFRPAVNDHIDRNHMARVMNREK

SEQ ID NO: 3988 - protein, 848 aa, Corynebacterium glutamicum
MNRATASEEEEDLSSSIKVSLAFELEGLSNAPSLMVVEKALEKIPGVSADLIYPSQTAWITATDRVHPETLIEVFEQFGIKAHLSNSSLLRRHQQLSAEVNREARLDRYRSRMDAKRISPRVRRHNRQEMVHAVRARESGWIKRRNHTTSQHEDPMSGDVLFTARALITPKRLWVSLPFALIVLALSLNPSWQFDYWQWLSAVLAIPVVVWGAWPFHRAAAGGIRRGISALDATSSIAIAAAYAWSIAMLLFETPGGKSWRSYPSWFAFDHGTLTQNEIYFDVACGITVLLLAGRLLTRRRSQSSLLAELGRLQIDPQRIVTVVRKHRLKRVVQELNIPVQEVRVNDDVKVPPNTTIPVDGTVIGGGSRIAASIIMGQDQRDVKVNDKVFAGSLNLESEIKVRVIRTGHRTRIAAVHRWVKEATLKENRHNRAAIRSAGNLVPITFTLAVVDFCLWALISGNINAAFTTTLAVLACVAPVALALSAPLATRNSIEAAARHGILVRSGEIFRVLDDVDTAVFNRVGTLTDGEMTVETVTADKGEDPELVLRVAGALAMESHHAISKALVKASREARDTGAGGEDVPHWIEVGNVEITEAGSFQATIELPLIKPSGEKIMRTTEALLWRPRSMTEVREHLSPRLVAAATSGGAPLIVRWKGKDRGVITLSDHVRSDSSDAIIAIEEQGIETMMLSRDTYPVARRYADSLGITHVLAGIAPGKKAQVVRAVHTRGSTVAMIGDESVMDCLKVADVGVLMGVDRPSDLRDDSDDPAADVVVMREEVMSVPTLFKLARRYAKLVNGNIALAWIYNGVAMVLAVSGLLHPMAATVAMLASSLLIEWRSGRARKY

SEQ ID NO: 3989 - protein, 281 aa, Corynebacterium glutamicum
MVSMPCSSIAIIASEESDLTWSLRVITPRSLPFHRTISGAPPEVAAATSRGLKCSRTSVMDRGRHRSASVVRMIFSPDGLISGSSMVAWNEPASVISTLPTSIQCGTSSPPAPVSRASRDAFTSALEIAWWDSMANAPATRSTSSGSSPLSAVTVSTVISPSVSVPTRLNTAVSTSSRTRKISPERTKIPCRAAASMEFLVASGADNAKATGATHARTAKVVVNAALMFPEISAHRQKSTTARVNVMGTRLPAERIAALLWRFSFNVASLTHLCTAAMRVR

SEQ ID NO: 3990 - protein, 358 aa, Corynebacterium glutamicum
MSALTIPAARRTLNNAPIIDAANGKTPTRTPVWFMRQAGRSLPEYKKVREGISMLDSCFMPELLAEITLQPVRRHDVDAAILFSDIVVPLRAAGVGVEIVAGRGPVLDAPVRSRGDVLNLPILEGNVPEVEQGIGIILDELSDSQALIGFAGAPFTLASYLVEGGPSKNHEKTKAMMHGDPETWHALMARLVPTIVNSLKSQIDAGIDAVQLFDSWAGFLTERDYTEFVLPYSTEILEEVGKYQLPRIHFGVGTGELLGAMSKAGSEVMGVDWRVPLDKAAERIAAVSGPKVLQGNLDPALLFAGRAPLTKEIERIKAEAQTAVDAGHATGHIFNLGHGVLPNTVAEDITEAVSIIHS

SEQ ID NO: 3991 - protein, 448 aa, Corynebacterium glutamicum
MRFAIIGAGLAGLTAAYEIHKADPTAQIDVLEAGERIGGKLFTVPFASGPTDIGAEAFLAARSDAVEFFTELGLADSLVSPSAAKSQYFAGGALHAFPAGGVMGIPSNPPAGAQDTAFDWTPGQDISVGALVRRQYGDEIVDTVVSSLLGGVYSSTADDLGVRASVPALAAALDQLAEAGEPVTLSAAVKAVEAQREAAKTTSETRPVFQTFKGGYAELYEALAEQCGADIHLDSFVSAITKDGEGFAIKGGGEGTYDKVILAVPAPTAAVLLRDLAPAAAPHLRAIKLASSAVVGMRFDSSEGLPDNSGVLVAVNEPGITAKAFTFSSKKWPHLEARGGALVRASFGRLGDEASARMDEDLLVDAALDDLLTITGFDGRAAGLGEIFVQRWFGGLPAYGVDHIATVSAARAEIAAVPGVEAIGAWAGGVGVPAVIADAQAAVHRLLG

SEQ ID NO: 3992 - protein, 437 aa, Corynebacterium glutamicum
MTHMTSSNTARSAEWFEKAQKLTPGGVNSPVRAFGSVGGQARFIEKAHGSTLIDVDGNEYVDLVCSWGPMLMGHAHPAVVEAVQKAVVDGLSFGAPTIGEVELAQDIVKRTSVEEVRLVNSGTEATMSAVRLARGYTQRSKILKFEGCYHGHVDALLASAGSGVATFALPDSPGITGAQTSDTIVVPYNDIEAVRNAFAEYPGEIACIIAEAAGGNMGTVAPKDNFNDKLLAIAHADGALLILDEVMTGFRTSYRGWFGVDKVAADLVTFGKVVSGGLPAAAFGGKAEIMNMLAPQGPVYQAGTLSGNPVAVAAGRASLKLADESLYTTINANADRLHGLISDALTHEGVAHHIQRASNMLSIRFAEGEGHNFSDMKAADIFRFAPFFHTLLDNGVYAPPSVFETWFVSSALTDDDFSKIEQALKPAARAAAEAKAS

SEQ ID NO: 3993 - protein, 202 aa, Corynebacterium glutamicum
MTQTIVHLVRHGEVHNPEKILYGRMPGYRLSSRGRSQAARTAASFEGHDVTYIAASPLQRVQETSEPFIKVTGLELITDEDLLEAGNRFEGLRTKGWRSQLWNPVRWPLMYNPTLPSWGEHYTDILERMMAAVERARVAAEGHEAILVTHQLPIVCVQRHARGQSLSHNPATRQCDLASVTSLVFQDDQIVGVHYNEPAQEI

SEQ ID NO: 3994 - protein, 207 aa, Corynebacterium glutamicum
MRLTKLAATIGCVTLSGLALVACSSDSTAGTDAVAVGGTFQFHSPDGKMEIFYDEADRQQLPDIGGDSLMEEGTQINLSDFENQVVILNAWGQWCAPCRSESDDLQIIHEELQAAGNGDTPGGTVLGINVRDYSRDIAQDFVTDNGLDYPSIYDPPFMTAASLGGVPASVIPTTIVLDKQHRPAAVFLREVTSKDVLDVALPLVDEA

SEQ ID NO: 3995 - protein, 264 aa, Corynebacterium glutamicum
MVAQSIGQQFADVAASGPLFLGILAAALAGLVSFASPCVVPLVPGYISYLAGVVGGEVEYSAQGTKVKTKRFAVGGAAMLFILGFTVVFVLATVSVFGAISVLTLNADTLMRIGGVVTIIMGIVFMGFIPGLQRDTRMAPKRWTTWLGAPLLGGVFALGWTPCLGPTLAAIISISAGTEGMTAARGVILIVGYCLGLGLPFLLIALGSSKALTGVEWLRKHSRTLQIIGGVFLILVGVALLSGSWAIFINWVRQWTVEYGATLL

SEQ ID NO: 3996 - protein, 541 aa, Corynebacterium glutamicum
MLKTVKLYARKAWNWLTSMRTALALLFLLAIAAIPGALLPQRSLNESNVIEYIENNGKLAEFYDKIQLFDVFSSTWFTAIYVLLLISLVGCILPRSWEHYKAMRAPVVRAPRNLERLAHNGEGLVEKREEEVEKDARKLLKGWKITEYSAEEDRAGVRSIAAEKGYTRELFNLIFHLGIVGMIVTAGLGRLFYYEGHVIVVTDGEQNQQNSVFCNTATANYDSFRAGANFDGTGLTTFCFEAHDFSADYLANGQAEMFRSNISYAVGDDIQNDPETWEDYELRVNHPLRIEGDRVYLQGHGFAPTFTVTWPNGETRTQTVQWRPDDPTFFLSSGVVRFDPPAGMYPDLYERRQNQLAIQGLFAPTAEWEGDNNELLTSSYPAMRDPAVAIDIYRGDNGLDTGIGQSLFSLDSSLMHSGVLQKIERVNLQIGDTVTLDDGTTVSFDGASEFANYQISRDPTQNWVLVTTVISLVSLVGSLMIRRRRIWVRFYPQENGTTRVETGGLARTDRAGWGGEYEKFHRELLGLKEEDEDEEYFDHDD

SEQ ID NO: 3997 - protein, 337 aa, Corynebacterium glutamicum
MLPVNQTYAQFSDTAFVSAYIIYVLALILSLVYYVKQQGIIDARREQTRVSELVGAGGSADVDTDLPDDIADGVLADEDLAKREETARKLANMTQSLMWLGVMVHLVSVVMRALSASRFPFGNLYEYILMVTLFAMIGAVLILQRPQFRVVWPWILTPMLALLFYGGTQLYSDAAPVVPALQSFWFPIHVSSVSIGASIGIVSGIASLLYLLRMWQPKGKEKGFFGAVAKPLPSGKTLDNLAYKTAIWTVPIFGLGIILGAIWAEAAWGRFWGWDPKETVSFITWVLYAGYLHARATAGWRNTNAAWINILALVTMIFNLFFINMVVSGLHSYAGLN

SEQ ID NO: 3998 - protein, 267 aa, Corynebacterium glutamicum
MSLTEGEIIPIQTKLGHWRDVRDSEDLPFQVIASRTSVTIMENTLEWTNSRLERGEEFTELDIYAHYLEELEDYALQFTFDVEPYFTNLHSSNRMLFPGPPVDFPINAETRCIQLDAGVAVKKDGVVLGTSDMARSLPRTAAGQEAYEYFFKVVREGIIGQLRPGVICADVHEATLDYLSPQLPRMIDIGMLGADTDFNTIYRKRNVGHLMGKQESFANELRPGYKHILHHGSYGAAEIPWRYNGVAIGTEDLWYIGADKTYILSQR

SEQ ID NO: 3999 - protein, 157 aa, Corynebacterium glutamicum
MTEIAENLQRLGIELPDLPAPQYSYVPFNRQGNTLYVSGQISRTAAGDILAGRVGEDATLEEGIHAAEVATINLLARIHQSIGLDNVAQILKLNVWVNSSDDFIQQPQVADGASQLLEAVLGEAGKHARTALPTNTLPQGALVELDAVVAVTEAAEV

SEQ ID NO: 4000 - protein, 119 aa, Corynebacterium glutamicum
MTSVIPSSADSATEQRFAPLKSVPSRITDIAEEASDFYKALGDTTRLEILYLIFTTKSSRVSANALAHTLNISAPTVTHHMKKLIAANLVNREQCGKWAYFSINSAHIDTVAEIFAHAS

SEQ ID NO: 4001 - protein, 100 aa, Corynebacterium glutamicum
MGRLLLIILVIVAIVLLWKAFKPSTWKRNAEINQGQAPRAVKGPDDDEEFLWNIEKNRFKQRRADEAAQLEEEERLKRARERYAKPESSEEGPEKPTEDS

SEQ ID NO: 4002 - protein, 111 aa, Corynebacterium glutamicum
MSESNTPNLQTHQAPELNPELQKAARKNVLIYGLARLLLFVVLTLIIHSLALLISAPVPLVMSAMLALIVAFPLSMLVFSKLRMNATQAVSQWDAQRKAHKEWVRSELADR

SEQ ID NO: 4003 - protein, 298 aa, Corynebacterium glutamicum
MSHTEPQPNSVTLSDWIQGARPRTWANAFAPVIAGSGVAAFHDGFVWWKALLALVVAWALIIGVNYANDYSDGIRGTDEDRTGPLRLTGSGLAEPKKVKAAAFISFGIAGVAGTALSLLSAWWLILIGILCVLGAWFYTGGKNPYGYRGLGEIAVFIFFGLVAVMGTQFTQTGSVSWAGLAAAVGVGSMSAGVNLANNIRDIPTDSKTGKITLAVRLGDAGARKLFLALISTPFIMSICLAFVAWPALIAIIVFPLALKAAGPIRNNATGKDLIPVIGSTGRAMALWAVLTGLALAFS

SEQ ID NO: 4004 - protein, 288 aa, Corynebacterium glutamicum
MWVGYAVRQIASVFLTLLRMLPLAARNRVARGRIPETGDVVISLTTHGKRINYVHFTIESIARGHVKAPIVLWLDKPDFDAPWPATIKRLVARGLQVRCSDGFYGPHTKYWNQFREIHGTGVRVATVDDDMIYPEWFLQRLLFIGDLRMDAVVAYRAHRIELRDDRMLPYVKWSAADTSKASFLHFATGVSGVLYPVTFIDYVVSQGDVFLENCKRADDVWLHACALRSDHPIRQVYAQPRHFAVVPTTQVGALVVGNTLMGGNDEQIAKVYTDEDVAKLVAASKNED

SEQ ID NO: 4005 - protein, 441 aa, Corynebacterium glutamicum
MRTSPPASLSPTMVGNSPAQSALARCFSSQLAQVHGASTGFWQNARPKSSATTPNSEPSALESRNMNTRVLEALPVDLADPTAILGDLEDAISGKKTFLPIPVQDKTRAQLLRDSQRVGLAIDPSIALVMATSGSTGTPKGAQLTPLNLVSSADATHQFLGGEGQWLLAMPAHHIAGMQVLLRSLIAGVEPLAIDLSTGFHIDAFAGAAAELKNTGDRVYTSLTPMQLLKAMDSLQGIEALKLFDVILVGGAALSKQARISAEQLDINIVTTYGSSETSGGCVYDGKPIPGAKVRISDERIELGGPMIAQGYRNAPEHPDFANEGWFTTSDSGELHDGILTVTGRVDTVIDSGGLKLHPEVLERAIADIKGVTAACVVGIPDPRLGQAIVAAYSGSISPSEVIEGLDDLPRWQLPKRLKHLESLPSIGPGKADRRAIAKLF

SEQ ID NO: 4006 - protein, 137 aa, Corynebacterium glutamicum
MTMSTTREIAFLIARILLGVILIAHGWDKFAITGLEGVTGFFDSLGIPAAGIAAIAAAVVELLGGILIILGVFTRIVAAFVAIDMLFAALFAHVSSGIFVTNNGWELTGAIGAGALLLIAVGAGAWSIDGVLAKRKA

SEQ ID NO: 4007 - protein, 520 aa, Corynebacterium glutamicum
MITATALHGCSLIDGEWVAGKNGEITGFDPRTNASLNPSYSLANSAQLRAATTSAKRAFESYRLTTPEVRADFLDSIADNIDALSGEIVQRASLETGLGTTRLTGEVARTSNQLRLFAETVRSGQFHRVRIERGPRIDLRQRQVPLGPVAVFGASNFPVAFSTAGGDTASALAAGCPVVFKAHNAHPGTAELVGQAVRGAVEKHEFDAGVFNLVYGRGVEIGQELAADPNITAIGFTGSRQGGLALSQTAFSRPVPVPVFAEMSATNPVFVFPGALADLDASSSLAEAFTASVTGSSGQLCTKPGLVFIPRGVVGDAFVALVAAKFKETTGQTMLTQGIAQAWQRGVDNLAAQPSVKILAQGTPGDGENAPGPVVFESDVQALLNNVVLQEEIFGAASLVVRYDSPDQLHQVANSLEGQLTATIHASQDDFQEVSKLIPLLEDLAGRVLYGGWPTGVEVGHTVIHGGPYPATSNAQSTSVGTLAIERFMRPVSYQTFPAELLPDPVSEANKWAVPREIDR

SEQ ID NO: 4008 - protein, 316 aa, Corynebacterium glutamicum
MARFSPQDLADHLKDGLLSFPATAFQDDLEVDEAAYVEHIEWQSSYPVAGLFAAGGTGEGFSLTVEENHRVTQLAVQASSPEVPVLGSATGSTKSAIANAQGAEAAGAEGVLLLPPYLTECDAEGLYNHAAAVCESTSLGVIVYNRANAIYSPEVIARLSERYPNFIGFKDGTGNIEHLAKITTLCGDRLFYLGGLPTAETFALPLLQMGMSTYSSAMFNFIPDFALSFYADVRAQDSAAVKQKLSDFVLPYLDIRDRAQGYGVSIVKGGLKAVGRNAGGVRPPLRNLSEQDIADLSDLLATSGAGSYRLPVEVKA

SEQ ID NO: 4009 - protein, 293 aa, Corynebacterium glutamicum
MFTLEQLRCFVAVANHLHFGKAAAELSMTQPPLSRQIQKLEKIVGATLLDRDNRKVELTTAGFAFLKDARLILNSTEKAAERARLASSGMWGQLNIGYTAAAGFSILGPTLNQLHEKMPGVSVDLFEMVSTEQIAALESGLLDLGIGRLSSPVEGLQTRRLQADSLVLAAPKGHPLLDQNRPLLRKHLTGVPFLQHSPTKAKYLYDIVVRNFTINDAQVQHTLSQITTMVSLVASGLGVALVPESAKKLNYSGVEYRHFYDLPVGLAELQAIYSTSNDNPAVRKFIKNIDDTF

SEQ ID NO: 4010 - protein, 105 aa, Corynebacterium glutamicum
MSHNDSPNFARRALNWLRQGYPTGVPRHDTFALFYVLERELTEEDLNELAELLIAEGENNGLHDNPITREKIGKLITHVHSQPPEDEDIDRIQKKLQAEGFPTRN

SEQ ID NO: 4011 - protein, 148 aa, Corynebacterium glutamicum
MLGIDDMEMGIKQLGHDLVFLRCFRQTGDKLLTVNHTALVGAGADGGELISCSDVEGNCTTVDLCHLNIDGDRGSRNRWSCVGEVHMSAQRDFTVVQMGTQKFHAGPLDDADHISSGQDIWHGFKFCCFGKQMRNCAVCWHYVGHLVG

SEQ ID NO: 4012 - protein, 250 aa, Corynebacterium glutamicum
MAKLFDSHFHIIDPQHPLIENNGYLPEPFTVEDYTARVEGLEVAGGAIVSGSFQAFDQGYLKDALAVLGPGYVGVTQIPADTSDQEILDLDKAGVKAVRLNLKRGGSAGLDDLETLARRVHDLAGWHTELYVDARELDELESTLASLPAVSIDHLGLHRDGLPALLRLVENGIKVKATGFGRVELDPTEVIQAIMAVDPTALMIGTDLPSTRTKRPFEDADLDLIAETVGEDHVDNVFWNNAAAFYLGDQ

SEQ ID NO: 4013 - protein, 139 aa, Corynebacterium glutamicum
MKETLTTGLTHQMTYIVPANRTVPHLLPEAAEFETMPDVLATGYMVGIIEWACMELLRPHLDDGEISLGTHVNFSHAAPTVPGSTVTIDVEVTEINRRAVTFNITAADEFATISTGTHQRGVVNREKFVSRLPEAPKEN

SEQ ID NO: 4014 - protein, 126 aa, Corynebacterium glutamicum
MVMACTRQAERKSSPKPLGCSTPKDSARSESTGSWLNPAWSPQFFNAVVIPENGTSPNTWIRHTLTELSAQDGLANPAKCGSFFSLLIDGASVRAITTGEITGIVDAKQTATEIINIRRNASGESS

SEQ ID NO: 4015 - protein, 87 aa, Corynebacterium glutamicum
MNFATIFGSIFEVTLVGILLGAGLPALFALGIRFAHSPSSNGTNALGKIASTICFAIIAVAIIAGILWVTKATIYQYSGFDIFGTEG

SEQ ID NO: 4016 - protein, 425 aa, Corynebacterium glutamicum
MTELIILLIVIVTALAFDFTNGFHDTGNAMATSIATGALKPKVAVALSASLNLVGAFLSVEVATTVAKGVVDLDQFDLSNAWDSHQLLLVVFAGLIGAIVWNLLTWLLGIPSSSSHALFGGLIGAAIASLGFGGVVWEGVLSKMIIPALAAPVVAGLVAAIGTFAVYSITKAVGDNEKNRYFRWGQIGSASLVSLAHGTNDAQKTMGVIFLSLVATGHLGTDADIPFWVKATCALAIAIGTYLGGWRVIRTLGKGLVEIDSPQGMAAETSSAAIILTSSHFGMALSTTHVATGSIMGTGIGRKGAKVRWSVAGRMAMAWVITLPASAIVGVFCWWVAHGIGLISSDLLGVLVAFAILVILSGYIYARSRRVPVDPSNVNADWNEESNSVEPATPSAPAASEITEAPAAPAAQAVQDLNNENEVTK

SEQ ID NO: 4017 - protein, 74 aa, Corynebacterium glutamicum
MAQNKKDIEHIVALQGRGQASKIRIVHIRGGDEPLLWIPDIFLGEINSNYLGNDLYWKQLQDRVVLNSLTPESL

SEQ ID NO: 4018 - protein, 102 aa, Corynebacterium glutamicum
MESQLVAYIDESSAMRSQNRQDYMVCAAIIDSVNSDAIRTELIPLRLPGQIKLHWTDERESRRRTIVKTLSTLDSMQAVVTHRSEISKDRTLPKEMPRKYVF

SEQ ID NO: 4019 - protein, 319 aa, Corynebacterium glutamicum
MSNYSTDNPFDPTQWATVPGFEEFTDITYHRHVGTTRADGIVRIAFDRPEVRNAFRPHTVDELYQALDHARRTPDVGTILLTGNGPSEKDGGWAFCSGGDQRIRGRSGYQYATEHARDDATADVSTVDIARTKVEGGRLHILEVQRLIRTMPKVVIAVVNGWAAGGGHSLHVVCDLTIASRQEARFKQTDADVGSFDAGYGSAYLAKMVGQKNAREIFFLGRTYDAERMQQMGAVNIVADHGDLEKEAIQAAREINTKSPTAQRMLKFAFNLTDDGLMGQQVFAGEATRLAYMTDEAVEGKEAFLEKREPNWNEFPYYY

SEQ ID NO: 4020 - protein, 201 aa, Corynebacterium glutamicum
MRLLLTSFGHDHIRDFVRGTVAYIPDATRLFADSPEAAPFMETERNMLREHGLSIRELPISTSTPEEVDRVLGEVDGVYVAGGETFDLMWLLRSTGNDEVLIKHVRAGLPYIGTSAGAVIAGPSIEPISFLDSPDVAPNLSDYSGLGLCEHVVVPHAGGTIPQFPIDVFAETVRTYGAEFPLVLLKDGQALLIDDHGVHLI

SEQ ID NO: 4021 - protein, 103 aa, Corynebacterium glutamicum
MCAILRQDGAMNSLFDVSPHWSSANAKLTAHFNTGKFSTGMKFVNLIADSAEEANHHPDILLTYGFVEITLTSHDVGEITDRDVALAKVIDAHAKTLAISAEA

SEQ ID NO: 4022 - protein, 338 aa, Corynebacterium glutamicum
MSTPTVDEILERAHVVSLPMRVKFRGVTTREALLIEGPAGWGEFAPFLEYDPQESASWLKSGIEAAWEGFPAPLRDRVEVNATIPAVPADQVAEVLDRFPGCRTIKVKVAEPGQTLADDIARVAAAREARPGAIIRVDANCGWSVEQAVEAAQALAPLDYLEQPCATVEELAEVRMTVQRRGLFVRVAADESIRKSDDPYRVADLRAADVAVVKVAPLGGVKRVLEVVQHLRARTMDITVASALDTVVGMNAGLAAVAALPKLDDDDLIDVPPAAAGLATSQLFLEDVATPHAITDGFMETRVIAPEMDRLETLAASKDRRDWWFERVRESYPYLETI

SEQ ID NO: 4023 - protein, 543 aa, Corynebacterium glutamicum
MSSTPAQDLARAVIDSLAPHVTDVVLCPGSRNSPLSLELLARQDLRVHVRIDERSASFLALSLARTQARPVAVVMTSGTAVANCLPAVAEAAHAHIPLIVLSADRPAHLVGTGASQTINQTGIFGDLAPTVGITELDQVAQIAESLAQGASQIPRHFNLALDVPLVAPELPELHGEAVGASWTHRWINHGEVTVDLGEHTLVIAGDEAWEVEGLEDVPTIAEPTAPKPYNPVHPLAAEILLKEQVSAEGYVVNTRPDHVIVVGHPTLHRGVLKLMSDPGIKLTVLSRTDIITDPGRHADQVGSTVKVTGTQEKQWLKICSAASELAADGVRDVLDNQEFGFTGLHVAAAVADTLGTGDTLFAAASNSIRDLSLVGMPFDGVDTFSPRGVAGIDGSVAQAIGTSLAVQSRHPDEIRAPRTVALLGDLSFLHDIGGLLIGPDEPRPENLTIVVSNDNGGGIFELLETGADGLRPNFERAFGTPHDASIADLCAGYGIEHQVVDNLQDLIIALVDTTEVSGFTIIEASTVRDTRRAQQQALMDTVH

SEQ ID NO: 4024 - protein, 147 aa, Corynebacterium glutamicum
MEWYQVRRRARQLLIVLFIAAMLGAASMVIGPFLNDRTIEGNSGRALAQVTNVGSYRTTVDFQDENGIYHSPATGLLFPTGLGEGQRVWVNYAKSDPDLVKVEGRKWTLSIIPALSVAAVATATWSVLWLGVGRFGRRSDDANETTV

SEQ ID NO: 4025 - protein, 413 aa, Corynebacterium glutamicum
MEIIRPMRVAIVAESFLPNVNGVTNSVLRVLEHLKANGHDALVIAPGARDFEEEIGHYLGFEIVRVPTVRVPLIDSLPIGVPLPSVTSVLREYNPDIIHLASPFVLGGAAAFAARQLRIPAIAIYQTDVAGFSQRYHLAPLATASWEWIKTVHNMCQRTLAPSSMSIDELRDHGINDIFHWARGVDSKRFHPGKRSVALRKSWDPSGAKKIVGFVGRLASEKGVECLAGLSGRSDIQLVIVGDGPEAKYLQEMMPDAIFTGALGGEELATTYASLDLFVHPGEFETFCQAIQEAQASGVPTIGPRAGGPIDLINEGVNGLLLDVVDFKETLPAAAEWILDDSRHSEMCAAAWEGVKDKTWEALCTQLLQHYADVIALSQRIPLTFFGPSAEVAKLPLWVARALGVRTRISIEA

SEQ ID NO: 4026 - protein, 453 aa, Corynebacterium glutamicum
MSNRHLQLIAIGGAIGTGLFMGSGKTISVAGPSVILVYAIIGFMLFFVMRAMGELLLANLNYKSLRDAVSDILGPGAGFVTGWTYWFCWIATGMADIVAITGYTQYWWPEIPLWLPGVLTIALLFALNLAAVRLFGEMEFWFAIIKIVAIVSLIVVGLFMVVTAFESPNGTTAQFNNLIEHGGFFPNGITGFLAGFQIAIFAFVGIELAGTAAAETENPTKTLPRAINSIPIRIVVFYVLALAVIMMVTPWDQVRADNSPFVQMFALAGIPAAAGIINFVVITSAASSANSGIFSTSRMLYGLSLEGAAPKRWSRLSKNLVPARGLTFSVICLIPAVGLLYAGGTVIEAFTLITTVSSVLFMVVWSYILVAYIVYRRNSPELHKKSIFKMPGGVVMAVVVLVFFAAMLVVLSLEPDTRAALIATPVWFIILGIGWLSIGGAKGAKHRSQITSH

SEQ ID NO: 4027 - protein, 230 aa, Corynebacterium glutamicum
MAKADLDKDPFDVASMFDDVGKNYDLTNTVLSFGQDRVWRKRTRQRLDLKPGEKVLDLAAGTAVSTVELAKSGAFCVACDFSQGMLAAGKDRDVSKVVGDGMQLPFADNSFDAVTISYGLRNIHDFRAGLKEMARVTKPGGRLTVAEFSTPVIPVFGTVYKEYLMRLLPQAARAVSSNPEAYIYLADSIRAWPSQAELAREINQNGWSDCGWQNLTFGIVALHSAIKPEN

SEQ ID NO: 4028 - protein, 223 aa, Corynebacterium glutamicum
MWPYQGQIALGVFHKRVDGHRRGFQAIVDAFAVQRVHTRGGIADQHPVRASHIRHRAAHRQQGRGDVVLGPELPCFTTLTRIEAQQFLRIDLRWSRIRRERATTQIHRAVAQRENPPISWLHHTIFIAQFHMGVNPRFIRQRSFTISTSRNAIHLIALPLPTQFLTERGADTIGNNHMLRLDGFLLPCVINHNAFQEIPPQNGVLGARVLPRGYFLMRFCQAE

SEQ ID NO: 4029 - protein, 424 aa, Corynebacterium glutamicum
MGFVSTTFDVLIIGAGPSGASAAVHAARTGLQTLLIDASSFPRDKTCGDGLTPRAIHQLELLGVADQVTGDYFNKGLKLHGFGGSVEAPWPETYFTNKGSAMSRMEFDDLLFRLAKSHEEVTTWENASAQDPILRGNFLEGVVINHAGQEKTVKAKHVIIADGVRSPFGKKLGRQWQRDEVYGIAARAYCETPLSDEPWIHSHVELRDEDGVVQPGYGWIFPLGNGTVNLGCGALSTDTRPAKINTKKLLSFYAGQRRKAWQLGPEHDVASALLPMGGAVSNVAGANWMLIGDSAACVNPLNGEGIDYGLETAAMAVDTLVENPKRDLTLVWPHRLRDAYGETFMLARTAARLLTYPQFLPMAGPLAFRGPLQKAIMPAAARLMGNLITEEDKDLLARGWQAAGSAISWARKGSPLWDSTSSLV

SEQ ID NO: 4030 - protein, 350 aa, Corynebacterium glutamicum
MSSGRTVPTRSHGLGKEGVSTTGASQVEFGDPELTARINDAMVQVEELLHTELSSGEDFLVDIVMHLTRAGGKRFRPMFALLASEFGEKPLSENVIKAAVVVEITHLATLYHDDVMDEASMRRGVPSANARWDNSVAILAGDILLAHASGLMSQLGTDTVAHFAETFGELVTGQMRETVGPRDTDPIEHYTNVIREKTGVLIASAGYLGAMHAGAAPEHIDALKNFGAAVGMIFQIVDDIIDIFSETHESGKTPGTDLREGVFTLPVLYALREDTPVGAELRDILTGPLEDDETVNHVLELLSQSGGRQAALDEVYRYMDIANAELDRLPDSTVKEALRNLATFTVKRVG

SEQ ID NO: 4031 - protein, 111 aa, Corynebacterium glutamicum
MSDEQNSGVGGTSRPTGKRQLSGASTTSTSSYEAKQVSTQKKSSGSDSKPGGGVISFLPEVVGEVRKVIWPTARQMVTYTLVVLGFLIVLTALVSGVDFLAGLGVEKILTP

SEQ ID NO: 4032 - protein, 318 aa, Corynebacterium glutamicum
MSDENINEFEQDEDLNFGASFSDEFADDDFDAEADVEADAAAEASALEAEQDLEEETLDAPEEAAEEAPAAAESEAPVEEDEEADSLAQAAAALGDTDEQDADAEYKARLRKFTRELKKQPGVWYIIQCYSGYENKVKANLDMRAQTLEVEDDIFEVVVPIEQVTEIRDGKRKLVKRKLLPGYVLVRMDMNDRVWSVVRDTPGVTSFVGNEGNATPVKHRDVAKFLMPQEQAVVTGEAAAAAAEGEQVVAMPTDTKKPQVAVDFTVGEAVTILTGAFASVSATISSIDPELQKLEVLVSIFGRETPVDLSFDQVEKVS

SEQ ID NO: 4033 - protein, 145 aa, Corynebacterium glutamicum
MAPKKKKKVTGLIKLQIQAGQANPAPPVGPALGAHGVNIMEFCKAYNAATENQRGNVVPVEITVYEDRSFDFKLKTPPAAKLLLKAAGLQKGSGVPHTQKVGKVSMAQVREIAETKKEDLNARDIDAAAKIIAGTARSMGITVEG

SEQ ID NO: 4034 - protein, 236 aa, Corynebacterium glutamicum
MSKNSKAYREAAEKIDAGRIYSPLEAANLVKETSSKNYDASIDVAIRLGVDPRKADQLVRGTVSLPNGTGKTVRVAVFAQGEKATEAEAAGADFVGTDELVEKIQGGWTDFDVAIATPDQMAKIGRIARVLGPRGLMPNPKTGTVTNDVAKAIEEVKGGKISFRVDKASNLHAAIGKASFDAKKLAENYGALLDEIIRIKPSSAKGIYVKRVTLSSTTGPGVEVDTHVTKNYAEEA

SEQ ID NO: 4035 - protein, 504 aa, Corynebacterium glutamicum
METPTQDMDVRWLYTQSQLKLREILPTNKTFDVIQISELVDPTDFISPNSVVLSVGIAFAETPDGLRDWAHRLADAGVIAIGFGSGLTFPQVPQALIDASLHLGLGLFEVPREIPFISITSSVRDEQTRRAGRLQQELLLEQERLNSIAISGGIEALCRAAADYLGGAVAIVDSDGRVACSITTDDLDALPQAVSRLNGSSQALTDATNFGFIHRMTRYGDRHHVLSVLMPTRPSEQHRALIRHCAGLADILLQRPEAMRDREIEVRSLAMSLLLGRSDDLATIHRVFADITDASGNIRPILITGNTPQSVRKALSSVATALYKQERALAHLRLAESTELLFLRGSRSVHNIVQLFGTAASGVRLCIGLPTRAENIDKKLIRELTATAKTLQLGTHAEPRDGTLLWLQNPELRKILKIRSRDTYDRLLDHDRTNNTELAPTLVSFTQHSGHIGDTAKELGIHRHTVRTRMIRIEEICEIDLNDPLTRAELLLVIATKEGDVEKQ

SEQ ID NO: 4036 - protein, 448 aa, Corynebacterium glutamicum
MEDLSYRIPQSRTVAEQVPGPKSKALDERRQAAVARALAPGLPGYVVDADGGILADADGNRFIDLASGIAVTTVGGSNAAVAKAVGAAAARFTHTCFMVSPYETYVAMAERLNALTPGDHDKKSALFNSGAEAVENAVKVARAYTGKGAVVVFDNAYHGRTNLTMAMTAKNRPYKSGFGPLAADVYRAPMSYPLRDGLSGPEAAERAISVIESQVGAENLACVVIEPIQGEGGFIVPAPGFLAAISTWCRENDVVFIADEIQSGFLRTGDWFASDAEGVIPDVITTAKGIAGGMPLSAVTGRAEIMDAPGPGALGGTYGGNPVACAAALAAIEVMEQADLKTRAQEIETIIRDEFAQLSAFPEVAEIRGRGAMMAIELIDATGRPNAALTAAVAARAKAEGVLLLTCGTDGNVIRLLPPLVIAEDTLRDGLQVLVAALERETAHQKVG

SEQ ID NO: 4037 - protein, 453 aa, Corynebacterium glutamicum
MSLTFPVINPSDGSTITELENHDSTQWMSALSDAVAAGPSWAAKTPRERSVVLTAIFEALTERAQELAEIIHLEAGKSVAEALGEVAYGAEYFRWFAEEAVRLPGRYGQSPSGIGHIAVTRAPVGPVLAITPWNFPIAMATRKIAPALAAGCPVLVKPASETPLTMVKVGEIIASVFDTFNIPQGLVSIITTTRDAELSAELMADPRLAKVTFTGSTNVGRILVRQSADRLLRTSMELGGNAAFVIDEAADLDEAVSGAIAAKLRNAGQVCIAANRFLVHESRAAEFTSKLATAMQNTPIGPVISARQRDRIAALVDEAITDGARLIIGGEVPDGSGFFYPATILADVPAQSRIVHEEIFGPVATIATFTDLAEGVAQANSTEFGLAAYGFSNNVKATQYMAEHLEAGMVGINRGAISDPAAPFGGIGQSGFGREGGTEGIEEYLSVRYLALP

SEQ ID NO: 4038 - protein, 156 aa, Corynebacterium glutamicum
MHTWPALRSFAAMAPDTASSRSAASSITKAAFPPSSMEVRSSRSADWRTRMRPTLVDPVKVTLAKRGSAMSSADSSASRVVVMIETKPCGILKVSKTEAMISPTLTMVSGVSEAGFTNTGQPAARAGAILRVAMAMGKFHGVIASTGPTGARVTAM

SEQ ID NO: 4039 - protein, 397 aa, Corynebacterium glutamicum
MSSAKKKYLSVAQGVALIYGTNIGAGVLSLPYAARNGGFLALVVALLIAGTLTTISMLYIAEVSLRTKKPLQLSGLAEKYLGQWGRWLVFIAIVVNSVGALIAYASGSGILIGNLTGLPPIVGTLGFFVLGTLIMWKGLHTASFVEALITTGMATIIIVLCGWTVLGPGISADNLIVFHPFFIVPIMNLAVFTFLAQYVVPEIARGVNPATPKAVPRAIIIGMVATGVTLAAVPFAALGLLGTGVSEVVTISWGEALAPVAYYMANAFALLAMFTSFIAIGFTAMRNVLDIGHWPQHGWQRSVAVGLTVLPPLAISLAGLGGFVAALSYAGGFAGAIMSIIPVLLLRNSRKSGDQEPVWKATWQAHPIFQILLIVVYSLAFVYSVLAIVGLMPAGWA

SEQ ID NO: 4040 - protein, 650 aa, Corynebacterium glutamicum
MLVRDIFMGDNGVMNKKLNTPNPWMLFIRSFDGIITVAALVAIAIHLILWLALDLDGLAKNWPLIAIVIVGGIPLMWDVLKSAIKTRGGADTLAAVSIITSVLLGEWLVAAIIVLMLSGGEALEEAASRRASGTLDALARRAPSTAHRLLGATILDGTEEIAVEEITVGDLVAVLPHELCPVDGEIVAGHGTMDESYLTGEPYVVSKSKGSQAMSGAVNGDTPLTIVATKLAHDSRYAQIVGVLHEAENNRPEMRRMADRLGAWYTVIALALGGLGWIVSGDPVRFLAVVVVATPCPLLIAVPVAIIGAISLAARRGIIVKNPGMLENASGVKTVMFDKTGTLTYGRPVITDIHTAPGVEEDTVLALAASVERYSRHPLADAIREGAKARELHLPDVVEVSERPGQGLTGTVGEHLVRITNRRSTLEIDPDSKNYIPVTSSGMESVVLVDDKYAALIRLRDEPRASASEFIAHLPKKHKVDKLMIISGDRASEVRYLADKVGIDEVHAEASPEDKLNIVNRHNEHGATMFLGDGINDAPAMAVATVGVAMGADSDVTSEAADAVILDSSLERLDDLLHISARMRRIALQSAGGGMALSVIGMILAVFGFLTPLMGAIFQEVIDVLAILNSARVALPRGAISDFDTQEKVS

SEQ ID NO: 4041 - protein, 471 aa, Corynebacterium glutamicum
MTFRGGNTGAKHAVVVGSGPNGLTTAAVLAKAGWQVDVYEAAPTPGGAARSESVLGEGTISDLGAAGHPFGVASPAFHYLGLEDHGLEWAYSPFAMAHPLDYGRAGLLETSLPETAKKLGPDARRWKNLHQGLTKNIDKHLANLLGPVLKWPAHPIRMAKFGPFALLPAKRLASAAFETEEARSLFIGSAMHSVTPPHKPMTASLGLLFGALGMSRGWPVAVGGSGRIVDALVNVINHHGGTIHCDSQIDSLSQFRDTDAIILNQTPSQVLKLKGTDLNAGLPQRMSTWKHGPSSYKVDYLLDGPIPWSNPQVGQATTVHVGGSSEEIAFAEAEVAAGRMPERPFIILCQQQVADPSRAREGRHVVWAYAHVPRGFVDKRAALLITAQIERFAPGFRDRIVHSVDTNAEDLEAWNPNLVGGDITAGSALLRRMPTKIGEKTYMASASNAPGGGVHGMPGWWAAQAVLADHR

SEQ ID NO: 4042 - protein, 201 aa, Corynebacterium glutamicum
MEPTVKASARHTIHVTADTWRIRLSASAHSHPNDAYARRATAISAIGSVLIDVPLQGERISESTAYDGQINADWNAEVTGTDVNIARDIISRLAAVPDVQVDGPLWSLSDSLAAEAAVEALQGAADTARNTATAIAESLGGQLGALLYATTDTHSSTPIPARAEMMAAKASIPPRTLDLELAPSDIEVTKEIAVTFEFLAG

SEQ ID NO: 4043 - protein, 171 aa, Corynebacterium glutamicum
MANPRNEAALAELKARFAETDTVVLTEYRGLTVAQTTELRKALGFDVQYSVAKNTLVKIAANEAGVEGLDDLLTGPTAVAFIKGEAVDTAKVLKKFGEENKAFVVKGGYMDGNALTAEQVNAIAELDNRETTLAKLAGAMKGSLAKAAGLFNAPASQVARLAVALQDKKDA

SEQ ID NO: 4044 - protein, 128 aa, Corynebacterium glutamicum
MAKLTKDELIEAFKEMTLIELSEFVKEFEEVFDVTAAAPVAVAAAGAAGGEAAAAEEKDEFDVVLEDAGAKKIGVIKAVRELVSGLGLKEAKELVEGAPKAILEGANKDDAEAAKAKLEEAGAKVTLK

SEQ ID NO: 4045 - protein, 46 aa, Corynebacterium glutamicum
MRNRYREIELKTPPTPTNPKTQPKPTPDSTKPHPWIESRVWGFEKV

SEQ ID NO: 4046 - protein, 324 aa, Corynebacterium glutamicum
MLPKSRIFSAILLGIGVALVVWGLVAPRFVHADGRLPLDLEATTYVLHDSDAQTTINSDPLAGVVTTPVTRQLHFEVMDPASADDATIRIGDSMLRGNPDTQGFEQERLLSATVSSFRIDRTSGEVLSDIALTNQLASPTVQYSVDGIWLKFPTDAQETTYNVVDPVLRSALPADFVESTEIDGREVLHYRQVIDNVNVAEYFADANNTTTLTKEDGGTTTGYFYHNVTRDFWVDQRTGLVVDLAENIDDFYGDRSGQKYEQKLLFDASLDDAAVSKLVAQAESIPDGDVSKIANTVGIVIGAVLALVGLAGCFGAFGKKRREA

SEQ ID NO: 4047 - protein, 1165 aa, Corynebacterium glutamicum
MLEGPILAVSRQTKSVVDIPGAPQRYSFAKVSAPIEVPGLLDLQLDSYSWLIGTPEWRARQKEEFGEGARVTSGLENILEELSPIQDYSGNMSLSLSEPRFEDVKNTIDEAKEKDINYAAPLYVTAEFVNNTTGEIKSQTVFIGDFPMMTDKGTFIINGTERVVVSQLVRSPGVYFDQTIDKSTERPLHAVKVIPSRGAWLEFDVDKRDSVGVRIDRKRRQPVTVLLKALGWTTEQITERFGFSEIMMSTLESDGVANTDEALLEIYRKQRPGEQPTRDLAQSLLDNSFFRAKRYDLARVGRYKINRKLGLGGDHDGLMTLTEEDIATTIEYLVRLHAGERVMTSPNGEEIPVETDDIDHFGNRRLRTVGELIQNQVRVGLSRMERVVRERMTTQDAESITPTSLINVRPVSAAIREFFGTSQLSQFMDQNNSLSGLTHKRRLSALGPGGLSRERAGIEVRDVHPSHYGRMCPIETPEGPNIGLIGSLASYARVNPFGFIETPYRRIIDGKLTDQIDYLTADEEDRFVVAQANTHYDEEGNITDETVTVRLKDGDIAMVGRNAVDYMDVSPRQMVSVGTAMIPFLEHDDANRALMGANMQKQAVPLIRAEAPFVGTGMEQRAAYDAGDLVITPVAGVVENVSADFITIMADDGKRETYLLRKFQRTNQGTSYNQKPLVNLGERVEAGQVIADGPGTFNGEMSLGRNLLVAFMPWEGHNYEDAIILNQNIVEQDILTSIHIEEHEIDARDTKLGAEEITRDIPNVSEEVLKDLDDRGIVRIGADVRDGDILVGKVTPKGETELTPEERLLRAIFGEKAREVRDTSMKVPHGETGKVIGVRHFSREDDDDLAPGVNEMIRIYVAQKRKIQDGDKLAGRHGNKGVVGKILPQEDMPFLPDGTPVDIILNTHGVPRRMNIGQVLETHLGWLASAGWSVDPEDPENAELVKTLPADLLEVPAGSLTATPVFDGASNEELAGLLANSRPNRDGDVMVNADGKATLIDGRSGEPYPYPVSIGYMYMLKLHHLVDEKIHARSTGPYSMITQQPLGGKAQFGGQRFGEMEVWAMQAYGAAYTLQELLTIKSDDVVGRVKVYEAIVKGENIPDPGIPESFKVLLKELQSLCLNVEVLSADGTPMELAGDDDDFDQAGASLGINLSRDERSDADTA

SEQ ID NO: 4048 - protein, 1333 aa, Corynebacterium glutamicum
MLDVNVFDELRIGLATADDIRRWSKGEVKKPETINYRTLKPEKDGLFCERIFGPTRDWECACGKYKRVRYKGIICERCGVEVTKSKVRRERMGHIELAAPVTHIWYFKGVPSRLGYLLDLAPKDLDLIIYFGANIITSVDEEARHSDQTTLEAEMLLEKKDVEADAESDIAERAEKLEEDLAELEAAGAKADARRKVQAAADKEMQHIRERAQREIDRLDEVWQTFIKLAPKQMIRDEKLYDELIDRYEDYFTGGMGAESIEALIQNFDLDAEAEELRDIINNGKGQKKMRALKRLKVVAAFQRSGNDPAGMVLNAIPVIPPELRPMVQLDGGRFATSDLNDLYRRVINRNNRLKRMIELGAPEIIVNNEKRMLQESVDALFDNGRRGRPVTGPGNRPLKSLSDLLKGKQGRFRQNLLGKRVDYSGRSVIIVGPQLRLHECGLPKLMALELFKPFVMKRLVENEYAQNIKSAKRMVERQRPEVWDVLEEAISEHPVMLNRAPTLHRLGIQAFEPVLVEGKAIQLHPLACEAFNADFDGDQMAVHLPLSAEAQAEARVLMLASNNILSPASGKPLAMPRLDMVTGLYYLTLEKSSEEFGGQGAYQPADENGPEKGVYSSLAEAIMAYDRGVLGLQAPVRIRLNHLRPPAEVEAEQFPDGWNQGETWLAHTTLGRVMFNEILPWNYPYLEGVMVRKGGGSDKIMLGDVVNDLAAKYPMITVAQTMDKMKDAGFYWSTRSGVTIAMSDVLVLPNKEEMLDRYEESARQIEVKYNRGKLTGRERYDRLVELWKDATDEVGQAVEDLYPDDNPIPMIVKSGAAGNMRQIWTLAGMKGMVVNSKGDYITRPIKTSFREGLTVLEYFNNSHGSRKGLADTALRTADSGYLTRRLVDVAQDVIVRVEDCGTRQGVRVPVAAEVLDATGAVTGYTRHDLIETSVSGRVLAGDATNAAGEVVLAAGTDLTELNIDLLVEAGIKDVKVRSVLTCQTPTGVCAKCYGKSMASGQQVDIGEAVGIVAAQSIGEPGTQLTMRTFHQGGVGGDITGGLPRVQELFEARVPKNCAPIASVEGVIHLEDEGNFYTLTIVPDDGSDNVVYEKLSKRQGLASTRVAMESNAGAFIERTLTEGDRVTVGQRLLRGAADPHDVLEILGRRGVEQHLIDEVQAVYRAQGVAIHDKHIEIIIRQMLRRGTVIESGSTEFLPGSLVDLSEAKLANSEAIGAGGQPAELRSEIMGITKASLATESWLSAASFQETTRVLTDAAINKRSDKLIGLKENVIIGKLIPAGTGISRYRNISIKPTEAARNAAYSIPTYGESIYGDDGFGEFTGASVPLDEAF

SEQ ID NO: 4049 - protein, 194 aa, Corynebacterium glutamicum
MAGVAGDSTSCIQNLSSDRNANTLAGATVLNTHDDVLSDVNKTTGQVTGVSGTQRGIGQALTGTVGVVEVLENGQAFTEGSLDRAGDVVTLRVHNHALHTSKGPDLTHVTGSTRLHDHWNWVVVWVQILDSLSNLVSCVLPQLDQTVVALTAGELTAVVLNFDLACRFLVAVQHFFLVRKNQNVRHSDGHTGTG

SEQ ID NO: 4050 - protein, 60 aa, Corynebacterium glutamicum
MWKLSIGIAVGAILFGLGLWGTHFEDTVISIAGWVGTFASFAVWFWVIWWAAVGNTKSPL

SEQ ID NO: 4051 - protein, 260 aa, Corynebacterium glutamicum
MDELLKQEVKDFLTTRRARITPAAAGLETQPWSDRRVPGLRREEVADLAGISLEYYIRFERGNLKGASPEILQSLAKALQLSPIEREHLHNLAYRADHPRNLPSAETPTAPLQDIVDAVTDKPAWIRNEQMDILATNRLCAELYAPIFKDLPDRPNTARHCFIGATASEFWVDRDQFSAEFAAKLRLEYARRPSVPGLKELIDELHQKSSVFRDNWASADVLSFGSGIKRFRHPTLGERVYEYETFNLNSAPGYVLSIYF

SEQ ID NO: 4052 - protein, 266 aa, Corynebacterium glutamicum
MSARCRQFPTTRVGLSRSHYQLAAENTKSLVRMVPMTVPQGNEPAKKLATDLNRNQVVDELSAAVSRGQLTLEEFEDRSSKAWNARHLDTLVELISDVNDNPYTLLGQQFPGASYAPAAYETTPPAMPNVSDPVNIVRNRITGNPNGSKMSVSFMGGTVRKGGWHVPNVHTSFAMMGGNQIDLRDAFLESDRIQINAYTFMGGIEIIVPEGVFVICDGMGIFGGFEQSVDKAGALNPARLPSNAPTVHIKGLAFMGGVSVVTKKNI

SEQ ID NO: 4053 - protein, 122 aa, Corynebacterium glutamicum
MPTIQQLVRKGRHDKSAKVATAALKGSPQRRGVCTRVYTTTPKKPNSALRKVARVRLTSGIEVSAYIPGEGHNLQEHSMVLVRGGRVKDLPGVRYKIVRGALDTQGVKDRKQARSRYGAKRG

SEQ ID NO: 4054 - protein, 155 aa, Corynebacterium glutamicum
MRKSAAPKRPVVQDPVYKSELVTQLVNKILIGGKKSTAERIVYGALEICREKTGTDPVGTLEKALGNVRPDLEVRSRRVGGATYQVPVDVRPERANTLALRWLVTFTRQRRENTMIERLANELLDAANGLGASVKRREDTHKMAEANRAFAHYRW

SEQ ID NO: 4055 - protein, 705 aa, Corynebacterium glutamicum
MLKDLNKVRNIGIMAHIDAGKTTTTERILFYTGINRKVGETHDGGATTDWMEQEKERGITITSAAVTCFWDNNQVNIIDTPGHVDFTVEVERSLRVLDGAVAVFDGKEGVEPQSEQVWRQATKYDVPRICFVNKMDKLGADFYFTVGTIEDRLGAKPLVMQLPIGAEDNFDGVIDLLEMKALTWRGVTPIGTEATVEEIPAELADRAAEYREKLLETVAESDEELMEKYFGGEELSIAEIKAAIRKMVVNSEIYPVYCGTAYKNKGIQPLLDAVVDFLPSPLDLGETKGTDVKDPEKVLTRKPSDEEPLSALAFKIAAHPFFGKLTFVRLYSGKVEPGEQVLNSTKNKKERIGKLFQMHANKENPVEVAHAGNIYAFIGLKDTTTGDTLCDANAPIILESMDFPDPVIQVAIEPKTKSDQEKLGVAIQKLAEEDPTFTVHLDDESGQTVIGGMGELHLDVLVDRMKREFKVEANIGDPQVAYRETIRKPVESLSYTHKKQTGGSGQFAKVIITIEPYAPEADELEEGESAIYKFENAVTGGRVPREYIPSVDAGIQDAMQYGFLAGYPLVNVKATLEDGAYHDVDSSEMAFKLAGSQAFKEAVAKAKPVLLEPIMSVEITTPEEYMGEVIGDVNSRRGQIASMDDRAGAKLVKAKVPLSQMFGYVGDLRSKTQGRANYSMVFDSYAEVPANVAADVIAERNGTAS

SEQ ID NO: 4056 - protein, 720 aa, Corynebacterium glutamicum
MGRRKANCFSTFSFGSKRSLGSGAVALSNNICGNVGWDLSVGIEDHGVVCTTLGLRAKVTDVTEHLRQWNLSLNQLGACTVIHGSDLATAGVHVTDDFTHVLLRSGDFNGHDWLEEDWLCLCNSFLERLGTGELEGHFRGVNVVVSAIFKGCLDVNQWVASQEAVLHCVLDTSVNGWDVFTWNTTTGDSVLELVDCGLALFKLVCLRCVRLNGDDDLSELTGTTSLLLVGVAEGLNRLTDGLTVSNLWVTDVCLNLELALHAVNKNIEVQLAHAANDGLAGLIVQVNGEGWVFFSKLLDSYAELLLVRLGLRLNSNLDNWIREVHGLKNDWSVCVTEGVTGGGVLQADERVDVTSVCNLNRVFLVGVHLEQLTNAFLLVLGGVKNLLAWLNLAGVQTNEGQLTEEWVSCNLECKCRQWLFVGRLTGQNLLRILNVSALGLAEIQWGRQEVNDCVEQWLDALVLVGGATVNRVDLRVNNHLTDSCLDLSDAELFATEVLLHELFVGLCNGLEKLLTVLSCAVCELCWDLLNGSFGTNWGNSTPGQCLHFKKVDDAVEVVLSTDWELHNQWLCTQAVLDGANGEVEVSTELVHLVHEADTWNVVLGSLTPNLLRLWLNAFLAVEHSNCAVKHAEGTLNLNGEVNVARGVNDVDLVVIPETGNRGGGNGDAAFLLLLHPVGGCATVVGLTDLTVDAGVEEDAFGGRGLTSIDVRHDADVADLV

SEQ ID NO: 4057 - protein, 48 aa, Corynebacterium glutamicum
MLLKADFKISNKPLPHLPYAPTDTLKRAGWGVEKQIAFRRFPSDLNDL

SEQ ID NO: 4058 - protein, 76 aa, Corynebacterium glutamicum
MPMMSTSSFTFRVPRSTRPVTTVPRPVMVKMSSIGMRNGLSVSRTGSGMLSSQACMSSRICLPHFSSPSRAFRAEM

SEQ ID NO: 4059 - protein, 51 aa, Corynebacterium glutamicum
MTEIAPNKLSARYRNREIEPKTPTRQTNSETNPRNDKTATPEDISSGIAVS

SEQ ID NO: 4060 - protein, 243 aa, Corynebacterium glutamicum
MKDPSRIPPVVAQLQKVWEAQPDLALPTLLGILGNRGIGWGSTDEDLVEALNTMYTENPGEIRGGSRLADPQREVPGRFLVETESPAYRITVDPFRISVRRIAKGPHRPLQPGVWEFQEIRRCRSGEPLLITDVEGIDHRLGVVVRITLLNDSPAPTTKSLDKVRRREVGDKVFYLHFESGDTALLNHGLEIYQASRRTLEQHSVKWDQLITATPGQLLKLKETGSGKILELGVLEKIIPLEG

SEQ ID NO: 4061 - protein, 264 aa, Corynebacterium glutamicum
MNNRLTMEDVTMAYDNRVIAEHLNVTIPDNTFTAIIGPNGCGKSTLLRGFSRVLNPQHGKVLLDGRQLDSFKPKEIARELGLLPQTSIAPEGIRVYDLIARGRAPYQSLIQQWRTSDEDAVAQALASTNLTELAARLVDELSGGQRQRVWVAMLLAQQTPIMLLDEPTTFLDIAHQYELLELLRAFNEAGKTVVTVLHDLNQAARYADHLIVMKDGHVHATGTPEEVLTAEMVQGVFGLPCIISPDPVTGTPTVVPLSRSRAGA

SEQ ID NO: 4062 - protein, 345 aa, Corynebacterium glutamicum
MQRRRFSFRIPARLMVVSLILFAIALCSATWAITMGDYPLSLGQVINALAGTGEKFQLLVVREWRLPVAIAAVVFGALLGIGGAIFQSITRNPLGSPDVIGFDAGSYTAVVLVILVLGNTHYWSIAFAAIVGGIVTAFAVYVLAWRKGVQGFRLIIVGIGVSAMLSSVNAYLITRADVEDAMVVGFWSAGSINRITWQSLLPSLVIAAVIIVAAIVLARSLRFMEMGDDVATTLGVKTNSTRLALIVVGVATSALVTAAAGPISFIALVAPQLARRLTKTPGVSLVAAAAMGSALLSCAHLLSLIISSFYRTIPVGLLTVSIGGCYMIWLLLRETRRQYRTGTIR

SEQ ID NO: 4063 - protein, 345 aa, Corynebacterium glutamicum
MAVEKQKETSISKNLGRRRALGILGIVVALGALIVLSIAVGANPLSFSSVWQGFTAHDSSEASIIVWSMRIPRTLVGIVTGAAFGVAGALIQALTRNPLADPGILGVNAGAGFAVTVGVGFFGLSSVTGYIWFAFLGAAAATLLVYFIGASTSGSVNPVALVLAGVALAAVLGGVTSFLTLIDPETFESIRNWNLGSVARTDLSDTMTVLPFLAVGLAIALLLSGALNSIALGDDLAASLGTKVMRTRVLGIISVTLLAGGATALTGGIGFVGLMVPHVVRWVVGPDQRWIITFSALCAPVLVLGADILGRIIARPGEIEVGIVTAVIGAPVLIALVRRRKASGL

SEQ ID NO: 4064 - protein, 172 aa, Corynebacterium glutamicum
MGILKATSRALTSRAQFHTTRHHWKNLTSPADIYGNINSTHVAGTRVMNGIGGSGDFTRNAFASTFISPSAAKVDAISAIVPFASHIDHTEHDAMVVITEYGYADLRGLSPKQRVPKMIAIAHPDYRPLLEAYFDRALNSADSYQHTLHDLRTAFDFHNRLNSQGTMKIEKA

SEQ ID NO: 4065 - protein, 101 aa, Corynebacterium glutamicum
MAGQKIRIRLKAYDHEAIDASARKIVETVTRTGARVVGPVPLPTEKNVYAVIRSPHKYKDSREHFEMRTHKRLIDILDPTPKTVDALMRIDLPASVDVNIQ

SEQ ID NO: 4066 - protein, 218 aa, Corynebacterium glutamicum
MSENEIKGILGTKLGMTQIFDEENRVIPVTVVEAGPCVVSQIRTVETDGYNAIQIAYGEIDPRKVNQPLTGHFKKAGVTPRRHVTEIRMDDVSGYEVGQDVTVEIFNDIKFVDVTGTTKGKGYAGAMKRHGFAGQGAGHGNQAAHRRVGGIGAAATPGRIFKGKRMAGRMGNDRVTTQNLKVQKIDADANIILIKGAIPGNRGGIVTVKTAVKGGAHA

SEQ ID NO: 4067 - protein, 229 aa, Corynebacterium glutamicum
MCTALHCGLNGNDATTVTRDCALDKDDVGIGVNLLNLEVLGGDAVITHAASHTLALEDATWGSSCTNATYAAVCSLVTVAGTLASEAMALHSAGVALTLGGTGDVNELDVVEDFNGNVLSNLVTGDIVHTNLGDVAAGGNACFLEVTSQWLVHLAWVDFAVGDLDGVVAIGLNGANLGNYAWTRFNDGNRNNAVLLVEDLSHAELGAQNALDLVFTHYLFSAAKNSVDH

SEQ ID NO: 4068 - protein, 218 aa, Corynebacterium glutamicum
MTNLKLDVQTADGNINGSVELPAEIFDREVSVALLHQVVNAQLAAARQGTHSTKTRGEVRGGGRKPFRQKGTGRARQGSIRAPHFTGGGISHGPKPRDYSQRTPKKMIKAALYGALSDRARNARIHVVSELVPGQTPSTKSAKAFIERLTERKSVLLVVSREDINAQKSANNLPGVHILAADQLNTYDVLKSDDVVFSVEALHTFINRASGAAQEEQN

SEQ ID NO: 4069 - protein, 101 aa, Corynebacterium glutamicum
MATIANPRDIIIAPVVSEKSYGLMEQNVYTFFVSTDANKTQIKIAIEEIFGVKVASVNTVNRAGKRKRSRTGFGTRKATKRAYVTLREGSDSIDIFNGSVA

SEQ ID NO: 4070 - protein, 109 aa, Corynebacterium glutamicum
MSFSIDVLSDGAVEDVDGVAAFAKSHISALGSLASTEAGAGALALTCTVNGVHRCNLDAEDLFDGNLDLSLVSVSGDEERVNVLLHEAVGLLRNDRCDDDVAWVGDSSH

SEQ ID NO: 4071 - protein, 280 aa, Corynebacterium glutamicum
MAIRKYKPTTPGRRASSVSMFTEITRSTPEKSLLRPLSKTGGRNSHGHITTRHRGGGHKRRYRVIDFRRNDKDGVLAKVAHIEYDPNRTANIALLHYFDGEKRYILAPKGLTQGTVIESGAAADIKVGNNLPLRNIPTGTTIHNVELKPGAGAKLARSAGASIQLLGKEGSYAVLRMPSSEIRRVDIRCRATVGEVGNAEQINIRWGKAGRMRWKGWRPTVRGVVMNPVDHPHGGGEGKTSGGRHPVSPWGQKEGRTRKPKRYSDDMIVRRRRANKNKKR

SEQ ID NO: 4072 - protein, 92 aa, Corynebacterium glutamicum
MPRSLKKGPFVDEHLLNKVDAQNEKGTKQVIKTWSRRSTILPDFIGHTFAVHDGRKHVPVFVDDAMVGHKLGEFAPTKTFKGHVKDDKKGRR

SEQ ID NO: 4073 - protein, 95 aa, Corynebacterium glutamicum
MTLEGLGRGEFAQLVANHGIVHENWHMLASIMDSKGVTDEIGENGGTAGPGLDDLLGSLFVLSIYLVEEVLIDERTLFKAAWHSSLPPLSASCSC

SEQ ID NO: 4074 - protein, 120 aa, Corynebacterium glutamicum
MSDNITSASATARFVRVSPMKARRVIDLVRGKTVVEALSILKYAPQAASEPVAKVVASAAANAENNFGLDPRTLVISEAYANEGPTMKRFQPRAQGRAFQIRKRSSHITVVVESQKEGAN

SEQ ID NO: 4075 - protein, 248 aa, Corynebacterium glutamicum
MGQKIHPHGLRLGITSDWKSHWYADKSYADYVAEDIKIREFLSKGLDRAGIADVVIERTRDRVRVDIHTARPGIVIGRRGAEADRIRRELEKLTGKQVALNILEVKNVDANAKLVAQSIAEQLTNRVAFRRAMRKAIQSAMRQPQVKGIKVVCSGRLGGAEMSRTERYHEGRVPLHTLRAEIDYGTYEAHTTFGRIGVKVWIYKGDVVGGRRESEINAPAERRGRGDRNARPRRGGQRRQRAEQKQEG

SEQ ID NO: 4076 - protein, 138 aa, Corynebacterium glutamicum
MLIPKRVKYRRQHRPTRSGISKGGNRVTFGEYGIQALEPAYITNRQIESARIAINRHVKRGGKVWINIFPDRPLTQKPLGVRMGSGKGPVEKWVANIKPGRILFEMSYPDEATALEALRRAGQKLPCKVRIVKREDQL

SEQ ID NO: 4077 - protein, 76 aa, Corynebacterium glutamicum
MAIGTPAHEFRELNEEELVTRLNEAKEELFNLRFQLATGQLTNNRRLRTVKRDIARIYTVIRERELGLSVVPGAEA

SEQ ID NO: 4078 - protein, 92 aa, Corynebacterium glutamicum
MSEANVNNQEKSTRKVRTGYVVSDKMQKTIVVEVEDRKQHALYGKILRSAKKVKAHDEEQIAGIGDLVRIEETRPLSKDKNYRLIEIVEKAK

SEQ ID NO: 4079 - protein, 98 aa, Corynebacterium glutamicum
MTPKLLSLFDDLDQTVVLVLGQWAGLFDANQVTDSGDLLLIMSLDLLRGAKDLAVESVLLAVFDLDNDGLLHLVRNHVASADLAGALFLVVHVCLTHD

SEQ ID NO: 4080 - protein, 106 aa, Corynebacterium glutamicum
MIRWWLNLHAPSIRNIRMAHENQKTVSIFAWLSVLVVAILGYVLWLVPISWYGIREWIYPIIAVPLIGYALFTAFKSKSWVLGICAILALLSPTIWLTAGFFVFGF

SEQ ID NO: 4081 - protein, 232 aa, Corynebacterium glutamicum
MSLRKNLALGSSTVLLTAVLSGCVSLDERSTDTSTENVTTVTATLTSTAAAEPTTRTTVQSATEASTTAPVQCNLDPRTSDFGPYLAQSRTPVGELAGSADSVVQVPDWFYHFQMGDNGYDSCSKLSYVVLNGSNGDAERSTGTGAAIADVVVLFIDGHMVARPAPFEMKTVESVTRVSDSEIQVVYGHAGRSTAEGVTDYFTFNFFVDNGVLSGRGDLPEHIDTHMRLYLL

SEQ ID NO: 4082 - protein, 122 aa, Corynebacterium glutamicum
MIQQESRLKVADNTGAREILCIRVLGGSTRRFAGIGDVIVATVKEATPGGNVKSGEIVKAVIVRTKKETRRADGSYISFDENAAVIIKNDNEPRGTRIFGPVARELREKKFMKIVSLAPEVI

SEQ ID NO: 4083 - protein, 104 aa, Corynebacterium glutamicum
MKVHKGDMVLVISGPDKGAKGQVIAAFPKTEKVLVEGVNRIKKHVANSAPERGAESGGIVTQEAPIHVSNVMVIDSDGNPTRVGYRFDENGKKVRVSRRNGKDI

SEQ ID NO: 4084 - protein, 191 aa, Corynebacterium glutamicum
MTENYIPRLKTRYQDEIRTKLQGEFEFENVMQIPGVTKIVVNMGVGDAARDSKLINGAIEDLTAITGQKPQLRRAKKSIANFKLREGMPIGAKVTLRGDRMWEFLDRLLTVALPRIRDFRGLSDQQFDGHGNYTFGLTEQTMFYEIDVDKIDRPRGMDITVVTTAVTDDEGRSLLRELGFPFKGEDGNRQQ

SEQ ID NO: 4085 - protein, 344 aa, Corynebacterium glutamicum
MSTQWVTFRGKLPNQNKGTFMNVQRKLLAIVGAFMAGSLALGTPTAQAQSIGSSASQRTEVLRGLTSSAGIPDATAPEGGAKVVVFGDSHASGTNAPFDVDERGCLKGNQSWPDQLQAQQGLQQGELIDLSCNGASINSTGFHFSDEVRHAEALGAIGPNTENIFIQFGKNDQWGHSPINLRYSVINCLFDAANGCGEKAVAAGTMQDPSSVTGENYAQRMKPVIDYLKYYAPNAQITLLGYQEYTPRSGSEICVRVGGTELRKPDATNLVSYMNNLESAIFEASEILDVQHANLREATAGHSSCSAEPWVNGVLDMRVNAVGGTWHPSPKGDEVTAGLLGTLM

SEQ ID NO: 4086 - protein, 269 aa, Corynebacterium glutamicum
MTLSLPPIGFGTVHLDGAPGVEAIATAIDAGYRLIDTAYNYENEGTVGKAVRESGVPREELIVTSKLPGRFHARDLGRVRIEESLYRLNLDYIDLLLIHWPNPSKDLYVEAWETLIEVRDAGLVKHIGVSNFLPNHIDRLRRETGELPAVNQIELHPYFPQVEQVDFHDELGIITEAWSPLSNGRGLVEEPLLKEIGERYGVGSGEIALAWHHARGIVPIPRSTNPARQRSNLEAVKISLIDEDVQAITALARKNGRIKDQDPAVYEEF

SEQ ID NO: 4087 - protein, 164 aa, Corynebacterium glutamicum
MPEQVEQPNQAREELERIFPQWFVSAAENRDMSVGQAMKFSPKRWLFPDFSFSYDDQDFVMPLIINFDSLINDLLAHQPGAFHYPGVTLSFPNNWEDLSHKQIQDCLWNALEEWFYFLEIYTWSAVDQRKYEHGQVPGDLRIGCLFEFFSSSRPNLQFLTDPLP

SEQ ID NO: 4088 - protein, 305 aa, Corynebacterium glutamicum
MGRITQNLQVPRVVSTDEQVFVNTRPDTVAVEEPLEIRVNGTALTTTMRTPGHDIELVHGLLLSEGLITDASEVFTARYCAGAVGPDNQNTYNVLELDVIPKDNPARDPVQNPSHNPEGSQHEALHIPTFQPVRELNLVAAQRNVLTTSACGVCGTTSIEQLMNKKGWPITPITPDPRMIVSLPDKLKSKQKIFDKTGGVHAAGLATLDGEMLIIREDVGRHNAADKVIGNMLMAGKLPLENTILVMSSRASFELVQKAAMAGISGVIAVGAATSLAIEAAQDSGIFLAGFVRGNKFNHYAGELG

SEQ ID NO: 4089 - protein, 112 aa, Corynebacterium glutamicum
MQPSSETSFTVDTTPSKNNEAEKMQKMYQWLDTVCTELDIDPDILAEVVPHLLNLTRDVAHGPSRPAAPMTSFLLGLAAGRSGTSTDDWAESTLVNALHLQEIIAKNYPEAK

SEQ ID NO: 4090 - protein, 711 aa, Corynebacterium glutamicum
MLTMNKPGGIDCPGCAWPEPSTANLGVVEFCENGAKAVAEETTPDRAGKEFWAEHSIYDLREKTDHWLGKRGRITEPMFYDRSSGDDHYRPISWDRAFAIIASKLREIEPDEAVFYTSGRAPNEPAYMLQLLARRLGTNNLPDCGNMCHESTGTALGETLGLGKGSVVMEDFYNTDLLISVGQNPGTNHPRALTAFKELKENGGKILALNPMPETGLMKFREPQSVKGALSISDKLADEYLQIRLDGDRAFFQALNKELIRRDALDHAFLDKFCSGVDETIEHLKSLDDEVLLKGCGLTAAEINKAADMVEKSDTVVVSWTLGVTQHKNAVYTIREMVNFLLLTGNIGKPGAGTAPLRGHSNVQGDRTMGIWEKMPEAFLAALENEFGFDVPRKHGFDTVNSLRAMREGKTKFFLSLGGNLVRVSSDTSVVEKGMESNELTVHLSTKPNGSQAWPGEQSLILPVIARTDKDVQKSGVQRVTVEDSAGAVHASTGKRTANKDLNLKSECDIIGTIGKQTFGDAFWQPMIDNYDVVRDHIEATIPGFHDFNRRIDNPGGFLLPNGPRERIFNTSNGKAQLTVNETNVIELPKDYLLMNTVRSHDQYNSTIYGLDDRYRGVRNGRRVVFVNPQDCKQRGLKDGDIVDIVSVFDDGERRAPNFRVVEYDTARDCVTTYFPEANVLVPLDSVAEKSNTPVSKSVVVRLEATGRTAS

SEQ ID NO: 4091 - protein, 252 aa, Corynebacterium glutamicum
MSWTTKSLHLQILRTKCSKTTSAHRRSNAHYSVYRIENERFKALTITFSRVALTTLAVTATTLSLSTAANAQSSLLDKTLDARQCIDADNVWVSVDYGADSEKEPEGACATEFTDGVVALESAGFKLTFDESEMGKYMTGINGVVPDWVETGTYWSYYSGEVADDYSVDYTYYEVGASNSEPEGGTVEAWVVGTGEETPALETLPETPAATGSSEDGGWIAVIAGLLALIGGGVAALYQGLITIPGLVLPKF

SEQ ID NO: 4092 - protein, 268 aa, Corynebacterium glutamicum
MINAITLKPKTFLTLSFLAVLSIVIFFWPLIVNPESFLSDKAQAPLYIAIVIPLVLAAVIAEISENGFDVKAVAMLGVLTAMVAVVRPFGAGAAGFEAVFFVLILGGRAFGPGFGFILGNTGLFASALLTAGIGPWLPYQMLAAAWVSFGAGLLPQVRGKKEMLIIVLYAIVSSLGYGTMMNMSFWPYAIGVTSGLSFTPGAPVLENLHTFMLFCLTTSMGWDLGRAFFTSVLLLLTAKPVLGALRRASRRAAFGVERDFGEAGVPRV

SEQ ID NO: 4093 - protein, 554 aa, Corynebacterium glutamicum
MLELESVAASYYDDERTLAAPQISDVNLTLFEGEILLVVGRTGSGKSTLLNAMSGAMPHATGGRLDGRVRVVGRDTRDFPPRMLSDVVGVVGQDPAASFITNTVEEELAYSMEQLGLPPAVMRKRVEETLDLLGIAELRYVPLAELSGGEQQRVAIGAVLTTRPALIILDEPTSALDPNGAEDVLATVTKLAHDLAMTVVLAEHRIERVLQYVDRVAHVGADGHVTVGTPEEIMADSDVAPPIVELGRWAGWAPLPLSIRDARAHSADMRKRLYQRGLVVNKLHNHAVQPLLIAEDIMVDFPEIRAVDGVNLNLNSGEITVLMGRNGCGKSSLLWALQGSGTRNQGSVQVLDEAAGFSWTDPKTLKPAKRRNLVSMVPQTPTDILYESTVHAELARSDKDAAAPAGTTREILDSLVPNIPDHLHPRDLSEGQKLSLALSIQLAAKPRVVFFDEPTRGLDYDGKKSLARSFQQLADDGHAILVVTHDVEFSALCADRVLFMASGKIISDGTAVEILPASPAYAPQVAKITAGIQEESHWLTVSAVKAALGHGEIS

SEQ ID NO: 4094 - protein, 382 aa, Corynebacterium glutamicum
MKWIERYVLSRRMVHPWAWWVWALGIAGCASMTNNPYILALTFATLCFVVFNRRGSSPWSRAFPIYLMIAGWLVVYRLVMHIVVGAKIGTIELFRIPPVQLPEWAAGIHVFGTVYLEGLIIATTQGLTLGTMIVAVGAANSLADPKKLLKSLPGALGELGTAVVIGISIAPQMAESAFRINRARTLRGDDAKGVRGFARILMPVFQDTLDRSLALANSMDARGYGRQAHVSKFQQRVTSIFGAFGILGVTVGLFVVLDASSPMFVAVPVFITGVGFLIISLVVASHRKTSTTFDQLPWGAAEWLVCITGVIPLLMAALTRYLDPGSMITTWVPLHMPDTVPLLVVAGLVVATMPGFLTPRLPKNKVRVKRRKAINSPERAEV

SEQ ID NO: 4095 - protein, 358 aa, Corynebacterium glutamicum
MMSRTSTFHLSLKSFAAAVALWIVLAISPWVPSAHALTTPCEDDQVTVMVEGNTIGCADAGGNGYQTLLDAGFDVETTVQFPEFLCRINDFPGPDVDDCMTASPAEAYWSYWHAPLGGDEWEYSNLGAFLYYPKPGTVEAWYWGDTDRPGAIPVSKSQAELGLDSADPDYKIDFDPNDFITTTPTSESPIADLGGDEEPTETTEAPIAGAGAGSARGQAAEPTAEVNPENPNEVLVYQDSEGNSITKGQYENLVAAAAAKTTAAVQAPAGAGEANSQPQATAVAEAPEVDPMTTQVLMAPAGQDGDVMAEGSTQQTYATGTVDSSAQGWIIGLTLAVISLVSASAVAAWAIRRSEVQG

SEQ ID NO: 4096 - protein, 394 aa, Corynebacterium glutamicum
MAHLRGKRTIRWSAATVALATGVSLLAPQVVAAQDASSDIQLATQFIEKEFATNGLIPGPVGTPDIGLNQDLLLSLNALAPDSPEIDAAYAAIAPELEGYVSVSDYIFSDRLAKTVAFQDALGVRDADFIAQLVSAVQENGQIKNLDNGEATTAINNFSQAWGVLALHRVGETEAAERATEFLKTQVCSDGGVQLASAIEPTCKTTDSDVTAMAAQALTLANGAQDPTTQATLDYLVTTMDETGGVKNTWTGVNSNSTGIVGSAFALAGDEENYLKAREYLASVQFGEDADPSIQGGFAFTVKAKETNTAISDQIRRATGQAALGFAGGNYANDKLITIANPVDPTPDPEIPTPPADSEGSTGGIGGAGIIIAILAILAAIAGVMGPMMANLQF

SEQ ID NO: 4097 - protein, 156 aa, Corynebacterium glutamicum
MEEFGSGPIHGSGYFENYLPIDYSEAGFHHYLKERTDAADPSVPPPEGFVHCSYFWIVDDDDVLVGFLALRHELNQHLLEVAGHIGYGVRPSARRKGAATAALKLGVHEAQALGIDKVLLCVAGDNEASRNVIEKCGGVYESTIRGMRRYWIATDS

SEQ ID NO: 4098 - protein, 132 aa, Corynebacterium glutamicum
MTMTDPIADMLSRVRNASNAHHDTVSMPSSKIKANIAEILKQEGYIANYTVEDAKVGKTLSLELKYSNTRERSIAGLRRVSKPGLRVYAKSTNLPQVLGGLGVAIISTSQGLLTDRQATEKGVGGEVLAYVW

SEQ ID NO: 4099 - protein, 178 aa, Corynebacterium glutamicum
MSRIGKEPITIPSGVETKIDGQLVEVKGPKGTLNVNVPEPISVAVEDGKIVVTRPDDHRTNRSLHGLSRSLVNNLVVGVTEGYTIKMEIFGVGYRVALKGKDLEFSLGYSHPVLIEASEGITFAVDGNTKLSVSGIDKQKVGQVAAVIRRLRKDDPYKGKGIRYEGEQIRRKVGKTGK

SEQ ID NO: 4100 - protein, 134 aa, Corynebacterium glutamicum
MSNTENKQKRVSVGKDIATRRRVARARRHFRIRKNLRGTPEAPRLVVHRSSRHMHVQIIDDVAGHTLAAASSIEAEVRATEGDKKAKGAKVGQLIAERAKAAGIEQVVFDRAGYKYHGRVAALADAAREGGLKF

SEQ ID NO: 4101 - protein, 211 aa, Corynebacterium glutamicum
MPGRERRDGGRSADDNKQNDRNERRGGGRRDDRRNQQQDERSQYIERVVTINRVSKVVKGGRRFSFTALVIVGDGKGMVGVGYGKAKEVPAAIQKGAEEARKNFFRVPMVNGTITHPVQGEKAAGIVMLKPAAPGTGVIAGGAARPVLECAGIQDILSKSLGSDNAINVVHATVDGLKQLVRPEEVAARRGKTIEEVAPARILRARAGQEA

SEQ ID NO: 4102 - protein, 61 aa, Corynebacterium glutamicum
MALKITQIKGTVGTKPKHRENLRSLGLKRIRHTVIRPDTPEVRGMILAVRHLIVVEEVAGE

SEQ ID NO: 4103 - protein, 148 aa, Corynebacterium glutamicum
MSEPIKLHDLRPAAGSNKAKTRVGRGEASKGKTAGRGTKGTKARKQVSAAFEGGQMPLQMRLPKLKGFKNPNKVDYQVVNIADLAEKFPQGGDVSIADIVAAGLVRKNELVKVLGNGDISVKLNVTANKFSGSAKEKIEAAGGSATVA

SEQ ID NO: 4104 - protein, 243 aa, Corynebacterium glutamicum
MELNWFAHCYLLPRHFFDDDQVANCQDHATYLWGIGADHGVADSLQTEGTKIFAMLGLGAHSAFDLSNLQRHFLRLLTCACTQNTCWCDLFDGLATAGCNLFRADQLLQAIHSCVDDVDSVVRTKGLGQDVLDTCALKNWTCCATGDNTGTWSSWLQHNDAGCLFALNWVGDGAVDHWDAEEVLTSLFCTLLDCGRNFLGLAVTDTDHSLAVANDDKCGEAEATTTLDDLGHTVDGDYTLDVL

SEQ ID NO: 4105 - protein, 107 aa, Corynebacterium glutamicum
MESSNSQAQGRADRILDSALKEGASIVVDGRTAREFQMDIEVGMVGINVPIPVPIGAFSFGGWKDSLFGDTHMYGSESFNFYTRSKVVTTRWPLPNESQIELGFPTH

SEQ ID NO: 4106 - protein, 121 aa, Corynebacterium glutamicum
MQHPPVPGKSILAFYAVVLVALCLWFKIGSIPDIVVIGFILALSFASAIITAALTQKSPQWVLLTVGLVGLIIVGICIYLWITVPEGILDVAVLLVASGAVIAESSLLISRMWPRRRQATS

SEQ ID NO: 4107 - protein, 152 aa, Corynebacterium glutamicum
MSASGRIIAEDFPPSSKVTGRSSSPQAAAIFFPTGVDPVNATLSTPGWRTRASPKRPEPVSRLTTPAGTPAASMASMMKRIDSGVGEAGLMMTVQPARSAGASLMTTRLIGKFHGAMSAQTPMGSLSTMDSALPAGNGRMSSPSNQGARVAK

SEQ ID NO: 4108 - protein, 497 aa, Corynebacterium glutamicum
MNAATRRASLQLPYTHVDDFYINGSWVKAEGTQRNPVVDPAVGQEWGSVPEATASELDSAVGAARTALKSWSALTGAERTGYLLKIATEIESRSEALALTNTRENGSPISETRGAASNAAGIFRYFATLAPWLDGEDIRPFPAGSAESIVDKDPIGVCALIAPWNFPINLVVIKLAPALLAGCTVIIKPASPTPLSIRFIIEAIEAAGVPAGVVNLLTGSGRFGDALVRHPGVDKVAFTGSTPVGKKIAAACGELLRPVTLELGGKSSAIILPDADMSVLSTRLIRSCMRNTGQTCYISTRIIAPSSRYAEVVQTVASTIAAGRQGDPYDEETVFGPVASASQYSTVMSYIDSAREEGARVVAGGTRSISLSEGLESGEFIQPTVFADVTPDMRISREEIFGPVISILKYDDTNGVSEAIALANNTKFGLGGLVFGADEEQALEVARQVDSGSVGINFFGSNHSAPFGGRHESGMGVEYGIEGLSAYLTYKSIHRTI

SEQ ID NO: 4109 - protein, 245 aa, Corynebacterium glutamicum
MTRSNLPAWEQADPSVHASDPRAITFAEDFGIRPIPAVGPIDTTAICATPSNGFEQLWKAIEPETRTRANDIHLPIVVAYAERLCDAYPLADRELVLVAAILHDTGWAHVDESRIISEGFSGNWRKAAIRFEHETEGCTVARRVLPSLGYTVDFVEHVCDIIDGHDTRQVAYSLEDALVRDCDRLWRFDRAGITASSSWFGMPVSDYVDRLHREILPELITEAAHQMATADLNRAKALLRTDAIR

SEQ ID NO: 4110 - protein, 102 aa, Corynebacterium glutamicum
MIQPHTCVSGVVNERSMPSVTLIWQDKREQSSRSTAAPHSISSSISSIGGSASYCAGSTNTWQVAHDKEPPHSATIPGTPFRTAVSITESPTVASMVRVLPA

SEQ ID NO: 4111 - protein, 422 aa, Corynebacterium glutamicum
MNTSAETGILIIGANQSGVQLAISLRATGFTESITLLGEEDHRPYQRPALSKEFLQDKIDKERLIFRSNEYWEENNIRLVKGVRIERIEKNDDGSGVAYGAGQEFAFRRLALAVGARPRHLDLPGATLEGVTYLRNADDALALKAMIGSVTDAVVVGGGFIGLEAACSLHDLGKNVTVLEYGPRLIGRAVGEETAAFFLEQHRSRGVNIVLDARMKQFVGKDGKLSGIELEDGTVIPAQLVIVGIGVIPNTELAAVLGLDINNGIVVDKHAVASDGTTIAIGDVANIPNPIPGSPADERIRLESVNNAIEHAKIAAYSLVGQPEAYAGIPWFWSNQGDLKLQIAGLTLGYDSTVIRQDPEKKKFSVLYYRGDNIIAADCVNAPLDFMAVRSALSRNQNIPADLAADISQPLKKLAVDLEVTR

SEQ ID NO: 4112 - protein, 106 aa, Corynebacterium glutamicum
MSTIHFIDHAGKTRTIEATVGDSVMETAVRNGVPGIVAECGGSLSCATCHVFVDPAQYDALPPMEEMEDEMLWGAAVDREDCSRLSCQIKVTEGMDLSLTTPETQV

SEQ ID NO: 4113 - protein, 248 aa, Corynebacterium glutamicum
MPSPRTVLITGAAGGLGRAFAEGFAAQGDRIAVADINLDGAQETVDKLKALGADAAAFEVDVTSLESTEALAAGAAEFGGGRIDVLINNAAIYATVTRSPFEDIDPAEWDLVMGVNLKGPWLVTRSVSPFLSDNARVVNLSSATVFSGSAHWAHYVASKGGVIALTRVLAKELGGRGITVNAVAPGFTLTEASLGLMDSAETYGVDRGSIKRASQPKDIVGTTMFLASPEAEYITGQTLIVDGGRQFI

SEQ ID NO: 4114 - protein, 71 aa, Corynebacterium glutamicum
MVVDAAPVPVTAGKPYSRHTIAAWLIMPPISVTVALILPKIGPQEGAVTGATRISSCWISERSSALRITRA

SEQ ID NO: 4115 - protein, 580 aa, Corynebacterium glutamicum
MFKPFETIGGEFAVKCLGQYNARHLMIPNANGIEFRVHLGYLYMSPIPVPEDQIAERVPMFQERITHYFQNWEPMLANWKERVLGTINELESLEFKPLPDYVPIDDIVSGKAKDGTEVLMENFDRLIQLAYQNWQYHFEFLNLGYIAYLDFFNFCKEVFPDIPDQSISMMVQGVDMELFRPDDELKILAQLAVDLGLQTHFANPDDPQATLAAIAKAEGGATWIARWEEAQDPWFNFTVGNGFYGHDKYWIEHLELPLGYIADYIRRLDEGQTISRPKDELIAEKERVVEEYRDLLDGEQLAQFDAKCGLAATAYPYVENHNFYIEHWTMSVFWRKVRELSRTLQGYGFWENEDDMLYLNRTEVRDVLFDLATAWGVGAPGGPIGTIIWPEEIERRKAIVTALKTARPAPALNTPPESITEPFTRMLWGITTEQVQSWLGNDEDAEEGTLKGMAASPGVVEGYARVILSADDLSEIQQDEILVAPVTAPSWGPIFGKIKATVTDIGGMMSHAAIVCREYGLPAVTGTGAASTTIKTGDYLKVDGTKGKVVIVDPDAPRIEGPGAHSHAHSVAAHGVDTHA

SEQ ID NO: 4116 - protein, 360 aa, Corynebacterium glutamicum
MNIPFVQRFDEGLDPVLEVLGGKGASLVTMTDAGMPVPPGFVVTTASFDEFIREAGVAEHIDKFLNDLDAEDVKEVDRVSAIIRDELCSLDVPENARFAVHQAYRDLMERCGGDVPVAVRSSATAEDLPDASFAGQQDTYLWQVGLSAVTEHIRKCWASLFTSRAIIYRLKNNIPNEGLSMAVVVQKMVNSRVAGVAITMNPSNGDRSKITIDSSWGVGEMVVSGEVTPDNILLDKITLQVVSEHIGSKHAELIPDATSGSLVEKPVDEERANRRSLTDEEMLAVAQMAKRAEKHYKCPQDIEWALDADLPDGENLLLLQSRPETIHSNGVKKETPTPQAAKTIGTFDFSSITVAMTGTK

SEQ ID NO: 4117 - protein, 430 aa, Corynebacterium glutamicum
MTMTSQTSQQSTSTGGCPFGHTSESTSHHGYQPFDMHNPFPAYKELRQEEPVMFDERIGYWVVTKYDDIKTTFDDWETFSSENAQAPVRKRGPQATQIMTDGGFTAYSGLSARIPPEHTRIRAIAQKAFTPRRYKALEPDIRAMVIDRVEKMLANDQHVGDMVSDLAYDIPTITILTLIGADISMVDTYKRWSDSRAAMTWGDLSDEEQIPHAHNLVEYWQECQRMVADAHAHGGDNLTADLVRAQQEGQEITDHEIASLLYSLLFAGHETTTTLISNCFRVLLDHPEQWQAILENPKLIPAAVDEVLRYSGSIVGWRRKALKDTEIGGVAIKEGDGVLLLMGSANRDEARFENGEEFDISRANAREHLSFGFGIHYCLGNMLAKLQAKICLEEVTRLVPSLHLVADKAIGFRENLSFRVPTSVPVTWNA

SEQ ID NO: 4118 - protein, 268 aa, Corynebacterium glutamicum
MAGGNREPGRTVTSKVIAVLGAFEHTMRPLGVTEIAELADLPPSTTHRLVSELTEGGLLSKKSDGRYQLGLRIWELAQNTGRQLRDTARPFIQELYSLTSETAQLVVRDKDEALLIDRAYGTKKIPRSARVGGRLPLNSTAVGKILLAFDEPWVKQSYLKLPLNASTPKTIVNPDVLAAQLKQIHSQGFAITHDEQRIGGASIAVPVWHTGKLGAALGLVVPTAQAANLERYLPILQATSQRITKATALIPLDTLLASHKNAERKGDT

SEQ ID NO: 4119 - protein, 181 aa, Corynebacterium glutamicum
MRLVLLGPPGAGKGTQAAILSEKLGIPHISTGDLFRANIGEGTPLGIEAKQYIDAGKLVPTDVTARMVASRLAESDAAEGFLLDGFPRTVEQADILANLLSEAGQTLDGVVNYQVSEDVVVERMLSRGRADDNEETIRTRLGVYRDETAPLIDHYGDKIINIEAEGEVEEINARTLKALGK

SEQ ID NO: 4120 - protein, 204 aa, Corynebacterium glutamicum
MLSTYHRRFSSTREEILFAQCLEGTSVDLFDFAFSLNVDDLVTVVIDQRSSLVAVDTETGADGLFVVISATTGQHALHDDVFRNLVVNNTIEGLASFGKQVSQDVSLLNGAWETIQKEAFCSIGLSKAGSNHTCSHVGWNQLASVDVLLGLDTQRGTFANVGAEKIASRNVRNAKLLRENCSLGALTSTGRSEEYESHYFRSPS

SEQ ID NO: 4121 - protein, 264 aa, Corynebacterium glutamicum
MGFRSKKKVIAAKTAAELDAMQAAGEIVGKALQAVRAEAKAGMSTWDLDQIAEQVIRDAGAVPTFLGYQGFPASVCASVNEVIVHGIPSKETILEEGDLVSIDCGATFDGWVGDSAWSFGIGELDEDVQGLNLATEWVLMEGMKAMVPGNRLTDVSHALEVATRKAESKFGVALGIVDGYGGHGIGRHMHEEPYLANEGKAGKGPVIQEGSVLAIEPMLTLGTEDSAVLEDDWTVVTLDGSWASHWEHTVAATKGGPRILTPRY

SEQ ID NO: 4122 - protein, 276 aa, Corynebacterium glutamicum
MPPGEEAIKLFYLSNIKIIKQPYILQRMAKNSRIRYSASIKRAAAAILTAAATSVALIAVPATASAQDLATGSSQIQTDAREGAWATRNTIQDQLASIGPAALPVRAAVDNAINGMFPGLVDEKVAAEQEAARAEAEREAAAAREAEAARVAAEEAARFDRGSCPAIADVCVDIDGGRTWLQENGQVTYGAVPVSSGGVGQETPRGTFYINRKVKDEISYEFGNAPMPYAMYFTYNGHAFHQGNVATTSAGCVRLNTQDAIYYFNNVGIGDMVYIY

SEQ ID NO: 4123 - protein, 72 aa, Corynebacterium glutamicum
MAKEGAIEVEGRIVEPLPNAMFRVELDNGHKVLAHISGKMRQHYIRILPEDRVVVELSPYDLTRGRIVYRYK

SEQ ID NO: 4124 - protein, 122 aa, Corynebacterium glutamicum
MARLAGVDLPRNKRMEVALTYIYGIGPARSKQLLEETGISPDLRTDNLTDEQIAALRDVIEGTWKVEGDLRRQVQADIRRKIEIGCYQGIRHRRGLPVRGQRTKTNARTRKGPKKTIAGKKK

SEQ ID NO: 4125 - protein, 134 aa, Corynebacterium glutamicum
MPPKARTNARRTGRRVVKKNVANGNAYIKSTFNNTIVSITDTNGAVISWASSGHVGFKGSRKSTPFAAQMAAENAARKAMDHGMKKVDVFVKGPGSGRETAIRSLQAAGLEIGSISDVTPQPHNGCRPPKRRRV

SEQ ID NO: 4126 - protein, 201 aa, Corynebacterium glutamicum
MARYTGPATRKSRRLRVDLVGGDMAFERRPYPPGQAGRARIKESEYLLQLQEKQKARFIYGVMEKQFRRYYAEANRRAGKTGENLVVLLESRLDNVVYRAGLANTRRQARQLVSHGHFTVNGKAIDVPSFRVSQYDIINVREKSQKMNWFEEAQDNLADAVVPAWLQVVPENLRILVHQLPERAQIDIPLQEQLIVEFYSK

SEQ ID NO: 4127 - protein, 338 aa, Corynebacterium glutamicum
MLISQRPTITEEFVNNARSRFVIEPLEPGFGYTLGNSLRRTLLSSIPGAAVTSVKIDGVLHEFTTISGVKEDVSDIILNIKGLVLSSDSDEPVVMQLVKEGPGVVTAGDIQPPAGVEIHNPDLHIATLNETAKIEIELIVERGRGYVPATVTATGGEIGRIPVDQIYSPVLKVSYKVEATRVEQRTDFDKLVIDVETKNSITARDALASAGKTLVELFGLARELNIAAEGIEIGPSPQETEYIAAYSMPIEDLDFSVRSYNCLKREDIHTVGELAERAESDLLDIRNFGQKSINEVKIKLAGLGLTLKDAPEDFDPSTLEGYDAETGGYIDVEAEDSE

SEQ ID NO: 4128 - protein, 52 aa, Corynebacterium glutamicum
MMVGRCEMSIELSLSDDRYLTSVKVSKTMKDVWKIERFLCTRGSRVSKNYFE

SEQ ID NO: 4129 - protein, 163 aa, Corynebacterium glutamicum
MPTPKKGARLGGSASHQKKILSNLAASLFEHGAIKTTDAKAKALRPYAEKLITKAKSGSVADRRNVLALVPNKEIVAYLFNELAPKFENRPGGYTRIIKLENRKGDNAPMSQISLVLEETVSAEASRATRASASKKAAEEAETEEVVEAPAEETATEEAAEEK

SEQ ID NO: 4130 - protein, 289 aa, Corynebacterium glutamicum
MRIRLDLAYDGTDFHGWAKQGTSDLRTVQKVLEDNLSMVLRETVELTVAGRTDAGVHAAGQVAHFDIPAHALEQRSIDGDPSKLVRRLGRLLPDDIRVHGVRFAEPGFDARFSAMRRHYVYRITTHPAGALPTRRHDTAQWPKPVELERMQLAADALLGLHDFVAFCKAKPHATTVRELQKFAWKDVSTDIEPQVYEAHVVADAFCWSMVRSLVGSCMAVGEGRRGSGFTAELLDASERSPMVPVAPAKGLSLVGVDYPSADKLQERALETRAVREFPDASASLKLDDE

SEQ ID NO: 4131 - protein, 799 aa, Corynebacterium glutamicum
MLTTLWIAVLVFTVPGLVVSWVSGLKVPWAIAASIPATFGIYGLSAWLLGLWEMRFDLHSVVISTLVFAAVALVWRLFFVGGWLVRRRKARIRRQTLADEERAENAEVSAGEPAESSTNEAAESESETSERRGIWRVIFDYMRDGGILDHRWLLPAAGAITGAWLIIDRAVDLLLSTEHGLGDIVQGWDVHWHASTVRFIDETGIASSTMMGQLRNIETQQDLFYPSAWHAGAWVLSDVGNLTIVEATNLTGIVLSGLLLPLAVALIAWRMINNRGLTAQIGAGFAGLITIASPVLFWVGNYVGAWPYVAAIGASGVVLALFMSTPSVPVRIFAAALAFMGMFQLHPAPSTIVIMVLLLWWLLKLVVVPSQKVKGWKAGIGIRLKDVGILAITGIIGVLFMLPQVISGSEQTEDVLSYSAEEQVTRSESWLVSIFMETRHVDFFGNIDIVPVLVFAAIGGVVALVWRGNLWAPVFYFASVALTANSLKPFEEPWGDWLNIVGGLHYSTGHRLIMPVAMFTFAAAGIGAAAVIRLICLGPIKKFTTVSGVVSVVMALVVAVPLQTWAKDFVEEGSETTILAPHNDERMVSNNDLAAWDWLIQQPGGADMNIMGDPADGNGWMYAYNGLHSVARHYAWPAAGEGSATAMLFWWPQLLGVGTDENPDQVNDVDQAARDLNVGYFMISPWTFWDFQIPNFRQIDLLWQTPGVTPVYKKGDSVIFAVNDMFTDAELDQMRAPGNSPEPLPELPTLGELGLAETEDEVDQTYYHRPTVPAGVNSEMPSAETLYAPDPTKPHTVPN

SEQ ID NO: 4132 - protein, 152 aa, Corynebacterium glutamicum
MWKDLTEPLPEACAEGLEIRVVKSPEELADYAAVLSANWNPPAETVQRFYTEAAEYALRKNSPALYLVGYAGNRAVCSAEAFIHASVVGIYNISTLEHKRRRGYGGAITLATLHTARNAGCDTAVLQASEDGEPVYRKLGFTDCGRFTEYSL

SEQ ID NO: 4133 - protein, 101 aa, Corynebacterium glutamicum
MKDLGKLQRAIEENLAEHFCHLHRHLASATITHTDGLLIADSSLDDDTFNIIAGARFTPEIAAARIAETTAFVEHALRPFSWWVGPASSPRNIGELLVEAQ

SEQ ID NO: 4134 - protein, 419 aa, Corynebacterium glutamicum
MAEGMLMPTTSAQVSGHKFLVRRIEHGLVMGDVRMIHDPLGRRRRALVFGVVACVMLAVGSLALAIFRPAKDPADAPLIRSESGALFVQLDGSVHPVANVASARLIVGEPVDPVNASDAIIAGMPRGVPVGVPDAPGLFSSTEEPEQDWFVCQDVGTGDLHITVPRGGLGPTLIAEGNGWLGASKSETGEVTWNLITADGRRELPAWGSEHGRIMRRHLGISEDTPRVYLTTELLNAIPEHDAVRFPAPLPELVDASTRNWLRLDGALAEITPLQRGLLIDAGSGVFPDPTALLGVHEETANTLTLPEQTVSWQDLDGGFACADGEGQIGFLETLESGVALSGDSRAKSFSTNAGGAVGVDSGFGYYVVSDFGLMHPVSTGESMVALGITDVQVVPWSVLRLLPQGSELAKETALAPTY

SEQ ID NO: 4135 - protein, 515 aa, Corynebacterium glutamicum
MSGLVDPDSTFLKTIGKLSNSLSIGRGVDQKEVIPKGWNAHWEAITKLKRSFDAIPAGERVRLAKKTSNLFRGRSDAGHGLDVAALGGVIAIDPVNATADVQGMCTYEDLVDATLSYGLMPLVVPQLKTITLGGAVTGMGVESTSFRNGLPHESVLEMDIFTGTGEIVTCSPTENVDLYRGFPNSYGSLGYAVRLKIELEPVQDYVQLRHVRFNDLESLTKAIEEVASSLEFDNQPVDYLDGVVFSPTEAYLVLGTQTSQPGPTSDYTRDLSYYRSLQHPEGITYDRLTIRDYIWRWDTDWFWCSRAFGTQNPVVRKLWPRDLLRSSFYWKIIGWDRKYSIADRLEERKGRPARERVVQDVEVTIDKLPEFLKWFFESSDIEPLWLCPIKLREVPGSSVGAGEILSSAEAIDSGAAEHPWPLYPLKKDVLWVNIGFWSSVPVDLMGSDAPEGAFNREIERVMAELGGHKSLYSEAFYTREDFEKLYGGTIPALLKKQWDPHSRFPGLYEKTVKGA

SEQ ID NO: 4136 - protein, 451 aa, Corynebacterium glutamicum
MWPHFKKMHKKRKQSIMSNAVAQDLMTIADIVEATTTAPIPFHITAFDGSFTGPEDAPYQLFVANTDAVSYIATAPGDLGLARAYLMGDLIVEGEHPGHPYGIFDALKEFYRCFKRPDASTTLQIMWTLRKMNALKFQEIPPMEQAPAWRKALINGLASRHSKSRDKKAISYHYDVGNEFYSLFLDDSMTYTCAYYPTPESSLEEAQENKYRLIFEKLRLKEGDRLLDVGCGWGGMVRYAAKHGVKAIGVTLSEQQYEWGQAEIKRQGLEDLAEIRFMDYRDVPETGFDAISAIGIIEHIGVNNYPDYFELLSSKLKTGGLMLNHSITYPDNRPRHAGAFIDRYIFPDGELTGSGTLIKHMQDNGFEVLHEENLRFDYQRTLHAWCENLKENWEEAVELAGEPTARLFGLYMAGSEWGFAHNIVQLHQVLGVKLDEQGSRGEVPERMWWTI

SEQ ID NO: 4137 - protein, 142 aa, Corynebacterium glutamicum
MGTMREMVSDRIDRLQEAHARSKQKKFGFLVRPGTLILGWLVTIIGLITIPLPGQGWLTTFIGVGILSLELKWAKNLLAWGVHQYDRFFTWYGKKSFRFRMAMLALMILLIWVVFIVTFWLMWHAGTIPWADEFFTWLGLSR

SEQ ID NO: 4138 - protein, 453 aa, Corynebacterium glutamicum
MCGLKGWNHCVLQLVCHSHCICWMYLECCAVLILDSVDKMRRLIAVSLAALFMLASTPATRAQEVEALACPEVAIADPSSAVLDEHLSQSLSQAHQLATGAGVMVAVIDTGVSLHPRLPHLIPGGDFVGAHQSPDVPGELIDCDGHGTIVAGIIASQGNPGTGWPYDGSSDPYIGVAPDSGIISIKQTSSYVRTREDSNVGTLSTLAESIHRALDSGAHVINISVVSCLPQSPDEAASFQPLTDALNRAELQGVIVVAAAGNLGQDCPVGSTVYPAHSDTVLSVSARFDSHTLAEYSMPGNQQILSAPSHIQAGLSPRGDGFASHMITTAGESPFEGTSFAAPVVSATAALLRQHFPFATPYEIRARIFNSIDPARGAIDPYLALTQEIYPTTPLVHEIALSVPTPPDDSPRERGILVTAIIVGLLAVLAVLMGLRRIHHHSAFQKASSSVIT

SEQ ID NO: 4139 - protein, 457 aa, Corynebacterium glutamicum
MAIDNALRVSIRIDLTVGDAPAAVADVALPAGSSLADILDEILELTDAPRISRPWVAHTAAGSPIDCGIPLAETQVEQGSVVVLSPERDLEAPVLRDVAEALVEFSSTNRAGHLVELMTFAGLIGAAVLMTSPAASGIIVPGRMGIFVAICALLLLWLPPAHTPILRNVLPITLILGAGGAVSVLVAGTSGTSPGALTWTIFAGACTILASSLLVHVVYRPAILLVATLSTLGLGLLVLAATTTLWKLKATEDFSGPAAITVTASTITMCFAPKIAASLAGLRVPSLPTAGEDLSVSDLTMTDPEKRIKTTKTLFDAQILGLGVLSGPLALLSVTPGTWTTTVFSLCIAVASLLHANRHQAPIPTWTLMGLSALGFISMALSASRSGSLIALIGSVVIIAVLVSVALWISTVPTLEPTTIVWLERLESLCLAASLPLALHLLDVFGMLRGLDIGFGG

SEQ ID NO: 4140 - protein, 1189 aa, Corynebacterium glutamicum
MTWPERDPAPPLPTEPLIAEAVPQAVRPAPKPLLKVLMPVIMVAMVAMVLAMVALMILTSGQLNPMVLIFPMMMGMSVLMMFAPPEGDDTDEVRRTYLRHLGALRAKATDHAAMQRRHEWHRHPDPATLWSTLGTRRMWERTQDDQDCLEIRFGLGVTRLDPAINVSDSGAPEDLDPVCAVSLRHTIRDVGSVQSMPVSVQLQAFRFIGLNGAGAHDLARALVVQLLYHHGPEVVGIKAIGESGWEWLKWVPHTRDPEKAAFRILLVDSVLTNGTESFIDDPQWTTIINVGAQTSTALGQLAEDEGLLLHVDKRLHVATAHGAEELGTPDAVSAELAEVFGRRLTAFRRTTTAHAASSGELLSLLGIDDVEHLTPETLWMNKRTQPKTRLAVPLGLNASGRPMVLDLKESAHGGMGPHGLCIGATGSGKSELLRTLVLGLTITHSPEELNLVLVDFKGGATFLGFEQLPHTSAVITNLEEESVLVERMHDAISGEMNRRQEALRQAGGCANVDEYNQRDGVKPMPALLIVIDEFSELLGQHPDFADLFVAVGRLGRSLHIHLLLASQRLEEGRLRGLDSHLSYRIGLKTFSASESRQVLGITDAYQLPSQPGAGFLKSDVDTVTRFQASYVSGPIMRRHHLAPTQSRVRLFTSWEEPKEEVIVEQSTETLIDAVVARAISAAKLRGLSAHRIWLPPLPAEVSIGALADDVGELSAVIGMIDRPYQQRQDPLLIDFSLNGGSGHWAICGGPQTGKSTALRSIVISMAATHSTENIRFYVLDLSGTSLENLSRLPHVAGVAGRKDPEKVRRVVDEVRGLINHPEQRHTFLIVDGWHTITQEFDELFDAFVDIAANGLASRVHLVLSTQRWSSIRPAVRDLVTGRIELKLGEAMDSVIDRKAQLRIPSKPGRGLNLDKEHILIAHASGQDIAQVCVMADGQGWQQVPQLSVLPAHILLHELELSATPGIPIARGGAELSTLTWDPESSRHLLAFGSQGCGKSSLIRTIVTGLTIVGREKARLVFFDLRRTHLGLVPEDMLAAYCATSTAVHNTIKDMVATLSARLPGPDITAQELRDRSWWQGPDIYLVIDDYDLLPAGTLHPLREIIPHARDVGLHIVLTRKAGGASRALYDPVMSEIKDQSPHVVLFDADRDEGAILGIKPTAQPPGRATMSIRGENIGVAQMARIGDDS

SEQ ID NO: 4141 - protein, 274 aa, Corynebacterium glutamicum
MLHVINPQKGQQFTRARRVCCGCASKSSQTAAKNLRKLSANRIRRAQLLRAVRGSHMQTLIDVQQQPFILCQLAQCGAGLRANVDDRGPLGVINEAFGAVGQHGIHQQNPKGCLLRIAGVRYPFQPLPTRLPDRFDTHHLRSVVVQQLHNQRPRQIMCARTVEPNESKRLQLNRHRHALHRPHIPNGVTQRHRTYRIKILRRTRITHVNSRIKPGHAQTKTDFQTILIILGALPHPPSPQRGPQGCWIRMPVPFMPALHRRVICRFRPQCTQVT

SEQ ID NO: 4142 - protein, 221 aa, Corynebacterium glutamicum
MHSPCGPIPPCADSFRSSTIGRPDAFKPKGTAKRVLGCVRLFIHKVSGVKCSTSSIPKRDSNSPELAACAVVVRRKAVKRRPKTSASSALTASGVPSSSAPCAVATCRRLSTCNSSPSSSASWPNAVLVCAPTLMIVVHWGSSMKLSVPLVNTESTSKIRKAAFSGSRVCGTHFSHSQPDSPIALIPTTSGPWWYNNCTTSARARSCAPAPLSPMNRNACN

SEQ ID NO: 4143 - protein, 300 aa, Corynebacterium glutamicum
MSTQTITITVLETATIFDGPETIYRYDLAAEGILDGWAHSAVLDQVKQIAGENWPTVEIVVDGTDNVVNALTSMFASKGVTCGGVGVEAPPVAEEPPKIKRPTSGKQVRQFYGIKPLHLLLVSILVGSIAGIWVISGFTGPVDSRPVDKVAEISTQGETSISNQPQPQPTVLVTEDLLIEAPFGFEMRSDEQSRYLEGPDPNLRIHVGVDPLHGADAALVAEELRRLITEDPSLEEIPAGEWGEKTTIDYRETPGDGSHVLWVTWFDTDRQLNVGCHSKAAETLVHKAQCRNVIEHLTLK

SEQ ID NO: 4144 - protein, 108 aa, Corynebacterium glutamicum
MSNLFRTESDVMLATASQVDDINDQVQGELSRLRGVVDSVRGSWAGQAQVSFDSLMNRWNSSARQLQEALASISDNIRHNARSFENTEADNSQAFNAVGAGDGAGLPL

SEQ ID NO: 4145 - protein, 96 aa, Corynebacterium glutamicum
MDMIRYEFGAIQGAATDINSTSGRINSLLDGLKSQLQPMVASWEGESSEAYSEAQLKWDRAAAELNTILATISNTVAQGAERMSDVNRRAAASWGA

SEQ ID NO: 4146 - protein, 147 aa, Corynebacterium glutamicum
MSTYHPKSGDITRKWYVIDATDVVLGRLATHAADLLRGKGKPLYAPNVDCGDHVIVINADKVAVTSNKREREMRYRHSGYPGGLKSMTLGRSLDLHPERTIEDSIVGMMPHNKLTAASAKKLHVFSGSEHPYAAQKPEAYEIKKVAQ

SEQ ID NO: 4147 - protein, 182 aa, Corynebacterium glutamicum
MSEPIQNENVESNVADAADIAAATAATEEFTNTIGDAIATASEEETIEAAPVVLDGPIQTVGRRKRAIVRVRLVAGSGEFKCNGRTLEEYFPNKLHQQLIKAPLVLLDRENQFDIVATLKGGGPTGQAGAFRLAIARALNAYNPAERGELKKAGFLTRDARAVERKKAGLHKARRAPQYSKR

SEQ ID NO: 4148 - protein, 447 aa, Corynebacterium glutamicum
MTRLFGTDGVRGLANEVLTAPLALKLGAAAAHVLTAEKRVDGRRPVAIVGRDPRVSGEMLAAALSAGMASQGVDVIRVGVIPTPAVAFLTDDYGADMGVMISASHNPMPDNGIKFFSAGGHKLPDHVEDEIERVMDSLPAEGPTGHGVGRVIEEATDAQDRYLEHLKEAVPTSLEGIKIVVDAANGAASVVAPTAYEAAGATVIAIHNKPDSYNINMDCGSTHIDQVQAAVLKHGADLGLAHDGDADRCLAVDKDGNLVDGDQIMALLAIAMKENGELRKNTLVGTVMSNLGLKIAMDEAGITLRTTKVGDRYVLEDLNAGGFSLGGEQSGHIVLPDHGTTGDGTLTGLSIMARMAETGKSLGELAQAMTVLPQVLINVPVSDKSTIVSHPSVVAAIAEAEAELGATGRVLLRASGTEELFRVMVEAGDKEQARRIAGRLAAVVAEV

SEQ ID NO: 4149 - protein, 101 aa, Corynebacterium glutamicum
MSGFELKIGESLATLRGLLGETAQQHSIHRQRVPYYSPSASGRGFSAHGVALADMFEGLHRGVEKRIDAFTQTTQAAEEEVKRFDNTDKVFGAGFDGIDPK

SEQ ID NO: 4150 - protein, 503 aa, Corynebacterium glutamicum
MNDPLAGYGAVISALQGASGGMYRGPAKSEGQLREMYQTIEGLDTSSLREAAEAAVGGTNEARIQGWVGPLLKFFGTVGGGMIATEIAERAVDWFKNRNDVEEVSEAADKAADAIDSTVTESDQGMMHIIQQLLDIVSTLTQILGSMDRGKFPQEFRDCVQTGADLIDQAGDMLEGLCADRDDAISQCFSALTDHGKQVCETEPKPLCSAASGGSSGGATSSAAASSGGSSSSTASSGSSGGSSSAADSSTSTNAESSVEKEKTTPAAVEKPDEKPVEKPVEKTPEKPVEKPVEKQECEEKPDPDPEKCKTEPVECEPTPKPETEPEPKPTPTPTPGTPTPIPELETEDCEPGKETGTDSESESEECAPELNDVPEESDLIGQLIKGAIGIGIVVVGVGLLVNFLEQCVPVIEEVPVPEPEPIPEPAPQPEPTSVKPPESELDKVAEPAPKPIPQANYTAAAATNYSAPAHAPVVPITPAAPEVPAAPEVPAPAVNLHKAGGW

SEQ ID NO: 4151 - protein, 191 aa, Corynebacterium glutamicum
MMSCPIRSDSSGTSLSSGAHSSDSDSESVPVSLPGSQSSVSSSGIGVGVPGVGVGVGFGSGSVSGFGVGSHSTGSVLHFSGSGSGFSSHSCFSTGFSTGFSGVFSTGFSTGFSSGFSTAAGVVFSFSTLDSALVDVELSAALLDPPELPELAVLELEPPEEAAAEEVAPPDEPPEAALHNGFGSVSQTCFP

SEQ ID NO: 4152 - protein, 78 aa, Corynebacterium glutamicum
MVAVEYAEFLQQFRERTAKRMEEFEKAIASTQRKLDDVAEEVEKKKQPVVVESLEKPIRMARRQQRGRGPVKSVLREA

SEQ ID NO: 4153 - protein, 285 aa, Corynebacterium glutamicum
MAENLNKHLSKLSKRGPHRVLVGDMNYAGIPGKIYTPAEGDGIPGVAFGHDWMKSIKYYHQTLRHLASWGIAVAAPDTENGFMPDHKGFASDLESSIQILGGVKLGSGNVTVNPACLGVVGHGMGAGAAVLSAANRDLVRAVGAIYPAKTSPSAIDAAFAVKAPGLVIGSSSLGLFESGEPAKLAANWAGDVCYRESEKGNQQGFSEDTMFKLVAGIGSPQTGAQETVRGLLTGFLLHQLAGEKKYKAFSEPDAEAKKVVSYFGQELQEHAFPKDTSPFAFLNEK

SEQ ID NO: 4154 - protein, 361 aa, Corynebacterium glutamicum
MNLLTTKIDLDAIAHNTRVLKQMAGPAKLMAVVKANAYNHGVEKVAPVIAAHGADAFGVATLAEAMQLRDIGISQEVLCWIWTPEQDFRAAIDRNIDLAVISPAHAKALIETDAEHIRVSIKIDSGLHRSGVDEQEWEGVFSALAAAPHIEVTGMFTHLACADEPENPETDRQIIAFRRALALARKHGLECPVNHVCNSPAFLTRSDLHMEMVRPGLAFYGLEPVAGLEHGLKPAMTWEAKVSVVKQIEAGQGTSYGLTWRAEDRGFVAVVPAGYADGMPRHAQGKFSVTIDGLDYPQVGRVCMDQFVISLGDNPHGVEAGAKAVIFGENGHDATDFAERLDTINYEVVCRPTGRTVRAYV

SEQ ID NO: 4155 - protein, 165 aa, Corynebacterium glutamicum
MKSEFPVSGTRRFEHAADTQNFGEELGRHLEAGDVVILDGPLGAGKTTFTQGIARGLQVKGRVTSPTFVIAREHRSEIGGPDLIHMDAYRLLGEDSEDADPIGALDSLDLDTDLDLAVVVAEWGGGLVEQIADSYLLITIDRETAVQEDPESEARIFHWEWREGR

SEQ ID NO: 4156 - protein, 533 aa, Corynebacterium glutamicum
MLDFLAANPLIALVVILAVGLAIGQIRVFGLSLGAAAVLFVALVVSTANTDIVIPMIVYQLGLAMFVYVIGLSAGPAFFSEFAKKGWKLTIFMLLLLATLIGLAWVLIKSLGLDAAIGTGMFTGALTSTPGMAAVVELIEGIDPSLASEPVIGYSLAYPGAVLGSIVVAAVGAKLLKVNHREDARKEGMITAPLVWKGVQLKPGITGRVGDLPRLAGESIIATRIVDDPHTHRLADPDLPITEGMELLINGTEEAVDRAIKALGEERETKIEDTELIYTRLTVSSPEVAGRTVAELDTVAHGFMIARIRQGDSEVVPKPDTVINYSDRIRVVVAPGRVAEVRRFLGDSEKSLADVNLLPLAIGLSLGLLLGAIPIPLPGGTTMSLGFGGGPIIAGLILGALKHTGPLTWQMPFHANRTISTLGLALFLAGVGTSAGAGFRAALTDSSSLIYMAGGLVITLASALLCAVIGMWVLRLRWDEAMGVAAGTTTNPAIISYLNGQTGTDLANRGYATVYPTAMIGKILGAQILFLLL

SEQ ID NO: 4157 - protein, 413 aa, Corynebacterium glutamicum
MTKTLGSLQLEEITLTLPLTEDVADERTIDVFARIATRVGGEDLPYLVFLQGGPGNEAPRPSLNPLNPNWLGVALEEYRVVMLDQRGTGRSTPVGNDILEKPTAEVVEYLSHLRADGIVRDAEALRKHLGVNQWNLLGQSFGGFTTLHYLSRHADSLDNVFITGGLSAIDRPAEDVYANCYNRMRRNSEEFYRRFPQLRETFRGLVNRARAGEIVLPTGEVVSETRLRSLGHLLGSNDGWFDLYNLLELDPTSNAFVHDLAGLLPFGNRNPIYYVLHESSYADGVVTNWAAERVLPEDFREDPTLLTGEHVFQEWTDTVPSLKPWKDVALALAQQEWPKLYDAKALENSQAKGAAAVYANDVFVPVDYSLETAQHLPGVQLFITSQHEHNGLRASSGAVLKHLFDLAHGREVR

SEQ ID NO: 4158 - protein, 225 aa, Corynebacterium glutamicum
MLVLALDTSTPDLIVGVVDSDTGNTRAETIIEDTRAHNEQLTPTVQKTLLDANLSFSDIDAIVVGCGPGPFTGLRVGMVSGAAFGDALGIPVYGVCSLDAIAHNIGARNIPHALVATDARRREIYWATYRSGERDQGPDVIAPANIQISGAVDTISIPEHLVEKLPEELQNVTMHSGKPAPASLVAVADFSVEPQPLVPLYLRRPDAKEPKPKPKSAAIPEVDLS

SEQ ID NO: 4159 - protein, 169 aa, Corynebacterium glutamicum
MSEQFELRELRREDAGRCADLEQILFPGDNPWPRDVFAVEFSHPTNFYIGAFDEGYLVAYAGLAMMGPADDPEFEIHTIGVDPEFQRKGLGRVLMDQMMHAADSHDGPVFLEVRTDNVPAISMYEAFGFKTLAVRKNYYRPSGADAYTMQRPRLSDRKDQQTDTEGTPS

SEQ ID NO: 4160 - protein, 344 aa, Corynebacterium glutamicum
MIVLGIESSCDETGVGVVKLDGEGNLEILADSVASSMQEHARFGGVVPEIASRAHLESMVPVMREALRQAGVDRPDAVAATVGPGLAGALLVGASAAKAYAAAWGVPFYAVNHLGGHVAVANLEGETLPHAVALLVSGGHTQLLEVDAVGLPMKELGSTLDDAAGEAYDKVSRLLGLGYPGGPIIDKLARRGNPEAIAFPRGLMKKSDSRHDFSFSGLKTSVARYVEAAERNGEVISVEDVCASFQEAVCDVLTFKAVRACRDVGAKVLLLGGGVAANSRLRELAQERCDKADIELRVPRFNLCTDNGVMIAALAAQRIHEGAQESPISVGTDPSLSVETPQVF

SEQ ID NO: 4161 - protein, 574 aa, Corynebacterium glutamicum
MKPVFSVDQIRRAENTLFELQADPDELMISAASAVADVALAMVDGPAPAVSSEESILLLVGPGGNGGDALYAGAFLAEEGHHVDALLLGNGKVHQSALAYYESLGGQIISDFPPHYLYRLVIDGLFGIGGRGGLTPELASLVESFSASGIPILAIDVPSGVHADSGELPPGVMVTVEGFDNDAPMARQKIPAHIDADVTITFGGLRRAHAVSPACGEVLCADINIAGGGGKSLSAELSQVQAEDATPQMFASKAYQRKDSLFERANLKATAPHIHRIGQHFTVLNMEPGPDHDKYSGGIVGIVAGSGTYPGAAVLSVKAAVRATSAMVRYVGPALNFVIQSLPEVVATQSLATAGRVQAWVHGPGRGLEAEQSAELAELLSRPEPVLIDADSLSLLQLSAELRQALRERKAPTVLTPHKGEFERIAAELRSEGVEIPQADKDPIGAAQALAKEFDCCVLLKGKYTVIAAHDFVHAINAGHSWLATPGSGDVLSGLVGAHLAQSYAELNRLPEFFPDVTLSDSAIYTQIAPAATIHAVAAGLAARTEFGFAPTSASLIADAIPAATAKVDLKRIV

SEQ ID NO: 4162 - protein, 143 aa, Corynebacterium glutamicum
MRGMTYGFLVNTDLTHRAIDFDLENAAKFLGGADDGRVAVAFQEDGTLYAALYSASAKDEGAAANPVASLGRNAAATGDGSFFSDPTTAICGPVIFVGAEGEDITLDEIERIKDGIRAARNYRDDYPEEFNLWRNAVYNLRTA

SEQ ID NO: 4163 - protein, 151 aa, Corynebacterium glutamicum
MCQTTYLALYPRECQHSTVEGAKNSHGSQTLSRTQVIYSVAPQVEFLWIIIAVVTSGANAVLNSLNFIQRDVFAFGPHEDHRATDCSGRIREEGAITGSSGVAAKGCYWVCCGTLIFCAGAVESGVQGAILLESDSDAAIIGTAEELRSVF

SEQ ID NO: 4164 - protein, 99 aa, Corynebacterium glutamicum
MANVNIKPLEDKILVQINEAETTTASGLVIPDSAKEKPQEATVIAVGPGRFDDKGNRIPLDIKEDDVVIFSRYGGTEIKFGGVEYLLLSARDILAIVEK

SEQ ID NO: 4165 - protein, 538 aa, Corynebacterium glutamicum
MAKLIAFDQDAREGILRGVDALANAVKVTLGPRGRNVVLDKAFGGPLVTNDGVTIARDIDLEDPFENLGAQLVKSVAVKTNDIAGDGTTTATLLAQALIAEGLRNVAAGANPMELNKGISAAAEKTLEELKARATEVSDTKEIANVATVSSRDEVVGEIVAAAMEKVGKDGVVTVEESQSIETALEVTEGISFDKGYLSPYFINDNDTQQAVLDNPAVLLVRNKISSLPDFLPLLEKVVESNRPLLIIAEDVEGEPLQTLVVNSIRKTIKVVAVKSPYFGDRRKAFMDDLAIVTKATVVDPEVGINLNEAGEEVFGTARRITVSKDETIIVDGAGSAEDVEARRGQIRREIANTDSTWDREKAEERLAKLSGGIAVIRVGAATETEVNDRKLRVEDAINAARAAAQEGVIAGGGSALVQIAETLKAYAEEFEGDQKVGVRALATALGKPAYWIASNAGLDGSVVVARTAALPNGEGFNAATLEYGNLINDGVIDPVKVTHSAVVNATSVARMVLTTEASVVEKPAEEAADAHAGHHHH

SEQ ID NO: 4166 - protein, 85 aa, Corynebacterium glutamicum
MDWDSSTVTTPSLPTFSIAAATISPTTSSRDETVATFAISLVSDTSVARAFNSSKVFSAAAEIPLLSSIGFAPAATLRRPSAMSA

SEQ ID NO: 4167 - protein, 386 aa, Corynebacterium glutamicum
MMSCMCIGCFFCRLLNNRSLSGQNHACNRGCIHYCGMGDLDWVDDTVVDQVSVFQSCSVEALAVWQSSSACNNNRAVKTCVGGDPVRWLAQSSSQCANADLLVAFELFGVSLQSLSDLNQSGTATSDNAFLCCCASSVDGIFDTQLAVVDFGFSCCTNADDSNTTGELSQTLFCLFAIPGGIGVGDFATDLAATCFNVFCGTCTINDDGFVLGNGDAACGTENFFASFVEVDAHFWIHDSCLGDNSQVIHERLASVTEVRGLHCNDLDGLADGVHNQGLQRLALDVFCDDQQRTVGLHNLLQQWEEVWEGRNLVANKQHCRVVQDSLLSVVVVDEIRGKVALVERNTFGDLESSLDGLGLLNGDDTVLANLFHRCSNDLADNFIAG

SEQ ID NO: 4168 - protein, 99 aa, Corynebacterium glutamicum
MTLPHQLPGPNADFWDWQLHGTCRGETSDVFYHPDGERGRARQRRELRAKAICAACPVLESCRKHALAVAEPYGVWGGLSESERLVILRNNERKQPVAV

SEQ ID NO: 4169 - protein, 188 aa, Corynebacterium glutamicum
MADTERELADLVPQATAGDRRALQRIMEIIHPIVLRYARARIGGGRQPTAEDVAQEICLAVATSIRNFVDQGRPFMAFVYGIASNKVADAHRAMSRDKSTPIEEVPETSPDTFTPEDFALVSDGSNRVRELLDLLSEKARDILILRVIVGLSAEETAEMVGSTPGAVRVAQHRALTTLRSTLEQQENK

SEQ ID NO: 4170 - protein, 342 aa, Corynebacterium glutamicum
MTRRLHGGEQDGQEHVKGQLKQLFDDDAFLTDLSRGVDPSEGDDALAGLLLDLTKEAQEPPATMPDWSTLLPGILDQDQDLPVESTSDTTVMQASNPATQEFAPVSISDTPNTATNSADADESATVVPLAARREKRAKSGSSGVHSLDASATQRKSHPFLSGLVGAAAATLVIAGGGAAVYNADENSPLYGMNQQLFGNQDSPSVVELASTLEEVDSRTASGDVEGARALLEQARAMLDGMAPPRKAPSEATRTVESEPGTQTLTATVTESASPEPPVTETQTVTSTEVQTVTTTAVAPPVWTPNPEPTTTAAPTSTPSTGGGEGTGNDGDSGLVPPQTPGN

SEQ ID NO: 4171 - protein, 126 aa, Corynebacterium glutamicum
MNFDAMMPRDPFADDPNDPASFITDDDPYDHPEPLSEEERIHVSQDLRLVMEFKKVLGPRGIEGVFFMCEDCEEFHYYDWDIMAANMRATLAGELSPVHEPSAQPNIDAYVPWDYCIGYLDGLEAK

SEQ ID NO: 4172 - protein, 506 aa, Corynebacterium glutamicum
MTTQSRVSTGGDNPNKVALVGLTFDDVLLLPDASDVVPSEVDTSTQLTRNIRLNTPILSAAMDTVTEARMAIGMARHGGIGVLHRNLSIQEQAENVELVKRSESGMVTDPVTCTPDMSIQEVDDLCARFRISGLPVVDEAGKLVGICTNRDMRFESDMNRRVAEVMTPMPLVVAEEGVTKEQALALLSANKVEKLPIIAKDGKLVGLITVKDFVKTEQHPNASKDASGRLLVAAGIGTGEESFQRAGALADAGVDILVVDSAHAHSRGVLDMVSRVKKSFPKVDIVGGNLATREAAQAMIEAGADAIKVGIGPGSICTTRVVAGVGAPQITAIMEAAVPAHKAGVPIIADGGMQFSGDIAKALAAGANSVMLGSMLAGTAEAPGETITINGKQYKRYRGMGSMGAMQGRGLSGEKRSYSKDRYFQSDVKSEDKLVPEGIEGRVPFRGPIGDIIHQQVGGLRAAMGYTGSSTIEELHNARFVQITSAGLKESHPHHIQQTVEAPNYH

SEQ ID NO: 4173 - protein, 209 aa, Corynebacterium glutamicum
MACAASRVAKLPPTISTLGNDFFTRDTMSKTPRLWACAESTTKMSTPASASAPARWNDSSPVPMPAATSRRPDASLDAFGCCSVLTKSFTVIRPTSLPSFAMIGSFSTLFADSKARACSLVTPSSATTKGIGVITSATRRFMSLSKRISRLVQIPTNFPASSTTGRPEMRKRAHRSSTSWMLMSGVQVTGSVTIPDSERFTSSTFSACS

SEQ ID NO: 4174 - protein, 374 aa, Corynebacterium glutamicum
MRDHVEIGIGREARRTYSLDDISVVSSRRTRSSKDVDTTWHIDAYKFDLPFMNHPSDALASPEFVIEMGKQGGLGVINAEGLWGRHADLDEAIAKVIAAYEEGDQAAATRTLQELHAAPLDTELLSERIAQVRDSGEIVAVRVSPQNVREIAPIVIKAGADLLVIQGTLISAEHVNTGGEALNLKEFIGSLDVPVIAGGVNDYTTALHMMRTGAVGIIVGGGENTNSLALGMEVSMATAIADVAAARRDYLDETGGRYVHIIADGSIENSGDVVKAIACGADAVVLGSPLARAEEAAGKGYFWPAVAAHPRFPRGVVTESVDLDEAAPSLEQILHGPSTMPWGVENFEGGLKRALAKCGYTDLKSFQKVSLHVN

SEQ ID NO: 4175 - protein, 307 aa, Corynebacterium glutamicum
MAIIKGMNKQSAAVLMVMGSALSLQFGAAIGTQLFPLNGPWAVTSLRLFIAGLIMCLVIRPRLRSWTKKQWIAVLLLGLSLGGMNSLFYASIELIPLGTAVTIEFLGPLIFSAVLARTLKNGLCVALAFLGMALLGIDSLSGETLDPLGVIFAAVAGIFWVCYILASKKIGQLIPGTSGLAVALIIGAVAVFPLGATHMGPIFQTPTLLILALGTALLGSLIPYSLELSALRRLPAPIFSILLSLEPAFAAAVGWILLDQTPTALKWAAIILVIAASIGVTWEPKKMLVDAPLHSKCNAKRRVHTPS

SEQ ID NO: 4176 - protein, 303 aa, Corynebacterium glutamicum
MLNLNRLHILQEFHRLGTITAVAESMNYSRSAISQQMALLEKEIGVKLFEKSGRNLYFTEQGEVLASETHAIMAAVDHARAAVLDSLSEVSGTLKVTSFQSLLFTLAPKAIARLTEKYPHLQVEISQLEVTAALEELRARRVDVALGEEYPVEVPLVEASIHREVLFEDPMLLVTPASGPYSGLTLPELRDIPIAIDPPDLPAGEWVHRLCRRAGFEPRVTFETSDPMLQAHLVRSGLAVTFSPTLLTPMLESVHIQPLPGNPTRTLYTAVREGRQGHPAIKAFRRALAHVAKESYLEARLVE

SEQ ID NO: 4177 - protein, 523 aa, Corynebacterium glutamicum
MSLQTNHRPVLVVDFGAQYAQLIARRVREAGIYSEVIPHTATADDVRAKNAAALVLSGGPSSVYAEGAPSLDAEILDLGLPVFGICYGFQAMTHALGGTVANTGKREYGRTDINVAGGVLHEGLEACHKVWMSHGDAVSEAPEGFVVTASSEGAPVAAFENKERKMAGVQYHPEVLHSPHGQAVLTRFLTEIAGLEQNWTAANIAEELIEKVREQIGEDGRAICGLSGGVDSAVAGALVQRAIGDRLTCVFVDHGLLRAGEREQVEKDFVAATGAKLVTVDERQAFLSKLAGVTEPEAKRKAIGAEFIRSFERAVAGVLEEAPEGSTVDFLVQGTLYPDVVESGGGSGTANIKSHHNVGGLPDDVEFKLVEPLRDLFKDEVRAVGRELGLPEEIVGRQPFPGPGLGIRIIGEVTEDRLETLRHADLIARTELTEAGLDGVIWQCPVVLLADVRSVGVQGDGRTYGHPIVLRPVSSEDAMTADWTRLPYEVLEKISTRITNEVPDVNRVVLDVTSKPPGTIEWE

SEQ ID NO: 4178 - protein, 221 aa, Corynebacterium glutamicum
MNSAPIALRFASGSVTPASLDRNAWRSSTVTSLAPVAATKSFSTCSRSPARSRPWSTKTQVKRSPMARCTKAPATAESTPPDRPQIARPSSPICSRTFSMSSSAMFAAVQFCSRPAISVRKRVRTAWPCGECNTSGWYCTPAILRSLFSKAATGAPSEDAVTTKPSGASETASPWLIHTLWQASRPSWRTPPATLMSVRPYSRLPVLATVPPSAWVMAWKP

SEQ ID NO: 4179 - protein, 147 aa, Corynebacterium glutamicum
MSEILETYWAPHFGKTEEATALVSYLAQASGDPIEVHTLFGDLGLDGLSGNYTDTEIDGYGDAFLLVAALSVLMAENKATGGVNLGELGGADKSIRLHVESKENTQINTALKYFALSPEDHAAADRFDEDDLSELANLSEELRGQLD

SEQ ID NO: 4180 - protein, 63 aa, Corynebacterium glutamicum
MEFLIVFAKPDRRAKGPQKSESLARVFGYGDLEPDRRAKTSSKRKFLARVSGFAKSTTHIGSG

SEQ ID NO: 4181 - protein, 392 aa, Corynebacterium glutamicum
MSTFQEPHHNQGFIPFAQPGYEAPTPHLATGTFQQMWQTRPARIPAKQGGHAKVAGVCEGIGVRYQIDPVLIRLFFVVTGVFGAGVAAYLIAWLCMPRYSVPVSPIEALWTPGHTKDRNHGWWLVIAFFMFSGVLSSGAGGISGPAAAITYLCLLAMWWALHKKQPLPPRGLLTTEFTVSEDATMKNEDLYPRPQPDLSTITPVEGYYAPFAQQTPEAPHWDPLAQNQYNTWDVQVPPQKPQKKRHVWPWIVGGVVGTGVVMSALAGLFISNIDPIYFEDDPGIGDVNLIPTNDELLSSYTSGVGEMNLDFSNLTQLDQEQNVQITSGIGEVMVTLPDDVPVSLSCSAGVGTARCDVGDLAAHNADLEGPMLNLVVNSGIGDVKVEFADQND

SEQ ID NO: 4182 - protein, 380 aa, Corynebacterium glutamicum
MPLYPTFTRSRDGRVVAGVASGLAKHLNVSVFWVRALLIFAALLSGAGLFAYALIWIFTRIEKKGSGEASTSKRWVSWCLVLLAIGGAAASVMLSTGFAVGTLVPIGVVGVGLLMVWLAYDRGVESGPNLLIIATGGVLMLVAIVLIVMNWNTQDGFVMALVAVVLTLVGVAALGVPLWVRMWDQLGEERAEKAAAAERADIASRLHDSVLQTLALIQKRADDPAEVARLARGQERELRQWLFDSQDKTPQTTGTVFTALERACGEVEDIYALRIVPVTVGTDEALTEKTQAAVMAVREALVNVAKHAGVETADVYAEIMLGELNIFVRDRGAGFDPDNIPDGHHGLAESVQGRVERAGGKVRIKSEIGEGTEVAITMDV

SEQ ID NO: 4183 - protein, 230 aa, Corynebacterium glutamicum
MVDVFLVDDHSVFRSGVKAELGNAVTVVGEAGTVADAVAGIKASKPEVVLLDVHMPDGGGLAVLQQINDSDVDTIFLALSVSDAAEDVIAIIRGGARGYVTKSISGEELIEAINRVKSGDAFFSPRLAGFVLDAFAAPDSAAGAGIVDAPEKDAAVESGKILDDPVVDALTRRELEVLRLLARGYTYKEIGKELFISVKTVETHASNILRKTQQSNRHALTRWAHSRDLD

SEQ ID NO: 4184 - protein, 108 aa, Corynebacterium glutamicum
MAAKKSGAGSRGGAGRSASADKQIDQSQAKFTFQPTRTLLFSVIFTVLVMWQSGFSYWYAIPILFFIWAIFILGHSFYNWANLKLIEMGRRNKQVLEEQEKQKKKRGF

SEQ ID NO: 4185 - protein, 163 aa, Corynebacterium glutamicum
MHSCSMGFGKAILLEIMDPMNSYNTMKSHVTPIPTPVSVRLSSSVLVGAAIASLTTDLAPAVKFSVTGVGLALALLIAFAHPYRGEMRMYRFQNNISPVPTIGQVMPLFFTWLALMLAPIISGAPLWATILVFLAATGWMYLTFPHVDGSRKLAFAEGPRRNT

SEQ ID NO: 4186 - protein, 321 aa, Corynebacterium glutamicum
MSKRSRAFATALIALGLGLSSCSTTEDTAISETTVSSVATKTTSTLPEMNSAVSADGVTITIDSAFTTDSVEMESLDRPSGDIQPEMSREDGIFVVVETTIKNESGADMDITCASTGSTVYAEISTNQEAVYQPIRDLFLIPGNPECNHNLGSGFDAPMTWVFQIPKDATAERFGFTHSELGDGKLTWIALNDLSNSEPATESTMRDEAAIDPSTPQQTPVQETVISQNTIETPVAPAPAVPAYGASCPVSMLQQPSQAADGSALVCIYAGTPNPIWVYGPEPLGVGTATPGGACEGYEAGGQDASGNIMMCSGGQWVYGP

SEQ ID NO: 4187 - protein, 275 aa, Corynebacterium glutamicum
MHTVENECLLELMSGTGVRKLWGDGTPVSLPDLSGLSRAERIDALRSRMSTMGAAVPKFEPSVEESAEQKQDSLAEKQDIVAVPSAFSDLFPGDGLPRRAVTQLVEQPLVVVDFLAHITAQGGHAAVIGWKDLAYAGVIDSGGVCENIIAIPNPGTEPLNVAAVLCEGLDVVVYKGPEISLSPTRARPLLGKLRQGTAALVMVGTKVSSPALSVDAEITDYVGIGAGSGRIRGVEMQVRAVSKTHGVRSGKVLISRPQDAALLEPEQPTTLRAVP

SEQ ID NO: 4188 - protein, 530 aa, Corynebacterium glutamicum
MTRVMALWFPDWPVQAVHLDEDAPAHNKPVAIAAHYRIQVCGVAARKRGVRRGMKVRQAQAVCPELEVVDADADRDARMFEGIVASLGEVASSVEVLRPGLVAVDAGAAARYYGSEDIAAQMLIDAALRQGIDVFAGVADEITTAVIAARANGGTVVKREASRSFLQQQPLGVLAAEEALGCEAEVVRALADLGMRTLGELAELPVEAVATRFGNAGLRCHNIARARHDRKVAPPITHADWEVSHVPEEPILRVDAASFVARNLASRLHQLLSKGGVVCQLLKVTADFSTGDTVSRIWRTGEPLTEQATADRVRWQLDGWLTARGVHSDDPNEHDGITALWLIPLECVPPDMASGGLWDTGRSQQHVARQVIERVQSSLGVDAVLQPVPAGGRGVEERIHFVPYGEKRDAIRNPAGSWPGKIPGPLPARLGGGINHPASQVTMIDTEGQRIYVTAEALLSSSPYALSWGPARYLITGWAGPWPVDDRWWEKNGTKYARLQVVGRAVSEERQLSAWLLMWKDNKWRIEATY

SEQ ID NO: 4189 - protein, 220 aa, Corynebacterium glutamicum
MTQGYGVCMIVQPTSHSKHRARLKTLAIVGASALTLAGCGTSNSTTNDASSVTQTMSATADGAQLSNEASTGPTALGEADVAMKTLRPDAPAQLMVTDVRIGSHSGFDRVVFDLTGTGTPGWFIDYTSNPTQQGSGNTINFTGDTALNVNIDGTVYPFDLGLEDPEIGTVDGSGSIVTQVVSAGTFEGRSQFVIGLNGKHRYSVTELQDPHRLVVDVLAQ

SEQ ID NO: 4190 - protein, 287 aa, Corynebacterium glutamicum
MTLRCSDVNVEPLPGTAKTGSGFVLLEHAGSWSRDVLDGGTFDPELTDQLKRHLKASGMGLQLIRKPGREGRNVEKHNLFLVFAEASIIEHLVVDAPADVLDLDLSGPGKNNAQRMDDPMLLICTHSKRDVCCAIKGRPLAAAVEPQFGPLHVWEASHTKGHRFAPSMLLMPWNYSYGLLDEAETVQLFQGALDNKLFLPGNRGRGTLDARGQVAEIAVAEAFGEAVAPASLQVEFEDDSVLVTHPDGRTWVVELERIEVDGVVSSCGDQPKTGKAWVARQVTELIG

SEQ ID NO: 4191 - protein, 287 aa, Corynebacterium glutamicum
MMEKIRLILLSSRPISWINTAYPFGLAYLLNAGEIDWLFWLGIVFFLIPYNIAMYGINDVFDYESDMRNPRKGGVEGAVLPKSSHSTLLWASAISTIPFLVILFIFGTWMSSLWLTLSVLAVIAYSAPKLRFKERPFIDALTSSTHFTSPALIGATITGTSPSAAMWIALGSFFLWGMASQILGAVQDVNADREANLSSIATVIGARGAIRLSVVLYLLAAVLVTTLPNPAWIIGIAILTYVFNAARFWNITDASCEQANRSWKVFLWLNYFVGAVITILLIAIHQI

SEQ ID NO: 4192 - protein, 130 aa, Corynebacterium glutamicum
MTYIFISIPFLAIAMVLFVLKLQSGTPKLLPITAVSALTLCSLTIIFDNLMVWADLFGYGDTQHLGIWLGLIPLEDLFYPLFAVLLIPALWLPGNMFKRRKKRPHHSLPTIANGSITTRSTTTQSEPEKP

SEQ ID NO: 4193 - protein, 132 aa, Corynebacterium glutamicum
MAFIYLGTLLVLIGCMALCDHRWKLAFFRHPLRAILSVGAAYIGFLLWDIFGIITGTFYRGDSAFMSGINLAPHMPIEELFFLFFLCYITLNLTSAAALWLKAPLPKKPGKKSPLTPQRDTFQPTTTPEVEP

SEQ ID NO: 4194 - protein, 548 aa, Corynebacterium glutamicum
MKVSTKTPRSSGTAVVIGAGVAGLATSALLARDGWQVTVLEKNTDVGGRAGSLEISGFPGFRWDTGPSWYLMPEAFDHFFALFGACTSDYLDLVELTPGYRVFSGTHDAVDVPTGREEAIALFESIEPGAGAKLGNYLDSAADAYDIAIDRFLYNNFSTLGPLLHRDVLTRAGRLFSLLTRSLQKYVNSQFSSPVLRQILTYPAVFLSSRPTTTPSMYHLMSHTDLVQGVKYPIGGFTAVVNALHQLALENGVEFQLDSEVISINTASSRGNTSATGVSLLHNRKVQNLDADLVVSAGDLHHTENNLLPRELRTYPERYWSNRNPGIGAVLILLGVKGELPQLDHHNLFFSEDWTDDFAVVFDGPQLTRPHNASNSIYVSKPSTSEDGVAPAGYENLFVLIPTKASSSIGHGDAYMQSASASVETIASHAINQIATQAGIPDLTDRIVVKRTIGPADFEHRYHSWVGSALGPAHTLRQSAFLRGRNSSRKVNNLFYSGATTVPGVGIPMCLISAENIIKRLHADTSAGPLPEPLPPKTTPSQKTSYDH

SEQ ID NO: 4195 - protein, 304 aa, Corynebacterium glutamicum
MTHQNSPLFLKSALRLYNRASFKASHKVIEEYSTSFSLSTWLLSPRIRNDIRNLYAVVRIADEIVDGTAHAAGCSTAKIEEILDAYEIAVLAAPQQRFNTDLVLQAYGETARRCDFEQEHVIAFFASMRKDLKANTHDPDSFTTYVYGSAEVIGLLCLSVFNQGRTISKKRLEIMQNGARSLGAAFQKINFLRDLAEDQQNLGRFYFPKTSQGTLTKEQKEDLIADIRQDLAIAHDAFPEIPVQARIGVISAYLLFQKLTDRIEATPTADLLRERIRVPLHIKLSTLARATMKGLSMSIYRKNS

SEQ ID NO: 4196 - protein, 730 aa, Corynebacterium glutamicum
MSTSITTENKKKSGPPRLMRIFLPALLILVWLVGAGVGGPYFGKVSEVSSNSQTTYLPESADATQVQEQLGDFTDSESIPAIVVMVSDEPLTQQDITQLNEVVAGLSELDIVSDEVSPAIPSEDGRAVQVFVPLNPSAELTESVEKLSETLTQQTPDYVSTYVTGPAGFTADLSAAFAGIDGLLLAVALAAVLVILVIVYRSFILPIAVLATSLFALTVALLVVWWLAKWDILLLSGQTQGILFILVIGAATDYSLLYVARFREELRVQQDKGIATGKAIRASVEPILASGSTVIAGLLCLLFSDLKSNSTLGPVASVGIIFAMLSALTLLPALLFVFGRVAFWPKRPKYEPEKARAKNDIPASGIWSKVADLVEQHPRAIWVSTLIVLLLGAAFVPTLKADGVSQSDLVLGSSEARDGQQALGEHFPGGSGSPAYIIVDETQAAQAADVVLNNDNFETVTVTSADSPSGSAPITADGIVPLGSGTAPGPVVVEGQVLLQATLVEAPDSEEAQKAIRSIRQTFADENISAVVGGVTATSVDTNDASIHDRNLIIPIVLLVILVILMLLLRSIVAPLLLVVTTVVSFATALGVAALLFNHVFSFPGADPAVPLYGFVFLVALGIDYNIFLVTRIREETKTHGTRLGILRGLTVTGGVITSAGVVLAATFAALYVIPILFLAQIAFIVAFGVLIDTLLVRAFLVPALFYDIGPKIWWPSKLSNQKYQKQPQL

SEQ ID NO: 4197 - protein, 382 aa, Corynebacterium glutamicum
MRDNWPCDTRMDNGMTITTEHSTHPDLDFNDEIYRELNRICASLSQQCSTYQPEFRTCLDAAFQALRGGKLIRPRMLLGLYNTLVDDDIEVKLNTVLQVAVALELLHFSLLVHDDVIDGDLYRRGKLNFIGQILMHRTPESFAQIQRDPEHLDWAQSNGLLMGNLFLAATHQIFARLDLPHHQRVRLLDLLNHTINDTIVGEFLDVGLSSKAISPNMDIALEMSRLKTATYTFELPMRAAAILAELPQEIETKIGEIGTNLGIAYQLQDDYLSTFGDAAEHGKDAFSDLREGKETTIIAFARDTAKWTDIQDNFGSADLSTSQAERIQHLLIQCGAKNHSLNAISDHLNICRSMIKTLSPQVDPKAQNLLLKQVEQLASRKS

SEQ ID NO: 4198 - protein, 195 aa, Corynebacterium glutamicum
MLNMQEPDKIHPAEPTLRNIYDVKTSDPKSELVDRSGMSEEDIAQIGRLMKSLASLRDVERSIGEASARYMELSAPDMRALHYLIVAGNAGEVVTPGMLGAHLKLSPASVTKTLNRLEKGGHIVRNVHPVDRRAFALMVTDATRGEAMRTLGKHQARRFDAAKRLTPQEREVVIRFLQDMAQELSLNNAPWLNTE

SEQ ID NO: 4199 - protein, 216 aa, Corynebacterium glutamicum
MRISSKLVTTALLAAISLFGISTAQAQDIFDGGRLAGGSSQVSNLSSVPENLALPEIENSIDLERYKGKWYQVAAIPQPFSLQCSHDVTADYGVIDSDTISVTNKCGTFFGPSVIEGSAKVVSNASLKVSFPGIPFQSEDNQANYRVTYIEDDYSLAIVGSPSRSSGFILSRTPQLSSDQWSHVRNITEDSGWWPCAFITVPATGGLNTATPLCTL

SEQ ID NO: 4200 - protein, 475 aa, Corynebacterium glutamicum
MITELLAAGFQVRATSRKKTSLQRFDWYEDVEAVEADLTDATELDTLFKDVDVVYYLVHSMGGKNVDFEEQEQRTAENVIQAADQAGIKQIVYLSGLHPRNRKIEELSKHMRSREKVAQILLAGQTPALILRAATIIGSGSASFEIIRHLTERLPRMIAPQWITNQIEPLAIRDVLHYLISAADLKDPVNRSCDIGCGKSYEFADLLRIYADVRGLKRHVNSVPLNLPMDKLSGLWISLVTPVPFQLSFPLAQSMAEDAVTEEHSIKDIISDPPDGFIEYREAVELALAAEFDRGVPTSWDRSWTVQQPWAGQPTDPEWAGKAVYEDVRTEDTDLRAAQVWPIIEGLGGVNGWYSAPLLWRLRGIADRLIGGPGLGGRRDPRHLKLGDRIDWWRVTEIDPPHRLVLTAEMKVDGGAWLILEVADKENGGCTYTQRAIFEPKGLPGYLYWWVVSPFHAIIFPYMRSNILKAARKLT

SEQ ID NO: 4201 - protein, 468 aa, Corynebacterium glutamicum
MNDPQRSPTLLWFRDDLRLSDNAALKWAADHGPVIGLFIDETINRSIGAAARWWREQSLNALAQDLSFYGVPLLRRTGNPLEILPKIVSEMEVKAVTWNRRYHQPLCEVDATLKKNLRDKGIEVHSHPGFLLTEPWEVSTATGTPYKVFTPFSKAAWEVARVHAYETVKNNVPVPSHLTGPEDVELPILEMEQPFWSTTLVKECAPGEKNASEKLFDFLEHLQDYPQARDSLARSATSKLSAHLRFGEISIHRVWAETAAIDSEGTELFLKELLWRDFAWHRLYALPHMDTQNVRMQFNRFGWSWDPSEKDKLNTPSTPLIPTKADQFHEDLAAWRAGKTGIPLVDAGMRELWATGSMHNRVRMVVASFLTKNLQIHWRHGEEWFWETLVDADPASNAFNWQWAAGSGDDASPYFRIFNPVTQAKKFDPDETYIRRWVPEYGTPSYPDPIVDLKESRQIALDAYSAIK

SEQ ID NO: 4202 - protein, 251 aa, Corynebacterium glutamicum
MTTSIQRRISIVIPCLNDAVLLEQCLSSIVAQTLQPEEVIVVDNGSTDNSVEVANRMGARVVHEPLQGITWASAAGYNSARGDLIVRFDADCVIPPDHLSQVNAIWNRTEETPGRTIVALTGTGSFDIPGRMGEWLALCYLGAYRWSTKQALGHYPIFGSNSVISRQWWEDVKDQITLSETFVHEDMYFSFFVRPHETVWFEKNLKLIMHPRALMGVRQSFIRLVRGFYTIKIAWKREPVHQRLESRRDWT

SEQ ID NO: 4203 - protein, 805 aa, Corynebacterium glutamicum
MFRLAFAQLRRRGGRYFSLFFAIFASVALTVSATALTNSLVSSVNDLFAKPYENADLVVTVSAKNEDSFAAFEQQLATTPGVEALAFDQNFAASVKQSDGIYASTSVQSISEGPLQWRPILEGRLPQGPGEIAVTTAPGAPEVGEHVSIRLSQNTEDTEVLVVGVVEPAAQETLGGAPFVVASPDALMEWNSSGVRGEFRVATSDPASLEAASFSDATVVVASAEGHVDKLADSYLGQRDRYFLLLAAFVAVAAAVAFLVVFSAYSVLTGERVREFGLIRSVGASTPQILGSVIFEAGILGVVAAGFGAPAGLMAARLLADNAARFGIRVPIDVIDLPSSTMWLIAGVGVVMSVIAALPAVFSVCRKSAVESLSTPAISRTSPWFGALWLLLAGIVGAGGMWAYEATSDYRGMRSVALSIAGSGALVCALLIATAVLVPWLLHVFSRIVGGTVPTLQLGLAFAAKQKSRSAALIAVILAGSALSSAVLHGQAHIGTHLVAVAKGMGGTDMMVTALDGEIPAGMLEEISSIDGVKTAIAPATTAVELEDSGNFSVLMLAEEDGASVMRAGDTGAPAGGLVLGRNSPDQDAYPAGQAANIIVADTPTQAEIFHSDNYFSMIDPALATGPSTTRNVLILLDGDSNQAPDNATAQAVRKTISLFDGRYSITEGFSARQNTFELVSRITTMSTLLAIVALAIAAVGLINTVALTISERARDRYLLRTIGLTSTGQILVMAIEMIALSLPAAIVGAVSGGFLGRFVASSATNTAATAPLQVDILGGTVLAMVAGSVLCALIVLANKRRRVV

SEQ ID NO: 4204 - protein, 239 aa, Corynebacterium glutamicum
MNPATDNAPPVLSAQDLMMIYGKGSTEVRALDGISVQIQSDKWTSIMGQSGSGKTTLLQCLSGLAQPTSGRVTLNKNNITLSSLSENKRAKLRRTHISMVFQDFNLVPILSVKDNILLPLRLAHRRVDKQWFEHITSVLKIDNRMRHLPGELSGGQQQRAAIARALMSRPDIVIADEPTGSLDSVTSDAVLNLFRSIVDDFGQSLVFVTHDKDAAHRGDVLITMRDGKIIDTADLRVGR

SEQ ID NO: 4205 - protein, 51 aa, Corynebacterium glutamicum
MAVQEDHAPLNLLHRKTRDIYLEVGIAGFSMPKCPYSVDALVHPRSYAPKE

SEQ ID NO: 4206 - protein, 222 aa, Corynebacterium glutamicum
MILAADWNRLGPTFQTAIIDTLLMVIITMVVAGLLGLVVGLLLYTTRAGGILKNKVIYTILNVLVNFVRPIPFIILIAAIKPLTVAVMGTSIGRDAGIFVMVVAAIFSVARIVEQNLVSIDPGVIEAARSMGASPMRIIATVIIPEALGPLVLGYTFLFIAIVDMSAMVGYIGGGGLGDFAIVYGYRAFDNEVMYVAVLVIVIIVQAAQLLGNWLSKKIMRR

SEQ ID NO: 4207 - protein, 282 aa, Corynebacterium glutamicum
MAKQIFRFHLVWGVTQRGGHELLSNLCLWIGEHLVDAAVFHNFAGFHHSNLVCDGTHNFHFVGDHNDGDAQFAVYLAQQLQNFMGGFWVQSGGGFVGKQKRWIGGQCTGNADALLLAARQLLGVVFAFVAQADELEHFLHASFTSCLVHLGNFQRVLHISSRSTRLEQVELLENHADITAQFTQLRLGHSDDVGAVEQQRTARGGVKAIDEADKSGLAGARVTDDADYLTGFYGESDIIKRGGFSRFIVAKDFGYAAELNASALGAGLLRGVFLWRRCGRGV

SEQ ID NO: 4208 - protein, 360 aa, Corynebacterium glutamicum
MSHTASTPTPEEYSAQQPSTQGTRVEFRGITKVFSNNKSAKTTALDNVTLTVEPGEVIGIIGYSGAGKSTLVRLINGLDSPTSGSLLLNGTDIVGMPESKLRKLRSNIGMIFQQFNLFQSRTAAGNVEYPLEVAKMDKAARKARVQEMLEFVGLGDKGKNYPEQLSGGQKQRVGIARALATNPTLLLADEATSALDPETTHEVLELLRKVNRELGITIVVITHEMEVVRSIADKVAVMESGKVVEYGSVYEVFSNPQTQVAQKFVATALRNTPDQVESEDLLSHEGRLFTIDLTETSGFFAATARAAEQGAFVNIVHGGVTTLQRQSFGKMTVRLTGNTAAIEEFYQTLTKTTTIKEITR

SEQ ID NO: 4209 - protein, 299 aa, Corynebacterium glutamicum
MKLRRITTTAIAGLFAATALVACGSDSDGSSTTVAEGTEGVTIRIGTTDAAKEAWTVFEDKAAEEGITLDIVPFSDYSTPNEALAQDQLDVNLFQHLKFLAEYNVGSGADLTPVGSSEIVPLALFWKDHDSIDGIDGESVAIPNDPSNQGRAINVLVQAGLVTLKTPGLVTPAPVDIDEAASKVSVIPVDAAQAPTAYQEGRPAIINNSFLDRAGIDPNLAVFEDDPESEEAEPYINVFVTKAEDKDDANIARLVELWHDPEVLAAVDRDSEGTSVPVDRPGADLQEILDRLEADQENA

SEQ ID NO: 4210 - protein, 1004 aa, Corynebacterium glutamicum
MQGEASVPFAELHATSSYNFLTGASDPSDVVVQAKKLGLVALSVMDRDGFYGAVRFAEAAAEAGMHTVYGAELSLQEGVLTVLCKNPEGYKKLSHLISDAKMATGEKGEVRYPPLPMVAEHAAGDWVVLAGFQWLDKIDYVIDCFKPENIVLEFGSTMTPEDADRNEYLRRTQAKFQLRGILSTNPESAARGSVRLAGAKQALARKMPLADAESELHPMGTTWMRSGDTLLKAHPDYADLIATTVELAAECAFTLDLVAPNLPKWDTPGEHTEMSWLAHLVSTRIDTRYVGRSADIKARAATQIDYELGVIEKLGFPGYFLVVNDLVEFCRDSNILCQGRGSAANSAVCFVLGITNAEPISAGLLFERFLSPDRDGPPDIDIDIESGRREEVIQYVYEKYGRDNAAQVANVITYRTKGAMRDAARALGYPQGAADAWAKGTSEPPDDVLELAAQFKGQPRHLGIHSGGMVICDRPIADVVPVEWARMDNRSVVQWDKDDCATAGLVKFDLLGLGMLEAIHHMLDLVAEHRGKKINLWELDLAEPEVYDMLCKADAVGVFQVESRAQLSTLPRLKPRTFFDLVVEVALIRPGPIQGGSVHPYLRRRAGEEAITYDHPVLEKSLGKTLGIPLFQEQLMQVAVDAAGFSGGEADSLRRAMGSKRSPERMAALRSRFFQGLKDTNGIVGETAEKLWNKIVAFAAYGFPESHSQSFASLVYFSAWFKYHYPAEFCVGLLRAQPMGFYSPQSLISDARRHGVSILPITVNDSGVEADAPNGAIRLGLNLVKGLGHDAAQRIEDNAPFDSIPDLSRRADLNVAQVEALARAGAVDCLGVGRRQALWQAGVAATEKPGMLPGLSVIEAPALPGMSAFELMATNISATGVTADYQPMALIRERMEELGIVPADRLLEVEDGTRLRIAGIVTHRQRPQTASGLTFLGMEDETGLMNVMVSVGLWQRQRVLARNAKALIIRGIVQNAQGVATVVADRLEPLDMGEFLSRGSRDFR

SEQ ID NO: 4211 - protein, 149 aa, Corynebacterium glutamicum
MNPVSPKLTTARYLTRIPWLLISAIVFGVLGVFVSSWFYAGVIVVAVILIWQLWLIPQQVKRLGWLETSDELLITKGKLWHTFTVVPYGRIQFVDVTAGPLERAFGMKQVQLHTASASSDSTIQGLPVAEADALRERLAIKARERMSGL

SEQ ID NO: 4212 - protein, 471 aa, Corynebacterium glutamicum
MSSLEGFRKVHRATPFLRIWTIIVAVLAAFAFNSGASVLSFIWGVVTGEYGFAVLPILLTVGGAVIVVALAWIITGIWWKAVGFRITNEEVQLQRGVISKDLRTARFDRIQAVDLVESFIARIFRLAEVRIETAGGSDSAISIGFLRKSEAEALKRELLDASQHSVATTPAGVPAEPGVGETVVVESAGDVLVPQIPVQRTLASTALSLATIITAIGIVILLFVPFGVSIAVPFFVGMVPAVWNLIDKSWQFTATQRNDVLHVSYGLANRRKQSIPLGRIHAVKLKQPLLWRLVGWWTVTVTVVGYGDTTQGGTSKILPVGSKELALKVLEAVGPLNSADIAESADPSHMSRPQYTPPVAARLLTPVDRTRQGVTLIGVAGAPGAVVVHEGRFMPRMSVIDTSHIQELTLKHGPIQRILGLSTVVFNLVQGPVGMAASDLSAADGKELLNILRNRKLPALESAPLGQNSLD

SEQ ID NO: 4213 - protein, 246 aa, Corynebacterium glutamicum
MPTKNGTAMLTPKGTKSKITIPIAVMMVASDKAVLARVRCTGICGTRTSPALSTTTVSPTPGSAGTPAGVVATECWEASRSSLFRASASLFLKKPMLMAESLPPAVSMRTSASRKIRAMNDSTRSTAWIRSNRAVRRSLLITPRCSCTSSLVMRNPTAFHQIPVIIQASATTMTAPPTVNRIGSTANPYSPVTTPQMKLKTDAPELNANAARTATMMVQMRRNGVARWTFRNPSRLLIVRSSSPGP

SEQ ID NO: 4214 - protein, 223 aa, Corynebacterium glutamicum
MHISDLPDRSQDYLKTIWDITELLDDQPAALGDIAEKMNQKTPTASEAIKKLAARGLVNHEKYAGVTLTEQGKTLAIDMVRRHRLLETFLHDVLGYTWDEVHADADLLEHAASDQLIERIDAHLGRPRKDPHGDPIPTAEGVIEESPRTTLEAVQPGETVTISRVKDIDPELLRYLAQYNVSPGCRITVASGPLAGMVHVVVEGTDTSFPLAETQLPLITVQD

SEQ ID NO: 4215 - protein, 266 aa, Corynebacterium glutamicum
MVMGPTHAMSGAAVGLAVAQILPAEWGGVTTATEAFIYAGLAAGAALLPDLDSPQATVSRSFGPITQVISRFTENICQTFVNVTRGRKDKHCNNGHRTLTHTVWSAAATGAGATALIGAYGKPAVIGLLFFFLGLAIRGLMPEWSKNADWLLVTGASAALAVGVWNYAPESSFGIVLGSAITVGSLTHLAGDMATKAGIPAFAPVIPLKGKRWWNLKLPKFLSIRANGPADKFLLFVFSVAVIIQIGLVSSGNMSTIMMNLLSPAL

SEQ ID NO: 4216 - protein, 46 aa, Corynebacterium glutamicum
MHQLLSQLKIQNLSEFKNKPKGGHLFERVLDLGNLSKILPFRLKSG

SEQ ID NO: 4217 - protein, 258 aa, Corynebacterium glutamicum
MSERQLEKSIEHAVELAREARNIEVFTGAGMSADSGLETYRDDKTGLWSNVDPQAMASIDAWRKDPEPMWAWYRWRAGVAARAEPNAGHQAISYWEGSDTVEHVHITTQNIDNLHERAGSSDVTHLHGSLFEYRCSDCATPWEDDKNYPQEPIARLAPPQCEKCGGLIRPGVVWFGENLPVEEWDIAEQRIAEADLMIIVGTSGIVHPAAALPQLAQQRGVPIVEISPTRTELSRIADFTWMSTAAQALPALMRGLSA

SEQ ID NO: 4218 - protein, 164 aa, Corynebacterium glutamicum
MTEDDLDLLHRTVELATQALKQGNSPYGSLLVDPFGAVVFEDHNRDADGDLTKHPEFAIAKYAIENYSASERAACTVYTSTEHCAMCAGAHAWAGLGKIYCATTGGQTAAWYAKWGAESGPLNPISADKISPNISIEGPASRFEEVLYELHRWFYLGQSPNKAL

SEQ ID NO: 4219 - protein, 332 aa, Corynebacterium glutamicum
MQSRLSKILRSSVVGVAVLALLAGCSNNADDTDADSTSTGNSAFPVSIEHEFGTTTIDDVPERVVTLGVTDADIVLALGTVPVGNTGYKFFENGLGPWTDELVEGKELTLLDSDSTPDLEQVAALEPDLIIGVSAGFDDVVYEQLSDIAPVVARPAGTAAYAVAREEATNLVARAMGQSEKGQELNEETDALIQAARDENPSFDGKTGTVILPYQGKYGAYLPGDARGQFLDSLGISLPEAVLSRDTGDSFFVDVPAESVKDVDGDVLLVLSNDENLDITAENPLFETLNVVQKDAVIVATTEERGAITYNSVLSVPFALEHLAPRIAEALK

SEQ ID NO: 4220 - protein, 157 aa, Corynebacterium glutamicum
MPEHPLHVIFDNPVIPPNTGNAIRMCAGTGAHLHLVEPLGFELTEKHLRRAGLDYHDLADVTVHATFDEAMAAVPGRVFAFTTTANTRFTDIAFEPGDALLFGTEPTGLPQEHVEHSRITSELRIPMLPGRRSMNLSNSAAVATYEAWRQLGFVGGV

SEQ ID NO: 4221 - protein, 284 aa, Corynebacterium glutamicum
MTAIKLDGNLYRGEIFADLEQRVAALKEKGIVPGLATVLVGDDPASHSYVKMKHRDCEQIGVNSIRKDLPADVTQEELFAVIDELNNDDSCTGYIVQLPLPKHLDENAVLERIDPAKDADGLHPVNLGKLVLNEPAPLPCTPNGSISLLRRFGVELDGAKVVVIGRGVTVGRPIGLMLTRRSENSTVTLCHTGTKDLAAETRAADVIIAAAGQPHMLTADMVKPGAAVLDVGVSRKDGKLLGDVHPDVWEVAGAVSPNPGGVGPLTRAFLVHNVVERAEKLAGL

SEQ ID NO: 4222 - protein, 85 aa, Corynebacterium glutamicum
MQKAGIVVFVLAVVAASAFALTEHWRRATFTLGASLLYLSLLRLTCDSKILGVLAVRSRRFDAIYTAIVGGLMTFLATSVDALGS

SEQ ID NO: 4223 - protein, 460 aa, Corynebacterium glutamicum
MEAIAILFVIGAILVVAVIVLGIFFLTSRTWIKVAAADEALIVSAKKKGESQVIVHGKAVVMPITQTHQKISLRSRQVNMQVTAQSDDNVTLNVEAVALVKIGSEAEFIRRAAQRFASSDKEIVRFTQDQLEGVLRGVVAQQTVTSLMRERKKFSEQIAETVIPELEKQGLILDSFQIRGITDDVGYIKSLGAPEIQAKKQAAEIAETEAARAIAKSRIANQEADLVEQTQLDANKAAADAQVGEARAQAMQAERLADEKARLEVLRQQAENKQIELEAEVNKVADAERYRRKQEVEADTFEQTRRAQAQVEIAEAEATAAKVRAMAEAEAVRLKGQAEADAIKAKAEAYRENQEALLAQQAMEILPELMSNFASGYANIGSMTVLSGGEGSENSVGSRFAGEQALGLKSIIESVKQTTGIDLAEIIQGRAAGHAQGSAQGAAIAEALSRDETVEDRSEK

SEQ ID NO: 4224 - protein, 321 aa, Corynebacterium glutamicum
MTLLNSRRAAGAFATTLVASTLGLSGCTSVTSSATSSPEPPTKVAAAMQTTTGETSISNETSFNASRETSLTALGFLDYLDEEQRAALLGEGLDISTLTWANQVTALRVLESLFNEHAYELVSAVIQHVAQEPGDNPHHFLKFSPEPSTENSWELTLDGPTVGLKVTFDPDGQITFKDAHLGLSPAEVVSVTEALDTSYSESQIKKAAEQLVGSLNPTQQAALQGSGLRGAQLTEEQKTLFLKMTSNWIDLANGDSGSEQQEEIADTFSDTYIIWNEQKDGSAFFQMKGPELDFSYKESVPENAELSARGVPNIQTSFQSP

SEQ ID NO: 4225 - protein, 377 aa, Corynebacterium glutamicum
MPTLAPSGQLEIQAIGDVSTEAGAIITNAEIAYHRWGEYRVDKEGRSNVVLIEHALTGDSNAADWWADLLGPGKAINTDIYCVICTNVIGGCNGSTGPGSMHPDGNFWGNRFPATSIRDQVNAEKQFLDALGITTVAAVLGGSMGGARTLEWAAMYPETVGAAAVLAVSARASAWQIGIQSAQIKAIENDHHWHEGNYYESGCNPATGLGAARRIAHLTYRGELEIDERFGTKAQKNENPLGPYRKPDQRFAVESYLDYQADKLVQRFDAGSYVLLTDALNRHDIGRDRGGLNKALESIKVPVLVAGVDTDILYPYHQQEHLSRNLGNLLAMAKIVSPVGHDAFLTESRQMDRIVRNFFSLISPDEDNPSTYIEFYI

SEQ ID NO: 4226 - protein, 437 aa, Corynebacterium glutamicum
MPKYDNSNADQWGFETRSIHAGQSVDAQTSARNLPIYQSTAFVFDSAEHAKQRFALEDLGPVYSRLTNPTVEALENRIASLEGGVHAVAFSSGQAATTNAILNLAGAGDHIVTSPRLYGGTETLFLITLNRLGIDVSFVENPDDPESWQAAVQPNTKAFFGETFANPQADVLDIPAVAEVAHRNSVPLIIDNTIATAALVRPLELGADVVVASLTKFYTGNGSGLGGVLIDGGKFDWTVEKDGKPVFPYFVTPDAAYHGLKYADLGAPAFGLKVRVGLLRDTGSTLSAFNAWAAVQGIDTLSLRLERHNENAIKVAEFLNNHEKVEKVNFAGLKDSPWYATKEKLGLKYTGSVLTFEIKGGKDEAWAFIDALKLHSNLANIGDVRSLVVHPATTTHSQSDEAGLARAGVTQSTVRLSVGIETIDDIIADLEGGFAAI

SEQ ID NO: 4227 - protein, 734 aa, Corynebacterium glutamicum
MKKSPKMSPTARVGLLVFGVIAAVGWGAIAFSRGETINSVWLVLAAVGSYIIAFSFYARLIEYKVVKPKDQRATPAEYVNDGKDYVPTDRRVLFGHHFAAIAGAGPLVGPVMAAQMGYLPGTLWIILGVIFAGAVQDYLVLWVSTRRRGRSLGQMVRDEMGTVGGAAGILATISIMIIIIAVLALIVVNALADSPWGVFSITMTIPIALFMGVYLRYLRPGRVTEVSIIGVALLLLAIVAGGWVADTSWGVEWFTWSKTTLALALIGYGIMAAILPVWLLLAPRDYLSTFMKIGVIGLLAVGILFARPEVQMPSVTSFALEGNGPVFSGSLFPFLFITIACGALSGFHALISSGTTPKLVEKESQMRMLGYGGMLMESFVAMMALITAVILDRHLYFSMNAPLALTGGDPATAAEWVNSIGLTGADITPEQLSEAAESVGESTVISRTGGAPTLAFGMSEILSGFIGGAGMKAFWYHFAIMFEALFILTTVDAGTRVARFMMTDTLGNVPGLRRFKDPSWTVGNWISTVFVCALWGAILLMGVTDPLGGINVLFPLFGIANQLLAAIALALVLVVVVKKGLYKWAWIPAVPLAWDLIVTMTASWQKIFHSDPAIGYWAQNANFRDAKSQGLTEFGAAKSPEAIDAVIRNTMIQGILSILFAVLVLVVVGAAIAVCIKSIRARAAGTPLETTEEPDTESEFFAPTGFLASSRDKEVQAMWDERYPGGAPVSSGGH

SEQ ID NO: 4228 - protein, 203 aa, Corynebacterium glutamicum
MRSHAKGTAGIHAHLYRPFFTTTTSTRASAIAASSWLAIPNSGKSTLMPPSGSVTPMSKIAPHRAHTNTVEIQLPTVHEGSLKRRRPGTLPKVSVIIKRATRVPASTVVRMNRASNMMAKWYQNAFIPAPPMNPERISDIPNAKVGAPPVREITVDSPTLSAASDSCSGVISAPVSPMELTHSAAVAGSPPVSASGAFMEKYR

SEQ ID NO: 4229 - protein, 67 aa, Corynebacterium glutamicum
MMALTHALWKIPRAVWWYLTELMGDTAYSKYVVHLKHHHPDAPIPTEREYWRAKYADQDANPGARCC

SEQ ID NO: 4230 - protein, 203 aa, Corynebacterium glutamicum
MSNVINLVLMQAHSTHQVNLNLIPSSDATDQILATFSSLLCCSQNRRNVISWVGVFRSEERVMEIKLTHRSAVSKRSPFRGITSWQTENRCTPTIGNWPDLCHRTGRANWSTQHGSCLHRCIVDDAVDDHFLSVRSNLNWVGCNASDLVSQVLLVRELFRRTVGAHFVVNHGWNVTPSQRTNVAHHTNSLKSNVGHCKSCVIL

SEQ ID NO: 4231 - protein, 318 aa, Corynebacterium glutamicum
MWNTIYQAIGQALHTTTATRQSRKGAISSWKAFAPAFAGKMSIEAVDRAMRGEGAPSPIWEGEDGVIAWLLSGLDHIYTIPLPAEGEAKRAILDTYTKEHSAEYQSQAPIDLARSMGEKLAAQGLDLRDVDSIVLHTSHHTHYVIGTGSNDPQKFDPDASRETLDHSIMYIFAVALEDRAWHHERSYAPERAHRRETIELWNKISTVEDPEWTRRYHSVDPAEKAFGARAVITFKDGTVVEDELAVADAHPLGARPFAREQYIQKFRTLAEGVVSEKEQDRFLDAAQRTHELEDLSELNIELDADILAKAPVIPEGLF

SEQ ID NO: 4232 - protein, 304 aa, Corynebacterium glutamicum
MFSSAVAPTERRKALRAALAAPEIARMPGAFSPLAARAIQEAGFEGVYVSGAVVAADLALPDIGLTTLTEVAHRSRQIARVTDLPVLVDADTGFGEPMSAARTVSELEDAGVAGCHLEDQVNPKRCGHLDGKEVVGTDIMVRRIAAAVNERRDEQFVICARTDAAGVEGIDSAIERAKAYADAGADMIFTEALYSPADFEKFRAAVDIPLLANMTEFGKTELLPAQLLEDIGYNAVIYPVTLLRIAMGQVEQALGDIANTGIQTDWVDRMQHRSRLYELLRYNEYNAFDQQVFTYSADSYKPIF

SEQ ID NO: 4233 - protein, 383 aa, Corynebacterium glutamicum
MSSATTTDVRKGLYGVIADYTAVSKVMPETNSLTYRGYAVEDLVENCSFEEVFYLLWHGELPTAQQLAEFNERGRSYRSLDAGLISLIHSLPKEAHPMDVMRTAVSYMGTKDSEYFTTDSEHIRKVGHTLLAQLPMVLAMDIRRRKGLDIIAPDSSKSVAENLLSMVFGTGPESPASNPADVRDFEKSLILYAEHSFNASTFTARVITSTKSDVYSAITGAIGALKGPLHGGANEFVMHTMLAIDDPNKAAAWINNALDNKNVVMGFGHRVYKRGDSRVPSMEKSFRELAARHDGEKWVAMYENMRDAMDARTGIKPNLDFPAGPAYHLLGFPVDFFTPLFVIARVAGWTAHIVEQYENNSLIRPLSEYNGEEQREVAPIEKR

SEQ ID NO: 4234 - protein, 310 aa, Corynebacterium glutamicum
MRTSVVVALDMVIHSLYIGGLEDGLVAVSGIGEYLLVESVVLVVAQQLIQPGSVLHPVDPVGLDSGVCNVAESLFDLSHRNAQQGHWVDHCVVSDVFQKLRGQKFGFAKFRHVGQQRNVDGRAEFFKICRAVQRFGEDHVGAGIRVSFGALDRGVDAFHSRGVGASADDELLIATLVDSCGDATNHDVRAHYFFSVQVPTAFGVDLIFQVAARDTCIFEFGDGARCGHGFAEAGVGVDQHGQVCHACDLPGAVRHFGQCGQADIRQCKVSRHDGARDVHAFKSGFLDCARRQRGECTRHAGNFRRSQCRA

SEQ ID NO: 4235 - protein, 64 aa, Corynebacterium glutamicum
MYFDVSQDVDDELHFSFFELYADQAALDAHRCAPHFYVWREAVAKHVLPGSQKNMVGTRMLHHG

SEQ ID NO: 4236 - protein, 224 aa, Corynebacterium glutamicum
MRTVFRFTGVENLLGVLCFRSGFNFPNQIAECVIEILWIAKRCNIQRDEQVASSTWGSGIIRTMYLGAVLGTSENSRKHIHHEANRITFVTSHGKDDTVDCLSRIRGGCALTRDRPSLRNGHVCLSCVVDLSARNRSIGYIDYRSRFSKRCRNRPWVGTDPFFSATPGRHRRRCIGGENGNTSLRCRFPGVVHGSSKMIGVAHRHRTDAEHHCPSHCFFTSMIS

SEQ ID NO: 4237 - protein, 347 aa, Corynebacterium glutamicum
MPEVTVNAQQLTVLCTDILTKTGVPAADAHLVGDSLVQADLWGHPSHGVLRLPWYVRRLHSGAMTTHAHVEVLNDLGAVLALDGHNGIGQVLADHARKEAVTRAMMFGIGAVSVRNSNHFGTAMYYTRKAAAQGCVSILTTNASPAMAPWGGREKRIGTNPWSIAAPFGETATVVDIANTAVARGKIYHARQTNMPIPETWAITSEGAPTTDPAEAINGVVLPMAGHKGYAISFMMDVLSGVLTGSQHSTKVHGPYDPTPPGGAGHLFIALDVAAFRDPQDFDDALSDLVGEVKSTPKAQNTEEIFYPGESEDRAHRKNSAHGISLPEKTWMELQELAIENHVVTHR

SEQ ID NO: 4238 - protein, 240 aa, Corynebacterium glutamicum
MVQKDAQASPATRKADQVYTQIRREIEDGTLNPGQRMSEVWLVEHTGASRTPVRDALRRLAADELIILEPRQAPMVSPLSLRHIKDLFEFRRIVEVAALEEISVGASKSPRIFGEFSTLAADFRELENSADDADFTADFRRLTSKFDDLVAANTHNQFLGRSILSLKPHTTRLRIIAHSDHARLRQSVQEHIEMCEAVASGDLRSAGAACRQHLIHVEKSILTALINADSTGSQGIDIRS

SEQ ID NO: 4239 - protein, 234 aa, Corynebacterium glutamicum
MRFSRVLPALLITTAVSIPTASAATLTADTDKELCIASNTDDSAVVTFWNSIEDSVREQRLDELDAQDPGIKAAIESYIAQDDNAPTAAELQVRLDAIESGEGLAMLLPDDPTLADPNAEESFKTEYTYDEAKDIISGFSSDPASDVLSQLQQAATTGTRTAEIRAEVFADRTDDYNESQTALKEDFQNCIDAIDDARPIPLQYILIGGAIALAVIVLGIRAWTNSRKQSKHSQ

SEQ ID NO: 4240 - protein, 299 aa, Corynebacterium glutamicum
MPAPVTAIVESATQISPNFIRIVFTGPELKVVGSDTPLYDQRIKLIFPNPGQPLPEFPQEGLWYEEWAKLPEDSRGVMRTYSIRSLERTEEATRMTVDFVLHIAPGLTGPASTWAASAAAGDEILIVAPRLDAEYMGGIEFAPGAATKVILAGDETAAPAIARILEDLADSDIPGTAMIEIPSDDDALAIEGPSSIDVKWLPRNGRKHGELLMETLALHHEETEAAATSEGELVWETPVFSATGEQITESNPRSGDYYWIAGESGVVTSIRRSLVKEKGLDRSQVAFMGYWKHGVSMRG

SEQ ID NO: 4241 - protein, 269 aa, Corynebacterium glutamicum
MTTNHQLSAEEISLAYGERTIIDSLSVDIVPGKITSIVGPNGCGKSTLLRAFARLLKPSAGQALIDAHPLPSLPGKELARMLGLLPQSPTAPEGIVVADLVGRGRHPHQGLMGRWSTRDYEVVAQALEMTNTTELAERPIDELSGGQRQRVWIAMALAQETDILLLDEPTTYLDIANQLEVLDLLTDLNHNHGTTIVMVLHELGLAARYSDHLIAMNAGKIYAQGTPTNVITETMMSEVFHTDARIIADPVSGAPLVMPMGRHHITALH

SEQ ID NO: 4242 - protein, 353 aa, Corynebacterium glutamicum
MDYSSSESQRAMSLSHQLKRQRASRNSRRWLIVAALGVVTLGIFAFSLMWGEVFYGPAQVLKVLSGQQVPGASYSVGVLRLPRAVMGLTAGLAFGAAGVIFQTVLRNQLASPDIIGISSGASAAGVICIVFFGMSQSAVSAISLCASLAVALLIYLVAYRGGFSATRLILTGIGIAAMLNSLVSYSLSKADSWDLPTATRWLTGSLNGATWDRAMPLIVTTVVLIPLLVANARNVDLMRLGNDSAVGLGVATNRTRVIAIIAAVALIAVATAACGPIAFVAFVSGPIAARILGSGGSLIIPSALIGGLIVLIADLIGQYFLGTRYPVGVVTGAFGAPFLIYLLIRSNRAGVTL

SEQ ID NO: 4243 - protein, 332 aa, Corynebacterium glutamicum
MMSTTKKLLFLSATLVLLAVACVCSVKFGVRSTSTDDAIQALLGHSDTTEQAAALKRIPRTVLGIIIGAALAIAGTTMQAVTRNPLADPGIFGILAGASLAVVIGISFFGLAGAVPTMIVAVVGSAAAAVFVYTVGSLGRGGATPLKLALAGAATTAALTSLVSAVLLPRVDVMDRFRFWQIGGVGGAEWDRMALAAPFLAVGFLLCVLTSTGLNALALGDDVATSLGENVLRTRIVASIGAVILCGVATALAGPIAFVGLVVPHITRLIVGTDHRWLVPCSALAGAVLIVAADTFGRVVTRPSEIAVGIIMPIIGAPLFIWIIRRQKVKEL

SEQ ID NO: 4244 - protein, 350 aa, Corynebacterium glutamicum
MRTSRVLAGILAATLTVSLAACSQDSSETSSNSSSAASQSSDVSNEAFPVTIEHAFGETTIESKPERIATVGWSNHEVPLALGVTPVGFEKVTWGDDDNNGILPWVEETLSKLGSDEPVLFDATDSIPFEEIANTAPDVILASYSGITQEDYDQLSQIAPVVAYPEIAWGTSLDEMIEMNSKAIGLEQEGKDLIADLDAEVASAIDANPELKDAKPVFAFFDESDFSQIGVYTSIDPRMSFLLDAGVQEASVLKEHSSPDSFYEQVSAENPETFDDVDVIITYGTEDDAANAELLSKMQADPLLSRIPAIAEGKVVFLGANPLAASANESPLSIPWGINDYFAKLAEPLK

SEQ ID NO: 4245 - protein, 424 aa, Corynebacterium glutamicum
MHESGKNPVKVVDSQAPQGRGGHIGGHIKRRPIPRQTEISEVRRYIVMTALALGGFAIGVTEFVSMGLLSAIASDFEISEDQAGHIITIYALGVVVGAPLITAFTGKLPRRRLLLILVAFFVVGNALSTLNASYEVLLIARFIAGLPHGAYFSVAGLAAASMAPDGQRGRAIAYVGMGLSVGTVAGVPAAQALGDAFGWSTAYVLVTVLGVLTLLALWFLMPHMTEMKPTSPLTELSALKNSQVWLTLGIGSIGFGGMFAVYTYISWTMTDQAGMPSSLIWIVLMAYGVGMICGNYVGGRIADWNVDRGILLALICIVVALIGFYFTSNNAILGTINFGLVGFFGSTLIPSLQIRLMDVAGRAQTLAASLNQSALNIGNALGAAIGGVVIGAGYSYSTPALAGAGLAFLAIVVWFPMVALRKRT

SEQ ID NO: 4246 - protein, 304 aa, Corynebacterium glutamicum
MSFHITSVNVNGIRAAVKQRSETNLGFLPWLEETRPDVVLLQEVRASEKDTATALQPALDNGWHYIGAPAAAKGRAGVGILSRHELEDVNIGFGSFLDSGRYIEATIKDTTLDVPVTVASLYLPSGSAGTDKQDEKYRFLDEFEGFLDQRAKERSHMVIGGDWNICHRREDLKNWKTNQKKSGFLPDERAFMDSVFGTFPDEATQVAGAGDFFGAVDYEGTRRREATTDPAWFDVARRLQPEGDGPYTWWTYRGKAFDTGAGWRIDYQAATAAMLERAERSWVDKAAAYDLRWSDHSPLNVIYS

SEQ ID NO: 4247 - protein, 219 aa, Corynebacterium glutamicum
MLLTILWAIGITAEGMTGALAAGRQKMDLFGVSVIACVTAIGGGSIRDMLLGHYPLVWVEKPLYLLLIIGAAILTVSISFLMEHFRVLFLVLDAVGLSAFAVIGTQIALEMGYGFIIAVVASVLTGVFGGVMRDLLCDRIPLVFQKELYASIAFLATCVYFAMMYLGASENVTVLVSVVVAFVVRLLSIWRGWSLPVFDYQEREYKRDPKMRLWRMFRK

SEQ ID NO: 4248 - protein, 65 aa, Corynebacterium glutamicum
MYMGKSFALLVLGAIILAGGVWYTIEVGYSVMAIVAALIMAAGGGIITWGLAVAADVNSPTSHKI

SEQ ID NO: 4249 - protein, 325 aa, Corynebacterium glutamicum
MKKSLIAIVASALVLSGCTSDSSDSSGTSGTVETTSITTSVAAADGAFPRTVTLDDSSITLESKPERIAVLTPEAASLVLPITGADRVVMTAEMDTADEETAALASQVEYQVKNGGSLDPEQVVAADPDLVIVSARFDTEQGTIDILEGLNVPVVNFDSDAWGDIDAITKHLEIVGELVGEEDKAAEAIAEIDANRIDIDKPATSPTVLTLMQRGPRQMVMPESAMLNGLIREAGGTPVVDSLGAVGTITADPEQVVAMAPEIIIIQDFQGKGRENFANFLSNPALANVPAIENDKIFYADTVTTGVTAGTDITTGLQQVAEMLS

SEQ ID NO: 4250 - protein, 260 aa, Corynebacterium glutamicum
MPQLVEIRDLNVEFPSRHAVKNVSFSAPAGKVTALIGPNGAGKSTALSAIAGLVESTGEVMVGGSGVASKSAKARARLLSLVPQNTELRIGFSARDVVAMGRYPHRGRFAVETDADRRATDDALRAINALDIAEQPVNELSGGQQQLIHIGRALAQDTAVVLLDEPVSALDLRHQVEVLQLLRARANSGTTVIVVLHDLNHVARWCDHAVLMADGEVVSQGDIREVLEPATLSTVYGLPIAVRDDPETSSLRVIPHPNPF

SEQ ID NO: 4251 - protein, 339 aa, Corynebacterium glutamicum
MSRTGVSKKPKLTAPVVIIGTLVLLIIAFTASLMLGPVTVPLNELATNPVVTDIRAPRIIIAALVGAALAVSGAIMQTVFHNPLADPGIVGVSSGAAVAAVLAIVTGASFFGQWTVPFAAFVGALVTVAVVYLIASSRAMDGRGADPATLVLVGMAITAFLGAVISSATANAPQDSELRSVTFWLNGDLVSRTWEHVGVAIIPIIVGLILAIGGSRDLNLLLLGDSTAQTSGLNVNRARIILLALAALLTATAVAVSGTITFVGLVVPHLVRIVLGADHRALLPAAAILGATFVIVSDTVARMIFSPIVLQTGVVVAFIGSPIFLYLLLSMRKRRGLGL

SEQ ID NO: 4252 - protein, 345 aa, Corynebacterium glutamicum
MTTQDKDLTAQTASRVLSGIQPTADSYHLGNYLGAVKQWIDLQDSYDAFYFIPDLHAITVDQEPEELRNRTISGAAQLLALGIDPERSTLFVQSHVPAHAELSWVLTCLTGFGEASRMTQFKDKSSKRGADRTSAGLFTYPMLMAADILLYRPHLVPVGEDQRQHLELTRTLAERFNNRFGKAFEVPEGFIPQGASKIYDLQNPTAKMSKSGDNPKGIINLLDDPKVSTKRIKSAVTDNDGVIAYDPENKPGVSNLLVIQSALTGTSIDSLVDGYQGAGYGALKGDTADALEAFTTPLKAKYDEYMNDRGELERVLAIGAERATEVANETLADVYDKIGFLASRR

SEQ ID NO: 4253 - protein, 361 aa, Corynebacterium glutamicum
MSTRTTPQDRYTDEYGIERVNKDEPGLVDKLRDKHDWFDHLMRMNERFGAKGGNQLSAGITYFSVLSIFPIAMLVFGIAGVILAGNPEVLTDIQNRINDALEGEIGNTVNGIIDSAIAQRGAVLGIGGVTALWSGLGWMANLRFGVSRMWAIDPTEGNFIQKKLTDLVALIVLLLAMGVAFGITALGASGLTKNLLDFVGLGEIPGISYITWVVAALVGVLANFLVFMWLIFSLPRTKVPMKPGLQAALLGAIGFEVVKQVGSLLASNALSNPAGAAFGPIIGIMVVLYLIWRILMYCSAWAATSEEALRLATVPAPEPAIIRVRHEIDPGEEVSQSARKVGIGVAVGAATAGAFALLRKK

SEQ ID NO: 4254 - protein, 301 aa, Corynebacterium glutamicum
MNTNLPNLYTAFDLDRSESSEALGVSLSARDLRLEQMGIAQDDPRRAQTVQAFAVLADPAKRATYDAQLEAGVPLTWAQIQHLGNFGTLPSTPTAQPFAAPQPEPSPEPQQQWNSGQNYAYGNPTMDYQTQQSYNPMQDQTQASMYAQPFANTPAPMYNSNQVFNRPTAGTRLWMAILDSIFAGIAGGIVSGIFGFGSEFLTSVIMILVLIVYIVGSESFLGSTPAKKIMGYETRDVDTHSKLSAGAAAKRNWWKLISFTGIGSVVSFVMAIVYGSSINESNQMRGMHDRLANAEVVKKNT

SEQ ID NO: 4255 - protein, 379 aa, Corynebacterium glutamicum
MEAPNTDLCPYKESPSPARSTSEVVAPGAQTPALVPVPSVPAGGEKLATCGVITPNGFELPEDSDETITASAWMVFDIDSGEIIAAKDPHGRYRPASIIKVLLSLVAIDELNPTTVVTGTMEAANIEGSRVGVGEGGQYTVDQLLHGLLLASGNDAAYLLAQELGGDQATLEKVNALAKELGTQDTFVATYSGLDAPGMSTSAYDMSLIYQHAWQNPVFESIISTDHIDFPGWGDNEGFQVWNDNALFMNDPDGIGGKTGYTDDANHTFVGGLDRGGRRLAAVLLDSTVSDIRPWEQARLLIDASLPITPGSGVGQLGSGSANDVAPATPELPEPTDNLTSGEGGSQNTLLKLVVPIGIIVLLLIAALAWTFRSPKKKN

SEQ ID NO: 4256 - protein, 409 aa, Corynebacterium glutamicum
MAEKGIVPVKLSLTEGDFYTLWAPNWREGGNEWQAFLGANDDLYVFNSPEELLVFLESDDKHDLTSHPEWKKFNSGDAARVVPDANAELDIIGAPALLADRPSYANVKTLSRIFAVMRSLGHVTAASPVTVFFSSHSVLSNVDRGSEHYSGPNGLGEWTSVGRAVATNWNGVVDALDEAITVKEVNSLFTEDAATRIQEAQAAVQAAREAEEQIAKEEAEKVDPYDNSPWAAAGIDPIKVSIDGRTIYTLRTYLGGQPVFLGKFGEIFTFNSQKSLLRWLVEHDDHDLARASTWSDLMLGINAGETELLVHSDNVYSFNGLVKDINTSVDAVDTQQMARAYELMADTADWADDDSMNSYFLANPRMQDYISYMLGGSDTSGYVPHAPFNDHSESWRELEEMLIKRFSKF

SEQ ID NO: 4257 - protein, 286 aa, Corynebacterium glutamicum
MIGLISALSRLATHEPAQLPQLAIPQAPDISAAIALGRELSANPTTLLSLFDATSQQHHLLVTSLIQAAPLIDAARHDIATTAQHYLNQAAGLVMRSFSMNPAESFAARTELISLPGLMIAEASQRLEEMSRQVQPIVEKLVQIQDLTPEPTAEPVAETAPVYMAAQAPSNDNEVGKQAVAAAKEALGTPYLWGGTSTSGFDCSGLTQWAWRRAGVEIPRIADQQAVGRQVTYDELQEGDLLIWDGHVAMYAGGGQIIEAGDPVQLNPIRTSNIGMAFHGYFRPTG

SEQ ID NO: 4258 - protein, 65 aa, Corynebacterium glutamicum
MDIKLRARISGKRGHSRGGQQTQLVGELFGVGQINPHTLLDWKSGRLVPSKPKFARAVFFWAAMI

SEQ ID NO: 4259 - protein, 117 aa, Corynebacterium glutamicum
MLNHCRPEEDRAGEFGLGGNQTATFPVQQSMRINLPHAKELAHELCLLPTPAVPALPTDSGAQFDIHQALSASLATYARNLTLLSHTAENLGNRALTGLAEIEDTDDQLAHALERLT

SEQ ID NO: 4260 - protein, 211 aa, Corynebacterium glutamicum
MDITIVNHPLVASRLTLLRDERSDNAAFRAAANDLGAMLIYEASRDLEVEHFDTKTPVAMAEGTRLKQPPIIVPIIRAGLGMIDPALSMIPDAQVGFIGLARDEETHEPVPYLEALPQDLSNQPVFLVDPMLATGGSLLHAIRLLADRGATDITAICMVSAQPGVDALAESGLPVRLVTATIDPGLDENAYIVPGLGDAGDRLYGPRNIDL

SEQ ID NO: 4261 - protein, 128 aa, Corynebacterium glutamicum
MSKEMSEKRWSSYGHAFASRLKKLRTLRGFSQEELADLSGVSRNTISNYERNENNKGNAVDPQLSNIYRLAQALDVPPIALMPAGSVPVAKICVDETAAIDVRWPSEKDPLLFDADLRLTRNREQPGN

SEQ ID NO: 4262 - protein, 394 aa, Corynebacterium glutamicum
MEIGVQVASWMDRHHDEVIKWRRHLHSHPELSHMEYRTTEYLASVLKDHGMEPHLFPGTGLMVDIGPEGDSRLAFRADIDALPLLESTGLEFSSTATGVAHACGHDVHTVIALALACALNTIELPIGIRVIFQPAEEVMTGGATDVIAHGGLDGVDAIYAIHVEPKLKVGRVGVRAGAITSASDVIEIRVKGEGGHSARPHLSADVVYALSKLVVDLPGLLSRRVDPRTGTVLVFGTINAGYAPNAIPDSGIVSGTLRTADISTWRDMRPLISELVEQVLAPTGVTHELIYNPGVPPVLNDDVATALLASAARDMDTQSVVQAPQSSGGEDFSWYLEHVPGSMARLGCWPGHGPKQDLHQSDLVVDERAIGVGVRLFGSLVQQYSSRSEAFLNS

SEQ ID NO: 4263 - protein, 575 aa, Corynebacterium glutamicum
MRQPAHQFPSREIPFCFVRRRIRKTCSAVESSLIVIPRKQRIGVFMDESRQLSFGTAGLRAPVGPARHQMNVLQVTRTTAGVASWLAERAALNPVPHLVPEDETGIGRALYPQDGPLRVVVGYDARYGSHTFAATTAEVFAGAGFEVTLLPTPSPTPLIPWLVNKHGLDAGVQITASHNGAADNGYKVFLSNGRQLYSELEPELEAHINAVEDPIRVPRVTVRPTADQLRRYVDEMVSLVTPDQADLLRVNSERGNLRVVYTALHGVGGRAMANAFQFAGFPHTHGVKAQQYPDPTFPTVAFPNPEEPSAIELLLERAKEKNADILFALDPDADRCAVGIRTADGGHRMLSGDEVGTLLATRLVPEYSGEGPRPVVATTVVSSQLLGIIAEDKGWDYSETLTGFKNLSRAADGLDGPLAFAYEEAVGTCPVPDVVPDKDGISTALFMASWAAELKAQGASLQQKLNELYRRYGYFASSQIAVRTSSPRELVDHWIAHPQQELIGVSVTPHILPEKQGIALHGQVGHVHIRAIGRVSGTEAKAKLYLEVGQASSHDEAAQLLHQLEDEVQSWLSKL

SEQ ID NO: 4264 - protein, 469 aa, Corynebacterium glutamicum
MAKRIVIIGGGPAGYEAALAGAKYGAEVTVIEDVGVGGSAVTMDCVPSKSFIAGTGIKTDLRRADDMGLNRGLGKAHLEIDALNIRVKDLAKAQSEDILGQLQRSDVRMINGVGRFDDYNTKQTTHYIKVTHSDGSEETVECDLVLVATGATPRILKGAEPDGERILTWRQVYDIEELPTHLIVVGSGVTGAEFVSAFAELGVKVTMVASRDRILPHDDADAADVLETVLAERGVSLEKHARVESVTRTEDGGVCVRTADGREIYGSHALMTVGSIPNTADLGLENIGVELAPSGHIKVDRVSRTNIPGVYAAGDCTDLFPLASVAAMQGRIAMYHALGEGVSPIRLKTVATAVFTRPEIAAVGITHAQVDSGEVSARVIVLPLATNPRAKMRSLRHGFVKLFCRRNSGLIIGGVVVAPTASELILPIAVAVTNRLTVADLADTFAVYPSLSGSITEAARQLVQHDDLG

SEQ ID NO: 4265 - protein, 1140 aa, Corynebacterium glutamicum
MSTHTSSTLPAFKKILVANRGEIAVRAFRAALETGAATVAIYPREDRGSFHRSFASEAVRIGTEGSPVKAYLDIDEIIGAAKKVKADAIYPGYGFLSENAQLARECAENGITFIGPTPEVLDLTGDKSRAVTAAKKAGLPVLAESTPSKNIDEIVKSAEGQTYPIFVKAVAGGGGRGMRFVASPDELRKLATEASREAEAAFGDGAVYVERAVINPQHIEVQILGDHTGEVVHLYERDCSLQRRHQKVVEIAPAQHLDPELRDRICADAVKFCRSIGYQGAGTVEFLVDEKGNHVFIEMNPRIQVEHTVTEEVTEVDLVKAQMRLAAGATLKELGLTQDKIKTHGAALQCRITTEDPNNGFRPDTGTITAYRSPGGAGVRLDGAAQLGGEITAHFDSMLVKMTCRGSDFETAVARAQRALAEFTVSGVATNIGFLRALLREEDFTSKRIATGFIADHPHLLQAPPADDEQGRILDYLADVTVNKPHGVRPKDVAAPIDKLPNIKDLPLPRGSRDRLKQLGPAAFARDLREQDALAVTDTTFRDAHQSLLATRVRSFALKPAAEAVAKLTPELLSVEAWGGATYDVAMRFLFEDPWDRLDELREAMPNVNIQMLLRGRNTVGYTPYPDSVCRAFVKEAASSGVDIFRIFDALNDVSQMRPAIDAVLETNTAVAEVAMAYSGDLSDPNEKLYTLDYYLKMAEEIVKSGAHILAIKDMAGLLRPAAVTKLVTALRREFDLPVHVHTHDTAGGQLATYFAAAQAGADAVDGASAPLSGTTSQPSLSAIVAAFAHTRRDTGLSLEAVSDLEPYWEAVRGLYLPFESGTPGPTGRVYRHEIPGGQLSNLRAQATALGLADRFELIEDNYAAVNEMLGRPTKVTPSSKVVGDLALHLVGAGVDPADFAADPQKYDIPDSVIAFLRGELGNPPGGWPEPLRTRALEGRSEGKAPLTEVPEEEQAHLDADDSKERRNSLNRLLFPKPTEEFLEHRRRFGNTSALDDREFFYGLVEGRETLIRLPDVRTPLLVRLDAISEPDDKGMRNVVANVNGQIRPMRVRDRSVESVTATAEKADSSNKGHVAAPFAGVVTVTVAEGDEVKAGDAVAIIEAMKMEATITASVDGKIDRVVVPAATKVEGGDLIVVVS

SEQ ID NO: 4266 - protein, 290 aa, Corynebacterium glutamicum
MMDHAHDSCSPTLRRDLEVTGQLQPEKAVDLAAPHEGKVANITKVTSSNMEHTITQASKAKEVVVLIGHSLLPTFQDLEKDILHFQAGNKGRFSVAIVDPDRSADVVARFRPKQIPVAYVVKDGASIAEFNSLNKEPVAQWLDHFVSRETIPNEKEGDVDKQIDPRLWRAAELVNAGDFRAALALYEQLPQDATVKRAHAAVSVLARMSVADRGEDPIEKSRRDPDDVNKALAAADMYVLMNQPDTALAHLAALLPKPEAARRIVELLNLFDPLDLVALEIRAQVGNAMS

SEQ ID NO: 4267 - protein, 162 aa, Corynebacterium glutamicum
MKKAMRAAIGLAVSTAMTFGIAPSAHAFTALSSNIFAPPARNTENANGDVSQVELEVFALVNQHRIAHGVAPLAMNESLNSGSKSWSYTMSRTGNFVHSSGGNYGENIYWASNIRPASLIFESWKNSPGHNRNMLDTRYSQIGVGVVYDSSGQTWATTQFYF

SEQ ID NO: 4268 - protein, 362 aa, Corynebacterium glutamicum
MATTTPVTVLSGFLGSGKTTLLNQILHHRGSRKIAVIVNDFSEINIDAALIASEGHLTRGEDRFVELTNGCICCTLREDLVDSVGELASSDRFDHIVIESTGISEPMPVAATFEWQWDDGTRLADKAPIDTMVTLVDATQFIDLIRKNTSLTEADMGATEDDERTIADLLTDQIEFADRIYITKSDLVDRTVLEQTRALIASMSPRARIDLLIDGLNDGSPITDDILGAFLYDEATARAYEGYTEELENPHTPETEEYGISSVVFRSDRPFNKDRLLQVLRSTTGLVRSKGYCWIADHLNIVQVWHQAGPNLSIRPAAYWANSEITPGTELVLIGIHIDGPTLLALLQGATLTDAEVAALVL

SEQ ID NO: 4269 - protein, 308 aa, Corynebacterium glutamicum
MSSHDLVDVVVVGAGAAGLAAAVALGRSLRSVIVIDAGQPRNSYAHAAHNVLGQEGIAPAELLEKGRAEARSYGVTIAPGRVAKVERTGSTFAITLDDASLLHSRRIILAHGAVDDLPEVEGLSDFWGTKVLHCAYCHGFEARDSEIVVVGTSPMAAHQALMFSQLSKTVSLVGTIDIDEQTSESLDSAGVKVLGTNAVRVSAEGDGLSVELSEGDHLSCDNIVVASRPLVDGTLYTQLGGQMEENPMGRFIPGTQTGRTPIEGVWAAGNAQAPMAMVYGSAAQGVMAGAEINFDLILEDISVASAQS

SEQ ID NO: 4270 - protein, 498 aa, Corynebacterium glutamicum
MRIHDVYTHLSADNFPKAEHLAWKFSELATDPVEVTPDVSEMIINRIIDNAAVSAASVLRRPVTVARQQAQSHPREKGGKVFGISGSYSPEWAAFANGVAVRELDFHDTFLAAEYSHPGDNIPPLLAVAQAQRSSGRDLIRGIATAYEVQVELVRGICLHEHKIDHVAHLGPSAAAGLGTLLHVDEETIYQAIGQALHTTTATRQSRKGEISSWKAFAPAFAGKMAIEAMDRAMRGEGSPAPIWEGEDGVIAWLLSGKDHVYHVPLPEHGEPKLGILETYTKEHSAEYQSQAPIDLARRMKPLVDAAGGTEHIAEIVLRTSHHTHYVIGTGANDPQKMDPQASRETLDHSIMYIFAVALQDGVWHHEFSYTRKRSTRPETVELWHKIRTVEDPEWTRRYHSDDPAKKAFGAKAVITMADGTVIEDELAVADAHPLGARPFARENYIEKFRTLAQGIVIDSEQERFLHAVQSLPDLDDLDQLNIEVDISNQAATKAGLL

SEQ ID NO: 4271 - protein, 296 aa, Corynebacterium glutamicum
MGRRRQAFKAALAAPHIARLPGAFSPLIARSIEEAGFEGVYVSGAVIAADLALPDIGLTTLTEVAHRARQIARVTDLGVLVDADTGFGEPMSAARTVAELEDAGVAGCHLEDQVNPKRCGHLDGKEVVRTDVMVRRIAAAVSARRDPNFVICARTDAAGVEGIDAAIERAKAYLDAGADMIFTEALHSEADFRYFRHAIPDALLLANMTEFGKTTLLSADVLEEIGYNAVIYPVTTLRIAMGQVEQALAEIKEHGTQEGWLDRMQHRSRLYELLRYEDYNVFDQHIFTYRKGENNE

SEQ ID NO: 4272 - protein, 126 aa, Corynebacterium glutamicum
MAASIPSTPAASVRAQMTKFGSRRAETAAAMRRTITSVRTTSLPSKCPQRLGLTWSSRWHPATPASSNSATVRAADMGSPKPVSASTSTPRSVTRAICRARWATSVSVVKPISGSARSAAMTAPET

SEQ ID NO: 4273 - protein, 394 aa, Corynebacterium glutamicum
MTSTFSPTEKEKTMSDSQVRKGLNGVISDYTSISKVMPESNSLTYRGYAVEDLVENCSFEEVIYLLWFGELPTTEQLRTFNTTGRSYRSLDAGLISLIHSLPNTCHPMDVLRTAVSYMGTFDPDPFTRDADHIRSIGHNLLAQLPMVVAMDIRRRSGEEIIAPDHNKGIASNFLSMVFGNDDGSVANSADDIRDFERSLILYAEHSFNASTFSARVISSTRSDTYSAITGAIGALKGPLHGGANEFVMHTMLDIDDPNNAADWMGKALDRKERIMGFGHRVYKNGDSRVPSMEKSMRSLAARHRGQKWVHMYESMQEVMEARTGIKPNLDFPAGPAYYMLGFPVDFFTPLFVLARVSGWTAHIVEQFENNALIRPLSAYNGVEEREVVPISERT

SEQ ID NO: 4274 - protein, 125 aa, Corynebacterium glutamicum
MEPMELNGGRFYARKLTSDNRIDDVPALSLILADAAQFIADATTAWHEDTEYTWAICEQTSVELLALARLDPKQRTLEVVPAGDPATQLPNDPVLAPKTIGDAVAEGRDTITRWAQGYLEISLTD

SEQ ID NO: 4275 - protein, 441 aa, Corynebacterium glutamicum
MSKLYAGARINALRRTHQLTQSALADKLDLSTSYLNQLENDGRPLTATVLLQLMKVFDVEASYFSPDRGTATATRLAETLAMNQGPTMSMDDLLDFADRFPQLAQHIIQPAEVDPTHSSAHDFVRDYFATHKNYIDSLDRLGEELATAIGQPGLRVTRLAQLLDAEYNITVRFRAPDITGRRHFDPQSRQILLRQDLSEAQQCFQLAEELTFLAHAELLDTLTTDQPDLPSEAAIRLAKVGLSQYFAAAVVMPYTRFLEFAQDKHYDIELISEAFGVSFESACHRLSTLQRSGASGVPFFFVRSDRAGNISKRQSAATFHFSRTDGTCPLWALHRAFERQGNITRQVARMPDGRTYLWLARAVKGRTHGFGYPAAEFAIGLGCDISEAPGLVYSQGLNLDPESAAEIGPGCRICPRENCVQRAFPPSGQESIRPAPVQLLN

SEQ ID NO: 4276 - protein, 82 aa, Corynebacterium glutamicum
MCIESRQPISVKENKKPQGEHTMKDTTEINWQGYADGTAIREAVIHSIEREVSAGEQPTPNDLKFLGLFQHRAGYVGSLITG

SEQ ID NO: 4277 - protein, 453 aa, Corynebacterium glutamicum
MSLHRVFHLHSLEDNNGVAFVDFSAFFDVDLDDSALHWSCHCIAGYASLCTTCATLLGLLLRTSGATECQIAWECNLNATAVDLHNNLLCWGLVLIFVELGSVNVRCDWVIPNLFDPLGVDLEAFVVAHECWVFHDVLVEWDNGWHALDNVLCKCTAGALESLLAGVAPNDQLCQHGVELSGDFGTFNDTGVHADAWALWLAVAGDLAWCRHEVGASVFAVDAELECVAAWSWIFLDGELVAFCDAEHFADQVDAGGLFGDWVFHLEAGVDLEEGDQAVGANEVLNGACTVVASFLTDSLRGGVETLALVIGEEWCWCFFDELLETALQGAVTGSGDNNVAVLIGDDLSLNVACLVQVALHEALAAAERCGCFTGCGLEEVSDFFHLVGNLHATSAATESCLDGDWETEFFSESHNFCCVFYWFLGARSHWSLGGICDVASGDLVAEGADGLR

SEQ ID NO: 4278 - protein, 301 aa, Corynebacterium glutamicum
MAAPFDPFPAFEEYAHPERIVSASWLSARLGSPGLKVVESNEDSLLYDIGHLPGAVRIDWAKDLNDPLTRDFIDGEAFAELMNRKGIARDDTVVVYGDKSNWWAAFTLWVFELFGHSDVRLLNGGRDAWMAEERDTSYVVPEYPSANYPVVERVDENQRAFVAEVLGSLTQSGGMTLVDVRTPSEFSGLDEHGNPTSNTGVLRGGHIPGAINLDWSDAVLPNGNFRTRAELDKLYADLNPADDTVVYCQVGDRAAHTWFVLKYLLGFNNVRNYDGSWAEWGNMVRMPIETGENTKNNVSVS

SEQ ID NO: 4279 - protein, 355 aa, Corynebacterium glutamicum
MKKSIVVFEVEGGSDKHFDGHRKDTMPIVNSINDAGWQAEVVYYRPEWTEGLFEYVSENFDGYISRVNPGNIPGGERGYFDLLTRLSEAGLVGMSTPEEMMAYGAKDALVKLSQTDLVPSDTEAYYDVETFHKVFPTSLSFGERVLKQNRGSTGSGIWRVQLVDKELAASIEPGTALPLDTEIKCTEAVDNHTEVRKLGEFMDFCDQYIIGDNGMLVDMRFMPRIVEGEIRILLVGPHPVFVVHKKPAEGGDNFSATLFSGAKYTYDKPEQWQELIDLFADARPVIAEKLGGDNIPLIWTADFMLGDVVDGKDTYVLGEINCSCVGFTSELDMGIQQLVASEAIKRIEEFAQLTV

SEQ ID NO: 4280 - protein, 138 aa, Corynebacterium glutamicum
MVQINDMLAPPPVKLPEDPALGADPTLTSTAIAHPDSPLVWAYRAENLIKSASNDEEKIQAYAFARTGYHRSLDRLRANGWKGWGPVPFSHEPNQGVLRAIASLALAAKLIGEDNEYDRCRQMLSDADPESVAVLLDK

SEQ ID NO: 4281 - protein, 716 aa, Corynebacterium glutamicum
MGTARGLSQVLKEARQGGKPTSATQKVPRSGYRYDLDGLRGIAIAFVVLFHVFVGKVSGGVDVFLLLSGYFFLGSQLRYADRPDSSINPWWPIWRTLRRLLPALVLVLGVSMVLILAWVPRLQRIEIANQAVASLFYVQNWELASQGAAYGAASAEVSPFQHLWSMAVQGQFYLFAILLSMAIILIRRYRPEYSAVRLATPVLAVLTSVSFFSAILWHFIDQSVNYYSTFTRFWELGLGALLVLHAPRILISAKTKSILAAVGLFMVLSTGFFMDGAETFPGFPALYPILGACLVILGDGKISVFLSRKWMLWLGDIAYPLYLWHWPLLIIFTALFNQEEPSIWLGIAVIMLSLGLAQLTNKYVEKPMQQQGKRPLFRESRSADALQKLRSSRPARMRAYAGIAVVAVGFALTSTPQVLYQRVLDTQMSDLDPEIYPGALSLAGFDAPEVKPKPNPYVLADTVSPAWAKGCMSVFGDDPSELAPDNYDEDYCAFGNPNSPVEVYLVGGSHAEQWMAPLDALGKQHNFKVIPLVRQSCPTFVVELDGIFSDDCIEFNEKVIERLAEVKPDLVVSNSTRPLLEKGRGIDEVPESYITLWDFLEAEDIPFMGLRDNPWFIQPGGEGWMVSQCYEEEQSLVDCSITKDNFYAPVDPAEKELAIRNNMLAVDTSRWFCPDDLCIPVIGNVYVYRDGNHMSDEYAQSLAPFLWSNMRRLLVA

SEQ ID NO: 4282 - protein, 197 aa, Corynebacterium glutamicum
MQIVLASQSPSRRRILNSAGVEPLIHPADVDEDALLHSLNGSAPEEIVRQLALAKAQVVAPSYPGDVVIGGDSMLLIDATLQGKPHTREATIERWKQQRGNKATLITGHAIIFGDEVIVESSSTNIHFAEASDVDIERYADSGEPLECAGAFTLEALGGWFIDSIEGDPSSVIGLSLPVVRRALYRLGFNASDFWNM

SEQ ID NO: 4283 - protein, 82 aa, Corynebacterium glutamicum
MSEETTQDTKAAEKPFLQIVSGNPTDQEVAALTVVFAGLAKAAAAQQMVSASKDRNNWGNLDERLSRPNTFNPSAFQNVNFF

SEQ ID NO: 4284 - protein, 537 aa, Corynebacterium glutamicum
MTAAQTKPDLTTTAGKLSDLRSRLAEAQAPMGEATVEKVHAAGRKTARERIEYLLDEGSFVEIDALARHRSKNFGLDAKRPVTDGVVTGYGTIDGRKVCVFSQDGAVFGGALGEVYGEKIVKVMDLAIKTGVPLIGINEGAGARIQEGVVSLGLYSQIFYRNTQASGVIPQISLIMGACAGGHVYSPALTDFIVMVDQTSKMFITGPDVIKTVTGEDVTQEELGGAHTHMATSGTSHYSASDDSDALDWVRELTSYLPSNNRAETPRQEADIMIGSIQENINDVDLELDTIIPDSPNQPYDMKEVISRIVDDAEFFEIQEDYAENILCGFARVEGRSVGIVANQPTQFAGCLDIKASEKAARFIRTCDAFNIPILEFVDVPGFLPGTNQEFDGIIRRGAKLLYAYAEATVGKITVITRKSYGGAYCVMGSKDMGADLVFAWPTAQIAVMGASGAVGFIYRKELKQAATEGKDVAEVMKGYEQEYEETLVNPYVAAERGLVDAVIPPSETRGQIIEGLRLLDRKVVNVPAKKHGNIPL

SEQ ID NO: 4285 - protein, 543 aa, Corynebacterium glutamicum
MTISSPLIDVANLPDINTTAGKIADLKARRAEAHFPMGEKAVEKVHAAGRLTARERLDYLLDEGSFIETDQLARHRTTAFGLGAKRPATDGIVTGWGTIDGREVCIFSQDGTVFGGALGEVYGEKMIKIMELAIDTGRPLIGLYEGAGARIQDGAVSLDFISQTFYQNIQASGVIPQISVIMGACAGGNAYGPALTDFVVMVDKTSKMFVTGPDVIKTVTGEEITQEELGGATTHMVTAGNSHYTAATDEEALDWVQDLVSFLPSNNRSYAPMEDFDEEEGGVEENITADDLKLDEIIPDSATVPYDVRDVIECLTDDGEYLEIQADRAENVVIAFGRIEGQSVGFVANQPTQFAGCLDIDSSEKAARFVRTCDAFNIPIVMLVDVPGFLPGAGQEYGGILRRGAKLLYAYGEATVPKITVTMRKAYGGAYCVMGSKGLGSDINLAWPTAQIAVMGAAGAVGFIYRKELMAADAKGLDTVALAKSFEREYEDHMLNPYHAAERGLIDAVILPSETRGQISRNLRLLKHKNVTRPARKHGNMPL

SEQ ID NO: 4286 - protein, 288 aa, Corynebacterium glutamicum
MGVSPLKRAFRRDPTTLASMNVDISRSREPLNVELLKEKLLQNGDFGQVIYEKVTGSTNADLLALAGSGAPNWTVKTVEFQDHARGRLGRPWSAPEGSQTIVSVLVQLSIDQVDRIGTIPLAAGLAVMDALNDLGVEGAGLKWPNDVQIHGKKLCGILVEATGFDSTPTVVIGWGTNISLTKEELPVPHATSLALEGVEVDRTTFLINMLTHLHTRLDQWQGPSVDWLDDYRAVCSSIGQDVRVLLPGDKELLGEAIGVATGGEIRVRDASGTVHTLNAGEITHLRLQ

SEQ ID NO: 4287 - protein, 162 aa, Corynebacterium glutamicum
MGNSLEKHIAEGDRIHVDLTSPLSAMLFPIFELIVITGICWMGIGFLDQLPGIDGTNPADSFPEGTRNLLVGVWAVLAAWRFGLPLIRQRRLRVILSDRKLLVRRAGLRTGFDSIPLSYIQRVQRRRNTLVLGVGGHHRPYVINQVPKARKVEALLKDLTFW

SEQ ID NO: 4288 - protein, 387 aa, Corynebacterium glutamicum
MPIVAVIGDGQLARMMQTSAIELGQSLRVLAGAPDSSAAQVAADVVLGDYTNIDDLRVAIEGADVMTFDHEHVPNEHLHQLIAEGVNVQPRPEALVNAQDKLVMRKRLRELGAPVPPFAAIESVEDAVGFFEAVDGQVCLKARRGGYDGKGVWFPADVAELQSLVAELLDGGTPLMAEKKVALNRELSAMVARTPSGETKAWPVVESVQKNGVCAEAIAPAPELSAELQESTRGLAQKIATELGVTGVLAVELFETLDQNGQPEIFVNELAMRPHNTGHWTQDGCVTSQFEQHLRAVLDYPLGATDTLADYTVMANVLGADTDPEMPMATRMVEVGRKYPDAKIHLYGKGHRPGRKIGHVNMVGSDLEKTRAEALACAYFLVNARWD

SEQ ID NO: 4289 - protein, 624 aa, Corynebacterium glutamicum
MKSARPKSVAPKSGQALLTLGALGVVFGDIGTSPLYSLHTAFSMQHNKVEVTQENVYGIISMVLWTITLIVTVKYVMLVTRADNQGQGGILALVALLKNRGHWGKFVAVAGMLGAALFYGDVVITPAISVLSATEGLTVISPSFERFILPVSLAVLIAIFAIQPLGTEKVGKAFGPIMLLWFVTLAGLGIPQIIGHPEILQSLSPHWALRLIVAEPFQAFVLLGAVVLTVTGAEALYADMGHFGARPIRVAWFCVVMPALILTYLGQGALVINQPEAVRNPMFYLAPEGLRIPLVILATIATVIASQAVISGAYSLTKQAVNLKLLPRMVIRHTSRKEEGQIYMPLVNGLLFVSVMVVVLVFRSSESLASAYGLAVTGTLVLVSVLYLIYVHTTWWKTALFIVLIGIPEVLLFASNTTKIHDGGWLPLLIAAVLIVVMRTWEWGSDRVNQERAELELPMDKFLEKLDQPHNIGLRKVAEVAVFPHGTSDTVPLSLVRCVKDLKLLYREIVIVRIVQEHVPHVPPEERAEMEVLHHAPIRVVRVDLHLGYFDEQNLPEHLHAIDPTWDNATYFLSALTLRSRLPGKIAGWRDRLYLSMERNQASRTESFKLQPSKTITVGTELHL

SEQ ID NO: 4290 - protein, 205 aa, Corynebacterium glutamicum
MAHISVERFRTRYCQDNGTKQHKCLERLSHNQAQGPMWRQALQDFWVPDDLRNSQSCKGDKPQQHDGAEGFADFFCTERLDCKNSDQNCERYGQNEALKAWGDNRQAFCCAENRDRRGDHHIAIKQCGAQHAGYCHEFSPVPTVFQQSNERQDATLSLVVSSGDQHDVFDGDDQSDGPQHHGDDAVHIFLSDFDFVVLHAECSVK

SEQ ID NO: 4291 - protein, 119 aa, Corynebacterium glutamicum
MKKNPLVEWVWVMDELGVGWCQCEKDSITGKAPHPVNKPLVTKSIIRALGDVPDVMSNQDISLVVVDLWKFDTITPPIAESLMRSVKAVNGEMHPQYPTATAMAAIKHFSNTFDGQINA

SEQ ID NO: 4292 - protein, 165 aa, Corynebacterium glutamicum
MGPLVGLIMGSDSDWDTVAPAAEVLAEFGIPFEVGVVSAHRTPEKMLNYAKTAHERGIKTIIACAGGAAHLPGMVAAATPLPVIGVPRALKDLDGLDSLLSIVQMPGGVPVATVSIGGAKNAGLLAVRILGAGDPSLVTKMADYQENMAKEVEAKDEALKKRLLG

SEQ ID NO: 4293 - protein, 151 aa, Corynebacterium glutamicum
MNPIVVLGSKVVDGQVTGLLASRLEKAIEVSSLTPEAPVVVSGFGEAAAMADYLRARGVTTIVEEPWATSTNENLENAHALFPDTLQWTVVTSGFHAWRTYLWAWHLGIPIKVVTARTPSAERLGMAMRECFALPHSTLRVLWRKIRTPKN

SEQ ID NO: 4294 - protein, 264 aa, Corynebacterium glutamicum
MSTAYFIAHGNDTYRPTEHSSGVWRDDELHLAPVAGLVIHHMERWRREVVGDALVFSRFSLEVLGQIARDDVTLRTEIVRPGRTIELIETVAEINGRVTIRARAWLLKTSDLAHISGDTFEALPSMTELADVKSAFQWSGGFMDSIVFVEDAEKIPGKNRAWITGDVQLVDGEDSEPLAEFSKFLDVANGVAVREDPKTWMFPNVDLTFHLFRQPVGTKVGFDTRAAFGPNGIGLTTSVIHDAEGPVGTLNQSLTVRPIAELNK

SEQ ID NO: 4295 - protein, 438 aa, Corynebacterium glutamicum
MTPKEIHLNLFAFGAGHHAAAWRAVEGSVEKLGLISWWEELARTAERGKLDAVFLADGQAINPVGLENGPGWFLEPVTALTAMARATNNIGLISTISSTFWQPFHAARMIASLDHISGGRAGINVVTSMTDAEARNHGMDALPGHDVRYARAAEFIETITALWDSWPAESLVMDRAGKFADSSLIKSIDHDGEFFQVAGPLNIPSPPQGRPVLFQAGSSPQGREIAAKYAEAIYSVAWDLEQAQDYRSDIHARATAQGREPMPVLPGLVTFVGTTVEEARAKQQALNALLPVKDSLNQLSFFVGQDCSTWDLDAPPPPLPPLEEFSGPKGRYETVLRIIESKSPTVRELLGYLAAGGGHATFIGTPESIADEIERWIDEGGADGFNLMPPMLPHSLDDFVDLVVPELQRRGRFRTEYSHTTLRGHLFNQVAYSARSLV

SEQ ID NO: 4296 - protein, 500 aa, Corynebacterium glutamicum
MHTPDLHHRHSPRLLTIDIMPKPLPPETRRKIIDFDPFAPNSPSIEEFCSRLKISRRSFYNIRNRYQQDANAALHPHSSAPITARRTYDESITSTLLSIRARLKAQGWEYGPISIRFEGISTGELTAPIPSVSTIARLLRAAGAVESNPKKRPKSSVVRFQRGQAMEMWQIDGFIYTLHDTDLTRVTIYQILDDATRFDVGTCVFPANENSVDARTALEQAIAHFGAPHELLSDNGSAFNRMRQGYVGSLESYLATVGCLSITGKPGHPQTQGKNERSHRTLFRFLQAHQPHTLEECAHYIEQFRDHYNNRRPHQGLPNNLTPAAAWEIVGCVEQQPPIDPVVLQQQADHYARRRIEKQSDVPLVRQEESVPVSKMQQTEQRRRVRRFGKKPVDPDVFTFAGNNQKVVFQGMRISVPRTMRDREFYRTVTATELGFWDAITGELELSIPLPVVAIARGKSYINSYNIRGVWMQHPTPLWQRKRDEAEKRFKSIDPGDLLR

SEQ ID NO: 4297 - protein, 263 aa, Corynebacterium glutamicum
MLDISEQIVLVTGGARGLGRALSESFLREGARVVVNYHRSADAAAELAGEKAVAIQADVRDREQVKSMFAQAKEHFGSPITTVVNSALADFSFDGDARPKAEDITIERFNQQYTSAIEGALNTIQEALPGFEEVGSGRVINIGTNLFQNPTVPYHDYTAAKAALLSLTRTFAKDLGPRHITVNMVSGGLLRTTGASAATPEEVFDFIAAGTPLGSVTTPQELADASLFFASPWSRAVTGQNLVVDGGLVFNCFVSEGCAHSVS

SEQ ID NO: 4298 - protein, 123 aa, Corynebacterium glutamicum
MKDSSKFATKNYSARLFLLLYVLTVVVGWIFALGNPYSVVTAFSIFVGVGFAVAAVACALTRRAPLWLLGFLGGVGIVLVLMGIYFRVTQPDGILTGYLIPIGFGFFLAEAAVAIERYWHRRH

SEQ ID NO: 4299 - protein, 114 aa, Corynebacterium glutamicum
MSNLADIYGAETITFDPAGHRWLPFIEKHWRHGQDDPIECTRIKELTRQIATTDDPNISVLWTLFQYGGENIGDISIYYLDRFSFRGFQVPAAEHPRGAIAIHIGPLVGIADEI

SEQ ID NO: 4300 - protein, 189 aa, Corynebacterium glutamicum
MMAIIYNTSSTLNGFIADKDNSLQWLFDVPGSDGASEDFGNFLSKAGTIVMGSTTYEWLLKDLDFISDPHKWTDVYGDRPTWVFSSRNLETPEGKPVKVVNGDVADVLPAILEESPENTDIWIVGGGDLAGQFFDAGALDRIILTMAPVFLDEGQPAMPRRIESNRLRTVNVREVGQFTEITLETIKGA

SEQ ID NO: 4301 - protein, 140 aa, Corynebacterium glutamicum
MGIKRLDNVAIVVESLDEAVGFFEKLGMSLDGRTMVQGDFADRTVGLSGIRSEIAVLKTPDGHSRVELTQYLQPEPIATAPSAPNQIGMHRLMFAVDDIEETIEHIGAEPLDGIANYEDTYRLCYLRGPSGIIVALAQEL

SEQ ID NO: 4302 - protein, 74 aa, Corynebacterium glutamicum
MSADKSQDQSESQRKGLQPEALLGFLGFFSFLAVIQAVINVLRPEPAVWPALLALVLVIATVSVWRAWRKRRPN

SEQ ID NO: 4303 - protein, 278 aa, Corynebacterium glutamicum
MTKRTKGLILNYAGVVFILFWGLAPFYWMVITALRDSKHTFDTTPWPTHVTLDNFRDALATDKGNNFLAAIGNSLVISVTTTAIAVLVGVFTAYALARLEFPGKGIVTGIILAASMFPGIALVTPLFQLFGDLNWIGTYQALIIPNISFALPLTIYTLVSFFRQLPWELEESARVDGATRGQAFRMILLPLAAPALFTTAILAFIATWNEFMLARQLSNTSTEPVTVAIARFTGPSSFEYPYASVMAAGALVTIPLIIMVLIFQRRIVSGLTAGGVKA

SEQ ID NO: 4304 - protein, 344 aa, Corynebacterium glutamicum
MATFKQARSAAWLIAPALVVLAVVIGYPIVRAIWLSFQADKGLDPTTGLFTDGGFAGLDNYLYWLTQRCMGSDGTIRTCPPGTLATDFWPALRITLFFTVVTVGLETILGTAMALIMNKEFRGRALVRAAILIPWAIPTAVTAKLWQFIFAPQGIINSMFGLSVSWTTDPWAARAAVILADVWKTTPFMALLILAGLQMIPKETYEAARVDGATAWQQFTKITLPLVRPALMVAVLFRTLDALRMYDLPVIMISSSSNSPTAVISQLVVEDMRQNNFNSASALSTLIFLLIFFVAFIMIRFLGADVSGQRGIKKKKLGGTKDEKPTAKDAVVKADSAVKEAAKP

SEQ ID NO: 4305 - protein, 156 aa, Corynebacterium glutamicum
MKGVRMASGKDLQVSTFGYISRCPVQVYEAIADPRQLERYFATGGVSGRLETGSTVYWDFVDFPGAFPVQVVSATQAEHIELRWGQANELRSVNFEFEPFRNFTRTKLTITEGSWPLTPAGAQEALGSQMGWTGMLSALKAWLEYGVNLRDGFYKQ

SEQ ID NO: 4306 - protein, 424 aa, Corynebacterium glutamicum
MSSISRKTGASLAATTLLAAIALAGCSSDSSSDSTDSTASEGADSRGPITFAMGKNDTDKVIPIIDRWNEAHPDEQVTLNELAGEADAQRETLVQSLQAGNSDYDVMALDVIWTADFAANQWLAPLEGDLEVDTSGLLQSTVDSATYNGTLYALPQNTNGQLLFRNTEIIPEAPANWADLVESCTLAEEAGVDCLTTQLKQYEGLSVNTIGFIEGWGGSVLDDDGNVTVDSDDAKAGLQALVDGFDDGTISKASLAATEEETNLAFTEGQTAYAINWPYMYTNSEEAEATAGKFEVQPLVGKDGVGVSTLGGYNNGINVNSENKATARDFIEFIINEENQTWFADNSFPPVLASIYDDESLVEQYPYLPALKESLENAAPRPVSPFYPAISKAIQDNAYAALNGNVDVDQATTDMKAAIENASS

SEQ ID NO: 4307 - protein, 141 aa, Corynebacterium glutamicum
MPCSTKLPAPVHIVGLAGLNWDRCSRSGAERMATAKVRDRWQQLFWGGIKLKGLNGLFELIGGVLLLLVDPESLHHWTVLLTQNELNEDPDNGIATFLGHSSESLTSHATLFSARYLLTHGLAKVVLLVAVLKTNCGHTRG

SEQ ID NO: 4308 - protein, 332 aa, Corynebacterium glutamicum
MATVTFDKVTIRYPGAERATVHELDLDIADGEFLVLVGPSGCGKSTTLRALAGLEGVESGVIKIDGKDVTGQEPADRDIAMVFQNYALYPHMTVAKNMGFALKLAKLPQAQIDAKVNEAAEILGLTEFLDRKPKDLSGGQRQRVAMGRALVRDPKVFLMDEPLSNLDAKLRVQTRAEVAALQRRLGTTTVYVTHDQVEAMTMGDRVAVLKDGLLQQVAPPRELYDAPVNEFVAGFIGSPSMNLFPANGHKMGVRPEKMLVNETPEGFTSIDAVVDIVEELGSESYVYATWEGHRLVARWVEGPVPAPGTPVTFSYDAAQAHHFDLESGERIA

SEQ ID NO: 4309 - protein, 123 aa, Corynebacterium glutamicum
MLLAFIAYQLYQIALHASAGMIAPTIFHSIGVTREKLHHVWICNVDGVVGVSCLIRIDIENLIHHQLNGSTRTITFSRGCSSTLSLLHETSDAPRARVAPIKAKVRRVFMRPIRILLGLGSSR

SEQ ID NO: 4310 - protein, 1600 aa, Corynebacterium glutamicum
MSNAPKKSFSDFFSPLATETETTITLSAIEVEKVNAKTEVTRNIDPVEAAEQISRDYRRYLKTLISPSNKTIAAEFNREIDESENLVYGPILQLTPPYAPGKSPAQLIDEGVLSPNFSRLDAALPKDRPLYQHQEDALRKIASGRNLIVSTGTGSGKTESFLIPIFDQLLRQQQAGELNPGVRALLLYPMNALANDQEKRLRELLADTPEITFGRYTGDTKQTREEAEKYFKLINGRNATPLPNELISRDEMQENPPHILLTNYAMLEYLLLRPADNAFFDDAYSNNWKFLVLDEAHVYAGAQGTEVGMLMRRLKDRVQRGNPLQCIATSASLEGTKEAIMTFGQDLFGEPFEFVNEDPSRQDLVSAHRRKLPKTFTWSLPDELFDQPLESDGLFQALQERGGDQYEELSKEEHIVKLRELSQQSSTRVEDIGKGLWPNVTDKASMHRTHMLVNLGSGVLSHDGVPALSARYHMFVRAVEGAFLGYTEQGKPIVSLDRQVTLGDTARPMYEMGACIKCGTVHISAHNDSGFLVPPENSSNFDEQQLKWVVLTDDFETADIDEDDLETDADENVKVLELQKLCTACGKLNGKNSLLCSGCSSHHDQFIDVKILEPRNGSQLTCTRCGGREKNLIRRLRTDSNAAPSVLTTSLFQLLPESADQDTSRKIGAGRKLLTFSDSRQAAAYAAPYLQASYTRLLERRILIETLRDEEFTEGASIERWISRASEVAKNNRVLANNLNPRETLEQTGNWVFADLASTVRRSSTEGLGLAKIELTPEALSQLSFRKPLGEMFGDPDAADAFFNLFAQEFRHKGAINCPDYVNLEDERFGPRRGQHFFTKDGGRKSTRRLYSWIPQRGTNNRKDFITKVLNRIGQAGDEGENITTLLHHLWNDYTNSEILKVPGEKAEGYTLNYNSLQVSPGKQHSWYECDTCRNTTPFNVLGLCPHGFCKGKLKEIDTSLPEYANNHYRKLATSLEILPLSAKEHTAQWTPTEAAEVQKEFIEGKINVLSCSTTFELGVDVGDLQSVMMRNVPPRTANYVQRAGRAGRRSGSAAFVLTFAKRSSHDLAVFKNPTQMIDGEMTVPFLHINNARIARRHTYSIALAAFFREQAAQNRFWKKAGEFFLGTDAAPYLRPAVAEQEATEILEEFLSPVPNYITEALRRVFPESLHEDLDIENQGWVKQFLEIFDTTRQEISEDFQTLKKMQGRALGSEQGKKADAFKRTITTLMDQDLLGYLAKKNMLPKYSFPVDTVDLQTNFSEAGNKVSLSRDLQLAITDYAPGAELVAGGKLWKSAGIRHLAGKKVETFYWTTCTECKHTETSRFGFTSEDVCSQCSAPISLGKENKFLIPRFGFVADPNPTEVGTAPPVRSSNRLEFVKQFGVKDDSEEFSNSDGTATAQVLTSSWSRTEMGALETGPNKNGFWYCQTCGFGTPNGAEIPKSHRNPRTKQQCGTYYLEPHSLGHTYQTDIATVAVPSYTNLDFEGWRSGMYAIIEAAAECLEINRDDLNGTMAKHDNRPTMVLFDTVPGGAGITRKVRENFPQVLEAAIRRVETCSCGIDTSCYACLRSFSNQRFHLDLRRDIALDLLHHMAVAMPKSE

SEQ ID NO: 4311 - protein, 124 aa, Corynebacterium glutamicum
MSIEHGGSRKRCQEDEWIFYKQIFKNRWLGLISANCFHQDCNDRFVFFNGQLKIQRKEWGRARDFLSIIANTTDASLQFGVCKPQLIIESFEILKIVSETALLFESARDSHGMRPLNGRIGSNN

SEQ ID NO: 4312 - protein, 1233 aa, Corynebacterium glutamicum
MTISRRLKQERSFADDLQDLKTLNDQLRFTNAKLQARISGIGNDGKKITRPTPLLALDFQLTVEEYETIIAILVEAVGGNQSKPAILKDLFIEYPLVFLAALSGTAMLDAQEGFWPAFWKRTQVSVPEHVYDAIRKELVNSIRKNGLETFSLADLNRREYVGLIQLHSGLSAKDMLALVKFIDHTRAENQGWDSGEDFASYAKSVFSSGDNLLTTESLKQLVTHIPARSVDFIARVYELTNWYRDLKDLNEVEAFVGTHGLPELSFKFLLECLSGEAEQIAEKTKAAPASLENLEPPHLYLDPQSFELSLVFPAISKTAALQIPAPEWTVIYDGNSIKVRPEQDWSYGGFAEYRLPLDKPLSSLRVITPTEKSLILIEGFGHKNPIMFFKNNGQPYANQEMLSGNAVTAIVPAAAIIRARMRASKTFNYQDLGPLSGWNKWVIRSIPLKRAESITVSHGGFRKELPVRRKVDVQWITEDLTIENLQGLDHEPVFHTSPRIEFPTSGSNWVIQYSQILPDGSLIEMEDYPVEPENFGYELDLFEESDDPWVGQFLVTLLKDEKVYETRKFNLAEGLDLSLTFSGGGPENRFRYPSINQGQTGLTKTFARFSSNSEKHIRFPDEIIGLDAFTSQKAFNIASGDFPEDYNLDVFITPPQLHYQVPVTHSQTKWESTKTTLDFNDFADGNLQIRFPNEVYDPNLKIIKMVAYKKPESSEPKYLSKIGSSKVWSIPMDRIKELMDDDAQFLLIAEWFAESKDQHREKIISEAKRTGKISNAALKSARPQPQASSHIATIEKKPLLAAAEIKLSTVELELGRHTSKRLEGWAWSALNPLDPPIKVDFQGTSGSLPDTHFVVGPLIVEVREKEFLSQWQPKVPSVKAVVANDPSFELDPQFDPFLTHRWMFAPRSGKVLLPQEIRTVWDARFNMRHVLAQRENLHVKSIQDFDDATSTYLTSDPRVALDELDKSSIPSNSHFESFIRSGLAELSFEVDDTAGDIHRVPWIGLIQEMNDLRILQIQGYETEERAIERRNSQSYIREIGGSELWNILKGNSEGLSLAQKCAPQATEINVIRNSGLEAMRNGLGADQFSAEFISADSRLRAQLEWLENRRELNDLGQLPTLFDFAEKYEYLIDHLGDDRIKVTARELSTLASEHRRGNAENWLYAPYVSFIYSLLNRMIAHEVIRPIAQINYSRHDWANAARLIPRLTGFDLVSAEAKVLSAINNNNIIPTAI

SEQ ID NO: 4313 - protein, 211 aa, Corynebacterium glutamicum
MLALDPASPRLTVYNESTGARLDFSAITLDNWASKVGNMLLEELDLEEGSLITIDLPVSWQAAMIMLGALATSVEVSFDDPEADAIFTSLDRFSHYKGHSDVLIVSEDPFGRGVVEGGGELPNGAIDFGPTVRFYGDQFFQPTRTLPEIIQHSDVPVGARVLATGWSDIESFNHQVLEPLAVGGSAVIVTGLADIERLNQIATNEKTTHRI

SEQ ID NO: 4314 - protein, 811 aa, Corynebacterium glutamicum
MRGDVQKITKVYDGKHRTLEIPVYQRNYDWTEKQCSRLFDDLSEVVKENHRQHFFGAVVGKPQGSWTWVVIDGQQRLTTISLFMLALVHSLRASEVEEGEFNAGYNIDLATLIEDDYLRSGNEGNLKFKLKPVKNDNEAYQKLFGPESEFIESSNLTANYRYFRNVLKATDLTAAQLWEAIEKLRVMYLDLEEFDDPQRIFESLNSTGLELSEADKVRNLVLMDQELKTQEKLYEQRWNPIEVCVKFDTDNFIRWYLTLKTARTPRKQDVYEEFKKFIRNSKLPVEFILDDMYEYAKLYRDLLGATTGFIAADRCLKRFVPVMGDVVLPFLLPVLKDAKDGIITESDFLGVLKVLESYLFRRFAVGVASNALSKIFSTAYSDIKKFWTPGQSYSSLLAYILKRRDGSGRFPSDSEFRENFATKNFWNIHNENRRYLFDCLENADSNDVRDIQTSLDEGSLSIEHIMPRSLNDQWRAELGPEYARIHETWINRIGNLTITGYNSAYSNSSYERKRTMENGFLVSPYRINNFIKKQKHWSEEQLIERTELLTQAALDYWPLPKETFQPPQAVLPTESLDSDLSFRGREIVAFEYEDYKETVTSWADMLQSVLKVLNQSFRQELIALTNEEICLATSNNSNSSLREIDHGLFVDTGSSTSVKIGFLRRVFTQLGLEQEALVFTLRPLANDVEPRDDELEVEVEKKYSDLTKFIPQLEEAENLEGADTEVIPLLSKLKEQLTAFSPENPQAALGGLPVPEFLKQNVIEQLSAEHILAVLTQHFNIASMMGDDYLLEELRSGRLRELLQRLEELDS

SEQ ID NO: 4315 - protein, 521 aa, Corynebacterium glutamicum
MDFAYLDTPNSNDLRRVIETEGFDSWRVYIDPSQRSLVTRNFSGSGRVFGGAGTGKTVVVVHRANRLVTSDGHLETDDKTPRVLLTTYTRGLADALKSSMNALNPTFPEAEKPGSPGLWISGIDALANKVVALANTAEREAATTAILGRAAGRITPFIGNGEQEFWIDAIISADPGDLSEEISNTEFLAQEFETVILARGITQEKDYLRAPRPGRGTPLNRVQRKKVWAIIQQFMTSCAREGKMSWPALSSIAANILEQRAAAGQGRLFDHVLIDEAQDFHAGHWLLLRAAVAEGPNDIFLAEDSHQRIYGQHHVLSRFGISTRGRASKRLTLNYRTTAENLSYALGMLTGEWTDAEGETDTIEHYRSARKGPKPHLYQFESETDEFEAIAELIKVWQDRTTDVRIGILARTRPLINRVVNALSEQGIDAVKTQNAELAAHETVSVMTMHGAKGMEFTHVILIGMGRDLIPLQYTMQGLGEAERNDAQQRERSLLYVAASRARDALVLTTHTEPSELLPRV

SEQ ID NO: 4316 - protein, 119 aa, Corynebacterium glutamicum
MSLVSSLRVSGSVEGAGIASDSRISSMLKPATRPISASFSHVGLLGSAAAMSSSEASSNTIRVAAGSMPSSASRTSGVCPACASASPGLGSSTGVGTSTASRSCSSARFAASSALRRDS

SEQ ID NO: 4317 - protein, 131 aa, Corynebacterium glutamicum
MPCMCERLTRAGQLHWGGYFDGVPELLLRPLCGLFRFATRFLIVFLRRNGSFLDESSNAVNRVDFKADFSCLGDGIIMGINTNHYKVMIKFVVKLKKHCAELIIDPTCADAGVDAVFDGLNMKPRGSWIGG

SEQ ID NO: 4318 - protein, 132 aa, Corynebacterium glutamicum
MVFIPMMMPSPRQEKSALKSTLLTALLDSSRKLPFLRKKTIRNLVAKRKRPQSGRRSNSGTPSKYPPQWSCPALVRRSHMQGTPQKSWKPSSALTRLPPVLCWNLPQRMTSQQRFLAARRGKKTHLSALSPV

SEQ ID NO: 4319 - protein, 275 aa, Corynebacterium glutamicum
MHWLPWHLCARNTAKLPPGVPSAYLASKRIFGCARSPALTAPWGLGMNNPCFAGPMMARQKMPIPNNGCRRVIAAVVAVPAGWSAWNKAPISRCWKNKKFASTPLNNPINKERFSTPPLSSAQPLSRGAALLGREELMAPQQCCGSIAPAMNSARANPAQKKNNQVLLSQCSPTLALRQTISPPNRPALPVVMLIPSVISDRESLPCSLSHSPIFLVWPIWIALRKRRWSLPIPCKMPRTAPGTSKHVPALLPFVPIPGAQWVIMKSPCHQSPGR

SEQ ID NO: 4320 - protein, 2069 aa, Corynebacterium glutamicum
MATELKRFLGHGDSGMFHGPYVRARLPYAQAQEWENVLSWLPENFVPYHHQKAAFQRLSSLDNRGKDRRPDPTLVVTGTGSGKTESFLYPILDHALRLRKRGQQGIKALLLYPMNALANDQADRLARLIHNNPALKGVTAGIYTGEAKGNRTQMGERELINDPQAMRVSPPDILLTNYKMLDQLLLRSVDREMWQKSATSLQYLVLDEFHTYDGAQGTDVALLLRRLGLMLKSQQPANFLDDSAMHRPLGIITPVATSATLGSGDSGSPMLDFAYTIFGERFPADAIVGETRLELDQWRAEIAQNFGAPAVSEPRELPTVEDIEVVLDTIATAQHEDDYAQLCFRVFCEKVWLCEADLHAAISAYAAHDLTAAILQHAADSTPLSRRDQDEVTALPELVLGATARILGEVKAAEFISHALAAMAFVRAEYGKVAAWGAKRLPGVETHLWVREVSRIDRALGVGDEQSMFRWSDDGPAEDANTQQWLPACYCRSCGRSGWMVSLEQGTNIPVLEEQKIRLNSFEQPHKQRALLDATSEQRAAIEQGRSVAGPRGVDGTSAVLWFHSASNELSTRQPSPEEEQSGSSIAVLTHFGPEADDLSAKQTCPSCGDVDSIRYIGSGISTLLSVSLSNLFGMADLDSAEKKTLVFADSVQDAAHRAGYVQARSRAFALRTYTRRAVGDNEVTLPSISRALMDNATSGRTRYELLPPDLTDLDIYKPYWHPDASKAERREASRNVHKRLSFDLALEFGQRADLPRSLALTGALSAFVDLPKGVALSAAAEALYAIEVPTLDIEDENLRLRWVQGALELLRARGGINHEWFGAYLRTDGNPYMLNRRQARAEGIPGFVRGGAPEFPRVGSALSGSLRSSTGTTPLGSPRGRYASWTSQVLGISTHDAATAITKLFDALSNRSILSSISTDSGGKIYCLEAERIRIFSEDHPEVLECSVCHAQTGVTDHVRELLDGAPCFSPSCGGVLHTEEVEDNYYRRLYSAIEPRTVIAREHTSMLKKKDRLALEQSFRGGEGSAKQSPDAPNVLVATPTLEMGIDIGDLSTVMLASLPTSVASYVQRVGRAGRLSGNSLVLAVVRGRGVTLPRLNQPLSMIKGAITPPVAYLSASEILHRQFLAYVIDCLDTRAELPKLETAIDVFDNAAGKTPLVALLKAQIHAGLDPLLEEFVRTLNMQISIDNIFELRTWASGNSTDSLLALLETSQKEWMEERRSLTARRGELEKIFDKLDARNDAHDEELKEEKRKTAASLKAVKLQIRDLLGEFWIAALERYGLLPNFTLVDDSVELNVAVTSFNPQEVEFDTKNHAYSRGISAALFELAPGATFYAQGIAAKVDSIEIGEHGSAIEQWRLCPVCSHSEILQPGVSTPGSCPTCGSPAFADKGQILEVVQMRKVSSAVEKTRAAISDDREDRFSTRFNQHVSFVVPPDGHGKSWYLNDGFGIEHLPKVELRWLNLGIGNGQKRRLGGFEVTSPLFNVCRHCGHLDSEAGANSRWDHRPWCPHRYEQKEDTVSFALGRTLKTQGVLMLLPEYFGSEADSMVVTSLIAAIKLGFREVLGGDPDHLDVTSVQVPRTSGDGALDALLLHDQVPGGTGYLNQFADPTKVRELISRAWERVSRCQCQYDERLACPECLLPYTRTATLLQTSRAAAEKALRAILLNSSRPEEITDLSAVPDWTFLEKRPENTLGSQLELRFRVMLRRALKNRHAKLVDRVNGSNSYVDIEMSSGVRWRMSEQVDRGYTRPDFWFEPLNGNYPTVAVFTDGAAFHISSANYRLDGDIQKRMKLALDPDNILPWNITSLDLDRFSNPAAQGEEPAWFSPIGRQLSKANLILDPQSTALLAATPMDQLLAFLDNPAASSWKEFAHIAAAHMLGHNPQKNGDGIVGTFRNKISLRATMVNRELRARQLWLAPTTPEELEVDTWTAFLNLANLMWLAPESVDVSTNGSPHKIDIVPAPAAPLAVEVPELWAPILDGFTADEDEEAEGALQILAKEHALVPETTGDELSSIPTIATWPSVKIALLYESDPDEPLEDDLKAEGWTLLFANDLETSDIPAALRP

SEQ ID NO: 4321 - protein, 1532 aa, Corynebacterium glutamicum
MSAFDSILNVEEWISDHYLTNDDAKGASFSKRVRERIKEWKTTEDATQQSGPLTRFSSNRLQLQHALSELDDATTAASLVASALGYGVPSARHAQRGSDTISYSSWVGNAGSVEFLAATPAESFEENFRSLPLEPVAVNDKPQDITAAKLVGQIFLSDTPPAFVVITAGKWVVLAERETWPLGRHLAIDISLVVERNDTKAQGEMQQTVVALARENTERAADGTTWWEETIEQSREHAVKVSGELRSAVRESIEILGNDVLTRYEAKELSTAEIDGGELAKQSLRYLYRILFLLFAEASPELEILPTGTPEYDEGYGLARLRELILNPPVTQHARTGTHLYDSLQLLFTLVDKGHHPTDAKAVAFDAEAGEEGLHFRNLSADLFLPAATELIDRVGLSNEALNKVLENLLLSRVQSGKDRGFISYATLGVTELGQVYEGLMSYTGFIAQEDLFEVAPHGKADKGSWMLPVSKADEVPADSFIEVDQEAPGGGVIKVRKRHPRGSFVFRQSSRDRERSASFYTPQVLTSFTVTQAIEELQASKRITTANDVLSLTICEPAMGSGAFAVEAVRQLAELYLELRQEELEQQIPAEDRAKELQKVKAHIALHQVYGVDLNSTAVELAEISLWLDTMNAEMDAPWYGLHLRNGNSLVGATRSLYAPSLLNKKAWLTATPTRYRLDDIAQAIDENKAEPLFNHGIHHFLLPSTGWGATADAKDLKDLMATEIKELKSWRTSIRASLSKTQIKQLNNLALRVETLWRFVLMRIRIAESQISRSTTLWGQEPAEVSEVVTREQIEQDLFGNIDGAYNRLRLVMDAWCALWFWPLDAVATAEHPERPALPDLDEWLATLTEILGIDLPLKSKNENQIVLGPDTNWLAINDAEATDLGFSGALSFERVSANHPWINVARQVAKQQSFFHWDLDFAHVFAKGGFDLQVGNPPWVRPDVNFEDLLAEHDPWWAVMSKPTQASKKERQKNFHNNPKSLEHVVSGAGETVATSAILGSVTLYPHLKDQRPDLYRGFMEKTWSNASPAGAISLIHPESHFTEKKAAPLRRGAYERLRRHWQFINELILFDVHDLVKYGVHVYGAPQESINFLSAASLYHPQTVLDSLDHDGSGNLPGLKDDNGNWDRRPHKDRIQLVNADTLTVWKSILEDEQTPYLDTRMVYTVNTEAAAVLEKLASAPRIKELGLQFSSGWNETTDKKKGYFDVGWGYPASWSDAILQGPHLGVATPMIKQPNPTMKHNQDWSEIDFEAIPANFIPATAYQPDRQTKPTYDADYGTWTFGDKQVPVADTFRIAWREMAATTGFRTVYPSVIPPGANHVHTVNSAASRSNLKTILVGAQLGAILSDYFARSSGSSHIFNDIVRKIPLPNFTSLEKQFARTYLRLNCLTSAYAPLWEEITGEPWDVQVPLRNAEQRRAAQNDIDAMVALSLGISADELCMIYRTQFPVMRRYDQEDHFDANGRKVPKEIIKLQQKLKDGQELSVEKRTWVHPQSEVSYTFEYPFRVLDREADLRAAYAKFENQLKEP

SEQ ID NO: 4322 - protein, 962 aa, Corynebacterium glutamicum
MSESGALSSTDSLSPGVTIEVRDEIWLVTHVTRSTDGFRVKARGLSDYVRDHEATFFTALDKDLKVIDPTQVTVSLDDSSNYRRTRLWLEATMRKTPVPLYQESLSVADQMLADPLEYQLAAVRKTLSSANLRPRVLIADAVGLGKTLEMGMILAELIRRGRGERILVVTPRHIMEQFQQEMWTRFAIPLVRLDSVGIQQVRQKLPASRNPFTYFPRVIVSMDTLKSPKYRAQLEKVHWDAVVIDEIHNATNAGTQNNELARTLAPTAEALILASATPHNGDPESFKEILRLLDPTAVMPDGTIDAEAAQRLIIRRHRNSPEVSGFVGEKWAPRNEPQNFLVAASKEENGVAAELNHVWISPGASNPIKDRLFPWTLVKAFLSSPAALGETVSNRLKKASAPEEKRALETLSQLNSAITPQTSQKYQSLLSYLGDIGVKKNSDTRVVIFSERVATLHWLQENLIRDLKMPPNSIAVMHGGLPDQEQMRLVDEFKKTDSPIRIMITGDVASEGVNLHTLCHNLVHYDIPWSLIRIQQRNGRIDRYGQTHNPSIVTFLLDPAEDSKVGEVHVLERLMEREHEAHSLLGDAASLMGKHSERLEEETIREVLRGAQNFNDAVADPAEVLENPAGLDDIDWLLAQIAQADAKAETEAEAETENQTAPDAASNSTQHAQRRLYAQESSFLYDCLLEGFNNVPEDSINRGGVGFKKHDNDIVELTPTDDLRRRLDFLPQDYVAARKVKEDLLLASTLMRGQERLNAARTGEDGSTWPSAHYLGPLHPVTSWAADRALATMPRSEIPAASGKVTEPTVLLMSTLSNRRGQIVSRSFVASSGPFDTEVLSDPIQWLHSIGLDETAINPGTAALPDDIEQLISLAVQAARGEIRPLMIAARAQAQTRVEHWAKRAEAWNNKRSGAASTSRTARTAKLIEEQQKLSNALEPDRELIRPLAVILPQPATLNTEV

SEQ ID NO: 4323 - protein, 518 aa, Corynebacterium glutamicum
MTEKYRPVRDIKPAPAAMQSTKQAGHPVFRSVVAFVSVLVLLVSGLGYLAVGKVDGVASGNLNLGGGRGIQDGNAADGATDILLVGSDSRSDAQGNTLTEEELAMLRAGDEENDNTDTIMVIRVPNDGSSATAVSIPRDTYIHDDDYGNMKINGVYGAYKDARRAELMEQGFTNESELETRAKDAGREGLIDAVSDLTGITVDHYAEVGLLGFVLLTDAVGGVEVCLNNAVDEPLSGANFPAGRQTLGGSDALSYVRQRHDLPRGDLDRIVRQQSYMASLVNQVLSSGTLTNPAKLSALADAVTRSVVIDEGWEIMSFATQLQNLAGGNVTFATIPVTSIDGTGDYGESVVTIDVNQVHAFFQEALGEAEPAPEDGSDDQSADQAPDLSEVEVHVLNASYVEGLANGIAAQLQELGYSIAETGNAAEGLYYESQILAAEEDSAKALAISEALGGLPIVANSSLDDNTVIVVSAGDYAGPTAEANAVTSSTVGQPGADVGEPIESPEFDAGGDGPRCVN

SEQ ID NO: 4324 - protein, 299 aa, Corynebacterium glutamicum
MSTLKSPIAVITVTYSPGKYLASFLDSLPGATSRDTHVVMADNGSVDGVPEQAAASRSNVEFLSTGGNLGYGTAINIAARSLRARREAGEIDGEFFLVSNPDVVFDEDSIDQLLECAKRHPEAGAVGPLIREADGSAYPSARAVPTLANGIGHALLGAVWKSNPWSAAYRDDEDMDTERTAGWLSGSCLLLRWDAFDRVGGFDERYFMYMEDVDLGDRLVRAGFTNVFCPSAQIIHAKGHVAGKNPENMLPAHHESAYRFQADRLAKPWQAPIRLALRIGLKLRAGVAVGVSKMRTKAS

SEQ ID NO: 4325 - protein, 348 aa, Corynebacterium glutamicum
MVGGKGTRLRPLTVNTPKPMLPTAGHPFLTHLLARIKAAGITHVVLGTSFKAEVFEEYFGDGSEMGLEIEYVVEDQPLGTGGGIRNVYDKLRHDTAIVFNGDVLSGADLNSILDTHREKDADLTMHLVRVANPRAFGCVPTDEDGRVSEFLEKTEDPPTDQINAGCYVFKKELIEQIPAGRAVSVERETFPQLLEEGKRVFGHVDASYWRDMGTPSDFVRGSADLVRGIAYSPLLEGKTGESLVDASAGVRDGVLLLGGTVVGRGTEIGAGCRVDNTVIFDGVTIEPGAVIENSIISSGARIGANAHISGCIIGEGAQVGARCELNAGMRVFPGVVIPDSGIRFSSDQ

SEQ ID NO: 4326 - protein, 136 aa, Corynebacterium glutamicum
MGEGKIFQTCSGTNIPDENRLKVALKVRGGRVMEDSAGDVSAKLKAGQTRTALEMTLDDLFGAVEQEWQEQALCAQTDPEAFFPEKGGSTREAKRICQGCPVRDECLEFALEHDERFGIWGGLSERERRRLKREIS

SEQ ID NO: 4327 - protein, 152 aa, Corynebacterium glutamicum
MHTRTFRNRHGRGLRGPLMPVEVPRHASRRQAFDRAVLEAYSPLYGIYQKELSNLDIAVDTVPRMRLSADLAILPDEITADGPVPLGRVIPPAIDTKGNPTRARIVIFRMPIEQRVTNAVERHELLTHVLTSLVANYLNIDPRDIDPGFQDL

SEQ ID NO: 4328 - protein, 130 aa, Corynebacterium glutamicum
MSQFRRCSRPGCGKPAVATLTYAYSDSTAVVGPLAPAAEPHSWDLCEHHAERITAPLGWEMLRVNDIKVDDDEDLTALAQAVREAGRTVSGLVPEDEVGGNHPVNRSARIAEQKVHRRGHLYVVPDQDES

SEQ ID NO: 4329 - protein, 458 aa, Corynebacterium glutamicum
MRTRESVTAVIKAYDVRGVVGVDIDADFISETGAAFGRLMRSEGETTVAIGHDMRDSSPELAKAFADGVTAQGLDVVHLGLTSTDELYFASGTLKCAGAMFTASHNPAEYNGIKLCRAGARPVGQDSGLANIIDDLVEGVPAFDGESGSVSEQDLLSAYAEYLNELVDLKNIRPLKVAVDAANGMGGFTVPEVFKGLPLDVAPLYFELDGNFPNHEANPLEPANLVDLQKFTVETGSDIGLAFDGDADRCFVVDEKGQPVSPSAICAIVAERYLEKLPGSTIIHNLITSKAVPEVIAENGGTAVRTRVGHSFIKAKMAETGAAFGGEHSAHYYFTEFFNADSGILAAMHVLAALGSQDQPLSEMMARYNRYVASGELNSRLANAEAQQERTQAVLDAFADRTESVDTLDGVTVELKDTSAWFNVRASNTEPLLRLNVEAASKEEVDALVAEILGIIRA

SEQ ID NO: 4330 - protein, 335 aa, Corynebacterium glutamicum
MVQVDNTFYDGSAYDPETVRFFDVAQEGAQVRQIGGLVAQGALSAFEGLRPRSVVVMLDGQIHRSCVRLVETLHSPMRQPLVITSTLPHYIGALDVLIVITDNGADEKALKALITASQRGVATLLIGPSSGPLIDESPQDTFVLPTLPTAAGLSPARIVASISTLLDLLEADPSIISDRLEHLADCIDEEVESLSPERDELVNPGRKLRAYVDHARIVHTGRTDVGLAIANVIAPIWTRRGLVSAVLDFPELMESLPELRGPEPITDDIFHDPFIDDEPGVVPFRAVVWAEEEPGIPDAMAQSCDGPSKGALTQALRLLVRGQSATTYSIEEKDL

SEQ ID NO: 4331 - protein, 394 aa, Corynebacterium glutamicum
MELLEGSLRTYPWGSRTLIADLKGEESPSSRPEAEVWFGAHPGSPSTIGGNALNEVIAANPEEALGTRVAEAFENELPFLLKILAAGAPLSLQAHPSLEQAREGFARENSAGIDLGAPNRNYRDPNHKPELIVALTEFIAMAGFRPLRNTLTIFDALACEPLDRYRSMLTVDNEEESLRALFTTWITIPIGKRHELIDALISNAHTYLEASDRDEDIAFVLSHIIELNEQYPGDVGVLGALLLNFYKLAPGEALYLDAANLHAYISGLGVEIMANSDNVLRGGLTSKYVDVPELVRVLDFNSLENARVDVEEDGATTHYPVPINEFQLDRVAVQGEAEANHDGPMIVLCTSGTVSLEAGEKTLEVAAGHAAWVPANDPTIAMRSEDAEVFLARV

SEQ ID NO: 4332 - protein, 50 aa, Corynebacterium glutamicum
MADGACLLPSKSGFGWGASAQPSYMAKTKKLEAFGHLVWSGSKLASVPKY

SEQ ID NO: 4333 - protein, 120 aa, Corynebacterium glutamicum
MVVGELPEGVKPELRPLSGRTKAFGGRYGSSVLMGAKVWFSRSGSASLVSVLPGESYLAWVWVVDVVVDVAISEVGRLGLDICQTIKPRAVAAKQPATMKTRARRVSVFIVVHLRSAVVV

SEQ ID NO: 4334 - protein, 188 aa, Corynebacterium glutamicum
MAPINTEDPYLPPNAFVRPDNGRSSGLTPSGSSPTTTSRVSSPSSAGSASPTQITSRSNEPSEPGDESTAATQPSSPDRPTEPTNPVDPTGPSEPTEPTDPIETTDPIETTDPVAPSTPPTSDDSTSTPQPDESDTPPTDFVEEPTAPLNPDQPAGSTTDATPNATPSAPADTTSNSVANSVEPTATS

SEQ ID NO: 4335 - protein, 117 aa, Corynebacterium glutamicum
MGAWDDAILTEEVNVDFLDEISELDTQDILEALEDACLLVVNQDNATEDEHLNGQAAATIAAIMFGAPYSAGQVLENYPFIRELVGEGSEALRGAAAQVLEEADVEYDLEAYLEALN

SEQ ID NO: 4336 - protein, 474 aa, Corynebacterium glutamicum
MDFKVADLSLAEAGRHQIRLAEYEMPGLMQLRKEFADEQPLKGARIAGSIHMTVQTAVLIETLTALGAEVRWASCNIFSTQDEAAAAIVVGSGTVEEPAGVPVFAWKGESLEEYWWCINQIFSWGDELPNMILDDGGDATMAVIRGREYEQAGLVPPAEANDSDEYIAFLGMLREVLAAEPGKWGKIAEAVKGVTEETTTGVHRLYHFAEEGVLPFPAMNVNDAVTKSKFDNKYGTRHSLIDGINRATDMLMGGKNVLVCGYGDVGKGCAEAFDGQGARVKVTEADPINALQALMDGYSVVTVDEAIEDADIVITATGNKDIISFEQMLKMKDHALLGNIGHFDNEIDMHSLLHRDDVTRTTIKPQVDEFTFSTGRSIIVLSEGRLLNLGNATGHPSFVMSNSFADQTIAQIELFQNEGQYENEVYRLPKVLDEKVARIHVEALGGQLTELTKEQAEYIGVDVAGPFKPEHYRY

SEQ ID NO: 4337 - protein, 236 aa, Corynebacterium glutamicum
MSMSVARLMPSIREWRVPYLLSNLDLVTASLTFIAGKGSTPSSAKWYRRCTPVVVSSVTPLTASAILPHLPGSAARTSRSMPKNAMYSSESLASAGGTRPACSYSRPRITAMVASPPSSRIMFGSSSPQLKIWLMHHQYSSSDSPFHANTGTPAGSSTVPEPTTIAAAASSWVEKMLQEAQRTSAPKAVRVSISTAVWTVMWIEPAIRAPFKGCSSANSLRNCMRPGISYSARRIW

SEQ ID NO: 4338 - protein, 240 aa, Corynebacterium glutamicum
MHIDLIIKVTDVAQQSVILHLEHLLEGNDVLVAGRGDHDVGVLDGLINGDHRVAIHQSLKSVDWVSFGDLDASALAVESLSAALADIAVTADKHVLAAHEHVSGAVDAVDQGVAGAVLVIKLGLGDSVVDVHRWERQHAFFSEVVQAVHTGGGFLGDTLNGLSDLAPLARLCSKNLTQHAQECDVLIGIVGLCWWNQTSLLVFATANNSHGGVTAVVEDHVWQLIAPAEDLVDAPPVLLQ

SEQ ID NO: 4339 - protein, 203 aa, Corynebacterium glutamicum
MIVSIEGIDGAGKNTLVSALTQVIDAKVLAFPRYETSIHAQLAAEALHGRMGDLTDSAYAMATLFALDRHFAIDDLNAPGVVLLDRYVASNAAYTAARLLDDDAPRWVADLEFGRLGLPRPTLQVLLDTPAEVAQDRARRREALDSARARDRYESDSALQQRTAEHYRRLAADNWESPWIVVAPDEDPGHVAQRIVEFLGTIN

SEQ ID NO: 4340 - protein, 226 aa, Corynebacterium glutamicum
MSQKILVVDDDPAISEMLTIVLSAEGFDTVAVTDGALAVETASREQPDLILLDLMLPGMNGIDICRLIRQESSVPIIMLTAKTDTVDVVLGLESGADDYVNKPFKAKELVARIRARLRATVDEPSEIIEVGDLSIDVPAHTVKRNGAEISLTPLEFDLLLELARKPQQVFTREELLGKVWGYRHASDTRLVNVHVQRLRAKIEKDPENPQIVLTVRGVGYKTGHND

SEQ ID NO: 4341 - protein, 228 aa, Corynebacterium glutamicum
MKNLIVVASFVANTADGEDDLRIFWIFFNLGAQTLNVNVDQSSVGCVAVAPHFAQQFFTGEYLLWFAGEFQQEVEFEWGQGNLSAVSFDGVCWDVDGQIADFDDFAGLVHGCAEAGTDAGDKFFRFERLVHVIVCTGFQTEHHINGVGFGGEHDDGYGGFLADEATNVDAVHAWKHQVEQNQIRLFPGGGFHGECAVGDSYGVKAFCAEHDGEHLGDGGIIINHENFL

SEQ ID NO: 4342 - protein, 499 aa, Corynebacterium glutamicum
MLGSIFTASAVVMILLGLGMLTVFTQRLVDQKIDIASSEIDRARVIVEEQITASGASTSVQARVNSARAALSSLGTSGGTETNAAYDPVVLVNNDDLVVSPEGYQIPERLRYFVSENQVSYQFSSIDQGDGSSYQALIIGTPTESDIPNLQVYLVFSMESDESSLALMRGLLSAALLIVVVLLVGIAWLATQQVTAPVRSASRIAERFAQGKLRERMVVEGEDEMARLAVSFNAMAESLSAQITKLEEYGNLQRQFTSDVSHELRTPLTTVRMAADLIADSEDELSPGARRASQLMNRELDRFESLLSDLLEISRHDAGVAELSTALHDVRIPVRSALEQVQHLATELDVELLVNLPEEAINIQGDSRRIERIIRNLLANAIDHSKGLPVELKVADNVDAVAIVVIDHGVGLKPGQDELVFNRFWRADPSRVRHSGGTGLGLAISREDAMLHGGNLDAAGTIGVGSIFRLVLPKEPHGNYREAPIPLIAPETPWEGEQQ

SEQ ID NO: 4343 - protein, 568 aa, Corynebacterium glutamicum
MSKISTKLKALTAVLSVTTLVAGCSTLPQNTDPQVLRSFSGSQSTQEIAGPTPNQDPDLLIRGFFSAGAYPTQQYEAAKAYLTEGTRSTWNPAASTRILDRIDLNTLPGSTNAERTIAIRGTQVGTLLSGGVYQPENAEFEAEITMRREDGEWRIDALPDGILLERNDLRNHYTPHDVYFFDPSGQVLVGDRRWLFNESQSMSTVLMALLVNGPSPAISPGVVNQLSTDASFVGFNDGEYQFTGLGNLDDDARLRFAAQAVWTLAHADVAGPYTLVADGAPLLSEFPTLTTDDLAEYNPEAYTNTVSTLFALQDGSLSRVSSGNVSPLQGIWSGGDIDSAAISSSANVVAAVRHENNEAVLTVGSMEGVTSDALRSETITRPTFEYASSGLWAVVDGETPVRVARSATTGELVQTEAEIVLPRDVTGPISEFQLSRTGVRAAMIIEGKVYVGVVTRPGPGERRVTNITEVAPSLGEAALSINWRPDGILLVGTSIPETPLWRVEQDGSAISSMPSGNLSAPVVAVASSATTVYVTDSHAMLQLPTADNDIWREVPGLLGTRAAPVVAY

SEQ ID NO: 4344 - protein, 196 aa, Corynebacterium glutamicum
MELFFPRACGGCGAPGASLCSDCQRVWRKPPTLARLDLDLPVWTLSPYDGPHRNVLIALKEHGRADLVAFVGAVVGASISYLAAQGEIEHDITLVPAPTRATSRRRRGGDPVERVCNASRLSTFPCLQISSRTPDSVGQTAQQRRLNMRVELVRQPRGSVLIIDDVVTTGATISASANVLRAAGVQVRGALTYCQA

SEQ ID NO: 4345 - protein, 52 aa, Corynebacterium glutamicum
MLLLLPIVVTALMCEWNYSYYDDAINFTSYTTSGHNHIANRGPFYIQDHAWQ

SEQ ID NO: 4346 - protein, 221 aa, Corynebacterium glutamicum
MTTPAENNTLSPETKVSITGRNVEVPDHFAERVNTKLAKIERLDPTLTFFHVELQHEPNPRRADESDRIQITATGKGHIARAEAKEDSFYAALETALAKMERSLRKVKARRSISRSGHRAPLGTGEVGAQLVAESQEARGADELGKYDVDPYADKVDDVMPGQVVRTKEHPATPMSVDDALSEMELVGHDFYLFVNEETNQPSVVYRRHAFDYGLISLSDA

SEQ ID NO: 4347 - protein, 845 aa, Corynebacterium glutamicum
MFGLSKVLRVGEGRAVKRLHKIADQVIALEDKFANLTDEELKAKTAEFKERIAGGEGLDEIFLEAFATAREAAWRVLGQKHYHVQIMGGAALHFGNVAEMRTGEGKTLTCVLPAYLNALEGKGVHVVTVNDYLAKRDAEMMGRVHRYLGLEVGVILSDMRPDERREAYAADITYGTNNELGFDYLRDNMARSLSDLVQRGHNYAIVDEVDSILIDEARTPLIISGPVDGTSQFYNVFAQIVPRMTKDVHYEVDERKKTVGVKEEGVEYVEDQLGIDNLYAPEHSQLVSYLNNAIKAQELFTRDKDYIVRNGEVMIVDGFTGRVLAGRRYNEGMHQAIEAKERVEIKNENQTLATVTLQNYFRLYTKLAGMTGTAETEAAELNQIYKLDVIAIPTNRPNQREDLTDLVYKTQEAKFAAVVDDIAERTEKGQPVLVGTVSVERSEYLSQLLTKRGIKHNVLNAKHHEQEAQIVAQAGLPGAVTVATNMAGRGTDIVLGGNPEILLDIKLRERGLDPFEDEESYQEAWDAELPAMKQRCEERGDKVREAGGLYVLGTERHESRRIDNQLRGRSARQGDPGSTRFYLSMRDDLMVRFVGPTMENMMNRLNVPDDVPIESKTVTNSIKGAQAQVENQNFEMRKNVLKYDEVMNEQRKVIYSERREILESADISRYIQNMIEETVSAYVDGATANGYVEDWDLDKLWNALEALYDPSINWTDLVEGSEYGKPGELSAEDLRTALVNDAHAEYAKLEEAVSAIGGEAQIRNIERMVLMPVIDTKWREHLYEMDYLKEGIGLRAMAQRDPLVEYQKEGGDMFNGMKDGIKEETVRQLFLLRKQFIKQDAEVAD

SEQ ID NO: 4348 - protein, 224 aa, Corynebacterium glutamicum
MAEGRTRNPKRPSPALTPRAALRCVRGLPEATDRAQDITNVRNLELEQAQQISLRENLKAKNKPPQSVRQSNHRLRLLCHEETKEREIMRGLIVDYAGVLDGTDEDQRRWRNLLAAAKKNGVGTVILSNDPGGLGAAPIRELETNGVVDKVLLSGELGVEKPEEAAFQAAADAIDLPMRDCVLVDDSILNVRGAVEAGLVGVYYQQFDRAVVEIVGLFGLEGEF

SEQ ID NO: 4349 - protein, 168 aa, Corynebacterium glutamicum
MRVYIPATFSTLRGLNESRVITARSGYGFAVTPALLDFYTDGDEEEIAHAAFQDAAEASIRLLAIGDEETFPYRRVVVSVDVDDSVVTYQPENGESVVKLSPAHINLDDVAAIHIDVEASEADTKKAIEVIDESDLGEEDAELTVGDAQDNFMAWYDPEELPFLVELL

SEQ ID NO: 4350 - protein, 329 aa, Corynebacterium glutamicum
MARRSYDESDVRVRPGKGTRPRTKDRPSHENALVGMVVTKDRGRWGVVLDGRQDAIVTMRARELGRTAIEVGDRVGVVGDTSGRPGSLARIVRLEERTSVLRRTADDTDPFERIVVANADQLLIVSAVADPPPRAGFVERALIAAFVGNLQPVLCLTKSDLADPAEFAAEFEALEVPVVVCGVDDPLDPVLEVVEGHITALIGHSGVGKSTLVNRLVPDADRETGVVSGVGKGRHTSTQSVALAIDNGWIIDTPGIRSFGLAHVDADTVVGVFDDLALAAEDCPRGCSHLGPPADPGCALDRLEGASARRVEAVRALLVALRSNDAWDM

SEQ ID NO: 4351 - protein, 471 aa, Corynebacterium glutamicum
MYRGPGVPCGATTDRSSAISVASISESPVVNKTNLPHITSIMVFVSDSSISLPIWDAPRARGPIVSDLAIPGSKSITNRALILAALASTPSTIIDVLRSRDTDLMTDGLRSLGITITEEAVDRYRVEPGQLSAGSVECGLAGTVMRFLPPVAAFADGPVHFDGDPQARVRPMTSILDALRSLGVEVDNNNLPFTVNAGEVPEGGVVEIDASGSSQFVSGLLLSAPRFKNGVTVKHVGGRLPSMPHIEMTVDMLRSAGIEIEESENQWVVHPGEILGRTWRIEPDLSNATPFLAAAAVTGGTIKINHWPIKTTQPGDAIRSILERMGCEVELVAQGEGYDLSVTGPVALKGIEIDMSDIGELTPTVAALAALASTESRLTGIAHLRGHETDRLAALTAEINKLGGKCTELKDGLLIEPASLHGGVWHSYADHRMATAGAIIGLAVDGVQVEDIKTTSKTFPGFENVWEEMVG

SEQ ID NO: 4352 - protein, 160 aa, Corynebacterium glutamicum
MLLEPARWGLFPHWKKDDSGPPLFNARGETVAEKPSFRDAFKQQRCLIPMDGYYEWHDKKPHFVSLGDELMWAAGLWSTGLDQMSATMVTTESVEPIAWLHNRLPRFLEHDELEQWLFGTAEEAKEMLHPVSQEWVKRLSVREVSSDVGNVRNDHAGLLD

SEQ ID NO: 4353 - protein, 41 aa, Corynebacterium glutamicum
MRKQSPTRRFQKHLFPGANDRNYLSRSKVVSRSRSSLRSHD

SEQ ID NO: 4354 - protein, 370 aa, Corynebacterium glutamicum
MFYFTVNNPQDPLSTEIVETNRRDLAFWHRLRPKDDDDLATAINKICVRTGLSRKLIAACLFSICFLPYLPNFHKLVEKLGHLDMARINAITKAGEKVPSEKRELFDAYLVDYLTPRAEAQCLPQASSISAMMRKFIAQHCPDDKASSATNDGSIRYRRNNKGGISITVDATASEVTEIKAALEQMSKDKDCTPGTSLLHIIRGLPTKVVLNTYGTKDSPEYLEGGTWLSKEQSEFWKTRTTSSRDMDAAHFSYTTAYAPTREMRVYIKGLRTTCSVPGCSVAVENCQLDHIIPWGEGGPTTPWNIHPLCVFHHIQKTEGRLQCYPLPDGTVLFLVDGIPVFSIPDGPLSKSNKTWGTKFGKYMERRIAA

SEQ ID NO: 4355 - protein, 206 aa, Corynebacterium glutamicum
MAENRTGTVDGDALAARFEEEALPLLDQLYGGALRMTRNPADAEDLVQDTYIKAYQAFASFKPGTNLKAWLYRIMTNTYINMYRKKQRQPSQTSADEITDYQLVESQSHTSTGLESAEVEALKNLPDGKIGDAMNQLSPEYRMVVYYADVEDLAYKEIAEIMDVPLGTVMSRLHRGRKQLRGMLKEVAKEQGIGLEHPDMKKNSEA

SEQ ID NO: 4356 - protein, 86 aa, Corynebacterium glutamicum
MDWRHEAICREEDPELFFPVGNSGPALAQIASAKMVCNRCPVTSQCLAWALETGQDAGVWGGMSEDERRALKRRKNRGRGRARIAV

SEQ ID NO: 4357 - protein, 140 aa, Corynebacterium glutamicum
MAVTSPNMPASIRWGGIVALIQSTIGFGYAFFLIYREATGETDPSIVYETDNANTWVGYGTAAFFIIVFGTVVAGAINMMKGHRWGRGAVVMLNIILLPAAYYMFIEGRFSWAIVTGISALFVLGALFNKRAVLWANNEI

SEQ ID NO: 4358 - protein, 400 aa, Corynebacterium glutamicum
MAAKLQPLKRTKKDLIATGVITALAVIGVGTVWATAPIRGSELTPADEPFIASTTLDAIPETLSEHWRATDTSTNHKPLITGGVISTADGNTIKTYTPDGALLWSYERDKELCSLSVGFDAAVATYKTGIGCGDVTAINANDGQYQATRSAISSDHVAPISSNDRIGVLGTERLELWRSDLVRTIEYGDVEAPQESGQQPHPECSITSAMTRKDLLAITEDCPDGSSYLRFMGTTPDDSRTPEITQDIEITDGRIVAIGQSVAAVYTNDPSPRIVSYNDDGELVGEQAVDEVEFPDPPFQSATADLPHHMSWFNGDSLVLFSPTQLNVRQSFNDALGTGIALNGSLLYPTAEGITVANWDTGEVQRTIPVDRAGYDGEVALGVVGQVIVEKRGSEIVALG

SEQ ID NO: 4359 - protein, 424 aa, Corynebacterium glutamicum
MSSESPRPTFTELGVAVEITDALEALGINRTFAIQEYTLPIALDGHDFIGQARTGMGKTYGFGVPLLDRVFDSADVAETDGTPRALVIVPTRELAVQVGDDLQRAATNLPLKIFTFYGGTPYEEQIDALKVGVDVVVGTPGRLLDLHKRGALSLDKVAILVLDEADEMLDLGFLPDIEKILRALTHQHQTMLFSATMPGAILTLARSFLNKPVHIRAETSDASATHKTTRQVVFQAHKMDKEAITAKILQSKDRGKTIIFARTKRTAAQVAEDLASRGFSVGSVHGDMGQPAREKSLNAFRTGKIDILVATDVAARGIDVDDVTHVINYQTPDDPMTYVHRIGRTGRAGHNGTAVTLVGYDETLKWTVIDNELELGQPNPPQWFSTSPELLETLDIPEGVTERVGPPTKVLGGTAPRPPRRTRK

SEQ ID NO: 4360 - protein, 75 aa, Corynebacterium glutamicum
MDIKIGFADTARELVISSALQQDEAAAKVSEALANDSGVLDLSDEKGRRYIIRNSRIAYVEVGTSAPRTVGFAGA

SEQ ID NO: 4361 - protein, 282 aa, Corynebacterium glutamicum
MVRFARDYGWRAYAIPVLTVITVWVLFDVFSADQPANGASGEASTSLSTPTSTLRAGPDPAQAEPQSVPLTELPPGGSYTETGAGTFRQVGAALPRVGEGQEQTFTYVIEIEDGVNTAAYGGDDAFVAAVDATLSDPKGWTADPAFAFEHISGDEDPDLRIQLTSLSTTHELCGNDIEMETSCFYSDGGRVMINESRWIRGAAPFKGDLGSYRQYLINHEVGHGLGYAAHDACTAPGELAPIMMQQTLSLNNSELFRIDPDEVYPDDDATCEFNPWPYPRGF

SEQ ID NO: 4362 - protein, 253 aa, Corynebacterium glutamicum
MSNQLPDHVRDAFQVGAGPAEQLGQAWDFGFRVGNTVFAKVTAPEVSGWSSKTRETLKPEGVRVVRPIRSTDGRFVVAGWRASVFSTGTISKRVDETVVAGLRLADALVDTHAPEPVDNVFNRADVQAWEEQPGRIGELLEPINRVNQVGHADMLATTLYAGTQPPAVTDLVPVLRPHGFTAALVIVDGLLLGAVDEGILRRFSHLPEIEQLVLRAFLFRRNLQEFSENNDPNVISNLNRVESTLVSYVSDKI

SEQ ID NO: 4363 - protein, 1016 aa, Corynebacterium glutamicum
MSEYKPPIPSDPQVRLIKPTSKLRPRSWEGEVSHLVKQGTGLWRVTGEAGSGVSSAVVDTVLERIRQGWEPSSMLVVATSKEAASRLRQEISESVAQMDYVSEGPLVRSVHSVAFALIRDASDDDVRLITGAEQDAVIRELLRGHADDGRGGWPQEQREGLRMVGFARQLRDFLLRAVERGVGPDELVELGERFERANWVAAGEFLREYKQVMKLSGAHSFSASELVTEALRGPEPSVKYRGVFIDDAQHLDPKSAELVSRFFPEAELAVVAGDPQQSVFRFRGANPDFLTKLSVDHEVVLKGRRKASTSIVVAETESAHADLLADTVRRAHLIDGRSWSEIAVIVRSAGMIAPIWRTLLAAGVPVHISPTDVVLAEQRIVAAMILGLRALTESLNAIELEDLLLGPIGGADPVTLRRLLRGLRQAEMKMGGQRRAIEVLRSLLAESDAEMLGFLTDRELNLLERVRSVLEAGREALAEHGSIEEVLWALWSATDLSNSLSAISLRGGASGSQADRDLDAMMALFDAAGDYVERYPSAGVRSFILHISEQELPTGMRERRGAIPEAVEVLTAHATTGREWKRVIVAEVQEGSWPSLGETGTLLGQEEFVDLVDEGIDPDIIISRSAERLAEERRLFYLATTRSTESLLVTAVNSPDSDEVREPSRFLELLSQPIVVLEGEEASAIAEPEEIGHRLLSIPAMVAELRRVVNDPRDPRRKQAARQLSRLAEAGIPGANPAEWTNLRTPSTDEELIKGAVSLSPSRIEQLLNCPLRAVLDRLDSEEETPIAMLKGTLVHAFAEAVAGGVDAALAEEKVTSAYMQLANVPSWSRESTEIAFRRILSRTDTWLKTSRADFTEVGTEMDVSVTIDDSVSIRGRMDRLERNKSGELVVVDFKTGKTQIAAKDMGDHPQLFAYQLALSKGVLHGDKISDPNPGETPDPVGGGLLVYPATDTKAVGQRMQDPKTQEDLDDFAAMLPGLAEHLRGPNLLARVNPTCSTCPVRSLCPVQPEGRVIHA

SEQ ID NO: 4364 - protein, 260 aa, Corynebacterium glutamicum
MRAPHRVSKQVRMRRLGLCHDNACRRFPPPLQHHLVIHTQLGEKIRIRTTEPKHRLLRITRHHSQLRLREKPRHKFRRLRIQMLRIINKHTAILHRRLRTTQRFSHQLRRRKTMRPRQLHHLLVLTKELTRSNPIGALKSLPQFHQLIRAHTTLHRTKQKVTQLPSEPHHPQTLTLLLRPPPTTIISMTTQQLPNHRILLSARNQPHIIIRRITNQRESHRVHRSHQRPLRHIIHLGYGFRDLLPQATRRLFRRGDNQHR

SEQ ID NO: 4365 - protein, 1073 aa, Corynebacterium glutamicum
MSSMRRISPRLLSQYLGQEHAPTDQQSAIIGSEPGPLLVVAGAGAGKTETMAARVVWLVANGFVAPDQVLGLTFTRKAAQQLSQRIRKRLETLAGVPRLKDIDPTGQLEKNLQAITPTVSTYDSYAGTLIREYGLLLPVEPSARLITQTELYHIARNVVNNYDGELTATQTPATVTEYLLKLVSEMDNHMVTAEDIREESDPFIKLFDELPKGKGQRDNLNAEMTKWRDTQVARLQYLPLVKALKEELHNQAVVTFGEQMSKAAHLASTHPQVGYSQRRRFRVVMLDEYQDTSHSQRVLLSSLFGGTDPGLTVNAVGDPMQAIYGWRGATAANLENFVDDFPVIHLDGKTRAPKNELTTSWRNPPEVLTLANAVSREVLGSPDAPTRTVQPLQPREGAPTGEVSLGWFGTAAQEREFVADEMVKHWNAREEKGTFTAAVLVRKKRHSAPMAEELTKRGIPVEIVGLSGLLDIPEIADLISLATMLVRPHDNRAALRILAGPHVGLGVADLQRLQGRARNIAGRVSRERREKNPDPLAELDAIIEEATAIEPEAVVGLADAVADLGEGDRFSEEGLSRLKRLATQLRYLRKYSLGRSVADIFADIETVFNIRTEVLSRQDPHADGAAGTVHLDKFAEEVASHGGIGLPELLDYFELAKDQEEGLEPGEVTVRSDRVQILTVHKAKGLEWDIVSVLHADASTYDAKASTWLKNVTMIPSSLRGDAGTGAPEMDTSEADDRKALEDSGKEYTSEVREGLREENSRLFYVGITRSERVLLVTGSALDESGTKAKVPYGHLEILRDKAPECVVSWWEGEEGDVEKQKPAEGVFPQLLAADSSGADLVRGPRAEPNNEGGLESLWEKEVSALIDEHRRLSNPIVEVETPRELTATDLVSMKNNPEQFARRMRRPVPFKPNTYAKRGTLFHQWLEDRFGSTALLDETELPGIDEDYSDDAFIELRDAFLGSTWENRTPEFVEHPFEVTIGEHVIRGRMDAVFHTDGTWMVVDWKTGRTPTGPEMDAAIIQLAVYRLAWARLKGLEPEEVRAAFHYVAHDHTFEPNDLPTQEELARLLSQE

SEQ ID NO: 4366 - protein, 444 aa, Corynebacterium glutamicum
MTLLTHQHRSSKCALLLPRIPMLHHLISHKLTFLRRRTKPSERHFTGRCAFPRLQRLHRPSRRIGRPKHLPRNCVGKGEDFWWVSPTCGQLVFRCSRFSIEMDDGEIVNEILQVRRCRTSPTINRLHWIAHSINSETRIGATEKTAQQHTLRVAGVLILIKHDNAEPSPLRIAHLRMRRCEMSCLRHLLTKRHHSLIVQFLFQSLHEGQVLEASDLCIPPLRHFGVEVVALTLALGEFVEKLNERIGLLTDILCGNHVVVHFGYQLEEVFRDSGRRLGGGELTVVVVHHVASDVIKLRLCDQPCGRFYWKQQSVFSNQRARIGVIGGYRWGDRLKVFLQLAGGINVFQARHTSKSLQTLSDALRQLLRRLPGKCQTQHLIWGDESVRYQPHHSCSHRLRFSCAGTSHYQQWAGFGSNDRRLLISWRMLLSQILGEQSRRNPTHG

SEQ ID NO: 4367 - protein, 335 aa, Corynebacterium glutamicum
MSIIRIPQAAKRSPWALILTRIGYAMVLLVIVTMVVYFDRNGYSEDLTFIDALYYSTVSLTTVGYGDITPVTQSARLINIIVLTPARIGFLILLVGTTLSVLTEESRRALQIQRWRKRMRNHTVVVGYGTKGRSAVAALLADGVPANQIVVIDTDQVSLDAANNSGLVTVKGSATKADVLRLAGVSRARAVVVAPNLDDTAVLVTLSVREIAPQAMIVASVRESENQHLLEQSGADSVVISSETAGRMLGLATVTPSVVEMMEDLLSPDEGFSVAERLVGEDEIGSNPRHLADIVLGVVRSGELYRIDSPEAETVEPGDRLLYVRRVFSEEVNDK

SEQ ID NO: 4368 - protein, 238 aa, Corynebacterium glutamicum
MRILPIGPHDEIAVNGSIVLLSEHDGDIVSVGPDLGTVRVTLEEIESLGTPTAPRDLGSREVDACVSLLRNRELVRFDPHDGSELTYREHSVAYGASGKPLFPRLDPAVIGIVELRGEDRLLLGMNAQKRQRYSLIAGYVSHGESLEDAFTREVFEEAARRVSEISYVSSQPWPISGSLMLGMKGFTEDELPQGETDGELAETIWASPLDIIDRKIPIAPPGSIAYDMINAWARDKQN

SEQ ID NO: 4369 - protein, 678 aa, Corynebacterium glutamicum
MINLQDLDEDQRIAASAPRGPVCILAGAGTGKTRTITYRIAHLIDQGFVSPNRVLAVTFTSRAAGEMRHRLNLMGIGGVQARTFHAAARKQLLYFWPQVAGNLPWRLLDNKFQLVGRAVRGARLESQTEKVRDILGEIEWAKASLITPEQYPDRLGTRTPPAPAEKIAEVYQRYENMKATPEGMLLDFDDLLLHTAGALENSPAVAEEFRQQYRSFVVDEYQDVTPLQQRVLDAWLGDRDDLTVVGDANQTIYSFTGATPEFLLNFSRKYPEATVVKLQRDYRSTPQVTALANTVIGQARGRVAGTRLELQGMRIAGPEPEFSAFDDEPTEAREVAGRILTLLKNGVQASEIAVLYRINAQSAVFEQALADAGIVYQVRGGEGFFTRPEIRQALSQLIRTSQRDVDESDLVRLTQRTLVPLGLSSEEPSGAQERERWQSLNALVDLVKDLVKATPDLDLTGLLLKLRERQEAKHPPTVEGVTLASLHAAKGLEWDAVFLVGLVDSTLPISHAIKSGDEAIEEERRLFYVGVTRAREHLHCSWALARQEGGRKSRKRSRFLDGIVVEMASESGTPRSNRPKNCRVCGSVLSSPAEKAVGRCASCPIQADERVFEQLRTWRNDTAKRENKAAYMVFSNATLMAIAEMNPTNENELLSVPGVGPMKIENYGDDVLAILGAL

SEQ ID NO: 4370 - protein, 197 aa, Corynebacterium glutamicum
MCHLKNFPQNLIDTVTSSGLISSQLQSSVMQEKPEMPAIEVIRSAKRTKTVQARIVDGQIQVRIPARMSKAEEEKAVGEIVAKLKRRTQSAVSSDADLIERAHKLNKTVLEGRARVESIRWVSNQKGRWGSCTVATAEIRISDRLKHVPDYVLDAVLVHELTHTFIAGHSAEFWEWADKTPLAERAKGYLEAYQRWG

SEQ ID NO: 4371 - protein, 272 aa, Corynebacterium glutamicum
MGEIFQMTHIALANSAQVLIRPDSAIQFGIDATRAGVLNIDPSLSSRVVPVLRNLRTARPIVDVIADLTTAGLAPTAASSLLEDLLEFGVVRESAAAQVLLFGDGSLVDVTSFLLETSGFVPRPQIIDESPREFFELPSSHILVLNKLAHSQRLSPLLHKYAPTYLCAAIVDNRGIIGPGRRSRSGPCLMCVDLHRCDIDPHWLSIINQQPNGPTFPDPVTEMATAARLVAWVTADTWLPGVVEEVNPHDRTNSVRTLPVHPKCPMCWSLGS

SEQ ID NO: 4372 - protein, 201 aa, Corynebacterium glutamicum
MGSKSSPSDSPRSASMNSAGLSISSAVGRKSGWFQTASRRSTPTAFSTRRHSSAASETFGAPSSMPTTWENACSADPPVARRRFQASFMASVDGMRSLRAWVTTMSTQPSTSARRVSRRDTALALRDPMRGDRSIPWSSFIISWRRSGSGLSIWKLPMASWMCEVSISRPTAYSSTEETRRSTSHGTCLKRRWRAASRAQM

SEQ ID NO: 4373 - protein, 482 aa, Corynebacterium glutamicum
MPCRLVNMNSNGFGFSFGNNDDDDDKNRNNDPFGLFGGNFGFGGQGGAGGPGGLGDILNQFGQMLSGMGDSMNSPEAAGPVNYDLAARIARQQIGRVAPVKDSEKEAVEESLRLAELWLDNATQLPTSGHRVEAWNPENWLENTLPVWKRLVSPVAEQMNKAQLENLPEEAREMMGPMSSLMNSMSSMNFGVQLGNALGDLAKQTLTGSDFGLPISPVGVSAVLPGNIAEASKGLNVAPQEMLVYICAREAARQRLFKHVPWLVERLVSSVEEYAVGLEIDTSHIQEAMGNFQMDNPDPERLQEMMNELQGMDLSPRIGSRNANAVSRLETLLALVEGWVDIVVTQALSERIPSTDAMNEAWKRRRATGGSAEQAFSQVVGIELGAPKVSEAAELWRRVENAVGVERRDAVWNHPDFLPTAEDIDKPAEFIDALLGESDGEDFDPIAEITALEKLLAEEAEKKNDSEDDSEDDGSEGTSDKN

SEQ ID NO: 4374 - protein, 350 aa, Corynebacterium glutamicum
MNRRIKTLTWGAIPLVLLASLVSIDHIPGTNINLSVPYAAEGPGPTINTLGQVDGEDVVSISSADLDETEGNLNMTTVSVRSGMTLSQVISRWLFTDDTIVPIEQVFPPGQSTEEVEESNRTAFISSESSATIAAMNYLNIPVEVEVAEVLTDSAATGIFEPGDKLLSIDGTAISTPGDAQTIVRSKAPGDEITISYERNDAESQATITLREHPDDSSVALLGISMLSVPSSAIEVDYNLEDIGGPSAGMMFSLAVVDKLSPGALNGGKFVAGTGTIAEDGSVGPIGGIAHKVRAAEDAGAEVFLSPADNCAEAMSAKPQDMTILKVDSLSQAIDQMAAYNEGSDFQTCG

SEQ ID NO: 4375 - protein, 225 aa, Corynebacterium glutamicum
MASTPHKHVRVALGLVALIPLLAACTGGGSTETSTESTAETTPATTTEATTTPATTASSSVIETTESSTAETSTKESGETSTSKPRMTKDVEVAYKAFSSLAPVELFEQFETCDPSGVEDSFACNGPEVGQFQFFDNASKATSTTQLLTELRSSRVVEDSGSKVVGWTTIGTMSIITVVDNDQGLVLQQMVSSDKIDPEERIYELGLSTPKDTEESSEETSASKN

SEQ ID NO: 4376 - protein, 174 aa, Corynebacterium glutamicum
MNDSIFSPQALNKAMLEAVEFIHAEGWDAGPTLFALVPTEMLVDTLDEAADDSPLTLVVQDNLPDNLLPGSEALGDYVSRLAWPAEIAGAVLAQEIMFTDAAVAGSEPRPARLFSGVLRGEAELTLLQLRPTEEELAERGPFAEDEIELRGGPGVAPGVIAALRYTLEADPDEI

SEQ ID NO: 4377 - protein, 985 aa, Corynebacterium glutamicum
MSTGLTPPPQPIKRPPKAVTWIFAIIALVILIAPMSVGFYTDWLWFGEVDFRGVFSKVIVTRIVLFVIFALIAGFVTWLAGYFVTKLRPDEMSAFDTQSPVYQYRQMIENSLRRVMVIIPIFVALLAGLIGQRSWRTVQMWLNGQDFGVSDQQFGLDYGFYAFDLPMLRLIADSLSMMLIVAFLIALVGHYLMGGIRAGNQMTGQKSFVSRGARTQLAVTAGLWMLVKVAGYWLDRYDLLTKENSTFTGASYTDINAQLPAKIILLVIALFVAIAFFSAIFLKDLRIPGLAVVLMLLSSVIIGAAWPLMLERFSVQPNRAEKEAEYISRNIESTRYAYGITDEDVTYEENWGAGETTNEEVAADSATISNIRLLDPQILSPTFTQQQQLRNFYGFPDQLAMDRFEVDGKLRDFVVAARELDPNALQQNQQDWINRHTVYTHGNGFIAAQANQVDEVARDVGSTRGGYPVYTVSDLQSNARAAESEDAEELGIKVDEPRVYYGPLIASATDGADYAIVGDTGDGPVEYDTDTSSYTYEGAGGVDIGNMVNRAMFALRYQEMNMLLSDRVGSESKILFERDPRSRVEKVAPWLTTDSKTYPTVIDGRIKWIVDGYTTLDSLPYSTRTSLTEATQDAVMPDGTPQPLITDRVGYIRNSVKAVVDAYDGTVELYEFDTEDPVLKAWRGVFPDTVKDGSEISDELRAHLRYPEDLFKVQRDMLAKYNVDDSGTFFTNDAFWSVPGDPTAAEGRQELKQPPYYVVAADPETGESSFQLITPFRGLQREYLSAHMSASSDPVTYGEITVRVLPTDSVTQGPKQAQDAMMSSDQVAQDQTLWRGSNDLHNGNLLTLPVGGGEILYVEPIYSQRKDQASAFPKLLRVLVFYKGQVGYAPTIAEALSQVGIDPKEAQDIEEVDGTATTPSTDETDTDTDQPATETPTAPVSEAEGIAAINDALSNLEAARDSSFEEYGRALDALDRAVDSYQSAQ

SEQ ID NO: 4378 - protein, 453 aa, Corynebacterium glutamicum
MLADLPIALNPHEPTSIPTQLTEQIRRLVARGILTPGDPLPSSRSLSTQLGVSRGSVVTAYDQLAGEGYLSTARGSGTTINPDLHLLKPVEIEKKETSRSVPPPLLNLSPGVPDTATLADSAWRAAWREACAKPPTHSPEQGLLRLRIEIADHLRQMRGLMVEPEQIIVTAGAREGLSLLLRTMDAPARIGVESPGYPSLRRIPQVLGHETIDVPTDESGLVPRALPHDLNALLVTPSHQYPYGGSLPADRRTALVAWAEANDALLIEDDFDSELRYVGMPLPPLRALAPDRTILLGTFSSVITPQVACGYLIAPTPQARVLATLRGILGQPVGAITQHALASYLASGALRRRTQRLRRLYRHRRSIVQDTLGDLPNTQLRPINGGLHAVLLCDKPQDLVVTTLASRGLNVTALSHYWGGTGADNGIVFGFGSHDEDTLRWVLAEISDAVSLG

SEQ ID NO: 4379 - protein, 317 aa, Corynebacterium glutamicum
MTESGSTASPLCGVGSSVMTETQETYQATTRVKRGLADMLKGGVIMDVVTPEQARIAEDAGASAVMALERVPADIRSQGGVARMSDPDLIEGIVNAVSIPVMAKARIGHFVEAQVLEALGVDFIDESEVLSPADYTHHINKWKFDVPFVCGATNLGEALRRITEGAAMIRSKGEAGTGDVSEAVRHLRTIRGDINRLRSLDEDELFVAAKEFQAPYDLVREVASTGKLPVVTFVAGGVATPADAALVRQMGAEGVFVGSGIFKSGNPAARAAAIVKAATLFDDPSVIADVSRGLGEAMVGINVSDVPAPHRLAERGW

SEQ ID NO: 4380 - protein, 115 aa, Corynebacterium glutamicum
MPTMASPRPRDTSAMTEGSSKSVAALTIAAARAAGLPDLKMPEPTKTPSAPIWRTSAASAGVATPPATKVTTGSLPVEATSRTRSYGAWNSLAATKSSSSSRERRRLMSPRMVRR

SEQ ID NO: 4381 - protein, 200 aa, Corynebacterium glutamicum
MIVGVLALQGGVEEHLTALEALGATTRKVRVPKDLDGLEGIVIPGGESTVLDKLARTFDVVEPLANLIRDGLPVFATCAGLIYLAKHLDNPARGQQTLAVVDVVVRRNAFGAQRESFDTTVDVSFDGATFPGVQASFIRAPIVTAFGPTVEAIAALNGGEVVGVRQGNIIALSFHPEETGDYRIHQAWLDLVRKHAELAI

SEQ ID NO: 4382 - protein, 121 aa, Corynebacterium glutamicum
MDSSLGSVVLMLFSVVLIAVVCISMTRMAAQAKLDRHSSAGIRSRHTQASNAAWKEGHSAALPLIYTIGWVAAITTPIAIATELALGTPWGILSDLAGMLCEVAVLLLATRVANNAARSVI

SEQ ID NO: 4383 - protein, 354 aa, Corynebacterium glutamicum
MRRPVSRRAIFATSVLVAGVSIMSPSANAAEAPASEWVNTTAIVDQANAQLSQFGVSLDRSAAELFDDQANSQIDAALSPYADKVPTSGGQVVEQSLQVVEQEVQKALPNYEIRTDLQSQVMGATLGEVLHRVPGSWFDAPAVPEESRIVEEQGKSLYGPGTPIYLNGNSMCTLAVTGTDADGRKIGITAGHCGKSGDAVRSADSFWVGDTGTVVYNAPNADYSVIEFGSNAELSNTYNGVTANAVGGGVTNGQEVCKNGVATGYTCGLVWTADERMTMSQVCAGRGDSGAPLIADGRVVGLVSGGVIPDYNLACATPLQGPFFMPTLSVNMDTVLTDLDSQDLPGRGFQPTAG

SEQ ID NO: 4384 - protein, 167 aa, Corynebacterium glutamicum
MTLCRSRKKSLDRLFKSKLRLVLAGHFLNADPSAMASIFDVDFESGVISSVIRARELTLDDFSLGCVTPLVAFVGWEFPQGVEPCLPVKVEQSIIYPRTSEGVGASQGEGMGDADFEGFSGAWCAGLELYLALKLGARVTCQMGYSLEGLTRMVSPRCLYGLRFGKW

SEQ ID NO: 4385 - protein, 195 aa, Corynebacterium glutamicum
MVCWSGALPGSEAGCSCDMSDGVFAGRSHSYGQPSMSLRSALRQMVIDRSAAKEIFGRGSLEELTIKIATNAGYGKLSQDVAPRSGWNAFEETMESIGGSAVTSPYHAAMTTSLVRALLLAISNEIEILSVTTDGFITRESNIEALECCGIADVFRDSRGALTGDRTVWEIKHLQDDLLNFTTSANISPSYEGGG

SEQ ID NO: 4386 - protein, 527 aa, Corynebacterium glutamicum
MKLFSQAAGIIAAALLVTGGIAPVAQGQALQVVTPEQQESYVQQFHHDGDTPPVVDGVGGYTEQEVAEIHEAIRQAQDSGAPNDELIPGEMWSDKVELPSTIDKAAADEAEIAIAQQQSQPQARGLAAAAACQTFWPSPYQVCGAILERYIQQGAQFGWMLLLTEGQALNPDGQGYRQRFMNGFIYWHPSTGAHAVNNYSAQVWERNGWESGWMGYPTGGEVPVSGSNPIDGELSGWVQTFQGGRVYRSPVLDGFQVASINGLILDKWLELGGPDSDLGFPIADEAVTADGVGRFSVFQNGVVYWHPQHGAHPILGNIYSIWREEGAESGEFGYPIGDPEKYTENMANQVFEKGELAANLYPNPLEAFIEFLPFANLEEAIEYFENGLSNSRVEANSLNAKKDSIQCQSQSANIHVRTKSDGVGIRVPKIGFKARMDCDLPGTVSDVVGYGWIYYDYWGRWAQAAYAQQFFGNRNSVVQTNLEAGCSGEKNTLFWGTSYFQVTYEGQPYFGQSATNYAYLPCTIDRS

SEQ ID NO: 4387 - protein, 143 aa, Corynebacterium glutamicum
MYSDKLILLFLSEQDSSYECCVGLLDGSDGLDYIEKLLKGRKLKNHFLEWEDINKADVAREEIYKGQLVHLVFVTALSTPGEISFVFPGQSLMSATLEEDFAALVLEEERTSFRPELSHLWSLPVGWVAPGLEGFVERNSEAA

SEQ ID NO: 4388 - protein, 170 aa, Corynebacterium glutamicum
MMKERRIKTLAALVICGLTVSGCGNYLGDINVKGRAGFSVSEAGDLIVRVQPCGLPIDTVDMAGPMPQDQPPQANPVYLQLSDPDGRTDPFIVDPENLDPSWAIIAGDGLPTDPDALIIVNAHVEGESTQTSQVSAYVRDVQGLRTDQIYVGTLESSRIVDESTFLHCRK

SEQ ID NO: 4389 - protein, 74 aa, Corynebacterium glutamicum
MTQIGIHADNTPYCINSVRGVVFRIEKDLRDTKLHRYSHQQGCAALVKILNSLQDEKSFNRNHVYLKATWLDHD

SEQ ID NO: 4390 - protein, 103 aa, Corynebacterium glutamicum
MIDMCTTPRQEIMIREQFKEINNGRVVPHYDQLEQLAEIFSTKDSIDMVNEILNRDTDFLSNEGTIFMEYIFNGGFHTDNGYQPLSYAYVERGLAIRPPRIVL

SEQ ID NO: 4391 - protein, 260 aa, Corynebacterium glutamicum
MSKYADDLALALELAELADSITLDRFEASDLEVSSKPDMTPVSDADLATEEALREKIATARPADSILGEEFGGDVEFSGRQWIIDPIDGTKNYVRGVPVWATLIALLDNGKPVAGVISAPALARRWWASEGAGAWRTFNGSSPRKLSVSQVSKLDDASLSFSSLSGWAERDLRDQFVSLTDTTWRLRGYGDFFSYCLVAEGAVDIAAEPEVSLWDLAPLSILVTEAGGKFTSLAGVDGPHGGDAVATNGILHDETLDRLK

SEQ ID NO: 4392 - protein, 273 aa, Corynebacterium glutamicum
MIKTITKTFVIAHDQDSDEHLAQALVYNAGRLAWRMRENGVDTDYKTSVSDVVTDADRAAEAFVAGVLEALRPEDGVLGEEGADRASKSGKTWVIDPVDGTYNFTQGSDYWCSALALVEGDPSAPSRVLFGAVHRPAMGYTWFGGPGIRTTLDGKELDLLVDAPLNQISLATYIHPSRIAEPDIQKAWMSVATHPATLRMFGAGSIDLANIADGSIGAWVQHSVADWDWLPGRALIEGVGGACIKVTAGGVEWSVAGNAEAVSEISETLSALD

SEQ ID NO: 4393 - protein, 368 aa, Corynebacterium glutamicum
MRPEFSAELSELDSTLTTIEKVLNPQEMSDRVRELEAQAADPSLWDDPDHAQQVTSELSHVQAELRKITDLRQRIEDLPIMVELAEEEDGDTSIAEEELADLRSLIDALEVKTMLSGEYDAREAVINIRSGAGGVDAADWAEMLMRMYTRWAEKNGHKVDIYDISYAEEAGIKSATFVVHGDYMYGQLSVEQGAHRLVRISPFDNQGRRQTSFAEVEVLPVVEKVDSIDIPDADVRVDVYRSSGPGGQSVNTTDSAVRLTHIPTGIVVTCQNEKSQIQNKASAMRVLQAKLLERKRQEERAEMDALGAGGNASWGNQMRSYVLHPYQMVKDLRTNFEVNDPQKVLDGDIDGLLEAGIRWRMAESQSAE

SEQ ID NO: 4394 - protein, 229 aa, Corynebacterium glutamicum
MITFENVTKNYKTSTRPALDNVSLHIEKGEFVFLIGPSGSGKSTFLRLMTREENVSSGSLTLADFQVNKLRGTQVNKLRQRIGYVFQDFRLLKNKNVYDNVAFALEVIGKKKDKIQELVPETLEMVGLAGKANRMPNELSGGEQQRVAIARAFVNRPLVLLADEPTGNLDPDTSDEIMILLNRINRLGTTVVMSTHNARTVDDMRRRVIELQLGKLVRDDAHGVYGEMR

SEQ ID NO: 4395 - protein, 88 aa, Corynebacterium glutamicum
MSSTVRALWVDMTTVVPRRLMRLSKIMISSEVSGSRLPVGSSASKTSGRFTKARAMATRCCSPPDSSLGMRLAFPARPTISRVSGTSS

SEQ ID NO: 4396 - protein, 300 aa, Corynebacterium glutamicum
MAFGYVLREAVRGMGRNVTMTIALIITTSISLALLATGFLVTNMTDRTKDIYLDRVEVMIQLDEDTSANDPECTAESCTEVRDVLEGLDGIDSITYRSREASYERFVEVFKDTDPVLVAETSPDALPAAFHVRLEDPLAVEILDPVRDLPQVSNVIDQVDDLRGATENLDSIRNATFLIAAVQVLASIFLIANMVQIAAFNRREETEIMRIVGASRFYTQGPFVFEAILSTLIGAVFAVGALFLGKELVIDKALRGLYDSQLIAPVTTTDIWLVAPIISGIGVVIAGIIAQLTLRFYVRK

SEQ ID NO: 4397 - protein, 164 aa, Corynebacterium glutamicum
MAKKKKKVDENNSVLATNRKARHDYHIIDTWEAGVVLLGTEIKSLREGKVSLVDSFATIDNGEIWLQHLHIPQYSMGSWTNHTPKRTRKLLLHRNEIDSLMGKVRDGNRTLVPLKLYLKNGRVKLELGLAQGKQDYDKRQDIKRRTEEREVTRELGRRIKGINA

SEQ ID NO: 4398 - protein, 117 aa, Corynebacterium glutamicum
MSIHIAKVHDVLKGEKTYGTTILVDRLWPRGVKKDDLEPDLWLKSVAPTTELRKWFGHDPAKFSEFSTRYTEELNASNDKDLETLVDATSRHPVTLLYGAADRDHNHAIVLAKWLKK

SEQ ID NO: 4399 - protein, 179 aa, Corynebacterium glutamicum
MAEPFSEFGCGGDAFEPEVWLKVVFFHTAWPEPIHQNGGSVGFFTFEDVVDFCDVNTHLRVDSLNATAELTGDFAFFGATLDILALVVILLTLCESEFEFDATVFEVKLERNQRAVAVADFTHQGINLVAVQQKFAGALGRVVCPGAHGILRDVEMLKPDFSVINGGKGIHEGYLTFAQ

SEQ ID NO: 4400 - protein, 100 aa, Corynebacterium glutamicum
MLALPSSIIDPLWCQFAALIPPVTDTHPLRCHRPRIPDRIIFDKLIQVLVLGASYAKIADTTCSATTLRTRRDEWITAGIFEQLEQICLEFYDRIVGLDL

SEQ ID NO: 4401 - protein, 135 aa, Corynebacterium glutamicum
MMLTEQLFRHQVGIDRALQSAHNATIRANPNLEIESDDTVVEFQTDLFQLLEDASGDPLVPAGAQGGGRACRVGDLGIGGAEDEDLDELVEDDPVRDAWAVAPKWVGVGHGWDQRGELAPEGVDDRGWKGKHECS

SEQ ID NO: 4402 - protein, 275 aa, Corynebacterium glutamicum
MSTALPDQLKWEYSAFPVQISQKQRLSPGFMRITVTGDKLRFFGQWGLDQRIKLIIPSPAGNIPDFGILDEPTPPPTTWLPRAKSFPADQRPILRTYTPSAVRPELCEVDIDIYLHNPSGPVSRWAKNCSVDDELIITGPDVRAGETGYGITYHPTSAIDRLCLIGDCASAPAIANIVNQSKVPTTVFLHVDSLEDDVLIADSSTKLTFEDIDAYKAKVFQWASANAADPSVHFWIAGETSMVRFIRKELINSYRVDSSRITFLGYWKYGRRTVD

SEQ ID NO: 4403 - protein, 306 aa, Corynebacterium glutamicum
MSSRRKLSSALIVLLAAALPLTACSSSSEEEASTSSATREFTDAHGTTEVPENPQRVVVLEPLELDTAIALGITPVGAAVANNVTGIPAYLGVDGIEPVGTVSEPNIEAIAALEPDLILGTDSRHAEIYDRLESIAPTVFMTTHVDPWKDNVVFIGDALGKKQESEDLIQGFNDKCEEIKSEHDVEGKTVNMIRPRDEQTMSLYGPTSFAGSSLECAGLTIPDQEWKDDLQADIAPENFMLATADYVFVTATDVTDENELPEVIRENREQFPSLTLVDTSYWVSGVGPLGGSKVLEDIDAFLDAQQ

SEQ ID NO: 4404 - protein, 196 aa, Corynebacterium glutamicum
MSTEIHNAPPKAPTWLGWVLMIGGIIGLILSVIIMAEKLAILEDPGHITSCDFNAVLACGDVMRSGQANAFGIPNPLIGIAGFAAVAIIGAGILAGGGFRGWFWFGAQAGLTFAMMFCHWLAYQSMSVIRALCPYCMGVWTVSIIMFVLVTAWNVKTFSGSDSTFVNALYKYKWVIAIVWLLLIAAAAVWSFRYMF

SEQ ID NO: 4405 - protein, 338 aa, Corynebacterium glutamicum
MVKNRFKLVSIATVAALALVGCSSTDSTSSESSSAAESTAAASTLTIEDNHGTEGISLPIEGVAATDNRAFELLDRWGVELVAAPLQLVPFTVTGYTEEGGVANLGSHREPDLEALAAAQPSLIINGQRFAQYYDDIIALNPDATVVELDPRDGEPLDQELIRQAETLGEIFGEEEDAAKIVADFESALERAKTAYAAISDQTVMAVNVSGGNIGYIAPSVGRTYGPIFDLVGLTPALEVGNASSDHEGDDINVEAIAAANPDLILVMDRDGGTSTRNEADYVPAEQIVSDNEALANVKAVTDGYVYYAPADTYTNENIITYTEILNGMADMFEKAAQ

SEQ ID NO: 4406 - protein, 333 aa, Corynebacterium glutamicum
MATPASAPTSEPRLKRTRAKLFDWKLLIGIIFVAGLVVLSLLTGQYDIFGGDDGQLMFEAVRIPRTVSLILSGAAMAMCGLVMQLLTQNKFVEPSTTGTTEWAGLGLLFVIYFVPAATVLDRMLGAVVFSFIGTMVFFLFLRRVTLRSSLIVPIIGIMLGAVVSSISSFFALQFDMLQQLGTWFAGSFNTVFRGQYEVLWIVVIVVIAVFFFADRLTVAGLGEEIATNVGLNYNRMVLIGTGLIAIATGVVTVVVGSLPFLGLIVPNVVSMFRGDDLRSNLPWVCLTGIAIVTICDLISRTIIAPFEIPVSVILGIIGAVVFVIMIVRQRGRG

SEQ ID NO: 4407 - protein, 314 aa, Corynebacterium glutamicum
MAALLVTALAFTWGLIWYKNPMPVGHPAFALIAERRMESVFVMLIVAVCQGFATVAFQTVTNNRIITPSIMGFESLYTLIHTSTVFFFGATALLATRNLEMFVGQLVIMVLLTLVLYTWLLSGKRGDMHAMLLVGIIIGGGLGSISTFMQRILTPSEFDILSARLFGSVNNAETEYFPIAVPLVVVASVLLLLSSRRLNVVGLGKDAATNLGINHRRSSIYTLVLVSVLMAVSTALVGPMTFLGFLVATLAYQFADTYDHRYILPMSALIGFVVLSGAYFVMNHVFRAQGVVSIIIEMVGGTVFLIVILRKGRL

SEQ ID NO: 4408 - protein, 251 aa, Corynebacterium glutamicum
MITLTNVRKEYSSDVAIGPVNLEIPAGGITALVGPNGAGKSTLLTMIGRLLGIDEGNITVASYDVTSTASKDLAKIISILRQENHFVTKLTVRQLVGFGRFPYSKGRLTEEDEGIISRYIDFFNLTELEDRYLDQLSGGQRQRAYVAMVLCQETDYVLLDEPLNNLDIAHSVEMMKHLENAAAQFGRTIIVVLHDINFAARYADYIVAVKHGMIEKEGTPEQIMKNEILSEIFNTEIEVIEGPHGKIACYH

SEQ ID NO: 4409 - protein, 49 aa, Corynebacterium glutamicum
MRQQGSRYAIRAGRNLPDKEFRYLRMVIVTTAVYWGLNSQLRLTANRSS

SEQ ID NO: 4410 - protein, 91 aa, Corynebacterium glutamicum; identical to SEQ ID NO: 3587

SEQ ID NO: 4411 - protein, 403 aa, Corynebacterium glutamicum
MNPLRTNQWGIKYSSCMSNDFVVSRLRPFGETIFATMTQRAVEAGAINLGQGFPDEDGPRRMLEIASEQILGGNNQYSAGRGDASLRAAVARDHLERFDLEYNPDSEVLITVGATEAITATVLGLVEPGDEVIVLEPYYDAYAAAIALAGATRVAVPLQEVENSWDVDVDKLHAAVTKKTRMIIVNSPHNPTGSVFSKKALKQLAGVARAYDLLVLSDEVYEHLVFDDQKHVSVAKLPGMWDRTVTVSSAAKTFNVTGWKTGWALAPEPLLEAVLKAKQFMSYVGATPFQPAVAHAIEHEQKWVSKMSKGLELKRDILRTALDKAGLKTHDSMGTYFIVADIGDRDGAEFCFELIEKVGVAAIPVQAFVDHPKKWSSKVRFAFCKKEETLREAAERLKGIKKL

SEQ ID NO: 4412 - protein, 213 aa, Corynebacterium glutamicum
MHNFSFDVDESYAKKNNEILRDAKRLQISALCLGLILGGGAVAVYLFSNGAVWMWMIAIVMVFLALLSFIMIPVIPRQMGNAQTLYDDYELAPAIIAEVNPRDVVLLALVNRNVNPEAKPEWALATRTIVRVGAHERRLGERIPSVAITGRRTVKDQDHWDEISPMPITWGTTDKDIIREAEKTIPHELWAKLEKNRGKLEDVKKTPNNLFKL

SEQ ID NO: 4413 - protein, 557 aa, Corynebacterium glutamicum
MAFGDGPLIVQSDKTVLLEIDHPQAGEARIALAPFAELERAPEHIHTYRITPLALWNARAAGHDAEQVVDMLERFSRFPVPQALLIDIAETMSRYGRVRLHRHPAHGLILESGEPAILVEISRHKKIKPMLGAQVDPETIVVHPSERGRLKQELLKVGWPAEDLAGYVDGESHPIGLSTEFEDWSLRDYQQMAADSFWEGGSGVVVLPCGAGKTMVGAASMARAQATTLILVTNTVAGRQWKDELLRRTTLTEDEIGEYSGERKEIRPVTIATYQVVTRRTKGEYKALELFDSRDWGLIIYDEVHLLPAPVFRMTSDLQSRRRLGLTATLVREDGREGDVFSLIGPKRYDAPWKDLESQGFIATADCVEIRSTMTDAERMVYATAESADRYRLAATAHTKVAVVRKLLEEHAGKPTLIIGAYLDQLEELGAEFNAPVIDGKTPNKKREALFDQFRSGSLSVLVVSKVANFSIDLPEASVAIQVSGTFGSRQEEAQRLGRLLRPKHDGSEAHFYSIVSRDTLDTEYAAHRQRFLAEQGYAYRILDADDILFPLPKKEL

SEQ ID NO: 4414 - protein, 733 aa, Corynebacterium glutamicum
MKKDSPIPTLKGWLDTQSDDQLSTILRNRPDTVLPLPPNLASLAARLQLRASAIRAVLKLNALELGVLEAVANLGGELHPVTAPEVVEYLHVALAEDLPAQDTIGAALATLKNFALVYGDDQLMIAQETMPALPVHWRLLPEVSDRGQSEEQVRESVDKLSDRHRKLLHTLAASGGFGLTRDAAPDADPSRPIPQLLASGLLARVDEQTVRLPAMVRRVIEGREQLPAQVRPIPRTAAPGSNDGGIAAGLEVVRHMRLLIDALSHVPAPTLKVGALGVRVVTRLSKELDLDETELARLLSLGMASGLIRKGVPDPLPMDDDGGDYVAPTPLADEWMEYDLAHQLGTLMSGWWKQTYAPWLVGRADDKDKPIHVLSKTSIIDSLPDARAKILSSLSRVLVDNLHADLAFHYPLAASRMNPDTITQLVQEAQWIGAYSQGVTAAGQALIDGENPTEVIKAPAPVENFIVQGDFTIMVPGPLTPAMQKTMDSIASLESPGLASVYRLSEKSIRHALDLGLTTPEILEFLKEHSMTDLPQSVGYLLSDIARKHGTLRGGPALSYIRSDDPALLHSAVEAGADVALRQIAPTVAIAQAPLLQVITVLRAAGFQPVAEDGEGASLNISPSPARVPAASPPPVVPALDESRVQAAVKAIRRENSASQGTVSTQPTLSVLQAAVRGQRTVTLGFVDKQGVAVHRVVKPLTVNAGQVDAVDEATGAVHRFMLHRITEVIVDN

SEQ ID NO: 4415 - protein, 73 aa, Corynebacterium glutamicum
MFPEFERMYDMANVEKKHFVDPAWPEHNPADGHVVTELISKVAGASSPWGDDKEFPVSAEETGYVHPYTRINR

SEQ ID NO: 4416 - protein, 281 aa, Corynebacterium glutamicum
MQLDLADESVVVRLNLSWNGDAVLSEGAGDSAVGGLDGVQVGGANCDVGCRSVVLSNSWCSCSWLWGGGGSGEVTLGWSGVQSKGSGASRPCAPALTSQGALCNSDLLLTGCLVCVGSELLAAVSSPGASGELQTTVVAVTGVDCPVTTGLALCEAIPVGIRCSRCRRSHDGCSSTESDGGSCELGERGASLSGVTSHEKFSSHLSPSRLAVGLERRSCSASGCLASPQGVGLHAFFCEKMVGGFPVPVCNMAHMNAGVCGLKFCCTKEVVQLPTPDRVWR

SEQ ID NO: 4417 - protein, 199 aa, Corynebacterium glutamicum
MRGKLFMGRHSTKTSSAFTKLAASTIAFGAAATIMAPSASAAPDSDWDRLAQCESGGNWAINTGNGYHGGLQFSASTWAAYGGQEFATYAYQATREQQIAVAERTLAGQGWGAWPACSASLGLNSAPTQRDLSATTSTPEPAAAAPAVAEYNAPAANIAVGSTDLNTIKSTYGAVTGTLAQYGITVPAEVESYYNAFVG

SEQ ID NO: 4418 - protein, 127 aa, Corynebacterium glutamicum
MPVGTVKWYDAERGFGFVSNPGGEDCFVGKQVLPKGVTELHKGQRIDFDFAAGRKGPQALRIKILETPRRRPQHKYKPEELNGMISDLITLLESGVQPGLAKGQYPEHKAGAQVAEILRVVAKELES

SEQ ID NO: 4419 - protein, 175 aa, Corynebacterium glutamicum
MASRKTKRKNLIQILSLIVAVLLVVILSVVFQQWWNNRPEPLPQEISISASSPAGEIEVFPFSMCEPGVECEENEVPTLEVGADEELHLTIPEAIHDHDWYLLTIYDDPAANDEFYHTSYDATEATVPGSVDPTEEGAERPRLVVVEVSAVMIGEDENGEESPYTVTWSLSTMNE

SEQ ID NO: 4420 - protein, 258 aa, Corynebacterium glutamicum
MKKLASIAILSSLPLASCSTPPTDSEAVVEHLVPEIISTHSFDSTSFTQGLELDGDELIVGTGQYGGSRIYRSSVDGQESVSQSLDPEFFGEGITKSGDAIWQLTWNEGVAFKRDADTLEELDRVSYNGQGWGICSTDDALITSDGSSTLTFRDPETFAENSTVDVTLDGSPVGNLNELECVDGEVYANIFLDTDIMRIDPNSGEVTAVIDASNIPNNATPDTNNVLNGIAHIPDSDRFYITGKRWPDLYEVRFVPAD

SEQ ID NO: 4421 - protein, 233 aa, Corynebacterium glutamicum
MVTTSFLMVDGHIRNLQGHIDRLEAAAPTASQFHDRIITQLREAPGSVQAAVTIENNHYNVELRPPRKLNSLVTLDTHGHRDERLHPKIKGHDIAWQNTATANSRRQGADDGLLVDESGQVIMAINASLLAIKGDTVFHSTHPRSLPSVLESTVIAYLQEQGCNAKPREQGFNINDLRSSEVWLVDSLSGIRRVAAWLEYGSKFPVSETRPVAAFVPTFSEVNDYLWSTAQQV

SEQ ID NO: 4422 - protein, 46 aa, Corynebacterium glutamicum
MSYSVGVGEIGLGHWGGFLVGSSLLGGGLAPSGRQMEKFCCAKGFS

SEQ ID NO: 4423 - protein, 491 aa, Corynebacterium glutamicum
MRYPAMTSGKSTSTRGALDRYFKISERGSSIGTEIRAGVVTFFAMAYIIILNPLILGTTPDVEGNTLGIAQVAAATALAAGVMTIAFGLIARYPFGIAAGLGINTMVAVTLVSGEGLTWPEAMGLVVLDGVVIVILAVSGFRVAVFRAIPASMKAAISVGIGLFIAMIGLVDAGFVRRIPDAAGTTVPVTLGIDGSIASWPTFVFVVGVLLCGILVVRRVRGGLFIGILGTTILAIIAEAIFDSGASFENGEANAEGWSLAVPGLPDSFGGIPDLSIVGAVDLIGAFSRIGVVAATLLIFTLVLANFFDAMGTMTALGKQGNLVDDEGNLPDIKKALVVEGAGAIVGGAFSASSNTVFADSSAGVADGARTGLANVVTGSLFLAAMFLTPLYEIVPIEAAAPVLVVVGAMMMGQVTEIDFSKFYIAFPAFLTIVIMPFTYSIANGIGVGFIMYAIMAAAAGKAKQVHWLMWLVAGLFVVFFAIDPIMEAVG

SEQ ID NO: 4424 - protein, 304 aa, Corynebacterium glutamicum
MGTISYSGVKNMAAKNKEPVTTLARPVRAPSATPAEESANTVLEDAEKAPPTMAPAPSTTSAFLMSGRLPSSSTKLPCLPRAVMVPMASKKFARTRVKISKVAATTPMRLNAPIKSTAPTMERSGMPPKESGRPGTASDQPSAFASPFSKDAPESKIASAMIAKMVVPKMPINSPPRTRRTTRMPQRRTPTTNTNVGQDAMEPSMPKVTGTVVPAASGIRRTKPASTRPIMAMNRPIPTLMAAFMDAGIARNTATRKPDTAKITMTTPSRTTSPIASGQVRPSPETSVTATMVLIPRPAAMPNG

SEQ ID NO: 4425 - protein, 276 aa, Corynebacterium glutamicum
MTTRTVISDPADPRLDDVRDLNHSDSRPDLPGGKGLVVAEGPLVVGRLLESRYPVRAIVGFKNKLDSFLDSIDASLVEGIPVYEVSRELLAEVAGFDMHRGLLATADRTEEASVAQVLENARTVVVLEGVGDHENIGSMFRNAAGMGVDAILFGNGCADPLYRRVVRVSMGHVLRLPFAHLEGTYTTWQRSLEQLKEAGFHLVSLTPDPEAEHLEDALAGKDKVALLVGAEGPGLTEHAMRATDVRARIPMAPGTDSLNLATSAAIAFYERDRSQR

SEQ ID NO: 4426 - protein, 292 aa, Corynebacterium glutamicum
MLMPSQLGENAAIVTLWFVSASDPQSIIRSEPRADRGYGRKLLAQLNPTWPITPIGQFALNRSVPASANEFYIAGFPGITIIQTVLEDVTSLSKLNPRLLRSVPATDVYIFAVNEETTLGGFAHIYNGEIKRSFIAYEERVFEDNGIPGGFETPYWAGKKGTRKTALSLPFNPIELVHEAQRAWLGFDATTSPDINVVAYATDGRPEPRIAAPRIINSEEVTRSAVEKLGLRESAFYDDYEEYEAPDRVVSKRITSNAKKAASSAQKFGKSLWRASREFGSNMAERLRHTDR

SEQ ID NO: 4427 - protein, 311 aa, Corynebacterium glutamicum
MREIFLISGDSTESSLVFKTSEEDGAEEFFIAVTDELHAILAGHSEIKSAPEPEEHKEVPPPVLEPVAAVEEPREEKEIDPRISAPLTMSPREIQIRVRSGATIEELAEEIGVTEARVEPYAHPVLLERARIADLAKQSHPIRENGPAKLTLWEILATAFATRGHDLTTARWDAYKDATNQWIVRVDWKAGLSDNYAEWTLNLHNTSNPTADPRTPVAADLIDPEFIQPVRTLTSVNSTQEQYDDETDVFDTVPSPDDAPDSESDAVAEITNDNEPEVDAEGPRNRRRKAVTPHWEDVLLGVRANTKRPKK

SEQ ID NO: 4428 - protein, 376 aa, Corynebacterium glutamicum
MTDFPTLPSEFIPGDGRFGCGPSKVRPEQIQAIVDGSASVIGTSHRQPAVKNVVGSIREGLSDLFSLPEGYEIILSLGGATAFWDAATFGLIEKKSGHLSFGEFSSKFAKASKLAPWLDEPEIVTAETGDSPAPQAFEGADVIAWAHNETSTGAMVPVLRPEGSEGSLVAIDATSGAGGLPVDIKNSDVYYFSPQKCFASDGGLWLAAMSPAALERIEKINASDRFIPEFLNLQTAVDNSLKNQTYNTPAVATLLMLDNQVKWMNSNGGLDGMVARTTASSSALYNWAEAREEASPYVADAAKRSLVVGTIDFDDSIDAAVIAKILRANGILDTEPYRKLGRNQLRIGMFPAIDSTDVEKLTGAIDFILDGGFARK

SEQ ID NO: 4429 - protein, 491 aa, Corynebacterium glutamicum
MEKRFPTMVWGMEHTSALTLIDSVLDPDSFISWNETPQYDNLNQGYAETLERARSKAKCDESVITGEGTVEGIPVAVILSDFSFLGGSLGTVASVRIMKAIHRATELKLPLLVSPASGGARMQEDNRAFVMMVSITAAVQRHREAHLPFLVYLRNPTMGGAMASWGSSGHLTFAEPGAQIGFLGPRVVELTTGHALPDGVQQAENLVKTGVIDGIVSPLQLRAAVAKTLKVIQPVEATDRFSPTTPGVALPVMEAIARSRDPQRPGIGEIMETLGADVVKLSGARAGALSPAVRVALARIGGRPVVLIGQDRRFTLGPQELRFARRGISLARELNLPIVSIIDTSGAELSQAAEELGIASSIARTLSKLIDAPLPTVSVIIGQGVGGGALAMLPADLVYAAENAWLSALPPEGASAILFRDTNHAAEIIERQGVQAHALLSQGLIDGIVAETEHFVEEILGTISNALSELDNNPERAGRDSRFTRFERLAQ

SEQ ID NO: 4430 - protein, 113 aa, Corynebacterium glutamicum
MNAEQITQGRRQPTAQEFRDMQASPEFGELRSKFRSFAFPMTVAFFLWYVVYVLVASFASEWMATPVFGAINIGLIFGFLQFVTTFVITYIYVMFANKNLEPRQAAIRQKMEG

SEQ ID NO: 4431 - protein, 551 aa, Corynebacterium glutamicum
MNSTILLAQDAVSEGVGNPILNISVFVVFIIVTMTVVLRVGKSTSESTDFYTGGASFSGTQNGLAIAGDYLSAASFLGIVGAISLNGYDGFLYSIGFFVAWLVALLLVAEPLRNVGRFTMADVLSFRLRQKPVRVAAACGTLAVTLFYLIAQMAGAGSLVSVLLDIHEFKWQAVVVGIVGIVMIAYVLLGGMKGTTYVQMIKAVLLVGGVAIMTVLTFVKVSGGLTTLLNDAVEKHAASDYAATKGYDPTQILEPGLQYGATLTTQLDFISLALALCLGTAGLPHVLMRFYTVPTAKEARKSVTWAIVLIGAFYLMTLVLGYGAAALVGPDRVIAAPGAANAAAPLLAFELGGSIFMALISAVAFATVLAVVAGLAITASAAVGHDIYNAVIRNGQSTEAEQVRVSRITVVVIGLISIVLGILAMTQNVAFLVALAFAVAASANLPTILYSLYWKKFNTTGAVAAIYTGLISALLLIFLSPAVSGNDSAMVPGADWAIFPLKNPGLVSIPLAFIAGWIGTLVGKPDNMDDLAAEMEVRSLTGVGVEKAVDH

SEQ ID NO: 4432 - protein, 272 aa, Corynebacterium glutamicum
MDVSRTSKVHPGWRVSTVLLAGVVIIGGIFTLPQKEEVKVSELQPQASAASIPSSSSTAGKAVEESPLTQFVENSTGSQITYMSLKDDFHTGTSTERFARPALSLSKLYIAEYVLEHGTNNEKSLAMEMIKDSSDVSAEILYEAYPESIEEIADQYGLLSTRGDAHWGYSVTSTYDLVKFVSALIIDDPDSPILEAMRNASAVAADGYPQDWGTAVLDEAEGSKWGWSDDLMLHSSVTFGEDYVVAAAVTGSKEDLTQLVENQLGEVVSQHG

SEQ ID NO: 4433 - protein, 280 aa, Corynebacterium glutamicum
MQINRRGFLKATTGLATIGAASMFMPKANALGAIKGTVIDYAAGVPSAASIKNAGHLGAVRYVSQRRPGTESWMIGKPVTLAETRAFEQNGLKTASVYQYGKAETADWKNGAAGAATHAPQAIALHVAAGGPKNRPIYVAIDDNPSWSEYTNQIRPYLQAFNVALSAAGYQLGVYGNYNVINWAIADGLGEFFWMHNWGSEGKIHPRTTIHQIRIDKDTLDGVGIDMNNVYADDWGQWTPGNAVDDAIPTIPGNSNTGTGTGIDADTINQVIKILGTLSS

SEQ ID NO: 4434 - protein, 2969 aa, Corynebacterium glutamicum
MSISSLTPLHSFKEPAILYAGQASAWQQVIADSSEDHITATHLRELLSRSRAKTAPFARQITAIVPGSLARLEELTREDAQIGADIDAQPAVSIPGILLGQIAATRQLRDLGLDVAAASRLGHSQGILGVEAVDNEEDVLAFAILLGAAASQFAGKGAHMLSVRGLSREIIQDTIAGVDGVEVSLRNARAHFVVSGKPEALKKAAAALQRAADVYNEDINEKRKGGSLAEPKFDYLDVAIPFHHSSMQDAADLAVEWATTCGLNVNARALAEAILVNPADWVEQIANLKADYVLSLDAGVSRFTAPLLDGRGISLVPAFSAAERDNLARPGFHVPTAEDWSEFAPKLVKLPNGEHKVLTGFSRLTGYSPIVLAGMTPTTVDPEIVAAAANAGHWAEMAGGGQYSEEVFTKNKEKLVSLLKVGRSAQFNSMFFDRYMWNLQFGAQRIVSKARATGTSINGVVVSAGIPEVEEATELINDLNADGFPYVAFKPGTVDQIRATLKIADANPETKIIIQIEDGHAGGHHSWVNLDDLLLTTYAELRSRKNVVVMIGGGIGTPAKAAYYLTGEWSTDLGFPAMPVDGILVGTAAMATKEATTSPQVKQALVDTPGVDPHDAGGWVGRGDARGGVTSGLSHLHADMYELDNDSAAASRLISSIDSDDYADHREELIEAINKTAKPFFGEVEEMTYAEWIQRWVELAYPTQDPTWDDRFLDLVHRIEARLNEAEHGAITTLFPDHASVENEEEAVEKLLAAYPQAREIQVSARDAAWFIGLCRKHHKPMPWVPAIDADLARWWGLDTLWQSQNERYGANSVRVIPGPVSVAGIDRVDEPVAELLGRFEAACVDALDGEPEEIFARLNESKNEREFLLATPHIVWHGNLIDNPAHVLNEGAFELIEEDGYWVIRILADSYFDDLPVEQRPYLVQHVDIPVELGDAVATGGSPVVSREKLPESVFALLAGVAGVGSVSAAGDEIKALPEAVQDGTPFGTVRDSFTLPASLLTAHTAVTGAALEAHNVGTPDVLMGACWPAIYAALGTGKLSDGYPVIEGLLNAVHLDHLLDLRIPLEELANGRTIDVEARTDSIEESASGRIVTVRIVLTTEGEVAAKLVTRFAIRGRITTNEMAAPADSYGARDEVVEATPRSFIRQATVSAPADMTPFAMVSGDYNPIHTSDNAAKLVGLDAALVHGMWLSATAQHLAGLGSEVIGWTYSMYGMVQLNDVVDITVERVGRAGLKPAYEVTCRIDGNVVSRGQALLKAPSTAYVYPGQGIQAKGMGQGDRTASAEARAVWERADAHTRANLGFSIQQVIDENPTELKVGDTTFVHPAGVLNLTQFTQVALAVVAYAQTERLKAANAIVDGSLYAGHSLGEYTALASLGNIFELEGVIDVVFSRGSAMHSLVPRDEKGRSNYGLAAFRPNMINVAATEVENWVDRVAEESGEFLQIVNYNVDGQQYAVAGTLAGLKALKASASANPRAYVNIPGIDVPFHSSVLRPGVPAFAEKLDELLPETIDIDALRGRYIPNLVARPFELTQSFVDAILAVVPSERLKGIKVEDTDENTLARLLLIELLSWQFASPVRWIETQALIIDTVDQIIEVGLAASPTLTNLALRTMDVIGKSRPVFNVERDQDTVMLNDVRQAPVAEVEEEAVEEAPAAAAAPAAEAPVAAAPVAAAAPAPVGNAPELKFNAANAIMVLFAVQNKINIDQITAADTSETLTNGVSSRRNQMLMDMSTELSVPTIDGAADADVATLQGRVVTAAPGYKPFGPVLSETVRARLRALTGAAGLKTSYIGDRVTGTWGLPESWTAHVEVELLLGTREGESVRGGNLGSLPANASSKGDVDALIDAAVQNVAAANGTSVSMSSGGAASGGGVVDSAALDAYASTVTGEEGVLANVARGILSQLGLDTKDEVEGAEIDTELYDAVEAELGTGWLKLVTPVFSADRAILFDDRWASAREDLARLANGEDIAVERFAGTGETVVKQAAWWAEHVEDTALAATLKQVSEVAAKPANEPHIDDVALVTGAAPESIAGAVAARLLSQGATVILTASNVSQARKEYARKLYAANATPNAKLWIVPANMSSYRDVDAVIDWIGNEQRVTVGSTVTVTKPALTPTLAYPFAAPSVSGTLADAGPQAENQARLLLWSVERTIAGLADLASRGVDGRVHVVLPGSPNRGMFGGDGAYGEVKAAFDAILAKWGSETGWPQFVSLAQARIGWVAGTGLMGRNDVLIPAAEKLGIHVYTPEEISSELLGLASAESREKALEAPIDYDLTGGLSGGVSIAALAASLESDAVETTSAAEDTIKALPSPKHPEQPVGTPVGEVKTDLEDMVVMVGVGEVSSWGSGRTRFEAEYGIQRDGSVDLTAAGVLELAWMMGLISWSEDPKPAWYDADGTEVPEEEIYERFRDEVIARCGVRELVDDAFLVDGGSLDAAEVFLDRDISFSVTSAEEAQAYVDADASVTVEEADGEWIVTKKKGSTSFVPRKATLTRSVAGQLPTDFDPAKWGIPASMIDALDNIAAWNLVTAVDAFLSSGFSPAELLQSIHPADVSSTQGTGIGGMQSLRKLFVNRFLGQDRPSDILQETLPNVVAAHTMQSYVGGYGQMIHPVAACATAAVSVEEGVDKIRLNKADFVVAGGIDDIQVESLTGFGDMNATADTQAMLDKGIDPRFISRANDRRRAGFLEAAGGGTVLLARASVAAELGLPVLAVVAHAQSYADGAHTSIPAPGLGALGAARGGKKSVLARELNKLGLTPDDVRVVSKHDTSTNANDPNESELHNLLWKTIGREADNPMFVVSQKSLTGHSKGGAALFQIGGLVSILETGKLPQNASLDCVDPEMEAKGENFVWLRKPLDLGAGSIKAGVLTSLGFGHVAAVVVLATSGIFEQAMRNAGLDVEAWRARATQRLRTGANRLEAGMVGRAPLFEQVDGRRLPEHGAHQAEINLLIDADARLGADGIYQG

SEQ ID NO: 4435 - protein, 163 aa, Corynebacterium glutamicum
MKLLKFAAAGTFALALAGCTQTESLVATIESATSAAQASGNDVEGDQTSAFELSVGECFNDTYEEEISEVPIVDCAEPHDNEIYYLYDIEGDDFPTDITTTGYEGCLPTFEGFVGAPYETSIYEVYPMTPTFGSWTNGDREVVCSVYLATGEQMTGTAAGTAQ

SEQ ID NO: 4436 - protein, 62 aa, Corynebacterium glutamicum
MVRVHGGQWKIMAGERTENLQISLVFYVDFGEKGGTLPYGTINYFSDSQDPTGLKRLFDISV

SEQ ID NO: 4437 - protein, 349 aa, Corynebacterium glutamicum
MLDNSFYTAEVQGPYETASIGRLELEEGGVIEDCWLAYATAGTLNEDKSNAILIPTWYSGTHQTWFQQYIGTDHALDPSKYFIISINQIGNGLSVSPANTADDSISMSKFPNVRIGDDVVAQDRLLRQEFGITELFAVVGGSMGAQQTYEWIVRFPDQVHRAAPIAGTAKNTPHDFIFTQTLNETVEADPGFNGGEYSSHEEVADGLRRQSHLWAAMGFSTEFWKQEAWRRLGLESKESVLADFLDPLFMSMDPNTLLNNAWKWQHGDVSRHTGGDLAAALGRVKAKTFVMPISEDMFFPVRDCAAEQALIPGSELRVIEDIAGHLGLFNVSENYIPQIDKNLKELFES

SEQ ID NO: 4438 - protein, 142 aa, Corynebacterium glutamicum
MLQSPKRAIGLSAALLTLTACGANDELSSYLTSIETATAQVSLNDIYNDQWSEFAVVCPYTPSDYAKAELDVGDTPWPDKWPDEQTNFLLLKSDTGEYKWVRYRRSNLDFCSEPRIDFTLFPTAATLEFTANDGWILESVHP

SEQ ID NO: 4439 - protein, 89 aa, Corynebacterium glutamicum
MTRYKPSFHDVQRRPIVVNQITKDSVPVLAVDEIQDDGTPRRIMLLNKYDAKQLSAACDRYLQEIFSATFAGVNTDLSPDDMAKLFGDE

SEQ ID NO: 4440 - protein, 79 aa, Corynebacterium glutamicum
MSNVTIYATDWCPYCRSLLKGLDGQEYDLIDVDQDEEAGEWVKSVNDGNRIVPTVRYSDGTHATNPLAAEVIAKIEALA

SEQ ID NO: 4441 - protein, 152 aa, Corynebacterium glutamicum
MIGAIWAQGRDGIIGDGTDMPWHIPEDLKHFKKTTMGQPVIMGRRTWESLPFKPLPGRENFILSSREPGDWSAGGTVVTEIPKSGWIMGGGEVYKATVGSADVLEITLIDATFDVSTPVYAPEIPANFNLDDESEWFTSGEYRYKFQRYIKV

SEQ ID NO: 4442 - protein, 266 aa, Corynebacterium glutamicum
MTVPTPYEDLLRKIAEEGSHKDDRTGTGTTSLFGQQIRFDLNEGFPLLTTKKVHFHSVVGELLWFLQGDSNVKWLQDNNIRIWNEWADEDGELGPVYGVQWRSWPTPDGRHIDQISGALETLRNNPDSRRNIVSAWNVSELENMALPPCHLLFQLYVADGKLSCQLYQRSADMFLGVPFNIASYALLTHMFAQQAGLEVGEFIWTGGDCHIYDNHKEQVAEQLSREARPYPTLELNKAASMFEYSFDDITVSGYDPHPLIRGKVAV

SEQ ID NO: 4443 - protein, 252 aa, Corynebacterium glutamicum
MTAQIDDSILTHRLAQGTGEILKGVRNVGVLRGRNLGDAGDELAQSWIARVLEQHRPNDGFLSEEAADNPDRLSKDRVWIIDPLDGTKEFATGRQDWAVHIALVENGVPTHAAVGLPDLGVVFHSADARAVTGPYSKVIAISHNRPPKVALSCAEQLGFETKALGSAGAKAMHVLLGDYDAYIHAGGQYEWDSAAPVGVCKAAGLHCSRLDGSELTYNNKDTYMPDILICRPELADELLEMCAKFYEENGTY

SEQ ID NO: 4444 - protein, 1520 aa, Corynebacterium glutamicum
MAKSILSRFRPQVAEWFRDVFASPTPVQEGTWEAVSKGKNALVVAPTGSGKTLAAFLWALDSLTEQTGQQVLDTGTPVPVRGGKVKVLYISPLKALGVDVENNLRAPLTGIARTASRMGLDVPNITVAVRSGDTPSAERARQVRKPPDILITTPESAYLMLTSKAGATLSDVDVVIIDEIHAMAGTKRGVHLALTLERLEKLVGRPVQRVGLSATVRPLETVAGFLGGGRPVEIVAPPAEKKWDLTVTVPVEDMSDLPVQEPGSTIGELVMDDPLGITGESALPTQGSIWPHIEQQVYNQVMSAKSTIVFVNSRRSAERLTSRLNEIWAMEHDPESLSPQLRRDPAQIMSSADVAGKAPQVIARAHHGSVSKDERATTETMLKEGRLRAVISTSSLELGIDMGAVDLVIQVESPPSVASGLQRVGRAGHTVGATSIGSFYPKHRSDLVQTAVTVQRMKEGLIEEIHVPKNALDVLAQQTVAAVSIKDVQVDEWYETIRKAYPYRDLAREVFDSVIDLVSGVYPSTDFAELKPRVVYDRVSGVLEGRPGSQRVAVTSGGTIPDRGMFGVFLVGDGPRRVGELDEEMVYESRVGDVFTLGASSWRIEEITRDQVLVTPAPGHTGRLPFWTGDAAGRPAELGKALGAFRRSTLTDPSSSGLEGWAHDNLIAFLQEQEESTGVLPDEKTLVLERFKDELGDWRIVLHTPYGRGVNAAWALAVGAKIAEETGMDAQAVAGDDGIVLRLPEGDEDPSAALFMFEAEEIETLVTEQVGNSALFASRFRECAARALLLPRRNPGKRAPLWQQRQRAAQLLDVARKYPSFPIILETVRECLQDVYDLPALKNLIEDLQLRKVRIAEVTTQQPSPFASALLFNYTGAFMYEGDSPLAEKRAAALALDPALLAKLLGEVELRQLLDPDIIAEVHQQLRRQGDRAARNNEELADSLRILGPIPLDELGEHITFENPDLEDRAMTVRINGREHLAQVLDAPLLRDALGVPVPPGVPAQVETITDALEQLVNRWVRTRGPFTANDLAEAFGLGIATAITALQSAPVIEGRYRQGVDVQEYCATEVLSIIRRRSLAAARKQTRPVSQSAFARFLLDWQQIAPVGATPELRGVDGTYTVIEQLAGVRLPASAWEDLVLPRRVADYSPIHLDELTSNGEVLIVGAGQAGSRDPWISLLPVDYAAQLVGEASTSMSPLQDAVLDQLRAGGAFLFSDILEENFGYTTAQLQEAMWGLVEAGLVSPDSFAPIRARLASGTTAHRAKRRPARSRLRTRTSFASDVPPDMRGRWTLSVQPADATSRSVAHGEGWLDRYGVLTRGSVVAEDIVGGFALAYKVLSGFEESGKAMRGYFIEGLGAAQFSTPAIIDRLRGHDDSPDVEGWPSGATDPDVYLIAAADPANPYGAALPWPEQGPSRAAGAMVVLCDGLLLAHLTRGGRTLTVFSDNIPKIATALITYERLTVEKINGDNVFDSPLLEQFRKHGATITPKGMRFRPPVARETPSDTLPTRTFRGGFGRR

SEQ ID NO: 4445 - protein, 256 aa, Corynebacterium glutamicum
MPEGDSVFQLSRKLQFMRGREVLETSLRVPSVALHDFTGQTVNRVWPYGKHLFMQFGEEILHTHLKMEGTWAVHRKGDRWRKPGHTARVVLVLSENIEVVGHSLGFVRVFPANRYSEEIAYLGPDVLAEEFDINTARNNIASNPSRTIGEALLDQSNLAGVGNEYRAEICFLMGVHPATQVGYVDVEKALKITRRLMWENRNSPIRVTTGVRRAGESTYVFGRNNKPCRRCRTPIVKAELGERIIWWCPRCQPLNS

SEQ ID NO: 4446 - protein, 136 aa, Corynebacterium glutamicum
MRLILNLIWLFFGGIWLALGYVFFGIIACIFIVTIPAGIASFRMANYALWPFGRTVVRNPKAGGFSALSNGLWFIIAGLWLAIGHLTTAAAQAITIIGIPLAIANIRMIPVTCFPFGKEIYDSNRIPFGYEPMVKF

SEQ ID NO: 4447 - protein, 200 aa, Corynebacterium glutamicum
MILDWVISIMEALGAVGVGVAVFLENVFPPIPSEVVLPLAGFTTTQGDLNVWAALMWSVIGSVSGAFLLYGLGRSIGAARLRQVADWMWLVDATDVDKSLSWFEKYGKYSVFFGRLVPGVRSLISIPAGVDKMNPVLFGVLTAVGSTIWNAVLIWTGVWLGAEWETVSMWFESYSTIIYVGIALIVAYVLFVLVRRRIKT

SEQ ID NO: 4448 - protein, 391 aa, Corynebacterium glutamicum
MKNPRLIALAAIILTSFNLRTAITALAPLVSEIRDDLGVSASLIGVLGMIPTAMFAVAAFALPSLKRKFTTSQLLMFAMLLTAAGQIIRVAGPASLLMVGTVFAMFAIGVTNVLLPIAVREYFPRHVGGMSTTYLVSFQIVQALAPTLAVPISQWATHVGLTGWRVSLGSWALLGLVAAISWIPLLSLQGARVVAAPSKVSLPVWKSSVGVGLGLMFGFTSFATYILMGFMPQMVGDPQLGAVLLGWWSILGLPLNILGPWLVTRFTNCFPMVVIASVMFLIGNGGFCLAPDVAPWLWATLSGLGPLAFPMALTLINIRAETSAGASALSSFGQGLGYTIACFGPLLTGFIVDATGSFRTIFVLFAVATLFVIRGGYFATRQVYVEKLLNR

SEQ ID NO: 4449 - protein, 239 aa, Corynebacterium glutamicum
MLSVSIPNSATFSALVDTATKCFATASSPSFSTSQARAARALDSVSWVVKVFEAITNNVDSASRSSNTETRSAGSTLETNSAEIPAVAYARRAFVAMAGPRSEPPIPMLTIFLIVWPVCPNQLPERSAVAKSRMRPKTSWTSAATSWPSTDRSASAGRRSAVWRTARSSVLLRCSPANIASMRSRRPDSSVSARSLVRVASSSRFFDRSTWRPAAEKVYFSARFSSLKSSRRVVAWKFE

SEQ ID NO: 4450 - protein, 540 aa, Corynebacterium glutamicum
MADISTTQVWQDLTDHYSNFQATTLRELFKEENRAEKYTFSAAGLHVDLSKNLLDDATLTKLLALTEESGLRERIDAMFAGEHLNNTEDRAVLHTALRLPAEADLSVDGQDVAADVHEVLGRMRDFATALRSGNWLGHTGHTIKKIVNIGIGGSDLGPAMATKALRAYATAGISAEFVSNVDPADLVSVLEDLDAESTLFVIASKTFTTQETLSNARAARAWLVEKLGEEAVAKHFVAVSTNAEKVAEFGIDTDNMFGFWDWVGGRYSVDSAVGLSLMAVIGPRDFMRFLGGFHAMDEHFRTTKFEENVPILMALLGVWYSDFYGAETHAVLPYSEDLSRFAAYLQQLTMESNGKSVHRDGSPVSTGTGEIYWGEPGTNGQHAFFQLIHQGTRLVPADFIGFARPKQDLPAGERTMHDLLMSNFFAQTKVLAFGKNAEEIAAEGVAPELVNHKVMPGNRPTTTILAEELTPSILGALIALYEHIVMVQGVIWDINSFDQWGVELGKQQANDLAPAVSGEEDVDSGDSSTDSLIKWYRANR

SEQ ID NO: 4451 - protein, 392 aa, Corynebacterium glutamicum
MEVPSLFTNFFAVNNPDSPPARQKTKLRELEHRFWQEHLPGDDDDHSTAISSLAIVTGLTKAQVSRISIAFATLADLPELKALQQKLYHLDLSRLITISNELAGINPDNLAGADAILTEYLTATSPNQILPSPASIGRKIKEIRDLLDDARATGSRGTQDDSSFGVTFSPDGTAEIGASVDAVDGHIINDAVTQHAKKNDLTYGEAFSDILRNNIQVKVVLNLYTAKDLANAPVWASGIGWLDAKTGTFWSEKANKEQDMDAAAKISTDKHDPPPALRDALIGRDGTCRFPGCSVPALKTQADHRIPYEEGGETCLGGIGCLCQHHHNMKTDGRVTYLLDPFSGIIVWLMGDGTWAVSEPNGPLNPKNARWAQTVAQHRARHHKRWVKEDAK

SEQ ID NO: 4452 - protein, 127 aa, Corynebacterium glutamicum
MDNLSEFSASHAQQNSSEGRAFLADLFTELVDDCYFSGVHETCSARAHACFSDGLGNLRAAFHRIEDFAVQAVDLLAILLDLRIGQWVIRARRHPDLEVVTCISHAHYSATSGCRLCVSTPPSRLLG

SEQ ID NO: 4453 - protein, 103 aa, Corynebacterium glutamicum
MCMTNAGDNFEIRMPSGTDDPLSDAEIQKYREEINRLDREILDAVKRRTKISQTIGKTRMSSGGTRLVHTREVAIINQFREEIGEEGPALAGILLRMGRGKLG

SEQ ID NO: 4454 - protein, 763 aa, Corynebacterium glutamicum
MNTSPFTPGSPDLIDGLNEQQRAAVEHIGSPLLIVAGAGSGKTAVLTRRIAYLMRYRGVHPQQILAITFTNKAAAEMRERVSQLVGPVAERMWVATFHSVCVRILRQQAQLVEGLNTNFTIYDSDDSRRLLTMIAKDLELDIKKFSARTLLGAISNLKNELVTPQEALADAERTHNPYETVVARAFSEYQSRLRRANAVDFDDLIGETVRIFREHPPVAEYYRRRFRHVLIDEYQDTNHAQYELISTLVGKPDQDPSELCVVGDSDQSIYAFRGATIRNIEEFERDFSNARTILLEQNYRSTQTILSAANAVISQNENRRPKNLWTALGEGEQIIGYVADNEHDEARFIASEIDNLVDHGMSYSDIAIMYRTNNSSRALEDVFMRTGVPYKVVGGTKFYERKEIRDIIAYLRVLENPDDTVNLRRIINTPKRGIGDRAQAFIALHSENNQISFGQALLDAALGKVDLLGARGKNAVIKFNELFDALRSELPTMVNEVTGLPDIGQVISRILDITGYKAELEASNDPQDGARLDNLNELVSVAREFSSDAANRMVNEVPEGEAQPGSLQAFLERVSLVADADQIPDSDNGVVTLMTLHTAKGLEFPIVFLTGWEDGQFPHLRSLGDAKELAEERRLAYVGITRARKRLYMTRAMLRSSWGNPVTNPPSRFLQEVPAELIDWRREEPQMSSAWAPRPTRSIPTKTRTNNKQLDLSVGDRVNHDKYGLGTVLSSDGSGPRATVTIDFGSSGKVRLMLLGGVPMEKL

SEQ ID NO: 4455 - protein, 741 aa, Corynebacterium glutamicum
MTTLLAATRPTLRDAFKHPWRSLAAILLVAVPMFLVSFFLTYDQSINNAASYPGSQVQAHYDGEGAYQLLQENLPEDFHLELFANGYPEVSFGDEEVNFFVVQSTNVQQASFPADALDVLGATIGDTVTIHGTPVEVQSISPTNILLPEGTLFSLENFSESETFSGTWYFPGSNFTEENRQALEAVGFEVNEYRRGPISVDPNLIPSYIMGFLSTTILAVVALMLISPVFTISASRQTRTFALLASQGATPRHIRWAVLTYGLFAGLVGASIGLVLGQIGIYGWWKYTYPEFSLTTPWLVLVGFWALAIIASTIAAFLPAVFVSRSSIINGIYGGISDKIIRWSPRMLIGPIVLIAAAVIALFIGDGEWGGVVKQLCFLAAVIALPASVPAVLWALGRLPGLTFKLATRDMLRRSMHSIPAIGALAAVIMLGTFMQTTGLATQASDREATASVYPEAVFLRGDTQIPGLMGQKIDVYGDNHGFGIYELDVDFYSANYVPALTSFFGGPVIATPKILDMFGVHEQADIYAPSTYNSGLQEYAIYPGDETYMLDTAAVLPPLYSHVLLSPETFEEIGGQTEFLGTIVLPQELDDQTVQAINRSRDAHFSHDGHNSSLASSAALTAVAIVVVSLVIVLANRKLQQHALIAIGATPGTIYKVNALNAALLALVGGIMGLVSGWIAALLTGTTDEIVDGAILNYGTLEHMMLPWPLLVSLLVVAPLVCAVIGAIASPSGRHQEASI

SEQ ID NO: 4456 - protein, 222 aa, Corynebacterium glutamicum
MTNTPFPLELQNISCAFGEGPRHVSALNNVSLAVNPGELVAIMGPSGSGKSTLLNVAGLLQRATSGHVLIDGASASDLNAKRAAETRRRHIGVIFQNYNLVPTLTVGENVGLPLELDGKTDRQAVAIALAEVGLEGFDDRFPEEISGGQAQRVAIARALIGPRKILLADEPTGALDTSTGDAVLRVLRQRIDSGAAGLLVTHEPRFAAWADRTIMLRDGEIQ

SEQ ID NO: 4457 - protein, 169 aa, Corynebacterium glutamicum
MSIKHALLVLMLDEPTSASQLQTKFEETMGIWQLNIGQVTQTIQRLQRDGLAETAGTTVSSNGRTVDTFQPTDLGRELVAQWFESPVTVTLSERDELVTKIAIAESRGLNLIPLLDIQRNTVMAELRALNKSSRDLAETRNTQRLLVEKRIFELEAQARWLDRIEALEQ

SEQ ID NO: 4458 - protein, 237 aa, Corynebacterium glutamicum
MQKHTRGGKHRKQTTSPVTKGGVAFVAVATGAVSTAGAGGAVAAQASNQPVEVNFELTANDTTDLVAGSSAPQILSIAEFKPVVNLGDQIVKTIQYNADRIQADLDARGPSVVRPAEGSYTSGFGARWGTNHNGVDIANAIGTPILAAMDGTVIDAGPASGFGNWVRLQHEDGTITVYGHMETVEVTVGQTVKAGERIAGMGSRGFSTGSHLHFEVYPAGGGAVDPAPWLAERGITL

SEQ ID NO: 4459 - protein, 475 aa, Corynebacterium glutamicum
MSKKNSSQTRPGQIRRRRPKPQAPAQTPQKAAQQSKLLRFLPTVLIPHGVAVLLVIILAVASLMFTNSSMVNLSATIAQLWLSLNLGAVDGSGEVISVLPTLPGFIFLWAIAARIHRAVKDRVSIADLGVLAALVLGIPLALTAIAAFMLFDASSVLNVEVPPITRLLRVMLFHLSALFLGMGPRLWQALARRYGAPEWLIDAITQAFRFLIAFGTVSLVSVLVMTAINHSAFTATMQGYDDSASVVALIVLSILYLPNMMIFAMGNLIGSPLYFGDASISVFSVHSVPLPPLPILAALPSEALSWAVALLVIPAIIATWVCVRNPMRLAVNTTAAVISALCFLVLAVFAGGTLGVYNYVGLNLLASVGLVFVYFALVGLLIAGIDKLRNPVEVKSVKAVAVVEPEPEEVEEDEEEHVEEEVDEEEEEVEEGVEEVEEDDAEDPEENPEEEESDEEIETETEAEETNDGSEAEDR

SEQ ID NO: 4460 - protein, 76 aa, Corynebacterium glutamicum
MEGNAATLIAELPSVAFAQVLAVLAGDVGSDRVVSANYFSCSSINNCATNTDSFGDGTSESNTVRKVLLFAQFAKK

SEQ ID NO: 4461 - protein, 209 aa, Corynebacterium glutamicum
MVPRPKTVNISVVNSDSTTTIVVLASGTGTLLQSLIEAQGTYSIVGVVSDVECPALSRAADAGIDTAVVPLGKDRAQWNHELADAVAVSDPDLVVSAGFMKILGEGFLSRFPSRIINTHPALLPSFPGAHAVRDALAYGVKVSGSTVHLVDAGVDTGPIIAQRAVPVEVNDDESSLHERIKQVERKLIVEVLNSVEFSRQGGVQLNWRG

SEQ ID NO: 4462 - protein, 520 aa, Corynebacterium glutamicum
MSDDRKAIKRALISVYDKTGLEDLAQALHRENVEIVSTGSTAAKIAELGIPVTPVEELTGFPECLEGRVKTLHPKVHAGILADTRKEDHLRQLKELEVAPFQLVVVNLYPFAETVASGADFDACVEQIDIGGPSMVRAAAKNHPSVAVVVSPNRYEDVQEALKTGGFSRAERTKLAAEAFRHTATYDVTVATWMSEQLAAEDSETEFPGWIGTTNTLSRSLRYGENPHQSAALYVGNTRGLAQAKQFHGKEMSYNNYTDSDAAWRAAWDHERPCVAIIKHANPCGIAVSDESIAAAHREAHACDSVSAFGGVIASNREVSVEMANQVAEIFTEVIIAPSYEEGAVEILSQKKNIRILQAEAPVRKGFESREISGGLLVQERDLIHAEGDNSANWTLAAGSAVSPEVLKDLEFAWTAVRSVKSNAILLAKNGATVGVGMGQVNRVDSARLAVDRAGAERATGSVAASDAFFPFADGFEVLAEAGITAVVQPGGSIRDNEVIEAANKAGVTMYLTGARHFAH

SEQ ID NO: 4463 - protein, 273 aa, Corynebacterium glutamicum
MSELICGPAILFAPAGRAEIIPKAASKADMVIIDLEDGAGEVDREVAYRNIRESGLDPKRTIVRTVGPSDPHFLADVEMVKSTDFTLVMVPKLLGSVPEELDGLNIIAMIETPQAATSIPQIAADPKVVGMFWGAEDLTHLLGGTHSRFLGDESNEGSYRDTMRLTRALMHLHAAANGKFTIDAIHADFHDEEGLYLEAVDAARTGFAGTACIHPKQIEIVRRAYRPEANQLEWAKKVVEEAENHPGAFKLDGQMIDAPLISQARMVISRQPA

SEQ ID NO: 4464 - protein, 222 aa, Corynebacterium glutamicum
MAGAVGRPRRSAPRRAGKNPREEILDASAELFTRQGFATTSTHQIADAVGIRQASLYYHFPSKTEIFLTLLKSTVEPSTVLAEDLSTLDAGPEMRLWAIVASEVRLLLSTKWNVGRLYQLPIVGSEEFAEYHSQREALTNVFRDLATEIVGDDPRAELPFHITMSVIEMRRNDGKIPSPLSADSLPETAIMLADASLAVLGAPLPADRVEKTLELIKQADAK

SEQ ID NO: 4465 - protein, 109 aa, Corynebacterium glutamicum
MVVNIRENLMIPTVKIARWAAHKAGSLAPTTAQRLVDARGVLTNDEVDALTQVWTSALSLQSKRWMDHIHDQETTAWELPALQRATFGASARLLSEVLRSVEAREIDTK

SEQ ID NO: 4466 - protein, 107 aa, Corynebacterium glutamicum
MKPTSVNSAEIFSFGSSWLSTTASHLTGEVGSASPRPTGPVSTTWASKPGECKTSVITCDSHPASSAGSSPWFSALPNKSSDSFSTPRTVAKSCASGAASASSVNEG

SEQ ID NO: 4467 - protein, 83 aa, Corynebacterium glutamicum
MKQRNNAKRVRLEQTRRPKKNPLKAAGIEKVDYKDINTLRQFISDRHKIRSRRVTGLTPQQQREVATAVKNAREMALLPFTSR

SEQ ID NO: 4468 - protein, 101 aa, Corynebacterium glutamicum
MAKKSKIAKNEKRKEIVARYAERRAELKAIISNPNTSDEDRLDAQFELNSQPRDAAAVRVRNRDSHDGRPRGYLRKFGLSRVRMREMAHRGELPGVRKSSW

SEQ ID NO: 4469 - protein, 54 aa, Corynebacterium glutamicum
MARNDIRPIIKLKSTAGTGYTYVTRKNKRNNPDRISLMKYDPVVRKHVEFREER

SEQ ID NO: 4470 - protein, 78 aa, Corynebacterium glutamicum
MSAHCQVTGRKPSFGKSVSHSHRRTSRRWNPNVQRRKFYVPSEGRTITLTVSTKGLKVIDRDGIEAVVAQIRARGEKI

SEQ ID NO: 4471 - protein, 537 aa, Corynebacterium glutamicum
MRDLLPSRDDYQLLRFSWKMDIAAGVTVGIVALPLALAFGVSSGVGAEAGLVTAIIAGLVAAIFGGSNVQVSGPTGAMVVVLAPIVAQYGVGAVALLSLMAGVIVLVAGVLRLGRTVSFIPWPVIEGFTAGIGVIIFLQQVPAAFGYSGHLPTNALLAAIHTVSHATKDAILPLLIIIVTAAIMIVLGKIAPKLPASFIAILVVSIGVALLKLPVELIGELPNSLPAPHLPDVNLEMFTSLLGPAFAVAALAAIESLLSARVAASMADTGPYNADRELVGQGLASISAGFFGGMPATGAIARTAVNVRSGGRTRIASIIHALVLLGVVYVAANIVAVIPLAALSGVLMVTASRMVSIEVISRVMRSTRSDAIVFVITAIVTISVDLVIAVGIGIAVATFFMLRRMSMNAGVFRETLPEPATLNDEKIGLFRIEGALFFGAAERLSQQILDYEDLEVVILRLSHIQMIDATGAHQLTELVNALERKNVTVLIKGVRKEHIHVLGVLGAIRSLRHENHLFDDLAPAVEHARKHVKIDNS

SEQ ID NO: 4472 - protein, 104 aa, Corynebacterium glutamicum
MLSSKDLPIYQRKADLFKGLAHPYRIRALEIIATNNEVSVGQITKEMDLEASHVSQHLKVLRKFGLVSSQREGLVVYYRLTYPEVADFLKVSRSLLKRMAGEDA

SEQ ID NO: 4473 - protein, 88 aa, Corynebacterium glutamicum
MKKDIHPDYHAVVFQDAGTGFQFLTKSTASSDRTVSWEDGNEYPLIVVDVTSESHPFWTGAQRVMDTAGRVEKFERRFGGMARRKKKA

SEQ ID NO: 4474 - protein, 57 aa, Corynebacterium glutamicum
MAVPKRRMSRANTRMRRSQWKADNVALQEVKIDGQTVRIPRRLVKAAQLGLVDVEQF

SEQ ID NO: 4475 - protein, 149 aa, Corynebacterium glutamicum
MRGTYGALELPLFSLLCLLLAASHATEATLELLNTTSGVHDTLSAGPEWVRLAGDVNDDQWVLVTIFPGHGAVAGSGGLGQELEASTCVLEDYRMVVRVDILFHLLSIPSGLKLQVGSSGCQIVPELGSVSMHHHDLAMNLQYLTPVAL

SEQ ID NO: 4476 - protein, 232 aa, Corynebacterium glutamicum
MKILVVDDEQAVRDSLRRSLSFNGYNVVLAEDGIQALEMIDKEQPALVILDVMMPGMDGLEVCRHLRSEGDDRPILILTARDNVSDRVGGLDAGADDYLAKPFALEELLARVRSLVRRSAVESNQSSSIEQALLSCGDLTLDPESRDVYRNGRAISLTRTEFALLQLLLKNQRKVLTRAQILEEVWGCDFPTSGNALEVYIGYLRRKTELEGEDRLIHTVRGVGYVLRETAP

SEQ ID NO: 4477 - protein, 455 aa, Corynebacterium glutamicum
MSLRWRLALLSATLVAFAVGVITVAAYWSVSSYVTNSIDRDLEKQADAMLGRASEAGFYATAETEIALLGEYASDTRIALIPPGWEYVIGESISLPDSDFLKSKEAGKQILVTSAERILMKRDSSGTVVVFAKDMVDTDRQLTVLGVILLIIGGSGVLASILLGFIIAKEGLKPLSKLQRAVEEIERTDELRAIPVVGNDEFAKLTRSFNDMLKALRESRTRQSQLVADAGHELKTPLTSMRTNIELLLMATNSGGSGIPKEELDGLQRDVLAQMTEMSDLIGDLVDLAREETAETSSIVDLNQVLEIALDRMESRRMTVRIDVSETVDWKLLGDDFSLTRALVNVLDNAIKWSPENGIVRVSMSQIDKATVRIVIDDSGPGIAEKERGLVLERFYRAVSSRSMPGSGLGLAIVNQVVNRHGGQLVVGESDDGGTRITIDLPGEPIRSGFENVDD

SEQ ID NO: 4478 - protein, 413 aa, Corynebacterium glutamicum
MRSSYPQWGNTASNQNPYPGAGFGSEQNTQQGNEQQAPAWTSWDNQPLSTDVKPAKEKRKVGIGTALALMLVGSIATGSVVGVAATQLGSDSSTPVNALEQPSVQRTTNAEPGSAEQVAAAVLPSVVSIQAITRTSASEGSGSIISSDGYVMTNNHVVAGIEQSGVLEVSFSDGTTAQADFIAGDPSTDIAVIKIRDVSNLPVMSFGDSDALGVGQSVMAVGSPLGLSSTVTTGIVSAVNRPVRASGDGGESSLIDAIQTDAAINPGNSGGPLVDMDGNLIGMNSVIASISSTSDSAGSIGLGFSIPSNFAKRVADQLISTGQVTQPMIGVQVGTDNSVTGAVIASVQDGGPAADAGLQPGDIVTKLNDRVIDSPDSLIAAVRSHDFGETVTLTITQPDTSQSREVEVTLTSE

SEQ ID NO: 4479 - protein, 195 aa, Corynebacterium glutamicum
MSKDPLGSLTDVVDTRVPLPDVEPDPEFLKATEKEFHMASQKRALVVLVGDHVAEADGTGRLVTELLLESGFNVDAVVSVKSKKSQIRQAIETAVVGGADLVLTIGGVGVGPRDKTPEATSAVLDQDVPGIAQALRSSGLACGAVDASVSRGVAGVSGSTVVVNLAESRSAIRDGMATLTPLVDFVVDQLRTSVV

SEQ ID NO: 4480 - protein, 66 aa, Corynebacterium glutamicum
MSWSGVSRQRRRAFRASDAKDYDRTADSPLESTTNDDVREVSLDPEQDDQPTGEEFWKEQQPPHHG

SEQ ID NO: 4481 - protein, 135 aa, Corynebacterium glutamicum
MLKGFRDFVLRGNVIELAVAVVIGTAFTAIVTAFSESIINPLIASIGSTEVEGLGFHIRAGNAATFVDFGAVITAAINFLIIAAIVYFVLVAPMNKLSETLAKRKGVEEDETPASIEAELLTEIRDLLQEQKRLQ

SEQ ID NO: 4482 - protein, 217 aa, Corynebacterium glutamicum
MDLKKTFTTPSWHRTLVLRRIIAFILIGIAGLLMAHSWLKKDPTAVVIVQEIPAGTKVEASDLGLQAIPTSLLPSTSYDSIDDVVGLVAASTLSSGEIATKPRFVGTELINSIATNVTDSSLVEEINMVPLSLAEPSVIPLLQHGDTISVVSQDPDTGLPENIAAGGTVILAGGTDPSTILIALPQSIAEKVAAQSLNTPLAVVLTGDRADNYTTEE

SEQ ID NO: 4483 - protein, 190 aa, Corynebacterium glutamicum
MSQTKQELRTKLREARTNMDEASRTRENAAIIANVSYYIRSKQPKRIAAYVPVRTEPGGRLLLDALHAETSALILPVSLEDRRLDWALYEGPTSLVPGAFGIQEPGGTRLGPEALNFCDLVIAPALACTPSGIRLGKGGGFYDRALATGVKADVITLLFNGEIRDDIEVEEHDLPVNVIITPAGVRNLGA

SEQ ID NO: 4484 - protein, 299 aa, Corynebacterium glutamicum
MPAAGLGTRFLPATKTVPKELLPVVDTPGIELIAAEAAELGATRLAIITAPNKAGVLAHFERSSELEETLMERGKTDQVEIIRRAADLIKAVPVTQDKPLGLGHAVGLAESVLDDDEDVVAVMLPDDLVLPTGVMERMAQVRAEFGGSVLCAVEVSEADVSKYGIFEIEADTKDSDVKKVKGMVEKPAIEDAPSRLAATGRYLLDRKIFDALRRITPGAGGELQLTDAIDLLIDEGHPVHIVIHQGKRHDLGNPGGYIPACVDFGLSHPVYGAQLKDAIKQILAEHEAAERIADDSQVK

SEQ ID NO: 4485 - protein, 419 aa, Corynebacterium glutamicum
MRSVEQQLSIVTEAAVAPEPVRIAIAEALGLMCAEEVQASRALPGFAQAAIDGYAVRAVDVGGEKSLSQQLPVAPPEKSLPVVGEVAAGSQQPLRLQPKQAVMVHTGAPLPMLADAVLPMAWSDRGRKRVTAQRPVRSGEFVRKEGDDIQPGDIAVSAGAVLGPAQIGLLAAVGRSKVLVYPRPRMSVISVGAELVDIDRQPGLGQVYDVNSYSLAAAGREAGADVYRYGIAAGEPRRIKEIIESQMLRSEIIVITGAVGGAGSAGVRQVLNELGDIDTERVAMHPGSVQGFGLLGENKIPCFLLPSNPVASLVIFETFVRPVVRMSLGKSNAARRVVRARALNHVVSVAGRKGFIRSRLMRDAETQDYLVEALGGATGAPSHLLAGLSEANGMIRIPEDVTEIRPGDVVDVIFLAQGR

SEQ ID NO: 4486 - protein, 220 aa, Corynebacterium glutamicum
MRNAPSGPTHFRHPGWPESTQTVILPDGGRLRLRPLKRRDFRAWSDLRMRDKEFLKPVEPTVPTSWSEAHSRLSWWDNITYLMRAARKGTVVPMVIELDGRFVGQLTIGNIQHGGISDAWIGYWVSSAVTGRGIATAACALGVDHAFRRIGLHRLTATYLPSNPASGKVLGHSGFRPEGYLIRNLHIDGQWMDHHFVALLADEYSITAVERLTREGRLRR

SEQ ID NO: 4487 - protein, 340 aa, Corynebacterium glutamicum
MLHVSGILVIGLIVVVWLVVLAPLLLRGQKPIAKAGEAFDDTRVISEGGSNIPSPRRPGLSSAQLDDEEDTDDVDDDYEIVDSPSIFRPRKEEPVEEDLDTDVELEEDIEVSLETDDYVEPAPVVEVSQEWNVEDHYELDDSYDTPLDHLHPAARARAYEDFQEHQPEQQPEVEEFDADDELTEEDVAFAQRRRGRGYYDPEADREFAASQYVRRQRTLLGLAATVVISVILGFVFGGWVWGLPAVALAATALYLMALRSQVREENALRARRIRRLRRSRMGVRNSEDLPSRLRRPGAVVLELDDESPDFEGLPTVAMPEEPYYEEPRRNIRHLGQRRVS

SEQ ID NO: 4488 - protein, 400 aa, Corynebacterium glutamicum
MSGTSPKLKVFTFLAVLVAAFNLRSAIVSVGAVLDDLVHDFGASGSTAGIITAIPGIAFGIFGVAAVPLAKKIGLSGALTSGMIVGLIGLSIRPWVGNIWAFIFLTGFVVMGIAVANILLPAWIKLHGGKSTVALMTVYTTVLGVGSTLGPLSTLLFSGSNAWRWAIFIWALPAVLQVAIWLPMWWDKKYDFPAETVKSGSTGKIWTSPTAFFIMLFFGLQSMNAYIQMGWLPKIFIDAGVSPAHASIGLSIVGIMGIVGGFTMPVAIARTRDKNLVWFPVVFGASMFLGYVGTWLWPSQGWYLWSFLLGLGGLCFPMAIALIPARTKDPRITASLSGFVQPVGYILAALGPLAVGAIYQAIGSWSEILVGLALGTVVLSIVGFRAARNVTVDDELRRSK

SEQ ID NO: 4489 - protein, 473 aa, Corynebacterium glutamicum
MVNPPTMPMMPTIDNPIEACAGLTPASIKILGSHPIWIYAFMDCKPKNSMMKNAVGDVQIFPVEPDFTVSAGKSYFLSHHMGSQIATCKTAGSAQIKIAQRHAFDPLNSNVDNGPKVDPTPSTVVYTVINATVLLPPWSLIHAGSKMLATAIPITTKPVRKINAQMLPTHGRIDNPMSPTIIPDVSAPLSPIFFAKGTAATPKMPKAIPGMAVIIPAVDPDAPKSWTRSSSTAPTDTMAERKLKAATRTARKVKTFSFGEVPDIVRNLTLWLAHATLTQVSNVSTWLLVVRFLRHCHRWEAFEIWRFIIKLEDNCTWTTQTGRKVFRVSYTHPGAAEPADSTSAKSILLTNLTAQSHQVQCGRSQCYCWQSPDPTAKDESENYRDNDCGCKTQQGALAANILGGSELTVSLWVVVATATSTLCKGNIFFSQLIVCIKFFDLRLLLRLVFLEVLICTSPCSWVQVIKRGVVGII

SEQ ID NO: 4490 - protein, 135 aa, Corynebacterium glutamicum
MDKPVVRDAALLIFRAVLGVIFVAHGWEKLFISGVTKTTGQFSAWGVPQPKLSVWITSISELLGGAFLVVGLLTTFVAGALALLIAAAIYFVHLSSGFFTVENGIEFPLLIIVSLLVIVVFGSGRASVDGVLTRG

SEQ ID NO: 4491 - protein, 238 aa, Corynebacterium glutamicum
MCLVLVEPALMGCSRVVDCSAIQAALSAKLDGEPTGLDDAVIEAHLANCEECRNYYNRAAELNRMLNFCAAEPRTLTPPDLSEIILAEVEPEWRRHANAKVVGSLLSRVLLVILGVVYLAWGITMLGDSASISVQEDPLTSRLLAEAVAYRIALSVGLLFAAWKPRIIAGMLPIFGTLWTFSAGFAARDLVFGVADSQTGLSIGLLLISTIVLSFALVNSSGPGILRRTWNSLNAAPG

SEQ ID NO: 4492 - protein, 389 aa, Corynebacterium glutamicum
MGGMSFAEHAIIWHVYPLGALGAPIRPEAPAPVTHRLPNLIGWLDYVVELGCNALMLGPVFESVSHGYDTLDFYRIDPRLGTEEDMDALLEAANQRGIGVLFDGVFNHVSSSSKYLDLTTGASFEGHDILAELDHTNPAVVDLVVDVMNHWLDRGIAGWRLDAVYAIAPEFWEKVLPEVRRKHPHAWIVGEMIHGDYSDYVKSSGIDSVTEYELWKAIWSSIKERNFFELEWTLSRHNEFLDTFVPQTFIGNHDVTRIATRIGQSNAILAAAILFTVGGTPSIYYGDEQGFTGLKEDNVFGDDAIRPPLPAEFSPLGTWIENIYKALIALRRQHPWLYQAHTEVLEIANEAMTYKSVGLGGEELTVHLDLEEVSVRILDGEKVLFQYSA

SEQ ID NO: 4493 - protein, 520 aa, Corynebacterium glutamicum
MSQALPVRDQGRDQGIFAGTLPPAPPKFKWTRLDTYTWAIIAVFALVTRFTGLSSATASGTPVFDEKHYVPQAWDMVRSWINPITGGIESNPGYGLVVHPPLAKQLEALGEWVFGYTPLGWRIMVAIFGTLTIFAIMAIARRLSGSTMVTFIAGILALADGVLLVSSRFGMLDIFLVFFITAAAWALIRDHQQMHQRLNDLLLTNGQITKDFGPRFGFRWWRFTTGVFLGLALSVKWSGLYYIAFFGLTSVFLDLWLRKRYGVRRYVTGTLKNDVIPALGSLVIIPALLYIWSWRAWFASETSVYRHAKTDGTITEDSILQLFPESIAGWIHYHISVLEFHGSLTTSSGHSHPWDSKPWAWLVSGRPILYFSSTDISCDVGGTCRRMIYLFGTPAIWWLTVPVILWALWSFFARRSRGYVVPLVAFAAGFLPWLAAYDRQMYFFYATALVPFTIIMLALACGELWGRGKMTPTGLTRGSMAVVTYISLVVMMFLAFSPLFYGFVIPDYVYESLMWFPSWR

SEQ ID NO: 4494 - protein, 275 aa, Corynebacterium glutamicum
MPTGIIIAATPLGNIGDASPRLVHALANATVVAAEDTRRTASLAAALGVEIKGQLVSNFDHNEQARVGKLIEAARTGTVLVVSDAGMPVVSDPGFALIDAAHDANIPVTCFPGPSAVPTALALSGLHVGRFAFDGFAPRKQGARTTWLESLKTEKRAVCFFESPHRIAETLAHAAEVLGERRVAVCRELSKTYEQVKRGTLPELAEWAQDGVRGEITVVIEGAGDIAADVDSLIDAAQQRVDSGERLKAVCADLAKIHGVSKNELYDAVISAREN

SEQ ID NO: 4495 - protein, 610 aa, Corynebacterium glutamicum
MTKNVLVSVAWPYANGPRHIGHVAGFGVPSDVFARFQRMSGNNVLMVSGTDEHGTPLLVQADKEGVTVQDLADKYNRQIVEDLTGLGLSYDLFTRTTTSNHYAVVQELFRGLYDNGYMIKETTLGAISPSTGRTLPDRYIEGTCPICGTDGARGDQCDNCGNQLDPADLINPVSKINGETPEFVETEHFLLDLPALAEALTEWLKGREDWRPNVLKFSLNLLDDIRPRAMSRDIDWGIPIPVEGWQDNNAKKLYVWFDAVVGYLSASIEWAYRSGDPEAWRTFWNDPETKSYYFMGKDNITFHSQIWPAELLGYAGKGSRGGEIGDLGVLNLPTEVVSSEFLTMSGSKFSSSKGVVIYVKDFLKEFGPDALRYFIAVAGPENNDTDFTWDEFVRRVNNELANGWGNLVNRTVSMAHKNFGEVPVPGALEESDKKILDLATAAFESVAANLDQSKFKAGISEIMHVVGEANAYIAEQEPWKLAKDDTKRERLATVLWTALQVVSDCNTMLTPYLPHTAQKVHETLGRDGIWAATPQIVEVTNESPRQPIGVGLPDPEHTYPVIMGDYKTQLAKWQRIDVVPGTTLEKPAPLIAKLDPELGETGPEWAPVQN

SEQ ID NO: 4496 - protein, 683 aa, Corynebacterium glutamicum
MNATREEANNLLAGIAGPGAQLRDDQWVAIDALVNQRKRMLVVQRTGWGKSAVYFIAAKLLRARGAGAAVIISPLLALMRNQVASAERAGIKAATLNSANMTEWETIQQQVVSGDADVLLISPERLNNPDFRDTILPRLAAETGLVVVDEAHCISDWGHDFRPDYRRIRDLLAGLAPNIPVLATTATANDRVVEDVRAQLGDGTGLLRGGLDRESLYLSVVNLLNPTERPAWLATHLKELTGSGIIYCLTVSAAHDLADALNSVGWNVAAYTGRTEAGERERLEHALINNEIKALVATSALGMGFDKPDLGFVVHMGSPSSPVSYYQQIGRAGRGTARADVILLPGTEDKEIWEYFASVSFPREEVVRQLLAVLTDEAQSTVKLESQVDLSRSRLEQVLKVLDVDGAVKRVRGGWVSTGQEWIYDAERYAGLEQARKIEQQSMVNYQNTTECRMLYLRKELDDVEATTPCGRCDNCTGKTWGLDTDASITLKVDQQLQTPGVKIAPRKMWPTGISVRGKIAGLEEGRALGRLNDIARGPALKALLDSGAYSDDPWMARIIEVLKNWDWTNRPANVVALGNTNFGSTEMIIQVAQSIAAVGRMNFAGVLPAAPGAEEVMAQNSAYRVEALLKQWDWSQGLQLVPGPILLVTDLIDTGWSVTVAGNGIAQRTSEKVLPFALASRG

SEQ ID NO: 4497 - protein, 211 aa, Corynebacterium glutamicum
MQIIDLSHAFAPGQPHYPGDPDQEIKTVSTIENDGFLMHQYRLVGPWGTHVDAPAHFDPQGRTLDQIPVEETHLPLYCLRFSRPDLCTAADIEAFEHTHGKIEPGSFVALHTGWEWGKQGIAPGWSIEALEILHARGVIAIGHDLPDTDPSLEAQRWWLCRDHWQIENLTNLDKVPATGAMIACPWPVPKDGASFPVRPIALVPEHLSPTR

SEQ ID NO: 4498 - protein, 386 aa, Corynebacterium glutamicum
MATTSLPTTITPDSEETVEKRHSLTPILDSLPCESVPYALAAGEGQQHQLGPYHLTVMSRPEDNGGIFSLARVSAGKTPATRFFSVAGPTFLYMMEGRLTLWFADGRQEIIAGGSATIPTNTPWSFACEGLVNSALVYYSSSNAFLHAAEKLGTSSFSHTFRVSGEVTGIPYEELEDCGFTFYERDHLAELGPHFDRLPEDMKAFALNDGEGDRLEQFEQINSFVCRPRHTGNQFLAMQTKGAKTPYIPRHFHRLHTENFICLDGRVKLHVNGQEIILSRGDYVHAPAGTIHSFAFAGHNTQMLGVLTTEVFEKFFDYINTPTNARVQLEDGGKPFFPAEAFAKVQAELDVVVVGPPRISTLDVVTNSRFEPINRTITYRALDANQ

SEQ ID NO: 4499 - protein, 177 aa, Corynebacterium glutamicum
MSSHVRCVMEGYGPTQIEKLLPAYTQVNTAGNNPATTPEQDLLGGAATSPENYDHQLQYAVDASPVHQNAAQAPPFLIMHGTGDRMVPPEQSAALHTHLVQAGRQSTLVLIEGFGHGFLNPGEVAELGPNVRLDNGRLEREPQTNFSAQQSPGNPFELQGLAADHEMIKRFFTLHLR

SEQ ID NO: 4500 - protein, 98 aa, Corynebacterium glutamicum
MEAEAPVEDLSAFIEQEKASFPITWMCRKLGVSRASYYRWAKPAGLTPTAIRHLELRAEVAQEFEKSNQMAGRDQLTTLLNQRGVKVSTGTVGSIMNE

SEQ ID NO: 4501 - protein, 159 aa, Corynebacterium glutamicum
MSDECGPGRTPRSVTLSARTEHIKNHMLDSHGKRDFTATVPGTRLVGDITYLKTGSGWLYVATVIDLATRMVVGWSMDSNMRTPLVINALAMARDHGCLHPEGAIFHSDRGSQYTSEQFQTWCAGNKITQSMGLTGVCWDNGSRGEFFLTFEDRNVSPL

SEQ ID NO: 4502 - protein, 138 aa, Corynebacterium glutamicum
MTSATWGIYQRMIAAYREKDRSLGRAAMEALIDAVSQDVPAGLDELRKLGRTLKARATDVLAYFERPGTSNGPTEAINGRLEHLRGSALGFRNLTNYIARSLLEFRRIQTSTTPSSVKSRFRHPSSSRTTMNDVPTHL

SEQ ID NO: 4503 - protein, 288 aa, Corynebacterium glutamicum
MAEEVPVIRLDLKLVVDLLRQHLEPVPIVATQGHIDGDEPCDVPALQRGVASGGTGRAEPVERRALFFIRRADEELTSVLGLCEELLEHLLARGLLRLADGEQQVMLETVAVLHHALGQLVGQHAEHGLRYRVGEGRTNAGNLREQAVGPRLEREHARLQRWTHELQEDEGVFAVLLGQVEGTAAHVLTRDRQRHVGFEEQPTDLFELVRVVRADVKHGRVHFAREGAGAHREHHQLAGRAGSLEQVLGVRIVASRRRHDLAQVLGVLGLVRVFGSWGDILGRPLAAL

SEQ ID NO: 4504 - protein, 571 aa, Corynebacterium glutamicum
MTQPGQTTTTSHEAIDAFKRIVGDEHVLTSERATMPFSKGYRFGGGPVFAVVRPGTLVEMWRALQVSVDNNLIVIPQASNTGLTGGSGPGFQDYDRPIVIISTHRIDEVHLINDAREAISLAGTPLTHLTDALAKHQREPHSVIGSTSIGASVIGGIANNSGGSQIRKGPAFTREAIFARVNDDGKVELVNHLGISLGDDPEVALDRLQRGEWSPEDVTPAPEDSNETEYAEHLRKIVPSPARYNANPEYLFEASGSAGKLMVFAVRTRTFPREVHPTVFYIGTNNTHELEEIRRLFLEADMPLPISGEYMGRSAFDLAEKYGKDTFVFLKFMSPALQTRMFSFKTWANGLFSKIPGIGPTFADTVSQAMFSVLPNQLPKRMMEYRNRFEHHLLLTVSESQKAASEKMLKEFFAEPEHTGEFFICTSDEEKSASLNRFGAASAATRYAALKRRHIAGLIPIDVALRRDDWNWLEVLPEEIDDQLEVKAYYGHFFCHVMHQDYVAKQGVDLEALHDRIQHLLEERGAKLPAEHNYGRIYKLPESMEEHFKELDPTNTFNAGIGGTSPHKDWA

SEQ ID NO: 4505 - protein, 280 aa, Corynebacterium glutamicum
MLADDVVVVAEFRDRIYPGLVETGRVERGGDKPFHTVVNAENYHALEMLTYTHRHSIDAIYIDPPYNTGARDWKYDNDYVASDDDYRHSKWLAFMERRLKICRELMRSDATLVATIDEHEVNRLGVLLDQLFPESTRQLVTIVNNPKGVTQGYLSRVEEYAFFVFGPDARIGSVDDDLLTHRDMADAEGELQRPRWKGLLRSGDDSLRADRKDMFYPVWFDESTGRLSHAGEALPLDETPDFSPQDGLTPIWPIRRDMKEGPTRAAPRRSILDYALHPHL

SEQ ID NO: 4506 - protein, 73 aa, Corynebacterium glutamicum
MSLGPGKPHQRRSIVEAFVDTNSASKTEESTMFNVRMTTSVHRRLKLQAFKEHRTMKEIVEQSVVRYLNECED

SEQ ID NO: 4507 - protein, 98 aa, Corynebacterium glutamicum; identical to SEQ ID NO: 4500

SEQ ID NO: 4508 - protein, 159 aa, Corynebacterium glutamicum; identical to SEQ ID NO: 4501

SEQ ID NO: 4509 - protein, 119 aa, Corynebacterium glutamicum
MLTIASRLDVMNRLGRAMADPTRSRILLALLEGPAYPAALAQDLELTRSNVSNHLACLRDCGIVVAEPQGRQTRYEIVDAHLAQALNALLDITLAVDDNAECIDAGCAVPGCVTGQESA

SEQ ID NO: 4510 - protein, 207 aa, Corynebacterium glutamicum
MCHWTGECVVATGLLSAIGLFIATNIDDIIVLSLFFARGAGQKGTTLRILAGQYLGFMGILAAAVLVTLGAGAFLPAEAIPYFGLIPLALGLWAAWQAWRSDDDDDDDAEIAGKKVGVLTVAGVTFANGGDNIGVYVPVFLNVDTAAVIIYCIVFLVLVAGLVLLAKFVATRPPIAEVLERWEHVLFPIVLIGLGIFILVSGGAFGL

SEQ ID NO: 4511 - protein, 114 aa, Corynebacterium glutamicum
MPLRTLLSSDTPRYGASGVDAFGVVIDGQGDIQQRVQRLRQMSINDLVAGLSPLRFGNNNSAVPQAGEMVRHVRARQFQILGESGRVGRPLQQRQENAGTSRIRHGPTQPVHHV

SEQ ID NO: 4512 - protein, 277 aa, Corynebacterium glutamicum
MSKKKPRPIPVPAQFIPGLIDAHTHLASCGGDLAGLVERAKEAGVEKLCTVGDGLAEAELALEAAQQFGNVFAACAIHPTKADQLDGAARARLTQMAADPNCVAIGETGLDSYWIKHDPEDTAALDVQEEALRWHIDLAISADKPLMIHNREADADLMRVLADAPPPKDTILHCFSSPLDVAKEALDRGYVLSFAGNVTFKRNEELREAARIAPISQILIETDAPYMTPEPFRGSRNEPSLIGHTALCIAEVRGMAVEDVAAALNENFDRVYGVTNL

SEQ ID NO: 4513 - protein, 357 aa, Corynebacterium glutamicum
MPLRLATGGVLATLLIGGVTAAATKKDIIVDVNGEQMSLVTMSGTVEGVLAQAGVELGDQDIVSPSLDSSISDEDTVTVRTAKQVALVVEGQIQNVTTTAVSVEDLLQEVGGITGADAVDADLSETIPESGLKVSVTKPKIISINDGGKVTYVSLAAQNVQEALELRDIELGAQDRINVPLDQQLKNNAAIQIDRVDNTEITETVSFDAEPTYVDDPEAPAGDETVVEEGAPGTKEVTRTVTTVNGQEESSTVINEVEITAAKPATISRGTKTVAANSVWDQLAQCESGGNWAINTGNGFSGGLQFHPQTWLAYGGGAFSGDASGASREQQISIAEKVQAAQGWGAWPACTASLGIR

SEQ ID NO: 4514 - protein, 293 aa, Corynebacterium glutamicum
MEEPSGAQLLGPVEIRALAEKLDVTPTKKLGQNFVHDPNTVRRIVAAAELTPDDHVVEVGPGLGSLTLALVESAASVTAVEIDPRLAAELPETFQWRAPALAHKLSIVLKDALKVQQSDMAVQPTALVANLPYNVSVPVLLHMMEEFPTINKVLVMVQAEVADRLAADPGSKIYGVPSVKASFYGPVTRAGSIGKNVFWPAPKIESGLVKIVREDTAWKQDDETRKKVWPIIDAAFLQRRKTLRAALSGHYGSGQAAEEALRAADIDPTLRGEKLDVTDYVRLAGVLQQKDEK

SEQ ID NO: 4515 - protein, 311 aa, Corynebacterium glutamicum
MKITAKAWAKTNLHLGVGPAHDDGFHELMTVFQTIDLFDTVTLTTLDEELVEEGSVVKQLSVTGARGVPEDASNLAWRAVDALVKRRAEKTPLSAVSLHISKGIPVAGGMAGGSADAAATLRAVDAWIGPFGEDTLLEVAAELGSDVPFCLLGGTMRGTGRGEQLVDMLTRGKLHWVVAAMAHGLSTPEVFKKHDELNPESHMDISDLSAALLTGNTAEVGQWLHNDLTSAALSLRPELRSVLQEGIRSGAHAGIVSGSGPTTVFLCESEHKAQDVKEALIDAGQVYAAYTATGPAASTADQRGAHILTVS

SEQ ID NO: 4516 - protein, 214 aa, Corynebacterium glutamicum
MPSWRTLRSSGRKLSAALVRSLCSHCPTSAVLPVRSAALRSLISICDSGFSSSCFLNTSGVDRPCAIAATTQCSLPRVNISTSCSPRPVPRMVPPSRQNGTSEPSSAATSSNVSSPKGPIQASTARSVAAASAEPPAMPPATGIPLEICSETADSGVFSARRLTNASTARHARLLASSGTPRAPVTDNCLTTLPSSTNSSSRVVKVTVSNRSMV

SEQ ID NO: 4517 - protein, 611 aa, Corynebacterium glutamicum
MANLINLENVSKTWGLKTLLDGVSLGVQTGDRIGVVGLNGGGKTTLLEVLTGIEKPDQGRVSHNSDLRMAVVTQRAELNDDDTVADVVLGPLGLEVFEWASNATVRDVLGGLGIVDLGLDTKVGNLSGGERRRTNLAAALVRDLDLIVLDEPTNHLDVEGVQWLASYLLSRRIAIVVVTHDRWFLDTIATTTWEVHDGVVDSYEGGYNDWTFARAERARQADAIEQRRQNLARKELAWLRRGAPARTSKPRYRIEAAEALIADVPAPRDKVELMAFSKSRQGRVVIELEDATVATPDDRILVEDLTWRLAPGERIGLVGVNGSGKTTLLRTLAGEQPLQAGKRIEGQTVKLGWLRQELDDLDLSRRLIDCVEDVASYVMMGDKQVSASQLAERLGFSPKRQRTPVGDLSGGERRRLQLTRVLMAEPNVLLLDEPTNDLDIDTLQELESLLDGWPGTMVVISHDRYLIERVTDSTWALFGDGKLTNLPGGIEEYLQRRAAMAAAEDSGVLNLGAATQAGTFSAATEQAATSVESSGISSQERHRITKEMNALERKMGKLDQQMDKLNQQLADAAEAMDTIKLTELDTKLRAVQEEHGELEMQWLELGEEIEG

SEQ ID NO: 4518 - protein, 264 aa, Corynebacterium glutamicum
MPSAGEEILEQRAQLEFDQRRADVVMIGSQVVYGSVGLSAAIPVMHNEGLRVVAVPTVVLSSMPRYASSHRQPMSDQWLADALQDLVDLGIIDEVSTISTGYFTSASQVRVVAAWLQKIRETHPHVRIVVDPIMGDSDVGIYVADEIATAICQDLCPLATGIIPNAFELSHMVGSGDPRSLLGPFGEWIIITSATETVGTTVTRIVTRDSVQEIASATVDTTAKGAGDVYAAALIAALHKDFSLIDAASHASNTVCAGLQTKAL

SEQ ID NO: 4519 - protein, 160 aa, Corynebacterium glutamicum
MSSLDNAPLLELDVQEWVNHEGLSNEDLRGKVVVVEVFQMLCPGCVNHGVPQAQKIHRMIDESQVQVIGLHSVFEHHDVMTPEALKVFIDEFGIKFPVAVDMPREGQRIPSTMKKYRLEGTPSIILADRKGRIRQVQFGQVDDFVLGLLLGSLLSETDET

SEQ ID NO: 4520 - protein, 107 aa, Corynebacterium glutamicum
MILINVKFKPLPEYVDTFREQVAEFTEKTRAEEGNIFFDWSINTDNPNEFILIEAFQDDAAEAHVNSDHFKAACELFPTILSETPEIINTLIEGKTEWDRMAEFAVN

SEQ ID NO: 4521 - protein, 107 aa, Corynebacterium glutamicum
MHIVNIRFKPKAKYVDTFRYTVDKFTESTRTEEGCLYFDWFRNTDYPGEYLVIGVWTDEGATEHKKSEHFLRAQETLPPLLQQTPMIIQSEFSKKKGWERFSDFTVY

SEQ ID NO: 4522 - protein, 320 aa, Corynebacterium glutamicum
MRKKKDGQNLPDFRKNPPKLDKKAYEKELKRLQAELVDLQQWVVETGARVVIVMEGRDAAGKGSAIKRITQYLNPRSARIEALPTPNSREKGQWYFQRYIEKLPTAGEIVIFDRSWYNRAGVERVMGFCTSQEYRRFLHQAPIFERLLVEDGIHLRKYWFSVSDEEQIERFEDRLSDPLRRWKLSPMDLQSITRWEDYSRAKDEMFIHTDIPSAPWYTVESEDKKRSRINVISHLLSTIPYEKIDRPLPEIPHRPDSESDYVRPPRDEFRYVPDVAAHLEEERIKKEEKAKKAKKPAKAAGKNSDKQKSSGGKGKKKSKK

SEQ ID NO: 4523 - protein, 264 aa, Corynebacterium glutamicum
MDFRLVATDMDGTLLNTHHEVPEKFWDILEQMRAKGIAFAPASGRQLATLQKQFGHAGEPISYIAENGTVVVHDGEIISLTTIDSDTVHSIIDAVRASDIDMGVVVCRPERAYVERNDEAFRAEGLKYYVSIEEVQDLHEAVNNEVIKVAIFTFQDAEKDCAPIIRAASPNANVVVSGQHWVDVMDPSANKGQALAALRDALGLEESQTLVFGDYLNDTELIKAAGKSYAMSNAHPDILELADEIAPSNIEEGVIVVLEKLLNG

SEQ ID NO: 4524 - protein, 339 aa, Corynebacterium glutamicum
MSNVVNTFVQNSTGMVELNRPKALNSLNQEMIDLVQEALTTWADDDQVQQVLIYSSSERAFCAGGDVRAVRESVLEGDVAAGDKYFIDEFAMNNTLGTYPKPVISVINGVAMGGGMGISMHGSHRIVTEKAFASMPEMAIGYVPDVGFTYFGQRASSLAIATFLAVTGWRMSPADMLWAGVATHFVEDAQGFIDAVLNESLDGALEKFSTQPTGSSELAGVASQIEETFGHSSWALIDASLRSHPDAEFVAKVDGLMASAAPASVVATVKLMHQNSEATTLREGLDNELAMSLYMIRQPDFAEGVRAVLVDKDRNAAFSPANYEDVDESHFVTLFQRSS

SEQ ID NO: 4525 - protein, 218 aa, Corynebacterium glutamicum
MHQLHGSHHRCRCCRRHQPIHLGNKFSIGVRPEGGVDKRPRAVPKGLLNLAGDAGQLAAARRLRGEFLQRAIKRLVQDRINEPLRILNKMRCDASPQHIGRAHAPPGHRQKCGDGQRRCTLTEISKAHIGNIADRHLRHRRERFFRDDPVRSMHGNSHSATHRDAVDHRNDRLRIGSQRVVHRELIDEILIAGRNIALQHALTDRAHITAGTKCTLRG

SEQ ID NO: 4526 - protein, 259 aa, Corynebacterium glutamicum
MALSVDGAMFAQCLKKGRAVKPLGKIAVPWTWYLGIVGVIIFDVVAAITMLTLVPNKMPERVNSGLVALGGSYAPPMSRETLIARVIAGAVLVLVISLGISLLISAQSKNLASDHPDASAIQIARRWAFLNNIQSCIGWFSFFLAAILSISSLRLNGPGATTHLEMAVYIIAVSVLAWALMISLRRGQVAIDRAIPIREDDSELKWGMIYHDASDKRVFVELDDGHTTVINMARGGAWLLIAVMVLPALAIVGWVLLEN

SEQ ID NO: 4527 - protein, 404 aa, Corynebacterium glutamicum
MHILKGMEIPLPTSLIDVITDGALGQTCIDQAFAAQLGRVTGVEFNLSDDKTAAEVRINKASGSPFDTTGEVIAWINNQEFEWVSTRGEDLGLPELQGIQPLDDDLITAARTLYSNAPAFIAPLRDGRRALVAINHTPKLVGIRRTLIEGLQALKPGTDLKRALTSFAAFCELGIRFDDNRISFSDGTSLLLRGGKVIEIAGGLSLRDVRADAAFMSAEHQLLFDAISSSHNVTFDPHTNVATVANEHQVHAIPLAVIDGTRWVWTWSLKELNGQATEGLARFGFDNGLLLLTNAEILAEEATAFNLIDVAKQVLNTWTHTIVQQPDGTGIVLLLDHPRLQLPPASHAAVEATLYHQLPGDIDARRAVASYAAHRQLPFDGYALTVEGQQVGVTFDGEHLTKVG

SEQ ID NO: 4528 - protein, 462 aa, Corynebacterium glutamicum
MLSGTGIAAAQDSAFDYGMDPSMNYNPIDDIKDRPQGLSNLPYFGSKLTSWGSSDATASSGIVTSALPQYTDPRYPLGKDDLPKATIDMEPEALARLERFVGVDGDRIRQINAYSPSMGRTIPLVWVVPEDNTVPGPTVYALGGGDGGQGGQNWVTRTDLDELTSENNINLIMPMLGSFSFYADWAGESESMGGAQQWETFLMHELPEPLEAAIGADGQRSIVGMSMSGGSVLNFATHDPNFYSSVGSFSGCAETNSWMGRRGIAATAYNGNVVPEQIFGEVDSDYSRYNDPLLNAAKLEEQDNLYIFAGSGVFSELDVIGDNAPIDEDAFKNRVLVGFEIEAMSNTCTHNLKAATDQMGIDNINYDFRPTGTHAWDYWNEALHRFFPLMMQGFGLDGGPIPIYNPNGVTSSESSSELSSDVSLGTVIGSVAGSSGSSAGSSVREFIAGSSGSSQSAGSFYE

SEQ ID NO: 4529 - protein, 193 aa, Corynebacterium glutamicum
MSGLRETKKAATRTALSRAAAEIALMEGPEAFTVAAIAAAAGVSPRTFHNYFPSREDALVQFVVIRVQELTDQLYEFPTSVPPRDAIEQLVINQLRDGDDAMDSFSAMFRIGEILENLDPIKCVIDKERLIAPLLEFMVERDKDLDKFDAATLIHLHAAAIATSLHTFYQASEPRDIEDGVALIRRACAWIKK

SEQ ID NO: 4530 - protein, 791 aa, Corynebacterium glutamicum
MAKFLYKLGSTAYQKKWPFLAVWLVILIGITTLAGLYAKPTSSSFSIPGLDSVTTMEKMQERFPGSDDATSAPTGSVVIQAPEGKTLTDPEVGAEVNQMLDEVRATGVLKDADSVVDPVLAAQGVAAQMTPALEAQGVPAEKIAADIESISPLSADETTGIISMTFDADSAMDISAEDREKVTNILDEYDDGDLTVVYNGNVFGAAATSLDMTSELIGLLVAAVVLIVTFGSFIAAGMPLISAIIGVGIGIMGIQLATAFTDSVNDMTPTLASMIGLAVGIDYALFIVSRFRNELISQTGANDLEPKELAERLRTMPLAARAHAMGMAVGTAGSAVVFAGTTVLIALVALSIINIPFLTVMAIAAAITVAIAVLVALSFLPALLGLLGTRIFAARVPGPKVPDPEDEKPTMGLKWVRLVRKMPVAYLLVGVVLLGAIAIPATNMRLAMPTDGTSTLGTAPRTAYDMTADAFGPGRNAPMIALIDATDVPEEERPLVFGQAVEQFLNTDGVKNAQITQTTENFDTAQILITPEFDAIDERTSETLATLRADAETFADDTGATYGITGVTPIYDDISARLGDVLVPYVLIVLVLAFLVLLLVFRSIWVPLIAALGFGLSVLATFGATVAIFQEGAFGIIDDPQPLLSFLPIMLIGLVFGLAMDYQIFLVTRMREGFTKGKTAGNATSNGFKHGARVVTAAALIMVSVFAAFIAQDMAFIKTMGFALAVAVFFDAFVVRMMIIPATMFLLDDKAWWLPKWLDKILPNVDVEGEGLSELHEARTEELKENVGVGA

SEQ ID NO: 4531 - protein, 166 aa, Corynebacterium glutamicum
MTQSAPEFIATADLVDIIGDNAQSCDTQFQNLGGATEFHGIITTVKCFQDNALLKSILSEDNPGGVLVIDGDASVHTALVGDIIAGLGKDHGWSGVIVNGAIRDSAVIGTMTFGCKALGTNPRKSTKTGSGERDVVVSIGGIDFIPGHYVYADSDGIIVTEAPIKQ

SEQ ID NO: 4532 - protein, 222 aa, Corynebacterium glutamicum
MPQLFHAVSFALMDSVNVLLIGIIVAIAALLPRKGKYGPIATLLVAGDWLGVFLLSILVMLVFDGLEDLVQGFLDSIWFGVILLVTGIVSFVATLVSKTDSTRKLDGFLAPVKTPSWKTVGAGLILGIVQSATSVPFYAGLGYLSVGNFSPEIRYGGLVVYATLALSLPIIVAILVGMVRKYPESPVGRLFELIGQNKERVTKWSGYLVSLVLCIMGITSIL

SEQ ID NO: 4533 - protein, 127 aa, Corynebacterium glutamicum
MCQILNPKPKRHFIKSNIEIPIDGGKKKLDYGGWVEVEHSDLMTYLNYRNVMKKVRIPGFLASKFPGLEDSYGTPVLLTVKHEDYYPHFQPLEESSSMYQDFHKGISSREADLRINSWLLVTHEYMR

SEQ ID NO: 4534 - protein, 517 aa, Corynebacterium glutamicum
MSITTHVQALTTALNAIDNHLASMLDHGVTPDQYKAIEPDLIALEHTINHHATIAAQTTALAERTNAAQSIGSTHLIDYLTTTFGLSKARAHHRINLAHSLYPIPKPNSGSGNGGNGGNPDGGPDGGDSGDDDSGDDDPDPEPDKPEDGKPDSDKPRRPRISAEKHAIITDELARLNPNTTPSAEELRNQALSQAIWRTPEDLRTWLRHQVTTANKNNPNPITAMKRRYLSVGKPDADNMVRISGLVPAATAALITANTAPLTKRGNLVDLPAAEDMRTRGQRHADALHHIMEIYNHGIVTPARGGTASIIISMTTDDLDEINHANSSGESLLNNLYPTNTGYSLNLAEIMNLIAAKYDFAVLLDGETGQPLNVNRMQRSANLTQRIALFASELVCSAPNCDRPQLECEVHHLDPWMRGGLTNLVNLTHQCFNHHPRNDDSRSGVNGKGFMDRDPATGRVGHYPVGGEGPVFNRSAAADRSGGAWARRKHHGPPPTPPDPPDPPGPEPDPGDEGRLF

SEQ ID NO: 4535 - protein, 312 aa, Corynebacterium glutamicum
MKDRRHLSLNSAISSPSVRVKISTPRCFASSGAVSAVVRRATEYGIGSATVSTLYSTSMRACITSNCIGPTAAMTGLASPRRSFLRIWTTPSESSCSRALRNCLYLPSDLARRMRKCSGANFGIGGYWIFRPSKMVSPGARAPALTRPTMSPGKAVSTVERVRPKTVRAYLVEKLRPDWEWVTCMPRSNSPETTRMKARVSRWFLSMPAWTLKTTPEKSSVVSRWSSIAEVAASRALGSASRPAGDGASWQRVSRIWWTPKLSIAEAKISGEVVQLRKSSWSWTAPSAARSSASSVAFSQTSPSRSMASSGV

SEQ ID NO: 4536 - protein, 549 aa, Corynebacterium glutamicum
MSNANPDTTAAEAHRRRTFAVIAHPDAGKSTLTEALALHAHIISEAGATHGKAGRKATVSDWMEMEKDRGISIASSALQFEYAPEGHAGEPFMINLVDTPGHADFSEDTYRVLMAVDAAVMLIDAAKGLEPQTLQLFRVCKARGLPIITVINKWDRVGRTPLELVDEIVKEIELQPTPLFWPVGEAGDFRGLARINNDGEVEEYIHFTRTAGGSTIAPEDFYTPEEAIEREGDVWENATEEAELLAADGAVHDQELFLNCTTSPLIFASAMLNFGVHQILDTLCQLAPSPAGRDADPKALEAATSAMDDHRDTTDDFSGVVFKVQAGMDKNHRDTLAFMRVVSGEFDRGMQVTHSQSGRSFSTKYALTVFGRTRSTVETAFPGDIVGLVNAGALAPGDTIFEGRKIQYPPMPKFAPEHFRILRAKSLGKYKQFRKALEQLDSEGVVQILKNDLRGDANPVMAAVGPMQFEVMQARMEVEYNVETVADPIPYSVARRTTAETAPELAKQRGVEIFTRTDGELIALFSDKWRLSFIEKEHPDFVLESLVAE

SEQ ID NO: 4537 - protein, 423 aa, Corynebacterium glutamicum
MSRPIVKQAFTVTAVTAMAFALASCTRAVDATSADGTASNTAASCVDTSGDSIKIGFINSLSGTMAISETTVNQSLHMAADEINAAGGVLGKQLEISEEDGASEPATFAERSQRLIQQECVAAVFGGWTSASRKAMLPVFEGNNSLLFYPVQYEGMESSPNIFYTGATTNQQIIPALDYLRENGLNRLFLVGSDYVFPRTANSIIKDYAEANGMEIVGEDYAPLGSTDFTTIANRMRDSNADAVFNTLNGDSNVAFFRQYNSLGFNADTLPVMSVSIAEEEVGGIGTANIEGQLVAWDYYQTIDTPENETFVENFKDLYGQDKVTSDPMEAAYTSLYLWKEMVEKADSFDVAAIQAAADGTTFDAPEGTVVVDGDNHHISKTPRIGRIRPDGLIDTIWETDSPVDPDPYLSSYDWAKTTAATS

SEQ ID NO: 4538 - protein, 294 aa, Corynebacterium glutamicum
MDILLNQLVAGLSVGSVLLLVAVGLSLTFGQMGVINMAHGEFIMVGAYTAYVVQLVVGSAGLSLLISIPLAFIIGGLFGVLLEQFLLKYLYHRPLDTLLATFGVGLILQQLARNIFGAPAVDVRAPEFLRGNVEVLGVLVPTARLFILALAIASVTALAVFLNRTAWGRRIRAVVLNRDLAETAGIDTRATDRMTFFVGSGLAGIAGVAITLIGATGPTIGQNYIVDAFLVVAAGGIGRVKGAVIMAFVLGITQAFVEYTTGASIAKFIVLIAVVAFLQFRPQGLFQTQTRSLV

SEQ ID NO: 4539 - protein, 359 aa, Corynebacterium glutamicum
MSTQLKLKKPAKKKTTPKLSVVNAPTLRTAALGLAALAAVLLCAPLFLSTFQLTLMSRLVCYAIVAVGIGLAWGRGGMLTLGQGVFFGIGAYIMAMHMLYSDSQIFGTTVPQWWSIFANPAVALIAVVALPGIVAFVLGFSIFKRRIKGAYFAIVNQALAAAVVVLLVGQQDSLGGSNGLSGFRSFMGFAVYDPINRIMFYFTAVGVLLALVAISYWLMRSRYGELLVATRDAEERVRFLGYDPALIKTAAYVIAAMIAGIAGALFVPIVGIISPAEIGVVPSIVFVIAVAAGGRASLFGPVVGALVLGWVESTLAQTFPSMWSYFQGAILVLVIVLLPGGIASIKLSALKNKARKATS

SEQ ID NO: 4540 - protein, 242 aa, Corynebacterium glutamicum
MSLKITNLKVAFGSFIAVNEISFQVLPGHVHFLIGANGAGKTTCIDAISGLAPGQGSVQLDGTEILGTPVHRIARMGVGRTFQTASVFEELSVLQNLDIACGIHRPLRALLGVRHRIDPRIEHALEVTGLADLVNAQAGTLSHGQKQWLEIAMLLVQDAQVLMLDEPVAGMSEEERVATGELLQRVARGRVVLVVEHDMEFMRRFATRVTVMNRGTILCEGSVDEIQANPDVQSIYLGTAGK

SEQ ID NO: 4541 - protein, 233 aa, Corynebacterium glutamicum
MLEITNLCAGYGRTQVLHSLSISTSSNGILSILGHNGAGKSTLLRTAVGLIKPTSGEVKLFGQDVTSLSTHERVKRGMAYVPQGQQSFTQLSCMENLQVVADLQGRVGKARIAEALDRFPALTQVLDRQAGLLSGGQRQQLAIARALITAPKLLLLDEPTEGIQPSVVAEIQQTIIDLAKDGMSIVLVEQNIGFALDAATSYAIVARGQVVESGQGAETTAEKQTKVRESLAI

SEQ ID NO: 4542 - protein, 204 aa, Corynebacterium glutamicum
MTSVSFLSKIQALFAPKPELPAAKWLVVGLGNPGAKYESTRHNVGYMCQDMLIDAHQQQPLTPATGYKALTTQLAPGVLAVRSTTFMNHSGQGVAPIAAALGIPAERIIVIHDELDLPAGKVRLKKGGNENGHNGLKSLTEELGTRDYLRVRIGISRPPAGMAVPDYVLEPVDHDQPGIELAAEAVDLLLAQGLSAAQNAIHSR

SEQ ID NO: 4543 - protein, 341 aa, Corynebacterium glutamicum
MSILDTLKTPVIVAPMAGGPSTPALVNAAAEAGSLGFLAGGVMPLEQLKQELSEVKGVFGVNLFRPQTDAPKPSDIDELAGLLSSAFRQFGLDEPTVPTPDLSNGWEAKFEAVLAAKPAVFSCTFGIFSAEEFARIKATGIEAWVTVTNPEDALAAQKAGANALVVQGPEAGGHRSTWSIEVEPDERDLKTLLAAVKQAGVYLPLIAAGGLSTSADVAAILEAGASAASCGSAFLLSDEAGTSSLNREILDAAPALGLESVSSRAFSGRYARGVETRFTRSNEGLPPLYPYLNPMITSLRKVAGSAGNWDYAYCLVGVGLESIAKGSAKQILESLTPSALG

SEQ ID NO: 4544 - protein, 355 aa, Corynebacterium glutamicum
MLYGFGRIGRLLARILVSREALYDGARLRAIVVRKNGEEDLVKRASLLRRDSVHGGFDGTITTDYDNNIIWANGTPIKVIYSNDPATIDYTEYGINDAVVVDNTGRWRDREGLSQHLKSKGVAKVVLTAPGKGDLKNIVYGINHTDITADDQIVSAASCTTNAITPVLKVINDRYGVEFGHVETVHSFTNDQNLIDNFHKGSRRGRAAGLNMVLTETGAAKAVSKALPELEGKLTGNAIRVPTPDVSMAVLNLTLNTEVDRDEVNEFLRRVSLHSDLRQQIDWIRSPEVVSTDFVGTTHAGIVDGLATIATGRHLVLYVWYDNEFGYSNQVIRIVEEIAGVRPRVYPERRQPAVL

SEQ ID NO: 4545 - protein, 123 aa, Corynebacterium glutamicum
MVARPSTMPAWVVPTKSVETTSGERIQSICWRKSECRDTRRRNSLTSSRSTSVFRVKLSTAMDTSGVGTRMALPVSLPSSSGSALDTAFAAPVSVRTIFRPAARPRREPLWKLSIRFWSLVKE

SEQ ID NO: 4546 - protein, 177 aa, Corynebacterium glutamicum
MNNSPLLVVGLGNPGPKYVGTRHNIGFEVAEELVSRSFGSFSVHKRSNTDIAQLPGLIVAKPRSFMNLSGTPIRALCDFFKISPANVIVVHDELELDFGSVKLRQGGGDHGHNGLKSTSKSLGTKDYWKLSMGIGRPPGRMDPASFVLKPFGKQELADIPIMAADAADLVEKHLQQG

SEQ ID NO: 4547 - protein, 200 aa, Corynebacterium glutamicum
MAKYQTIEAAVRSEFGKGSARRARVAGQIPAVVYGADVESNLHVTIDHRTFAALVRQEGVNAVLELDIEGQKQLTMIKHIDQNVLTFHIDHLDLLAIKRGEKVEVDVPVIVEGEPAPGTMWVQDADTIKVEADVLSIPEEFTVSIEGLELGAQITAADIKLEGDTTLVEDPETLIVNIVLPAVEEEDTEEDEAAEEAATE

SEQ ID NO: 4548 - protein, 143 aa, Corynebacterium glutamicum
MARLQHDMIFINLPVSDLAASKRFYAGLGFKENTVFSDEHTASFEVSDAIVVMLLETARFSDFTKRPIVEKNGSREVLNCLSVCSTEDADEFVRRAQEFGGTITRELAAEGPMYGGAFDDPDGHGWELMYFDPEALAQMMPEG

SEQ ID NO: 4549 - protein, 208 aa, Corynebacterium glutamicum
MPTTDVFNRVRLALEPLADPARATGMASYMRDQFSFLGIPSTPRKEACKPVLSALKELDTDFVSDCFGAAEREYQYVACDHINRVGITDLGFAKALVQTKSWWDTVDSLAKPIGAKHDDDLMKTWALDEDFWVRRIAIIHQLGRKKNTDAALLAWIIEQNLGSSEFFINKAIGWALRDFARHDPSWVRAFVDATDLSPLSRREALKNI

SEQ ID NO: 4550 - protein, 325 aa, Corynebacterium glutamicum
MTAHWKQNQKNLMLFSGRAHPELAEAVAKELDVNVTPMTARDFANGEIYVRFEESVRGSDCFVLQSHTQPLNKWLMEQLLMIDALKRGSAKRITAILPFYPYARQDKKHRGREPISARLIADLMLTAGADRIVSVDLHTDQIQGFFDGPVDHMHAMPILTDHIKENYNLDNICVVSPDAGRVKVAEKWANTLGDAPMAFVHKTRSTEVANQVVANRVVGDVDGKDCVLLDDMIDTGGTIAGAVGVLKKAGAKSVVIACTHGVFSDPARERLSACGAEEVITTDTLPQSTEGWSNLTVLSIAPLLARTINEIFENGSVTTLFEGEA

SEQ ID NO: 4551 - protein, 485 aa, Corynebacterium glutamicum
MSASDFSSAVVVLAAGAGTRMKSDLQKTLHSIGGRSLISHSLHAAAGLNPEHIVAVIGHGRDQVGPAVAQVAEELDREVLIAIQEEQNGTGHAVQCAMDQLEGFEGTIIVTNGDVPLLTDHTLSALLDAHVEVPTAVTVLTMRLDDPTGYGRIVRNEEGEVTAIVEQKDASAEVQAIDEVNSGVFAFDAAILRSALAELKSDNAQGELYLTDVLGIARGEGHPVRAHTAADARELAGVNDRVQLAEAGAELNRRTVIAAMRGGATIVDPATTWIDVEVSIGRDVIIHPGTQLKGETVIGDRVEVGPDTTLTNMTIGDGASVIRTHGFDSTIGENATVGPFTYIRPGTTLGPEGKLGGFVETKKATIGRGSKVPHLTYVGDATIGEESNIGASSVFVNYDGENKHHTTIGSHVRTGSDTMFIAPVTVGDGAYSGAGTVIKDDVPPGALAVSGGRQRNIEGWVQKKRPGTAAAQAAEAAQNVHNQEG

SEQ ID NO: 4552 - protein, 409 aa, Corynebacterium glutamicum
MTNPTEERNARRLIWANGLQNIGDQIVAAKTVLPWLLQAAGAPGFLLALLVPIREAGSMLPQAAITGWVLRQTSRSKVWVIGSNGQFVSALGIGVAALFLRGWALGITVIVLLAALSLFRSMCSIASKDVQGKVISKGKRGLVTGRATVIGGVMGLVAGLAIAIFLGSHSPTRVLAAVVIASSFSWLFASIVFARIEYAKPATPKNAPSANPWVRRCIAALKDDKAFRRFVLVRSMMLVTALSTAFIVALAAESGNSIDSLGFFLIASGLASMVGGRISGIWSDHSSKNVMAGGALFGSIVLILVVLSSAFAPAQINTLVFPLSFFLITLAHTAIRVARKTYVMDMAEGDQRTRYVADANTLMGVVLLIVGALSGFIAIFGNEAALLFLAAIGLLGTISARGLKEVSAG

SEQ ID NO: 4553 - protein, 511 aa, Corynebacterium glutamicum
MPELNRRTFFKGAGVLAATVVGAQVLVACSSDDVRGYGGEPRTLPIPPADLGTREGSSVHFALEAQTGESQILPDVTTKTWGFNGTHLGPTLVVKKGDDVHVDVINNLDEMTTVHWHGMKLPAIADGGPHSPIGPGQTWSPTWTVANDAATLWYHPHTHGLTGLHAYRGLAGMIIVEDEATDKLDLPREYGVDDIPLVLMDHRFLEDGSLDEEDLPDLGLLGDTPTANGITNAHFDATTRRVRFRVLNGSNMRFYNLAFSDTRTFQVIASDSGLLDEPQDRTTLAIGPGERWEIVVELEPGEDVTLESVGFEDNYGVPDDEFVPDFGMSDSFQLLTITGPSDDAAQAPALPGVLVKSTEPDVIDATERTFIMNTFSINDLQMDMQRVDVVIDHDQPEVWIVTNDNSDWPHNFHVHDARFKVLKFEGTDVELFNDGWKDTVGLPPGATATLAVEFGHYPDPQWPYMYHCHMLYHEDQGMMGQFVIVEPGDEPAAVLGSGTGSSIDSAGGHAH

SEQ ID NO: 4554 - protein, 306 aa, Corynebacterium glutamicum
MTTTPAIDVTDLVRTYGDYTAVKGLNFHVQRGEVFGLLGTNGAGKTSTLEVIEGLSAPSSGTVRISGLDPVADRAILRPELGIMLQSGGLPSQLTVAETMDMWHGTCTYPRAIKDVLADVDLLHRENVKVGALSGGEQRRLDLACALLGDPSILFLDEPTTGLDPESRRHTWQLLLDLKQRGVTMMLTTHYLEEAEFLCDRIAIMNAGEIAVEGTLDELVAREKSIISFVLRGGQVELPVLSGAEIIRDNNHVRIATTTLQQHTLEILTWAAETGIALEGFAAKPATLESVFMDIASLENTSLQTA

SEQ ID NO: 4555 - protein, 277 aa, Corynebacterium glutamicum
MTTSHTARGLQHATPERRKTSFFKTSLFKAEWLQFRRNKTLLFMATVFPVGIPLLLFLIGNGGAAESANSFDYFVMYTLLFVQFYTVLSMATTRRDERVLKRLRTGEARDIDIIGAICFPGALLTLIFTVVIIPLLMVLGAPAPINLVPIVFAVLIGLLLCSALALMTSGFTRNAEAAQMTSMPVFMLAMGGLGSIRFVFGDSIVADILAYTPFAAISDLVQIGWAGATFADSVGGVEAANFAGIFQDMLIPLGILAAWTAAAVWAANRYMRWDSYR

SEQ ID NO: 4556 - protein, 419 aa, Corynebacterium glutamicum
MNKDFWTAGWTARWFSRGVSLLASPVTAPLNSWRRLPNLAKYTLYTRVSLQAIPVVLLSAYFLGIVANAGTLNPSFVWLLGFSVILLIVTVLVYEYQPSLNSHPRRSVQPFFFTGLVLNVLGVVVSVVLQIPGLNMSDNTRATALIFTLTCVFLLSIAYIPWMNYRWVWLIAMSAVLWWTSTTTDYLSALWVVIPPLMAGTVRLSVWTVDVMKEVERSRELEASLRVTEERLRFAQELHDTLGQHLAAMSVKSELALALAKRGDDRLENELRELQKLTRTSMSEMRDVVSGYRTVNLATEIEGAKSLLADAHIHLSVIGTTSQVSPAHRELCAWLVREATTNILRHSDATDATLTLSSTEVRMDNNGVNKDIGRLSGLSALRSRAESAGMTLIVSREDDQFSVRMLINAPANTPAEKEA

SEQ ID NO: 4557 - protein, 203 aa, Corynebacterium glutamicum
MISISIADDEALIASSLATLLSLEPDLDVRPTAGSGEELIETWADPSNRTDVCVLDLQLGGIDGIDTATRLMETTPDLAVLIVTSHARPRQLKRALAAGVLGFLPKTSTADEFATAIRTVHAGRRYIDPELAAMTISAGESPLTNREEEVLELAGQGLSAEEIAVAAHLAPGTTRNYLSQAMTKVGAQNRFEAFTRARELGWL

SEQ ID NO: 4558 - protein, 68 aa, Corynebacterium glutamicum
MKHYWSMYFGAGPLNTPHTKEVWFMDIVSIVNHWFEWSTNNWVNMTGLPRETFVPAFVGSTVLAVLSF

SEQ ID NO: 4559 - protein, 385 aa, Corynebacterium glutamicum
MTAWLCSFPSGVQDEYDMMNGVVQPQEHLDATLIAADFHGNPENSGDRKERLNFQGWKYALNRTVRDVFPDGLLDLAALLTFFSILSIAPAVLLGYSVITIFLASDSTEILNLVRDEVNQYVPEDQSHVVNGVIDSIAGSAAAGQVGVAVGVITALWTSSAYVRAFSRCANAVYGRSEGRTLIKRWAMLLFLNLALLLGIIIILVSWVLNETLVMGIFAPIAEPLHLTNVLSFLTDRFMPIWIWVRFPVIVGVLIMFVATLYYWAPNARPWKFRWLSLGSFLAIVGILLAGVGLNFYFTLFAAFSSYGAVGSLLAVFIALWVFNICLIIGLKIDVEISRAKQLQAGMPAEDYSLVPPRSIEKVAKMKQRQQRLMDQAAAIREESN

SEQ ID NO: 4560 - protein, 480 aa, Corynebacterium glutamicum
MMRTTHTASSILRRMIRRQRGKVAFGAFFLGMWQLSEALVPIAIGLIVDHAVLTKDLRRLVVGLVAFVVLFVVLSFSYRFGSRALNRAVNFESHALRVEVADHALKNLDPRNLVPGEVMSRSTADADSSTRIFGQIGTGVSAATGFLGAATYLLISDWLVGLLVLVLVPIISGVVALASKGISKRSVTQQEKLAESGAQASDIMMGLRVIKAIGGERWAVKTFEKASQASARAAVDTAVASGKVAGIGELSIAVNLAAVLLLAGWRVTTGELGPGQLIAIVGVAVYLSEPIRLLSNSINASAIAHGAAERVANFLNLDESQAQYESSETINDGEFLVIVPPASTLPHGDNILATPHAADIFEGTLRSNISMNHEDNVPIDPQVIRASGLTDIIEVDGLDAPVRDTGSNLSGGQRQRVALARALHADAEVLVLMDPTSAVDSVTEVSIAQGIKQLRAGKTTIVVSSSPAFYNLADRVISHV

SEQ ID NO: 4561 - protein, 51 aa, Corynebacterium glutamicum
MPRCRLIILRRMLEAVCVVLIKTLSMCQFNSQQPNLGNTDLKQLFDKNNKG

SEQ ID NO: 4562 - protein, 578 aa, Corynebacterium glutamicum
MSNLMASSTPKQAFSAAFTQLKPHRIKLFGVVLCGVLVAVAGLVGPWAVGGLVDKLLATPSMRDVVVFALLIVAGGVVSSLGTWWGSALMARALEPAIAGLREDVLRAAVSLDANTIETAGRGDVISRIADDSREVSTAASTVVPLMVQAGFTVVISAFGMAAVDWRLGLVGLVAIPLYWTTLRVYLPRSGPLYTREREAFGVRTQRLVGAVEGAETLRAFRAEDTELKRIDAASGEARDISISVFRFLTWAFSRNNRAECITLVLILGTGFYLVNIDLVTVGAVSTAALIFHRLFGPIGTLVGMFSDIQSASASLIRMVGVINAASNQVSGTSPASASTALTLFDVSHHYHTAPVIKNASVQLEPGEHIAIVGATGAGKSTLALIAAGLLSPTSGQVALGGSSFSNVEPEALRQKIAMVSQEIHCFRGSVLDNLRIARPEATDADIHAVLADIGDSWLERLPQGIDTIVGDGAFRLTSVENQIMALARVHLADLAIVILDEATAESGSDHAKQLEDAALKVTENRSAIIVAHRLNQAKTADRIIVMDSGEIIESGTHEELRAIGGRYEQLWTAWSAR

SEQ ID NO: 4563 - protein, 655 aa, Corynebacterium glutamicum [sequence omitted]

SEQ ID NO: 4564 - protein, 83 aa, Corynebacterium glutamicum
MKGIHQEISRIERSHDYLWSVREDLHARFDNQLKAHFVDSVLDSIAEGYEGRINRFRKIFIEMKAVEELRTIAATRPSHLLAA

SEQ ID NO: 4565 - protein, 173 aa, Corynebacterium glutamicum
MIAYLTISNSLPARGIMTLPTPTHSTKGSSGRMKRMALIGSSLIISMGLITACGSAAAEPEAPAPTVTETVTATVTTTAKASTITSTVTETTSAEDLAQEIVKPAAVEEYSEPQVNTPQQFAAIPEPAPAVAPAQTYYANCAAVRAAGAAPLYAGSPGYSSKLDRDGDGIACE

SEQ ID NO: 4566 - protein, 64 aa, Corynebacterium glutamicum
MNNLDPEVEEPNISQWESLDDDIIPGNCTKVFLSEPQLMHGPLLRAFGAVATWGGSQEGSVFIV

SEQ ID NO: 4567 - protein, 303 aa, Corynebacterium glutamicum
MPIPPGLLIQLRSIFLDPAVDRGVIDRHSPLGHHLFEVAIAHAVAAVPPHRPQDDFTRELPTGEDAHGPDYSTPVFLLPQLCNSTVLGYPAGDPELQDDGWYRQAFADGFLHGKQLSTFFPAWDEFAWDDSAGGEPGVLMSRQAANYDKGPAGGNKYTDQVVLETEDMCGNEIILRRGWYNSDASRKDKPWGYDKIRHKHGVFSLWSVSIVFENSCINRIEGTQQVYEEEVYQVKCDRLFLNCEQTGQSFVYRGIYERNIYKPGATEPLGLRTFFPVHNEGTHGSSDVTPTWFSTDIPTLDLW

SEQ ID NO: 4568 - protein, 81 aa, Corynebacterium glutamicum
MLLSWIRRPGGIGKFLTGRPGPGGWMRPISGSGESGATSIGQSPPVARPWTSTSPRRETSRRRSVSWRRRCGRINRQAIRG

SEQ ID NO: 4569 - protein, 236 aa, Corynebacterium glutamicum
MGIFSGRQFPREIILWAVRWYCRYGVSYRDLEEMMTERGVPVDHTTIYRWVQKYAPELDKKTRWYRQVPDWQARSWRVDETYIRVGGKWCYLYRAITAGSQTLDFYLSPKRNVAAAKRFLAKTLRSNKSAGYPRVISTDKAPSLARAISELKAEGVCPSTVEHRRVKYLNNVIEGDHGRLKRILGPKGAFKNRTSAYRTLKGMEAMHSLRKGQGTMFAYGHPNPDAVIVSRVFETA

SEQ ID NO: 4570 - protein, 154 aa, Corynebacterium glutamicum
MVMTYKADYDLDLEKVVFRMSQLFEDLIPSENAFDYYDKSTWPTLTMAATWVQDDCLLIVFRVEESRGETFVGYFSRISPRYNPDNIEFGAVELMYADSIAGDWFIEKVDLKAPQKIHWRNTHHSLNTPADIEELLDYANEIPMWLSPDLEKWM

SEQ ID NO: 4571 - protein, 199 aa, Corynebacterium glutamicum
MTDKFDRVLAVEVCIQEWIDEQNLTLEVPLMIARLQLRDVAKDITAVHEEKFYDLTDIDTDAFVKNIKLGWNERLIKKSLFPQPDVHKQHFTETEHGIDATVTVWSKGFDPESGPDFLVSYVDGLWSADIRNRITKFQNREIVSKFYFTPEHIKEDGDFSAEIFINRPENDDDSQDLVEVWTDQDTRYCGEMIIYFKWL

SEQ ID NO: 4572 - protein, 104 aa, Corynebacterium glutamicum
MWEIDATDRGHDFPPPKFETFSELSTRIYGSRLRQYQRKRKPPLISTESAGERGVLLASPPGLEPRMTVPKTVVLPITPWGTAVINCTARVYIIVLENQLLGSA

SEQ ID NO: 4573 - protein, 217 aa, Corynebacterium glutamicum
MVRQRMTGKERREQLISIGRAVFAERGFDGASVEEIAARANVSKPVVYEHFGGKEGLYAVVIDREMVKLEAMITGSLQHGRSRYRIEQAVLALLTYVEDETDGFLILVRDMRPGERRSYGTLLNDATTQVSHILGNAFTRSGLNAEYANLYGQALVGMVSMTAQWWLDERTPPKEEVAAHIVNLCWNGLTGMEADPKLTPISSAEGAIFGQEKESEA

SEQ ID NO: 4574 - protein, 1209 aa, Corynebacterium glutamicum
MKVAATDPKLKGLMSNVGQQHLHITGIDQARPWAIGALAHHAPVLVVTATGREAEDLTAELKAMMGDKVAWLPSWETLPHERLSPGVDIVGKRAQVLNHLGDLKVVVAAARAFCQPVLKDAEGRAPLTLKEGAEFDFSALTTELVFRAYKHVDMVAKRGEFATRGGILDIFPTTLDYPVRVEFWGDEVSDIRQFSVADQRTIPEITIKSIEIFPARELLITEEVASRAESLISKHPGNPTLVEMLSRIADSQDVDGMEALIPALTDTPMVPMLELMPENTHVLVIAPEKVRRRIADLEATDAEFLMAGWEAAAMGADGPVAAEGLDLEASSYRSYESLEVSASKSDVRWWTFAPPGMFEASEEATLPLDFEAGPAPRGELPKIDAMMAQLLAHTTGGGRAAFIAPTQGAIKRMVDRFAEKGIPTHVATPGWEPTPGQVTLYHALSHAGLVFPKVRKHRDGAAMPLVVITETDLTGNRVGDIAGAKRRPAKRRNKVDPLALEPGDLVVHETHGIGRFVKMTERTISAGDETSRREYIVLEYAPSKRGQPGDQLYVPMDALDMLSRYVGGEKPTLSKMGGSDWKNAKKKARAAVREIAGELVELYAKRQSAPGHPFAPDTPWQKEMEDNFPYVETEDQMLAIDAVKEDMEKSVPMDRVIIGDVGYGKTEVAVRAAFKAVQDGKQVAVLVPTTLLAQQHQSTFEERMTGFPVTIKGLSRFTSPAESREILSGLAAGSVDIVIGTHRLLQTGVQWKNLGLVIVDEEQRFGVEHKEHIKALRTHVDVLTMSATPIPRTLEMSMAGIREMTTMLTPPEDRHPILTYVGPYEDKQVAASIRRELLRDGQVFFIHNKVADIEKKAREIRDLVPEARVVVAHGQMSEELLEQTVQGFWDREYDVLVCTTIVETGLDISNANTLIVENAHHMGLSQLHQLRGRVGRSRERGYAYFLYPKGATLTEMSYDRLATIAQNNDLGAGMAVAMKDLEMRGAGNVLGAEQSGHIAGVGFDLYVRLVGEAVEAYRALADGKVVDGTVKGPKEIRVDLPVDAHIPEKYINAERLRLEIYRKLAQSESEVDLRLAVEEMEDRYGPIPEEVERLLAVSRLRHLMREAHLTDIAVQGTRIKVHPVDLADSQQVRLKRLFPGATYRAAAKAIQLSFPKTGNKVTDPLLRDVDLLQWVANFISNMFNLEEIDVRGPQPGKPKKKSSVISVSL

SEQ ID NO: 4575 - protein, 408 aa, Corynebacterium glutamicum
MNHQIPWLQRQRIHLVAAFCRSTFRPCNIANTVTSQIGFCNNHQRHCSAIAVFTHLRKHQASMAQRMIKSHLTRRWLPTRGRHMGGNALFRETIDHALNRTLGRRDKRSPPTAGCVRKQLRHHRIDLRQLTARRRPGFKIKRQRRLLRGLKHARRRESPPTHIAFRRRNLQTFITAIARSFQVQAFRSHWTISTHRSCFPTSHQKLSIGCFQIRNASAHLLRSNHQHMGVFRHELQHRNHRRIRQRRNQRLHAINILGIRNPRQHLHKRRVARVLRNKRLRTRCHFFSNEQFPCRENLNALDGDFWNGALIGDRELPNVRDFIAPELHTHRIIQCGGENIQNATAGSKLTALGHHIDMLVRTENQLSGQGREIKLRAFFKSEGCTTFSIFEYRLAKRTRSSHHDFEVA

SEQ ID NO: 4576 - protein, 76 aa, Corynebacterium glutamicum
MTISTDPAAKPERISRDSAGEVKRDNPLMVTGKPVIRSSNVDWCCCASNVVGTRTATCLPSCTALNAARTATSVLP

SEQ ID NO: 4577 - protein, 656 aa, Corynebacterium glutamicum
MSNTAGPRGRSHQADAAPNQKAQNFGPSAKRLFGILGHDRNTLIFVIFLAVLSVGLTVLGPWLLGKATNVVFEGFLSKRMPAGASKEDIIAQLQAAGKHNQASMMEDMNLVPGSGIDFEKLAMILGLVIGAYLIGSLLSLFQARMLNRIVQSAMHRLRMEVEEKIHRLPLSYFDSIKRGDLLSRVTNDVDNIGQSLQQTLSQAITSLLTVIGVLVMMFIISPLLALVALVSIPVTIVVTVVVASRSQKLFAEQWKQTGILNARVEETYSGHAVVKVFGHQKDVQEAFEEENQAVYKASFGAQFISGIIMPTMMFVGNLSYVAIAVVGGLQVASGSLSIGGVQSFIQYSRQFTQPLSQLGSMANLLQSGVASAERVFELIDEDEQDSDPAQPNTVAAGANRLEFKDVSFGYSEDRPLINNLDLEVRSGSTIAIVGPTGAGKTTLVNLIMRFYDINSGSITLGETAQDAVDIRTMAREDLRSRTGMVLQDTWLFAGTIRDNILYGRPEATEEEMLAASKAAYVDRFVRSLPEGYDTVLDDEAMNLSVGERQLITIARAFLANPRLLILDEATSSVDTRTELLIQRAMSKLRQDRTAFVIAHRLSTIRDANLILMMKDGEIVEQGNHRELMALEGAYWELYNSQFNAPAKEELQADGDH

SEQ ID NO: 4578 - protein, 577 aa, Corynebacterium glutamicum
MLWSILVRFLKPAWPLILTVIIFQLAQSITSLLLPTLNADIIDNGVVTGDIGYIWHTGGIMLALTLVQVACAIAGVYFGSKLSMRVGRDLRSAIFGKVVNFSEREMGQFGAPSLITRNTNDVQQVQMLVQMTSTLMISAPMLAIGGIIMAVRQDLGLSWLMVVSIPVLIIVVALIIVRMVPLFQTMQKRIDRINQIIREQLTGIRVIRAFVREDVERERFTTASKDVADIGVRTGNLMALMFPAVMLIMNLSAVAVIWFGAFQVESGETQIGTLFAFLQYIMQILMGVMMAAFMFVMVPRAAVSADRIGEVLETTPSVQAPETPAQPSTSAGEIVFNNATFAYPGADDPVLNNVSFRVAPGSTTAIIGSTGSGKTTLIGLVPRLFDVTEGDVTVDGTDVREFEPLKLWDRIGLVPQKSFLFSGTIASNLRYGNEDATETQLWQALAIAQAADFVREMPEGLDSEIAQGGTNVSGGQRQRLAIARALLKQPEIYIFDDSFSALDVSTDAALRRALSTNLPDATKLIVAQRVSTIRDADQIVVLDNGEVVGIGTHTNLLNTCGTYREIVESQETAQAQS

SEQ ID NO: 4579 - protein, 794 aa, Corynebacterium glutamicum
MFGAEDPANSSLVDNLGLTLPWSLNDPHFLTAGFSASTTTAALMSTLWIIVFAVPSERILGSLKFAITAALIHITSIPLGIGIAHLIEEADLNRWGNNMLADVLLTPDFWVFGVAAFASASMPLLWRRRTRLFLFTITLTLLLYTGTLADVTMLTATIIGTVAGELNRHRKTPGGRWLPGSLTVREARIMTAILVTAVAAGPVLAALNPLTHGPFSSATKLIWQPLVTEEHMHHLCHTDSTSDACQGALDQLQQHGVGPSVANLIPLILTVVLAMGLSRGRRLAWILAVLAQLISIAVLMFQLTKLSADSTDLLWSVNAFSVIVPWLVALAVLVFSRRAFQVKIDTTRISKSLGALMVTWLATAALWILATLFLPHAFHPHPTLGLAFKELPFRYLPPTIETVLSHQLFPRSPAGWAVFEWTGTLFWLVVAATLYHLLMGVPSNKAHEDQENAATLLRSGSGDHLSWMTIWGGNTYWWAPENAGYVAYRVKRGIAITLGEPILGPDSSVSKAELAAQFEEFASNQGWIVAWYSVCEEFSKERINAGHHTLRVAEEAVLSSANADFKGKHFQNVRTARNRAAKEGVSSIWTTWADLSAEMQHKIITLSEEWVSDKALPEMGFTLGTVNELSDPDTYLLLAIDEEEHLHGVTSWLPVYEKGRIVGYTLDVMRRDPQGFKSVIEFLISEAVVIARDHDLEWMSMSGAPLSTPPGVADDGTIGQILELLGRAMEPFYGFRSLAASKNKFHPEHHGWYLCYRDELSLPSIGLAVAACYLNEFPLPNWLKKTATSAPSHS

SEQ ID NO: 4580 - protein, 99 aa, Corynebacterium glutamicum
MTYGEVAKLRVILGPINQVQMNCLERLETMGIFDEAKKKATEFLDSDSGEQKSDGLLDKAADKAKGLLGEDKADQINKVRDAVDERIGKNNGGEENPAN

SEQ ID NO: 4581 - protein, 195 aa, Corynebacterium glutamicum
MRVVVVDPKHPVLPVSFLEAVLGRGEPVSIDPDFPFDIEKWGIKTSTSASWFIIAKPQSTLLIDAPLNPLHEAVGVMRAAVGRGEWERTQTHESLIPYLEEESQEFIEAIHGGDDEHMKSELGDVLLQVLFHAEIAARQGRFDIFDVAASFVAKMQSRSPYLFDGSTGIVDTDEQQRLWAQGKAQEKLSSEEGRR

SEQ ID NO: 4582 - protein, 142 aa, Corynebacterium glutamicum
MWLLPYLFHFHLSDLLRKPMKKLRFATIAAATVALTASLTPSASAQDFNQIIDNFDCGILQTAIYTTGLAHENSTRSELAANLRNSAAVGQLDFPLNIAATGYSERIANRALTCGIVKEDPQDFLSQLQLLSSNLSSSFFTA

SEQ ID NO: 4583 - protein, 126 aa, Corynebacterium glutamicum
MKLSHRIAAMAATAGITVAAFAAPASASDFANLSSTNKELSPQYNWVACGILEGGLKAAGVLEEGQYNRELAEAIAAKGEGFWTTQFPQIGDWNEDQAAALADRAQTCGLVKADTYLSELSSNFSS

SEQ ID NO: 4584 - protein, 262 aa, Corynebacterium glutamicum
MSSGVRKAMGFGCGSVLAVIMVISFVGWALSFMDGTAPIRQLQQIPEDVPPARGVEVPQIDTEADGRTSNHLRFWAEPIAQDTGVSAQAIAAYGNAELIASTAWPGCNLGWNTLAGIGQVETRHGTYNGKMFGGSSLDENGVATPPIIGVPLDGSPGFAEIPDTDGGELDGDTEYDRAVGPMQFIPETWRLMGLDANGDGVADPNQIDDAALSAANLLCSNDRDLSTPEGWTAAVHSYNMSNQYLMDVRDAAASYALRQPAI

SEQ ID NO: 4585 - protein, 425 aa, Corynebacterium glutamicum
MAEIMHVFAREILDSRGNPTVEAEVFLDDGSHGVAGVPSGASTGVHEAHELRDGGDRYLGKGVLKAVENVNEEIGDELAGLEADDQRLIDEAMIKLDGTANKSRLGANAILGVSMAVAKAAADSAGLPLFRYIGGPNAHVLPVPMMNIINGGAHADSGVDVQEFMIAPIGAETFSEALRNGAEVYHALKSVIKEKGLSTGLGDEGGFAPSVGSTREALDLIVEAIEKAGFTPGKDIALALDVASSEFFKDGTYHFEGGQHSAAEMANVYAELVDAYPIVSIEDPLQEDDWEGYTNLTATIGDKVQIVGDDFFVTNPERLKEGIAKKAANSILVKVNQIGTLTETFDAVDMAHRAGYTSMMSHRSGETEDTTIADLAVALNCGQIKTGAPARSDRVAKYNQLLRIEQLLGDAGVYAGRSAFPRFQG

SEQ ID NO: 4586 - protein, 48 aa, Corynebacterium glutamicum
MRRSWLYFATRSERAGAPVLIWPQLSATARSAMVVSSVSPERWDIMEV

SEQ ID NO: 4587 - protein, 180 aa, Corynebacterium glutamicum
MAKQKKTHKGLVPVSSRERASESVSATRAPFRLGAVGIGAIALVVLLILFVIAIPVRNYFQLRSDIAQTEASIEAKEQQIKQLESDLNRYQSEAYIREQARLRLGVIEPGETAFRIVDPALDTDTSVTSDGNEEKPLGAWYENLWDSVTKPEALGEEEIAPPAVEGEVPTLAPTEEATVQ

SEQ ID NO: 4588 - protein, 182 aa, Corynebacterium glutamicum
MNEADLNAVEEQLGRAPRGVLDISYRSPDGVPGVVMTAPKLDDGTPFPTLYYLTDPRLTTEASRLEVALVMKWMTDRLSTDEELRADYQRAHEHFLAKRNAIEDLGTDFSGGGMPDRVKCLHVLIAYALAEGPDHFRLGTEAVAMAAEHGDLRGTAIPEDWPTVQDLGINMEDFDFSRAGGA

SEQ ID NO: 4589 - protein, 321 aa, Corynebacterium glutamicum
MTRYAAIDCGTNSIRLLITEVTPEGFKEITRENTIVRLGKGVDATGQLDPEAIERTRVALENYVELMETHGVEAVRMVATSATRDASNRDEFFSMTRQLLSKIRPGYQAEVISGEEEALLSFRGAIVDLPEDQGPFCVIDLGGGSTEFIVGTYDGEILGSHSTQMGCVRLTERIMRSDPPTETEVEIARDYVAERIQEVKAIVPISKAKTFVGCAGTFTTISAWVQGLESYDRDAIHLSALNFDALRVVTDEIISESSSQRASNPVVDPGRADVIGGGSVVVQAAIDLASKEAGVDYIIISEKDILDGLILGLVEADSLKK

SEQ ID NO: 4590 - protein, 328 aa, Corynebacterium glutamicum
MFRNRWPRNGSLSPTCSGEIKVLHVDAQVLYCWPVLWDGGTAEVAVFGSHCYCFGAETEMVWAFCQCIGDEDVEALHSVRHATAGEIRAEIFNCVALCQEVLVGALVVGTKLFVGGKAISHPLHYQCDLEAGCLGGQAWICQVVQGWEWGSVIQFWCGHHHTGYSIRAAVRNIEDTSWGPSQLLFDSVQICFIHTHVFYSVMSLCLKRYCTVASSVGASVGTSPSTAGGAISSSPSASGLVTESQRFSYQAPSGFSSLPSEVTEVSVSSAGSTILNAVSPGSMTPRRRRACSRMYASDWYLLRSDSSCLICCSLASMEASVWAMSERS

SEQ ID NO: 4591 - protein, 310 aa, Corynebacterium glutamicum
MLTLNDVITAQQRTAPHVRRTPLFEADPIDGTQIWIKAEFLQKCGVFKTRGAFNRQLAASENGLLDPTVGIVAASGGNAGLANAFAAASLSVPATVLVPETAPQVKVDRLKQYGATVQQIGSEYAEAFEAAQTFESETGALFCHAYDQPDIAAGAGVIGLEIVEDLPDVDTIVVAVGGGGLYAGIAAVVAAHDIKVVAVEPSKIPTLHNSLIAGQPVDVNVSGIAADSLGARQIGREAFDIATAHPPIGVLVDDEAIIAARRHLWDNYRIPAEHGAAAALASLTSGAYKPAADEKVAVIVCGANTDLTTL

SEQ ID NO: 4592 - protein, 65 aa, Corynebacterium glutamicum
MPAIELPEPNEPVPAGDFIADPDATMHYFAVDRSGSLQWEQGSFSYFDVEAHIVELIPASVSDAF

SEQ ID NO: 4593 - protein, 110 aa, Corynebacterium glutamicum
MGVSYIIAGDEQLDMAEAVRKIGETFKTEEIILGGGGTLNWSMLRDGLCDEVSIVMMPIADGEKHTHSLFEADEKYSAPLPIGFSLASVEPLEDGSVWMRYGVNGPVDAN

SEQ ID NO: 4594 - protein, 63 aa, Corynebacterium glutamicum
MDKVKFFRSRDNKNIAGVCAGVAKYYDLDADTVRYWYVFAHFFGVPMFSVYLIQWLIYPQEES

SEQ ID NO: 4595 - protein, 331 aa, Corynebacterium glutamicum
MSSASLLWCHSGVSTVRFGERIFTLVAGDLLFAPEEAQVADDSQGLVLNIRFETLNIMGPARRIHLGHVWNDRLTFEYSRSLFGKETLSPDIARLFTDRVPTPPLPAPRKARAVAQVLVSNPADQTSLEEFAEIQGVSARTLQRQFLKSTGYSFSEWRAAQRVCVAASLLAHDFSISVVANLVGFAATSSLTRAFRRHTGATPSTFTTGQIGMGSAGHPPRIPATTTFAEAHQDQQLWIYSGTATVTTPGYCRFMGQGDMVTIPAGTQTRIDVAAGSIAFPVPVGLDEWGMDLTRVVAVNNQQPKPLTILEQSEWSKLSEELLNTPVPVQM

SEQ ID NO: 4596 - protein, 272 aa, Corynebacterium glutamicum
MRSSNPVFSSLKETQRPQGQNPYGGYDNFGGVYQQNVAPQKAERPMTVDDVITKTGITLAVIIVFALVTFGVWLVSPGLGMILTLVGAIGGFITVLVSTFGKKYGSAAVTLIYAVFEGLFVGGISLLLSGFTVGNANAGGLIGQAVLGTIGVFIGMLFVYKTGAIKVTPKFNRILTGMMVGVLVLVLGNVVWALFTGGASPLRDGGIIAIIFSLFCIGLAAFSFLSDFDAADRLVREGAPSKMAWGVALGLAVTLVWLYTEILRLLSYFQNR

SEQ ID NO: 4597 - protein, 129 aa, Corynebacterium glutamicum
MLSSPGGYLRSLNCVHEFAYGNDSLRRPQAILRSHFLWAPWQFLLGPTAELHIRTKEPQKSSSLWSQTHIYRALKCAFETKEPSTTHVFGLDMTGAQELTPPHAHRAPIRSQKTPSLPKKNRMKGSCAA

SEQ ID NO: 4598 - protein, 150 aa, Corynebacterium glutamicum
MTTLSRKFFVSATTALAAVALVACSPNEIDSELKVPTATGVSLPSKNVSATSTATTDEDAPGYIDCVAAPTQQPAEISLNCAMDIDRLTDISWSEWDTDSATGTGTRIVTAANGQETETEDIEVKLSFPTESSQGLVFTQVTVDGQVLFL

SEQ ID NO: 4599 - protein, 174 aa, Corynebacterium glutamicum
MASVDKQYITPETKAKLEEELNALIAHRPAVAAEINERREEGDLKENAGYDAAREMQDQEEARIKQISELLANSTTEREGIIEGVANVGSVVHVYYDGDENDKETFLIGTRAGASENPDLETYSEQSPLGAAILGAQEGDTRQYTAPNGSVISVTVVSAEPYNSAKAATLRGKN

SEQ ID NO: 4600 - protein, 161 aa, Corynebacterium glutamicum
MSTNSNSPSNASGASNIPNTQRPASRYNSPRPEAAAGRNISGKIIAVIGVLLVIAIVIVGANFLKNRDAQTVSGQMGSFERIDDDTFRFEVDVTRDDPSQVAYCIVTAKDYSHAEVGRREVLVEPSDHSTVRISTLIPTREPAVSGGVYGCSTVIPSHMNL

SEQ ID NO: 4601 - protein, 291 aa, Corynebacterium glutamicum
MSGLRLMAIHAHPDDESSKGAATMARYAAEGNQVMVVTCTGGERGDILNPAMDKPGILDNIFAVRQEEMAKAMEILGTEHRWLGYEDSGLPQGDPLPPLPEGCFALEDSDKVTQDLVKILREFRPHVIITYDENGGYPHPDHLKVHEVSMLAWEKSGDAAYAPELGAPWEPLKLYYTHGFIRQRMEMFHDLLIEQGKPSPYTPMLERWKANEADVMARVTTQVPCERFFDQRDDALRAHATQIDPAGAFFGTPVEVQRRLWPTEEFELAKTRVKTSIPEDDLFAGITPDAE

SEQ ID NO: 4602 - protein, 106 aa, Corynebacterium glutamicum
MIDLSPVFNTAAGVYNDTNAIILAQQQQGGPLGPEFGKASPVGLLLIVAMLVAILVLGWAFHRRWSRMNRRRIFAERNGLDPFDIEGVRKAMAEAGLNEKSKKGFL

SEQ ID NO: 4603 - protein, 366 aa, Corynebacterium glutamicum
MSSPVSLENAASTSNKRVVAFHELPSPTDLIAANPLTPKQASKVEQDRQDIADIFAGDDDRLVVVVGPCSVHDPEAAIDYANRLAPLAKRLDQDLKIVMRVYFEKPRTIVGWKGLINDPHLNETYDIPEGLRIARKVLIDVVNLDLPVGCEFLEPNSPQYYADTVAWGAIGARTTESQVHRQLASGMSMPIGFKNGTDGNIQVAVDAVQAAQNPHFFFGTSDDGALSVVETAGNSNSHIILRGGTSGPNHDAASVEAVVEKLGENARLMIDASHANSGKDHIRQVEVVREIAEQISGGSEAVAGIMIESFLVGGAQNLDPAKLRINGGEGLVYGQSVTDKCIDIDTTIDLLAELAAAVRERRAAAK

SEQ ID NO: 4604 - protein, 211 aa, Corynebacterium glutamicum
MILAGVSMGSIDHETSVFTKLLDDGLHRSCIMIRAGGTAAQNDVGVAVACGLHDAQRAVVGGSEEEVWVLGSLYRVDCNLDVSVSSVLETNWHRHPRSQLAVHLRFGGTSADCSPCDSVGVVLRAVWFEEFAADWEIKVHNVDKHFARNAQALWDVVGFVEVRIIDQSLPSDDGARLLEVHAHDNLEVLIKALCQRSQAVCVIDGCFRIVN

SEQ ID NO: 4605 - protein, 225 aa, Corynebacterium glutamicum
MCDGNRRWAREAGFTDVSHGHRVGAKKIGEMVRWCDDVDVNLVTVYLLSMENLGRSSEELQLLFDIIADVADELARPETNCRVRLVGHLDLLPDPVACRLRKAEEATVNNTGIAVNMAVGYGGRQEIVDAVQKLLTIGKDEGLSVDELIESVKVDAISTHLYTSGQPDPDLVIRTSGEQRLSGFMLWQSAYSEIWFTDTYWPAFRRIDFLRAIRDYSQRSRRFGK

SEQ ID NO: 4606 - protein, 58 aa, Corynebacterium glutamicum
MSSDFPDSCCGNLPTPKSGSQTPTGQPSDASTSSAPFATTRSAAEDSVNNLFSKERHV

SEQ ID NO: 4607 - protein, 173 aa, Corynebacterium glutamicum
MSDYIVAFESAYGSTKQYAESLAQRLGVDALNFEQACAELAANPTAAIVVLSFVHGPSHPGAKFITDTDLSGHRVALCTVGMTLDDVVQKKDGAARSLGNKADDVTRFYLPGRLNYSELSTAHRTTMWTIVNMLKAKPLKNDNDKMMINTFDTDVDRVDESRLDAVEEWARGL

SEQ ID NO: 4608 - protein, 106 aa, Corynebacterium glutamicum
MADFYGSAVFDPVRPRQVEIETKAALIEGSFGLNLHLSRRLSVMLNQGVEPHCGFWPQNAVELKTHCIQRRCAQKYIGLNSLLKAWRQHIQTHTPSKIPTAQNASQ

SEQ ID NO: 4609 - protein, 312 aa, Corynebacterium glutamicum
MKPSPRTPDFSPYLDFDRAQWRELRNSMPQVLTQKEVIELRGIGENIDLAEVAEVYLPLSRLIHLQVAARQQLTAATETFLGTSPSISVPFVIGVAGSVAVGKSTTARLLQVLLQRWNSHPRVDLVTTDGFLYPGAELIRRGLMSRKGFPESYDQRALLRFVTDVKSGKLEVNAPVYSHTAYDRVPGEFTTVRQPDILIVEGLNVLQTGPTLMVSDLFDFSVYVDARTEDIEKWYIDRFLKLRDTAFRRPGAHFSHYADMADPESIAVARELWQSINLPNLVENILPTRVRASLVLKKGSDHLVERVRMRKI

SEQ ID NO: 4610 - protein, 434 aa, Corynebacterium glutamicum
MTDAHQADDVRYQPLNELDPEVAAAIAGELARQRDTLEMIASENFVPRSVLQAQGSVLTNKYAEGYPGRRYYGGCEQVDIIEDLARDRAKALFGAEFANVQPHSGAQANAAVLMTLAEPGDKIMGLSLAHGGHLTHGMKLNFSGKLYEVVAYGVDPETMRVDMDQVREIALKEQPKVIIAGWSAYPRHLDFEAFQSIAAEVGAKLWVDMAHFAGLVAAGLHPSPVPYSDVVSSTVHKTLGGPRSGIILAKQEYAKKLNSSVFPGQQGGPLMHAVAAKATSLKIAGTEQFRDRQARTLEGARILAERLTASDAKAAGVDVLTGGTDVHLVLADLRNSQMDGQQAEDLLHEVGITVNRNAVPFDPRPPMVTSGLRIGTPALATRGFDIPAFTEVADIIGTALANGKSADIESLRGRVAKLAADYPLYEGLEDWTIV

SEQ ID NO: 4611 - protein, 620 aa, Corynebacterium glutamicum
MRVLIIDNYDSFTFNLATYVEEVTGQAPVVVPNDQEIDEMLFDAVILSPGPGHAGVAADFGICAGVIERARVPILGVCLGHQGIALAYGGDVDLAPRPVHGEVSQITHDGSGLFAGIPETFEAVRYHSMVATRLPESLKATATSDDGLIMALAHEVLPQWGVQFHPESIGGQFGHQIIKNFLNLARTYRWQLTEKTIPLSVDSAAVFETFFAHSSHAFWLDDAQGTSYLGDASGPLARTKTHNVGEGDFFTWLKEDLAANSVAPGQGFRLGWVGYVGYELKAEAGARAAHTSSLPDAHLIFADRAIAVESDQVRLLALGEQDEWFEETIKKLHNLVAPRIPASGHLALQVRDSKDEYLDKIRRAQELITRGESYEICLTTKLQGTTDVAPLAAYLALRGANPTAYGAYLQLGDTSILSSSPERFITIDSAGYVESKPIKGTRPRGRTAQEDQEIIAELRSNPKDRAENLMIVDLVRNDLARGALPTTVKTSKLFDVETYATVHQLVSTVSAELGPRSPIECVRAAFPGGSMTGAPKLRTMEIIDELEAAPRGIYSGGLGYFSLDGAVDLSMVIRTLVIQNNHVEYGVGGALLALSDPEAEWEEIRVKSRPLLNLFGVEFP

SEQ ID NO: 4612 - protein, 241 aa, Corynebacterium glutamicum
MTYLVWDGATLVEGALESTPTVVDSYLAKDHRVVRWDLHEQRFATSVDVDPWDFLHAVREAIPRQGSWFPKVEWHGDDLFAVNIRPAPTLRKATSLWLSEDPDPRTQPTIKGPDLDVLAHLRSRANDNGCDDALLISADGFILEAANATVVFWADPQTVIVPRGDVLPSVTLAATIPLWEKAGITLRYQNIRHIGFPAWCGSSLHGWTPVVSWGRGLGKIAAAKAPSVKPWNEKLRPTIFL

SEQ ID NO: 4613 - protein, 288 aa, Corynebacterium glutamicum
MEPLRWVFLQVLELLVSQCTCLELLWRGGQKQSELLSGGLWLHSPARWLAYRFFVHAHNGSIVFMLTLSFITGTEPGKWFTRFRDRTHHGGLETLDSDDALGLMLAGQAQLALTRLPDARIDASLHVVTLYQEQPGVAFPKDFFLSAEEGAVDLADLDGEIINWSMPDSGEVDAAAVRDALQIVAANVGVVIAPRPLLKVLSKKLVEHRDIKGGTETSIALVWKKDEDSEEIQDFVGIARGRTRNSSRQQTVKLSAREKTLAKQARRQGEKPKTPKRPQARKRPGKRR

SEQ ID NO: 4614 - protein, 131 aa, Corynebacterium glutamicum
MGVNEESVRQPSGRAMKPQTAAKKLGLFLPATPEEFQTGALTHQEFKNLQENPPEWLQTLRREGPHPRPVVAQKLGITIAALKKNDMDKPLTTAEIKALLENQPEWLRTARTQLAEGRETAKKETEETTED

SEQ ID NO: 4615 - protein, 179 aa, Corynebacterium glutamicum
MVERDFTIRPIREGDFPQVRDIYELGLETGHATYETSGPTWDQFSQSKIMDTVMVAVENNDPDFILGWVSAAPISSRQVFHGVVEDSIYIHPQGQGRGIGGALLDALITYCESNGIWSIHSWIFPENLGSAKLHESKGFVKVGTMHQMARMPYGEMEGQWRDCDLWECLLSVPEQAQSS

SEQ ID NO: 4616 - protein, 293 aa, Corynebacterium glutamicum
MSFKVISTGPQAIFQDRGRFGFASAGVGTSGSFDRLSAARANHALGNDPNATVVEILLGGFEVEALHTTSIVFTGTEAEVMVRTAGGQSKNATTNTIIDVAAGERIRVEPATYGMRAYFAARGGFAVEKTLGSASTDLISHMGPRPIEPGDVIDVATDIADSQWWPKLRQLPTLWKRMPTETLTVIRGPRDKWFTQESLNNFFTQVFTVSNDSNRIGLRMHSSEPIQHRVEGELKSEGMVRGSIQIPPGGNPVVFGPDHPVTGGYPVIAVLTSRSCDRSAQLLPGDKVRFKLL

SEQ ID NO: 4617 - protein, 352 aa, Corynebacterium glutamicum
MVSVSSAAPFAAGVSAIESTISAKRFGVICLVSNVTNSVCAAGIVSMIPGTCMPTKERLSARTASKMLPWTASASSASKSMMTACSPHGLTSMGNLNLMSCKGGHDFLHQCESLRIIPMNTDGVGVDKHALPGDRGDGLAGGKRQGLPGCGFGVVQYRAGKLAGNQLAIGGVGAVGESFLLNLKPHGAGLLDDLGASQGHEGELRIDQLDALDDCCGLGFVNRNGVVQRAVWFYIFHNRTAGFSRSLNGADLVDRFGDEVIVSDVEVAATKTCDVVVTNVCADADVACMGCAHSFEQHSGVAGMETAGNIGAGHQVKNSYVVAHDPAAVAFAEVAVEIDGGHEKILSKNVNC

SEQ ID NO: 4618 - protein, 223 aa, Corynebacterium glutamicum
MRFRFPMLVRPCGEQAVIIDLLAEDAEAVQGSILDAVLALNRSLVGMQVPGIIDTIPAAQTLLVTFDTKQITPNRFAEIVDSIALTPAAKGAAELTDTIEIPVVYDGPDLETVAQHTGLSVEEVIATHSGTVWTAAFGGFAPGFYYLIPQTPLWDIPRLESPRTKIPAGSVAVAGEFSAVYPQQSPGGWQLLGTTEIPMWDVDRWQPSLLKPGDSVRFVQVKK

SEQ ID NO: 4619 - protein, 252 aa, Corynebacterium glutamicum
MTTIDLNSDLGESYGSWVMGNDVAVLDLVSSANIACGFHAGDATVLFKTVRAAHARHVRIGAHIGYNDIAGFGRRNLDIAHDDLVAETIYQIGAIQAAAKASGAVVEYVKPHGALYNTIAVDEAQAAAVIEGIKLVNPELSLMALAGSQIVEQARAVGLQVEQETFADRAYTADGQLVSRKLPGAVLHDPETAARQALAFATGQPITAITGESVLVDANSICVHGDNPQALALVEKIVTTLAAHEVQVSHAR

SEQ ID NO: 4620 - protein, 197 aa, Corynebacterium glutamicum
MLDSGRTGPNNVKAVSNSSITGILITGLMRVVLFLAVLGVVAGGVTLSTTGNPAAEAFQHAAGDIGLRIFGAVLWAASISSVIGASYTSATFLVENKPEKKRLQNWVTIIFILISCSVFIVLGTAPAILLVFAGAFNGLVLPVGFTLMIYVAIFRQKDLLKGYKYPVWLIVVGVIGLVIAWFLAYVSFGGVFDLLSS

SEQ ID NO: 4621 - protein, 224 aa, Corynebacterium glutamicum
MCASVSDVSTDGSTHKCGDDKPVDGVRKYCILQRRANWRLGDESHVDGEQDHHDAEDHEEFVQSSTKSLEQEDRNRDGRGDHATNFDVPAKQRVKPKATTGDVADVEYYAANTDQYGQHPTKTWDNRVAEFLGAHFRDADDAPHIQLHRDVNEDRHQDRKCESCAELVGEDSGLGEEPWADGRSCHEEDGTHQSASARGGYCSLLEGWRIGFCNVARPRGSSAG

SEQ ID NO: 4622 - protein, 201 aa, Corynebacterium glutamicum
MSRIITTPRTTRNLSRAAPSRLNKKIAIAMAAVITPPTLTSQPSSALSPRPPPAMLPMLNTTPPIQTSTASTQPKPGITVLPSSWARISETPMMRHTFSCTAMSMRIDTRIANAKAAPSWLVKTAVWVRNPGPMAEVAMRKMAPIRALRPEAVTAACLRDGALAFAMSPGPGVPVLAETSWLSSAFLLSAIVALLSWGLSK

SEQ ID NO: 4623 - protein, 227 aa, Corynebacterium glutamicum
MCPQSFKISHMTQAIAASLDLAARITAKIDQGVLTPGTRLPEVALAEELGVSRNTLREAFRVLMQDGLVDHIPNRGVFVHTFTKSDVEDIYAYRTFIEVAAIRSARKNPQLLEQSLGVMREAYERGAAANAVGDWQTVGSANSAFHLAIVDLAGVARLSADARKVLALARIGFMATYNVETFHSIYVEKNHQILKYLAAGEFEEAEQYLQKYFEDSRDDLSAHLPEF

SEQ ID NO: 4624 - protein, 426 aa, Corynebacterium glutamicum
MVATTPGKEAHPMAFGFFSRRKKKNKDKNPNENSAVPAHSEDSPQEVFEGNGRQVGDPIEQQVDRDAKGRLTAADFLPDADLPQLNRSRANMLRRELEYRFSLQNAHINIDGNTAMIQRSDGGAAHVSLRTLAMNAAGLDNFDQLPELVESFVHGTLADATLNDLSTADLYKALRLRLLPTPGEGDDLVEHGLDRESQIRDDSILRTFTSDMSIALVLDTEHAIRIQPLKELEEFDDLSALERAADRNTWQELYDANVDASFVDAESDSEGSSFWAFESNSYYLGSAPLFLNDLLAKWAPDLDQSDGVIFAVPDRDLLIARPVTTGEDLMNGITAMVRIAMRFGLGNPTSISPRLHLLRDNQVTTFTDFRVVSPEMEAEWEDSAFDAPPAGAIGIEVRPDPYLMERLQQGGFGDFGDFGKPRDLDM

SEQ ID NO: 4625 - protein, 473 aa, Corynebacterium glutamicum
MSDFMTEQEFRIEHDTMGEVKVPAKALWQAQTQRAVENFPISGRGLESAQIRAMGLLKAACAQVNKDSGALDAEKADAIIAAGKEIASGKHDAEFPIDVFQTGSGTSSNMNTNEVIASIAKANGVEVHPNDHVNMGQSSNDTFPTATHVAATEAAVNDLIPGLKVLHESLAKKANEWSEVVKSGRTHLMDAVPVTLGQEFGGYARQIQLGIERVEATLPRLGELAIGGTAAGTGINTSADFGGKVVAELINLTDVKELKEAENHFEAQAARDALVEFSGAMRVIAVSLYKIANDIRLMGSGPLTGLGEIRLPDLQPGSSIMPGKVNPVLCETATQVSAQVIGNDAAVAFSGTQGQFELNVFIPVMARNVLESARLLANTSRVFATRLVDGIEPNEAHMKELAESSPSIVTPLNSAIGYEAAAKVAKTALAEGKTIRQTVIDLGLVDGEKLTEEELDKRLDVLAMAHTERENKF

SEQ ID NO: 4626 - protein, 163 aa, Corynebacterium glutamicum
MTSAITTATDLRSVLRNVPTPISFIATHTDQPLGMIVGSFVSISAEPPLVGIFLQKSSSSWPAIEQALVTGQELGISILGGAHADHVRKLSGPSDQRFENLGWASTENGAIHLEGADAQLTTKLHDLQEIGDHFFAVLEVIDASADQDFSSALVYHRSQVSSL

SEQ ID NO: 4627 - protein, 87 aa, Corynebacterium glutamicum
MSWAFNGFLSDDALVELMGLDFRNRTDYFTTEEQKLYGMELKTAIENPDSAAFINHVRIIREKRGREPLNTEQEESLHTHHKAFHEF

SEQ ID NO: 4628 - protein, 149 aa, Corynebacterium glutamicum
MELSAHTPLEEFHQILTRLRIQLLAEHAHRSTPSPAWTPTTPGLFTYDDEAFSGVIIRKFPSSTTSERWLIIGSDWEDISPFQSKEKGHLHISPAAPEWTGLVSLEDFYPYRGSVIGDAPSSVTWFEDGIWHVSGERKKQWDTLDPHRP

SEQ ID NO: 4629 - protein, 188 aa, Corynebacterium glutamicum
MSKIAIITGSTRPGRVNIDVANWVLERAQERNDAQYELVDIADFNFPVLDEAMPAGYGQYANEHTKAWAAKIAEFDGFIFVTGEYNHSVPAALTNALSYLSAEWNNKAAGIVSYGSAMGVRAAEHLRGILSELQIAHVQKTGLLSIFTDFEYPNFKPSEQGISSVDAMLEQLVVWTKAMSTIRESANV

SEQ ID NO: 4630 - protein, 496 aa, Corynebacterium glutamicum
MSILIKEQNMATAENTTQENRKILFNAFDMNCVAHQSPGLWTHPKDKARDYNTLDYWVHLAKTLEKGLFDGLFIADVLGTYDVYGSSNEAALSSGAQVPVNDPILLVSAMAYATKNLGFGITAGTAYEHPYPFARRLATLDHLTNGRVGWNVVTGYLPSAAQNMGDTDQLPHDERYDKADEYLEVIYKLLEGSWEDDAVQNNTETSVFTDSSKVHAINHHGKYFDVPGIAITEPSVQRTPVIYQAGASPRGLKFAGENAEAVFINSSTVEAITKTVAKIRAAAVAAGRDPHAVKIFAMQTIITGETEADAQAKLEEYSRYIDPVGGLTLMSGWTGADLSQYDLDEPITNIESNAIQSTAATISNGTGEGAWTVRKLGEATGIGGFGPVLVGSGANVAAELARIQDLSDVDGFNLAYAITPGTFEDVVDFVVPELQKLSRYKTEYAPGSLRNKLLGKGDRLDDTHRGASYRLGARNSTATIDLSSISAQLVSQGAHS

SEQ ID NO: 4631 - protein, 360 aa, Corynebacterium glutamicum
MISPQTIIDNLAPVLAEIAATAAQREQDREFSRDLAKQLSAGGFTKLRIPVEFGGLGFSLPEAFEVLVAAAAADSNIAQGLRPHFLAVESLLIAPYSEHRTKWLRKIAEKGVVIGNALTEVGNKPGELKTKIRKEGESYVLSDTKFYSTGSLYADWIQVHAKDEEDQDVFAFVDRDASGVVLVDYWDEFGQQLFASGTSFFEKVVVDPLDIVTRDYTAPSAFQALAQSHHLSTLTGISQAITRDIVTYVQNRTRIFSHGSGDLPRFDPQVQQVVGEVKAKSYAVEKIFQGFAQELDLVVDKAKAGTATEVDLAAVDLSAYQAQLAVAPLVLSQATQAFEVGADALNGGHVAAQYTIGSLS

SEQ ID NO: 4632 - protein, 399 aa, Corynebacterium glutamicum
MSQEILSHFAPALERIRSGAVEREQQRALPVEEIKELVELGFTGLRVPEELGGAGASLESVVELLIEIAGADSNIAQALRGHFAFVELLLEAPESEFRTHWLREVATGRLVGNAESEKRGVYGDPQTFIDEVETENGPIFVLNGTKFYTTGTYFADYTWTTALLRNLNGQETLVSLPVDLHAPGVDVVDDWSGFGQKLTASGTTTFKDLEVDPRWIIPRTDAPTLVWTYLQLSLLTVLVGSAAAAVDEVVARAQSSTRNAWNPGVERRSDPAATIAIGDARSRVTVIRGALLDATRHVSNAATIVTPEAFNEADAIVAALWPIVSGQALVVTSNVFDAVGASAVLGEHSIDRHWRNVRTVSSNNPVFLAKNAVGEYALNGTPVGTNIGKALSRPVSLSS

SEQ ID NO: 4633 - protein, 260 aa, Corynebacterium glutamicum
MLTKHCRCTHRIENVGCHHQSLSGDDGPERCNNSVRLVEGFGGYDRGGVGNVAGGVEKRSTNNGDSAACVADRYGCGRIAAALDARVPRISGGGLGAGNHLIDSCCGTANQHGQQAQLQIRPHQRGRISAWNDPPRIHLQVFKRGRSRGGELLPKPAPIINNIHARRVQIDRQTDQSFLAVEVAQQRGGPGVVRKIGAGGIKLSAVEHENRSVFSLHLIDEGLRIAVNAAFLTFGVAHKSSGGDFAQPMGAEFALRRFQE

SEQ ID NO: 4634 - protein, 230 aa, Corynebacterium glutamicum
MLVPTGVPLRAYSPTAFLARNTGLFEDTVRTLRQWRSMECSPSTADAPTASKTLDVTTKACPETMGQSAATIASASLKASGVTIVAALETWRVASRSAPRITVTRLRASPIAMVAAGSLRRSTPGFHAFLVEDWARATTSSTAAAALPTSTVSRLSCRYVHTSVGASVRGMIHRGSTSRSLNVVVPEAVSFCPNPLQSSTTSTPGACRSTGKLTKVSWPLRLRSSAVVQV

SEQ ID NO: 4635 - protein, 392 aa, Corynebacterium glutamicum
MSENNPTTLHWFLPTYGDSRGITAGGHGFGFHSGSRTADLDYLSQIALAAERNGFESVLTPTGLWCEDAWITTAALLSRTSKLKFLVAIRPGQVSPTIIAQQGAAFQKFSNNRLLINVVVGGEDHEQRAFADYSSKEERYHKADETLEIIDHLWNSAEPLNFQGEFLSVENAVLKEQPEVSPPIYFGGSSQLGIEIAAQHSDVYLTWGEPAEKVEEKLARVRAEADKRNRELDYGIRLHVIARPTEDEAWSVAQNLLDQLDQEEVARIQEGLARSQSEGQRRMTELHGQGAAFTAGADARSLEIAPNLWAGVGLVRGGAGTALVGSYEQVAQAILRYRDIGLSHFIFSGYPHLEETYHVGEGVVPELLKLGVPVNNHEEQRNDVVATPFISR

SEQ ID NO: 4636 - protein, 321 aa, Corynebacterium glutamicum
MELVRVTEAAALASGRWVGRGMKNEGDGAAVDAMRQLINSVTMKGVVVIGEGEKDEAPMLYNGEEVGTGFGPEVDIAVDPVDGTTLMAEGRPNAISILAAAERGTMYDPSSVFYMKKIAVGPEAAGKIDIEAPVAHNINAVAKSKGINPSDVTVVVLDRPRHIELIADIRRAGAKVRLISDGDVAGAVAAAQDSNSVDIMMGTGGTPEGIITACAMKCMGGEIQGILAPMNDFERQKAHDAGLVLDQVLHTNDLVSSDNCYFVATGVTNGDMLRGVSYRANGATTRSLVMRAKSGTIRHIESVHQLSKLQEYSVVDYTTAT

SEQ ID NO: 4637 - protein, 190 aa, Corynebacterium glutamicum
MAEKRPKIFDGSRDMIISLVVSAIIMLVAVGFTGMCSFNTGSPENGQVPEVDASTFMSMEARAMTDHATRLPETPEGWTTNSARRTMVDDTPASVVGYVTADEGYIQLTQTGETVEDAVAGYDTRWRDLSESYDLDGHDVGIYTSQESDVRDLRVMDLGDARVMVSGAATDEEFNDLLRAVANSEPLPTN

SEQ ID NO: 4638 - protein, 634 aa, Corynebacterium glutamicum
MSQPLSKRLSIRKALASAFIVALAFSLSPVAKAQANETPTMIVLDNSGSMTAQDAGGQTRIDAAKQASTQLINDISDRTDVGLTYYGGNTGETEADVEMGCQDVTILGGPSRGNADTLIDTINSLQPRGFTPIGKALTDTAAELPEGGNIVLVSDGIANCTPPDVCEVAQELAQSGINLVINTIGLNVDPAAREELECIAGVGGGTYADASDAQSLTDALTRAASRQYNSYTSDVTKIDGASEQSAAVEIDEDTELFLTDLPQESRFWKIPVEPGETISVSANTVTDPTVLTMGQGGIKLEAQLHTEEAPQYGLRGRCTRVSFDNFKPGLGVRGIQNASVASKEVGTNNCDTDAIYLEISRSGDYLNGQDIPTEITIERFGKVDESTIGNVTEEHSSVDLTEAAASEAHPVTPGQWFTSAADLDPAGEKVSSIIVPGETHFYALPVDYGQELRAAVETTFDQIDSSALGTHLYIQAFSPNRAEIELTNRDTSYADDNGLKTFGFFTPVSAANLFEKSSQGISLRSPWQGGTQYLAVTYLPSGQDEDVSATDQLPTLEYELVAEAFGDPVDPPVFASLTGATPSTSTPPSDVAEDEQISEATEEDSSSFPIVWIGLGVIGLGIIIGLIFALRRKN

SEQ ID NO: 4639 - protein, 95 aa, Corynebacterium glutamicum
MVAWVPCAFRRKTTATMANTSPRDVIKPPTNPADVSPREVVMVAPASQAATAFPRLNTPMLMEEAMPTNEASLQAVLDQLRNEPELAPFIEVMEN

SEQ ID NO: 4640 - protein, 75 aa, Corynebacterium glutamicum
MASSINIGVFNLGNAVAAWLAGATITTSLGLTSAGLVGGLMTSLGLVLAIVAVVLRRKAQGTQATISVVEHQPAQ

SEQ ID NO: 4641 - protein, 81 aa, Corynebacterium glutamicum
MTNPDIVGSGQGNDSFEPVAQLSYERARDELVEIVKILELGQMGLDESLKYWERGEALAKRCEEHLAGASARVEQALNQAE

SEQ ID NO: 4642 - protein, 417 aa, Corynebacterium glutamicum
MSSEKASSKSTPEAPWPVREVNTQVKQWIERLGHLWVEGQLAQINVKPNWKLSYLTLRDVEQEMSVQLTCPTDIIRNRPTPLKDGDRVIVYGKPAFYAGRGTFSLWVTDIRPVGIGELLARIEELRKRLAAEGLFDPARKKRLPFLPNRVGLITGRGSAAERDVLSVAKDRWPEVQFEVINTAVQGASAVPEIIEALRVLDQDPRVDVIIIARGGGSVEDLLPFSEEALQRAVAAAQTPVVSAIGHEPDTPVLDNVADLRAATPTDAAKRVVPDVAEERMLINQLRSRSAAALRGWVQREQQALAAIRTRPVLADPMTPINRRRDEIAQAVGLIRRDVTHLVRTEQALVASLRAQVSALGPSATLARGYSVVQVIPRDGSAPEVVTTIEQSPPGSQLRIRVADGSITAASMGTQQAN

SEQ ID NO: 4643 - protein, 325 aa, Corynebacterium glutamicum
MSSPVISPETKTGKKILLAAPRGYCAGVDRAVETVERALEEYGAPIYVRKEIVHNRYVVDTLAEKGAIFVNEASEAPEGANMVFSAHGVSPMVHEEAAAKNIKAIDAACPLVTKVHKEVQRFDKQGFHILFIGHEGHEEVEGTMGHSVEKTHLVDGVAGIATLPEFLNDEPNLIWLSQTTLSVDETMEIVRELKVKFPQLQDPPSDDICYATQNRQVAVKAIAERCELMIVVGSRNSSNSVRLVEVAKQNGADNAYLVDYAREIDPAWFEGVETIGISSGASVPEILVQGVIERLAEFGYDDVEEVTSAAEKIVFALPRVLRHKN

SEQ ID NO: 4644 - protein, 143 aa, Corynebacterium glutamicum
MTHGALYFFMAFVTDEENVESLLIKALDFLVHFGDQRAGRVNSLDVFSCSFFVDHWAHAVCREHHVGTFWCFRCFVDKNRALFCQGVHNVTVVHDFFTDINWGAVFLERALDGFHCTVYAGTVSARGCKQDLLSGFGFGADNR

SEQ ID NO: 4645 - protein, 276 aa, Corynebacterium glutamicum
MSHGSASSRRSSRPPQQTAFVGLPTWSGPSVVLASLITGMLVSLMLGVIGLPYQLIFIIATLGVTLLVEARGLFLTVASIPILFGIFTPLTSWFVSQQGVAANVSPGVSVTEILTAVYPLAQLFPTLIMVTLVAALIAVVRIILLRRNQESRQVSGELTRRAQREAEEANQNAARRARAQSTRVQSSKTRNRRAQPTGDTGSQVTVDELIRRSQERRQTVAQRQTERGVPFTPTPGPVVAPKPRPSAPEAPAPTDVGERRQAAPKRRTSLDDDLYS

SEQ ID NO: 4646 - protein, 440 aa, Corynebacterium glutamicum
MVIGDYFKRVSMWSLRLVFVAAAVFILWWVIGRFWQGVLPVTLAIIICTVLSSPNSWLRKHGVPSVVSAFITIGTFFAVVGAILWLIAPSIAQQSQVLYFQAFEGILSIQLWLQGPPLNLDSGDLSRYFNEAAAWLQNQAGAIAGEIFSGLGAATSVIVTLGVVLVLTFFFLKDGHRFLPWTRKIGGKQAGWHVTELLTRAWTTLSGFVRAQALVSAVDAVFIGIGLLIVGVPMALALSVITFVAGFIPIIGAFTAGALAVLVALVSLGFTEAVIVLVIVVAVQQLEGNILSPLLQSKAMNLHPVIVLLSVTVGGTLFGIVGAFLAVPVAAMIAVFFRYFQDMTSLRAGEKVASDLKFESEYGEFAGRAMEADGEIFRRRYYQDLLGGDAETNELKIPEFLGEDRESVDPNEVRRKELKRRFTSARTATSQAFDKIRKRN

SEQ ID NO: 4647 - protein, 60 aa, Corynebacterium glutamicum
MGTTAIIMMVLFMVIIWGGLVYATIALRREPDEKVGLFGTSPYATDSVLIEQESERPATA

SEQ ID NO: 4648 - protein, 579 aa, Corynebacterium glutamicum
MGNSYWSFVHDWRLVKMSAPQHTPPTSPQKGERREVFSSRSVFILAAIGSAVGLGNIWRFPYVAYDNGGGAFLIPYAIALLTAGIPLLFLDFAIGHRYRGSAPLAFRRFKKQTETIGWIQVGIAFFITIYYAAIIGWAGLYAFKSLNKAWGADPDTYFFSDFLNFDSEAVVSMDIVPQIAIALFIVWIAAIVVLAIGVDKGIGRVSMVFMPLLVIIFLIVVIQAVLLPGAEIGLDALFTPNWEALKNPTVWIAAYGQIFFSLSVGFGIMLTYSSYLKPRTNLTSTGLVTGFANSSFEVLAGIGVFAALGFMAANAGVGVDEVATSGIGLAFVAFPAIINEMPLGGLFGFLFFSSLTIAGFTSLFSLLEVVVSAVKDKFGLNRKATAIGVGVVMALLSLGLFSTTSGLATLDIMDKFTNNIGIVAVALIAVVSIDWVLRRIDEFSTHLNAISAFKVNTIWRISVVNITTLVLGSTLALELTSLINEPYGGYTVLQNGLFGWGVLAVILVAAFLLPMVSWPKGTLVDGPPGSDFGVLPEFKRTLHRPRRWASNDPISPFDANEDASRFPTVAITNPEAKES

SEQ ID NO: 4649 - protein, 411 aa, Corynebacterium glutamicum
MKLFISRALIAGTVSLTLFSSPLASAQSSGLSSVLSSEDSSATNSEQDFEKSSESGSSAQDFIALSTANPDLTGGSVEGLLSSMSLIGSSQLPLGGPLLSSDSNYPLETDPSITEARIVEKRVLNGLRLEKWSVASPSMQRNVDVQIMKSAEADSPAPMLYMLDGIGGNKNSSGWINGGEGPKVFADENVTVVMPLGAASSMYSDWLEEDPALGRIKWETFIVEELAPLLEAEEELNFNGHRGIGGLSMGATGAVHLANSNPDLFDGVIGISGCYSTLDPIGQTTVSLIVNSRGGNVENMWGPTGSETWKAHDVTSNPEGLRDMAVYLSAANGVVDDIDLADSEKEPFYNLLAGVVLERGSLSCTEALDESMSRAGMNHQVVDYKDSGTHNWRNFNPQLQPGWDAIKHALY

SEQ ID NO: 4650 - protein, 361 aa, Corynebacterium glutamicum
MTLTLGIVGLPNVGKSTLFNALTRNDVLAANYPFATIEPNVGLVELPDARLERLSEIFGSERILPATVSFVDIAGIVKGASEGEGMGNAFLANIREADAICQVVRAFADENVIHVDGEVNPATDISVINTELILADLQTVEKALPRLEKDARKDKGLGEVVDETKKALAILSDDRTLFSAAKAGDIDLALLRDLHLMTAKPFLYVFNSDEKVLTDDAKKDELRALVAPADCVFLDAQTETELLELEEDEAAELLEAVGQTEPGLHSLARAGFETLGLQTYLTAGPKESRAWTIHKGDTAPQAAGVIHSDFERGFIKAEIVSFEDLDAAGSMAEAKAQGKVRQEGKDYVMVDGDVVEFRFNV

SEQ ID NO: 4651 - protein, 99 aa, Corynebacterium glutamicum
MAQKLYPPIHPGEILMEDFIKGFGLTQNKVAVSIGVPPRRINEIVHGKRSITADTALRLGRYFGIDPQFWLSLQTQYELELDRDAGAATYAQITPLKVA

SEQ ID NO: 4652 - protein, 274 aa, Corynebacterium glutamicum
MARKHLLSLADWNRGELEALFELAEQYEAGGGPRFDGAAAMFFPPTSLRTRLSFERGATAMGLQPITFPSDSLDKDEDLVDVVGYLSQWADVVVVRHPQLTALQRLASADAAPVINAMTSENHPCEVLSDLYALSRHHDISALRYLFVGGDGNIARAWWEAAQAFGLEMRQSCPEELRVVGMPWEENLPHAIASADVVLTDGPGRHAELLEPYRVTAALLDRAPRGVRLAPCPPFIRGREVSADAIEHPAFVGYSFKRHLMPVQQAILARSINA

SEQ ID NO: 4653 - protein, 167 aa, Corynebacterium glutamicum
MTPPNTQRRRFRRKRPADIDLMADMLGDPEVMRFYPSAKTREQAARWITWNEENYAEHGYGLWIVETIHGEFVGDCGLTWQEVNGAPKLEVGYHVVTARQGLGYATEAAIACRDYARDVVGSPELVAIIHPENEASERVARKLGMHRLADDHGGNIPVRTVLGMTFE

SEQ ID NO: 4654 - protein, 210 aa, Corynebacterium glutamicum
MLPAGQSAPKSSLQTGSTPSRWTSPMTIDEGRRQFEVNVFGAMALTRLVLPHMQKQKWGTIVNITSMGGKIYTPLGGWYHGTKFALEALSDALRLEVAPFGIDVVVIEPGGIATEWGGIAADNLDAVSKDSAYKRQADAVSKSLRSEANSNRNSPPSVVADAIGKAVTARHPKTRYAIGFGAKPLIASRNILTDRQFDPVITRATGVPRD

SEQ ID NO: 4655 - protein, 402 aa, Corynebacterium glutamicum
MAYDFVIGMDVGKYFHHACVLDPQGRQVLSKRINQHEGSLRKLFDKFLANDAEVLVVVDQPNNIGRLTVAVAQAMGADVRYLPGLAMRQLSRIHVGNSKTDVRDAYVIAHAGLNLPDALRSVDRVEEVFLQLKVLNGIDEDLARAYTRLINQMQSALVGTYPAFEHVLRGQMIHRKWILHLLAKYGGPTKIRRVGKARLAAFARGHRARNPEPVIDAMLAAIHGQTVSIAGAEYAELGVAMSAKDALAKLEHRKEIEGQVLELIQDIPQTEILLSMPGIGPRSAAQILMTVGDMSDFPDAAHLASYAGLSPQTNQSGTSIMSNSPNRAGNKKLKNALWQSSFASIRFHERSRQFYERKRNEGKRHNAAVVALARRRLNVLFAMMRSGELYRDIPTAQEAAAA

SEQ ID NO: 4656 - protein, 1014 aa, Corynebacterium glutamicum
MNTTSRWLLANSSDPLLYRDSSLLVALLRQIVFAFAYLIAVIGSYSLVYGDSLVAIVWPSVGIAVWWAVTCRSWKNFALICGYVFLVPAIYLHFFAETSLRGVILAGIAHAIAGPGVALVMAFMENAQLPELLRKRHAFAPFSHIRLPGDVFRLLVAGIVMVAISKLIVILAYALADLPYSFTLYLTMALRDLTGIIVVAGPGIALSTPLVLNIHRSAWREFAVVIIATVGVLALIFGFAVDLPTVYLAMLPLYWSATRLPVLLAVLHAVFTSAIVVILYFLLGTGSFAITDESILVQATTIQLFVLMCILLSLVVSTTVQQTSALVEELEVVAKTLPDALFIVNKNGTAFPVNAGAKNFVKQSPDGHYSMPKLQNIDGEPMDEKESPSSMALRGQGVEGVLAKLGEVLGEDPDLARRIFEISASPMYLRGETEPGHALVIWHDSTNEYYTMQQLTLAYEESRLLFEKAPQGIAMLDPSGEIVMANRSFGDLVGTTPVRLLGRNLEDFGVEEGTMEYVTPVLSDPEAVVHLDRSLETLRGKQKNVAMSFSSMGNVGGRIGTLLVNVVDVTERQELIELVEHLADHDSLTGLVNRRRLESDIEELILKNERDSTDSALLLLDLDYFKEVNDSLGHEAGDQLLIEFAEILKDSVRDSDIVGRIGGDEFVIVLPDTDRDGAEAIGIRIIELVNQHFKGRGKVLSRVSVSIGGTLFSDARAQGVNPFILADQLLYDAKHAGRNRVAVRRAENTIVRSAKPAFSVEELSEILESHSIRLELQPILELETGRVGAAEGLLRINLDGTDVPTGQFVQSVEQAGLAPKLDIAVMREGINHIERLRAVCPTFSLALNLSGYSLSSAKIREELRAEFRARDLPRGSIRFEITETAPIEDIDAAKEFVQMLKDFGFHIVIDDFGAGHEPYQYLKKFDFSVLKIAGEFIEGMVTNRVDRSIVESIAQLAKDEEMETVAEFVSSKEILEAVREIGVTYAQGFHIGKSKPIDEFIATYLETNQTATWG

SEQ ID NO: 4657 - protein, 255 aa, Corynebacterium glutamicum
MFYGESGSGWLGQYQRNEYTRYSRDIYRRRGRVFVLTGTASAFRPRGLRTVAESRGTLIPGRKGDVYDTAALTEDNELTLALKSLGGLMVSPNECSVVTEVMPTWRELWHQRLRWQRGALENLGAYGITPQTTRYWFQQLGIGYGALALVAYFAVIIITFLARDQWIWYPFWMLLGLLFMIERVLTVWRSTWFARFVAALLIPELIYASYLNLVFLKGVVDILLAKQAHWGEHGDKTMQVADAAAEINDEGEERR

SEQ ID NO: 4658 - protein, 73 aa, Corynebacterium glutamicum
MIFSEEILHTDWFAALAAFVAINTTIYVVLAIAKTLPKIYVTDYLPRNYERAETRSIYPDVEEPKRKKSEKKD

SEQ ID NO: 4659 - protein, 111 aa, Corynebacterium glutamicum
MATSALKFLLLGFGAIGRQLVTLFDEGEFGVEAFTRAVSPHIAHGTLGIELYDDQLPKLIADSGSVVEVAHGKDLVLTSVGALAEQVVRQALLVGSGKVHVTSGAIGLFRF

SEQ ID NO: 4660 - protein, 97 aa, Corynebacterium glutamicum
MADKRRAKTMMREIVDQMRLLKGQANRELAQLGRSLHKRLGDILAYFDVGISNGPVEAINGRLEHLRGIALGFRNLNHYILHCLIHSGQLTHKINAL

SEQ ID NO: 4661 - protein, 125 aa, Corynebacterium glutamicum
MLDVVEGRSADALRAWLARRSPAFRHQVRIVTMDGFQGYATTSKQLLPAARRVMDPFHVVLLAGDKLTRCRQRLQQEKYHRRGLHDDPLYKNRKTLLTTQKWLSKKKQSVLMSCLALIKTTRHCN

SEQ ID NO: 4662 - protein, 48 aa, Corynebacterium glutamicum
MSIAATAKALGLGWDLTCQLALDMCHELIYYDPTHLEIVHVIGVDEHK

SEQ ID NO: 4663 - protein, 47 aa, Corynebacterium glutamicum
MFVDEHDQAMLDARNPNILYERNGHTVFKLEIALFDNIDCNASTSTV

SEQ ID NO: 4664 - protein, 122 aa, Corynebacterium glutamicum
MAFPVTEDKILAAEETLGRRLPETLRERLLQNNGGEVIDNENNDWILHPVRDDSDRKRLVRTANDIIRETESAREWDNFPENAIAIANDGTGDLIILLPDDDAFYIWSHEDEPLIETELEDA

SEQ ID NO: 4665 - protein, 166 aa, Corynebacterium glutamicum
MASPENILLYLPEKEEQQVREVFAGLEEQGFPVQNQKPHITITFSPSMPDDVVQRASELLPPVMPARFARVGTVVFGTKRKQTVAWLLETSEELEEVARNISALNPNGRGQRWVPHLTMGLRLPREIVPDYIRALDEVTSPHFKEFTATTAAYWRPKIHHLTVFKA

SEQ ID NO: 4666 - protein, 281 aa, Corynebacterium glutamicum
MNIHLCCCSRLCGRMVATSQFIDDSEAAQAVRAAIVAGYRNIDTALAYGNERGVGEGIRTAGVPREELFISTKLAAEIKDYDGAVAAIDESLAKIGLDYVDLMLIHSPQPWSDFRGGDYSEGNREAWRALEDAYKAGKIRSIGVSNFLEADLENILDSATVAPHVNQLLVHVGNTPSELISFCDSKGILVEAYSPIAHGEMLKNQQVKAIADKYNVSIPQLCIRYTIQLGTVSLPKTANPDHMSSNAQIDFEISEEDMAALQEVTARDYGEHSGFPVYSGK

SEQ ID NO: 4667 - protein, 107 aa, Corynebacterium glutamicum
MGQKVTAGRDILGEFAPKSAELNDDVLFGQVWSRESELSPRDRSIVIVTMLMASGVLDSAFESHVQRAKDNGVTAEEIAEIITHVAFYAGWPKAWAAFRIAKDIYTK

SEQ ID NO: 4668 - protein, 221 aa, Corynebacterium glutamicum
MPSISSVSSARSAAKVAVRLSLGRSISGRKLEGFVSCFCIIQTANQNSRDLITRNHAIGWATRLIGVALKHDDLTLVIVVVIKPTRANNGVTVSASSNKLLAMSLPLGISHTWAGRSNGGHQHNFYIFSLDCLQRVGNAGVINIPHIAFTSGGAVSENDSLDAFYSFLNRGRIKQVSYDNLCLSWKHPCTGLATDKCLNLVSLVKCFRDNMSAYASCCSYD

SEQ ID NO: 4669 - protein, 65 aa, Corynebacterium glutamicum
MMQKHETKPSSFLPLMDLPKESLTATFAALRADDTDDIDGILDSNIVPVESTAPLFQTDLASVSA

SEQ ID NO: 4670 - protein, 218 aa, Corynebacterium glutamicum
MSETVLVIGATGSIGRHVVSEALNQGYQVKAFVRSKSRARVLPAEAEIIVGDLLDPSSIEKAVKGVEGIIFTHGTSTRKSDVRDVDYTGVANTLKAVKGKDVKIVLMTAVGTTRPGVAYAEWKRHGEQLVRASGHGYTIVRPGWFDYNNDDERQIVMLQGDTNQSGGPADGVIARDQIARVLVSSLNDAKARNKTFELSATYGPAQGKPDRNFCSTSG

SEQ ID NO: 4671 - protein, 579 aa, Corynebacterium glutamicum
MSIKWARFVPGITAMRGYQRSWLKGDVIAGITVAAYLVPQVMAYAVIAGLPAVVGLWGVLAPMALYFFLGTSRNLSVGPESTTALMTAAGVGALVGAAGGPERYAEVAALLAIAVGIVCAVGFIGRLGFLTRLLSRPVLVGYLIGIAVLMIVSQLSKVTQVNVESGQTWQEIISFIKVAGQAHIPTVILAVVVLSLLYLANWLTPKFPSTLMVLLLSAAAVGFFHLDRFGLEVIGEVPRGLPQPSIPSIGDLEIWSLLPYAVGIAIVGFSDNVLTARAFASGKDEVIDSNQELLALGTANLANGFFQGFPVSSSGSRTVLGDTAGARTQVHSLVVVALVIMVLLFAGPVLESFPDAALGALVIYAATQLIDIAEIKRIARFRKSELVITAATAASVVASGVLAGIGVAVTLSILDLIRRITRPYADVLGYTPGMAGMHSLEDYPESTAVEGLVVFRYDSPLFFANADDFSKRAIEAVDEATQPVHWFLLNAEANTEVDLTAVDAMEALRKTLEERGIRFAMARVKQDLRRSLEPAGFIESVGEEYIFATLPTAVKGYSVEFRDRFGNYPEGVPKEILEL

SEQ ID NO: 4672 - protein, 199 aa, Corynebacterium glutamicum
MRCINKTVDQQIALFGQSGSGKTALLCSFYGTARESSQEDVKLFEISAEDDRHTELMRLYLGMRDDSLFPPANRFESKNTVFSLKQKGVPIKEARKADQVRVTWNDYPGEWFEGGATTESEKQDKINTFRNLLGSDVALFLVDGQRLHDYADDEERYLTYLFDSFTESLSQIKEAILEDGTPLQQFPRIWVIALSKADL

SEQ ID NO: 4673 - protein, 166 aa, Corynebacterium glutamicum
MKSMNCVQSCSNLSIMMKPSHLEKTSYFYHQRNSLPGHTDLSQRKGVDVLLPLACVLPIQHQLWWQELRVLPINLANRLVGNEFVKNGMKIIFKMASNKFIDNKKGLAMLVFAELVMEMLDQPEEQLHNVRGVAIEKREFLKALTADFTSRLKQAQTDKILVWDFA

SEQ ID NO: 4674 - protein, 115 aa, Corynebacterium glutamicum
MGFRMTIMWATRGKNWGFRFLADGAESDPLPTYTKAFENREWEREFIRTSPEFTAARIDDPLDRTDNVGRTIPHDFVLRGQFAEGINTLEDVREIIWPLVAQQYEDIWDQPINSD

SEQ ID NO: 4675 - protein, 51 aa, Corynebacterium glutamicum
MPGLTVDWDTLLDPYDSEQSVVVWTGKPGSNTHKSLMVLAGLAKAKTSNAQ

SEQ ID NO: 4676 - protein, 213 aa, Corynebacterium glutamicum
MAWGLSFNEPSGLRRRRPLSRSARSSLAKVSAETAASSPSWRRIASMSRSVWELLSCSARLSSSARSCMAPVPSPSPMPSSPENCSEPSQLRSGRRPWRFPARSPSNSCSSGDPKAWADSFMSSRRCSSDMELNMRLAAAERAARASMSSLMSRGCSGKCSPCLAIKLAKSVGVSVPSRCLESRSLRSRSISAMAALSSSEAPSMACFMPENC

SEQ ID NO: 4677 - protein, 652 aa, Corynebacterium glutamicum
MATSHSRPRRSRYGRYTGGPDPLAPPVDLSDALRDIADDVMAGYSPEQALREYLRRGARGQEGLDDLAWRAAERRRELLSRNNLGGTLAEVRKLLDEGLKLERAQLARDIDMDDTDRAFREMQISNLPESTAAAVSELNSYDWQSQEARQKFEQIRDLLGREMLDQQFSGMKQAMEGASDEDKAAIAEMLRDLNDLLSKHREGTDTPTDFANFMAKHGEHFPEQPRDINELIDALAARSAAASRMFNSISEEQRRELMKLSAQAFGSPELQELLGDLAGNLQGLRPDLNWDGSEQFSGDEGMGLGDGTGAMQDLAELDNLAEQLSNSHTDLDIDAIRRQLGDDAAVSAETLAKLERALRDSGLLRRNPDGSLKLSPQAMRRLGKALLDAASEQLSSRPGSRDSRLAGANGEATGASRPYVFGDTQPWDVTRTITNALQRTAGTDTEGPLRINLDDVEVIETEARTLNAVALLVDTSYSMAAEGRWVPMKQTALALHHLVSTRFRGDELALITFGRHAQNMDIEELTALPPVHEQGTNLHHALLLAERFFARHPSMKASLLIVTDGEPTAHLEADGHAWFNWPTDPETMFKTVTQLDKVTKRGTHTTLFRLGHDQGLEHFLNQLADRVGGTVVAPDLDGLGAAVVGEYLRHRY

SEQ ID NO: 4678 - protein, 432 aa, Corynebacterium glutamicum
MRVEIRDNLLAKLRSGEDPWPGLHGLNYTVIPQLERALIAGHDIVLLGERGQGKTRLLRTLITLLDEWSPIIPGRDVPEHPLAPNVEISDDQPIEWVHRDARYTEKLATPDTSVADLIGDVDPMRVAEGRSLGDLETIHYGLIPRANRGIVAINELPDLAERIQVAMLNVMEERDVQIRGYNIRLDLDVLVVASANPEDYTNRGRIITPLKDRFGAEIRTHYPLELDDEVAIIRQEAELVAQVPDILVEILARYTRALRESSSVNQRSGVSARFSIAGAETVAAAALRRAAVFGEDEAVARLVDLEAAVEVLGGKIEFESGEEGREWEILDYLLRTATAEALRSTLRSLDLTPLIAALDGSITVSTGTNITASEFLASLPELGESTLYDDIAQAFGATTPSTRAMAIELALEGLYLSRKIAKDSGEGETIYG

SEQ ID NO: 4679 - protein, 214 aa, Corynebacterium glutamicum
MVLLIRHGQTPTTGQVLPGQTPGLHLSDKGEEQAREVAQRLAEVPITAVYSSPMERAQETAAPTVSAHGLELTVEPGLIECDFGEWTGRKLTELNALEEWKAVQKTPSTFRFPGGESFVEMQDRMVEAIGNIAQQHPGEIVAAFSHADTIKAAVAHFVGTPLDSFQRIFIDTASISAVEFTGKSSGVSSHMLLTNSRTGSLGYLRDKLPKAPQP

SEQ ID NO: 4680 - protein, 235 aa, Corynebacterium glutamicum
MITSPFERELKLLNEGELGIVQQLVESSNIGFIVDLELDGDYGWAVYKPELGEQPLWDFPPGLYKRERAAFVISEFLGWNIVPPTVIMHDAPAGVGSVQWFIENNGEHYFPLFDTRADLHPQFVRMAVFDLLCNNTDRKAGHVLLDGDHIWGIDHGLCFSVEPKLRTVIWDFAGCTIPDDLVTDVEQLLEDVPEELHQLLHPAEIDALQRRASRISRLPFLPQAKSHRQFPWPLV

SEQ ID NO: 4681 - protein, 254 aa, Corynebacterium glutamicum
MSDLKSLATKFASDHESGKLLVLPTVWDTWSAGLVEEAGFSGLTIGSHPVADATGSSDGENMNFADYMAVVKKITSAVSIPVSVDVESGYGLSPADLIAQILEAGAVGINVEDVVHSEGKRVREAQEHADYIAAARQAADVAGVDVVINGRTDAVKLGADVFEDPMVEAIKRIKLMEQAGARSVYPVGLSTAEQVERLVDAVSVPVNITAHPVDGHGAGDLATLAGLGVRRVTFGPLWQKWLAATSAQQLKGWA

SEQ ID NO: 4682 - protein, 547 aa, Corynebacterium glutamicum
MTETLVVNGLAGGYGHRTLFNDVNLTVAAGDVVGVVGVNGAGKSTFLKILAGVEKPLAGTIALSPADAFVGYLPQEHTRTSGETIAVYIARRTGCQAATTAMDDTAEAFGADPDNAALADAYAEALDRWMASGAADLDERIPIVLADLGFELPTSTLMEGLSGGQAARVGLAALLLSRFDIVLLDEPTNDLDLDGLEQLENFVQGLRGGVVLVSHDREFLSRCVTTVLELDLHQNSHHVYGGGYDSYLEERAVLRQHARDQYEEFAEKKKDLVARARTQREWSSHGVRNAIKRAPDNDKLRKKAAAESSEKQAQKVRQMESRIARLEEVEEPRKEWKLQFSVGKASRSSSVVSTLNDASFTQGDFTLGPVSIQVNAGDRIGITGPNGAGKSTLLRGLLGNQEPTSGTATMGTSVAIGEIDQARALLDPQLPLISAFEKHVPDLPISEVRTLLAKFGLNDNHVERDVEKLSPGERTRAGLALLQVRGVNVLVLDEPTNHLDLEAIEQLEQALASYDGVLLLVTHDRRMLDAVQTNRRWHVEAGEVREL

SEQ ID NO: 4683 - protein, 132 aa, Corynebacterium glutamicum
MTSIKATRTSPNTYTVVNDFGAELKVSAPGVPGTFSPGELLQAAVVGCASLSAEAQLAHQLGQDFTASATVESTETTGLITDLLYTLQVDMAGLDQQAQDKLIASAAKKIDRLCSVKRSIHHGINTETVIAP

SEQ ID NO: 4684 - protein, 114 aa, Corynebacterium glutamicum
MSDQLAPCPECSSEYTYENGGVLVCPMCAHEWVEGEVAEETATVIKDSVGNILNDGDSVSIVKSLKVKGGGAIKIGTKVSGIRLLEEPVDGHDIDAKVPGFGQMRLKSSVVKKA

SEQ ID NO: 4685 - protein, 158 aa, Corynebacterium glutamicum
MSTDPEEFDQAETLDQLAYEIILLTRYGVQNTPTNKREAIMDRSALILLTRLDAQGPMTVNELAESFGLNVSTVHRQLKAAIANGLIEVVDDQACPAKLHRPTELGKEKLQQELLARQQDLTRILHDWDEEDIKTHAKLLRKHNESLEEYLDMKWPRP

SEQ ID NO: 4686 - protein, 406 aa, Corynebacterium glutamicum
MSVAEEGKLFTPTFVMGWFANLFQFLVFYFLITTMALYAIKEFQASEVEAGFASSSIVIGAVFSRFFSGYIIDRFGRRKIVLISVLVTTIACALYLPIESLPLLYANRFLHGVGYAFAATAIMAMVQELIPASRRSEGTGYLALGTTVSAALGPALALFVLGTFDYDMLFIVVLATSVISLIAVVFMYFKTSDPEPSGEPAKFSFKSIMNPKIIPIGIFILLICFAYSGVIAYINAFAEERDLITGAGLFFIAYAVSMFVMRSFLGKLQDRRGDNVVIYFGLFFFVISLTILSFATSNWHVVLSGVIAGLGYGTLMPAVQSIAVGVVDKTEFGTAFSTLFLFVDLGFGFGPIILGAVSAAIGFGPMYAALAGVGVIAGIFYLFTHARTDRAKNGFVKHPEPVALVS

SEQ ID NO: 4687 - protein, 436 aa, Corynebacterium glutamicum
MKSTGNIIADTICRTAELGLTITGASDAGDYTLIEADALDYTSTCPECSQPGVFRHHTHRMLIDLPIVGFPTKLFIRLPRYRCTNPTCKQKYFQAELSCADHGKKVTHRVTRWILQRLAIDRMSVHATAKALGLGWDLTCQLALDMCRELVYNDPHHLDGVYVIGVDEHKWSHNRAKHGDGFVTVIVDMTGHRYDSRCPARLLDVVPGRSADALRSWLGSRGEQFRNQIRIVSMDGFQGYATASKELIPSARRVMDPFHVVRLAGDKLTACRQRLQREKYQRRGLSQDPLYKNRKTLLTTHKWLSPRQQESLEQLWAYDKDYGALKLAWLAYQAIIDCYQMGNKREAKKKMRTIIDQLRVLKGPNKELAQLGRSLFKRLGDVLAYFDVGVSNGPVEAINGRLEHLRGIALGFRNLNHYILRCLIHSGQLVHKINAL

SEQ ID NO: 4688 - protein, 358 aa, Corynebacterium glutamicum
MLYLDNAATTSVRNEALEAMWPYLTGAFGNPSSPHEVGRLASAGLEDARTRVARIIGGRPTQVTFTSGGSEANNLAIKGACLANPRGRHLITTPIEHDSVLETAAYLERFHDFEITYLSPDHTGLISPEGLRKAVRPDTTLISIGYANNEVGTIQPIAELAAVSSTPFHTDAVQAAHLTFDLGVDALSLSGHKFGAPKGIGVLWSKLPLEPVIHGGGQEKGRRSGTENVAGAIAFATALELARAESYPDLGEFIEEVLTIPGAHLTGHPRMRIDGHASFLFDSIGSETVLLELERQGIVCSPGSACGSGEVSHVLLALGLEEDQARTAVRCTFSTTHSREDALVAASALKSAVALIRG

SEQ ID NO: 4689 - protein, 279 aa, Corynebacterium glutamicum
MTTHIDRIVGAALSEDAPWGDITSDTFIPGSAQLSAKVVAREPGVFSGQALFDASFRLVDPRINASLKVADGDSFETGDILGTITGSARSILRSERIALNFIQRTSGIATLTSCYVAEVKGTKARIVDTRKTTPGLRIIERQAVRDGGGFNHRATLSDAVMVKDNHLAAIASQGLSITEALSNMKAKLPHTTHVEVEVDHIEQIEPVLAAGVDTIMLDNFTIDQLIEGVDLIGGRALVEASGGVNLNTAGKIASTGVDVISVGALTHSVHALDLGLDIF

SEQ ID NO: 4690 - protein, 394 aa, Corynebacterium glutamicum
MPDVYGPGASQNDPIPAHAPRQQVLPEEYQRASDDELHRRIREAKDTLGDKVVILGHFYQRDEVIQHADFVGDSFQLARAAKTRPEAEAIVFCGVHFMAETADLLSTDEQSVILPNLAAGCSMADMADLDSVEDCWEQLTSIYGDDTLIPVTYMNSSAALKGFVGEHGGIVCTSSNARSVLEWAFERGQRVLFFPDQHLGRNTAKAMGIGIDQMPLWNPNKPLGGNTVSELENAKVLLWHGFCSVHKRFTVEQINKARAEYPDVHVIVHPESPMPVVDAADSSGSTDFIVKAIQAAPAGSTFAIGTEINLVQRLAAQYPQHTIFCLDPVICPCSTMYRIHPGYLAWALEELVAGNVINQISVSESVAAPARVALERMLSVVPAAPVTPSSSKDA

SEQ ID NO: 4691 - protein, 214 aa, Corynebacterium glutamicum
MPASPEIQMAVSTIIFALRPGPQDLPSLWAPFVPRTREPHLNKWALPGGWLPPHEELEDAAARTLAETTGLHPSYLEQLYTFGKVDRSPTGRVISVVYWALVRADEALKAIPGENVQWFPADHLPELAFDHNNIVKYALERLRTKVEYSEIAHSFLGETFTIAQLRSVHEAVLGHKLDAANFRRSVATSPDLIDTGEVLAGTPHRPPKLFRFQR

SEQ ID NO: 4692 - protein, 200 aa, Corynebacterium glutamicum
MGLIIDTTGLAHSPQAPLTLFRVLGAAAVLVGSLAAVGVFSKKNIGQTQSQGASIWLWRLFGVVMGMCQATQVAVNGYLGTVLGSPIESALVSFAVGTTALFILLLVTRTKWRGINGAGKKNPWWMWIGGVIGATVIFSTAYLGPIIGTGVTVVVMLLGMMLASLMIDAFGILGSPRRHIHIAQLLGLVVIILGVTMIRI

SEQ ID NO: 4693 - protein, 200 aa, Corynebacterium glutamicum
MKITRHIHACVEISQGNDRIIIDPGTFGAPDLCGATILVTHNHADHVDPELLKPGMTIYAPRSVAHSIPVECHIVEHGRNFTVGSLSVEVLGSEHAMLTHSMPIAENVGYLINGRVLHPGDTFQPIKDVELALVPVNGPWVKMLDVEGYLKKFPPKRFIGIHDGIVNDRGLAINKKFLTHLGETYGSEYSPLEEGESLEI

SEQ ID NO: 4694 - protein, 114 aa, Corynebacterium glutamicum
MDLHKVAAAHAATLPLSTKEFPFGPEHEVYKVRGKVFLLLTILNDEPIITLKSDPEIGASLRSGFPTIQAGYHMNKVHWLSISDGERITKDFIEGLVEESYELVISTLPKYKRP

SEQ ID NO: 4695 - protein, 263 aa, Corynebacterium glutamicum
MRRAVTGAQDFTDYEWEILHPGVLPTPLNVALDELLLDQVASGQRGPTMRIWDWDDRATVIGSFQSYVNEINQEGVNEHGVTVVRRMSGGGAMFMEGGNCITYSLYAPESLVAGLSYEQSYEYLDRWVIAALKTHDVDAWYVPINDITSTGGKIGGAAQKRRSGAVLHHVTMSYDIDADMMTQVLRIGKVKISDKGLRSAKKRVDPLRRQTGASREQIIDTLKSTFSARYGAQEVELSDEDFAAGHDLVKTKYATEEWTKRVQ

SEQ ID NO: 4696 - protein, 137 aa, Corynebacterium glutamicum
MVGTISTYIAFNGNTTEALKHWQEVFGGELNLLTYGQLTLEGMPFDPPADALAHGVLTLDNGGLISGSDSFEGEMLVKDTAYSMLYNAESVEDGRARIDKIVAAGGEEAMKFEQAPWGGFFGQVFDKFGVMWNISSD

SEQ ID NO: 4697 - protein, 431 aa, Corynebacterium glutamicum
MSTTTPTRATKSVGTVLALLWFAIVLDGFDLVVLGATIPSMLEDPAWDLTAGQATQISTIGLVGMTIGALTIGFLTDRLGRRRVMLFSVAVFSVFTLLLAFTTNVQLFSLWRFLAGVGLGGALPTAIAMVTEFRPGTKAGSASTTLMTGYHVGAVATAFLGLFLIDGFGWHSMFIAGAVPGLILLPLLYFFLPESPQYLKISGKLDEAQAVAASYGLSLDDDLDREHEEELGESSSLSSLFKPSFRRNTLAIWGTSFMGLLLVYGLNTWLPQIMRQADYDMGNSLGFLMVLNIGAVIGLYIAGRIADKNSPRKTALVWFVFSAFSLALLAVRMPLIGLYGIVLLTGIFVFSSQVLIYAFVGENHPAKMRATAMGFSAGIGRLGAISGPLLGGLLVSANLAYPWGFFAFAGVGLLGALIFSASKTLRHRENA

SEQ ID NO: 4698 - protein, 395 aa, Corynebacterium glutamicum
MNHVPVAIIGAGPAGLTLAHLLHLQGVESIVFESRTRKDVEETVRAGILEQGTLNLMRETGVGARMEAEADHDEAIDISINNERTRIPLTELTGHKVAIYPQHEYLKDFIAKRIEDGGELLFTTTVDSVENYEGDLAKVTYTEADGSSTTITADYVIAADGSNSPYRKLITEDGGVRARHEYPYAWFGILVEAPKTQKELIYATHPEGFALISTRTDEIQRYYLQCNPDDTPDMWPDDRIWEQLHLRADSPGITVSEGRIFDKAVLRFRSAVTEPMQKGRLFLAGDAAHTVPPTGAKGLNLAVADVSVLAPALVRALKKKDTGLLDSYTSLAVPRIWKAQHFSYWMSSMLHAVPGEDHFATQRRFAELRSVLESQSGQRYLAEQYVGRDLPRFEV

SEQ ID NO: 4699 - protein, 196 aa, Corynebacterium glutamicum
MQKTNQPKSSWRVIDIVIASVLGVACGLIFIVWNSIGYAWTTAFHALTPGLGGIAIGIWLLGGVLGGLVIRKPGAAIFVEVVAACVSAALASQFGISTIYSGLAQGIGAEIIFALFLYRRYSLPTTMLAGMGAGGGAIFLEMFFYGNLAKTMSFNIIYSTTVLISGAILAGLLSWYLVRALARTGALDRFAAGREV

SEQ ID NO: 4700 - protein, 446 aa, Corynebacterium glutamicum
MTTALGTRVVARNFGYRHASRENPALKDINFEIAPGERILLTGASGAGKSTLLAALAGVLGGSDEGVSTGELLVDAPSIGLVLQDPDSQVIASRIGDDVAFGCENLQIPREEIWPRVERALELVGLDLPLSHPTKYLSGGQKQRLALAGVIAMGARLILLDEPTANLDPQGQKDVVAAVDRVVQETGATLIVVEHRHELWVNIIDRIISITDGEDVQPAELIKVGQLPGAQPSTSKPILWANDLLCTWGGLRSFEVPEGASTVITGPNGAGKSTLALTMGGLLPPKSGQLELSDTVRGGLNTPPHKWRSADLAARIGTVFQDPEHQFVARTVRDELEIGPKIMKVDASERIEELLDRLRLRHLENANPFTLSGGEKRRLSVATALVAAPKLLILDEPTFGQDPETFTELVTMLRELTDNGISIVSVTHDPDFIAALGDHHIEVSAK

SEQ ID NO: 4701 - protein, 251 aa, Corynebacterium glutamicum
MNLLIKINPVTRIIALMVLTTPLLLSLDVMSAAIALVATIILAPFAGVTWKMLLKRGWMLFLMAPVAALSMALYGRPDGKEYFSFLLIHVTDNSLALAAAIGLRVLAIGLPVVVLIARIDPTDLGDGLAQLLKLPERFVIGAVAGSRLMTLFREDWYSMSRARRARGIADQGKIKHFFTMTFGLLVLSLRRGSKLATAMEARGFGRTTGRTWARESTVGARDLVLILVCAAISAIALTVSIQTGFFKFLGT

SEQ ID NO: 4702 - protein, 177 aa, Corynebacterium glutamicum
MITVLIDGQSGAGKTTLAGELAARTGFQLVHLDDFYPGWTGLEAASEIVARHVLDADNPGFFTWDWHNNCQGDWIKLEPGRSLIIEGSGSITAATKRKASLLGELVTVRITGPEALRKQRALNRDPDYAPFWKVWAQQEQRHFSLGVEVDHEIVLGSDEASGRPEEIYDSLGTAQSS

SEQ ID NO: 4703 - protein, 350 aa, Corynebacterium glutamicum
MPFSWLKPIDYARIFVGWASIFIIPLITLPSIIELALIVAVILFCAFGVVKMAERLAHILGDPFGSLILTLSIVIIEVILICAVMLGPADSTTAGRDSVMAVSMIIMGLVVGLCLLIGGLRHGSMPHNGVGTPTYLVLIATFSVIAFAVPAFRGEYSTGQALVISTLTAVVYGFFLFRQMGAQAGEFQEVEVAEKADDAAKWEVPFRGLILIITVLPIVLLSHDMATVMDEVLASLGAPVAMAGLIIATIVFLPETITSLKAAWTGEIQRVSNLAHGAQVSTVGLTIPAVLVIGVITGQDVVLGETPINLLLLGTTIAVTAIAFSSKKVSAVHGSVLLMLFGVYMMSMFA

SEQ ID NO: 4704 - protein, 236 aa, Corynebacterium glutamicum
MGMSALETLQWQDWSSVLIVVAHPDDPEYGLSAAVKEWTDAGVEVSYLLLTHGEAGIQGLDPKETGSLRAAEQRAACDVVGVRNLTILNHPDSMLVYNLVLRKDIAREIRIRKPNAVVVSNFDVEAYGGLNQADHRVAGLAAIDATRDAANPWAQPELLQEDLQPWGAEVIIIAGHPEPTHTMDLAKDSVDAGVASLQAHKEYLAALPDPPKPEEFIPAFLEVEGGYAAAFRVFGR

SEQ ID NO: 4705 - protein, 241 aa, Corynebacterium glutamicum
MENPGDLGAMPQYGFEHISMLITAVVLAILVVPIARRFNFAPAFGWVLLIATLLSNLWNFMPGYYTLDQSWPFHFSDALRIIAAIALINRARWAVSVTILWGTTINLMSLLTPDVQYLQVPWLEFLMYWFMHISVFLAAIILIFAFGEKPGLSGVVMSVAVAISWGIMCLMVNAFLGTNYGYLSTEPESASILDLLGGWPFYIVAEVLLLCAVWALWSYLIDKLPITYRPAYRPKTRKAAA

SEQ ID NO: 4706 - protein, 780 aa, Corynebacterium glutamicum
MQKADSHDWISVHGANENNLKNVSVRIPKRRLTVFTGVSGSGKSSLVFGTIAAESRRLINETYSTFVQGFMPSMARPDVDHLEGITTAIIVDQEQMGANPRSTVGTATDATAMLRILFSRIAEPNAGGPGAYSFNVPSVSASGAITVEKGGNTKREKATFKRTGGMCPACEGMGRASDIDLKELFDASLSLNDGALTIPGYTPGGWSYRMYSESGLFDAAKPIKDFTDEERHNFLYLEPTKMKIAGINMTYEGLIPRIQKSMLSKDREGMQKHIRAFVDRAVTFIPCPACGGTRLAPHALESKINGKNIAELCAMEVRDLAKWIKTVEAPSVAPLLTALTETLDNFVEIGLGYIQLDRPAGTLSGGEAQRTKMIRHLGSALTDVTYVFDEPTAGLHAYDIERMNKLLLDLRDKGNTVLVVEHKPETIAIADHVVDLGPGAGAGGGEIRFEGSVDKLKDSDTVTGLHFNDRASLKESVRAPHGALEIRGADRNNLNNVDVDIPLGVFTAISGVAGSGKSSLIHEIPRDESVVFVDQTAIHGSNRSNPATYTGMLDSIRKAFAKANDVKPALFSPNSEGACPNCKGAGSVYVDLGMMAGVSSPCEVCEGKRFDESVLDYHFGGKDIADVLGLSAANAYEFFAAKDSKILPAAKIAKRLVDVGLGYITLGQPLTTLSGGERQRLKLATHMADKATTFILDEPTTGLHLADVKTLLDLFDQLVDDGKSVIVIEHHLGVLAHADHIIDVGPGAGSDGGSIVFEGSPAELIKTDTPTGRHLKAYVD

SEQ ID NO: 4707 - protein, 165 aa, Corynebacterium glutamicum
MAKTHFQGNETATSGELPQVGDNLAEFNLVNTELGEVSSKDFQGRKLVLNIFPSVDTGVCATSVRKFNEAAASLENTTVLCISKDLPFALGRFCSAEGIENVTPVSAFRSTFGEDNGIVLEGSPLKGLLARSVIVVDENGKVAYTQLVDEISTEPDYDAALAALN

SEQ ID NO: 4708 - protein, 72 aa, Corynebacterium glutamicum
MSGRMDRSSHERNVETGDCPEAIGGEANISEFCSIDELGEFGELGEFSAPSESSEVGELGRLLANVVTCTSG

SEQ ID NO: 4709 - protein, 592 aa, Corynebacterium glutamicum
MYTHSTGTPQLDFDGDIYPLHLFFSAQTAQHFALERVNWHVLRAIVKPEQGELIVEALLAPIESATKIGVWVQDEFLGVIAESQFLLNSQLSRIFASGHLISSQLLLTPSKGSLASVLLPNLKFGLISNDPPRADSHLLPLGRMWRVEPTVHALFEDFSLGSTILFGLRLDLEALIVSYNGIECGILNFDDASALSSAVKFSNANGLTPTVLGHVVRENGETSFEIDVLPLELWSKKQHRLEVLKIPRLIPKEADSQNYVKATALLSDEILRPQTLSKKALSLSDTAVKYSPHVACGVGMFSLFAVIPFDKLSDHSAMLLAVISLMLFVLALVILFKRIQSTNTQRWNLASSVGLLATLPIIIFLVADTLIPQGSLENHAQPDVQVTTLANRRPSSPTSLDSLGALNSPSSPNSPSSSMLQNSEMFASPPIASGQSPVSTFRSWLDRSILPLTRENSASESAVTALGPSIVQPASESITTPAQTSQSRHAIDDGDDSKTSTGRPAPTTNSPIIALPPTWIIGPEDPESTDPTAPTEPTEPSEPVATDEPSETSEQTSPLLAPSTTPETEPETTEAPVETTEASSEITVSEVN

SEQ ID NO: 4710 - protein, 318 aa, Corynebacterium glutamicum
MAGGLAALLDDVAAITRAAAASLDDVTAMAGKTSVKAAGVVVDDTAVTPQYVQGVKPARELPMIWRIAKGSLVNKIIIILPIALLLSAFAPWALTPILMLGGSYLCFEGAEKIWHSLHRRIKGEQHSTEPKSQESPKSEDQLVKSAITTDLILSAEIMVISLNQIADQTIWMQAAVLFVVGIGITALVYGVVGVLVKMDDVGLTLSKRDSAGIQKFGRGLVKAMPIVLQVISVVGVFAMLWVGGHIMVVGTEELGWELPYHLVHGLESWANGIGGSALGWVGNTFGSLVFGLIWGAIITVVVSVIKKFIPQRAQNSSH

SEQ ID NO: 4711 - protein, 300 aa, Corynebacterium glutamicum
MKIAIVGAGAVGGYFGALLQESGADITMVARGRTLEALKSKGLHINDARGERYVPIPAVASVQELKDADVVMIATKALSRSLDLAELLGGIPANSVVAITQNSIESADLAAKSIGADRVWPGVVRGFFVHEGPASVSYKGGPLSYTFGDSGELSRQFASTLEQAGIDGVLHPDILVDVWEKAMFVEVFGGLGAFVEKQLGTLRTHFRASLEALMEEVAEVARAAGVALPSDAVERTMNFADRMPENSTSSMQRDLAAGVASELEAQTGAIVRAAHKVGVKTPLHDLIYAGLKLKEEENSL

SEQ ID NO: 4712 - protein, 122 aa, Corynebacterium glutamicum
MIVTSTARVSIDRPSRYAKQLTSHLGEKLSTSWDPEAERGSVVLVGKGPDHEDQRFAFDGSATCDLVAGDGVLLLHIESPASLVERFENVIGGHLVGFARRDEMKIAFRRGDGSEGLSFESV

SEQ ID NO: 4713 - protein, 99 aa, Corynebacterium glutamicum
MLFDVVMDQKGCLLSPSNIIRIAAVLIPNDQDQILCVRKEGTELFMFPGGKQELWETPAQAAANSRKKTSIFMGVFRHRQQTNLASMWTAMCLAHLMCS

SEQ ID NO: 4714 - protein, 87 aa, Corynebacterium glutamicum
MGDSCTGSRELEEEDLDLYGRFQAPAANEPGFYVDCHVFSTFDVFLNYTPDVYEELAEAKYFSPKPRSKKLAPLTRDVFEAISSEVR

SEQ ID NO: 4715 - protein, 129 aa, Corynebacterium glutamicum
MLISLLIVLILGVVCIGIGIHFIGKDRHFQSNAVEVEAEVTGFVELEDERYLTQYRFELDHHEVFGVLPKSTPRPITTKGAVIPLLVNRDDSTQVRRLTARKDVTLRFFLILIGGLMVCTAVPLLFFVA

SEQ ID NO: 4716 - protein, 278 aa, Corynebacterium glutamicum
MSSASFTTKALSVLAALTAASAPLVAASPAHALANARNVTGSSTTSDSIVRLHIGNTACTGTMITPTWAITARHCIPEGGIAGAAIGSSTLSQFQQVSQAILHPTADLALVELPNQASSNTVDLYGAHVQPGENGQAAGWGGYSAFGQNVAQQADVQIQRRVVNVPSPDRTAVLLEGTVSNGRLVPGDSGGPLYINGQLAGVLSMSTDVENDALDGTVGWYIPVAEHAEWIAYYTGKHIAPIAGAPAELVDATANPTFIPAPQPFTGSSIGGWALGSS

SEQ ID NO: 4717 - protein, 115 aa, Corynebacterium glutamicum
MKVTIFHNPRCSTSRNTLAYLRDKDIEPEIVQYLKDTPTASELKELFNTLGIPVHDGIRTREAEYTELGLSPETPETELIDAIVAHPRLLQRPIVVTAKGARIARPKIDVIDSIL

SEQ ID NO: 4718 - protein, 400 aa, Corynebacterium glutamicum
MIIQILRVAFAFVGIIVGAGFASGQEVMQYFVAFGIDGIWGVIVSAVIMSVMALIILQLGSYFNAGEHGEVFRRVSHPVFSKILDIGVVVTLFSTGFVMFAGAGSNLNQQWGLPLWIGSVIMVLLVLAAGMLDVDKVTTVIGAITPFIIIFITAASIYTLVGNFSSVEQLDSAALEVGTTLPHWAVAAVNYVGFNLMVAVSMAVVIGGSMFNPRVAGRGGLLGGLILGFLIIISALTLFATVEEVGQDDMPMLTIINNLNPLAGQVMAVVIYGMIFNTALGMFYALGRRLTAKNPQRFRPVYVVTVLIGFVLSFVGFKNLVGYVYPVLGYIGLLLIAVMMVAWVRGRVRIYKESERRMRIADLLQIGHDGALSGAELAVLNQEIQDSNLDEEQIKAAVRK

SEQ ID NO: 4719 - protein, 179 aa, Corynebacterium glutamicum
MTDLHPVKQEIFNTAESINTDPKGFLREVDTFKVTDFGLYMARGANHPKFGYLESWLLPELGLRANIFHFRKGVDERQDYYIDVAEIRVEDNIWTTRDLYVDLISVCGEPVTVMDIDELAAATSAGLITADDAERAIDATLNAVEGITRHGDDPMQWLRSKGIELTWADASQVELVPAE

SEQ ID NO: 4720 - protein, 238 aa, Corynebacterium glutamicum
MTKTLPRLLTVAAALAIALPATPVASAVTPVEQAFNASSNLSSGLPVDQWGRPNEQFRQQIEQAVNQPWVPQEIKNIVSQAMGFITGDGSEGGDIEIPDNAPRIAQFFWPTRSENCINGNSAAVGSAFAVPGPADLPLPGAGVGQTSFVFTALGTGPLAEQQSTAMTVQWANLSNFTHGTTTLSNTGINPDGPSTISGVADTGRGIIVASMSGGLTTSTENGSANCNFIPTAVVFDVR

SEQ ID NO: 4721 - protein, 637 aa, Corynebacterium glutamicum
MTHPEFRNVAIVAHVDHGKTTLVNAMLEQSGVFSDHGEVADRVMDSGDLEKEKGITILAKNTAIRRKGAGKDGNDLIINVIDTPGHADFGGEVERALSMVDGVVLLVDASEGPLPQTRFVLGKALAAKMPVIIAVNKTDRPDARIDEVVEEAQDLLLELASALDDEEAAQAAEQLLDLPVLYTSGREGKASTENPGNGNVPNSPDLMPLFETLYEVLPEPTADIDGPLQAHVTNLDSSSFLGRIGLVRVHAGTLRKGQQVAWIHYDEEGNQHTKTAKIAELLATVGVARVPATEVVAGDIAAISGIEDIMIGDTLADPENPVALPRITVDEPALSMTIGVNTSPMAGRGGGDKLTARVVKARLENELIGNVSLKVNPTERPDTWEVQGRGEMALSILVETMRREGFELTVGKPQVVTQTIDGKLHEPYEIIVIDVPSEYQGNVTQLLATRKGLMQSMSTTPGSDWIRMEFRIPARGLIGFRTQFMTETRGTGIANSYSDGMDVWAGEIKGRAHGSLVADRSGQITAYALTQLADRGSFFVEPGTETYEGVVVGLNNREEDMDINPTKEKKLTNMRAASADTTVTLAKARSLSLDEALEFCGVDECVEVTPDVLRIRKVILNATERGRARSRAKSLNK

SEQ ID NO: 4722 - protein, 502 aa, Corynebacterium glutamicum
MGVRIRFGILSVVACTVSLVACQANPGPAPVEEPTTATATTTATETTTVETEAPKQDRETISIGIDPIRNGFNPHLLSDDSPLVRDTASLVLPSAFEGNQLNTDLLDNVEQVDETTVRYTIAQEAQWSDGTPITGSDFEYLRRSIVAGTGTLNDSAYSAISEIRTSGGGKTVDVIFEHPVADWHLLFNNLLPSHLITGNSTFQTAFYDSIPASAGRYMVRSIDRQRGVITLSRNDRFWGANPAHVEVLQFNTVASASRAGEYLRTGQSSFMNLSPQETLVDTLNLVPDTEVRVSDTTRTLELVFNAEALAPAQRAYLTSLIDVPLTAKLAGGRSANLGVPQTVEASVDKQEIPALRLAADPADDAGLAAARGIVDMLAADGIKAQVVTTDLNSAIAGNFDAIVAWTRTATDSIALADRVGCGVNLAKWCAEGTTEYINGVLAGEIDFDPAWEQQFNTENHLRVPILRETRVEAKNNGILGAADGWPGGISSAASWRKNDVEE

SEQ ID NO: 4723 - protein, 290 aa, Corynebacterium glutamicum
MLKNDLSGARVVAVHAHPDDEAITTGGVLADLAARGADVTVITCTLGEQGEVIGETFAQLVNGDADQLGGFRIHELYASLEILGVRGIHLGGAGCWRDSGMVGDPANEHPRAFIHSGDRAVEQLKELLAELKPHLLITYGPDGGYGHPDHIRAHEITHAAAGEQRILWAVSDREELEDGLKAITGLPEGWGRGELSAVDSVDLSVELNDEVYATKVESMRAHATQLWIADGSVSRTNPVAAHAVTQQDNVKVWALSNLIAQPIMRHEHYQLGAGTPLPEGATGVLDGLEF

SEQ ID NO: 4724 - protein, 146 aa, Corynebacterium glutamicum
MTDWSSDTVMAESKQVRNKSFIHRNLGKGEVFGGLFWLSLGALISVLLEVIYLGTRITLPGGTSLAFPYTIAIAFLFNMVLTRTSMLWTDHWLAKFTPLTVWILGFMALLVWTVVAGDQLIPNNIRTVLLLFAGFSGGIWPAVKGK

SEQ ID NO: 4725 - protein, 105 aa, Corynebacterium glutamicum
MTYTIAQPCVDVLDRACVEECPVDCIYEGKRMLYIHPDECVDCGACEPACPVEAIFYEDDVPDEWLDYNDANAAFFDDLGSPGGAAKLGPQDFDHPMIAALPPQA

SEQ ID NO: 4726 - protein, 367 aa, Corynebacterium glutamicum
MTSRTPLVSVLPDFPWDSLASAKAKAASHPDGIVNLSVGTPVDPVAPSIQIALAEAAGFSGYPQTIGTPELRAAIRGALERRYNMTKLVDASLLPVVGTKEAIALLPFALGISGTVVIPEIAYPTYEVAVVAAGCTVLRSDSLFKLGPQIPSMMFINSPSNPTGKVLGIPHLRKVVKWAQENNVILAADECYLGLGWDDENPPISILDPRVCDGDHTNLIAIHSLSKTSNLASYRAGYLVGDPALIGELTEVRKNLGLMVPFPIQQAMIAALNDDDQEAGQKLTYAIRRAKLMRALLESGFQVDNSEAGLYLWATREEPCRDTVDWFAERGILVAPGDFYGPRGAQHVRVAMTETDERVDAFVSRLS

SEQ ID NO: 4727 - protein, 207 aa, Corynebacterium glutamicum
MSLKFSVERGHLSSESSPESSTEQKTWGSRFLRASRQFIKFGIVGGSGTLVNLAVAALSKKIAGWTAGIHESDAFMNLLGSAFHIRWYHVFMTIAFLVANTWNYQLNRMWTFKTATIVSWWRGFFPFLATGLVAFIASQVVATLLMNETSPIALSSEIFDDSTGFRTKFYWALVISILVSMPVNFIVNKYWTFKKPKSKVVVETDPV

SEQ ID NO: 4728 - protein, 395 aa, Corynebacterium glutamicum
MNPGGILMTTDIYFSHNNPHDPYAHHTTELNRDTHHLWVVLTTDSDDFDADSFTTEVIRITGYSRHEVNNGLNAMAAMTNLPHLRAIQERYYFLSIRYLASIMIAVAKADPTLWEELDLRITDALTPVTAGEVMIQSSTLSKRIAAWIKELDPEPTPEPIPKEDYVHVHTTDEATYVRIKISGPNRLILNDIITQLKDTDTEDSLPEALMAFLMEKIQLKITKYLFTPHKHPEQVWSPDYGDIGPEAYANATLVCAKDLDEVAGATEKSYTPSEKMKALIRARDGHCRFPGCCVPASKCQVDHIIPWAEGGPTAAWNLQLLCQRHHNMKTDGRFTADANGLAEIRWIGPMDVPAVTRPTGPLVKAMPRGIWGQVLRDRIQARFERIRVRALNKED

SEQ ID NO: 4729 - protein, 297 aa, Corynebacterium glutamicum
MTTASATGIATLTSTGDVLDVWYPEIGSTDQSALTPLEGVDEDRNVTRKIVTTTIDTDAAPTDTYDAWLRLHLLSHRVFRPHTINLDGIFGLLNNVVWTNFGPCAVDGFALTRARLSRRGQVTVYSVDKFPRMVDYVVPSGVRIGDADRVRLGAYLADGTTVMHEGFVNFNAGTLGASMVEGRISAGVTVDDGTDVGGGASIMGTLSGGGQHVISLGKRCLLGANSGCGIPLGDDCIIEAGLYITAGTKVLFDGSLHKASTLAGSNGLIFRRDSVSGQVVAVPNTKVVELNTALHSN

SEQ ID NO: 4730 - protein, 221 aa, Corynebacterium glutamicum
MLDRLVEIAIRRETEVEVHPREVWNDVVCHARFAENDVEAFTVGQAINVDFCGLIRSNLRNDRRQLMHRIITQPASRRMGTHTMRRHLDAQIALAARLNPAASRLTQQRQISRQPLRMLIANVAQTIEVISNFLALIRNQRQIMFKLSRRGQGGKSMQIHRQPRFHIDGATAIHDAVFHTAWQIVRDRHCIDMTSKHDPRGQSPVRASKNVVVEAEDLYTR

SEQ ID NO: 4731 - protein, 256 aa, Corynebacterium glutamicum
MAPKQTPSPEKNRNLVGPVLQRRQTEGTFDQRLLEMRADHNWKHADPWRVLRIQSEFVAGFDALHEMPKAVTVFGSARIKEDHPYYKAGVELGEKLVAADYAVVTGGGPGLMEAPNKGASEANGLSVGLGIELPHEQHLNPYVDLGLNFRYFFARKTMFLKYSQAFVCLPGGFGTLDELFEVLCMVQTGKVTNFPIVLIGTEFWAGLVDWIRHRLVEEGMIDEKDVDRMLVTDDLDQAVKFIVDAHAGLDVARRHN

SEQ ID NO: 4732 - protein, 277 aa, Corynebacterium glutamicum
MSSLPVIMAIVNRTPDSFYDKGATFEDTAALNRAAEVIEQGAGIVDIGGVKAGPGDFVSAEEEIDRVVPIIAAVRERFPDIDISVDTWRASVADVAVAHGATLINDTWAGHDHELVQVAGQHKVGYVCSHTGGVIPRTRPYRVHFDDIVADVITETTKLAEQAVRAGVPEERVFIDPTHDFGKNTFHGLELLRRIDEVVATGWPVLMALSNKDFIGETLERGVDKRVAGTLAATAWAAARGVAAFRVHEVAETFDVLQMTAAIMGDVAPLNTIRGLA

SEQ ID NO: 4733 - protein, 243 aa, Corynebacterium glutamicum
MSSVSVVIPALNEAPTVAKVVEAVLADNPLEVLVIDADSTDATAAEARSAGATVLNWREILDTEPIPGKGESLWRGVAAARGDIVVFVDADLTSFRPGMVNSLVAPFLNDDIHLVKADYVRTFGDHTTGGGRVTELTAKPLLRALFPELSHIRQPLGGEYAIRRSTALAMPFVSGYGVEVGLLIDVATQFGTSSIAQVDLGSRSHNHQSLEALGSMADVVATTILQRFGHDLPVVQREPLGIH

SEQ ID NO: 4734 - protein, 102 aa, Corynebacterium glutamicum
MLTWIIMIIVLIALIVIFTWVFAKLFGRGEQTQPLPENNEIVEHNRQAVGEGNIDKIMFDTVIRGYRQDQVDDVIEHLKWQVDSLNAQLEQAHLRAKTFETG

SEQ ID NO: 4735 - protein, 55 aa, Corynebacterium glutamicum
MAAMKPRTGSGPMEAVEESRKIVMRIPSDGGGRLVVELNKEEAAELGALLLEAAK

SEQ ID NO: 4736 - protein, 288 aa, Corynebacterium glutamicum
MLSHIIDVLADPIDGTPLVGAEDFSRLVSESGHSYDVARQGYVTLAGGAGLRYSGDDAQMIADRETFLSGGHFAPFVEAVTEHVQDVVDQAGLSDDAQPVVCEIGAGTGYYLSHTLDSVAGSRGIGIDVSVHAAKRLAKCHPRVGAVIADAWARLPIADNSVDAITVIFAPRNAAEFARILKPKGQVIVLTADTGHLAELREPLGIIDVEAGKVDRMIEQAAGHLKPVGERDLVEFEMLLDQKSIASQIGMSPSARHIKPEALAERIAALPEQMKVTARAKITRLERI

SEQ ID NO: 4737 - protein, 498 aa, Corynebacterium glutamicum
MTNVSGYHRPELHITAESGVLFAPAGVLLDDDTWHFFHQYRPSPDHGPRWAHQFAERTPFVWDICDDVLAPEGDETQVRAGSVVSNNGGVDLYFTSVVGPTSTIQLAHINNIRGTTELINEDELGLDPDVSRIGEVVGNTDGYVKFRSPCVIPGWEDQGNRDEGHSGWLMLAVTGPVEAPTVVVLDSPDGREWSITGPLSLNGLSGLESDEVLVAPRMIRLRDEVDHEIYDVLIVTIEQDGIDISGYLVGQLNGSEFDVKTPFTRIDFGHDFSRPRNTNYAETTIGYDFAHIFGLMNGVGRLDSPTEHLSWKEEGWANAISFPRIVTLQDGTVFQTPPEGLLDAIHESEAAAGWTGLCEIPSNSAVEVALKDQEGEIAATITHRHNQLVVDRSMNPNHAGDPHAIAPLTDDETDSLFIVVDGSTVEVFADGGYVSMASRVYFNNGPFSEFEVTTTGDASIIRQESHFPVDFSSVSLDIDDLTALMQFDENEPHEGPVR

SEQ ID NO: 4738 - protein, 409 aa, Corynebacterium glutamicum
MPPFRYRCATVFRWLIFEIMRVGMMTREYPPEVYGGAGVHVTELTRFMREIAEVDVHCMGAPRDMEGVFVHGVDPALESANPAIKTLSTGLRMAEAANNVDVVHSHTWYAGLGGHLAARLHGIPHVATAHSLEPDRPWKREQLGGGYDVSSWSEKNAMEYADAVIAVSARMKDSILAAYPRIEPDNVRVVLNGIDTELWQPRPTFDDAEDSVLRSLGVDPQRPIVAFVGRITRQKGVEHLIKAAALFDESVQLVLCAGAPDTPEIAARTTALVEELQAKREGIFWVQDMLGKDKIQEILTAADTFVCPSIYEPLGIVNLEAMACNTAVVASDVGGIPEVVVDGTTGALVHYDENDVETFERDIAEAVNKMVADRETAAKFGLAGRERAINDFSWATIAQQTIDVYKSLM

SEQ ID NO: 4739 - protein, 405 aa, Corynebacterium glutamicum
MKGRPNVLAIVLAGGEGKRLFPLTEDRAKPAVPFGGTYRLIDFVLSNLVNSGFLKIAVLTQYKSHSLDRHISLSWNVSGPTGQYIASVPAQQRLGKRWFTGSADAILQSLNLISDEKPDYVIVFGADHVYRMDPSQMLDEHIASGRAVSVAGIRVPREEATAFGCIQSDVDGNITEFLEKPADPPGTPDDPDMTYASMGNYIFTTEALIQALKDDENNENSDHDMGGDIIPYFVSRNDAHVYDFSGNIVPGATERDKGYWRDVGTIDAFYECHMDLISVHPIFNLYNSEWPIHTTSEGNLPPAKFVRGGIAQSSMVSSGSIISAGTVRNSVLSNNVVVEEGATVEGAVLMPGVRIGKGAVVRHAILDKNVVVRDGELIGVDQVRDAQRFKVSAGGVVVVGKNQVV

SEQ ID NO: 4740 - protein, 213 aa, Corynebacterium glutamicum
MSNAFEYLRTYVESTTETDAAVARAREDAAEFGLPAPDEMTGQLLTTLAATTNGNGSTGAIAITPAAGLVGLYILNGLADNTTLTCIDPESEHQRQAKALFREAGYSPSRVRFLLSRPLDVMSRLANDSYQLVFGQVSPMDLKALVDAAWPLLRRGGALVLADALLDGTIADQTRKDRDTQAARDADEYIRSIEGAHVARLPLGAGLTVVTKA

SEQ ID NO: 4741 - protein, 213 aa, Corynebacterium glutamicum
MKKKSRDDAPVVIETVQAEHAEELTGTAAFDAGQADMPTWGELVAEHADSVYRLAYRLSGNQHDAEDLTQETFMRVFRSLKSYQPGTFEGWLHRITTNLFLDMVRHRGKIRMEALPEDYERVPGNDITPEQAYTEANLDPALQAALDELSPDFRVAVILCDVVGMSYDEIAETLGVKMGTVRSRIHRGRSQLRASLEAAAMTSEEVSLLVPTH

SEQ ID NO: 4742 - protein, 164 aa, Corynebacterium glutamicum
MFNSDTTANLQAKSRDRAGSKAKRSRPSFDSVARDVLDVRTKTAQVKNKAKEFSSVDHLSADAAAMFVDNELSRGAMHRARLHIVHCAECREEINRQRETVDYLRSECKNEEVSAPMDLKARLASLATECMPGPGAENLAMQRPESFVAKVESVVRAVRKNQGR

SEQ ID NO: 4743 - protein, 156 aa, Corynebacterium glutamicum
MFSSVGWGEIFLLVVVGLVVIGPERLPRLIQDARAALLAARTAIDNAKQSLDSDFGSEFDEIRKPLTQVAQYSRMSPKTAITKALFDNDSSFLDDFDPKKIMAEGTEGEAQRNKQAADNNANVVERPADGSTARPTQNDPKDGPNYSGGVSWTDII

SEQ ID NO: 4744 - protein, 375 aa, Corynebacterium glutamicum
MMTQVTESAVRSALSRVEDPEIGKPITELGMVKSVSIDGSDVQVEVYLTIAACPMKTTIVTNTEAALKDIDGVGQVHVTTDVMSDEQRRALRVSLRGETSEPVIPFAQPGSTTRVYAVASGKGGVGKSSMTVNLAAALAKRGLSVGILDADIYGHSVPGMLGSDQRPHQVDDMIMPPQAHGVKMISIAHFTEGNAPVVWRGPMLHRAIQQFLTDVFWGDLDILLLDLPPGTGDIAITVAQLIPNAELLIVTTPQAAAAEVAERAGTISVQTNQKVAGVIENMSAMVLPDGTTMDVFGTGGGQKIADRLTAVTGEEVKVIGSVPLDPNLRIGGDVGNPIAISEPHSPTAAAINEIAEHLAHRKVSLVGKTLGLGVK

SEQ ID NO: 4745 - protein, 193 aa, Corynebacterium glutamicum
MADFNRSELDSPLFGSRKRFKFDDDTIGAYAEKVARFFGTGQYLFWQTIFVVVWIFLNIGGWAWSWDPYPFILLNLAFSTQAAYAAPLILLAQNRQEDRDKHTILADRRRAEETKADTEFLARELAGVRLALGDTVTRDYLRHELEDLRGLLDRIEAKLDDEAASRIADRHEQHGSGPQDLSDPTQGDVADEF

SEQ ID NO: 4746 - protein, 430 aa, Corynebacterium glutamicum
MSGISRLYVGRLAGMVVRGPDTDAIGRVRDVVVNIRPYGHDSRALGLVVELVNNKRRIFVPMLRIAAIEPKDITLVTGSVSLRTFRVRTGELQVMGDIVGAKVHTDDPELQQFHGRAVEIADVELELSRTRDWIITRVAVLGERPKFGRRPVLHTVPWSHIHGITAGGVGESNHTAELIAGFEDMRPADVAKQLYQLPTAQRTEVTEELDDEKLADILQELSEDRQAELIEELDIERAADILEEMDPDDAADLLGELPDDKADVLLDLMDPEESAPVRRLMDFSPDTVGALMTPEPLIMDPSTTVAEALAMARNPDLPTSLASLIFVVRPPTATPTGKYLGCVHLQKLLREPPSSLIGGILDPDLPPLYADDSQETAARFFATYNLVCGPVLDENRHLLGAVAVDDLLDHMLPEDWRDAGIRPGKEHTHG

SEQ ID NO: 4747 - protein, 172 aa, Corynebacterium glutamicum
MKRKMIKMTQPRPDAASVSLEKKRPEGWPVGSFETYPEAQAAVDLLSDNAFPVTELTIVGVDLIEVERVTGRLTWGRVIAGGMASGAWLGLFFGIVMALMSGFWFSSIAAGIGMGLVFGIVGAAVPYAASKGKRDFTSSTQIVAGRYDVICSPERAREARDMIALKTRDLRQ

SEQ ID NO: 4748 - protein, 222 aa, Corynebacterium glutamicum
MKNVGKRILVLALGASVAGCSTLSQEPSPPVPLGNVDTVQIVSPNGEIESFVLGKLYETALVERGRSASVQLIDGDLDEQLSMLRDDSTDLVIACSGQLLEYYNPDLASEFAVEYANQTAFDKNSGEWREKVYDALQGSLPDSIVATDPSNAIGCKDDTSLPQNIVPIYRKPNLDRDNRDTLNFVSGSLGTSDLEALVKDAQTTGTTSETALDFLLSKGFSR

SEQ ID NO: 4749 - protein, 198 aa, Corynebacterium glutamicum
MPCESHSIRPFLLPWLPKVEGMKRICAVAISSVLLLSGCSSTSTTQLEGFDGRSAQEIITELDQTPVADRATNLMASIRADELILSDQSGQLSIDMPADEFYISAAPYTTTTHECFYHSLTTCTGELANTPVKVTVVADNGETILEEDTITYDNGFVGMWLPRNIDATLTIEHDGLKSTQPISTGDDAPTCITTAELA

SEQ ID NO: 4750 - protein, 1257 aa, Corynebacterium glutamicum
MLQLGLRHNQPTTNVTVDKTKLNKPSRSKEKRRVPAVSSASTFGQNAWLVDEMFQQFQKDPKSVDKEWRELFEAQGGPNTTPATTEAQPSAPKESAKPAPKAAPAAKAAPRVETKPADKTAPKAKESSVPQQPKLPEPGQTPIRGIFKSIAKNMDISLEIPTATSVRDMPARLMFENRAMVNDQLKRTRGGKISFTHIIGYAMVKAVMAHPDMNNSYDVIDGKPTLIVPEHINLGLAIDLPQKDGSRALVVAAIKETEKMNFSEFLAAYEDIVARSRKGKLTMDDYQGVTVSLTNPGGIGTRHSVPRLTKGQGTIIGVGSMDYPAEFQGASEDRLAELGVGKLVTITSTYDHRVIQGAVSGEFLRTMSRLLTDDSFWDEIFDAMNVPYTPMRWAQDVPNTGVDKNTRVMQLIEAYRSRGHLIADTNPLSWVQPGMPVPDHRDLDIETHNLTIWDLDRTFNVGGFGGKETMTLREVLSRLRAAYTLKVGSEYTHILDRDERTWLQDRLEAGMPKPTQAEQKYILQKLNAAEAFENFLQTKYVGQKRFSLEGAEALIPLMDSAIDTAAGQGLDEVVIGMPHRGRLNVLFNIVGKPLASIFNEFEGQMEQGQIGGSGDVKYHLGSEGQHLQMFGDGEIKVSLTANPSHLEAVNPVMEGIVRAKQDYLDKGVDGKTVVPLLLHGDAAFAGLGIVPETINLAKLRGYDVGGTIHIVVNNQIGFTTTPDSSRSMHYATDYAKAFGCPVFHVNGDDPEAVVWVGQLATEYRRRFGKDVFIDLVCYRLRGHNEADDPSMTQPKMYELITGRETVRAQYTEDLLGRGDLSNEDAEAVVRDFHDQMESVFNEVKEGGKKQAEAQTGITGSQKLPHGLETNISREELLELGQAFANTPEGFNYHPRVAPVAKKRVSSVTEGGIDWAWGELLAFGSLANSGRLVRLAGEDSRRGTFTQRHAVAIDPATAEEFNPLHELAQSKGNNGKFLVYNSALTEYAGMGFEYGYSVGNEDSIVAWEAQFGDFANGAQTIIDEYVSSGEAKWGQTSKLILLLPHGYEGQGPDHSSARIERFLQLCAEGSMTVAQPSTPANHFHLLRRHALSDLKRPLVIFTPKSMLRNKAAASAPEDFTEVTKFQSVINDPNVADAAKVKKVMLVSGKLYYELAKRKEKDGRDDIAIVRIEMLHPIPFNRISEALAGYPNAEEVLFVQDEPANQGPWPFYQEHLPELIPNMPKMRRVSRRAQSSTATGVAKVHQLEEKQLIDEAFEA

SEQ ID NO: 4751 - protein, 1247 aa, Corynebacterium glutamicum
MKTEQSQKAQLAPKKAPEKPQRIRQLISVAWQRPWLTSFTVISALAATLFELTLPLLTGGAIDIALGNTGDTLTTDLLDRFTPSGLSVLTSVIALIVLLALLRYASQFGRRYTAGKLSMGVQHDVRLKTMRSLQNLDGPGQDSIRTGQVVSRSISDINMVQSLVAMLPMLIGNVVKLVLTLVIMLAISPPLTIIAAVLVPLLLWAVAYSRKALFASTWSAQQKAADLTTHVEETVTGIRVVKAFAQEDRETDKLDLTARELFAQRMRTARLTAKFIPMVEQLPQLALVVNIVGGGYLAMTGHITVGTFVAFSSYLTSLSAVARSLSGMLMRVQLALSSVERIFEVIDLQPERTDPAHPLSLPDTPLGLSFNNVDFRGILNGFELGVQAGETVVLVGPPGSGKTMAVQLAGNFYQPDSGHIAFDSNGHRTRFDDLTHSDIRRNLIAVFDEPFLYSSSIRENISMGLDVSDEQIEHAARLAQAHDFIDRLPNKYEEVIGERGLTLSGGQRQRIALARAFLAHPKVLVLDDATSAIDASTEDRIFQALREELHDVTILIIAHRHSTLELGDRVGLVEDGRVTALGPLSEMRDHARFSHLMALDFQDSHDPEFTLDNGSLPSQEQLWPEVSTEKQYKILAPAPGRGRGMSMPATPELLAQIEALPAATEETRVDAGRLRTSTSGFKLLSLFKQVRWLVVAVIALLLVGVAADLAFPTLMRAAIDNGVQAQSTSTLWWIAIAGSVVVLLSWAAAAINTIITARTGERLLYGLRLRSFVHLLRLSMSYFERTMSGRIMTRMTTDIDNLSSFLQSGLAQTVVSVGTLIGVVTMLAITDAQLALVALSVVPIIIVLTLIFRRISSRLYTASREQASQVNAVFHESIAGLRTAQMHRMEDQVFDNYAGEAEEFRRLRVKSQTAIAIYFPGLGALSEIAQALVLGFGALQVTRGDISTGVLVAFVLYMGLMFGPIQQLSQIFDSYQQAAVGFRRITELLATQPSVPDLGTNRHARQAATQPLLLDDVTFGYSDDPILDNVTVQIEPGTTVAVVGPTGAGKSTVVKLLSRLYDPNEGAVKAGEIDIKDFPTADWRRTIGTVPQEAHLFSGSIADNIGYGCREASTSKIEAAARRVGALNAIAAIPDGFNHQVGERGRNLSSGQRQLIALARAELIEPSIMLLDEATSTLDPATEAVILNASDRVTKGRTSIIVAHRLATAKRADRILVVEQGRIIEDGSHDALLSANGTYARMWHLMA

SEQ ID NO: 4752 - protein, 239 aa, Corynebacterium glutamicum
MAEHNAIITDAVHSDPAVLEDNAGFSGKYLIRALDKAAHMQTGAIEGYISWLRKHNPEKTPAQLQVLVDKHFMRLATGSGAGVGMAAAVPGIGFVTGALAVGAESLVFLDAAAFYTMASAHLRGIDIRHPERRRGLILVVLLGTAGKAIVDAGVGDLSKKNHAPGIAISRFNIGGLMEVNGRLMRYAVKEVSKRFRSALIGKILPFGIGAVLGTMANRKIAKRTVGNAYDSLGPLPTHF

SEQ ID NO: 4753 - protein, 268 aa, Corynebacterium glutamicum
MVNYVDRETTLCISLAARPSNHGVRFHNWLYAELGLNYLYKAVAPADITAAVAGIRGLNIRGAGVSMPYKSDVIPLIDELHPSAERIRSVNTIVNNDGHLVGYNTDYTAVYHLLEEHRVNPNARVAIKGSGGMANAVVAALAEYGLSGTVVARNHTTGSALASRYGWEYSATVPEDAKILVNVTPMGMNGPDQDVVSFGEDEVDRADVIFDCVAFPVETPLIKLAKEKGKQTIDGGEVAALQAAEQFHLYTGVLPTNDQIIAAEEFSK

SEQ ID NO: 4754 - protein, 537 aa, Corynebacterium glutamicum
MADEMVVPTSTGFVKGVKGPGLKTWRGIPYGRNTGGKYRFRAPRPAKKWDGVRDCSMFGEVASQPTYSWTDKIRGSEDCLNLDVVRPDSEEKLPVVVYLHGGSFIMGSSSEKALRGYNLVTNMNVVYVSVNFRLGALGYLDLRSVGEDCVANPALHDQLLALQWVSRNIEAFGGDPDNVTLMGESAGAAAVVALMCVPAAGGLFHRAIAQSAPVISVHSSTQAKFWARELIYRMALPRETTLDELRQESADDLVRAGQSMMWRSGELLQLNSCYGPTVDGSLLPEHPLTMFEQGRQHRIPFMIGTNNGETSFSKAFYLRSSARRRSALRMLSVYDPHNAERVVSAYGGGEARTDFSELLADALFWAPSVRLAQSHASQDEDTWMYRFDYAPQSMRKLGLGAIHSFELNAVFGDHESSRSMNLAKIAGGMDHLDKVTELVQEHWKQFIYFGRPGEEWKAYRGRSDTEPGRATFVIDINSRIAWDPRQDKRTAWENYDMLEWGTGRPDLANELDFIEPEETEEEQQLKWLSLMQFFGSR

SEQ ID NO: 4755 - protein, 217 aa, Corynebacterium glutamicum
MSIWKRLLVQYPRFADTLTAGQPITLEELATPEVILEAVAKGQEIFGIEQPKHAAQLWFHSLCTAIVGPAVTAMVEFDVIPSLDIRRGQLHNIDGYWFGFRPEEMLVDASLHLSGTQFGESIRVVIDALCAATDLRPAPLWAVASDALGIAASGAGVEAFEEEHAREVAEALIEGMNSVNSVPSPRFNDDDYFIRAGCCMIFHSPRADFCTSCPQKR

SEQ ID NO: 4756 - protein, 292 aa, Corynebacterium glutamicum
MWTLGLSAVSLGDVPSTNQMEGHQNMSFFEDIAAGLDSDGIESRVNGDTMFVPITSDLEIQFVEIDSLLPAANVYIAAANVDEDDDEFEAVLVSVVFSVEDAVAAVAKHVATDQVVTVLRDLLEGTDERIQDLEFFQDAVNANLVRAEVGQNSELQVLVEVEDGVPTATVNFIAIGESFEDLIDQAIEELWESDGDAVLSDEDRQRMFADLTSELEFVTDEVLDLGTFTDFDRLFDILSLADDQAEDWEAQLVPFEDEEFDEPDVYDLFVDDSEEDDDDLDDDEDDEDDDED

SEQ ID NO: 4757 - protein, 175 aa, Corynebacterium glutamicum
MSLGCSTLPTMIKHRNRLMSSIYSATRYAAHFKSVFPTALDDIQSMMRHPRSLARAIPTWRPPSIPLPSLPGEDPLTLTLSRHRAGPAARQIIREFGEQREPAYLITIRITSPEGFKVSTRLAEGWIRAILSTAHSGTVHQLTDEPAPTFCWLVDAHFDPVRSPSFLFEYSKSAA

SEQ ID NO: 4758 - protein, 405 aa, Corynebacterium glutamicum
MLTQKIELEAKPKIPEEIWVLVVAAFIIALGYGLIAPILPQFVVGFDVSFAAASAVVSIFAGARLLFAPMSGSLIDKIGSRRVYLTGLLTVAITTGLVALAQEYWQILLLRGIAGIGSTMFTVSAMGLIVKMAPVEIRGRCSSVYASSFLFGNIIGPVVGAAMSGLGMRWPFAIYGASVGLAALVVWWRMPKTNDSLRKADSNSVPALRFAEAIKDSAYRSALFSAFANGWSNFGVRVAVLPLFAAAAFSNGGAIAGFAMAAFAAGNALCLQFAGDLSDRIGRKPMIISGLIVNAVFTAMIGFGTEVWILITVSALAGAGAGLLNPSQQAVLADVIDSRPGGKVLANFQMAQDFGAIVGPILVGMIAEQAGFQIGFMLCGVISLLAAVAWIFGRETLPTAKVEQV

SEQ ID NO: 4759 - protein, 449 aa, Corynebacterium glutamicum
MTPIVESRAWKALGALSVGLFLTLLDQSLVAVALPKIQEDLGASLNQAVWVSAVYLLTFAVPLLITGRLGDRYGQRNIYLAGMAVFTLAALACVFAPSIEWLIAARAVQGLGGSLLNPQPLSIIHKIFAHDRRGAATGVWSAVASSAGLFGPVIGGVLVGWISWRAVFLVYVPLGLISLFMVARYVPKLPTGTSKIDWLSGAVSLVAVLGVVLALQQGPELGWGTLIWVSLAVGIAAAVLFIWMQTRSKAPLMPLRIFKTRNFAIGAFSIFSLGFTVYSVNLPIMLYLQTAQGMSSQLAGLMLVPMGIISVVMSPVIGRLVDRLAPGMISKIGFGALIFSMALMAVFMIANLSPWWLLIPIILFGSSNAMSFAPNSVIALRDVPQDLVGSASGFYNTSRQVGAVLGAATLGAVMQIGVGTVSFGVAMGAAILVTLVPLIFGFLAVTQFR

SEQ ID NO: 4760 - protein, 235 aa, Corynebacterium glutamicum
MGDQVNANRAKADARKSVQRLIARAEVSIDKHAIALSQSGVTSADLLQNLRSNIGDQRRLIDLNPLSIERLDEALVDLKQCRQVIQRIGTISGASKGKESQWTNQNRAGINATNLLATEILNQRGRIQNETCIRRQLRHEVVVVGIKPLGHCLCRQGLSTASSAKVAVNPQWETIVFMISDVIKTLRQHTQNSGGIEHCVVVGTSCKRNGIQSRQRIRCSVDQLAGGLRKFATFN

SEQ ID NO: 4761 - protein, 745 aa, Corynebacterium glutamicum
MTSNFSSTVAGLPRIGAKRELKFALEGYWNGSIEGRELAQTARQLVNTASDSLSGLDSVPFAGRSYYDAMLDTAAILGVLPERFDDIADHENDGLPLWIDRYFGAARGTETLPAQAMTKWFDTNYHYLVPELSADTRFVLDASALIEDLRCQQVRGVNARPVLVGPLTFLSLARTTDGSNPLDHLPALFEVYERLIKSFDTEWVQIDEPALVTDVAPEVLEQVRAGYTTLAKRDGVFVNTYFGSGDQALNTLAGIGLGAIGVDLVTHGVTELAAWKGEELLVAGIVDGRNIWRTDLCAALASLKRLAARGPIAVSTSCSLLHVPYTLEAENIEPEVRDWLAFGSEKITEVKLLADALAGNIDAAAFDAASAAIASRRTSPRTAPITQELPGRSRGSFDTRVTLQEKSLELPALPTTTIGSFPQTPSIRSARARLRKESITLEQYEEAMREEIDLVIAKQEELGLDVLVHGEPERNDMVQYFSELLDGFLSTANGWVQSYGSRCVRPPVLFGNVSRPAPMTVKWFQYAQSLTQKHVKGMLTGPVTILAWSFVRDDQPLATTADQVALALRDEINDLIEAGAKIIQVDEPAIRELLPLRDVDKPAYLQWSVDSFRLATAGAPDDVQIHTHMCYSEFNEVISSVIALDADVTTIEAARSDMQVLAALKSSGFELGVGPGVWDIHSPRVPSAQEVDGLLEAALQSVDPRQLWVNPDCGLKTRGWPEVEASLKVLVESAKQAREKIGATI

SEQ ID NO: 4762 - protein, 152 aa, Corynebacterium glutamicum
MVTPVDGWVVGHSLEKVTSNHVEKKLKVLKKHVTLGDVIIIASVVFLLVGAMLANAAAALFSASEPFGRISYLIGLPNEDDFVPYSLRFVAFFPLMLSASMAASFFGVWAVLIIPFGYFPSLMMVHKHNKQVQRTWDSVTVADFYEDSTPLV

SEQ ID NO: 4763 - protein, 466 aa, Corynebacterium glutamicum
MKNKRVAIIGAGPSGIAQLRAFESAEKQGHEIPELVCFEKQDTWGGQWNYSWRTGTDSYGEPVHSSMYRNLWSNGPKEVLEFAEYSFDEHFGKPISSYPPREVLWDYIAGRAKKSNVEKYIKFAHVVRWVSFDEATKLFTVTVENLRTGETSSDTYDNVIVGAGHFSFPNVPHFDGVETFPGQIMHAHEFRGAEAVADKDILLIGASYSAEDIGTQAYKMGARSVTFSYRSNPMGYEWPEEMTELPLVERFDGSEVHFVNGEKRKVDIVVFCTGYLHHYPFMPSELTLSSPNNLYPDTLYRGVVSEANNQLFWLGAQDQWLTFNMFDAQAWYVRDVILGRVALPSKEAQRNHMDKWLSRFEGLKSENDQIDFQCDYVEDLIDQTDYPSFDLKEVANILKGWVKSKEEDILNYRDYTYTSVMTGTTSVEHHTPWMIELDDSLERYLSEPQEDEARQVYRGKKVRDKA

SEQ ID NO: 4764 - protein, 108 aa, Corynebacterium glutamicum
MAIIASVVFLIAGTILAAIATARWSMLEPYGLIPYFIGHDIDFEQKGQFLVYFLRAAGFFVLIVAAAFAQPFFGLWALLLLVVGGFPSGMMVRQHNRRVRAMWRPRET

SEQ ID NO: 4765 - protein, 315 aa, Corynebacterium glutamicum
MRCGGPARHRLRTTLEHMPQIPAQNFDDVALIIEGGGTRNSYTAAVIDQLIANNIHFGWVGGVSAGASHTVNYLSADRFRTVSSFVEFAADRRYSGIQPLVRGRGYFNAVDIYETSTQPDQEFPFDFDTFSADPTPFQLSAVRADTGETVFWGREDTPDLSALMKRVRASSTMPGFMPITYIDGHPYVDGAVGETGGLMLQPAIDAGFTRFFVIASRPRDYWRKEIGRPGFIKAALRRFPTIADLTIARPALYNSVKQQILDLEKQGSAYVFFADNMNIQNTEINLKKLRASFDAGMQQTRKDWPEIMSFLNQTR

SEQ ID NO: 4766 - protein, 264 aa, Corynebacterium glutamicum
MNSPLQHSAFPVPGAQLSTSYSDEHGQAVIQLHGLTSSRQRDRLLDLDLGRGLSGTRLLRYDARGHGTSTGRAASTDYQWDTLAGDLLMLLDAHFPHEQVHGVGPSMGCATLLKAAVLNPDRFSGFTLMLPPTAWESRKAQASEYLSRAEFLETHGMDAFLNAEKLHAQPPATVGTPDTVPDISAELLPWAYRGAAQSDLPSKKEIAKITAPTTILSWTDDPGHPVSTAIELTRLMPNAQLRIATTPAEVARWPQHLRDDLQLD

SEQ ID NO: 4767 - protein, 549 aa, Corynebacterium glutamicum
MRLTHVDQLNLPFGTLSSYHPYASAPGEAVPVSFDQQRHVGAGERPGSWMAISVSMPKAISREELERAWLEVIERHGTLRTVFSTGMGGEVQQHRIDVGPGKWIDHAVAPGESINEALRAVLNRQCSPYSRPSHSLCIIDAHPRPTVIIGSDHSHVDMWSMLVIVRDLLAALDMELPVEPPLAFESHTAELLAAPPAPERIHQRWREILEAGGGKMPQFPLPLGDAISMPERVEVRDIFGVNGLAIYSARARAQQVSSLALTISVMADVTAALADLPLRAVFPVHSRFDQRWHDSVGWFISNSVIEVPDSDPHTAAQAVREAVSLGSYPLAELLEPWGGMPETPGMFAISWLDLRRLPVSIDDIGLQAQYVSASLRTDGVMLWFILDRSGAHLRCRYPDSLVARENVGRWIDAIVAQMRAEAGTVNLQAGGEQLTLRHGTRADISEIAPLLARNAADPCELVDLEHALDLLTHESSHFLAVVRNARGKIIAAMQLTIVPEFSRGGALHLHIEGPFIIPEYRTTDLDKKLRAWAVEHGRARGVKVEEVVG

SEQ ID NO: 4768 - protein, 64 aa, Corynebacterium glutamicum
MVYWRLVVEGDLRGQGVPEWSRVSVEVVWVLKRDSRRVTFWGKWGRCETWVFADQGLTTNRPGK

SEQ ID NO: 4769 - protein, 518 aa, Corynebacterium glutamicum
MNTLVKLRFRELIPAVVAGSVTMIASITLTVVSAWLITKAWEMPPVMDLTVAVTAVRALGISRAMFRYIERIVSHDLALKAASRARSSAYQRLASSPNSALTMRRGELLSRLGVDIDSVADVIVRAVIPAGVALLTGVVAIIFTAILSPATALVLAIGLIAAAIIPPLLAARGVKTAEARRAESSEAYLSSLDQVLSNQAALRVRGEMPAALSKADVAARSYSSSLEAGAKDTAIGAASSLWIHGFTVIGVLMVSASLYADGSHSPQWFGVLVLLSLAAFEAVSVLPDAAIARTRAADATRRLAEISALPESVSLELRTASDQPVLRAENLVYGWDSDLGTSNLDLTFGSRHEIIAPSGTGKTTLLLTLAGLLEPRGGQVLIDGTNPSELKNAVLFSPEDAHIFATTVRDNLALGAPEATDAEMTSILEHVGLSEWVQGLPDGLGTVLDSGADSLSGGQRRRLLLARVLLSDAPILLLDEPTEHLDTAGSSEILSMLASDELPGKRARRTVVIVRHVR

SEQ ID NO: 4770 - protein, 511 aa, Corynebacterium glutamicum
MSTKSSAPAKRRAGPVDPRLLRLSPATRRWVIIAGVLTALKTLATVAMGLLIGQMAAGIIEVSGSSLPRMELIALAITVVVRGLLAWAQDRFAQRASSQVTVDLREKTLRHLAQSDPRTIDQALWRTRLTSGLDGLGPYLTGFLPALAATIIATPVMLAVVGWLDVGSMVIAIITLPLIPVFMWLVGTLTAGRTEQRLSDLAILGGQLLDLIAGLPTLRAFRRHQDMAAQVTRLSSQHASSTLSVLKIAFLSSFVLEFLATLSVALVAVGIGFRLLAGDLTLAIGLTVLIIIPEVYAPIREVGTRFHDAQDGLVATDEILKLLSVSSLVDAPTHTPRDVAGGLEVSVEKLRADGRDGPRPADLSFTAKPGQLTVLWGPNGSGKSTALLAVLGLATEGITGEVSVKDASGQEFKDSALWEHCAYLPQRPVIDPESVSDYAELSLGQRQRLALKRELGAQLLLLDEPTAHLDPDNAAIMIQQLQAEARRGTTVLAVSHDPLLRAAADEVVEVK

SEQ ID NO: 4771 - protein, 333 aa, Corynebacterium glutamicum
MDLNTFWFILIAFLFAGYFLLEGFDFGVGILAPIIGKDSAARNTVIRTIGPVWDGNEVWLIVAGGALFAAFPEWYATMFSGMYLPLFLVLVSLIMRVVGLEWRKKVDDPRWQKWSDRAIFIGSWTPPLMWGFIFANILRGMPLKADHTIDAAAALPGMVNVFAILGALAFTALFALHGLAFIRLKTAGRVRTDAAKAAPVVALLAAVTGGPFVLWAAIAYGRSWSWILAVLIIAAVLGGAFALIKDRDGLSFLSTSVAVIGVVALLFSSLFPNVMPTTLADGVSLDIWNASASAYAFTILTWTAAVIAPLVVLYQGWTYWVFRKRLHAEPVSA

SEQ ID NO: 4772 - protein, 513 aa, Corynebacterium glutamicum
MDVVDIARWQFGITTVYHFIFVPLTIGLAPLVAIMQTFWQVTGKEHWYRATRFFGTVLLINFAVGVATGIVQEFQFGMNWSEYSRFVGDVFGGPLALEGLIAFFLESVFLGLWIFGWGKIPGWLHTASIWIVAIATNISAYFIIVANSFMQHPVGAEYNPETGRAELTDFWALLTNSTALAAFPHAVAGGFLTAGTFVLGISGWWIIRAHRQAKKAESEIESKHSMHRPALWVGWWTTVVSSVALFITGDIQAKLMFVQQPMKMASAESLCETATDPNFSILTIGTHNNCDTVTHLIDVPFVLPFLAEGKFTGVTLQGVNQLQAAAEQAYGPGNYSPNLFVTYWSFRAMIGLMLGSLAIAAIAWLLLRKKRTPTGKIARLFQIGSLIAIPFPFLANSAGWIFTEMGRQPWVVHPNPESAGDARTEMIRMTVDMGVSDHAPWQVWLTLIGFTILYLILFVVWVWLIRRAVLIGPPEEGAPSVEAKTGPATPIGSDMPMTPLQFTAAAPTTGEKE

SEQ ID NO: 4773 - protein, 755 aa, Corynebacterium glutamicum
MQEEALDALLSLTEKGEKRGVIISATGTGKTILAALATRMLKPERVLFVVHREQILDKARSEFIKVLERPAVDFGKMSGSTKELDKPFVFGTIQTLTKEATLSQISPTDFDLVIVDEVHRAGAESYLALLNHLQPQFLLGLTATPERTDGFNIYELFDFNVPYEIRLQAALESNMLVPFHYYGVTDFTLDSETTVTDTSKLSALVSEERVHHILEALKTYGHPENVRGLIFCSKTEEAEELSKLLDQSLFNGSLLKTKALSAKDSIPYREEVVAELESGDLDYILTVDIFNEGIDIPSVNQIVMIRSTQSSIVFTQQLGRGLRKAAGKDHLRVIDFIGNYANNYLIPIALFGDNSRNKNSIRRRLIESDIDGTISGVSSVNFDPIAQERIFAALKAAKLDSKAQFKQDIVQLQDRLNHVPALLDFARFNTVDPFILATHSGNYWSLLSSVKFVDHAPSESEKYFLDFLTGELLNGKRPHELLLIQELMKQPETSTEEFRKLLQAQSTSSDEQTINSVERILSQEFYTGPNRKKFGEHPILSVQNRTYSFTPEFRRALDESLEVTDRDEAAQNFKFHVQDIIDTGLFIARNNGFWQGNLVVGERYSRRDVCRILNWERNNESTIYGYKVDSYTSTCPIFVTYHKADDVSESTRYQDELVDPNTLHWYSRGNRKITSNEIKPIAANAVDLHVFVKKDDAEGLDFFYLGQAHSENSKQSSMPGNKGVVQPVVTMDLQFDTPVEQSLFEYLSTNLAVTE

SEQ ID NO: 4774 - protein, 114 aa, Corynebacterium glutamicum
MAINRIIKLKSNVAILAGRELQIPFPVYQQSIICEVGTTHYCGDSHVVMENVALGVETIALMYEDFHVLQSKKLTKHRWIIEIQVAGRDNSSFTLEVQQCLFQQRDTATGNKSD

SEQ ID NO: 4775 - protein, 131 aa, Corynebacterium glutamicum
MKKRINVTGAVLVKENRILAAQRGPEMSLPGYWEFPGGKIEQGETPEASLARELKEELLCDATVGEHLTTTEHEYDFGIVVLSTYFCTLNDAEPQLTEHAEIRWVAPHELESLEWAPADIPAVKLLVEQLA

SEQ ID NO: 4776 - protein, 255 aa, Corynebacterium glutamicum
MSLRKLTSLIGILAVVGLVAFILFNFVKTNDETSNVSQSESTAETVSETNGVLSDGAENIASQSDESKSGVEIIDSGFGQSSNSAMAIVIAKTSGGSLAGEFVTATVNFLDESGAVVATEDQVETLSWEDQELVLPVSHYKEDSSRPEITSIEAFLSVTDYGSGQPDETALPVLETTDISNPYAGSYNASFALKNDSSDDFKNLRVGIVCYNEQTDIIGGGFKFPNLVPAGGSIRMDASVTVSEMPASCKAYLNH

SEQ ID NO: 4777 - protein, 468 aa, Corynebacterium glutamicum
MNASPAPTRSFKGLRARHIHFIALGSAIGTGLFYGSAGAIQAAGPSVLLVYLLGGAVVYFMLRALGEMAVHHPVRGSFAVYTRAHLGGWAGYITGWMFAFEMLIVCLADLTAIGIYMNFWFPGTPQWTWVVATLLIVGGANLASVRWFGELEFIFTIIKVTAVVAMIVGGAAILAFGLGANAEVAGVSNLWEHGGFFPNGVEGMIAAFILVLFAFGGTEIIGVAGSEAEDPEKSIPKAVNTVPVRILLFYVGAILVILALNPWPSITGEESPFVQIFDTLGVNWAAGLLNAVVITAALSAINADLFGAGRVLTGLAKENLAPKAMGKIAKNGVPVMTTTIMIIVLIVGVILNAVLPERVFEIVASLATFATVYVWLMILLAQVGSRRNMPADEVKSLKFPVPFYPFGQYFAILFIAFTFGIMVWYDNYHLPLAVGVGFLVLMTILYYATGRPKAIAPIDYEELDPRRD

SEQ ID NO: 4778 - protein, 732 aa, Corynebacterium glutamicum
MSNTENVNGDVEQPNNVISSESQETPQGDSASADFALETPTNTVEDAPASEGSEEITRVADTSEDADSADADNASNVINENEDSSEGANQPSNESSSTEAKSGFDALGLPERVLDAVRKVGYETPSPIQAQTIPILMEGQDVVGLAQTGTGKTAAFALPILARIDKSVRSPQALVLAPTRELALQVADSFQSFADHVGGLNVLPIYGGQAYGIQLSGLRRGAHIVVGTPGRIIDHLEKGSLDISGLRFLVLDEADEMLNMGFQEDVERILEDTPDEKQVALFSATMPNGIRRLSKQYLNNPAEITVKSETRTNTNITQRFLNVAHRNKMDALTRILEVTEFEAMIMFVRTKHETEEVAEKLRARGFSAAAINGDIAQAQRERTVDQLKDGRLDILVATDVAARGLDVERISHVLNFDIPNDTESYVHRIGRTGRAGRTGEAILFVTPRERRMLRSIERATNAPLHEMELPTVDQVNDFRKVKFADSITKSLEDKQMDLFRTLVKEYSQANDVPLEDIAAALATQAQSGDFLLKELPPERRERNDRRRDRDFDDRGGRGRDRDRGDRGDRGSRFDRDDENLATYRLAVGKRQHIRPGAIVGALANEGGLNSKDFGRITIAADHTLVELPKDLPQSVLDNLRDTRISGQLINIERDSGGRPPRRFERDDRGGRGGFRGDRDDRGGRGRDRDDRGSRGGFRGGRDRDDRGGRGGFRGRDDRGDRGGRGGYRGGRD

SEQ ID NO: 4779 - protein, 229 aa, Corynebacterium glutamicum
MPTPSQHKDASTAQTDNQVPTGRRAQKREQTRARLITSARTLMAERGVDNVGIAEITEGANIGTGTFYNYFPDREQLLQAVAEDAFESVGIALDQVLTKLDDPAEVFAGSLRHLVRHSLEDRIWGGFFIQMGAAHPVLMRILGPRARRDLLHGLETGRFTIEDLDLATTCTFGSLIAAIQMALSADQDSNDDKDQIFAAAMLRMVGVQAAEAREIASRPLPEISPVKPQ

SEQ ID NO: 4780 - protein, 530 aa, Corynebacterium glutamicum
MSPNNFDTDVCIVGGGPTGTLLAVLLGQKGHRVTILEKWPTFYERPRAVTFDHEIARILGYIGIDSENDEAIDYHSDSYDWKNAAGETLLEVDWTSMTDSGWRTRYWFYQPELEKRLRDLALTMDFVDIRCGFTAVGLSQDENSAIIHGIVTDTPENIPADAQREDIRAKYVIGADGANSFVRNSLGLEMNDLGYFFDWLILDLKPTQDIDYGTDHWQLCDPKRPTTIVPGGPGRRRWEFMALPGEDLKELASEESAWNLLEPWDVTPGKAILERSAVYRFQARWAQEWRSGRALIAGDAAHLMPPFAGEGMCAGLRDSLALAWRLDLVLSGKSDDALLDTYGEERREHVHYYIDFSMDLGNVICITDEDEARLRDERMIKELEAQDGVPVNTDVAHLGPGIWDKDSSHGGELAKQGIVEYQGRKARFDDAVGRGWAVLGLNTDPREVLDEDSLVALDAIGAIVESVGDATSAVLDVEGLYTRWLKEAGATFIITRPDFYVYSTAVDAEQLQTQIKQLSDLLHLNSVVGA

SEQ ID NO: 4781 - protein, 356 aa, Corynebacterium glutamicum
MSLQFDHETLGQRVLFGSGEAAQNLAAEISRLDAKNVMVVAGDFELPMARQVAADIDVKVWHSNVVMHVPIETAEEARSVAKENDIDVVVCVGGGSTTGLAKAIAMTTALPIIAVPTTYAGSEATNVWGLTEAARKTTGVDNKVLPVTVIYDSALTMSLPVEMSVASGLNGLAHCIDSLWGPKADPINAAMAAEGIRALSAGLPKIVADAQDVDGRDEALYGAYLAAVSFASAGSGLHHKICHVLGGTFNLPHAQTHATVLPYVLAFNAPYAPQAEQRAAAAFGSATALEGLQQLRAQVGAPQRLSDYGFTAAGIPEAVEIILEKVPANNPRTVTEENLTALLTTALNGDDPATLN

SEQ ID NO: 4782 - protein, 295 aa, Corynebacterium glutamicum
MTISAQQQAVEEDLVERVLASFDSCENPRLKLVMKSLTVHLHDFIRDVRLTEEEWNYAIDFLTKVGHITDDKRQEFVLLSDTLGASMQTIAVNNEAYEDATEATVFGPFFVDDAPLVQNGDDIAFGAVGQPAWVEGTVKDTEGNPIPNARIEVWECDEDGLYDVQYADERSAGRAHLYSDENGEYHFWGLTPVPYPIPHDGPVGQMLQAVGRSPVRCAHLHFMVTAPEKRTLVTHIFVEGDPQLEIGDSVFGVKDSLIKKFVEQPAGTATPDGRDVGDQTWARTRFDIVLAPGNV

SEQ ID NO: 4783 - protein, 157 aa, Corynebacterium glutamicum
MTTIMIAIHAIAAILFLGPATVANSQFHVRAYDAHNGNTQAAGSAKTLFKISQSYGMLSLLVPLLGIAIMLLDWSFYKSEGQFHAAIALSVITWALLLFVIFPRQKKMMGALDLLEDDEQAAKTYEIENWDKAKSQLSMFGGIWALLWVIIAVLMFI

SEQ ID NO: 4784 - protein, 180 aa, Corynebacterium glutamicum
MKNFIRVLIAFSVFLCIYTVAPHIGRGPGDLAPVTAIPQRATVLGYDRASMFGGWLGGVREGIVDEAGDTDPYSGNRLDLSSAEVDHILPLSAAWDLGAHRWSAGERISFANDPLNLVLVSKAENQEKSDQLPSEWLPSDRSARCWYVERLFAVANAYELPLPENDIRVGRKQCGFAKPW

SEQ ID NO: 4785 - protein, 1034 aa, Corynebacterium glutamicum
MTSHLLHGLWIKDRGLQLWIEQVEGHRIVLPEAVEKGTFPPVVEQILDGKTFRARMNVHLRTPKGRHVELPTPTAAFTPEEAVTVFSQLSFLKAETPAATRAQRDSIAPDLWWLIVMYQGLARFVQAGRVTLRTVMMDNAWWPQWQLSASLSERGWLAEMNHAAPGILRINGGRDLAGSMSNELPHWIANAILRDYRDETMPYARHEFVEALLFNHSLRKGSTMLTHALNQWKNTITSASLQLVILVEEPPAESDYEDPMDSVWPVRLMVRTGVDAPQAIQKGSIDSGGMEQLRSQYETAKTTSMLLDPAREDAMLGHMVDIAQNGDWDIFLTTEEIVNFISHDVAKLRKAGIPVMLPKAWSTYETRAQVEARTPNDAADSSTKAIIGLDQLVEYNWRISVGDIQLSDEEMRELIDSKTGLIRLRGDWVMADQDALRRITSYMEELSKSSEKRARTEMEKVAMQAKLAEANGEEGWQLLAAKAETLRKEFNEKFSGDGQGEVTLAELREIALKAAENEPVEFTGSQWFNSLLGGTETPAPVRVDIPDTVLADLREYQRRGVDWLYWMSANNLGAVLADDMGLGKTLQLLSLLAVERAENPELERGPTLVVCPTSVVGNWAAEAAKFVPSLKVLMHHGPQRLNDADFLSQSKGMDLIITSYGVITRDFKLMGQVGFERVVLDEAQAIKNSSTRVSKAVRSLPSRHRVALTGTPVENRLSEMRSILDFCNPGVLGSASFFRNHFAKAIEREQDDTMTERLRQLTAPFILRRLKTDPNIIDDLPEKTEQIIRVDMTTEQASLYKALVEDVQKQLDERQGMSRKGLVLATITRIKQICNHPAHFLGDGSEVTLKGKHRSGKVEALMELIDTAVKEERRMLIFTQYAAFGRILAPYLSDRLGTNIPFLHGGVTKPGRDRMVAEFQSEDGPPAMILSLKAGGTGLNLTAASIVVHMDRWWNPAVENQATDRAFRIGQRKNVDVYKMITVGTMEESIQDILDGKTHLASAIVGEGEGWITELNPEELAMLMSYREKEGADD

SEQ ID NO: 4786 - protein, 355 aa, Corynebacterium glutamicum
MALARCVFPSRISWMDSSMVPTVIILYTSTFLRWPMRKARSVAWFSTAGFHHLSMWTTMDAAVRFKPVPPAFKDRIIAGGPSSDWNSATMRSRPGLVTPPCRNGIFVPNRSDRYGAKIRPKAAYWVKISMRRSSFTAVSISSMSASTLPERCLPFSVTSEPSPRKCAGWLQICLMRVMVARTRPLRDIPWRSSSCFCTSSTSALYRDACSVVISTRMICSVFSGRSSMIFGSVLRRRKINGAVSWRRRSVMVSSCSRSMALAKWLRKNDAEPSTPGLQKSKMERISDRRFSTGVPVSATRWREGNERTAFDTRVEEFLIACASSSTTRSKPTWPMSLKSRVITPYEVIIKSMPLD

SEQ ID NO: 4787 - protein, 286 aa, Corynebacterium glutamicum
MQMTESRRVKMDNVIYANFGSKQRVSTPDDRTQVINKSRHKQFSPAGTRTVMLTEKNADSGRRSRGEQYYRNGNVTGMTVLEGRVECTVAGSQNEPFVTTVTFPYRSSEKLREAYAAIADTPNGLRLVRDGHLTSSMLDHLVGSPDESIYFDCTCPDRSLVCKHAVASAYHVAEKMTANPGLILDIRGQGMAGLEALIRTYHTKVETEPEDNDSFWNGRELPALPDPKIAPAIDDSDINYLHKALRMVSYTSLEQLRAVSDIEDMYEILVANHPDNQQVYEEEDTD

SEQ ID NO: 4788 - protein, 391 aa, Corynebacterium glutamicum
MSTVHDEMGVMNTTVKFLHSSDLQIGMTRWFLSDEAQARFDDDRIRAIEKMGKIARKNQCEFIVLAGDVFEHNSLEQRTTGRALEALRSLKLPVYLLPGNHDPLTADSLFYRAKDIDGVTILSDTTVHGVAPGVEIIGAPLLHKMATSDLVAEALKDLEPTSNVRIAVGHGQAEARTTDHRADLIDLNTVEAKLADGTIDYLALGDTHSAQPVGTSGKVWFSGAPETTDFHDLDPDRVGGEVNSGKVLIVSASKGDVSVEEVEVGKWTFHALSKEITSGTDVEDFLDTLQAYPDKSRTVIKYGLRGTITLEQNRRLEEGIAGLEDVFASLKPRERTTDLVLEPGEEELANLDATGYAAEVLRELADSVVNGAAPEEDRDALNLLFRLSREV

SEQ ID NO: 4789 - protein, 876 aa, Corynebacterium glutamicum
MRIHEIIIDNFRAIEHLELRDIPDQGVIVIHGDNEQGKSSILEAIKTVLNSKHRTTSKTIKAIQPVDRDVPISITLEATVGTVRFRIHKRFLKSTAAELQVIEPRPSNHRGLEAEAALAEILESHLDTSLLDALFMKQGEVEAGISAVGIPTLTSALNAQNGNTEDATEDTALMEAVEKEYLKFYTNSGKANTRFLQFSKQVETLRTDLDEANAEVAKLSSHVDRVKRLEIDRDQATAQLPKAEEELAGRKAELEEAQKVKAQATEILAQFSRAEEQLEQATGAQKRRKELRNKLELAQTEVEKAEAGQENLAQEASREAEEFLALSEKFEAARAAETLAVEKVKAARQSVAGIKNRDRKEHLTVMLGELDRIGQRLYELRSVQHSSVRVSQRDIDALQKAITEVDIQRTLVEAQQGSITLSASTPTDIQLGDDTVSATDAGTTVALDRELTVVVGDVTLVINPGKTAAESRTDFESAEAALAELLDQLDVSDLDQLRERFTAQEQRDADIAELVREQQRMSGGTETTVLRAELEGLHVPEDLDPSISVDDAQTQLNEAEESRELAAEAHKHANAALDGLRSRPVDKALTVFNAQLAALQRNLSSAQVELDRAVAETSDDEVDAAVQRCAEALAGVRVQKQEIEQVLAKTNPDMAQRLCDAAEANVRSYKTAVSDATTELVRLEGLIGVAAGAKERLDKVKSALTAAENRFESEQRRAHAARRLYALMVFYRDESRKRYAAPFADKLSRLAASVFGESADFDLDDELKISSRSIGPRTVDLANLSGGAKEQLAILTRFAIAELVAESSAQGAVPVFIDDALGSTDPERLTRISTLFSDAGKDSQVFVLTCVPDRYNYVEVTQKHSIESLKTANALL

SEQ ID NO: 4790 - protein, 102 aa, Corynebacterium glutamicum
MPASLNRVDMRVSRSGSVLPNASSINTGTAPCAEDSATNSAIAKRVRIASCSFAPPERLARSTVRGPMERLEIFSSSSRSKSADSPNTDAASLDSLSAKGAA

SEQ ID NO: 4791 - protein, 106 aa, Corynebacterium glutamicum
MLLGDLYIVVPVWNTGENKHLRVLACITKQSRYAGQSLWVCAPQCIINKHRHSTLRGGFCYQFCDSKAGEDCQLFLCAARKIGKVHCSWSYGTTGDLQLIIKIKVC

SEQ ID NO: 4792 - protein, 258 aa, Corynebacterium glutamicum
MASEATRHLMGEKTSVAYVHDVLIKGVPVRIYNPHPNDGPLPVFIYFHGGGWVLGDLESVDSTVRDIAVASGALCISVDYRRAPEHPFLAALDDCQVVTEAVLNGELASANQHLVAVGGDSAGGNIAAVIAQQLRDQITHQVLVYPVMDVILLVICSIITTGFALLMHPKSKDKTETISDEFLAEIQAGSEKISILRSTPAEKANASRWIMYFVGGIGLLYSVFSLWTGGVTGLTLNSFNFLFLSLGMVLTANYGPEY

SEQ ID NO: 4793 - protein, 126 aa, Corynebacterium glutamicum
MISFTGLGVVISGFFTSISTATTWPVIAFLYSGLLNIAVPSGGSKFIIEAPYIIPTPVDLGADMGLVLQAYQMSDGATNLLIPFFALPYLANFKIKFSQVVGYTVPPVLVVIAVICIYLFLRASII

SEQ ID NO: 4794 - protein, 262 aa, Corynebacterium glutamicum
MPRLFVCGRLSSLDCGAVDLDLDLLRNQNATGGEWSLEIYAEVLAVDFGGGFEAKAGVAEWILSNATNLNVQGDGLGGVTNCEVAGNGAFVFVLDNKGSSFESHFRELVYCEEVVALNVCIAVCVAGGNGSGLDNNLCRGVLWVFSIYDNGVGVLGEFTANLGNHCVASHELDFGVCRVEGPGASQLAHCEVLFGESVFRFLTVPTLLHLCSLCRCRCSCSILAKIDDVSTIFLKNLMWKLKPAGGGVNKIVCWAGEWAAVY

SEQ ID NO: 4795 - protein, 179 aa, Corynebacterium glutamicum
MSKLTGTWTLDPAHTEIKFVARHAMVTKVRGEFTEYTDSIVVDAENPENSSAKVVIKTASVTTGNADRDAHVKGDDFFAVDKFPEMTFEATSFVIKNENEGTVTGDLTIRDTTKSVTLDVEVGGVAEDPFGNTRLGFEASTEINRKDFGVDFQAPLSTGGVLVSEKIKIEIDGSAIKAA

SEQ ID NO: 4796 - protein, 162 aa, Corynebacterium glutamicum
MTTPRWLSTEEQQLWRMILSATRKMERTLDETLVENHNLTTSEFAVLVTLSEATGQQMRLRDMCQELDWDRSRTSHQVTRMDKKGLVAKVKCAGDARGVNVEITPEGERRLKDAVPAHVETVRQLVFDPMEERHMEGLRSYLTAVLNSNTCIEINNQRAAEL

SEQ ID NO: 4797 - protein, 74 aa, Corynebacterium glutamicum
MIPMTFPAQSRRLARSTTDKWIGGVAGGLAETYGWNPAYVRLAFVASVLFPLPGSQILFYALAWLIIPSRENRF

SEQ ID NO: 4798 - protein, 173 aa, Corynebacterium glutamicum
MDSSRYRLKVLCVSSHRLPLVVANIYRLLRKMNMKTHPASAKQTTELRLLTATVYFKALNEVHNVMQMIDPLTPVVPITTGTSVAELYADAREHLDNGATQVMIPVISPSNLTLSVVALGNEEVDALGHSEGQAVHSLLEIHTPKRSWPLSELYIDDNEGLAQVSRCFARLVG

SEQ ID NO: 4799 - protein, 250 aa, Corynebacterium glutamicum
MSTDSQNPVRKSCAQPHSCSQEVRLKAMSRSPLTKGLNQLEHLELDKSLTAWSWAEDDPLYLAGENLNGSYLIVAGRVRVSRDTIDGKELTVDIATPGDVIGAIDTEPQPAVDSAWAIETTCALFLPATALATVIEQHPSFALAMIRMQQQRLATARDHEINLTTTTVEQRVAIAVRTLGRKIGQRRPDGILLIQVRIRREDVAGLAGTTVESTSRVLARLRKEGVIDSGREWIAVVDERQLDAIIGEDF

SEQ ID NO: 4800 - protein, 78 aa, Corynebacterium glutamicum
MTAPNTLKQTTLRSDEFSCPSCVSKIENKLNGLDGVDNAEVKFSSGRILVDHDPSKVSIKDLVAAVAEVGYTAKPSAI

SEQ ID NO: 4801 - protein, 625 aa, Corynebacterium glutamicum
MKTWKTWGVVGASGLLIILSWLSSSSPMLADAFMIAAAIVAGWPIAQSAYQALRIRMVSIDLLVVVAAVGAMFINNYWESAAVTFLFALGKALERATMNRTRKALSDLVDAAPETATRLNADDSTEVVELWELEPGDIVLVRNGEQIPVDGNVIAGVGGIDESNITGESMPAEKGQGSDVYAGTWLRSGVLRVEATGIGSDSTLAKIIHRVEDAQDDKARTQTFLEKFSKWYTPGVMIAAAVVGLITWDVELALTLLVIGCPGALVISIPVSIVAGIGRAARDGVLIKGGEYLETAAKVDVVVVDKTGTLTTGRPELTDVEVIEPAYSQGEVLELAARAETASEHPLADAIIRGAQDRGLSTTLVEAAENITGRGIIANVDGQAVAVGSAELLDHEPDSTRILELNAEGKTAMFVGVNGHAIGIVAVADAVRSDSASAIESLHKAGIQVVMATGDAHRVAQNVASKLGVDEVYSELLPEQKLELVRDLQAAGKTVAMVGDGVNDTPALAAADIGVAMGVAGSPAAIETADIALMADRLPRLAHAVTLAKRTVRTMRINILIALATVMVLLAGVLFGGVTMSVGMLVHEASVLLVISIAMLLLRPTLKEDAAQASDIKRSEIQQIA

SEQ ID NO: 4802 - protein, 210 aa, Corynebacterium glutamicum
MSENLPAPENLLDAERIQMIKNFRNELTGFMLNYQFGIDEILTKINILKTEFSQLHEYAPIEHVSSRLKTPESIVKKVIRKGDELSLAAIKDTVFDIAGIRIVCSFLKDAYAIADMLTNQKDVTVIEAKDYIANPKPNGYKSLHLILQVPVFLSNSVEKVNVEVQIRTIAMDFWASLEHKIYYKFEQEVPQSILDELSEDGKNPRGSEVT

SEQ ID NO: 4803 - protein, 527 aa, Corynebacterium glutamicum
MPRSTIKRVVAVLAASTALSPFLVSMPTAAAQENIRWEECPPQVDIASAQCGSIDVPMHYSDPSLGDISVGFVKVPAQGEKHGTIFGNSGGPGGDAYSFFGSQSMNWPEAMYQNYDLVAVQPRGMVGSTPVNCDNIAPGYDFLSLLTREGAFVKESCEIGTPGYTSSLTTDNTANDWERVRQALGDDKISIFGLSYGTYLGSVYATRYPQHTDKVVLDSAMAPSLAWNGIMASQEQGYKNSLNDFFTWVAENNDTYGLGTTPLAVYQNWSNKIVAETGTNPTVAPPPAQVGDVPPAFAWAGQAGADMMTATNPTSVQLQGLATQLLNPGSNQSLSPLLNVTRAYIPQPSTWPMLAGAISGQTPIPDVTDTGDDPYVIESINASVNMQRMVMCNENTVAPDPVAMARMAWTSMVTGDVFDIYSVKFSSGQACSGITPTSGRQPTDGSQLAVQPLLLQGTSDPQTPYWTHNELADAMNAHVVTVNGPGHGQSIGGTNQAINDIVVDYLRTGHTDATWVEGNTPTPITAG

SEQ ID NO: 4804 - protein, 201 aa, Corynebacterium glutamicum
MNHSDDDRMQKWFQIRRELGKEIVKQLQKDLPAVASDIGSMVYSSDQVPLGNATLTAYGDIGNRVASAATSARYNVEELLDAIENARFAIWVPNYDNSYYLSGEEGADEFQTYLIKDASRFLESSGNTPPENPQYSDSKLTFASELLPFYTAFNNSTYPLLHACVQGEPTEVDLYFYELEQAELKEKETAQLSSGSSFGSS

SEQ ID NO: 4805 - protein, 40 aa, Corynebacterium glutamicum
MELRSIIVGAGLTAIALSSMLSQPVQAFTMTIEMVSVFFT

SEQ ID NO: 4806 - protein, 36 aa, Corynebacterium glutamicum
MWKIAWGFWLNWLACSLSKESPCVQSDRKSAMMMHV

SEQ ID NO: 4807 - protein, 420 aa, Corynebacterium glutamicum
MSTMTQCTTPTSAPKHFPSEPSGHTSWALTTPKPKNSTKPSPRSLTASAKWALTPPKPKKQTPSLYTAAHLWSTTNAHQPSSAPSTPDSSKKASVKTTASSWNSNHSTRRAPVRFTCSANNCCTNKAPFLIRRGPSLLGLRLVNFNLDWSRNLKLKHLNARLTSIFQNLVWNWLSGQHHGGWAGTGKVCRVATVAQAVYPLRGNRQHFCTIRLVQTVTSTLPQQIRTLLQRNDHHCNAGHVKSRIDVSDFSGKDSAHSFGGCVEIRNQRSRTNIVLHLKWYSSILWLALAVDRQICPRHHCSTQHRSRSIIWVAFKGRGQLNNLLLSQREIRQTISCSNTSNRRCSRGAKTTRLRNVVVAHHSQSRNFSVSCLQASTNSFNHQVGAIKRDFALAFAKNFHFQARWNNFHFDSVVYRQCQT

SEQ ID NO: 4808 - protein, 230 aa, Corynebacterium glutamicum
MTTQTAPTAASDLFAESYKLSPKQREVLDALQTFPDGARAIDVAKKLDLHVNTARGHLEELVAKEAIRVVTAAAKGRGRPSLIFQTRVPDNRAVAKEYITLIELMANMLGDVDDDAMHNPDLRAKALSIGTQWAHVMGINHAEAEELDEALSPLINRLREMGFDPTETEEANSLALHSCPFVVNDKRPSAFVCAIHAGFIQESLGENNRIQLELKPLNAPGTCKVHVFSE

SEQ ID NO: 4809 - protein, 259 aa, Corynebacterium glutamicum
MSNFETFLWVAYPWLCIAAYIIGISWRWRADQFGWTTHSSQIYESKLLRIASPLFHWGMVFVVIGHLMGLAIPKSWTQAVGISDAAYHLIATIPGTIAGIAAVLGLIGLIIRRVINKTVFLSTSRSDKVMYVLLGAAILSGFIATVSTQVFGGAHGYDYRETISPWLRQLLIFNAQPELMADVPWEFKVHIVAGFTLIALWPFTRLVHAFSAPVGYVTRPYVVYRTRDTTSEPARQNVAWEPIRSVKNQLDNDSKWHGA

SEQ ID NO: 4810 - protein, 244 aa, Corynebacterium glutamicum
MANAPLRCSHQGRTRRMRTHTGKIPDHFVPRISMTEEQRRVVFMLNSLLLDYPEEGFVDKLNAVEAQLDVLPLPVAAHVVEFLDAARVAGLRAMQEAYVETFDQRRRCSLFLTYYAVGDTRQRGTAILTFRQTLQQLGFESERDELPDHLCVVLEAAALADSSLFDAATQVLSAHRDGIEVLRAALDNLDSPYRYLIMSLCQALPEIDEETANSYMELIRSGPPAEMVGIGTPLPFPTSQPDIH

SEQ ID NO: 4811 - protein, 531 aa, Corynebacterium glutamicum
MKVMAQIAMIMNLDKCIGCHTCSVTCKQAWTNRQGTEYIWFNNVETRPGVGYPRGWEDQDKWEGGWVRTNSGKLKPKAGGRLKKLATIFHNPKLPTIDDYYEPWTYEYDKLLSAPAGQKTQPTARPVSQLDGRPIDKIEWSSNWDDNLGGSTTTLDQDPVLEKMNLTVQKEIEDSFMFYLPRICEHCLNPTCVSSCPSGAMYKRAEDGIVLVDQDQCRGWRMCVSGCPYKKVYFNHKSGKAEKCTLCYPRLEVGQPTVCSETCVGRLRYLGVLLYDADRVAEVAATPDEKDLFEAQKTLFLDPHDPQVIADAQRNGIPHSWLEAAQNSPIYDLIFKYEVALPLHPEYRTLPMVWYIPPLSPIVDEVTASGNDGEDHKILLTALSTMRIPLEYLAGLFTAGDTRPVEKSLRRLAAMRSYMRDISLGREPQEEIAEAVGMTGKVVQEMYRILAIAKYDDRYVIPTASPETPRGISSLDPFGDVDPARATEQLNIGLGEGAPEACGTGAPSGKVSLTSWNVGERPAAMFPPRKD

SEQ ID NO: 4812 - protein, 198 aa, Corynebacterium glutamicum
MILAIVLPGISPTSSISGTIPPGILSSSGESWAIGAVITSVWVPNQVAACEENSLVRSWKTSQSVRVSHGGLIAALNEWMKGCISVVDKSCFSYQVAAGSTISETKVVEVLRKSVVSIKSSFPSGASSLHTMELGRSSGAFSSADASESTPNIWRKKNSVPLAEEPIRFVRQLSRMRGQFSGASGSSQANCKSPSVSC

SEQ ID NO: 4813 - protein, 91 aa, Corynebacterium glutamicum
MEFLQDHMAHGKGECAVSTRVDACPFISKFGGVSEIRGNHNNLGALVAGFHHEVGVRRAGHRNVGTPHHEVAGVVPVARFRNVSLIAESLW

SEQ ID NO: 4814 - protein, 1248 aa, Corynebacterium glutamicum
MTTTTSSGKSSEKINPLFKLGSFLRKGTVGSEGQQIFLQGGRQADVFYRNRWAFDKVVRSTHGVNCTGSCSWKVYVKDGVITWESQAVDYPTTGADMPDYEPRGCPRGASFSWYTYSPTRIRYPYIRGVLVDMYREAKERLGDPVLAWRDIVETPEKRKAYVSQRGKGGLIRVQYEEAMEIAAAAHVYTIRQYGPDRIHGFTVIPAMSQVSYGAGTRFLQMIGGVALSFYDWYADLPPASPQTFGDQTDVPESGDWYNSSYLMMWGSNIPVTRTPDSHFMVEARYKGTKVVVVSPDFADSTKFADEWARIHPGTDGALAFAMGHVILKEFHVDKKTPYFMDYMRKYTDSPFLVELDEHGDGTYTPGKFLTADRAADISPALAATPNATHRLLVLQKDGSVVDPGGTVADRWGEEGMGKWNLRLDGVDPVMTIADVQTDTETAEVLFPRFDLPATATQEGPIGAGTISRGVPTITLNGRKYTTVFDVLLAHYGVNREELNLPGEWPKDFQDPVMGTPAWQEELTGVPANQAIRLGREFAQNADDSKGRSQIIMGAGVNHYFHADSIYRTFLALTSMCGTQGVNGGGWAHYVGQEKLRPMNGWAQYAFATDWQRPPRQMITTGFYYLTTDQWRYDNTRANRLASPLANRGTVGDKMTADTLVESMKRGWMPSFPQFNRNPLILSQEAEEKGVSVSDHIVQQLTDGDLQFACEDPDAPENWPRILLNWRTNLMGSSAKGTEFFLRHMLGVDSDASAEENAPEDRPSSIVWRDEAPEGKLDLMLTTDFRNTSTTLVSDIVLPAATWYEKHDLSTTDMHPFIHSFNAAINPPWETRTDWEVFHDLTKEFSSQAATWLGTQTDVITAPIAHDSPDELNMPGGIVPDIDEVGLIPGKTMAKIIPVERDYSKVYEKWTHLGPLTAKAGTGTHGTAFNVTKQTEELALINGTSITESAGERPRLDSAVKAIEMILHLSGVSNGEVAAEGFKNQGARVGTDMMDLIADHEGTHINWDMVKERPAEVITSPEWTGSKKDGRRYTAFSINIEYDKPWHTLSGRMHYYLDHDWFIDYGEQLPIFRPPLDKIHINGEVGPGQSVTGTDGEPEVTVRYLTTHNKWSIHSQYYDNLHVLSISRGGQVIWMSNKDAEKLGIADNDWIEAYNRNGVVSARAIVSHRIPEGTVFMNHAQERTAGTPLNEKSGRRGGTHNSLTRIMIKPVHVAGGYGHLTYGFNYIGPTGNNRDEVTRIRRRSQEVQY

SEQ ID NO: 4815 - protein, 450 aa, Corynebacterium glutamicum
MKRHHVTQLNTKGVVLQGWDPEDPEHWDSKIAWRTLWITTFSMIIGFCVWYLVSAIAPLLNRIGFDLSAGQLYWLASIPGLAGGLIRLIYMFLPPILGTRKLVGISSGLFLIPMFGWFLAVQDSSTPYWWLLTLAALTGIGGGVFSGYMPSTGYFFPKAKSGTALGIQAGIGNLGVSIIQFMGPWVMGFGLLGIGFLTPQRTIEGTTVFVHNAAIVLVPWTILAAVLSFLFLKDVPVTANFRQQIDIFGNKNTWILSIIYLMTFGAFAGFAAQFGLIINNNFGIASPMAETYPAEMLHAGATFAFLGPLIGALVRAAWGPLCDRFGGAIWTFVGGIGMTIATAAAAIFLSRAETPDDFWPFLWSMLALFFFTGLGNAGTFKQMPMILPKRQAGGVIGWTGAIGAFGPFIVGVLLSFTPTVAFFWGCVVFFIIATALTWIYYARPNAPFPG

SEQ ID NO: 4816 - protein, 163 aa, Corynebacterium glutamicum
MMPAQNKNLPGSVIVVSDRIKSGERIDKAGPVAVDLLQESGVEISTFTVVEEGFEPVHQELVKALARRDRVIITIGGTGVGPRNRTPEATEPHIDTLLPGLMTQILFSGLSNTAQAGLSRGLVGLSARDSTAALIVNAPSSSGGVRDALGVVCPLFGSIFERL

SEQ ID NO: 4817 - protein, 622 aa, Corynebacterium glutamicum
MRPSSRPLGLVLCTALASTIITVPAASAQEPALLDASAIAPHTASYGYYVDAWDTNVSTDLNPSSNAAVGVLEEMLELWTPGEEWNTGVKVDPTVLDSNIAQSVAISQQATDAQQERAWVIDRRNQNYTATDGLGAYADSYRETAQVGTTIPDVVPADATTVKYNDGGNVNGNWAETGGELGSTVDLIEAIRQHAATSNNAKAYYQYPRPYRWTESIEPEAWGEGVDMPEYANPLRKDESEAASDGGFPSGHTSAGGMATNGLAYAFPQQYDKLLMTAAEIGESRIQLGMHSPLDVIGGRVLSTAITAGALNDPNLDSVKAEAFDDAQAWISNQSDITTNTRDFDEQLAEYTNFLTFGFEQSGDTTQDMRVPKGAEALLETRLPYLDDEQRRWVLHSTGLESGFPVLDDAEGWGRLNLYAAQAGYSAFDTNVDVTMNAIDGGYNAKDNWQNDIEGAGSLTKNGSGELTLSGDNSYTGGTTITAGTLVAATESALGAGDLTINDGATLKITQPVTVDGTANLGGTLHVALPVGTNHVTVIDAASISGEFDEVIVDGAVDAQVSYDNGSVVITTGAPSDDVKETGSSAGGILAIVAALGGIAALIFGAFTQFGFPPAIKEMFDL

SEQ ID NO: 4818 - protein, 228 aa, Corynebacterium glutamicum
MNDVWEKVGGGVDKHTQAATALSCGLHLSNRGAGAVRKWRCGQGLTDRDFIQLDNSADLGGGLLIQSASFSGMLNEGMEGIGVIATSCSSINGSFTNFADQIVRHFVDPLQQWTKQVNEAPCGNRDSSKCRLRMRDCPGFRSHFADDQVQKRYDKQRQNKRNDICHNQRYTRPFEERHQSIMNPRLRDSTQRESHHGDSQLRAREHESKFIEASQRSAGRPRGFHSLL

SEQ ID NO: 4819 - protein, 336 aa, Corynebacterium glutamicum
MTEWYVVLPATILLIALSAFFVIIEFALLAARRNRLEETVETSRSSRAALRSLNELTLMLAGAQLGITMVTFALGAITKPWVHYALMPLFEWARIPLVMADVIAFILSLFIVTFLHLVIGEMAPKSWAIAHPETALRTIAIPARGFINLFRPLLQWINKMANDLVRKVGETPVDRAAAGGYDTDTLHALIEHSRETGALDQQSAAQISGIIKLDKITVGQTLTASPFTHSASATVAEVQAAAQRSGSLRVLIDAPSHLFPHVIHVRDTLGASPDEKASKWSRPILTVAETDTLHQALEYMREHNEQISAVLSADGKTVLGVITWDHILKYLWPASV

SEQ ID NO: 4820 - protein, 467 aa, Corynebacterium glutamicum
MLTAVLSLIAGLVVIGVIIVLNGYFVAQEFAYMSVDRNELRALADSGDKKARRALSITKRTSFMLSGAQLGITVTGLLVGFVAEPLVGNALGVLLGGVGVPAAVSISVGTVLALAISTVVQMIFGELFPKNYTLATPLKSALALAPSTTWYLKLAGWLITFFDFASNALLRLFRIEPVEDVDSSATAQDLPHIVASSRDSGVLNNSMSLSLDRLLDFPSHDVGHAMIPRSRVGVVDPETTIAEVKALMRKAHTRYPIIDDNHVPIGVINLIDILGTDIHGAEISDSAKVTEFMHQPVIVPEFMSLPDVVTELHNREDRLACVIDEYGGFIGIVTLEDLAEEVLGDINDEHDVFSSEDITETSPDKWLIDGDTPLDEVERAIGYELPEGDYETISGLLFDHANALLKTGDVIEIPLDFEPEDYLNNTSPTQRILRITVLEVERNVPVKLALALLEDHPDNHPAPKENR

SEQ ID NO: 4821 - protein, 187 aa, Corynebacterium glutamicum
MNIIILAGGEGKRMGGVDKAAVAVDGRTLLDILLSQLDPEDDVVVVSPAIIDGITTVCEEPPLGGPVAGIEAGLNSFEHAHEFTAILAVDAPYSAAMLPLLQAQIGKADVAVTLAADGWVQPLCALWRSGSLEAVIHSLGETRNRPAKALLKQAGHIVEVGGDGTEKDYDTVAELEVLGNVTLPKAH

SEQ ID NO: 4822 - protein, 403 aa, Corynebacterium glutamicum
MAQQRSVDDYLSILIDSVAPLPPVKTPILGAHPLSHLAEDVVATIPIPKFTNSAVDGYAILKEDIHGSGPWTFLVGGDTPAGSAPASINNGKAIRVMTGGPVPSTNKDMIVVPVELTNAPVDHSLPTEITINELPGERNNIRHAGEHLKEGEIAVAAGTAFDAGTVSTVISVGHDTVKAHPCPRVAVITTGDELNQGNPWGIPNSNGPMLVAELKRVGIKDPQHFHSDDSETALRETLDKAAEVADVIITVGGISAGAFDVVKAVGTKTGGFEFFPIAMKPGKPQGHGQWGDAKVVCLPGNPVAAWVSFRLFVVPVIERLGGGKRLASISELPVVALRSNRALKAREGAVLAIPVAIDWEKRMANSQAHRSHMVGALAGSGGIALVTSSIAEDGLVDVVLGRM

SEQ ID NO: 4823 - protein, 377 aa, Corynebacterium glutamicum
MTTRLYLSPTPPRNDREGASKSTSASIKHDAYLPPADGNRVLVDRFGRIARDLRVSLTDRCNLRCTYCMPAEGLEWLPTEQTLNDAEVLRLIRIAVVKLGIRQIRFTGGEPLLRKNLEDIIAGTAALRTDEGEKVHIALTTNGLGLDKRIAGLKEAGLDRVNISLDTIDAERYVSLTRRDRLSGVLASIDAAVAAGLHPVKINAVVMPGVNEVDIVPLAEYCISKGSQLRFIEQMPLGPREQWKRGDMVTAEEILARLEEKFTLSPAKEPRGAAPAALWNVVDKSNPDITGQIGIIASVTHPFCGDCDRSRLTTDGTIRNCLFSRTETPLRDALRDGASDDELAQLWAGAMWEKKPGHGIDDEGFLQPDRPMSAIGG

SEQ ID NO: 4824 - protein, 575 aa, Corynebacterium glutamicum
MLSTMQDVPLSLTRILEYGSTVHGDTLITTWGGADGIEQAQQTFSAVGARAAALAHALHDSLGITGDQRVASMLYNCAEHMETMFAVACMGAVFNPLNKQLMNDQIVFILNHSEAEVVIADPRMAEQLGEILKETPKVRAVVFIGPNDFSSAAAHMPEGMKLYSYEALLDGRSTVYNWPEQDERTAAAICYSTGTSGPPKGVVYSHRSLYLQSLSLRTTDSLAVEHGETFLCCVPIYHVLSWGVPIAAFMSGTPLVLPGPDLSAPTLAKIISTTLPRVAHGVPTLWIQLMVHYLKNPPERMSLRELYVGGSAVPPIVITMWEQRYGVDVVHVWGMTETSTVGTVSRPPSGVSGESRWNYRVSQGRFPASLQYRIVNDGQVMASTDRNEGEIQVRGPWVTASYFHPDVEKEGGTASTFRDHDVEEENDELFTADGWLRTGDVGSVTSDGFLTIQDRARDVIRSGGEWIYSAQLENLIVATEEVVECAVIGFPDDKWVERPLAVTMLYPGIERTRETAERLRDQLRDRLPNWMLPEYWTFVDEVDKTSVGKYDKKDLRNHLRNGDFEVIKLKGPGEK

SEQ ID NO: 4825 - protein, 762 aa, Corynebacterium glutamicum
MTTTDNTAANQGELTALRLPDLRKIAADLGLKGTSALRKGDLINAISAAREGKPTAAAKKTSPRKAPSRTRATQPSAPVEQAQEAPAQTSTAPASAPSEETPAAPARRGRRRVTTTATTPEPAAPAQSQPAEAQPAQTQAAQQEELPVAAKESAPATENTQGQAQGQAQGQAQGDEHDDRFESRSAARRARRNRQRQIHRDGDDNANANTESEQNTPAQNATAQAESEQTAAPAQAEAAEQNQNDNSESSENRSDNYRNNNRRSRNNRNNRNYRDNNESSDNAGQSSNDDADNNQARSEDNNDDRRSRNNRNNDRNDRNDRNDRDNDDNDDRRNRRGRRNRRGRNDRNDRDNRDNRDNRDNSNDGDNNQQDELQQVAGILDIVDHNVAFVRTTGYHAAPSDVFVSNQLIRRMGLRSGDAIEGQVRMNQGGGNHNNHGRNRQKYNNLVRVEMVNGLPAEETRNRPEFGKLTPLYPNQRLRLETEQKILTTRVIDLIMPIGKGQRALIVSPPKAGKTTILQNIANAISTNNPECYLMVVLVDERPEEVTDMQRSVNGEVISSTFDRPPSEHTAVAELAIERAKRLVEQGQDVVVLLDSITRLGRAYNNSSPASGRILSGGVDSNALYPPKRFLGAARNIENGGSLTIIATAMVETGSAGDTVIFEEFKGTGNAELKLDRKISERRVFPAVDVNPSGTRKDELLLNPDEARIMHKLRRILSALDNQQAIDLLIKQLKKTKSNAEFLMQVASSAPMAGTEKEEDYS

SEQ ID NO: 4826 - protein, 201 aa, Corynebacterium glutamicum
MSTMIVLSPVLLHAEHAATVSARSTAMAMTMRMQTQSLSRTPLPRTQPHRLSLSRLQLLHRLKQLSRTRTITASPPRTAAITTATTIVVPATTGTIAITAITTSPLIMQDSPAMMMPTTIRHGLRTITTIAVLVITVTTTAMIVTIAMTATTTTTMIAATVADAAIAVDATTVTIATTEITGITATTATMATTTSKMSCSR

SEQ ID NO: 4827 - protein, 232 aa, Corynebacterium glutamicum
MRRYGPRCPGCLLPAAAHLAGCCRHRCCCRGYPGYLGCRDRYGRCVHGDCGVRDGCGDHRCRRCRGHCDRYDHCGRCYGYYENGDRRYCPQTVPDCCRHHHCWTVLHYQRTRCYRGNCDCSGCCGNDDCCCGSYRCGSRRTRCYRSGSAQLLQPVQELQSAQTQPVRLRSGQGCSAQTLCLHSHCHRHRGGSGADGCGVLGVQQNGTQNDHRAHRPELGPELGPELGPECFL

SEQ ID NO: 4828 - protein, 341 aa, Corynebacterium glutamicum
MVVVVATTLVHTNLTFNGVTGTKTHTADQLVADKHVRRCSVVTGGAHECDVMVHDVQDACYLLQLILLVVVAIVAVVAVIPVISVVAIVTVVASTAIAASATVAAIIVVVVVAVIAIVTIIAVVVTVITRTAIVVIVLRPCLIVVGIIIAGLSCIIRGLVVIAVIAIVPVVAGTTIVVAVVIAAVLGGLAVIVLVLLSCFSLCRSCSLLRLSLCGCVLGRGVLLRLCVCIRIVIAIAVDLALTVAACSACSRTGLKTIIVLIALSLALSLALSLALSVFCSWCGLLRCNRKFFLLCSLSLCWLSFCRLGLCRRCWLWGGRGGGYTATSTTSGSCGSLFRWC

SEQ ID NO: 4829 - protein, 358 aa, Corynebacterium glutamicum
MASQVSAVDDILSEYHGLEQQMADPELHNDAAAARRVGKRYSELQPIINVHRDLVSAQEDLEAAREMAHEDHEFQAEAERLEVEVVELEEKLADLLAPRDPHDGEDIVMEIKAGAGGEEAALFAGDLLRMYQKFADKHGFVVEVLDSAESDLGGVKDITLSIRSRQPSRDGAWSQFKFEGGVHRVQRVPVTESQGRIQTSAAGVLVYPEPDEVENVEIDEKDIRVDVYRSSGKGGQGVNTTDSAVRITHLPTGLVVTCQKERSQIQNRARAMQVLAARLQAMKEEEAAAEAATGRAAQIRTMDRSERIRTYNWPENRISDHRIGFKANNLDSVLDGELDDLFTALQAAERAERLEAEG

SEQ ID NO: 4830 - protein, 279 aa, Corynebacterium glutamicum
MLTLGEALRDATATLERAGVASPLVDARLIAAHLLGCGPLDIALRMRDEVPAGFAAAVERRARREPLQHILGTAPMGPLDLHVGPGVFIPRPETEVLADWAVRQVAGDVEKRKIVDLCTGSGALAAYIGHALIDATLYAVELDPGAATWAQRNFDEFAPQVKLIHGDVTDPTLLAEVHGTIDLVVSNPPYVPESDDLDPEVYQDPHMAVFSGADGMDVINKMVHLIFNLLKSGGAVGIEHDDTTSDAVRQVFSQHGGFGTIEVLHDLTGRARFVTARKL

SEQ ID NO: 4831 - protein, 258 aa, Corynebacterium glutamicum
MHLSQQCRICYITVDELHLRGKFIKVSLRPGRCPRIEFDSVEGRVDKRMPDVGRKRAGSGAQVNDFSLFDVASHLPHGPVREHLGFRARNEHARSHMQIQRAHGCRAQDVLQRFASRTTLNRRRKPSRHLITHAQCNIERTATQQMSRNQTSVHKWRRHPRPFQGGGGVAQSFPKGQHLALGLKTFCTLSSLQRGEQIIQFTIENRIKVVRLKTNTVIADAVFRPVVGTDALRAVHGANLRSTSRSSLSRRFLFLHRL

SEQ ID NO: 4832 - protein, 216 aa, Corynebacterium glutamicum
MSRIYDCADQDSRAAGLKAAVDAVKAGQLVVLPTDTLYGLGCDAFNNEAVANLLATKHRGPDMPVPVLVGSWDTIQGLVHSYSAQAKALVEAFWPGGLSIIVPQAPSLPWNLGDTRGTVMLRMPLHPVAIELLRQTGPMAVSSANISGHTPPTTVLEARQQLNQNVAVYLDGGECALATPSTIVDISGPAPKILREGAISAERVGEVLGVSAESLR

SEQ ID NO: 4833 - protein, 382 aa, Corynebacterium glutamicum
MGVGFAGIPLRELGLVILVAAAITYLSTGIIRTVMVKSGRLNEIRERDVHVIPKPRLGGVAMFSGFLGAVFLADQLPALTRGFMPITPEMNAVIWAGFVIVVVGALDDLFDLDAITKLVGQVIGAVTMSLLGLTWSILYVPFGGGTTLLLDQVQSTILTSLFTVALINALNFVDGLDGLSAGVGMIAGAAILLFSLTILFDQNGAVSAYPPAIIAAALVGICAGVLPHNFEPSRIFMGDSGSMLIGLLLAAASTSASGKINMSLYGAADFIALISPIIVVLAAVAIPLLDLVMAVVRRVGRGASPFSPDKMHLHHRLLSIGHTHRRVVLVLYTWASAVAFGAVSFSVVPPLFATGSSICGILIAVAVTAVPVMKSRRAAKLD

SEQ ID NO: 4834 - protein, 162 aa, Corynebacterium glutamicum
MSYWANKPVGFPFVSAENTENTDSPFEISEFDDHRRPLQRALKFGSIALIVFTLISLAIWGATRGVPGVWGVVIGAAVGGGFVLLTALSVLFTANSNVTTTGAVVLGGWLLKIVILIIVLAVIKDMTFYDNTALFVTVVIALVVVLLTEVWGVVTSRVTYVG

SEQ ID NO: 4835 - protein, 83 aa, Corynebacterium glutamicum
MGGVSVLGNWRGTFRDNPPNCWQISDEISPRSPHELPPFTLKISPVTHITPPNRTRSHAIFEVWFAFGNECPRPTWIKDEFTC

SEQ ID NO: 4836 - protein, 270 aa, Corynebacterium glutamicum
MKGEFHAPDLDKEFFPGHVTDSGEVVNMLFTDFANGWFAMDRIVLIRLLMTAVVVVFFLWAMRKPKLVPHGVQNFAEYALDFVRIHIAEDILGKKEGRRFLPILATIFFAALLMNLATIIPGLNISSNSRIAFPIVMAVAGYIAFIYAGSKRYGFFKYVKSSVVIPNIPPALHVLVVPIEFFSTFILRPVTLALRLMANFLAGHIILVLLFSATNFFFFQFNGWTAMSGVTILMAVLFTVYEIIVIFLQAYIFALLVAVYIELSLHADSH

SEQ ID NO: 4837 - protein, 80 aa, Corynebacterium glutamicum
MNEIILAQDATESTITGLGAVGYGIATIGPGLGIGILVGKALEGMARQPEMAGQLRTTMFLGIAFVEALALIGLVAGFLF

SEQ ID NO: 4838 - protein, 188 aa, Corynebacterium glutamicum
MANSIYNLAQADALPLESGNSILFPPLYDIVWSLIPFLIILIVFWKLVLPKFQEVLTEREDRIKGGIQRAEAAQAEAKAALEKYNAQLAEARTEAAEIREQARERGKQIEAELKDKANEESNRIIESGSKQLLAQREQVVNELRREMGQNSINLAEHLLGDQLSDNVKRSGTIDRFLADLDTVAPNGK

SEQ ID NO: 4839 - protein, 271 aa, Corynebacterium glutamicum
MHAASREALAKVSSDLDAALAADNTMAVAAQAGTELFDVVDILDGDRALRVAVADSSKDAHSRVGLIEAVFGGKVSPSVLEVLKDAAEQTWSTPREFRAGLVQLGRRALLRSAEKQGQLGQVEDELFRLSRILDRESKLTQLLSDRTQEIGGRRDLLAKVLYGKVTAVTEALALQAIGRPEHNPIDDIAALAGAVAELQGRSVAHVVTAVELNEGQQQALAEKLGRIYGRAMSIHSEVDTSLLGGMIIRVGDEVIDGSTSGKLERLRASFA

SEQ ID NO: 4840 - protein, 558 aa, Corynebacterium glutamicum
MLEETTESRKNMAELTISSDEIRSAIANYTSSYSAEASREEVGVVISAADGIAQVSGLPSVMANELLEFPGGVIGVAQNLEADRVGVVVLGNYELLKEGDQVRRTGDVLSIPVGEAFLGRVINPLGQPIDGLGEIASEEDRVLELQAPTVLERQPVEEPLATGIKAIDAMTPIGRGQRQLIIGDRKTGKTAVCVDTILNQKANWETGDKTKQVRCIYVAIGQKGSTIAALRKTLEEQGALEYTTIVAAPASDAAGFKWLAPFAGAALAQHWMYQGNHVLVIYDDLTKQAEAYRAISLLLRRPPGREAYPGDVFYLHSRLLERAAKLSDELGAGSITALPIIETKANDVSAFIPTNVISITDGQVFLESDLFNRGVRPAINVGVSVSRVGGAAQTKGMKKVAGSLRLDLAAFRDLEAFATFASDLDAASKSQLERGQRLVQLLIQSENAPQAVEYQIISLWLAGEGAFDNVPVEDVRRFESELHEYLGSNAAQVYEQIAGGAQLSDESKETLLKATEDFKSAFQTTDGTPVINEPEVEALDAGQVKKDQLTVSRKVSKK

SEQ ID NO: 4841 - protein, 325 aa, Corynebacterium glutamicum
MATIRELRDRIRSVNSTKKITKAQELIATSRITKAQGRVAAAAPYAEEIQRVLERLASASSLDHPMLREREGGKRAAVLVVTSDRGMAGGYNHNVLKKAAELEKLLAESGYEVVRYVTGKKGVDYYKFRAEDVAGTWTGFSQDPDWAATHNVRRHLIDGFTASSEGEAAWREGLNLPEGQDIQGFDQVHVVYTEFISMLTQNPVVHQLLPVEPVIEDEIFEKGEDLLSSSGEVEPDYEFEPDADTLLEALLPQYVSRRLFSIFLEAAAAESASRRNAMKSATDNATELVKDLSRVANQARQAQITQEITEIVGGAGALADSGESD

SEQ ID NO: 4842 - protein, 483 aa, Corynebacterium glutamicum
MTTALEEQNAQQAATAGRVVRVIGAVVDVEFPRGELPALYNALTVEVTLESVKKTVVLEVAQHLGDNLIRTIAMAPTDGLVRGAAVTDTARPISVPVGDVVKGHVFNALGDCLDDVSLNNNPEIERWGIHREPPSFDQLEGKTEILETGIKVIDLLTPYVKGGKIGLFGGAGVGKTVLIQEMITRIAREFSGTSVFAGVGERTREGTDLFLEMEEMGVLQDTALVFGQMDEPPGVRMRVALSGLTMAEYFRDVQNQDVLLFIDNIFRFTQAGSEVSTLLGRMPSAVGYQPTLADEMGVLQERITSTKGRSITSLQAVYVPADDYTDPAPATTFAHLDATTELDRSIASKGIYPAVNPLTSTSRILEPAIVGERHYEVSQRVIGILQKNKELQDIIAILGMDELSEEDKITVARARRIERFLGQNFFVAEKFTGLPGSYVPLTDTVDAFERICNGDFDHYPDQAFNGLGGLDDVEAAYKKLTGK

SEQ ID NO: 4843 - protein, 124 aa, Corynebacterium glutamicum
MAEITVELVSVERMLWAGQASIVTAQTTEGEIGVLPDHEPLLGQLVENGVVTIQPIDGEKLIAGVSDGFLSVSKEKVTILADFAVWANEVDTASAEADLNSDDELAKAHAEAGLRAVRRSSEGL

SEQ ID NO: 4844 - protein, 157 aa, Corynebacterium glutamicum
MEYLTWGLVIVAVSAVLLAAWRFFTLRSRGTTVILRELPQSGVHGWRHGSFRYNGNDLEYFKLRSLSPMADLILNRLSVTLLDRRDPAADEAVFMSQGLKILHIKSKNDQIELALDAHGEMAFTAWLEAAPDARAEHSLNPRDFNRFRASKDTRKNR

SEQ ID NO: 4845 - protein, 230 aa, Corynebacterium glutamicum
MRLVIARCSVDYVGRLEAHLPSADRLLMVKADGSVSIHADDRAYKPLNWMTPPCSLVETPITDEDGEATGESLWVVENKKGEQLRITVEEIHSEQNFDLGQDPGLVKDGVEDHLQELLAEHITTLGDGYTLIRREYPTAIGPVDILCRNSDGETVAVEIKRRGGIDGVEQLTRYLELLNRDELLKPVHGVFAAQEIKPQAKTLAEDRGIKCVTLDYQALRGIESNELTLF

SEQ ID NO: 4846 - protein, 95 aa, Corynebacterium glutamicum
MGRKNRRTNIQPARDLPVDGTSYWGTQTQEGPSWTFGEPYLVRQIGSSAAKKFYICPGCNQNIPPGVAHIVAWPKEAGGRADDRRHWHKPCWERR

SEQ ID NO: 4847 - protein, 151 aa, Corynebacterium glutamicum
MSTEQSLNIPHEYVICLDHVGIAVPDLEEAIEFYRSAFGWVNHHQEINEEQGISEAMIGPKDIKSTEGMIQLIAPLNEDSTIAKFLEKKGPGIQQMCLRTNNIDALSEHLRRQGVRLLYPEPKNGTGGARINFLHPKDAGGVLLEITQPQS

SEQ ID NO: 4848 - protein, 104 aa, Corynebacterium glutamicum
MADMIVAFSVAPTVTDNPDAEMADAVTEAIRIVRASGLPNETNAMFTLIEGEWDEVMAVIKEATEAISRVSPRTSLVIKADIRPGHTGQLTRKVEAVEERLARD

SEQ ID NO: 4849 - protein, 307 aa, Corynebacterium glutamicum
MTSPHNFVSGAIDLGEVKARADARQKAHEQGPVTQGIASSLDVTMENLENEVLRRSTQVPVIVLVGTPRSPDSEQLKSDLTTLAAESGRKFIFGYVNADTDADVAQVFGVQGLPSVIAVAAGRPLADFQGGQPADALKQWTDQVVQAVGGQLEGLPEEATDGEQEDAPVEDPRFDAATDALNRGAFDEAIAVYESILAQEPNNADAKQARDTAKLLGRLATVDPSVDVVAAADADPTNVDLAYTAADAAVVAGDPEAAFDRLIALLTISAGDQKNQVKERLLELFGMFETADPRVLQARGKMASALF

SEQ ID NO: 4850 - protein, 381 aa, Corynebacterium glutamicum
MTLTFHWFLSTSGDSRGIIGGGHGAEKSGTSRELSHSYLKQLALAAETNGFESVLTPTGTWCEDAWITDASLIEATKRLKFLVALRPGQIGPTLSAQMASTFQRLSGNRLLINVVTGGEDAEQRAFGDFLNKEERYARTGEFLDIVSRLWRGETVTHHGEHLQVEQASLAHPPEIIPEILFGGSSPAAGEVAARYADTYLTWGETPDQVAQKINWINELAAQRGRELRHGIRFHVITRDTSEEAWVVAEKLISGVTPEQVAKAQAGFATSKSEGQRRMAELHSKGRAFTSGSTARDLEVYPNVWAGVGLLRGGAGTALVGSHEEVADRIEEYAALGLDQFVLSGYPNLEEAFHFGEGVIPELLRRGVDIKNQESRVLEPVG

SEQ ID NO: 4851 - protein, 256 aa, Corynebacterium glutamicum
MTTTLTRPKIALPARIYSPLAVLVFWQLGSSLGAIPERILPAPTTILAASWEVATNGTLLDALLVSSQRVLLGFALGAVLGISLGVLTGMSRFADTAVDPLIQAARALPHLGLVPLFIIWFGIGELPKVLIISLGVLYPLYLNTASGFRQIDPKLLEAGHVMGFGFFQRLRTIIIPSAAPQLFVGLRQASAAAWLSLIVAEQVNAREGLGFLINNARDFYRTDLVIFGLIVYASLGLLSEALIRAWERHTFRYRNA

SEQ ID NO: 4852 - protein, 243 aa, Corynebacterium glutamicum
MTATLSLKPAATVRGLRKSYGTKEVLQGIDLTINCGEVTALIGRSGSGKSTILRVLAGLSKEHSGSVEISGNPAVAFQEPRLLPWKTVLDNVTFGLNRTDISWSEAQERASALLAEVKLPDSDAAWPLTLSGGQAQRVSLARALISEPELLLLDEPFGALDALTRLTAQDLLLKTVNTRNLGVLLVTHDVSEAIALADHVLLLDDGAITHSLTVDIPGDRRTHPSFASYTAQLLEWLEITTPA

SEQ ID NO: 4853 - protein, 319 aa, Corynebacterium glutamicum
MKFKKIALVLAFGLGLASCSSASGDPATNADGSIDLSKVTLNIGDQIAGTEQVLQASGELDDVPYKIEWSSFTSGPPQIEALNAGQIDFAITGNTPPIIGGPTNTKVVSAYNNDALGDVILVAPDSSITSVADLAGKKVAVARGSSAHGHLIQQLEKAGVSVDDVEINLLQPSDAKAAFQNGQVDAWAVWDPYSSQAELEGAQVLVRGAGLVSGHGFGVASDEALDDPAKEAALADFLDRVADSYEWAEDNTDEWATIFSQESGFDPEASQLNTRSLRHQVPLDESVNTYQNALIDAFVSAGLVEDFNFEDTVDTRFEG

SEQ ID NO: 4854 - protein, 731 aa, Corynebacterium glutamicum
MTVDPASHITIPEADLARLRHCNHHDPHGFYGWHETEAGSVIRTRQVGATQVNLLIDDTSHVMTPIGDDIFAIDLGHRERADYRLEVTWPDQEPQVKADPYYFLPTVGEMDIYLFSEGRHERLWEILGANIKTYQTALGTVRGTAFTVWAPNAIGCAVVGGFNGWNASQHPMRSMGGSGLWELFIPGIEEGEVYKFAVQTREGQRRDKADPMARRAELAPATGSIVASSEYQWQDSEWLRERSQTDLASKPMSVYEVHLGSWRWGKNYEDLATELVDYVADLGYTHVEFLPVAEHPFGGSWGYQVTGYYAPTSRWGTPDQFRALVDAFHARGIGVIMDWVPAHFPKDDWALARFDGEALYEHPDWRRGEQKDWGTLVFDFGRNEVRNFLVANALYWIEEFHIDGLRVDAVASMLYLDYSREHGEWEPNIYGGRENLEAVQFLQEMNATVLRLHPGALTIAEESTSWPGVTAPTWDGGLGFSLKWNMGWMHDTLEYFSKNPVHRAFHHSELTFSLVYAFSERFVLPISHDEVVHGKGSLWDRMPGDTWNKAAGLRTFLAYMWSHPGKKLLFMGQEFGQREEWAEGQGLPWDIVDGWQGEYHEAIRTLTRSLNGVYSDSPALHTQDFTGEGFTWNKGDDATNNILAFTRFGSDGSQMLCVFNLSGTSQPEYQLGVAAGGEWKLVLNTDDAEFLGAENDIATSVQAAATPRDNFAYSLSLHVPAMSAQFYSLQK

SEQ ID NO: 4855 - protein, 498 aa, Corynebacterium glutamicum
MRELVTMGENLQVRVERRAALVNSWYELFPRSTGGWDESGTPVHGTFATTAQALERVAKMGFDTVYFPPIHPIGEVNRKGRNNTLTPEPHDVGSPWAIGSKDGGHDATHPRLGTIEDFQALLARARELNLEVALDLALQAAPDHPWAQEHREFFTVLADGTIAYAENPPKKYQDIYPINFDNDAPKIYEEVYRVVKFWVDLGVTTFRVDNPHTKPANFWQWLISAIHKSNPEVIFLAEAFTRPARLYGLAKIGFSQSYTYFTWKVTKEELTEFATEIARMADISRPNLFVNTPDILHASLQHGGRAMFAIRAALAATMSPVWGVYSGYELFEHEAVKPGSEEYLDSEKYELRPRDFEGALERGDSLEDYIALLNQIRRANPALQQLRNIHFHEADNDQIIAYSKVDALTGNTVLIVVNLDPRSAREATVRLDLGALGLEAGAQFEVRDAITGSRYLWSETNFVRLEPLRDVAHIFVLPELPASRRERLAWREIKTYRA

SEQ ID NO: 4856 - protein, 116 aa, Corynebacterium glutamicum
MSDTRGERWGETCAYIAAAPQRGGDVEKRSPILFRQILRSTLKQLSPVLKVVIQLIRTLTGLNLSGNRMTPRSHRIRPRIYTKCPITRDIRNEKCIRLILIIRSGAHMNLNRLSRH

SEQ ID NO: 4857 - protein, 293 aa, Corynebacterium glutamicum
MGDVTNSINNSAAASFPSDEEESNEDLLIDFQGVFFKRDGRNLVGPVDWQVELDERWVIIGPNGAGKTTLIRMASAEEFPSGGMARLMGERIGKTDMRDLRSMIGVSSSALGNRIPSEEKVSDLVISAGYAILGRWREDYDEMDFGQATEILEQVGAMHLADRTWGTLSEGERKRVLVARALMTNPELLILDEPTAGMDLGGREDLVGYLGELAMDPDAPAIVMITHHVEEIPAGFTHAMLLDEGEIVAQGLINTVMTNENLSKAFHQPIQVDRIGERYFARRVRTARSHRAQ

SEQ ID NO: 4858 - protein, 268 aa, Corynebacterium glutamicum
MAMVMQGIGGRKLAATVLLVRDGIINGRPDVEVYIQERVSTMANFPRATVFPGGGVDSRDFADGHGKEVWRGPSAEEWGVRLGVEPHVAYALVFAAVRELFEEAGTLLAEHTDGSGLVKNAGQYHGYRELLETHEMSLTDMLQSENLAIRSDLIVPFARWASPEGNREQFDTFSFVAVEPEGQCADGNTSEASSTGYFPARLILDGWRAGLLRLVIPTWASLFELSQFKTVEELLEYSAQVDMSPVLDDAVDNPRYAEFYQAMRTERF

SEQ ID NO: 4859 - protein, 352 aa, Corynebacterium glutamicum
MATLRKHFGDFGRAVAELAGARRSAVGKLPQDWLMCQESAQQTTPPAVSAERARRLKTALGENVIVHDVTCSIGTEGHELIDAGLRYLGSDLDFSRTLMAAHNLQGKNALIFRADALQPASRGADVIIADPARRAGGKRITNPAQLLPPLPSLLDAWINQPLAVKCAPGLDFSEWPGLVSIASVDGGVKEACLYTTDLADGETREAIVIKDGLIDRITNFEDDATGQDLAAAPGEFIIDPDGAIVRAGLVRHYAVREQLWMLDERIAYLTGNRIPEGTSGFRFIEEVPLKKLKSAMAAHDAGAVEILVRGVDVDPDQLRKRLQLKGTKAMSVVITRIGSRGVALICGPRERA

SEQ ID NO: 4860 - protein, 204 aa, Corynebacterium glutamicum
MCCHRRFQLLQRNLFNKPKTAGTLWNPIARKVCDPLIQHPQLLTHCIVANQPGAHDGTVWVDDELTRCSRKVLSRGIVFKVGDAVNEPIFDHDSFASFPICQIRSVEACFFHASINAGNTDETWPFRKIKAGGTFNGEWLVDPGVEKRRQRWQELCRICNALAPGASGRVRDDDVGSPACGLERVGAENQGVFALEIVGCHEGA

SEQ ID NO: 4861 - protein, 262 aa, Corynebacterium glutamicum
MSTIVVLVKNVPDTWSKRTLEADFTLDREGVDRVLDEINEFALEQALRLRESNPDAGYRVVALSAGPAGGEEALRKALSMGADEAIQLSDDALAGSDLLGTAWALNNAINTIAGVALIVTGSASSDGSMGALPGVLAEYRQVPALTNLSALKVEGASITATRIDNHGTYELQAALPAVVSISDKADKPRFPNFKGIMAAKKAEIKKLSLAEIGVAPEQVGLSHAATAVTAAADRPERSQGDVIGASGAAEKIAEYLASENLI

SEQ ID NO: 4862 - protein, 317 aa, Corynebacterium glutamicum
MSISYVLVEQLDGRPEPVTLELITAARALGDVVAVVVGEPGAGVNLAAELGNWGAAQVVSAEISGASNRLILPAVDALHILAANNPGPIVIAATASGNEIAGRLAARLASGVLTDVVGINADRTAQQSIFGDTIQVSAAVGGASPLYTLRPGALDGVAVPATGELATIEIPGATAKDVTITSFTPSTQSDRPELPQAKVVIAGGRGVGSEENFRSIVEPLADALGGAVGATRDAVDLGYYPGEYQVGQTGVTVSPDLYIGLGISGAIQHTSGMQTAKKVIVINNDEDAPIFQIADLGVVGDLFDIAPALIEEINKRK

SEQ ID NO: 4863 - protein, 205 aa, Corynebacterium glutamicum
MRCTFWLRTTQVQLLSLQLQAVMRSLVVWLPVWLLVCSPMSSESMPTAPHSSPFSATPFRCPLQLVALHRCTPCVQVPLMAWPFLQPVNWQPLRSQAQPPRMSPSPPSRQAPRAIALSCHRQRSLSQVDVVSEAKKTSAASLNHWQMHWAVPLAQPATPLIWATTQASTRLVRPVSPCPQTSTSASAFPVQFSTLLVCRPQRRLL

SEQ ID NO: 4864 - protein, 376 aa, Corynebacterium glutamicum
MNTFYLDHAATTPMREVAAAAWMENAQALNPASQYGSGRKARSVADSAREEIASLLGCEPIEVVFTASGTEADNLAVQGLFHASPLNRIISTPIEHPGILETVKALELGGAEAELMPIGPDGRVSSFEALDKPAAVATMMWANNETGAIQPVSEFIAAAQASGTPTHIDAVQVVGHLPVNFDELGATTLAASAHKFGGPRGVGLLLVRRSPAPSAVLHGGGQERGIRPGTLDVAGAAATAAALREAVAELDGEATRLRGLKKMLLDAILHTIPNVLVHTTEPSLPGHLHLSFPGAEGDSLIMLLDSLRIEASTGSACSNGVNRASHVLLAMGISETDARGAIRFTLGRTTTEESIKAVIAVIEDVVTRARTAGMAF

SEQ ID NO: 4865 - protein, 104 aa, Corynebacterium glutamicum
MIKKYLSTIAAVTIASAVLFAPSAQANTISSHFPEHDMVDPYGPTMTSTGLNRSQETVMFHGLFGAIVLSTGSPVVGDCQNVPLSHQQVICPLATELHYAIYGR

SEQ ID NO: 4866 - protein, 382 aa, Corynebacterium glutamicum
MTPTADIWFKDTLAAHFTRDGDQTTFSYTADYAGPPIATSLPINSEPVITRSGAIPPFFAGLLPEGRRLSSLRRNIKASADDELSLLLAVGADPVGAVAIFPHGENPQPAPPTVDFDDELDFSAALTESGIADPVALAGVQDKASARTIAVPVASDAILKLSPPEYPYLVENEAACYQLLTKNKLRIELSKVEVLHDKHGRSGLLVHRFDRTPKGKIPVEDAGQVLGIWPADKYLVSYEDIAQALTKVCASPILAMRNLAFQIAVAWLSGNGDLHAKNISIINKGRGFEISPIYDIPATAVYGDTTMALEIQGSKKDLSQKKFLKFCTSIGLPEKTAMSVANAALLATENAAETILASGNFDTRMNRDLARVLKHRRSAWGA

SEQ ID NO: 4867 - protein, 75 aa, Corynebacterium glutamicum
MHMNAEEIGMALLNGRKELGLRQGELADLAGVSERFIRDVEKGKTTVRLDKVIDVLRVLGLELSVGIHDPLKVNQ

SEQ ID NO: 4868 - protein, 168 aa, Corynebacterium glutamicum
MSAFHIRAEQSRDISAIHDVTEAAFTGIEHSDGTEQDLVDKLRAAKALSLSLVAEADGEVIGHIAASEVLIGGGVQGWFGIGPVSVRPDKQQQGVGIALMGSALDQLRAEGAGGIVLLGDPGYYRRFGFEVVPGLVYPDAPAEFFMAVCLNAPAFPQGVVEYHSAFGG

SEQ ID NO: 4869 - protein, 314 aa, Corynebacterium glutamicum
MARKKNTSDQSRSQAANTPIAGTYEGEYSVIELEADSYTTDGWLISINGVPSSHIVLGQPQALEFEYMRWIATGARAFIDAHQDASKLRITHLGGGACTMARYFADVYPQSRNTVVELDAELARLSREWFDIPRAPRVKIRVDDARMVAESFTPASRDVIIRDVFAGAITPQNFTTVEFFEHCHRGLAPGGLYVANCGDHSDLRGAKSELAGMMEVFEHVAVIADPPMLKGRRYGNIILMGSDTEFFSSNSTEASAITRELLGGGVPAQYKDESWVRKFASGAQARHDGVSTLQMPSDTPQHPAETPEHSNTQP

SEQ ID NO: 4870 - protein, 383 aa, Corynebacterium glutamicum
MSSMSARNPFRPTFGVSPTVLAGRDSLLQSFKLGLAEGPGSPFRALLISGSRGMGKTVLLNEFEDAAASQGWITLRAYPDNSMVDGLVNSAIPEALQNLDGPQSKRMLSGVAIPGIATVTAIADPTKKDPTPTLISRLRELATRLQKHGSGILITLDELQSANVDLLHVLATAVQDLLRDDFDIALVAAGLPEGIDRLLQHEGTTFIRRAERILLNPVNHEDSVEMFLDTAAEGQRHMTSEAAELAAQISKGYPYSMQLTGSLAWARSTLDNSDTIQAEQVDAVRDEVVRRMGMQVHEPSLHQVPDGELTILYAIAQLSKNGEMVSTGDIAHLMGVKPNALSMQRKQLLSRGLVEVPKYGFLNFTLPYMREHLLNSPHHRPIT

SEQ ID NO: 4871 - protein, 132 aa, Corynebacterium glutamicum
MRFETEYVERLYVFSTTQQAQEISEELAVEFLKENPDISHHEILVQHSAEDTFEVEKVWVEMFGDSTDIQDRTISLIEYRFTINSNADEDMDELSMGIYAVIRALIKKHSKVEYFSMFSLASDLLASDLEEE

SEQ ID NO: 4872 - protein, 365 aa, Corynebacterium glutamicum
MRVLAAMSGGVDSAVAASRAVAAGHEVVGVHLALSQDPQTVRESSRGCCSLEDSADARRVCDKLGIPFYVWDFSDRFKEDVIDNFIDSYAIGETPNPCLRCNEKIKFAALLERGIALGFDAVVTGHYARLTQPADGGDGYLRRGVDPNKDQSYVLGVLGAHEIEHCMFPVGDTIKPEIREEASAAGFSVAKKPDSYDICFIPDGNTQAFLGKHIGMRPGMIVDQEGTQLREHAGVHEFTIGQRKGLDIKAPAADGRPRYVTDIDAKTGTVTVGTRENLKISTIHADRLKFLHPAMDGQIDCEVQVRAHGGVVSCSATIDRDADFMVLNLNEPLQGVARGQAAVLYLPDADGDIVLGSGTICHTES

SEQ ID NO: 4873 - protein, 218 aa, Corynebacterium glutamicum
MDTSVLTELRAFLIHDHARTHTDVLAQERLGVAIRNEANVVGVWLLCHRETCSTGFFTDFRLDGIADWEHAVLDLMSAKHTKHVRLILVGINSATQVAIATISRLGQARVVAGNHCIETKRDATLKQGGKLDFLITTQARVWSLTDRVRINEVVDHIFLETIREIPDIKRDTQLVTHATSISGIFQRAATARRLTHRLRILRQRQMHANHFMTSCDRA

SEQ ID NO: 4874 - protein, 330 aa, Corynebacterium glutamicum
MGAYGLGELPGKSAAEAADIIQGETGDLLHIPQLPARGLGADLIGRTVGLLDMINVDRGARSWVMSTRPSRLTHLTGDFLDMDLDACEETWGTGVDKLKIQVAGPWTLGARIELANGHRVLSDRGAMRDLTQALIAGIDAHARKVAGRFRAEVQVQIDEPELKSLIDGSLPGTSTFDIIPAVNVADASERLQQVFSSIEGPTYLNLTGQIPTWDVARGAGADTVQISMDQVRGNEHLDGFGETITSGIRLGLGITTGKDVVDELLERPRQKAVEVARFFDRLGVGRNYLVDAVDIHPGEDLVQGTITEAAQAYRMARVMSEMLSKDSGDL

SEQ ID NO: 4875 - protein, 487 aa, Corynebacterium glutamicum
MSDKKQDLTSSAAGSAAPQTKAYPAMPLPEKQAWPALIALCIGFFMILLDQTIVAVSTPALQADMGASYNEVIWVTSVYLLTFAVPLLVTGRLGDKYGPKNVYVAGMVIFTVSSLACGLAPDMFTLIIARGVQGLGAALLTPQTMATINRIFAFERRGAALGVWGSTAGLASLAGPILGGVITENWGWQWVFYINVPIGVISVIAVMKYVPEFPPLTRPLDPLSIVLSIVAVFFLVFAFQEGEGAGWAAWVWIMIVAAFALFAWFIYQQSRAEKSGNDPLVPLEIFKFRNFSLGNICIMAMGFTVAGTPLPIMLYFQQAHGMNAMEAGFMMVPQALMAAVLSPFVGKLVDRSNPGLMAALGFSTVAVSIVLLSMVMIFDTGLVWALVSMTLLGIGNAFVWAPNSTSTMRDLPHKFMGAGSGVFNTTRQLGSVIGAAAIGAVMQIRLAAGDEGAAFGQALLLAAAVLVIGIVASTMAGKNAHPAPVKP

SEQ ID NO: 4876 - protein, 245 aa, Corynebacterium glutamicum
MRLLGLGTMNSPSNPSPTVPSFDTTKMLSFDLETTGVNPFDTRIVTSAMVTITSKGAEPIELLADPGIEIPEAATAVHGITTEHARANGRPHDEVLAETISRLRAGWQAGLSVIVFNASYDLTVLRNHDPSFTIDGLVYDPFVIDKVKDRYRKGKRTLTDMCAHYDVQLGNAHEATSDALAAARIAWKQVRLWPELTKMTGEELMEFQAVNYYEQQKSFRSYLIGQGRDASDVNTSWPVQTDPAS

SEQ ID NO: 4877 - protein, 680 aa, Corynebacterium glutamicum
MTEDNAQLRRTWNDLAEKVRYHRDRYYNEQPEIPDADFDALFKQLQQLEEDHPELAVPDSPTMVVGAPVAEQSSFDNVEHLERMLSLDNVFDEQELRDWLGRTPAKQYLTELKIDGLSIDLVYRNGQLERAATRGDGRVGEDITANARVIEDIPHQLQGTDEYPVPAVLEIRGEVFITVEDFPEVNAQRIADGGKPFANPRNAAAGSLRQKNIEDVKKRRLRMISHGIGFTEGFSPASQHDAYLALAAWGLPTSPYTEAVTDPEDVVKKVSYWADHRHDALHEMDGLVIKVDDIASQRALGSTSRAPRWAIAYKYPPEEVTTKLLDIQVGVGRTGRVTPFAVMEPVLVAGSTVSMATLHNQSEVKRKGVLIGDTVVIRKAGEVIPEVLGPVVELRDGTEREYIFPTLCPECGTRLAPAKADDVDWRCPNMQSCPGQLSTRLTYLAGRGAFDIEALGEKGAEDLIRTGILLDESGLFDLTEDDLLSSNVYTTNAGKVNASGKKLLDNLQKSKQTDLWRVLVALSIRHVGPTAARALAGRYHSIQALIDAPLEELSETDGVGTIIAQSFKDWFEVDWHKAIVDKWAAAGVTMEEEVGEVAEQTLEGLTIVVTGGLEGFTRDSVKEAIISRGGKASGSVSKKTDYVVIGENAGSKATKAEELGLRILDEAGFVRLLNTGSADE

SEQ ID NO: 4878 - protein, 221 aa, Corynebacterium glutamicum
MSFLIRVLLSDTPGSLALLAEALGIVEANIQSVDVVERFPNGTVMDDLVISIPRDVMADTIITAAEEVDGVEIDSIRPFSGTVDRRGQIQMLAAVAHQRRDITAAMEEMVDVIPRTMTSGWALVIDLKGPITRIAGSLAAPEDDGTVPENIVLKEARMLNPENDPWIPESWTLLDSSLAIAPIGKHGLALIIGRPGGPDFLASEVEHLGQVGDIIGAMLQK

SEQ ID NO: 4879 - protein, 99 aa, Corynebacterium glutamicum
MPEISRDQVAHLAKLSRLALTEEELEQFAGQIDDIVGYVSAVQNVDAAGVEPMSHPHSIATTMREDVVHKTLDAAAALDQAPAVEDGRFMVPQILGEGD

SEQ ID NO: 4880 - protein, 497 aa, Corynebacterium glutamicum
MTNKYLVEGSENELTTKTAAELAGLIHSREVTSREVTQAHLDRIAAVDGDIHAFLHVGQEEALNAADDVDKRLDAGEAPASALAGVPLALKDVFTTTDAPTTAASKMLEGYMSPYDATVTRKIREAGIPILGKTNMDEFAMGSSTENSAYGPTHNPWDLERTAGGSGGGSSAALAAGQAPLAIGTDTGGSIRQPAALTNTVGVKPTYGTVSRYGLIACASSLDQGGPTARTVLDTALLHEVIAGHDAFDATSVNRPVAPVVQAAREGANGDLKGVKVGVVKQFDRDGYQPGVLEAFHASVEQMRSQGAEIVEVDCPHFDDALGAYYLILPCEVSSNLARFDGMRYGLRAGDDGTRSADEVMAYTRAQGFGPEVKRRIILGTYALSVGYYDAYYLQAQRVRTLIAQDFAKAYEQVDILVSPTTPTTAFKLGEKVTDPLEMYNFDLCTLPLNLAGLAGMSLPSGLASDTGLPVGLQLMAPAFQDDRLYRVGAAFEAGRK

SEQ ID NO: 4881 - protein, 283 aa, Corynebacterium glutamicum
MNTPAPRKRREMKIKTATVTGVRQISPDLIRFSFDCPEIVGADLGFTDHYIKILFVPAGADYSWPFDMAEIAETQPRELQPVRRTYTFRTVDTVAGTFDIDFVAHGTDGLAGPWAQQAQVGDVIAFGGPGGAWKPETTYEHYVLAGDEAAAPAIFAALEHLPAGTTAKAFIEISSNEARFNAPASDNIEVVWVPRDGATHGTLLIDALRQDGYPTKKTSWFIHGVAEMVKETRKFLFVEGNVDKADASISGYWRLGMTEDQWQASKREFNEQNEAEELALSKA

SEQ ID NO: 4882 - protein, 102 aa, Corynebacterium glutamicum
MKKASQVSTATVVAAGLIGGWLTARESGIRPLGTIPLAASGALAARSWNEKKGPAVATGLLATYVGAFGLSHPLAKKIGAWPAVLTVTAGAAAIAYAVSDSQ

SEQ ID NO: 4883 - protein, 357 aa, Corynebacterium glutamicum
MFRRGCCDGFNMEDMRIATLTSGGDCPGLNAVIRGIVRTASNEFGSTVVGYQDGWEGLLGDRRVQLYDDEDIDRILLRGGTILGTGRLHPDKFKAGIDQIKANLEDAGIDALIPIGGEGTLKGAKWLSDNGIPVVGVPKTIDNDVNGTDFTFGFDTAVAVATDAVDRLHTTAESHNRVMIVEVMGRHVGWIALHAGMAGGAHYTVIPEVPFDIAEICKAMERRFQMGEKYGIIVVAEGALPREGTMELREGHIDQFGHKTFTGIGQQIADEIHVRLGHDVRTTVLGHIQRGGTPTAFDRVLATRYGVRAARACHEGSFDKVVALKGESIEMITFEEAVGTLKEVPFERWVTAQAMFG

SEQ ID NO: 4884 - protein, 210 aa, Corynebacterium glutamicum
MARTSCTNTITSGQNTVESSWGSTTLNVAKNGRTNIVAEAHVDLISDLLSNSREGLVTELVNVAFTKLHGAFAWQRTFRNDDNAVLLAHLEATFHRLADLCNIERYFWNNGVVSTAGHTCVQSNPTHVAAHDLHDHHTVVRFSGGVQAVNSVGSHCHSSIETEGEVSAIHVIVNGLWDTDNRDTVIRQPLGTLQGSFATDWDKGIDAGVF

SEQ ID NO: 4885 - protein, 369 aa, Corynebacterium glutamicum
MASETSSPKKRATTLKDIAQATQLSVSTVSRALANNASIPESTRIRVVEAAQKLNYRPNAQARALRKSRTDTIGVIIPNIENPYFSSLAASIQKAAREAGVSTILSNSEENPELLGQTLAIMDDQRLDGIIVVPHIQSEEQVTDLVNRGVPVVLADRSFVNSSIPSVTSDPVPGMTEAVDLLLAADVQLGYLAGPQDTSTGQLRLNTFERLCVDRGIVGASVYYGGYRQESGYDGIKVLIKQGANAIIAGDSMMTIGALLALHEMNLKIGEDVQLIGFDNNPIFRLQNPPLSIIDQHVQEIGKRAFEILQKLINGDTAQKSVVIPTQLSINGSTAVSQKAAAKAAKAAQKAAAKAAQNTQHEVSLDGEL

SEQ ID NO: 4886 - protein, 524 aa, Corynebacterium glutamicum
MVNSEQALHQHDPAPILQLDKVSKSFGPVNVINQVSIDVRPGRVLALLGENGAGKSTLIKMMSGVYQPDGGQILVDGKPTTLPDTKTAESFGIATIHQELNLVPTMTVAENVMLGRTPRKWGLVNFKHLRRQAQAALDLIGVDVDLNAQVGSLGIARQQMVEIAKALSMNARILILDEPTAALTGREIDQLFKVVDQLKEKGVAMVFISHHLDEIARIGDTVSVLRDGQFIAELPADTDEDELVRLMVGRSIENQYPRSAPEIGQPLLEVKNLNAEGRFTDISLTVRAGEVVGLAGLVGAGRTEVVRSIAGVDKVDSGEVIVAGKKLRGGDISEAIKNGIGHIPEDRKAQGLVLGSSVEDNLGLATLASTARAGLVDRSGQHKRAAEVAEKLRIRMASLKQPISDLSGGNQQKAVFGRWVLAGSNVLLLDEPTRGVDVGAKVEIYNIINEMTEKGGAVLMVSSELPEVLGMADRILVMSGGRIAGELPAKGTTQDDVMALAVSQVDDSITEEAAAEIENTKEDR

SEQ ID NO: 4887 - protein, 324 aa, Corynebacterium glutamicum
MSTAVVSQKKSTTASKIGHWMLNNGALVGLIALCVGLFIATPHFLTIPNLINIGIQSATVAILAFGMTFVIVTAGIDLSVGSVAALGAMTSAYFFAEVGLPGWITLLIGLFIGLLAGAISGISIAYGKLPAFIATLAMMSIARGITLVISQGSPIPSAPAVNALGRTYFGIPMPILMMALAGIVCWFILSRTVLGRSMYAIGGNMEAARLSGLPVKKILVMVYALAGVYAALAGLVMTGRLSSAQPQAGVGYELDAIAAVVIGGASLAGGTGKATGTLIGAILLAVIRNGLNILNVSSFWQQIVIGCVIALAVGFDVIRNKTSK

SEQ ID NO: 4888 - protein, 314 aa, Corynebacterium glutamicum
MYARKLIALSASVVLAFSLSACNRESSGTSADGGSADGSITLALSTQTNPFFVQLRDGAQEKADELGVTLNVQDASDDAATQANQLNNAVTTGAGVVIVNPTDSDAVVPSVEALNQADIPVVAVDRSSNGGEVASFVASDNVAGGAQAAAALAEAIGGEGEILMLQGIAGSSASRDRGQGFEEEIAKHEGISIVAKQTANFDRGEGLDVATNLLQAHPNVKAIFAENDEMALGAIEALGARAGEDVIVVGFDGTNDGLAAVEDGRMLATVAQQPEELGAKAVEEAAKLLRGEDAETEVPVEVVTVKLDNVADFK

SEQ ID NO: 4889 - protein, 123 aa, Corynebacterium glutamicum
MKKSGLLNPDLCYAIARLGHTDTWAVADCGLPIPEHVEIIDLALVFGIPTFEQVLNALKPEVVVEGAVIAEGAPERIREMVDTDVEVVTHEELKAQLAECAFVIRTGETTAYANVIFKSGVAF

SEQ ID NO: 4890 - protein, 212 aa, Corynebacterium glutamicum
MQFAQNPRLTNDAVILEPLSHQWTQDLQEAVASQELWRHWFVALPTPEGMAEEIDRRLAEHADGLCAPWAIISAATGRAVGMTSFHTLDHANKRLEIGRTWMAAHVQGTGINPSVKFLQLQRAFEDLGVNAVEFRTNWHNHRSRAAIERLGAKQDGVLRKHRIHPDGTVRDTVIYSITNDEWPAVKLTLMERLYRHMQVPIIPNEASLFDAS

SEQ ID NO: 4891 - protein, 338 aa, Corynebacterium glutamicum
MKKRVSLFKSAASIVVVAGMALGMVGCSSTESESESSADVTSSADGAYPVSIATKFGDVTVESQPERVVALGWGDAEAALEFGVQPVGASDWLAFGGEGVGPWIEDSAYDEAPEIIGTMEPEYEKIAALEPDLILDVRSSGDQERYDKLSSIALTIGVPEGGDSYLTPRAEQVTMIATALGQAERGEEVNAEYEQLTADIRAAHPGWPEKTAAAVSATATSWGAYIKGSNRVDTLLDLGFQENPELAKQQPGDTGFSIKFSEETFGVVDSDLVVGFAIGMTPEEMAEQVPWQMLTATRDGRSFVMPREISNAFSLGSPQSTRFALDALVPLLEEHAGE

SEQ ID NO: 4892 - protein, 335 aa, Corynebacterium glutamicum
MSTQVELKTPKSEDRAAYIAALGFPVLVIIGGIIGFTASDVVLNISSWVNPLLGIIMFSMGLTLKPVDFALVAKRPLPVLIGVIAQFVIMPLIALLVVWVLQLPAEIAAGVILVGCAPGGTSSNVVSYLSRGDVALSVTMTSISTLLAPIFTPLLTLWLAGQYMPLNAADMAVSIVQVVLIPVVGGLVVRLIFPTLIGKVLPLLPWISVIAISLIVAIVVAGSRDKILEAGLLVLAAVIIHNTLGYSLGYLAAKFTGQPAAARRTTAIEVGMQNSGLAAGLASQYMSPMSALPGAIFSVWHNLSGALLAALCRASDKRAAEKVASEKAASEKAAS

SEQ ID NO: 4893 - protein, 493 aa, Corynebacterium glutamicum
MDFDEVLEKYDPVMGLEVHVELGTETKMFSASSAHFGAEPNSNVDPVSLGLPGALPVVNAKGVEWAIKIGLALNCSIAESSRFARKNYFYPDQPKNYQISQYDEPIAYDGYLDVVLEDGTEWRVEIERAHMEEDTGKLTHLGGTSGRIHGATASLVDCNRAGVPLIEVVTKPIEGAGARAPEIAKAYVSALRDLVKALGVSDGRLDQGSMRVDANLSLRPIGQEEFGTRTETKNINSLKSVEQAITFEMQRQAQVLDDGGVIDQETRHYQEADGSTSKGRPKETAEDYRYFNDPDLPPVIAPREWVEEIRATLPELPWVRRARIQEEWKLSDAEMRDLINANALDLIIETVEAGTTPDEARAWWVSYISQKANESGVELDALGVAPAHVARVVALVSEGKLTNKLARQAIDGVIAGEGDVDAVVAARGLEVVRDDGAIEKAVDDALAANPDIVEKYRAGNTKVTGAIVGAVMKATRGKADPAQVNQLIAKKLA

SEQ ID NO: 4894 - protein, 224 aa, Corynebacterium glutamicum
MIKELLNKLFGNKKASPAMTQSETISHKENNTMTTYTIFGRGNMGTAIAGVLTKGGATVEHIGSADSDIATINGDVVILAVPYPAVESIIASHKDALAGKTVIDITNPLNFETFDSLVVPVGSSATAEIQAQLPTSRVLKAFNTNFAATLATGKVGDITTTVLVAGDDEDAKNALITDVNAGGLDALDAGSLKRAHELEAVGFLQLTLAGSEKIGWTGGFGLVK

SEQ ID NO: 4895 - protein, 359 aa, Corynebacterium glutamicum
MANTSSDWAGAPQNASADGEFVRDTNYIDDRIVADVPAGSEPIAQEDGTFHWPVEAGRYRLVAARACPWAHRTVITRRLLGLENVISLGLTGPTHDVRSWTFDLDPNHLDPVLQIPRLQDAYFNRFPDYPRGITVPALVEESSKKVVTNDYPSITIDFNLEWKQFHREGAPNLYPAELREEMAPVMKRIFTEVNNGVYRTGFAGSQEAHNEAYKRLWVALDWLEDRLSTRRYLMGDHITEADIRLYPTLVRFDAVYHGHFKCGRNKITEMPNLWGYLRDLFQTPGFGDTTDFTEIKQHYYITHAEINPTRIVPVGPDLSGFATPHGREKLGGSPFAEGVTLPGPIPAGEEVKNPEPFQK

SEQ ID NO: 4896 - protein, 258 aa, Corynebacterium glutamicum
MARSQKRTPAIRSTKKVKSVISSIITIAVAAVAFAAYVIDGGVEEASGTPTSSESSVAATAPAASSETAAEYRAMLASLDVKGRAPGTGYDRELFGPAWTDTVSVEYGHNGCDTRNDILQRDLDDIQLREGTKDCIVTSGLLSDPFSGELIDFVRGERSGDVQIDHLVPLHDAWVKGAQQWDEQTRKNFANDPDNLLAVKGTLNQQKGAGDAATWLPPNTAFRCDYAKKIITVKDRYNVWVTEAEASALERQLDTCAA

SEQ ID NO: 4897 - protein, 352 aa, Corynebacterium glutamicum
MTDNSRNSNQNFDQPDLNDLDDDSAIPTYKGPSPSANSSNATERLGSVYDRTGRAAPQNIPPASNAAETTAFERPDNQSAKPVASEAPTTITPASSGALASDAPTSYVQAQPSQQQTPQQVPPAPPTQVTRQISRPEEPGYQPEPSYSEPYTDSDFAPAGAAAAAAAVAPPMIAEQPQIVEDARRGTLDFGLLIIRAVIGVYLIVRGVFTFFTLGGSAGLAGLEAEFAGYQWPEILAILLPSIELAAGVFLLLGLMTPVAAAVATVATSFTTLHQVNTHEGGWGELSEPLMLALILTIVVVGLQFTGPGKISLDSGRGWAKRPLVSSWIFVVIGIAAAVLLWWFGAGVNPIA

SEQ ID NO: 4898 - protein, 79 aa, Corynebacterium glutamicum
MSTGSLLWVPVLFHVLACVGVVELPVANTHHKLQDFCWLWWIFPLYSPMRATFGPIPKGKALFVVDPCPGSFQEPQLPH

SEQ ID NO: 4899 - protein, 613 aa, Corynebacterium glutamicum
MIPLRSKVTTVGRNAAGARALWRATGTKENEFGKPIVAIVNSYTQFVPGHVHLKNVGDIVADAVRKAGGVPKEFNTIAVDDGIAMGHGGMLYSLPSREIIADSVEYMVNAHTADAMVCISNCDKITPGMLNAAMRLNIPVVFVSGGPMEAGKAVVVDGVAHAPTDLITAISASASDAVDDAGLAAVEASACPTCGSCSGMFTANSMNCLTEALGLSLPGNGSTLATHAARRALFEKAGETVVELCRRYYGEEDESVLPRGIATKKAFENAMALDMAMGGSTNTILHILAAAQEGEVDFDLADIDELSKNVPCLSKVAPNSDYHMEDVHRAGGIPALLGELNRGGLLNKDVHSVHSNDLEGWLDDWDIRSGKTTEVATELFHAAPGGIRTTEAFSTENRWDELDTDAAKGCIRDVEHAYTADGGLVVLRGNISPDGAVIKSAGIEEELWNFTGPARVVESQEEAVSVILTKTIQAGEVLVVRYEGPSGGPGMQEMLHPTAFLKGSGLGKKCALITDGRFSGGSSGLSIGHVSPEAAHGGVIGLIENGDIVSIDVHNRKLEVQVSDEELQRRRDAMNASEKPWQPVNRNRVVTKALRAYAKMATSADKGAVRQVD

SEQ ID NO: 4900 - protein, 188 aa, Corynebacterium glutamicum
MGAVVFGLISLLVIGAAPQYLFWLLALPVIFGYWVLKSSTIVDEQGITANYAFKGKKVVAWEDLAGIGFKGARTFARTTSDAEVTLPGVTFNSLPRLEAASHGRIPDAITASKEAADGKVVVVQEDGYSVMMSKEEYLERQKALGKPVQLNFDDDTDGNTTQTESVESQETGQAASETSHRDNPASQH

SEQ ID NO: 4901 - protein, 491 aa, Corynebacterium glutamicum
MRIIKRRVESAADADTTKNQLAFAGVGVYIAQIVAFFMLAVSAMQAFGFSLAGAAIPATIASAAIGLGAQSIVADFLAGFFILTEKQFGVGDWVRFEGNGIVVEGTVIEITMRATKIRTIAQETVIIPNSTAKVCINNSNNWSRAVVVIPIPMLGSENITDVIARSEAATRRALGQEKIAPEILGELDVHPATEVTPPTVVGMPWMVTMRFLVQVTAGNQWLVERAIRTEIISEFWEEYGSATTTSGTLIDSLHVEHEEPKTSLIDASPQALKEPKPEAAATVASLAASSNDDADNADASVINAGNPEKELDSDVLEQELSSEEPEETAKPDHSLRGFFRTDYYPNRWQKILSFGGRVRMSTSLLLGALLLLSLFKVMTVEPSENWQNSSGWLSPSTATSTAVTTSETSAPVSTPSMTVPTTVEETPTMESNVETQQETSTPATATPQRADTIEPTEEATSQEETTASQTQSPAVEAPTAVQETVAPTSTP

SEQ ID NO: 4902 - protein, 77 aa, Corynebacterium glutamicum
MSLGLVTMKLCLVTGMVMPRISASWKASVPSRPLPTWPVMATMGTESKFASAIGVTKLVAPGPEVAMQTPTRPVTCA

SEQ ID NO: 4903 - protein, 202 aa, Corynebacterium glutamicum
MMVASGLLDITRTRSESRMASSTSWVTMTTVRREASQMLSSWSWSSRRVRASRAPKGSSRSMIGGSMAKARAMPTRCCMPPERRAGRRSAASVRPTCSRWVRVMSARSVLLKEGRAERRPKSMLPRAVNQGRRAWSWKTMPRSGPGPLISSLPALTVPVDGEASPAIILRIVDFPQPEGSRRETNSPSLMVMLVSPMIVVEP

SEQ ID NO: 4904 - protein, 166 aa, Corynebacterium glutamicum
MTARGNIDFGLRSARPSLSKTERADITRTHLEQVGLTDAAERRPARLSGGMQQRVGIARAFAIDPPIMLLDEPFGALDALTRRELQLQLLNIWEASRRTVVMVTHDVDEAILLSDRVLVMSKSPEATIITDIPVNLPRPRHELSEDASVEAETTALRKRMLHLLEH

SEQ ID NO: 4905 - protein, 89 aa, Corynebacterium glutamicum
MTKPNASVELNTITKSYGSTTIIGDTSITINDGEFVSLLDPSGCGKSTILKMIAGLASPSTGTVSAGNEEIKGPGPDRGMVFQDHALLP

SEQ ID NO: 4906 - protein, 294 aa, Corynebacterium glutamicum
MTHILFDSRRFLQLGAFASLSTALAGAARYVTSTSNNEPADNTPLTIGYVPIAGSAPIAIADALGLFKKHGVNVTLKKYSGWSDLWTAYATEQLDVAHMLSPMTVAINAGVTNASRPTELSFTQNTNGQAITLASKHYGSVNSAADLKGMVLGIPFEYSVHALLLRDYLVSNAVDPIADLELRLLRPADMVAQLTVEGIDGFIGPGPFNERAISNGSGRIWLLTKQLWDKHPCCAVAMAKEWKAEHPTAAQGVLNALEEASAILSNPAQFDSSARTLSQEKYLNQPATLLDGPS

SEQ ID NO: 4907 - protein, 149 aa, Corynebacterium glutamicum
MCEHRMTLDYFKASGTDYALGLAAESEGARRTGITGMASAFKEFAGCGEIDLEATRVEGGLKVSGKLRWASNLCEDPVIVPAAKTAEGLQLLFALGAETEGVTLGSSLALLGLNATACAWVSFEDVFIPGAQILSHDFLTLWHRCAQPS

SEQ ID NO: 4908 - protein, 123 aa, Corynebacterium glutamicum
MASVRPTFVILRISEYFGVAEAAINAATGRLTSLSEVFIDNAAEIQDNLSSLVALQKDLAERVNVEGVNPVTPVDLLELRLGSAQLAVAATAIEVRVAGGAGYVKSSSTSRRFRVEMGACTGP

SEQ ID NO: 4909 - protein, 162 aa, Corynebacterium glutamicum
MTLKTVNGTQLRDTVGSFPSGVTVVTTTDGEVDHGLTVSAFVSLSLEPAMVLVSIDKKSSVVPFLEQGSPVAVSVLSEEQSDLAITFGRHLENKFDGVSIKRSTNRAAVLEGASAWLSGAVVDKYPGGDHFIITIAVEECAHDEEQKPLLYHRGRLFQWQED

SEQ ID NO: 4910 - protein, 318 aa, Corynebacterium glutamicum
MESHDLQQRSYAHNPDGHDHSHDGLGHSHAPSSLKALFAVIIFTSIIFLAELIAGLISGSLALLADAMHMLSDSTGLIIAAVAMLIGRRARTSRATYGYKRAEVLAAMVNATVVTALSVWIVVEAIMRLGKDLEIQTNLMLIVAVIGFVTNGISALVLMRHQDGNINMRGAFLHVLSDMLGSVAVIIAGLVIRYTGWMPADTIASIAIAAIIIPRAFSLLKEALNILLERVPTGAEPAEVDAALRKVPGVSDVHDLHIWSIDGKEILATVHLVVDSSTNQLHSCGVLDRAEAELSKLGILHSTIQLESADHSDHESVC

SEQ ID NO: 4911 - protein, 51 aa, Corynebacterium glutamicum
MTPAKHTSPLIESLLKMKGWRINLLATEKACHGGKEVAFAPRREHTLPRQW

SEQ ID NO: 4912 - protein, 230 aa, Corynebacterium glutamicum
MQLICRRIHHQMHRGQDFLAVNAPNVKIMHIADTWDFTKGCVDLCRLRTCRNTLQQDIESFLQEAECARNNNRSNRNRSNGIGRHPSRVANHQARNNDGNGTQHVTENVKECSTHIDIAILVAHQHQGGNSVGDKTNDRDDEHQVGLDFQVLAQTHDGLNDDPHRQCCNNGGVNHRCQDFRTLVSVGRTRSACPTANEHGDSRNDQASGVGQHVHGVSQQCQRSGNKAGD

SEQ ID NO: 4913 - protein, 605 aa, Corynebacterium glutamicum
MGFSTPSYPLNDLFARIDRGDIQLPDFQRDYAWDVDRIRSLITTVLRGFPVGVLMALDTRGEEMRFRPRALSGAPDTGKDPGLLLLDGQQRLTTLYHCFSGDGYVNTVDFRSKKVTRKFYIDVAKAVESPVMSDEAIFSVDETGKIISHFGPVIDGGITDLETALAHGCLPVSVLLDDNGTDFLFDLADMAGEGAREHAKRFQSQIVKTLVSYDIPMIRLDRETAKGGIGSIFAQANSSGLQMDVFDLLTAVFAADESVETEFSLRDDWVRVERNLRQHSALDGIGSTEFLTAVALLVSARKGHASGYREDILNLTLAEYIPAADEMIKGFDEAAEFLRQRCILSLDQVPYTAQIVPLAVILTLLDAEEMATARSWDRLNQWFWSGVLGELYGSPAVIARSGRDTDQVAAWIREGAGETAVVPKTIRDTVFHESRLLSATQDTGVWKGIFALLMGRGARDWRTGQQFDRWTFDELGCNFHQIFPTKWCKERGIDPVLTESVLNRTPMGRRTEVVIGDTPPSRYLSRVQSKSLMGDEEFDQMLDTHLLSAEDLHSSNTTHFFASRRTNFIDMVEDAIGKAVIRDVNESDLTGGHDGPDAFGDAAEE

SEQ ID NO: 4914 - protein, 581 aa, Corynebacterium glutamicum
MTHLVSPVRRIIAATTTAVVALGLVSCSTDSSQEGANGAAEVMAEGASTSEVVDDSPYREARAENVARVVSEDFPSTPTVISDADYSGIKASELFFDSSDNVVVAGNGIAEELRAASIGVVAHAPVLHARGDNNAAVMAEIERLGASTVLLIGDALPELAEDETITKVIHDDGTEEGLAQLTALQFETKQVDTVEDLVRETASLTPEDQTLLAPAWGGVAPTPSDDKLAAFPLQSKRDGEMSPIVIASPESGISAVATARAFGAEIRFMDYPDPRFNQEQMKMVAGLADRPLLALGDQFGTGEQLAEKIKRGEEVTTELPGGGGLVFPGRRMVALYGHPSGPALGALGEQPAAEAVARATDMAAQYQEFEDQPVIPAFEVIATVASEFAGDDGNYSNEFPVEDLVGYVDAITEAGGYAVLDLQPGRANFLDQAKMYEELLKRPNVGLALDPEWKIGPDEQPMTRVGSADAAEINEVSQWLADLTAENDLPQKAFVLHQFQLEMLTNRDQINTDHLELAVVLHADGHGNAGDKYATWNMLREGLSPNYFMAWKNFYDEDFPTFTPQQTYEEVDPRPWFVSYQ

SEQ ID NO: 4915 - protein, 530 aa, Corynebacterium glutamicum
MSQNGRPVVLIADKLAQSTVDALGDAVEVRWVDGPNRPELLDAVKEADALLVRSATTVDAEVIAAAPNLKIVGRAGVGLDNVDIPAATEAGVMVANAPTSNIHSACEHAISLLLSTARQIPAADATLREGEWKRSSFNGVEIFGKTVGIVGFGHIGQLFAQRLAAFETTIVAYDPYANPARAAQLNVELVELDELMSRSDFVTIHLPKTKETAGMFDAQLLAKSKKGQIIINAARGGLVDEQALADAIESGHIRGAGFDVYSTEPCTDSPLFKLPQVVVTPHLGASTEEAQDRAGTDVADSVLKALAGEFVADAVNVSGGRVGEEVAVWMDLARKLGLLAGKLVDAAPVSIEVEARGELSSEQVDALGLSAVRGLFSGIIEESVTFVNAPRIAEERGLDISVKTNSESVTHRSVLQVKVITGSGASATVVGALTGLERVEKITRINGRGLDLRAEGLNLFLQYTDAPGALGTVGTKLGAAGINIEAAALTQAEKGDGAVLILRVESAVSEELEAEINAELGATSFQVDLD

SEQ ID NO: 4916 - protein, 109 aa, Corynebacterium glutamicum
MSRPRSSAMRGALTKVTDSSIIPENKPRTADKPSASTCSEESSPRASTSMETGAASTSLPARRPSLRARSIHTATSSPTRPPETFTASATNSPASALSTESATSVPARS

SEQ ID NO: 4917 - protein, 289 aa, Corynebacterium glutamicum
MPPATLFNVLTSAGLDPHQSGDAIVVESAHFTLTFTWDEWLRAQATWVGELSASDYVRSIVAINSAHDARATPKMMLDAPTGLTTVLKADKGQLQAFAVEALPIGDGLSEAQLAGFVAAAFDGAIDLTREFHALYPERSPQERGAMLNIKLVDASPSQTVTPVRVANWFMDQGVEEVPYDAASGRISFELGDTPVDVILDDPELLKIQAVVVADRDVEATEVLHLCNRANLDSDHSTIFMRSDGDDVDFVATVAVPIRAGLNDFQLSQALHDGVVGVVGQVRAVINQLH

SEQ ID NO: 4918 - protein, 354 aa, Corynebacterium glutamicum
MRYIALAKVTSMHQRSMSFTFIRTFFVLFGITLLVSCVPEPPDSYTKESTVLRYQVSDFNLNFVELAVALGYLNNIELQVVGSVQGGVESIESLKKDDIDFAAVPFIGLVAGEIATGAPIKAVAASYGISHDSSSALLVLKDSEIHEVHDLIGKTVGINTLGALGSAMVERHLFDAGLTEPEIVSVTQRALPGEYLEQRLYQGQVDAIWVTDSAKHQALETGDFRILAEDSDLVQELNTGCMVVSQKLIDEHPAVVGELVDGVAQAIEFERSHSPEEVREVYFNYLEAHGQSDRISSFRYWEHSGIATRGGVLSDREFSMWSHWIDRQYDVPDINPASIYTNQFNPYRKVNPSP

SEQ ID NO: 4919 - protein, 622 aa, Corynebacterium glutamicum
MVNLMSVELEEIRDFLAGFEPFAQLPAEELDQLPGKMSLRYFRRGEEIIPIGVPNHYMGVIRSGAIDVLDQEGVLLDRRDAGRSFGYSTMGPERNSRYRMVAVEDSLVLRLGRDDFDELAKRNPDLNRYYSSWSKRIRAAADQLRQESSSKVLRTKLGEFKIANPISCSPDTTIMDAAIKMDEFGVSSLLVQIDGELKGIITDRDMRSRVVAKDLDIQLPVSEVMTVDPRCATSQGLAFEAMLLMSELRIHHLPIVDDGQISGIVTAADIMRLLRHDPIYLTADLSRKNTVEELANTFQSAAEVASRFIDRGASAEEVSSLLTVAADSLARRLLVLAERKFGAPPVPYCFVVVGSQGRKEMGLASDQDNALVLDNSYNDREHGQYFAALSEFVCQGLDRAGQVLCPGDMMASNPEWRKTADQWISTFHSWITAPEPDALLHAQTFFDFRGIYGDTEMAKDVHQNAVNMARGARRMHAHLASLAARRDPPLGFFRGLVVERSGEYGATMDIKKGGTAGIVQMARLYALATGSDAIGTRERLIAASGHGQVSRKGAQDLLDAFDFLAAMAFQHQARLIKVGEKPNYHIDPKTLGKMDREHLRDAFSIIKDMQSALATKYPVRNI

SEQ ID NO: 4920 - protein, 134 aa, Corynebacterium glutamicum
MWMMAKSPASSLQLTSCACCATIRFTSLRICREKIPWRNWPTPSSRQRRWLRDLLIGELLRKKSVACSPWLRILWQEGSLCWRSGNLVHRQFRIALWWWARRAGKKWDWPLIKTMPLFWTIPTMTASMDSILQR

SEQ ID NO: 4921 - protein, 218 aa, Corynebacterium glutamicum
MLGRRKAKIRRATGALQEFYSVPRPGASTRIEDLKLLAVDVETTGLKPHRHQIVSIGWVPINGDVIDLSGAGYVVIRGSEGFSVGSSAVIHQLTDDEIAAGIDIKEALGQLLQALQGRAMLAHFSPIERDFISAACLKHFGTLLDVPLVDTFAMERRHMERMSTYPRGEDLRLARIRQRYGLPNYSNHQALTDALACAEVYLVQITHLRANTLKDIWE

SEQ ID NO: 4922 - protein, 268 aa, Corynebacterium glutamicum
MRFGRIATPDGMCFCSIEGEGDDVANLTAREIEGTPFTEPKFTGREWPLKDVRLLAPMLPSKVVAIGRNYADHVAEVFKKSAESLPPTLFLKPPTAVTGPESPIRIPSFATKVEFEGELAVVIGKPCKNVKADDWKSVVLGFTIINDVSSRDLQFADGQWARAKGIDTFGPIGPWIETDINSIDLDNLPIKARLTHDGETQLKQDSNSNQMIMKMGEIIEFITASMTLLPGDVIATGSPAGTEAMVDGDYIEIEIPGIGKLGNPVVDA

SEQ ID NO: 4923 - protein, 206 aa, Corynebacterium glutamicum
MWTPKMDHHHHDHGEKRPYDQVTPESMENQYTTTEQVWSGNPNQALIAYLGEEPAEGTALDIGCGEGADLVWLSSKGYVTTGIDFAPTAVKRAKQNAPSAEVLLVSFTEFAIESGRQFDLVSCSYGQIPANDTSVAQLENLVAPGGTLLFTHHDFESESAATPKWLSENLSEAFRVELVESFERDIKTGAGAHHHVDIVLKATKVD

SEQ ID NO: 4924 - protein, 376 aa, Corynebacterium glutamicum
MSAHRNPSAPNTAPDFLLSRGHGSVRTQGSKEVFTDPWEAVDALKQGRVAMVVGALPFERDKPAALTVPEHIIREDGPLEPHAYYRFGPGSVLHASVAGIDPSPIEHLRRVNAAINTINNTVLNKVVLARAVDISFEPPVDPLLVAARLIDNSHNKDGFIADLTPAGPDFAGHMLVGSSPEVLIKRQGSTITAYPLAGSAPRLADPVRDEAQGQNLLASAKNLEEHSYVVNHLRTILEPLCSQFDAPTVPELTKTNEMWHLATPIVGTLKYPHITALELAIRTHPTPAICGTPTDAAEALIIEAESPRNFYAGAVGWCDSTGDGEYMVAIRCAEVSEDGTWARAWAGGGIVAESDAQEEFDETTAKLQTIMRSLGL

SEQ ID NO: 4925 - protein, 496 aa, Corynebacterium glutamicum
MACMTDVRVRFCPSPTGTPHVGLVRTALFNWAYARHTGGKLVFRIEDTDAARDSEESYSAIIDSLRWLGMDWDEGVEKGGPHEPYRQSQRKDIYQDVLKQLIDAGEVYPAYSTAEEVEERHKAAGRDPKLGYDNFDRDLTEEQVAAFEAEGRKPVWRLRMPEQDWKWTDLVRGEVEFKSFTQPDFVVARSNGEPLYTLVNPVDDALMEVTHVLRGEDLLPSTPRQLALYEALKRIGVAKATPAFGHLPFVMGEGNKKLSKRDPQSSLFNHRDNGIIPEGMLNYLALLGWSLSADQDIFGVDELIANFDVADVLGNPARFDQKKLEAINADHIRLLEPKDFEARLRAYMTEYTEFPADYPAEKFAIAAELVQTRIKVLSEAWDLLKFLVTADEDLVFNEKAAKKNLKETAVEPLNAGIAALEAVEEWTTPNIEAALNKALIEDLGLKPRVAFGALRIGISGEAVSPPLFESMELLGKESTLVRLKVTREQTPFVVAE

SEQ ID NO: 4926 - protein, 71 aa, Corynebacterium glutamicum
MAIIVDIDVMLARRKMGVGELAEKIGITPANLSVLKNGRAKAIRFSTLEAICRELGCQPGDILRYDASLHN

SEQ ID NO: 4927 - protein, 172 aa, Corynebacterium glutamicum
MKRYAHPRRMSERFPMNPRILMLLRIIFGAAFLALLVLQVLLAIKIVRDGLNSGELSPIPLTILASFVIIGFGLVQFIIVCLFALLRLVEDDEIFDAHSLAWVDRIAITIAAGAVLLLPMAYIVAEVDDAPGAIVFGLILAMLITGVSLLVKIMRALLARAIGFSTELESVI

SEQ ID NO: 4928 - protein, 174 aa, Corynebacterium glutamicum
MPFPALLLPLIFWTGIAALSSWAVSRALPLRADNSIEIDAPVEKVWDFIEETNRVPEWNEHILYVQAPGEIEQGMKLKMKTRHPETNRLTLKFRPTIDVLRPHRELTWSTKIVARWLLTVTDTIELKPLEDGRTEVDQSMSFSGVLSPGVPFLASISRIKENSNRQLKALIEAE

SEQ ID NO: 4929 - protein, 114 aa, Corynebacterium glutamicum
MDASNDAPKSINSGANIPRIPVKLSDCVTFVLSPAGSSTNEWLPSISPGNATCPSQRSSRAGSAARMVGVELIDEPPSLFVNATVFPTTASPLKDVMVGCHCGKGSRSLNTSHT

SEQ ID NO: 4930 - protein, 207 aa, Corynebacterium glutamicum
MPHCLWIWGHHLRHPIKHLQILWSLKSSDFSRSPPGRLAEIIDTAWRLVETRGWANVSMRTLAAELNIKAPSLYKHVKTREDIAAHIATKAFIQLGQSLHEHCESVEDLLAEYRSMARENPNIYRLLTSSEFPRELLPEGLETWAGTPFYLVTGHDPIKGQALWAFAHGMAILEIDARFAGPNNGSPADGVWEIGARAFDTQVFDQG

SEQ ID NO: 4931 - protein, 101 aa, Corynebacterium glutamicum
MVGNTVAFTNKEGGSSISSTPTILAAEPARELRWLGHVAFPGLMDGNHSFVLEPAGESTKVTQSESFTGILGMFAPLFMDLGASFEASNKALANFVESKEQ

SEQ ID NO: 4932 - protein, 60 aa, Corynebacterium glutamicum
MKTKKQSRILFIALGLVIALPALSFGLSQLLPATTTREITIDAQPDQVWEVLSDLEPFPQ

SEQ ID NO: 4933 - protein, 110 aa, Corynebacterium glutamicum
MFYKVYNLEKRLAYGVIGNTTVSGTVILGSSPGRPAAISWKTIDRVLMPRSSSGLGRRPLTPVTRVQIPYGVLLKASTLHQLRVGCFVFANTSDITPSQDKCTGSCSRGF

SEQ ID NO: 4934 - protein, 71 aa, Corynebacterium glutamicum
MSKPDVIDELRAKLGSDTRAVKVTHYSKGAGIYHDDYMARVFGELKHHGIMWGAEGSRCFYGFITHWKKVT

SEQ ID NO: 4935 - protein, 61 aa, Corynebacterium glutamicum
MPAPPRDWWWTLIAIKLLPATGLIAGIWIPDIALAANIGVIAYFLIPAVAHIRARFLGQAF

SEQ ID NO: 4936 - protein, 106 aa, Corynebacterium glutamicum
MFALDHRVENLVLLVHFCRLLPLTVSVLTPANSAIPRIVMAAKTSSWKSCTAALRTRACVACLSRLQLESAISHPLNEHVHFSIRFETEIAHHFREDFNYMVANYS

SEQ ID NO: 4937 - protein, 384 aa, Corynebacterium glutamicum
MKHMNNSVDQQIALFGQSGSGKTALLCSFYGAARDSTQSEGQLFELSAKDDRHTKLMKMYLGMKEDSLAPPQNRFESHKTVFSLKQKNIPIKDAAKSDQVNLTWHDYPGEWFEGGAVTDSEKQDKVETFRNLLGSDVALFLVDGQKLHDYANEEERYLSYLFDGFIENLNQIKDAILEGGKQLQQFPRIWVIALSKADLWPDLQVKDFENLLNKKAGNEIIALRSKLLEFIDNDEAFSFGKDFLLLSSAKFTPGHIDISQRKGVDVLLPLACVLPMQRHLWWQELKVLPINLADILLGNEIAQMGFKIVSKVLKNKVSGTNNKAMAALVFAELVRDMVDQPTELLQKAREEAVGRREFLKAITAEFTRKLNQAEADQVLVRDFA

SEQ ID NO: 4938 - protein, 108 aa, Corynebacterium glutamicum
MTLMWATRGKDWGFRFLDDGGELDPLLIYKQAFADRELAGEFVLIRPEFTATRMFDPLGRTDHAGRIIPHDFVLRGQFAEGVTTLEDVQEIIWPLVEKRYEAIWDRSV

SEQ ID NO: 4939 - protein, 587 aa, Corynebacterium glutamicum
MTPTQNEIHPKHSYSPIRKDGLEVPETEIRLDDSPSGPNEPFRIYRTRGPETNPKQGLPRLRESWITARGDVATYQGRERLLIDDGRSAMRRGQASAEWKGQKPAPLKALPGKRVTQMAYARAGVITREMEFVALREHVDAEFVRSEVARGRAIIPNNVNHPESEPMIIGRKFLTKINANIGNSAVTSSIEEEVSKLQWATRWGADTVMDLSTGDDIHTTREWIIRNSPVPIGTVPIYQALEKVNGVAADLNWEVFRDTIIEQCEQGVDYMTIHAGVLLAYIPLTTRRVTGIVSRGGSIMAGWCLAHHRESFLYEHFDELCEIFAQYDVAFSLGDGLRPGSLADANDAAQFAELKTIGELTQRAWEYDVQVMVEGPGHVPLNMIQENNELEQKWAADAPFYTLGPLVTDIAPGYDHITSAIGAAHIAMGGTAMLCYVTPKEHLGLPNRDDVKTGVITYKLAAHAADVAKGHPGARAWDDAMSKARFEFRWNDQFALSLDPDTAIAYHDETLPAEPAKTAHFCSMCGPKFCSMRISQDIRDMFGDQIAELGMPGVGDSSSAVASSGAREGMAEKSREFIAGGAEVYRR

SEQ ID NO: 4940 - protein, 116 aa, Corynebacterium glutamicum
MTGNSPTSIAELEQWFSIPRMNTYRNSENPEGFYIWNTQLSKAYLEDIQHVEVLLRNRVDAQLRSARGPFWFEDDSYFRFAQQFKKALTTAKRRTKTNDSPGKIITAQQVTFRRRR

SEQ ID NO: 4941 - protein, 177 aa, Corynebacterium glutamicum
MPPKEDRLCTQKNAEKSDFLKEIPMGNISAKPPLPNSCGHHLPGHEPYYLQVKVLRERATWEPVTNLRMDGQFVEFDAGGEHIRGWNHDPARMEWFVKNGGLAEWSGSSPTSRLMRFESKNGHYMVSIGPKYDRNGCYGNISLGIVPTSPGLDFHEGFKQALEAFKYVEREYGTEQD

SEQ ID NO: 4942 - protein, 44 aa, Corynebacterium glutamicum
MVPRVRAPFIMNFMLEVPLASLPAVEICSETSDAGKMCSAGETL

SEQ ID NO: 4943 - protein, 312 aa, Corynebacterium glutamicum
MNSAVLDWSHAVDGLFIQSIGCALQTEAAIDLCDDFPHAPEQLLEDLLIPLLKSFGEHGVVGVCEGLGHDCPGFFPAHVMLVHEQTHKLRDSQHWVSVIELHGVELGKVAEVLVVRQVALNHGLQGSRGEEVLLANAQLLALVGGVIRVEHAADIGNALALDDGVGKALGVEGIVIEFFPRLRLPQAQSSHVVSAIAGDRHVIRNSAGFHIVKAHNQLVGCTTNGKRIFLFAPWVWLFYLEALVKGLTEKTEAVEQTITSNGVVLGNSRIQEASGEAAQATIAQCCVIFDFQDVGDLMAQLTGSSCSLINQT

SEQ ID NO: 4944 - protein, 809 aa, Corynebacterium glutamicum
MGFIFRHFPLNSSAMTENQPLPADLVGSHVRAAAGTPADLATDRKFWTGLSRAVQERIADDWERTREAYGAARQQHYFSAEFLMGRALLNNLTNLGLVDEAAAATRELGHEITDILEIENDAALGNGGLGRLAACFLDSAVTQDYPVTGYGLLYRFGLFRQSFNEGFQVEKPDPWREEEYPFTIRRASNQLVVCFDDMKTRAIPYDMPITGYGTHNVGTLRLWKAEPWEEFDYDAFNSQRFTDAIIERERVSDICRVLYPNDTTYEGKKLRVRQQYFFTSASLQAMIQGHLAHHKDLSNFAEFHSVQLNDTHPVLAIPELMRLLMDEHDMGWEESWAIVSKTFAYTNHTVLTEALEQWDQQIFQQLFWRVWEIITEIDRRFRLERAADGLDEETIDRMAPIQHGTVHMAWIACYAAYSINGVAALHTEIIKAETLADWYALWPEKFNNKTNGVTPRRWLRMINPGLSDLLTRLSGSDDWVTDLDELKKLRSYADDKSVLEELRAIKAANKQDFAEWILERQGIEIDPESIFDVQIKRLHEYKRQLMNALYVLDLYFRIKEDGLTDIPARTVIFGAKAAPGYVRAKAIIKLINSIADLVNNDPEVSPLLKVVFVENYNVSPAEHILPASDVSEQISTAGKEASGTSNMKFMMNGALTLGTMDGANVEIVDSVGEENAYIFGARVEELPALRESYEPYELYETVPGLKRALDALDNGTLNDNNSGLFYDLKHSLIHGYGKDASDTYYVLGDFADYRETRDRMAADYASDPLGWARMAWINICESGRFSSDRTIRDYATEIWKLEPTPAVKK

SEQ ID NO: 4945 - protein, 61 aa, Corynebacterium glutamicum
MPGPQGRAFQGLPFQAFRLSMPDMANPSGGWPFFAFRRKPTAAGKSFSSKSAVFLAIGSNY

SEQ ID NO: 4946 - protein, 52 aa, Corynebacterium glutamicum
MCRAVTCKKCGKTTWAGCGQHVDQVMKNVPSSQRCQGHKAEPSKGFLSKLFG

SEQ ID NO: 4947 - protein, 469 aa, Corynebacterium glutamicum
MLFERIYEEGLAQASYFIGCQREGKAIVVDARRDIQTYLDLAAKNNMVISAVTETHIHADYLSGTRELAAATGAEIFLSGEGGADWQYGFTGTTLMHNSTIKLGNITITAKHTPGHTPEHLSFLITDGAVSKDPGFMLSGDFVFVGDVGRPDLLDEAAGGVDTRFAGAQQLFHSLKEQFLALPDHIQVYPGHGAGSPCGKALGAIPSTTVGYEKANAWWAPYLRSDDEAGFVEELLDGQPDAHAYFARMKKQNKQGPAVLSTLSPLVKLEAEEVVEKLGSEAVFVDTREQNQVHLGTVVGALNIPRGAKASNFAAWVIDPQKDAQDLIVLAPDANTAADFRDALLRVGIDTVRYFTNSIDGLPTFVPELISPAELAETNYDALIDIRAKSEFAAGSIPGAQQLSGGSAMWRLNELPAGGTLVTFCQSGARNTVVANALRRAGFTVIELEGSYAAWEKSAANPKNLQTAV

SEQ ID NO: 4948 - protein, 250 aa, Corynebacterium glutamicum
MILALLGGLIIGLLLGMLGGGGAILAIPLLIYGFSFSATQATAASLIIIGLGALIGLISQYAAGHVRLKEGLSFGLLGLVGSFVGSHLASNIPDSLLLSGFAILTLVVALTMISKLRSTREYITRRPSILAIALSATGVGFLTGFFGVGGGFAIVPALIFALGFSMRQASATSLVVIAVNSAIAMGFRYSDLASIDWSVISPIIITTVLGAFSGVKLAKKVKASSLQLGFAGFLIFISIYMGFQNFPDLF

SEQ ID NO: 4949 - protein, 159 aa, Corynebacterium glutamicum
MLKFQSRALILTVSMLATLSGCSQESDPIQSPITITTTATTMLTTTVTTSAPNPVPPDAQLGDSVDLEVSRATVCIYGDGYGTTTWLAGTDTSCEFVGAVHQKLVTGVNATTEDIRDFLPMDINVTSPVTGQEYQMSCTNESAKVSACRSNTNASVYFY

SEQ ID NO: 4950 - protein, 188 aa, Corynebacterium glutamicum
MNTLSPRLRKAMNTAAWAHRHHVRKGGGIPYVSHLYSVMYLLASVTNDEDVLIAGLLHDTLEDVPEEYNSAQLEADFGPRVRELVEELTKQPLKSWKARADAYLLHLSAGASLEAVLISTADKLHNLMSILDDLEIHGEDLWQRFNAGKEQQIWWYSEVYQISLQRLGFNELNKQLGLCVEKLLKQSA

SEQ ID NO: 4951 - protein, 235 aa, Corynebacterium glutamicum
MGQQEIIEDSTESGIKVLDRTVLILNVIAEQPRSLAELAAATDLPRATAHRLASALEVHGMLARSRDNRWTIGARLASLGARGADTLIDTAVPIMADLMERTGESVQLYRLTGTTRTCVASQEPSSGLKNVVPVGTRMPLNAGSAARVFAAYLPIPSASVFSREELDQVRASGLAESVGERELGLASLSSPVFDSNGSMIAALSISGVAERLKPHPAAMWGTELIDAAERLGALL

SEQ ID NO: 4952 - protein, 481 aa, Corynebacterium glutamicum
MTSPVENSTSTEKLTLAEKVWRDHVVSKGENGEPDLLYIDLQLLHEVTSPQAFDGLRMTGRKLRHPELHLATEDHNVPTEGIKTGSLLEINDKISRLQVSTLRDNCEEFGVRLHPMGDVRQGIVHTVGPQLGATQPGMTIVCGDSHTSTHGAFGSMAFGIGTSEVEHVMATQTLPLKPFKTMAIEVTGELQPGVSSKDLILAIIAKIGTGGGQGYVLEYRGEAIRKMSMDARMTMCNMSIEAGARAGMIAPDQTTFDYVEGREMAPKGADWDEAVAYWKTLPTDEGATFDKVVEIDGSALTPFITWGTNPGQGLPLGESVPSPEDFTNDNDKAAAEKALQYMDLVPGTPLRDIKIDTVFLGSCTNARIEDLQIAADILKGHKIADGMRMMVVPSSTWIKQEAEALGLDKIFTDAGAEWRTAGCSMCLGMNPDQLKPGERSASTSNRNFEGRQGPGGRTHLVSPAVAAATAIRGTLSSPADI

SEQ ID NO: 4953 - protein, 197 aa, Corynebacterium glutamicum
MEKFTTYTGVGVPLQRSNVDTDQIIPAVYLKRVTRTGFEDGLFSNWRQNDPNFVLNTDTYKNGSVLVAGPDFGTGSSREHAVWALMDYGFRAVFSSRFADIFRGNSGKAGMLTGIMEQSDIELLWKLMEQTPGLELTVNLEKQIVTAGDVVISFEVDPYIRWRLMEGLDDAGLTLRKLDEIEDYEAKRPAFKPRTNA

SEQ ID NO: 4954 - protein, 106 aa, Corynebacterium glutamicum
MASGYGLGFEPVRGLEPILEGHFSCVLGNGFGLLGAERHIKPRVLAYRGPLVWICTSQASKRTKKTKTLRESRASWSIPDMPTPLAHQDAQKHPATEDHGVLSLSD

SEQ ID NO: 4955 - protein, 318 aa, Corynebacterium glutamicum
MLINGRLQQIPARPTEEFTRPTLAAGAVLWRGDITNPDSIEVAVIHRPHYDDWSLAKGKVDPGESIPTTAAREILEETGYDIRLGKLIGKVTYPVLDRTKVVYYWTAQVLGGEFVPNDEVDEIRWLSVDEACELLSYQVDTEVLAKAAKRFRTPSTTRVLYVRHAHAHGRQTWGGDDNKRPLDKKGRRQAEMLVPMLLPFKPTAIYSAVPDRCQATALPLADELGLDVSVNRLFGDDAWETDPEACKKRFTDVVAQGGVPMIVGQGDIIPEMIKWFSENGTLPIDEKIKAKKGSVWVLSFHDGVFTGADYLASSLPVK

SEQ ID NO: 4956 - protein, 52 aa, Corynebacterium glutamicum
MKNYFHLLFTSDPLIAHSGLGVWRHFWMIPGKFWAAAAGFQEVSMRVAWDMG

SEQ ID NO: 4957 - protein, 332 aa, Corynebacterium glutamicum
MVSVSVMGAGSWGTTLAKVFSDAGNAVTLWARREELASTIRDSHENRDYLPGITLPESLQVTSSATEALEGAAIVVLAIPSQALRGNLAEWKETIPQDATLVSLAKGIEKGTHLRMSEVIAEVTEADPSRIAVLSGPNLAREIAEGQPAATVIACPDENRAKLVQAAVAAPYFRPYTNTDVVGTEIGGACKNVIALACGISHGYGLGENTNASLITRGLAEIARLGATLGADAKTFSGLAGMGDLVATCSSPLSRNRSFGERLGQGESLEKAREATNGQVAEGVISSQSIFDLATKLGVEMPITQAVYGVCHRDMKVTDMIVALMGRSKKAE

SEQ ID NO: 4958 - protein, 360 aa, Corynebacterium glutamicum
MSNSNSGKVRVAVVYGGRSSEHSVSCVSAGAIMAHLDPEKYDVIPVGITVDGAWVVGETDPQKLTLIDRTMPEVEHHEEVRPSLDPAHRGEFHFSDGSLYATADVIFPVLHGRFGEDGTVQGLFALSDIPVVGPGVLASAAGMDKEYTKKLMAAEGLPVGREVILRDRTELTEAEKNLLGLPVFVKPARGGSSIGISRVTAWEDFNKAVGLARAHDEKVIVESEIVGSEVECGVLQYPDGRIVASVPALLSGTESGAGGFYDFDTKYLDNVVTAEIPAPLDEKTTELIQSLAVESFQALACEGLARVDFFVTANGPVLNEINTMPGFTPISMYPQMFTASGVAYEELLDVLVQQALHRDN

SEQ ID NO: 4959 - protein, 326 aa, Corynebacterium glutamicum
MSAVNSAGRPANGGINKTPMIIALVLSIVLVLAVLFGARVLLGPAGQQQIAMSGLPAPDAESAECAALLEDLPGEAFGHTRAEIMDPVPPGAAAWSTSDLERVTLRCGVDMPFQYTALANTVDVDGTTWLPVSDMTPGSSLETWYSVNRFPVVAITADDISTDSADNPVAPFSSAVDKLEKRDGQPFDAPLTGLSSAGTTCTSLFDALPRQLEVGGDDGTTYERIEEDRMQAAGYSDDAVAWDTPGLEPIVIRCGVEPSENYAAGAMLQQIDDIPWFEDTILASGTTSSTWYALGREIDIAVSLPQAASSSLITISGFIEDTVPAE

SEQ ID NO: 4960 - protein, 331 aa, Corynebacterium glutamicum
MTLAHSLSFPDSLRDGPTVGDLGEFEVIRVITEQAGSSLNGDDAAVLRHASPNSRAVVTTDMLVAGRHFQLDWSTPEQIGQKAIVQNFADIEAMGARPVAALLAISAPTHTPVEFVRGLARGMNQRLEEYSAELVGGDITSGDSLVIAVTAIGQLGGSLPELTLGRARPGQTLVAHGKIGYSAAGLALLQHFGPDNVPEHLRPLVDAHCAPVLTPGRGMVARAAGATAMTDNSDGLIVDLNQMAMKSGVRIDVDSSSISPDELLSEAASVLGTDAWRWILSGGEDHTLLSTTFGDAPSGFRTIGQVTKTRHEDLVTVDKKTPAFSDGWRSF

SEQ ID NO: 4961 - protein, 254 aa, Corynebacterium glutamicum
MEKLLMTNTLWNSVDELPIHDSWKPVLKPVEDAIRKLGVFLAEEEFLPPVDDVFRAFSYPFDAVKVLIMGQDPYPTPGHAMGLSFSTQPDVRPLPRSLNNIFKELVSDVGSLGDSASEQGALDLGINAPGSVAGTQVALPADGDLRAWSNQGVALFNRVLTVHPGQAGSHKGKGWEAVTEQAIKALAERDQPLVAILWGKQAQEVQKFLGDTPCICSVHPSPLSASRGFFGSKPFSRANEILSSLGATEIDWSL

SEQ ID NO: 4962 - protein, 527 aa, Corynebacterium glutamicum
MDAAGVLEWARTAVEQLSERRAEINALNVFPVPDADTGSNMTYTMTAALDEALKLGELGDVARITEALAVGSVRGARGNSGVVLSQVLRAIAQAAADGVIDGHTIQEALSIARSLVDRAITDPVEGTVVTVLRSAAIEVEHLVEAGHAALPDVVNAAVKAARTALARTPSQLAVLREAGVVDAGGQGLVILLESLAEQINGNPPHHPSHHSEPAEEPSFHGKTGDLEVMFYIACDSAQTLDALHNELETLGDSLLIARETNTRGTVHIHSRRAGEVIQKAFAAGDVSELRLEILPDTSGSFTEEPRRVLMAVAPDGLVAELYRSAGVKVVARNIAQSKSDDVVAKIVSIARKSGADEVILLPNGLLTKRELVSIERSSHAFEQSVVILPTATLVAGLAAVSVHEPAQPLAVDSYAMAEAAGSMRTATIRAATSAALTQAGACSKGDLLSFIGPEIALVSEELNDALSRTALRLLDGSSEQITLLIAQDRQSAFDEDVFRRGLGTHTDVEITVYPATGMENLVEIGVE

SEQ ID NO: 4963 - protein, 707 aa, Corynebacterium glutamicum
MLGWHDERLLKDILPAKEATAIKKALGYTTAEELLRHHVRKYSHHGSGVGIGDATEGDLVTIVGQVAFAKQSYTQSGKMLYKVTVLTETERIGISFFGAKHIPRLLPEGTRALFTGKVKFFRNEPQLSHPEFIVIPDPGSGRRLTATGGMKSLAAYGDVEEVALRLVDREYIPIYAGTATMTTWRIMAAVQRVLETMPVIKEPLSVVPEGMPSFDEAIRGIHDPGHESPSTFINRLKYNEALSLATVMAIRRADTKNRKAPPMPRALKGHQHMLIDALNFQLTVGQKQVIREISADIEQRVPMSRLLQGEVGSGKTIVSLIAMLQAIDSGRQCAMLAPTEVLATQHARSLSKTLDDAGLDINVVLLTGSMPTGAKKEALLEIISGDADIVVGTHALIQDTVEFFDLGLVVVDEQHRFGVEQRDQLRTKGREGLTPHLLVMTATPIPRTIAMTVFGDLAVSTLRELPGGRRPIQTSVIPDHKPGWVKRGWERIGEEVLAGRQAYVVCPRIEGEGGVLEIHAYLSEQVYPGLNVGMLHGRMDTDLKDSVMQEFAQGEIDILVATTVIEVGIDVANATVMLIREAERFGVSQIHQLRGRVGRGQHDSLCLLHTTFDEDSPQGQRLAAISTTTDGFQLSELDLQVRQEGDVLGTRQSGSDTKLRHLSFISDQKIIERALIDATELVAASRSRALELVSDIAMINQEYLEKS

SEQ ID NO: 4964 - protein, 108 aa, Corynebacterium glutamicum
MSASPEMISSRASFLAPVGIEPVKSTTLISRPASSRVLLRLRACWVANTSVGASMAHCLPESIACSIAINDTMVLPEPTSPWSRRDMGTRCSMSALISRITCFCPTVS

SEQ ID NO: 4965 - protein, 71 aa, Corynebacterium glutamicum
MKIYAPFAGIVHYFVDEGDPVETGMQLGTVETIKLEAPIMAPGPGIVAKVSFDDFSDVTGGDELLELEAKN

SEQ ID NO: 4966 - protein, 194 aa, Corynebacterium glutamicum
MGQTRIISGDARGRKIEVPPAGTRPTSDRAREGLFSSLQVRFGFEGQRVLDIFAGSGALGLEAASRGADEVVLVESNPKAVEVIRRNVDVVKHPRVTVAEMKASTYLASAPDKFFTMVLADPPYELADDAVTEMLTALTPKLLDGAAVVVERHVDSPETAWPAWLVPTTQKLKKRTYGIARMDMAVFDESLLQE

SEQ ID NO: 4967 - protein, 160 aa, Corynebacterium glutamicum
MKAVCPGSFDPITLGHLDIVTRAAAQFSEVTILVTANPNKNSGLFTVAERMDLIRESTAHLDNVKVDTWASLLVDYTTEHGIGALVKGLRSSLDYEYELPMAQMNRRLTGVDTFFLLTDEKYGYVSSTLCKEVARFGGDVSGLLPEVVAKAVTEKYSNQH

SEQ ID NO: 4968 - protein, 360 aa, Corynebacterium glutamicum
MFGGSGFNDNSIGHEHDLVGDFVGEAHFVGDNKHGHAVVGELFHHSQDFTDEFRVQSAGGFVEKHELWLHGDGAGNCNALLLTTRQLDGVGVRLVGEADLLKQLHGTCAGLAFGLLLHVDGSFDDVLDHRAVGEEVEVLEHHADIGALLGGVLLRDFVQHAIALAVANEIAIDIQATRVDLFQVVNAAQHGGFTGTRRTDQAGDGTFRNLQVNALEHFQASVVFADLLSINHQLRHLLVLLGSFRNNGDIARDCAFSISQRSELTCGQGAGAALFEVLLQVVLTNHKNRGDDQVPARSNQKHWNWLEEGVRNIHAAAVQLERIRNRNNQRGGLEHGDQFIAGWRNDDAHGLRQDGATHGH

SEQ ID NO: 4969 - protein, 68 aa, Corynebacterium glutamicum
MNTTWSATSWAKPISWVTTSMVMPSSASCFITRRTSPTSSGSKALVGSSKSMSFGSMATARAIATRCC

SEQ ID NO: 4970 - protein, 250 aa, Corynebacterium glutamicum
MIDAQQVCKNYGRLEVLKGIDLQVPKGTVTCLIGPSGSGKSTMLRCVNHLEKVNAGRLYVDGDLIGYRERDGVLYEISEKDAAKQRSDIGMVFQNFNLFPHRTVIENIIEAPIHVKKQPESKARARAMELLEQVGLAHKADAYPVQLSGGQQQRVAIARAVAMEPKLMLFDEPTSALDPELVGEVLRVMKQLADDGMTMLVVTHEMGFAHEVADQVVFMADGVVVEAGTPEQVLDNPKEQRTKDFLSSLL

SEQ ID NO: 4971 - protein, 281 aa, Corynebacterium glutamicum
MALLAWFIISALNNEAYGWDTYRSYLFDTRIATAALHTIALTLLSMILGVVLGAILAVMRMSGNPVMQGVAWLYLWIFRGTPIYVQLVFWGLLGSLYQSINLGFAEIDLQSLLSNMFLLAVIGLGLNEAAYMAEIVRSGIQAVPEGQMEASKALGMNWSMTMRRTILPQAMRIIIPPTGNELISMLKTTSLVVAIPYSLELYGRSMDIAYSLFEPVPMLLVAASWYLVITSILMVGQYYLEKHFEKGSTRTLTARQLAALADAEGAIPGNVTVVPETSKEN

SEQ ID NO: 4972 - protein, 287 aa, Corynebacterium glutamicum
MATSFTLASCVTNEEQGNPDGWEQIVPDPVPEIQAMVPEALAQRGVLTAGANPPFPPFEFKDSDGQIIGVEMDLVRAMAGVMGLEFSPQEQDFSLILPSVQAGTLDIGASGFTDNEERRENFDFIDFLFAGVQWAQATDRETPIDPENACGLTVAVQRTTVAETDDVRPRSAQCEAEGKEPITILSYETADTAATALILGRADALAADSPVSAWAAERSEGRIEVVGDMYLAAPFGFAFPLESDLTPAAAAAFQHLIDTGDYQRIMAQWGIEEGLLDEALINEQPLN

SEQ ID NO: 4973 - protein, 269 aa, Corynebacterium glutamicum
MSSQQTIFIILLFAAVILISIVMITAAFKTRKKRFAARAEGMANPTIPAPTVPWQRFAGALAALYARPEWHKTRGAKRVYSAEQTYFGFVSAMPLGMVQNMLQTDWGVKKSEHAVDQLSKGVEVIVGVAAGNWRKNGVSPAQVEEAGQRLAAEGLAHPHFVVFQKQLQQADPNAEYDLDVLAFDIARVANLLRWAAYTDLLLPAEARWFQDQLGIAAAVSFGSWEEYGERYVRGLQKNFKGGNKPYIEGERWLNTEAESPWKTQKWISA

SEQ ID NO: 4974 - protein, 326 aa, Corynebacterium glutamicum
MSATNPDALDVQHVYPIKTKKTPLAVIFNIISGGLIGMAELVPGISGGTVALVLGIYERALHNGDLLIDLIKVLIKDRSKVKEAAAKIDWWFLGAIGVGMVVMVFSMSSILHTVVEDYPEITRGLFLGMVAVSILVPLGMMDMRDAKKRLAIVIPLFIICAMLGFFGTSFTSAPRTDPSLIFVFICAAIAVCALVLPGVSGSFFLLAVGMYAPIMESLSNRDLSVIGVFLLGALTGVILFVKVLSYVLEHHRTITLTIMAGLMLGSLRALWPWQDGDANLLAPGDNAVMIFSIIILGGAIVAALMFAERVSSKNIDSETVAEEHPR

SEQ ID NO: 4975 - protein, 136 aa, Corynebacterium glutamicum
MRKGHYDRYRNEGWGYLKNYCKHNFANHAMAEAVVDKAVIDYGSSPGTSYYKFEKTVYFLDCRTYTFNKNSGCKEMHAPQWVTIIYNPHTFTGANSNRPKGVISAWCNSTPPGGIEHEPEISQCPDHVNLYNKLRI

SEQ ID NO: 4976 - protein, 252 aa, Corynebacterium glutamicum
MPFSHDKSELGGETPYGLVHVNPMAEVRPVKAQTNEPQALQVADIQPFHAVIAASKQLTLIDVVDVCLGTVLRAWEALSLRWVDVVLDEEHPRIFIRGTIVYNKEKGNHRQDKTKTTSSRRVIQLPEIASDVLRKRHALYAEHLEMVFPSARGTYIYESNFNKLLRKHRKGTAYDWVTVHSIRKTLASIVSENLDSKAASDVLGHADSRLTERVYIAKTDKDVPIGDVVNQALKEARKVSKKSPNKEAKEEE

SEQ ID NO: 4977 - protein, 248 aa, Corynebacterium glutamicum
MTEPHQLCIYTKGHKTSGFRFIGPSLSLDFLLINIMGKWNAFSRVTKRDGSSLPFPGNVFTNQRIVGAVRQCLFQAIVAEKWSLFSSNIRSLVADLPDVLTVSELQEWLEFFVQHTGIGVKVGRALIVDPDQEWTQLAGRCELVGYCALSPGWPSPISSVFEKTDLELWESALATSWMMLGPFIAERYTYQMPVEEFYWRHDAELRWWESFVNGCFDDLTSLQKLLSLLLAKHYLSRDYLMVRVFTID

SEQ ID NO: 4978 - protein, 144 aa, Corynebacterium glutamicum
MGFSALELWSTELGITVSVTPEPQNSDYESGLAQVEGHEWHVRTARNTPSKPGAFVAFWQRGVGGQTQPFSDDGMNAGLLVFVRNDVRRGVFRFSAGHLAELGITAADGQPGKRGFRVYPSWCEGLNSQARATQRAQSSAFEEY

SEQ ID NO: 4979 - protein, 169 aa, Corynebacterium glutamicum
MKSGLCSARCFLLYKPQIAHRQNRPKFTNDVSSSCRKTSRVTTSSPPSTGGEHDVISILLECARLCSLRGPRLRIEPFAPGGVNAKSTFARLSVCCGNPQFCKMTSGKPKHSAPNIVPHKDKKTGIHPVVTKRLGLSSYASLPKGNKGTRLRRRVPCSPDMPLMAFNLC

SEQ ID NO: 4980 - protein, 288 aa, Corynebacterium glutamicum
MNKADEIFLCEGDIFAPLIAGLSSVNSAIRSAAVHHAFRSMDRAAATGTTYGASIVQSLCDIVVTHMYVESDSQVSIDSGVVSALTIDGKEVSLDLPNKELESLGLDEYSTSPSGASIAVTNEGGGAFRSLIHIPNLESNGEFEFSFSNDMTLSSLPDGGVTVRDNKGDILGTLDAPWAIDATGASVKTWYEIRQSTIVQHVAPTSSTQFPVVADPFWIPFLGIMGGHLTRHALTQMAKRKITKELVEHVIKTGRGSKGNGNTTVFNGNGIRVIVDNVSGNVITVTKG

SEQ ID NO: 4981 - protein, 73 aa, Corynebacterium glutamicum
MNFEYDPEADAAYLTLTQSGVLPEQQISAITTEGMEGEIEIDVDENGKVIGIEFVNASLILPSDFLKKSNRIS

SEQ ID NO: 4982 - protein, 64 aa, Corynebacterium glutamicum
MGTYQLALSIQHIKPRTGLNQRRALNVLLLVPRSIRCPDALRWCTRYNTVRRHSWCKYLAPAVF

SEQ ID NO: 4983 - protein, 285 aa, Corynebacterium glutamicum
MKYEFNNRFRTKSVLASVLKQSNRVSGHLHDQELFLLNRVSRIAGASAITLCIGLTTILSPTSTAQSLEQITPLPESAIDLNAEIHVNTSDISAEQILGAQDEITTMYDSHDPYEYFDTLTDIEQRSIIAALKRDPSSLQQRQETRLAAQSDPYKIYISGLEMLSCINLVDVVSCGIANQAATKANNEAVARYPGDSLRNGKGDAFRHCSWNALMTIRIGSNGAERIATNHETIGDGPADENAMDLFNNAQGRQIGAGFINSKDETSALAICALWTNLGRLKTLK

SEQ ID NO: 4984 - protein, 37 aa, Corynebacterium glutamicum
MRQSLGSIGTSADNALAESFNAALRREVLQDSKTFAN

SEQ ID NO: 4985 - protein, 123 aa, Corynebacterium glutamicum
MRKTYVFLTQFIVENGNESNAYSRYRERVQNLLALDGVDVISVSKNLQQAEKAYGWESLSDQYQMEHNGKYPENHILCDVYTVVILNDIEKFEEAAELLIMDDRDVSVDAFPSRVDAFEQVLF

SEQ ID NO: 4986 - protein, 105 aa, Corynebacterium glutamicum
MECDMRKLASIGIAIALSLAITPTIQANEIIAPQAMDRIAVKCNVHKIWSVPSLNNYDGWVVVGHAYSKVEAEKRANTFVPFGHTKRHCLPVPIDRFPFEGLNRS

SEQ ID NO: 4987 - protein, 107 aa, Corynebacterium glutamicum
MIFPTSQPDAWQKKAFEFIEQRNLSRSNFTRGAADSTSYWWSYSTPSGHHLAAGSRRLGSGLPIDWQQWRWDSPEPPSAAPWDDERWIPYDGNISTSNWTIEPFPFD

SEQ ID NO: 4988 - protein, 125 aa, Corynebacterium glutamicum
MKYFALNRDNLIGPAVEILAPLGWASYGLWHRRGTEQIVELARRGTDSAEIDALVTQQWNNTSESFLHHVAIPLRRYGRGIDYSFQRLQFQRGNLIDQAVKCHENGNYAAAILLTFPKSMGLPEI

SEQ ID NO: 4989 - protein, 316 aa, Corynebacterium glutamicum
MCSRFFSFVGALLIGLMPFTIPVHAQEITKEQDSGGKWPNTISEYRELQQNPEAYPPFNLSNINLEATSTHPVVDNRIAALWQFDPEAEDTKKVVRSCTANHIEGKFWITARHCVTSEKDFLGYLEQSDGEVAGVENTYTISEHHDLALIKVGRGISAQTFDLPEEKIAIGKVLTLIGYGGSNDFSSIARVESVAHLDKFNVGFSTYYLDVLETVSLTDSRSCNGDSGGAVFAGNTIHAVHTAGAINFDCSPGEGKKMWHSAISPHTAWIHQIMSSENSTSVEEEQRAFEGFRSRYRIAEDQPSATFSSSLSPLSS

SEQ ID NO: 4990 - protein, 102 aa, Corynebacterium glutamicum
MGIVIMLAVAVVLFFGVQLLARGNKQTLNVKAYTALAVTTIIVLSVVIFSGALQSDSIGITGSLIALVILTILMQPVFVQLQRKIEAQREKTKDELSPPQNG

SEQ ID NO: 4991 - protein, 188 aa, Corynebacterium glutamicum
MKFFGFYRPIALIAGITVSASILTSVATAAESPTSFQAITPAFSSSSAPEADAEANTSEATADLLYVAENQLLIKLSNAVVEDVNGEILMKDNKGTLLENLTAELQAQPGFSIEKVDSHTALLTMNPDEVPDLQDWRCGVGALSGGVAGVVATGLALAALGVATGGTGFAVLAAGGLAGYGTGAVANC

SEQ ID NO: 4992 - protein, 74 aa, Corynebacterium glutamicum
MLKMDGLFTPFSDASLNNTVKTDGDSVPGQDLPITKISEDRFERSAYAAQLAKITCDVASQGEYTVFGLTGQWC

SEQ ID NO: 4993 - protein, 97 aa, Corynebacterium glutamicum
MLWVLTGILLAMVSTALRIRFGSGVAIAATVLWTVISITLGGDVLAETMLWLVAVPSWPETADTTTRFLIAMLLQAVLITGSTIWAIREIRDSERRG

SEQ ID NO: 4994 - protein, 905 aa, Corynebacterium glutamicum
MGECVANFSTRLHSGGVTEKTDQTLMLIDGHSMAFRAFFALPAENFSTSGGQATNAVYGFLSMLSTLLKDEQPTHVAVAFDVGRKTFRTDMFPAYKAQREATPPEFKGQVEILKEVLSTLGITTIEKIDFEADDVIATLSVAAKPLGFKTLIVTGDRDSFQLVNDTTTVLYPMKGVSVLHRFTPEAVEEKYGLTPRQYPEFAALRGDPSDNLPNIPGVGEKTATKWIAQYETLDNLLDHADEIKGKVGASLRERIEQVRMNRKLTEMVKDLELPLGPDDFEMKPVQVAEVAAKFDDLEFGTNLRERVLAVVKAEGSAAPVEEVEAEQVVVDTQSLAQWLPARAGQALALALAGVAKPAAGDTYALAIADTKRHAVLVDVADISAEDEKALATWLASEDPKMLHGAKAAYHMLAGRGFELHGVVHDTAIAAYLLRPGQRTYELADVYQRHLQRQLSTNDNGGQLTLLDAADDQSLVDDVIAILELSEELTKQLQEIQAFELYHDLEIPLSGILARMEAIGIAVDVATLEEQLKTFIGQVAQEEEAARELAEDPTLNLSSPKQLQVVLFETFGMPKTKKTKTGYSTAAAEIEALAIKNPHPFLDHLLAHRQYQKMKTTLEGLIREVAPDGRIHTTFNQTVASTGRLSSTDPNLQNIPVRTEAGRKIRSGFVVGEGYETLLTADYSQIEMRVMAHLSQDPGLIEAYREGEDLHNYVGSKVFNVPIDGVTPELRRQVKAMSYGLVYGLSAFGLSQQLSIPAGEAKQIMESYFERFGGVQRYLREIVEEARKAGYTETLFGRRRYLPELTSDNRVARENAERAALNAPIQGTAADIIKVAMIRVDRSLKEAAVKSRVLLQVHDELVVEVAAGELEQVREILEREMDNAIKLSVPLEVSAGDGVNWDAAAH

SEQ ID NO: 4995 - protein, 474 aa, Corynebacterium glutamicum
MLPSKISHMILSIVLLGYFMILLDTSIVITGLPAIGSELGIDPVHLSWVQSSYTLVFGALLLLGARAGDIFGRKKVLYIGLALFAASSLAIALSPNAAVLIGARVVQGAGAAIIAPATLALITEFFPEGPARLRATSAYGAVAGIGVAAGLVIGGVFADLLSWRIGFFINVPIAAVLAYIVHKAIPATFSRPGSLDIFGAITSTAGIAAVLYAIVRSADYSWTDPFVLISLVLGIAVFIWFLRHESSAKEPLLPLGLFKNRRRNTILASRFLLVGSVMSFFFFATQLFQDTMGMNALQAGLAFMPLSLLQFASAAMVPRLSRAGVSDSMLTVIGFAIMVIGMAGLAFVPNTMIALILPIVLVGFGQGFAFGPMTALAVQGAPKDQSGAVSGLVNSLHQIGGTFGLGVFSSLAVAVIGHDATSEMISDRAHFGFLLSTVTLTLATIFAVTLLKRHETRKSSERPTQLVDEKAVTS

SEQ ID NO: 4996 - protein, 303 aa, Corynebacterium glutamicum
MDVHADTREFLTARRNRLTPKDAGLPIYQGKRRVPGLRREEVAMLAGVSVDYYTRLERGNLSGVSEQVLSALATALQLDDAETQHLFDLAKLSNSPASRRKRTPAPKSVLRPEVLRILNSMHDIPAYIRSESRDLLAANTFGRALYAPLYESTVSDGISGEPGSINVARFTFLDPAAREFFPEWERTSADLVASLRTVAAQRPNDTLFSNLIGELVTKSEVFAQMWADHNVRMHRTGSKKIVHPLVGEMELDFETLDLPADPDIALVVYSAAEGSTSAMNLQLLANWTGNDSPSLSTELGDTI

SEQ ID NO: 4997 - protein, 291 aa, Corynebacterium glutamicum
MTFTLNNGLAIPDIGFGVFQTPPDETRNSVNAALEAGYRHIDTAAAYGNEREVGEAIAASGIGRDEITIETKIWVTDYGFEETLHAFDKATGKLGVDTLDILILHQAVPSSFDRTIAAYKALEKLLFDGAVRAIGVSNFMPEHLDKLLLETSIVPALNQIECHPYFQQRDVLARNEQLGILTQAWSPIGGITFYRDGQLPSTLENEVIAGIAAEVGKTPAQVMLRWHLQRRRHAIPKSVTPSRIVENFEIFDFELSDEQLQQIDALNTDLRGGPEPENITMENYYREIPEA

SEQ ID NO: 4998 - protein, 53 aa, Corynebacterium glutamicum
MVSNARFWCSKLSNQTKRSPNFRAFGLWMDRPNQVTNEVEIERSLAIWSGFDD

SEQ ID NO: 4999 - protein, 218 aa, Corynebacterium glutamicum
MLHEKDVRLLGTPAALSGKKILEIGCGSAPCARWLANDVPNAFVTAFDISSQMLKYAGHDHNVHLVQADAMSLPYADSSFDVVFSVFGAIPFVEDSAALMKEIARVLKPGGRLIFSITHPMRWIFLDDPGPAGLTAITSYFDQRGYVEEDEETGALSYAEQHRTMGARINELIDASLHLDHLIEPEWPDELEENWGQWSPLRGKLFPGTAIFLATYRP

SEQ ID NO: 5000 - protein, 486 aa, Corynebacterium glutamicum
MPTNNAPQVAINDIGSAEDFLAAIDATIKYFNDGDIVEGTVVKVDRDEVLLDIGYKTEGVIPSRELSIKHDVDPDEVVEVGDQIDALVLTKEDKEGRLILSKKRAQYERAWGAIEELKEKDEPVTGTVIEVVKGGLIIDIGLRGFLPASLVEMRRVRDLDPYIGQELEAKIIELDKNRNNVVLSRRAFLEQTQSEVRSEFLHQLQKGQVRKGVVSSIVNFGAFVDLGGVDGLVHVSELSWKHIDHPSEVVTVGDEVTVEVLEVDLDRERVSLSLKATQEDPWRVFARTHAVGQIVPGKVTKLVPFGAFVRVEEGIEGLVHISELAQRHVEVPDQVVAVGEEVMVKVIDIDLERRRISLSLKQADEDYTEEFDPSKYGMADSYDEQGNYIFPEGFDAETNEWLEGFDEQRQAWEARYAESERRFTAHTAQIERRRQQAEEAAAEAPAGNYSTDSAEDAPAAEAVEESAGSLASDEQLAALREKLAGN

SEQ ID NO: 5001 - protein, 492 aa, Corynebacterium glutamicum
MQELLVTCELLAKSSELLIGSEGASGLFNCFCCRCIFCRISGVVAGRSLGSCLFSLLTTTLDLSGVSGEATLGLGVASFPSLTLLIEAFEPFVGLGVEALREDVVTLLVVGVSHSVLGWVELFGVVLVSLLEGQGDTTTLEIDVDDLDHDLFANCDNLVRNLDVALSQLGDVDEAFDALFDANERTEWNQLGDLAWNDLAHSVSASEDAPWVFLGSLQGQGDALAVEIDLENLNGDFVADGDNLRWVVDVLPGQLGNVNQSVDTAEIDECAEVDDGRDDALADLALLELVQELGADLRLGLLEECATGQNDVVAVLVQLDDLSFELLADVRIQVADATHLNEGCRQEATETDVDDEATLDDLDDGTGNWLVLFLELLDGAPSTLVLSTLLGKDQTTFFVFLGEDKCVNLVADFDDLVWIDIVLDGQLAGWDDTLGLVSDVEKYLVTIDLYHGAFNDIAIVEVLDGCVDCCKEVLSRANVVDGYLRCIVGGHM

SEQ ID NO: 5002 - protein, 200 aa, Corynebacterium glutamicum
MLRIGLTGGIGSGKSTVADLLSSEGFLIVDADQVARDIVEPGQPALAELAEAFGQDILKPDGTLDRAGLAAKAFVSEEQTALLNAITHPRIAEESARRFNEAEDQGAKVAVYDMPLLVEKGLDRKMDLVVVVDVDVEERVRRLVEKRGLTEDDVRRRIASQVPDDVRLKAADIVVDNNGTLEDLHAEASKLIAEILSRVN

SEQ ID NO: 5003 - protein, 366 aa, Corynebacterium glutamicum
MKDYAVHTRGLVSLLSLIFLFVLSGCGGNATTADEAAESDVVTSSSAPPSKRALDVGEAVEIPGVVLTVNSVTQSDQLMLYSEGSARGSEPREQRNAASGEKFVSVDTTVKNSSSDPWDLSCGHVLQTWLLEDELDDQQGDQEKKFSPIDNLDQISGNPECGVLLEVGTEIEMTWSFTIPDDIEITHFGFSLSDSTSNDLAIISLGGAIETSSAITTTEVIAPENDTETLLEITPVDCQVGLGPIVTSWSDGTVGGWSQHCQDVHDEVLAGEVAANTPVCDGVVCTYPSGATMPDPNAPQIPSDTSGAVCDENQCVYPNGYIARIGDPNVPNYLKPGNSPWVQGQIDFQNCLDSGKTIEQCREELN

SEQ ID NO: 5004 - protein, 194 aa, Corynebacterium glutamicum
MDRYLHRILARNRDSVRTCRWFSHFLLTTVFIGRFHQRSVEKRWAPVTHMALTSLLHQLADKKHSDLSREDIVPRAFTVPTSTDAHAIHQDLEKLRNSVLKEQNHLTTVLGTWSEFLTSNSDNSDILRSSAELGLQLEQVRDKALEVEQRIKASAQVDLTDLAHEIEICNQHHATLISAIQVRLQSHTAELRAG

SEQ ID NO: 5005 - protein, 82 aa, Corynebacterium glutamicum
MRQSMRTLLSKASALHVVTVIGALALIVIILWIDISTGFWQEIVILSGLAAGLVTFCSRRYLLVDFTSAALKNVGRQSPTWP

SEQ ID NO: 5006 - protein, 319 aa, Corynebacterium glutamicum
MGGAICWSRCAEISNGHACGECAVQLHIEWCFAGGEYGWVNKVCNSTRVVYWWVIKTLCVLVILAESVEKRDDEVGDVGAQLVELGFDLRCCERLVGKVEADHSQWPLFVEYDVGCFGVDLDVEFSYGGPVSYVVAPAHEDNFLDSLGDAWFFPDCQRDVGQWSGGNQRYAAGLVIHDGIDDEIHRVGVFYLLGWFRQFVLVDFHAGIAVDIFGYLNGAHQWSGDTAVDGRIDISDGGYDLRIVGDLVQGLVAADRGDSKQFNFWAAGCEQHGYSVVVSWIAVEDDLGGHRVKLLSSVCGFSWRLERLLQPGLWLPLYR

SEQ ID NO: 5007 - protein, 312 aa, Corynebacterium glutamicum
MTTKIILDCDPGHDDAVAMLLAAGSPEIELLGITTVGGNQTLDKVTHNTQVVATIADINAPIYRGVTRPLVRPVEVAEDIHGDTGMEIHKYELPEPTKQVEDTHAVDFIIDTIMNNEPGSVALVPTGPLTNIALAVRKEPRIAERVKEVVLMGGGYHVGNWTAVAEFNIKIDPEAAHIVFNEKWPLTMVGLDLTHQALATPEIEAKFNELGTDVADFVVALFDAFRKNYQDAQGFDNPPVHDPCAVAYLVDPTVFTTRKAPLDVELYGALTTGMTVADFRAPAPADCTTQVAVDLDFDKFWNMVIDAVKRIG

SEQ ID NO: 5008 - protein, 483 aa, Corynebacterium glutamicum
MSLPVQPSKTSAATVIPLMIALLVAVFAFQLNASMLAPALATMETELNATAAQIGMTQTAFFTAAALFSLFLPRWGDLIGRRKVLVGMMIVTGIGCVVAAFAPNVTILFLGRLIQGVAGPTVPLCLIILRQQVTNEKQYALLLGIVTSVNGGIGGVDALAGGWLAETLGFRSIFWVMAAFCAVAALALPFSVKESTAEETPKMDWLGVLPLAVSIGSLLMAFNEAGKLGAANWILVVVLFIIGIAGVIFFYNIEKRVKHPLVSVEYLGQRRTWALLLSTLLTMTGVFAVMNGLLPNLAQDAANGAGMSASVVSWWTLTPYALAGLVFGPIAGILAGKFGYKIVLQIGIAATIIGVAGATFLVGSTSHLAYLGISIFVGITYAGIANIMLNGLGIVLSPANNQGYLPGMNAGAFNLGAGISFAILFAVSTAFSDNGGGYAAGMWAGVIILVLAFLCSLLIPRPESITDTVAAKVQAEEAAQAAS

SEQ ID NO: 5009 - protein, 307 aa, Corynebacterium glutamicum
MSNSTGTDIVVVGSINADLTAKVQRHPEPGETLLGSGGTVSAGGKGANQAVAAAQLGAKVTMIGAVGTDQMAGEALTHLRQSGADMSAIATVDGPTGLAIITVSDDGENTIIVIPGANASVTAEFVDKHSQLIENAGIVLLQGEIPADGFERAVDLSQGRVVINLAPVVPVGHDQLRRADPLLVNEHEGALVLDMLGTPATTSDPQSLVTELLEQGFTSVVMTLGAEGALVGTPGQLTAIPTPKIQAVDTTGSGDAFAGALVAKLSEGAGLIEAATFAARVGAYAATRPGAQASYPTLTTDLPSTTH

SEQ ID NO: 5010 - protein, 346 aa, Corynebacterium glutamicum
MATEKFRPTLKDVARQAGVSIATASRALADNPAVAASTRERIQQLASDLGYRANAQARALRSSRSNTIGVIVPSLINHYFAAMVTEIQSTASKAGLATIITNSNEDATTMSGSLEFLTSHGVDGIICVPNEECANQLEDLQKQGMPVVLVDRELPGDSTIPTATSNPQPGIAAAVELLAHNNALPIGYLSGPMDTSTGRERLEDFKAACANSKIGEQLVFLGGYEQSVGFEGATKLLDQGAKTLFAGDSMMTIGVIEACHKAGLVIGKDVSVIGFDTHPLFALQPHPLTVIDQNVEQLAQRAVSILTELIAGTVPSVTKTTIPTALIHRESIINSTLRKKDGLPNE

SEQ ID NO: 5011 - protein, 266 aa, Corynebacterium glutamicum
MNKKANDLKPHFMRRRAKYGVLMESHGVGSSTTLARLHIPLMTGAGNMPFDPVGEWVAKSINRELDEYPMTEAEVLEICFRQGQYNLKMEYRISGRKFHVDRGSAEYSLRFNPWTLAQSETSTDANGEETTFTMSPKLTADGWFEPGEAVSKSIFMGSPQLLPRWTQFVTNKLYSRLGEDPLKITMLDSRYLKIVQAATEEDPGWGLFVDWVHDCGLYFCRYGLNREMYQEVEATSVHQWLSGETSFRELERDEIGELQIVNSSTD

SEQ ID NO: 5012 - protein, 699 aa, Corynebacterium glutamicum
MAFAAEHPVLSHSEHRPVGEIERSDDKFVVVSEFEPAGDQPAAIKELDERLDRGERDVVLMGATGTGKSATAAWLIEKQQRPALVMAPNKTLAAQLANELRQLLPNNAVEYFVSYYDYYQPEAYIAQTDTYIEKDSSINEDVERLRHSATSSLLSRRDVVVVSSVSCIYGLGTPQSYLDRSVVLNVGEEIDRDRFLRLLVDIQYERNDVGFTRGAFRVKGDTVDIIPAYEELAVRIEFFGDEIDALYYIHPLTGDTIRQVNEIRIFPATHYVAGPERMEKAVADIKAELEVRLADLENRGKLLEAQRLRMRTEYDLEMIEQVGFCSGIENYSRHIDGRGEGTAPATLIDYFPEDFLTIIDESHVTVPQIGGMFEGDMSRKRNLVEFGFRLPSAMDNRPLTWEEFDERRGQTVFMSATPGKFEIAAADGEFVEQVIRPTGLVDPKVTVKPTKGQIDDLIHEIRQRTDKDERVLVTTLTKKMAEDLTDYLLENGIRVRYLHSDIDTLQRVELLRQLRLGEYDVLVGINLLREGLDLPEVSLVAILDADKEGFLRSTTSLIQTIGRAARNVSGEVIMYADKITDSMQYAIEETDRRREKQVAYNKEHGIDPQPLRKKIADILDQVYDNSADGAGPSASGDAAVVAKPDVSSMPAKEVQKLIDDLSAQMAAAARELKFELAGRLRDEIFELKKELRGIKDAGI

SEQ ID NO: 5013 - protein, 147 aa, Corynebacterium glutamicum
MSENYSKIVVGTDGSKSSLLAVERAARIAAAFDATLIIGCAYYESKEDASETLRQDSVTILGDDPARENLDKAADAARAVGATSIETEVRTGTPVEALMAIVNDHQADLLVVGNRGINSLTGRLLGSVPADVARQSDCDVMIVHTVS

SEQ ID NO: 5014 - protein, 127 aa, Corynebacterium glutamicum
MDISPIQQPANVFSSMCSSRGALQHVTGRWGSLTMVALKRSDEPMRFAEIRRKVEGISDRMLSQTLAQLERDGMVDRTVHSSIPPHVDYTLTPLGTKLADALVLLVSTVEAELDQVVRAQEIYDKQH

SEQ ID NO: 5015 - protein, 282 aa, Corynebacterium glutamicum
MRIAVTGATGSLGGHVVDSLLNKGVAASDIVAIVRNEEKAADLKARGIALGVATFEDEAALTAALEGVDRLVFISGSEVGQRVAQHTNVINAAKAAGVTFIAYTSLLNLGTSKLALAPEHIATEKLLAESGIDHALLRNGWYWENYESSIGAAKATGKVFGAAEGARVSAAARKDYAEAAAVVITSDNQAGKVYELAGAPALTYPEIAAGIGEVIGSEAEYVNLSVEEYQNALEQAGVPAEFAALLAGMDPIIAEGALYSDSTDLQDLIGRPSTSIVEALSS

SEQ ID NO: 5016 - protein, 228 aa, Corynebacterium glutamicum
MLAENWACGIVRLPGTTSSGAGFCHRFLINGNLDAINRDHDGLLWQHLIRLDCLGQNAGHFLAALNFPGQSVLGTRWDDTGEQLTDGGQHHASLAEFRQNVRNILQKCLVRANDQHARLSQLIAPGIKQISHTVQRDRSFTCSRATLNNHDTAGGIADDLILLALNCFNDVAHVAAAGLFQRLVQHRFRADTTLLDNIGHLTGQYLIINTRDNAPTGANVPADMHALR

SEQ ID NO: 5017 - protein, 783 aa, Corynebacterium glutamicum
MIAPKCCIYSSSNTFSHCSTSGNRRSPGVTTIRQSDSESDVHNALTTAISQEQAYVDVLFGRLDDEVARSNQRLSEVMKDVDPSNPDPEALVRRETEYHGLNEKLDRLNLAQLGLVFGRIDVESEAEDAENPVPGHPDLDRRYIGRMGLDVREDNYRTLLLDWRSPMARPFYLATTVSPEGVHIRRHIRTRGRVVTGVDDEVLTGEMADVIEQGGVGSESVLHQALEQARSGHMRNIVETIQREQDEIIRDTTRGVMVVQGGPGTGKTAVALHRVAYLLYTWRDQLAKSGVLIIGPNKTFLEYISHVLPELGETGVVLSTVGELFPGIVPTGSEDTLTREIKGSEEMASILAEAVKAYQVLPEKTIVVSVDGIEISIDEKTVAKSRTRARRARQSHNSARPIFREHLVEQLAHQMAQTIGADPLGGKNLLSAADIDQLHDDLLDDAALQSVIDDFWPELRPQDVLHDLLISEERINVAAAGYDEETKSALLRGELDPWAPSDAALLDELALLIGLPDPEEAREKAEAKWREQIDDAQEVLDVLSSSQSSDIDDVTEAEVLSAFDVIDAETLAQRQTVTDNRTTAERAQADHKWAYGHVIVDEAQELSPMEWRMVFRRSPSRWMTLVGDIAQTGSPAGVDDWAESLWPFVEKRFRHHELTVNYRTPAEIMSVANELLTQINPDIAPAMAIRESGREVVNLPLDADLSAVMDSLREEDSQRTIAVISSRRHHESDFYLVDDIKGLEFDHVIVVDPAGIVEESPQGLQDLYVAVTRATQSLTILGE

SEQ ID NO: 5018 - protein, 304 aa, Corynebacterium glutamicum
MIRKLARPMLASVYVADGAETVLNTSAHVEGTQVVLDRIRYVLPRKYAKRISRDPELVTRVIGGTKVGAGSLLAIGRAPRTSAATLAILTIPNILARNAFWETQDADEKRNRRNGFLTNIALLGGLFITSVDTEGKPGVKWRATNATKRGKKQLQQALPTKSETEKFGEKASDWFNDTSDKVTEYAYTAQDFVGENKDDWIKSATETAHKVADTVSDYAHKATSYLEENSGDWLEAAQANAKTARKSAVKAAGKAQEKANFALQVAEETSGRANKKATKSYDKLQKQADKAIDRAQKKLKGIEL

SEQ ID NO: 5019 - protein, 200 aa, Corynebacterium glutamicum
MTNELTLHHISVSQMDNNCYLLAANGNGLLIDAADDAAALLKLAEDAGVTITKVLTTHRHADHVRALPEVLQKTGATHYAPFLEVPALPSAVDVELHHGDSIEFEGHVFPISILRGHTPGGAVLTAEIDGKTHLFVGDSLFPGGLGKTSSEGDFVRLFNDVKERIFDTYDDDSIVWPGHGKETTLGAERPQLEIWWERRW

SEQ ID NO: 5020 - protein, 949 aa, Corynebacterium glutamicum
MADRLVVRGAREHNLKGVDIDLPRDSMVVFTGLSGSGKSSLAFDTIFAEGQRRYVESLSSYARMFLGQMDKPDVDLIDGLSPAVSIDQKSTNRNPRSTVGTITEVYDYLRLLYARAGTAHCPVCDARVERQTPQQMVDQILGMEEGLKFQILAPVVRTRKGEFVDLFADLASQGYSRVRVDGEVHQLSDPPKLEKQIKHDIDVVVDRLQVKASQKQRLTDSMETALRLADGVAVLEFVGLEEDDPNRLRRFSEKMSCPNGHALTVDELEPRAFSFNSPYGACPACDGLGVRTEVDIDLIIPDPDAPATKAVQPWNSSPNHSYFEKLIEGLAKALGFDPETPYSELTAAQKKALVYGSKEEVSVRYKNRYGRVRSWTAPFEGVMGYFDRKLEQTDSETQKDRLLGYTREVPCPTCKGARLKPEILAVRLDSGSHGALSIAGLTALSVHEAFEFLDNLTLGKREEMIAGAVLKEIHARLKFLLDVGLSYLTLDRAAGTLSGGEAQRIRLATQIGSGLAGVLYVLDEPSIGLHQRDNQRLITTLEHLRDIGNTLIVVEHDEDTIRRADWLVDIGPRAGEFGGEVVYQGEPKGILDCEESLTGAYLSGRRTLGVPDTRREIDKERQLKVVGARENNLQGIDVKIPLGVLCCITGVSGSGKSTLVNQILAKVLANKLNRARQVPGRAKRVEGLEHLDKLVQVDQSPIGRTPRSNPATYTGVFDKVRNLFAETTEAKVRGYKPGRFSFNIKGGRCEACQGDGTLKIEMNFLPDVYVPCEVCDGQRYNRETLEVKYKGKNIAEVLGMPISEAADFFEPITSIHRYLATLVDVGLGYVRLGQAATTLSGGEAQRVKLAAELQKRSNGRTVYILDEPTTGLHFEDIRKLMMVIEGLVDKGNSVIIIEHNLDVIKAADWIVDMGPEGGSGGGTVVAEGTPEQVAEVAGSYTGQFLKELL

SEQ ID NO: 5021 - protein, 102 aa, Corynebacterium glutamicum
MLKGSDQALVVTLVQTNGWLIQDVEHTSQTGTNLSSQADTLRFTTRQGACGAIKGEVGKAHVKQEFQAGVNFLQHSSRDHFLALAQCEVIQKLECFMHRQRG

SEQ ID NO: 5022 - protein, 150 aa, Corynebacterium glutamicum
MGRLAIKMRSLPMKAPHLLLQQLFKELAGVGTRNFSNLLWGSFSDHGSTAASALWTHVHDPVGSLDHVEVVLDDDHGVTLVHQAFDHHHEFANIFKVQTSSWLIEDVNGATVGTLLQLSGKFHTLGFTTRQGCCCLAQTDIAKADINQRC

SEQ ID NO: 5023 - protein, 239 aa, Corynebacterium glutamicum
MDAVSDERSAKIPRAATAHAGIRASHGQSTAMNMLVVMNTMSTGETAPTHVETGLVSKLRQYSSNAMSWLSVAVILNGSHNVKATSRTAVIVPTIVAGHSMVCQDADKTNCRMTANAAMLARMIFVEMRYDSNNAATMEKIGHQASAESAKSIAENPETAMAPTNTVWPSAADFSVLDRLHNRPTIKNPILPINATSEPNPGGHHSKMKMIALVVARNAIWEVTVNATSASTRVPRLRT

SEQ ID NO: 5024 - protein, 708 aa, Corynebacterium glutamicum
MDMNSSDRLALRTALEKLSASATAMASASNDIKDLVARLDAQEMSLIDANPAPTPAPTAPPEAQLEPQPLVYATASTAPALADVSGTNRIPRFVRHRALDPASEGWPLGVEKQKVQAPAYPHPVRPARPAKPPMTSEEKIMRGVAIGGGVITVAGVILLVSVAIQRGWLGPLGRVIGAYLLAVLLLGAAHYVRKRGTRVEALVALTVTSQIAFLATTSAIIFILEWWPPGLGSLVALIGNIGFLIVGRLWSLSKTEKSAAEGHTVFVGAIAVSGFSAILFALSADAWWPIFSIVAALLLSYRISTNIIRASMAAFAVILQFVLSASWQTMEWPATIVGTITAVLLVALTLWDPFKITATDSHDIALEEYWRSFETNPVSTWVGAVSPVLIVFITTSMFIAVDWPWLALIPACAVAALGIFALRSSDTASIENQRMSRLIAVVGLALIAETFVQLFYGDLPTNPLLVMVFLIAGAALFMWLRMLPPQRQLGVVPWVAWLIAAVAMTGVLLRNVVSISPLWLTDTQALIQALLILVFIAATIQVRRSFYGHKLWLQILVGLTLLTLSAISIVTITTFIGRLIAGNAGMMLGFLIGHATVSILWMVIAAALMLNRKLLDAPGALWTGVGLAVAGTFKLVFFDLVALSGVPRAIAFLLSGIALLTIAAMRGRRTSENKADVARPQVARHGATSHKNEEPSHESPSSSPTTTL

SEQ ID NO: 5025 - protein, 189 aa, Corynebacterium glutamicum
MVRYVKFSRTANRGVHISAEARINERIRVPEVRLVGPNGEQVGIVRIEDARKLAFDADLDLVEVAPNAKPPVCKIMDYGKFKYEAAQKARESRKNQQQTVVKEQKLRPKIDDHDYETKKNNVIRFLEKGSKVKVTIMFRGREQARPELGYRLLERLANDVVDFGIVETRAKQDGRNMTMVLGPVRKGKK

SEQ ID NO: 5026 - protein, 64 aa, Corynebacterium glutamicum
MKNKTHKGTAKRVKVTGSGKLVREQANRRHLLEGKSSTRTRRLKGIVEVDKADTKRMKRLLGKA

SEQ ID NO: 5027 - protein, 127 aa, Corynebacterium glutamicum
MARVKRSVNAKKKRREILKSAKGYRGQRSRLYRKAKEQWLHSMTYSYRDRRARKSEFRKLWIQRINAAARMNGITYNRLIQGLRLAEIEVDRKILADLAVNDFATFSAICEAAKAALPEDVNAPKAA

SEQ ID NO: 5028 - protein, 274 aa, Corynebacterium glutamicum
MRSTMTLLLKPILQAAGINPEDALAMRHVFISIHEDTNSNGITRESKDEEILAYTASQSSDPRRFPLNPPRFWMVFIREGGSQARLWKVVENHGEVTNDGVRRVFNLTEIELMDDLAGRLVIRWNSPRKWWIKGTTAALYTVDTIADAEPIPFPGFDNLVLSYPFLQEVMREPAYASWRTALGAVKGIYLITDTRTGRHYVGKAEGLENIRQRWNSYATNGHGGNVKLKQLKPDTFRFSLLRVFDPATPTSIINAAESHFKIALDTIKHGLNAN

SEQ ID NO: 5029 - protein, 189 aa, Corynebacterium glutamicum
MPMINPRVHPRRYGSRSYCTNPWGGIMRVNREFGWEEVGPSQEGERFTFSDEAVRHMVDINERFKALQAEHPVVQRFLEHDSEKDQVLDEIYKSLASEVIYFSSQSGLMISFDWMGWEEANYWLFSERSNKGESVNMETVMDVETARKLITALVRSEYFGYYTPTGFLKNGNFLFIFDRLTGMIARGER

SEQ ID NO: 5030 - protein, 301 aa, Corynebacterium glutamicum
MDKLRKRAKRSRRTEWWLAAALLAPNLLLLAIFTYRPLLDNFRLSFFNWNISSPTSTFIGFDNYVEFFTRSDTLQVVLNTVIFTACAVIGSMVLGLLLAMLLDQKLFGRNFVRSMVFAPFVISGAAIGVAFQFVFDPNFGLVQDLLGRIGVDSPQFYQNPNWALFMVTFTFVWKNLGYSFVIYLAALQGLNKDLSEAAAVDGASAWTRFWKVTLPQLRPTTFFLSITVTLNSVQVFDIIHTMTRGGPLGNGTTTLVYQVYTETFTNYRAGYGATIATILFLLLLIITVIQVRYMDKENKQK

SEQ ID NO: 5031 - protein, 278 aa, Corynebacterium glutamicum
MISTDRNVLVKIMGYVGMVLAILFIGLPLVFIVLTSFKQQSEIYTQPVTWFPSEFNFDNYANVFERVPFLNYFRNSIIITVILCLVKIILGVISAYALSILRFPGRNLVFLLVISALMVPSEVTVISNYALVSQLGWRDTYQGIIVPLAGIAFGTFLMRNHFMSIPSELIEAARMDHCGHFRLLWKVLLPISMPTLVAFSMITVVNEWNQYLWPFLMAETDNSATLPIGLTMLQNNEGVSNWGPVMAATIMTMLPVLVMFLALQQYMIKGLISGAVKG

SEQ ID NO: 5032 - protein, 438 aa, Corynebacterium glutamicum
MAQISRRHFLAAATVAGAGATLAACAGTGGSTSSSSDSGSESDTNTIVWWSNHPANSKDVELELISRFEAENPDLKVQLVDAGANYAEVSQKFNAALSGGDLPDLVVLSDTEWFNFAINGATVNIDEVAKRNNIDTSTYVDSLFNDYSHEGGHYGLPFARSTVLFYYNKDLWAKAGLEDRGPESWEEFSEWGPKLQEAMDSGFAHGWGDATNYLSWTFEGPMWSLGGNYSEGWESRLTTPETIRAVEWLKSTVDEGFATVSTDVTNEFATGLIGSCIQSTGDLSSVAGAASFDWGVAALPNPTGEGACPTGGAGLGIPSGISEQRQDNALKFIDFLTNAANTGYWSRETGYVPVRKDAASDPDHAAFLEENPAYNVAVEQLPDTRSQDNFRVLLPNGDRTIGDALEKICLTGADIDVTLAEVETKLNTIYTRDIEPLI

SEQ ID NO: 5033 - protein, 408 aa, Corynebacterium glutamicum
MASIVFENVTRKYSPGARPAVDKLNLEIADGEFLVLVGPSGCGKSTSLRMLAGLEPIDEGRLLIDGKDATELRPQDRDIAMVFQSYALYPNMTVRDNMGFALKNQKVAKAEIEKRVAEASRILQLDPYLDRKPAALSGGQRQRVAMGRAIVREPSVFCMDEPLSNLDAKLRVSTRAEISGLQRRMGVTTVYVTHDQVEAMTMGDRVAVLLLGVLQQVDTPQNLYDYPANAFVASFIGSPSMNLIEGTIRGDKVTLGTGIQISVPDEVAAEVRNNPDRFEGRPVIVGARPEHMYLTTANESGAVLGEVSHIDELGADSMVYVLASGVKNPNTDLLGEGIPEDMRVTVVGAEETDKARLGIRVERHHGLKAGDKVHVVAAPKDVHLFDGLDGRRIGATVLAPAHTVQAGH

SEQ ID NO: 5034 - protein, 83 aa, Corynebacterium glutamicum
MSRSCGRSSVASLPSMSRRPSSIGSRPASMRKEVDFPQPEGPTRTRNSPSAISKLSLSTAGRAPGEYLRVTFSKTIDAMSQPP

SEQ ID NO: 5035 - protein, 239 aa, Corynebacterium glutamicum
MYKNMHIVAHRGAEDLHLENTMTAFQAAAPADAFELDIHATADNQVIVIHDRTAARVAAPDSLHRDTPVARLSAAQIKEITLIDGSPVPTLEEVLLQTSLPIQVEIKSAGAVPAAAALLQKYPEHLERLLFISFIDAALVEIVDRLPEARVGILRDASMDDLRILDYIPLKNVGAILPSWKALNVASIADLHTKGIKVGCWTIRDENAFGIAQQAGVDYATVSDPSRFLAPSPAGELHW

SEQ ID NO: 5036 - protein, 198 aa, Corynebacterium glutamicum
MNVYTHAITDKAAKHLSDTVTTTGIFALCDDVLWSVGKAITGQPRLVSVPVETREPGNAGTLIRVSDAVGADAVVFAGESVDPLGAKAVRSSAGSLFHIPVARNNNIADVLGQLRSKGLQILATSADGEVDLDDADELLAKPTAWLFGNEAHGLDESLLAQADHRVRIPIRGRAESLNLATAASICLYESSKALFAGE

SEQ ID NO: 5037 - protein, 340 aa, Corynebacterium glutamicum
MTEASLNEAADAAIKAFDGAQNLDELAALRRDHLGDAAPIPQARRSLGTIPKDQRKDAGRFVNMALGRAEKHFAQVKVVLEEKRNAEVLELERVDVTVPTTREQVGALHPITILNEQIADIFVGMGWEIAEGPEVEAEYFNFDALNFLPDHPARTLQDTFHIAPEGSRQVLRTHTSPVQVRTMLNREVPIYIACPGRVFRTDELDATHTPVFHQIEGLAVDKGLTMAHLRGTLDHLAKELFGPETKTRMRSNYFPFTEPSAEVDVWFPNKKGGAGWIEWGGCGMVNPNVLRAVGVDPEEYTGFAFGMGIERTLQFRNGLSDMRDMVEGDIRFTLPFGIQA

SEQ ID NO: 5038 - protein, 828 aa, Corynebacterium glutamicum
MTGLLGHANEGWKVPSSDLDSGYVRVGFETEGYWPIPETTGPLVFGRVETIEELTEFKKPIRHCHVNVGDANGTGELQSIVCGARNFKEGDTVVVSLPGAVLPGDFAISARETYGRMSAGMICSASELGLADKQNSGIITLDPSYGEPGEDARQALGLEDTVFDVNVTPDRGYALSARGLTRELASAFSLTFTDPAIEPAVAGIEVKVPAVEGSLINVELREETKAIRFGLRKVSGIDPAAESPFWMQRELMLSGQRPVNAATDVTNYVMLLLGQPMHAFDAAKVTGDLVVRNATAGEKFETLDHVKRTLNEEDVVITDDNGIQSLAGVMGGLTSEISDTTTDVYFEAATWDTITVARTSRRHKLSSEASRRFERGVDPAIVEIALDIAATLLVEIAGGTVDAGRTLVGDVPAMQPITMKVTRPSELAGVDYSAETVIARLEEVGCTVAVSGDTLEVTPPTWRGDLTMSADLVEEVLRLEGLEAIPTIIPTAPAGRGLTDAQKRRRAVGHALAYAGYAEIIPSPFMDPEVFDVWGLAADDERRKTVSVLNPLEAERNVLSTSLLPSMLDAVKRNVARGHNDFSLFGLQQVAFEHGSGVSPMPSVASRPEESVVAELVDSLPNQPLHVATVGTGNIEFEGPWGKGRAYTFADAIESARAVARAAGVTLELANADALPWHPGRCAALLIDGTPVGYAGELHPQILEKAGLPARTCAMELDLSALPLVENLPAPVLSSFPALHQDIALVVDETIPAEDVRAVVEAGAGELIETVELFDVYRSEQLGENKKSLAFSLRFRATDRTLTDEEANEARLQAAELAKEKFNAEMRG

SEQ ID NO: 5039 - protein, 257 aa, Corynebacterium glutamicum
MHRLAEQQHDVVGDVGGGVDWSLTREHEFTLHPEWGFCCWINARDFTQTETDCLGLFTQLHVNQGTFNCWDLDLNACYSWLDRRVGEGQAESRCQFAGQATSRQCVTAVWGDVDIENGIFKSQCLTCVFARLAVRRIQGDDAGVLLISKTQLRGRTDHACRHASVSFTSRDREIARQHSARKGHDNGVAFLEVAGATNDGLQFAGSVGVANIDVAVADGLLELGELFDGFHAAENEWSGGFRDWPVAFGFKADADIT

SEQ ID NO: 5040 - protein, 324 aa, Corynebacterium glutamicum
MAQRKLASVIGAALAASAVLVGLMTPATAQSSGSSSTDITRALTSSGGVADSRAPEGGAKVVVFGDSHTSGTNAPFRTDERGCLKGANNWADQLQSQLGLGAGDLIDVSCSGASINSDGFHFSDEVRHAEARGAIGPNTTDIFVQLGKNDQWGLSNVNLLQSVQTCLTDVFAGCGDAAVAAGKMQDPNAVTAENYAERMKPVIDYLKYYAPNAEITLVGYQEYTARSGSQVCVRLGGTPLVKNDAPALVSFMNKLDMAIDGAAGILGVSHVDLRSATEGHDSCSNDPWVNGVFDARAEIVGGPWHPSVKGDSVTAGILRDRVNA

SEQ ID NO: 5041 - protein, 461 aa, Corynebacterium glutamicum
MTSKSISGKRPNLPSLTGARWLAALAVYFLHALVFLSVYPFQQSELFATIHKFVPMQLGSAGVTFFFILSGFLIYWSNSQLKGMKNVLYYCKRRITKIYPMHLIALAMFIVASAKFTTTGITWVLDFARVELWLPNALLIHTWNPDWVTLGGLNVPSWSLGAEMLFYLTFPLFIPLVRKVKGVGNWWAFGITFAVSLALITVIHFYADGPKGIENFFVPRLWDTNVSPVAEVHADPVWFMQEEIPVLESYWLSYYFPLTRLIEFYLGVFGAKLVAEGMFKNTNITIPLIALAVSFVATWFVPLAFKMSVIMSLPMAFVVATLAVRDIEGKSGEIASPRAVLLGNISFAFYMVQFPVMVFVQRYFIAGKEYGFLGWAFYAVVCFIVSVILAWVLFTFVDDPLMKATARKKGSRRLKQSNILVRDLKVLFGKSPEKPLKVETRAENLTENSEAPAKVATGIKS

SEQ ID NO: 5042 - protein, 134 aa, Corynebacterium glutamicum
MAIYRKLAASAAALALSASLVACGDSEDTTEETSTTSSSTTSSSSSSSSSSTAATSEESSAVEEPAVEAPVEEAPVEAPVEQAPVVEQAPVEQAPAPVQEAPAPVEQAPAPVQEAPAADAPPALPGGGGGHAGY

SEQ ID NO: 5043 - protein, 347 aa, Corynebacterium glutamicum
MTIKVAIAGASGYAGGEILRLLLGHPAYASGELEIGALTAASTAGSTLGELMPHIPQLADRVIQDTTAETLAGHDVVFLGLPHGFSAEIALQLGPDVTVIDCAADFRLQNAADWEKFYGSEHQGTWPYGIPEMPGHREALRGAKRVAVPGCFPTGATLALLPAVQAGLIEPDVSVVSITGVSGAGKKASVALLGSETMGSLKAYNTSGKHRHTPEIAQNLGEVSDKPVKVSFTPVLAPLPRGILTTATAPLKEGVTAEQARAVYEEFYAQETFVHVLPEGAQPQTQAVLGSNMCHVQVEIDEEAGKVLVTSAIDNLTKGTAGAAVQCMNLSVGFDEAAGLPQVGVAP

SEQ ID NO: 5044 - protein, 388 aa, Corynebacterium glutamicum
MAEKGITAPKGFVASATTAGIKASGNPDMALVVNQGPEFSAAAVFTRNRVFAAPVKVSRENVADGQIRAVLYNAGNANACNGLQGEKDARESVSHLAQNLGLEDSDIGVCSTGLIGELLPMDKLNAGIDQLTAEGALGDNGAAAAKAIMTTDTVDKETVVFADGWTVGGMGKGVGMMAPSLATMLVCLTTDASVTQEMAQIALANATAVTFDTLDIDGSTSTNDTVFLLASGASGITPTQDELNDAVYAACSDIAAKLQADAEGVTKRVAVTVVGTTNNEQAINAARTVARDNLFKCAMFGSDPNWGRVLAAVGMADADMEPEKISVFFNGQAVCLDSTGAPGAREVDLSGADIDVRIDLGTSGEGQATVRTTDLSFSYVEINSAYSS

SEQ ID NO: 5045 - protein, 391 aa, Corynebacterium glutamicum
MSTLETWPQVIINTYGTPPVELVSGKGATVTDDQGNVYIDLLAGIAVNALGHAHPAIIEAVTNQIGQLGHVSNLFASRPVVEVAEELIKRFSLDDATLAAQTRVFFCNSGAEANEAAFKIARLTGRSRILAAVHGFHGRTMGSLALTGQPDKREAFLPMPSGVEFYPYGDTDYLRKMVETNPTDVAAIFLEPIQGETGVVPAPEGFLKAVRELCDEYGILMITDEVQTGVGRTGDFFAHQHDGVVPDVVTMAKGLGGGLPIGACLATGRAAELMTPGKHGTTFGGNPVACAAAKAVLSVVDDAFCAEVARKGELFKELLAKVDGVVDVRGRGLMLGVVLERDVAKQAVLDGFKHGVILNAPADNIIRLTPPLVITDEEIADAVKAIAETIA

SEQ ID NO: 5046 - protein, 401 aa, Corynebacterium glutamicum
MTNRIVLAYSGGLDTTVAIPYLKKMIDGEVIAVSLDLGQGGENMDNVRQRALDAGAAESIVVDAKDEFAEEYCLPTIKANGMYMKQYPLVSAISRPLIVKHLVEAGKQFNGTHVAHGCTGKGNDQVRFEVGFMDTDPNLEIIAPARDFAWTRDKAIAFAEENNVPIEQSVKSPFSIDQNVWGRAIETGYLEDLWNAPTKDIYAYTEDPALGNAPDEVIISFEGGKPVSIDGRPVSVLQAIEELNRRAGAQGVGRLDMVEDRLVGIKSREIYEAPGAIALIKAHEALEDVTIERELARYKRGVDARWAEEVYDGLWFGPLKRSLDAFIDSTQEHVTGDIRMVLHAGSITINGRRSSHSLYDFNLATYDTGDTFDQTLAKGFVQLHGLSSKIANKRDREAGNN

SEQ ID NO: 5047 - protein, 403 aa, Corynebacterium glutamicum
MQLDKALSQGLVEGVAGVVGSQVEVVQGVAGTTTIDGDGTCVQNHADIAGDVLLGGINERVQGALQRSEPQAVVYFLSPTCVNAALVASQFALDGDIFQSLVSLNQCDCAWCFVDFAGLDAHETVLNHVKAANALCACTTVQLFNSLQYGDWTAIDGDWLATLEGDDDLIWSVTQSWILGVCVDVLGWSIPQIFQVTGLNSAAPDVLVDGEWGLHGLLDWNVVLLGEGDSLVAGPCEVTSRCNDLQVWIGVHEADLETNLVVALTSAAVCNVGTVELLASLNEVLDDQWAGDCRNQWVLLHVHAVCLDGWQAVLLSELILCINNDGLSCTGIQCTLANVVHVLSTLAQVEGNCDDFTINHLLQVWNCHSGVQTAGVCKNDAVSHEVCSFILSSLPAVVDSKDV

SEQ ID NO: 5048 - protein, 477 aa, Corynebacterium glutamicum
MEQHGTNEGALWGGRFSGGPSEAMFALSVSTHFDWVLAPYDVLASKAHAKVLHQADLLSDEDLATMLAGLDQLGKDVADGTFGPLPSDEDVHGAMERGLIDRVGPEVGGRLRAGRSRNDQVATLFRMWVRDAVRDIALGTTELVDALSAQAKAHAGAIMPGKTHFQAAQPVLLAHQLLAHAQPLLRDIDRIRDLDKRLAVSPYGSGALAGSSLKLNPEAIAEELGFDSAADNSIDATSSRDFASETAFVLAQLAVDMSRLAEEIIAWCTPEFGYITLSDSWSTGSSIMPQKKNPDVAELTRGKSGRLIGNLTGLLATLKAQPLAYNRDLQEDKEPIVDSVAQLNLLLPAMTGLVSTLTFNTERMRELAPAGFTLATDLAEWMVRQGVPFREAHEASGACVRIAESRGVDLIDLTDEELSGVDARLTPEVREVLTIDGAVASRATRGGTAGVRVAEQRARVDAASTAHAEWARAGVRR

SEQ ID NO: 5049 - protein, 381 aa, Corynebacterium glutamicum
MNGSPDYSRKSRGRGFSVFLGIILLVIAVLAVLVGRGTIAMPKLFGSSNLTEVRAVIGSEKKEFFEDPEVVEAFADHGFEVNVDTAGSRRIATDVDLSPYDFAFPSSAPAAQKISEANTTTGRFTPFYSPMAVATFGTITDMLETKGIVSNVGGTDTIDLGALLNETQAGTRWSELSPNYQSNRVVQISTTDVRTSNSAAMYLSMMSWVKNGGKTVSSTAEADAIIPELSQLFVGQGYTESTSAGPFDEYLSQGMGSKPMVMIYEAQFLAEQNKENSRISGDMELVYPSPTVYSTHTVVSLSDVGAEIGELLETDETLQQLAVKHGFRPKNSAMIADAGMTDRMPNNLNVIDPPDYDFLERLIDGVGASYSATPAEEDTDL

SEQ ID NO: 5050 - protein, 525 aa, Corynebacterium glutamicum
MKNLVKGTALGLSLVLLAGCSTVSDSIDSLGGGLGGSSETLKIVAATELEDLQPAIEQASDDLGFDIELSFPGGTLSNSQALMDGAFDQDYDATWFATNRYVDLIGASNKLGETTKIATSPVAFGVKTSMAQELGWDQRQPTWEELGQASQTQDFTFGMTDPATSNSGFSALVAMATAYADTGQALTTNDIPAIAEPMSTSLSGQTITSGSSGWLKDTFLEQPDRANAIINYESVLHTMISEDGADITVVVPADGVVSADYPLSTITGSDQGEHVAELAGWFAEHPDALTDTYRRPTTANATLPAELSSQTIIEAPFPGSKTVTDALIDAYTNQFRVPGETTFVLDVSGSMLGQRITLLKDTMSDLISGGATTDLANVSLRDREKVSIIPFSFGPHEVISETLGAVGSPSRTDLQQRVEALQADGGTGIYDAVLAAYAESAGGDYIPSIVLMTDGELTAGRTYDQFLTEWNALPSNIRSIPVFVILYGEANVADMEQLAATTGGETFDAINGDLDEAFKEIRAYQ

SEQ ID NO: 5051 - protein, 204 aa, Corynebacterium glutamicum
MPTNNGGSFFFSRKNLAGIAIATLIIALHLVIGLGAFWPVVAIAGYGAAVALTPKNPPKKELPPVQATPELDSPGLLAARSQELVRTMYSHGAAAPVIEAIKRLDSSLQLVIGNWTSLTNFPEHQVTIRSIINQYIPGIIDAYLKIPTRNDPRAVEDLIESFDLLNSETMKIFNAIQEQGLNNLEDHGRALRMQFGQLPEEFRE

SEQ ID NO: 5052 - protein, 59 aa, Corynebacterium glutamicum
MSLDPQLLEVLACPKDKGPLRYLESEQLLVNERLNLAYRIDDGIPVLLIDEATEWTPNN

SEQ ID NO: 5053 - protein, 420 aa, Corynebacterium glutamicum
MNIIDELSWRGLINQSTDLEALREEASTPITLYCGFDPTGPSLHAGHLVPLLMLRRFQQAGHNPIVLAGGATGMIGDPRDVGERTMNSADTVSDWAERISGQLSRFVDFDGEHAARLVNNAEWTNEMSVVTFLRDVGKHFSLNTMLARDTVKRRLESDGISYTEFSYMLLQANDYVELNKRFGCTLQVGGGDQWGNIVSGVDLNRRVNGTSVHAVTVPLVTDSDGKKFGKSTGGGSLWLDPEMTSPYAWYQYFINASDADVIRYLRWFTFLTQEELAELEVEVAERPFKREAQRRLAREMTNLVHGTEATEAVELAAQALFGRAELRDLDEKTLAASVSETAVAEIKAGEPRTIIDLLVASGLADSKGAAKRAVKEGGAYVNNERIESDDWEPFAEDLLHGSWLVLRRGKKNFAGVQILG

SEQ ID NO: 5054 - protein, 155 aa, Corynebacterium glutamicum
MKTIITGVDSSQTALAAAEKAAELAASFDAELYVFSAYSISSVVAMQTAKSGNMAVKTSDAYQRLADGQAAAAQEAAESVAAILRNSWPTLQVKAIAVEGQPAEVLVQQAEHLNADAIVVGNKKAQGLQRILGSISRNVAAAANCDLYIVNTTRD

SEQ ID NO: 5055 - protein, 130 aa, Corynebacterium glutamicum
MMCFPFRVEVPALSWRLELIYTAPHARTNLQVKHDFNADPCTRMIMRQQKSAKFRLNMPQRFRILLIQASTALCRCNHLNDHINRPYALKRYGMINTKVGIRPIITGIYASPTPKKEASSQTLEKLEVFF

SEQ ID NO: 5056 - protein, 47 aa, Corynebacterium glutamicum; identical to SEQ ID NO: 3586

SEQ ID NO: 5057 - protein, 91 aa, Corynebacterium glutamicum; identical to SEQ ID NO: 3587

SEQ ID NO: 5058 - protein, 451 aa, Corynebacterium glutamicum
MSFYNKVFTRFSTSRNNMADNFDRSRDNDRSSDRTPRGDRGDRGGYRNSRGNDDRGNYRQNRDGESRDRGGYRGDRRDNRSGEYRQRDDRRDDRRDNRSDDRRGGYRSDRNFDDRNSNMRDDRRGGDRSYSRNDRSDRGYRSNDRYDRNDRRDDNRDTRGGDRGDRRYDRRDDRRDDRRDDRRGGQGQGRPGGDRRHANRAGAGRDQQRDSLHPQRAGFREERLNTRLNEPDLPGDIDIKDLDPLVLQDLKVLSKDNADAVAKHMIMAATWLADDPQLALRHARAAKDRAGRVSVVRETNGIAAYHAGEWKEALSELRAARRMSGGPGLIAVMADCERGLGRPEKAIELAREEDLSSLDQDNLIELAIVVAGARHDLGQHDSAIVELQKVNPSLKSTGFTHSRLSYAYADALVLAGRGDEAREWFQHAATLDEDGYLDAEERIEQLDNGNN

SEQ ID NO: 5059 - protein, 328 aa, Corynebacterium glutamicum
MSVITEYDSLLLDLDGTVYEGGRAIEHVVSALSGAGLPVMYVTNNASRAPEVVAAQLREIGLADTTADNVMTSAQAACKMAAEKIPAGSKVYVLGSESFRELATEAGFVVVDSADDKPVAVLHGHNPETGWAQLSEAALSINAGAQYFASNLDSTLPMERGRHIGNGSMVAAVVNATGVKPLSAGKPGPAMFYAGAKTLNSSKPLAVGDRLDTDIAGGNAAGMDTFQVLTGVSGYYDLVRAIPEQRPTYIATSMQDLYSDPGELKPGAQGGFSALIDGDTLVISGGDAGATPVAALRTALDVAWAATEPVTEVRADSEVAATALQSWW

SEQ ID NO: 5060 - protein, 54 aa, Corynebacterium glutamicum
MNSPKPHDPRAAHVTNPEEIAGKVNEVLSREAETLRDEALNLEEAHRILNDALS

SEQ ID NO: 5061 - protein, 273 aa, Corynebacterium glutamicum
MVARRRLDAELVRRKIARSREHAVEMIRGRRVFVAGMLALKPATVVEPEVSIRVEEDASEDWASRGAHKLLGALESFEPLGLKVKGRRVLDAGASTGGFTDVLLRREASEVVAVDVGYGQLIWRLQNDDRVRVVDRTNIRYMTLEDTGGECDMMVGDLSFISLKLTLPAIAKVLSDGADLLPMVKPQFEVGKDRLGSGGVVRSPELRAEVTADVAKFAATLGLSLKHVVASPLPGPSGNVEYFLWLVKDGGASMPDDQQLSAMIDTAVKEGPQ

SEQ ID NO: 5062 - protein, 291 aa, Corynebacterium glutamicum
MAAKLLDDAGIDVRVLINDADDPIAEHSVLGRFTHVRHAADAADGAELVLVLGGDGTFLRAADMAHAVDLPVLGINLGHVGFLAEWESDSLEEALKRVIDRDYRIEDRMTLTVVVLDGGGEEIGRGWALNEVSIENLNRRGVLDATLEVDARPVASFGCDGVLISTPTGSTAYAFSAGGPVLWPELDAILVVPNNAHALFTKPLVVSPKSTVAVESNSDTSAAMAVMDGFRPIPMPPGSRVEVTRGERPVRWVRLDSSPFTDRLVSKLRLPVTGWRGPQKQAENKDPRSAG

SEQ ID NO: 5063 - protein, 593 aa, Corynebacterium glutamicum
MLVDIAIENLGVIPAASAEFSSGLTVLTGETGAGKTMVVTGLRLLSGGRADASRVRTGSPQAVVEGRFVTQGVPCDIVERATGIVSNAGGAADENGEFLAVRSVGANGRSKAHLGGRSVPAATLSEFSDELLTIHGQNDQLRLLSPERQLEALDRFDPELAQLRKNYNAKYLTWKSLDKDLQKRLSSRRELAQEVDRLQFAINEIEEVSPQPGEDAELVEQIRRLQDVDTLREQAATALAAIDGAGSLSDAMGGSGGFDESQESASDQLGQAESALAGSDDSKLKDIAVQLAEITSQLSQVSMELGGFLSDLPADPQALDDMLTRQQQLKLLTRKYAADIDGVIEWQRKAQIRLDSIDISSEALDKLKEDAKKAQASMMRAAKKLSAVRAKAATKLGTTVTEELQGLAMQKARFEVALTSIEACASGIDQVEFQLAANAFAQPRPLASSASGGELSRVMLALEVILAAGTTGTTLVFDEVDAGVGGRAAVEIGRRLARLATKNQVIVVTHLPQVAAYADTHLHVAKNVGEASVTSGVESLTFDRRVEELSRMLAGLDDTATGRAHATELLERAQREKEDINEERVEPLLAASA

SEQ ID NO: 5064 - protein, 397 aa, Corynebacterium glutamicum
MGCMSLFNRKADLPGLQGATRICTPQGKGLKRLSEGDLAIIDAPDLSRTFAQRLLAAKPAAVLNVSRFTTGSVPNFGPQMLIDGGIQLVEGFGQELLDGTKDGKKGRLTEDGQLFYGERLISNGSVLSGPAAENAFADAQQSLLDRMEAYFGNTIQFIHSEAPLLIDGLGIPDTGNAIEGRKVLIASPGDNHRSRLKELRSFIREYDPVLIGVDGAADTLVELGYKPALIVGNPTGIGADALRSGANVILPADPDGHAVGLERIQDLGIGAMTFPSSVNSSTDLALLLADFHNPQMIVNVGGPVTLDGVFENREDSDPAALLTRAKLGTKLVDGSVIASLYTVRSSSNLGWMWALLAILVVLAVVIVIAGTAGSGSFTDNLIDTWNSFALTVQGWFK

SEQ ID NO: 5065 - protein, 321 aa, Corynebacterium glutamicum
MAKRRGRGAATFAALGFGAAAGIAFGTYVLAPNLPENIDPNAPTSAELVEAETLAEVNAVQADQADSIIDHIVEDVVAGTLTDRPVLVMRTADAEESDVADVSWLLQQAGAINAGSITLEENFFSQDGADQLKSIVANTLPAGAQLSETQLDPGTHAGEALGAALLLNPETGEPLASTAERGLLLNVLRDNGYISYEDGTILPGQVIVMITGDSDGSGDGAFAAETQSLFARALDAQGSGVVVAGRIHTAADTGVIGRLRANPDAAENVSTIDSVNRTWGKMATVLSVREELAGRSGAFGSAASADAASPSLDGTAAAPAQ

SEQ ID NO: 5066 - protein, 554 aa, Corynebacterium glutamicum
MTSSRKVRPTKHIFVTGGVVSSLGKGLTAASLGQLLIARGLSVTMQKLDPYLNVDPGTMNPFEHGEVFVTEDGAETDLDLGHYERFLDRNLGLNANVTTGKVYSTVIAKERRGEYLGKTVQVIPHITDEIKARILSMGEPDAHGNAPDVVISEVGGTVGDIESQPFLEAARQVRHEIGRENCFFIHCSLVPYLATSGELKTKPTQHSVAELRGIGILPDALVLRCDREVPQGLKDKIAMMCDVDYEGVVSCPDSSSIYNIPDVLYREHLDTFIIRRLGLPFRDVDWSTWHDLLERVNNPRHELTVGIVGKYIDLPDAYLSVVEAVRAAGYANWTRTNIKWITSDDCETPSGAMKALSGLDAIVVPGGFGIRGIEGKIGAITFAREHKIPLLGLCLGLQCTVIEAARQAGLEQASSTEFDPAATQPVIATMEEQKAAVSGEADLGGTMRLGAYPATLEEGSLVAELYGTTEVSERHRHRYEVNNAYRAQIAEGSDLVFSGTSPDGHLVEFVEYPKEVHPYLVATQAHPEYKSRPTHAHPLFYGLVKTALELRVHP

SEQ ID NO: 5067 - protein, 219 aa, Corynebacterium glutamicum
MHIPGTHEFTVTDTELLLESPILGVRRDSLIMPGGSTARREVVEHFGAVAVVAFDGENIAMVKQYRRSVGDSLWELPAGLLDIADEDELTGAQRELMEEAGLEASEWSVLTDLITSPGFCDEAVRVFLARGLTKVERPKVMGDEEADMINQWVPLHEAVGMVFSGQLVNSIAIAGVMAADAVIAGRASARAVTAPFTYRPTALAQRRKAHGIVPDMKKL

SEQ ID NO: 5068 - protein, 304 aa, Corynebacterium glutamicum
MKARVLAKTWLTHLAVERGLSANTLSNYRRDVERYCDWLEAAGLDDIRDITTAHVESYVKDLRRGIDGQQALSASSAGRALIVARGLHKFALMEGEVAADVAADVSPPAMGRHLPDTLSINEVALLIDAIPHSDIATPVDLRDRALVELLYGTGARISEAIGLAVDDVSEMPEVLRITGKGSKQRIVPFGSMAQQAVREYLVRARPALSKGKSHALFLNQRGGPLSRQSAWAVLKKTVERAGLDKDISPHTLRHSFATHLLEGGADVRVVQELLGHSSVTTTQIYTHITADSLREVWRGAHPRA

SEQ ID NO: 5069 - protein, 510 aa, Corynebacterium glutamicum
MAKTHIRLQDLSLSYTSTPLITKLNITVSSGQCAVIVGENGRGKTTLLRALAREFPPSAGEILTHGTVAIAHQHMPAGDLSVGEICDEAIRDSKNALEELERAGALLETNTAHALDGYQQALDAAEVLDAWNAEHRLEKALRSFGAITDRSRALSELSIGQRYRVRLACLIGGDADILLLDEPTNHLDRGALNYLTEAITSHKGVVLVVSHDQALIKDVADFIIDIDSTPDGLPRIYHEGFDSYRRQRSALLETWRQDYAAAQTVQQQLQEDLEHARQRVNSSWKPPKGTGKHTRASRAPGVVQALKRAQDALDSKALDVPPAPAPLLLPTLKVRPDKPMVDFSDLFVPHRLRLPGSHSVVSGDKIVITGDNGAGKSTLIEVLSGVLTPASGSVANHARTGVLGQESLVGEVPSIARDHAVKWGLLSVEESRFALQEFSIGQRRRLDLAMSLAGNPELLLLDEPSNHLSMHLVSALTEWLDTTAAAVIMVTHDRQLLRDTAHWRHIELKS

SEQ ID NO: 5070 - protein, 261 aa, Corynebacterium glutamicum
MEKHGPATIIAMANQKGGVGKTTSTINLGACLAEAGRKVLLVDLDPQGALTAGLGIHYDDVDITVYDLMVDNNSTIDQAIHHTGLPDLDVVPANIDLSAAEIQLVNEVGREQTLARALRPVMKDYDFIILDCQPSLGLLTVNALACAHGVIIPMECEYFSLRGLALLTDTVEKVADRLNFDLEILGILVTMFDRRTSHAREVMSRVVEVFDEKVFDTVITRTVRFPETSVAGEPIITWAPTSQGAEQYRSLAREVISRVND

SEQ ID NO: 5071 - protein, 255 aa, Corynebacterium glutamicum
MQLDNFEGPFDLLLQLITKKKLDVTEVALAQVTDEFIAYTRKLGETSDLDETTEFLVVAATLLDLKTARLLPRGEVDDEDDLELLEIKDLLFARLLQYRAYKQVAEMFAQWQRDARRRYPRAVSLETQFANLLPPVSLGHSLKSFSELAAVVFRPKPPETVKTDHVHQVAVSVPEQAGRILNTLKLAGIDHYLSFQLLTRDCTASMEVIGRFLALLELYKARAIETLQEEPLGELKVSWTGIDVDPAVVAASDWE

SEQ ID NO: 5072 - protein, 187 aa, Corynebacterium glutamicum
MATITRTDRLILVPLTVELEDEAHQIYSDSRIWEHRPQARHTNVRVTRDIIKRTNESWGKKDLGPWGVYLRDRPSEFVGVGGVELIDGKVWDLKYRLRPDLWGNGYATEISNAATLATKRIDDSLPLTARVTTNHPASFRILEKLGLTPVWEGRRVGTEDDPNEPDVRIYSDRPLSDEILEMLKQRP

SEQ ID NO: 5073 - protein, 289 aa, Corynebacterium glutamicum
MTSLKVTSSADATNNNDAHFPEGPVVTVDWLSHNLDRDDVIVLCATMEDDEIARQAGIPGAFLADLEGDFSDPHSELPHTAPPNLVGLLESYGISTDSTVVVYDLHGLMVAPRVWWLLRVAGLSSIGVLDGGLPAWVDAGLPTEPLSLPTSGGRISAEPQPDLLVGASGVERAIARSSKAVIDARNASRFAGVEEEPRPGLRKGSIPGSVNIPFTDISDEHGFVRPAEELKELIFSRTNGAQSLVFSCGSGVTACVDAYAAVIAGYDDVVVYEGSWAEWGNPANQKPIA

SEQ ID NO: 5074 - protein, 181 aa, Corynebacterium glutamicum
MSLIPQTRSRMESILLVVDTPVSARTLAGVLGIDVPATEAILKEMAFELSERGSGIDLRETAEGWRYYTRPENADIVEQFLLDGNQTRLSRAALETLAVVAYRQPVTRSQISAVRGVNVDGVMRTLQLRGLVKEVDVDESTGAHRYGTTELLLELLGIDSLDKLPDLAPLLPDVDSIDEDF

SEQ ID NO: 5075 - protein, 252 aa, Corynebacterium glutamicum
MGFLNRNDSDGVRLQKVLAQAGVASRRHAEILIDQGRVEVNDRIVTTQGVRVDPNNDVIRVDGVRIHINEDLEYFVLNKPRGMHSTMSDELGRPCVGDLVSEKTASGQRLFHVGRLDADTEGLLLLTNDGELANRLMHPKYEVSKTYLATVRGEATNKLVSALRDGVELEDGPAKADFAQIIDVFQGKSLLRIEIHEGRKHIVRRLFDELGFPVERLVRTKLHTVQLGDQKPGSLRALNSSELTSLYKVVQL

SEQ ID NO: 5076 - protein, 230 aa, Corynebacterium glutamicum
MPAGGLIVAIDGPSGTGKSTTSRALATRLSAKYLDTGAMYRVATLHVLNQGIDPADSAAVIAATAVLPLSISDDPASTEVLLAGVDVQKDIRGPEVTQNVSAVSAIPEVRENLVALQRALAAKAHRCVVEGRDIGTAVLVDAPIKAFLTASAEVRAQRRFDQDTAAGRDVDFDAVLADVVRRDELDSTRAASPLKPADDAHIVDTSDMTMDQVLDHLIHLVEASAERSNQ

SEQ ID NO: 5077 - protein, 519 aa, Corynebacterium glutamicum
MDVEGAFADEEELAPHGGWASADFDPAEFGYEDSDDDFDAEDFDETEFSNPDFGEDYSDEDWEEIETAFGFDPSHLEEALCTVAIVGRPNVGKSTLVNRFIGRREAVVEDFPGVTRDRISYISDWGGHRFWVQDTGGWDPNVKGIHASIAQQAEVAMSTADVIVFVVDTKVGITETDSVMAAKLLRSEVPVILVANKFDSDSQWADMAEFYSLGLGDPYPVSAQHGRGGADVLDKVLELFPEEPRSKSIVEGPRRVALVGKPNVGKSSLLNKFAGETRSVVDNVAGTTVDPVDSLIQLDQKLWKFVDTAGLRKKVKTASGHEYYASLRTHGAIDAAELCVLLIDSSEPITEQDQRVLAMITDAGKALVIAFNKWDLMDEDRRIDLDRELDLQLAHVPWAKRINISAKTGRALQRLEPAMLEALDNWDRRISTGQLNTWLREAIAANPPPMRGGRLPRVLFATQASTQPPVIVLFTTGFLEAGYRRYLERKFRERFGFEGTPVRIAVRVRERRGKGGNKQ

SEQ ID NO: 5078 - protein, 222 aa, Corynebacterium glutamicum
MASPRRPQVAAPRIKELRLTGLDNADPQDIESNEQIESCRFNEAELSERDLSGAGFIECEFLGLEAHETELRRAQFVETRIERANAPSFKAARSIWRNATISDSRFGAVEMYEATVQALKISDSKLSFVNLRGASLRDVLFENCVIDELDLGQARAERIAFKDCTVHSLTFDHAVLSNVDLRGLDIERISGVESMSGTVISSLQAADLSGAFARHLGITVND

SEQ ID NO: 5079 - protein, 166 aa, Corynebacterium glutamicum
MYLLNPPVTEPEILTVNEIPTVVAVFDNHPMNDMPAAFDQTYQVLFPTLGAKGIAPIGPGFALYTSEPTDTVSFEVGIPVSQPLEGDVSAANGIVLKNSVVPAGKIARISHIGSFDGLSQAWGSFVEALESAGHEIDMPCWEVYVTEPSPDMDPATLQTDLYVLLK

SEQ ID NO: 5080 - protein, 271 aa, Corynebacterium glutamicum
MNDPAHPPIPPVSKRDAPAFSDLQHRATSASAFTQGSTTYHDVRPGYPAEAVELARGFGRVLDVGAGTGKLTSELTADQVLALDPSMDMLRVFRSALPAVPCWQATAEHTGIRDNAVDLITCAQTWHWVDVTAASAEFDRVIAPEGAVLLVWNNLDTSIAWVHRLSRIMHAGDVLKPGFTPETAAPWIIDREIRTTWNQHLTPEEIIQLAHTRSYWLNASEKIKERVDQNLQWYLYEHLGFSPDNPVELPYRCDAFLLSRSGTLAGRSSNL

SEQ ID NO: 5081 - protein, 518 aa, Corynebacterium glutamicum
MQQTKSTPLDRYKNLPGPGARPSKMPALDAKLWTLKVALSQRPWSFVASAGMAASFICNGLTPVIVGKAVDEAIGTSDLQRLWFWIAMLAVLFLTAMTVNWIARYMLVRSQQLVSHDLRMLVTDRIQDPRGFAGKERTAGGLLSIASSDTQRVGDIVMMTVFPVAELASIIYGAVVMYSINPWLSVAVLIGGPLLVVVAIQVSKPLQKRSGARQQAVAQAAATATDVVQGLRILKGLGAIVTVRRRYEAISGEAYRKTVHADAAEARLNGVTDAAGAIFVSALGIGAGFLALQGQMSIGDLITVVGLTQFLIMPMTMLGRNVASRWASAEASAKRIRGVLGADFERVSAHDADKAEEIIQQLAKGLTVIRGTDEQLVEVLEQLPRTRVIVAPHAADLFDQSVRDNVHPVAEVAEKAIEVASCDDIPGGSSKIVGEGGRLLSGGQRQRVALARAIAFDPEVLVLQDPTTAVDSVTEQNIAQQVAAHRAGKVTIVFSEAPAWSAVADQHVEAAALREVMK

SEQ ID NO: 5082 - protein, 589 aa, Corynebacterium glutamicum
MSGETSKSMRFPLASLPQVRREVARQVGRIPRAKWWFLGALVLLSAGAYASVLVPQVLGRIVDLVSDGAQMRDFVELSVILIAVAIAGAVLSACGFYVVSRISEKIIANLREDMVGTALGLPTHQVEDAGSGDLVSRSTDDVSELSAAVTETVPILSSSLFTIAATIIALFSLDWQFVLIPVVVAPVYYFASKHYLSKAPDRYAAERAAMAERARKVLEAIRGRATVRAYSMEDAMHNQIDQASWSVVVKGIRARTTMLILNMWMLFAEFLMLAVALVIGYKLVIDDALTIGAVTGAVLMIIRLRGPMNMFMRVLDTIQSGYASLARIVGVVADPPIPVPDSGVKAPQGKVELRNVSFSYGDSWAVKDIDITINSGETVALVGASGAGKTTVAALLAGLRVPDQGQVLVDDFPVSHLSDRERIARLAMVSQEVHVFSGTLRQDLTLAKPDASDEELAHALGQVNALDWLESLPEGLDTVVGARGIQLEPVVAQQLALARVLLLNPAIVIMDEATAEAGSAGASALEEAADAVSKNRSALVVAHRLDQASRADQILVMDKGEVVESGTHQELLDHGGIYQRLWTAWSVGR

SEQ ID NO: 5083 - protein, 275 aa, Corynebacterium glutamicum
MNLLADHGQAGDTLAVREVRDGEVVDKHLPLIWHPQARQQGGDRRLTCARCAHERDSFAGIDRDVDVFHRPGIAIAKADVAQFHFALRCFHTAVGHRNRRIRNNSHDARQRRIAGLNGVEHAHEHIHRATQTNNHQHGTGNRADRQRIINDQLVADHQRDREHEEFRKQHPHVQNQHGGARTNTLDHHRPRRLINLIMHGIFHGIRPHSCTPANSLKYLSRTLRHRRAFCRIPIRRLAQIVLGREVVHRRHHDRNEHKLPVQRKQRNDRRGNGKQ

SEQ ID NO: 5084 - protein, 263 aa, Corynebacterium glutamicum
MLFAFGLTLFAGLATGIGGLIAVARKTVTEGFLAGSLGFSVGVMLYVSFVEILPGAFDELTSVWGEKGGSWAAVIGFFGGIALIAIIDRLVPTAINPHEPSTVGGAVEGFERRNRMMKMGVLTALAIAIHNFPEGFATFLAGLSDPMIAIPVAVAIAIHNIPEGIAVAVPLREATGSRRKALGWATLSGLAEPAGALIGFLLLMPFIGPEALGLCFAAVAGVMVFISVDELLPTAISSGKHHTAIYGLIAGMAVMAISLLLFI

SEQ ID NO: 5085 - protein, 63 aa, Corynebacterium glutamicum
MSMNNIVMNKVSSGQVCQVCQFFSKQFLFFPDYAAAWESAHQLKATSQEVFSCEFLGCRVAPV

SEQ ID NO: 5086 - protein, 516 aa, Corynebacterium glutamicum
MTILFMLITLLLATVIVVAIGDKTGLPWPALMTIVAAGGALLPFLPEFTIPADLMLPIFIPPLLWALARKSSWAVIRSQMSTIITMSVLLVFVTIAALTGASMLLLPGIGLAGAIMLAAAIAPPDPVAVDAVAEPAGIPKRITTTLQTEGLFNDAASIVAFHVALAALVAGEDLSWSTGVLEFLWSCLAAVILGLVIGRAAAWFTDHVSSVEARNAFTWVLPFAIYVVAEEIGGSGVIAIVIAAVEMNSRASIGAEDRLTGSAFWGTIEVLFTGVAFGLIGLNVRAAIDEVGSELWHAVVVGIVLSVVAIVVRGVWMFAAYKRNRFKIDKKGATNSSLRAPLRLQESLLMTWAGMRGLVTLALVLSIPEDIFPYHHELQVIALVVLLITMVGPGLTLPWLMRKLSLDKGPDAAGDESIAALTERAHKAATTYLVDTTELPMEQMVAIKNWFSQEIDADELQENVDKLHQRAHHARVGAIKAAQEELLKARRERGVNPAYVDEVLTNIDRMLVAAER

SEQ ID NO: 5087 - protein, 62 aa, Corynebacterium glutamicum
MKLTIDIDLDAIADDPAGEAGRILRYWAGALSQMDLSAEAEHALMNSTYDAEVGTIKITAEK

SEQ ID NO: 5088 - protein, 140 aa, Corynebacterium glutamicum
MGKLVDISCGIDPRAVDLAECGVFFLDAGGEPLVEGLEFYGAGGIEGSTAGGLEDVEAVEINSHIEAEFAWPGFWIPSVKKVLGISNSKGGEPRSHERFSGGGHPFAGVKAVAALTVGKASSAGAAFTQLKIHASSPRRR

SEQ ID NO: 5089 - protein, 125 aa, Corynebacterium glutamicum
MGKRCPCGTGLTYGECCYRFHSGEWVAPTAEALMRSRFTAFAVGNSQYLLDTWDPETRPSELGLDMGIDFYRLDILETTGGGPFDSTGTVKFQAFYKGLASGVQEEDSTFRKVNGAWVYSTGDVD

SEQ ID NO: 5090 - protein, 388 aa, Corynebacterium glutamicum
MKVPSSQGLMMAATLDLPDTDPIAYAMFAHCFTGSRFTPAAARVSKTLAESGVACLRFDFPGLSQSEGDFSKTTFNSNVDDIVAASQWLTEHYSAPQLLIGHSLGGAASLKAATKISCLKAVATIGAPFDPAHAVLHFADRICDVDDQGAVTLQLGGRDVTISREFLEDLAEVNPEDHLRRLRKPLLLLHSPTDQTVGVDNAQLIFRVTRYPKSLMTLDKADHLLTKDGTAQRAARIIANWVEPYLVPENVCEDLPEFVAEASTIKASKYGAAIRTGGHNFITDRDKSQGGKNLGFTPTSLLVSALAAANSQTIKQAAIDNRIKGLDDVKVTISQEQSADHGQIKLRRKISLIGNLSDADSASLRAASNSCSITQLLAQGIVIDDEVN

SEQ ID NO: 5091 - protein, 763 aa, Corynebacterium glutamicum
MAGFDWFWKALGGKSGRNQKRSVAIVNQVENHAAELDALDDVALAQRAKDLASGGRIDNHAEFLAILGVASQRTLGLKPYPVQSQAVLRLIEGDVVHMATGEGKTLVGAMAATGLGLMGKRVHSITVNDYLAVRDAEWMRPLVEFFGLSVASISEKMDAGERRQAYKAAIVYGPVNEIGFDVLRDQLITRREDAVQHGADVAIIDEADSVLVDEALVPLVLAGNQPGHAPRGKITDVVRSLKENDDYTIDDDRRNVFLTDKGAAKLEQQLGISSLYDDEHVGSTLVQVNLALHAQALLIRDIHYIVRDSKVLLIDASRGRVADLQRWPDGLQAAVEAKEGLAVSEGGKILDTITLQALIGRYPMACGMTGTAVEATDQLRTFYDLHVSVIERNHPLKRFDEADRIYATMAEKNRAIIDEIALLHSTGQPVLVGTHDVAESEELATALRELNIEVSVLNAKNDAEEAQIIAEAGDIGRVTVSTQMAGRGTDIRLGGADEADYDEVVKLGGLAVIGTARHRSQRLDNQLRGRAGRQGDPGLSLFFVSLDDDVVVSGGSGESVSAQPDATGLIDSDRIRDWVGHCQRVTEGQLLEIHSQSWNYNKLLADQRVIIDERRERLLDTALAWEELAQHAPARAAELEDLDQSVREQAARDIMLYHLDYNWSEHLALMDDVRESIHLRAIARETPLDEYHRIAVREFKDLAQRAVDDAVSTFKSVTIDHEGAHLDDEGLARPSATWTYMVSDNPLAGSGNSVISGIGNIFR

SEQ ID NO: 5092 - protein, 143 aa, Corynebacterium glutamicum
MSDNNGTPEPQVETTSVFRADLLKEMESSTGTAPASTGAENLPAGSALLVVKRGPNAGARFLLDQPTTTAGRHPESDIFLDDVTVSRRHAEFRINEGEFEVVDVGSLNGTYVNREPRNAQVMQTGDEIQIGKFRLVFLAGPAE

SEQ ID NO: 5093 - protein, 252 aa, Corynebacterium glutamicum
MSALRKTSPNGSIGASATRTVPVKPTKTMSIGVVLERLNAEFPDVTVSKIRFLESEGLITPERTASGYRRFTESDVERLRYILVTQRDNYLPLKVIREQLEAMDNGSVTAILGSSSEPLVSPEKFQAPAITRLTDSDVAEKAGVNVELVVDLVNARLIKPDAAGFFTNDDVAIASTAASLKAMGFDLRRLKSLGNAASRQADLISQVASPIAQGKSDVARQQAEEMAQQMCSLVVSMHASLVKNATREQLGY

SEQ ID NO: 5094 - protein, 211 aa, Corynebacterium glutamicum
MSFVELEFHGIHTMEPDGFTCALFRWDEGNKILPIWIDVDDALKIQAYLAGFNPRRPTAHELLAEAFQRLTPWVASLQIVSHFEGVYMATITTSEDEQFDARPSDVIMLSQLLEVPISIDEEILQQTAFYINDEDMESIFDIVIDRSKASGHPDGESASGDAQADADFQQLMQSLGVFEDDLFSAPDSPGDGLDGDFGEEGPSSEEKPENS

SEQ ID NO: 5095 - protein, 191 aa, Corynebacterium glutamicum
MYEDKNYQGEIFNGVPVQETLFEVGPDEQVGYRVPTACQVAGITYRQLDYWARTKLVVPTIRGARGSGSQRLYSFKDILVLKIVKRLLDTGISLQNIRLAVDKLRDMGTNDLAEITLVSDGTTVYECRSNEEVIDLLGGGQGVFGIAVPGIMKELTGDISSFPSERIDEEFQAETINFQDELAARRSRRTS

SEQ ID NO: 5096 - protein, 170 aa, Corynebacterium glutamicum
MNDRAHQRIGDIERSQALDRLGSYFADGYLDIDEFDTRTGAAAIARTAGEIDVLFTDLPEQQASTAVTPVQDDTEKELDLVLQRGKKLKQIDSAIWAVVMVSFFLGLFVFNVPYFWVVFILGGAASAGARFLLKVDDADEKLFEELHSKEQSEREARLRIAAQRRRELEQ

SEQ ID NO: 5097 - protein, 483 aa, Corynebacterium glutamicum
MARHSSGNSNLRLSKSLTIALIAIVALIVALVVWLFNRSDDSGSTTTTSQECISGNLSLPVGGDSTAAEELVNKFNDSSPVSRDFCVEAEAVDGNVPAATYLFAGSRSDAATALAETGAVASSSESSWPQVGSAQAGLAAASGTDASTITLDQVALPVATNSGASAAVALALAETPEAAAAALNRDADVTATGAADSPAFATVEGAELPEGYTFEAVDSAEVPVWAVAINAGNGISEDQARAASDFSSFSFDTGNADNSALESVLTQASSESAAETTEAQPSETPVEPAAASPSDTIINLDTSSNMDRVVDGSQETYHTVTSRTLANLARETGAQGNQVALNNYSSPLNPGVTKGWRANVSFPDSSSGENSAGAVVRLGTGGVPLTRASVVAATQIAKEGSPDGQPMRVVIVTSGSAGEYTDEAFLNDLSAAFADNISLHVVHVGHDPVDSVLSDFATSHNGTATQATTTEQIDAALREAFGL

SEQ ID NO: 5098 - protein, 200 aa, Corynebacterium glutamicum
MNQPARGGRGLVPSTHPRSIRGGEKCPTQLLFLVVGAFVSPIVDGAHVFFDEILQRNHAEKLTFEANLSHVRGAVVHKIQDVIHEAVGIHIAQRAQCRTRNGLGGIHLRISQTRQNILDVDITQVGSIAAGDREAGETGLADCFLQLVQGRARFTERQRAHVLILNHQFLDGTLLRAQRLGQAGVLFSIKEAFGTGLGNH

SEQ ID NO: 5099 - protein, 310 aa, Corynebacterium glutamicum
MDSRKLRRLEIVTVLDTFHLRVLSEDEWMELARAHHARADSFTKDHLKRRQAHIKHPVFDFLFEYYPVRVAHLKTWHPGIGVFLEGTPPHATMRDFLLVDASLHHAAGVQLDLASYMQRRGSSVRYIHELLSATRDNHAQFDCFGLHEWAMVYKSNDLRHDLPLRLTPSETDRVVESHNIKCTHFDAYRFFTTPAIPLNLTVLTREDQPRNDQCGCLHATMDLYKWSAKLGPLVPGDLFLDAFELARDTRILDMEASPYDVRGYGFGYVPIETAEGKAEYVSRQRELSERAKPIRDRLVSITKQALQASI

SEQ ID NO: 5100 - protein, 354 aa, Corynebacterium glutamicum
MSIWATVLLIIVLLSANAFFVAAEFALISSRRDRLDSLVSQGKKGAEKVLYATEHLSIMLAGAQFGITVCSLILGKVAEPAIAHFIEVPFTSWGVPNDLIHPISFVIALAIITWLHILFGEMVPKNIAIAGPETLGMWLAPVLIAFVKITRPLIEFMNWIARLTLRAFGVEQKNELDSTVDPEQLASMISESRSEGLLDAEEHARLSKALRSEQRSIKELVIKDEDVRTLAFGKSGPTLHQLEEAVRETGFSRFPVTGRDGSYLGYIHIKDILPRLADPEMDPSETIPRSALRPLSNVDADGLMDDVLDFMHYRSAHMAQVRLKGELLGVITLEDLIEEYVGTVNDWTHESSDD

SEQ ID NO: 5101 - protein, 460 aa, Corynebacterium glutamicum
MDILISILSLLGFVLLTASTGLFVAIEFALTGLEKSTVETHVKQKGDSSARAVQRDHQNLSFVLSGAQLGITITTLATGFLAEPVLAKFFTPALELVGLNESASSAVALIIALLVATTLSMVFGELVPKNWAITNPLGVARFVVHPVNWFNMVLKPFINGMNKSANFIVRKLGIEPAEELASARSSQELTALVRSSAESGGLDQNTAAVINRSLQFGDATADEFMTPRSTIESLRATDTVNDLIELALETGHSRFPVTEGDLDETIGMVHIKDAFSVVQAERATTMVRDLARKIPVVPASLDGDSVLNAVRSAGSQVILVADEYGGTAGMVTIEDVVEEILGEIHDEHDDSDAERDFQQFGASWEVSGLVRIDELEKRVGYVSPDGPYETLGGLIMYTVGAIPRVGDVALLPLTDTPTMDEFESGFSGRWIARVTVMEDRRIDKAVLTPITHEEAKEYEK

SEQ ID NO: 5102 - protein, 73 aa, Corynebacterium glutamicum
MPWGSFSSWDRLSLKSDASGWSGPLIWIRFVRACVDSGWNLWNQNDYGYFFVPALAAAVQVLEEQRLTGVVHQ

SEQ ID NO: 5103 - protein, 448 aa, Corynebacterium glutamicum
MTTFLELKLPDEIVRELRSQGITEAFPIQEAAIPDALAGKDVLGRGPTGSGKTFTFGLPMITRLARSGASKPGRPRGLVLVPTRELAAQVRERLDDPARVMGLRVLEVVGGVNINRNITALATPVDILVATPGRAQDLINQKKLSLADVSVTALDEADQMADMGFLPQVKKLMDLTPKNGQRLLFSATLDGDVSKLVDRYLHNPITHSTAPVQAAVDTMEHYRLLVGGRDPRNSVVLSIAAREGKTIMFMRTKHGVDRQVKKLRRVGVNAVGIHGDKGQSTRTNALAGFADGSIPVLVATDIAARGIDVDDVSLVVHVDPPAEHKAYLHRAGRTARAGTSGTVVTLVMDEQIKEVRELFQKAGVTAAEVKVNENSPELAKITGARRPSGVALPAPGQQQPKREQKNTHNRSDSRGSSRNPRRRGQSGSRSTGRSNPRRQTSRKDGPKS

SEQ ID NO: 5104 - protein, 245 aa, Corynebacterium glutamicum
MGKGFTGAILTVMGVKSHIATTTGKTVINDRMVTIHFHSETLLNTEGEVPGDWLRLWFPHESRPGKLYQRAYTLTNVDADAGTFDLAFVLHEPLGPASAWATRCEAGESLEVMRYPGIPFAIPDPAPRGFLFLGDLTSYPAICSILETLDGEIPATAYLIAHDPLDYTFDFPQGEHITAQWISNEQSFIDHIADTDYTDFYTWIGAESSETRAAKKHLQTHAGMPKTHMNAQGYWNKGRAMGKSN

SEQ ID NO: 5105 - protein, 492 aa, Corynebacterium glutamicum
MPSSTINNMTNGDNLAQIGVVGLAVMGSNLARNFARNGNTVAVYNRSTDKTDKLIADHGSEGNFIPSATVEEFVASLEKPRRAIIMVQAGNATDAVINQLADAMDEGDIIIDGGNALYTDTIRREKEISARGLHFVGAGISGGEEGALNGPSIMPGGPAKSYESLGPLLESIAANVDGTPCVTHIGPDGAGHFVKMVHNGIEYADMQVIGEAYHLLRYAAGMQPAEIAEVFKEWNAGDLDSYLIEITAEVLSQVDAETGKPLIDVIVDAAGQKGTGRWTVKAALDLGIATTGIGEAVFARALSGATSQRAAAQGNLPAGVLTDLEALGVDKAQFVEDVRRALYASKLVAYAQGFDEIKAGSDENNWDVDPRDLATIWRGGCIIRAKFLNRIVEAYDANAELESLLLDPYFKSELGDLIDSWRRVIVTATQLGLPIPVFASSLSYYDSLRAERLPAALIQGQRDFFGAHTYKRIDKDGSFHTEWSGDRSEVEA

SEQ ID NO: 5106 - protein, 154 aa, Corynebacterium glutamicum
MTSRDDQPQDLLSLAELAATRALTTDELEALNNANYGLDRNLGLRYTTIEPGRVVSELHVASKHLQVVGLVNGGVYAAIAESTGSVASMISAPGKMVVGINNNTDFISAVSSGVIVAEATPIQLGGRTHLWQIECTHRGEVVARTTLRTMVLNK

SEQ ID NO: 5107 - protein, 225 aa, Corynebacterium glutamicum
MADRMHPPRRSRRTNHTAHHGAEQVALYSGTMTTWKELTDNNPAHSENYAQRWRNLAAAGNDIYGEARLIDAMAPRGAKILDAGCGQGRIGGYLSKQGHDVLGTDLDPILIDYAKQDFPEARWVVGDLSVDQISETDFDLIVSAGNVMGFLAEDGREPALANIHRALGADGRAVIGFGAGRGWVFGDFLEVAERVGLELENAFESWDLKPFVQGSEFLVAVFTKK

SEQ ID NO: 5108 - protein, 247 aa, Corynebacterium glutamicum
MSTVTAVQVNGLKVSISSGFSRKKTKTILHDLDFTVETGKITGLLGPSGSGKTTLMRAIVGVQNFDGTLEVFDQPAGAASLRGKIGYVTQNASVYHDLSVIENLKYFGALAKGTSTPRTPEKILEVLDIADLAQRQVSTLSGGQRGRVSLGCALIASPELLVMDEPTVGLDPITRQALWEEFTTIAKAGAGVVISSHVLEEAARCDNLILLRDGRIIWRGTPTRLLEDTGKSSYEDAFLAAIDGVRS

SEQ ID NO: 5109 - protein, 247 aa, Corynebacterium glutamicum
MNPHYLLATVKRVLLQLKADKRSIALILLAPVALMSLFYYMYSSTPAGTQLFKTISTVMIAVFPLMLMFLMTSVTMQRERNAGTLERLWTTNIHRVDLIGGYGVAFGIMAVAQSLLMVLTLRYLLGVETESEWWISTLIAAITGLIGVSLGLLSSAFASTEFQAIQTLPLLILPQFLLCGLLIPRDDLPDVLRWVSNVLPLSYAVDAALEASRTGIGQQVVVNIAICAAFAVSFLLVAALSMPRMTR

SEQ ID NO: 5110 - protein, 291 aa, Corynebacterium glutamicum
MSWHQATDAPPSIRITTLAPSLQPNQRKVAEVMLVDAPSIVELTAQGLADRVGVGRATVIRTAQSLGYDGFPQLRVALAQELALAQGASRSMVEGALSSSLLGHLQAGISDFQASLGTVASALTEDDLTRCIEGLDSARRVLVASHGLSAPLGLDFSQRLNSMGRSAEVHSDSMSEQIVARQLGEGSVCFAISGSGASKATLATIEAARAGGATIMAMTCFAHSAIDVAADVSLIVPPMTASFQDELTRTSRAALMLVSEQLIELLITHRGQAAAQARATSMSMIGTSLEE

SEQ ID NO: 5111 - protein, 282 aa, Corynebacterium glutamicum
MSTLTSHRTVPAPSSPPARPNKLARNIVAIVAALIVLIATGTLKIEWNELPQMPAQVWHYLELMFSDPDWSKFGRAVQEMWRSIAMAWLGAILCVVVSVPLGMLAARGVGPYWLRTVLRFVFAVIRAFPEVVIAIILLTVTGLTPFTGALALGISGIGQQAKWTYEAIESTPTGPSEAVRAAGGTTPEVLRWALWPQVAPSIASFALYRFEINIRTSAVLGIVGAGGIGSMLANYTNYRQWDTVGMLLIVVVVATMIVDLISGTIRRRIMKGASDRVVAPSN

SEQ ID NO: 5112 - protein, 268 aa, Corynebacterium glutamicum
MTTPSSPLIPQKPRAGVKTYLIIGAIVVFTVATATPALGGIELDFASIAANWRNGANKLLQMLQPNFAFLPRTWLPMLETLQMALVGAVLSAAVSVPLTLWAAQATNTSAIGRGIVRTIINVVRSVPDLVYATILVAMVGVGALPGILTLFLFNLGIVVKLVSEAIDSTEHPYMEAGRAAGGSQFQINRVSALPEVMPLFANQWLYTLELNVRISAILGIVGAGGIGRLLDERRAFYAYADVSVIILEILIVVIVIEVISNALRKRLV

SEQ ID NO: 5113 - protein, 268 aa, Corynebacterium glutamicum
MNSDASATTNSWAINFDHVSVTYPNGTKALDDVSLTINPGEMVAIVGLSGSGKSTLIRTINGLVRATEGTVTVGPHQINTLKGKALRDARGQIGMIFQGFNLSERSSVFQNVLVGRFAHTAWWRNLLGFPTEHDKQIAFHALESVGILDKVWTRAGALSGGQKQRVAIARALSQDPSVMLADEPVASLDPPTAHSVMRDLENINNVEGLTVLVNLHLIDLARQYTTRLVGLRAGKLVYDGPISEATDKDFEAIYGRPIQAKDLLGDRA

SEQ ID NO: 5114 - protein, 70 aa, Corynebacterium glutamicum
MDSGHWLAASEEEDADDEEEDSSEEEQPTRARVEIASVETATRMDLDGLESLNMRSLKTFQRHETRKLRR

SEQ ID NO: 5115 - protein, 350 aa, Corynebacterium glutamicum
MFKLSKPSKSMRVAVSTLAISTLALVGCSSSDESSSSSSASSSSDAASQWPESITLSLVPSTEGEDLAEALAPLTDYLSENLGIEVNGVVASDYAATVEALGADQAQVIITDAGSLYNAIEQYDAQLILRDVRFGATSYSAVAYTNNPDKYCDDAPVAASYAASDVDMLYCNGIETEGQAATGEGPAALDALEKIESGDKVALQAATSPAGYQYPIVAMQDLGMDTDSAFVQVPVEGNNNAVLSVLNGDAEVSFGFWDARSTVLSEAPNAAEDVVAFAYTEMIPNGGVAASKSLPSDLVEKLTELMDDYADSSEEAKDVMFDMVGLSDWTADTAQDEITRYGEILKKFSN

SEQ ID NO: 5116 - protein, 234 aa, Corynebacterium glutamicum
MMNASSISSRFKDLFVTPSIVFDFDGTLAIGHGPVLAYALCVAPEGSKDFLERVRRELRRYDDGQSIYRDGYDIVAKLASELGIDDGTMSVAYGESRKLLGSDLAPVEHVRGIKDILSSLKGHARLVLATNAPENGVHDLLRQWGVADLFDQLHFVVGKPAGLISIISDLQLDGPVLAVGDIYEFDLSPAAQLGADTALVGATATISEAKVSMRGDSIADLPLLAWVSSRVSSS

SEQ ID NO: 5117 - protein, 528 aa, Corynebacterium glutamicum
MNSPSAPRVLSIAGTDPTGGAGIQADLKSIAAGGGYGMCVVTSLVAQNTHGVNTIHTPPLTFLEEQLEAVFSDVTVDAIKLGMLGSADTVDLVASWLGSHEHGPVVLDPVMIATSGDRLLDASAEESLRRLAVHVDVVTPNIPELAVLCDSAPAITMDEAIAQAQGFARTHDTIVIVKGGHLTGALADNAVVRPDGSVFQVENLRVNTTNSHGTGCSLSASLATKIAAGESVEKALEWSTRWLNEALRHADHLAVGTGNGPVDHGHLARRMTHAAETTPWAHLRAPRLDGATAASFTTPSTVKSPAPRIEPAGPFTRALWEASGDIIAGINSSDFITMLGDGTLRRPEFDFYIDQDAQYLAQYSRALARLSSIAPDSHAQIEWAQSAAECLVVEAELHRSYMAGKEVSAPSHITMAYTDFLIARTYTEDYVCGVAAVLPCYWLYAEIGLMLAEQNHDEHPYKDWLNTYSGEEFIAGTRAAIARLEKALENAGAEQRVDAARAFLSASVHEREFFDQATRHGWTMVGSS

SEQ ID NO: 5118 - protein, 268 aa, Corynebacterium glutamicum
MANSFLDSLTLVRQNTPLVQCLTNSVVMQFTANVLLAAGATPAMVDTPAESAEFAAVANGVLINAGTPSAEQYQGMTKAIEGARKAGTPWVLDPVAVGGLSERTKYAEGIVDKQPAAIRGNASEVVALAGLGAGGRGVDATDSVEVALEAAQLLAKRTGGVVAVSGAEDLIVSADRVTWLRSGDPMLQLVIGTGCSLGALTAAYLGATVDSDISAHDAVLAAHAHVGAAGQIAAQKASAPGSFAVAFIDALYDVDAQAVASLVDVREA

SEQ ID NO: 5119 - protein, 438 aa, Corynebacterium glutamicum
MAEARLRHLEPIDVEEWPGVASVPNLAFAGARARQAEYRFAKACSNAGLVLLGNDPDLIIDHEELFSRLAASGWLGLAESYMAGEWRSERLADVLTALLGTGFKPRGKLSGSFTLPGQAVDAGGALPNELIRLSSGDGMSAFGGVFASGVPTTLRTAVKSHVPGAGRNREPASHFVDITKISEPVAVEREDLGEAQRRAASFLLDGAKVKAGSHVLEFPSSGGALAILAARRQGTVDALTADPAQVSSLEETFVLAGVEEDIHIEVIPQAIPSPREWGGAYDSIVAMEKLEVVGKHGSKRFIKAIDRMLTTGGNVAMQSLVATDQWSPVCSEAISLLKAYIWPALHYPTVDEVHQLVDRDSSLRVVKETHFAGHYLKSVQLQREVFEGQIREAAADGFDAVYRRMWVYHYALIEALLRLGCLNAVQFALTTRNRRGRR

SEQ ID NO: 5120 - protein, 462 aa, Corynebacterium glutamicum
MTTTDHSTELNPSDPGGQTATLVIDKKTKRRVAAASTIGTTIEFYDFYAYAAAAVVVFPSLFFPANDNPTVNLLASFATFGLAFVARPLGSIIFGHFGDRVGRKATLIGSLLTMGIATILIGLLPTYGQVGIIAPALLALMRFCQGLGLGGEWSGAALLAGENAENTHRARAAMWPQLGAPFGFFLANGFMLILVGVLAHQDGDLHGAFMTWGWRLPFLSSAIMIAVGLWVRFSLEETPVFKQAVDQGKKVKSPLKELFKTSPGPVVQATLIMLSTYTLFYLVTTWILSYGIGNRSTGNGLSIPYFEFLQLQLATIVFFAIMIPVSGWLADVWGRKNTLTLASVLLLGFGLTFNLLLDPETATKTTVFIFLFVGMSIMGLIFGPMSAILPELFPTNVRYTGSGIAYNVSSILGAAIAPFIATWLVSEFSVAYVGYYLIIVTAITFVAVLTMKENKNHDLREV

SEQ ID NO: 5121 - protein, 158 aa, Corynebacterium glutamicum
MTEEREILTYEMFGTAMRELAQEIIDDYQPDCVLSIARGGLLIGGALGYALGIKNVSVINVEFYTDIGEHLEEPMMLPPTPKAVDLSGMRVLVADDVADTGKTLELVRDFLGDQVVEVRTAVIYHKPNSVFKPEYVWRETDKWINFPWSTLPPVEPSK

SEQ ID NO: 5122 - protein, 233 aa, Corynebacterium glutamicum
MHPAYHLNKALKRGFIGSGERDLRRSHFAGVYFLCPGTAHRRTMPFLQISLLSIGVAADAFACSVVRGTAIQVNLFKRALVLAGIFGVFQAAMPLIGWFIGRFFAGITFIAEIDHWIAFALLGIVGTKMIWDAFQPEDDETIVDDGRVQFRPAIILGLATSIDALAVGMGLAFVEVSILKVALSMGSITFALSLAGAWIGHHGGGKFGKWATILGGIILIGIGANIVYEHLSA

SEQ ID NO: 5123 - protein, 332 aa, Corynebacterium glutamicum
MKRVVEAWDRFQIPLYITALIAGALVGLQWPGSTGGFESAINPALMALLYATFLGIPITRIGAALKDLRFLIVLMSVNFVAVPLVAFALSRFIAGDEALLIGFLLVILAPCIDYVIVFAGLARAAQDKLLAATPILMLVQILLIPVFLAVFVGSDALGSISFGPFVEAFFLLILIPLVAAAGTQQVARKWQVGRTIMAAAEAIMVPLMMLTLFAVIASQVEAVSGQFTDIATVVPLYVAFLMVMIPIGGGISKLGGLGFKEQRAIVFSGATRNSLVVLPLALALPAGLEIAAVVVVTQTLVELIGMVVYVRIIPLIFHEKQTYRKLSGIGES

SEQ ID NO: 5124 - protein, 161 aa, Corynebacterium glutamicum
MSLSNKAKGIVAVIIVAWIVAMAGMVAYASSNNADKTFPTAGALEQTVAAFDRQGLQVSAVALADIYGDEYVSAAILCEGTPTATLEQSLGVDLSELNLDESGVPSGVSYLALSNQDGEVVYDKIDRANVDLCATPLNGAFSAYSLMPVAKVGENSWAIAA

SEQ ID NO: 5125 - protein, 231 aa, Corynebacterium glutamicum
MSQAAGKFKPMTSTLAESTLTSLKELEDPKILSVNERHGDDHAVNLTKLRAVAKELKKNQPLARELWATDDTAARLVALLICRPKEFDQSELDSMIHEARTPKVLDWLINYVVKKNPHWNDLRVLWLEDPAENVAAAGWALNTHAVITKPDALDDSEILDTIEAQMKTAEPRVQWSMNECLAQIGIHRPELRDRAIAIGERLEVLKDYPTPPNCTSPFAPIWIEEMVRRKK

SEQ ID NO: 5126 - protein, 485 aa, Corynebacterium glutamicum
MLASFRFAFSSPRRFRTEVLAGLVVALALIPESIAFSVLAGVDPKMGLFASCTMAMTIALTGGRPAMISAATGAVALVIAPVVRDHGVEYFLATVILAGIIQIALSLLGVAKLMRFIPRSVMLGFVNALACLVFFAQLPHLIDVPWMVYPLFALGIGIMLFWPKLTSVIPAPLIVIVALTAIVWVFGINIPNVSDQGELPSSLPEFLIPNVPLTLETLKIIGPYALGMSLVGLMESLLTAKLVDDITEVHSNKSREAAGQGIANIITAFLGGMGGCAMIGQTMINVKNSGARTRLSTFLAGGFLLLLVVLLGDVVGKIPMAALVAVMIIVSIDTADWHSLNPRTLKFMPLSETIVMFITIIATLVTGNLAIGVILGVLTAMVMFARRVAHLVSVERTTDNNISTYTVKGQLFWASSNDMVYSFDYSDEAEQIIIDLTAAEIWDASTVATLDSIIHKYAARGKSVEIIGLDGPSRDRLERLSGKLG

SEQ ID NO: 5127 - protein, 142 aa, Corynebacterium glutamicum
MLLSVVRSTDTRWATRRANMTMAVSTPRMTPIARFPVTRVAMIVINMTIVSLSGMNLRVRGFSECQSAVSMETIIMTATSAAMGILPTTSPSKTTRSSRKPPAKKVDRRVRAPEFFTLIMVWPIIAQPPMPPKNAVIMFAMP

SEQ ID NO: 5128 - protein, 205 aa, Corynebacterium glutamicum
MHVSTLPNKKLRTRIFAGTAAVALSLGVASCSNAEDAVDSATDAANSATSAAGSAINDATGTSSASTTEPSGTSGSDSGSDSAGGDTTEVESADGSTISIPTAVVTAANAAGFSTPESVEEGPNGESLVTFPEGYIVNSAEGGAQALVGMIGETWIGEGGLSAAVGLPTGPEEATTNGWTQQFTSGVISWLDDGSGQFAASVEPA

SEQ ID NO: 5129 - protein, 69 aa, Corynebacterium glutamicum
MGSLKLTGVLSVALFFYFIASFIRGPQLPTTHCNEQEPNEDEDPHGFPQYKAGESDEHDESEPQSWDHP

SEQ ID NO: 5130 - protein, 63 aa, Corynebacterium glutamicum
MMASRMIPALWFRLIVLIGFTGFVLWESMWIFVLIGLLLIAVSGWQLWTAYKTRDEVEKQRNT

SEQ ID NO: 5131 - protein, 250 aa, Corynebacterium glutamicum
MSNMQGNDSKKSSGASRAESPLIKFRTLIIVIFVILIVGLASIAVGPVVYQLIMGPGVKTEGIQADGAAPASTDMNGTWDVAPGSIPNTTSAGFTFAEILPGEEKITSGSTTGVTGEVVIEDNSLISGLITVNMTHITTDQEKRDINVRTKLFHTDQYPEATFEVTDSVDLSALPDTGSIAQVVIPGELTIHGETKAVEPTFDVLRTGDQVIVASDIEINRLDFGVETPEFIAAKINETGEINVRIVLEK

SEQ ID NO: 5132 - protein, 132 aa, Corynebacterium glutamicum
MADRVLRGSRMGAVSYETDRDHDLAPRQLVKYKTADGEIYEVPFADDAEIPEEWMCKNGKLGILMEGEGVESKPVKPPRTHWDMLRERRSIEELDVLLEERIEALRKRRRNAAKLLKAQQEAEEAEKAAEEV

SEQ ID NO: 5133 - protein, 270 aa, Corynebacterium glutamicum
MSSEAVDATTLVIIPTYNELENLPLIVDRVRTATPDVHVLIVDDNSPDGTGERADKLAADDDHIFVLHREGKGGLCAAYMAGFQWGLERDYQVLCEMDADGSHAPEQLHLLLAEITNGADLVIGSRYVPGGRVVNWPKNRWLLSKGGNVYISVALGAGLTDMTAGYRAFRREVLEALPLDELSNAGYIFQVEIAYRAVEAGFDVREVPITFTEREIGESKLDGSFVKDSLLEVTKWGLKHRGGQAKELSKEMVGLLNYEWKHFKKRNTWL

SEQ ID NO: 5134 - protein, 545 aa, Corynebacterium glutamicum
MTLFVRLALAAVGGLFVFASNEPIGWFVAGIVGTALFFISLAPWDLGVPQKRRKKNEPVPFLQQMSTGPTVVQGMLLGFVHGLVTYLQLLPWIGEFVGSLPYVALSVVEALYSIALGAFGVLIARWRDWKVLLFPAMYVAVEYLRSSWPFDGFAWVRLAWGQINGPLANLAALGGVAFVTFSTVLAAVGVAMVIISKKRLAGAIITASVIAIGAVSSLYVDRNGTSDESIEVAAIQGNVPRMGLDFNAQRRAVLANHARETLKLDEQVDLVIWPENSSDVNPFSDAQARAIIDGAVEHVQAPILVGTITVDEVGPRNTMQVFDPVEGAAEYHNKKFLQPFGEYMPFREFLRIFSPYVDSAGNFQPGDGTGVVEMNAANLGRAVTVGVMTCYEVIFDRAGRDAIANGAEFLTTPTNNATFGFTDMTYQQLAMSRMRAIEFDRAVVVAATSGVSAIVNPDGSISQNTRIFEAATLTESIPLKDTVTIAARVGFYVELLLVIIGVLAGLFAIRMNSRSKSAKGSARPAQVRVKKVPAKKAATNRRKVK

SEQ ID NO: 5135 - protein, 247 aa, Corynebacterium glutamicum
MRFRPSSSHRVLRLVSNARLRKLDHSHCTSAAARKSPPNSFLGHRDPLAIWSLSKGMVGHVPAAIAIPYFIIEILAFIGVVMWLGFGWALGLLVLFFVGGLLLAGVELRRISKSAAIHQASGQGSAGAIAGNIGLTAAGAILVAMPGFVSSIIGLLFIFAPTRALFRKVLAKRMRSAIENLGVRGFEAVNGYRTQASYGNFGAAFNGGAQQPSNEPIVIDEDEIQAWTSDLKPEDFTKGKDESDGEK

SEQ ID NO: 5136 - protein, 408 aa, Corynebacterium glutamicum
MQQGSEAVFRRIMGLSRRPDRKPGFDDVPHFGAAVRVPGLKHGTLVNAAPLKVLGARGEPNPASSYRFEYITGDSAGRAITATGAVLFSTRPWTTGPRPAIAMAPSTQGVAQHCDPSHTCAIGLNAFYDKPFDAIIAYELPVILWFLAHGLDVVFIDYPRDPATGVQYYCDSIAAAKSLLDAVLASRQLGLSPEAPLGLWGFSQGGGATGWAAQLQDYAPDVRPKAAVVGAPPVDLFRVLDTVDGGLLTGVIAYAIAGLAVNSSEMFEEIMSVLNERGVSDVLKNITSCAGGSLLASGYSSSRGWTHQGTPLADILDDLPLVVAEFGKQKLGRVAPEIPVLLWGSKNDDVIPIDPIRELRDSWADKGTPLTWHESQAPRVPGRTGLNHFGPYFRNLEKYSGWLIDHLV

SEQ ID NO: 5137 - protein, 258 aa, Corynebacterium glutamicum
MSSDVVFQSVSVNSGVSVGTVSFPAGRVGASEWEMLADVAESQGDGAIYVTSLAQCQVRGGSYSHAEPCATVVATPGHFVALAREIAGAVRRELTVGLDAGDGAILRQSFDVGFLLVDASFHIHINGVSTGQSVAPDDVVEVVRGLADASELSVESVAELCTPVAPVSLSEAQGNPAPIGWLEHDGVVSLGAGIPGGRVEARLARFIAVIEAETTITPWNSLIIHDLYEGVAEQVVKVLAPMGLVFDANSPLLESPAL

SEQ ID NO: 5138 - protein, 426 aa, Corynebacterium glutamicum
MSAPDSAPGTERGHERTHFAVVGDSQDPAQATAPRAPAESITLIGIGTDGFEGLGLKAQQALQRASVVIGSWRQLNLVPDAIKAERRPWPGNTKHPDLDALFKEFLGRHVAVLASGDPLFYGVGTAMVHVLGMDRLTVIPGPSSASLACARLGWTVNRTRVVYLGQEPIETLIPIIESGAQFLVLGKDEFSTAQVATLLNELGLGETPLTVLSDLGSTDEEITQGTASHPPAAVSVLNVIAVGARTAMPKPHFEGDVSNEDLRALTVAALEPTQGQMLWTFGDIGAALACDWLRAAGNKAHAISFASMVEQSQRNARKLGVSTLSVKETLSPKTLKDIRYVQGPESASPHAIFMNKGLGIDLVPETAWMMLRPGGKLIAQASTEDNIAKLHTLQEQHGGIIKHIRIDDTDVHQWRVTKPVTPEAVN

SEQ ID NO: 5139 - protein, 122 aa, Corynebacterium glutamicum
MTVKPRQPLTLIDLCDVIYSAGHVFDDLQCTREDTAEFLKVGSVNAIRHNVIGHSGDVALLQDLRDVAAFIINQPCAELDAAYLCALNSTITRSGPLYPGRLRSPHQHIGVSTNYGRHEPRR

SEQ ID NO: 5140 - protein, 82 aa, Corynebacterium glutamicum
MNTRQLDAVCRRRALPGNTVENRAISLFIDLARAQPFEDGNKRTALFVANSMLIASASPYLLIAPVDEKDSSIARSFNDHLA

SEQ ID NO: 5141 - protein, 246 aa, Corynebacterium glutamicum
MSILLLGGTSDIAGEIATLTCHGEDVVLAARRPEAAQGLAEDLRQRGATSVHVLSFDAQVLDTHRELVKKTQELAGEISLAVVAFGILGDQERAETDETHAVEIATVDYTAQVSMLTVLADELRAQTTPAAIVAFSSIAGWRARRANYVYGSTKAGLDAFCQGLADSLHGTHVRLIIARPGFVIGSMTTGMKPAPMSVYPRDVAAAVVSAYTSKKRSTTLWIPGRLRVLAWIMRMVPRPVWRKMPR

SEQ ID NO: 5142 - protein, 379 aa, Corynebacterium glutamicum
MSDPSTNNFPTSVYAQRLADAQEGARKAGLNGLIIGTGAELAYLTGSWISTHERLTALVIPSEGTATIVLPAVDRGDLALSAIPGLDINVAGWVDGDNAHELAVDALGVSEFEALGIGSSITADHLIPIQNLVGSTCRMELAVQVLKELFVSKDEAEIEQLRGAGAAIDRVHAKVPELLQDGRTEAEVAAQLNDLILEEHSEVDFVIVGSAENGANPHHGFSDRVLRNGDIVVVDIGGTFGPGYHSDCTRTYIVGGNPDDADPEFAKFYQVLYEAQLAAVAHVRPGVTAESVDAVARDHIAAAGYGEYFIHRTGHGIGLSTHEEPFIMAGNSLVLEAGMAFSIEPGIYIEGIHGARIEDIVVVNEDGCETLNNQPKELR

SEQ ID NO: 5143 - protein, 213 aa, Corynebacterium glutamicum
MRSNHTVRIKSAGRYASGLLITKKHVTDTFVPSVASISERATFILTADHFLRSCSKVIYVRGENFTATATTSLSVFGTDLGLIKLDGKAPTMPLPLFADKPLRVGMKTTTFGFGGLPSATVAKEIHGRVISAIPHGVSRNRITRVHHGALIFNSPEKAVKGDSGGPVLVNGRVAGIQSMISDPGGFNTGVATAASLIQHMPALAQALELLEHS

SEQ ID NO: 5144 - protein, 929 aa, Corynebacterium glutamicum
MSFSAEKGTHLSEFIADLGFDLDEFQIKGCHAVEEDHGVLVCAPTGAGKTIVGEFAVSLALSRGTKCFYTTPIKALSNQKYHDLVAKHGSDAVGLLTGDVSINHDADIVVMTTEVLRNMIYAGSFALERLSHVVMDEIHFLADASRGAVWEEVILNLDDSVNIIGLSATVSNSEEFGEWLTTVRGDTRVIVTDHRPVPLDQYMMVQRKVMPLFEPGTDGRVNKELEATIDRLNSKQSEQGRAAYRSGEGFRARSKGDKQDSRTGKPREQDRHRPLGRPEVLSILKGINMLPAITFIFSRAGCDGALYQCLRSKLVLTDQAESEEIARIVDAGVVGIPEEDLQVLNFKQWRAALMRGFAAHHAGMLPAFRHIVEELFVKGLVRAVFATETLALGINMPARTVVLEKMVKFDGEGHVDLTPGQYTQLTGRAGRRGIDVLGNAVVQWSPALDPRWVAGLASTRTYPLISTFQPGYNMSVNLLKTIGYEPSLRLLEKSFAQFQADGSVVGDVREIERAEAKVAELRAQLNKEIAATNPAVREDQDAVEVFIDYMELRRELNEEEKLNRKQSIEDRNVETVRVLSKLQIGDVIAMPGRKRPVLAVVMTPANQSRDPRPWVTTESGWSGRVDAESFTNPPITIGHMRLPRQAIEEPRRNARRVQELFRREHFKRPNKMREFARVRPNEAVTKLRNAIRDHEAHHWPDREHLARTAERMIRKERDLAKLTGNVDKARETLGRTFERILSLLSEMDYVDYSNPDNPVITDEGERLAKIHSEADLLVAQCLKRGIWDNLDPAELAGVVSMCTFENRRETGGEAQAVTEAMADSMNSVERIWGELVEDERRHRLPITRQPEAGFATAIHQWASGAPLGYCMAAAAENGAELTPGDFVRWCRQVIDLLEQVAKTAYFDETTRNARQAIDAIRRGVVAIGS

SEQ ID NO: 5145 - protein, 334 aa, Corynebacterium glutamicum
MVKRPRRVISKKKKKSPTGEMSIVEHIKEFRRRLLIALAGILVGTIIGFIWYDFSFWQIPTLGELLRDPYCSLPAESRWAMSDSEECRLLATGPFDPFMLRLKVAALVGMVLGSPVWLSQLWGFITPGLMKNERRYTAIFVTIAVVLFVGGAVLAYFVVAYGLEFLLTIGGDTQAAALTGDKYFGFLLALLAIFGVSFEVPLVIGMLNIVGILPYDAIKDKRRMIIMILFVFAAFMTPGQDPFTMLVLALSLTVLVELALQFCRFNDKRRDKKRPEWLDGDDLSASPLDTSAGGEDAPSPVETPEAVEPSRMLNPSGEASISYKPGRADFGDVL

SEQ ID NO: 5146 - protein, 105 aa, Corynebacterium glutamicum
MSLGPWEIGIIVLLIIVLFGAKKLPDAARSIGRSMRIFKSEVKEMNKDGDTPEQQQQPQQQIAPNQIEAPQPNFEQHYQGQQVQQPQNPQTPDYRQNYEDPNRTS

SEQ ID NO: 5147 - protein, 327 aa, Corynebacterium glutamicum
MPKSSNKISDLARQLNLLPYFTRYKGRTVMEAARDLGQPSSQIMEDLNRLWMCGLPGLLPGDLVELDHSFKEVKIHNAQGMDKPLRLTPTEAGVLLLTLESLESLPGIAKQEAVVSAANKLRAIMGEYSSTVFDSTGEDLDAEVLEIIRDAMDLHQQVSFEYHSHRSDNTSLRQVSPAHIFTHEGETYIKAWEEAVNQWRTFRLDRIRSIVLLDSKAVHPARGVSVSTDDPFEFAKSSDIATLLLREDAMWLGNYMAMEVDETVEPIRDSDGFSWHTVHFPLLSRDWFVRFAIGHAEHLKVTSPEDLRKCIKQKAFSGLSAYDHHVE

SEQ ID NO: 5148 - protein, 324 aa, Corynebacterium glutamicum
MSDRKEDLERQINLTFAFLSANSYSRKFLTQVWIRDNVGDYKGLTDTAFRKKLQRDLAYLRRVGVPIEQFTVTSGIAEGQQAYRLAQDSYKLPEVEFTPDEAAVLGMAGEMGHNQELGAFARSGWTKLAAGGAQRDLSTSTALTNAGDLGSLSAKTLDAIIKARQLGKQISFEYRRAPKDAPSLRHMDPWGLVPERDRIYLVGFDLDRQEARTFRITRVRNINLGADATHPMPAGTNLQDMVRAQLRRKSVLIDATLRITPGRAVELRAAGVETSDGAWFLEDVDRDWLVRTAAAHAPEALVIEPKDVIDDVIALLRKVENEVV

SEQ ID NO: 5149 - protein, 475 aa, Corynebacterium glutamicum
MTRRIMGIETEYGLTFVDGDSKKLRPDEIARRMFRPIVEKYSSSNIFIPNGSRLYLDVGSHPEYATAECDNLTQLINFEKAGDVIADRMAVDAEESLAKEDIAGQVYLFKNNVDSVGNSYGCHENYLVGRSMPLKALGKRLMPFLITRQLICGAGRIHHPNPLDKGESFPLGYCISQRSDHVWEGVSSATTRSRPIINTRDEPHADSHSYRRLHVIVGDANMAEPSIALKVGSTLLVLEMIEADFGLPSLELANDIASIREISRDATGSTLLSLKDGTTMTALQIQQVVFEHASKWLEQRPEPEFSGTSNTEMARVLDLWGRMLKAIESGDFSEVDTEIDWVIKKKLIDRFIQRGNLGLDDPKLAQVDLTYHDIRPGRGLFSVLQSRGMIKRWTTDEAILAAVDTAPDTTRAHLRGRILKAADTLGVPVTVDWMRHKVNRPEPQSVELGDPFSAVNSEVDQLIEYMTVHAESYRS

SEQ ID NO: 5150 - protein, 83 aa, Corynebacterium glutamicum
MYIGTNEFLGVVFQQSVDFIQQAVHTFGVDLNLSRCLCGILGVVLVTSAATHNLGLLCVHYTHSPAVNRYFLVLQPTYLDLAI

SEQ ID NO: 5151 - protein, 64 aa, Corynebacterium glutamicum
MNAKQTQIMGGGGRDEDNAEDSAQASGQVQINTEGVDSLLDEIDGLLENNAEEFVRSYVQKGGE

SEQ ID NO: 5152 - protein, 514 aa, Corynebacterium glutamicum
MARFMGSETEYGISTPSAPFLSPIVTSTHAVVAYSTARGFGEHRVRWDYAQESPLRDTRGFDLRRYHQAPVVDPHAIGVANVFVPNGARFYVDHAHPEYSSPEVTNAWDAMVYDAAGDHILMQAVSDVASFTSQNRSVLDGHDPCPALKIYKNNVDGKGASYGSHENYLYSRETDFDVLAQALIPFFVCRQVIIGAGRVGLGPQGDKPGFQVSQRADYIEQEISLETTLNRGIINTRDEPHTDADHWGRLHVIIGDANMSQTANFLKFGMTSLVLDAIEAGVDFSELKLKNAVSEVAKVSHDLSLTHQLRLADGSELTAIDILRRYLDKVQPFAETPVEQRVTALWGEVLGLLENDLLSTSHLLDWTAKLALIKSFEARGLSINDPKMYLIDLQYSDIDPQKSLYHALVSKGRMKTLCSAQDIADAAATPPQDSRAYFRGRVMDKFGESVLAANWESLIVATSSAKEYRVHTSGLDTLTREEAGELVEKSATIDELIEGLEKENLTPLTAIQAI

SEQ ID NO: 5153 - protein, 160 aa, Corynebacterium glutamicum
MSCAPCLLGRLMRILMSRRPGRKMAGSISSSRLVAPTTMTLDRSSTPSSSAKSCGTTVVSISELTPEPRVRKIDSISSKKMITGRPSPASSRARSKITRICRSVSPTYLFSSSGPLTLMKYEVPVSPMRLAKELATALAISVFPQPGGPYSSTPFGGCRL

SEQ ID NO: 5154 - protein, 527 aa, Corynebacterium glutamicum
MVTMSSPTDSSPSNSFSDFNREEQSRLSDEVRQLKRTNSDLGARNAKLAEMLKSSRDKLSVLFSQLEDMAQPPSVYGTFLETAKDGSNAEIFAGGRRMRVAVSPMLCAADLMPGVQVRLGEGNQVLEACDFEQTGELATLMEMIGRDRALVSDRSGEERVVKLAGPLMDRTAKLPRPGDTLLVDRKAGYAFEAIAKTEISRLALEEAPDVSYQDIGGLDDQIELIQDAVELPFLHPEMYRAYNLHPPKGVLLYGPPGCGKTLIAKAVANSLANRIGETGTSYFINVKGPELLNKYVGETERQIRVIFERARELAGDGRPVIIFFDEMESIFRTRGSGVSSDMETTVVPQLLAELDGVEDLSNVIVVGATNREELIDPAILRPGRLDIKIRINRPNKQGAHDIFTRYINDSIPLAEPAEDLIDRAVDHLYTPRPYVRLTLIDGSVETLNYHDFVSGAMIANIVDRAKKSAIKAHIDGTGVGLTAEQLIQAIDDENQQSEDLPNTSNPDEWSRITGRQGKQVTHAEVVI

SEQ ID NO: 5155 - protein, 278 aa, Corynebacterium glutamicum
MPYSGPFQAGDRVQLTDAKRRHFTIILEPGTTYHTHRGQIAHDDIIGADEGTVVHSTMGSDYLCFRHLMVDHVLSMPRGAAVIYPKDSAQILVEGDIFPGARVLEAGAGSGALSMALLRAVGEKGNVISYEIREDHLEYAVSNVEEYFGERPATWDPRLGDLKEVTVEDLGGPVDRIILDMLEPWEMLETCKDLLIPGGVFMTYVATVPQLMKVMEGIREQKCFTEPRAWESLVRDWKVEGLATRPEHRMNAHTAFLVLTRRLADGVEPPRPQRKARR

SEQ ID NO: 5156 - protein, 441 aa, Corynebacterium glutamicum
MDSHCGFGGPRCFQEFGYPCSMHVTDDFLSFIALSPSSYHAAAAVERRLLHEGFIRQEDTDEWDARPGGHVTVRGGAVVAWWVPEDASPDSGFRIIGSHTDSPGFKLKPRGDLSSHGWQQAGVEVYGGPILPSWLDRELALAGRIVLADGSVKLVNTGPILRIPHVAIHLDRTVNSQLTLNPQRHLQPVFAVGEPDVSILDVIAGAAVVDPADIVSHDLITVATQDAEVFGAHGDFLASGRLDNLSSVHPSMTALIAASQSDDTGSDILVLAAFDHEEVGSNSTSGAGGPLLEDVLNRTARALGADEDERRRMFNRSTMVSADAAHSIHPNFPEKHDQANYPIIGKGPVLKVNANQRYTSDAVTSGMWIRACQIAGVPHQVFAGNNDVPCGSTIGPISATRLGIDSVDVGIPLLSMHSAREMAGVKDLMWFEQALEAYLVN

SEQ ID NO: 5157 - protein, 278 aa, Corynebacterium glutamicum
MTSPVENVKKKPRPLALSPSRAGDYQQCPLLYRFRAIDRLPEPKTVAQVKGTLVHAVLEYMHKLPREEREYPAMVKQLKPTWAQMCEEDAELKELVPEDELYDFLVDSRTLLRGYFEMENPQGFDATECEMYVDTVLPNGVPVRGFIDRVDTAPTGQVRVIDYKTGKKPKPQWSQQAQFQMLFYALVYWRMFNEIPAQLRLMYLKVNDSMFLNPSREQLEFFERDLGDLWAKIEMDGKAGHFRTKTSKLCGWCPHQSLCPEYGGVPPEYPGWPGSTAD

SEQ ID NO: 5158 - protein, 88 aa, Corynebacterium glutamicum
MFVVAPQSRKPQHPGEILSERFLEPRGISHYDLAKTLHITEATIANFVEGRTDLTIGLAVRLSRSFDLSTQEWIALQRTFDQAHRRSA

SEQ ID NO: 5159 - protein, 403 aa, Corynebacterium glutamicum
MAVTARTDIKPHPSQPTALFTPVFILGWLVNLTQYLSFYFLITVMALYAMESFAVSEAAGGFAASSFVIGATVARVFAGWAADRFGKKQILLIFVGLGTVASLFYIPAASLPALVAVRFVHGFSYSLASTAVMALVQSVIPASRRAEGTGYFALGSTLATAFGPAIALFVIDDFNYNTLFWITTATSVFGLILTVLIRKPEFIKNAEHGRVKPVWSIKTVVHPSVMLIGFFMLAVGLAYAGVITFLNGFAQDTGLTAGAGLFFIAYAVAMLVMRFFLGRIQDKHGDNPVIYFGLISFALALGLMALATEDWHIVLAGALTGLGYGTIMPAAQAIAVDSVPSTQVGSGISTLFLFTDIGIGLGPILLGGLVAATGYNVMYAALAAVIVVAGVLYLVALGRKASH

SEQ ID NO: 5160 - protein, 526 aa, Corynebacterium glutamicum
MSKTSNKSSADSKNDAKAEDIVNGENQIATNESQSSDSAAVSERVVEPKTTVQKKFRIESDLLGELQIPSHAYYGVHTLRAVDNFQISRTTINHVPDFIRGMVQVKKAAALANRRLHTLPAQKAEAIVWACDQILIEERCMDQFPIDVFQGGAGTSLNMNTNEVVANLALEFLGHEKGEYHILHPMDDVNMSQSTNDSYPTGFRLGIYAGLQTLIAEIDELQVAFRHKGNEFVDIIKMGRTQLQDAVPMSLGEEFRAFAHNLAEEQTVLREAANRLLEVNLGATAIGTGVNTPAGYRHQVVAALSEVTGLELKSARDLIEATSDTGAYVHAHSAIKRAAMKLSKICNDLRLLSSGPRAGLNEINLPPRQAGSSIMPAKVNPVIPEVVNQVCFKVFGNDLTVTMAAEAGQLQLNVMEPVIGESLFQSLRILGNAAKTLREKCVVGITANADVCRAYVDNSIGIITYLNPFLGHDIGDQIGKEAAETGRPVRELILEKKLMDEKTLEAVLSKENLMHPMFRGRLYLEN

SEQ ID NO: 5161 - protein, 281 aa, Corynebacterium glutamicum [sequence omitted]

SEQ ID NO: 5162 - protein, 231 aa, Corynebacterium glutamicum
MIKAIFWDMDGTMVDSEPQWGIATYELSEAMGRRLTPELRELTVGSSLPRTMRLCAEHAGITLSDADYERYRAGMFARVHELFDESLVPNPGVTELLTELKALEIPMLVTTNTERDLATRSVAAVGNEFFIGSIAGDEVPTAKPAPDMYLEAARRVGFDPSECLVFEDSYNGMLGAVTAGCRVIGLHPEEVQAPEGVVPLRSLHGKNSFEGVTAEMVTAWYHQIEPAGVAK

SEQ ID NO: 5163 - protein, 1221 aa, Corynebacterium glutamicum
MSTSVTSPAHNNAHSSEFLDALANHVLIGDGAMGTQLQGFDLDVEKDFLDLEGCNEILNDTRPDVLRQIHRAYFEAGADLVETNTFGCNLPNLADYDIADRCRELAYKGTAVAREVADEMGPGRNGMRRFVVGSLGPGTKLPSLGHAPYADLRGHYKEAALGIIDGGGDAFLIETAQDLLQVKAAVHGVQDAMAELDTFLPIICHVTVETTGTMLMGSEIGAALTALQPLGIDMIGLNCATGPDEMSEHLRYLSKHADIPVSVMPNAGLPVLGKNGAEYPLEAEDLAQALAGFVSEYGLSMVGGCCGTTPEHIRAVRDAVVGVPEQETSTLTKIPAGPVEQASREVEKEDSVASLYTSVPLSQETGISMIGERTNSNGSKAFREAMLSGDWEKCVDIAKQQTRDGAHMLDLCVDYVGRDGTADMATLAALLATSSTLPIMIDSTEPEVIRTGLEHLGGRSIVNSVNFEDGDGPESRYQRIMKLVKQHGAAVVALTIDEEGQARTAEHKVRIAKRLIDDITGSYGLDIKDIVVDCLTFPISTGQEETRRDGIETIEAIRELKKLYPEIHTTLGLSNISFGLNPAARQVLNSVFLNECIEAGLDSAIAHSSKILPMNRIDDRQREVALDMVYDRRTEDYDPLQEFMQLFEGVSAADAKDARAEQLAAMPLFERLAQRIIDGDKNGLEDDLEAGMKEKSPIAIINEDLLNGMKTVGELFGSGQMQLPFVLQSAETMKTAVAYLEPFMEEEAEATGSAQAEGKGKIVVATVKGDVHDIGKNLVDIILSNNGYDVVNLGIKQPLSAMLEAAEEHKADVIGMSGLLVKSTVVMKENLEEMNNAGASNYPVILGGAALTRTYVENDLNEVYTGEVYYARDAFEGLRLMDEVMAEKRGEGLDPNSPEAIEQAKKKAERKARNERSRKIAAERKANAAPVIVPERSDVSTDTPTAAPPFWGTRIVKGLPLAEFLGNLDERALFMGQWGLKSTRGNEGPSYEDLVETEGRPRLRYWLDRLKSEGILDHVALVYGYFPAVAEGDDVVILESPDPHAAERMRFSFPRQQRGRFLCIADFIRPREQAVKDGQVDVMPFQLVTMGNPIADFANELFAANEYREYLEVHGIGVQLTEALAEYWHSRVRSELKLNDGGSVADFDPEDKTKFFDLDYRGARFSFGYGSCPDLEDRAKLVELLEPGRIGVELSEELQLHPEQSTDAFVLYHPEAKYFNV

SEQ ID NO: 5164 - protein, 190 aa, Corynebacterium glutamicum
MTDSTPQGSTPGMSPEAILNGTGKPWEEWLKLLDDVKATSWTHTHIAKHIVDNFDVSGWWAQGIAIGYEYERGMRKPGMTSDGFAANASKTLNLPVEKVWKLFGDDDLRAQWLDPALIEKTSASEPRTFNAKWLADDSRVSVNFTSKGDNKSSFGIQHRRLPDQDSIPVMKAFWKERIAALVEVSKQFSL

SEQ ID NO: 5165 - protein, 342 aa, Corynebacterium glutamicum
MMSRLQTEGAGNDHDHYEAVIIGGGQAGLATAYYLMRAGVQTLILDDQPASGGAWLHVWPSLHLFSTSDFSNLPGWPMPKFDGFPTSSHVVDYLTEYERRYEIPVSRSVSVDKVDFVNGAFHLQSGTRSWIAKNVVAATGTWSAPFVPTFPGKFSGTHWHSSNYPGVHPFVGQRIAIVGGANSGAQIAAELSEVSEVTWFTRDKPRWMPDDVDGRELFRRNRLRALAIQRGERDPGPDSELGDIVMLPEVRRARDSGKLFATPMFGSLDEIRADHLIWCTGFRPAIRPVRQLLKHGQPKVPGLYLVGYGDWTGPGSATITGVGLYAKRAAKEIAASVGKVVK

SEQ ID NO: 5166 - protein, 392 aa, Corynebacterium glutamicum
MTNVDIESILNIDRYQYTERCRMTNSTQTRAKPARISFLDKYIPLWIILAMAFGLFLGRSVSGLSGFLGAMEVGGISLPIALGLLVMMYPPLAKVRYDKTKQIATDKHLMGVSLILNWVVGPALMFALAWLFLPDQPELRTGLIIVGLARCIAMVLVWSDMSCGDREATAVLVAINSVFQVAMFGALGWFYLQVLPSWLGLPTTTAQFSFWSIVTSVLVFLGIPLLAGVFSRIIGEKIKGREWYEQKFLPAISPFALIGLLYTIVLLFSLQGDQIVSQPWAVVRLAIPLVIYFVGMFFISLIASKLSGMNYAKSASVSFTAAGNNFELAIAVSIGTFGATSAQAMAGTIGPLIEIPVLVGLVYAMLWLGPKLFPNDPTLPSSARSTSQIINS

SEQ ID NO: 5167 - protein, 140 aa, Corynebacterium glutamicum
MNNQPSVLFVCVGNGGKSQMAAALAKKHAGDALKVYSAGTKPGTKLNQQSLDSIAEVGADMSQGFPKGIDQELIKRVDRVVILGAEAQLEMPIDANGILQRWVTDEPSERGIEGMERMRLVRDDIDARVQNLVAELTQNA

SEQ ID NO: 5168 - protein, 213 aa, Corynebacterium glutamicum
MTGQAAPNLHTNILNRIANELALTYQGVFSAETINRYIFESYVSLARTAKIHTHLPILAEGFAKDRLHALAVAEGKVASPVPQVLFICVHNAGRSQIASALLSHYAGSSVEVRSAGSLPASEIHPLVLEILSERGVNISDAFPKPLTDDVIRASDYVITMGCGDVCPMYPGKHYLDWELADPSDEGEDKIQEIIEEIDGRIRELWKSIQLSQN

SEQ ID NO: 5169 - protein, 126 aa, Corynebacterium glutamicum
MTIRATFQPSVDEFISTLEEFATGSYLKEDEKEFWDEPFDVKALPDLRFILENYLDSLDKLGEAPDLDAVNASAQSTLDELEKFNTKHHGAVVEPEEKEEITKLMFDAAKQTGADDLSAEAFPEFE

SEQ ID NO: 5170 - protein, 404 aa, Corynebacterium glutamicum
MPLELFDTADQEVRLVETPPAGSDTPVGMYVCGITPYDSTHLGHAATYLAFDLIYRILLDNDHDVHYVQNITDVDDPLFERAARDGVDWRDLGTSQINLFRSDMEALSIIPPKDYIGAIESIDEVIEMVKTLLDEGAAYIVEDAEYPDVYASINATDKFGYESNYDAATMAEFFAERGGDPERPGKKNPMDALLWRAAREGEPSWESPFGAGRPGWHIECSAIATNRLGHSFDIQGGGSDLIFPHHEFSAAHAEAAHGVERMAKHYVHAGMISQDGVKMSKSLGNLEFVSRLTAAGHEPGAIRLGVFANHYRGNRDWNAESLATAEQRLATWREAARAATNREDAIAVVEQLRAHLSADLDTPGALAAVDNWAAGIDTTTDSKEFTEVGNIVVAAIDALLGVQL

SEQ ID NO: 5171 - protein, 293 aa, Corynebacterium glutamicum
MNEEITLLAAAADPAATENIGWVQTIVLSIVQGLTEFLPISSSGHLRIISELFWGADAGASFTAVVQLGTEAAVLVFFAKEIWQIITGWFAGVFNKERRGFEYRMGWMIIVATIPVVILGVLGKDLIREALRNMWITASVLILFSLVFILAEKMGKKERDYDKLTMKDAIIMGLAQCLALIPGVSRSGGTISAGLFLGLKREVATKFSFLLAIPAVLGSGLYSLPDAFAPSSGQAASGLQLTVGTLVAFVVGYISIAWLMKFVANHSFSWFAAYRIPAGLLVMLLLALGMLNP

SEQ ID NO: 5172 - protein, 316 aa, Corynebacterium glutamicum
MKQRMVGSSGLRVSRLGLGTSTWGSGTELAEAGDIFKAFINSGGTLIDVSPNYTTGVAEEMLGTMLDAEVSRSAVVISSSAGVNPALPLGRRVDCSRRNLIAQLDVTLRALNTDYLDLWSVGYWDEGTPPHEVADTLDYAVRTGRVRYAGVRGYSGWQLAVTHAASNHAAASARPVVVAQNEYSLLERRAEQELLPATQHLGVGFFAGAPLGQGVLTAKYRSEIPHDSRAASTGRDAEVQSYLDNRGRIIVDALDTAAKGLGISPAVTATTWVRDRPGVTAVIVGARTHEQLSHLLKAESVTLPTPITQALDDVSL

SEQ ID NO: 5173 - protein, 333 aa, Corynebacterium glutamicum
MSRLLPATALLASTALLLSACTQGVTDSPDMGKATPAVSPAASNPDGQVIEFGNITDMEVTDGDILGVRTEDALAIGTVSDFEAGSQVELDVDKQCGDLTATGGTFVLPCADGVYLIDAKDPDLDELRATDKPVTVAALTSDDQLLVGNGEDEELTIYREGEEPETFTVAGPNTQLIAVPVIDRHDAVVRTWNENTTIQDVDYPNDREGATLRVGLGVGQMAGGEDGLLVVSDEMGGQIAIYNADDVIRLQMTAPTDENPWAVAWDSSNALAWITSLTENTLVGYKISEGVPEEEQRLNTIADAQNLVVLSDSTLVVASATGDGIQIIDNPAS

SEQ ID NO: 5174 - protein, 371 aa, Corynebacterium glutamicum
MSKQSPTRKLRQTVYDASLKVMFTLRPERIHGIMNKALGVVDGVAPLNRTMEKIIAVHDDSLSQEVFGVTFPRPLGLAAGFDKNASMADAWGAVGFGYAELGTVTASPQPGNPTPRLFRLPADKAILNRMGFNNLGAAEVAKNLRNRKSTDVIGINIGKTKVVPAEHAVDDYRRSASLLGDLADYLVVNVSSPNTPGLRDLQAVESLRPILAAVQESTTVPVLVKIAPDLSDEDIDAVADLAVELKLAGIVATNTTISREGLNTPSGEVEAMGAGGISGAPVAARSLEVLKRLYARVGKEMVLISVGGISTPEQAWERITSGATLLQGYTPFIYGGPDWIRDIHLGIAKQLKAHGLRNIADAVGSELEWKN

SEQ ID NO: 5175 - protein, 117 aa, Corynebacterium glutamicum
MKKPTLYLNLEYGIRNSLWADKVPFPRKGVRFVTYPDELGLSNELSEKIQLWTRYWLANFVDVEDAPKGRPQWKAGSDVESWVAQGDIIESALRAELPDFAVFSKWRFYGLNVRFVQ

SEQ ID NO: 5176 - protein, 269 aa, Corynebacterium glutamicum
MSIPFSVLQDYLDLISPEALPQIPQPPAPAPTAPQLPPAPDPHSIEWPIFPPDRISANGRRYYEPQTRLEFMRIYTTLPHGYRQPFLKANNIGHCTVRTWLAAISTFSRLPHAFDDAHRFGIERTTPVDDVTTLTADDKRDLVIGYLAQPHGQGQQFLTFYQLRKHTIMAWCAAMTDGDLDADISPRQIGLMTTRTVVEIVRLRHMIAQQLERATIMENEYLKEIAALKKELAHYKQKDHQNQMVIDILGKAIGTRPNPGEGLDEEDAT

SEQ ID NO: 5177 - protein, 370 aa, Corynebacterium glutamicum
MITDLTTCARLSHNKALRLIKLSKSTAYYRNKPRPRPAPKPVLQAVPAPTAPGVEPTPEPWQGKEPAVSSVRQALAEHERQFIVDAITAYPQLSVSGVFNMLFNKGIYRASLRTWWRVAKQHKLLHKDRVSALSPGKRSPTPRVKPRLEATQPGQVVCWDVTFLPSLVRGKTYALHLAIDLFSRKIVGAKVAPTENTSTAVELLTQVLADNPGVVTVHSDNGSAMTSTRVRRLLADHGVALSLIRPRVSDDNAFVESVFHTLKYRPFYPKVFASMDQARVWVEEFVVYYNTVHPHSGVAGHTPQSVFDGSWRAAHRLRVQALDAHYRQFPQRYVGRPVVQEVAGVVRLNGARDDGSVQERVGGVASLLSA

SEQ ID NO: 5178 - protein, 162 aa, Corynebacterium glutamicum
MAGQLCGDGTRTSRVCHIMSSASGRSLKKLTSLEGRASWRKVPAAIRIGGAFVALGLVLLVFAAIELFTAGMLSPFVITPGFLLILVASIILGAFATTSKYEPSSKTQIISLSIAVALVIVSRLLPTIQVYVVEQFWLTAWGVAALLCGLVIRRAQLPKSTK

SEQ ID NO: 5179 - protein, 177 aa, Corynebacterium glutamicum
MSTYQDDRFPGPDPYAPLGEKPSFTLTSTDLENGAKLAEAQLGGTDISPQLSWSDLPEGTKSLAITCLDPDAPTGAGFWHWAVFNIPTTVTEIPTGAGDETLGGIEGVVSLKGDSGKRGFYGAQPPAGHAPHRYLFAVHALDVEKLDIAPDATPTVLGFNLYFHTLGRSIVWGWYEN

SEQ ID NO: 5180 - protein, 243 aa, Corynebacterium glutamicum
MMRSATTAWSRRCATTKVVRFRAISVAAFSNMRASSLPASLVASSMINTGGLRSTMRAREICCWISGVSSSAPAPILVSNPDGKKRRKAVVICPSPTDSSAAWSCASVACALAMRRSSARVPAKRWTSWLISATWRVVHVSVTVAVLMPPTKTAPESGRCSPAMTPASVDFPAPEVPTSAVVVPASKTRLKSSKMATPPGYLNVTSCTVTEGGSVQSADSDSCSVRRAIWARDTARPREVDAL

SEQ ID NO: 5181 - protein, 201 aa, Corynebacterium glutamicum
MLRHLLHPFRKIRLHLLCDAVPRRVRRNDDGFPASTKLFDAMCHFIQGHRIQPRGRFIQNEHLRINSQESCQSNPLALATGEIQSGLADQGIWKLKLPRHVQISTQSAQDVLTTCSMKSSAQHLRCDSAHRIQIILQHTFKHADAVRSHNDIFTNLKRLQLPINHIACLRCRRIPHRDPLFKFKGGRLRSWLSGRLIQFSD

SEQ ID NO: 5182 - protein, 599 aa, Corynebacterium glutamicum
MAQHERVADALQPASLAESWRELKTMPSGPKAWWYVSFVVISVVTVVAMVGTSNLLGYSVDLINGQSLPLIGSGSTAMIWLLGLVGAGILAETAGRALLQLVINTLARRLSVDLRKAALSSALRAPVPDVMELGTGNVISRLTQDIDNTVRIVGMVGVRLVITILILPSSLFALMTIHWTFVILFIAVIVVLIPSGRKAVRAIPSATNIVSSTEARRNNLLLDTIRGIETLRVLKLGAWGVQRMRQASWTAVQATADRAPIFTRLLALGSIAYGLLLIGVFGLSAFWVAQDAMSIGAATAAVFVVVRMEIHVFNVLFFASEIQSASTSLGRAVSLAQMARRTEQLSESADCTEPPSVTVQDVTFKYPGGVAILEDFNLVLEAGTTTALVGTSGAGKSTLAGVIAGLQRPDSGAVLVGGINTATVTDTWTTRQVALISQEVHLFAGTLAEDLRMANAHATDAQLHAALESVGLGQMTTAFRRFFPSGLDTKIGAGAEELTPEIQQQISLARIVLRNPPVLIMDEATSEAGSDDARMLEKAATEIARNRTTLVVAHRLDQAVVADRIIVMEQGTITEDGTHQELLAFEGRYAQLYQRWSAQ

SEQ ID NO: 5183 - protein, 83 aa, Corynebacterium glutamicum
MLDTNMPNTNSHVAAGNAHSNAQALLTGVEFSNLGSKGVPSSGESGTNQDHVRILGNSFVMAKTLPQLYTDSTYKAVSTTLSF

SEQ ID NO: 5184 - protein, 529 aa, Corynebacterium glutamicum
MRTWSWFVPDSPDEGTPLLPKLENSTPVKSAWALLWAFPAATWLLVFGMLVSSMFGAVVSLVVGRGSEWAFGSGELMPVLVVSVALAVLLWVIYILEGSADALTDLASARVVHNLRLELSGKLVTTPRNSLTPGEMLNTVDQDSVQIGGLKQVLNFPIMMVGYLLGSTISIAPISPLIAVLLVVGGVFTALASYFTATPLTKISAKRREAESKSVSLATDVAQGSRVVKGLGAVSQTEERFGAAADEALAIMLKEVRLQSLLTFVRQLVPAVFSVGLLAYASLLAFDGDITGGEMISVTLLVPPSLTVLGVSLGMMTEIWARGQASTKRVQNLVTELDKAAAEPRPQPATFEFEEGITVWDPSTPEARDVIDRELEALQVREDVIVAPHRVSVFEGVLKDNLNPMGTIAPEMLRAALHAASCEDILSRLGADLNMPGEFELPDTLIGEAGLNLSGGQRQRIALARFLAVDPEVLILDEPTTGLDAVTLDEVAHRVEKLRRGRKTVVITSNPTWHGVAKQMQSDFSEGVK

SEQ ID NO: 5185 - protein, 117 aa, Corynebacterium glutamicum
MSEATPYQCPFITAQGIEFFGTEPAYFGVESSGDRDAFFFPGEQLYSWELAPGKYRERGYSRSEGWREYAGLGHPSSVGTREYRNSGRSWDSLPCQIRLDFWRETQSRPRKDILEQW

SEQ ID NO: 5186 - protein, 203 aa, Corynebacterium glutamicum
MSPTVLPATQADFPKIVDVLVEAFANDPAFLRWIPQPDPGSAKLRALFELQIEKQYAVAGNIDVARDSEGEIVGVALWDRPDGNHSAKDQAAMLPRLVSIFGIKAAQVAWTDLSSARFHPKFPHWYLYTVATSSSARGTGVGSALLNHGIARAGDEAIYLEATSTRAAQLYNRLGFVPLGYIPSDDDGTPELAMWKPPAMPTV

SEQ ID NO: 5187 - protein, 363 aa, Corynebacterium glutamicum
MSDHGFLEDNLGTLTTTGGTDLGRSTAVAPEALKRARQRIDVQLLYDAVLQHDRTLMARAITLLESTAPAHRALAQELLVKLLPHSGNALRIGITGVPGVGKSTFIEAFGLHLIEQGHKVAVVAIDPSSTKTRGSILGDKTRMSKLSNAENAFIRPSPSAGTLGGVAKATREAMVVFEAAGYDIIIVETVGVGQSEVAVSHMVDIFTFLALSGAGDQLQGIKKGVLEMAELVAINKADGPNEKPAKRAARDLASALRMVRSPDELWHPPTITMSAVEGTGVDTFWHHVQNHHKTMVEAGEFDRRRRDQQVGWTWSMVHETIRMRLENDPGVQVVSQDMERALRKGSTTPTLAAQNILEAFDKA

SEQ ID NO: 5188 - protein, 737 aa, Corynebacterium glutamicum
MTSIPNFSDIPLTAETRASESHNVDAGKVWNTPEGIDVKRVFTQADRDEAQAAGHPVDSLPGQKPFMRGPYPTMYTNQPWTIRQYAGFSTAAESNAFYRRNLAAGQKGLSVAFDLATHRGYDSDNERVVGDVGMAGVAIDSILDMRQLFDGIDLSSVSVSMTMNGAVLPILAFYIVAAEEQGVGPEQLAGTIQNDILKEFMVRNTYIYPPKPSMRIISNIFEYTSLKMPRFNSISISGYHIQEAGATADLELAYTLADGIEYIRAGKEVGLDVDKFAPRLSFFWGISMYTFMEIAKLRAGRLLWSELVAKFDPKNAKSQSLRTHSQTSGWSLTAQDVYNNVARTAIEAMAATQGHTQSLHTNALDEALALPTDFSARIARNTQLLLQQESGTVRPVDPWAGSYYVEWLTNELANRARKHIDEVEEAGGMAQATAQGIPKLRIEESAARTQARIDSGRQALIGVNRYVAEEDEEIEVLKVDNTKVRAEQLAKLAQLKAERNDAEVKAALDALTAAARNEHKEPGDLDQNLLKLAVDAARAKATIGEISDALEVVFGRHEAEIRTLSGVYKDEVGKEGTVSNVERAIALADAFEAEEGRRPRIFIAKMGQDGHDRGQKVVASAYADLGMDVDVGPLFQTPAEAARAAVDADVHVVGMSSLAAGHLTLLPELKKELAALGRDDILVTVGGVIPPGDFQDLYDMGAAAIYPPGTVIAESAIDLITRLAAHLGFDLDVDVNE

SEQ ID NO: 5189 - protein, 616 aa, Corynebacterium glutamicum
MTDLTKTAVPEELSENLETWYKAVAGVFARTQKKDIGDIAVDVWKKLIVTTPDGVDINPLYTRADESQRKFTEVPGEFPFTRGTTVDGERVGWGVTETFGHDSPKNINAAVLNALNSGTTTLGFEFSEEFTAADLKVALEGVYLNMAPLLIHAGGSTSEVAAALYTLAEEAGTFFAALTLGSRPLTAQVDGSHSDTIEEAVQLAVNASKRANVRAILVDGSSFSNQGASDAQEIGLSIAAGVDYVRRLVDAGLSTEAALKQVAFRFAVTDEQFAQISKLRVARRLWARVCEVLGFPELAVAPQHAVTARAMFSQRDPWVNMLRSTVAAFAAGVGGATDVEVRTFDDAIPDGVPGVSRNFAHRIARNTNLLLLEESHLGHVVDPAGGSYFVESFTDDLAEKAWAVFSGIEAEGGYSAACASGTVTAMLDQTWEQTRADVASRKKKLTGINEFPNLAESPLPADRRVEPAGVRRWAADFEALRNRSDAFLEKNGARPQITMIPLGPLSKHNIRTGFTSNLLASGGIEAINPGQLVPGTDAFAEAAQAAGIVVVCGTDQEYAETGEGAVEKLREAGVERILLAGAPKSFEGSAHAPDGYLNMTIDAAATLADLLDALGA

SEQ ID NO: 5190 - protein, 241 aa, Corynebacterium glutamicum
MSGRLNTPISTVFHFFSSLFHDALRSVAQWSAWKKIAVSVVIVAIISVTFLVDVPPISVYRDWANNAGDAFVLVFCAFYILITQFPIPRTVLTLASGVLFGPVLGSVVALGSTTVSAVISLLIVRGLLGDWMAPRLTHPAVSRINTRLEQRGWLAITSLRMIAAIPFSILNYVAALTSVPVFSFAIATLIGSAPGTIVTVVLGDAVTGSGNWTAVAFTVFLAILGVLGIFLDQKMPVKPGK

SEQ ID NO: 5191 - protein, 199 aa, Corynebacterium glutamicum
MWALHARYRGRDTRRAELVKRFAEALSTLEGAGQFEVIGVEDIRAHITSPLTTCDVVMALLAAGDWAIGIGVIPTVDGTVDESDEAIIEQVKKISSDALRPTAKAGTVKVRIAGTKRDNTQAFNISAAFTLIGQVLSKRTIEGREATALVRSGLNQNEAAQELGISKQAMSQRLQAAGWQAESAGWQLAVNLIEQAGKR

SEQ ID NO: 5192 - protein, 432 aa, Corynebacterium glutamicum
MTGLILAIVFLVFVAVVVIKSIALIPQGEAAVIERLGSYTRTVSGGLTLLVPFVDRVRARIDTRERVVSFPPQAVITQDNLTVAIDIVVTFQINEPERAIYGVDNYIVGVEQISVATLRDVVGGMTLEETLTSRDVINRRLRGELDAATTKWGLRISRVELKAIDPPPSIQQSMEKQMKADREKRATILTAEGQREADIKTAEGEKQAKILQAEGEKHASILNAEAERQAMILRAEGERAARYLQAQGEARAIQKVNAAIKSAKLTPEVLAYQYLEKLPKIAEGNASKMWVIPSQFSDSLEGFAKQFGAKDAEGVFRYEPNTVDEETRDIANADNVEDWFSTESDPEIAAAVAAANAVANKPVDPEPGEILSKKTARRVEPEAVLEALQNGTTTQPEVEAAPPTANFAQEFPAPQANPEDYSDQHRENPYGN

SEQ ID NO: 5193 - protein, 145 aa, Corynebacterium glutamicum
MACVGAIIWFIGALVLAGLELAVGEFTLLMLGGAALATAGVALIGVPVWAEFVTFAVASAALLMFIRPAIRKRLLKPKVLDSSPRALVGHRAEVLEDVGATSGQVRLDGSIWSARSMDPTHTFAEGEIVSVIDIQGTTAIVWKEA

SEQ ID NO: 5194 - protein, 281 aa, Corynebacterium glutamicum
MSFSDPYAGNIFGGHSRNKQPEYPDVPAKPGLVVEVRGDGFVGAVTGFERTYDGDFVRLEDRRGRDALYKLRKGAFMIDGQIVNLTRFVEKQAPRKSNSGSRRVENAQAKVAAPSRIWVEGIHDAAIVEKVWGHDLRVEGVVVEYLEGLDNLEERLAEFQPGPGRRIGVLADHLVEGSKETRMTKSLPADVAVTGHPYIDIWAAVKPERLGLKAWPEVPYGEDWKTGICKRVGWSDPKEGWHRVYNAVNSFRDLDYTLIGAVERLVDFVTNLDLSKEDVLA

SEQ ID NO: 5195 - protein, 261 aa, Corynebacterium glutamicum
MEIRANVYSPLQNTAVWLGAWLYELVPTEDVIDAFVDLGGPHTFGDGGLLDMLRTLKELTSTLIDAPFHGPILTLALSGPGQVPALPAGSRAAVLASASKEGALVLGGVDKQHSWALIPTRGKDATEWNLVEVEGFLPAIATVSPGEADQLLRQATDQAANIIELSGYASLAPKSLKNPRLTVGMLSDFYDTPGLPYAVPERSAKLFARADRVAAIAETVQETIGDHSLDPQLIFLWSHIRTARMAGVSYALAEFARDYHS

SEQ ID NO: 5196 - protein, 370 aa, Corynebacterium glutamicum
MNERTSDAFDALLVLSFGGPEGHEEVRPFLENVTHGRGIPPERLDEVAVHYHHFGGISPINALNREIIANVEKELASRDHKLPVYFGNRNWKPFDNEAAEQMADDGVKNALVLATSAWGGYSGCRQYQEDIQGMIKHLESQGQSITFTKLRQFYDHPRFVSTMAQLVQDSYAKLPDELRDEARLVFTAHSIPLTADNAAGTPEDGSLYSTQVKEASALIAEAVGVSDFDVVWQSRSGSPHTPWLEPDIVDHAVELNEKGQKALVVCPVGFISDHMEVIWDLDSELMEEAEKRNMVVERVATVGPTDEFAALVVDLIEEAELKRVIERLGKLPARGSSVNGAPCGDGCCGTAKHKTARVNPNARSAAPAAN

SEQ ID NO: 5197 - protein, 600 aa, Corynebacterium glutamicum
MIALAVSGALLSSMTPAVAQPQNPDDAAIAQAEENVSAGDGEVARLAGSLSSTDAEINRVELEMGALREEVNKSLVDLHDAQAIAEQARQDALAAKKDLDDSQAQIEAAQERLDEISRAAYRQNGTSKGLSGISGNGNSEDALDRQTYLRTSAEKQQAAVEELDRLRTENANKESVLRQARIVAEQREAEAVEKQVQTEAAIAANSEQLNVLTNNRSTLVAQRDGAERNLAIARAQADNLQGQRAEYEEFQQAEQARIQAEAEAQAAAEEKRRADEAAAQAAAEAQEAAQQAQAAEEAQAAQAAETAQAQAAQAAETQAAQAAQAQAEANDRAAAQQRAAEAQAAAEQAQREADAQAANDAQAQALREQALTAASIAAAALIAASQSSHATTQNPYPTDEDADPTDIADIQGPTQPGTGESGDSQSNSSDNDSTGNDSTGSDSSDSDSSGNDSSEVISGDRSAQIETVIARAMSQLGVQYAWGGGNANGPTLGIRDGGVADSYGDYNKVGFDCSGLTLYAFAGVGISLPHYTGYQYQHGTKVSPSEMQRGDLIFYGPGASQHVAIYLGDGQMIEAPNSGSVVKISPVRWSGMTESVVRLI

SEQ ID NO: 5198 - protein, 166 aa, Corynebacterium glutamicum
MIPENIDLKQLASELGDDAVAMGEHTGNQFPTLEKDLINVVTDAKESDFGSLGVVILDETPVMTSNLRDIAQELLIQTDLDTVVVRAPMSAAVVSDVHSRAALESGQHDLLGTTDYVLGTELLVQDVTESTVGNIDWGQLLIWGLVALAIAVVVAGASVRRKAISL

SEQ ID NO: 5199 - protein, 943 aa, Corynebacterium glutamicum
MELTVTESKNSFNAKSTLEVGDKSYDYFALSAVPGMEKLPYSLKVLGENLLRTEDGANITNEHIEAIANWDASSDPSIEIQFTPARVLMQDFTGVPCVVDLATMREAVAALGGDPNDVNPLNPAEMVIDHSVIVEAFGRPDALAKNVEIEYERNEERYQFLRWGSESFSNFRVVPPGTGIVHQVNIEYLARVVFDNEGLAYPDTCIGTDSHTTMENGLGILGWGVGGIEAEAAMLGQPVSMLIPRVVGFKLTGEIPVGVTATDVVLTITEMLRDHGVVQKFVEFYGSGVKAVPLANRATIGNMSPEFGSTCAMFPIDEETTKYLRLTGRPEEQVALVEAYAKAQGMWLDEDTVEAEYSEYLELDLSTVVPSIAGPKRPQDRILLSEAKEQFRKDLPTYTDDAVSVDTSIPATRMVNEGGGQPEGGVEADNYNASWAGSGESLATGAEGRPSKPVTVASPQGGEYTIDHGMVAIASITSCTNTSNPSVMIGAGLIARKAAEKGLKSKPWVKTICAPGSQVVDGYYQRADLWKDLEAMGFYLSGFGCTTCIGNSGPLPEEISAAINEHDLTATAVLSGNRNFEGRISPDVKMNYLASPIMVIAYAIAGTMDFDFENEALGQDQDGNDVFLKDIWPSTEEIEDTIQQAISRELYEADYADVFKGDKQWQELDVPTGDTFEWDENSTYIRKAPYFDGMPVEPVAVTDIQGARVLAKLGDSVTTDHISPASSIKPGTPAAQYLDEHGVERHDYNSLGSRRGNHEVMMRGTFANIRLQNQLVDIAGGYTRDFTQEGAPQAFIYDASVNYKAAGIPLVVLGGKEYGTGSSRDWAAKGTNLLGIRAVITESFERIHRSNLIGMGVVPLQFPAGESHESLGLDGTETFDITGLTALNEGETPKTVKVTATKENGDVVEFDAVVRIDTPGEADYYRHGGILQYVLRQMAASSK

SEQ ID NO: 5200 - protein, 188 aa, Corynebacterium glutamicum
MSVAAGDKPTNSRQEILEGARRCFAEHGYEGATVRRLEEATGKSRGAIFHHFGDKENLFLALAREDAARMAEVVSENGLVEVMRGMLEDPERYDWMSVRLEISKQLRTDPVFRAKWIDHQSVLDEAVRVRLSRNVDKGQMRTDVPIEVLHTFLETVLDGFISRLATGASTEGLSEVLDLVEGTVRKRD

SEQ ID NO: 5201 - protein, 252 aa, Corynebacterium glutamicum
MVSVLLIQPRQGEAVAAAERRDFLQATGLKPQELTSRMLDTTTSRIGSLEGFDGVIVGGSPLNATNFEYSDWQRHVHRELSLLINHPLPTIFVCYGNTFLTFFSGGQIGRTHPEDSGATTVLLTDAGKRDVLTQDLPDSFTSFTGHTENSVAPAPGHVVLATGPTCPIQMLRANKNTWSVQFHADMDAVGMKNRMDFYSNYGYFSPEDYDRIIAELPSVDSIYANRVLRNFVEVCEGIRVADGAEHQLPELN

SEQ ID NO: 5202 - protein, 221 aa, Corynebacterium glutamicum
MTNKTRALLIGGHGKVALLATPMLIDASVQVTSMYRNPDHRSEIEALGATTLERDVTTLSVEDWADLLKDFDVVVWSAGNGGKNGADATYAIDRDAAIASIDGAASLGEKAPRYIMVSYIGSSTHTIDPSASFYPYAESKKAADEHLSSTNLDYLILAPAALTLDEVNGVEVIADTNEAAAGRTTSRVLVAEVITEFVVRDFPQTRVLPFVDGESPVSSIS

SEQ ID NO: 5203 - protein, 89 aa, Corynebacterium glutamicum
MFAIMTVTGQDHTGIIAAVSTALAELDVNIHNVSQTIMDQWFTMILHVGFDESVLDIATVQERMKPVEKEQGLVIRIQSEALFNAVNEI

SEQ ID NO: 5204 - protein, 131 aa, Corynebacterium glutamicum
MTSSSANAVETAAIIPVWSCPVTVMIANMGSCYNERWTRHFGSIIWGMPTLFNRSSKTYKSLHADWLDLPTELRFPVIAVAVAEFATKVSVWVSLSRRAPEKVRGPKWVWALLTIVNGVGPAAYWAFGRKN

SEQ ID NO: 5205 - protein, 464 aa, Corynebacterium glutamicum
MHMDDFSASLGFTDRSSRGILDTIEMIEKYRLDIRTVTMGISLLECARGSMEETATAVYDRVTSQAARLVEVCEGIERELGIPIVNKRISVTPIALVTAGCSGDPVDVARALDKAAKDVGVNFIGGYSALVEKGGTTSDIRLIRSIPEALSTTDVVCGSVNVASSRAGINMNAVNEMGKVVKQAAELTKDRSAIACAKLVVFANSVGDNPFMAGAFHGIEEPDCVVSVGVSGPGVVSRALGNLQGATLDQVAEEIKKAAFKITRTGQLVGAMASERLGVPFGIVDLSLAPTAEVGDSVANILEVMGLDQVGTHGTTAALALLNDAVKKGGMMACSRVGGLSGSFIPVSEDKGMIDAVRTGAISIDKLEAMTAICSVGLDMIAIPGDTPAETISGMIADEAAIGVMNHKTTAVRVIPVPGTVPGDEVDFGGLLGYAPVIPVNTVGNSEFIHRGGFIPAPVHGFRN

SEQ ID NO: 5206 - protein, 160 aa, Corynebacterium glutamicum
MPWKAPAMNGLSPTELAKTTSFAHAMAERSLVNSAACLTTLPISLTAFMLIPARDDATLTDPHTTSVVLNASGMERISRISEVVPPFSTSAEYPPMKFTPTSFAALSKARATSTGSPLQPAVTRAIGVTEMRLFTMGMPNSRSMPSQTSTRRAACDVTRS

SEQ ID NO: 5207 - protein, 152 aa, Corynebacterium glutamicum
MAASSAIMPEIVSAGVSPGIAIISKPTEQIAVIASSLSIEIAPVRTASIMPLSSETGMKDPDKPPTREQAIMPPFFTASLSSASAAVVPCVPTWSRPMTSRIFATESPTSAVGASERSTMPKGTPRRSEAIAPTSCPVRVILKAAFLISSAT

SEQ ID NO: 5208 - protein, 892 aa, Corynebacterium glutamicum
MSSPLPAAVTSKPAHALSSDEVLENLGVQDTGLTSAEATQRLEANGPNELPQTPPETVWQRLFRQVNDPMIYVLIAAAVLTAFLGHWTDTIVIGAVVIINMMVGFIQEGKAADALASIRNMLSPESAALRDGVFHKIDAAELVVGDVVKLSAGDKVPADLRMLAATNLHIEESALTGEAEAVVKGTDPVEADAGIGDRTSMAFSGTLVLTGSGTGVVTATGAGTEIGHITTMLADVDSVDTPLTRSMKKFSSALAIVCVFLAILMLVVAGLVHHTPLEELILSAIGFAVAAIPEGLPAVIAITLALGVQKMAARNAITRRLNSVETLGSVTTICTDKTGTLTRNEMTVRAIATGTSLYDVSGAGYEPLGEIRLKDGEQVSKQDFPDLYAMALVAANVNDAEIYQEDGMWRLSGEPTDGGIRAFAMKTNAEILTRTAEVPFDSAYKYMATLHTIDGANTMLVKGAPDRLLDRSAQQRNGEPLDRPYWEQLIEDLASQGLRVLAAAYKELPHSTSTITPEDVDQGELTFLGLYGIMDPPREEVIEAMKVVQSAGVRVRMITGDHSSTARAIAREVGIRGQNVLTGAEITAATDEELQGLVDNADLFVRTSPEHKLRVVRALQANGEVASMTGDGVNDAPALKQADVGVAMGIKGTEATKDAADIVLADDNFATIAGAVEMGRTIYDNLRKAVVFMLPTNGAQGLVIFIAMLLGWELPITALQVLWINLITAITLSLALSFEPAEPGIMNRKPRNPKSGLIDAPSVLRIVYVSLLLGGATFWAFLGARDAGIDIDTARTIAVTTLAVSQVFYLLSSRYFEVSALRKELFTTNPISWLCIALMLILQLAFVYLPFMQSTFDTAALTLRDWVMPLVFGVVVFAVVETEKFIRRLKAS

SEQ ID NO: 5209 - protein, 261 aa, Corynebacterium glutamicum
MVVTEPSVSTEFNRRVIAFRAAIFCTPNASVMAITAGRPSGMAATAKPMAERMSSSKGVWWTRPATTSMRIARNTHTIANADENFFIDRVNGVSTESTSASMVVMCPISVPAPVAVTTPVPLPVSTSVPENAMDVRSPIPASASTGSVPLTTASASPVSADSSMCRLVAASMRRSAGTLSPADSFTTSPTTSSAASILWKTPSRNAADSGESMLRIDANASAALPSWMNPTIMLMMTTAPITMVSVQCPRNAVSTAAAMRT

SEQ ID NO: 5210 - protein, 163 aa, Corynebacterium glutamicum
MKTSPLSYPESLHGTSEDLLIGNAKASKGWQITDRKLVLGYGEECFQNAVQQLFSWEAHQHAGITVTESDSIVELKFWSIRSYCRVLKSHQGSRRAILIYGTLEKHVERGEEAFEITMADNDQVTAHIVAFSKPAKWWAKLANPVVRLVQLRITDKYLEGLKP

SEQ ID NO: 5211 - protein, 454 aa, Corynebacterium glutamicum
MFTASIPTYELGSFSKGSYVEIKGTYFYPDTLNTLFRNSGAKDNEEFFVDVTLVPEPDNPHSTRGHAISVRWNDLVIGHIASDMTEKFQQVRRVAASGYDARVSARIWTNTNYKNERDFWVSVKLPDPDFLVPLNDPPHDGFTLLPYGTAIQVTKESDHMDVLSEFVPPSGQGQILVSLHIINAGVRKEWDGIEVRLDNQRIGELTKASSEKFAPVVRHFDDLGLSTLCRALIKGSSLAAEVTLYGARAHELSEEDLEPKSSSPLPRLVEYQSNPFNYQVPNRWPGEQNQRAPKSQKSSSSPFAAYRGPSQPSKSLTPFVAQTPAPQPSDRFIDWDSLLQPDGTPRATPFQRGVTRGLIGKHFSNQKSPRIDFATVGQCDAILRTFGEPTDKLYKDGRTSWPLWWALMAIVTLLVMLLNFIPGIGPIFPLIGLIVLGHHFWTRRKLNPPFGRSK

SEQ ID NO: 5212 - protein, 119 aa, Corynebacterium glutamicum
MCTQCRSMQRLSILQGIFQIGRIRYLCRSQRNLAHLGRLELGNRNFLIREALRGLTWFTGANLTSLLRSSSFLLGSKDLIIEETVTPLVGAGESTSESVAEQLVAKINVVPTTEIRRFI

SEQ ID NO: 5213 - protein, 52 aa, Corynebacterium glutamicum
MNYISLKPLHPFALMILTAATLTACSTSGETMSTETETTQSTKSSSMIAQPM

SEQ ID NO: 5214 - protein, 54 aa, Corynebacterium glutamicum
MNTAENPSASAEHRLSTAFGEREKDEAVQDCKNLEKVYGSDGWVDLPQETFILS

SEQ ID NO: 5215 - protein, 125 aa, Corynebacterium glutamicum
MGRPPPGDVHTLLDDIGAEESEADKVPIEWQNALTKADRYANRQHMSQARLYRQLTSDVGEGFTEEAAQYAIENVNADWNANALVKARNYQERQAMSVDRIYRQLTSEHGEGFTPEQAQYAIDNL

SEQ ID NO: 5216 - protein, 152 aa, Corynebacterium glutamicum
MMHTSSPMNELQAAGERTPPETATSVRTIPIADDLITVLDHRVAASIQGGIFETARGAPYRIASADGELRKTVTRLRECVTFHSFRHLYASRLISAGVSVKQVQRDLGHTTVSTTLDTYVPFFPGLNNQPAAEIARMMKFMRATCGRLSAGV

SEQ ID NO: 5217 - protein, 543 aa, Corynebacterium glutamicum
MIVTNDLEVRVGARTLLDAPGQLLRVQPGDRIGLVGRNGAGKTTTMRILSGETKPYGGSVTTSGEIGYLPQDSREGNIEQTARDRVLSARGLDQLRSSMERQQEIMETATDPGKLDAAIRKYSRLEEQFQSLGGYEADAEAAQICDNLGLEARILDQQLKTLSGGQRRRVELAQILFAATNGSGKSKTTLLLDEPTNHLDADSITWLRDFLAKHEGGLIMISHDVELLGAVCNKIWYLDAVRSEADVYNMGFSKYVDARALDEARRRRERANAEKKAGALKDQAARLGAKATKAAAAKQMIARAERMIDNLDEIRVADRAANIVFPEPAPCGKTPLNAKGLTKMYGSLEVFAGVDLAIDKGSRVVVLGFNGAGKTTLLKLLAGVERTDGEGGIVTGYGLKIGYFAQEHDTIDPDKSVWQNTIEACADADQQSLRSLLGSFMFSGEQLDQPAGTLSGGEKTRLALATLVSSRANVLLLDEPTNNLDPISREQVLDALRTYTGAVVLVTHDPGAVKALEPERVIVLPDGTEDLWNDQYMEIVELA

SEQ ID NO: 5218 - protein, 492 aa, Corynebacterium glutamicum
MTAGETTTMNVTLTNPFDNAIFDRAVSLERPEGWQAEDVRVSIPSGESVTIPVQVTAPLVADNGELPVEVSILDGADRYTGRLNLTVQGGQEPAPTSVKVSIPNLKDTYVAGEKISINFAVNNPFDVTVNSVPSLGEGENWMPANLRGFDPEQGTPNCRYKNLGANKSYDCTTTTYEVSDLDVERGYVDIPTVWTFTNSAGETVWSKNVDVPRVELNGTQDAVTDAIVTVDPINPVHSNGQSQTVEVQANVTSEGDLPAGSKVAFYLDSSPIDTAAVDAEGHASISIDVDNIASEQPERTFEVRARLVVPEDAPRSIARDALARFTVLSEQVQQNSLVIMNHPDVFSDGQTKTIVIAAKATAHDGSPVAIGTLIAFRVNGIERDVVPTNAQGTAKLQLDLKPVNTEDEEYEVTVEAELDELTAQTTFKVLAGEEEEPTSTEEQPSETEQPSEPEEESTGVAGSSNGGSFVALLALLAALGGIVGAVLGLLKL

SEQ ID NO: 5219 - protein, 394 aa, Corynebacterium glutamicum
MGLPFKKAGALSRRKAVFSALGAAALIGAALPTIPTAQAQTPTGYGFDATASISEEPEFSTQQLADGGTLGFDCYRIPSLGVAPNGNVLASWDGRPNNCSDAPQPNSIVGKVSTDNGATWGEQHDISAGITAEPKTGYSDPSIVVDWERGDVFNFHVKSFDAGYFTSQPGTDPDDRNVAHVAYAKSSDNGSTWVADTVITDQVVADDTWDSRFATSGNGIQLQYGAYKGRLVQPSVTRMTNGRVAAVAMLSDDHGATWYPSAPWGNSMDENKIVELSDGTLMNNSRSSGADTYRKVSYSTDGGVTWTEPTLDTQLPDPRNNASLIRVFPTAPEGSAQAKVLLFSNTATTSGRTNGTVRMSCDDGQTWPVSKVFEPGAIQYTSMATLPNGDIGML

SEQ ID NO: 5220 - protein, 236 aa, Corynebacterium glutamicum; identical to SEQ ID NO: 4569

SEQ ID NO: 5221 - protein, 81 aa, Corynebacterium glutamicum; identical to SEQ ID NO: 4568

SEQ ID NO: 5222 - protein, 87 aa, Corynebacterium glutamicum
MPIPPGLLIQLRSIFLDPAVDRGVIDRHSPLGHHLFEVAIAHAVAAVPPHRPQDDFTRELPTGEDAHGPDYSTPVFLLPQLCNSTVL

SEQ ID NO: 5223 - protein, 195 aa, Corynebacterium glutamicum
MTSKGQESSSDSTAGMDYIIRYSLNEFQRGSIVTRFETPPDKREVFGVLERYGISSTQVSEYSVSPARGVQQALTPVHQDIVEAQPSEDTSPPPLDRRKRKSGCGWVAVAIVVIAFVTPAVTAERSYTTGQSLAPSASRNLSFGERYDFCDAQLRYIAVSDENYWDEAPGFFEDRVSNNPIHPANLSFLVGCMSD

SEQ ID NO: 5224 - protein, 141 aa, Corynebacterium glutamicum
MEETMSEHTENTTEVEDQNASTFEAQSSERPEQSEADLAKASDVEEYMRDVIDPELGINVVDLGLVYDIYIINGNEAHIDMTLTSPACPLTDVIEDQARTAIVGNGIAEKMSLNWVWMPPWGPHMITEEGRAQLQALGFAV

SEQ ID NO: 5225 - protein, 149 aa, Corynebacterium glutamicum
MNLEQMYQEVILDHYKNPQHKGLRDPFDAEVHHVNPSCGDELTLRVKLSEDGSTVEDVSYEAVGCSISQASTSVMAEEIVGQPVDKALEKLTEFEKMIVSRGQFVGDEDLIGDGVAFSGVAKYPARVKCALLGWKAFQAATADAVAHAH

SEQ ID NO: 5226 - protein, 54 aa, Corynebacterium glutamicum
MVTTSIMEPPVKNGGSSSKIGDFAYTTPTPAGPSILWPENAEKSTSSSWKFTGI

SEQ ID NO: 5227 - protein, 421 aa, Corynebacterium glutamicum
MSDFLNADGSLNVDKVREEFPILKRTVRDGKPLAYLDSGATSQRPERVWRAEEHFVLHTNAPVHRGAYQLAEEATDAYEGAREKIAAFVGAEQHEIAFTKNATEALNLVAYTLGDDRSGKYRVQAGDTVVITELEHHANLVPWQELCRRTGATLKWYKVTEDGRIDLDSLELDETVKVVAFTHQSNVTGAVADVPELVRRAKAVGALTVLDACQSVPHMPVNFHELDVDFSAFSGHKMLGPAGVGVVYAKSPILDELPPFLTGGSMIEVVTMEGSTYAAAPQRFEAGTQMTSQVVGLGAAVDMLNEIGMEAIAAHEHALTAYALEKLTAIKGLTIAGPLTAEQRGGAISFGVEGIHPHDLGQVLDDQGVNIRVGHHCAWPVHRSMNVQSTARASFYLYNTFEEIDRLAAAIEKAKQFFGVE

SEQ ID NO: 5228 - protein, 252 aa, Corynebacterium glutamicum
MSTLEIRNLHAQVLPSDESAEPKEILKGVNLTINSGEIHAIMGPNGSGKSTLAYTLGGHPRYEVTAGEVLLDGENILEMEVDERARAGLFLAMQYPTEIPGVSVANFLRSAATAIRGEAPKLREWVKEVRTAQEALAIDPEFSNRSVNEGFSGGEKKRHEVLQLDLLKPKFAIMDETDSGLDVDALRIVSEGINSYKQETEGGILMITHYKRILNYVKPDFIHVFANGQIVTTGGAELADKLEADGYDQFIK

SEQ ID NO: 5229 - protein, 392 aa, Corynebacterium glutamicum
MTEVATVKAATPHNTKGDLFSSFNVEDFEIPRGRDEEWRFISLRRLRGLHNGEFAPATTSDVTVEIPADAEGASHEVVAKDDARLGRAGAPVDRVAAQAWTSKEQGNVVTFAKNSHNPTPVTITVTGKGEGVTSFGAISIEVEAGADAIVALQYVGSGTHADNVEFIVGDNARLTVITDTHWNADAVHLSNQLAQLGRDATLRHTVATFGGEVVRIVPRVRFTAPGGDAEMLGVYFADDGQYFEQRLLVDHAVPNCRSNVLYKGALQGDKNSDKPDARTCWVGDVLIRSNAHGTDTYEANRSLVLTEGARADAIPNLEIETGQIVGAGHAATVGRFDDEHVFYLQARGIPAEEARRLIVRGFFNEVINKVPVESIRGELDNRVSSELAVLGM

SEQ ID NO: 5230 - protein, 481 aa, Corynebacterium glutamicum
MTSATTNPGVNEPLTDDQIIESIGPYNYGWHDSDDAGASAQRGLSEDVVRDISAKKSEPEWMLQQRLKALSIFDKKPVPTWGADLSGIDFDNIKYFVRSTEKQAQSWEDLPEDIKNTYDKLGIPEAEKQRLVAGVAAQYESEVVYHQIREDLEEKGVIFLDTDTALKEHPEIFQEYFGTVIPAGDNKFSALNSAVWSGGSFIYVPKGVHVDIPLQAYFRINTENMGQFERTLIIVDEDAYVHYVEGCTAPIYKSDSLHSAVVEIIVKKGGRCRYTTIQNWSNNVYNLVTKRTKVEEGGTMEWVDGNIGSKVTMKYPAVWMTGPHAKGEVLSVAFAGEGQFQDTGAKMTHMAPYTSSNIVSKSVARGGGRAAYRGLVQINANAHHSTSNVECDALLVDDISRSDTYPYNDIRNDHVSLGHEATVSQVSEEQLFYLMSRGLAEEEAMAMIVRGFVEPIAKELPMEYALELNRLIELQMEGSVG

SEQ ID NO: 5231 - protein, 231 aa, Corynebacterium glutamicum
MTPVGDVVKGNDAHTGDGDTRRKILLILLERAPVIASDIAEQLQLSTVGVRRHLDNLVEENLAEAANPRQNPYEPKMRGRPAKTYRLTDKGRSIFGHEYDSLAAAALATLREVGGDDAVRQFARKRIETIVEGITPADVTDQSIEDTAKSLVEAFSRHGYAATVDATRNGLQLCQHHCPISTVATEFPELCEAEHQAVSELLGQHTQPLATIADGHGICTTNIPLTPIKHS

SEQ ID NO: 5232 - protein, 543 aa, Corynebacterium glutamicum
MEDEQSPLGATLFDVATGASSINDRDTDASGLEPEKIRRFAWLRLIGTMGALMIAFGALGAGALPVVNNPYVDFPGGNFMSRMLQTSSMIVLIGVGFLVLAWVLMAPLVGIPFKRSGNRTASVSLSMLRRTFGAWVAPIMLTAPLFTQDIYSYLAQGSVTAQGMDAYAGGPLELLGPDNHLARSVPFIWAQSPSPYGPVALSIAASISVITNDSIVGGVLAHRIASLLGVVAAGWAITMLARRCRVSEEASFYLGVLNPLLILHLIGGIHNESILLGFLLVGLELGLRGTDRIQTGLWGPAWTYIALSGVLISCAGLVKVTGFIGLGFVGMALARAFHARGHRHVVAIGVAGLVQVAALVITVVVLSVITGISLGWITGQGGAATIRSWMSMTTNIGVISGFIGMNLGLGDHTAAMLVVTRAAGIAVAAAFMVRMLFATYRGHIHAVGGLGVATFVLVILFPVVHPWYMLWAIVPLASWANRLFFQLGVIAYSTAFSFFVLPRGLALPVGTVFSIYFGAALGFSILLLVGWWSLRRNPTFGLH

SEQ ID NO: 5233 - protein, 340 aa, Corynebacterium glutamicum
MTTDFSASSSNFGAAEGALDAINPVPPNDPAIVVNNVVKRFGTKEAVAGISFEVPRGQVLALLGPNGAGKTTTIEMCEGFTAPTSGSIRVLGIDPATEPDQVRRRIGIMLQGGGSYSGIRVFEMLKLAASYNDNPHDPEWLLDLVGLREQRKTTYRRLSGGQQQRLSLALALIGRPEIIFLDEPTAGMDAQSRNMVWELVNDLRRDGVTIVLTTHLMDEAEALADHVIIVANGQILASGTPDELTAQRDHLEINVSVETTSPLDLDRLVDDLSSLNIGDVKARANRPLHYSLRTQQATPDSLAHIVQAVARQNVMIRSLDTGHRSLEDVFLDITGKELRS

SEQ ID NO: 5234 - protein, 268 aa, Corynebacterium glutamicum
MSKPFENSALRGSSRFPAGTFTPAPKRATPAKMLAAQGKMESLLFLRHGEQQLLSIIIPLVALIALANFDFIPGENSLDKTFPFALATAAMSAGFTGQAISLAFDRRYGALKRTGASGVPAWTIIFGKVIAVIAVTIVQIIFLGVTALLLGWSAPVGGVLFGIVTLFVGVSSFTALGMLMGGTLSSELVLALANLIWIVLSGLAAWAVFSPSVNAEGVLSIIPSVALSQGMVDAFNGELPWLQLGILVGWLIITGVAANKLFNFSASR

SEQ ID NO: 5235 - protein, 333 aa, Corynebacterium glutamicum
MKPITFWAPTIKVQRILALLLLIFQGGITVTGSIVRVTGSGLGCDTWPLCHEGSLVPVAGAAPWIHQAVEFGNRMLTFVLAAAALALFIAVLGAKRRREILVHSFIQGLGIILQAVIGGITVLVDLHWYAVALHFLPSMILVFMAAILYTRIGEPDDGEITTTFPTWIRNVAVIGAVALSVVLITGTMTTGAGVHSGDASITMDDRLDVSIDLMAHIHGYSMYIYLFFTLIVVAGLYKAKTTKHNKQLGLMLILFILIQAGIGILQYRMGVPRWSIPFHIAMSSVVVAFTSLLWAQGRIRVGGKATVTGSVDGDIKNEIITNPFEKKSKQPVK

SEQ ID NO: 5236 - protein, 119 aa, Corynebacterium glutamicum
MRFRLRALRWCLEQGRSDHKKTYPCQGGSSWLGGAWQNLGAEPASRRLGYRKISTRGRRRRIEKFQPTHRFRGRCRLTRKRPHLASRCHRRNRRREVCTCRWGPSHRDRYGRRPGADAH

SEQ ID NO: 5237 - protein, 543 aa, Corynebacterium glutamicum
MIALPLNGDCRARNTAVFADSETWVPFEDPFAALAAITPLATEKIEQILATTQEKFGPEPEHIKRPTRAELKQVKANGETIKLTITNELSVPTERLPAAVIAEIKHRAVIPNPEFYRRQAQRFSTFGVPRIVIRFAQAEQRLLLPRGLVDDTLRILTLAGYKVSVIWPRQTRKTIDASFEGELRSMQQEGIDSLKGQRTGVLVAPPGAGKTVMACALIANRKIPTAVIVNRAELISQWRDRLAQYLSIDADSIGQIGAGRRKTTGIIDLITVQSLSRKDSDPKILEQYGQIIVDECHNIAAPGAEAALNQVKAPYWLGLTATPFRSDHMDEIITMQCGPVRHRMEVATDNEQRLIHIHETSFDSEETTEIQDLYNELAVDSARNAQITAEVHKALEAGDRCLVLVNRIAALEALTSSITESGDHTVLVMHGRQTQEERVHLRAQLASLSEKQDPFVLVAMNKVAGEGLDIPSLNTLFLAAPVSFKGLVIQQIGRVTRATGDQNAPPVTATVHDFVDSKIPTLKRMHGRRLRAMQKEGFAVSEP

SEQ ID NO: 5238 - protein, 325 aa, Corynebacterium glutamicum
MGTMKAILVSRTGGPEVLEFTDTDAPKPTDDQVLVEVDMAGVNFIDTYYRQGEYHARLPFIPGFEGTGRVLEDPQGLIAAGTKVAWCDAMGSYAQQVCVPRDRLVAVPEGVSSEVAASMLMQGITAHYLTNGVYELEEGDSCLITAGAGGVGLLATQMAAAKGVRVYSVVSTDEKAELALDAGAYEVFRYSDNLAEQVRRHNGGRGVDVVYDGVGQSTFNESLEAVRPRGTVCLFGAASGPVEPFDPQLLNTHGSIFLTRPSIGAWTSEEGEFAKRAQAVTQAIVEGTLRVRVTGTYSLADAYIAHRDLQARSTSGSLVLEIPKD

SEQ ID NO: 5239 - protein, 323 aa, Corynebacterium glutamicum
MSDLKMQRSGGEPLDTIKAYIALTKPRVIELLLVATIPTMLQAERGENNIVLILLTVFGGWMGAAAANTFNMVADSDIDQRMGRTRARPLVRHTVSNRDASIFAWVLTVASFLWLWLLCDSMLAGIFVLITIFFYIFVYTKWLKRRTHMNIVWGGAAGCMPVLVGWAVIVDQFEPGVPQQWWQAIVLFMVIFFWTPPHTWALAMKYREDYKAAGVPMLPVVRTPVQVTAQIVWYSVATVLTTFLLIPATGWIYAAIAVISGVTFLFMAIKLHLGIKNGGKVKPLKLFILSNNYLAVLFVALSVDAVLGLETIGEMLGWTTTFF

SEQ ID NO: 5240 - protein, 700 aa, Corynebacterium glutamicum
MTTLTLSPELQALTVRNYPSDWSDVDTKAVDTVRVLAADAVENCGSGHPGTAMSLAPLAYTLYQRVMNVDPQDTNWAGRDRFVLSCGHSSLTQYIQLYLGGFGLEMDDLKALRTWDSLTPGHPEYRHTKGVEITTGPLGQGLASAVGMAMAARRERGLFDPTAAEGESPFDHHIYVIASDGDLQEGVTSEASSIAGTQQLGNLIVFWDDNRISIEDNTEIAFNEDVVARYKAYGWQTIEVEAGEDVAAIEAAVAEAKKDTKRPTFIRVRTIIGFPAPTMMNTGAVHGAALGAAEVAATKTELGFDPEAHFAIDDEVIAHTRSLAERAAQKKAAWQVKFDEWAAANPENKALFDRLNSRELPAGYADELPTWDADEKGVATRKASEAALQALGKTLPELWGGSADLAGSNNTVIKGSPSFGPESISTETWSAEPYGRNLHFGIREHAMGSILNGISLHGGTRPYGGTFLIFSDYMRPAVRLAALMETDAYYVWTHDSIGLGEDGPTHQPVETLAALRAIPGLSVLRPADANETAQAWAAALEYKEGPKGLALTRQNVPVLEGTKEKAAEGVRRGGYVLVEGSKETPDVILMGSGSEVQLAVNAAKALEAEGVAARVVSVPCMDWFQEQDAEYIESVLPAAVTARVSVEAGIAMPWYRFLGTQGRAVSLEHFGASADYQTLFEKFGITTDAVVAAAKDSING

SEQ ID NO: 5241 - protein, 360 aa, Corynebacterium glutamicum
MSHIDDLAQLGTSTWLDDLSRERITSGNLSQVIEEKSVVGVTTNPAIFAAAMSKGDSYDAQIAELKAAGASVDQAVYAMSIDDVRNACDLFTGIFESSNGYDGRVSIEVDPRISADRDATLAQAKELWAKVDRPNVMIKIPATPGSLPAITDALAEGISVNVTLIFSVARYREVIAAFIEGIKQAAANGHDVSKIHSVASFFVSRVDVEIDKRLEAIGSDEALALRGKAGVANAQRAYAVYKELFDAAELPEGANTQRPLWASTGVKNPAYAATLYVSELAGPNTVNTMPEGTIDAVLEQGNLHGDTLSNSAAEADAVFSQLEALGVDLADVFQVLETEGVDKFVASWSELLESMEARLK

SEQ ID NO: 5242 - protein, 388 aa, Corynebacterium glutamicum
MLILLQASFHGLKQFAPRSNELVHTLGLQDLEDICQVNAQSLKLGEHSVSFCRGVGQGVTVQVALLQNRVDGAFWHGVDGVWTSQLGNVKSCSVRRVLHAGGCPQWALSVGTFRQLGGVEKLLVHSVSALSVGNACLAAQSQSLIGSDCLEALVDLNVDAGDEEGSHRVDLGDVVAVCSSLLDALDERSDDLAVASNGEDQGDVNADALSQSVGDCWQRTWGCRDLDHDVWTINLCPQLLGLSQGCVAVSRDTWVNLDGHAAVVAVGGLEDAGEQITSIANVVDAHGVNSLVNRCASGLELCDLSVVGIALGHCCCENSWVGGDTDYRLFLNNLAEIAGSNALAGEVVEPSGSAELCKIINVRHETKFSLKELFLNCAQGEQASKGCA

SEQ ID NO: 5243 - protein, 484 aa, Corynebacterium glutamicum
MVIFGVTGDLARKKLLPAIYDLANRGLLPPGFSLVGYGRREWSKEDFEKYVRDAASAGARTEFRENVWERLAEGMEFVRGNFDDDAAFDNLAATLKRIDKTRGTAGNWAYYLSIPPDSFTAVCHQLERSGMAESTEEAWRRVIIEKPFGHNLESAHELNQLVNAVFPESSVFRIDHYLGKETVQNILALRFANQLFEPLWNSNYVDHVQITMAEDIGLGGRAGYYDGIGAARDVIQNHLIQLLALVAMEEPISFVPAQLQAEKIKVLSATKPCYPLDKTSARGQYAAGWQGSELVKGLREEDGFNPESTTETFAACTLEITSRRWAGVPFYLRTGKRLGRRVTEIAVVFKDAPHQPFDGDMTVSLGQNAIVIRVQPDEGVLIRFGSKVPGSAMEVRDVNMDFSYSESFTEESPEAYERLILDALLDESSLFPTNEEVELSWKILDPILEAWDADGEPEDYPAGTWGPKSADEMLSRNGHTWRRP

SEQ ID NO: 5244 - protein, 319 aa, Corynebacterium glutamicum
MIFELPDTTTQQISKTLTRLRESGTQVTTGRVLTLIVVTDSESDVAAVTESTNEASREHPSRVIILVVGDKTAENKVDAEVRIGGDAGASEMIIMHLNGPVADKLQYVVTPLLLPDTPIVAWWPGESPKNPSQDPIGRIAQRRITDALYDRDDALEDRVENYHPGDTDMTWARLTQWRGLVASSLDHPPHSEITSVRLTGASGSTSVDLAAGWLARRLKVPVIREVTDAPTVPTDEFGTPLLAIQRLEIVRTTGSIIITIYDAHTLQVEMPESGNAPSLVAIGRRSESDCLSEELRHMDPDLGYQHALSGLSSVKLETV

SEQ ID NO: 5245 - protein, 235 aa, Corynebacterium glutamicum
MVDVVRARDTEDLVAQAASKFIEVVEAATANNGTAQVVLTGGGAGIKLLEKLSVDAADLAWDRIHVFFGDERNVPVSDSESNEGQAREALLSKVSIPEANIHGYGLGDVDLAEAARAYEAVLDEFAPNGFDLHLLGMGGEGHINSLFPHTDAVKESSAKVIAVFDSPKPPSERATLTLPAVHSAKRVWLLVSGAEKAEAAAAIVNGEPAVEWPAAGATGSEETVLFLADDAAGNL

SEQ ID NO: 5246 - protein, 135 aa, Corynebacterium glutamicum
MILPVQEGISYFPTPLHLNHIGGSRLSAHVEDEDLRLDRDAVSEFGRKTHELFPGVNPEPNRFSVHYDTYTADKSPIIDAVDNVIVLTGGSGHAFKLSPAYGELAAQLAVGNTSPLYSEDFRIASHEPIKEAVHV

SEQ ID NO: 5247 - protein, 467 aa, Corynebacterium glutamicum
MQLLHNPTAMSASFDDPNLISLAGLVPTMHLADAASLSTLAQDRLSITGDKGANAGAKIASLVAGMVAGADSIDDMDVLRHGGMRRLFDRIYAPSTLGSFLRAFTFGHVRQLDAVASRFLVNLARQAPHLVPPPPAGSGGNGYVFVDVDDTIIEVHGHTKQGAGFGYSGIRGLNALLATVTTAQSAPIIVGQRLRKGSCGSPRGAHRLIADAMTTTRRLPGMEDKKILVRADSAYYGHPSVSVALRSGADVSVTVRMTPNVKKAIVAIPEDAWQTIQYTDAIFDEASQSWISLAQVAEVPFTAFTSRKKADHVPGRLVVRRIPELNKKDVYQPGLFDLHRFHAVFTTADPGVLDTVAADKTHRQHAIIEQVNADLKASALAHLPSGTFTANSAWLVCAVMAFNLTRATGVIAAGGMAKATTATIRRTLMAVPARVARRSRRLVLHLPEGWTWQPQWQKLFDHGHSPP

SEQ ID NO: 5248 - protein, 280 aa, Corynebacterium glutamicum
MKIAVIGLGSTGSMALWHLSNIPGVEAIGFEQFGISHGYGAFTGESRLFRMAYHEGSTYVPLLKRARALWSSLSEISGRELFHNFGVLSTGKEDEAPFQRLVESVERYELPHERLTAAQMRKRYPGLDFRDDEAGIVDLQGGALRPELAVFSAIETAKANGAQVRDHQKITSIEDNGDHVVIQAGEETTIVDRVIVTTGSWTSELVPSIAPLLEVRRLVLTWFLPNNPVDFQPENLPCFIRDRDGFHVFGAPCVDGYSIKIAGLDEWGVPLSLDPPMCPR

SEQ ID NO: 5249 - protein, 58 aa, Corynebacterium glutamicum
MQQDENRHEQAGDDEDDLKRQCHVENVPLPFENPGEPYAHLISNNFRQYTRVLPSRLD

SEQ ID NO: 5250 - protein, 229 aa, Corynebacterium glutamicum
MNTARSPTASSASSAPRRRLLRNSGHGWCLTASSPWHHRSPMCSSRWCCSRNSDSSQPTATTHAAPSMSSHCSKPSKISRPAPESSTNCGKLISTATTSCSATTSRKSCSVTPIPTRMADISPQTGRFTTRNCSSSNYADQPGSSFACSTAVVAPSAAVADLPTTRFLPSPGGLSKVPCASPSRARSSPLSTATPKPRAETSKPWSQPRLRHRFSTSPNSPITNARTTS

SEQ ID NO: 5251 - protein, 327 aa, Corynebacterium glutamicum
MDGASIRLIHAAWHVVVPCICQRKQLRGDLIHAVRQAELMLEGMQLACIVLEHGFRSAVSGILNCFRGDIRVTVVVSTNPGTWLDHGLQRNTLAETLTKLNSHITVDTWNLFQKAQLVVAQPYFDLVLDTWAGHTNQRGLPQNGDATADVLLDLIQLALRTSGRLRRLQSVAFTHVGGDPLLRIKNSAAASLSWVRSQNRRHLSIAQHIGHSFCANIALIEFQPGGIKSAVRRGVACIESLFTKLFIVEVFRQVSQQSEVGKCASNRCCLGWSNAVENLNQAIHFGVALGDIKRSQARLFDQFINLLAFLFRNYLTEDLTEEPDVIA

SEQ ID NO: 5252 - protein, 259 aa, Corynebacterium glutamicum
MARKPLIAGNWKMNLDHQQAIGTVQKLAFALPKEYFEKVDVAVTVPFTDIRSVQTLVEGDKLEVTFGAQDVSQHESGAYTGEVSASMLAKLNCSWVVVGHSERREYHNESDELVAAKAKAALSNGISPIVCVGEPLEIREAGTHVEYVVEQTRKSLAGLDAAELANTVIAYEPVWAIGTGKVASAADAQEVCKAIRGLIVELAGDEVAEGLRILYGGSVKAETVAEIVGQPDVDGGLVGGASLDGEAFAKLAANAASVA

SEQ ID NO: 5253 - protein, 136 aa, Corynebacterium glutamicum
MWEKPSSFRPSTRTDAAESPPPTTENASLPAVASMMAWAMPRVPSENAANSNTPIGPFQKMVLAVLRTSPKFLTDSGPMSRDIQPSGMESRSTICFSASLLNSDAATRSTGRTILSPKRASRSVQVAFISSCRRDC

SEQ ID NO: 5254 - protein, 405 aa, Corynebacterium glutamicum
MAVKTLKDLLDEGVDGRHVIVRSDFNVPLNDDREITDKGRIIASLPTLKALSEGGAKVIVMAHLGRPKGEVNEKYSLAPVAEALSDELGQYVALAADVVGEDAHERANGLTEGDILLLENVRFDPRETSKDEAERTAFAQELAALAADNGAFVSDGFGVVHRAQTSVYDIAKLLPHYAGGLVETEISVLEKIAESPEAPYVVVLGGSKVSDKIGVIEALAAKADKIIVGGGMCYTFLAAQGHNVQQSLLQEEMKATCTDLLARFGDKIVLPVDLVAASEFNKDAEKQIVDLDSIPEGWMSLDIGPESVKNFGEVLSTAKTIFWNGPMGVFEFAAFSEGTRGIAQAIIDATAGNDAFSVVGGGDSAASVRVLGLNEDGFSHISTGGGASLEYLEGKELPGVAILAQ

SEQ ID NO: 5255 - protein, 334 aa, Corynebacterium glutamicum
MTIRVGINGFGRIGRNFFRAVLERSDDLEVVAVNDLTDNKTLSTLLKFDSIMGRLGQEVEYDDDSITVGGKRIAVYAERDPKNLDWAAHNVDIVIESTGFFTDANAAKAHIEAGAKKVIISAPASNEDATFVYGVNHESYDPENHNVISGASCTTNCLAPMAKVLNDKFGIENGLMTTVHAYTGDQRLHDAPHRDLRRARAAAVNIVPTSTGAAKAVALVLPELKGKLDGYALRVPVITGSATDLTFNTKSEVTVESINAAIKEAAVGEFGETLAYSEEPLVSTDIVHDSHGSIFDAGLTKVSGNTVKVVSWYDNEWGYTCQLLRLTELVASKL

SEQ ID NO: 5256 - protein, 327 aa, Corynebacterium glutamicum
MSLTSDIKQELAQVHVAKNSVRAAEVSAILRFAGEMQAVGGKLVIEANLDSMQVGMRLQEFIQGLYNSRVDVHTVNPTVSRKTPRYLVRIIDNADEIARRTGLVTRSGHVVKGLAPSVVSGTISDAEAAWRGAFLANGSLSDPGRSSSLEVLCPGQESALALVGCARRIGIAAKTKDSRGFDRVNVRDAEAIGALLTRMGAQKTRMLWEEKRIKRESRTPANRLANFDDANLRRSARAAVAAAARVERAMKILGDDVPEHLAEAGQLRVQHRQASLEELGRLADPQMTKDAVAGRIRRLLTMADKRAEDLKIPDTNSVVTEDLLEEI

SEQ ID NO: 5257 - protein, 341 aa, Corynebacterium glutamicum
MTTFFDAPNGTPEEAPLERPRVITSLGGGHGLFQTLRAAQICSPTTINAVVTVADDGGSSGRIRRELGQIPPGDLRMALAALIADAEEGGLWENLLQHRFGGHGALAGHALGNLVIVALTDILGTSQHALDQIAQLAGAKGRIIPVCAEPLDLEAEVSGLDSDARVMRQVRGQVAVAATPGQVRRVRIIPDNPEPNPAAIEAILDADLVTLGPGSWFSSVIPHILVPGIVDALAQTKATKTVVLNLTSEPGETAGFSAERHIHVLRQHARNLQVDQVIVDAKTLSSQTERNHVERAARTLGAEVSFHDVQAEDGRGRFTSIHDPAKLCAALLASFAGARKR

SEQ ID NO: 5258 - protein, 309 aa, Corynebacterium glutamicum
MIQSTGVTHTDKSAQENPVKYRDNFTPVIITGMSGAGLSTAARVLEDLGWYVAHNIPPQIILELIDMCAREDSPVDKVAVVCDVRSREFRGSLTQVVSELRDKQLDPTVLFLEARDEVLIKRFDNVRRTHPLQGSQTLQVGIERERTVLSPVKEDASVVIDTSDLSVHDLRRAIESSFRTIATRTQHVTIESFGFKHGSPRDADFVVDVRFLPNPFWVPELRPFRGVDKPVSDYVLSQKGAEEFLNNFVDMLKDMLPGYRHEGKNFITIGVGCTGGHHRSVAVSEELAKRIADQTTLDVSVVHRDINRH

SEQ ID NO: 5259 - protein, 696 aa, Corynebacterium glutamicum
MADPTTYRPAPGTIPTEPGVYKFRDENRRVIYVGKAKNLRSRLSNYFQDVTQLHPRTRQMVFAASSVEWTVVSSEVEALQLEYTWIKRFDPRFNVKYRDDKTYPMLAVSTGERFPRAFFFRGPRRKGVRYFGPYSHAWAVRETLDLLTRVFPMRTCSKGVFNRHESLGRPCLLGYIDKCAAPCVGRVSEEEHREIVDGFTSFMAGHTDKVTRKLNADMMAAAEELDFERAARLRDDLEAIDKVMEKQAVVLGDGTDADIIAFATDQLEAAVQVFNIRGGRIRGQRGWVVEKPGDYAGLLVDATTQPEGDAPETDPALPFLMQDFLVQFYGDAVERAETEAKEDAAVIERRGVDKHSFEEAAPVTRASVVPREILVQVAPNEAEQTLKVLEELRGAGVDARVPQRGDKRALMETVERNAKELLKQHKLKRVGDLTARSAALQELQEALDMEQAPLRIECTDISHIQGTDVVASLVVFEDGLPRKSDYRRYRVKEAAGDGHSNDVASIAEITRRRFLRHNQDKLAVPEAEEFDGSTFSDEKVEEMSTDARRFAYPPQIFIVDGGAPQVAAAQEVFDELGIVDVVLIGLAKRLEEIWLPGDPDPVILPRNSQALFLLQQIRDEAHRFAITYHRQQRSKRMRVSELDSIKGLGQSRRTELVKHFGSVAKLKEASVEDISQVKGFGPKLAEAVYEGLHASK

SEQ ID NO: 5260 - protein, 193 aa, Corynebacterium glutamicum
MTTNAPDGATNNINNAHSGAVGKPKVQLSDAEIQEYTAAFAGTTTTKPWELEVTTKFLKKIAWVAVVVIMAVHIFMGAVVDVDFTGAAVTFVDTLAFPALGIIFSVLVFLGLTRPRVRANEDGVEVRNFIGTRFYPWVVIYGMSFPKGSSVARLELPDFEFVPMWAFQSRDGEDVVRAVATFRDLENKYMPED

SEQ ID NO: 5261 - protein, 159 aa, Corynebacterium glutamicum
MAKEGLPAVELPDASGLKVAVVTARWNAEICDRLHKHAVDAGRAAGATVSEYRVIGALELPVVVQELARTHDAVVALGCVVRGGTPHFDYVCDSVTEGLTRIALDTSTPIGNGVLTTNTEEQAVERSGGEGSVEDKGAEAMVAALDTALVLSQIRATEG

SEQ ID NO: 5262 - protein, 76 aa, Corynebacterium glutamicum
MPRPSCPRMYTTTPRPASWIRRKDSCSCCPQSQRRDPKTSPVKHSEWTRTRTFSPPSDATSPATMATSSVPSMMER

SEQ ID NO: 5263 - protein, 238 aa, Corynebacterium glutamicum
MPTHVHHYSPTSFLDQAQRLVQLLSTVAAPGSKNITSQALRVDSNQDVFATVGCHVAGNNGNKLGAIDDGTVTNSLERAEIGRQHSFHLALHQNFILATPLNELLNRDQLQIVLIAEAAQLRNPSHAGGVLFTDHFADNTCWAQACSASQIDSCFGVSSAHQDATFTSTQWHNVSGTGEIRAVGFWISKQAQSVGAVCCRNACGAGVGINGHGVSGAAGILIVRGHRRQIKTICILCG

SEQ ID NO: 5264 - protein, 112 aa, Corynebacterium glutamicum
MSCSIEISFRSCSSQKRRSSGTRAMPVGSSSLTTSQITPAGRRPAARAKSTAASVCPARTKTPPSRARSGTTCPGRVKSVRSASGSASKRKVWARSVAEMPVVPVLASTVTV

SEQ ID NO: 5265 - protein, 422 aa, Corynebacterium glutamicum
MSEHEQAHSQLDSVEEAIADIAAGKAVVVVDDEDRENEGDIIFAAELATPELVAFMVRYSSGYICAPLTAKDADRLDLPPMTAHNQDARGTAYTVTVDANTGTTGISATDRAHTLRLLADPEADRTDFTRPGHVVPLRAREGGVLVRAGHTEAAVDLARAAGLRPAGVICEVVSEEDPTGMARVPELRRFCDEHDLKLISIEQLIEWRRKNEILVERQVETVLPTDFGTFKAVGYRSIIDGTELVAIVAGDVASDGGENVLVRVHSECLTGDVFGSRRCDCGQQLHESLRLIQEAGRGVVVYMRGHEGRGIGLLAKLRAYQLQDEGADTVDANLALGLPADAREFGTSAQILYDLGVRSLNLISNNPAKKVGLEGHGISIASRTPIPVAVHEDNVRYLKTKRDRMGHDLPDVALWEQEHPEN

SEQ ID NO: 5266 - protein, 211 aa, Corynebacterium glutamicum
MFTGIVEELGSVAGVEHLGDSIRMQISASTVLEGVHLGDSISVNGVCLTVASFGEGHFTADLMQETLDRSSLGALSTGSKVNLERAMAADGRLGGHIMQGHVDATTSLIKRTSSENWDVLRFELPADLARYVVEKGSIALNGTSLTVSSLGDDWFEVSLIPTTLRDTTHGELAVGDIVNIEVDVIAKYVERMMTRGVAGNTPNDYTDFTRD

SEQ ID NO: 5267 - protein, 328 aa, Corynebacterium glutamicum
MDVAHALDLAHHVSDQVRGTTSPNPPVGAVILDADGEVVGVGATAPPGGPHAEVVALAAAGVRANGGTAVVTLEPCNHYGRTGPCSKALLDAGIAHVFYANADPFPSAAGGGAFLAEAGVDTHFLDERIRALEPWLVATRLGRPHVTLKFASTVDGFAGATDGTSQWITGPDARAFVHEDRSKRDAIIVGTGTALTDNPSLTARTDTGLYENQPRRVVIGSREVPADSNLARLGYEQYAGIPEALSALWDKGCRDILIEGGPTLAGAALRLGIVDQVQAYVAPALLGAGRSVINWPQETTMDQIMRFDTTSVRQLGSDVLIEMMRKEH

SEQ ID NO: 5268 - protein, 219 aa, Corynebacterium glutamicum
MAQRTPLIAPSILAADFSRLGEQVLAVPDADWIHVDIMDGHFVPNLSFGADITAAVNRVTDKELDVHLMIENPEKWVDNYIDAGADCIVFHVEATEGHVELAKYIRSKGVRAGFSLRPGTPIEDYLDDLEHFDEVIVMSVEPGFGGQSFMPEQLEKVRTLRKVIDERGLNTVIEIDGGISAKTIKQAADAGVDAFVAGSAVYGAEDPNKAIQELRALAQ

SEQ ID NO: 5269 - protein, 444 aa, Corynebacterium glutamicum
MRALGVDKPREIAFEVLDRVRTGEAYANLVLPRLLSKHNLSGRDAAFATEITYGTLRNVGLLDEVIKAASGRELSDIDPEVLDVLRLGAYQVMFTRVEDHAAVDTSVKMVGGLKKFQATGFANAILRNITRKEPEQWLKELEPAEELARVAFRTAHPRWIAQSFSQVLPADELEAALAADSERPVVHLVARPGEISAEELALITGGDEGKYSPYAVYLEGGDPGDIEPVKDGLAAVQDEGSQLIARALVEIPVEGTDAGRWLDMCAGPGGKAALIGALARMDRATVDAVEVSDHRARLIEKSVRGLPVKVHVGDGRTINLTGGYDRALVDAPCSGLGALRRRPEARWRKQESDIVELNTLQYELLESAVNKVRSGGVIVYSTCSPDLRETRGIVDKALGALEIEELEAAEFMPGMTDTGDEKSVQMWPHRHGTDAMFVAVLRKK

SEQ ID NO: 5270 - protein, 315 aa, Corynebacterium glutamicum
MRLVFAGTPEPAVVALQKLIDSDHEVVAVLTQPDARRGRGRTLHPSAVAELAQQHGIEVLKPTSLKADTEDGQAIRQRLAELAPDCLPVVAYGQLITKDLLDVAPHGWVNLHFSLLPAWRGAAPVQASIREGDQITGATTFRIDEGLDTGVILSTIEDTIQPTDTADDLLTRLAYSGGDLLVETMTGLEQGTITPRAQEGEATYASKITTQDAQIDWSKPAEVIDRHIRAHTPGPGAWTTLVDARLKVGPISHSGEVEVAADLAPGAILAQKNSVVVGTGTTPIVLGNIQPPGKKMMNAADWARGVQLDQEAKFQ

SEQ ID NO: 5271 - protein, 169 aa, Corynebacterium glutamicum
MAVREVRLFGDPVLVSRADEVVDFDESLSTLIDDMFDTMEDAGGVGLAANQVGVLRRVFVFDTSHQEGGLRGHVINPVWEPLTEDTQTGKEGCLSIPDVSAETTRYETVRLSGQDRDGNPVGFVANGLLARCIQHETDHLDGVLFLKRLDPAERKAAMGVIRASAWFNK

SEQ ID NO: 5272 - protein, 688 aa, Corynebacterium glutamicum
MAKTRVPAPEKSVARVLPLLGLPHLDRLFDYRISEDQHDDVQPGVRVRVRFGGRLVDAIVMSRTAQTSHEGKLMWLDRVISPIVVYPPQTAKLIEQLSDRYGGVRSDLIRSALPARHAGAEEADTSTSWESLGEVKEPDLSSWSAYQHGQSFVDAVLAGTTARASWQIAPGDDWALALASLAVKVVKDGGGALLVVPDQRDLDRLEAALRGLVAAKQITVLNSGLGPQARYRRFLSVLSGQGRLIIGTRSAAFAPVKDLKLAVILNDGDDNLVDPRAPYAHAREVLTTRSSLEASSLIIAGHARTAETQLLVESGWMHNLIAPRDTIRTRMPRIQAVGDSDFQMERDPMARSARLPGIAFHAVRSALERDQPALIQVPRKGYVPTLACGNCRTPARCRHCNGPVGLPQGSSDLAGVPTCRWCGRPDSRFKCQNCGSPKLRAVVLGTERTAEELGRAFPSVRVITSGGNKVVDSVENRASIVVSTPGAEPFVANSPERPEKSEKPEHKGAYGALLLLDTWALMGRQDLRAMEDALHKWAAAATLVHSHLHQGQVIVVADPSFPAVQSLIRWDMAGAAAQELASRREVMFPPSVHMAAIDGATAALESFLDLAELPDHAEVLGPVDLPPGVSLPGEYDEQRFGPPQRLLIRTPLGPRSELGRALRSAQVARAVRKNDLPLRIQMDPIHIG

SEQ ID NO: 5273 - protein, 407 aa, Corynebacterium glutamicum
MAQPTAVRLFTSESVTEGHPDKICDAISDTILDALLEKDPQSRVAVETVVTTGIVHVVGEVRTSAYVEIPQLVRNKLIEIGFNSSEVGFDGRTCGVSVSIGEQSQEIADGVDNSDEARTNGDVEEDDRAGAGDQGLMFGYATNETEEYMPLPIALAHRLSRRLTQVRKEGIVPHLRPDGKTQVTFAYDAQDRPSHLDTVVISTQHDPEVDRAWLETQLREHVIDWVIKDAGIEDLATGEITVLINPSGSFILGGPMGDAGLTGRKIIVDTYGGMARHGGGAFSGKDPSKVDRSAAYAMRWVAKNIVAAGLADRAEVQVAYAIGRAKPVGLYVETFDTNKEGLSDEQIQAAVLEVFDLRPAAIIRELDLLRPIYADTAAYGHFGRTDLDLPWEAIDRVDELRAALKLA

SEQ ID NO: 5274 - protein, 420 aa, Corynebacterium glutamicum
MTHVSSPSAPRNVVVGVAGGIAAYKACHIVRAFKEAGDNVRVVPTESALKFVGKATFEALSGNPVSTTVFDAVDSVQHVKVGQEADLIVIAPATADLMARVVAGRGDDLLAATLLVATCPVVIAPAMHTEMWFNPATVANVATLRQRGITVIEPAHGRLTGKDTGPGRLPDPEQIVDLANAVHAGARLPQDLAGKKVLITAGGTHEHIDPVRFIGNSSSGRQGFALGEIAAQRGAHVSIVAGNAAELPTPAGAEIVPVVSTQDMFDAVQERAGQSDFIVMAAAVADFTPASQATSKLKKGSDSDEDALSTISLVENPDILATTVKRREAGELDSNPVIVGFAAETGDEHTTALEYARKKLQKKGCDLLMCNEVGMGKVFGQKHNEGWILDAHGGVVDVEHGSKIEVAAQIWDAALAYREV

SEQ ID NO: 5275 - protein, 97 aa, Corynebacterium glutamicum
MSVTNVSNETNATKAVFDPPVGITAPPIDELLDKVTSKYALVIFAAKRARQINSFYHQADEGVFEFIGPLVTPQPGEKPLSIALREINAGLLDHEEG

SEQ ID NO: 5276 - protein, 209 aa, Corynebacterium glutamicum [sequence omitted]

SEQ ID NO: 5277 - protein, 106 aa, Corynebacterium glutamicum
MALPQLTDEQRKAALAKAAEARKARAELKENLKRGNTNLREVLDKAESDEIIGKTKVSALLEALPKVGKVKAKEIMDELGIAQTRRLRGLGDRQRRALLERFGFED

SEQ ID NO: 5278 - protein, 278 aa, Corynebacterium glutamicum
MTFGEKLLNAASTRGRLCVGIDPHESLLTSWGLPVNVDGLAEFSRACVEAFADTVALVKPQVAFYERFGSAGFAILEETIQTLRERGCLVVSDAKRGDIGSTMAGYASAWLDPASPLSSDAVTVSPYLGFHSLDPVFELAEQHGRGVFVLAATSNPEARELQDQQNADGVSISQQIVDQAAALNAPYMAQGKAGNIGVVIGATLSKPPRLSTLGGAILMPGVGAQGGTASDVDEIAGDMAHLAFPNVSRSILATGPDIAEMKNSVAKNAADFPGFPRS

SEQ ID NO: 5279 - protein, 1113 aa, Corynebacterium glutamicum
MPKRSDINHVLVIGSGPIVIGQACEFDYSGTQACRVLKEEGLRVTLINSNPATIMTDPEMADHTYVEPIEPEYIDKIFAKEIEQGHPIDAVLATLGGQTALNAAIQLDRLGILEKYGVELIGADIDAIERGEDRQKFKDIVTTIGGESARSRVCHNMEEVHETVAELGLPVVVRPSFTMGGLGSGLAYNTEDLERIAGGGLAASPEANVLIEESILGWKEFELELMRDTADNVVVICSIENVDALGVHTGDSVTVAPALTLTDREFQKMRDQGIAIIREVGVDTGGCNIQFAINPVDGRIITIEMNPRVSRSSALASKATGFPIAKMAAKLAIGYTLDEITNDITGETPAAFEPTIDYVVVKAPRFAFEKFVGADDTLTTTMKSVGEVMSLGRNYIAALNKALRSLETKQQGFWTKPDEFFAGERATDKAAVLEDLKRPTEGRLYDVELAMRLGASVEELYEASSIDPWFLAELEALVQFRQKLVDAPFLNEDLLREAKFMGLSDLQIAALRPEFAGEDGVRTLRLSLGIRPVFKTVDTCAAEFEAKTPYHYSAYELDPAAESEVAPQTEREKVLILGSGPNRIGQGIEFDYSCVHAALELSRVGYETVMVNCNPETVSTDYDTADRLYFEPLTFEDVMEVYHAEAQSGTVAGVIVQLGGQTPLGLADRLKKAGVPVIGTSPEAIDMAEDRGEFGALLNREQLPAPAFGTATSFEEARTVADEISYPVLVRPSYVLGGRGMEIVYDEASLEDYINRATELSSDHPVLVDRFLDNAIEIDVDALCDGDEVYLAGVMEHIEEAGIHSGDSACALPPMTLGAQDIEKVREATKKLALGIGVQGLMNVQYALKDDILYVIEANPRASRTVPFVSKATGVNLAKAASRIAVGATIKDLQDEGMIPTEYDGGSLPLDAPIAVKEAVLPFNRFRRPDGKTLDTLLSPEMKSTGEVMGLANNFGAAYAKAEAGAFGALPTEGTVFVTVANRDKRTLILPIQRLALMGYKILATEGTAGMLRRNGIECEVVLKASDIREGVEGKSIVDRIREGEVDLILNTPAGSAGARHDGYDIRAAAVTVGVPLITTVQGVTAAVQGIEALREGVVSVRALQELDHAVKA

SEQ ID NO: 5280 - protein, 393 aa, Corynebacterium glutamicum
MSKDTTTYQGVTEIGSVPAYLVLADGRTFTGFGFGAIGTTLGEAVFTTAMTGYQETMTDPSYHRQIVVATAPQIGNTGWNDEDNESRDGKIWVAGLVIRDLAARVSNWRATTSLQQEMAGQGIVGIGGIDTRALVRHLRNEGSIAAGIFSGADAQRPVEELVEIVKNQPAMTGANLSVEVSADETYVIEAEGEERHTVVAYDLGIKQNTPRRFSARGVRTVIVPAETPFEDIKQYNPSGVFISNGPGDPAAADVMVDIVREVLEADIPFFGICFGNQILGRAFGMETYKLKFGHRGINVPVKNHITGKIDITAQNHGFALKGEAGQEFETDFGTAIVTHTCLNDGVVEGIALKSGRAYSVQYHPEAAAGPNDASPLFDQFVELMDADAQKKGA

SEQ ID NO: 5281 - protein, 447 aa, Corynebacterium glutamicum
MVDSNTQYPETGALAPAPADSLLISNVLVYGEGEPTNVFVKDGVIAAIGGTHEADRTIDGNGGVLLPGFVDMHVHLREPGREDTETIATGSAAAAKGGFTAVFTMANTTPVMDQPVIAESVWFKGQNIGLCDVHPVGSITKGLEGKELTEFGMMARSEAKVRMFSDDGKCVDDPQVMRRALEYAKGMDVLIAQHAEDHRLTEGASAHEGENAARLGLRGWPRVAEESIVVRDAIMARDYGNRVHICHASTEGTVELLRWAKSQGIPITAEVTPHHLTLTDERLETYDAVNKVNPPLRESRDAEALKKALLDGTIDVVATDHAPHGSEDKCCEFENAKPGMLGLETSLSIIVDTFVATGLADWRFVARVMSERPAEITRLPGQGRPIAEGEPANLAIVDPGKTWTASGADFASKAENTPFEGQEFSAKVTHTVLRGKVTCADGVAQNA

SEQ ID NO: 5282 - protein, 312 aa, Corynebacterium glutamicum
MKHLLSISDLSKDEIVGLLDEADRFKEVLEGREVKKLPTLRGRTIFTLFYENSTRTRSSFETAGKWMSADVINISASSSSVKKGESLKDTGLTLSAIGADAIIMRHPASGAAQQLAQFVAPGGNGPSVINAGDGSHQHPTQALLDALTIRQRTGRIEGLKVVIVGDCLHSRVVRSNVDLLSTLGAEVVLVAPPTLLPIGVENWPVRFSYDMDAEIADADVVMMLRVQQERMQGGFFPSHREYATLYGMSKEREARLKDSAIIMHPGPMLRGMEINFQVADAPRTAVLQQVSNGVHMRMAILFALVAGSDATI

SEQ ID NO: 5283 - protein, 192 aa, Corynebacterium glutamicum
MSERNSAVLELLNEDDVSRTIARIAHQIIEKTALDSKDADRVMLLGIPSGGVPLARRLAEKIEEFSGVSVDTGAVDITLYRDDLRNKPHRALQPTSIPAGGIDNTTVILVDDVLFSGRTIRAALDALRDVGRPNYIQLAVLVDRGHRQLPIRADYVGKNLPTARAEDVSVMLTEIDGRDAVTLTREDSEGDS

SEQ ID NO: 5284 - protein, 388 aa, Corynebacterium glutamicum
MFAYRQTQLIEDLKFLSRTSTLFDGSPLTVAITGSRGLVGRALTAQLQTGGHEVIQLVRKEPKPGQRFWDPLNPASDLLDGADVLVHLAGEPIFGRFNDSHKEAIRESRVLPTKFLAELVAESTQCTTMISASAVGFYGHDRGDEILTEESESGDDFLAEVCRDWEHATAPASDAGKRVAFIRTGVALSGRGGMLPLLKTLFSTGLGGKFGDGTSWFSWIAIDDLTDIYYRAIVDAQISGPINAVAPNPVSNADMTKILATSMHRPAFIQIPSLGPKILLGSQGAEELALASQRTAPAALENLSHTFRYTDIGAAIAHELGYEQLADFAQQQEIEAERKQERAELKAAKKIAKKAPVLEESPTNLEDPEEVEQSILSSILNFRRKRND

SEQ ID NO: 5285 - protein, 159 aa, Corynebacterium glutamicum
MPQSPTAHDPNDIQEFNLDAVAGILQDEKLDYRIDEHDGEKVIRTGFINAAISFILLDGSLTMEAMWRGAPSTDAAAQVLAATNEWNLTQFAPTIRFFELNEGTLAINALRHVVVSAGMSHNQVGSYVMSSIESAVQCFEWLEQQFPDLVTWKDEHHDH

SEQ ID NO: 5286 - protein, 154 aa, Corynebacterium glutamicum
MTTDSNSATIPTPKPIPVTIDRISLIMKEFGIDLSIADEQGTGSQVASANLNGHHVMFAVIGSVLIVRADRATEMPVSDGNPAWHLACNQVNCFNFAAKAVVVDRTDNIVIRAEKDVPIAAGLNDIQLSAMLKNAIDHVLAIQDAVANAGKEIG

SEQ ID NO: 5287 - protein, 70 aa, Corynebacterium glutamicum
MQARKSANMSDESIEEQEKELAALKAQIDELEKKDKQNKLIIEILSKAVEKNVAEAEAKRARKYPPNPLW

SEQ ID NO: 5288 - protein, 227 aa, Corynebacterium glutamicum
MSERRQDYKRHGSRYKARMRAVDILFEAESRDVDPVAIIDDRHKLARDTNPIVAPVAEYTETIINGVAVELDTLDVFLAEHIAETWTLGRLPSVDRAILRVASWEMIYNADVPVTTAIVEAVEIASEYSGDKSSAYINATLDAMASKVETLRERAANPEAVLAEASESLDDAPVAPWDDSDALDDSDEDFEAVDAAEVFEAEETVEVSEVAEDSEVSKVSEEKADES

SEQ ID NO: 5289 - protein, 187 aa, Corynebacterium glutamicum
MATTADFKNGLVLKNEGKLQQIIEFQHVKPGKGPAFVRTKLKDVVTGKTIDKTWNAGVKVETATVDRRDVTYLYNDGTSFIVMDDKTFEQYELSPDAFGDAGRFLLENMRVQVSFHEGEALFGELPVSVDLRVEHTDPGLQGDRSTGGTKPATLETGAEIQVPLFIETGNVLKVDTRDGSYLSRVNN

SEQ ID NO: 5290 - protein, 363 aa, Corynebacterium glutamicum
MALADTRFATRRRALAAKLAAQRIDSILVTSPIHVRYLSGFTGSNGALIVNKDLSAQICTDGRYTTQIAEEVPDIEALIERASATTLLAQVEGPRRIAIEAAQTTLDQLDSLREATQEDVELIPVSGVVESIRLTKDSFELDRLRDVAALASQAFEDLLAAGELAEGRSERQVAADLEYRMRLLGAERPSFDTIVASGPNSAKPHHGAGDRILQRGDLVTIDFGAHARGFNSDMTRTLVMGEAGEFEAEIYDIVLRSQLAGVEAAYSGANLFDIDAACRKIIEDAGYGEYFVHSTGHGIGLEVHEAPSASKTSQGVLETGSTLTIEPGIYVPGKGGVRIEDTLIITSGAPEIITKVSKDLIVV

SEQ ID NO: 5291 - protein, 365 aa, Corynebacterium glutamicum
MSAVQIFNTVHVNGSSPYDVHIGSGLNELIVQRAAESGAEQVAILHQPSMDDIASELDAALVAAGLKVLHLNVPDAENGKSLEVAGQCWDELGGAAFGRRDIVIGLGGGAATDLAGFVAAAWMRGVRVIQVPTTLLAMVDAAVGGKTGINTAAGKNLVGAFHEPDAVFIDTDRLATLPDAEIIAGSAEIIKTGFIADPEILRLYETDPAACLKKEVEGSHLPELIWRSVTVKGSVVGQDLKESSLREILNYGHTFAHAVELRENFRWRHGNAVAVGMMFIANLSHKLGLIDAPLLERHRSILAAIGLPTSYEGGAFDELYDGMTRDKKNRDGNIRFVALTAVGEVTRIEGPSKQDLQSAYEAISH

SEQ ID NO: 5292 - protein, 164 aa, Corynebacterium glutamicum
MVLVGLPGAGKSTIGRRLARALNTELVDSDELIERATGKACGAVFSELGEPAFRELEAIHVAEALKSSGVVSLGGGSVLTESTRELLKGQDVVWIDVPVEEGIRRTANERSRPVLQAADPAEHYRNLVKVRTPLYEEVATYRLRTNNRSPQQVVAAVLHHLEID

SEQ ID NO: 5293 - protein, 137 aa, Corynebacterium glutamicum
MGIFLVGLWCAVLAVIDIKYRRLPDVLTLPGALLINLWALTIYPQWMLGGLVWAGIYFLTAVLVGGIGGGDIKLALGLGTAVAALGMQALMVAIVGSSLISVLLGGIFAAVKGVKRPKFIPHGPSMVIASACSYVAF

SEQ ID NO: 5294 - protein, 101 aa, Corynebacterium glutamicum
MEHQPHLLKLADEWAPTFKMLGDRTRLRLLIALHYHGPGEATVSELADIVGVTLPTASAALQLLADNGVVESFKEGRVTRYKLVDATTHTLLHHLGGTHRH

SEQ ID NO: 5295 - protein, 358 aa, Corynebacterium glutamicum
MLLSARTHTSFQELGLNASRRKAINWTLALTVVLIASMFVGVLIGASGTSVFSTWTVISHHLFGTELGGSDTADAIIWYIRTPRVLLAAIVGAGLALAGAIMQVLVRNMLADPYILGVNSGASCGAAAALLFGVGAGFGDYALQGSAFLGAMAASGLIFFVARAAGRISSTRLLMSGVAIGYMLSAATSFLIFSSDSAEGSRSVLFWLLGSLGLAAWNGPMAIIFLIVGIALALLMVLGPQLDALNSGDETALTLGVSPDRLRILLLVITCLLVGSMVAMAGSIGFIGLVIPHLARRFVSGKHRLMLPVSALMGAILLIWADIAARTLLAPQEIPIGIITALIGAPFLLILVRRMHTY

SEQ ID NO: 5296 - protein, 202 aa, Corynebacterium glutamicum
MSAVMMPMGISWGASRVRAAISAQMSKIAPINADTGSMSRCFPLTKRLARWGMTRPMNPMLPAMATMDPTSRQVITRRRMRRRSGDTPKVSAVSSPEFKASNCGPNTMSNARAMPTMRKMIAIGPFHAASPKDPSSQNNTERLPSAESEEKMRKLVAAESMYPIATPDINKRVEEMRPAARATKKINPEAAIAPRNALPWRA

SEQ ID NO: 5297 - protein, 319 aa, Corynebacterium glutamicum
MRKLALPLVAFLTGGLAACSSSDVVESQGITVENCGSVVNFDSPPSHIALMKSAAVPTLDALGVLDRVVTKAGAFPAGYYDADLSERVTDIPTLSNKIDASGHVLISKEVVVAANPDIVFGETDTINRASMASSNIPVVEEPAFCGSIDGDVSFDDVWSQISTYGTIFDRSTEADAYIATLKERVSEVSSRVTDSGKTVAVLYPTIGGGVTYAYGRGSMANPLVAEAGLTNVFADQSERVFEVTAEELISRNPDYIIVLHSDGSPSDIVAEVGNLQGSSALTALSENKVLPILMNFAEPPTPLAVDGLEKIIDFVETHP

SEQ ID NO: 5298 - protein, 251 aa, Corynebacterium glutamicum
MIEATHLRHSFGDNIVIDDVTLHLPAHGTVSLVGPNGSGKTTLLRALYGALQPNEGHIHVDGVPLISLHRKDIAKTMAVVIQEHDSDLPMTVADLVLLGRLPHQKMFAGNSQADQLLVKEALTRVGAIHLADRQFGALSGGERQRVLIARALVQNATHILLDEPTNHLDIRYQHEVLHLVRELSSSSIIVLHDLNLAAAYSDHIILLDQGRVVTQGTPSEVLTPEHLEPVYGVRVERFDLGDEVHLRFKRH

SEQ ID NO: 5299 - protein, 276 aa, Corynebacterium glutamicum
MGSHITHRAAVLGSPIEHSKSPVLHNTGYKALGLDQWEYDRFECTGDMLPGIVSGADETYCGFSVTMPSKFAALEFADEVTERACAIGSANTLLRTATGWRADNTDVDGIRGALGELLGGASLAGKHAIVIGSGGTARPAIWALIEAGVARITVLNRSDRTAELQTLFDETPTTLAYAPLEHLHIEADVVVSTVPSAAIAGLEDTLAIAPVLDVIYDPWPTPLVEVTRAKGLKAVGGHVMLAHQSYGQFEQFTGMDAPRDAMREALEESLGISEEH

SEQ ID NO: 5300 - protein, 389 aa, Corynebacterium glutamicum
MNQIRNRRMEPVYVKRRQRFIAVTIASLILIIGAIIYIGVATSNRTPHDYEGSGNGVVQLVEIPEGSSISELGPELEERDIVATNSAFQTAASNNPNAGSVQPGFYRLQEQMNAAAAVSALLDPDNQVDLLDIHGGATLMDVTVVGGNTRAGIYSQIAAVTCTEGSANCITAEDLQQVASTVSPAELGVPDWAIAAVEARGTDPKRLEGLIMPGQYVVDPSNDAQGILTDLITRSANHFQETDITGRADAIGLTPYELLTAASLIEREAPAGDFDKVARVILNRLAEPMQLQFDSTVNYGLSEQEVATTDEDRQTVTPWNTYAMDGLPQTPIAAVSTEALQAMENPAEGNWLYFVTIDTDGTTVFNDTFEEHEADIEQALNSGVLDSNR

SEQ ID NO: 5301 - protein, 182 aa, Corynebacterium glutamicum
MKVSADTPGHDDPGPGRRLGLDVGTVRIGVAASDRDAKLAMPVETVPRETGFKGPDLADIDRLVAIVEEYNAVEVIVGLPTDLQGNGSASVKHAKEIAFRVRRRLTNAGKNIPVRLGDERLTTVVATQALRASGVSEKAGRKVIDQAAAVEILQTWLDARTRALEPQSTDTQDFDEKGNFPG

SEQ ID NO: 5302 - protein, 888 aa, Corynebacterium glutamicum
MQTHEIRERFTNHFVNAGHQAVPSASLILDDPNLLFVNAGMVPFKPYFLGQQTPPFENGTATSIQKCVRTLDIEEVGITTRHNTFFQMAGNFSFGQYFKEGAITHAWGLLTGSVADGGFGLDPERLWVTVYLDDDEAAEIWEKKIGVPSERIQRLGMADNYWSMGVPGPCGPCSEIYYDRGEKYGKEGGPVADDNRYMEIWNLVFMEKERGQGIGKDNFDILGDLPKKNIDTGMGVERVACILQDVENVYETDLLRPVIDVAETLTGTKYGSDNTSDIRFRVIADHSRTGMMLILDGVTPGNEGRGYILRRLLRRIIRSARLLGATGETMEQFMNTIMDTMTPSYPEIADNRERIMRVAVTEERAFLKTLVSGTHLFEEAATSIKAAGSTKVAGAQAFALHDTYGFPIDLTLEMAAEAGLEVDVEGFDSLMAEQRSRAKADSQAKKHGHTDLSIYREWVDNNPTVFTGFEELDSQSKVLGLLSDGAKISEATEGQEVEVILDQSPLYAESGGQLGDRGQILLGDTVLDVHDVQKIGKKLWVHKALVANGGLAVGDEVVASVDKQWRHAARQAHTATHLIHAALRQVLGPTALQAGSMNKPGYLRFDFNYTEQLTPAQVEQIQAITNEAVDTDWAVNTVETSLEEAKAMGAMALFGENYGSTVRVVEIGGPFSMELCGGTHVAHSSQIGPVALLGESSIGSGVRRIEAYSGLNSFNYLSKERALAEGLASSLKAPSEELPERVAQLVDKLKAAEKEIEALHRQQLMAQTADLLNNAQEIGGVTTLLLRVKDNTNAGDLRTIATTLKDKLGDREGVLVIASDNAGKVPFVVAATKAAVARGAHSGNLVKLVGSYIDGRGGGKADLAQGSGANIAGLESAFGAVRAEIEAL

SEQ ID NO: 5303 - protein, 459 aa, Corynebacterium glutamicum
MAQDSLFETPETPGSAGNTSSVSNSKAASKYFHPGGHAPLAARMRPRTLDEVVGQQHLLGEGRPLRRLIEGSGDASVILYGPPGTGKTTIASLISAAAGDRFVAMSALSSGVKEVRAVIERARMDLQLGQRTVLFIDEVHRFSKTQQDALLSAVENRTVLLVAATTENPSFSVVSPLLSRSLLLQLESLSDEDIKTVLNKALEDERGLAGRITATDEAVDQLVLLAGGDARRGLTYIEAAAEAVEDGGVLDIDTVMANVNRAVVRYDRDGDQHYDVVSAWIKSIRGSDVDAALHYLARMIDAGEDPRFIARRLVVHSSEDIGMADPSAMQVAIAAAQAVQLIGMPEARINLAQATIHLALAPKSNAVIMAMDAALTDVQQGHIGTVPAHLRDGHYEGAKKLGNAVGYSYPHDDPRGVVRQEYLPENLRDRVYYEPTTHGGEKRIAEYIGRLRRIIRGTK

SEQ ID NO: 5304 - protein, 408 aa, Corynebacterium glutamicum
MADVLRRMPMLSHEEIVAIAEDLLSKRYGGVQTLSDVEQLNGSGTSAVLRARVANSPFLQQRSVVLKYVPSTGDVFDDSALVREIVSYQFTTSLSEDVRPGPVILAYDIDKRILVISDSGNGDTFADLIDQRTGDQRMQILRNLGQSLGSLHAATADREEDFNILLNRMLAKYPATAEMQKNRDRLLPAAIEVGKKILVDAGVTVPEVVEEFARVARRRLISGRHRAFTPFDLSPDNIIVAERTHFLDYEVAGFRDATFDVACVIAGFPQFVFSRPISDDEVDELIESWVQEVRGIWPNVNNEERLQARIVTALIGWALSSVAFMKLGSISGMLNLLHVTEDGNTTLDVSNLDELLIPRSAEDDELVQQDLHDTFSALQRFAARGLDSRFPEVARFADDVVRLFLKND

SEQ ID NO: 5305 - protein, 608 aa, Corynebacterium glutamicum
MLRTHLSGELRKENAGQSVTLTGWVNRRRDHGGVIFIDLRDRTGIAQVVFRNEDVAERAHALRSEFVLRVTGVVEERPEGSQNPNLASGDIEVSVTEFEVLNESAPLPFQIEDSSSAGEVGEETRLKYRYLDLRRPVQANALRLRSAANKAARTVLDSHDFTEIETPTLTRSTPEGARDFLVPARLRPGTFYALPQSPQLFKQLLQVAGMERYYQIARCYRDEDFRADRQPEFTQLDVEMSFVDQDDVIALGEEIISEVWKLIGYEIKTPIPRMTYADAMRRYGSDKPDLRFDIEITECTEFFQDTTFRVFKNEYVGAVVMTGGASQPRRQLDAWQEWAKQRGAKGLAYILVGEDGELSGPVAKNITDAERAGIAAHVGAQPGDCIFFAAGDTKSSLALLGAARGEIAKKLDLIKEGDWAFTWIVDAPMFEPAADATASGDVALGNSKWTAVHHAFTSPKPEFLDNFDTNPGDALAYAYDIVCNGNEIGGGSIRIHQRDVQERVFEVMGITGEEAREKFGFLLDAFAFGAPPHGGIAFGWDRIVSLLGGFDSIRDVIAFPKSGGGIDPLTDAPAAITPQQRKEAGIDAKPKPKAEAQAEAQAEESAEK

SEQ ID NO: 5306 - protein, 297 aa, Corynebacterium glutamicum
MTFRDDVTRSGGNARKSGGGGRGMAVGGGIGGLLLVGLFLLLGGNPAEIDQVLGGDQTQIESGESTGAGDFDHCQTGADANASDDCRLYYTSFSVNEMWQTLLPAQAGIEYTEPTLTLFKNSTQTGCGFASASTGPFYCPSDQDAYFDLTFFDQMRQFGAENAPLAQMYIVAHEYGHHVQNLEGTLGLSNYNDPGADSNAVKIELQADCYAGIWANHSSEGPDPLLQPITESELDSALLAASAVGDDNIQQRSGGDVNPESWTHGSSQQRKDAFLAGYNTGQMSACDFLGRGVYNDA

SEQ ID NO: 5307 - protein, 892 aa, Corynebacterium glutamicum
MAESNAMDRAQISALLDRAQHTINLAEQANNVLRLLKTPGTATVGDNGTLGTDTYLIPSRNITWPDNLYVNVFLDGMNAEATLTDYVASVASIPRLCQIINEGQGGMFRRLFNPTKVQAGDQAVFDLMVKLDEISSTTHEVSRMLEGVHAARTRQQQGVALFPGIHGVGERYIERAQQVLASALGIAGFGAEPWDGHTLAQARRVVQRYAQDPNSEYRLKSEAEKHLTSINELRVQILLEQLPVDALRMATDHRLRFGSLDSIHVATVADVLKTHTSILTTVQGIGAQTAGRMKAAAETLKQEALRRQNTSIGDEPTQPAMRLINVLARFDQTETITPEERARRTRVIDYVEHIPPSLDPYIVINPATPEFNNFTDDLRWIDANPNLFHPQTITTPPADIWDDYISRPAHYQGLLATLLGRDIEGADELLDATTLQKIRDLTLDKTHLTDLHLRGYQSFGARFAIIQKKTLLGDDMGLGKTVQALSAAAHLAATEKDFRTLVVVPASVIVNWTRECKRFLNLPVFIAHGDNKQDAINAWSNTNGIAICTYDGVRTMDIPAPGLVIADEAHLIKNPSTKRTQALRKLIDAAPYTLLMTGTPLENKVEEFVNLVRYIQPELITRGMSKMQAENFRERIAPAYLRRNQADVLDELPERTDSIDWIDLTPEDRSAYDDQVRQGSWMGMRRSAMLSPTPRLTSAKMQRILELFEEAEEHGRKALIFTYFLDVLDELEKHLGERVIGRISGDVPATKRQLLVDALSHSKPGSALIAQITAGGVGLNIQSASLCIICEPQVKPTIEQQAVARVHRMGQTATVQVHRLIGDETADERMLEILAGKTHVFDVYARLSETAEIPDAVDITESQLAARVIDEERARLGLTESTGPKDEETALS

SEQ ID NO: 5308 - protein, 619 aa, Corynebacterium glutamicum
MAFLHFGSELKRFGRGKLPPLGFVVVMLLPLLFGGVFVSAYYDPIGGLSKLPVAVVNQDEGELDAGAQVVENLLEQDDIKFIEVSAEEAREGINDGTYYFGIEIPKNFSDSIASVTSDSPAPATVNAVFNNSNGFIASMLGNQVVNTVVETMDTEFGVRIVDNMLVGFSTLGDGMNQAAEGATTLSDGVGSANDGAVQLADGAVTLRDGIASANEGAQSLADGASQLDTGLGSAATGSQTLADGLSSLSAGTAQLGQGATQVSDGVGQLVDQVAPLTAYVPDINSQLITLRDGAATIASELSDPSSTYRSGVDSAVSASQQLAAGLQTLKDGSSQLSIGARTLADGTSQLAAGSEQLVVGAQALRDGTVQLDEGSSELALKLTDGASQVPTFADGADTTIATPVETEQAGDTTPLFGIGLAPFFMAVGLFMGATVAWMILHPISRRALDSRMGGFRGTLASYLPSTVLGLGQATIMWAVLYFLLDLNPAHPAGLWMAMVAISWVFISITHMFNNVAGPSAGRVLSIVMMSFQLVSSGGLYPPETQPAFFHWFHTYDPITYAVNLVRQMIFNETPSNDPRFIQAIWVLLFIWALMLAISTLANRTNKVLRMKDYHPELKV

SEQ ID NO: 5309 - protein, 216 aa, Corynebacterium glutamicum
MNTPLLRSSGLSIRDTPFADVEIAPDSGLTLLSTGRESQSSSFSLVLSGRMRASTGTIELNGEPIKATKLAKHVALAGIPEIDSLERLVTVRTVVREQLAWSSPWYLMVPRDISDSGRWVDVEKHLGLNLNPKTLIGDLSVLERFKLRIALALLARPEAQLLVVDDPDQVRSMELRAEVLHALKGVAEDLPVVVVSTNPDFDSLADTALTITGAGN

SEQ ID NO: 5310 - protein, 198 aa, Corynebacterium glutamicum
MRADALKRREHIITTTCNLYRTHHHDSLTMENIAEQAGVGVATLYRNFPDRFTLDMACAQYLFNVVISLQLQAISTFPTDPEGVWTSFNQLLFDRGLGSLVPALAPESLDDLPDEVSALRRTTEKNTTTLINLAKQHGLVHHDIAPGTYIVGLITISRPPITALATISENSHKALLGLYLSGLKHGMMANIGEHDGKS

SEQ ID NO: 5311 - protein, 238 aa, Corynebacterium glutamicum
MTESPDLAVSFLAAFNDIEAHLRTQLRAKRSDSFRWMVRIAEKQHLISKEQAETLDAFAELRNAISHGQYNDLRPIADPRPDTVDTIEKIRSLLLNPPIALNVLPEQKVRSYSLEDPVSRALEVVHTTEISQFPIYKGTEYVALLTTNTIARWVASDLHDNAQLDARSIKEVLDYAESSDTAVFLPRTSTAQEIIDIMTGPKLPWSVILTEHGKPHQKPLRVVTGRDMRTLMDMLKIY

SEQ ID NO: 5312 - protein, 371 aa, Corynebacterium glutamicum
MQFGIFTIGDVTVDPTTGKAPTEGERIHAMTQIALKAEEVGLDVFATGEHHNPPFVPSSPTTHLAYIAAKTEKLLLSTSTTLITTNDPVKIAEDYTFLQHLSGGRVDLMMGRGNTGPVYPWFGKDIHQGIPLAIENYHLLRRLWREDVVNWQGKFRTPLQGYTSTPAPLDGVAPFVWHGSIRSTEIAEQAAFYGDGFFHNNIFWNKEHTAQMVNLYRQRFEHYGHGQADQAIVGLGGQVFIGDSEEEAKKTFRPYFDNAPVYGHGPSLEDFSRLTPLTVGTAEQVIERTMEFADWVGDYQRQLFLIDHAGLPLEMVLDQIERLGHDVVPEVRRRMEERRPDHVPSNPPTHQSLKANRNSPHFQINPGQPTE

SEQ ID NO: 5313 - protein, 42 aa, Corynebacterium glutamicum
MRKLTVVTAGLSNPSTTRSVADQLTKAVQTAVSARGESWILK

SEQ ID NO: 5314 - protein, 165 aa, Corynebacterium glutamicum
MSSPALDAAKQRLAESDGLIAVTPVFTASYSGIFKMFFDVLDPKTIVGLPTIIAASAGTARHSLVLDHAIRPLFTYLRAVVVPTGVFAATEDFGTEAGADIERRVNRAAGELATLMLQDYSSVQGLGGATANQDADLSFRRTTGVTPGENFSSFADLLKGHDGNG

SEQ ID NO: 5315 - protein, 449 aa, Corynebacterium glutamicum
MAISVVDLFSIGIGPSSSHTVGPMRAALTYISEFPSSHVDITLHGSLAATGKGHCTDRAVLLGLVGWEPTIVPIDAAPSPGAPIPAKGSVNGPKGTVSYSLTFDPHPLPEHPNAVTFKGSTTRTYLSVGGGFIMTLEDFRKLDDIGSGVSTIHPEAEVPCPFQKSSQLLAYGRDFAEVMKDNERLIHGDLGTVDAHLDRVWQIMQECVAQGIATPGILPGGLNVQRRAPQVHALISNGDTCELGADLDAVEWVNLYALAVNEENAAGGRVVTAPTNGAAGIIPAVMHYARDFLTGFGAEQARTFLYTAGAVGIIIKENASISGAEVGCQGEVGSASAMAAAGLCAVLGGSPQQVENAAEIALEHNLGLTCDPVGGLVQIPCIERNAIAAMKSINAARLARIGDGNNRVSLDDVVVTMAATGRDMLTKYKETSLGGLATTLGFPVSMTEC

SEQ ID NO: 5316 - protein, 287 aa, Corynebacterium glutamicum
MLNHLVPHHARSGPLAARDRHQTINADVGVIGNIETARGRVGVGAVINKRAHTHQRGDDLFAIKRCSAYRIDGLKQQIDIAFICSRIISVTVNHGVGWTNKGAPHPRIHDHMLAVFATHKHATLAAQITSEQMHSLGLAHLQLGYLRQITQRLRNPRTRSVDHHRGIHLMRGVGDLISHFYTLDAAFFHVPENASDFGVVDRRSAICRKSFNHREEESFCMEIQRIIVAPRSLQALRVKPRDFLEQCIFRNPPETRRVVFLRLPLVTLPRHRFIQRHTSTQHRGFRL

SEQ ID NO: 5317 - protein, 562 aa, Corynebacterium glutamicum
MTSAHFESRRIGPPLRDNYDVIVIGGGISGVQIARHAQGRGLRTVMFEARDYSSGTSSTTSKMIHGGLRYLEQYDFGVVQEAVKERRYLGIAAPHLVAPRSFMLTAFDWSEPKAPMLGAGVALYETMAWQRNQGQSKENHSPRFRWIPKNALLKEVPWLDPEGLKGAWRHDDTLNLHAERLLLAVIKAFAADGGTAINHAKVTRILRNVEEGRVKGVEVTDQVTNTTHEVNAPVVINAAGPWVAQALGDLAEVTKLKVRQSKGVHLLTGDLGSQSGVFVRGKNGKHVIVNPWMGRTLIGPTDTMIDGDADDAAADESDIDLLLETIDSVRATPLDRKEIISTLVGVRPLVDDGTDTYTSSRRFDISDHANVGIDGLVSVSGGKWTTSRVMGYKVIEHVVEHQAAVLPPLRHFDSRQMPLSTSFGAYESVADSFESALRSHPELDVDDEIRVHLARLYGTEHEKVLDLVAKQPDLGRRLDPDNLDIAAQAVFAVAEEAAVDLADVLDRRIVLGTLGYVQPAAVRATAEAMAQVTGWSAELIDAQCQSYLAKQDKIQAVLKPYR

SEQ ID NO: 5318 - protein, 429 aa, Corynebacterium glutamicum
MSQNKSKSEKLQSFAAPKGVPDYAPPKSAAFLAVRDAFVNQAHKAGFEHIELPIFEDTGLFARGVGESTDVVSKEMYTFADRGERSVTLRPEGTAGVMRAVIEHSLDRGQLPVKLNYAGPFFRYERPQAGRYRQLQQVGVEAIGVDDPALDAEIIALADRSYRSLGLQDFRLELTSLGDRHCRPEYRQKLQDFLFALPLDEETRKRAEINPLRVLDDKRPEVQEMTADAPLMLDHLDAECREHFETVTGLLDDMGVPYVINPRMVRGLDYYTKTCFEFVHDGLGAQSGIGGGGRYDGLMAQLGGQDLSGIGYGLGVDRTMLALEAEGVTVGAERRVDVYGVPLGKDAKKALAGIVNTLRAAGISTDMSYGDRGLKGAMKGADRSNALYTLVLGEQELENNTIAVKDMRAHEQHDVALDEVVAFLQGKLI

SEQ ID NO: 5319 - protein, 213 aa, Corynebacterium glutamicum
MEILGFAAGPYKTNCYVVRGENEVAIIDPGMHAHDDLVEYITTNNLSVDKIVLTHGHIDHTRDAGVVAKRFNAPVYIHPDDAFFLEVYKGSGTKTAMLFDADNMVSPDPESLRDLVDGETITLAGEEFTLKHAPGHSPGCTLIVGKEYCFSGDVLFKGSIGRTDFEWSDADAMNESLRTAVLPLDDALQILPGHGPTTTMRAERTGNPFLLAL

SEQ ID NO: 5320 - protein, 169 aa, Corynebacterium glutamicum
MPATGTVTVNLTTAQGNIGMELDRSVSPCTVNAVEHMASEGYYNDTVCHRITTSGIYVLQCGDPSSTGAGGPGFSFANEYPTDEATDLTTPVIYERGTIAMANAGADTNGSQFFLNYEDSPLAPNYTYFGQITEEGLATLDAIAEVGTEGGTGDGAPAQEVRIESAAVA

SEQ ID NO: 5321 - protein, 79 aa, Corynebacterium glutamicum
MFLGQLPRGTVFLLSLTTISAAGSQIAFTGCLFWMHRRAVHWAFPGQIPNRLHPVKSMLTGLLSLFSSVFTPKHSQVSQ

SEQ ID NO: 5322 - protein, 185 aa, Corynebacterium glutamicum
MKLFSRTSLVALGTAAAITLSGVTAPAFADEDSNAAVSALKTAEDNTPEAPGASTPLKLEQPGTITGVPGKAITPVTVKVVAGEAESFTSDNLPSGLLIDNTGKITGTPKKEFTGSAKIIAKNEAGVEAEVYVNFDFNEEPSSEEPSSGSSDTDNIENWIKIITAVIGALTTILTFSTKLDSFLK

SEQ ID NO: 5323 - protein, 114 aa, Corynebacterium glutamicum
MHNGESAHKVTFVFEYLNLRGLAMKLFSRTPLVALGTAAAMAATSISVPAQAEEVAPAQVVYVADTVEEETGSSNGSSDIDSDTILDYVVVITGIVGVLSAGLTFATAFQRSLQ

SEQ ID NO: 5324 - protein, 760 aa, Corynebacterium glutamicum
MSLERNTQKSSMGVRSMSARLARSLTGNRVRTNPVLDPLLSIHRQFHPRADVQVLERAYDTAERLHDGVIRKSGDPYITHPLAVATIAAEIGMDTTTLVAALLHDTVEDTDYSLDDLTRDFGEEVARLVDGVTKLDKVALGAAAEAETIRKMIVAMSQDPRVLVIKVADRLHNMRTMRFLPPEKQAKKARQTLEVIAPLAHRLGMASVKWELEDLSFAILYPKKYEEIVRLVADRAPSRDRYLKEIIDQVTGGLRENNIAAEVLGRPKHYWSIYQKMIVRGRDFDDIFDLVGIRILVDNVNNCYAAIGVVHSLFNALPGRFKDYISAPRFGVYQSLHTTVMGPGGKPLEVQARTHDMHYNAEFGIAAHWRYKETKGSHSGEQAEVDQMAWMRQLLDWQKEAADPNEFLDSLRYDLTSKQIFVFTPKGDVVNLPVNSTPVDFAYAVHTEVGHRCIGAKINGKLVALETKLKSGDRVEVFTSKDQNAGPSRGWQEFVVSPRAKAKIRQWFAKERREEYLEAGRDALAAVIQRGGLPMHRLFTASSMKTVATELHYPDVDALYTAIGSGSVSAQHVVNRLMAIFGDEEDAEDALVARTPFSELVNSRATTESSTGILVEGSPDVMAKLAKCCMPVPGDEIFGFVTRGGGVSVHRTDCTNVEKLKEEPERIVSVSWASEGQGSVFSATLQLEALDRAGLLFELTRVINEQKVSVTAMNSHCSEDRVATVRFTFAVSDTKQLGSLMTQLRNAEGVFDVYRVTSGG

SEQ ID NO: 5325 - protein, 185 aa, Corynebacterium glutamicum
MSEQALSTFDRAREALDKKTRYVQDFPEKGVLFEDLTPVLGDAESFVAVVDAMAEAAEKLNAEIIGGLDARGFLLGSAVAYKLGLGVLAIRKKGKLPPPVVTQEYELEYGTAALELPSEGIDIAGKNIVLIDDVLATGGTLGAARKLIESCDGHVSGYVLAIEVPGLGGRDNLGDRPVIVVRDPQ

SEQ ID NO: 5326 - protein, 50 aa, Corynebacterium glutamicum
MSSTSKGHLTLFCVQWIHIGSMKMPIPLELMRSRRGALKNNCGLKSHQFH

SEQ ID NO: 5327 - protein, 581 aa, Corynebacterium glutamicum
MISNLSNGGRHSATGRRYIGIARFGCRRGKNRIITVLLRFGERLGTSHMLFRKSRSAVIMLVAALVMTSCGDGEPEPTSHQTSLFGYAVNSSLATTNAASLLGVANDAGLLAARVYPGVYVQGPSGQMIPNTDLASTQVLPGINRQVIYTINEDATYSDGQPVVCDDFLLSATAGQMPELFQSHVPLTSQIERVDCVSGSKVATVVFKEDLGERWRYLFEQGDLLPAHAVASKAGMTLEELNQALKDKDPEALTEPARVWSEGFQLSQFDPELQTAFGPYKVDSVGEFGEVKLVRNEFYSGDQAVEAEITMWPKGSDLSAIADNGNLQIADVVAWESEPWVNRDDPLNPYDIKEEVGVLTEQLTLASAGVFYAAEARQAFAACVDQEAVAAASSSISGIDVPAVGVHSVRHQNPVVHQIGDLPAQHMAVDINAASALAGQSIRIGYDGPDERKAAMVEAIRQSCEPAGITVIDASQEAVSLNDLSRTEVSEWGYEQYFEGTLDAVLRTVDPHREYENANTIGTDAESTRRTEEQLWAEVPSIPLAAQPRVFVIDRTVGNVVVNTDLAGIGWNMDRWSRSEE

SEQ ID NO: 5328 - protein, 403 aa, Corynebacterium glutamicum
MTDSQTESLSTQSVKPAKKRSWFNSLYTGDGGIDFIAKTKLWYWITGILLVISILFIAIRGFSLSIDFQGGTKMSMPASDYSTEQVEETFTEATGITPEIVQIVGSGDARTLEIYSERLSDEDVEKARLAIYEEYQPLNSEGQPSPDAIGNSTVSESWGSTITQRMVLALIAFLVIAAIYIAFRLEREMAIAAMAALVVDGIVIAGIYAVIGLEVSPATVIGLLTVLTFSIYDTVVVFDKVRENTEGFEGSRRRTYAEQANLAVNQTFMRSISTTIISALPIIALMVVAVWMMGVGTLKDLALIQLIGVIEGTFSSVFLATPLLVSLKNRLSKTKAHTASVMKLRDGQSTLIDATPHTNADASAHGTESDTDGVTPEAPAKRTVSKPIVDDHRSSGTWRPGRS

SEQ ID NO: 5329 - protein, 210 aa, Corynebacterium glutamicum
MAICCCRYWLVREDQVAEPSSPSPDLKAKLISIWPDWALNPPVMGRLVSISLPVRRAPFSSSVSPLSKGAGSSTYTPPTAGSHATNGRRGSSVPAKGSISSVVHCIKELAAIWTVGSVDWRSVRSMSVISWRRCVASMELAGSSIGVADTVTGSGSVASSPSTAVVDATAVFISSKEAFACSSVMTPYSTHLLAISSSSGINVVISGIPA

SEQ ID NO: 5330 - protein, 644 aa, Corynebacterium glutamicum
MELKETFLARQKKSAASAWERWPKRAIALFVLIVVGVYALVLLTGDRSATPKLGIDLQGGTRVTLVPQGQDPTQDQLNQARTILENRVNGMGVSGASVVADGNTLVITVPGENTAQAQSLGQTSQLLFRPVGQAGMPDMTTLMPELEEMANRWVEYGVITEEQANASLEEMNTAVASTTAVEGEEATEPEPVTVSATPMDEPANSIEATQRRQEITDMLRTDRQSTDPTVQIAASSLMQCTTDEMDPLAGTDDPRLPLVACDPAVGGVYVLDPAPLLNGETDEENGARLTGNEIDTNRPITGGFNAQSGQMEISFAFKSGDGEEGSATWSSLTSQYLQQQIAITLDSQVISAPVIQSATPVGSATSITGDFTQTEAQDLANNLRYGALPLSFAGENGERGGTTTTVPPSLGAASLKAGLIAGIVGIALVAIFVFAYYRVFGFVSLFTLFAAGVLVYGLLVLLGRWIGYSLDLAGIAGLIIGIGTTADSFVVFYERIKDEIREGRSFRSAVPRAWESAKRTIVTGNMVTLLGAIVIYLLAVGEVKGFAFTLGLTTVFDLVVTFLITAPLVILASRNPFFAKSSVNGMGRVMKLVEERRANGELDEPEYLKKIHAKNAAADKASTDNSSTDNSEAPGTDTNQEEEK

SEQ ID NO: 5331 - protein, 121 aa, Corynebacterium glutamicum
MDIVFLIILLAIFIVPTFLMSRRQRARMTEIQKLQDSVVPGDRIVTTAGQHATVISTTAETVDLEIAPGMISTFEKLAIVRVLSKANEPQMLDEPTLFDQPEDDQPNDGFDGRTDGHPENR

SEQ ID NO: 5332 - protein, 360 aa, Corynebacterium glutamicum
MERTEFEIPGGIPPRRNGGQGRAADTNVDANLKPDEYDAEVTLRPKSLTEFIGQPKVRDQLSLVLTGAKNRGVVPDHVLLSGPPGLGKTTMAMIIAQELGTSLRMTSGPALERAGDLAAMLSNLMEGDVLFIDEIHRIARPAEEMLYMAMEDFRIDVIVGKGPGATSIPLEIPPFTLVGATTRSGMLTGPLRDRFGFTAQMEFYDVPDLTKVVKRTAKILDVGIDNDAAVEIASRSRGTPRIANRLLRRVRDFAEVHADGHITMGAANAALIVFDVDEVGLDRLDRAVLDALIRGHGGGPVGVNTLAVAVGEEPGTVEEVCEPYLVRAGMIARTGRGRVATAAAWRHLGLEPPEGTIGDY

SEQ ID NO: 5333 - protein, 206 aa, Corynebacterium glutamicum
MIASLRGTVINIGLSSAVIECNGVGYEVVTTPNTLSQLVRGEEALVLTTMVVREDAMKLYGFIDNESREMFSVLQTVSGLGPRLALACESVLSPLEISQAITNADAKTLQRVPGVGKRMADRLIVELKGKVAAFAAGVVDEGGEQISLPNANIASEVVVEQVSQALVGLGFSEKQSDDAVSFVLAADPSLDTSGALRAALAKLSGK

SEQ ID NO: 5334 - protein, 221 aa, Corynebacterium glutamicum
MNHEGLRVMGIDPGLTRCGLSVVQAGRGRTVYPVSVGVVRTPPDAELAERLLRLSKAVGEWMDEYTPDVIAIERVFERGNVSTVMNTAHAVGVLILAAAERGLPVHMYTPSEVKKAISGNGRADKKQMTVMITRILGLGEPPKPADAADALSLAVCHCWRAPMLMRAQSQYSEQELEKRRRVQQGKLGKAKSTYNAEQAQSHASDPAKAAHPSQFQRTDTN

SEQ ID NO: 5335 - protein, 251 aa, Corynebacterium glutamicum
MSGHSKWATTKHKKAANDAKRGKEFAKLIKNIEVAARTGGGDPSANPTLDDMIKKAKKASVPNDNIERARKRGSGEEAGGADWMNIMYEGYGPNGVAMLIECLTDNRNRAATEVRTAMTKNGGNLGESGSVSYMFTRTGVVTVQKGDLSEDDVLMAVLEAGAEEVNDNGDLFEVTCAPTDIQAVRDALVEAGIEVEDSESDFRASVQVPLDADGARKIFKLVDALEDSDDVQNVYTNIDLSDEVLTELEND

SEQ ID NO: 5336 - protein, 282 aa, Corynebacterium glutamicum
MKTIEDILTLEEIDRDIYRGPVIESYLARTFGGQVAAQALVAATHTVDKAFTVHSLHGYFIAPGDPTAPAIYLVDRVRDGKSYVTRSVRGIQDGEVIFSMQASFHRGDEGIEHMDKMRKVPAPDEIKGTVERMPISSRRVLDEWAEWDIRVIPQDQLELSDFTATEQAVWIRCTADLPDNPTFHQCSLTYLSDMTLLHSALVPHPGEKMQMASLDHAVWFLRPFRVDEWLLYDQRSPSASSGRALTHGRLFNQQGDLVAIVNQEGMTRTLHEGAQSIPMRKD

SEQ ID NO: 5337 - protein, 158 aa, Corynebacterium glutamicum
MTPQKLHRFAALLEMGTWTLLIIGMILKYSGVTDAVTPIAGGIHGFGFLCFAAITITVWINNKWTFPQGIAGLIVSVIPWAALPFALWADKKGLVAGGWRFSDPSEKPHTFFDKILAQLVRHPIRSILILLVIIAVVFSILLAMGPPYDPDAIANTVD

SEQ ID NO: 5338 - protein, 154 aa, Corynebacterium glutamicum
MTLVYLLIAVVVTATVLWAYFTAQRLNRLHIRTDSARQALQAALDRRAALVGALLPDAAEASKRAEAIPLEYSRFSQRARAEREISELILKQGKTLPDSIVDAATRVELAHRFYNEAVSDTRDLRTRLMVRSFRLGGTAPLPEYFELLDTDLLT

SEQ ID NO: 5339 - protein, 361 aa, Corynebacterium glutamicum
MRIGMVCPYSFDEPGGVQAHILDLARTFIAQGHEVQVLGPCSADTQVPDFVVRGGGSIPIPYNGSVARLSFGPKMFKAVRTFLREGNFDVLHIHEPNSPSFSMAALRFAEGPIVATYHASSSGSKLLKAFLPVLSPMLEKVRAGIAVSEMARRWQVEQVGGDPVLIPNGVETSMFKAARQIEPNDPVEIVFLGRLDESRKGLDILLRALTRLDRPFTCTVIGGGTPREVAGINFVGRVSDEEKAAILGRADIYVAPNTGGESFGIVLVEAMAAGCAVVASDLEAFSLVTDSEAAQPAGVLFKTGSDADLAKKLQALIDDPSSRSTLIAAGLKRANAYDWSTVSTQVMAVYETIAIDKVRLG

SEQ ID NO: 5340 - protein, 321 aa, Corynebacterium glutamicum
MKPKDFCTAENWAENLSALGYLAGWRFVRMLPLPIARRVFDLGADLASKSGKGMGQLRANLARVVGAENVTQALVKQATRSYARYWLEAFRLPAIARDPELLARLRKGTVGLDLLDESLAAGKGVVLTLPHSGNWDMAGAFLISHHGQFTTVAERVKPERLFEAFVEFRESLGFEVLPLTGGERPPFEKLKERLTSGGIVCLLGERDLRHSGVETTFFGEKTSMPAGPAQLAIETGAALHVVHPWFDDDGWGLSVSDAVTVDNLSDTVQRIAHLFMANITAHPADWHMLQPLWFGDLDPERLKRSREQTNVHKPVALQEDN

SEQ ID NO: 5341 - protein, 219 aa, Corynebacterium glutamicum
MLGLHGRKPAQVIVEPVAKLMIKLKVTPNQLTLVSAGLTVGVALLLIPTGHLIWAAVLTGLFAAFDMIDGTVARMQGGGTKFGATLDATCDRITDGALFGAITWWLVYSYDAPQALVAASLVCLVASQVISYVKARGEASGFTMDGGLVERPERLIVSLVGLGLTGMGVPYAIDVALWALAAGSIYTVVQRLVMAGKSPLAKEFTKAPAGAKADYSNTK

SEQ ID NO: 5342 - protein, 220 aa, Corynebacterium glutamicum
MQLAGSPEMDSSDSHVGQDVYVDQGLGEPDRLERLWAPYRMSYINTRSGGKQSTTAKRDPFIEVPKMSDEDGLIVARGELVYCVLNLYPYNAGHMMVIPFRKEKNLEDLSLAESAELMLFTQTAIKALKQVSNPDAVNVGLNLGKASGGSVGDHLHVHVVPRWSGDANFMTVIDGVKVLPQTLRQTRAMLAQAWGTIDGAPGTVDPTLTSAIRTAAPKEH

SEQ ID NO: 5343 - protein, 686 aa, Corynebacterium glutamicum
MNTTDTAVANLVVFEVPAGTAIGAAMRELDLPNKGPEAIVCAKDAEGQLKDLSHVPETTATFTAVPANTDDGRAVIRHSCAHVLAQAVQAEFPGTKLGIGPAIENGFYYDFDAAEPFTPEDLKTIEKRMKKIIKTGQKFERRVYESAEAAAEELKNEPYKLELIQDKGNVDPNSDEATEVGAGELTAYDNVNPRTSEVEWSDLCRGPHIPTTRYIPAFALTRSSAAYWRGDQDNAGLQRIYGTAWEDKESLDAYQTMLAEAEKRDHRRLGTELDLFSFPDDLGSGLPVFHPNGGIVRNEMEDHSRRRHIAAGYSFVNTPHITKQDLFERSGHLGFYKDGMFPPMQVDAEFDEDGNVTKPGQEYYLKPMNCPMHNLIFDSRGRSYRELPLRLFEFGNVYRYEKSGVIHGLTRARGFTQDDAHIYCTEDQLEAELTSVLDFILSLLRDYGLDDFYLELSTRDPKKSVGSDEIWERSTEILNRVATNSGLELVPDPEGAAFYGPKISVQARDAIGRTWQMSTVQLDFNMPERFNLEYTSSDGSKQQPIMIHRALFGSIERFFGVLLEHYAGAFPAWLAPHQVMGIPVADDCIPHLETITAQLREKGIRADVDTSDDRMQKKIRNHTTGKVPFMLLAGARDVEANAVSFRFLDGTQVNGVPVDEAIAVISSWIGDRINDQPSEDSIAARR

SEQ ID NO: 5344 - protein, 402 aa, Corynebacterium glutamicum
MVSRRGFLGGAGLIAGASALAGCSAGENEPDGASISLKGQVVEFDGRHQAGIATPHQANLNLVAFTLRAGVDRAGVTRLMRVWTEDARALCAGETPLGSLEPEMVTSPANLTITCGFGASLFDVTQQVDLRPEWLKPIPEFERDQLRPEWGEADLVLQICSDDPVTLSHATRHMIRSGVDYAATRWVQQGFMNAHGVNETDETPRNLFGQKDGTVNPRTDDEIQQTAWISEGPDWAIDGSCMVVRRIAMNLDEWEILDRPSREVSVGRTLDTGAPLSGGDEFSEADYSARDSYGLPLIDPASHMARSRAPESNPEQVILRRVFNYDLPPDPTSEELSNAGLVFICFQKNPDLQFTPIQQRLDEQDRLNQWITHIGSAVFFIPPGTDPNDSSRDDFWGAGLLL

SEQ ID NO: 5345 - protein, 188 aa, Corynebacterium glutamicum
MAGLVALVAFSSQIAIILITSSNGARRDRIKLNFRTISQFKSDRHFIASLDWVRKPHDHQMIATWCQLDALPCRDHKTTWLFLHDAINNLMDLKAGSINISSKARNVDLIIRIVHQRSEHCRHVAVLHRRTNNSVFRGDHSIAYLRAAGGSSLHARGGGITLISRRTRRHNQRTAQYSTCDKKLLHGE

SEQ ID NO: 5346 - protein, 182 aa, Corynebacterium glutamicum
MKKFFVAGAVLSSALVMAACSPANQSDSTSTSVETTSSSSTQVSDAVITTENAVVRASVEDSDMTAVFATLVNNSDDEINVSGFTADVDAASFEVHEVVDGVMQEKPGGFVIPAGESIELAPGGDHLMIMGLANPIEAGDEVTVTLELADGSEVKLDPIPARTIAAGDEDYGDLGTEGHEGH

SEQ ID NO: 5347 - protein, 245 aa, Corynebacterium glutamicum
MIFPSGELSGGRFRQLTGRKDETNASDHGEKEVSPIYERLNVASEKNLKLRTLAAAAGVLGVGAMSMLVAPQAAAHDVVVDSNPENGSVVDEFPETIELEFSGIPQDLFTTVALSNADSGEVLTSGTPQLEGQHLSYEVPSDVQTGAGNYILGFQITSSDGHATKGSISFEVTGSAETTTETTAETTTESAATTDTSETTEAETTETADETSGIPAPWNWVLSIVAVLVVASAIVMMIAKNRNQK

SEQ ID NO: 5348 - protein, 126 aa, Corynebacterium glutamicum
MTFFINGFYSSYSNNEKGSVTMPHPPMNRTHSAARGRTTITAQTTALHNHVSRTTIKPVVNIELQDADLRAYSRAEVQERLGGICSRSVDRLINSGQLKAVPGTRGKGKRPLITARSLAQYIYSGG

SEQ ID NO: 5349 - protein, 198 aa, Corynebacterium glutamicum
MLILNYRTRIFAPTHVLKFRSDSAAFVHARLIDSSTQANSKLCLVPEVKGSGHSLPPDPLRNTSTLGARARQRKHRATTIAAVLQWWLFFWHSLRLCSMSATSAAIPFEQSMTTGTSPEVFSHIIHKKNCQPVLRSTAKEKEHGKATDWQSSTQVFDEGFGEPRERTSARYLSLGRHSLTREPVTSVTKLKPILNKIL

SEQ ID NO: 5350 - protein, 469 aa, Corynebacterium glutamicum
MTSAVNVQKKTTQKVLKPINTKNYSATDAVQTGQHGSALGSNIGVYTYTAGLDIGNGYVKGIIEATGDTTGTSVDVIDMPSAATRMSRPTEVPEPDDTAVAVTGADFFNHIDTNFNSPMVKGNYRYLCGTRSLSARGSLEEFDLVGNRSKAEQELSKVLVMAVLAAKAVKDFVAAHGRIPQVAVEGDPGVLRVHTYLALALPINEYVGHRHGYKAQFMGDGAANPAVHVVTVNNFETPATVQLIFERVEVIAEGASAQYAITAGGEVLMNGMLADVRSKGLALEGVTAGDVLQARHTIGVDVGEGTVNFPVFTDGRFNHDASRAYDKGYGTVLESAIQAMDDAGLAHNFNSRKQLADYLQRPPSALKRNFYTRVEQHVDQEAVFFVQDVAAEFARVLSDVGALTEVAFVYGGGSGPLRDRLHEALLIKAAEMGSEDTFPVLYLDSAYSRKLNREGLMIAARSIAAKARK

SEQ ID NO: 5351 - protein, 205 aa, Corynebacterium glutamicum
MQLLKRNFPTQCTKWGSHMAQKQDTTHVSEDDAPWRNVRMRFPETDAIVERFLETQGARGISLAMRQLIYLFVAEYGDVEVATVIGLKLVESLQAGAEGSDLFAQLAAGVADVDAVTTRKKAPQQIAPPSTTTRAPDQVNEFVAEAESQPVEESVVEAKVPKQQVAPQPAQKPEQKPEQKSAQPAQSEPDDGFDMDDVMGQAFGR

SEQ ID NO: 5352 - protein, 133 aa, Corynebacterium glutamicum
MSPAYLCARPRTRASVTFRPTCGVNLPFHADRARTVSTSTNSATVLWLGYQAPNSISTAVSGAVANHAAKDLQKFQTALQSRNPDQRKVVIGYSYGSTVAGKAASSSELDVRARHFRGDGYSIALNNAVEIKG

SEQ ID NO: 5353 - protein, 189 aa, Corynebacterium glutamicum
MLVNYVVQSATEADIDEAAATLAVAFVSYPWTRWCLPEADYDSRLLRLQSIYLSHALQHGMILITPNRDGVAALLPPNAPEPSESVQLEIAEIMGDRVQEVFGLVLPPRLDTSWDFATLGVRPESAGRGLGSALIKEALLRVSESDHRRVSLETSAESNVSLYERHGFKVSHRSEVPGGPVVYTMGVEL

SEQ ID NO: 5354 - protein, 362 aa, Corynebacterium glutamicum
MSEAFRQHVWLRTVWLANPQGEAKECFYFNKRLRGIFYALINHRCTSLAVYIVLLYSTPTYSPIFFQKRAHYPMTTPQPSKPAPWSLAYKYQAISNDDFDNHMDDLSSRQDHEAYGTYNPDNGVMPDHVIVPSPYEPYDDAAPIDPFDYDEDLLDEIKEERAAQAADAQVTETTKADADVAELAAAIDEQNRTHKEQFPTADRKELFAWLDKRRPELSDDFIKAFDDFLHSFACLDKTTITLLAQSPVRTSTGYTGTFIGIPNNEPLSEEPTPTIYIVHDNHTGIIHSYPARMINLKSELGSAEMIHEAIWGSPHQQQLISWYETYYTNIYYGFNPPTEPHKSLEIFAQDFCLTPPEKPPFF

SEQ ID NO: 5355 - protein, 367 aa, Corynebacterium glutamicum
MWWKGVIIFFTIDRCSNGLGFITSVEDHISDTRYRLTNGGRACRDTCIGITDPPVTVVANVWCEAILTRCSSATLSWDTSILFTDVPVTVVTNNSVRDFIFKLIKNDDGGLATTWITRFSDLNVHITGTLARSARVTSVTLIALWTLRLDTGIFTIDVPVAINDLNGVSTVGSIFTVLSIGSVGAIFTNCLDTGIFTIDVPVAINDLNGVSTIGSVGAILTTSRNAGINDADPPITIITDAWGVTVFTVIATCSSTGVVLTDPPVTIWADVRGQSVLTVFAGISLVALLTLVDGDFSAVREHHNSVAVRIETGFDDRNGLAICAITSIFTIGASVTLITLINGNNSAIGELNKSVAFSIVAGVNNSN

SEQ ID NO: 5356 - protein, 233 aa, Corynebacterium glutamicum
MVTGGSVRTTPVLLHVAMTVKTVTPHASVIMVIGGSASLIPAFLLVVRMAPTEPMVLTPLRSLMATGTSMVKIPVSRQLVKMAPTEPMDKTVKMEPTVLTPLRSLMATGTSMVKIPVSRRRVQRAIRVTLVTRALRARVPVMWTLRSENRVIQVVARPPSSFLINLNMKSRTLLLVTTVTGTSVKRILVSQLRVALEHLVRMASHHTLATTVTGGSVIPIQVSLQARPPLVRR

SEQ ID NO: 5357 - protein, 860 aa, Corynebacterium glutamicum
MSLNLKKNSARSITALTVAGLGLSIVPAASAQDVADDTTNSDSTRDAICAAAPLVAGAAVGVGLLSQQPEFQHMVSQIQSDAQRIGQDLSNQFNNSLESLNIGLGNGVHGPQQNAVQGIDLTEAARTMAGWNDLAAQVGQTAGPAIGAVAGTAGLIALVDYCWLEGFDFAGGSSGTDGENGVDGQDGTSITITEIKTDDDGNTIVVFSDGSEITITNGKDGAAITIVNTYRDDEGNTVVEFSDGSTIVIDKGEDGKDGEDGKDGEDGKDLTVTDTYINDDGDTVVELSDGSTIIVKKGTDGKDGADGSDGADGVSITVENSYVDADGNTVVEFSDGSNVTINKGEKGDKGDAGADGEDGADGESITVVNTSNDAEGNTLVELSDGTVITINKGDKGDAGADGEDGSNGADGESITVIETRFDADGNTVVVFSNGTEITINKGEKGDKGDTGEDGKDGLTPYIGPDGNWWIGENNTCTAARGNDGKDGDTPRIGDNGNWWIGIVDTGVPARGQDGANGADGANTVEIINGYWYINGENTGVKAVGENGTNGADGQDGENGTNGANTVEIINGYWYINGENTGVKAQGPKGDKGDTGDTGAPGEGSGNVDIEIRESSYPGGGQATIIILDQFEYEIPHTVIGDNGNWYIGEKDTGIPAQGGTGTPGEDGLTPHIGDNGNWWIGDTDTGVSASPTPVGEAVAGVTDVVFNTSDEPKTITATINGEEYDYTLPPHSAVVFYATGSPMAYSLPNASGLTVIGTEETPGFTTIRFSDHSTVTIPHGRDGTNGTNGTDGKDGLTPHIGENGNWWIGEKDTGISTTFGGGGNPGTGNDCITVPGDDLGFPDDAEAGAETGADAEGTID

SEQ ID NO: 5358 - protein, 371 aa, Corynebacterium glutamicum
MSLKLNSRRLASIAVAVAVGVSGVAAVGAAPATAQQVGAGTPIHVVNLDRTVVDPVTGDITFHFTDGTFVTLKAGVDGKDGTDGQDGVIGKDATIVDVATESNGDVKLTFSDGTVVTIPAAKDGVDGEDGKDGEDATVVSTATDANGNIVITFSDGSVLVVANGKDGNDGSDGQDGADGENGKDGENGANATIVDQIANDDGSITIVFSDGSEVTIPAPAKGATDELAQCLLNPKMLLLAAIPAAGAIANAVAPAIPRVVEDVRAQFNLPSLNPQFDQWLYNATKDIDAGLLISGATGLAVLSVLADDFCGDIDADDNADGDVAAEKPTGSSGLGSSEQSEKVDGDDDSVIDTETDADLEVEEDPELVNAG

SEQ ID NO: 5359 - protein, 641 aa, Corynebacterium glutamicum
MTFNKQGREVGVRPQFVLGSRIARPIALALATTVAIGGVAVATSDHVAQFGMATASAATLPDSIVTSVSYTLNGLSFSDPVELGISDNDKREELLGDITKGELRLQMEFSIPDSATAEDEYVFNLTGDGLRFFNSNDRTVPVRNDAGIRVADLLVSNGGTRGTLTNFSSDAGTTSRTAALDMELYGWVSSAQQTGERPIQDWTVGKTEGQVENKVVRYGVAGHPWIISTVQHTWVKSTQTVSHFRSEQDWKINQPPAVDMGALAYAAPLGVVVGHANVVISNNNGAGFRGALVNTTPTTRDVILNFTAADGATLRERSGGGFEDFDVFSEVPRVEETSTRISYSYKNSFEYDEFVAAFPEYDVAAWEPTVVYSADKTTATATFKNIPSDISFSWTGIEALEPFSPGKTFEHKVQGSVGEPAGAFTRDNYFTEGELYKHRHADDLLSGDGLFGPNITDGDGNLPSVDDGKDGDDGSDGSDGRDGVVAIDVVDNADGTVTVTLSDGTTFTLDAGQDGKDGLDGLDGTGLTLESATPDEDGNITYVLSDGTEFTVRNGVDGSDGKDGKDGVNGTDGVDGSDGKGLVEVSRVTNDNGSVTITYEDGSQITTKPTPTNWLSKLLDLLLPLFNLFGLGGGSVISSSK

SEQ ID NO: 5360 - protein, 161 aa, Corynebacterium glutamicum
MTALPCPPTQKLLYAQMREIAAELTACDATRGLHAEVAAEWLSDAITGEPTSIEIDPHRNLFYALNVEHPRLHELFAGYATRLDELDRAPQQCESRQYFLDYVCADNPFGSDKPEGIIVLLADHVLAADPVTNKPALKSEAFPTVTDYCRTHSAKPTDILI

SEQ ID NO: 5361 - protein, 63 aa, Corynebacterium glutamicum
MTKHDHTYTTPAEHSDPADQRIFPLAESDIEKFDMQLDQPVNTKEMQAFPHAPTIFGTEIVFD

SEQ ID NO: 5362 - protein, 104 aa, Corynebacterium glutamicum
MALRLCSINYHCCTHTYNTSHTQTRKGHPMTTVQVSTRTVREHRFTVPVDYAVGATISEIYAACAMAEKKANNLGLNTTKDDWARVTVTDNAVVFIVENVIGNT

SEQ ID NO: 5363 - protein, 143 aa, Corynebacterium glutamicum
MQPRQPLQVLSQVRLFKLYNPSFDDQTPSVLYPVEAGTVSLVDVKKAASRAFEQWEKHNESAGDVGDDLSLQSIVDLIERDTFPTDDEQELNNVALLIGELLVREAGGEWTSYISKKNDEDESLEIFGVFGTGGTEGLSVVGN

SEQ ID NO: 5364 - protein, 199 aa, Corynebacterium glutamicum
MLSICAKIGYSTTIAEVEMNFRKGQTYGICGENGSGKSTLLRTLCGEIHPIDGYATIDDQSVTEPSSIGKIIKISTPEFYPDISIGEHFKILTKTTKVDYDDAIKRWNLEKLLEKSPNRVSSGQQQRSFLALQLGVKCDVIVLDEPERHLDSFWIRILSEELKDRAKSGTTVILASHSQEILKVCDEVISLERYLNANK

SEQ ID NO: 5365 - protein, 333 aa, Corynebacterium glutamicum
MQINKVIKFAILLAVVLGISFSTVSWVFDQYKLNANDYSPISSFVWNLIFIIGLSTLVEKFLPLLSISKLEWIYHVRPLGQLSFGRFSPILQLSVFALFGLLVGAANGHFWIWLMISLLARLVTGLFKRKSIPNLLSAGRRKILSEASLNVLDSALVADSTTVAHLKWIDRPPTGNYLILTFRRFLRRPHIALTMLVVISFTFSFSNVFGNFTPCLFFLLWSILGADVARCADFSKLKGPNHLKVVTLIVHGLFALAIMLIITGTIQMLPYGILILPSILWTGIVRSRARRVDQITYIDSGVIGPISPEIIKFYLSGLLPTVVVSIIIVSLLN

SEQ ID NO: 5366 - protein, 53 aa, Corynebacterium glutamicum
MQITEETVVGVVRPSAGFPASDAMELVDVYRLILTIFGFPVLSWGCHVLASSN

SEQ ID NO: 5367 - protein, 369 aa, Corynebacterium glutamicum
MNRPLQSQNFSITSEWANATFNDIEDSLEGSFDIEPGQYIGRGEYFVATSGTGSKKFIKVVLGDGIDSELNRRIEGEILASSLHLPSTDLISPVVIQYVKESSNFPGDFYIVSDFKDDTETLELSKASLPLTDLAKIGAFLFRLESVTVPPQNPARRAMDVLDGLSLLANKGNIETGAQLTKGTIQALEIINQEATNIENALEKVTKVGSRKFFSHGDLKFSQFLINGETGKIFLCDWEECGSAHFANDLCFLAGDLFYSTIRELVDTNIKNIKGSSIIQEAYDNATLEAVSKVNAILTGYSSERGYSLTSDEKRIISIRIGLAGLFRLYTVSAKSNELRPRELALASIGMQITLGQAPNLVFTDSKVV

SEQ ID NO: 5368 - protein, 140 aa, Corynebacterium glutamicum
MSAKNAVERTEIFLATLQIAENSNLIFQGKTSWNTSLLRTDDIVFYFPLESHFSEAQRLIKKFLPFRSDDGLVESFFTSYLAPGVSKAVEVPTAKNNGLSFGMEWSTICAQLIIEEFSGKSVTIAEKLSEWGIPQKEAHA

SEQ ID NO: 5369 - protein, 197 aa, Corynebacterium glutamicum
MGYSSEGGPRIMTKVTNVSWLVTGSMSALSIPGLIFSLRSSHPNLNFTPYLTQSASRIVTMTSMATLSGVTPRNSDWGSEPEATPSHIQIESESDAYLIAPATLDFLARFARYDCSTPFSLALQCTKKPILVAPSLPPGGKDSIAYKSLSMDLLKWENLRLLSPIETKSASSPNASSSGFGSATRLIEFMLENLQGT

SEQ ID NO: 5370 - protein, 288 aa, Corynebacterium glutamicum
MKKVFQNEMRTIWQRDSANDQEPWSEIRRYSPANGKLPRLPEQLPQENSSIYWGQSEDFTFKIGTLIDESFWSGINKKAISMTDDDKSKLILNYSEKAISAFSEFSTSAHCRYLPVFAQYIHHLPRDLRELKELLLDSHVRCVFEDANLSVSSIFKDIQSFEDYSKKSHRIVHGCFRFRNIGFSGNGKLLVISGDDLIYGSEIFIQAAMLADLFELSSSKVVAVNKSMFVMYQTFTQNKDSFYVNKLNRFTFLYLISHYVQFLFTYKKSFPKRLLSEATLLRFNGPVI

SEQ ID NO: 5371 - protein, 140 aa, Corynebacterium glutamicum
MERGLSKHNRFVLHSHGTGRRHSVGADAVWAYVITALKQAYLGRFSFVAEALLLTQPNQWPAHAQQQWQQLVLQADHANLYSEIYHPSVLMKRNTGIIAAADLVLAVINKNATTGGTAHTVREAETMRKQVFRIHPAGLV

SEQ ID NO: 5372 - protein, 40 aa, Corynebacterium glutamicum
MEFILFFALLFFTVALLISIGLIVILVKVVQKRKSDKLEK

SEQ ID NO: 5373 - protein, 245 aa, Corynebacterium glutamicum
MLTSIRASTTVIALSVLISTLTFASPSEAIEGVDPIHITDQLTIDYTAEQIDEVRDGLRSYNVPEEQVNRLIGKLEQGELWDSIDPQKHPVDIEDFENEQGKGTIERFADGSVVVSTLQVPIDANNSLIQPRSIVPGSIRDCEEFFAQGHRFNTNCLAQKTIILATMSFRFDYYYTVQDAKIQKFYNPSVTGIGMSFETPTFEQTSDRNVRMSALLSLLFQGFPIQNMAWIQVDVDTNGAHFSAN

SEQ ID NO: 5374 - protein, 75 aa, Corynebacterium glutamicum
MQVIETLDPDQRAAVLAAAIPREAKILGRKVTLRPGWGNMRVHVVIAVIFIKFLQPDLRQALLTTGDAVLVEDDT

SEQ ID NO: 5375 - protein, 298 aa, Corynebacterium glutamicum
MTVCEILHNVHNPKDFPLRFLFLPRTTTAQLRSETCSTNHPPASSKETAHHVPHQRYARTFSCKFEFANAQCSEPEEMGEYFQVVQNIAMTLGAGESVDLVVREYINDVEGNPTIYHGMPLRTEYRAFIDLDHCDPSAGEPEPRLLGVTPYWHPSVMEKALAFASSDVGAEFGHINDDYRTYRAHKDSLMSKFHTHRDDVISRITALLPQLRAQELQGQWSVDIMKNGEDFYLIDMALMCESALSELLTVTDEYATVEPSVINDFANQLVIDYDEHDMGFDRDFPAGVYNTRQASAIN

SEQ ID NO: 5376 - protein, 52 aa, Corynebacterium glutamicum
MARSLFMSSSERSFAVVVFYVFGTVAGTGVQQVQQVQQVQQVQQVQQVQQVQ

SEQ ID NO: 5377 - protein, 158 aa, Corynebacterium glutamicum
MQGLCFLTRKETTMFTAFKSNPTTIKKLVSELINGDDAALNELERHVTNESVRARELPNVQYKATAGRNFAISKLVQNLRRINKAQNNPRGVPTHATVILLKEDGSYDGEEQWRIPEKAITPFDMLRSPDFNHNRLKNRPLMVESQYPWGVPGLIKMN

SEQ ID NO: 5378 - protein, 251 aa, Corynebacterium glutamicum
MKDPRTTAKLTPVSVPATASLSFLNKRRGLSQPSSNRLKNTQSSHSRKEHMTMYNAAKTLVPQIVAFDDTAIIALDQAAEDEFRKANYPEVKANQEAAYILAEAAQNIQRIATARATGDVPATARVVRIKGSEKYYTEEQWRIPENAYYPRSMAESPDAHLDDRGIYIIPAQYPWGYEEIINLPARATSTPAVAPRTEAAPATVSDAEVQSLLEYLRTNAFVSRHDGDTTKADIFNKHADTVNKLAALRAP

SEQ ID NO: 5379 - protein, 141 aa, Corynebacterium glutamicum
MSISPKNSGTPNENAAAAQVAANLANLTSQATGSMDETNEQVIKSNEHGSDAYLADIKASREMWAKIALDPNQSEETRKEARENMARIDEYAREHDKDNKGLLQKLAKNKAELIGTVAVATLGVVAAIANNGKIPMIQLKK

SEQ ID NO: 5380 - protein, 229 aa, Corynebacterium glutamicum
MYQNTHILMTLAILLSCDLNESHKLCWGFFKVKYRSFSGKKPHYFLQKGVFLMKASQTLTRNTRARKLGMGILAATIMATGALAGTAPQATAAVDTTAPYVSYVVDIPGKVGEPIKPQYLTISDQSAYTVTFKYMPSWLKYDANKKMLYGTPTEVDVWTPEVHVVDAHGNKTVRYFTVVAVPANTAPTTTTPSTPKPSTPQVTTPTTPKAPTLPKSTFDWTLWGSIFGF

SEQ ID NO: 5381 - protein, 143 aa, Corynebacterium glutamicum
MYCTLVHCRGCFLCANEFLRNTTTAKLRSGACVNPRCARTCLHTAHSTTQKEPFTMLNALNAVLDVVESAQGLVFVVITASLLTLAVIYIKNYPHAPQPATQHTTDQPTVPEPLQILDNPAQTTAAGLRHDLHSDLYAEEKSA

SEQ ID NO: 5382 - protein, 155 aa, Corynebacterium glutamicum
MSEFPTPTTFHVEPETLSSATDLTVDAHKIAELLLSTTDYRVFYMPRLAGVTPIVSYLYVYDGENFLIVGRSTHVPWEYYVHYPIKPSREFGSAIAVPLDDSDDPYDAAEVVALVKQYMTPTLTPGEGYMQGFYKGLTFTNHLDIHRPLTQIISD

SEQ ID NO: 5383 - protein, 79 aa, Corynebacterium glutamicum
MCLSNNPAYALAVPADTLAVNPNSTLPAQLAIVEHTTLGAVVAVHTPDARTGHHLYIRSSVTAESEVHTGTATPVELVF

SEQ ID NO: 5384 - protein, 227 aa, Corynebacterium glutamicum
MHHAERVTCFFPTFPHNYRRDALMSAFDELRKNYRYKFTDTWPANAVTGTGYYANPAFIIISADAMTQNTHADSNLITVKEHLNTLFPYSVQRKDRAFVSEIYTPINLLEDNPELAQEILDVLDTLSNNAVFNDAHYSELELERLNEYVIDTLAYDMKSDMMRALVKARPEADLEAMEELDIANIQSWINLHSSTVSEHNDGSVDDAPFNSLALAEIYLQQLADHTV

SEQ ID NO: 5385 - protein, 320 aa, Corynebacterium glutamicum
MRPINSTTSDTERRFTMSKNNAAHPQSVFHIHIPAHTTMHSDRFEHPDNGYGYTIRQDTDAENPMTHHDTKDAALWVHNRPRRGDTVADKPEGNEILDIFAKFICGQHDNDDNPFEVWSDGDSDASLIRTKAYVAEHHPELIFDISAKTITGYSQGDWLDVVCVTTAATCDELIPADSLIDIYRQWAFGDVWTVIPDSQPGLAGIYADDPADALAYYQENFEDEPIWDLLSRHDADKDAAALAAASAAENHALARGTTPVVIRTQDIITNARYLMSDSADDNPEYDRALVELSAYLLSIDLDDRVAAEMTILGRPVPKEG

SEQ ID NO: 5386 - protein, 160 aa, Corynebacterium glutamicum
MCTDTVSRMYAFYILDTMLNRSIKQIEQCLDRQDTTISHIIADSVHDKLHEYATTNPPCDSDKQALLGHVELEIASLQIIITSIHPAEGTDMVVCGTVSASASTWFYTVDEVFTQGWRSHFGSVLVEGSFALLIDPDTFDVHNLDLVGQQHVHWVPARQP

SEQ ID NO: 5387 - protein, 227 aa, Corynebacterium glutamicum
MLSQANMGGSPCRGVVRMAVCQLPQPEKTTLIKKDLLLMTSTTNSTAMFNDHLIPMAELDEQALRDSVGSWAQYKHPLDQRKEPELVLIRRVNSSERVWVLSFTDLRADAGLVPRSTPNADPSNIRNTIFSVAVRDLVLDRSLPRLLNLNGQPPAGEWEEGFVYVDYDQSDTVDGYLIEHSEPVSIESQTTGEMHYFDKVPGGVAVTNNPDGTEQGDARRWVSHWES

SEQ ID NO: 5388 - protein, 95 aa, Corynebacterium glutamicum
MPNHPPISTFDDRRSAMREGITDYLANTNANGLGGYSISDTHLDNLAEKFTRTHGEAQYDAGFDPNDLEPETFVRDIEMSWDERAIDRALIHTQL

SEQ ID NO: 5389 - protein, 125 aa, Corynebacterium glutamicum
MRAVRQLFATLFSPMSTTIKAAAPYSLHAHDLEQLAVDLTLVTTFDSNAAVDVTPTHTEAPGFTLHEGTDTAPMAPTLVVPISSDISTAVSEISTLVQQARTDAASAIHEAEAEFYNQLAAVLAQ

SEQ ID NO: 5390 - protein, 204 aa, Corynebacterium glutamicum
MFGSSFKEQTTNPRSQRVSYLRVSSTDQNLARQREAVNHSGHIDREFTDELSGGAKSHRPGLEDCINYLREDDVLVVASIDRLARSLVDLRVIIDRITDKGASVIFLKENLTFAAGRDDPRANLMLGILGSFAEFERSIIRERQAEGIALAKKAGKYAGRPKALDKEQIQEAKDMIAQGETKSAVAKHFGINRSTLYEYLKNPD

SEQ ID NO: 5391 - protein, 335 aa, Corynebacterium glutamicum
MGDSMTVAHKRSLTWIKRLSATTFAAFLGIQLVTPAHSIENTTQIPESELHNLGLTDEEIQEFNQYLIDESLFQETVETSPIVVSDNEDAAQDPGFGLFTTNPVKHTDEHIGALYFSDLPGISNLTCTANYIGGKFWTTAHHCVEGRSRFVGFIEQSDGQYAGIEHVYTKSSDYDIALIKVGSGIDAEQFSLTRSRPAVGKMLEVVGFAVVNPFSSRATMEVTNSNTVANYPMSNLYYKDVFSAKPAGSFPYVISGGDSGAAVWSGETMYGIASGSNGSTKNLAANVGPHVSWIEQTMQNNSNSSPYEILQAFRGGLATSYPKYNQIRDLVDSSS

SEQ ID NO: 5392 - protein, 125 aa, Corynebacterium glutamicum
MLRKVSIALVASAAILVSVPFAQASTSVALSSESSDSLGSIPNDLIGGLAGYFNKDLTEEQRDAIRFGPTTAQEAEQCLAKYGLGGEGPWPTIAVYPNCSFETIEQDFYDQAVAETLAAIGIGSS

SEQ ID NO: 5393 - protein, 159 aa, Corynebacterium glutamicum
MTVDLYQARIPFQRDGVRFDHTMITHIQAGLHLGGCRAAGLLPIPAHIDHIVRLTAADFYDTQSAPQLLSNTVLDVLDTTTQDLKALWPVAEHIATTIPESENVLIHCQMGINRSAALMTRVLMLRNDCTADEAIALLRDRRSPFVLFNEHFVEQLRAL

SEQ ID NO: 5394 - protein, 242 aa, Corynebacterium glutamicum
MSPNFQARGTTAPTVALSMRQIAHIREEIKKSPLAASVFITPTTKQMVVRDLESLFQQLYHTDLPEPSIKDSGLISAIGSSAGNTNNPALALETQMAYHLVLAMHHTDVATWHKVVTKNITESAAAQDAAVEHSAKYDAVYDAAQLMGITVEEGNVGSIAIAFSTARADGKSDWCVSGISRYIEVTEALDAARAVTKNTAALNKTALPDVQPAPVVHSAQFMNKSAHDHGVNTAEKDQPTLF

SEQ ID NO: 5395 - protein, 141 aa, Corynebacterium glutamicum
MVMTSGFSQEEWCVIIADSPERSFAVVVFSLLAQTPTSTITRARKKNPVKRMFSSRGNGSLSAYSARSCSTKCSLNSTNGERRSRSSAIASSAVQSLRNINTRVMSAAERLIPIWQWISTFSDSGMVVAICSATGHNAFKS

SEQ ID NO: 5396 - protein, 246 aa, Corynebacterium glutamicum
MSAALPHTAADPVHTTPAKPLLDHVLDSLGRSIISGEMEAGSTFKLQDIGEKFGISRTVAREAMRALEQLGLVASSRRIGITVLSHEHWAVFDKAIIRWRLEDERQREQQLQSLTELRIAIEPIAARSVALHASSAEIAIIGDLAARMRNLGEAGRGASQEFLDADVKFHELILQYCHNEMFAAMAPPIKAVLVGRTTLGLQPDRPAEEVLDNHDALAHALSVRNADLAEKASRSILNEVRDALTS

SEQ ID NO: 5397 - protein, 263 aa, Corynebacterium glutamicum
MINKRSMFMSLKTRRIFGALAVSLSISFSAIATPAASAQELVVSTSAVNEFGVVTSDITAEQILQAQDLIAEMKQSEDIYEYFGALSDVEQRSIIAAVKENPYLIENESPRMRVQSETPDEETPDKKKPSKTYKLYMSILEMMSCINLVDVPSCAQALKAANIAEREAKARYPDSVTNGKGDALRHCAWSALMTIRIGKDAAERIGNAHETVVRGEPEEREMDLINNALGRDIGERFIINGDETGALSTCVSMANIGLLHTLL

SEQ ID NO: 5398 - protein, 152 aa, Corynebacterium glutamicum
MKIKKFSITALASVLMLTGCATNHSSPLYSYLNASTSTTVEQVRLSDLYGEQWTEFALVCPYTTKDEVKEELGIKINTYLTDSTDDSSNDIVLRDKDGSYDWIYFNRFDIVYLCNGSAENLKIYPIDSVLEFEHRDDYGTWKLSAITEPGNQ

SEQ ID NO: 5399 - protein, 62 aa, Corynebacterium glutamicum
MSVDDLYAVALDTHTGKPIPCVLCENAPQIVIYDGCCSLAYTQALGDLAEAEYYGADLAAAA

SEQ ID NO: 5400 - protein, 224 aa, Corynebacterium glutamicum
MRHTTSATSTTSIIKRAMTISAAVLIASAVGLTTSASSLNTLSATSPESPDQAATVSQAESDSELDDGMKKLATKILNRADNAENNDDTGKNLNNDDKKLNTKQPQRPAEKVAQAIELSLDTTTNAEKPDKSFHHEKPVNAYVTSVSYNKSNDTWTIKPSDSAVNTPTNDAERISNIIQEARDLGLSDDESLTQQIAFHAHAANYLVTEWVLRGYQLANPKVLP

SEQ ID NO: 5401 - protein, 139 aa, Corynebacterium glutamicum
MRKQRRMMMAVGCAGILSTLAVGLTACSNDAALSDFFESASLRDHLAAHTPGESSRDTATVSVSLHEFYSVQWTDFAIVCPGISRDDITAALDSTVVGDNYDDIPATGLPDTASALVTNTHPGAYRPDPPLMQSSPLDK

SEQ ID NO: 5402 - protein, 105 aa, Corynebacterium glutamicum
MECDMRKLASIGIAIALSLAITPTIQANEIITPQAMDRIAVKCNVHKIWSVPSLNNYDGWVVVGHAYSKVEAEKRANTFVPFGHTKRHCLPVPIDRFPFEGLNRS

SEQ ID NO: 5403 - protein, 123 aa, Corynebacterium glutamicum
MRKTYVFLTQFIVEKGNESNAYNRYRERVQNLLALDGVDVISVSKNLQQAEKAYGWESLSDQYQMEHDGKYPENHILCDVYTVVVLNDIEKFEEAAELLIMDDRDVSVDAFPSRVDAFEQVLF

SEQ ID NO: 5404 - protein, 69 aa, Corynebacterium glutamicum
MSAQWGHGFNKGLHKGRVQGSVGASLVLLAGVGLVGGSKKLMEKRRQKVSIADSDQSTEGTATDSGFDE

SEQ ID NO: 5405 - protein, 734 aa, Corynebacterium glutamicum
MSGLFTPFSDAAKNNTVKTDGDSVSGRDLPITKISEDRFERSAYSAQLANIICDVAPWGASTVFSLTGQWGSGKTSLVNLIRSEESLSNEKWTIVDFNPWVASDPQSLIEEFYRVIVGTVPDDKTGQKIKTVLQKTFSTIGSIAGGVGGFGVLEALALSKGVDAANAVYKTWKQEQDSWPTLYTRAANHFKDLNKRILIVVDDIDRLHTDELALLMKVIRLLGRFPQVNYLLVYEEESLLTTLARSTAVGGSEDDALRFMEKIVQYPFDVPPLTSFQIEKELSALFDKLFQGVSLSGDPEDFALVKSRMFDVWEKTLVTPRLLHRFAALLTNWTRIYGSGEVNGVDLTILATIRIVFPSVYKRLSRAKEVLLQGGRTTGSQKPGWEKQLCEGMNNEQMDLLKTMLLFLFPRLSDHPSTRMHRERGISTEVYFDTYLMFQRPGHVISDEQLDKYLSNADDAMGFVDLINSDDNDMVASVMKKLPLAIDRLDGEGVRHMAVEVLFTAANGMHDKGRQVRMSGIFSDLYSHACSILGALPQLPVEQLYEKFFSEMTLNEAAFWLNQVGERARACGNDVSGLELFRKVNIKTEARILSVLKNQDPSDWDLGPYSLGILAKSSNFSSVLKSLQSGIEEHQFDVIDIGVLFLTTVYSSRQGPSGGAWIDSFQHSLFSRYVPDSLRAITKSEVDVELGKIQFTDFSWEGKRKVVAYALETGRSDFTRERLGGYSIADSIVD

SEQ ID NO: 5406 - protein, 582 aa, Corynebacterium glutamicum
MRCYLPTFPVVCHKIRSMTVFHDFEIVVTPNPDAPEALQKIGEQYWIISEINPDLKTVQWAQNVSDIDHQPWSSSAYLAAAAAVDATVPTAHCSACDSILTLTSRAAVSEVLRERPIKCKKCTPKIDEHIKKILDPAAQARQKERAARKREEDCKRAQQRLADQKAREARQLLDIERQQVIADRYGPLVNMHSDAVLAGASIRAKIGALATIYGAQNLENVIHSVSFTDRRISPDGQLSKELFREAWSANLLIPDPSSDVEAFAWSEKNSTELAGGIFVEKMLFTVPDTGRSNNRVQSFSEELRNHISLKDMYSTQREELLDLAYELMVGEAVRFANFRLYDQNLPPLTEANIDKLRAHLREAAASASLGVLYLMVWRSVKDAAAAHTKHTRMSKENATTHSVTKVSIFVDQLLSGTFPCSKPFHESSQVPLSEATKIVFNLIMESPPMETEPSVLRNSLQEHSDWELLQQCDEKIPDREFLMEWLYQEQTWTAEQFFDALAMVSSSEFRICAPGCAHQVSADIATQVLEFHDRVSFHDDRKSAMLAAEATIIGNKIGSQARAGDFVLGEVITKLQNIPGEV

SEQ ID NO: 5407 - protein, 73 aa, Corynebacterium glutamicum
MEKSWIFARNHQELAEVLLEHLDITHDSDLVRLAAACLDCEVDAVMWVEDKDNEPPLNSFFTLSAVTLLNIYL

SEQ ID NO: 5408 - protein, 48 aa, Corynebacterium glutamicum
MGKSEALHTGTLDLCAHSDTDVQFRPLNTALTFHYNADSAVWELAPFD

SEQ ID NO: 5409 - protein, 143 aa, Corynebacterium glutamicum
MYSDKLILLFLSEQHSSYECCVGLLDGSDGRDYIEKLLKGRKLKNHFLEWEDINKADVAREEIYKGQLVHLVFVTALSTPGEISFVFPGQSLMSATLEEDFAALVLEEERTSFRPDLSHLWSLPVGWVAPGLEGFVERNSEAA

SEQ ID NO: 5410 - protein, 178 aa, Corynebacterium glutamicum
MRRVNAAVVGVKNRTFEVSTLVFSHEQRVLDQARAHVICDRKAHQPAGVTVNDRGQVHIRPILNWQIGDIPDIELVRLVSGELPADKVREHCLGFVRHGGGDLAFLCVSEQLQRSHDPGNPLVVRKVMADLVFEFSRDSFGPITATVSGEYSLDLDPKNSVAEQAFFTREGGAFPFVI

SEQ ID NO: 5411 - protein, 298 aa, Corynebacterium glutamicum
MIRFRFVDDARKTYSVKRICDVLKLNRSSYYKWKSTAFTREKRLLSDAILGVQVKTVFTTHSGCYGAKRIAAELKDQIGHDLANHKRVARIMRSLKLFGYTKKRKVTTTVPDKTKTVFPDLVGRKFTADKPNQLYVGDITYLPIQDGSNMYLATVIDCYSRRLVGFSIADHMRTSLVQDALLMAKDQRGNLKGAIFHSDHGSVYTSHAFQETCKKLGIRQSMGSIGTSADNALAESFNAAMKREVLQDSKTFENQLCCRRDVFRWCTRYNTVRRHSWCRYLAPVVFEERGPAILRSAS

SEQ ID NO: 5412 - protein, 98 aa, Corynebacterium glutamicum
MPRKTYTEEFKRDAVALYENSAGTSIQKIANDLGINRMTLKNWITKYGANSTPHGANTATALSEAERIRQLEKENALLREERDILRKAAKYFAEETNW

SEQ ID NO: 5413 - protein, 71 aa, Corynebacterium glutamicum
MTTTEKIVAPATSVVVRGTPKGHTAEDEEGRKDSAATDPSLAWELGDKGRPKDGGLRQQTRCIGYADRIEN

SEQ ID NO: 5414 - protein, 433 aa, Corynebacterium glutamicum
MSALSRPHKIATGVAVATLTLTLCTSAAGVVHAAQQSISGPESSCAFNQQRWDDSKVKLDDTIATAKNSLVQTGELHRNEQDLLTGYLFQQPHSSNYLALNNAYADAVAIKDSFVRPTCDGSKESKIASEHAVSEVVGAVNVLARAQKALQINSDTYEQQRRCDALRLASRDESDVLMRIDRTMLQLRRTLADIDQASTDIRDIRAQTTSFERDLAREQKEADAAARAQAVDTSTTPTSSTEDRVNDILKESRTDHSGDSYTRSTTTSAQSTEPDSATNTSYLSRRLDSLERSAQHIDLNTQCDNLDDLRELTNNDTRDHTGSVISIADQLTDITNEINELRDSTFATRDSAQQAQDQVIAQREELQRAKEARLEEQRLAKEAEEGARNAAIQERDAAEAALREAQDLLSRLDDTGNATSDDTAALVDGLLNN

SEQ ID NO: 5415 - protein, 626 aa, Corynebacterium glutamicum
MKVDFSMTVTSPAALALSDMSYVDIIKKKRGWTTEFFHSTINTGETTTPLPDSDRATALIHDHITKAQEITIITDFDMDGISAGVIAYAGLAELGAQVNMVVPDYRGERNVTASDIDRALELYPATSLIITCDVGIGSHEGIARAHERSIAVLVTDHHMEVEPCQADVVLNPNRIDSDYPNKDICGAQVIFATLSDYARRYRADKIIDINLLAVFSGIGALADVMPLTRDTRPTVKQAIALLRLAIPQVSKNRFGGWDTYAARSVNPDTSTLMHIVNASQHDHRFIAAFQGISILLGELIAQKKLVNIDNISESFIGFTLGPMFNATRRVGGDMHDSFLVFAPHAALASQPSMNPNRHAAISRIIDNNERRKELSKSSYAAVHSSDQPYAPFVWLSEAPSGILGLIASQLTRESDVPAIVINPDTLSGSARSPEWAPIITQVNTLSAQGHGGIHAAGHEYACGMRFDNHDDIVTFVATLDALDKNTPREAQPADLHLVDIDHARPVLDNPSLTQELSTVDAAVDAAQLLVLIDQLDQLQPFGHGFTYPRIDVTFRPAETEFKVMGQHHQHLKVITHSGLTLLWWNKAQQLDEIAQSELVTMSVELDVNMFRGFISPQGIVSACTVI

SEQ ID NO: 5416 - protein, 260 aa, Corynebacterium glutamicum
MTVTTAQRIADEFQRGISIGPWDLCEVPAGDDYLEHTTKVRRRHSTAVEIHTDSLIICAPEGSTYSHNRTKAGLASTGTVTVPVKGLSEPVKLSLNLLADYGNSFDTVHDDLWQRELREQTRGQLLTLNAVSGLGDDSVAIMGTPWGDGLTGEANTIKGREHFVMWAAGCRFEDGYGRHALREDRHVRHQARAGEDSTAHHGWLLKGTVFGKELTGDAVTAAMTVFSDVVVTVDEGRIPGMKSGQPFSMATRLRASSAPV

SEQ ID NO: 5417 - protein, 550 aa, Corynebacterium glutamicum
MIARTAIDDCINRLGPDVVTMSSEDIADQVVNSINVAIARENTRAQDANAAVRYTPIFKLDFSHVAVLMRRLHVIINIAPSHNSDPDSDMLAIYDPNPRSEHYGIYRTSEAEIRRVAREYCPDLTSAQFRELQMALSDAAPRKVRHKQRDLIPVKNGIFNYSTKQLEPFSQEFVFLAKSAVNYNPNAQNPVITHPQDGSVWDVESWMNDLSDDPEVVNLLWEIIGAIVRPYVSWNKSAWFYSEAGNNGKGTLVELMRNILGAEAYTSIQLSDFSKEFHLESLTRAQAILVDENDVGAFLEKSANLKAIVTNDVISINRKHKTMLSYQFYGFMVQCINGFPKVKDQSESFFRRQLFVPFEKSFTGAERKYIKDDYMSRTDVLEYVLHRVLHMNYDNLSTPAAALAVLDEYKEFVDPVRAFWNEFSDQFVWDLLPLQFLYEFYRKWFDRDSPSGSVLGKRSFIQKITTIAVDSGQWEYPLTAQRPGGDMAVPEPLVIDYDLTEWQNATVPKGHVNKGLPLPLKANYRGLLRKPLTTPATPPAAPLNPTPPTP

SEQ ID NO: 5418 - protein, 1263 aa, Corynebacterium glutamicum
MSAPTIYPGTKTSIDPITMDDARIIFFDIESLHNIFTVATYDSLSHHVDVFYLLDHTTSPQITVLPHSMDYFDQTRSDAVMAAIIEQNPAFAEIKGSPITTADVALHNLGDTNANRRWQSNVLLARLLGGISVRGEVPEHQSHNHLAKQFAEATLVTRDFDVNYDPTSAHPFTAGFNSINYDTTLLSLYFAMLTSNIGSTPTYFPVITAQELRAHNDKLFSPEFIKNMPKYLWDRDSGAGLRAASGFRNAMLKSGRHIDIQRLNEKQLFVGLKRLLGLLGHQILESDRLSGDDAHVDTNEDVLDLIAYNVSDVVGTRLLAEDPVYSGSFDLRAGLLSTYPETVFDHDGTFRQPSTQMRKDRLTINTSSAQFAARILAPYRPLRDVPDAIGDMPVVSYLYPDAAVAEATGQKQVNVLDESKKFFYDNITDPEARAAFDEVFAFYADIEGRNFNSHNEAIDTQINQLRAYLNQVVAFDAAGYALYDVRTRFEQIFPKDRSYINDATDMTPRAVSSFDDLVALCDDIRGVLDRGLEISSPNHHEMVDAMRKQLHYIQAFYRAWGPIQRRFNDADPAVTHPHLTVIYPPLTPASAEKFNKITSVAAVSKRPTTLPYFRADGSPTRGFANFSTGGIHGAEYNEDRFDHDQDLHTVATREFFAILDATLAALYAAHQAEPESADYQIAQDALAWAKNVLSDQKLIAKSPQLYNPETGVTYEWEFVAQAAWWIRNKPVEVILPTGESMTVKHKSVLASASYPLRDNVAYWRSEPKTPQLFPVAKSGGSSLEKKYNYTSVGTAIHEDFSSYYPLLLTNMAAFTNADLGIDEKTGRPRDRYREIYEQKEIYGAQRKDPSIDEETKQRLGILREGTKLILNSATGAADAGHDTPILMNNRVIAMRIIGQLFSWRIGQAQSLAGATIISTNTDGLYSVLDMGTNQRVLDEHATAIGVQIEPEELDIVSKDSNSRAEFLGNGYINAAGDLACWDGPNSRNSLDHPAFVDHVLVKYFQLVVNNTVPEIPETPELEGVPLALDQPMNRHEVSKIVATMHKEFEPKKLLSFYQNILASSRGSNTFLFSVPYIPATEGEETHPATDTSTIATPTLSFDAYGNKAEVMPTQSTVDKRVPSLLQYYTRTFHVRQDTQQAVFDVIGANPVLIAAAKAASISPASADSRRKKGLASTNADPVAKHVLEIAGADVESLRHEKDLKVTKHTGQDPALPVVVFNQTIWHNPNDDVINALLGAIDQDAYIDMAISSYNKSWHNIIPA

SEQ ID NO: 5419 - protein, 149 aa, Corynebacterium glutamicum
MSTTTSTTTKHAPVRPLETVIEQALQDACAVHNIMYLKFTSSVTGVPDRILQGINAAGQPLTVYVELKRPGTHPRTRQKEVMNRLINHGALVFVVDARDIDVTHFRHNYHTVESLLELTFLSTKIPVPERFDLFNSNTKANTYSAVPAL

SEQ ID NO: 5420 - protein, 178 aa, Corynebacterium glutamicum
MKCGVPCGRMSGVLAMLQTISFKKLNLLTTLKRKGELVIMITRHDVPYIIAPPVYAIFASLMTTPPWFYRTTYTIDGFDFKISWVYTITIYISLMILIIGFYQANMRKACPYEEDPLVDIWHKVWSTALFILPIVLSIAVYSLITQRGFDWYVMVFILPVGLMIAYGFFKPCDCDKHR

SEQ ID NO: 5421 - protein, 613 aa, Corynebacterium glutamicum
MTSTTQPGTTPELSADTHSEPWDVVIENTLEPFQKVVRQFIIDRPYSGIFLTMGGGKTLTTLSALTYIQPPGHILVVAPLNISRLTWPEEVRKWNIPVNAISLITNERGTKLTRAKRLKLYEETATTPPTLYYITINLLEDIVNYFGDRWPFWTVIIDESQTISDISSKRTRALFSVRPYIGRLILLTGTPSANKFDSIYAQVAVLDYGASLGDNIDVFRARWCAPDIITDKQVRRWKPANKQAEAEVYRTISHLVMSAVNTDIKLPPLHFVDHEVHMSDDEHRDYELFKKDAVLAALLDMAEENEGGEGADDTDAADSATTTPPASSQPTNPAIPAGLLQAIQQTQDTNGRAIAPVTTAELDHFDDLPVQRQEDLGTLVVISAVHAATLRMKLLQYAGGAVYVDPEDSAQSQDLDASTARDVIDATNTAMTTITSRPTMIVHLHKVRKVIEILCNPALGGEPVNIDQDETGKQVYTPTPTLVAYRFISDKEILLHYLAQAGVQGVEVFDGSPDMLSRWNAGRIPVLLLQPASAGHGLNFQHGGHRLVWYNLPDNNEHYMQANARLHRIGQKNPVTIHRIITADTYDANMPAILAGKANRQQRLIDAVRRDPV

SEQ ID NO: 5422 - protein, 125 aa, Corynebacterium glutamicum
MSDHDAPQTPIPKGFWQQIDHQLDRLGTQRPETFAALRDILLDPAYTAIVHDRNRYGVVTFDTNSAFFSGSGGDNGLADVLINCDWRMTDYRAEYYYVMTHKYTKESFTYIEGDVKRGDLIPPNN

SEQ ID NO: 5423 - protein, 112 aa, Corynebacterium glutamicum
MTQIAMYLAGPMTGIPEYNYPTFHAAANKFRAAGYTVLSPAEDEYESQLTAPLPENAEHKYDHYLRLGIEKLLKADAVHMLQGWQSSAGATLEHDIAQKLRLAITYEEPPAS

SEQ ID NO: 5424 - protein, 122 aa, Corynebacterium glutamicum
MVRTMDMAIIQSVEYTSDVSHERITNVVSVGVVYEGKQYVVDLNGDDIDTELDMITLKEVIKIGREESARQIRRGSVDAELHRKARLWAIDNDMAVGQRGIVPQEIIDAYKEYCEKEGIPFE

SEQ ID NO: 5425 - protein, 206 aa, Corynebacterium glutamicum
MTFKVLIRIAEHQGRLHVHSPYSKAFAARARKLNGLWSPETKTWHFSPDKEQPVRRALKDVYGWDEFTTPELCTVQLTVTPEAVLNKHTLTIAGVTLLSRLRRNYSVWLGDNVRIISGNFPEAAGSPQYPLIMGVKAQPVVIHVQEFPVDAVSTIPPRFNPIVITAPPSIDIAALRAEREQLTRRISEIDKKIARAVHPTIQTEAA

SEQ ID NO: 5426 - protein, 179 aa, Corynebacterium glutamicum
MMQTLKRKIPLISCNDLKEVQLLFLKGQMHTVGYKLDTDLRKLTNTDVLDLINALFGTTVTSADDEAADFIDSDPQFAVLVELAYHDCARRAAMGLSRVQQLIYDNAAKSTYYRSVAARHRKHIRELHEQTQRDGIHFDNPLSRAVINDLSMSMNRARLNRIASWKSAGVQRYLNPTIS

SEQ ID NO: 5427 - protein, 176 aa, Corynebacterium glutamicum
MTTSSPLKSKNSLNGAQTTFVRNCVADGPTEVKATIDARGGIEQLRDNEISQLPDKLWFNSATSASNDEFTTDNIRLGLLYNMALNKASAHRYELAARWYAIVSPQPSQEASHKRIASWHLTQLHALVTLSRTLGVIIPGDEIDALAQSMENARQVGTENWSTVTMRTYVTNRKAS

SEQ ID NO: 5428 - protein, 266 aa, Corynebacterium glutamicum
MVHCHHAHLRDQPQGILMTRDIFHEAAKLIAHLGWRDAFPALQRTDPAPTHAVPIRAFDLKAGAVITDENRSNAYIYDTLVITQPYKHELPHQNTHPFEWALEQIATLDPAFSIKLDRSVTVPEIGLYARTLHDLNTRHQDFLAQRNAMLLVVARRGVDPKNIADVLGLTTNQIHRILSATPADSPTDLGVNPATTMGDVVRFIKKRRTTMQLRGTAVRALLYHGLTPAVISRLSGMSRAGVINAAKAFPTTINHKVKKRKQHFHV

SEQ ID NO: 5429 - protein, 62 aa, Corynebacterium glutamicum
MSNLGTYYAARRAVIGQLLNEGLDAEQIATRLQLSPDLINADFEALEKEKGEAQKKSQQPGF

SEQ ID NO: 5430 - protein, 124 aa, Corynebacterium glutamicum
MCISTHALKGEPTMTTQPLVILFTLHANPSHDHKERATTITGSLSSIRRWLVSQADLYGWNLGNFSAWSLDRRDHDPGEIIPELNQNTLLACASLVWDIPPAHIALQAVIPKPENIPLMRAATL

SEQ ID NO: 5431 - protein, 146 aa, Corynebacterium glutamicum
MCLERRCSHQRDIFWLGYYSLQCNMSWWNIPDQGCTGEQGILIELRDDFTRVMIASIKTPSREITEIPAVEICLRNQPATDGAQRASNSGGAFFVVMGGIGVEGEEYDKWLGGHSWFSFQSVCRNAQQPSNMMLLGCCGVRIGGFV

SEQ ID NO: 5432 - protein, 192 aa, Corynebacterium glutamicum
MAIKGAMPKNRVPGVAAGAFIAAAVIAGGSGVTFLAQGGGDVNTVAVVEPQDEVKNQVVTETEIVTKVHDPSSSDASDADSNTGTAEGADSDHKEPREHDSAQEPTAPTDPTLTITGNGDTPVSALDAVAGPARPGTVHVIENGETLSSISQDSGVPVGLIIDRNKLVDPDLIYAGTPLAIPTEQELAAAIQ

SEQ ID NO: 5433 - protein, 407 aa, Corynebacterium glutamicum
MTYPVTPQPVQPAPVAEKIKASSLKEGTQVFIKGRVNYSRIASFITGTERENRNRDRLHPIEFDYTSLTLSHPEIIYGNPQQKTNEELFLEQRIFVGKKRPEEGPKFSIDNKSNRLPQVWVPSTNADGTYEQLEGLEGELDAGLNVIILIEFYKPRTQVNRGSRLNAVFLQEPIRYYTPGYNADKLAALGIVLNAPPKDTIQLVPNEVAAGQDQSTTDASGLPLPGQGYSAPDQPYQAQPQYQQATPAAAPQQYQAPQPQYQQSAPQAQPAPAPVAQFQQAAPQAPAQPAQQQYQAPLPAGNPLAAGQPVAPQAPLNQPTPAVQQAMPTQAPQTPAQPVQPPAPQAGSAFTDAPGAVPQAPAVQAAPAVAQAPVAPVVDMTEPASPWDLPAAPSQPAQPAQGITYPA

SEQ ID NO: 5434 - protein, 284 aa, Corynebacterium glutamicum
MKNSSLSSESLSARSVLKRVQNSPLTTRATVYHRFGCHPPMLMVLMSSLKVSKVSSTQGSTSLFSSSSISHVHRLIAAPASTPCSCRSPFVTTPLVTMQISSLPSESYLTHRQRTLFSSFLMRSLQDKTSPPPMHPVSRFQARDIAHLISHIRRSLSISRQPQRLHLSSTRPHSPSTSSQLHRHNLHRHQLRSSSRQRLRHLLSQHSSSIRHHFLPVILLQQVSQLHHRLHSTSQLRQYSRQCLPKPHKHRHNQFSHQHHKPVLHLPMLRVLCHRHQQFRLLPL

SEQ ID NO: 5435 - protein, 465 aa, Corynebacterium glutamicum
MQGLGSFFTRVEARSVCPPRPTFRPPLFVNLPTTKPRSLMVNPFHTLDNSPFDPVAQFPAFYHNPLINHLGRRRAWTISDINKRPINVQQMLTTATYGSPVIHGARIEDAATSLLTLDELRTQIPTAANNAFYLDAVQDGCLILDIEKTCPPEVAATLLTLSPTAFYTEVSMSGRGYHLVMPIPENFAAFPAVHNKPSIKHPKRWFEILTSQWITFTRQPIPEHVLHHSESANTSAVPWLNDQPLTWENVFADLAKTVAPNLKTGAGLTITPNALMPPDLSDAERIRDDEVIDSTCRLFAEHYSKTLADFYDDASRFEFSQIGVIINLLLPTMRMHPTTISLDKPINSDHIIRLLFAVATRVITHRSKHDEERSGVPYLMYQVISCLDMREHPDNGDYRVVPSRHNRDQHSNNPSAHVVHQQPQPQPSAADSPHHYRALPQENTVSEHSFKIYNPPATPPLGGEN

SEQ ID NO: 5436 - protein, 198 aa, Corynebacterium glutamicum
MNGAFFAMLKFRIISTVTTGSQPTPRKSWSHPDTTLLVTMVTAPSLCSAINVWNATERIPAQKILNVEEVHVLGECSDAIISTSLTKKDNPHALVPDDFDQIGDVFGYAQDNVAVFDVIVAALGGAGYGLLPGLVMHHIDEHTVALVFDTDSPTGTHILGERCVYSDIIHMTDDKSARGWGAVIAIARAIILKVEQIM

SEQ ID NO: 5437 - protein, 60 aa, Corynebacterium glutamicum
MAKEFEFTIPDQHNRLPLIYLVAARTITSARTQLRAELDQDDPDLLSSIDIDALPYVIVE

SEQ ID NO: 5438 - protein, 419 aa, Corynebacterium glutamicum
MSLYLDDTLSRIVELDLKDTRIVPFLAGEPGIGKTSFIYGIGERAGYKVFSISVNTLADKGDLTGARTLQDPADGKWKQMFFPHATFVEANDYALANPNETVVILLDEINRTDSDVTSASMTISTERRVGTTDLAPNVRLAVTGNLTGNVTHLDSASLTRFSLYEVKPSAETFMNIMGGRLNKYIRTVLTKYPEYIFMKPTTATALITTGDDDDDHTTNAKQMMDFNAVLGSDQDMVQFTAPRTIEGLSVWLNNADDDFLRLLLQEKVDGLARSMSLLQATLESHTGDTAFTAEVLSEMTNDLLSSASQAPSGPIKPFVYDRLAAAPSNTVLEQEVHTLSLNDRADVLLFALHDTVNNAAPSIIAHLASEGVLDELPKDRISKIVSLGPVPTANYHALTRQDTTLTRNLGPAVLGFLES

SEQ ID NO: 5439 - protein, 618 aa, Corynebacterium glutamicum
MTLVIESDPLMVTFSVANHAPHTFSPFDIEPPLTGNATTDEHGYEHTSVLEKLASNHLFNPINPQHPVTITATENGSTVDLDAAALAQHLALAITPDSMLANHQGYNRDMMGLLSQLTNHVGFDRRFIVDQLFISQVLKANRLPAPANNVIYTVPNDVIPSAKDILSTTAKMNNPLTVTASAPITVDDIHTAYEVFFASLASVFFPYTYGAVFLNNAEFVEFVDYLINEATTLHSASLISNNTFNRFQSMRNISIDNLTAEFLLRKNEAETTDDYSFPRVLVSLLHSWVKLNHDDARANNDAPTCALAPFSVAQWIMPETIVFINAEAHAHASSQDIEKKWKEINAALTGSIRIMSPNAISKLQSAQHLGMQAQMQAMRARKDHHNMQKRSSQENDFSKALPSPQTIVLSVAEVLRKLTHVRQSHNPQKYQKKSLTRASRRHPDNPNVPGTIKSKLFYPDLHVYVDTSGSISEESYRNSVVLLMQLATKLDINLYFSTFSHVLSEEVLLPTKGKTPQQLAALISAIPKVSGGTDYHQIWDYIQINPQRQERMNLVLTDFGFMPNRGLNIDHPSSIFYVPILPDYGSWSMVRRDMSHFANEMVDFDPYIHSRLLGVHGK

SEQ ID NO: 5440 - protein, 655 aa, Corynebacterium glutamicum
MNSRGLPHTTNHYKKEPPTVPFHDFTDPDSDPRQNAPANPTAQPPSAPTSHSSQQGLPPGAIMIPFPGQPQQQSAPNDETRFIDLNERHKDDEPALFRDDVIDQTLAILISKNKPNALLVGPAGTGKSRIAEDIARRLANDDVSIPDQLVGHRILDVSIAELVAGAGVVGQLEERILDLIKYATDPSNKVIIFIDEIHQIAGDQSSHSGSQAKVAQILKPYLARGDLRVIGATTTQEARDFDHDPALKRRFSRVNVDEFDRDQTLTILHAARDGYLKHFNNAVTVSDDVLGYVYTYSQQFNPGNTAQPDAALTLFDKALASLTMEKQRLINNHVIAPSLKFPVSERHIHNTARKLAFGSQVPASINTDDARDKLETLFGQDHIIEPVLTAIKREQLGIFPRTKPLSWVFAGSSGVGKTEMARILSRAINGGDPIIINGPEYISPESITGLIGSSDGYIGSNSKRAKPLDPLISNPRQVIVLDEFEKSHPHFQQLFMAALDTGTMAMANGTTLNFSQAIIIATTNAARDKIGRDSFGFDSDNSGVLGSAQAATDPRAQERLKSLMSKDFPVELLNRFQNIFAFNRIDAGTYREILDNLYQRRRDAVLLSHPHYAAQIPADIDSDTLDQLVETTFISDFGARPAARTIEDHIASLLM

SEQ ID NO: 5441 - protein, 158 aa, Corynebacterium glutamicum
MIDTTANSTSGTLPTLTADQAAFITGFCEAAIFTATVTIDNEPIFLDEAFFLGQETYTDILMNQLRTNEAIVKDCLDFFLDNYTTMNKLIVDGLCPDWEHHGHDFLLTRDHHGAGFWDRGYDEYGAQLTDNAEKYSENCLNFWIEPDSDPLIINFEYH

SEQ ID NO: 5442 - protein, 52 aa, Corynebacterium glutamicum
MYDFQTIPQPPRDGYDNPSLDPRNPGYREQEYEDYLNAVLMTGNSTRYPAAA

SEQ ID NO: 5443 - protein, 108 aa, Corynebacterium glutamicum
MVGCTFLLRRPVLPPTPVRSRWKNFAVSPLGFRAGALRFFLGFSAAASTPSSVALVLMVASPSRSASALIASSKSASVSGLYSVAVPMVESSSELRLSMIIGMRMWLS

SEQ ID NO: 5444 - protein, 104 aa, Corynebacterium glutamicum
MSLTSVITISTDITCGWILPRRLSLYDPVRRYSMTVPPPLITPLMSITASPFTLLPVKIMDLLCLMTRATRCLIGMIILFLPQVSSVLALSLIFSITILLASLV

SEQ ID NO: 5445 - protein, 785 aa, Corynebacterium glutamicum
MAASGYQIQPHFSTQQREAITTDNPLAIIQAGAGTGKSTVILERIEYLCAAGTNPEEIAVLSFTNAAADNITAKNDKVTSMTISKMVHEIYAHNFPDHEISTIDTIINTLDIEYGDQMVTSDYMIQLRDLLYKVMTQGGNANLTALSIFMESHIEAFISVLDQIKQTSLELEIIICYLLLDKLIEPHASPKYLIIDEVQDNSVFEFVFALRFAAKHNTSLYLVGDSSQTLYEFRSANPKALNSLEASGVFGTYRLTTNYRSNQEILDFANIHLSDIEANQFAGIQLYANSFDAPTADSFKEKVELDMHHVSKQSEFTDSIPYFMESNKARFDAAILNNEQTIVLAHSGREIRAAQQALAEMYPSITVRNLQSDKGFNNTVFSTFIKDFWFEVTAVDPAHAAFTFTSQVTAHLDKLVRGKREQMEDRVIRSMAAWWRENERDIQGWVQQTQSGAITNEEFFYRLRQCILDYEIRNNRARQSMLNARNNANKEAVAQEKPLLMVSTIHSAKGLEFDNVIVLQKPSSDAEMTEEGKRATYVALTRAKKRELIIAGSTRAYPRIVTDYEQIVDLLEKRDEERKIKEEEAAALATLEAEQETRALAAAEAQAQALLLEHNPWLRDLSDEEVTALTEQEIINNVEAALQIEEEEEEARALAAAEPAIQQYLSQFAFDEFPDDDNVANTVVHVAPQPILHQAVPADVTVQSSTAPVTPVVADLEVTTVAADPVEPTIVAAQPEVDDNLVYSTSTPNSHSDVIAVNSDTSENAAVNPVLSDIEALRAIFNNQD

SEQ ID NO: 5446 - protein, 186 aa, Corynebacterium glutamicum
MRHSEQFSTTRTKTPAAVERFSHIILTTPLQHQHKSIFAVTGLLGRAPHSLFFPIGFYYTPMTSITTTDTPLYTALPHTRISDAELLTPTTTVHEILVYGPAECPGCTATLDFFARKNMPATKVTVAAGDVAHTYITQDLGYLQAPIVTVRISSSASNHDNEHNTQILHWSGVNRYLMQALSRTHF

SEQ ID NO: 5447 - protein, 126 aa, Corynebacterium glutamicum
MSESTSSANSTTILNDTFNPKPGVPYARVDNLEFATRDEFRAWATAEMEAGNVISATIANAPREDRIKSFVMDLVRDGIDDAAEEIVSRIDSGDFTMKEALTAIAASINDLDADDVVSDIVENHFN

SEQ ID NO: 5448 - protein, 155 aa, Corynebacterium glutamicum
MIDHKLWFNTVTNNASVREAAGKCDIPIRTLNEQLNRRILPEKTVIALARAYDLSPVDALVRTGHLTEEEAGSREEDASPDSADDYPTWALNSHLDYGILGAFGDIAEEVNSERVNRDNAIEQIRAWLDELPGSLFNNLRSTKTGYIELFETYLD

SEQ ID NO: 5449 - protein, 88 aa, Corynebacterium glutamicum
MSFKHLYDKTPEMIVHVYCSGPLCDAELEHDRDGWTCPECGTFWVDPSGKGERAQVDTPDDELEGLPVYNLSGEHLYNHHEHPESAEI

SEQ ID NO: 5450 - protein, 259 aa, Corynebacterium glutamicum
MTTPHSHRAPRLASTVIIARESADSGTLEFFIQQRQSTMAYAANAVVFPGGGVEDSDYPFMLPHRDQHMSPEHIKHHASRLHMDSETMAAHISAARREVWEETGVDLGNYNHELIPIDRWITPDIPAFRRRYDTATFVLILSKDSTNAALQHQHQTTEATHSYWATAEELLTQWSTGHLNLLLPTWWHINQLNHLHTLNQLYSFAQRTHNPQHTPPTVFANWTAPADEAAMQHYGFPDPDAYFDHATIAGKHHTLITRK

SEQ ID NO: 5451 - protein, 234 aa, Corynebacterium glutamicum
MTFAELSSPRTIIAFNGRAESGKDTAAQYLTHMHSFHRIAFADGVRDALYALNPLVCVEQAITTHGAIYDRVATVVDTLGWDTAKQIPDIRALMQRIGTEAGWRIHGEHLWVNLAIKKINELPADHAIVITDLRFPNEIEWLNSLKANPMNTIQTVKVIRPDHESTLTAGSFGTTSHISESFNLTTDTVLRNDGTIDDLHSKLADFLSTSPQPVLSRNAPVPKHNAPAPTTDAM

SEQ ID NO: 5452 - protein, 75 aa, Corynebacterium glutamicum
MTTPDPTNRDTQELMGVPKTQVRLGEGGMDANGVLNSVDQQLRMRQRYQAMNQEERPVIQEETQVQQQNDGFSFG

SEQ ID NO: 5453 - protein, 722 aa, Corynebacterium glutamicum
MVTVAGNEKNKIREERVARRAQAVVEAEISLAAQASEQVREQAEAPDVNEQVEEVSVEVSSVQSLTQPKTLGQLHDPRKNVMSSSDLASIIGVEQQPVAYGESEEPETLRDVLPRRKLHPSEITPSYEVADGEQRSIFGESAPSDFDDLSDVEEFDTSHWVRAGQDDRSDDDRLADEAGVPRSGAQDVADNEANLSGVDEQLHMREVHAQSFDPIDVAKKERKAAEKKYAKPPKSDNPYLARDAKDAAARKRKINAAHDNFAQEMAQAAMGPLRKGVNTQTVMAACTTAAVMWCMSPRMTGVNVDMKRKFNKDLEQAKDTKLSKYVSKDFWKSKLTRDKTEKEAKSLSDAFMQQKTAIISNRERIPMSVASAAQTVVRLSDQAYEAMREVDTDGQAIVDAKDVSAQVAEDIDMVVKQGEEHGLKSKDIYGAARDIVGRRMERDPGYAARFNETAFGTVRLGEQRRGMVISKTPTWQFPDGAGLSKNAGWFSVREPMGNAQNFADNLAATLATEMRVAGEQYGSDGVRDVVAGFMTATDVSESGLASAKKLLPDFDTRGRSASRVRQIAMAQRTQAAIKVLQDDGNQTAMTTEQVKEVQVWAMDQAEKVMQRDHPAILDKFVRKHGQTFGQDADAFVKSITMEKDTSSEYTDAMVRPQENRGSGRELAARRRVQAAQINQAAQLDMNVHDFRESNLPEERPANPYEAYVRETEAKTNDPQYGY

SEQ ID NO: 5454 - protein, 91 aa, Corynebacterium glutamicum
MAVDFSRKGTRGQSMRATPRQQSRSVAREVVASDPVVEVAAQPVSPLTDKELAAVVPAHVRTARLGAAELLRRFERTGAAAQNNQFDDMDF

SEQ ID NO: 5455 - protein, 2169 aa, Corynebacterium glutamicum
MSKTLFRHAFERSLEMARSEWGQKDHWGKAPLGDHDAVRIYRQAEALMKQRAANNKGLDLNDEATYGAIMFASFDDAFAADAEAHGCVHRPQFAKVTRRNILNSPQYTAIKSSYDALVQQDLVAQQQQAQALQQAAYEQEQAAIFQARDQATFQAEQTLAQESVRQSEGVGLPVIDPMESYFREYAFYEGVEMFGTWGTHVDAGVSQFSTSDGRAIRALVDEHLATYEPVEQRGSTQAFFASVNAAFAEVAPHAAPMFSAIAREGEGSKGYQALRHRFDKMVGTAIGPNGLPEGPDLGGRRLPISPYDPRWSDREVVRVHGTKLLSLSEESVGMIRDLDLATIHLQDNDVYEGTHREDDTKGGVRPLTQWVNGEAIAWRTITENDQMRLPNIGQFMTAKEYRAAASWLRAGLIDTADVASQKIDPNKVMSDEGIARSEAILTYLSDEGVDFRIEPDREPGQLKVRIEGTRIDIRLTDTRANEQWVGRVYDSGTVIKYSAEQTAEERLRARERMENGDGTWTPATDYEPSPTEVVDLVKFALGREVERQDGKGLVGVPNARHPRALEQAQDAYFTKNRSAFMVREGLSIVQDARDRSAGPGKWFDNEAKASEWLGNNIALTRARVAEELGVEELIALSAQYADDPDFMPAFAGEDELMAIKQDYWAMLRGEETDLLNPGVNRDDYMAAIRDGDHEQIAAMTSAMNAVTVEDRVRQHAALVLDDYVGTVEPDPVTGLRFNPVTVAQHMPSAKSLWSNHDDIIAALRATSITGDELRGDEFYNDVINQQLLKFNPETAQKMVNNPDLDPQLARFGTVIAETISRNGADVVDIAVDDNGVVRWTAQRRVGAKDSRAVDSKGQVRGERTRHVQGEIGQIFTRGEHGEIVTKFNGGENYMFAPGYTASVVPQKPGETKSLEERTKLKGYEQVMSEALVYRVREDLMFTERSRVGATTSINSAYKRLYDNRFPVDFFERSAEEGLSDEWRAALLETASLRVRYDNSIRDGANVMEDIRAQQRGFDARNDNSRDALVLTGGRNISVLDVDAGKGFFDPMMTGMAANQGSVRYLLPSAKVGADGMITPGDPADRVPVAAHPESWAMGFDPHDRQNMTFSNIMQASAVTGGARTAMIQLGGWNFEDGIIVSADFANTHVIRDTEDEMRPLVAGDKLSDFHGNKGVIALVVDPAMSDADARAAGLESEVAFFRDNPDLEVVMSPFSAISRFNGGTARELMNNPQDVVFRNNDGSTRVQPGASGDLNFIVTHMAVDAKTNVYDEEAVREGQGRKASSQLAWVLQAQECHEIMEHFYGNNVSALANFQEYLRVTGLDVTPYGELREGFSESNEQRNIIEMPSIYDENGELNNRVNRAQVREAFVEQISRAGGVMEIPFQLQLRNGAQLEESPNNPDMYQLPLLSPHLRSDEDLADGSTSRHEYTTRYMAIFDTCYKLAEEQAKIDALRQEEAQHGTLPRAAEKRLSESQKFVDQAQKKVQASFDGIANDIVASRIETKNNVFKDGFMSARQSHSATAVWTGDPRLSVDEVAMNSSMARELGVLDNGYAMVWRDPVIRDGGVRYLRVVINDDLHGVAVNPVSVKSFDGDFDGDSVGLVGNLPKKAHEEALSRLTVEANMLDLGDGKRMEDGTMFYGLTLHDSLDVQVAQHHDPAMAENMKVIVSELNRYQREYEAGEISREELLEVNRAHMDDLNEHYAQAFANRDGLVTLRFDGMENHMASVAQCFETGAKGSPGKLKEYATYIGADPAQGFKDVGQPTPEALRSHYEGSQKATAIKVLFTGVAGKKEQEMVALCRNLGLTKEAMAASAPAQQSILQAKHDPIDALYRAETLMGPVGDLYQGRKMRRGENEQGRYEWEVVRDENHQPIQATKDEWVQQYMEMYADDKGMGVSVGVDQVEKIAEEFSDEQGYMRVLSHDELPTEIKPLALDQLAYGDKKNRFDLLCEMAKQQVNIYDGDAYDFAPRVVRANMKAMEDAARFGIPDVEIQSISAQQSLASFERVPQRSGFRIERRVPAEVGTGIAAPAPLPDAGVQGNYVQQQVPATPPVMPVTPPAQQPVSPAQTDFRGVGQPLDQGGKIGNYGHQGPAMGAQQPVVPQQQNIPPVHNPVPQNSVPPTPVVPKPGTGNPFTHGGANNQFMGRFDTSRYNQQEPPQRQDGGFEL

SEQ ID NO: 5456 - protein, 363 aa, Corynebacterium glutamicum
MSTKPTIVSTFSGCGGLDLGLQEVGFDPIWANDFSEEAVQTYKHNIGDHIVHGDITEIDPFTDDTIPDGDLVTGGFPCQDFSMIWKRPGLDGKRGTLYQNFRDFVAAKKPKAFIAENVKGLLTANQHKAIKTIIEDLEAVEPGYIVKPRLYNFAEYGVPQFRERVLIVGIRRDTGFDFKHPAPTHGPRGDMPYKTAGEALKGVKDVPTNNNHMKIMPRTVEVLKRIPEGENFTAIPKDDPYYVKGMISHVYRRLHRDEPSKTLIAGGGGGTWGYHYEENRALTNRERARIQSFPDDFEFLGSNTEVRRQIGNAVPPVGMHAVGERLMNLYTGNYTPVDLEEQHAYLQTLSIKERLALADQEAD

SEQ ID NO: 5457 - protein, 358 aa, Corynebacterium glutamicum
MKPTVNVVFNAHHPKDTQPLDKFFDKELKDTHHLDITVGYISEKSLQYLLLIAGTHPDLTITLTCGMHAREGMTAAQLHHARVLHDYLSDHDRGGVFVIPRLRYHGKIYLFHKNQHTDPIAYIGSANLSAIVPGYTSTFETGVILDPAPEDLVLHLNRDVVPLCVPIDTAHVPIIKDQESPMKHVAEATAVSTSDVVAIMSSPFTYSFDLKLKATASSNLNAHNSGGGARKQKNGSFLARNWYEGEIIVGVETTRLPGYPQNKSEFTAVTDDGWSFVCKISGGNGKNLRSKGDLSILGTWLKSRFIEQGALEYGEDATQENIDRFGRTHMTMRYHPDFDVWSFDLSQTPKPSTQIGQD

SEQ ID NO: 5458 - protein, 507 aa, Corynebacterium glutamicum
MTQTLAGERRIVTTAELKAMLARGDKVFLPGVAARAPEILDNFDPADRARLDVPAADNEIVSVEFSRRDTVQCISIADRDHLYITDDMIPTHNTSNIIFLKSTDETMIKTLVDWSGERHVVRRNSKTVTRDLAQLVMRTEGKVSYTSATEKEPVVSYNDLNTLPSQNAIVFRAGQYPVWSRNETIWPMSFMLFANQIIQPGREYSLQTIPTLSSANEFDVNQNAPDFMAMLEKRMAQSIRTQRAVDIYKKATGLDDSDIARLDMDVYSAEIMDIVDTMIAKDEYDDTPDYDEGDESVMNARDFMESEYDVFDDEFEDSAQGFPVATGTKVKKKSLSEEAEVNDEFIHDQENAEHKLADMRLKRYAEGKVSRDMLADQFGHILQDSLEDELTAAYDESLHAFAQDPNFRVTANNGLVNAVDGTVLIEALSQEDIALMRAQAGVEQSRVYSEGEEALSGTEDDPLSAMGKYKTTRAFRIMLVELPHWRDLAQGHFDKEVARAFRRIEDA

SEQ ID NO: 5459 - protein, 239 aa, Corynebacterium glutamicum
MSLLFSGTFTQGEKSPVTNTNRIEDHYLKGGRGRGTDDPSNMQIAGSMLRTLFVRKIRALLLVLMIAPTPLVEGLTSTAMIVSVVILAIYMAITMYRVVHGRHEFAHIARRMALYVNKTSSRFSVVIAYVVLIAIYALLIPGLVYSVTFGFIVPSTPNTFSDAPAWIMCVSLLLIAVASFITSIMDDFIDGILTDFYDEDNADSPDSPAEDIATRPVESATTSALAGFAVGYICGRFNR

SEQ ID NO: 5460 - protein, 606 aa, Corynebacterium glutamicum
MPTLLIDTHPHLAAQLLDPGLGELLTAGSNKKVQWQCPKHSNHIWTASVNNRTNAKNPRCPYCAGTRVLAGFNDLATTHPHLAVQLVDQDIAVTISAGSGKRQLWQCVVNPKHQWLATPNNRTSTKSASSGCPYCANRAVLVGDNDFATTYPELAAQLVDQSAATTFTAGHNKPVEWICCKHEPPFIWKTSPILRVRQNTQCPVCSERTVAPALNDLATTHPKLAEQIADPQPSGVSAAAIIPTISRGSHTQLTWQCSKNHDHQWVATVKDRVRGTDCPTCANTGTSRKEAELIEVIRALFPNTDVQQGALINGRTGNQGASPSTDVLIPSKNLAIEFNGLYWHSELFIKDKHYHANKSALAEQAGVQLIHVWEDDWNLRRDIVIRMIAHKLHATHNLSAVLPTETTDSRVATTAFARTLTLSVVSGSRAAAFLNSNHIQGAVSATKHFALCDNNDDIRALLSVRSPKNNARMYRKKGTWEIQRYATLGNVPGGFTRLLKFAEHTLNEHSTVLKQWISFSAADVSDGSLYRTAGFTAEQQLAPDYRYVGGATGWRRTPKESFQRKRFRDDPALLWNESWTEHEAALNNELYRIYDAGKTRWVKNVA

SEQ ID NO: 5461 - protein, 62 aa, Corynebacterium glutamicum
MAFAEGYYQEMAEVVCEAREEGITHEDTLHMLNDMMAMKRSGEVLNTLADVLYANECPEYRI

SEQ ID NO: 5462 - protein, 117 aa, Corynebacterium glutamicum
MEIRSKRYLLTSLILQTLQQLTQVYGEASDKILQGNAQPLTAKIATPDGWVTMGEAEAGMKVLTPKGTVSEIDGVFPQGERDVFTVTRKDGSTTEACDEHLWEVIVVPAEQDAASAA

SEQ ID NO: 5463 - protein, 288 aa, Corynebacterium glutamicum
MWHCRCTCGVEKDLAAGSLKNGDSKSCGCLKIESLSKNRDLVGSTFGRWSVVRRGEDVLQWGRLSKAWFCECECGATRDVLEQSLLRGRSISCGCYRIEQRRETAVFEDLTGKVFNQWTVLSRTDDRFYPGGGRSQMWLCRCMCGSENAVAGIMLRQGISQSCGCLHGSIQESHVRDFLLKNDFQFESQKTFDGLVGVGGGPLSYDFLVFKDTEPWLLIECQGEQHFRPVEYFGGESRFAIQQEHDRRKRAFTVVRELTLLEIPYTARTAESIGELLVSGPFQEEVFG

SEQ ID NO: 5464 - protein, 110 aa, Corynebacterium glutamicum
MVHFTIKLLNIGSYFTPNIFPSSVSPIRYMLPLGAHSDPARLGCACNTSGRFINSSLTCPLRALTHFYAEQFKSRTFASSSVISLDNILTLGSFWTPGISAAHQITLTLS

SEQ ID NO: 5465 - protein, 560 aa, Corynebacterium glutamicum
MIDMWTRETRPNNMCINDPKGELLKKNYVRMSKRGFQVVQFNLINNLKTDIYNPLGLAAEAAREGNGMKCATYVENIAEVFFPVDGADDPVWPNAANNAFKRAAYGLIDFYLEEEREMRKQAAAENWDAKVLDTRIDQMWGKVTLYNCYQLFVQLSAKKLKNPVERLNERARAGEFGNLETDENAAMMFQDAVTEAEENEMFLWEGEKEKDMLTLFFSATDGLPKSSVRTLVGNADKALKAMGGAEKMMASVYGIAITAMSFFTDPTISTLTSGTLSQNVDLAGLSFPRRMGVRFAAPYVKRYNLVGSQVKWDAYSDAKFTKPLGKNFVHDDTLSVEGWARFYIKDSFPSNTAYLRLRILNGTSGTLIKTLYFKFTKGYQTNLKGRAFITDPVTDEKIIKNGLLIELVKNDAGDFVPGHVQFKTKKLNLDQLTQEQINMPGHDMIKQVDAMVDAVSALNVRYSEKPKAVFFVTPPHLMKYAKLILILIKQLVDLNFDSSYMTRENQKPDYKTRFMLDELGNLQSEGHGIAGFETMLSIGLGQEQQFSATSCVAKNYALAA

SEQ ID NO: 5466 - protein, 402 aa, Corynebacterium glutamicum
MTILQQATDLYLRGFPGDYIKTHTGLSIQSVLKQNLVKGTRFSKADVQNYQISFIEKRFNHDEVEAAYREMSCEFDDLYQAGRSKKIMALDCGFGDYAKVFRSILGESRYRVLRDECWKLKQIATVRERYGVDNVFDKSTFDRFVNEVAVERGREKRTATLVERYGVEHPNQDPDILLRMQNTLRATMNDRHGVDYPTQIPEVAEKVRKSRQETMTSLYGAPDSVLVPEIREKIFEARRLNGTLNDSKPEDALEVLLQNRFGMDDVLRNVVVDDRYPFHVDYYIKSRDMFIELNGDRSHNDHWFDSSDERDQSLVRFWMGRADELESEFGGQSRYRSFIRVWTETDVAKREAARINKLNYLVFWDGSSSIDGEGRHPRLSDARAWFDGGCLDSIDWDSRQTY

SEQ ID NO: 5467 - protein, 431 aa, Corynebacterium glutamicum
MCGGHLYRKNNRKVRAMALFGSSKRDYDNVSGGKAFKGGGTKDLKQTDRTFDQLRKQRVTDKARNRDVHNEQQLARGEIGEMRSPMWVEVGAAILGVFVLVVMWLAWGGIGLLIQTMMNTGSPNDKELFDELGVRPYYVAVEQQIGTSSAHTTCYQPLDEFGNNFGDCTRSVPKEPVWYADYVASVFAEHGFDAPEPIDNSVGSWLLFGHVGIIRVTFVIAVAAGVYAMSRAAMMRQLETQNVAVDTTDINQHTNDARLAIPQEIVRDLSLFPDVGAHSPVQPSSMISHVMLSNKGLKKVDVTQFAQETIIDNDTGEIVSEKGEVLYDGAGQPITKSLPMIDNEFSHAIFDKSDVPNLPELRRFFNPAKIEWNPGGSNRDKTGKQDTVAQHINEDWEFPDYEPQRPAGAYVVDEAPVNTLVLAMTRAGKGN

SEQ ID NO: 5468 - protein, 831 aa, Corynebacterium glutamicum
MLDSLKNRFTKAKGSHGVGEGAVSGDAAVKPLRKEERLASVIQETEPGAAVEVMRRNDAFALPGETGWVVMLLPTHDSQFGGLNAKEKNREDKGTIINLVVNDDIHSVVTPELLDSDVLGVIPDADSFDRMDEFDLLRNKARWHYGVAAIEPDTGELVVFKVPAKNSASARGDIFSEVGDVLSGAADLEDVVDFEVIATFLEVLNETSEVDIDDEDGDVPYGLEGVNAAGVITDDLIREKLDVDSYPSSAEIIDNIVHVFTKLQGKHHVAPQPVLHSADVVDVDAQESHDTVVIESPDDVALAEQVDVPDFSDGFGIDDAEVTEPEDEEVVEATADADPFGDVAEDDPFGSDDEPDFGASDVVAAPAPVAGMSDEQIQALIRGVSESVQAKTGSELNALREELAQALAYNPVQDSQAALAQVHAADARSFDADQVGDAVTKRYVNDDLGLYVDEANFNNALTRAPFQVAMPQFQETTPWLGDQLRTLVAVFNGQLLDQHQRDYEEVRAMYIALNDRSNLEIARDLGLDNKDSEFYEVYRAIERDRDVMAGDQQRVESERRQQLQQEYEANREEYVMAKIAEQRVEYDRRHMPRHTASLEAVGRELTSLRDRTIEDYTARMNTLRRARAGERANAAESRIIDELRPIVERQAELQRAAFDGFIVDLDKFIADHREDDLRLASVNEQKLAADNRVAQLTKEAEERIEGIRVETDKMIASQRKALERQEAEFAAELKRRDTIVAASEERAEREITTARLDAEAALKRMEEQIRVNNEAHEAEIVIERDRATQAEANSMTFVESVKQQDRSNNIILIAVLIVGLIAGMVAGAAFF

SEQ ID NO: 5469 - protein, 595 aa, Corynebacterium glutamicum
MTQVVAGTLVGESINREIDEDKYPYLSSYAAPVAVPVREIIGREEEVNKIMAALMRPEISNVMLVGPAGSGKTTLVQQALVKDPERNYIEVDVAKMVADLSTPAQMAARIKGVFEDAIAYRKHEGHELVLFVDEFHQIVQLSNAAVEAIKPILAMSGVLGVRVIAATTLEEFHEHIRPNQALTERLQEIRLTPTDQKTTVAILRGMADRYGVSDQFYDDHVFEQIYSTTERFMPSSVQPRKSIRVLDAMVGWHRLSGKPMDMDLLGDVLHDAIGVDIAFKVDGTSIKDKLDEKVMAQSLATTVVARRLQLVVADLHDKSRPLSNFLFTGPTGVGKTELVKQLARVLFGDDTGRLIRFDMSEFALESSLDLFRSELTRRVADQGNAIVLLDEVEKADRAIARLLLQVLDDGRLSDDYNREVSFLNTYIVMTTNAGSEIFETISNYATDDTGDGRAIKDFVKNIHTSIKNKGFPPELLGRVDEIVPFQPLSETTQDRIISKKLQDVATEVYERHGVKLHCSQKVMEFLLVDQVEESAESGGARGAVRSLQREVVTEVATFINTYPEVRDIYVDVDGQMRNKTNRVSTARVVIKRVEG

SEQ ID NO: 5470 - protein, 207 aa, Corynebacterium glutamicum
MTTALCTLIWQRVSAMSKSQDDRKIAELEAQFHSLGLNNTELVTLDDAASLLGVPAGIHQIEAEVMLVNFGDGADGMGGDTTKFLHYQPDESQPYVWVMKRVYSFEAMKKLMVGLFIGLCILIVGGPALGLMLGGFIGVLIGLCLGTSAAMIVGPFGLMRMKAYPPCMDSPWVYMSQEQWRTAMGAAQQTEVSFVEHWDNIYGDNLH

SEQ ID NO: 5471 - protein, 371 aa, Corynebacterium glutamicum
MKMGTPENEIIFHTWNRTTRCEVTRDAADHRVSVTEITESRWVIHIIVSGILSALAVLVFIIGAGLPLLYVPIFVTVIVMVVYALLRYEQRMSGTVYEEADPVEMDSVIWEGIKCDIASDIAARAEAKKAKKPVASDAVAVGNYIASLRQHMLVETQRRYHHKLGRELHNDPAQLEDYGSGLRDCECRACVVAQKLGVTVHAHGVVQASARKKDRVIIGRADGIDVAGWWNHRQEARRKTSAAKQLERDAQRKRTQAERDKEIERKRKAQEFVAEQSGKAAAAQRRAEKKAAKQARVDELVAQKQAAQEQKTHCKRDKQRAKKAQGRKVGAVDNSAVDDVLAYAEKTRSIAGCRDDDSVVHVDMAAGVRDV

SEQ ID NO: 5472 - protein, 282 aa, Corynebacterium glutamicum
MAFPLLAVAGTVAPVAAGWAKDKFLSNSQNNQQAQNQQMSFGQVNNSAQNSGSENSGFMGQYGNLGAGLAGAATGAGLAYSDFEDGQSLSSKARNMVGKGLAGAGAGVFTKLANDAIQAEGGSMKASAYSAIAGGLGSYLKDGGPGVIKSAMASGAAGFGADKVHDKLAESGHEGLADSLSGAIQGGGLGYSTLGGVTGAGIGGATGGLAGLAQNYFGGGDDYSNAGASASGFSANQVNSEISTEIPQFANLGQPQRSELEQLALPQESRSVDKSYDQGYEA

SEQ ID NO: 5473 - protein, 327 aa, Corynebacterium glutamicum
MLGCGVLRLLKRWLVIHLRLCCRLLRLRCQSCCYCWRLRLRCQSCCYCWRLVKRIPSRCLRCLSCCCLLLRGCMSYRVCIDRGSCICWLLALWHWCLELLILHNWLRCHLWCLSLGRLGLCSLLRFCCLAIHCHSHKLLLLNIHRVRNRNPRWLQRLSVHDRRERLAVLGLREHDISLDQHGVTNCLTVFAQERGHMVAPLCCHRLHRLNLRIRIRNTCVALTVLSVKMQMRHSLWCKIRIRTSAVSVNRNLRYLNIHKVDSVTLFGHMLGAVVDVDNKIYTFSRRVRIDDIAIFILASKISHDTNPFTLICSGLFILLPRTILIKY

SEQ ID NO: 5474 - protein, 293 aa, Corynebacterium glutamicum
MANFRSKDKDGNVINPNASTKGVDLVVNVYDSAKHVTEKGNTVHFVDVQVAQIPIDADGTRANANLAPQTMPHLHLDTKDGQRNTGVAYSDAQIQAMQTVAAQGRNHMTPLLSKDGETVGYSMLVKADVMFPKTKDGKSLPAVMNTKSLQPSGVPISDAMNIQQQQFMAVAMNRQAAEAQKAAQAQATQAQAPQVAPQPVMQNQQFQAPVPQGQQPAYAGAPVYADAVAHATAQQQAAAAQAPQAPAGNPFNQPPAVAAALAPQTQPPAVAAALAPQTQQPAAQPQMDNEPPF

SEQ ID NO: 5475 - protein, 66 aa, Corynebacterium glutamicum
MLKYTFKLIKEHFDLIHIKVFFFFNQPPTPIHHHGYSAAVNPAQLDPQHHESVAALAYLAQLFYPA

SEQ ID NO: 5476 - protein, 922 aa, Corynebacterium glutamicum
MSLKQAIIVRNEYTIKQANGKGSRGSSPGKYISGYMARSDAVEAVAPIVRNKLDDFIMRYMARDSAVEQLTTDSNADYDQQPEMNSRRGRQGRRATLKQRRAERSARRAALRAGVNTDSDTTNPSQPVHPRELAEFTTQDGQRVHDLMLRAQGNGGVAFGYGDVSLSHDDLHAASNNVQELYENRHTVMKVVLSFTQDYLTAHGLIPEDLDIKRAGDYRGQVDQMKLRMAVMHGVDRLAQRHYDDLRYVGVIQVDTKHVHAHLTMVDAGYGHRAADGTQKGKINKPGKAILRRGIDAWLDQHQHMAHLSAAVGYEKRNVTSYVKRWAFHQLTQESAAQFVVACLPEDKRLWRASTNAKEMDKPNRLVRELVEARLGETDSPMPAALSQVYQYAQKRRVKEGLSKQDTQRLIDNGREKIIEQAMNGVYSVLSAISDEQRDVSTAMLTVMRQDYEDLLDGIARKKSKDLDEQGSSGSQEVGKEEPEPSIEEFGLRLRSYSARLNHHREQREAFAVKKRSWEDANSQGLADPTSQVMWSFYDTEEQYHAMCQSKYQHFLTFAPPVGQWEKQWAEVADYGKRVVGLRALRADRSLARMSDERAAEALGRQLYDQPGGGLLARTGAEGKAGRAVLDGRIERMMVTYQQKIDDLRREWAQLGARLEVEGDAVLMDAADLRESGGEGADERQIQQQTIELPVADVSDSVRTYLDEELRDSRDVSAHDPVHTLRGRFQVVFRPEHDFEQVRGADLHDLHYDWFSDQKVSQPIVRSYGELVTQRRYAFERAREWMISSQQEPEAVAEELDHAGADITRMEATSSEVSRTGILRSAMLARIREQARQRAQRAAEEQARRERELVAQRQQEIDQETTQPAFEVVQRHVQPESVQIKRGRTVALDKRVQPLIRDAVDRAVLDSQLRSTRDGGLG

SEQ ID NO: 5477 - protein, 200 aa, Corynebacterium glutamicum
MKLDDAMVMIEQRLVKGRGATKTQLAPYEHIQRNIAARGLRADDGGSCFGYGDASLSNDDVATAAEDIQDLFACGHTVISAIVVFDKSYLSEHGIMSFDPNYFGQDIYADTHPEIDLMELRLAVMNGLLGLEGTFFEDMRYVASIEVSRSYVYAHIMMADAGVDDARGNAQVKITDTERVLFRRGVESRFVEQEARNVVL

SEQ ID NO: 5478 - protein, 417 aa, Corynebacterium glutamicum
MKLAGFNTNSPAAQRVAEQGEKVQLDAPVYAVFTPDVVEVEFIGTQHEPVLHVEGAIDSVTALSQLPYDIQKITFDSENQQRFSGFYKFSPQQHKELIDKGLYLEGFQPPREMMTSLPWELPMNADVTVVAPESQDAPPIVLVGLSEIHGVDFSQESSGYELTSMFEDYRSQREAGEADKDFSESISRAEIEGKDIFADANRTRTGVSAHAQRLEQERALSAAQLMAKLAGISFQTEPVLVGAEESFDAEQFLAHDLDDTAGMSEWEREVTEFYNEKIRAQEPVVEREAERDSDIETEVDAAPTVSAAEINDVIHDLDELEFDDVIDLDADDVVNTAEVEAPASVSAAEISATELDFDRESRAKTAQREASRRVAQKIQTQESVREAYIREQKHGYDASPAEGRKFDEKIAERGLDL

SEQ ID NO: 5479 - protein, 232 aa, Corynebacterium glutamicum
MARAKNKKQRQLQHAHDAAQAEIAEAVAVNTVEPINARTGGWPSWVDKVWKLTGSLGGWFAFLVFAIAVWPVAILAAGTVVTIIGTWGVSVLPSLVISSIGASAGVIISTTDGFLFSWVIPVLFLMIVLALVVMKVLNLIFGALWRFTMTLRQGLYAGREKISRDDAKRARAEKKLTKQQAKEAKKQRKLDAIYSAQQAEETLAQQAQSEPEESDDKNRHDALNDAVAAARN

SEQ ID NO: 5480 - protein, 238 aa, Corynebacterium glutamicum
MTTRNVDNQSGVTEDEPMFDQVKRFFVRNIVMIIALILAVVVIIVATSTSADRHAVLKRQTGEIMALQQERDALNSKLEGQLEQVVRDATGGMDIEHKAADDAVVREFLSMALTWDSVRDYLDVREQVMRVYDLDEESQFMSVFMPGEMAGIARTDPTGEVHYAYDADLSNRFSSLESVVTRINGTEYSYVSTVTMKSKRSGGEAETTSTSRLAYDVIDGKIRNLEARTVPGGVKYSG

SEQ ID NO: 5481 - protein, 336 aa, Corynebacterium glutamicum
MAENNGGSDDLKPISVDGVVNGEVRSDKEKQAFEKITGDDLRRRAEQIRKRRLAKAQEDARKRKPLFGLGRIAVTVLAGAVFIGTTLWISTTSGGFDDKVSANNEQIVTLRNEVNDLKNTAETMPKKETLASQFDAATSRAQNVADLQNQLAGIITSVDDDAATEQFKTIVDELKPKFTVSAGTTGEFPAAGRWYQPQEVVVGDNNRPTWAPMGAESWGWTVTPTLSMSDTEHVVVMWEARLTGGERDGALLAWVTADYNINTGVFSSLALAHTYEGHQRIGATTSPSEFGAHGTNAEASAARAGSEGGGLEGEAIFVDELQRALEIAQLNKQENR

SEQ ID NO: 5482 - protein, 553 aa, Corynebacterium glutamicum
MANDFIEPNDAPDAPDNGDSGSSGFVDEAKDKTRSAAQGLGYGALRVGFGTAALAANGARSMGNLAKNLWTRMMGLALSAGTGISAATGGMITARVGAMLAGTGSVLSSVTTIALIVSMIVVPAGRKDGIIELCEPPVTANPFTIDAGDMTENAKLVYGALSYLGMNDQNIAGVLGNFETESGIDPTAVEGIFDEPNTIGPRKRAAWDKNFEPQPMGIGLGQWTAGRTQMLLDFAADRNRDWHYIDVQLAFAISGDNESDRKVFLEMVDNKNSSSNSPTAASEYFLREWERPADVAGNAPIRAEQASKWYAQMGGWQKNSTLGESVIAMADGAAAKSTARDEQDALNDCPEEDRTSGGNTSAAEAMVTISHPYLADSRGNDGTDIYRYIHDEVLTGDPYYASCDRGVATAIRWSGTDDTFPAGPTAAQYEYVVGTGSGRWEEIGNLATMSENDLLPGDVLLGAPNHVAMYVSNEVVVDMLGPGNAEPNAAIGHASLNDRSPGLDTLSLDGWGVNFKVFRNTQAETNSVFSGVQIPAGKEIGEMTNPTRTTPAG

SEQ ID NO: 5483 - protein, 496 aa, Corynebacterium glutamicum
MSLKKWGRAMTNTVQRKAKQKKSSSNKEGMQKKVDRIVSRFRLGQHYTIERVALISGAAVVSGSLLFGSTIVYAVQAGNIDFSQTATYNAEFRSSRTNQVSELAGFWKNVEGTRAFAVIKFAVPANMSTNAEDYFAYVTGVKDLGTSPKAADVSQATVGSIYSFGDGRIGLMLEAPEGFDMQVLNITMRAKKELVEVDSTNLTSENMKAQGYDDSFIDHDQWRIMLNPAAETLATLPALNDEQIDLRALYWQTSMTDTEVGHRQALDTSLSRMNALLGRIENYKEALGVTSATIMGERVSLIEPIPHESIRGDRIEGLASVDVTKQLAEDPTGKSVPGWEDKTFMAASLDNLMSEGYQYNSYRLVTDHIFGGGYDFDWRLGTTLDGYLKDVVPGNQDAMTWITDHAYQTKATWNANQMEWVLSNGDRLEDHVLSEGAKPLIDLKNNLAQAYQDYFNEKQRYQRQLLQQLLISETQLDQAVENTQVAQGSDAVEFRF

SEQ ID NO: 5484 - protein, 133 aa, Corynebacterium glutamicum
MFITYGNSVESRVNMSIPGNVSYVAQGGTGWDGADQYTTGESWDLQSFLENSTDYLMIIGGSLLALVGGAAVIWGFVNVMRKLFGGQSGQQIQWFTTILLIIVGGAFLVGGITLALNFASGAGDTVTGFGTGG
